United States Patent 11,369,692 (MATERIALS AND METHODS FOR TREATMENT OF DUCHENNE MUSCULAR DYSTROPHY) - sequence listing, part 33

SEQ ID NO: 1091166 - DNA, 22 bp, Artificial Sequence
  chemically synthesized
ctcacaaaaaaaaccccctatg

SEQ ID NO: 1091167 - DNA, 22 bp, Artificial Sequence
  chemically synthesized
ctcatcctgtttcatagggggt

SEQ ID NO: 1091168 - DNA, 22 bp, Artificial Sequence
  chemically synthesized
cctcatcctgtttcataggggg

SEQ ID NO: 1091169 - DNA, 22 bp, Artificial Sequence
  chemically synthesized
acaaaaaaaaccccctatgaaa

SEQ ID NO: 1091170 - DNA, 22 bp, Artificial Sequence
  chemically synthesized
cgtttcctcatcctgtttcata

SEQ ID NO: 1091171 - DNA, 22 bp, Artificial Sequence
  chemically synthesized
acgtttcctcatcctgtttcat

SEQ ID NO: 1091172 - DNA, 22 bp, Artificial Sequence
  chemically synthesized
aacttacgtttcctcatcctgt

SEQ ID NO: 1091173 - DNA, 22 bp, Artificial Sequence
  chemically synthesized
aaacttacgtttcctcatcctg

SEQ ID NO: 1091174 - DNA, 22 bp, Artificial Sequence
  chemically synthesized
taaacttacgtttcctcatcct

SEQ ID NO: 1091175 - DNA, 22 bp, Artificial Sequence
  chemically synthesized
tgaaacaggatgaggaaacgta

SEQ ID NO: 1091176 - DNA, 22 bp, Artificial Sequence
  chemically synthesized
agtaacagttttaaacttacgt

SEQ ID NO: 1091177 - DNA, 22 bp, Artificial Sequence
  chemically synthesized
gagtaacagttttaaacttacg

SEQ ID NO: 1091178 - DNA, 22 bp, Artificial Sequence
  chemically synthesized
tgagtaacagttttaaacttac

SEQ ID NO: 1091179 - DNA, 22 bp, Artificial Sequence
  chemically synthesized
tgtgattttgagtaacagtttt

SEQ ID NO: 1091180 - DNA, 22 bp, Artificial Sequence
  chemically synthesized
gctatgtgattttgagtaacag

SEQ ID NO: 1091181 - DNA, 22 bp, Artificial Sequence
  chemically synthesized
actggctatgtgattttgagta

SEQ ID NO: 1091182 - DNA, 22 bp, Artificial Sequence
  chemically synthesized
aaaactgttactcaaaatcaca

SEQ ID NO: 1091183 - DNA, 22 bp, Artificial Sequence
  chemically synthesized
aaactgttactcaaaatcacat

SEQ ID NO: 1091184 - DNA, 22 bp, Artificial Sequence
  chemically synthesized
taattcactggctatgtgattt

SEQ ID NO: 1091185 - DNA, 22 bp, Artificial Sequence
  chemically synthesized
tgtaattcactggctatgtgat

SEQ ID NO: 1091186 - DNA, 22 bp, Artificial Sequence
  chemically synthesized
ttactcaaaatcacatagccag

SEQ ID NO: 1091187 - DNA, 22 bp, Artificial Sequence
  chemically synthesized
ctcaaaatcacatagccagtga

SEQ ID NO: 1091188 - DNA, 22 bp, Artificial Sequence
  chemically synthesized
aaaatcacatagccagtgaatt

SEQ ID NO: 1091189 - DNA, 22 bp, Artificial Sequence
  chemically synthesized
gcaaatccctctgtaattcact

SEQ ID NO: 1091190 - DNA, 22 bp, Artificial Sequence
  chemically synthesized
ataactggcaaatccctctgta

SEQ ID NO: 1091191 - DNA, 22 bp, Artificial Sequence
  chemically synthesized
cagagggatttgccagttatca

SEQ ID NO: 1091192 - DNA, 22 bp, Artificial Sequence
  chemically synthesized
aaaggcaaaaaattgataactg

SEQ ID NO: 1091193 - DNA, 22 bp, Artificial Sequence
  chemically synthesized
gccagttatcaattttttgcct

SEQ ID NO: 1091194 - DNA, 22 bp, Artificial Sequence
  chemically synthesized
ccagttatcaattttttgcctt

SEQ ID NO: 1091195 - DNA, 22 bp, Artificial Sequence
  chemically synthesized
tcaattttttgcctttcaacat

SEQ ID NO: 1091196 - DNA, 22 bp, Artificial Sequence
  chemically synthesized
tttgcctttcaacatgatcctg

SEQ ID NO: 1091197 - DNA, 22 bp, Artificial Sequence
  chemically synthesized
ccgtgtcaaaaacaggatcatg

SEQ ID NO: 1091198 - DNA, 22 bp, Artificial Sequence
  chemically synthesized
ttgcctttcaacatgatcctgt

SEQ ID NO: 1091199 - DNA, 22 bp, Artificial Sequence
  chemically synthesized
tgcctttcaacatgatcctgtt

SEQ ID NO: 1091200 - DNA, 22 bp, Artificial Sequence
  chemically synthesized
gcctttcaacatgatcctgttt

SEQ ID NO: 1091201 - DNA, 22 bp, Artificial Sequence
  chemically synthesized
cctttcaacatgatcctgtttt

SEQ ID NO: 1091202 - DNA, 22 bp, Artificial Sequence
  chemically synthesized
tcaacatgatcctgtttttgac

SEQ ID NO: 1091203 - DNA, 22 bp, Artificial Sequence
  chemically synthesized
caacatgatcctgtttttgaca

SEQ ID NO: 1091204 - DNA, 22 bp, Artificial Sequence
  chemically synthesized
aacatgatcctgtttttgacac

SEQ ID NO: 1091205 - DNA, 22 bp, Artificial Sequence
  chemically synthesized
gcaaggggagaaatgttcccgt

SEQ ID NO: 1091206 - DNA, 22 bp, Artificial Sequence
  chemically synthesized
tttttgacacgggaacatttct

SEQ ID NO: 1091207 - DNA, 22 bp, Artificial Sequence
  chemically synthesized
ttgacacgggaacatttctccc

SEQ ID NO: 1091208 - DNA, 22 bp, Artificial Sequence
  chemically synthesized
tgacacgggaacatttctcccc

SEQ ID NO: 1091209 - DNA, 22 bp, Artificial Sequence
  chemically synthesized
gacacgggaacatttctcccct

SEQ ID NO: 1091210 - DNA, 22 bp, Artificial Sequence
  chemically synthesized
acacgggaacatttctcccctt

SEQ ID NO: 1091211 - DNA, 22 bp, Artificial Sequence
  chemically synthesized
atatcatgtcagctggcaaggg

SEQ ID NO: 1091212 - DNA, 22 bp, Artificial Sequence
  chemically synthesized
aatatcatgtcagctggcaagg

SEQ ID NO: 1091213 - DNA, 22 bp, Artificial Sequence
  chemically synthesized
ctccccttgccagctgacatga

SEQ ID NO: 1091214 - DNA, 22 bp, Artificial Sequence
  chemically synthesized
tccccttgccagctgacatgat

SEQ ID NO: 1091215 - DNA, 22 bp, Artificial Sequence
  chemically synthesized
acagaacttaatatcatgtcag

SEQ ID NO: 1091216 - DNA, 22 bp, Artificial Sequence
  chemically synthesized
cccttgccagctgacatgatat

SEQ ID NO: 1091217 - DNA, 22 bp, Artificial Sequence
  chemically synthesized
ctgacagaacttaatatcatgt

SEQ ID NO: 1091218 - DNA, 22 bp, Artificial Sequence
  chemically synthesized
actgacagaacttaatatcatg

SEQ ID NO: 1091219 - DNA, 22 bp, Artificial Sequence
  chemically synthesized
tactgacagaacttaatatcat

SEQ ID NO: 1091220 - DNA, 22 bp, Artificial Sequence
  chemically synthesized
gccagctgacatgatattaagt

SEQ ID NO: 1091221 - DNA, 22 bp, Artificial Sequence
  chemically synthesized
ccagctgacatgatattaagtt

SEQ ID NO: 1091222 - DNA, 22 bp, Artificial Sequence
  chemically synthesized
acatgatattaagttctgtcag

SEQ ID NO: 1091223 - DNA, 22 bp, Artificial Sequence
  chemically synthesized
cagcatcctttactgacagaac

SEQ ID NO: 1091224 - DNA, 22 bp, Artificial Sequence
  chemically synthesized
tcactccagcatcctttactga

SEQ ID NO: 1091225 - DNA, 22 bp, Artificial Sequence
  chemically synthesized
agttctgtcagtaaaggatgct

SEQ ID NO: 1091226 - DNA, 22 bp, Artificial Sequence
  chemically synthesized
ccccattgtcactccagcatcc

SEQ ID NO: 1091227 - DNA, 22 bp, Artificial Sequence
  chemically synthesized
tgtcagtaaaggatgctggagt

SEQ ID NO: 1091228 - DNA, 22 bp, Artificial Sequence
  chemically synthesized
tcagtaaaggatgctggagtga

SEQ ID NO: 1091229 - DNA, 22 bp, Artificial Sequence
  chemically synthesized
cctcccccattgtcactccagc

SEQ ID NO: 1091230 - DNA, 22 bp, Artificial Sequence
  chemically synthesized
tacctcccccattgtcactcca

SEQ ID NO: 1091231 - DNA, 22 bp, Artificial Sequence
  chemically synthesized
gagtgacaatgggggaggtaga

SEQ ID NO: 1091232 - DNA, 22 bp, Artificial Sequence
  chemically synthesized
ggacagacaaacctctacctcc

SEQ ID NO: 1091233 - DNA, 22 bp, Artificial Sequence
  chemically synthesized
aaagcacactgggacagacaaa

SEQ ID NO: 1091234 - DNA, 22 bp, Artificial Sequence
  chemically synthesized
aaaaagaattaaaagcacactg

SEQ ID NO: 1091235 - DNA, 22 bp, Artificial Sequence
  chemically synthesized
gaaaaagaattaaaagcacact

SEQ ID NO: 1091236 - DNA, 22 bp, Artificial Sequence
  chemically synthesized
gtctgtcccagtgtgcttttaa

SEQ ID NO: 1091237 - DNA, 22 bp, Artificial Sequence
  chemically synthesized
tctgtcccagtgtgcttttaat

SEQ ID NO: 1091238 - DNA, 22 bp, Artificial Sequence
  chemically synthesized
tcccagtgtgcttttaattctt

SEQ ID NO: 1091239 - DNA, 22 bp, Artificial Sequence
  chemically synthesized
ttaattctttttcaaacctgtg

SEQ ID NO: 1091240 - DNA, 22 bp, Artificial Sequence
  chemically synthesized
taattctttttcaaacctgtga

SEQ ID NO: 1091241 - DNA, 22 bp, Artificial Sequence
  chemically synthesized
aattctttttcaaacctgtgac

SEQ ID NO: 1091242 - DNA, 22 bp, Artificial Sequence
  chemically synthesized
attctttttcaaacctgtgact

SEQ ID NO: 1091243 - DNA, 22 bp, Artificial Sequence
  chemically synthesized
cataggccagcccagagtcaca

SEQ ID NO: 1091244 - DNA, 22 bp, Artificial Sequence
  chemically synthesized
tttttcaaacctgtgactctgg

SEQ ID NO: 1091245 - DNA, 22 bp, Artificial Sequence
  chemically synthesized
tttcaaacctgtgactctgggc

SEQ ID NO: 1091246 - DNA, 22 bp, Artificial Sequence
  chemically synthesized
ttcaaacctgtgactctgggct

SEQ ID NO: 1091247 - DNA, 22 bp, Artificial Sequence
  chemically synthesized
tcaaacctgtgactctgggctg

SEQ ID NO: 1091248 - DNA, 22 bp, Artificial Sequence
  chemically synthesized
caaacctgtgactctgggctgg

SEQ ID NO: 1091249 - DNA, 22 bp, Artificial Sequence
  chemically synthesized
aaacctgtgactctgggctggc

SEQ ID NO: 1091250 - DNA, 22 bp, Artificial Sequence
  chemically synthesized
ggcattccataggccagcccag

SEQ ID NO: 1091251 - DNA, 22 bp, Artificial Sequence
  chemically synthesized
ctgggcattccataggccagcc

SEQ ID NO: 1091252 - DNA, 22 bp, Artificial Sequence
  chemically synthesized
actgggcattccataggccagc

SEQ ID NO: 1091253 - DNA, 22 bp, Artificial Sequence
  chemically synthesized
tgactctgggctggcctatgga

SEQ ID NO: 1091254 - DNA, 22 bp, Artificial Sequence
  chemically synthesized
tgggctggcctatggaatgccc

SEQ ID NO: 1091255 - DNA, 22 bp, Artificial Sequence
  chemically synthesized
ggctggcctatggaatgcccag

SEQ ID NO: 1091256 - DNA, 22 bp, Artificial Sequence
  chemically synthesized
gcctatggaatgcccagtaagg

SEQ ID NO: 1091257 - DNA, 22 bp, Artificial Sequence
  chemically synthesized
tggaatgcccagtaaggctcac

SEQ ID NO: 1091258 - DNA, 22 bp, Artificial Sequence
  chemically synthesized
ggtaaagtggggtggatgaggt

SEQ ID NO: 1091259 - DNA, 22 bp, Artificial Sequence
  chemically synthesized
tgggtaaagtggggtggatgag

SEQ ID NO: 1091260 - DNA, 22 bp, Artificial Sequence
  chemically synthesized
ctgggtaaagtggggtggatga

SEQ ID NO: 1091261 - DNA, 22 bp, Artificial Sequence
  chemically synthesized
aaagtcttctgggtaaagtggg

SEQ ID NO: 1091262 - DNA, 22 bp, Artificial Sequence
  chemically synthesized
acctcatccaccccactttacc

SEQ ID NO: 1091263 - DNA, 22 bp, Artificial Sequence
  chemically synthesized
ctgaaagtcttctgggtaaagt

SEQ ID NO: 1091264 - DNA, 22 bp, Artificial Sequence
  chemically synthesized
atccaccccactttacccagaa

SEQ ID NO: 1091265 - DNA, 22 bp, Artificial Sequence
  chemically synthesized
tacccagaagactttcagcaac

SEQ ID NO: 1091266 - DNA, 22 bp, Artificial Sequence
  chemically synthesized
acccagaagactttcagcaaca

SEQ ID NO: 1091267 - DNA, 22 bp, Artificial Sequence
  chemically synthesized
cccagaagactttcagcaacac

SEQ ID NO: 1091268 - DNA, 22 bp, Artificial Sequence
  chemically synthesized
tcaaacacgacccatagtgttg

SEQ ID NO: 1091269 - DNA, 22 bp, Artificial Sequence
  chemically synthesized
gtcaaacacgacccatagtgtt

SEQ ID NO: 1091270 - DNA, 22 bp, Artificial Sequence
  chemically synthesized
tcagcaacactatgggtcgtgt

SEQ ID NO: 1091271 - DNA, 22 bp, Artificial Sequence
  chemically synthesized
cagcaacactatgggtcgtgtt

SEQ ID NO: 1091272 - DNA, 22 bp, Artificial Sequence
  chemically synthesized
agcaacactatgggtcgtgttt

SEQ ID NO: 1091273 - DNA, 22 bp, Artificial Sequence
  chemically synthesized
ggtacccatagaacttgtcaaa

SEQ ID NO: 1091274 - DNA, 22 bp, Artificial Sequence
  chemically synthesized
tgggtcgtgtttgacaagttct

SEQ ID NO: 1091275 - DNA, 22 bp, Artificial Sequence
  chemically synthesized
ttgggtacccatagaacttgtc

SEQ ID NO: 1091276 - DNA, 22 bp, Artificial Sequence
  chemically synthesized
attgggtacccatagaacttgt

SEQ ID NO: 1091277 - DNA, 22 bp, Artificial Sequence
  chemically synthesized
cttattgggtacccatagaact

SEQ ID NO: 1091278 - DNA, 22 bp, Artificial Sequence
  chemically synthesized
gcttattgggtacccatagaac

SEQ ID NO: 1091279 - DNA, 22 bp, Artificial Sequence
  chemically synthesized
aatttgcttattgggtacccat

SEQ ID NO: 1091280 - DNA, 22 bp, Artificial Sequence
  chemically synthesized
gacaagttctatgggtacccaa

SEQ ID NO: 1091281 - DNA, 22 bp, Artificial Sequence
  chemically synthesized
acaagttctatgggtacccaat

SEQ ID NO: 1091282 - DNA, 22 bp, Artificial Sequence
  chemically synthesized
tatgggtacccaataagcaaat

SEQ ID NO: 1091283 - DNA, 22 bp, Artificial Sequence
  chemically synthesized
ccacccatcctcaatttgctta

SEQ ID NO: 1091284 - DNA, 22 bp, Artificial Sequence
  chemically synthesized
tgggtacccaataagcaaattg

SEQ ID NO: 1091285 - DNA, 22 bp, Artificial Sequence
  chemically synthesized
gccacccatcctcaatttgctt

SEQ ID NO: 1091286 - DNA, 22 bp, Artificial Sequence
  chemically synthesized
tggatttgccacccatcctcaa

SEQ ID NO: 1091287 - DNA, 22 bp, Artificial Sequence
  chemically synthesized
cctatggatttgccacccatcc

SEQ ID NO: 1091288 - DNA, 22 bp, Artificial Sequence
  chemically synthesized
caggaagctgcctatggatttg

SEQ ID NO: 1091289 - DNA, 22 bp, Artificial Sequence
  chemically synthesized
aggatgggtggcaaatccatag

SEQ ID NO: 1091290 - DNA, 22 bp, Artificial Sequence
  chemically synthesized
aggaaatgaggtggggctccag

SEQ ID NO: 1091291 - DNA, 22 bp, Artificial Sequence
  chemically synthesized
gaggaaatgaggtggggctcca

SEQ ID NO: 1091292 - DNA, 22 bp, Artificial Sequence
  chemically synthesized
aacttgaggaaatgaggtgggg

SEQ ID NO: 1091293 - DNA, 22 bp, Artificial Sequence
  chemically synthesized
ctaaacttgaggaaatgaggtg

SEQ ID NO: 1091294 - DNA, 22 bp, Artificial Sequence
  chemically synthesized
cctggagccccacctcatttcc

SEQ ID NO: 1091295 - DNA, 22 bp, Artificial Sequence
  chemically synthesized
ctggagccccacctcatttcct

SEQ ID NO: 1091296 - DNA, 22 bp, Artificial Sequence
  chemically synthesized
gagccccacctcatttcctcaa

SEQ ID NO: 1091297 - DNA, 22 bp, Artificial Sequence
  chemically synthesized
tagtggatgctactaaacttga

SEQ ID NO: 1091298 - DNA, 22 bp, Artificial Sequence
  chemically synthesized
cctgtagtggatgctactaaac

SEQ ID NO: 1091299 - DNA, 22 bp, Artificial Sequence
  chemically synthesized
atttcctcaagtttagtagcat

SEQ ID NO: 1091300 - DNA, 22 bp, Artificial Sequence
  chemically synthesized
cctcaagtttagtagcatccac

SEQ ID NO: 1091301 - DNA, 22 bp, Artificial Sequence
  chemically synthesized
ctcaagtttagtagcatccact

SEQ ID NO: 1091302 - DNA, 22 bp, Artificial Sequence
  chemically synthesized
aagtttagtagcatccactaca

SEQ ID NO: 1091303 - DNA, 22 bp, Artificial Sequence
  chemically synthesized
agtagcatccactacaggtagt

SEQ ID NO: 1091304 - DNA, 22 bp, Artificial Sequence
  chemically synthesized
gtagcatccactacaggtagtt

SEQ ID NO: 1091305 - DNA, 22 bp, Artificial Sequence
  chemically synthesized
gacatggtgggaaactacctgt

SEQ ID NO: 1091306 - DNA, 22 bp, Artificial Sequence
  chemically synthesized
attggacatggtgggaaactac

SEQ ID NO: 1091307 - DNA, 22 bp, Artificial Sequence
  chemically synthesized
gtgtattcattggacatggtgg

SEQ ID NO: 1091308 - DNA, 22 bp, Artificial Sequence
  chemically synthesized
caggtagtttcccaccatgtcc

SEQ ID NO: 1091309 - DNA, 22 bp, Artificial Sequence
  chemically synthesized
tctggtgtattcattggacatg

SEQ ID NO: 1091310 - DNA, 22 bp, Artificial Sequence
  chemically synthesized
cccaccatgtccaatgaataca

SEQ ID NO: 1091311 - DNA, 22 bp, Artificial Sequence
  chemically synthesized
ccaccatgtccaatgaatacac

SEQ ID NO: 1091312 - DNA, 22 bp, Artificial Sequence
  chemically synthesized
gaaagctgtctggtgtattcat

SEQ ID NO: 1091313 - DNA, 22 bp, Artificial Sequence
  chemically synthesized
ctagaaagctgtctggtgtatt

SEQ ID NO: 1091314 - DNA, 22 bp, Artificial Sequence
  chemically synthesized
gctagaaagctgtctggtgtat

SEQ ID NO: 1091315 - DNA, 22 bp, Artificial Sequence
  chemically synthesized
aatttgctagaaagctgtctgg

SEQ ID NO: 1091316 - DNA, 22 bp, Artificial Sequence
  chemically synthesized
tggtggggaaccattgaatttg

SEQ ID NO: 1091317 - DNA, 22 bp, Artificial Sequence
  chemically synthesized
tctagcaaattcaatggttccc

SEQ ID NO: 1091318 - DNA, 22 bp, Artificial Sequence
  chemically synthesized
ctagcaaattcaatggttcccc

SEQ ID NO: 1091319 - DNA, 22 bp, Artificial Sequence
  chemically synthesized
tagcaaattcaatggttcccca

SEQ ID NO: 1091320 - DNA, 22 bp, Artificial Sequence
  chemically synthesized
gcaaattcaatggttccccacc

SEQ ID NO: 1091321 - DNA, 22 bp, Artificial Sequence
  chemically synthesized
acagggaagtagcctatggtgg

SEQ ID NO: 1091322 - DNA, 22 bp, Artificial Sequence
  chemically synthesized
aatggttccccaccataggcta

SEQ ID NO: 1091323 - DNA, 22 bp, Artificial Sequence
  chemically synthesized
acaaaattcacagggaagtagc

SEQ ID NO: 1091324 - DNA, 22 bp, Artificial Sequence
  chemically synthesized
cccaccataggctacttccctg

SEQ ID NO: 1091325 - DNA, 22 bp, Artificial Sequence
  chemically synthesized
gaggggaatgctgacaaaattc

SEQ ID NO: 1091326 - DNA, 22 bp, Artificial Sequence
  chemically synthesized
cttccctgtgaattttgtcagc

SEQ ID NO: 1091327 - DNA, 22 bp, Artificial Sequence
  chemically synthesized
ccctgtgaattttgtcagcatt

SEQ ID NO: 1091328 - DNA, 22 bp, Artificial Sequence
  chemically synthesized
cctgtgaattttgtcagcattc

SEQ ID NO: 1091329 - DNA, 22 bp, Artificial Sequence
  chemically synthesized
tgaattttgtcagcattcccct

SEQ ID NO: 1091330 - DNA, 22 bp, Artificial Sequence
  chemically synthesized
gtgtgaagagaatattggaggg

SEQ ID NO: 1091331 - DNA, 22 bp, Artificial Sequence
  chemically synthesized
tgtcagcattcccctccaatat

SEQ ID NO: 1091332 - DNA, 22 bp, Artificial Sequence
  chemically synthesized
gtcagcattcccctccaatatt

SEQ ID NO: 1091333 - DNA, 22 bp, Artificial Sequence
  chemically synthesized
tcagcattcccctccaatattc

SEQ ID NO: 1091334 - DNA, 22 bp, Artificial Sequence
  chemically synthesized
aagctagtgtgaagagaatatt

SEQ ID NO: 1091335 - DNA, 22 bp, Artificial Sequence
  chemically synthesized
ccctccaatattctcttcacac

SEQ ID NO: 1091336 - DNA, 22 bp, Artificial Sequence
  chemically synthesized
caatattctcttcacactagct

SEQ ID NO: 1091337 - DNA, 22 bp, Artificial Sequence
  chemically synthesized
tagccagtgagctgaagctagt

SEQ ID NO: 1091338 - DNA, 22 bp, Artificial Sequence
  chemically synthesized
tcttcacactagcttcagctca

SEQ ID NO: 1091339 - DNA, 22 bp, Artificial Sequence
  chemically synthesized
ttcacactagcttcagctcact

SEQ ID NO: 1091340 - DNA, 22 bp, Artificial Sequence
  chemically synthesized
cacactagcttcagctcactgg

SEQ ID NO: 1091341 - DNA, 22 bp, Artificial Sequence
  chemically synthesized
acactagcttcagctcactggc

SEQ ID NO: 1091342 - DNA, 22 bp, Artificial Sequence
  chemically synthesized
gcttcagctcactggctataga

SEQ ID NO: 1091343 - DNA, 22 bp, Artificial Sequence
  chemically synthesized
cagctcactggctatagacttg

SEQ ID NO: 1091344 - DNA, 22 bp, Artificial Sequence
  chemically synthesized
agctcactggctatagacttgt

SEQ ID NO: 1091345 - DNA, 22 bp, Artificial Sequence
  chemically synthesized
acccaatccagaacaagtctat

SEQ ID NO: 1091346 - DNA, 22 bp, Artificial Sequence
  chemically synthesized
attgacccaatccagaacaagt

SEQ ID NO: 1091347 - DNA, 22 bp, Artificial Sequence
  chemically synthesized
actggctatagacttgttctgg

SEQ ID NO: 1091348 - DNA, 22 bp, Artificial Sequence
  chemically synthesized
cattgacccaatccagaacaag

SEQ ID NO: 1091349 - DNA, 22 bp, Artificial Sequence
  chemically synthesized
cttcattgacccaatccagaac

SEQ ID NO: 1091350 - DNA, 22 bp, Artificial Sequence
  chemically synthesized
gctatagacttgttctggattg

SEQ ID NO: 1091351 - DNA, 22 bp, Artificial Sequence
  chemically synthesized
ccttcattgacccaatccagaa

SEQ ID NO: 1091352 - DNA, 22 bp, Artificial Sequence
  chemically synthesized
tagacttgttctggattgggtc

SEQ ID NO: 1091353 - DNA, 22 bp, Artificial Sequence
  chemically synthesized
gttctggattgggtcaatgaag

SEQ ID NO: 1091354 - DNA, 22 bp, Artificial Sequence
  chemically synthesized
ttctggattgggtcaatgaagg

SEQ ID NO: 1091355 - DNA, 22 bp, Artificial Sequence
  chemically synthesized
tggattgggtcaatgaaggaaa

SEQ ID NO: 1091356 - DNA, 22 bp, Artificial Sequence
  chemically synthesized
gattgggtcaatgaaggaaact

SEQ ID NO: 1091357 - DNA, 22 bp, Artificial Sequence
  chemically synthesized
ggtcaatgaaggaaacttctct

SEQ ID NO: 1091358 - DNA, 22 bp, Artificial Sequence
  chemically synthesized
ccatgggatgacagagaagttt

SEQ ID NO: 1091359 - DNA, 22 bp, Artificial Sequence
  chemically synthesized
cctcccatgggatgacagagaa

SEQ ID NO: 1091360 - DNA, 22 bp, Artificial Sequence
  chemically synthesized
ctctgtcatcccatgggaggca

SEQ ID NO: 1091361 - DNA, 22 bp, Artificial Sequence
  chemically synthesized
tctgtcatcccatgggaggcag

SEQ ID NO: 1091362 - DNA, 22 bp, Artificial Sequence
  chemically synthesized
gaaagtgtgtgtctgcctccca

SEQ ID NO: 1091363 - DNA, 22 bp, Artificial Sequence
  chemically synthesized
agaaagtgtgtgtctgcctccc

SEQ ID NO: 1091364 - DNA, 22 bp, Artificial Sequence
  chemically synthesized
tgtcatcccatgggaggcagac

SEQ ID NO: 1091365 - DNA, 22 bp, Artificial Sequence
  chemically synthesized
tagaaagtgtgtgtctgcctcc

SEQ ID NO: 1091366 - DNA, 22 bp, Artificial Sequence
  chemically synthesized
tcatcccatgggaggcagacac

SEQ ID NO: 1091367 - DNA, 22 bp, Artificial Sequence
  chemically synthesized
tttagaaagtgtgtgtctgcct

SEQ ID NO: 1091368 - DNA, 22 bp, Artificial Sequence
  chemically synthesized
ctttagaaagtgtgtgtctgcc

SEQ ID NO: 1091369 - DNA, 22 bp, Artificial Sequence
  chemically synthesized
aaacttctttagaaagtgtgtg

SEQ ID NO: 1091370 - DNA, 22 bp, Artificial Sequence
  chemically synthesized
gattcaaacttctttagaaagt

SEQ ID NO: 1091371 - DNA, 22 bp, Artificial Sequence
  chemically synthesized
aacccaaggctggattcaaact

SEQ ID NO: 1091372 - DNA, 22 bp, Artificial Sequence
  chemically synthesized
tctaaagaagtttgaatccagc

SEQ ID NO: 1091373 - DNA, 22 bp, Artificial Sequence
  chemically synthesized
ctaaagaagtttgaatccagcc

SEQ ID NO: 1091374 - DNA, 22 bp, Artificial Sequence
  chemically synthesized
taaagaagtttgaatccagcct

SEQ ID NO: 1091375 - DNA, 22 bp, Artificial Sequence
  chemically synthesized
aagaagtttgaatccagccttg

SEQ ID NO: 1091376 - DNA, 22 bp, Artificial Sequence
  chemically synthesized
gaatccagccttgggttgagct

SEQ ID NO: 1091377 - DNA, 22 bp, Artificial Sequence
  chemically synthesized
aatccagccttgggttgagctc

SEQ ID NO: 1091378 - DNA, 22 bp, Artificial Sequence
  chemically synthesized
atatggaaagataggagctcaa

SEQ ID NO: 1091379 - DNA, 22 bp, Artificial Sequence
  chemically synthesized
gggttgagctcctatctttcca

SEQ ID NO: 1091380 - DNA, 22 bp, Artificial Sequence
  chemically synthesized
ggttgagctcctatctttccat

SEQ ID NO: 1091381 - DNA, 22 bp, Artificial Sequence
  chemically synthesized
agctcctatctttccatattag

SEQ ID NO: 1091382 - DNA, 22 bp, Artificial Sequence
  chemically synthesized
ctatctttccatattagttcct

SEQ ID NO: 1091383 - DNA, 22 bp, Artificial Sequence
  chemically synthesized
tctttccatattagttccttgt

SEQ ID NO: 1091384 - DNA, 22 bp, Artificial Sequence
  chemically synthesized
aggaatagtacacaaacaagga

SEQ ID NO: 1091385 - DNA, 22 bp, Artificial Sequence
  chemically synthesized
tccatattagttccttgtttgt

SEQ ID NO: 1091386 - DNA, 22 bp, Artificial Sequence
  chemically synthesized
ccatattagttccttgtttgtg

SEQ ID NO: 1091387 - DNA, 22 bp, Artificial Sequence
  chemically synthesized
catattagttccttgtttgtgt

SEQ ID NO: 1091388 - DNA, 22 bp, Artificial Sequence
  chemically synthesized
agcctgaggaatagtacacaaa

SEQ ID NO: 1091389 - DNA, 22 bp, Artificial Sequence
  chemically synthesized
aagcctgaggaatagtacacaa

SEQ ID NO: 1091390 - DNA, 22 bp, Artificial Sequence
  chemically synthesized
gttccttgtttgtgtactattc

SEQ ID NO: 1091391 - DNA, 22 bp, Artificial Sequence
  chemically synthesized
cttgtttgtgtactattcctca

SEQ ID NO: 1091392 - DNA, 22 bp, Artificial Sequence
  chemically synthesized
gtttgtgtactattcctcaggc

SEQ ID NO: 1091393 - DNA, 22 bp, Artificial Sequence
  chemically synthesized
tttgtgtactattcctcaggct

SEQ ID NO: 1091394 - DNA, 22 bp, Artificial Sequence
  chemically synthesized
aagaataccttaagcctgagga

SEQ ID NO: 1091395 - DNA, 22 bp, Artificial Sequence
  chemically synthesized
taaagaataccttaagcctgag

SEQ ID NO: 1091396 - DNA, 22 bp, Artificial Sequence
  chemically synthesized
gtgtactattcctcaggcttaa

SEQ ID NO: 1091397 - DNA, 22 bp, Artificial Sequence
  chemically synthesized
tgtactattcctcaggcttaag

SEQ ID NO: 1091398 - DNA, 22 bp, Artificial Sequence
  chemically synthesized
ttcctcaggcttaaggtattct

SEQ ID NO: 1091399 - DNA, 22 bp, Artificial Sequence
  chemically synthesized
ctcaggcttaaggtattcttta

SEQ ID NO: 1091400 - DNA, 22 bp, Artificial Sequence
  chemically synthesized
aggcttaaggtattctttagag

SEQ ID NO: 1091401 - DNA, 22 bp, Artificial Sequence
  chemically synthesized
aaggtattctttagagatctct

SEQ ID NO: 1091402 - DNA, 22 bp, Artificial Sequence
  chemically synthesized
ataggaaataaaagagatctct

SEQ ID NO: 1091403 - DNA, 22 bp, Artificial Sequence
  chemically synthesized
aggtattctttagagatctctt

SEQ ID NO: 1091404 - DNA, 22 bp, Artificial Sequence
  chemically synthesized
aataggaaataaaagagatctc

SEQ ID NO: 1091405 - DNA, 22 bp, Artificial Sequence
  chemically synthesized
taataggaaataaaagagatct

SEQ ID NO: 1091406 - DNA, 22 bp, Artificial Sequence
  chemically synthesized
ttaataggaaataaaagagatc

SEQ ID NO: 1091407 - DNA, 22 bp, Artificial Sequence
  chemically synthesized
atttttaataggaaataaaaga

SEQ ID NO: 1091408 - DNA, 22 bp, Artificial Sequence
  chemically synthesized
tttagagatctcttttatttcc

SEQ ID NO: 1091409 - DNA, 22 bp, Artificial Sequence
  chemically synthesized
tagagatctcttttatttccta

SEQ ID NO: 1091410 - DNA, 22 bp, Artificial Sequence
  chemically synthesized
agagatctcttttatttcctat

SEQ ID NO: 1091411 - DNA, 22 bp, Artificial Sequence
  chemically synthesized
gagatctcttttatttcctatt

SEQ ID NO: 1091412 - DNA, 22 bp, Artificial Sequence
  chemically synthesized
gaaattaatttttaataggaaa

SEQ ID NO: 1091413 - DNA, 22 bp, Artificial Sequence
  chemically synthesized
ctggaaattaatttttaatagg

SEQ ID NO: 1091414 - DNA, 22 bp, Artificial Sequence
  chemically synthesized
actggaaattaatttttaatag

SEQ ID NO: 1091415 - DNA, 22 bp, Artificial Sequence
  chemically synthesized
ttttatttcctattaaaaatta

SEQ ID NO: 1091416 - DNA, 22 bp, Artificial Sequence
  chemically synthesized
cttactggaaattaatttttaa

SEQ ID NO: 1091417 - DNA, 22 bp, Artificial Sequence
  chemically synthesized
ttatttcctattaaaaattaat

SEQ ID NO: 1091418 - DNA, 22 bp, Artificial Sequence
  chemically synthesized
tatttcctattaaaaattaatt

SEQ ID NO: 1091419 - DNA, 22 bp, Artificial Sequence
  chemically synthesized
atttcctattaaaaattaattt

SEQ ID NO: 1091420 - DNA, 22 bp, Artificial Sequence
  chemically synthesized
actacttactggaaattaattt

SEQ ID NO: 1091421 - DNA, 22 bp, Artificial Sequence
  chemically synthesized
tttcctattaaaaattaatttc

SEQ ID NO: 1091422 - DNA, 22 bp, Artificial Sequence
  chemically synthesized
cctattaaaaattaatttccag

SEQ ID NO: 1091423 - DNA, 22 bp, Artificial Sequence
  chemically synthesized
ctattaaaaattaatttccagt

SEQ ID NO: 1091424 - DNA, 22 bp, Artificial Sequence
  chemically synthesized
ttaaaaattaatttccagtaag

SEQ ID NO: 1091425 - DNA, 22 bp, Artificial Sequence
  chemically synthesized
aaaattaatttccagtaagtag

SEQ ID NO: 1091426 - DNA, 22 bp, Artificial Sequence
  chemically synthesized
acacaaataagtattaactact

SEQ ID NO: 1091427 - DNA, 22 bp, Artificial Sequence
  chemically synthesized
aacacaaataagtattaactac

SEQ ID NO: 1091428 - DNA, 22 bp, Artificial Sequence
  chemically synthesized
atttccagtaagtagttaatac

SEQ ID NO: 1091429 - DNA, 22 bp, Artificial Sequence
  chemically synthesized
ccagtaagtagttaatacttat

SEQ ID NO: 1091430 - DNA, 22 bp, Artificial Sequence
  chemically synthesized
cagtaagtagttaatacttatt

SEQ ID NO: 1091431 - DNA, 22 bp, Artificial Sequence
  chemically synthesized
aacagagatggtttaacacaaa

SEQ ID NO: 1091432 - DNA, 22 bp, Artificial Sequence
  chemically synthesized
aaacagagatggtttaacacaa

SEQ ID NO: 1091433 - DNA, 22 bp, Artificial Sequence
  chemically synthesized
atacttatttgtgttaaaccat

SEQ ID NO: 1091434 - DNA, 22 bp, Artificial Sequence
  chemically synthesized
agtcacttaaacagagatggtt

SEQ ID NO: 1091435 - DNA, 22 bp, Artificial Sequence
  chemically synthesized
atttgtgttaaaccatctctgt

SEQ ID NO: 1091436 - DNA, 22 bp, Artificial Sequence
  chemically synthesized
tttgtgttaaaccatctctgtt

SEQ ID NO: 1091437 - DNA, 22 bp, Artificial Sequence
  chemically synthesized
gtgttaaaccatctctgtttaa

SEQ ID NO: 1091438 - DNA, 22 bp, Artificial Sequence
  chemically synthesized
tgttaaaccatctctgtttaag

SEQ ID NO: 1091439 - DNA, 22 bp, Artificial Sequence
  chemically synthesized
aaccatctctgtttaagtgact

SEQ ID NO: 1091440 - DNA, 22 bp, Artificial Sequence
  chemically synthesized
tgtttaagtgactgagtggttt

SEQ ID NO: 1091441 - DNA, 22 bp, Artificial Sequence
  chemically synthesized
tttaagtgactgagtggtttct

SEQ ID NO: 1091442 - DNA, 22 bp, Artificial Sequence
  chemically synthesized
aagtgactgagtggtttctgtg

SEQ ID NO: 1091443 - DNA, 22 bp, Artificial Sequence
  chemically synthesized
agtgactgagtggtttctgtgc

SEQ ID NO: 1091444 - DNA, 22 bp, Artificial Sequence
  chemically synthesized
agtggtttctgtgccctgtctg

SEQ ID NO: 1091445 - DNA, 22 bp, Artificial Sequence
  chemically synthesized
gtagtcagggtccagacagggc

SEQ ID NO: 1091446 - DNA, 22 bp, Artificial Sequence
  chemically synthesized
tattagtagtcagggtccagac

SEQ ID NO: 1091447 - DNA, 22 bp, Artificial Sequence
  chemically synthesized
gtattagtagtcagggtccaga

SEQ ID NO: 1091448 - DNA, 22 bp, Artificial Sequence
  chemically synthesized
ctgtgccctgtctggaccctga

SEQ ID NO: 1091449 - DNA, 22 bp, Artificial Sequence
  chemically synthesized
tgtgccctgtctggaccctgac

SEQ ID NO: 1091450 - DNA, 22 bp, Artificial Sequence
  chemically synthesized
tgccctgtctggaccctgacta

SEQ ID NO: 1091451 - DNA, 22 bp, Artificial Sequence
  chemically synthesized
tctggaccctgactactaatac

SEQ ID NO: 1091452 - DNA, 22 bp, Artificial Sequence
  chemically synthesized
gaataacaccttgtattagtag

SEQ ID NO: 1091453 - DNA, 22 bp, Artificial Sequence
  chemically synthesized
gaccctgactactaatacaagg

SEQ ID NO: 1091454 - DNA, 22 bp, Artificial Sequence
  chemically synthesized
ggctagaataacaccttgtatt

SEQ ID NO: 1091455 - DNA, 22 bp, Artificial Sequence
  chemically synthesized
gggctagaataacaccttgtat

SEQ ID NO: 1091456 - DNA, 22 bp, Artificial Sequence
  chemically synthesized
actactaatacaaggtgttatt

SEQ ID NO: 1091457 - DNA, 22 bp, Artificial Sequence
  chemically synthesized
aaacttgggctagaataacacc

SEQ ID NO: 1091458 - DNA, 22 bp, Artificial Sequence
  chemically synthesized
gaaacttgggctagaataacac

SEQ ID NO: 1091459 - DNA, 22 bp, Artificial Sequence
  chemically synthesized
ctaatacaaggtgttattctag

SEQ ID NO: 1091460 - DNA, 22 bp, Artificial Sequence
  chemically synthesized
atacaaggtgttattctagccc

SEQ ID NO: 1091461 - DNA, 22 bp, Artificial Sequence
  chemically synthesized
aataagaaaatacttgaaactt

SEQ ID NO: 1091462 - DNA, 22 bp, Artificial Sequence
  chemically synthesized
gaataagaaaatacttgaaact

SEQ ID NO: 1091463 - DNA, 22 bp, Artificial Sequence
  chemically synthesized
tgaataagaaaatacttgaaac

SEQ ID NO: 1091464 - DNA, 22 bp, Artificial Sequence
  chemically synthesized
ttctagcccaagtttcaagtat

SEQ ID NO: 1091465 - DNA, 22 bp, Artificial Sequence
  chemically synthesized
ttgaataagaaaatacttgaaa

SEQ ID NO: 1091466 - DNA, 22 bp, Artificial Sequence
  chemically synthesized
tagcccaagtttcaagtatttt

SEQ ID NO: 1091467 - DNA, 22 bp, Artificial Sequence
  chemically synthesized
gcccaagtttcaagtattttct

SEQ ID NO: 1091468 - DNA, 22 bp, Artificial Sequence
  chemically synthesized
aagcataaacttttgaataaga

SEQ ID NO: 1091469 - DNA, 22 bp, Artificial Sequence
  chemically synthesized
aaagcataaacttttgaataag

SEQ ID NO: 1091470 - DNA, 22 bp, Artificial Sequence
  chemically synthesized
taaagcataaacttttgaataa

SEQ ID NO: 1091471 - DNA, 22 bp, Artificial Sequence
  chemically synthesized
caagtattttcttattcaaaag

SEQ ID NO: 1091472 - DNA, 22 bp, Artificial Sequence
  chemically synthesized
ttaaagcataaacttttgaata

SEQ ID NO: 1091473 - DNA, 22 bp, Artificial Sequence
  chemically synthesized
aagtattttcttattcaaaagt

SEQ ID NO: 1091474 - DNA, 22 bp, Artificial Sequence
  chemically synthesized
agtttttaaagcataaactttt

SEQ ID NO: 1091475 - DNA, 22 bp, Artificial Sequence
  chemically synthesized
tcttattcaaaagtttatgctt

SEQ ID NO: 1091476 - DNA, 22 bp, Artificial Sequence
  chemically synthesized
cttattcaaaagtttatgcttt

SEQ ID NO: 1091477 - DNA, 22 bp, Artificial Sequence
  chemically synthesized
gactgagtttttaaagcataaa

SEQ ID NO: 1091478 - DNA, 22 bp, Artificial Sequence
  chemically synthesized
ttattcaaaagtttatgcttta

SEQ ID NO: 1091479 - DNA, 22 bp, Artificial Sequence
  chemically synthesized
tggactgagtttttaaagcata

SEQ ID NO: 1091480 - DNA, 22 bp, Artificial Sequence
  chemically synthesized
attcaaaagtttatgctttaaa

SEQ ID NO: 1091481 - DNA, 22 bp, Artificial Sequence
  chemically synthesized
ctggactgagtttttaaagcat

SEQ ID NO: 1091482 - DNA, 22 bp, Artificial Sequence
  chemically synthesized
ttcaaaagtttatgctttaaaa

SEQ ID NO: 1091483 - DNA, 22 bp, Artificial Sequence
  chemically synthesized
tctggactgagtttttaaagca

SEQ ID NO: 1091484 - DNA, 22 bp, Artificial Sequence
  chemically synthesized
aaaagtttatgctttaaaaact

SEQ ID NO: 1091485 - DNA, 22 bp, Artificial Sequence
  chemically synthesized
ttttctggactgagtttttaaa

SEQ ID NO: 1091486 - DNA, 22 bp, Artificial Sequence
  chemically synthesized
attttctggactgagtttttaa

SEQ ID NO: 1091487 - DNA, 22 bp, Artificial Sequence
  chemically synthesized
tcttattttctggactgagttt

SEQ ID NO: 1091488 - DNA, 22 bp, Artificial Sequence
  chemically synthesized
atgctttaaaaactcagtccag

SEQ ID NO: 1091489 - DNA, 22 bp, Artificial Sequence
  chemically synthesized
tgctttaaaaactcagtccaga

SEQ ID NO: 1091490 - DNA, 22 bp, Artificial Sequence
  chemically synthesized
taaaaactcagtccagaaaata

SEQ ID NO: 1091491 - DNA, 22 bp, Artificial Sequence
  chemically synthesized
aaaaactcagtccagaaaataa

SEQ ID NO: 1091492 - DNA, 22 bp, Artificial Sequence
  chemically synthesized
aaaactcagtccagaaaataag

SEQ ID NO: 1091493 - DNA, 22 bp, Artificial Sequence
  chemically synthesized
aacacgtattatcttattttct

SEQ ID NO: 1091494 - DNA, 22 bp, Artificial Sequence
  chemically synthesized
attcaacacgtattatcttatt

SEQ ID NO: 1091495 - DNA, 22 bp, Artificial Sequence
  chemically synthesized
agtccagaaaataagataatac

SEQ ID NO: 1091496 - DNA, 22 bp, Artificial Sequence
  chemically synthesized
agcaacataccctgattcaaca

SEQ ID NO: 1091497 - DNA, 22 bp, Artificial Sequence
  chemically synthesized
cagcaacataccctgattcaac

SEQ ID NO: 1091498 - DNA, 22 bp, Artificial Sequence
  chemically synthesized
atttcagcaacataccctgatt

SEQ ID NO: 1091499 - DNA, 22 bp, Artificial Sequence
  chemically synthesized
aatcagggtatgttgctgaaat

SEQ ID NO: 1091500 - DNA, 22 bp, Artificial Sequence
  chemically synthesized
ccccaaagaaaaaataattcat

SEQ ID NO: 1091501 - DNA, 22 bp, Artificial Sequence
  chemically synthesized
cccccaaagaaaaaataattca

SEQ ID NO: 1091502 - DNA, 22 bp, Artificial Sequence
  chemically synthesized
ctgaaatgaattattttttctt

SEQ ID NO: 1091503 - DNA, 22 bp, Artificial Sequence
  chemically synthesized
acatttcccccaaagaaaaaat

SEQ ID NO: 1091504 - DNA, 22 bp, Artificial Sequence
  chemically synthesized
aaatgaattattttttctttgg

SEQ ID NO: 1091505 - DNA, 22 bp, Artificial Sequence
  chemically synthesized
gtataaaccctgacatttcccc

SEQ ID NO: 1091506 - DNA, 22 bp, Artificial Sequence
  chemically synthesized
ttttttctttgggggaaatgtc

SEQ ID NO: 1091507 - DNA, 22 bp, Artificial Sequence
  chemically synthesized
ggtataaaccctgacatttccc

SEQ ID NO: 1091508 - DNA, 22 bp, Artificial Sequence
  chemically synthesized
tggtataaaccctgacatttcc

SEQ ID NO: 1091509 - DNA, 22 bp, Artificial Sequence
  chemically synthesized
ttggtataaaccctgacatttc

SEQ ID NO: 1091510 - DNA, 22 bp, Artificial Sequence
  chemically synthesized
tttctttgggggaaatgtcagg

SEQ ID NO: 1091511 - DNA, 22 bp, Artificial Sequence
  chemically synthesized
ttctttgggggaaatgtcaggg

SEQ ID NO: 1091512 - DNA, 22 bp, Artificial Sequence
  chemically synthesized
tctttgggggaaatgtcagggt

SEQ ID NO: 1091513 - DNA, 22 bp, Artificial Sequence
  chemically synthesized
ctttgggggaaatgtcagggtt

SEQ ID NO: 1091514 - DNA, 22 bp, Artificial Sequence
  chemically synthesized
tttgggggaaatgtcagggttt

SEQ ID NO: 1091515 - DNA, 22 bp, Artificial Sequence
  chemically synthesized
tgggggaaatgtcagggtttat

SEQ ID NO: 1091516 - DNA, 22 bp, Artificial Sequence
  chemically synthesized
aaggtttttggtataaaccctg

SEQ ID NO: 1091517 - DNA, 22 bp, Artificial Sequence
  chemically synthesized
gggggaaatgtcagggtttata

SEQ ID NO: 1091518 - DNA, 22 bp, Artificial Sequence
  chemically synthesized
aaaggtttttggtataaaccct

SEQ ID NO: 1091519 - DNA, 22 bp, Artificial Sequence
  chemically synthesized
ggggaaatgtcagggtttatac

SEQ ID NO: 1091520 - DNA, 22 bp, Artificial Sequence
  chemically synthesized
taaaggtttttggtataaaccc

SEQ ID NO: 1091521 - DNA, 22 bp, Artificial Sequence
  chemically synthesized
ttttaaaggtttttggtataaa

SEQ ID NO: 1091522 - DNA, 22 bp, Artificial Sequence
  chemically synthesized
tattttaaaggtttttggtata

SEQ ID NO: 1091523 - DNA, 22 bp, Artificial Sequence
  chemically synthesized
ctattttaaaggtttttggtat

SEQ ID NO: 1091524 - DNA, 22 bp, Artificial Sequence
  chemically synthesized
taaccttctattttaaaggttt

SEQ ID NO: 1091525 - DNA, 22 bp, Artificial Sequence
  chemically synthesized
ataaccttctattttaaaggtt

SEQ ID NO: 1091526 - DNA, 22 bp, Artificial Sequence
  chemically synthesized
cttataaccttctattttaaag

SEQ ID NO: 1091527 - DNA, 22 bp, Artificial Sequence
  chemically synthesized
ataccaaaaacctttaaaatag

SEQ ID NO: 1091528 - DNA, 22 bp, Artificial Sequence
  chemically synthesized
taccaaaaacctttaaaataga

SEQ ID NO: 1091529 - DNA, 22 bp, Artificial Sequence
  chemically synthesized
acacaaaactacttataacctt

SEQ ID NO: 1091530 - DNA, 22 bp, Artificial Sequence
  chemically synthesized
ttaacacaaaactacttataac

SEQ ID NO: 1091531 - DNA, 22 bp, Artificial Sequence
  chemically synthesized
taaaatagaaggttataagtag

SEQ ID NO: 1091532 - DNA, 22 bp, Artificial Sequence
  chemically synthesized
attaacacaaaactacttataa

SEQ ID NO: 1091533 - DNA, 22 bp, Artificial Sequence
  chemically synthesized
aaaatagaaggttataagtagt

SEQ ID NO: 1091534 - DNA, 22 bp, Artificial Sequence
  chemically synthesized
tattaacacaaaactacttata

SEQ ID NO: 1091535 - DNA, 22 bp, Artificial Sequence
  chemically synthesized
aaatagaaggttataagtagtt

SEQ ID NO: 1091536 - DNA, 22 bp, Artificial Sequence
  chemically synthesized
caatcctttattaacacaaaac

SEQ ID NO: 1091537 - DNA, 22 bp, Artificial Sequence
  chemically synthesized
tattgcaatcctttattaacac

SEQ ID NO: 1091538 - DNA, 22 bp, Artificial Sequence
  chemically synthesized
taagtagttttgtgttaataaa

SEQ ID NO: 1091539 - DNA, 22 bp, Artificial Sequence
  chemically synthesized
atgtaattatattgcaatcctt

SEQ ID NO: 1091540 - DNA, 22 bp, Artificial Sequence
  chemically synthesized
tgtgttaataaaggattgcaat

SEQ ID NO: 1091541 - DNA, 22 bp, Artificial Sequence
  chemically synthesized
gtgttaataaaggattgcaata

SEQ ID NO: 1091542 - DNA, 22 bp, Artificial Sequence
  chemically synthesized
ttaatgtaattatattgcaatc

SEQ ID NO: 1091543 - DNA, 22 bp, Artificial Sequence
  chemically synthesized
tgttaataaaggattgcaatat

SEQ ID NO: 1091544 - DNA, 22 bp, Artificial Sequence
  chemically synthesized
tattaatgtaattatattgcaa

SEQ ID NO: 1091545 - DNA, 22 bp, Artificial Sequence
  chemically synthesized
ataaaggattgcaatataatta

SEQ ID NO: 1091546 - DNA, 22 bp, Artificial Sequence
  chemically synthesized
actctattaatgtaattatatt

SEQ ID NO: 1091547 - DNA, 22 bp, Artificial Sequence
  chemically synthesized
gtattaactctattaatgtaat

SEQ ID NO: 1091548 - DNA, 22 bp, Artificial Sequence
  chemically synthesized
ggtattaactctattaatgtaa

SEQ ID NO: 1091549 - DNA, 22 bp, Artificial Sequence
  chemically synthesized
caatataattacattaatagag

SEQ ID NO: 1091550 - DNA, 22 bp, Artificial Sequence
  chemically synthesized
atcttggtattaactctattaa

SEQ ID NO: 1091551 - DNA, 22 bp, Artificial Sequence
  chemically synthesized
gatcttggtattaactctatta

SEQ ID NO: 1091552 - DNA, 22 bp, Artificial Sequence
  chemically synthesized
acttgatcttggtattaactct

SEQ ID NO: 1091553 - DNA, 22 bp, Artificial Sequence
  chemically synthesized
taacttgatcttggtattaact

SEQ ID NO: 1091554 - DNA, 22 bp, Artificial Sequence
  chemically synthesized
tctaacttgatcttggtattaa

SEQ ID NO: 1091555 - DNA, 22 bp, Artificial Sequence
  chemically synthesized
cattaatagagttaataccaag

SEQ ID NO: 1091556 - DNA, 22 bp, Artificial Sequence
  chemically synthesized
ctctctaacttgatcttggtat

SEQ ID NO: 1091557 - DNA, 22 bp, Artificial Sequence
  chemically synthesized
actctctaacttgatcttggta

SEQ ID NO: 1091558 - DNA, 22 bp, Artificial Sequence
  chemically synthesized
atagagttaataccaagatcaa

SEQ ID NO: 1091559 - DNA, 22 bp, Artificial Sequence
  chemically synthesized
ggaatagcttactctctaactt

SEQ ID NO: 1091560 - DNA, 22 bp, Artificial Sequence
  chemically synthesized
ataccaagatcaagttagagag

SEQ ID NO: 1091561 - DNA, 22 bp, Artificial Sequence
  chemically synthesized
aggaatagcttactctctaact

SEQ ID NO: 1091562 - DNA, 22 bp, Artificial Sequence
  chemically synthesized
tccttaggaatagcttactctc

SEQ ID NO: 1091563 - DNA, 22 bp, Artificial Sequence
  chemically synthesized
tgtccttaggaatagcttactc

SEQ ID NO: 1091564 - DNA, 22 bp, Artificial Sequence
  chemically synthesized
ttctgtccttaggaatagctta

SEQ ID NO: 1091565 - DNA, 22 bp, Artificial Sequence
  chemically synthesized
atctattctgtccttaggaata

SEQ ID NO: 1091566 - DNA, 22 bp, Artificial Sequence
  chemically synthesized
gagagtaagctattcctaagga

SEQ ID NO: 1091567 - DNA, 22 bp, Artificial Sequence
  chemically synthesized
agtactcatctattctgtcctt

SEQ ID NO: 1091568 - DNA, 22 bp, Artificial Sequence
  chemically synthesized
cagtactcatctattctgtcct

SEQ ID NO: 1091569 - DNA, 22 bp, Artificial Sequence
  chemically synthesized
tcagtactcatctattctgtcc

SEQ ID NO: 1091570 - DNA, 22 bp, Artificial Sequence
  chemically synthesized
ttcagtactcatctattctgtc

SEQ ID NO: 1091571 - DNA, 22 bp, Artificial Sequence
  chemically synthesized
ttcctaaggacagaatagatga

SEQ ID NO: 1091572 - DNA, 22 bp, Artificial Sequence
  chemically synthesized
acatttttcagtactcatctat

SEQ ID NO: 1091573 - DNA, 22 bp, Artificial Sequence
  chemically synthesized
ctaaggacagaatagatgagta

SEQ ID NO: 1091574 - DNA, 22 bp, Artificial Sequence
  chemically synthesized
gacatttttcagtactcatcta

SEQ ID NO: 1091575 - DNA, 22 bp, Artificial Sequence
  chemically synthesized
aggacagaatagatgagtactg

SEQ ID NO: 1091576 - DNA, 22 bp, Artificial Sequence
  chemically synthesized
agtgtttgacatttttcagtac

SEQ ID NO: 1091577 - DNA, 22 bp, Artificial Sequence
  chemically synthesized
cagtgtttgacatttttcagta

SEQ ID NO: 1091578 - DNA, 22 bp, Artificial Sequence
  chemically synthesized
gccaagatccaacttcagtgtt

SEQ ID NO: 1091579 - DNA, 22 bp, Artificial Sequence
  chemically synthesized
aaaaatgtcaaacactgaagtt

SEQ ID NO: 1091580 - DNA, 22 bp, Artificial Sequence
  chemically synthesized
ggagatacacctggccaagatc

SEQ ID NO: 1091581 - DNA, 22 bp, Artificial Sequence
  chemically synthesized
aagttggatcttggccaggtgt

SEQ ID NO: 1091582 - DNA, 22 bp, Artificial Sequence
  chemically synthesized
ccaaagtgctgggagatacacc

SEQ ID NO: 1091583 - DNA, 22 bp, Artificial Sequence
  chemically synthesized
gatcttggccaggtgtatctcc

SEQ ID NO: 1091584 - DNA, 22 bp, Artificial Sequence
  chemically synthesized
gcctcccaaagtgctgggagat

SEQ ID NO: 1091585 - DNA, 22 bp, Artificial Sequence
  chemically synthesized
ggcctcccaaagtgctgggaga

SEQ ID NO: 1091586 - DNA, 22 bp, Artificial Sequence
  chemically synthesized
ggccaggtgtatctcccagcac

SEQ ID NO: 1091587 - DNA, 22 bp, Artificial Sequence
  chemically synthesized
gccaggtgtatctcccagcact

SEQ ID NO: 1091588 - DNA, 22 bp, Artificial Sequence
  chemically synthesized
ccttggcctcccaaagtgctgg

SEQ ID NO: 1091589 - DNA, 22 bp, Artificial Sequence
  chemically synthesized
gccttggcctcccaaagtgctg

SEQ ID NO: 1091590 - DNA, 22 bp, Artificial Sequence
  chemically synthesized
tccacttgccttggcctcccaa

SEQ ID NO: 1091591 - DNA, 22 bp, Artificial Sequence
  chemically synthesized
ccagcactttgggaggccaagg

SEQ ID NO: 1091592 - DNA, 22 bp, Artificial Sequence
  chemically synthesized
aagctatccacttgccttggcc

SEQ ID NO: 1091593 - DNA, 22 bp, Artificial Sequence
  chemically synthesized
tgggaggccaaggcaagtggat

SEQ ID NO: 1091594 - DNA, 22 bp, Artificial Sequence
  chemically synthesized
gggaggccaaggcaagtggata

SEQ ID NO: 1091595 - DNA, 22 bp, Artificial Sequence
  chemically synthesized
ccgggctcaagctatccacttg

SEQ ID NO: 1091596 - DNA, 22 bp, Artificial Sequence
  chemically synthesized
ggaggccaaggcaagtggatag

SEQ ID NO: 1091597 - DNA, 22 bp, Artificial Sequence
  chemically synthesized
aactcccgggctcaagctatcc

SEQ ID NO: 1091598 - DNA, 22 bp, Artificial Sequence
  chemically synthesized
gaactcccgggctcaagctatc

SEQ ID NO: 1091599 - DNA, 22 bp, Artificial Sequence
  chemically synthesized
gtcttgaactcccgggctcaag

SEQ ID NO: 1091600 - DNA, 22 bp, Artificial Sequence
  chemically synthesized
tccaggctggtcttgaactccc

SEQ ID NO: 1091601 - DNA, 22 bp, Artificial Sequence
  chemically synthesized
gagcccgggagttcaagaccag

SEQ ID NO: 1091602 - DNA, 22 bp, Artificial Sequence
  chemically synthesized
agcccgggagttcaagaccagc

SEQ ID NO: 1091603 - DNA, 22 bp, Artificial Sequence
  chemically synthesized
ccatgttgtccaggctggtctt

SEQ ID NO: 1091604 - DNA, 22 bp, Artificial Sequence
  chemically synthesized
gccatgttgtccaggctggtct

SEQ ID NO: 1091605 - DNA, 22 bp, Artificial Sequence
  chemically synthesized
tgccatgttgtccaggctggtc

SEQ ID NO: 1091606 - DNA, 22 bp, Artificial Sequence
  chemically synthesized
ttttgccatgttgtccaggctg

SEQ ID NO: 1091607 - DNA, 22 bp, Artificial Sequence
  chemically synthesized
aagaccagcctggacaacatgg

SEQ ID NO: 1091608 - DNA, 22 bp, Artificial Sequence
  chemically synthesized
gacaacatggcaaaacaacatt

SEQ ID NO: 1091609 - DNA, 22 bp, Artificial Sequence
  chemically synthesized
tgtgtgtgtgtgtggaaatgtt

SEQ ID NO: 1091610 - DNA, 22 bp, Artificial Sequence
  chemically synthesized
gtgtgtgtgtgtgtggaaatgt

SEQ ID NO: 1091611 - DNA, 22 bp, Artificial Sequence
  chemically synthesized
tttgtgtgtgtgtgtgtggaaa

SEQ ID NO: 1091612 - DNA, 22 bp, Artificial Sequence
  chemically synthesized
ccggttatttgtgtgtgtgtgt

SEQ ID NO: 1091613 - DNA, 22 bp, Artificial Sequence
  chemically synthesized
ccactcccggttatttgtgtgt

SEQ ID NO: 1091614 - DNA, 22 bp, Artificial Sequence
  chemically synthesized
ccacacacacacacacaaataa

SEQ ID NO: 1091615 - DNA, 22 bp, Artificial Sequence
  chemically synthesized
cacacacacacacacaaataac

SEQ ID NO: 1091616 - DNA, 22 bp, Artificial Sequence
  chemically synthesized
caggtgcatgctgccactcccg

SEQ ID NO: 1091617 - DNA, 22 bp, Artificial Sequence
  chemically synthesized
ggactacaggtgcatgctgcca

SEQ ID NO: 1091618 - DNA, 22 bp, Artificial Sequence
  chemically synthesized
agtagctgggactacaggtgca

SEQ ID NO: 1091619 - DNA, 22 bp, Artificial Sequence
  chemically synthesized
ctgagtagctgggactacaggt

SEQ ID NO: 1091620 - DNA, 22 bp, Artificial Sequence
  chemically synthesized
agcctcctgagtagctgggact

SEQ ID NO: 1091621 - DNA, 22 bp, Artificial Sequence
  chemically synthesized
ccacctcagcctcctgagtagc

SEQ ID NO: 1091622 - DNA, 22 bp, Artificial Sequence
  chemically synthesized
cccacctcagcctcctgagtag

SEQ ID NO: 1091623 - DNA, 22 bp, Artificial Sequence
  chemically synthesized
tagtcccagctactcaggaggc

SEQ ID NO: 1091624 - DNA, 22 bp, Artificial Sequence
  chemically synthesized
aggtgatcttcccacctcagcc

SEQ ID NO: 1091625 - DNA, 22 bp, Artificial Sequence
  chemically synthesized
ctcaggaggctgaggtgggaag

SEQ ID NO: 1091626 - DNA, 22 bp, Artificial Sequence
  chemically synthesized
ggctcaggtgatcttcccacct

SEQ ID NO: 1091627 - DNA, 22 bp, Artificial Sequence
  chemically synthesized
aggaggctgaggtgggaagatc

SEQ ID NO: 1091628 - DNA, 22 bp, Artificial Sequence
  chemically synthesized
cctgggctcaggtgatcttccc

SEQ ID NO: 1091629 - DNA, 22 bp, Artificial Sequence
  chemically synthesized
gacctccctgggctcaggtgat

SEQ ID NO: 1091630 - DNA, 22 bp, Artificial Sequence
  chemically synthesized
aggtgggaagatcacctgagcc

SEQ ID NO: 1091631 - DNA, 22 bp, Artificial Sequence
  chemically synthesized
tagcctcgacctccctgggctc

SEQ ID NO: 1091632 - DNA, 22 bp, Artificial Sequence
  chemically synthesized
actgtagcctcgacctccctgg

SEQ ID NO: 1091633 - DNA, 22 bp, Artificial Sequence
  chemically synthesized
agcccagggaggtcgaggctac

SEQ ID NO: 1091634 - DNA, 22 bp, Artificial Sequence
  chemically synthesized
gagtgcagtggcatgatcgtgg

SEQ ID NO: 1091635 - DNA, 22 bp, Artificial Sequence
  chemically synthesized
cagtgagccacgatcatgccac

SEQ ID NO: 1091636 - DNA, 22 bp, Artificial Sequence
  chemically synthesized
agactggagtgcagtggcatga

SEQ ID NO: 1091637 - DNA, 22 bp, Artificial Sequence
  chemically synthesized
tccctgagactggagtgcagtg

SEQ ID NO: 1091638 - DNA, 22 bp, Artificial Sequence
  chemically synthesized
tgtccctgagactggagtgcag

SEQ ID NO: 1091639 - DNA, 22 bp, Artificial Sequence
  chemically synthesized
ctctgtccctgagactggagtg

SEQ ID NO: 1091640 - DNA, 22 bp, Artificial Sequence
  chemically synthesized
gctctgtccctgagactggagt

SEQ ID NO: 1091641 - DNA, 22 bp, Artificial Sequence
  chemically synthesized
cactccagtctcagggacagag

SEQ ID NO: 1091642 - DNA, 22 bp, Artificial Sequence
  chemically synthesized
aagacagggtcttgctctgtcc

SEQ ID NO: 1091643 - DNA, 22 bp, Artificial Sequence
  chemically synthesized
aaagacagggtcttgctctgtc

SEQ ID NO: 1091644 - DNA, 22 bp, Artificial Sequence
  chemically synthesized
taaagacagggtcttgctctgt

SEQ ID NO: 1091645 - DNA, 22 bp, Artificial Sequence
  chemically synthesized
cagtctcagggacagagcaaga

SEQ ID NO: 1091646 - DNA, 22 bp, Artificial Sequence
  chemically synthesized
ttaaagacagggtcttgctctg

SEQ ID NO: 1091647 - DNA, 22 bp, Artificial Sequence
  chemically synthesized
tttaaagacagggtcttgctct

SEQ ID NO: 1091648 - DNA, 22 bp, Artificial Sequence
  chemically synthesized
ttttaaagacagggtcttgctc

SEQ ID NO: 1091649 - DNA, 22 bp, Artificial Sequence
  chemically synthesized
tttttaaagacagggtcttgct

SEQ ID NO: 1091650 - DNA, 22 bp, Artificial Sequence
  chemically synthesized
ttttttaaagacagggtcttgc

SEQ ID NO: 1091651 - DNA, 22 bp, Artificial Sequence
  chemically synthesized
tttttttaaagacagggtcttg

SEQ ID NO: 1091652 - DNA, 22 bp, Artificial Sequence
  chemically synthesized
ttttttttaaagacagggtctt

SEQ ID NO: 1091653 - DNA, 22 bp, Artificial Sequence
  chemically synthesized
agggacagagcaagaccctgtc

SEQ ID NO: 1091654 - DNA, 22 bp, Artificial Sequence
  chemically synthesized
tttttttttaaagacagggtct

SEQ ID NO: 1091655 - DNA, 22 bp, Artificial Sequence
  chemically synthesized
ttttttttttaaagacagggtc

SEQ ID NO: 1091656 - DNA, 22 bp, Artificial Sequence
  chemically synthesized
aaatttttttttttttaaagac

SEQ ID NO: 1091657 - DNA, 22 bp, Artificial Sequence
  chemically synthesized
tgaaaagactcaaatttttttt

SEQ ID NO: 1091658 - DNA, 22 bp, Artificial Sequence
  chemically synthesized
tctttaaaaaaaaaaaaatttg

SEQ ID NO: 1091659 - DNA, 22 bp, Artificial Sequence
  chemically synthesized
gctgtgaaaagactcaaatttt

SEQ ID NO: 1091660 - DNA, 22 bp, Artificial Sequence
  chemically synthesized
agctgtgaaaagactcaaattt

SEQ ID NO: 1091661 - DNA, 22 bp, Artificial Sequence
  chemically synthesized
taaaaaaaaaaaaatttgagtc

SEQ ID NO: 1091662 - DNA, 22 bp, Artificial Sequence
  chemically synthesized
aaaaaaaaaaaaatttgagtct

SEQ ID NO: 1091663 - DNA, 22 bp, Artificial Sequence
  chemically synthesized
aaaaaaaaaaaatttgagtctt

SEQ ID NO: 1091664 - DNA, 22 bp, Artificial Sequence
  chemically synthesized
gcttagctgtgaaaagactcaa

SEQ ID NO: 1091665 - DNA, 22 bp, Artificial Sequence
  chemically synthesized
ggcttagctgtgaaaagactca

SEQ ID NO: 1091666 - DNA, 22 bp, Artificial Sequence
  chemically synthesized
accttggcttagctgtgaaaag

SEQ ID NO: 1091667 - DNA, 22 bp, Artificial Sequence
  chemically synthesized
gagtcttttcacagctaagcca

SEQ ID NO: 1091668 - DNA, 22 bp, Artificial Sequence
  chemically synthesized
tgaaactgaccttggcttagct

SEQ ID NO: 1091669 - DNA, 22 bp, Artificial Sequence
  chemically synthesized
agtcttttcacagctaagccaa

SEQ ID NO: 1091670 - DNA, 22 bp, Artificial Sequence
  chemically synthesized
ttcacagctaagccaaggtcag

SEQ ID NO: 1091671 - DNA, 22 bp, Artificial Sequence
  chemically synthesized
tcacagctaagccaaggtcagt

SEQ ID NO: 1091672 - DNA, 22 bp, Artificial Sequence
  chemically synthesized
cacagctaagccaaggtcagtt

SEQ ID NO: 1091673 - DNA, 22 bp, Artificial Sequence
  chemically synthesized
acagctaagccaaggtcagttt

SEQ ID NO: 1091674 - DNA, 22 bp, Artificial Sequence
  chemically synthesized
aaagtcattgtgaaactgacct

SEQ ID NO: 1091675 - DNA, 22 bp, Artificial Sequence
  chemically synthesized
agccaaggtcagtttcacaatg

SEQ ID NO: 1091676 - DNA, 22 bp, Artificial Sequence
  chemically synthesized
catcaaaaaattaaaagtcatt

SEQ ID NO: 1091677 - DNA, 22 bp, Artificial Sequence
  chemically synthesized
cacaatgacttttaattttttg

SEQ ID NO: 1091678 - DNA, 22 bp, Artificial Sequence
  chemically synthesized
acaatgacttttaattttttga

SEQ ID NO: 1091679 - DNA, 22 bp, Artificial Sequence
  chemically synthesized
ttaattttttgatgcaactgct

SEQ ID NO: 1091680 - DNA, 22 bp, Artificial Sequence
  chemically synthesized
taattttttgatgcaactgctg

SEQ ID NO: 1091681 - DNA, 22 bp, Artificial Sequence
  chemically synthesized
aattttttgatgcaactgctgt

SEQ ID NO: 1091682 - DNA, 22 bp, Artificial Sequence
  chemically synthesized
attttttgatgcaactgctgtc

SEQ ID NO: 1091683 - DNA, 22 bp, Artificial Sequence
  chemically synthesized
tttgatgcaactgctgtctcct

SEQ ID NO: 1091684 - DNA, 22 bp, Artificial Sequence
  chemically synthesized
ttgatgcaactgctgtctccta

SEQ ID NO: 1091685 - DNA, 22 bp, Artificial Sequence
  chemically synthesized
tgatgcaactgctgtctcctac

SEQ ID NO: 1091686 - DNA, 22 bp, Artificial Sequence
  chemically synthesized
gatgcaactgctgtctcctacc

SEQ ID NO: 1091687 - DNA, 22 bp, Artificial Sequence
  chemically synthesized
atgcaactgctgtctcctacct

SEQ ID NO: 1091688 - DNA, 22 bp, Artificial Sequence
  chemically synthesized
aatatcagtgtcaggtaggaga

SEQ ID NO: 1091689 - DNA, 22 bp, Artificial Sequence
  chemically synthesized
gaatatcagtgtcaggtaggag

SEQ ID NO: 1091690 - DNA, 22 bp, Artificial Sequence
  chemically synthesized
tttgaatatcagtgtcaggtag

SEQ ID NO: 1091691 - DNA, 22 bp, Artificial Sequence
  chemically synthesized
tatttgaatatcagtgtcaggt

SEQ ID NO: 1091692 - DNA, 22 bp, Artificial Sequence
  chemically synthesized
ctatttgaatatcagtgtcagg

SEQ ID NO: 1091693 - DNA, 22 bp, Artificial Sequence
  chemically synthesized
ctgtctcctacctgacactgat

SEQ ID NO: 1091694 - DNA, 22 bp, Artificial Sequence
  chemically synthesized
tttctatttgaatatcagtgtc

SEQ ID NO: 1091695 - DNA, 22 bp, Artificial Sequence
  chemically synthesized
atttctatttgaatatcagtgt

SEQ ID NO: 1091696 - DNA, 22 bp, Artificial Sequence
  chemically synthesized
tctcctacctgacactgatatt

SEQ ID NO: 1091697 - DNA, 22 bp, Artificial Sequence
  chemically synthesized
tatttctatttgaatatcagtg

SEQ ID NO: 1091698 - DNA, 22 bp, Artificial Sequence
  chemically synthesized
ttatttctatttgaatatcagt

SEQ ID NO: 1091699 - DNA, 22 bp, Artificial Sequence
  chemically synthesized
ctacctgacactgatattcaaa

SEQ ID NO: 1091700 - DNA, 22 bp, Artificial Sequence
  chemically synthesized
cctgacactgatattcaaatag

SEQ ID NO: 1091701 - DNA, 22 bp, Artificial Sequence
  chemically synthesized
acactgatattcaaatagaaat

SEQ ID NO: 1091702 - DNA, 22 bp, Artificial Sequence
  chemically synthesized
gaatgtgtttttatttctattt

SEQ ID NO: 1091703 - DNA, 22 bp, Artificial Sequence
  chemically synthesized
atattcaaatagaaataaaaac

SEQ ID NO: 1091704 - DNA, 22 bp, Artificial Sequence
  chemically synthesized
aaatagaaataaaaacacattc

SEQ ID NO: 1091705 - DNA, 22 bp, Artificial Sequence
  chemically synthesized
tgatatggaattggaatgtgtt

SEQ ID NO: 1091706 - DNA, 22 bp, Artificial Sequence
  chemically synthesized
aatgtgggttgtgatatggaat

SEQ ID NO: 1091707 - DNA, 22 bp, Artificial Sequence
  chemically synthesized
caatgtgggttgtgatatggaa

SEQ ID NO: 1091708 - DNA, 22 bp, Artificial Sequence
  chemically synthesized
caattccatatcacaacccaca

SEQ ID NO: 1091709 - DNA, 22 bp, Artificial Sequence
  chemically synthesized
aagatcatttcaatgtgggttg

SEQ ID NO: 1091710 - DNA, 22 bp, Artificial Sequence
  chemically synthesized
catatcacaacccacattgaaa

SEQ ID NO: 1091711 - DNA, 22 bp, Artificial Sequence
  chemically synthesized
tgtggcaagtaaattgaagatc

SEQ ID NO: 1091712 - DNA, 22 bp, Artificial Sequence
  chemically synthesized
ctatgtggcaagtaaattgaag

SEQ ID NO: 1091713 - DNA, 22 bp, Artificial Sequence
  chemically synthesized
aaatgatcttcaatttacttgc

SEQ ID NO: 1091714 - DNA, 22 bp, Artificial Sequence
  chemically synthesized
caatttacttgccacatagcaa

SEQ ID NO: 1091715 - DNA, 22 bp, Artificial Sequence
  chemically synthesized
aatttacttgccacatagcaat

SEQ ID NO: 1091716 - DNA, 22 bp, Artificial Sequence
  chemically synthesized
agtcaaatagatattgctatgt

SEQ ID NO: 1091717 - DNA, 22 bp, Artificial Sequence
  chemically synthesized
acttgccacatagcaatatcta

SEQ ID NO: 1091718 - DNA, 22 bp, Artificial Sequence
  chemically synthesized
cttgccacatagcaatatctat

SEQ ID NO: 1091719 - DNA, 22 bp, Artificial Sequence
  chemically synthesized
gatctgagtcaaatagatattg

SEQ ID NO: 1091720 - DNA, 22 bp, Artificial Sequence
  chemically synthesized
gccacatagcaatatctatttg

SEQ ID NO: 1091721 - DNA, 22 bp, Artificial Sequence
  chemically synthesized
ctggatctgagtcaaatagata

SEQ ID NO: 1091722 - DNA, 22 bp, Artificial Sequence
  chemically synthesized
ccacatagcaatatctatttga

SEQ ID NO: 1091723 - DNA, 22 bp, Artificial Sequence
  chemically synthesized
ttgctggatctgagtcaaatag

SEQ ID NO: 1091724 - DNA, 22 bp, Artificial Sequence
  chemically synthesized
cactattgctggatctgagtca

SEQ ID NO: 1091725 - DNA, 22 bp, Artificial Sequence
  chemically synthesized
ttgcactattgctggatctgag

SEQ ID NO: 1091726 - DNA, 22 bp, Artificial Sequence
  chemically synthesized
tttgactcagatccagcaatag

SEQ ID NO: 1091727 - DNA, 22 bp, Artificial Sequence
  chemically synthesized
atcattgttgcactattgctgg

SEQ ID NO: 1091728 - DNA, 22 bp, Artificial Sequence
  chemically synthesized
catcattgttgcactattgctg

SEQ ID NO: 1091729 - DNA, 22 bp, Artificial Sequence
  chemically synthesized
gactcagatccagcaatagtgc

SEQ ID NO: 1091730 - DNA, 22 bp, Artificial Sequence
  chemically synthesized
actcagatccagcaatagtgca

SEQ ID NO: 1091731 - DNA, 22 bp, Artificial Sequence
  chemically synthesized
gtccttcatcattgttgcacta

SEQ ID NO: 1091732 - DNA, 22 bp, Artificial Sequence
  chemically synthesized
agatccagcaatagtgcaacaa

SEQ ID NO: 1091733 - DNA, 22 bp, Artificial Sequence
  chemically synthesized
tggtccttcatcattgttgcac

SEQ ID NO: 1091734 - DNA, 22 bp, Artificial Sequence
  chemically synthesized
caaacaatctctggtccttcat

SEQ ID NO: 1091735 - DNA, 22 bp, Artificial Sequence
  chemically synthesized
gaaaaggggaattccaaacaat

SEQ ID NO: 1091736 - DNA, 22 bp, Artificial Sequence
  chemically synthesized
gggattggaaaaggggaattcc

SEQ ID NO: 1091737 - DNA, 22 bp, Artificial Sequence
  chemically synthesized
tttggaattccccttttccaat

SEQ ID NO: 1091738 - DNA, 22 bp, Artificial Sequence
  chemically synthesized
ggaattccccttttccaatccc

SEQ ID NO: 1091739 - DNA, 22 bp, Artificial Sequence
  chemically synthesized
gaattccccttttccaatcccc

SEQ ID NO: 1091740 - DNA, 22 bp, Artificial Sequence
  chemically synthesized
cccttttccaatccccaattcc

SEQ ID NO: 1091741 - DNA, 22 bp, Artificial Sequence
  chemically synthesized
tccaaatcaacataaggaattg

SEQ ID NO: 1091742 - DNA, 22 bp, Artificial Sequence
  chemically synthesized
atccaaatcaacataaggaatt

SEQ ID NO: 1091743 - DNA, 22 bp, Artificial Sequence
  chemically synthesized
ttccaatccccaattccttatg

SEQ ID NO: 1091744 - DNA, 22 bp, Artificial Sequence
  chemically synthesized
tatccaaatcaacataaggaat

SEQ ID NO: 1091745 - DNA, 22 bp, Artificial Sequence
  chemically synthesized
tccaatccccaattccttatgt

SEQ ID NO: 1091746 - DNA, 22 bp, Artificial Sequence
  chemically synthesized
ccaatccccaattccttatgtt

SEQ ID NO: 1091747 - DNA, 22 bp, Artificial Sequence
  chemically synthesized
caatccccaattccttatgttg

SEQ ID NO: 1091748 - DNA, 22 bp, Artificial Sequence
  chemically synthesized
cttatgttgatttggataaaat

SEQ ID NO: 1091749 - DNA, 22 bp, Artificial Sequence
  chemically synthesized
ggtggcatatccatattttatc

SEQ ID NO: 1091750 - DNA, 22 bp, Artificial Sequence
  chemically synthesized
atgttgatttggataaaatatg

SEQ ID NO: 1091751 - DNA, 22 bp, Artificial Sequence
  chemically synthesized
tgttgatttggataaaatatgg

SEQ ID NO: 1091752 - DNA, 22 bp, Artificial Sequence
  chemically synthesized
atttggataaaatatggatatg

SEQ ID NO: 1091753 - DNA, 22 bp, Artificial Sequence
  chemically synthesized
aatcctgggtggcatatccata

SEQ ID NO: 1091754 - DNA, 22 bp, Artificial Sequence
  chemically synthesized
gaatcctgggtggcatatccat

SEQ ID NO: 1091755 - DNA, 22 bp, Artificial Sequence
  chemically synthesized
ggataaaatatggatatgccac

SEQ ID NO: 1091756 - DNA, 22 bp, Artificial Sequence
  chemically synthesized
gataaaatatggatatgccacc

SEQ ID NO: 1091757 - DNA, 22 bp, Artificial Sequence
  chemically synthesized
cagtcttgaatcctgggtggca

SEQ ID NO: 1091758 - DNA, 22 bp, Artificial Sequence
  chemically synthesized
caaatgtaccagcagcacctcc

SEQ ID NO: 1091759 - DNA, 22 bp, Artificial Sequence
  chemically synthesized
aagactggaggtgctgctggta

SEQ ID NO: 1091760 - DNA, 22 bp, Artificial Sequence
  chemically synthesized
gaggtgctgctggtacatttgc

SEQ ID NO: 1091761 - DNA, 22 bp, Artificial Sequence
  chemically synthesized
ctggtacatttgcagatatctg

SEQ ID NO: 1091762 - DNA, 22 bp, Artificial Sequence
  chemically synthesized
gtacatttgcagatatctgccc

SEQ ID NO: 1091763 - DNA, 22 bp, Artificial Sequence
  chemically synthesized
gcagatatctgccctaccctca

SEQ ID NO: 1091764 - DNA, 22 bp, Artificial Sequence
  chemically synthesized
aagagaagtatgtgagggtagg

SEQ ID NO: 1091765 - DNA, 22 bp, Artificial Sequence
  chemically synthesized
cagatatctgccctaccctcac

SEQ ID NO: 1091766 - DNA, 22 bp, Artificial Sequence
  chemically synthesized
tgaagagaagtatgtgagggta

SEQ ID NO: 1091767 - DNA, 22 bp, Artificial Sequence
  chemically synthesized
tccaattctgaagagaagtatg

SEQ ID NO: 1091768 - DNA, 22 bp, Artificial Sequence
  chemically synthesized
ccctaccctcacatacttctct

SEQ ID NO: 1091769 - DNA, 22 bp, Artificial Sequence
  chemically synthesized
tatccaattctgaagagaagta

SEQ ID NO: 1091770 - DNA, 22 bp, Artificial Sequence
  chemically synthesized
tctatccaattctgaagagaag

SEQ ID NO: 1091771 - DNA, 22 bp, Artificial Sequence
  chemically synthesized
ctctatccaattctgaagagaa

SEQ ID NO: 1091772 - DNA, 22 bp, Artificial Sequence
  chemically synthesized
ccctcacatacttctcttcaga

SEQ ID NO: 1091773 - DNA, 22 bp, Artificial Sequence
  chemically synthesized
ttctctatccaattctgaagag

SEQ ID NO: 1091774 - DNA, 22 bp, Artificial Sequence
  chemically synthesized
acatacttctcttcagaattgg

SEQ ID NO: 1091775 - DNA, 22 bp, Artificial Sequence
  chemically synthesized
ctcttcagaattggatagagaa

SEQ ID NO: 1091776 - DNA, 22 bp, Artificial Sequence
  chemically synthesized
tcttcagaattggatagagaag

SEQ ID NO: 1091777 - DNA, 22 bp, Artificial Sequence
  chemically synthesized
agtaggaaaacctcttctctat

SEQ ID NO: 1091778 - DNA, 22 bp, Artificial Sequence
  chemically synthesized
ttcagaattggatagagaagag

SEQ ID NO: 1091779 - DNA, 22 bp, Artificial Sequence
  chemically synthesized
gagtaggaaaacctcttctcta

SEQ ID NO: 1091780 - DNA, 22 bp, Artificial Sequence
  chemically synthesized
cagaattggatagagaagaggt

SEQ ID NO: 1091781 - DNA, 22 bp, Artificial Sequence
  chemically synthesized
agaattggatagagaagaggtt

SEQ ID NO: 1091782 - DNA, 22 bp, Artificial Sequence
  chemically synthesized
gatagagaagaggttttcctac

SEQ ID NO: 1091783 - DNA, 22 bp, Artificial Sequence
  chemically synthesized
aaaaggaacgccttgagtagga

SEQ ID NO: 1091784 - DNA, 22 bp, Artificial Sequence
  chemically synthesized
cagattgaaaaggaacgccttg

SEQ ID NO: 1091785 - DNA, 22 bp, Artificial Sequence
  chemically synthesized
acagattgaaaaggaacgcctt

SEQ ID NO: 1091786 - DNA, 22 bp, Artificial Sequence
  chemically synthesized
tcctactcaaggcgttcctttt

SEQ ID NO: 1091787 - DNA, 22 bp, Artificial Sequence
  chemically synthesized
cctactcaaggcgttccttttc

SEQ ID NO: 1091788 - DNA, 22 bp, Artificial Sequence
  chemically synthesized
ctactcaaggcgttccttttca

SEQ ID NO: 1091789 - DNA, 22 bp, Artificial Sequence
  chemically synthesized
acatgcttacagattgaaaagg

SEQ ID NO: 1091790 - DNA, 22 bp, Artificial Sequence
  chemically synthesized
ctcaaggcgttccttttcaatc

SEQ ID NO: 1091791 - DNA, 22 bp, Artificial Sequence
  chemically synthesized
gacatgcttacagattgaaaag

SEQ ID NO: 1091792 - DNA, 22 bp, Artificial Sequence
  chemically synthesized
tgacatgcttacagattgaaaa

SEQ ID NO: 1091793 - DNA, 22 bp, Artificial Sequence
  chemically synthesized
ttgacatgcttacagattgaaa

SEQ ID NO: 1091794 - DNA, 22 bp, Artificial Sequence
  chemically synthesized
aaggcgttccttttcaatctgt

SEQ ID NO: 1091795 - DNA, 22 bp, Artificial Sequence
  chemically synthesized
cttttcaatctgtaagcatgtc

SEQ ID NO: 1091796 - DNA, 22 bp, Artificial Sequence
  chemically synthesized
ttcaatctgtaagcatgtcaaa

SEQ ID NO: 1091797 - DNA, 22 bp, Artificial Sequence
  chemically synthesized
tcaatctgtaagcatgtcaaaa

SEQ ID NO: 1091798 - DNA, 22 bp, Artificial Sequence
  chemically synthesized
caatctgtaagcatgtcaaaag

SEQ ID NO: 1091799 - DNA, 22 bp, Artificial Sequence
  chemically synthesized
aatctgtaagcatgtcaaaagg

SEQ ID NO: 1091800 - DNA, 22 bp, Artificial Sequence
  chemically synthesized
taagcatgtcaaaaggtccccg

SEQ ID NO: 1091801 - DNA, 22 bp, Artificial Sequence
  chemically synthesized
aatagtcaatgtcggggacctt

SEQ ID NO: 1091802 - DNA, 22 bp, Artificial Sequence
  chemically synthesized
ttgaatagtcaatgtcggggac

SEQ ID NO: 1091803 - DNA, 22 bp, Artificial Sequence
  chemically synthesized
attgaatagtcaatgtcgggga

SEQ ID NO: 1091804 - DNA, 22 bp, Artificial Sequence
  chemically synthesized
atgacttattgaatagtcaatg

SEQ ID NO: 1091805 - DNA, 22 bp, Artificial Sequence
  chemically synthesized
actaatgacttattgaatagtc

SEQ ID NO: 1091806 - DNA, 22 bp, Artificial Sequence
  chemically synthesized
actattcaataagtcattagtc

SEQ ID NO: 1091807 - DNA, 22 bp, Artificial Sequence
  chemically synthesized
ttcaataagtcattagtcaatg

SEQ ID NO: 1091808 - DNA, 22 bp, Artificial Sequence
  chemically synthesized
aataagtcattagtcaatggtt

SEQ ID NO: 1091809 - DNA, 22 bp, Artificial Sequence
  chemically synthesized
gggtagtatgcatgaaaccatt

SEQ ID NO: 1091810 - DNA, 22 bp, Artificial Sequence
  chemically synthesized
gtcaatggtttcatgcatacta

SEQ ID NO: 1091811 - DNA, 22 bp, Artificial Sequence
  chemically synthesized
catgcatactaccctagttact

SEQ ID NO: 1091812 - DNA, 22 bp, Artificial Sequence
  chemically synthesized
atgcatactaccctagttacta

SEQ ID NO: 1091813 - DNA, 22 bp, Artificial Sequence
  chemically synthesized
ccctagttactaccccccctta

SEQ ID NO: 1091814 - DNA, 22 bp, Artificial Sequence
  chemically synthesized
gttactacccccccttattctc

SEQ ID NO: 1091815 - DNA, 22 bp, Artificial Sequence
  chemically synthesized
ctacccccccttattctctttt

SEQ ID NO: 1091816 - DNA, 22 bp, Artificial Sequence
  chemically synthesized
cccccccttattctcttttttc

SEQ ID NO: 1091817 - DNA, 22 bp, Artificial Sequence
  chemically synthesized
attctcttttttctcttcatac

SEQ ID NO: 1091818 - DNA, 22 bp, Artificial Sequence
  chemically synthesized
ttctcttttttctcttcatacg

SEQ ID NO: 1091819 - DNA, 22 bp, Artificial Sequence
  chemically synthesized
tcttttttctcttcatacgtta

SEQ ID NO: 1091820 - DNA, 22 bp, Artificial Sequence
  chemically synthesized
ttttttctcttcatacgttata

SEQ ID NO: 1091821 - DNA, 22 bp, Artificial Sequence
  chemically synthesized
ttttctcttcatacgttatatt

SEQ ID NO: 1091822 - DNA, 22 bp, Artificial Sequence
  chemically synthesized
tttctcttcatacgttatatta

SEQ ID NO: 1091823 - DNA, 22 bp, Artificial Sequence
  chemically synthesized
ttctcttcatacgttatattat

SEQ ID NO: 1091824 - DNA, 22 bp, Artificial Sequence
  chemically synthesized
tctcttcatacgttatattatt

SEQ ID NO: 1091825 - DNA, 22 bp, Artificial Sequence
  chemically synthesized
ctcttcatacgttatattattt

SEQ ID NO: 1091826 - DNA, 22 bp, Artificial Sequence
  chemically synthesized
tcttcatacgttatattatttg

SEQ ID NO: 1091827 - DNA, 22 bp, Artificial Sequence
  chemically synthesized
ttcatacgttatattatttgtt

SEQ ID NO: 1091828 - DNA, 22 bp, Artificial Sequence
  chemically synthesized
catacgttatattatttgtttt

SEQ ID NO: 1091829 - DNA, 22 bp, Artificial Sequence
  chemically synthesized
atacgttatattatttgttttt

SEQ ID NO: 1091830 - DNA, 22 bp, Artificial Sequence
  chemically synthesized
gaatgtgcaagacataaaaaca

SEQ ID NO: 1091831 - DNA, 22 bp, Artificial Sequence
  chemically synthesized
ctagaatgtgcaagacataaaa

SEQ ID NO: 1091832 - DNA, 22 bp, Artificial Sequence
  chemically synthesized
cctagaatgtgcaagacataaa

SEQ ID NO: 1091833 - DNA, 22 bp, Artificial Sequence
  chemically synthesized
tattatttgtttttatgtcttg

SEQ ID NO: 1091834 - DNA, 22 bp, Artificial Sequence
  chemically synthesized
atttcctagaatgtgcaagaca

SEQ ID NO: 1091835 - DNA, 22 bp, Artificial Sequence
  chemically synthesized
tttgtttttatgtcttgcacat

SEQ ID NO: 1091836 - DNA, 22 bp, Artificial Sequence
  chemically synthesized
ctgatttcctagaatgtgcaag

SEQ ID NO: 1091837 - DNA, 22 bp, Artificial Sequence
  chemically synthesized
gtttttatgtcttgcacattct

SEQ ID NO: 1091838 - DNA, 22 bp, Artificial Sequence
  chemically synthesized
tttttatgtcttgcacattcta

SEQ ID NO: 1091839 - DNA, 22 bp, Artificial Sequence
  chemically synthesized
ttatgtcttgcacattctagga

SEQ ID NO: 1091840 - DNA, 22 bp, Artificial Sequence
  chemically synthesized
tatgtcttgcacattctaggaa

SEQ ID NO: 1091841 - DNA, 22 bp, Artificial Sequence
  chemically synthesized
atgtcttgcacattctaggaaa

SEQ ID NO: 1091842 - DNA, 22 bp, Artificial Sequence
  chemically synthesized
tgtcttgcacattctaggaaat

SEQ ID NO: 1091843 - DNA, 22 bp, Artificial Sequence
  chemically synthesized
aggaagagttactgatttccta

SEQ ID NO: 1091844 - DNA, 22 bp, Artificial Sequence
  chemically synthesized
gcacattctaggaaatcagtaa

SEQ ID NO: 1091845 - DNA, 22 bp, Artificial Sequence
  chemically synthesized
gttaaggaagagttactgattt

SEQ ID NO: 1091846 - DNA, 22 bp, Artificial Sequence
  chemically synthesized
cacattctaggaaatcagtaac

SEQ ID NO: 1091847 - DNA, 22 bp, Artificial Sequence
  chemically synthesized
gttagttaaggaagagttactg

SEQ ID NO: 1091848 - DNA, 22 bp, Artificial Sequence
  chemically synthesized
taggaaatcagtaactcttcct

SEQ ID NO: 1091849 - DNA, 22 bp, Artificial Sequence
  chemically synthesized
ggaaatcagtaactcttcctta

SEQ ID NO: 1091850 - DNA, 22 bp, Artificial Sequence
  chemically synthesized
aaaacattggttagttaaggaa

SEQ ID NO: 1091851 - DNA, 22 bp, Artificial Sequence
  chemically synthesized
aaaaacattggttagttaagga

SEQ ID NO: 1091852 - DNA, 22 bp, Artificial Sequence
  chemically synthesized
ataacttaaaaacattggttag

SEQ ID NO: 1091853 - DNA, 22 bp, Artificial Sequence
  chemically synthesized
cataacttaaaaacattggtta

SEQ ID NO: 1091854 - DNA, 22 bp, Artificial Sequence
  chemically synthesized
ttccttaactaaccaatgtttt

SEQ ID NO: 1091855 - DNA, 22 bp, Artificial Sequence
  chemically synthesized
ccttaactaaccaatgttttta

SEQ ID NO: 1091856 - DNA, 22 bp, Artificial Sequence
  chemically synthesized
accttcataacttaaaaacatt

SEQ ID NO: 1091857 - DNA, 22 bp, Artificial Sequence
  chemically synthesized
cttaactaaccaatgtttttaa

SEQ ID NO: 1091858 - DNA, 22 bp, Artificial Sequence
  chemically synthesized
ctaaccttcataacttaaaaac

SEQ ID NO: 1091859 - DNA, 22 bp, Artificial Sequence
  chemically synthesized
aactaaccaatgtttttaagtt

SEQ ID NO: 1091860 - DNA, 22 bp, Artificial Sequence
  chemically synthesized
gctaaccttcataacttaaaaa

SEQ ID NO: 1091861 - DNA, 22 bp, Artificial Sequence
  chemically synthesized
actaaccaatgtttttaagtta

SEQ ID NO: 1091862 - DNA, 22 bp, Artificial Sequence
  chemically synthesized
accaatgtttttaagttatgaa

SEQ ID NO: 1091863 - DNA, 22 bp, Artificial Sequence
  chemically synthesized
ttaagttatgaaggttagcaaa

SEQ ID NO: 1091864 - DNA, 22 bp, Artificial Sequence
  chemically synthesized
taagttatgaaggttagcaaat

SEQ ID NO: 1091865 - DNA, 22 bp, Artificial Sequence
  chemically synthesized
aagttatgaaggttagcaaatt

SEQ ID NO: 1091866 - DNA, 22 bp, Artificial Sequence
  chemically synthesized
atgagtaggaaaaatttgctaa

SEQ ID NO: 1091867 - DNA, 22 bp, Artificial Sequence
  chemically synthesized
agttatgaaggttagcaaattt

SEQ ID NO: 1091868 - DNA, 22 bp, Artificial Sequence
  chemically synthesized
gatgagtaggaaaaatttgcta

SEQ ID NO: 1091869 - DNA, 22 bp, Artificial Sequence
  chemically synthesized
tgaaggttagcaaatttttcct

SEQ ID NO: 1091870 - DNA, 22 bp, Artificial Sequence
  chemically synthesized
tggtttgatgagtaggaaaaat

SEQ ID NO: 1091871 - DNA, 22 bp, Artificial Sequence
  chemically synthesized
tatggtttgatgagtaggaaaa

SEQ ID NO: 1091872 - DNA, 22 bp, Artificial Sequence
  chemically synthesized
gcaaatttttcctactcatcaa

SEQ ID NO: 1091873 - DNA, 22 bp, Artificial Sequence
  chemically synthesized
ttcctactcatcaaaccataga

SEQ ID NO: 1091874 - DNA, 22 bp, Artificial Sequence
  chemically synthesized
tcctactcatcaaaccatagaa

SEQ ID NO: 1091875 - DNA, 22 bp, Artificial Sequence
  chemically synthesized
cctactcatcaaaccatagaac

SEQ ID NO: 1091876 - DNA, 22 bp, Artificial Sequence
  chemically synthesized
ctactcatcaaaccatagaacc

SEQ ID NO: 1091877 - DNA, 22 bp, Artificial Sequence
  chemically synthesized
catgtgagatatggttctatgg

SEQ ID NO: 1091878 - DNA, 22 bp, Artificial Sequence
  chemically synthesized
ctcatcaaaccatagaaccata

SEQ ID NO: 1091879 - DNA, 22 bp, Artificial Sequence
  chemically synthesized
ctacatgtgagatatggttcta

SEQ ID NO: 1091880 - DNA, 22 bp, Artificial Sequence
  chemically synthesized
atcaaaccatagaaccatatct

SEQ ID NO: 1091881 - DNA, 22 bp, Artificial Sequence
  chemically synthesized
agtacatctactacatgtgaga

SEQ ID NO: 1091882 - DNA, 22 bp, Artificial Sequence
  chemically synthesized
ctgagtacatctactacatgtg

SEQ ID NO: 1091883 - DNA, 22 bp, Artificial Sequence
  chemically synthesized
actgagtacatctactacatgt

SEQ ID NO: 1091884 - DNA, 22 bp, Artificial Sequence
  chemically synthesized
acttactgagtacatctactac

SEQ ID NO: 1091885 - DNA, 22 bp, Artificial Sequence
  chemically synthesized
tattcacttactgagtacatct

SEQ ID NO: 1091886 - DNA, 22 bp, Artificial Sequence
  chemically synthesized
atattcacttactgagtacatc

SEQ ID NO: 1091887 - DNA, 22 bp, Artificial Sequence
  chemically synthesized
tatattcacttactgagtacat

SEQ ID NO: 1091888 - DNA, 22 bp, Artificial Sequence
  chemically synthesized
acatgtagtagatgtactcagt

SEQ ID NO: 1091889 - DNA, 22 bp, Artificial Sequence
  chemically synthesized
gttttatattcacttactgagt

SEQ ID NO: 1091890 - DNA, 22 bp, Artificial Sequence
  chemically synthesized
agttttatattcacttactgag

SEQ ID NO: 1091891 - DNA, 22 bp, Artificial Sequence
  chemically synthesized
taatgatgtttagttttatatt

SEQ ID NO: 1091892 - DNA, 22 bp, Artificial Sequence
  chemically synthesized
ataatgatgtttagttttatat

SEQ ID NO: 1091893 - DNA, 22 bp, Artificial Sequence
  chemically synthesized
tataatgatgtttagttttata

SEQ ID NO: 1091894 - DNA, 22 bp, Artificial Sequence
  chemically synthesized
agtaagtgaatataaaactaaa

SEQ ID NO: 1091895 - DNA, 22 bp, Artificial Sequence
  chemically synthesized
tcaagaagaaaacccattttat

SEQ ID NO: 1091896 - DNA, 22 bp, Artificial Sequence
  chemically synthesized
gtcaagaagaaaacccatttta

SEQ ID NO: 1091897 - DNA, 22 bp, Artificial Sequence
  chemically synthesized
aacatcattataaaatgggttt

SEQ ID NO: 1091898 - DNA, 22 bp, Artificial Sequence
  chemically synthesized
tttgtcaagaagaaaacccatt

SEQ ID NO: 1091899 - DNA, 22 bp, Artificial Sequence
  chemically synthesized
taaaatgggttttcttcttgac

SEQ ID NO: 1091900 - DNA, 22 bp, Artificial Sequence
  chemically synthesized
agaatggattatttgtcaagaa

SEQ ID NO: 1091901 - DNA, 22 bp, Artificial Sequence
  chemically synthesized
ctaagaatggattatttgtcaa

SEQ ID NO: 1091902 - DNA, 22 bp, Artificial Sequence
  chemically synthesized
tctcctaagaatggattatttg

SEQ ID NO: 1091903 - DNA, 22 bp, Artificial Sequence
  chemically synthesized
tcttcttgacaaataatccatt

SEQ ID NO: 1091904 - DNA, 22 bp, Artificial Sequence
  chemically synthesized
cttcttgacaaataatccattc

SEQ ID NO: 1091905 - DNA, 22 bp, Artificial Sequence
  chemically synthesized
ttcttgacaaataatccattct

SEQ ID NO: 1091906 - DNA, 22 bp, Artificial Sequence
  chemically synthesized
cttgacaaataatccattctta

SEQ ID NO: 1091907 - DNA, 22 bp, Artificial Sequence
  chemically synthesized
catactatctcctaagaatgga

SEQ ID NO: 1091908 - DNA, 22 bp, Artificial Sequence
  chemically synthesized
ttgacaaataatccattcttag

SEQ ID NO: 1091909 - DNA, 22 bp, Artificial Sequence
  chemically synthesized
gcatactatctcctaagaatgg

SEQ ID NO: 1091910 - DNA, 22 bp, Artificial Sequence
  chemically synthesized
tgcatactatctcctaagaatg

SEQ ID NO: 1091911 - DNA, 22 bp, Artificial Sequence
  chemically synthesized
gacaaataatccattcttagga

SEQ ID NO: 1091912 - DNA, 22 bp, Artificial Sequence
  chemically synthesized
acaaataatccattcttaggag

SEQ ID NO: 1091913 - DNA, 22 bp, Artificial Sequence
  chemically synthesized
gtcagtgttttgcatactatct

SEQ ID NO: 1091914 - DNA, 22 bp, Artificial Sequence
  chemically synthesized
ctagtcagtgttttgcatacta

SEQ ID NO: 1091915 - DNA, 22 bp, Artificial Sequence
  chemically synthesized
tcctagtcagtgttttgcatac

SEQ ID NO: 1091916 - DNA, 22 bp, Artificial Sequence
  chemically synthesized
ctcctagtcagtgttttgcata

SEQ ID NO: 1091917 - DNA, 22 bp, Artificial Sequence
  chemically synthesized
ttaggagatagtatgcaaaaca

SEQ ID NO: 1091918 - DNA, 22 bp, Artificial Sequence
  chemically synthesized
aggagatagtatgcaaaacact

SEQ ID NO: 1091919 - DNA, 22 bp, Artificial Sequence
  chemically synthesized
ggagatagtatgcaaaacactg

SEQ ID NO: 1091920 - DNA, 22 bp, Artificial Sequence
  chemically synthesized
aaacaaaatagcaaatttctcc

SEQ ID NO: 1091921 - DNA, 22 bp, Artificial Sequence
  chemically synthesized
actaggagaaatttgctatttt

SEQ ID NO: 1091922 - DNA, 22 bp, Artificial Sequence
  chemically synthesized
ggagaaatttgctattttgttt

SEQ ID NO: 1091923 - DNA, 22 bp, Artificial Sequence
  chemically synthesized
aaatcaaaactaaaacaaaata

SEQ ID NO: 1091924 - DNA, 22 bp, Artificial Sequence
  chemically synthesized
caaatcaaaactaaaacaaaat

SEQ ID NO: 1091925 - DNA, 22 bp, Artificial Sequence
  chemically synthesized
tcaaatcaaaactaaaacaaaa

SEQ ID NO: 1091926 - DNA, 22 bp, Artificial Sequence
  chemically synthesized
ttcaaatcaaaactaaaacaaa

SEQ ID NO: 1091927 - DNA, 22 bp, Artificial Sequence
  chemically synthesized
gctattttgttttagttttgat

SEQ ID NO: 1091928 - DNA, 22 bp, Artificial Sequence
  chemically synthesized
ctattttgttttagttttgatt

SEQ ID NO: 1091929 - DNA, 22 bp, Artificial Sequence
  chemically synthesized
ttttgttttagttttgatttga

SEQ ID NO: 1091930 - DNA, 22 bp, Artificial Sequence
  chemically synthesized
tgttttagttttgatttgaaaa

SEQ ID NO: 1091931 - DNA, 22 bp, Artificial Sequence
  chemically synthesized
gttttagttttgatttgaaaaa

SEQ ID NO: 1091932 - DNA, 22 bp, Artificial Sequence
  chemically synthesized
ttttagttttgatttgaaaaat

SEQ ID NO: 1091933 - DNA, 22 bp, Artificial Sequence
  chemically synthesized
tagttttgatttgaaaaatcac

SEQ ID NO: 1091934 - DNA, 22 bp, Artificial Sequence
  chemically synthesized
agttttgatttgaaaaatcaca

SEQ ID NO: 1091935 - DNA, 22 bp, Artificial Sequence
  chemically synthesized
gttttgatttgaaaaatcacac

SEQ ID NO: 1091936 - DNA, 22 bp, Artificial Sequence
  chemically synthesized
atatatcacacatggtgtgatt

SEQ ID NO: 1091937 - DNA, 22 bp, Artificial Sequence
  chemically synthesized
catatatcacacatggtgtgat

SEQ ID NO: 1091938 - DNA, 22 bp, Artificial Sequence
  chemically synthesized
tgatttgaaaaatcacaccatg

SEQ ID NO: 1091939 - DNA, 22 bp, Artificial Sequence
  chemically synthesized
tcatatatcacacatggtgtga

SEQ ID NO: 1091940 - DNA, 22 bp, Artificial Sequence
  chemically synthesized
gatttgaaaaatcacaccatgt

SEQ ID NO: 1091941 - DNA, 22 bp, Artificial Sequence
  chemically synthesized
atttgaaaaatcacaccatgtg

SEQ ID NO: 1091942 - DNA, 22 bp, Artificial Sequence
  chemically synthesized
gaaaaatcacaccatgtgtgat

SEQ ID NO: 1091943 - DNA, 22 bp, Artificial Sequence
  chemically synthesized
aaaaatcacaccatgtgtgata

SEQ ID NO: 1091944 - DNA, 22 bp, Artificial Sequence
  chemically synthesized
tagataaattttcatatatcac

SEQ ID NO: 1091945 - DNA, 22 bp, Artificial Sequence
  chemically synthesized
atagataaattttcatatatca

SEQ ID NO: 1091946 - DNA, 22 bp, Artificial Sequence
  chemically synthesized
ttatagataaattttcatatat

SEQ ID NO: 1091947 - DNA, 22 bp, Artificial Sequence
  chemically synthesized
cttatagataaattttcatata

SEQ ID NO: 1091948 - DNA, 22 bp, Artificial Sequence
  chemically synthesized
catttcttatagataaattttc

SEQ ID NO: 1091949 - DNA, 22 bp, Artificial Sequence
  chemically synthesized
ataaataacactacatttctta

SEQ ID NO: 1091950 - DNA, 22 bp, Artificial Sequence
  chemically synthesized
cataaataacactacatttctt

SEQ ID NO: 1091951 - DNA, 22 bp, Artificial Sequence
  chemically synthesized
ttcataaataacactacatttc

SEQ ID NO: 1091952 - DNA, 22 bp, Artificial Sequence
  chemically synthesized
ttcttcataaataacactacat

SEQ ID NO: 1091953 - DNA, 22 bp, Artificial Sequence
  chemically synthesized
atctataagaaatgtagtgtta

SEQ ID NO: 1091954 - DNA, 22 bp, Artificial Sequence
  chemically synthesized
attcttcataaataacactaca

SEQ ID NO: 1091955 - DNA, 22 bp, Artificial Sequence
  chemically synthesized
tctataagaaatgtagtgttat

SEQ ID NO: 1091956 - DNA, 22 bp, Artificial Sequence
  chemically synthesized
tttattcttcataaataacact

SEQ ID NO: 1091957 - DNA, 22 bp, Artificial Sequence
  chemically synthesized
taagaaatgtagtgttatttat

SEQ ID NO: 1091958 - DNA, 22 bp, Artificial Sequence
  chemically synthesized
gtaccccatattatttattctt

SEQ ID NO: 1091959 - DNA, 22 bp, Artificial Sequence
  chemically synthesized
ttagtaccccatattatttatt

SEQ ID NO: 1091960 - DNA, 22 bp, Artificial Sequence
  chemically synthesized
tgttagtaccccatattattta

SEQ ID NO: 1091961 - DNA, 22 bp, Artificial Sequence
  chemically synthesized
tttatgaagaataaataatatg

SEQ ID NO: 1091962 - DNA, 22 bp, Artificial Sequence
  chemically synthesized
atgaagaataaataatatgggg

SEQ ID NO: 1091963 - DNA, 22 bp, Artificial Sequence
  chemically synthesized
tgaagaataaataatatggggt

SEQ ID NO: 1091964 - DNA, 22 bp, Artificial Sequence
  chemically synthesized
ataatacatgcaattctgttag

SEQ ID NO: 1091965 - DNA, 22 bp, Artificial Sequence
  chemically synthesized
ctaataatacatgcaattctgt

SEQ ID NO: 1091966 - DNA, 22 bp, Artificial Sequence
  chemically synthesized
acagaattgcatgtattattag

SEQ ID NO: 1091967 - DNA, 22 bp, Artificial Sequence
  chemically synthesized
tgtcacatgtaatctgctaata

SEQ ID NO: 1091968 - DNA, 22 bp, Artificial Sequence
  chemically synthesized
ttatgtcacatgtaatctgcta

SEQ ID NO: 1091969 - DNA, 22 bp, Artificial Sequence
  chemically synthesized
gttatgtcacatgtaatctgct

SEQ ID NO: 1091970 - DNA, 22 bp, Artificial Sequence
  chemically synthesized
catgtattattagcagattaca

SEQ ID NO: 1091971 - DNA, 22 bp, Artificial Sequence
  chemically synthesized
ttagcagattacatgtgacata

SEQ ID NO: 1091972 - DNA, 22 bp, Artificial Sequence
  chemically synthesized
cacacacatttgttatgtcaca

SEQ ID NO: 1091973 - DNA, 22 bp, Artificial Sequence
  chemically synthesized
gcagattacatgtgacataaca

SEQ ID NO: 1091974 - DNA, 22 bp, Artificial Sequence
  chemically synthesized
cattccacacacatttgttatg

SEQ ID NO: 1091975 - DNA, 22 bp, Artificial Sequence
  chemically synthesized
cctccattccacacacatttgt

SEQ ID NO: 1091976 - DNA, 22 bp, Artificial Sequence
  chemically synthesized
catgtgacataacaaatgtgtg

SEQ ID NO: 1091977 - DNA, 22 bp, Artificial Sequence
  chemically synthesized
tccctccattccacacacattt

SEQ ID NO: 1091978 - DNA, 22 bp, Artificial Sequence
  chemically synthesized
ctctccctccattccacacaca

SEQ ID NO: 1091979 - DNA, 22 bp, Artificial Sequence
  chemically synthesized
ttcctctccctccattccacac

SEQ ID NO: 1091980 - DNA, 22 bp, Artificial Sequence
  chemically synthesized
attcctctccctccattccaca

SEQ ID NO: 1091981 - DNA, 22 bp, Artificial Sequence
  chemically synthesized
tattcctctccctccattccac

SEQ ID NO: 1091982 - DNA, 22 bp, Artificial Sequence
  chemically synthesized
attttattcctctccctccatt

SEQ ID NO: 1091983 - DNA, 22 bp, Artificial Sequence
  chemically synthesized
tctcattttattcctctccctc

SEQ ID NO: 1091984 - DNA, 22 bp, Artificial Sequence
  chemically synthesized
gctgtctcattttattcctctc

SEQ ID NO: 1091985 - DNA, 22 bp, Artificial Sequence
  chemically synthesized
tcgctgtctcattttattcctc

SEQ ID NO: 1091986 - DNA, 22 bp, Artificial Sequence
  chemically synthesized
tctcgctgtctcattttattcc

SEQ ID NO: 1091987 - DNA, 22 bp, Artificial Sequence
  chemically synthesized
tctctcgctgtctcattttatt

SEQ ID NO: 1091988 - DNA, 22 bp, Artificial Sequence
  chemically synthesized
ctctctcgctgtctcattttat

SEQ ID NO: 1091989 - DNA, 22 bp, Artificial Sequence
  chemically synthesized
tctctctcgctgtctcatttta

SEQ ID NO: 1091990 - DNA, 22 bp, Artificial Sequence
  chemically synthesized
aagatagaccagtatgtgtggg

SEQ ID NO: 1091991 - DNA, 22 bp, Artificial Sequence
  chemically synthesized
ctcaagatagaccagtatgtgt

SEQ ID NO: 1091992 - DNA, 22 bp, Artificial Sequence
  chemically synthesized
actcaagatagaccagtatgtg

SEQ ID NO: 1091993 - DNA, 22 bp, Artificial Sequence
  chemically synthesized
cttactcaagatagaccagtat

SEQ ID NO: 1091994 - DNA, 22 bp, Artificial Sequence
  chemically synthesized
ccttactcaagatagaccagta

SEQ ID NO: 1091995 - DNA, 22 bp, Artificial Sequence
  chemically synthesized
tccttactcaagatagaccagt

SEQ ID NO: 1091996 - DNA, 22 bp, Artificial Sequence
  chemically synthesized
ttccttactcaagatagaccag

SEQ ID NO: 1091997 - DNA, 22 bp, Artificial Sequence
  chemically synthesized
ttttccttactcaagatagacc

SEQ ID NO: 1091998 - DNA, 22 bp, Artificial Sequence
  chemically synthesized
accacagagttcttttccttac

SEQ ID NO: 1091999 - DNA, 22 bp, Artificial Sequence
  chemically synthesized
gtctatcttgagtaaggaaaag

SEQ ID NO: 1092000 - DNA, 22 bp, Artificial Sequence
  chemically synthesized
tgaccacagagttcttttcctt

SEQ ID NO: 1092001 - DNA, 22 bp, Artificial Sequence
  chemically synthesized
ctctgaccacagagttcttttc

SEQ ID NO: 1092002 - DNA, 22 bp, Artificial Sequence
  chemically synthesized
tcttgagtaaggaaaagaactc

SEQ ID NO: 1092003 - DNA, 22 bp, Artificial Sequence
  chemically synthesized
gagtaaggaaaagaactctgtg

SEQ ID NO: 1092004 - DNA, 22 bp, Artificial Sequence
  chemically synthesized
agtaaggaaaagaactctgtgg

SEQ ID NO: 1092005 - DNA, 22 bp, Artificial Sequence
  chemically synthesized
agacatcccaagaaggttactc

SEQ ID NO: 1092006 - DNA, 22 bp, Artificial Sequence
  chemically synthesized
tgtggtcagagtaaccttcttg

SEQ ID NO: 1092007 - DNA, 22 bp, Artificial Sequence
  chemically synthesized
tggtcagagtaaccttcttggg

SEQ ID NO: 1092008 - DNA, 22 bp, Artificial Sequence
  chemically synthesized
aaaggcaactgagacatcccaa

SEQ ID NO: 1092009 - DNA, 22 bp, Artificial Sequence
  chemically synthesized
aaaaggcaactgagacatccca

SEQ ID NO: 1092010 - DNA, 22 bp, Artificial Sequence
  chemically synthesized
ttaaaaggcaactgagacatcc

SEQ ID NO: 1092011 - DNA, 22 bp, Artificial Sequence
  chemically synthesized
ggattcttaaaaggcaactgag

SEQ ID NO: 1092012 - DNA, 22 bp, Artificial Sequence
  chemically synthesized
cttgggatgtctcagttgcctt

SEQ ID NO: 1092013 - DNA, 22 bp, Artificial Sequence
  chemically synthesized
ttgggatgtctcagttgccttt

SEQ ID NO: 1092014 - DNA, 22 bp, Artificial Sequence
  chemically synthesized
gggatgtctcagttgcctttta

SEQ ID NO: 1092015 - DNA, 22 bp, Artificial Sequence
  chemically synthesized
ggatgtctcagttgccttttaa

SEQ ID NO: 1092016 - DNA, 22 bp, Artificial Sequence
  chemically synthesized
taagttaggattcttaaaaggc

SEQ ID NO: 1092017 - DNA, 22 bp, Artificial Sequence
  chemically synthesized
agttgccttttaagaatcctaa

SEQ ID NO: 1092018 - DNA, 22 bp, Artificial Sequence
  chemically synthesized
acaaaaacattgtaagttagga

SEQ ID NO: 1092019 - DNA, 22 bp, Artificial Sequence
  chemically synthesized
ccttttaagaatcctaacttac

SEQ ID NO: 1092020 - DNA, 22 bp, Artificial Sequence
  chemically synthesized
cacaaaaacattgtaagttagg

SEQ ID NO: 1092021 - DNA, 22 bp, Artificial Sequence
  chemically synthesized
ttaagaatcctaacttacaatg

SEQ ID NO: 1092022 - DNA, 22 bp, Artificial Sequence
  chemically synthesized
taagaatcctaacttacaatgt

SEQ ID NO: 1092023 - DNA, 22 bp, Artificial Sequence
  chemically synthesized
aagaatcctaacttacaatgtt

SEQ ID NO: 1092024 - DNA, 22 bp, Artificial Sequence
  chemically synthesized
agaatcctaacttacaatgttt

SEQ ID NO: 1092025 - DNA, 22 bp, Artificial Sequence
  chemically synthesized
tagcatgtgatttcacaaaaac

SEQ ID NO: 1092026 - DNA, 22 bp, Artificial Sequence
  chemically synthesized
acttacaatgtttttgtgaaat

SEQ ID NO: 1092027 - DNA, 22 bp, Artificial Sequence
  chemically synthesized
acaatgtttttgtgaaatcaca

SEQ ID NO: 1092028 - DNA, 22 bp, Artificial Sequence
  chemically synthesized
caatgtttttgtgaaatcacat

SEQ ID NO: 1092029 - DNA, 22 bp, Artificial Sequence
  chemically synthesized
catgtgtattatagcatgtgat

SEQ ID NO: 1092030 - DNA, 22 bp, Artificial Sequence
  chemically synthesized
acatgtgtattatagcatgtga

SEQ ID NO: 1092031 - DNA, 22 bp, Artificial Sequence
  chemically synthesized
tacatgtgtattatagcatgtg

SEQ ID NO: 1092032 - DNA, 22 bp, Artificial Sequence
  chemically synthesized
tttacatgtgtattatagcatg

SEQ ID NO: 1092033 - DNA, 22 bp, Artificial Sequence
  chemically synthesized
ttgtgaaatcacatgctataat

SEQ ID NO: 1092034 - DNA, 22 bp, Artificial Sequence
  chemically synthesized
tgtgaaatcacatgctataata

SEQ ID NO: 1092035 - DNA, 22 bp, Artificial Sequence
  chemically synthesized
gtgaaatcacatgctataatac

SEQ ID NO: 1092036 - DNA, 22 bp, Artificial Sequence
  chemically synthesized
tgaaatcacatgctataataca

SEQ ID NO: 1092037 - DNA, 22 bp, Artificial Sequence
  chemically synthesized
ggtaaattctttacatgtgtat

SEQ ID NO: 1092038 - DNA, 22 bp, Artificial Sequence
  chemically synthesized
taatacacatgtaaagaattta

SEQ ID NO: 1092039 - DNA, 22 bp, Artificial Sequence
  chemically synthesized
agagacaatccaatgccagaca

SEQ ID NO: 1092040 - DNA, 22 bp, Artificial Sequence
  chemically synthesized
cagagacaatccaatgccagac

SEQ ID NO: 1092041 - DNA, 22 bp, Artificial Sequence
  chemically synthesized
acccagtgtctggcattggatt

SEQ ID NO: 1092042 - DNA, 22 bp, Artificial Sequence
  chemically synthesized
cccagtgtctggcattggattg

SEQ ID NO: 1092043 - DNA, 22 bp, Artificial Sequence
  chemically synthesized
aggtttcagagacaatccaatg

SEQ ID NO: 1092044 - DNA, 22 bp, Artificial Sequence
  chemically synthesized
caggtttcagagacaatccaat

SEQ ID NO: 1092045 - DNA, 22 bp, Artificial Sequence
  chemically synthesized
tcaggtttcagagacaatccaa

SEQ ID NO: 1092046 - DNA, 22 bp, Artificial Sequence
  chemically synthesized
agctttcaggtttcagagacaa

SEQ ID NO: 1092047 - DNA, 22 bp, Artificial Sequence
  chemically synthesized
gcattggattgtctctgaaacc

SEQ ID NO: 1092048 - DNA, 22 bp, Artificial Sequence
  chemically synthesized
gctcagctttcaggtttcagag

SEQ ID NO: 1092049 - DNA, 22 bp, Artificial Sequence
  chemically synthesized
gattgtctctgaaacctgaaag

SEQ ID NO: 1092050 - DNA, 22 bp, Artificial Sequence
  chemically synthesized
aatattagctcagctttcaggt

SEQ ID NO: 1092051 - DNA, 22 bp, Artificial Sequence
  chemically synthesized
aaatattagctcagctttcagg

SEQ ID NO: 1092052 - DNA, 22 bp, Artificial Sequence
  chemically synthesized
tctctgaaacctgaaagctgag

SEQ ID NO: 1092053 - DNA, 22 bp, Artificial Sequence
  chemically synthesized
tgaaacctgaaagctgagctaa

SEQ ID NO: 1092054 - DNA, 22 bp, Artificial Sequence
  chemically synthesized
aaacctgaaagctgagctaata

SEQ ID NO: 1092055 - DNA, 22 bp, Artificial Sequence
  chemically synthesized
aaagctgagctaatatttaaac

SEQ ID NO: 1092056 - DNA, 22 bp, Artificial Sequence
  chemically synthesized
agataaaatgagcaatagttta

SEQ ID NO: 1092057 - DNA, 22 bp, Artificial Sequence
  chemically synthesized
agctaatatttaaactattgct

SEQ ID NO: 1092058 - DNA, 22 bp, Artificial Sequence
  chemically synthesized
tcagataaaatgagcaatagtt

SEQ ID NO: 1092059 - DNA, 22 bp, Artificial Sequence
  chemically synthesized
atatttaaactattgctcattt

SEQ ID NO: 1092060 - DNA, 22 bp, Artificial Sequence
  chemically synthesized
aaactattgctcattttatctg

SEQ ID NO: 1092061 - DNA, 22 bp, Artificial Sequence
  chemically synthesized
aactattgctcattttatctga

SEQ ID NO: 1092062 - DNA, 22 bp, Artificial Sequence
  chemically synthesized
ttgctcattttatctgagaggc

SEQ ID NO: 1092063 - DNA, 22 bp, Artificial Sequence
  chemically synthesized
ctcattttatctgagaggcctg

SEQ ID NO: 1092064 - DNA, 22 bp, Artificial Sequence
  chemically synthesized
atgtatagcagatacaggcctc

SEQ ID NO: 1092065 - DNA, 22 bp, Artificial Sequence
  chemically synthesized
attttatctgagaggcctgtat

SEQ ID NO: 1092066 - DNA, 22 bp, Artificial Sequence
  chemically synthesized
tatctgagaggcctgtatctgc

SEQ ID NO: 1092067 - DNA, 22 bp, Artificial Sequence
  chemically synthesized
cattaatgtatagcagatacag

SEQ ID NO: 1092068 - DNA, 22 bp, Artificial Sequence
  chemically synthesized
atctgagaggcctgtatctgct

SEQ ID NO: 1092069 - DNA, 22 bp, Artificial Sequence
  chemically synthesized
gcattaatgtatagcagataca

SEQ ID NO: 1092070 - DNA, 22 bp, Artificial Sequence
  chemically synthesized
tctgagaggcctgtatctgcta

SEQ ID NO: 1092071 - DNA, 22 bp, Artificial Sequence
  chemically synthesized
atttgcattaatgtatagcaga

SEQ ID NO: 1092072 - DNA, 22 bp, Artificial Sequence
  chemically synthesized
agaggcctgtatctgctataca

SEQ ID NO: 1092073 - DNA, 22 bp, Artificial Sequence
  chemically synthesized
atctaatttgcattaatgtata

SEQ ID NO: 1092074 - DNA, 22 bp, Artificial Sequence
  chemically synthesized
aatctaatttgcattaatgtat

SEQ ID NO: 1092075 - DNA, 22 bp, Artificial Sequence
  chemically synthesized
taatctaatttgcattaatgta

SEQ ID NO: 1092076 - DNA, 22 bp, Artificial Sequence
  chemically synthesized
tttaatctaatttgcattaatg

SEQ ID NO: 1092077 - DNA, 22 bp, Artificial Sequence
  chemically synthesized
tatctgctatacattaatgcaa

SEQ ID NO: 1092078 - DNA, 22 bp, Artificial Sequence
  chemically synthesized
ctatacattaatgcaaattaga

SEQ ID NO: 1092079 - DNA, 22 bp, Artificial Sequence
  chemically synthesized
tacattaatgcaaattagatta

SEQ ID NO: 1092080 - DNA, 22 bp, Artificial Sequence
  chemically synthesized
atgcaaattagattaaagagat

SEQ ID NO: 1092081 - DNA, 22 bp, Artificial Sequence
  chemically synthesized
gattaaagagatttttcactta

SEQ ID NO: 1092082 - DNA, 22 bp, Artificial Sequence
  chemically synthesized
aagagatttttcacttatcttc

SEQ ID NO: 1092083 - DNA, 22 bp, Artificial Sequence
  chemically synthesized
catgaagaggtatgaagataag

SEQ ID NO: 1092084 - DNA, 22 bp, Artificial Sequence
  chemically synthesized
ttcacttatcttcatacctctt

SEQ ID NO: 1092085 - DNA, 22 bp, Artificial Sequence
  chemically synthesized
tcacttatcttcatacctcttc

SEQ ID NO: 1092086 - DNA, 22 bp, Artificial Sequence
  chemically synthesized
cacttatcttcatacctcttca

SEQ ID NO: 1092087 - DNA, 22 bp, Artificial Sequence
  chemically synthesized
gagggaactacatgaagaggta

SEQ ID NO: 1092088 - DNA, 22 bp, Artificial Sequence
  chemically synthesized
acttatcttcatacctcttcat

SEQ ID NO: 1092089 - DNA, 22 bp, Artificial Sequence
  chemically synthesized
gttggagggaactacatgaaga

SEQ ID NO: 1092090 - DNA, 22 bp, Artificial Sequence
  chemically synthesized
atcttcatacctcttcatgtag

SEQ ID NO: 1092091 - DNA, 22 bp, Artificial Sequence
  chemically synthesized
tcttcatacctcttcatgtagt

SEQ ID NO: 1092092 - DNA, 22 bp, Artificial Sequence
  chemically synthesized
tcgttggagggaactacatgaa

SEQ ID NO: 1092093 - DNA, 22 bp, Artificial Sequence
  chemically synthesized
catacctcttcatgtagttccc

SEQ ID NO: 1092094 - DNA, 22 bp, Artificial Sequence
  chemically synthesized
attctcgttggagggaactaca

SEQ ID NO: 1092095 - DNA, 22 bp, Artificial Sequence
  chemically synthesized
atacctcttcatgtagttccct

SEQ ID NO: 1092096 - DNA, 22 bp, Artificial Sequence
  chemically synthesized
aattctcgttggagggaactac

SEQ ID NO: 1092097 - DNA, 22 bp, Artificial Sequence
  chemically synthesized
ttcatgtagttccctccaacga

SEQ ID NO: 1092098 - DNA, 22 bp, Artificial Sequence
  chemically synthesized
agacatttaattctcgttggag

SEQ ID NO: 1092099 - DNA, 22 bp, Artificial Sequence
  chemically synthesized
catgtagttccctccaacgaga

SEQ ID NO: 1092100 - DNA, 22 bp, Artificial Sequence
  chemically synthesized
gagacatttaattctcgttgga

SEQ ID NO: 1092101 - DNA, 22 bp, Artificial Sequence
  chemically synthesized
atgtagttccctccaacgagaa

SEQ ID NO: 1092102 - DNA, 22 bp, Artificial Sequence
  chemically synthesized
cctccaacgagaattaaatgtc

SEQ ID NO: 1092103 - DNA, 22 bp, Artificial Sequence
  chemically synthesized
caacgagaattaaatgtctcaa

SEQ ID NO: 1092104 - DNA, 22 bp, Artificial Sequence
  chemically synthesized
atcaatgaggaacttgagacat

SEQ ID NO: 1092105 - DNA, 22 bp, Artificial Sequence
  chemically synthesized
aatgtctcaagttcctcattga

SEQ ID NO: 1092106 - DNA, 22 bp, Artificial Sequence
  chemically synthesized
aagttcctcattgattagctca

SEQ ID NO: 1092107 - DNA, 22 bp, Artificial Sequence
  chemically synthesized
ctcattgattagctcatccatg

SEQ ID NO: 1092108 - DNA, 22 bp, Artificial Sequence
  chemically synthesized
acagatggcggagtcatggatg

SEQ ID NO: 1092109 - DNA, 22 bp, Artificial Sequence
  chemically synthesized
attgattagctcatccatgact

SEQ ID NO: 1092110 - DNA, 22 bp, Artificial Sequence
  chemically synthesized
attagctcatccatgactccgc

SEQ ID NO: 1092111 - DNA, 22 bp, Artificial Sequence
  chemically synthesized
gctcatccatgactccgccatc

SEQ ID NO: 1092112 - DNA, 22 bp, Artificial Sequence
  chemically synthesized
gcacagaccctaacagatggcg

SEQ ID NO: 1092113 - DNA, 22 bp, Artificial Sequence
  chemically synthesized
atccatgactccgccatctgtt

SEQ ID NO: 1092114 - DNA, 22 bp, Artificial Sequence
  chemically synthesized
gcatattggcacagaccctaac

SEQ ID NO: 1092115 - DNA, 22 bp, Artificial Sequence
  chemically synthesized
cgccatctgttagggtctgtgc

SEQ ID NO: 1092116 - DNA, 22 bp, Artificial Sequence
  chemically synthesized
ttagggtctgtgccaatatgcg

SEQ ID NO: 1092117 - DNA, 22 bp, Artificial Sequence
  chemically synthesized
gggtctgtgccaatatgcgaat

SEQ ID NO: 1092118 - DNA, 22 bp, Artificial Sequence
  chemically synthesized
tgccaatatgcgaatctgattt

SEQ ID NO: 1092119 - DNA, 22 bp, Artificial Sequence
  chemically synthesized
agaggataacccaaatcagatt

SEQ ID NO: 1092120 - DNA, 22 bp, Artificial Sequence
  chemically synthesized
atgcgacattcagaggataacc

SEQ ID NO: 1092121 - DNA, 22 bp, Artificial Sequence
  chemically synthesized
gatgcgacattcagaggataac

SEQ ID NO: 1092122 - DNA, 22 bp, Artificial Sequence
  chemically synthesized
atttgggttatcctctgaatgt

SEQ ID NO: 1092123 - DNA, 22 bp, Artificial Sequence
  chemically synthesized
aaaatttgatgcgacattcaga

SEQ ID NO: 1092124 - DNA, 22 bp, Artificial Sequence
  chemically synthesized
gaaaatttgatgcgacattcag

SEQ ID NO: 1092125 - DNA, 22 bp, Artificial Sequence
  chemically synthesized
gggttatcctctgaatgtcgca

SEQ ID NO: 1092126 - DNA, 22 bp, Artificial Sequence
  chemically synthesized
ggttatcctctgaatgtcgcat

SEQ ID NO: 1092127 - DNA, 22 bp, Artificial Sequence
  chemically synthesized
tcctctgaatgtcgcatcaaat

SEQ ID NO: 1092128 - DNA, 22 bp, Artificial Sequence
  chemically synthesized
agtcacttgaaaatttgatgcg

SEQ ID NO: 1092129 - DNA, 22 bp, Artificial Sequence
  chemically synthesized
cagtcacttgaaaatttgatgc

SEQ ID NO: 1092130 - DNA, 22 bp, Artificial Sequence
  chemically synthesized
tgaatgtcgcatcaaattttca

SEQ ID NO: 1092131 - DNA, 22 bp, Artificial Sequence
  chemically synthesized
aatgtcgcatcaaattttcaag

SEQ ID NO: 1092132 - DNA, 22 bp, Artificial Sequence
  chemically synthesized
caaatgtgtttcagtcacttga

SEQ ID NO: 1092133 - DNA, 22 bp, Artificial Sequence
  chemically synthesized
ttgcaaatgtgtttcagtcact

SEQ ID NO: 1092134 - DNA, 22 bp, Artificial Sequence
  chemically synthesized
tcaagtgactgaaacacatttg

SEQ ID NO: 1092135 - DNA, 22 bp, Artificial Sequence
  chemically synthesized
caagtgactgaaacacatttgc

SEQ ID NO: 1092136 - DNA, 22 bp, Artificial Sequence
  chemically synthesized
aagtgactgaaacacatttgca

SEQ ID NO: 1092137 - DNA, 22 bp, Artificial Sequence
  chemically synthesized
aaacacatttgcaataattact

SEQ ID NO: 1092138 - DNA, 22 bp, Artificial Sequence
  chemically synthesized
gaaaaaaaaggagaaatagtaa

SEQ ID NO: 1092139 - DNA, 22 bp, Artificial Sequence
  chemically synthesized
agaaaaaaaaggagaaatagta

SEQ ID NO: 1092140 - DNA, 22 bp, Artificial Sequence
  chemically synthesized
gcaataattactatttctcctt

SEQ ID NO: 1092141 - DNA, 22 bp, Artificial Sequence
  chemically synthesized
caataattactatttctccttt

SEQ ID NO: 1092142 - DNA, 22 bp, Artificial Sequence
  chemically synthesized
ctatttctccttttttttctaa

SEQ ID NO: 1092143 - DNA, 22 bp, Artificial Sequence
  chemically synthesized
ataatccaatgtatttagaaaa

SEQ ID NO: 1092144 - DNA, 22 bp, Artificial Sequence
  chemically synthesized
tttctccttttttttctaaata

SEQ ID NO: 1092145 - DNA, 22 bp, Artificial Sequence
  chemically synthesized
ctgataatccaatgtatttaga

SEQ ID NO: 1092146 - DNA, 22 bp, Artificial Sequence
  chemically synthesized
ctccttttttttctaaatacat

SEQ ID NO: 1092147 - DNA, 22 bp, Artificial Sequence
  chemically synthesized
gctgataatccaatgtatttag

SEQ ID NO: 1092148 - DNA, 22 bp, Artificial Sequence
  chemically synthesized
tccttttttttctaaatacatt

SEQ ID NO: 1092149 - DNA, 22 bp, Artificial Sequence
  chemically synthesized
cttttttttctaaatacattgg

SEQ ID NO: 1092150 - DNA, 22 bp, Artificial Sequence
  chemically synthesized
ttttttctaaatacattggatt

SEQ ID NO: 1092151 - DNA, 22 bp, Artificial Sequence
  chemically synthesized
tttttctaaatacattggatta

SEQ ID NO: 1092152 - DNA, 22 bp, Artificial Sequence
  chemically synthesized
agcatttgctgataatccaatg

SEQ ID NO: 1092153 - DNA, 22 bp, Artificial Sequence
  chemically synthesized
ttttctaaatacattggattat

SEQ ID NO: 1092154 - DNA, 22 bp, Artificial Sequence
  chemically synthesized
tttctaaatacattggattatc

SEQ ID NO: 1092155 - DNA, 22 bp, Artificial Sequence
  chemically synthesized
ttctaaatacattggattatca

SEQ ID NO: 1092156 - DNA, 22 bp, Artificial Sequence
  chemically synthesized
tctaaatacattggattatcag

SEQ ID NO: 1092157 - DNA, 22 bp, Artificial Sequence
  chemically synthesized
ctaaatacattggattatcagc

SEQ ID NO: 1092158 - DNA, 22 bp, Artificial Sequence
  chemically synthesized
taaatacattggattatcagca

SEQ ID NO: 1092159 - DNA, 22 bp, Artificial Sequence
  chemically synthesized
aatacattggattatcagcaaa

SEQ ID NO: 1092160 - DNA, 22 bp, Artificial Sequence
  chemically synthesized
gattatcagcaaatgctcagta

SEQ ID NO: 1092161 - DNA, 22 bp, Artificial Sequence
  chemically synthesized
tatgtaaatcagaagatactga

SEQ ID NO: 1092162 - DNA, 22 bp, Artificial Sequence
  chemically synthesized
tcagcaaatgctcagtatcttc

SEQ ID NO: 1092163 - DNA, 22 bp, Artificial Sequence
  chemically synthesized
attatatgtaaatcagaagata

SEQ ID NO: 1092164 - DNA, 22 bp, Artificial Sequence
  chemically synthesized
aattatatgtaaatcagaagat

SEQ ID NO: 1092165 - DNA, 22 bp, Artificial Sequence
  chemically synthesized
tgacttaattatatgtaaatca

SEQ ID NO: 1092166 - DNA, 22 bp, Artificial Sequence
  chemically synthesized
agtatcttctgatttacatata

SEQ ID NO: 1092167 - DNA, 22 bp, Artificial Sequence
  chemically synthesized
attatgacttaattatatgtaa

SEQ ID NO: 1092168 - DNA, 22 bp, Artificial Sequence
  chemically synthesized
aattgattatgacttaattata

SEQ ID NO: 1092169 - DNA, 22 bp, Artificial Sequence
  chemically synthesized
aaattgattatgacttaattat

SEQ ID NO: 1092170 - DNA, 22 bp, Artificial Sequence
  chemically synthesized
ctgatttacatataattaagtc

SEQ ID NO: 1092171 - DNA, 22 bp, Artificial Sequence
  chemically synthesized
taaattgattatgacttaatta

SEQ ID NO: 1092172 - DNA, 22 bp, Artificial Sequence
  chemically synthesized
tgatttacatataattaagtca

SEQ ID NO: 1092173 - DNA, 22 bp, Artificial Sequence
  chemically synthesized
atttacatataattaagtcata

SEQ ID NO: 1092174 - DNA, 22 bp, Artificial Sequence
  chemically synthesized
ctttaaattgattatgacttaa

SEQ ID NO: 1092175 - DNA, 22 bp, Artificial Sequence
  chemically synthesized
gctttaaattgattatgactta

SEQ ID NO: 1092176 - DNA, 22 bp, Artificial Sequence
  chemically synthesized
acatataattaagtcataatca

SEQ ID NO: 1092177 - DNA, 22 bp, Artificial Sequence
  chemically synthesized
catataattaagtcataatcaa

SEQ ID NO: 1092178 - DNA, 22 bp, Artificial Sequence
  chemically synthesized
aaatttgctttaaattgattat

SEQ ID NO: 1092179 - DNA, 22 bp, Artificial Sequence
  chemically synthesized
agtcataatcaatttaaagcaa

SEQ ID NO: 1092180 - DNA, 22 bp, Artificial Sequence
  chemically synthesized
atcccaattaaaatttgcttta

SEQ ID NO: 1092181 - DNA, 22 bp, Artificial Sequence
  chemically synthesized
aatcccaattaaaatttgcttt

SEQ ID NO: 1092182 - DNA, 22 bp, Artificial Sequence
  chemically synthesized
taatcccaattaaaatttgctt

SEQ ID NO: 1092183 - DNA, 22 bp, Artificial Sequence
  chemically synthesized
ttaatcccaattaaaatttgct

SEQ ID NO: 1092184 - DNA, 22 bp, Artificial Sequence
  chemically synthesized
gtgtttttaatcccaattaaaa

SEQ ID NO: 1092185 - DNA, 22 bp, Artificial Sequence
  chemically synthesized
ggtgtttttaatcccaattaaa

SEQ ID NO: 1092186 - DNA, 22 bp, Artificial Sequence
  chemically synthesized
aaagcaaattttaattgggatt

SEQ ID NO: 1092187 - DNA, 22 bp, Artificial Sequence
  chemically synthesized
cttggtgtttttaatcccaatt

SEQ ID NO: 1092188 - DNA, 22 bp, Artificial Sequence
  chemically synthesized
aagcaaattttaattgggatta

SEQ ID NO: 1092189 - DNA, 22 bp, Artificial Sequence
  chemically synthesized
taattgggattaaaaacaccaa

SEQ ID NO: 1092190 - DNA, 22 bp, Artificial Sequence
  chemically synthesized
aattgggattaaaaacaccaag

SEQ ID NO: 1092191 - DNA, 22 bp, Artificial Sequence
  chemically synthesized
attgggattaaaaacaccaagg

SEQ ID NO: 1092192 - DNA, 22 bp, Artificial Sequence
  chemically synthesized
aagcaaaaatgctccttggtgt

SEQ ID NO: 1092193 - DNA, 22 bp, Artificial Sequence
  chemically synthesized
gaagcaaaaatgctccttggtg

SEQ ID NO: 1092194 - DNA, 22 bp, Artificial Sequence
  chemically synthesized
tgaagcaaaaatgctccttggt

SEQ ID NO: 1092195 - DNA, 22 bp, Artificial Sequence
  chemically synthesized
ggattaaaaacaccaaggagca

SEQ ID NO: 1092196 - DNA, 22 bp, Artificial Sequence
  chemically synthesized
ttgaagcaaaaatgctccttgg

SEQ ID NO: 1092197 - DNA, 22 bp, Artificial Sequence
  chemically synthesized
tttgaagcaaaaatgctccttg

SEQ ID NO: 1092198 - DNA, 22 bp, Artificial Sequence
  chemically synthesized
ttttttgaagcaaaaatgctcc

SEQ ID NO: 1092199 - DNA, 22 bp, Artificial Sequence
  chemically synthesized
aaaacaccaaggagcatttttg

SEQ ID NO: 1092200 - DNA, 22 bp, Artificial Sequence
  chemically synthesized
atatagaatgacatcctatttt

SEQ ID NO: 1092201 - DNA, 22 bp, Artificial Sequence
  chemically synthesized
ttgcttcaaaaaataggatgtc

SEQ ID NO: 1092202 - DNA, 22 bp, Artificial Sequence
  chemically synthesized
tgcttcaaaaaataggatgtca

SEQ ID NO: 1092203 - DNA, 22 bp, Artificial Sequence
  chemically synthesized
gcttcaaaaaataggatgtcat

SEQ ID NO: 1092204 - DNA, 22 bp, Artificial Sequence
  chemically synthesized
cttcaaaaaataggatgtcatt

SEQ ID NO: 1092205 - DNA, 22 bp, Artificial Sequence
  chemically synthesized
caaaaaataggatgtcattcta

SEQ ID NO: 1092206 - DNA, 22 bp, Artificial Sequence
  chemically synthesized
aaaaaataggatgtcattctat

SEQ ID NO: 1092207 - DNA, 22 bp, Artificial Sequence
  chemically synthesized
tcataatcccatgaagattcat

SEQ ID NO: 1092208 - DNA, 22 bp, Artificial Sequence
  chemically synthesized
tatatgaatcttcatgggatta

SEQ ID NO: 1092209 - DNA, 22 bp, Artificial Sequence
  chemically synthesized
tatgaatcttcatgggattatg

SEQ ID NO: 1092210 - DNA, 22 bp, Artificial Sequence
  chemically synthesized
agtccgcaacactgtcataatc

SEQ ID NO: 1092211 - DNA, 22 bp, Artificial Sequence
  chemically synthesized
tcagtccgcaacactgtcataa

SEQ ID NO: 1092212 - DNA, 22 bp, Artificial Sequence
  chemically synthesized
catgggattatgacagtgttgc

SEQ ID NO: 1092213 - DNA, 22 bp, Artificial Sequence
  chemically synthesized
agttctcagtccgcaacactgt

SEQ ID NO: 1092214 - DNA, 22 bp, Artificial Sequence
  chemically synthesized
atgggattatgacagtgttgcg

SEQ ID NO: 1092215 - DNA, 22 bp, Artificial Sequence
  chemically synthesized
aagttctcagtccgcaacactg

SEQ ID NO: 1092216 - DNA, 22 bp, Artificial Sequence
  chemically synthesized
taagttctcagtccgcaacact

SEQ ID NO: 1092217 - DNA, 22 bp, Artificial Sequence
  chemically synthesized
tgacagtgttgcggactgagaa

SEQ ID NO: 1092218 - DNA, 22 bp, Artificial Sequence
  chemically synthesized
tgaatcaagttttaagttctca

SEQ ID NO: 1092219 - DNA, 22 bp, Artificial Sequence
  chemically synthesized
cggactgagaacttaaaacttg

SEQ ID NO: 1092220 - DNA, 22 bp, Artificial Sequence
  chemically synthesized
agaacttaaaacttgattcaca

SEQ ID NO: 1092221 - DNA, 22 bp, Artificial Sequence
  chemically synthesized
aaaacttgattcacaaccacct

SEQ ID NO: 1092222 - DNA, 22 bp, Artificial Sequence
  chemically synthesized
aaacttgattcacaaccacctt

SEQ ID NO: 1092223 - DNA, 22 bp, Artificial Sequence
  chemically synthesized
ggggacgtcaaggaaaaaggtg

SEQ ID NO: 1092224 - DNA, 22 bp, Artificial Sequence
  chemically synthesized
gattcacaaccacctttttcct

SEQ ID NO: 1092225 - DNA, 22 bp, Artificial Sequence
  chemically synthesized
attcacaaccacctttttcctt

SEQ ID NO: 1092226 - DNA, 22 bp, Artificial Sequence
  chemically synthesized
gagttaggggacgtcaaggaaa

SEQ ID NO: 1092227 - DNA, 22 bp, Artificial Sequence
  chemically synthesized
acaaccacctttttccttgacg

SEQ ID NO: 1092228 - DNA, 22 bp, Artificial Sequence
  chemically synthesized
agagttaggggacgtcaaggaa

SEQ ID NO: 1092229 - DNA, 22 bp, Artificial Sequence
  chemically synthesized
tagagttaggggacgtcaagga

SEQ ID NO: 1092230 - DNA, 22 bp, Artificial Sequence
  chemically synthesized
gttttagagttaggggacgtca

SEQ ID NO: 1092231 - DNA, 22 bp, Artificial Sequence
  chemically synthesized
tggttttagagttaggggacgt

SEQ ID NO: 1092232 - DNA, 22 bp, Artificial Sequence
  chemically synthesized
ctggttttagagttaggggacg

SEQ ID NO: 1092233 - DNA, 22 bp, Artificial Sequence
  chemically synthesized
ttctggttttagagttagggga

SEQ ID NO: 1092234 - DNA, 22 bp, Artificial Sequence
  chemically synthesized
tttccttgacgtcccctaactc

SEQ ID NO: 1092235 - DNA, 22 bp, Artificial Sequence
  chemically synthesized
ttccttgacgtcccctaactct

SEQ ID NO: 1092236 - DNA, 22 bp, Artificial Sequence
  chemically synthesized
tccttgacgtcccctaactcta

SEQ ID NO: 1092237 - DNA, 22 bp, Artificial Sequence
  chemically synthesized
ccttgacgtcccctaactctaa

SEQ ID NO: 1092238 - DNA, 22 bp, Artificial Sequence
  chemically synthesized
cctcttctggttttagagttag

SEQ ID NO: 1092239 - DNA, 22 bp, Artificial Sequence
  chemically synthesized
cttgacgtcccctaactctaaa

SEQ ID NO: 1092240 - DNA, 22 bp, Artificial Sequence
  chemically synthesized
acctcttctggttttagagtta

SEQ ID NO: 1092241 - DNA, 22 bp, Artificial Sequence
  chemically synthesized
tacctcttctggttttagagtt

SEQ ID NO: 1092242 - DNA, 22 bp, Artificial Sequence
  chemically synthesized
gacgtcccctaactctaaaacc

SEQ ID NO: 1092243 - DNA, 22 bp, Artificial Sequence
  chemically synthesized
acgtcccctaactctaaaacca

SEQ ID NO: 1092244 - DNA, 22 bp, Artificial Sequence
  chemically synthesized
gtgttttacctcttctggtttt

SEQ ID NO: 1092245 - DNA, 22 bp, Artificial Sequence
  chemically synthesized
agtgttttacctcttctggttt

SEQ ID NO: 1092246 - DNA, 22 bp, Artificial Sequence
  chemically synthesized
actctaaaaccagaagaggtaa

SEQ ID NO: 1092247 - DNA, 22 bp, Artificial Sequence
  chemically synthesized
agaaatttagtgttttacctct

SEQ ID NO: 1092248 - DNA, 22 bp, Artificial Sequence
  chemically synthesized
taaaaccagaagaggtaaaaca

SEQ ID NO: 1092249 - DNA, 22 bp, Artificial Sequence
  chemically synthesized
aaaccagaagaggtaaaacact

SEQ ID NO: 1092250 - DNA, 22 bp, Artificial Sequence
  chemically synthesized
tcagagaagttgagaaatttag

SEQ ID NO: 1092251 - DNA, 22 bp, Artificial Sequence
  chemically synthesized
gctatcagagaagttgagaaat

SEQ ID NO: 1092252 - DNA, 22 bp, Artificial Sequence
  chemically synthesized
aatttctcaacttctctgatag

SEQ ID NO: 1092253 - DNA, 22 bp, Artificial Sequence
  chemically synthesized
ctcaacttctctgatagctagt

SEQ ID NO: 1092254 - DNA, 22 bp, Artificial Sequence
  chemically synthesized
tcaacttctctgatagctagtg

SEQ ID NO: 1092255 - DNA, 22 bp, Artificial Sequence
  chemically synthesized
aacttctctgatagctagtggt

SEQ ID NO: 1092256 - DNA, 22 bp, Artificial Sequence
  chemically synthesized
tgtcacgtggacaccactagct

SEQ ID NO: 1092257 - DNA, 22 bp, Artificial Sequence
  chemically synthesized
ctctgatagctagtggtgtcca

SEQ ID NO: 1092258 - DNA, 22 bp, Artificial Sequence
  chemically synthesized
tctgatagctagtggtgtccac

SEQ ID NO: 1092259 - DNA, 22 bp, Artificial Sequence
  chemically synthesized
agaattgtgtcacgtggacacc

SEQ ID NO: 1092260 - DNA, 22 bp, Artificial Sequence
  chemically synthesized
tgatagctagtggtgtccacgt

SEQ ID NO: 1092261 - DNA, 22 bp, Artificial Sequence
  chemically synthesized
cagaattgtgtcacgtggacac

SEQ ID NO: 1092262 - DNA, 22 bp, Artificial Sequence
  chemically synthesized
tcagaattgtgtcacgtggaca

SEQ ID NO: 1092263 - DNA, 22 bp, Artificial Sequence
  chemically synthesized
atagctagtggtgtccacgtga

SEQ ID NO: 1092264 - DNA, 22 bp, Artificial Sequence
  chemically synthesized
ttcagaattgtgtcacgtggac

SEQ ID NO: 1092265 - DNA, 22 bp, Artificial Sequence
  chemically synthesized
tttcagaattgtgtcacgtgga

SEQ ID NO: 1092266 - DNA, 22 bp, Artificial Sequence
  chemically synthesized
tttttcagaattgtgtcacgtg

SEQ ID NO: 1092267 - DNA, 22 bp, Artificial Sequence
  chemically synthesized
gtggtgtccacgtgacacaatt

SEQ ID NO: 1092268 - DNA, 22 bp, Artificial Sequence
  chemically synthesized
agagagtactctttttcagaat

SEQ ID NO: 1092269 - DNA, 22 bp, Artificial Sequence
  chemically synthesized
gagagagtactctttttcagaa

SEQ ID NO: 1092270 - DNA, 22 bp, Artificial Sequence
  chemically synthesized
ttgagagagtactctttttcag

SEQ ID NO: 1092271 - DNA, 22 bp, Artificial Sequence
  chemically synthesized
cttgagagagtactctttttca

SEQ ID NO: 1092272 - DNA, 22 bp, Artificial Sequence
  chemically synthesized
ttcttgagagagtactcttttt

SEQ ID NO: 1092273 - DNA, 22 bp, Artificial Sequence
  chemically synthesized
tgaaaaagagtactctctcaag

SEQ ID NO: 1092274 - DNA, 22 bp, Artificial Sequence
  chemically synthesized
aaaaagagtactctctcaagaa

SEQ ID NO: 1092275 - DNA, 22 bp, Artificial Sequence
  chemically synthesized
tctcaagaagaatccttttgcc

SEQ ID NO: 1092276 - DNA, 22 bp, Artificial Sequence
  chemically synthesized
tcaagaagaatccttttgccct

SEQ ID NO: 1092277 - DNA, 22 bp, Artificial Sequence
  chemically synthesized
aagaagaatccttttgcccttc

SEQ ID NO: 1092278 - DNA, 22 bp, Artificial Sequence
  chemically synthesized
ttgcccttcctacttttttgca

SEQ ID NO: 1092279 - DNA, 22 bp, Artificial Sequence
  chemically synthesized
tgcccttcctacttttttgcac

SEQ ID NO: 1092280 - DNA, 22 bp, Artificial Sequence
  chemically synthesized
caggccatgtatgtgcaaaaaa

SEQ ID NO: 1092281 - DNA, 22 bp, Artificial Sequence
  chemically synthesized
gcccttcctacttttttgcaca

SEQ ID NO: 1092282 - DNA, 22 bp, Artificial Sequence
  chemically synthesized
cccttcctacttttttgcacat

SEQ ID NO: 1092283 - DNA, 22 bp, Artificial Sequence
  chemically synthesized
tacctccaggccatgtatgtgc

SEQ ID NO: 1092284 - DNA, 22 bp, Artificial Sequence
  chemically synthesized
cctacttttttgcacatacatg

SEQ ID NO: 1092285 - DNA, 22 bp, Artificial Sequence
  chemically synthesized
ctacttttttgcacatacatgg

SEQ ID NO: 1092286 - DNA, 22 bp, Artificial Sequence
  chemically synthesized
ttatacctccaggccatgtatg

SEQ ID NO: 1092287 - DNA, 22 bp, Artificial Sequence
  chemically synthesized
cttttttgcacatacatggcct

SEQ ID NO: 1092288 - DNA, 22 bp, Artificial Sequence
  chemically synthesized
ttttgcacatacatggcctgga

SEQ ID NO: 1092289 - DNA, 22 bp, Artificial Sequence
  chemically synthesized
tttgcacatacatggcctggag

SEQ ID NO: 1092290 - DNA, 22 bp, Artificial Sequence
  chemically synthesized
ttgcacatacatggcctggagg

SEQ ID NO: 1092291 - DNA, 22 bp, Artificial Sequence
  chemically synthesized
tgcacatacatggcctggaggt

SEQ ID NO: 1092292 - DNA, 22 bp, Artificial Sequence
  chemically synthesized
gcacatacatggcctggaggta

SEQ ID NO: 1092293 - DNA, 22 bp, Artificial Sequence
  chemically synthesized
cacatacatggcctggaggtat

SEQ ID NO: 1092294 - DNA, 22 bp, Artificial Sequence
  chemically synthesized
ccagtgcaaagatgattgttat

SEQ ID NO: 1092295 - DNA, 22 bp, Artificial Sequence
  chemically synthesized
cctcccagtgcaaagatgattg

SEQ ID NO: 1092296 - DNA, 22 bp, Artificial Sequence
  chemically synthesized
gaggtataacaatcatctttgc

SEQ ID NO: 1092297 - DNA, 22 bp, Artificial Sequence
  chemically synthesized
aaagtcattgcctcccagtgca

SEQ ID NO: 1092298 - DNA, 22 bp, Artificial Sequence
  chemically synthesized
acactcaaagtcattgcctccc

SEQ ID NO: 1092299 - DNA, 22 bp, Artificial Sequence
  chemically synthesized
tgcactgggaggcaatgacttt

SEQ ID NO: 1092300 - DNA, 22 bp, Artificial Sequence
  chemically synthesized
gcactgggaggcaatgactttg

SEQ ID NO: 1092301 - DNA, 22 bp, Artificial Sequence
  chemically synthesized
cactgggaggcaatgactttga

SEQ ID NO: 1092302 - DNA, 22 bp, Artificial Sequence
  chemically synthesized
ggaggcaatgactttgagtgtg

SEQ ID NO: 1092303 - DNA, 22 bp, Artificial Sequence
  chemically synthesized
agcatgaaggacctcacactca

SEQ ID NO: 1092304 - DNA, 22 bp, Artificial Sequence
  chemically synthesized
ctgagcatgaaggacctcacac

SEQ ID NO: 1092305 - DNA, 22 bp, Artificial Sequence
  chemically synthesized
cctgagcatgaaggacctcaca

SEQ ID NO: 1092306 - DNA, 22 bp, Artificial Sequence
  chemically synthesized
ttcctgagcatgaaggacctca

SEQ ID NO: 1092307 - DNA, 22 bp, Artificial Sequence
  chemically synthesized
tcttcctgagcatgaaggacct

SEQ ID NO: 1092308 - DNA, 22 bp, Artificial Sequence
  chemically synthesized
tctcttcctgagcatgaaggac

SEQ ID NO: 1092309 - DNA, 22 bp, Artificial Sequence
  chemically synthesized
tgagtgtgaggtccttcatgct

SEQ ID NO: 1092310 - DNA, 22 bp, Artificial Sequence
  chemically synthesized
gagtgtgaggtccttcatgctc

SEQ ID NO: 1092311 - DNA, 22 bp, Artificial Sequence
  chemically synthesized
ctctctcttcctgagcatgaag

SEQ ID NO: 1092312 - DNA, 22 bp, Artificial Sequence
  chemically synthesized
agtgtgaggtccttcatgctca

SEQ ID NO: 1092313 - DNA, 22 bp, Artificial Sequence
  chemically synthesized
tgctctctcttcctgagcatga

SEQ ID NO: 1092314 - DNA, 22 bp, Artificial Sequence
  chemically synthesized
tctgctctctcttcctgagcat

SEQ ID NO: 1092315 - DNA, 22 bp, Artificial Sequence
  chemically synthesized
catgctcaggaagagagagcag

SEQ ID NO: 1092316 - DNA, 22 bp, Artificial Sequence
  chemically synthesized
atgctcaggaagagagagcaga

SEQ ID NO: 1092317 - DNA, 22 bp, Artificial Sequence
  chemically synthesized
aggaagagagagcagagagtgc

SEQ ID NO: 1092318 - DNA, 22 bp, Artificial Sequence
  chemically synthesized
tgaggcgagtaggcactctctg

SEQ ID NO: 1092319 - DNA, 22 bp, Artificial Sequence
  chemically synthesized
agccatattatgaggcgagtag

SEQ ID NO: 1092320 - DNA, 22 bp, Artificial Sequence
  chemically synthesized
aggatggttcagccatattatg

SEQ ID NO: 1092321 - DNA, 22 bp, Artificial Sequence
  chemically synthesized
ctcgcctcataatatggctgaa

SEQ ID NO: 1092322 - DNA, 22 bp, Artificial Sequence
  chemically synthesized
agggttgaggatggttcagcca

SEQ ID NO: 1092323 - DNA, 22 bp, Artificial Sequence
  chemically synthesized
gcctcataatatggctgaacca

SEQ ID NO: 1092324 - DNA, 22 bp, Artificial Sequence
  chemically synthesized
ctcagggttgaggatggttcag

SEQ ID NO: 1092325 - DNA, 22 bp, Artificial Sequence
  chemically synthesized
ataatatggctgaaccatcctc

SEQ ID NO: 1092326 - DNA, 22 bp, Artificial Sequence
  chemically synthesized
aaccatcctcaaccctgagtaa

SEQ ID NO: 1092327 - DNA, 22 bp, Artificial Sequence
  chemically synthesized
aaccctgagtaacctcccttca

SEQ ID NO: 1092328 - DNA, 22 bp, Artificial Sequence
  chemically synthesized
accacgaaaagaatagtgaagg

SEQ ID NO: 1092329 - DNA, 22 bp, Artificial Sequence
  chemically synthesized
tcaccacgaaaagaatagtgaa

SEQ ID NO: 1092330 - DNA, 22 bp, Artificial Sequence
  chemically synthesized
agtaacctcccttcactattct

SEQ ID NO: 1092331 - DNA, 22 bp, Artificial Sequence
  chemically synthesized
ctcaccacgaaaagaatagtga

SEQ ID NO: 1092332 - DNA, 22 bp, Artificial Sequence
  chemically synthesized
tctcaccacgaaaagaatagtg

SEQ ID NO: 1092333 - DNA, 22 bp, Artificial Sequence
  chemically synthesized
ttctcaccacgaaaagaatagt

SEQ ID NO: 1092334 - DNA, 22 bp, Artificial Sequence
  chemically synthesized
ccttcactattcttttcgtggt

SEQ ID NO: 1092335 - DNA, 22 bp, Artificial Sequence
  chemically synthesized
cactattcttttcgtggtgaga

SEQ ID NO: 1092336 - DNA, 22 bp, Artificial Sequence
  chemically synthesized
actattcttttcgtggtgagaa

SEQ ID NO: 1092337 - DNA, 22 bp, Artificial Sequence
  chemically synthesized
acaaaatgatcttttctcacca

SEQ ID NO: 1092338 - DNA, 22 bp, Artificial Sequence
  chemically synthesized
ttcttttcgtggtgagaaaaga

SEQ ID NO: 1092339 - DNA, 22 bp, Artificial Sequence
  chemically synthesized
agctcacaaaatgatcttttct

SEQ ID NO: 1092340 - DNA, 22 bp, Artificial Sequence
  chemically synthesized
ttttcgtggtgagaaaagatca

SEQ ID NO: 1092341 - DNA, 22 bp, Artificial Sequence
  chemically synthesized
aagctcacaaaatgatcttttc

SEQ ID NO: 1092342 - DNA, 22 bp, Artificial Sequence
  chemically synthesized
ttcgtggtgagaaaagatcatt

SEQ ID NO: 1092343 - DNA, 22 bp, Artificial Sequence
  chemically synthesized
tcgtggtgagaaaagatcattt

SEQ ID NO: 1092344 - DNA, 22 bp, Artificial Sequence
  chemically synthesized
cgtggtgagaaaagatcatttt

SEQ ID NO: 1092345 - DNA, 22 bp, Artificial Sequence
  chemically synthesized
gtggtgagaaaagatcattttg

SEQ ID NO: 1092346 - DNA, 22 bp, Artificial Sequence
  chemically synthesized
tgtgagcttaaaccgttgtctg

SEQ ID NO: 1092347 - DNA, 22 bp, Artificial Sequence
  chemically synthesized
gtgagcttaaaccgttgtctga

SEQ ID NO: 1092348 - DNA, 22 bp, Artificial Sequence
  chemically synthesized
tgagcttaaaccgttgtctgat

SEQ ID NO: 1092349 - DNA, 22 bp, Artificial Sequence
  chemically synthesized
ggatgtacgtaacagagaatca

SEQ ID NO: 1092350 - DNA, 22 bp, Artificial Sequence
  chemically synthesized
aaaccgttgtctgattctctgt

SEQ ID NO: 1092351 - DNA, 22 bp, Artificial Sequence
  chemically synthesized
aaccgttgtctgattctctgtt

SEQ ID NO: 1092352 - DNA, 22 bp, Artificial Sequence
  chemically synthesized
ttgggatgtacgtaacagagaa

SEQ ID NO: 1092353 - DNA, 22 bp, Artificial Sequence
  chemically synthesized
tctgattctctgttacgtacat

SEQ ID NO: 1092354 - DNA, 22 bp, Artificial Sequence
  chemically synthesized
attctctgttacgtacatccca

SEQ ID NO: 1092355 - DNA, 22 bp, Artificial Sequence
  chemically synthesized
tctgttacgtacatcccaataa

SEQ ID NO: 1092356 - DNA, 22 bp, Artificial Sequence
  chemically synthesized
tgttacgtacatcccaataata

SEQ ID NO: 1092357 - DNA, 22 bp, Artificial Sequence
  chemically synthesized
ttacgtacatcccaataatacc

SEQ ID NO: 1092358 - DNA, 22 bp, Artificial Sequence
  chemically synthesized
cgtacatcccaataatacccat

SEQ ID NO: 1092359 - DNA, 22 bp, Artificial Sequence
  chemically synthesized
agcagtataggagatgggtatt

SEQ ID NO: 1092360 - DNA, 22 bp, Artificial Sequence
  chemically synthesized
gagcagtataggagatgggtat

SEQ ID NO: 1092361 - DNA, 22 bp, Artificial Sequence
  chemically synthesized
tgagcagtataggagatgggta

SEQ ID NO: 1092362 - DNA, 22 bp, Artificial Sequence
  chemically synthesized
tcaattttgagcagtataggag

SEQ ID NO: 1092363 - DNA, 22 bp, Artificial Sequence
  chemically synthesized
gtcaattttgagcagtatagga

SEQ ID NO: 1092364 - DNA, 22 bp, Artificial Sequence
  chemically synthesized
tgtcaattttgagcagtatagg

SEQ ID NO: 1092365 - DNA, 22 bp, Artificial Sequence
  chemically synthesized
gccaggcaactttgtcaatttt

SEQ ID NO: 1092366 - DNA, 22 bp, Artificial Sequence
  chemically synthesized
ctatactgctcaaaattgacaa

SEQ ID NO: 1092367 - DNA, 22 bp, Artificial Sequence
  chemically synthesized
tactgctcaaaattgacaaagt

SEQ ID NO: 1092368 - DNA, 22 bp, Artificial Sequence
  chemically synthesized
tctagccaggcaactttgtcaa

SEQ ID NO: 1092369 - DNA, 22 bp, Artificial Sequence
  chemically synthesized
ctcaaaattgacaaagttgcct

SEQ ID NO: 1092370 - DNA, 22 bp, Artificial Sequence
  chemically synthesized
aaaattgacaaagttgcctggc

SEQ ID NO: 1092371 - DNA, 22 bp, Artificial Sequence
  chemically synthesized
atcatattatctagccaggcaa

SEQ ID NO: 1092372 - DNA, 22 bp, Artificial Sequence
  chemically synthesized
catcatattatctagccaggca

SEQ ID NO: 1092373 - DNA, 22 bp, Artificial Sequence
  chemically synthesized
tcatcatattatctagccaggc

SEQ ID NO: 1092374 - DNA, 22 bp, Artificial Sequence
  chemically synthesized
acaaagttgcctggctagataa

SEQ ID NO: 1092375 - DNA, 22 bp, Artificial Sequence
  chemically synthesized
actttcatcatattatctagcc

SEQ ID NO: 1092376 - DNA, 22 bp, Artificial Sequence
  chemically synthesized
agattcactttcatcatattat

SEQ ID NO: 1092377 - DNA, 22 bp, Artificial Sequence
  chemically synthesized
cctggctagataatatgatgaa

SEQ ID NO: 1092378 - DNA, 22 bp, Artificial Sequence
  chemically synthesized
gctagataatatgatgaaagtg

SEQ ID NO: 1092379 - DNA, 22 bp, Artificial Sequence
  chemically synthesized
tgacactgagattcactttcat

SEQ ID NO: 1092380 - DNA, 22 bp, Artificial Sequence
  chemically synthesized
gataatatgatgaaagtgaatc

SEQ ID NO: 1092381 - DNA, 22 bp, Artificial Sequence
  chemically synthesized
gcatgcctatgacactgagatt

SEQ ID NO: 1092382 - DNA, 22 bp, Artificial Sequence
  chemically synthesized
tggcatgcctatgacactgaga

SEQ ID NO: 1092383 - DNA, 22 bp, Artificial Sequence
  chemically synthesized
ctggcatgcctatgacactgag

SEQ ID NO: 1092384 - DNA, 22 bp, Artificial Sequence
  chemically synthesized
tctggcatgcctatgacactga

SEQ ID NO: 1092385 - DNA, 22 bp, Artificial Sequence
  chemically synthesized
ttttctggcatgcctatgacac

SEQ ID NO: 1092386 - DNA, 22 bp, Artificial Sequence
  chemically synthesized
gttttctggcatgcctatgaca

SEQ ID NO: 1092387 - DNA, 22 bp, Artificial Sequence
  chemically synthesized
aatcccttgttttctggcatgc

SEQ ID NO: 1092388 - DNA, 22 bp, Artificial Sequence
  chemically synthesized
agtgtcataggcatgccagaaa

SEQ ID NO: 1092389 - DNA, 22 bp, Artificial Sequence
  chemically synthesized
aggtccagtaagatgaaattga

SEQ ID NO: 1092390 - DNA, 22 bp, Artificial Sequence
  chemically synthesized
gaggtccagtaagatgaaattg

SEQ ID NO: 1092391 - DNA, 22 bp, Artificial Sequence
  chemically synthesized
tagatatgtttgaggtccagta

SEQ ID NO: 1092392 - DNA, 22 bp, Artificial Sequence
  chemically synthesized
atagatatgtttgaggtccagt

SEQ ID NO: 1092393 - DNA, 22 bp, Artificial Sequence
  chemically synthesized
aatttcatcttactggacctca

SEQ ID NO: 1092394 - DNA, 22 bp, Artificial Sequence
  chemically synthesized
tatagatatgtttgaggtccag

SEQ ID NO: 1092395 - DNA, 22 bp, Artificial Sequence
  chemically synthesized
ttttatagatatgtttgaggtc

SEQ ID NO: 1092396 - DNA, 22 bp, Artificial Sequence
  chemically synthesized
attttatagatatgtttgaggt

SEQ ID NO: 1092397 - DNA, 22 bp, Artificial Sequence
  chemically synthesized
catcttactggacctcaaacat

SEQ ID NO: 1092398 - DNA, 22 bp, Artificial Sequence
  chemically synthesized
atcttactggacctcaaacata

SEQ ID NO: 1092399 - DNA, 22 bp, Artificial Sequence
  chemically synthesized
actggacctcaaacatatctat

SEQ ID NO: 1092400 - DNA, 22 bp, Artificial Sequence
  chemically synthesized
ctggacctcaaacatatctata

SEQ ID NO: 1092401 - DNA, 22 bp, Artificial Sequence
  chemically synthesized
gacctcaaacatatctataaaa

SEQ ID NO: 1092402 - DNA, 22 bp, Artificial Sequence
  chemically synthesized
aaacatatctataaaataagtg

SEQ ID NO: 1092403 - DNA, 22 bp, Artificial Sequence
  chemically synthesized
tgagaacatatgcccatcactt

SEQ ID NO: 1092404 - DNA, 22 bp, Artificial Sequence
  chemically synthesized
gtgagaacatatgcccatcact

SEQ ID NO: 1092405 - DNA, 22 bp, Artificial Sequence
  chemically synthesized
taaaataagtgatgggcatatg

SEQ ID NO: 1092406 - DNA, 22 bp, Artificial Sequence
  chemically synthesized
ataaatttgtgagaacatatgc

SEQ ID NO: 1092407 - DNA, 22 bp, Artificial Sequence
  chemically synthesized
aataaatttgtgagaacatatg

SEQ ID NO: 1092408 - DNA, 22 bp, Artificial Sequence
  chemically synthesized
tcacaaatttattaaatcttct

SEQ ID NO: 1092409 - DNA, 22 bp, Artificial Sequence
  chemically synthesized
aaacaaggaaaacagaagattt

SEQ ID NO: 1092410 - DNA, 22 bp, Artificial Sequence
  chemically synthesized
acaaatttattaaatcttctgt

SEQ ID NO: 1092411 - DNA, 22 bp, Artificial Sequence
  chemically synthesized
aaaacaaggaaaacagaagatt

SEQ ID NO: 1092412 - DNA, 22 bp, Artificial Sequence
  chemically synthesized
taaaacaaggaaaacagaagat

SEQ ID NO: 1092413 - DNA, 22 bp, Artificial Sequence
  chemically synthesized
ttaaaacaaggaaaacagaaga

SEQ ID NO: 1092414 - DNA, 22 bp, Artificial Sequence
  chemically synthesized
tttaaaacaaggaaaacagaag

SEQ ID NO: 1092415 - DNA, 22 bp, Artificial Sequence
  chemically synthesized
ttttaaaacaaggaaaacagaa

SEQ ID NO: 1092416 - DNA, 22 bp, Artificial Sequence
  chemically synthesized
attaaatcttctgttttccttg

SEQ ID NO: 1092417 - DNA, 22 bp, Artificial Sequence
  chemically synthesized
atttttttaaaacaaggaaaac

SEQ ID NO: 1092418 - DNA, 22 bp, Artificial Sequence
  chemically synthesized
ttaaatcttctgttttccttgt

SEQ ID NO: 1092419 - DNA, 22 bp, Artificial Sequence
  chemically synthesized
catttttttaaaacaaggaaaa

SEQ ID NO: 1092420 - DNA, 22 bp, Artificial Sequence
  chemically synthesized
tcatttttttaaaacaaggaaa

SEQ ID NO: 1092421 - DNA, 22 bp, Artificial Sequence
  chemically synthesized
aatcttctgttttccttgtttt

SEQ ID NO: 1092422 - DNA, 22 bp, Artificial Sequence
  chemically synthesized
ctgttttccttgttttaaaaaa

SEQ ID NO: 1092423 - DNA, 22 bp, Artificial Sequence
  chemically synthesized
gaagattttcatttttttaaaa

SEQ ID NO: 1092424 - DNA, 22 bp, Artificial Sequence
  chemically synthesized
tgttttccttgttttaaaaaaa

SEQ ID NO: 1092425 - DNA, 22 bp, Artificial Sequence
  chemically synthesized
ttttccttgttttaaaaaaatg

SEQ ID NO: 1092426 - DNA, 22 bp, Artificial Sequence
  chemically synthesized
tccttgttttaaaaaaatgaaa

SEQ ID NO: 1092427 - DNA, 22 bp, Artificial Sequence
  chemically synthesized
ccttgttttaaaaaaatgaaaa

SEQ ID NO: 1092428 - DNA, 22 bp, Artificial Sequence
  chemically synthesized
cttgttttaaaaaaatgaaaat

SEQ ID NO: 1092429 - DNA, 22 bp, Artificial Sequence
  chemically synthesized
gttttaaaaaaatgaaaatctt

SEQ ID NO: 1092430 - DNA, 22 bp, Artificial Sequence
  chemically synthesized
ttttaaaaaaatgaaaatcttc

SEQ ID NO: 1092431 - DNA, 22 bp, Artificial Sequence
  chemically synthesized
caaatatgtattggaagatttt

SEQ ID NO: 1092432 - DNA, 22 bp, Artificial Sequence
  chemically synthesized
taaaaaaatgaaaatcttccaa

SEQ ID NO: 1092433 - DNA, 22 bp, Artificial Sequence
  chemically synthesized
aaaaaaatgaaaatcttccaat

SEQ ID NO: 1092434 - DNA, 22 bp, Artificial Sequence
  chemically synthesized
aaaaaatgaaaatcttccaata

SEQ ID NO: 1092435 - DNA, 22 bp, Artificial Sequence
  chemically synthesized
ccaatacatatttgtaattttt

SEQ ID NO: 1092436 - DNA, 22 bp, Artificial Sequence
  chemically synthesized
caatacatatttgtaatttttc

SEQ ID NO: 1092437 - DNA, 22 bp, Artificial Sequence
  chemically synthesized
aagaaaaatacataaacaggaa

SEQ ID NO: 1092438 - DNA, 22 bp, Artificial Sequence
  chemically synthesized
gtaatttttcctgtttatgtat

SEQ ID NO: 1092439 - DNA, 22 bp, Artificial Sequence
  chemically synthesized
taatttttcctgtttatgtatt

SEQ ID NO: 1092440 - DNA, 22 bp, Artificial Sequence
  chemically synthesized
aaaattcaagaaaaatacataa

SEQ ID NO: 1092441 - DNA, 22 bp, Artificial Sequence
  chemically synthesized
ctcaaaattcaagaaaaataca

SEQ ID NO: 1092442 - DNA, 22 bp, Artificial Sequence
  chemically synthesized
gctcaaaattcaagaaaaatac

SEQ ID NO: 1092443 - DNA, 22 bp, Artificial Sequence
  chemically synthesized
ttcctgtttatgtatttttctt

SEQ ID NO: 1092444 - DNA, 22 bp, Artificial Sequence
  chemically synthesized
tcctgtttatgtatttttcttg

SEQ ID NO: 1092445 - DNA, 22 bp, Artificial Sequence
  chemically synthesized
cctgtttatgtatttttcttga

SEQ ID NO: 1092446 - DNA, 22 bp, Artificial Sequence
  chemically synthesized
ctgtttatgtatttttcttgaa

SEQ ID NO: 1092447 - DNA, 22 bp, Artificial Sequence
  chemically synthesized
agtttgctcaaaattcaagaaa

SEQ ID NO: 1092448 - DNA, 22 bp, Artificial Sequence
  chemically synthesized
tttatgtatttttcttgaattt

SEQ ID NO: 1092449 - DNA, 22 bp, Artificial Sequence
  chemically synthesized
atgtatttttcttgaattttga

SEQ ID NO: 1092450 - DNA, 22 bp, Artificial Sequence
  chemically synthesized
tgtatttttcttgaattttgag

SEQ ID NO: 1092451 - DNA, 22 bp, Artificial Sequence
  chemically synthesized
ttcttgaattttgagcaaactc

SEQ ID NO: 1092452 - DNA, 22 bp, Artificial Sequence
  chemically synthesized
tcttgaattttgagcaaactca

SEQ ID NO: 1092453 - DNA, 22 bp, Artificial Sequence
  chemically synthesized
cttgaattttgagcaaactcaa

SEQ ID NO: 1092454 - DNA, 22 bp, Artificial Sequence
  chemically synthesized
ttgaattttgagcaaactcaat

SEQ ID NO: 1092455 - DNA, 22 bp, Artificial Sequence
  chemically synthesized
ataggacaatgtattgagtttg

SEQ ID NO: 1092456 - DNA, 22 bp, Artificial Sequence
  chemically synthesized
aataggacaatgtattgagttt

SEQ ID NO: 1092457 - DNA, 22 bp, Artificial Sequence
  chemically synthesized
gaattttgagcaaactcaatac

SEQ ID NO: 1092458 - DNA, 22 bp, Artificial Sequence
  chemically synthesized
aattttgagcaaactcaataca

SEQ ID NO: 1092459 - DNA, 22 bp, Artificial Sequence
  chemically synthesized
aaacttaataggacaatgtatt

SEQ ID NO: 1092460 - DNA, 22 bp, Artificial Sequence
  chemically synthesized
tgagcaaactcaatacattgtc

SEQ ID NO: 1092461 - DNA, 22 bp, Artificial Sequence
  chemically synthesized
gaaacttaataggacaatgtat

SEQ ID NO: 1092462 - DNA, 22 bp, Artificial Sequence
  chemically synthesized
gagcaaactcaatacattgtcc

SEQ ID NO: 1092463 - DNA, 22 bp, Artificial Sequence
  chemically synthesized
agcaaactcaatacattgtcct

SEQ ID NO: 1092464 - DNA, 22 bp, Artificial Sequence
  chemically synthesized
ttgaaacttaataggacaatgt

SEQ ID NO: 1092465 - DNA, 22 bp, Artificial Sequence
  chemically synthesized
cttgaaacttaataggacaatg

SEQ ID NO: 1092466 - DNA, 22 bp, Artificial Sequence
  chemically synthesized
tcttgaaacttaataggacaat

SEQ ID NO: 1092467 - DNA, 22 bp, Artificial Sequence
  chemically synthesized
ttttcttgaaacttaataggac

SEQ ID NO: 1092468 - DNA, 22 bp, Artificial Sequence
  chemically synthesized
attttcttgaaacttaatagga

SEQ ID NO: 1092469 - DNA, 22 bp, Artificial Sequence
  chemically synthesized
tattttcttgaaacttaatagg

SEQ ID NO: 1092470 - DNA, 22 bp, Artificial Sequence
  chemically synthesized
aatacattgtcctattaagttt

SEQ ID NO: 1092471 - DNA, 22 bp, Artificial Sequence
  chemically synthesized
tttattttcttgaaacttaata

SEQ ID NO: 1092472 - DNA, 22 bp, Artificial Sequence
  chemically synthesized
tcctattaagtttcaagaaaat

SEQ ID NO: 1092473 - DNA, 22 bp, Artificial Sequence
  chemically synthesized
ggaagtctctttattttcttga

SEQ ID NO: 1092474 - DNA, 22 bp, Artificial Sequence
  chemically synthesized
aggaagtctctttattttcttg

SEQ ID NO: 1092475 - DNA, 22 bp, Artificial Sequence
  chemically synthesized
ttaagtttcaagaaaataaaga

SEQ ID NO: 1092476 - DNA, 22 bp, Artificial Sequence
  chemically synthesized
agtttcaagaaaataaagagac

SEQ ID NO: 1092477 - DNA, 22 bp, Artificial Sequence
  chemically synthesized
caagaaaataaagagacttcct

SEQ ID NO: 1092478 - DNA, 22 bp, Artificial Sequence
  chemically synthesized
aagaaaataaagagacttccta

SEQ ID NO: 1092479 - DNA, 22 bp, Artificial Sequence
  chemically synthesized
atataaatgtatttaggaagtc

SEQ ID NO: 1092480 - DNA, 22 bp, Artificial Sequence
  chemically synthesized
aatataaatgtatttaggaagt

SEQ ID NO: 1092481 - DNA, 22 bp, Artificial Sequence
  chemically synthesized
taatataaatgtatttaggaag

SEQ ID NO: 1092482 - DNA, 22 bp, Artificial Sequence
  chemically synthesized
ttaatataaatgtatttaggaa

SEQ ID NO: 1092483 - DNA, 22 bp, Artificial Sequence
  chemically synthesized
tttaatataaatgtatttagga

SEQ ID NO: 1092484 - DNA, 22 bp, Artificial Sequence
  chemically synthesized
ttttaatataaatgtatttagg

SEQ ID NO: 1092485 - DNA, 22 bp, Artificial Sequence
  chemically synthesized
tttttaatataaatgtatttag

SEQ ID NO: 1092486 - DNA, 22 bp, Artificial Sequence
  chemically synthesized
tagtgattttttttaatataaa

SEQ ID NO: 1092487 - DNA, 22 bp, Artificial Sequence
  chemically synthesized
cctaaatacatttatattaaaa

SEQ ID NO: 1092488 - DNA, 22 bp, Artificial Sequence
  chemically synthesized
ctaaatacatttatattaaaaa

SEQ ID NO: 1092489 - DNA, 22 bp, Artificial Sequence
  chemically synthesized
aatacatttatattaaaaaaaa

SEQ ID NO: 1092490 - DNA, 22 bp, Artificial Sequence
  chemically synthesized
caggttatagtgatttttttta

SEQ ID NO: 1092491 - DNA, 22 bp, Artificial Sequence
  chemically synthesized
acaggttatagtgatttttttt

SEQ ID NO: 1092492 - DNA, 22 bp, Artificial Sequence
  chemically synthesized
tacaggttatagtgattttttt

SEQ ID NO: 1092493 - DNA, 22 bp, Artificial Sequence
  chemically synthesized
atattaaaaaaaatcactataa

SEQ ID NO: 1092494 - DNA, 22 bp, Artificial Sequence
  chemically synthesized
tattaaaaaaaatcactataac

SEQ ID NO: 1092495 - DNA, 22 bp, Artificial Sequence
  chemically synthesized
aagtattttacaggttatagtg

SEQ ID NO: 1092496 - DNA, 22 bp, Artificial Sequence
  chemically synthesized
aaagtattttacaggttatagt

SEQ ID NO: 1092497 - DNA, 22 bp, Artificial Sequence
  chemically synthesized
taaagtattttacaggttatag

SEQ ID NO: 1092498 - DNA, 22 bp, Artificial Sequence
  chemically synthesized
ttaaagtattttacaggttata

SEQ ID NO: 1092499 - DNA, 22 bp, Artificial Sequence
  chemically synthesized
aaaaaaatcactataacctgta

SEQ ID NO: 1092500 - DNA, 22 bp, Artificial Sequence
  chemically synthesized
atggcttttaaagtattttaca

SEQ ID NO: 1092501 - DNA, 22 bp, Artificial Sequence
  chemically synthesized
gatggcttttaaagtattttac

SEQ ID NO: 1092502 - DNA, 22 bp, Artificial Sequence
  chemically synthesized
taacctgtaaaatactttaaaa

SEQ ID NO: 1092503 - DNA, 22 bp, Artificial Sequence
  chemically synthesized
aaaaatttgatggcttttaaag

SEQ ID NO: 1092504 - DNA, 22 bp, Artificial Sequence
  chemically synthesized
ctcaaaaatttgatggctttta

SEQ ID NO: 1092505 - DNA, 22 bp, Artificial Sequence
  chemically synthesized
taaaatactttaaaagccatca

SEQ ID NO: 1092506 - DNA, 22 bp, Artificial Sequence
  chemically synthesized
tactcaaaaatttgatggcttt

SEQ ID NO: 1092507 - DNA, 22 bp, Artificial Sequence
  chemically synthesized
ttctactcaaaaatttgatggc

SEQ ID NO: 1092508 - DNA, 22 bp, Artificial Sequence
  chemically synthesized
taaaagccatcaaatttttgag

SEQ ID NO: 1092509 - DNA, 22 bp, Artificial Sequence
  chemically synthesized
aaaagccatcaaatttttgagt

SEQ ID NO: 1092510 - DNA, 22 bp, Artificial Sequence
  chemically synthesized
aaagccatcaaatttttgagta

SEQ ID NO: 1092511 - DNA, 22 bp, Artificial Sequence
  chemically synthesized
acaatcacattgttctactcaa

SEQ ID NO: 1092512 - DNA, 22 bp, Artificial Sequence
  chemically synthesized
ttaacaatcacattgttctact

SEQ ID NO: 1092513 - DNA, 22 bp, Artificial Sequence
  chemically synthesized
ttgagtagaacaatgtgattgt

SEQ ID NO: 1092514 - DNA, 22 bp, Artificial Sequence
  chemically synthesized
ggaaaattattaacaatcacat

SEQ ID NO: 1092515 - DNA, 22 bp, Artificial Sequence
  chemically synthesized
tgagtagaacaatgtgattgtt

SEQ ID NO: 1092516 - DNA, 22 bp, Artificial Sequence
  chemically synthesized
gagtagaacaatgtgattgtta

SEQ ID NO: 1092517 - DNA, 22 bp, Artificial Sequence
  chemically synthesized
agtagaacaatgtgattgttaa

SEQ ID NO: 1092518 - DNA, 22 bp, Artificial Sequence
  chemically synthesized
ttaggaaaattattaacaatca

SEQ ID NO: 1092519 - DNA, 22 bp, Artificial Sequence
  chemically synthesized
ttaataattttcctaataattt

SEQ ID NO: 1092520 - DNA, 22 bp, Artificial Sequence
  chemically synthesized
ataattttcctaataatttata

SEQ ID NO: 1092521 - DNA, 22 bp, Artificial Sequence
  chemically synthesized
gaagtaataaggaatataaatt

SEQ ID NO: 1092522 - DNA, 22 bp, Artificial Sequence
  chemically synthesized
ttagaagtaataaggaatataa

SEQ ID NO: 1092523 - DNA, 22 bp, Artificial Sequence
  chemically synthesized
gttagaagtaataaggaatata

SEQ ID NO: 1092524 - DNA, 22 bp, Artificial Sequence
  chemically synthesized
tcctaataatttatattcctta

SEQ ID NO: 1092525 - DNA, 22 bp, Artificial Sequence
  chemically synthesized
cctaataatttatattccttat

SEQ ID NO: 1092526 - DNA, 22 bp, Artificial Sequence
  chemically synthesized
ctaataatttatattccttatt

SEQ ID NO: 1092527 - DNA, 22 bp, Artificial Sequence
  chemically synthesized
ataatttatattccttattact

SEQ ID NO: 1092528 - DNA, 22 bp, Artificial Sequence
  chemically synthesized
agatttgttagaagtaataagg

SEQ ID NO: 1092529 - DNA, 22 bp, Artificial Sequence
  chemically synthesized
atattccttattacttctaaca

SEQ ID NO: 1092530 - DNA, 22 bp, Artificial Sequence
  chemically synthesized
tattccttattacttctaacaa

SEQ ID NO: 1092531 - DNA, 22 bp, Artificial Sequence
  chemically synthesized
caaaattaagatttgttagaag

SEQ ID NO: 1092532 - DNA, 22 bp, Artificial Sequence
  chemically synthesized
acaaaattaagatttgttagaa

SEQ ID NO: 1092533 - DNA, 22 bp, Artificial Sequence
  chemically synthesized
cttattacttctaacaaatctt

SEQ ID NO: 1092534 - DNA, 22 bp, Artificial Sequence
  chemically synthesized
attacttctaacaaatcttaat

SEQ ID NO: 1092535 - DNA, 22 bp, Artificial Sequence
  chemically synthesized
ttacttctaacaaatcttaatt

SEQ ID NO: 1092536 - DNA, 22 bp, Artificial Sequence
  chemically synthesized
cttctaacaaatcttaattttg

SEQ ID NO: 1092537 - DNA, 22 bp, Artificial Sequence
  chemically synthesized
caaataaatatttacaaaatta

SEQ ID NO: 1092538 - DNA, 22 bp, Artificial Sequence
  chemically synthesized
ctaacaaatcttaattttgtaa

SEQ ID NO: 1092539 - DNA, 22 bp, Artificial Sequence
  chemically synthesized
gcaaataaatatttacaaaatt

SEQ ID NO: 1092540 - DNA, 22 bp, Artificial Sequence
  chemically synthesized
taacaaatcttaattttgtaaa

SEQ ID NO: 1092541 - DNA, 22 bp, Artificial Sequence
  chemically synthesized
tgcaaataaatatttacaaaat

SEQ ID NO: 1092542 - DNA, 22 bp, Artificial Sequence
  chemically synthesized
acaaatcttaattttgtaaata

SEQ ID NO: 1092543 - DNA, 22 bp, Artificial Sequence
  chemically synthesized
tatccattttgcaaataaatat

SEQ ID NO: 1092544 - DNA, 22 bp, Artificial Sequence
  chemically synthesized
atatccattttgcaaataaata

SEQ ID NO: 1092545 - DNA, 22 bp, Artificial Sequence
  chemically synthesized
aattttgtaaatatttatttgc

SEQ ID NO: 1092546 - DNA, 22 bp, Artificial Sequence
  chemically synthesized
attttgtaaatatttatttgca

SEQ ID NO: 1092547 - DNA, 22 bp, Artificial Sequence
  chemically synthesized
tttatatccattttgcaaataa

SEQ ID NO: 1092548 - DNA, 22 bp, Artificial Sequence
  chemically synthesized
tgtaaatatttatttgcaaaat

SEQ ID NO: 1092549 - DNA, 22 bp, Artificial Sequence
  chemically synthesized
gtaaatatttatttgcaaaatg

SEQ ID NO: 1092550 - DNA, 22 bp, Artificial Sequence
  chemically synthesized
taaatatttatttgcaaaatgg

SEQ ID NO: 1092551 - DNA, 22 bp, Artificial Sequence
  chemically synthesized
aaattatttatatccattttgc

SEQ ID NO: 1092552 - DNA, 22 bp, Artificial Sequence
  chemically synthesized
atttgcaaaatggatataaata

SEQ ID NO: 1092553 - DNA, 22 bp, Artificial Sequence
  chemically synthesized
tttgcaaaatggatataaataa

SEQ ID NO: 1092554 - DNA, 22 bp, Artificial Sequence
  chemically synthesized
gcaaaatggatataaataattt

SEQ ID NO: 1092555 - DNA, 22 bp, Artificial Sequence
  chemically synthesized
caaaatggatataaataatttt

SEQ ID NO: 1092556 - DNA, 22 bp, Artificial Sequence
  chemically synthesized
taaaataatgtatccattaaaa

SEQ ID NO: 1092557 - DNA, 22 bp, Artificial Sequence
  chemically synthesized
ataaaataatgtatccattaaa

SEQ ID NO: 1092558 - DNA, 22 bp, Artificial Sequence
  chemically synthesized
agacttataaaataatgtatcc

SEQ ID NO: 1092559 - DNA, 22 bp, Artificial Sequence
  chemically synthesized
ttaagacttataaaataatgta

SEQ ID NO: 1092560 - DNA, 22 bp, Artificial Sequence
  chemically synthesized
gttaagacttataaaataatgt

SEQ ID NO: 1092561 - DNA, 22 bp, Artificial Sequence
  chemically synthesized
tgttaagacttataaaataatg

SEQ ID NO: 1092562 - DNA, 22 bp, Artificial Sequence
  chemically synthesized
taatggatacattattttataa

SEQ ID NO: 1092563 - DNA, 22 bp, Artificial Sequence
  chemically synthesized
aatggatacattattttataag

SEQ ID NO: 1092564 - DNA, 22 bp, Artificial Sequence
  chemically synthesized
atggatacattattttataagt

SEQ ID NO: 1092565 - DNA, 22 bp, Artificial Sequence
  chemically synthesized
acaaggtatatactttgttaag

SEQ ID NO: 1092566 - DNA, 22 bp, Artificial Sequence
  chemically synthesized
aacaaggtatatactttgttaa

SEQ ID NO: 1092567 - DNA, 22 bp, Artificial Sequence
  chemically synthesized
ttttataagtcttaacaaagta

SEQ ID NO: 1092568 - DNA, 22 bp, Artificial Sequence
  chemically synthesized
tataagtcttaacaaagtatat

SEQ ID NO: 1092569 - DNA, 22 bp, Artificial Sequence
  chemically synthesized
ataagtcttaacaaagtatata

SEQ ID NO: 1092570 - DNA, 22 bp, Artificial Sequence
  chemically synthesized
taagtcttaacaaagtatatac

SEQ ID NO: 1092571 - DNA, 22 bp, Artificial Sequence
  chemically synthesized
aaaaaatttaacaaggtatata

SEQ ID NO: 1092572 - DNA, 22 bp, Artificial Sequence
  chemically synthesized
aaaaaaatttaacaaggtatat

SEQ ID NO: 1092573 - DNA, 22 bp, Artificial Sequence
  chemically synthesized
taaaaaaatttaacaaggtata

SEQ ID NO: 1092574 - DNA, 22 bp, Artificial Sequence
  chemically synthesized
aacaaagtatataccttgttaa

SEQ ID NO: 1092575 - DNA, 22 bp, Artificial Sequence
  chemically synthesized
acaaagtatataccttgttaaa

SEQ ID NO: 1092576 - DNA, 22 bp, Artificial Sequence
  chemically synthesized
atccacctttaaaaaaatttaa

SEQ ID NO: 1092577 - DNA, 22 bp, Artificial Sequence
  chemically synthesized
catccacctttaaaaaaattta

SEQ ID NO: 1092578 - DNA, 22 bp, Artificial Sequence
  chemically synthesized
tcatccacctttaaaaaaattt

SEQ ID NO: 1092579 - DNA, 22 bp, Artificial Sequence
  chemically synthesized
ttcatccacctttaaaaaaatt

SEQ ID NO: 1092580 - DNA, 22 bp, Artificial Sequence
  chemically synthesized
cttttcatccacctttaaaaaa

SEQ ID NO: 1092581 - DNA, 22 bp, Artificial Sequence
  chemically synthesized
ttgcttttcatccacctttaaa

SEQ ID NO: 1092582 - DNA, 22 bp, Artificial Sequence
  chemically synthesized
gttgcttttcatccacctttaa

SEQ ID NO: 1092583 - DNA, 22 bp, Artificial Sequence
  chemically synthesized
gttaaatttttttaaaggtgga

SEQ ID NO: 1092584 - DNA, 22 bp, Artificial Sequence
  chemically synthesized
tgttgcttttcatccaccttta

SEQ ID NO: 1092585 - DNA, 22 bp, Artificial Sequence
  chemically synthesized
ttaaatttttttaaaggtggat

SEQ ID NO: 1092586 - DNA, 22 bp, Artificial Sequence
  chemically synthesized
ctttgttgcttttcatccacct

SEQ ID NO: 1092587 - DNA, 22 bp, Artificial Sequence
  chemically synthesized
aatttttttaaaggtggatgaa

SEQ ID NO: 1092588 - DNA, 22 bp, Artificial Sequence
  chemically synthesized
gctttgttgcttttcatccacc

SEQ ID NO: 1092589 - DNA, 22 bp, Artificial Sequence
  chemically synthesized
tgctttgttgcttttcatccac

SEQ ID NO: 1092590 - DNA, 22 bp, Artificial Sequence
  chemically synthesized
ttttaaaggtggatgaaaagca

SEQ ID NO: 1092591 - DNA, 22 bp, Artificial Sequence
  chemically synthesized
attttgctttgttgcttttcat

SEQ ID NO: 1092592 - DNA, 22 bp, Artificial Sequence
  chemically synthesized
tttaaaggtggatgaaaagcaa

SEQ ID NO: 1092593 - DNA, 22 bp, Artificial Sequence
  chemically synthesized
aattttgctttgttgcttttca

SEQ ID NO: 1092594 - DNA, 22 bp, Artificial Sequence
  chemically synthesized
ttaaaggtggatgaaaagcaac

SEQ ID NO: 1092595 - DNA, 22 bp, Artificial Sequence
  chemically synthesized
taaaggtggatgaaaagcaaca

SEQ ID NO: 1092596 - DNA, 22 bp, Artificial Sequence
  chemically synthesized
aaaggtggatgaaaagcaacaa

SEQ ID NO: 1092597 - DNA, 22 bp, Artificial Sequence
  chemically synthesized
aaggtggatgaaaagcaacaaa

SEQ ID NO: 1092598 - DNA, 22 bp, Artificial Sequence
  chemically synthesized
atcccttaattttgctttgttg

SEQ ID NO: 1092599 - DNA, 22 bp, Artificial Sequence
  chemically synthesized
taactgatcccttaattttgct

SEQ ID NO: 1092600 - DNA, 22 bp, Artificial Sequence
  chemically synthesized
ataactgatcccttaattttgc

SEQ ID NO: 1092601 - DNA, 22 bp, Artificial Sequence
  chemically synthesized
aagatatttataactgatccct

SEQ ID NO: 1092602 - DNA, 22 bp, Artificial Sequence
  chemically synthesized
caactcaagatatttataactg

SEQ ID NO: 1092603 - DNA, 22 bp, Artificial Sequence
  chemically synthesized
gcaactcaagatatttataact

SEQ ID NO: 1092604 - DNA, 22 bp, Artificial Sequence
  chemically synthesized
ttgcaactcaagatatttataa

SEQ ID NO: 1092605 - DNA, 22 bp, Artificial Sequence
  chemically synthesized
cttgcaactcaagatatttata

SEQ ID NO: 1092606 - DNA, 22 bp, Artificial Sequence
  chemically synthesized
tcttgcaactcaagatatttat

SEQ ID NO: 1092607 - DNA, 22 bp, Artificial Sequence
  chemically synthesized
agggatcagttataaatatctt

SEQ ID NO: 1092608 - DNA, 22 bp, Artificial Sequence
  chemically synthesized
ggttttcttgcaactcaagata

SEQ ID NO: 1092609 - DNA, 22 bp, Artificial Sequence
  chemically synthesized
taggttttcttgcaactcaaga

SEQ ID NO: 1092610 - DNA, 22 bp, Artificial Sequence
  chemically synthesized
ctaggttttcttgcaactcaag

SEQ ID NO: 1092611 - DNA, 22 bp, Artificial Sequence
  chemically synthesized
taaatatcttgagttgcaagaa

SEQ ID NO: 1092612 - DNA, 22 bp, Artificial Sequence
  chemically synthesized
cacgacttctaggttttcttgc

SEQ ID NO: 1092613 - DNA, 22 bp, Artificial Sequence
  chemically synthesized
gagttgcaagaaaacctagaag

SEQ ID NO: 1092614 - DNA, 22 bp, Artificial Sequence
  chemically synthesized
agttgcaagaaaacctagaagt

SEQ ID NO: 1092615 - DNA, 22 bp, Artificial Sequence
  chemically synthesized
caagaaaacctagaagtcgtgc

SEQ ID NO: 1092616 - DNA, 22 bp, Artificial Sequence
  chemically synthesized
gaagtcgtgcagtttttctatc

SEQ ID NO: 1092617 - DNA, 22 bp, Artificial Sequence
  chemically synthesized
gatcaccacgtatcaaggatag

SEQ ID NO: 1092618 - DNA, 22 bp, Artificial Sequence
  chemically synthesized
ttctatccttgatacgtggtga

SEQ ID NO: 1092619 - DNA, 22 bp, Artificial Sequence
  chemically synthesized
tctatccttgatacgtggtgat

SEQ ID NO: 1092620 - DNA, 22 bp, Artificial Sequence
  chemically synthesized
ctatccttgatacgtggtgatc

SEQ ID NO: 1092621 - DNA, 22 bp, Artificial Sequence
  chemically synthesized
tatccttgatacgtggtgatct

SEQ ID NO: 1092622 - DNA, 22 bp, Artificial Sequence
  chemically synthesized
agtgaaaagggctagatcacca

SEQ ID NO: 1092623 - DNA, 22 bp, Artificial Sequence
  chemically synthesized
tccttgatacgtggtgatctag

SEQ ID NO: 1092624 - DNA, 22 bp, Artificial Sequence
  chemically synthesized
gagtgaaaagggctagatcacc

SEQ ID NO: 1092625 - DNA, 22 bp, Artificial Sequence
  chemically synthesized
tgagtgaaaagggctagatcac

SEQ ID NO: 1092626 - DNA, 22 bp, Artificial Sequence
  chemically synthesized
gatacgtggtgatctagccctt

SEQ ID NO: 1092627 - DNA, 22 bp, Artificial Sequence
  chemically synthesized
atacgtggtgatctagcccttt

SEQ ID NO: 1092628 - DNA, 22 bp, Artificial Sequence
  chemically synthesized
tccaggaggacattttgagtga

SEQ ID NO: 1092629 - DNA, 22 bp, Artificial Sequence
  chemically synthesized
atccaggaggacattttgagtg

SEQ ID NO: 1092630 - DNA, 22 bp, Artificial Sequence
  chemically synthesized
gcccttttcactcaaaatgtcc

SEQ ID NO: 1092631 - DNA, 22 bp, Artificial Sequence
  chemically synthesized
atgcttatccaggaggacattt

SEQ ID NO: 1092632 - DNA, 22 bp, Artificial Sequence
  chemically synthesized
ctgatgcttatccaggaggaca

SEQ ID NO: 1092633 - DNA, 22 bp, Artificial Sequence
  chemically synthesized
ttcactcaaaatgtcctcctgg

SEQ ID NO: 1092634 - DNA, 22 bp, Artificial Sequence
  chemically synthesized
tcactcaaaatgtcctcctgga

SEQ ID NO: 1092635 - DNA, 22 bp, Artificial Sequence
  chemically synthesized
cactcaaaatgtcctcctggat

SEQ ID NO: 1092636 - DNA, 22 bp, Artificial Sequence
  chemically synthesized
actcaaaatgtcctcctggata

SEQ ID NO: 1092637 - DNA, 22 bp, Artificial Sequence
  chemically synthesized
aaaatgtcctcctggataagca

SEQ ID NO: 1092638 - DNA, 22 bp, Artificial Sequence
  chemically synthesized
gtagtgttgctgatgcttatcc

SEQ ID NO: 1092639 - DNA, 22 bp, Artificial Sequence
  chemically synthesized
ggtagtgttgctgatgcttatc

SEQ ID NO: 1092640 - DNA, 22 bp, Artificial Sequence
  chemically synthesized
tggtagtgttgctgatgcttat

SEQ ID NO: 1092641 - DNA, 22 bp, Artificial Sequence
  chemically synthesized
tttggtagtgttgctgatgctt

SEQ ID NO: 1092642 - DNA, 22 bp, Artificial Sequence
  chemically synthesized
gctctttggtagtgttgctgat

SEQ ID NO: 1092643 - DNA, 22 bp, Artificial Sequence
  chemically synthesized
ctggataagcatcagcaacact

SEQ ID NO: 1092644 - DNA, 22 bp, Artificial Sequence
  chemically synthesized
gataagcatcagcaacactacc

SEQ ID NO: 1092645 - DNA, 22 bp, Artificial Sequence
  chemically synthesized
ccaaagagccaattttatgtat

SEQ ID NO: 1092646 - DNA, 22 bp, Artificial Sequence
  chemically synthesized
cacagtgaaaaaataaataaat

SEQ ID NO: 1092647 - DNA, 22 bp, Artificial Sequence
  chemically synthesized
tatgtatgtatttatttatttt

SEQ ID NO: 1092648 - DNA, 22 bp, Artificial Sequence
  chemically synthesized
atgtatgtatttatttattttt

SEQ ID NO: 1092649 - DNA, 22 bp, Artificial Sequence
  chemically synthesized
tgtatgtatttatttatttttt

SEQ ID NO: 1092650 - DNA, 22 bp, Artificial Sequence
  chemically synthesized
atttattttttcactgtggaat

SEQ ID NO: 1092651 - DNA, 22 bp, Artificial Sequence
  chemically synthesized
tttattttttcactgtggaatt

SEQ ID NO: 1092652 - DNA, 22 bp, Artificial Sequence
  chemically synthesized
attttttcactgtggaatttca

SEQ ID NO: 1092653 - DNA, 22 bp, Artificial Sequence
  chemically synthesized
ttttttcactgtggaatttcat

SEQ ID NO: 1092654 - DNA, 22 bp, Artificial Sequence
  chemically synthesized
tttcactgtggaatttcattta

SEQ ID NO: 1092655 - DNA, 22 bp, Artificial Sequence
  chemically synthesized
ttcactgtggaatttcatttat

SEQ ID NO: 1092656 - DNA, 22 bp, Artificial Sequence
  chemically synthesized
tcactgtggaatttcatttatt

SEQ ID NO: 1092657 - DNA, 22 bp, Artificial Sequence
  chemically synthesized
cactgtggaatttcatttattg

SEQ ID NO: 1092658 - DNA, 22 bp, Artificial Sequence
  chemically synthesized
agataatggagccaataaatga

SEQ ID NO: 1092659 - DNA, 22 bp, Artificial Sequence
  chemically synthesized
actgtggaatttcatttattgg

SEQ ID NO: 1092660 - DNA, 22 bp, Artificial Sequence
  chemically synthesized
attcagataatggagccaataa

SEQ ID NO: 1092661 - DNA, 22 bp, Artificial Sequence
  chemically synthesized
tggaatttcatttattggctcc

SEQ ID NO: 1092662 - DNA, 22 bp, Artificial Sequence
  chemically synthesized
ctaattcagataatggagccaa

SEQ ID NO: 1092663 - DNA, 22 bp, Artificial Sequence
  chemically synthesized
ttcctaattcagataatggagc

SEQ ID NO: 1092664 - DNA, 22 bp, Artificial Sequence
  chemically synthesized
catttattggctccattatctg

SEQ ID NO: 1092665 - DNA, 22 bp, Artificial Sequence
  chemically synthesized
atttattggctccattatctga

SEQ ID NO: 1092666 - DNA, 22 bp, Artificial Sequence
  chemically synthesized
aaattgttcctaattcagataa

SEQ ID NO: 1092667 - DNA, 22 bp, Artificial Sequence
  chemically synthesized
caaattgttcctaattcagata

SEQ ID NO: 1092668 - DNA, 22 bp, Artificial Sequence
  chemically synthesized
attggctccattatctgaatta

SEQ ID NO: 1092669 - DNA, 22 bp, Artificial Sequence
  chemically synthesized
ttggctccattatctgaattag

SEQ ID NO: 1092670 - DNA, 22 bp, Artificial Sequence
  chemically synthesized
gctccattatctgaattaggaa

SEQ ID NO: 1092671 - DNA, 22 bp, Artificial Sequence
  chemically synthesized
cattatctgaattaggaacaat

SEQ ID NO: 1092672 - DNA, 22 bp, Artificial Sequence
  chemically synthesized
tggtcataatttcaaattgttc

SEQ ID NO: 1092673 - DNA, 22 bp, Artificial Sequence
  chemically synthesized
tctgaattaggaacaatttgaa

SEQ ID NO: 1092674 - DNA, 22 bp, Artificial Sequence
  chemically synthesized
tgttgtggtcataatttcaaat

SEQ ID NO: 1092675 - DNA, 22 bp, Artificial Sequence
  chemically synthesized
aattaggaacaatttgaaatta

SEQ ID NO: 1092676 - DNA, 22 bp, Artificial Sequence
  chemically synthesized
tatgttgtggtcataatttcaa

SEQ ID NO: 1092677 - DNA, 22 bp, Artificial Sequence
  chemically synthesized
ctatgttgtggtcataatttca

SEQ ID NO: 1092678 - DNA, 22 bp, Artificial Sequence
  chemically synthesized
ggaacaatttgaaattatgacc

SEQ ID NO: 1092679 - DNA, 22 bp, Artificial Sequence
  chemically synthesized
tttctatgttgtggtcataatt

SEQ ID NO: 1092680 - DNA, 22 bp, Artificial Sequence
  chemically synthesized
atttctatgttgtggtcataat

SEQ ID NO: 1092681 - DNA, 22 bp, Artificial Sequence
  chemically synthesized
tatttctatgttgtggtcataa

SEQ ID NO: 1092682 - DNA, 22 bp, Artificial Sequence
  chemically synthesized
ttatttctatgttgtggtcata

SEQ ID NO: 1092683 - DNA, 22 bp, Artificial Sequence
  chemically synthesized
tcttttatttctatgttgtggt

SEQ ID NO: 1092684 - DNA, 22 bp, Artificial Sequence
  chemically synthesized
atcttttatttctatgttgtgg

SEQ ID NO: 1092685 - DNA, 22 bp, Artificial Sequence
  chemically synthesized
gaaattatgaccacaacataga

SEQ ID NO: 1092686 - DNA, 22 bp, Artificial Sequence
  chemically synthesized
ttatcttttatttctatgttgt

SEQ ID NO: 1092687 - DNA, 22 bp, Artificial Sequence
  chemically synthesized
aaattatgaccacaacatagaa

SEQ ID NO: 1092688 - DNA, 22 bp, Artificial Sequence
  chemically synthesized
tgaccacaacatagaaataaaa

SEQ ID NO: 1092689 - DNA, 22 bp, Artificial Sequence
  chemically synthesized
cgagtgctcttatcttttattt

SEQ ID NO: 1092690 - DNA, 22 bp, Artificial Sequence
  chemically synthesized
gcaattttcctcctccctgctt

SEQ ID NO: 1092691 - DNA, 22 bp, Artificial Sequence
  chemically synthesized
tcctcctccctgcttgtctgtg

SEQ ID NO: 1092692 - DNA, 22 bp, Artificial Sequence
  chemically synthesized
cctcctccctgcttgtctgtgt

SEQ ID NO: 1092693 - DNA, 22 bp, Artificial Sequence
  chemically synthesized
acaatgcccacaacacagacaa

SEQ ID NO: 1092694 - DNA, 22 bp, Artificial Sequence
  chemically synthesized
ctcctccctgcttgtctgtgtt

SEQ ID NO: 1092695 - DNA, 22 bp, Artificial Sequence
  chemically synthesized
ctccctgcttgtctgtgttgtg

SEQ ID NO: 1092696 - DNA, 22 bp, Artificial Sequence
  chemically synthesized
cctgcttgtctgtgttgtgggc

SEQ ID NO: 1092697 - DNA, 22 bp, Artificial Sequence
  chemically synthesized
cttgtctgtgttgtgggcattg

SEQ ID NO: 1092698 - DNA, 22 bp, Artificial Sequence
  chemically synthesized
gacgaggccctcacaatgccca

SEQ ID NO: 1092699 - DNA, 22 bp, Artificial Sequence
  chemically synthesized
agacgaggccctcacaatgccc

SEQ ID NO: 1092700 - DNA, 22 bp, Artificial Sequence
  chemically synthesized
gtctgtgttgtgggcattgtga

SEQ ID NO: 1092701 - DNA, 22 bp, Artificial Sequence
  chemically synthesized
tagacgaggccctcacaatgcc

SEQ ID NO: 1092702 - DNA, 22 bp, Artificial Sequence
  chemically synthesized
tctgtgttgtgggcattgtgag

SEQ ID NO: 1092703 - DNA, 22 bp, Artificial Sequence
  chemically synthesized
ttttagacgaggccctcacaat

SEQ ID NO: 1092704 - DNA, 22 bp, Artificial Sequence
  chemically synthesized
tgttgtgggcattgtgagggcc

SEQ ID NO: 1092705 - DNA, 22 bp, Artificial Sequence
  chemically synthesized
ctattttagacgaggccctcac

SEQ ID NO: 1092706 - DNA, 22 bp, Artificial Sequence
  chemically synthesized
actattttagacgaggccctca

SEQ ID NO: 1092707 - DNA, 22 bp, Artificial Sequence
  chemically synthesized
tgggcattgtgagggcctcgtc

SEQ ID NO: 1092708 - DNA, 22 bp, Artificial Sequence
  chemically synthesized
tttactattttagacgaggccc

SEQ ID NO: 1092709 - DNA, 22 bp, Artificial Sequence
  chemically synthesized
ctatttactattttagacgagg

SEQ ID NO: 1092710 - DNA, 22 bp, Artificial Sequence
  chemically synthesized
tgagggcctcgtctaaaatagt

SEQ ID NO: 1092711 - DNA, 22 bp, Artificial Sequence
  chemically synthesized
ccattactatttactattttag

SEQ ID NO: 1092712 - DNA, 22 bp, Artificial Sequence
  chemically synthesized
accattactatttactatttta

SEQ ID NO: 1092713 - DNA, 22 bp, Artificial Sequence
  chemically synthesized
gtctaaaatagtaaatagtaat

SEQ ID NO: 1092714 - DNA, 22 bp, Artificial Sequence
  chemically synthesized
aaatagtaaatagtaatggtaa

SEQ ID NO: 1092715 - DNA, 22 bp, Artificial Sequence
  chemically synthesized
gaaaagatggggaaacaaaact

SEQ ID NO: 1092716 - DNA, 22 bp, Artificial Sequence
  chemically synthesized
agaaaagatggggaaacaaaac

SEQ ID NO: 1092717 - DNA, 22 bp, Artificial Sequence
  chemically synthesized
tgtttccccatcttttctaaat

SEQ ID NO: 1092718 - DNA, 22 bp, Artificial Sequence
  chemically synthesized
gtttccccatcttttctaaatg

SEQ ID NO: 1092719 - DNA, 22 bp, Artificial Sequence
  chemically synthesized
tttccccatcttttctaaatgc

SEQ ID NO: 1092720 - DNA, 22 bp, Artificial Sequence
  chemically synthesized
ccccatcttttctaaatgctct

SEQ ID NO: 1092721 - DNA, 22 bp, Artificial Sequence
  chemically synthesized
aagccataatgaagagcattta

SEQ ID NO: 1092722 - DNA, 22 bp, Artificial Sequence
  chemically synthesized
cccatcttttctaaatgctctt

SEQ ID NO: 1092723 - DNA, 22 bp, Artificial Sequence
  chemically synthesized
gaagccataatgaagagcattt

SEQ ID NO: 1092724 - DNA, 22 bp, Artificial Sequence
  chemically synthesized
ttctaaatgctcttcattatgg

SEQ ID NO: 1092725 - DNA, 22 bp, Artificial Sequence
  chemically synthesized
tctaaatgctcttcattatggc

SEQ ID NO: 1092726 - DNA, 22 bp, Artificial Sequence
  chemically synthesized
ctaaatgctcttcattatggct

SEQ ID NO: 1092727 - DNA, 22 bp, Artificial Sequence
  chemically synthesized
taaatgctcttcattatggctt

SEQ ID NO: 1092728 - DNA, 22 bp, Artificial Sequence
  chemically synthesized
aatgctcttcattatggcttca

SEQ ID NO: 1092729 - DNA, 22 bp, Artificial Sequence
  chemically synthesized
aggaaagagagaaaatttgaag

SEQ ID NO: 1092730 - DNA, 22 bp, Artificial Sequence
  chemically synthesized
ttcattatggcttcaaattttc

SEQ ID NO: 1092731 - DNA, 22 bp, Artificial Sequence
  chemically synthesized
cattatggcttcaaattttctc

SEQ ID NO: 1092732 - DNA, 22 bp, Artificial Sequence
  chemically synthesized
attatggcttcaaattttctct

SEQ ID NO: 1092733 - DNA, 22 bp, Artificial Sequence
  chemically synthesized
tggcttcaaattttctctcttt

SEQ ID NO: 1092734 - DNA, 22 bp, Artificial Sequence
  chemically synthesized
acaaaggaatgttaaggaaaga

SEQ ID NO: 1092735 - DNA, 22 bp, Artificial Sequence
  chemically synthesized
caaattttctctctttccttaa

SEQ ID NO: 1092736 - DNA, 22 bp, Artificial Sequence
  chemically synthesized
aaattttctctctttccttaac

SEQ ID NO: 1092737 - DNA, 22 bp, Artificial Sequence
  chemically synthesized
tctctctttccttaacattcct

SEQ ID NO: 1092738 - DNA, 22 bp, Artificial Sequence
  chemically synthesized
ctctctttccttaacattcctt

SEQ ID NO: 1092739 - DNA, 22 bp, Artificial Sequence
  chemically synthesized
tctctttccttaacattccttt

SEQ ID NO: 1092740 - DNA, 22 bp, Artificial Sequence
  chemically synthesized
gggcatgttcacaaaggaatgt

SEQ ID NO: 1092741 - DNA, 22 bp, Artificial Sequence
  chemically synthesized
tctttccttaacattcctttgt

SEQ ID NO: 1092742 - DNA, 22 bp, Artificial Sequence
  chemically synthesized
tttccttaacattcctttgtga

SEQ ID NO: 1092743 - DNA, 22 bp, Artificial Sequence
  chemically synthesized
tccttaacattcctttgtgaac

SEQ ID NO: 1092744 - DNA, 22 bp, Artificial Sequence
  chemically synthesized
ccttaacattcctttgtgaaca

SEQ ID NO: 1092745 - DNA, 22 bp, Artificial Sequence
  chemically synthesized
cttaacattcctttgtgaacat

SEQ ID NO: 1092746 - DNA, 22 bp, Artificial Sequence
  chemically synthesized
aaaaactagggcatgttcacaa

SEQ ID NO: 1092747 - DNA, 22 bp, Artificial Sequence
  chemically synthesized
aacattcctttgtgaacatgcc

SEQ ID NO: 1092748 - DNA, 22 bp, Artificial Sequence
  chemically synthesized
acattcctttgtgaacatgccc

SEQ ID NO: 1092749 - DNA, 22 bp, Artificial Sequence
  chemically synthesized
ctttgtgaacatgccctagttt

SEQ ID NO: 1092750 - DNA, 22 bp, Artificial Sequence
  chemically synthesized
agtgatgtgctgaaaaactagg

SEQ ID NO: 1092751 - DNA, 22 bp, Artificial Sequence
  chemically synthesized
tgtgaacatgccctagtttttc

SEQ ID NO: 1092752 - DNA, 22 bp, Artificial Sequence
  chemically synthesized
cagtgatgtgctgaaaaactag

SEQ ID NO: 1092753 - DNA, 22 bp, Artificial Sequence
  chemically synthesized
gtgaacatgccctagtttttca

SEQ ID NO: 1092754 - DNA, 22 bp, Artificial Sequence
  chemically synthesized
tgaacatgccctagtttttcag

SEQ ID NO: 1092755 - DNA, 22 bp, Artificial Sequence
  chemically synthesized
acagtttcagtgatgtgctgaa

SEQ ID NO: 1092756 - DNA, 22 bp, Artificial Sequence
  chemically synthesized
tcacagtttcagtgatgtgctg

SEQ ID NO: 1092757 - DNA, 22 bp, Artificial Sequence
  chemically synthesized
ctctcacagtttcagtgatgtg

SEQ ID NO: 1092758 - DNA, 22 bp, Artificial Sequence
  chemically synthesized
gctctcacagtttcagtgatgt

SEQ ID NO: 1092759 - DNA, 22 bp, Artificial Sequence
  chemically synthesized
gtttttcagcacatcactgaaa

SEQ ID NO: 1092760 - DNA, 22 bp, Artificial Sequence
  chemically synthesized
ttgctctcacagtttcagtgat

SEQ ID NO: 1092761 - DNA, 22 bp, Artificial Sequence
  chemically synthesized
ttcagcacatcactgaaactgt

SEQ ID NO: 1092762 - DNA, 22 bp, Artificial Sequence
  chemically synthesized
tcagcacatcactgaaactgtg

SEQ ID NO: 1092763 - DNA, 22 bp, Artificial Sequence
  chemically synthesized
aattcttgctctcacagtttca

SEQ ID NO: 1092764 - DNA, 22 bp, Artificial Sequence
  chemically synthesized
cagcacatcactgaaactgtga

SEQ ID NO: 1092765 - DNA, 22 bp, Artificial Sequence
  chemically synthesized
agcacatcactgaaactgtgag

SEQ ID NO: 1092766 - DNA, 22 bp, Artificial Sequence
  chemically synthesized
aaactgtgagagcaagaattta

SEQ ID NO: 1092767 - DNA, 22 bp, Artificial Sequence
  chemically synthesized
tgagagcaagaatttagcatgg

SEQ ID NO: 1092768 - DNA, 22 bp, Artificial Sequence
  chemically synthesized
tcaaatcgtacatggagcacca

SEQ ID NO: 1092769 - DNA, 22 bp, Artificial Sequence
  chemically synthesized
agcatggtgctccatgtacgat

SEQ ID NO: 1092770 - DNA, 22 bp, Artificial Sequence
  chemically synthesized
tgaaattgtcaaatcgtacatg

SEQ ID NO: 1092771 - DNA, 22 bp, Artificial Sequence
  chemically synthesized
gcatggtgctccatgtacgatt

SEQ ID NO: 1092772 - DNA, 22 bp, Artificial Sequence
  chemically synthesized
gcctatgaaattgtcaaatcgt

SEQ ID NO: 1092773 - DNA, 22 bp, Artificial Sequence
  chemically synthesized
ttagcctatgaaattgtcaaat

SEQ ID NO: 1092774 - DNA, 22 bp, Artificial Sequence
  chemically synthesized
catgtacgatttgacaatttca

SEQ ID NO: 1092775 - DNA, 22 bp, Artificial Sequence
  chemically synthesized
gacaatttcataggctaacagc

SEQ ID NO: 1092776 - DNA, 22 bp, Artificial Sequence
  chemically synthesized
acaatttcataggctaacagca

SEQ ID NO: 1092777 - DNA, 22 bp, Artificial Sequence
  chemically synthesized
cataggctaacagcatcatcct

SEQ ID NO: 1092778 - DNA, 22 bp, Artificial Sequence
  chemically synthesized
ataggctaacagcatcatccta

SEQ ID NO: 1092779 - DNA, 22 bp, Artificial Sequence
  chemically synthesized
acagcatcatcctatcttctgt

SEQ ID NO: 1092780 - DNA, 22 bp, Artificial Sequence
  chemically synthesized
ataaaaggacagtggccagaac

SEQ ID NO: 1092781 - DNA, 22 bp, Artificial Sequence
  chemically synthesized
tcttctgttctggccactgtcc

SEQ ID NO: 1092782 - DNA, 22 bp, Artificial Sequence
  chemically synthesized
ctgttctggccactgtcctttt

SEQ ID NO: 1092783 - DNA, 22 bp, Artificial Sequence
  chemically synthesized
cagcacattaataaaaggacag

SEQ ID NO: 1092784 - DNA, 22 bp, Artificial Sequence
  chemically synthesized
tgttctggccactgtcctttta

SEQ ID NO: 1092785 - DNA, 22 bp, Artificial Sequence
  chemically synthesized
acagcacattaataaaaggaca

SEQ ID NO: 1092786 - DNA, 22 bp, Artificial Sequence
  chemically synthesized
ttctggccactgtccttttatt

SEQ ID NO: 1092787 - DNA, 22 bp, Artificial Sequence
  chemically synthesized
tggccactgtccttttattaat

SEQ ID NO: 1092788 - DNA, 22 bp, Artificial Sequence
  chemically synthesized
gccactgtccttttattaatgt

SEQ ID NO: 1092789 - DNA, 22 bp, Artificial Sequence
  chemically synthesized
cagcaaatttacagcacattaa

SEQ ID NO: 1092790 - DNA, 22 bp, Artificial Sequence
  chemically synthesized
tccttttattaatgtgctgtaa

SEQ ID NO: 1092791 - DNA, 22 bp, Artificial Sequence
  chemically synthesized
ttattaatgtgctgtaaatttg

SEQ ID NO: 1092792 - DNA, 22 bp, Artificial Sequence
  chemically synthesized
gaaaagttgcagcaaatttaca

SEQ ID NO: 1092793 - DNA, 22 bp, Artificial Sequence
  chemically synthesized
tattaatgtgctgtaaatttgc

SEQ ID NO: 1092794 - DNA, 22 bp, Artificial Sequence
  chemically synthesized
attaatgtgctgtaaatttgct

SEQ ID NO: 1092795 - DNA, 22 bp, Artificial Sequence
  chemically synthesized
tagaaaagttgcagcaaattta

SEQ ID NO: 1092796 - DNA, 22 bp, Artificial Sequence
  chemically synthesized
ttaatgtgctgtaaatttgctg

SEQ ID NO: 1092797 - DNA, 22 bp, Artificial Sequence
  chemically synthesized
atgtgctgtaaatttgctgcaa

SEQ ID NO: 1092798 - DNA, 22 bp, Artificial Sequence
  chemically synthesized
catgttctagaaaagttgcagc

SEQ ID NO: 1092799 - DNA, 22 bp, Artificial Sequence
  chemically synthesized
taaatttgctgcaacttttcta

SEQ ID NO: 1092800 - DNA, 22 bp, Artificial Sequence
  chemically synthesized
gctgcaacttttctagaacatg

SEQ ID NO: 1092801 - DNA, 22 bp, Artificial Sequence
  chemically synthesized
ctgcaacttttctagaacatgt

SEQ ID NO: 1092802 - DNA, 22 bp, Artificial Sequence
  chemically synthesized
caacttttctagaacatgtaac

SEQ ID NO: 1092803 - DNA, 22 bp, Artificial Sequence
  chemically synthesized
tgaatcagcaatgtgttacatg

SEQ ID NO: 1092804 - DNA, 22 bp, Artificial Sequence
  chemically synthesized
gtgaatcagcaatgtgttacat

SEQ ID NO: 1092805 - DNA, 22 bp, Artificial Sequence
  chemically synthesized
ttgtgaatcagcaatgtgttac

SEQ ID NO: 1092806 - DNA, 22 bp, Artificial Sequence
  chemically synthesized
ttctagaacatgtaacacattg

SEQ ID NO: 1092807 - DNA, 22 bp, Artificial Sequence
  chemically synthesized
cttgtgaatcagcaatgtgtta

SEQ ID NO: 1092808 - DNA, 22 bp, Artificial Sequence
  chemically synthesized
tctagaacatgtaacacattgc

SEQ ID NO: 1092809 - DNA, 22 bp, Artificial Sequence
  chemically synthesized
ctagaacatgtaacacattgct

SEQ ID NO: 1092810 - DNA, 22 bp, Artificial Sequence
  chemically synthesized
tagaacatgtaacacattgctg

SEQ ID NO: 1092811 - DNA, 22 bp, Artificial Sequence
  chemically synthesized
gaacatgtaacacattgctgat

SEQ ID NO: 1092812 - DNA, 22 bp, Artificial Sequence
  chemically synthesized
accaaacatttcttgtgaatca

SEQ ID NO: 1092813 - DNA, 22 bp, Artificial Sequence
  chemically synthesized
attgaccaaacatttcttgtga

SEQ ID NO: 1092814 - DNA, 22 bp, Artificial Sequence
  chemically synthesized
ctgattcacaagaaatgtttgg

SEQ ID NO: 1092815 - DNA, 22 bp, Artificial Sequence
  chemically synthesized
attcacaagaaatgtttggtca

SEQ ID NO: 1092816 - DNA, 22 bp, Artificial Sequence
  chemically synthesized
agagaagttaattgaccaaaca

SEQ ID NO: 1092817 - DNA, 22 bp, Artificial Sequence
  chemically synthesized
acaagaaatgtttggtcaatta

SEQ ID NO: 1092818 - DNA, 22 bp, Artificial Sequence
  chemically synthesized
tcgtattcagagaagttaattg

SEQ ID NO: 1092819 - DNA, 22 bp, Artificial Sequence
  chemically synthesized
gtcgtattcagagaagttaatt

SEQ ID NO: 1092820 - DNA, 22 bp, Artificial Sequence
  chemically synthesized
taaatttgtcgtattcagagaa

SEQ ID NO: 1092821 - DNA, 22 bp, Artificial Sequence
  chemically synthesized
ggtcaattaacttctctgaata

SEQ ID NO: 1092822 - DNA, 22 bp, Artificial Sequence
  chemically synthesized
gtcaattaacttctctgaatac

SEQ ID NO: 1092823 - DNA, 22 bp, Artificial Sequence
  chemically synthesized
tgactataaatttgtcgtattc

SEQ ID NO: 1092824 - DNA, 22 bp, Artificial Sequence
  chemically synthesized
acttctctgaatacgacaaatt

SEQ ID NO: 1092825 - DNA, 22 bp, Artificial Sequence
  chemically synthesized
actatgactataaatttgtcgt

SEQ ID NO: 1092826 - DNA, 22 bp, Artificial Sequence
  chemically synthesized
ctctgaatacgacaaatttata

SEQ ID NO: 1092827 - DNA, 22 bp, Artificial Sequence
  chemically synthesized
tctgactatgactataaatttg

SEQ ID NO: 1092828 - DNA, 22 bp, Artificial Sequence
  chemically synthesized
tctgaatacgacaaatttatag

SEQ ID NO: 1092829 - DNA, 22 bp, Artificial Sequence
  chemically synthesized
tatctgactatgactataaatt

SEQ ID NO: 1092830 - DNA, 22 bp, Artificial Sequence
  chemically synthesized
tgaatacgacaaatttatagtc

SEQ ID NO: 1092831 - DNA, 22 bp, Artificial Sequence
  chemically synthesized
aatacgacaaatttatagtcat

SEQ ID NO: 1092832 - DNA, 22 bp, Artificial Sequence
  chemically synthesized
gctctatctgactatgactata

SEQ ID NO: 1092833 - DNA, 22 bp, Artificial Sequence
  chemically synthesized
ggctctatctgactatgactat

SEQ ID NO: 1092834 - DNA, 22 bp, Artificial Sequence
  chemically synthesized
tggctctatctgactatgacta

SEQ ID NO: 1092835 - DNA, 22 bp, Artificial Sequence
  chemically synthesized
attttggctctatctgactatg

SEQ ID NO: 1092836 - DNA, 22 bp, Artificial Sequence
  chemically synthesized
aattttggctctatctgactat

SEQ ID NO: 1092837 - DNA, 22 bp, Artificial Sequence
  chemically synthesized
taattttggctctatctgacta

SEQ ID NO: 1092838 - DNA, 22 bp, Artificial Sequence
  chemically synthesized
atagtcatagtcagatagagcc

SEQ ID NO: 1092839 - DNA, 22 bp, Artificial Sequence
  chemically synthesized
tagtcatagtcagatagagcca

SEQ ID NO: 1092840 - DNA, 22 bp, Artificial Sequence
  chemically synthesized
cagtggactttaattttggctc

SEQ ID NO: 1092841 - DNA, 22 bp, Artificial Sequence
  chemically synthesized
aagtacaatgaagtagatctcc

SEQ ID NO: 1092842 - DNA, 22 bp, Artificial Sequence
  chemically synthesized
aagtccactggagatctacttc

SEQ ID NO: 1092843 - DNA, 22 bp, Artificial Sequence
  chemically synthesized
aaaagatattaaagtacaatga

SEQ ID NO: 1092844 - DNA, 22 bp, Artificial Sequence
  chemically synthesized
gagatctacttcattgtacttt

SEQ ID NO: 1092845 - DNA, 22 bp, Artificial Sequence
  chemically synthesized
taaaacctgaaaagatattaaa

SEQ ID NO: 1092846 - DNA, 22 bp, Artificial Sequence
  chemically synthesized
cttcattgtactttaatatctt

SEQ ID NO: 1092847 - DNA, 22 bp, Artificial Sequence
  chemically synthesized
cattgtactttaatatcttttc

SEQ ID NO: 1092848 - DNA, 22 bp, Artificial Sequence
  chemically synthesized
attgtactttaatatcttttca

SEQ ID NO: 1092849 - DNA, 22 bp, Artificial Sequence
  chemically synthesized
tactttaatatcttttcaggtt

SEQ ID NO: 1092850 - DNA, 22 bp, Artificial Sequence
  chemically synthesized
aaaaggaaattataaaacctga

SEQ ID NO: 1092851 - DNA, 22 bp, Artificial Sequence
  chemically synthesized
caaaaggaaattataaaacctg

SEQ ID NO: 1092852 - DNA, 22 bp, Artificial Sequence
  chemically synthesized
taatatcttttcaggttttata

SEQ ID NO: 1092853 - DNA, 22 bp, Artificial Sequence
  chemically synthesized
tcaaaaggaaattataaaacct

SEQ ID NO: 1092854 - DNA, 22 bp, Artificial Sequence
  chemically synthesized
aatatcttttcaggttttataa

SEQ ID NO: 1092855 - DNA, 22 bp, Artificial Sequence
  chemically synthesized
atatcttttcaggttttataat

SEQ ID NO: 1092856 - DNA, 22 bp, Artificial Sequence
  chemically synthesized
attttcaaaaggaaattataaa

SEQ ID NO: 1092857 - DNA, 22 bp, Artificial Sequence
  chemically synthesized
ctaattttcaaaaggaaattat

SEQ ID NO: 1092858 - DNA, 22 bp, Artificial Sequence
  chemically synthesized
cctaattttcaaaaggaaatta

SEQ ID NO: 1092859 - DNA, 22 bp, Artificial Sequence
  chemically synthesized
ttcaggttttataatttccttt

SEQ ID NO: 1092860 - DNA, 22 bp, Artificial Sequence
  chemically synthesized
tcaggttttataatttcctttt

SEQ ID NO: 1092861 - DNA, 22 bp, Artificial Sequence
  chemically synthesized
caggttttataatttccttttg

SEQ ID NO: 1092862 - DNA, 22 bp, Artificial Sequence
  chemically synthesized
aggttttataatttccttttga

SEQ ID NO: 1092863 - DNA, 22 bp, Artificial Sequence
  chemically synthesized
tccaacttcctaattttcaaaa

SEQ ID NO: 1092864 - DNA, 22 bp, Artificial Sequence
  chemically synthesized
atccaacttcctaattttcaaa

SEQ ID NO: 1092865 - DNA, 22 bp, Artificial Sequence
  chemically synthesized
tataatttccttttgaaaatta

SEQ ID NO: 1092866 - DNA, 22 bp, Artificial Sequence
  chemically synthesized
tatccaacttcctaattttcaa

SEQ ID NO: 1092867 - DNA, 22 bp, Artificial Sequence
  chemically synthesized
ataatttccttttgaaaattag

SEQ ID NO: 1092868 - DNA, 22 bp, Artificial Sequence
  chemically synthesized
taatttccttttgaaaattagg

SEQ ID NO: 1092869 - DNA, 22 bp, Artificial Sequence
  chemically synthesized
ccttttgaaaattaggaagttg

SEQ ID NO: 1092870 - DNA, 22 bp, Artificial Sequence
  chemically synthesized
cttttgaaaattaggaagttgg

SEQ ID NO: 1092871 - DNA, 22 bp, Artificial Sequence
  chemically synthesized
tagatcattttatccaacttcc

SEQ ID NO: 1092872 - DNA, 22 bp, Artificial Sequence
  chemically synthesized
ttgaaaattaggaagttggata

SEQ ID NO: 1092873 - DNA, 22 bp, Artificial Sequence
  chemically synthesized
tgaaaattaggaagttggataa

SEQ ID NO: 1092874 - DNA, 22 bp, Artificial Sequence
  chemically synthesized
gaaaattaggaagttggataaa

SEQ ID NO: 1092875 - DNA, 22 bp, Artificial Sequence
  chemically synthesized
aaaattaggaagttggataaaa

SEQ ID NO: 1092876 - DNA, 22 bp, Artificial Sequence
  chemically synthesized
ggaagttggataaaatgatcta

SEQ ID NO: 1092877 - DNA, 22 bp, Artificial Sequence
  chemically synthesized
gataaaatgatctataggtgtc

SEQ ID NO: 1092878 - DNA, 22 bp, Artificial Sequence
  chemically synthesized
gaacatcagagtagacacctat

SEQ ID NO: 1092879 - DNA, 22 bp, Artificial Sequence
  chemically synthesized
taatcctagaacatcagagtag

SEQ ID NO: 1092880 - DNA, 22 bp, Artificial Sequence
  chemically synthesized
gtaatcctagaacatcagagta

SEQ ID NO: 1092881 - DNA, 22 bp, Artificial Sequence
  chemically synthesized
taggtgtctactctgatgttct

SEQ ID NO: 1092882 - DNA, 22 bp, Artificial Sequence
  chemically synthesized
ctctgatgttctaggattacaa

SEQ ID NO: 1092883 - DNA, 22 bp, Artificial Sequence
  chemically synthesized
gacagaatagaatttgtaatcc

SEQ ID NO: 1092884 - DNA, 22 bp, Artificial Sequence
  chemically synthesized
agacagaatagaatttgtaatc

SEQ ID NO: 1092885 - DNA, 22 bp, Artificial Sequence
  chemically synthesized
tgatgttctaggattacaaatt

SEQ ID NO: 1092886 - DNA, 22 bp, Artificial Sequence
  chemically synthesized
tagacagaatagaatttgtaat

SEQ ID NO: 1092887 - DNA, 22 bp, Artificial Sequence
  chemically synthesized
atgttctaggattacaaattct

SEQ ID NO: 1092888 - DNA, 22 bp, Artificial Sequence
  chemically synthesized
tttagacagaatagaatttgta

SEQ ID NO: 1092889 - DNA, 22 bp, Artificial Sequence
  chemically synthesized
ctttagacagaatagaatttgt

SEQ ID NO: 1092890 - DNA, 22 bp, Artificial Sequence
  chemically synthesized
taggattacaaattctattctg

SEQ ID NO: 1092891 - DNA, 22 bp, Artificial Sequence
  chemically synthesized
ggattacaaattctattctgtc

SEQ ID NO: 1092892 - DNA, 22 bp, Artificial Sequence
  chemically synthesized
caaattctattctgtctaaaga

SEQ ID NO: 1092893 - DNA, 22 bp, Artificial Sequence
  chemically synthesized
tattctgtctaaagaaatacct

SEQ ID NO: 1092894 - DNA, 22 bp, Artificial Sequence
  chemically synthesized
ttctgtctaaagaaatacctta

SEQ ID NO: 1092895 - DNA, 22 bp, Artificial Sequence
  chemically synthesized
tgtctaaagaaataccttacat

SEQ ID NO: 1092896 - DNA, 22 bp, Artificial Sequence
  chemically synthesized
tctaaagaaataccttacattt

SEQ ID NO: 1092897 - DNA, 22 bp, Artificial Sequence
  chemically synthesized
aagatgtgaagaaaatgtaagg

SEQ ID NO: 1092898 - DNA, 22 bp, Artificial Sequence
  chemically synthesized
ttcaagatgtgaagaaaatgta

SEQ ID NO: 1092899 - DNA, 22 bp, Artificial Sequence
  chemically synthesized
aagaaataccttacattttctt

SEQ ID NO: 1092900 - DNA, 22 bp, Artificial Sequence
  chemically synthesized
acattttcttcacatcttgaat

SEQ ID NO: 1092901 - DNA, 22 bp, Artificial Sequence
  chemically synthesized
cattttcttcacatcttgaata

SEQ ID NO: 1092902 - DNA, 22 bp, Artificial Sequence
  chemically synthesized
tcttcacatcttgaataattta

SEQ ID NO: 1092903 - DNA, 22 bp, Artificial Sequence
  chemically synthesized
cttcacatcttgaataatttat

SEQ ID NO: 1092904 - DNA, 22 bp, Artificial Sequence
  chemically synthesized
ttcacatcttgaataatttatg

SEQ ID NO: 1092905 - DNA, 22 bp, Artificial Sequence
  chemically synthesized
taaaataaggagcataaattat

SEQ ID NO: 1092906 - DNA, 22 bp, Artificial Sequence
  chemically synthesized
cacatcttgaataatttatgct

SEQ ID NO: 1092907 - DNA, 22 bp, Artificial Sequence
  chemically synthesized
acatcttgaataatttatgctc

SEQ ID NO: 1092908 - DNA, 22 bp, Artificial Sequence
  chemically synthesized
taaatctataaaataaggagca

SEQ ID NO: 1092909 - DNA, 22 bp, Artificial Sequence
  chemically synthesized
gaataatttatgctccttattt

SEQ ID NO: 1092910 - DNA, 22 bp, Artificial Sequence
  chemically synthesized
tgtaaatctataaaataaggag

SEQ ID NO: 1092911 - DNA, 22 bp, Artificial Sequence
  chemically synthesized
aataatttatgctccttatttt

SEQ ID NO: 1092912 - DNA, 22 bp, Artificial Sequence
  chemically synthesized
atgctccttattttatagattt

SEQ ID NO: 1092913 - DNA, 22 bp, Artificial Sequence
  chemically synthesized
tgctccttattttatagattta

SEQ ID NO: 1092914 - DNA, 22 bp, Artificial Sequence
  chemically synthesized
cttattttatagatttacagag

SEQ ID NO: 1092915 - DNA, 22 bp, Artificial Sequence
  chemically synthesized
attttatagatttacagagggg

SEQ ID NO: 1092916 - DNA, 22 bp, Artificial Sequence
  chemically synthesized
taagtagtatagcccctctgta

SEQ ID NO: 1092917 - DNA, 22 bp, Artificial Sequence
  chemically synthesized
ttttatagatttacagaggggc

SEQ ID NO: 1092918 - DNA, 22 bp, Artificial Sequence
  chemically synthesized
tatagatttacagaggggctat

SEQ ID NO: 1092919 - DNA, 22 bp, Artificial Sequence
  chemically synthesized
atagatttacagaggggctata

SEQ ID NO: 1092920 - DNA, 22 bp, Artificial Sequence
  chemically synthesized
tagatttacagaggggctatac

SEQ ID NO: 1092921 - DNA, 22 bp, Artificial Sequence
  chemically synthesized
acagaggggctatactacttat

SEQ ID NO: 1092922 - DNA, 22 bp, Artificial Sequence
  chemically synthesized
cagaggggctatactacttata

SEQ ID NO: 1092923 - DNA, 22 bp, Artificial Sequence
  chemically synthesized
tactacttatagctttacgtac

SEQ ID NO: 1092924 - DNA, 22 bp, Artificial Sequence
  chemically synthesized
gaatatgtaatatatgtacgta

SEQ ID NO: 1092925 - DNA, 22 bp, Artificial Sequence
  chemically synthesized
agaatatgtaatatatgtacgt

SEQ ID NO: 1092926 - DNA, 22 bp, Artificial Sequence
  chemically synthesized
cttatagctttacgtacatata

SEQ ID NO: 1092927 - DNA, 22 bp, Artificial Sequence
  chemically synthesized
tagaatatgtaatatatgtacg

SEQ ID NO: 1092928 - DNA, 22 bp, Artificial Sequence
  chemically synthesized
atagctttacgtacatatatta

SEQ ID NO: 1092929 - DNA, 22 bp, Artificial Sequence
  chemically synthesized
ttttagaatatgtaatatatgt

SEQ ID NO: 1092930 - DNA, 22 bp, Artificial Sequence
  chemically synthesized
tagctttacgtacatatattac

SEQ ID NO: 1092931 - DNA, 22 bp, Artificial Sequence
  chemically synthesized
tacgtacatatattacatattc

SEQ ID NO: 1092932 - DNA, 22 bp, Artificial Sequence
  chemically synthesized
acgtacatatattacatattct

SEQ ID NO: 1092933 - DNA, 22 bp, Artificial Sequence
  chemically synthesized
cgtacatatattacatattcta

SEQ ID NO: 1092934 - DNA, 22 bp, Artificial Sequence
  chemically synthesized
tatgtaatgaatatgttgtttt

SEQ ID NO: 1092935 - DNA, 22 bp, Artificial Sequence
  chemically synthesized
catattctaaaacaacatattc

SEQ ID NO: 1092936 - DNA, 22 bp, Artificial Sequence
  chemically synthesized
tctatatgtaatgaatatgttg

SEQ ID NO: 1092937 - DNA, 22 bp, Artificial Sequence
  chemically synthesized
atctatatgtaatgaatatgtt

SEQ ID NO: 1092938 - DNA, 22 bp, Artificial Sequence
  chemically synthesized
acttatctatatgtaatgaata

SEQ ID NO: 1092939 - DNA, 22 bp, Artificial Sequence
  chemically synthesized
gacttatctatatgtaatgaat

SEQ ID NO: 1092940 - DNA, 22 bp, Artificial Sequence
  chemically synthesized
taaaacaacatattcattacat

SEQ ID NO: 1092941 - DNA, 22 bp, Artificial Sequence
  chemically synthesized
tgacttatctatatgtaatgaa

SEQ ID NO: 1092942 - DNA, 22 bp, Artificial Sequence
  chemically synthesized
ttgacttatctatatgtaatga

SEQ ID NO: 1092943 - DNA, 22 bp, Artificial Sequence
  chemically synthesized
aaacaacatattcattacatat

SEQ ID NO: 1092944 - DNA, 22 bp, Artificial Sequence
  chemically synthesized
gtgtacttttgacttatctata

SEQ ID NO: 1092945 - DNA, 22 bp, Artificial Sequence
  chemically synthesized
agtgtacttttgacttatctat

SEQ ID NO: 1092946 - DNA, 22 bp, Artificial Sequence
  chemically synthesized
tagtgtacttttgacttatcta

SEQ ID NO: 1092947 - DNA, 22 bp, Artificial Sequence
  chemically synthesized
attacatatagataagtcaaaa

SEQ ID NO: 1092948 - DNA, 22 bp, Artificial Sequence
  chemically synthesized
tgcattttagtgtacttttgac

SEQ ID NO: 1092949 - DNA, 22 bp, Artificial Sequence
  chemically synthesized
catatagataagtcaaaagtac

SEQ ID NO: 1092950 - DNA, 22 bp, Artificial Sequence
  chemically synthesized
tatgcattttagtgtacttttg

SEQ ID NO: 1092951 - DNA, 22 bp, Artificial Sequence
  chemically synthesized
aagctctatgcattttagtgta

SEQ ID NO: 1092952 - DNA, 22 bp, Artificial Sequence
  chemically synthesized
atcattcaagctctatgcattt

SEQ ID NO: 1092953 - DNA, 22 bp, Artificial Sequence
  chemically synthesized
aatcattcaagctctatgcatt

SEQ ID NO: 1092954 - DNA, 22 bp, Artificial Sequence
  chemically synthesized
acatttaatcattcaagctcta

SEQ ID NO: 1092955 - DNA, 22 bp, Artificial Sequence
  chemically synthesized
tgacatttaatcattcaagctc

SEQ ID NO: 1092956 - DNA, 22 bp, Artificial Sequence
  chemically synthesized
ctgacatttaatcattcaagct

SEQ ID NO: 1092957 - DNA, 22 bp, Artificial Sequence
  chemically synthesized
aaatgcatagagcttgaatgat

SEQ ID NO: 1092958 - DNA, 22 bp, Artificial Sequence
  chemically synthesized
acttctgacatttaatcattca

SEQ ID NO: 1092959 - DNA, 22 bp, Artificial Sequence
  chemically synthesized
aacttctgacatttaatcattc

SEQ ID NO: 1092960 - DNA, 22 bp, Artificial Sequence
  chemically synthesized
taacttctgacatttaatcatt

SEQ ID NO: 1092961 - DNA, 22 bp, Artificial Sequence
  chemically synthesized
actttaacttctgacatttaat

SEQ ID NO: 1092962 - DNA, 22 bp, Artificial Sequence
  chemically synthesized
gactttaacttctgacatttaa

SEQ ID NO: 1092963 - DNA, 22 bp, Artificial Sequence
  chemically synthesized
gaatgattaaatgtcagaagtt

SEQ ID NO: 1092964 - DNA, 22 bp, Artificial Sequence
  chemically synthesized
aatgattaaatgtcagaagtta

SEQ ID NO: 1092965 - DNA, 22 bp, Artificial Sequence
  chemically synthesized
taaacttgactttaacttctga

SEQ ID NO: 1092966 - DNA, 22 bp, Artificial Sequence
  chemically synthesized
ataaacttgactttaacttctg

SEQ ID NO: 1092967 - DNA, 22 bp, Artificial Sequence
  chemically synthesized
catttataaacttgactttaac

SEQ ID NO: 1092968 - DNA, 22 bp, Artificial Sequence
  chemically synthesized
gcatttataaacttgactttaa

SEQ ID NO: 1092969 - DNA, 22 bp, Artificial Sequence
  chemically synthesized
aatgtcagaagttaaagtcaag

SEQ ID NO: 1092970 - DNA, 22 bp, Artificial Sequence
  chemically synthesized
aatgagtttgcatttataaact

SEQ ID NO: 1092971 - DNA, 22 bp, Artificial Sequence
  chemically synthesized
aagtcaagtttataaatgcaaa

SEQ ID NO: 1092972 - DNA, 22 bp, Artificial Sequence
  chemically synthesized
aataattaaatgagtttgcatt

SEQ ID NO: 1092973 - DNA, 22 bp, Artificial Sequence
  chemically synthesized
caataattaaatgagtttgcat

SEQ ID NO: 1092974 - DNA, 22 bp, Artificial Sequence
  chemically synthesized
tcaataattaaatgagtttgca

SEQ ID NO: 1092975 - DNA, 22 bp, Artificial Sequence
  chemically synthesized
ataaatgcaaactcatttaatt

SEQ ID NO: 1092976 - DNA, 22 bp, Artificial Sequence
  chemically synthesized
gagactttcaataattaaatga

SEQ ID NO: 1092977 - DNA, 22 bp, Artificial Sequence
  chemically synthesized
taaatgcaaactcatttaatta

SEQ ID NO: 1092978 - DNA, 22 bp, Artificial Sequence
  chemically synthesized
ggagactttcaataattaaatg

SEQ ID NO: 1092979 - DNA, 22 bp, Artificial Sequence
  chemically synthesized
tggagactttcaataattaaat

SEQ ID NO: 1092980 - DNA, 22 bp, Artificial Sequence
  chemically synthesized
ctttggagactttcaataatta

SEQ ID NO: 1092981 - DNA, 22 bp, Artificial Sequence
  chemically synthesized
actttggagactttcaataatt

SEQ ID NO: 1092982 - DNA, 22 bp, Artificial Sequence
  chemically synthesized
tactttggagactttcaataat

SEQ ID NO: 1092983 - DNA, 22 bp, Artificial Sequence
  chemically synthesized
agttttactttggagactttca

SEQ ID NO: 1092984 - DNA, 22 bp, Artificial Sequence
  chemically synthesized
aagttttactttggagactttc

SEQ ID NO: 1092985 - DNA, 22 bp, Artificial Sequence
  chemically synthesized
atttaattattgaaagtctcca

SEQ ID NO: 1092986 - DNA, 22 bp, Artificial Sequence
  chemically synthesized
taagttttactttggagacttt

SEQ ID NO: 1092987 - DNA, 22 bp, Artificial Sequence
  chemically synthesized
ttaagttttactttggagactt

SEQ ID NO: 1092988 - DNA, 22 bp, Artificial Sequence
  chemically synthesized
aattattgaaagtctccaaagt

SEQ ID NO: 1092989 - DNA, 22 bp, Artificial Sequence
  chemically synthesized
attattgaaagtctccaaagta

SEQ ID NO: 1092990 - DNA, 22 bp, Artificial Sequence
  chemically synthesized
ttgaaagtctccaaagtaaaac

SEQ ID NO: 1092991 - DNA, 22 bp, Artificial Sequence
  chemically synthesized
aaagtctccaaagtaaaactta

SEQ ID NO: 1092992 - DNA, 22 bp, Artificial Sequence
  chemically synthesized
caaagtaaaacttaaaaatgta

SEQ ID NO: 1092993 - DNA, 22 bp, Artificial Sequence
  chemically synthesized
ataaaatgtaagtacattttta

SEQ ID NO: 1092994 - DNA, 22 bp, Artificial Sequence
  chemically synthesized
aagtattcataaaatgtaagta

SEQ ID NO: 1092995 - DNA, 22 bp, Artificial Sequence
  chemically synthesized
aaagtattcataaaatgtaagt

SEQ ID NO: 1092996 - DNA, 22 bp, Artificial Sequence
  chemically synthesized
taaagtattcataaaatgtaag

SEQ ID NO: 1092997 - DNA, 22 bp, Artificial Sequence
  chemically synthesized
aaaaatgtacttacattttatg

SEQ ID NO: 1092998 - DNA, 22 bp, Artificial Sequence
  chemically synthesized
aaaatgtacttacattttatga

SEQ ID NO: 1092999 - DNA, 22 bp, Artificial Sequence
  chemically synthesized
gaaatatatctttaaagtattc

SEQ ID NO: 1093000 - DNA, 22 bp, Artificial Sequence
  chemically synthesized
acattttatgaatactttaaag

SEQ ID NO: 1093001 - DNA, 22 bp, Artificial Sequence
  chemically synthesized
cattttatgaatactttaaaga

SEQ ID NO: 1093002 - DNA, 22 bp, Artificial Sequence
  chemically synthesized
atattggaaatatatctttaaa

SEQ ID NO: 1093003 - DNA, 22 bp, Artificial Sequence
  chemically synthesized
aatattggaaatatatctttaa

SEQ ID NO: 1093004 - DNA, 22 bp, Artificial Sequence
  chemically synthesized
taatattggaaatatatcttta

SEQ ID NO: 1093005 - DNA, 22 bp, Artificial Sequence
  chemically synthesized
tatgaatactttaaagatatat

SEQ ID NO: 1093006 - DNA, 22 bp, Artificial Sequence
  chemically synthesized
atgaatactttaaagatatatt

SEQ ID NO: 1093007 - DNA, 22 bp, Artificial Sequence
  chemically synthesized
tgaatactttaaagatatattt

SEQ ID NO: 1093008 - DNA, 22 bp, Artificial Sequence
  chemically synthesized
taaagatatatttccaatatta

SEQ ID NO: 1093009 - DNA, 22 bp, Artificial Sequence
  chemically synthesized
aaagatatatttccaatattaa

SEQ ID NO: 1093010 - DNA, 22 bp, Artificial Sequence
  chemically synthesized
aatggatatgctttaatattgg

SEQ ID NO: 1093011 - DNA, 22 bp, Artificial Sequence
  chemically synthesized
aagatatatttccaatattaaa

SEQ ID NO: 1093012 - DNA, 22 bp, Artificial Sequence
  chemically synthesized
ttaaatggatatgctttaatat

SEQ ID NO: 1093013 - DNA, 22 bp, Artificial Sequence
  chemically synthesized
agttattaaatggatatgcttt

SEQ ID NO: 1093014 - DNA, 22 bp, Artificial Sequence
  chemically synthesized
gagttattaaatggatatgctt

SEQ ID NO: 1093015 - DNA, 22 bp, Artificial Sequence
  chemically synthesized
tgagttattaaatggatatgct

SEQ ID NO: 1093016 - DNA, 22 bp, Artificial Sequence
  chemically synthesized
ccaatattaaagcatatccatt

SEQ ID NO: 1093017 - DNA, 22 bp, Artificial Sequence
  chemically synthesized
caatattaaagcatatccattt

SEQ ID NO: 1093018 - DNA, 22 bp, Artificial Sequence
  chemically synthesized
cggaatgttttgagttattaaa

SEQ ID NO: 1093019 - DNA, 22 bp, Artificial Sequence
  chemically synthesized
aagcatatccatttaataactc

SEQ ID NO: 1093020 - DNA, 22 bp, Artificial Sequence
  chemically synthesized
acggaatgttttgagttattaa

SEQ ID NO: 1093021 - DNA, 22 bp, Artificial Sequence
  chemically synthesized
caccttacggaatgttttgagt

SEQ ID NO: 1093022 - DNA, 22 bp, Artificial Sequence
  chemically synthesized
acaccttacggaatgttttgag

SEQ ID NO: 1093023 - DNA, 22 bp, Artificial Sequence
  chemically synthesized
aataactcaaaacattccgtaa

SEQ ID NO: 1093024 - DNA, 22 bp, Artificial Sequence
  chemically synthesized
ataactcaaaacattccgtaag

SEQ ID NO: 1093025 - DNA, 22 bp, Artificial Sequence
  chemically synthesized
aaatcacaaatttacaccttac

SEQ ID NO: 1093026 - DNA, 22 bp, Artificial Sequence
  chemically synthesized
aaaatcacaaatttacacctta

SEQ ID NO: 1093027 - DNA, 22 bp, Artificial Sequence
  chemically synthesized
aaaacattccgtaaggtgtaaa

SEQ ID NO: 1093028 - DNA, 22 bp, Artificial Sequence
  chemically synthesized
cttaaaatcacaaatttacacc

SEQ ID NO: 1093029 - DNA, 22 bp, Artificial Sequence
  chemically synthesized
acttaaaatcacaaatttacac

SEQ ID NO: 1093030 - DNA, 22 bp, Artificial Sequence
  chemically synthesized
tacttacttaaaatcacaaatt

SEQ ID NO: 1093031 - DNA, 22 bp, Artificial Sequence
  chemically synthesized
cgtaaggtgtaaatttgtgatt

SEQ ID NO: 1093032 - DNA, 22 bp, Artificial Sequence
  chemically synthesized
atacttacttaaaatcacaaat

SEQ ID NO: 1093033 - DNA, 22 bp, Artificial Sequence
  chemically synthesized
tatacttacttaaaatcacaaa

SEQ ID NO: 1093034 - DNA, 22 bp, Artificial Sequence
  chemically synthesized
ttttatacttacttaaaatcac

SEQ ID NO: 1093035 - DNA, 22 bp, Artificial Sequence
  chemically synthesized
gaacctattttatacttactta

SEQ ID NO: 1093036 - DNA, 22 bp, Artificial Sequence
  chemically synthesized
gtgattttaagtaagtataaaa

SEQ ID NO: 1093037 - DNA, 22 bp, Artificial Sequence
  chemically synthesized
aattggaacctattttatactt

SEQ ID NO: 1093038 - DNA, 22 bp, Artificial Sequence
  chemically synthesized
tgattttaagtaagtataaaat

SEQ ID NO: 1093039 - DNA, 22 bp, Artificial Sequence
  chemically synthesized
taagtaagtataaaataggttc

SEQ ID NO: 1093040 - DNA, 22 bp, Artificial Sequence
  chemically synthesized
aagtaagtataaaataggttcc

SEQ ID NO: 1093041 - DNA, 22 bp, Artificial Sequence
  chemically synthesized
agtaagtataaaataggttcca

SEQ ID NO: 1093042 - DNA, 22 bp, Artificial Sequence
  chemically synthesized
cacgtattgaattggaacctat

SEQ ID NO: 1093043 - DNA, 22 bp, Artificial Sequence
  chemically synthesized
aaagctgcacgtattgaattgg

SEQ ID NO: 1093044 - DNA, 22 bp, Artificial Sequence
  chemically synthesized
aaaagctgcacgtattgaattg

SEQ ID NO: 1093045 - DNA, 22 bp, Artificial Sequence
  chemically synthesized
cagtttaaaagctgcacgtatt

SEQ ID NO: 1093046 - DNA, 22 bp, Artificial Sequence
  chemically synthesized
ccagtttaaaagctgcacgtat

SEQ ID NO: 1093047 - DNA, 22 bp, Artificial Sequence
  chemically synthesized
tttccagtttaaaagctgcacg

SEQ ID NO: 1093048 - DNA, 22 bp, Artificial Sequence
  chemically synthesized
caattcaatacgtgcagctttt

SEQ ID NO: 1093049 - DNA, 22 bp, Artificial Sequence
  chemically synthesized
aatacgtgcagcttttaaactg

SEQ ID NO: 1093050 - DNA, 22 bp, Artificial Sequence
  chemically synthesized
ttaaactggaaataatatttca

SEQ ID NO: 1093051 - DNA, 22 bp, Artificial Sequence
  chemically synthesized
taaactggaaataatatttcat

SEQ ID NO: 1093052 - DNA, 22 bp, Artificial Sequence
  chemically synthesized
aaactggaaataatatttcata

SEQ ID NO: 1093053 - DNA, 22 bp, Artificial Sequence
  chemically synthesized
aactggaaataatatttcatat

SEQ ID NO: 1093054 - DNA, 22 bp, Artificial Sequence
  chemically synthesized
atcgggatgataatatgaaata

SEQ ID NO: 1093055 - DNA, 22 bp, Artificial Sequence
  chemically synthesized
gaaataatatttcatattatca

SEQ ID NO: 1093056 - DNA, 22 bp, Artificial Sequence
  chemically synthesized
gggctaatcgggatgataatat

SEQ ID NO: 1093057 - DNA, 22 bp, Artificial Sequence
  chemically synthesized
agggctaatcgggatgataata

SEQ ID NO: 1093058 - DNA, 22 bp, Artificial Sequence
  chemically synthesized
tagggctaatcgggatgataat

SEQ ID NO: 1093059 - DNA, 22 bp, Artificial Sequence
  chemically synthesized
ctttagggctaatcgggatgat

SEQ ID NO: 1093060 - DNA, 22 bp, Artificial Sequence
  chemically synthesized
actgctttagggctaatcggga

SEQ ID NO: 1093061 - DNA, 22 bp, Artificial Sequence
  chemically synthesized
catattatcatcccgattagcc

SEQ ID NO: 1093062 - DNA, 22 bp, Artificial Sequence
  chemically synthesized
atattatcatcccgattagccc

SEQ ID NO: 1093063 - DNA, 22 bp, Artificial Sequence
  chemically synthesized
tcatcccgattagccctaaagc

SEQ ID NO: 1093064 - DNA, 22 bp, Artificial Sequence
  chemically synthesized
gccctaaagcagtgagtttgtt

SEQ ID NO: 1093065 - DNA, 22 bp, Artificial Sequence
  chemically synthesized
caaagacagtgtgaataaacaa

SEQ ID NO: 1093066 - DNA, 22 bp, Artificial Sequence
  chemically synthesized
aagcagtgagtttgtttattca

SEQ ID NO: 1093067 - DNA, 22 bp, Artificial Sequence
  chemically synthesized
gtttattcacactgtctttgca

SEQ ID NO: 1093068 - DNA, 22 bp, Artificial Sequence
  chemically synthesized
tttattcacactgtctttgcag

SEQ ID NO: 1093069 - DNA, 22 bp, Artificial Sequence
  chemically synthesized
aatgtaccacaaacctgcaaag

SEQ ID NO: 1093070 - DNA, 22 bp, Artificial Sequence
  chemically synthesized
attcacactgtctttgcaggtt

SEQ ID NO: 1093071 - DNA, 22 bp, Artificial Sequence
  chemically synthesized
ttcacactgtctttgcaggttt

SEQ ID NO: 1093072 - DNA, 22 bp, Artificial Sequence
  chemically synthesized
attaaatgtaccacaaacctgc

SEQ ID NO: 1093073 - DNA, 22 bp, Artificial Sequence
  chemically synthesized
acactgtctttgcaggtttgtg

SEQ ID NO: 1093074 - DNA, 22 bp, Artificial Sequence
  chemically synthesized
acctaattaaatgtaccacaaa

SEQ ID NO: 1093075 - DNA, 22 bp, Artificial Sequence
  chemically synthesized
cacctaattaaatgtaccacaa

SEQ ID NO: 1093076 - DNA, 22 bp, Artificial Sequence
  chemically synthesized
tctttgcaggtttgtggtacat

SEQ ID NO: 1093077 - DNA, 22 bp, Artificial Sequence
  chemically synthesized
tgcaggtttgtggtacatttaa

SEQ ID NO: 1093078 - DNA, 22 bp, Artificial Sequence
  chemically synthesized
gcaggtttgtggtacatttaat

SEQ ID NO: 1093079 - DNA, 22 bp, Artificial Sequence
  chemically synthesized
caggtttgtggtacatttaatt

SEQ ID NO: 1093080 - DNA, 22 bp, Artificial Sequence
  chemically synthesized
catagatgcttcacctaattaa

SEQ ID NO: 1093081 - DNA, 22 bp, Artificial Sequence
  chemically synthesized
tacatagatgcttcacctaatt

SEQ ID NO: 1093082 - DNA, 22 bp, Artificial Sequence
  chemically synthesized
gtggtacatttaattaggtgaa

SEQ ID NO: 1093083 - DNA, 22 bp, Artificial Sequence
  chemically synthesized
tggtacatttaattaggtgaag

SEQ ID NO: 1093084 - DNA, 22 bp, Artificial Sequence
  chemically synthesized
agttctacatagatgcttcacc

SEQ ID NO: 1093085 - DNA, 22 bp, Artificial Sequence
  chemically synthesized
aattaggtgaagcatctatgta

SEQ ID NO: 1093086 - DNA, 22 bp, Artificial Sequence
  chemically synthesized
attaggtgaagcatctatgtag

SEQ ID NO: 1093087 - DNA, 22 bp, Artificial Sequence
  chemically synthesized
tatcactaagttctacatagat

SEQ ID NO: 1093088 - DNA, 22 bp, Artificial Sequence
  chemically synthesized
ttatatcactaagttctacata

SEQ ID NO: 1093089 - DNA, 22 bp, Artificial Sequence
  chemically synthesized
ggtgaagcatctatgtagaact

SEQ ID NO: 1093090 - DNA, 22 bp, Artificial Sequence
  chemically synthesized
attatatcactaagttctacat

SEQ ID NO: 1093091 - DNA, 22 bp, Artificial Sequence
  chemically synthesized
tattatatcactaagttctaca

SEQ ID NO: 1093092 - DNA, 22 bp, Artificial Sequence
  chemically synthesized
cctttattatatcactaagttc

SEQ ID NO: 1093093 - DNA, 22 bp, Artificial Sequence
  chemically synthesized
gcctttattatatcactaagtt

SEQ ID NO: 1093094 - DNA, 22 bp, Artificial Sequence
  chemically synthesized
tgtagaacttagtgatataata

SEQ ID NO: 1093095 - DNA, 22 bp, Artificial Sequence
  chemically synthesized
acagaggaaatttgcctttatt

SEQ ID NO: 1093096 - DNA, 22 bp, Artificial Sequence
  chemically synthesized
tcacagaggaaatttgccttta

SEQ ID NO: 1093097 - DNA, 22 bp, Artificial Sequence
  chemically synthesized
ctcacagaggaaatttgccttt

SEQ ID NO: 1093098 - DNA, 22 bp, Artificial Sequence
  chemically synthesized
agtgatataataaaggcaaatt

SEQ ID NO: 1093099 - DNA, 22 bp, Artificial Sequence
  chemically synthesized
gtgatataataaaggcaaattt

SEQ ID NO: 1093100 - DNA, 22 bp, Artificial Sequence
  chemically synthesized
aatggcttctcacagaggaaat

SEQ ID NO: 1093101 - DNA, 22 bp, Artificial Sequence
  chemically synthesized
aaatggcttctcacagaggaaa

SEQ ID NO: 1093102 - DNA, 22 bp, Artificial Sequence
  chemically synthesized
caaagggtttaaatggcttctc

SEQ ID NO: 1093103 - DNA, 22 bp, Artificial Sequence
  chemically synthesized
gcaaagggtttaaatggcttct

SEQ ID NO: 1093104 - DNA, 22 bp, Artificial Sequence
  chemically synthesized
tgcaaagggtttaaatggcttc

SEQ ID NO: 1093105 - DNA, 22 bp, Artificial Sequence
  chemically synthesized
cctctgtgagaagccatttaaa

SEQ ID NO: 1093106 - DNA, 22 bp, Artificial Sequence
  chemically synthesized
ctctgtgagaagccatttaaac

SEQ ID NO: 1093107 - DNA, 22 bp, Artificial Sequence
  chemically synthesized
tgtgagaagccatttaaaccct

SEQ ID NO: 1093108 - DNA, 22 bp, Artificial Sequence
  chemically synthesized
tgagaagccatttaaacccttt

SEQ ID NO: 1093109 - DNA, 22 bp, Artificial Sequence
  chemically synthesized
ggtcacaagattttgcaaaggg

SEQ ID NO: 1093110 - DNA, 22 bp, Artificial Sequence
  chemically synthesized
taggtcacaagattttgcaaag

SEQ ID NO: 1093111 - DNA, 22 bp, Artificial Sequence
  chemically synthesized
ctaggtcacaagattttgcaaa

SEQ ID NO: 1093112 - DNA, 22 bp, Artificial Sequence
  chemically synthesized
aaaccctttgcaaaatcttgtg

SEQ ID NO: 1093113 - DNA, 22 bp, Artificial Sequence
  chemically synthesized
aaccctttgcaaaatcttgtga

SEQ ID NO: 1093114 - DNA, 22 bp, Artificial Sequence
  chemically synthesized
ataaccttctaggtcacaagat

SEQ ID NO: 1093115 - DNA, 22 bp, Artificial Sequence
  chemically synthesized
tgcaaaatcttgtgacctagaa

SEQ ID NO: 1093116 - DNA, 22 bp, Artificial Sequence
  chemically synthesized
cccctaataaccttctaggtca

SEQ ID NO: 1093117 - DNA, 22 bp, Artificial Sequence
  chemically synthesized
gcaaaatcttgtgacctagaag

SEQ ID NO: 1093118 - DNA, 22 bp, Artificial Sequence
  chemically synthesized
caaaatcttgtgacctagaagg

SEQ ID NO: 1093119 - DNA, 22 bp, Artificial Sequence
  chemically synthesized
ttccccctaataaccttctagg

SEQ ID NO: 1093120 - DNA, 22 bp, Artificial Sequence
  chemically synthesized
gttccccctaataaccttctag

SEQ ID NO: 1093121 - DNA, 22 bp, Artificial Sequence
  chemically synthesized
tgttccccctaataaccttcta

SEQ ID NO: 1093122 - DNA, 22 bp, Artificial Sequence
  chemically synthesized
gtgacctagaaggttattaggg

SEQ ID NO: 1093123 - DNA, 22 bp, Artificial Sequence
  chemically synthesized
tgacctagaaggttattagggg

SEQ ID NO: 1093124 - DNA, 22 bp, Artificial Sequence
  chemically synthesized
gataaagcctttgttcccccta

SEQ ID NO: 1093125 - DNA, 22 bp, Artificial Sequence
  chemically synthesized
ggataaagcctttgttccccct

SEQ ID NO: 1093126 - DNA, 22 bp, Artificial Sequence
  chemically synthesized
tggataaagcctttgttccccc

SEQ ID NO: 1093127 - DNA, 22 bp, Artificial Sequence
  chemically synthesized
gaaggttattagggggaacaaa

SEQ ID NO: 1093128 - DNA, 22 bp, Artificial Sequence
  chemically synthesized
gtactttggataaagcctttgt

SEQ ID NO: 1093129 - DNA, 22 bp, Artificial Sequence
  chemically synthesized
ttagggggaacaaaggctttat

SEQ ID NO: 1093130 - DNA, 22 bp, Artificial Sequence
  chemically synthesized
gggggaacaaaggctttatcca

SEQ ID NO: 1093131 - DNA, 22 bp, Artificial Sequence
  chemically synthesized
agcactggtactttggataaag

SEQ ID NO: 1093132 - DNA, 22 bp, Artificial Sequence
  chemically synthesized
tcactcagcactggtactttgg

SEQ ID NO: 1093133 - DNA, 22 bp, Artificial Sequence
  chemically synthesized
tgttatcactcagcactggtac

SEQ ID NO: 1093134 - DNA, 22 bp, Artificial Sequence
  chemically synthesized
ctatgttatcactcagcactgg

SEQ ID NO: 1093135 - DNA, 22 bp, Artificial Sequence
  chemically synthesized
tatccaaagtaccagtgctgag

SEQ ID NO: 1093136 - DNA, 22 bp, Artificial Sequence
  chemically synthesized
atccaaagtaccagtgctgagt

SEQ ID NO: 1093137 - DNA, 22 bp, Artificial Sequence
  chemically synthesized
tccaaagtaccagtgctgagtg

SEQ ID NO: 1093138 - DNA, 22 bp, Artificial Sequence
  chemically synthesized
agtgataacatagtaattatac

SEQ ID NO: 1093139 - DNA, 22 bp, Artificial Sequence
  chemically synthesized
tactctcttgggttgttttctt

SEQ ID NO: 1093140 - DNA, 22 bp, Artificial Sequence
  chemically synthesized
tcttgggttgttttctttggat

SEQ ID NO: 1093141 - DNA, 22 bp, Artificial Sequence
  chemically synthesized
ttgggttgttttctttggattt

SEQ ID NO: 1093142 - DNA, 22 bp, Artificial Sequence
  chemically synthesized
gggttgttttctttggatttgt

SEQ ID NO: 1093143 - DNA, 22 bp, Artificial Sequence
  chemically synthesized
ggttgttttctttggatttgtc

SEQ ID NO: 1093144 - DNA, 22 bp, Artificial Sequence
  chemically synthesized
ttttctttggatttgtcttcta

SEQ ID NO: 1093145 - DNA, 22 bp, Artificial Sequence
  chemically synthesized
tctttggatttgtcttctattt

SEQ ID NO: 1093146 - DNA, 22 bp, Artificial Sequence
  chemically synthesized
ctttggatttgtcttctatttg

SEQ ID NO: 1093147 - DNA, 22 bp, Artificial Sequence
  chemically synthesized
tttggatttgtcttctatttgg

SEQ ID NO: 1093148 - DNA, 22 bp, Artificial Sequence
  chemically synthesized
tggatttgtcttctatttggta

SEQ ID NO: 1093149 - DNA, 22 bp, Artificial Sequence
  chemically synthesized
aaagaggtcaagtaccaaatag

SEQ ID NO: 1093150 - DNA, 22 bp, Artificial Sequence
  chemically synthesized
ggatttgtcttctatttggtac

SEQ ID NO: 1093151 - DNA, 22 bp, Artificial Sequence
  chemically synthesized
gatttgtcttctatttggtact

SEQ ID NO: 1093152 - DNA, 22 bp, Artificial Sequence
  chemically synthesized
gtcttctatttggtacttgacc

SEQ ID NO: 1093153 - DNA, 22 bp, Artificial Sequence
  chemically synthesized
tcttctatttggtacttgacct

SEQ ID NO: 1093154 - DNA, 22 bp, Artificial Sequence
  chemically synthesized
ctatttggtacttgacctcttt

SEQ ID NO: 1093155 - DNA, 22 bp, Artificial Sequence
  chemically synthesized
tatgcagtattaaaagaggtca

SEQ ID NO: 1093156 - DNA, 22 bp, Artificial Sequence
  chemically synthesized
tatttggtacttgacctctttt

SEQ ID NO: 1093157 - DNA, 22 bp, Artificial Sequence
  chemically synthesized
atatgcagtattaaaagaggtc

SEQ ID NO: 1093158 - DNA, 22 bp, Artificial Sequence
  chemically synthesized
tttggtacttgacctcttttaa

SEQ ID NO: 1093159 - DNA, 22 bp, Artificial Sequence
  chemically synthesized
ggtacttgacctcttttaatac

SEQ ID NO: 1093160 - DNA, 22 bp, Artificial Sequence
  chemically synthesized
gtacttgacctcttttaatact

SEQ ID NO: 1093161 - DNA, 22 bp, Artificial Sequence
  chemically synthesized
gacctcttttaatactgcatat

SEQ ID NO: 1093162 - DNA, 22 bp, Artificial Sequence
  chemically synthesized
acctcttttaatactgcatata

SEQ ID NO: 1093163 - DNA, 22 bp, Artificial Sequence
  chemically synthesized
ttttaatactgcatataaatta

SEQ ID NO: 1093164 - DNA, 22 bp, Artificial Sequence
  chemically synthesized
agccaaatgatgataatttata

SEQ ID NO: 1093165 - DNA, 22 bp, Artificial Sequence
  chemically synthesized
ttaatactgcatataaattatc

SEQ ID NO: 1093166 - DNA, 22 bp, Artificial Sequence
  chemically synthesized
taatactgcatataaattatca

SEQ ID NO: 1093167 - DNA, 22 bp, Artificial Sequence
  chemically synthesized
aatactgcatataaattatcat

SEQ ID NO: 1093168 - DNA, 22 bp, Artificial Sequence
  chemically synthesized
atactgcatataaattatcatc

SEQ ID NO: 1093169 - DNA, 22 bp, Artificial Sequence
  chemically synthesized
taaattaagccaaatgatgata

SEQ ID NO: 1093170 - DNA, 22 bp, Artificial Sequence
  chemically synthesized
catataaattatcatcatttgg

SEQ ID NO: 1093171 - DNA, 22 bp, Artificial Sequence
  chemically synthesized
gatgtaagttgtaaattaagcc

SEQ ID NO: 1093172 - DNA, 22 bp, Artificial Sequence
  chemically synthesized
tcatcatttggcttaatttaca

SEQ ID NO: 1093173 - DNA, 22 bp, Artificial Sequence
  chemically synthesized
aggtgctagatgtaagttgtaa

SEQ ID NO: 1093174 - DNA, 22 bp, Artificial Sequence
  chemically synthesized
tgaggtgctagatgtaagttgt

SEQ ID NO: 1093175 - DNA, 22 bp, Artificial Sequence
  chemically synthesized
ggcttaatttacaacttacatc

SEQ ID NO: 1093176 - DNA, 22 bp, Artificial Sequence
  chemically synthesized
gcttaatttacaacttacatct

SEQ ID NO: 1093177 - DNA, 22 bp, Artificial Sequence
  chemically synthesized
aatttacaacttacatctagca

SEQ ID NO: 1093178 - DNA, 22 bp, Artificial Sequence
  chemically synthesized
atttacaacttacatctagcac

SEQ ID NO: 1093179 - DNA, 22 bp, Artificial Sequence
  chemically synthesized
aggaaatctctgaggtgctaga

SEQ ID NO: 1093180 - DNA, 22 bp, Artificial Sequence
  chemically synthesized
acaacttacatctagcacctca

SEQ ID NO: 1093181 - DNA, 22 bp, Artificial Sequence
  chemically synthesized
caacttacatctagcacctcag

SEQ ID NO: 1093182 - DNA, 22 bp, Artificial Sequence
  chemically synthesized
acatctagcacctcagagattt

SEQ ID NO: 1093183 - DNA, 22 bp, Artificial Sequence
  chemically synthesized
gcggagctgaggaaatctctga

SEQ ID NO: 1093184 - DNA, 22 bp, Artificial Sequence
  chemically synthesized
catctagcacctcagagatttc

SEQ ID NO: 1093185 - DNA, 22 bp, Artificial Sequence
  chemically synthesized
ctggcggagctgaggaaatctc

SEQ ID NO: 1093186 - DNA, 22 bp, Artificial Sequence
  chemically synthesized
gcacctcagagatttcctcagc

SEQ ID NO: 1093187 - DNA, 22 bp, Artificial Sequence
  chemically synthesized
aaaacattcctggcggagctga

SEQ ID NO: 1093188 - DNA, 22 bp, Artificial Sequence
  chemically synthesized
agagatttcctcagctccgcca

SEQ ID NO: 1093189 - DNA, 22 bp, Artificial Sequence
  chemically synthesized
aaaccactgaaaacattcctgg

SEQ ID NO: 1093190 - DNA, 22 bp, Artificial Sequence
  chemically synthesized
cctcagctccgccaggaatgtt

SEQ ID NO: 1093191 - DNA, 22 bp, Artificial Sequence
  chemically synthesized
aaaaccactgaaaacattcctg

SEQ ID NO: 1093192 - DNA, 22 bp, Artificial Sequence
  chemically synthesized
ctcagctccgccaggaatgttt

SEQ ID NO: 1093193 - DNA, 22 bp, Artificial Sequence
  chemically synthesized
agctccgccaggaatgttttca

SEQ ID NO: 1093194 - DNA, 22 bp, Artificial Sequence
  chemically synthesized
aacttaaaaccactgaaaacat

SEQ ID NO: 1093195 - DNA, 22 bp, Artificial Sequence
  chemically synthesized
aaacttaaaaccactgaaaaca

SEQ ID NO: 1093196 - DNA, 22 bp, Artificial Sequence
  chemically synthesized
cgccaggaatgttttcagtggt

SEQ ID NO: 1093197 - DNA, 22 bp, Artificial Sequence
  chemically synthesized
aatgaagtagaatttaaactta

SEQ ID NO: 1093198 - DNA, 22 bp, Artificial Sequence
  chemically synthesized
tcagtggttttaagtttaaatt

SEQ ID NO: 1093199 - DNA, 22 bp, Artificial Sequence
  chemically synthesized
cagtggttttaagtttaaattc

SEQ ID NO: 1093200 - DNA, 22 bp, Artificial Sequence
  chemically synthesized
agtggttttaagtttaaattct

SEQ ID NO: 1093201 - DNA, 22 bp, Artificial Sequence
  chemically synthesized
taagtttaaattctacttcatt

SEQ ID NO: 1093202 - DNA, 22 bp, Artificial Sequence
  chemically synthesized
aagtttaaattctacttcattt

SEQ ID NO: 1093203 - DNA, 22 bp, Artificial Sequence
  chemically synthesized
agtttaaattctacttcattta

SEQ ID NO: 1093204 - DNA, 22 bp, Artificial Sequence
  chemically synthesized
aaattctacttcatttagccac

SEQ ID NO: 1093205 - DNA, 22 bp, Artificial Sequence
  chemically synthesized
aattctacttcatttagccact

SEQ ID NO: 1093206 - DNA, 22 bp, Artificial Sequence
  chemically synthesized
gagaaagcaaacaagtggctaa

SEQ ID NO: 1093207 - DNA, 22 bp, Artificial Sequence
  chemically synthesized
ggagaaagcaaacaagtggcta

SEQ ID NO: 1093208 - DNA, 22 bp, Artificial Sequence
  chemically synthesized
tacttcatttagccacttgttt

SEQ ID NO: 1093209 - DNA, 22 bp, Artificial Sequence
  chemically synthesized
cttcatttagccacttgtttgc

SEQ ID NO: 1093210 - DNA, 22 bp, Artificial Sequence
  chemically synthesized
catttagccacttgtttgcttt

SEQ ID NO: 1093211 - DNA, 22 bp, Artificial Sequence
  chemically synthesized
tcatacttggagaaagcaaaca

SEQ ID NO: 1093212 - DNA, 22 bp, Artificial Sequence
  chemically synthesized
atttagccacttgtttgctttc

SEQ ID NO: 1093213 - DNA, 22 bp, Artificial Sequence
  chemically synthesized
ttgtcatacttggagaaagcaa

SEQ ID NO: 1093214 - DNA, 22 bp, Artificial Sequence
  chemically synthesized
agccacttgtttgctttctcca

SEQ ID NO: 1093215 - DNA, 22 bp, Artificial Sequence
  chemically synthesized
gccacttgtttgctttctccaa

SEQ ID NO: 1093216 - DNA, 22 bp, Artificial Sequence
  chemically synthesized
gtttgctttctccaagtatgac

SEQ ID NO: 1093217 - DNA, 22 bp, Artificial Sequence
  chemically synthesized
gcatgagttattgtcatacttg

SEQ ID NO: 1093218 - DNA, 22 bp, Artificial Sequence
  chemically synthesized
tttgctttctccaagtatgaca

SEQ ID NO: 1093219 - DNA, 22 bp, Artificial Sequence
  chemically synthesized
gctttctccaagtatgacaata

SEQ ID NO: 1093220 - DNA, 22 bp, Artificial Sequence
  chemically synthesized
ctttctccaagtatgacaataa

SEQ ID NO: 1093221 - DNA, 22 bp, Artificial Sequence
  chemically synthesized
tctccaagtatgacaataactc

SEQ ID NO: 1093222 - DNA, 22 bp, Artificial Sequence
  chemically synthesized
ctccaagtatgacaataactca

SEQ ID NO: 1093223 - DNA, 22 bp, Artificial Sequence
  chemically synthesized
ggcatgttggcatgagttattg

SEQ ID NO: 1093224 - DNA, 22 bp, Artificial Sequence
  chemically synthesized
tccaagtatgacaataactcat

SEQ ID NO: 1093225 - DNA, 22 bp, Artificial Sequence
  chemically synthesized
gggcatgttggcatgagttatt

SEQ ID NO: 1093226 - DNA, 22 bp, Artificial Sequence
  chemically synthesized
caagtatgacaataactcatgc

SEQ ID NO: 1093227 - DNA, 22 bp, Artificial Sequence
  chemically synthesized
ggaagtttgggcatgttggcat

SEQ ID NO: 1093228 - DNA, 22 bp, Artificial Sequence
  chemically synthesized
aggaagtttgggcatgttggca

SEQ ID NO: 1093229 - DNA, 22 bp, Artificial Sequence
  chemically synthesized
ttaggaagtttgggcatgttgg

SEQ ID NO: 1093230 - DNA, 22 bp, Artificial Sequence
  chemically synthesized
cttaggaagtttgggcatgttg

SEQ ID NO: 1093231 - DNA, 22 bp, Artificial Sequence
  chemically synthesized
tcttaggaagtttgggcatgtt

SEQ ID NO: 1093232 - DNA, 22 bp, Artificial Sequence
  chemically synthesized
tttcttaggaagtttgggcatg

SEQ ID NO: 1093233 - DNA, 22 bp, Artificial Sequence
  chemically synthesized
ctttcttaggaagtttgggcat

SEQ ID NO: 1093234 - DNA, 22 bp, Artificial Sequence
  chemically synthesized
atgccaacatgcccaaacttcc

SEQ ID NO: 1093235 - DNA, 22 bp, Artificial Sequence
  chemically synthesized
tgatatatatttctttcttagg

SEQ ID NO: 1093236 - DNA, 22 bp, Artificial Sequence
  chemically synthesized
atctgtgatatatatttctttc

SEQ ID NO: 1093237 - DNA, 22 bp, Artificial Sequence
  chemically synthesized
aatctgtgatatatatttcttt

SEQ ID NO: 1093238 - DNA, 22 bp, Artificial Sequence
  chemically synthesized
cctaagaaagaaatatatatca

SEQ ID NO: 1093239 - DNA, 22 bp, Artificial Sequence
  chemically synthesized
ctaagaaagaaatatatatcac

SEQ ID NO: 1093240 - DNA, 22 bp, Artificial Sequence
  chemically synthesized
agaaagaaatatatatcacaga

SEQ ID NO: 1093241 - DNA, 22 bp, Artificial Sequence
  chemically synthesized
ccataatatttaatctgtgata

SEQ ID NO: 1093242 - DNA, 22 bp, Artificial Sequence
  chemically synthesized
taccataatatttaatctgtga

SEQ ID NO: 1093243 - DNA, 22 bp, Artificial Sequence
  chemically synthesized
ctaccataatatttaatctgtg

SEQ ID NO: 1093244 - DNA, 22 bp, Artificial Sequence
  chemically synthesized
tctaccataatatttaatctgt

SEQ ID NO: 1093245 - DNA, 22 bp, Artificial Sequence
  chemically synthesized
ttctaccataatatttaatctg

SEQ ID NO: 1093246 - DNA, 22 bp, Artificial Sequence
  chemically synthesized
cttttctaccataatatttaat

SEQ ID NO: 1093247 - DNA, 22 bp, Artificial Sequence
  chemically synthesized
acttttctaccataatatttaa

SEQ ID NO: 1093248 - DNA, 22 bp, Artificial Sequence
  chemically synthesized
acatttacttttctaccataat

SEQ ID NO: 1093249 - DNA, 22 bp, Artificial Sequence
  chemically synthesized
cacatttacttttctaccataa

SEQ ID NO: 1093250 - DNA, 22 bp, Artificial Sequence
  chemically synthesized
aatattatggtagaaaagtaaa

SEQ ID NO: 1093251 - DNA, 22 bp, Artificial Sequence
  chemically synthesized
tggtagaaaagtaaatgtgaaa

SEQ ID NO: 1093252 - DNA, 22 bp, Artificial Sequence
  chemically synthesized
ataatgaaatggcaaaatttca

SEQ ID NO: 1093253 - DNA, 22 bp, Artificial Sequence
  chemically synthesized
aataatgaaatggcaaaatttc

SEQ ID NO: 1093254 - DNA, 22 bp, Artificial Sequence
  chemically synthesized
taataatgaaatggcaaaattt

SEQ ID NO: 1093255 - DNA, 22 bp, Artificial Sequence
  chemically synthesized
agaagttttaataatgaaatgg

SEQ ID NO: 1093256 - DNA, 22 bp, Artificial Sequence
  chemically synthesized
cagaagttttaataatgaaatg

SEQ ID NO: 1093257 - DNA, 22 bp, Artificial Sequence
  chemically synthesized
tcagaagttttaataatgaaat

SEQ ID NO: 1093258 - DNA, 22 bp, Artificial Sequence
  chemically synthesized
tattttcagaagttttaataat

SEQ ID NO: 1093259 - DNA, 22 bp, Artificial Sequence
  chemically synthesized
tgccatttcattattaaaactt

SEQ ID NO: 1093260 - DNA, 22 bp, Artificial Sequence
  chemically synthesized
gccatttcattattaaaacttc

SEQ ID NO: 1093261 - DNA, 22 bp, Artificial Sequence
  chemically synthesized
ccatttcattattaaaacttct

SEQ ID NO: 1093262 - DNA, 22 bp, Artificial Sequence
  chemically synthesized
cattattaaaacttctgaaaat

SEQ ID NO: 1093263 - DNA, 22 bp, Artificial Sequence
  chemically synthesized
attattaaaacttctgaaaata

SEQ ID NO: 1093264 - DNA, 22 bp, Artificial Sequence
  chemically synthesized
ttaaaacttctgaaaatataac

SEQ ID NO: 1093265 - DNA, 22 bp, Artificial Sequence
  chemically synthesized
aaacttctgaaaatataacact

SEQ ID NO: 1093266 - DNA, 22 bp, Artificial Sequence
  chemically synthesized
ctgaaaatataacactttgtat

SEQ ID NO: 1093267 - DNA, 22 bp, Artificial Sequence
  chemically synthesized
tgaaaatataacactttgtatt

SEQ ID NO: 1093268 - DNA, 22 bp, Artificial Sequence
  chemically synthesized
aaaatataacactttgtatttt

SEQ ID NO: 1093269 - DNA, 22 bp, Artificial Sequence
  chemically synthesized
caaagtaaaggtgaaaaataca

SEQ ID NO: 1093270 - DNA, 22 bp, Artificial Sequence
  chemically synthesized
ctacaaagtaaaggtgaaaaat

SEQ ID NO: 1093271 - DNA, 22 bp, Artificial Sequence
  chemically synthesized
cctgctacaaagtaaaggtgaa

SEQ ID NO: 1093272 - DNA, 22 bp, Artificial Sequence
  chemically synthesized
tgtatttttcacctttactttg

SEQ ID NO: 1093273 - DNA, 22 bp, Artificial Sequence
  chemically synthesized
aattacctgctacaaagtaaag

SEQ ID NO: 1093274 - DNA, 22 bp, Artificial Sequence
  chemically synthesized
gtatttttcacctttactttgt

SEQ ID NO: 1093275 - DNA, 22 bp, Artificial Sequence
  chemically synthesized
gaattacctgctacaaagtaaa

SEQ ID NO: 1093276 - DNA, 22 bp, Artificial Sequence
  chemically synthesized
tatttttcacctttactttgta

SEQ ID NO: 1093277 - DNA, 22 bp, Artificial Sequence
  chemically synthesized
tgaattacctgctacaaagtaa

SEQ ID NO: 1093278 - DNA, 22 bp, Artificial Sequence
  chemically synthesized
ttcacctttactttgtagcagg

SEQ ID NO: 1093279 - DNA, 22 bp, Artificial Sequence
  chemically synthesized
cattttgaattacctgctacaa

SEQ ID NO: 1093280 - DNA, 22 bp, Artificial Sequence
  chemically synthesized
tcacctttactttgtagcaggt

SEQ ID NO: 1093281 - DNA, 22 bp, Artificial Sequence
  chemically synthesized
cacctttactttgtagcaggta

SEQ ID NO: 1093282 - DNA, 22 bp, Artificial Sequence
  chemically synthesized
acctttactttgtagcaggtaa

SEQ ID NO: 1093283 - DNA, 22 bp, Artificial Sequence
  chemically synthesized
gctgcattttgaattacctgct

SEQ ID NO: 1093284 - DNA, 22 bp, Artificial Sequence
  chemically synthesized
tactttgtagcaggtaattcaa

SEQ ID NO: 1093285 - DNA, 22 bp, Artificial Sequence
  chemically synthesized
tctagctgcattttgaattacc

SEQ ID NO: 1093286 - DNA, 22 bp, Artificial Sequence
  chemically synthesized
actttgtagcaggtaattcaaa

SEQ ID NO: 1093287 - DNA, 22 bp, Artificial Sequence
  chemically synthesized
ctttgtagcaggtaattcaaaa

SEQ ID NO: 1093288 - DNA, 22 bp, Artificial Sequence
  chemically synthesized
tgtagcaggtaattcaaaatgc

SEQ ID NO: 1093289 - DNA, 22 bp, Artificial Sequence
  chemically synthesized
gtagcaggtaattcaaaatgca

SEQ ID NO: 1093290 - DNA, 22 bp, Artificial Sequence
  chemically synthesized
tagcaggtaattcaaaatgcag

SEQ ID NO: 1093291 - DNA, 22 bp, Artificial Sequence
  chemically synthesized
gatgatgaaactgtctagctgc

SEQ ID NO: 1093292 - DNA, 22 bp, Artificial Sequence
  chemically synthesized
aaaatgcagctagacagtttca

SEQ ID NO: 1093293 - DNA, 22 bp, Artificial Sequence
  chemically synthesized
tagaggtattagatgatgaaac

SEQ ID NO: 1093294 - DNA, 22 bp, Artificial Sequence
  chemically synthesized
attgtagaggtattagatgatg

SEQ ID NO: 1093295 - DNA, 22 bp, Artificial Sequence
  chemically synthesized
gattgtagaggtattagatgat

SEQ ID NO: 1093296 - DNA, 22 bp, Artificial Sequence
  chemically synthesized
tgattgtagaggtattagatga

SEQ ID NO: 1093297 - DNA, 22 bp, Artificial Sequence
  chemically synthesized
ttgattgtagaggtattagatg

SEQ ID NO: 1093298 - DNA, 22 bp, Artificial Sequence
  chemically synthesized
gacagtttcatcatctaatacc

SEQ ID NO: 1093299 - DNA, 22 bp, Artificial Sequence
  chemically synthesized
atgacttttgattgtagaggta

SEQ ID NO: 1093300 - DNA, 22 bp, Artificial Sequence
  chemically synthesized
aatgacttttgattgtagaggt

SEQ ID NO: 1093301 - DNA, 22 bp, Artificial Sequence
  chemically synthesized
catcatctaatacctctacaat

SEQ ID NO: 1093302 - DNA, 22 bp, Artificial Sequence
  chemically synthesized
atcatctaatacctctacaatc

SEQ ID NO: 1093303 - DNA, 22 bp, Artificial Sequence
  chemically synthesized
ttaatgacttttgattgtagag

SEQ ID NO: 1093304 - DNA, 22 bp, Artificial Sequence
  chemically synthesized
cttaatgacttttgattgtaga

SEQ ID NO: 1093305 - DNA, 22 bp, Artificial Sequence
  chemically synthesized
tcttaatgacttttgattgtag

SEQ ID NO: 1093306 - DNA, 22 bp, Artificial Sequence
  chemically synthesized
atacctctacaatcaaaagtca

SEQ ID NO: 1093307 - DNA, 22 bp, Artificial Sequence
  chemically synthesized
tacaatcaaaagtcattaagaa

SEQ ID NO: 1093308 - DNA, 22 bp, Artificial Sequence
  chemically synthesized
caatcaaaagtcattaagaaaa

SEQ ID NO: 1093309 - DNA, 22 bp, Artificial Sequence
  chemically synthesized
atgtaataaaatgttttcttaa

SEQ ID NO: 1093310 - DNA, 22 bp, Artificial Sequence
  chemically synthesized
ttcatgtaataaaatgttttct

SEQ ID NO: 1093311 - DNA, 22 bp, Artificial Sequence
  chemically synthesized
attattcatgtaataaaatgtt

SEQ ID NO: 1093312 - DNA, 22 bp, Artificial Sequence
  chemically synthesized
ttcattattcatgtaataaaat

SEQ ID NO: 1093313 - DNA, 22 bp, Artificial Sequence
  chemically synthesized
attcattattcatgtaataaaa

SEQ ID NO: 1093314 - DNA, 22 bp, Artificial Sequence
  chemically synthesized
agaaaacattttattacatgaa

SEQ ID NO: 1093315 - DNA, 22 bp, Artificial Sequence
  chemically synthesized
aatttattcattattcatgtaa

SEQ ID NO: 1093316 - DNA, 22 bp, Artificial Sequence
  chemically synthesized
gaatttattcattattcatgta

SEQ ID NO: 1093317 - DNA, 22 bp, Artificial Sequence
  chemically synthesized
tgaatttattcattattcatgt

SEQ ID NO: 1093318 - DNA, 22 bp, Artificial Sequence
  chemically synthesized
ttgaatttattcattattcatg

SEQ ID NO: 1093319 - DNA, 22 bp, Artificial Sequence
  chemically synthesized
tcttttgaatttattcattatt

SEQ ID NO: 1093320 - DNA, 22 bp, Artificial Sequence
  chemically synthesized
tattacatgaataatgaataaa

SEQ ID NO: 1093321 - DNA, 22 bp, Artificial Sequence
  chemically synthesized
ctgtcttttgaatttattcatt

SEQ ID NO: 1093322 - DNA, 22 bp, Artificial Sequence
  chemically synthesized
attacatgaataatgaataaat

SEQ ID NO: 1093323 - DNA, 22 bp, Artificial Sequence
  chemically synthesized
ttacatgaataatgaataaatt

SEQ ID NO: 1093324 - DNA, 22 bp, Artificial Sequence
  chemically synthesized
catgaataatgaataaattcaa

SEQ ID NO: 1093325 - DNA, 22 bp, Artificial Sequence
  chemically synthesized
aaaagtaaattactgtcttttg

SEQ ID NO: 1093326 - DNA, 22 bp, Artificial Sequence
  chemically synthesized
aaaaagtaaattactgtctttt

SEQ ID NO: 1093327 - DNA, 22 bp, Artificial Sequence
  chemically synthesized
taaaaagtaaattactgtcttt

SEQ ID NO: 1093328 - DNA, 22 bp, Artificial Sequence
  chemically synthesized
ttttaaaaagtaaattactgtc

SEQ ID NO: 1093329 - DNA, 22 bp, Artificial Sequence
  chemically synthesized
attttaaaaagtaaattactgt

SEQ ID NO: 1093330 - DNA, 22 bp, Artificial Sequence
  chemically synthesized
tattttaaaaagtaaattactg

SEQ ID NO: 1093331 - DNA, 22 bp, Artificial Sequence
  chemically synthesized
ttattttaaaaagtaaattact

SEQ ID NO: 1093332 - DNA, 22 bp, Artificial Sequence
  chemically synthesized
tttttattttaaaaagtaaatt

SEQ ID NO: 1093333 - DNA, 22 bp, Artificial Sequence
  chemically synthesized
atttttattttaaaaagtaaat

SEQ ID NO: 1093334 - DNA, 22 bp, Artificial Sequence
  chemically synthesized
aaaagacagtaatttacttttt

SEQ ID NO: 1093335 - DNA, 22 bp, Artificial Sequence
  chemically synthesized
gtgcttatttttattttaaaaa

SEQ ID NO: 1093336 - DNA, 22 bp, Artificial Sequence
  chemically synthesized
caatgttggtgcttatttttat

SEQ ID NO: 1093337 - DNA, 22 bp, Artificial Sequence
  chemically synthesized
actttttaaaataaaaataagc

SEQ ID NO: 1093338 - DNA, 22 bp, Artificial Sequence
  chemically synthesized
ctttttaaaataaaaataagca

SEQ ID NO: 1093339 - DNA, 22 bp, Artificial Sequence
  chemically synthesized
tttaaaataaaaataagcacca

SEQ ID NO: 1093340 - DNA, 22 bp, Artificial Sequence
  chemically synthesized
ttaaaataaaaataagcaccaa

SEQ ID NO: 1093341 - DNA, 22 bp, Artificial Sequence
  chemically synthesized
taaaataaaaataagcaccaac

SEQ ID NO: 1093342 - DNA, 22 bp, Artificial Sequence
  chemically synthesized
ccagactgcaatgttggtgctt

SEQ ID NO: 1093343 - DNA, 22 bp, Artificial Sequence
  chemically synthesized
aaaataaaaataagcaccaaca

SEQ ID NO: 1093344 - DNA, 22 bp, Artificial Sequence
  chemically synthesized
cccagactgcaatgttggtgct

SEQ ID NO: 1093345 - DNA, 22 bp, Artificial Sequence
  chemically synthesized
aaataaaaataagcaccaacat

SEQ ID NO: 1093346 - DNA, 22 bp, Artificial Sequence
  chemically synthesized
tttcccagactgcaatgttggt

SEQ ID NO: 1093347 - DNA, 22 bp, Artificial Sequence
  chemically synthesized
tgtttcccagactgcaatgttg

SEQ ID NO: 1093348 - DNA, 22 bp, Artificial Sequence
  chemically synthesized
ctgtttcccagactgcaatgtt

SEQ ID NO: 1093349 - DNA, 22 bp, Artificial Sequence
  chemically synthesized
tctgtttcccagactgcaatgt

SEQ ID NO: 1093350 - DNA, 22 bp, Artificial Sequence
  chemically synthesized
ttctgtttcccagactgcaatg

SEQ ID NO: 1093351 - DNA, 22 bp, Artificial Sequence
  chemically synthesized
tttttctgtttcccagactgca

SEQ ID NO: 1093352 - DNA, 22 bp, Artificial Sequence
  chemically synthesized
atttttctgtttcccagactgc

SEQ ID NO: 1093353 - DNA, 22 bp, Artificial Sequence
  chemically synthesized
tatttttctgtttcccagactg

SEQ ID NO: 1093354 - DNA, 22 bp, Artificial Sequence
  chemically synthesized
ttatttttctgtttcccagact

SEQ ID NO: 1093355 - DNA, 22 bp, Artificial Sequence
  chemically synthesized
catatgcttttatttttctgtt

SEQ ID NO: 1093356 - DNA, 22 bp, Artificial Sequence
  chemically synthesized
acatatgcttttatttttctgt

SEQ ID NO: 1093357 - DNA, 22 bp, Artificial Sequence
  chemically synthesized
cagtctgggaaacagaaaaata

SEQ ID NO: 1093358 - DNA, 22 bp, Artificial Sequence
  chemically synthesized
tacatatgcttttatttttctg

SEQ ID NO: 1093359 - DNA, 22 bp, Artificial Sequence
  chemically synthesized
ttacatatgcttttatttttct

SEQ ID NO: 1093360 - DNA, 22 bp, Artificial Sequence
  chemically synthesized
ggaaacagaaaaataaaagcat

SEQ ID NO: 1093361 - DNA, 22 bp, Artificial Sequence
  chemically synthesized
catatgcatttttacatatgct

SEQ ID NO: 1093362 - DNA, 22 bp, Artificial Sequence
  chemically synthesized
acatatgcatttttacatatgc

SEQ ID NO: 1093363 - DNA, 22 bp, Artificial Sequence
  chemically synthesized
gatttacatatgcatttttaca

SEQ ID NO: 1093364 - DNA, 22 bp, Artificial Sequence
  chemically synthesized
gtaacagtgatgtgtgagggag

SEQ ID NO: 1093365 - DNA, 22 bp, Artificial Sequence
  chemically synthesized
actccctcacacatcactgtta

SEQ ID NO: 1093366 - DNA, 22 bp, Artificial Sequence
  chemically synthesized
cctcacacatcactgttaccag

SEQ ID NO: 1093367 - DNA, 22 bp, Artificial Sequence
  chemically synthesized
acacatcactgttaccagtatt

SEQ ID NO: 1093368 - DNA, 22 bp, Artificial Sequence
  chemically synthesized
agaggaggtcacagaatactgg

SEQ ID NO: 1093369 - DNA, 22 bp, Artificial Sequence
  chemically synthesized
cagaggaggtcacagaatactg

SEQ ID NO: 1093370 - DNA, 22 bp, Artificial Sequence
  chemically synthesized
ttaccagtattctgtgacctcc

SEQ ID NO: 1093371 - DNA, 22 bp, Artificial Sequence
  chemically synthesized
ccagtattctgtgacctcctct

SEQ ID NO: 1093372 - DNA, 22 bp, Artificial Sequence
  chemically synthesized
tatatgataaatttcagaggag

SEQ ID NO: 1093373 - DNA, 22 bp, Artificial Sequence
  chemically synthesized
tgtgacctcctctgaaatttat

SEQ ID NO: 1093374 - DNA, 22 bp, Artificial Sequence
  chemically synthesized
tgacctcctctgaaatttatca

SEQ ID NO: 1093375 - DNA, 22 bp, Artificial Sequence
  chemically synthesized
tcaaattatatatgataaattt

SEQ ID NO: 1093376 - DNA, 22 bp, Artificial Sequence
  chemically synthesized
actatcaaattatatatgataa

SEQ ID NO: 1093377 - DNA, 22 bp, Artificial Sequence
  chemically synthesized
aactatcaaattatatatgata

SEQ ID NO: 1093378 - DNA, 22 bp, Artificial Sequence
  chemically synthesized
taactatcaaattatatatgat

SEQ ID NO: 1093379 - DNA, 22 bp, Artificial Sequence
  chemically synthesized
ctctgaaatttatcatatataa

SEQ ID NO: 1093380 - DNA, 22 bp, Artificial Sequence
  chemically synthesized
tgaaatttatcatatataattt

SEQ ID NO: 1093381 - DNA, 22 bp, Artificial Sequence
  chemically synthesized
aattttaactatcaaattatat

SEQ ID NO: 1093382 - DNA, 22 bp, Artificial Sequence
  chemically synthesized
aaatttatcatatataatttga

SEQ ID NO: 1093383 - DNA, 22 bp, Artificial Sequence
  chemically synthesized
aaattttaactatcaaattata

SEQ ID NO: 1093384 - DNA, 22 bp, Artificial Sequence
  chemically synthesized
acttaaattttaactatcaaat

SEQ ID NO: 1093385 - DNA, 22 bp, Artificial Sequence
  chemically synthesized
atcatatataatttgatagtta

SEQ ID NO: 1093386 - DNA, 22 bp, Artificial Sequence
  chemically synthesized
tcatatataatttgatagttaa

SEQ ID NO: 1093387 - DNA, 22 bp, Artificial Sequence
  chemically synthesized
aactcacttaaattttaactat

SEQ ID NO: 1093388 - DNA, 22 bp, Artificial Sequence
  chemically synthesized
tagttaaactcacttaaatttt

SEQ ID NO: 1093389 - DNA, 22 bp, Artificial Sequence
  chemically synthesized
gatagttaaaatttaagtgagt

SEQ ID NO: 1093390 - DNA, 22 bp, Artificial Sequence
  chemically synthesized
atagttaaaatttaagtgagtt

SEQ ID NO: 1093391 - DNA, 22 bp, Artificial Sequence
  chemically synthesized
aaatttaagtgagtttaactat

SEQ ID NO: 1093392 - DNA, 22 bp, Artificial Sequence
  chemically synthesized
gtgaaaagagagctatagttaa

SEQ ID NO: 1093393 - DNA, 22 bp, Artificial Sequence
  chemically synthesized
agtgaaaagagagctatagtta

SEQ ID NO: 1093394 - DNA, 22 bp, Artificial Sequence
  chemically synthesized
aagtgagtttaactatagctct

SEQ ID NO: 1093395 - DNA, 22 bp, Artificial Sequence
  chemically synthesized
agtgagtttaactatagctctc

SEQ ID NO: 1093396 - DNA, 22 bp, Artificial Sequence
  chemically synthesized
aactatagctctcttttcacta

SEQ ID NO: 1093397 - DNA, 22 bp, Artificial Sequence
  chemically synthesized
actatagctctcttttcactaa

SEQ ID NO: 1093398 - DNA, 22 bp, Artificial Sequence
  chemically synthesized
tagctctcttttcactaaacat

SEQ ID NO: 1093399 - DNA, 22 bp, Artificial Sequence
  chemically synthesized
tcttttcactaaacattatatc

SEQ ID NO: 1093400 - DNA, 22 bp, Artificial Sequence
  chemically synthesized
ttttcactaaacattatatcat

SEQ ID NO: 1093401 - DNA, 22 bp, Artificial Sequence
  chemically synthesized
ttcactaaacattatatcatac

SEQ ID NO: 1093402 - DNA, 22 bp, Artificial Sequence
  chemically synthesized
tcactaaacattatatcatacc

SEQ ID NO: 1093403 - DNA, 22 bp, Artificial Sequence
  chemically synthesized
cactaaacattatatcatacca

SEQ ID NO: 1093404 - DNA, 22 bp, Artificial Sequence
  chemically synthesized
actaaacattatatcataccat

SEQ ID NO: 1093405 - DNA, 22 bp, Artificial Sequence
  chemically synthesized
gtaatacagaaaatggtatgat

SEQ ID NO: 1093406 - DNA, 22 bp, Artificial Sequence
  chemically synthesized
agtaatacagaaaatggtatga

SEQ ID NO: 1093407 - DNA, 22 bp, Artificial Sequence
  chemically synthesized
ttagtaatacagaaaatggtat

SEQ ID NO: 1093408 - DNA, 22 bp, Artificial Sequence
  chemically synthesized
aacattatatcataccattttc

SEQ ID NO: 1093409 - DNA, 22 bp, Artificial Sequence
  chemically synthesized
cttagtaatacagaaaatggta

SEQ ID NO: 1093410 - DNA, 22 bp, Artificial Sequence
  chemically synthesized
tatcataccattttctgtatta

SEQ ID NO: 1093411 - DNA, 22 bp, Artificial Sequence
  chemically synthesized
aaaatatgtcttcttagtaata

SEQ ID NO: 1093412 - DNA, 22 bp, Artificial Sequence
  chemically synthesized
attaaaaatatgtcttcttagt

SEQ ID NO: 1093413 - DNA, 22 bp, Artificial Sequence
  chemically synthesized
cattaaaaatatgtcttcttag

SEQ ID NO: 1093414 - DNA, 22 bp, Artificial Sequence
  chemically synthesized
tcattaaaaatatgtcttctta

SEQ ID NO: 1093415 - DNA, 22 bp, Artificial Sequence
  chemically synthesized
tctgtattactaagaagacata

SEQ ID NO: 1093416 - DNA, 22 bp, Artificial Sequence
  chemically synthesized
ctgtattactaagaagacatat

SEQ ID NO: 1093417 - DNA, 22 bp, Artificial Sequence
  chemically synthesized
tgtattactaagaagacatatt

SEQ ID NO: 1093418 - DNA, 22 bp, Artificial Sequence
  chemically synthesized
gattttcattaaaaatatgtct

SEQ ID NO: 1093419 - DNA, 22 bp, Artificial Sequence
  chemically synthesized
tattactaagaagacatatttt

SEQ ID NO: 1093420 - DNA, 22 bp, Artificial Sequence
  chemically synthesized
agattttcattaaaaatatgtc

SEQ ID NO: 1093421 - DNA, 22 bp, Artificial Sequence
  chemically synthesized
ctaagaagacatatttttaatg

SEQ ID NO: 1093422 - DNA, 22 bp, Artificial Sequence
  chemically synthesized
agaagacatatttttaatgaaa

SEQ ID NO: 1093423 - DNA, 22 bp, Artificial Sequence
  chemically synthesized
aagaagtcttagattttcatta

SEQ ID NO: 1093424 - DNA, 22 bp, Artificial Sequence
  chemically synthesized
aaagaagtcttagattttcatt

SEQ ID NO: 1093425 - DNA, 22 bp, Artificial Sequence
  chemically synthesized
taaagaagtcttagattttcat

SEQ ID NO: 1093426 - DNA, 22 bp, Artificial Sequence
  chemically synthesized
ttaatgaaaatctaagacttct

SEQ ID NO: 1093427 - DNA, 22 bp, Artificial Sequence
  chemically synthesized
taatgaaaatctaagacttctt

SEQ ID NO: 1093428 - DNA, 22 bp, Artificial Sequence
  chemically synthesized
aatgaaaatctaagacttcttt

SEQ ID NO: 1093429 - DNA, 22 bp, Artificial Sequence
  chemically synthesized
atgaaaatctaagacttcttta

SEQ ID NO: 1093430 - DNA, 22 bp, Artificial Sequence
  chemically synthesized
agatagagccactttaaagaag

SEQ ID NO: 1093431 - DNA, 22 bp, Artificial Sequence
  chemically synthesized
aactaagatagagccactttaa

SEQ ID NO: 1093432 - DNA, 22 bp, Artificial Sequence
  chemically synthesized
ctaaactaagatagagccactt

SEQ ID NO: 1093433 - DNA, 22 bp, Artificial Sequence
  chemically synthesized
agacttctttaaagtggctcta

SEQ ID NO: 1093434 - DNA, 22 bp, Artificial Sequence
  chemically synthesized
ctttaaagtggctctatcttag

SEQ ID NO: 1093435 - DNA, 22 bp, Artificial Sequence
  chemically synthesized
tttaaagtggctctatcttagt

SEQ ID NO: 1093436 - DNA, 22 bp, Artificial Sequence
  chemically synthesized
taaagtggctctatcttagttt

SEQ ID NO: 1093437 - DNA, 22 bp, Artificial Sequence
  chemically synthesized
aaagtggctctatcttagttta

SEQ ID NO: 1093438 - DNA, 22 bp, Artificial Sequence
  chemically synthesized
aagtggctctatcttagtttag

SEQ ID NO: 1093439 - DNA, 22 bp, Artificial Sequence
  chemically synthesized
aaaaaaggaaattgctaaacta

SEQ ID NO: 1093440 - DNA, 22 bp, Artificial Sequence
  chemically synthesized
tctaaaaaaaggaaattgctaa

SEQ ID NO: 1093441 - DNA, 22 bp, Artificial Sequence
  chemically synthesized
tatcttagtttagcaatttcct

SEQ ID NO: 1093442 - DNA, 22 bp, Artificial Sequence
  chemically synthesized
tcttagtttagcaatttccttt

SEQ ID NO: 1093443 - DNA, 22 bp, Artificial Sequence
  chemically synthesized
agtttagcaatttccttttttt

SEQ ID NO: 1093444 - DNA, 22 bp, Artificial Sequence
  chemically synthesized
gtttagcaatttccttttttta

SEQ ID NO: 1093445 - DNA, 22 bp, Artificial Sequence
  chemically synthesized
aaagtagtctatctaaaaaaag

SEQ ID NO: 1093446 - DNA, 22 bp, Artificial Sequence
  chemically synthesized
agcaatttcctttttttagata

SEQ ID NO: 1093447 - DNA, 22 bp, Artificial Sequence
  chemically synthesized
gcaatttcctttttttagatag

SEQ ID NO: 1093448 - DNA, 22 bp, Artificial Sequence
  chemically synthesized
cctttttttagatagactactt

SEQ ID NO: 1093449 - DNA, 22 bp, Artificial Sequence
  chemically synthesized
ctttttttagatagactacttt

SEQ ID NO: 1093450 - DNA, 22 bp, Artificial Sequence
  chemically synthesized
tttttagatagactacttttag

SEQ ID NO: 1093451 - DNA, 22 bp, Artificial Sequence
  chemically synthesized
ttttagatagactacttttagt

SEQ ID NO: 1093452 - DNA, 22 bp, Artificial Sequence
  chemically synthesized
tttagatagactacttttagtt

SEQ ID NO: 1093453 - DNA, 22 bp, Artificial Sequence
  chemically synthesized
ttagatagactacttttagttt

SEQ ID NO: 1093454 - DNA, 22 bp, Artificial Sequence
  chemically synthesized
taatagcaaacaaaactaaaag

SEQ ID NO: 1093455 - DNA, 22 bp, Artificial Sequence
  chemically synthesized
tagatagactacttttagtttt

SEQ ID NO: 1093456 - DNA, 22 bp, Artificial Sequence
  chemically synthesized
ataatagcaaacaaaactaaaa

SEQ ID NO: 1093457 - DNA, 22 bp, Artificial Sequence
  chemically synthesized
agatagactacttttagttttg

SEQ ID NO: 1093458 - DNA, 22 bp, Artificial Sequence
  chemically synthesized
gatagactacttttagttttgt

SEQ ID NO: 1093459 - DNA, 22 bp, Artificial Sequence
  chemically synthesized
ccataaatttataatagcaaac

SEQ ID NO: 1093460 - DNA, 22 bp, Artificial Sequence
  chemically synthesized
cttttagttttgtttgctatta

SEQ ID NO: 1093461 - DNA, 22 bp, Artificial Sequence
  chemically synthesized
accataaatttataatagcaaa

SEQ ID NO: 1093462 - DNA, 22 bp, Artificial Sequence
  chemically synthesized
ttagttttgtttgctattataa

SEQ ID NO: 1093463 - DNA, 22 bp, Artificial Sequence
  chemically synthesized
tagttttgtttgctattataaa

SEQ ID NO: 1093464 - DNA, 22 bp, Artificial Sequence
  chemically synthesized
agttttgtttgctattataaat

SEQ ID NO: 1093465 - DNA, 22 bp, Artificial Sequence
  chemically synthesized
gttttgtttgctattataaatt

SEQ ID NO: 1093466 - DNA, 22 bp, Artificial Sequence
  chemically synthesized
tgtttgctattataaatttatg

SEQ ID NO: 1093467 - DNA, 22 bp, Artificial Sequence
  chemically synthesized
gtttgctattataaatttatgg

SEQ ID NO: 1093468 - DNA, 22 bp, Artificial Sequence
  chemically synthesized
tttgctattataaatttatggt

SEQ ID NO: 1093469 - DNA, 22 bp, Artificial Sequence
  chemically synthesized
acgatgatgtttaccataaatt

SEQ ID NO: 1093470 - DNA, 22 bp, Artificial Sequence
  chemically synthesized
gctattataaatttatggtaaa

SEQ ID NO: 1093471 - DNA, 22 bp, Artificial Sequence
  chemically synthesized
ctattataaatttatggtaaac

SEQ ID NO: 1093472 - DNA, 22 bp, Artificial Sequence
  chemically synthesized
ttataaatttatggtaaacatc

SEQ ID NO: 1093473 - DNA, 22 bp, Artificial Sequence
  chemically synthesized
taaatttatggtaaacatcatc

SEQ ID NO: 1093474 - DNA, 22 bp, Artificial Sequence
  chemically synthesized
atggtaaacatcatcgtgaata

SEQ ID NO: 1093475 - DNA, 22 bp, Artificial Sequence
  chemically synthesized
tggtaaacatcatcgtgaatat

SEQ ID NO: 1093476 - DNA, 22 bp, Artificial Sequence
  chemically synthesized
aaggaaataataagaatgtgga

SEQ ID NO: 1093477 - DNA, 22 bp, Artificial Sequence
  chemically synthesized
tttttccacattcttattattt

SEQ ID NO: 1093478 - DNA, 22 bp, Artificial Sequence
  chemically synthesized
ttccacattcttattatttcct

SEQ ID NO: 1093479 - DNA, 22 bp, Artificial Sequence
  chemically synthesized
tccacattcttattatttcctt

SEQ ID NO: 1093480 - DNA, 22 bp, Artificial Sequence
  chemically synthesized
ccacattcttattatttccttg

SEQ ID NO: 1093481 - DNA, 22 bp, Artificial Sequence
  chemically synthesized
cacattcttattatttccttga

SEQ ID NO: 1093482 - DNA, 22 bp, Artificial Sequence
  chemically synthesized
cgataatatacctcaaggaaat

SEQ ID NO: 1093483 - DNA, 22 bp, Artificial Sequence
  chemically synthesized
ccgataatatacctcaaggaaa

SEQ ID NO: 1093484 - DNA, 22 bp, Artificial Sequence
  chemically synthesized
ttattatttccttgaggtatat

SEQ ID NO: 1093485 - DNA, 22 bp, Artificial Sequence
  chemically synthesized
attatttccttgaggtatatta

SEQ ID NO: 1093486 - DNA, 22 bp, Artificial Sequence
  chemically synthesized
ttatttccttgaggtatattat

SEQ ID NO: 1093487 - DNA, 22 bp, Artificial Sequence
  chemically synthesized
tttccttgaggtatattatcgg

SEQ ID NO: 1093488 - DNA, 22 bp, Artificial Sequence
  chemically synthesized
gtggtaatatttccgataatat

SEQ ID NO: 1093489 - DNA, 22 bp, Artificial Sequence
  chemically synthesized
ccttgaggtatattatcggaaa

SEQ ID NO: 1093490 - DNA, 22 bp, Artificial Sequence
  chemically synthesized
cttgaggtatattatcggaaat

SEQ ID NO: 1093491 - DNA, 22 bp, Artificial Sequence
  chemically synthesized
aattagtggtaatatttccgat

SEQ ID NO: 1093492 - DNA, 22 bp, Artificial Sequence
  chemically synthesized
gaattagtggtaatatttccga

SEQ ID NO: 1093493 - DNA, 22 bp, Artificial Sequence
  chemically synthesized
gaggtatattatcggaaatatt

SEQ ID NO: 1093494 - DNA, 22 bp, Artificial Sequence
  chemically synthesized
tgaattagtggtaatatttccg

SEQ ID NO: 1093495 - DNA, 22 bp, Artificial Sequence
  chemically synthesized
aggtatattatcggaaatatta

SEQ ID NO: 1093496 - DNA, 22 bp, Artificial Sequence
  chemically synthesized
tcggaaatattaccactaattc

SEQ ID NO: 1093497 - DNA, 22 bp, Artificial Sequence
  chemically synthesized
aaataatcaaacctttgaatta

SEQ ID NO: 1093498 - DNA, 22 bp, Artificial Sequence
  chemically synthesized
aaaataatcaaacctttgaatt

SEQ ID NO: 1093499 - DNA, 22 bp, Artificial Sequence
  chemically synthesized
ccactaattcaaaggtttgatt

SEQ ID NO: 1093500 - DNA, 22 bp, Artificial Sequence
  chemically synthesized
atggccatttaaaataatcaaa

SEQ ID NO: 1093501 - DNA, 22 bp, Artificial Sequence
  chemically synthesized
attcaaaggtttgattatttta

SEQ ID NO: 1093502 - DNA, 22 bp, Artificial Sequence
  chemically synthesized
aaaggtttgattattttaaatg

SEQ ID NO: 1093503 - DNA, 22 bp, Artificial Sequence
  chemically synthesized
ataatacaaattaatggccatt

SEQ ID NO: 1093504 - DNA, 22 bp, Artificial Sequence
  chemically synthesized
cataatacaaattaatggccat

SEQ ID NO: 1093505 - DNA, 22 bp, Artificial Sequence
  chemically synthesized
gattattttaaatggccattaa

SEQ ID NO: 1093506 - DNA, 22 bp, Artificial Sequence
  chemically synthesized
attattttaaatggccattaat

SEQ ID NO: 1093507 - DNA, 22 bp, Artificial Sequence
  chemically synthesized
ttttaaatggccattaatttgt

SEQ ID NO: 1093508 - DNA, 22 bp, Artificial Sequence
  chemically synthesized
taaatggccattaatttgtatt

SEQ ID NO: 1093509 - DNA, 22 bp, Artificial Sequence
  chemically synthesized
aaatggccattaatttgtatta

SEQ ID NO: 1093510 - DNA, 22 bp, Artificial Sequence
  chemically synthesized
aatggccattaatttgtattat

SEQ ID NO: 1093511 - DNA, 22 bp, Artificial Sequence
  chemically synthesized
tgtataaatcagtttcataata

SEQ ID NO: 1093512 - DNA, 22 bp, Artificial Sequence
  chemically synthesized
tgtgtataaatcagtttcataa

SEQ ID NO: 1093513 - DNA, 22 bp, Artificial Sequence
  chemically synthesized
ctgtgtataaatcagtttcata

SEQ ID NO: 1093514 - DNA, 22 bp, Artificial Sequence
  chemically synthesized
atttgtattatgaaactgattt

SEQ ID NO: 1093515 - DNA, 22 bp, Artificial Sequence
  chemically synthesized
gtattatgaaactgatttatac

SEQ ID NO: 1093516 - DNA, 22 bp, Artificial Sequence
  chemically synthesized
tattatgaaactgatttataca

SEQ ID NO: 1093517 - DNA, 22 bp, Artificial Sequence
  chemically synthesized
tgagtacttctgtgtataaatc

SEQ ID NO: 1093518 - DNA, 22 bp, Artificial Sequence
  chemically synthesized
atgagtacttctgtgtataaat

SEQ ID NO: 1093519 - DNA, 22 bp, Artificial Sequence
  chemically synthesized
tatgagtacttctgtgtataaa

SEQ ID NO: 1093520 - DNA, 22 bp, Artificial Sequence
  chemically synthesized
ttatgagtacttctgtgtataa

SEQ ID NO: 1093521 - DNA, 22 bp, Artificial Sequence
  chemically synthesized
tttatgagtacttctgtgtata

SEQ ID NO: 1093522 - DNA, 22 bp, Artificial Sequence
  chemically synthesized
tgaaactgatttatacacagaa

SEQ ID NO: 1093523 - DNA, 22 bp, Artificial Sequence
  chemically synthesized
ttttatgagtacttctgtgtat

SEQ ID NO: 1093524 - DNA, 22 bp, Artificial Sequence
  chemically synthesized
cttttttatgagtacttctgtg

SEQ ID NO: 1093525 - DNA, 22 bp, Artificial Sequence
  chemically synthesized
tgcttttttatgagtacttctg

SEQ ID NO: 1093526 - DNA, 22 bp, Artificial Sequence
  chemically synthesized
atttatacacagaagtactcat

SEQ ID NO: 1093527 - DNA, 22 bp, Artificial Sequence
  chemically synthesized
aagttctgcttttttatgagta

SEQ ID NO: 1093528 - DNA, 22 bp, Artificial Sequence
  chemically synthesized
atacacagaagtactcataaaa

SEQ ID NO: 1093529 - DNA, 22 bp, Artificial Sequence
  chemically synthesized
aaagttctgcttttttatgagt

SEQ ID NO: 1093530 - DNA, 22 bp, Artificial Sequence
  chemically synthesized
tacacagaagtactcataaaaa

SEQ ID NO: 1093531 - DNA, 22 bp, Artificial Sequence
  chemically synthesized
taaagttctgcttttttatgag

SEQ ID NO: 1093532 - DNA, 22 bp, Artificial Sequence
  chemically synthesized
tagaaattttaaagttctgctt

SEQ ID NO: 1093533 - DNA, 22 bp, Artificial Sequence
  chemically synthesized
gtagaaattttaaagttctgct

SEQ ID NO: 1093534 - DNA, 22 bp, Artificial Sequence
  chemically synthesized
ttgtagaaattttaaagttctg

SEQ ID NO: 1093535 - DNA, 22 bp, Artificial Sequence
  chemically synthesized
cttgtagaaattttaaagttct

SEQ ID NO: 1093536 - DNA, 22 bp, Artificial Sequence
  chemically synthesized
tcttgtagaaattttaaagttc

SEQ ID NO: 1093537 - DNA, 22 bp, Artificial Sequence
  chemically synthesized
ataaaaaagcagaactttaaaa

SEQ ID NO: 1093538 - DNA, 22 bp, Artificial Sequence
  chemically synthesized
tattttcttgtagaaattttaa

SEQ ID NO: 1093539 - DNA, 22 bp, Artificial Sequence
  chemically synthesized
tatattttcttgtagaaatttt

SEQ ID NO: 1093540 - DNA, 22 bp, Artificial Sequence
  chemically synthesized
ctatattttcttgtagaaattt

SEQ ID NO: 1093541 - DNA, 22 bp, Artificial Sequence
  chemically synthesized
ttctatattttcttgtagaaat

SEQ ID NO: 1093542 - DNA, 22 bp, Artificial Sequence
  chemically synthesized
cttctatattttcttgtagaaa

SEQ ID NO: 1093543 - DNA, 22 bp, Artificial Sequence
  chemically synthesized
tcttctatattttcttgtagaa

SEQ ID NO: 1093544 - DNA, 22 bp, Artificial Sequence
  chemically synthesized
taaaatttctacaagaaaatat

SEQ ID NO: 1093545 - DNA, 22 bp, Artificial Sequence
  chemically synthesized
aaaatttctacaagaaaatata

SEQ ID NO: 1093546 - DNA, 22 bp, Artificial Sequence
  chemically synthesized
aaatttctacaagaaaatatag

SEQ ID NO: 1093547 - DNA, 22 bp, Artificial Sequence
  chemically synthesized
ctacaagaaaatatagaagaaa

SEQ ID NO: 1093548 - DNA, 22 bp, Artificial Sequence
  chemically synthesized
tacaagaaaatatagaagaaaa

SEQ ID NO: 1093549 - DNA, 22 bp, Artificial Sequence
  chemically synthesized
caagaaaatatagaagaaaata

SEQ ID NO: 1093550 - DNA, 22 bp, Artificial Sequence
  chemically synthesized
tgccaaagtcagaaatattttc

SEQ ID NO: 1093551 - DNA, 22 bp, Artificial Sequence
  chemically synthesized
tatgccaaagtcagaaatattt

SEQ ID NO: 1093552 - DNA, 22 bp, Artificial Sequence
  chemically synthesized
tctatgccaaagtcagaaatat

SEQ ID NO: 1093553 - DNA, 22 bp, Artificial Sequence
  chemically synthesized
ctctatgccaaagtcagaaata

SEQ ID NO: 1093554 - DNA, 22 bp, Artificial Sequence
  chemically synthesized
ttctctatgccaaagtcagaaa

SEQ ID NO: 1093555 - DNA, 22 bp, Artificial Sequence
  chemically synthesized
agatattcttctctatgccaaa

SEQ ID NO: 1093556 - DNA, 22 bp, Artificial Sequence
  chemically synthesized
aagatattcttctctatgccaa

SEQ ID NO: 1093557 - DNA, 22 bp, Artificial Sequence
  chemically synthesized
cttaagatattcttctctatgc

SEQ ID NO: 1093558 - DNA, 22 bp, Artificial Sequence
  chemically synthesized
acttaagatattcttctctatg

SEQ ID NO: 1093559 - DNA, 22 bp, Artificial Sequence
  chemically synthesized
ctgactttggcatagagaagaa

SEQ ID NO: 1093560 - DNA, 22 bp, Artificial Sequence
  chemically synthesized
tgactttggcatagagaagaat

SEQ ID NO: 1093561 - DNA, 22 bp, Artificial Sequence
  chemically synthesized
actttggcatagagaagaatat

SEQ ID NO: 1093562 - DNA, 22 bp, Artificial Sequence
  chemically synthesized
tggcatagagaagaatatctta

SEQ ID NO: 1093563 - DNA, 22 bp, Artificial Sequence
  chemically synthesized
ggcatagagaagaatatcttaa

SEQ ID NO: 1093564 - DNA, 22 bp, Artificial Sequence
  chemically synthesized
gcatagagaagaatatcttaag

SEQ ID NO: 1093565 - DNA, 22 bp, Artificial Sequence
  chemically synthesized
cgagatgtcttacttaagatat

SEQ ID NO: 1093566 - DNA, 22 bp, Artificial Sequence
  chemically synthesized
acgagatgtcttacttaagata

SEQ ID NO: 1093567 - DNA, 22 bp, Artificial Sequence
  chemically synthesized
tacgagatgtcttacttaagat

SEQ ID NO: 1093568 - DNA, 22 bp, Artificial Sequence
  chemically synthesized
ttacgagatgtcttacttaaga

SEQ ID NO: 1093569 - DNA, 22 bp, Artificial Sequence
  chemically synthesized
tttacgagatgtcttacttaag

SEQ ID NO: 1093570 - DNA, 22 bp, Artificial Sequence
  chemically synthesized
cggtcagttttttacgagatgt

SEQ ID NO: 1093571 - DNA, 22 bp, Artificial Sequence
  chemically synthesized
acggtcagttttttacgagatg

SEQ ID NO: 1093572 - DNA, 22 bp, Artificial Sequence
  chemically synthesized
ttacggtcagttttttacgaga

SEQ ID NO: 1093573 - DNA, 22 bp, Artificial Sequence
  chemically synthesized
cttacggtcagttttttacgag

SEQ ID NO: 1093574 - DNA, 22 bp, Artificial Sequence
  chemically synthesized
aagtaagacatctcgtaaaaaa

SEQ ID NO: 1093575 - DNA, 22 bp, Artificial Sequence
  chemically synthesized
tcttacggtcagttttttacga

SEQ ID NO: 1093576 - DNA, 22 bp, Artificial Sequence
  chemically synthesized
agtaagacatctcgtaaaaaac

SEQ ID NO: 1093577 - DNA, 22 bp, Artificial Sequence
  chemically synthesized
ttcttacggtcagttttttacg

SEQ ID NO: 1093578 - DNA, 22 bp, Artificial Sequence
  chemically synthesized
tttcttacggtcagttttttac

SEQ ID NO: 1093579 - DNA, 22 bp, Artificial Sequence
  chemically synthesized
ttttcttacggtcagtttttta

SEQ ID NO: 1093580 - DNA, 22 bp, Artificial Sequence
  chemically synthesized
ttttttcttacggtcagttttt

SEQ ID NO: 1093581 - DNA, 22 bp, Artificial Sequence
  chemically synthesized
atctcttttttcttacggtcag

SEQ ID NO: 1093582 - DNA, 22 bp, Artificial Sequence
  chemically synthesized
gtaaaaaactgaccgtaagaaa

SEQ ID NO: 1093583 - DNA, 22 bp, Artificial Sequence
  chemically synthesized
accgtaagaaaaaagagatgaa

SEQ ID NO: 1093584 - DNA, 22 bp, Artificial Sequence
  chemically synthesized
atgtagtcgaatgtattcatct

SEQ ID NO: 1093585 - DNA, 22 bp, Artificial Sequence
  chemically synthesized
aatgtagtcgaatgtattcatc

SEQ ID NO: 1093586 - DNA, 22 bp, Artificial Sequence
  chemically synthesized
taatgtagtcgaatgtattcat

SEQ ID NO: 1093587 - DNA, 22 bp, Artificial Sequence
  chemically synthesized
attttaatgtagtcgaatgtat

SEQ ID NO: 1093588 - DNA, 22 bp, Artificial Sequence
  chemically synthesized
atgaatagaaggtcctaatttt

SEQ ID NO: 1093589 - DNA, 22 bp, Artificial Sequence
  chemically synthesized
gatgaatagaaggtcctaattt

SEQ ID NO: 1093590 - DNA, 22 bp, Artificial Sequence
  chemically synthesized
tgatgaatagaaggtcctaatt

SEQ ID NO: 1093591 - DNA, 22 bp, Artificial Sequence
  chemically synthesized
gactacattaaaattaggacct

SEQ ID NO: 1093592 - DNA, 22 bp, Artificial Sequence
  chemically synthesized
cattaaaattaggaccttctat

SEQ ID NO: 1093593 - DNA, 22 bp, Artificial Sequence
  chemically synthesized
aaattaggaccttctattcatc

SEQ ID NO: 1093594 - DNA, 22 bp, Artificial Sequence
  chemically synthesized
atggtgtcctttgatgaataga

SEQ ID NO: 1093595 - DNA, 22 bp, Artificial Sequence
  chemically synthesized
gatggtgtcctttgatgaatag

SEQ ID NO: 1093596 - DNA, 22 bp, Artificial Sequence
  chemically synthesized
cttgatggtgtcctttgatgaa

SEQ ID NO: 1093597 - DNA, 22 bp, Artificial Sequence
  chemically synthesized
ggaccttctattcatcaaagga

SEQ ID NO: 1093598 - DNA, 22 bp, Artificial Sequence
  chemically synthesized
aattacttgatggtgtcctttg

SEQ ID NO: 1093599 - DNA, 22 bp, Artificial Sequence
  chemically synthesized
caattacttgatggtgtccttt

SEQ ID NO: 1093600 - DNA, 22 bp, Artificial Sequence
  chemically synthesized
tcaattacttgatggtgtcctt

SEQ ID NO: 1093601 - DNA, 22 bp, Artificial Sequence
  chemically synthesized
ttcaattacttgatggtgtcct

SEQ ID NO: 1093602 - DNA, 22 bp, Artificial Sequence
  chemically synthesized
ctattcatcaaaggacaccatc

SEQ ID NO: 1093603 - DNA, 22 bp, Artificial Sequence
  chemically synthesized
tattcatcaaaggacaccatca

SEQ ID NO: 1093604 - DNA, 22 bp, Artificial Sequence
  chemically synthesized
tttttcaattacttgatggtgt

SEQ ID NO: 1093605 - DNA, 22 bp, Artificial Sequence
  chemically synthesized
ttcatcaaaggacaccatcaag

SEQ ID NO: 1093606 - DNA, 22 bp, Artificial Sequence
  chemically synthesized
atcaaaggacaccatcaagtaa

SEQ ID NO: 1093607 - DNA, 22 bp, Artificial Sequence
  chemically synthesized
agtctgtttttcaattacttga

SEQ ID NO: 1093608 - DNA, 22 bp, Artificial Sequence
  chemically synthesized
gagtctgtttttcaattacttg

SEQ ID NO: 1093609 - DNA, 22 bp, Artificial Sequence
  chemically synthesized
tgagtctgtttttcaattactt

SEQ ID NO: 1093610 - DNA, 22 bp, Artificial Sequence
  chemically synthesized
ttttgagtctgtttttcaatta

SEQ ID NO: 1093611 - DNA, 22 bp, Artificial Sequence
  chemically synthesized
tattttgagtctgtttttcaat

SEQ ID NO: 1093612 - DNA, 22 bp, Artificial Sequence
  chemically synthesized
ctattttgagtctgtttttcaa

SEQ ID NO: 1093613 - DNA, 22 bp, Artificial Sequence
  chemically synthesized
ttctattttgagtctgtttttc

SEQ ID NO: 1093614 - DNA, 22 bp, Artificial Sequence
  chemically synthesized
cttctattttgagtctgttttt

SEQ ID NO: 1093615 - DNA, 22 bp, Artificial Sequence
  chemically synthesized
tcttctattttgagtctgtttt

SEQ ID NO: 1093616 - DNA, 22 bp, Artificial Sequence
  chemically synthesized
ttttcttctattttgagtctgt

SEQ ID NO: 1093617 - DNA, 22 bp, Artificial Sequence
  chemically synthesized
cagttgttttcttctattttga

SEQ ID NO: 1093618 - DNA, 22 bp, Artificial Sequence
  chemically synthesized
aaaaacagactcaaaatagaag

SEQ ID NO: 1093619 - DNA, 22 bp, Artificial Sequence
  chemically synthesized
cagatgttgcagttgttttctt

SEQ ID NO: 1093620 - DNA, 22 bp, Artificial Sequence
  chemically synthesized
aaaatagaagaaaacaactgca

SEQ ID NO: 1093621 - DNA, 22 bp, Artificial Sequence
  chemically synthesized
tgtgttacagatgttgcagttg

SEQ ID NO: 1093622 - DNA, 22 bp, Artificial Sequence
  chemically synthesized
atgtgttacagatgttgcagtt

SEQ ID NO: 1093623 - DNA, 22 bp, Artificial Sequence
  chemically synthesized
ttatgtgttacagatgttgcag

SEQ ID NO: 1093624 - DNA, 22 bp, Artificial Sequence
  chemically synthesized
atattcttatgtgttacagatg

SEQ ID NO: 1093625 - DNA, 22 bp, Artificial Sequence
  chemically synthesized
catattcttatgtgttacagat

SEQ ID NO: 1093626 - DNA, 22 bp, Artificial Sequence
  chemically synthesized
tcatattcttatgtgttacaga

SEQ ID NO: 1093627 - DNA, 22 bp, Artificial Sequence
  chemically synthesized
ttcatattcttatgtgttacag

SEQ ID NO: 1093628 - DNA, 22 bp, Artificial Sequence
  chemically synthesized
caacatctgtaacacataagaa

SEQ ID NO: 1093629 - DNA, 22 bp, Artificial Sequence
  chemically synthesized
gcatttttcatattcttatgtg

SEQ ID NO: 1093630 - DNA, 22 bp, Artificial Sequence
  chemically synthesized
ctggcatttttcatattcttat

SEQ ID NO: 1093631 - DNA, 22 bp, Artificial Sequence
  chemically synthesized
gctggcatttttcatattctta

SEQ ID NO: 1093632 - DNA, 22 bp, Artificial Sequence
  chemically synthesized
acttgctggcatttttcatatt

SEQ ID NO: 1093633 - DNA, 22 bp, Artificial Sequence
  chemically synthesized
taacacataagaatatgaaaaa

SEQ ID NO: 1093634 - DNA, 22 bp, Artificial Sequence
  chemically synthesized
gacttgctggcatttttcatat

SEQ ID NO: 1093635 - DNA, 22 bp, Artificial Sequence
  chemically synthesized
tttgacttgctggcatttttca

SEQ ID NO: 1093636 - DNA, 22 bp, Artificial Sequence
  chemically synthesized
tatttgacttgctggcattttt

SEQ ID NO: 1093637 - DNA, 22 bp, Artificial Sequence
  chemically synthesized
ctatttgacttgctggcatttt

SEQ ID NO: 1093638 - DNA, 22 bp, Artificial Sequence
  chemically synthesized
atcttctatttgacttgctggc

SEQ ID NO: 1093639 - DNA, 22 bp, Artificial Sequence
  chemically synthesized
ttcatcttctatttgacttgct

SEQ ID NO: 1093640 - DNA, 22 bp, Artificial Sequence
  chemically synthesized
ggttattcatcttctatttgac

SEQ ID NO: 1093641 - DNA, 22 bp, Artificial Sequence
  chemically synthesized
tcgattgggttattcatcttct

SEQ ID NO: 1093642 - DNA, 22 bp, Artificial Sequence
  chemically synthesized
attatcgattgggttattcatc

SEQ ID NO: 1093643 - DNA, 22 bp, Artificial Sequence
  chemically synthesized
cattatcgattgggttattcat

SEQ ID NO: 1093644 - DNA, 22 bp, Artificial Sequence
  chemically synthesized
tcattatcgattgggttattca

SEQ ID NO: 1093645 - DNA, 22 bp, Artificial Sequence
  chemically synthesized
ttcattatcgattgggttattc

SEQ ID NO: 1093646 - DNA, 22 bp, Artificial Sequence
  chemically synthesized
ttttcattatcgattgggttat

SEQ ID NO: 1093647 - DNA, 22 bp, Artificial Sequence
  chemically synthesized
cttttcattatcgattgggtta

SEQ ID NO: 1093648 - DNA, 22 bp, Artificial Sequence
  chemically synthesized
tcttttcattatcgattgggtt

SEQ ID NO: 1093649 - DNA, 22 bp, Artificial Sequence
  chemically synthesized
aggttttcttttcattatcgat

SEQ ID NO: 1093650 - DNA, 22 bp, Artificial Sequence
  chemically synthesized
gttcaggttttcttttcattat

SEQ ID NO: 1093651 - DNA, 22 bp, Artificial Sequence
  chemically synthesized
ggttcaggttttcttttcatta

SEQ ID NO: 1093652 - DNA, 22 bp, Artificial Sequence
  chemically synthesized
tggttcaggttttcttttcatt

SEQ ID NO: 1093653 - DNA, 22 bp, Artificial Sequence
  chemically synthesized
agattttggttcaggttttctt

SEQ ID NO: 1093654 - DNA, 22 bp, Artificial Sequence
  chemically synthesized
aagattttggttcaggttttct

SEQ ID NO: 1093655 - DNA, 22 bp, Artificial Sequence
  chemically synthesized
taagattttggttcaggttttc

SEQ ID NO: 1093656 - DNA, 22 bp, Artificial Sequence
  chemically synthesized
tttaagattttggttcaggttt

SEQ ID NO: 1093657 - DNA, 22 bp, Artificial Sequence
  chemically synthesized
tctttaagattttggttcaggt

SEQ ID NO: 1093658 - DNA, 22 bp, Artificial Sequence
  chemically synthesized
ctctttaagattttggttcagg

SEQ ID NO: 1093659 - DNA, 22 bp, Artificial Sequence
  chemically synthesized
aaccaaaatcttaaagagaaat

SEQ ID NO: 1093660 - DNA, 22 bp, Artificial Sequence
  chemically synthesized
atgtatatacatatttctcttt

SEQ ID NO: 1093661 - DNA, 22 bp, Artificial Sequence
  chemically synthesized
aatgtatatacatatttctctt

SEQ ID NO: 1093662 - DNA, 22 bp, Artificial Sequence
  chemically synthesized
atgtttaatgtatatacatatt

SEQ ID NO: 1093663 - DNA, 22 bp, Artificial Sequence
  chemically synthesized
catgtttaatgtatatacatat

SEQ ID NO: 1093664 - DNA, 22 bp, Artificial Sequence
  chemically synthesized
aaagagaaatatgtatatacat

SEQ ID NO: 1093665 - DNA, 22 bp, Artificial Sequence
  chemically synthesized
aagagaaatatgtatatacatt

SEQ ID NO: 1093666 - DNA, 22 bp, Artificial Sequence
  chemically synthesized
aacatatcttcatgtttaatgt

SEQ ID NO: 1093667 - DNA, 22 bp, Artificial Sequence
  chemically synthesized
atgagattgaacatatcttcat

SEQ ID NO: 1093668 - DNA, 22 bp, Artificial Sequence
  chemically synthesized
ctaatgagattgaacatatctt

SEQ ID NO: 1093669 - DNA, 22 bp, Artificial Sequence
  chemically synthesized
attactaatgagattgaacata

SEQ ID NO: 1093670 - DNA, 22 bp, Artificial Sequence
  chemically synthesized
gattactaatgagattgaacat

SEQ ID NO: 1093671 - DNA, 22 bp, Artificial Sequence
  chemically synthesized
aacatgaagatatgttcaatct

SEQ ID NO: 1093672 - DNA, 22 bp, Artificial Sequence
  chemically synthesized
catgtccttgattactaatgag

SEQ ID NO: 1093673 - DNA, 22 bp, Artificial Sequence
  chemically synthesized
gcctacatgtccttgattacta

SEQ ID NO: 1093674 - DNA, 22 bp, Artificial Sequence
  chemically synthesized
aatctcattagtaatcaaggac

SEQ ID NO: 1093675 - DNA, 22 bp, Artificial Sequence
  chemically synthesized
taatcctggcctacatgtcctt

SEQ ID NO: 1093676 - DNA, 22 bp, Artificial Sequence
  chemically synthesized
attagtaatcaaggacatgtag

SEQ ID NO: 1093677 - DNA, 22 bp, Artificial Sequence
  chemically synthesized
attgtaatcctggcctacatgt

SEQ ID NO: 1093678 - DNA, 22 bp, Artificial Sequence
  chemically synthesized
gtaatcaaggacatgtaggcca

SEQ ID NO: 1093679 - DNA, 22 bp, Artificial Sequence
  chemically synthesized
tgtcaatcaacatggtatctca

SEQ ID NO: 1093680 - DNA, 22 bp, Artificial Sequence
  chemically synthesized
gtgtcaatcaacatggtatctc

SEQ ID NO: 1093681 - DNA, 22 bp, Artificial Sequence
  chemically synthesized
atttgtgtcaatcaacatggta

SEQ ID NO: 1093682 - DNA, 22 bp, Artificial Sequence
  chemically synthesized
tcatttgtgtcaatcaacatgg

SEQ ID NO: 1093683 - DNA, 22 bp, Artificial Sequence
  chemically synthesized
ctcatttgtgtcaatcaacatg

SEQ ID NO: 1093684 - DNA, 22 bp, Artificial Sequence
  chemically synthesized
caatgagataccatgttgattg

SEQ ID NO: 1093685 - DNA, 22 bp, Artificial Sequence
  chemically synthesized
tcaaacttctcatttgtgtcaa

SEQ ID NO: 1093686 - DNA, 22 bp, Artificial Sequence
  chemically synthesized
attgacacaaatgagaagtttg

SEQ ID NO: 1093687 - DNA, 22 bp, Artificial Sequence
  chemically synthesized
acacgtggaattgtcaaacttc

SEQ ID NO: 1093688 - DNA, 22 bp, Artificial Sequence
  chemically synthesized
acacaaatgagaagtttgacaa

SEQ ID NO: 1093689 - DNA, 22 bp, Artificial Sequence
  chemically synthesized
tcacacgtggaattgtcaaact

SEQ ID NO: 1093690 - DNA, 22 bp, Artificial Sequence
  chemically synthesized
tctcacacgtggaattgtcaaa

SEQ ID NO: 1093691 - DNA, 22 bp, Artificial Sequence
  chemically synthesized
ctctcacacgtggaattgtcaa

SEQ ID NO: 1093692 - DNA, 22 bp, Artificial Sequence
  chemically synthesized
atgtatatcttctctcacacgt

SEQ ID NO: 1093693 - DNA, 22 bp, Artificial Sequence
  chemically synthesized
gacaattccacgtgtgagagaa

SEQ ID NO: 1093694 - DNA, 22 bp, Artificial Sequence
  chemically synthesized
ttcatgtatatcttctctcaca

SEQ ID NO: 1093695 - DNA, 22 bp, Artificial Sequence
  chemically synthesized
acaattccacgtgtgagagaag

SEQ ID NO: 1093696 - DNA, 22 bp, Artificial Sequence
  chemically synthesized
gttcatgtatatcttctctcac

SEQ ID NO: 1093697 - DNA, 22 bp, Artificial Sequence
  chemically synthesized
tgttcatgtatatcttctctca

SEQ ID NO: 1093698 - DNA, 22 bp, Artificial Sequence
  chemically synthesized
ttgttcatgtatatcttctctc

SEQ ID NO: 1093699 - DNA, 22 bp, Artificial Sequence
  chemically synthesized
cacgtgtgagagaagatataca

SEQ ID NO: 1093700 - DNA, 22 bp, Artificial Sequence
  chemically synthesized
agtacacacacccaccaacaat

SEQ ID NO: 1093701 - DNA, 22 bp, Artificial Sequence
  chemically synthesized
cagtacacacacccaccaacaa

SEQ ID NO: 1093702 - DNA, 22 bp, Artificial Sequence
  chemically synthesized
gtatttattgttggtgggtgtg

SEQ ID NO: 1093703 - DNA, 22 bp, Artificial Sequence
  chemically synthesized
tatttattgttggtgggtgtgt

SEQ ID NO: 1093704 - DNA, 22 bp, Artificial Sequence
  chemically synthesized
attgttggtgggtgtgtgtact

SEQ ID NO: 1093705 - DNA, 22 bp, Artificial Sequence
  chemically synthesized
ttgttggtgggtgtgtgtactg

SEQ ID NO: 1093706 - DNA, 22 bp, Artificial Sequence
  chemically synthesized
aaatggccatttcagtacacac

SEQ ID NO: 1093707 - DNA, 22 bp, Artificial Sequence
  chemically synthesized
tgaaatggccatttcagtacac

SEQ ID NO: 1093708 - DNA, 22 bp, Artificial Sequence
  chemically synthesized
ttggtgggtgtgtgtactgaaa

SEQ ID NO: 1093709 - DNA, 22 bp, Artificial Sequence
  chemically synthesized
ctgaaatggccatttcagtaca

SEQ ID NO: 1093710 - DNA, 22 bp, Artificial Sequence
  chemically synthesized
tctgaaatggccatttcagtac

SEQ ID NO: 1093711 - DNA, 22 bp, Artificial Sequence
  chemically synthesized
gtgggtgtgtgtactgaaatgg

SEQ ID NO: 1093712 - DNA, 22 bp, Artificial Sequence
  chemically synthesized
ttttctgaaatggccatttcag

SEQ ID NO: 1093713 - DNA, 22 bp, Artificial Sequence
  chemically synthesized
agaataacaaattgttttctga

SEQ ID NO: 1093714 - DNA, 22 bp, Artificial Sequence
  chemically synthesized
aaatggccatttcagaaaacaa

SEQ ID NO: 1093715 - DNA, 22 bp, Artificial Sequence
  chemically synthesized
ttgagaataacaaattgttttc

SEQ ID NO: 1093716 - DNA, 22 bp, Artificial Sequence
  chemically synthesized
attgagaataacaaattgtttt

SEQ ID NO: 1093717 - DNA, 22 bp, Artificial Sequence
  chemically synthesized
accttattgagaataacaaatt

SEQ ID NO: 1093718 - DNA, 22 bp, Artificial Sequence
  chemically synthesized
cagaaaacaatttgttattctc

SEQ ID NO: 1093719 - DNA, 22 bp, Artificial Sequence
  chemically synthesized
agaaaacaatttgttattctca

SEQ ID NO: 1093720 - DNA, 22 bp, Artificial Sequence
  chemically synthesized
gttattctcaataaggtgaaca

SEQ ID NO: 1093721 - DNA, 22 bp, Artificial Sequence
  chemically synthesized
ttattctcaataaggtgaacat

SEQ ID NO: 1093722 - DNA, 22 bp, Artificial Sequence
  chemically synthesized
atgggtatgtgaatgttcacct

SEQ ID NO: 1093723 - DNA, 22 bp, Artificial Sequence
  chemically synthesized
gatgggtatgtgaatgttcacc

SEQ ID NO: 1093724 - DNA, 22 bp, Artificial Sequence
  chemically synthesized
ttctcaataaggtgaacattca

SEQ ID NO: 1093725 - DNA, 22 bp, Artificial Sequence
  chemically synthesized
tcttgatgggtatgtgaatgtt

SEQ ID NO: 1093726 - DNA, 22 bp, Artificial Sequence
  chemically synthesized
tcaataaggtgaacattcacat

SEQ ID NO: 1093727 - DNA, 22 bp, Artificial Sequence
  chemically synthesized
aataaggtgaacattcacatac

SEQ ID NO: 1093728 - DNA, 22 bp, Artificial Sequence
  chemically synthesized
ttgtcttgatgggtatgtgaat

SEQ ID NO: 1093729 - DNA, 22 bp, Artificial Sequence
  chemically synthesized
acatacccatcaagacaacaac

SEQ ID NO: 1093730 - DNA, 22 bp, Artificial Sequence
  chemically synthesized
aggatgcacatatcaaaaagtg

SEQ ID NO: 1093731 - DNA, 22 bp, Artificial Sequence
  chemically synthesized
tgaggatgcacatatcaaaaag

SEQ ID NO: 1093732 - DNA, 22 bp, Artificial Sequence
  chemically synthesized
tctgaggatgcacatatcaaaa

SEQ ID NO: 1093733 - DNA, 22 bp, Artificial Sequence
  chemically synthesized
ctctgaggatgcacatatcaaa

SEQ ID NO: 1093734 - DNA, 22 bp, Artificial Sequence
  chemically synthesized
cactttttgatatgtgcatcct

SEQ ID NO: 1093735 - DNA, 22 bp, Artificial Sequence
  chemically synthesized
aacagtttctctgaggatgcac

SEQ ID NO: 1093736 - DNA, 22 bp, Artificial Sequence
  chemically synthesized
tttgatatgtgcatcctcagag

SEQ ID NO: 1093737 - DNA, 22 bp, Artificial Sequence
  chemically synthesized
ttgatatgtgcatcctcagaga

SEQ ID NO: 1093738 - DNA, 22 bp, Artificial Sequence
  chemically synthesized
tgatatgtgcatcctcagagaa

SEQ ID NO: 1093739 - DNA, 22 bp, Artificial Sequence
  chemically synthesized
gatatgtgcatcctcagagaaa

SEQ ID NO: 1093740 - DNA, 22 bp, Artificial Sequence
  chemically synthesized
atatgtgcatcctcagagaaac

SEQ ID NO: 1093741 - DNA, 22 bp, Artificial Sequence
  chemically synthesized
tccatgttaaacagtttctctg

SEQ ID NO: 1093742 - DNA, 22 bp, Artificial Sequence
  chemically synthesized
ttatccatgttaaacagtttct

SEQ ID NO: 1093743 - DNA, 22 bp, Artificial Sequence
  chemically synthesized
gttatccatgttaaacagtttc

SEQ ID NO: 1093744 - DNA, 22 bp, Artificial Sequence
  chemically synthesized
agagaaactgtttaacatggat

SEQ ID NO: 1093745 - DNA, 22 bp, Artificial Sequence
  chemically synthesized
taacagtcttgttatccatgtt

SEQ ID NO: 1093746 - DNA, 22 bp, Artificial Sequence
  chemically synthesized
ttgtaacagtcttgttatccat

SEQ ID NO: 1093747 - DNA, 22 bp, Artificial Sequence
  chemically synthesized
tttaacatggataacaagactg

SEQ ID NO: 1093748 - DNA, 22 bp, Artificial Sequence
  chemically synthesized
aacatggataacaagactgtta

SEQ ID NO: 1093749 - DNA, 22 bp, Artificial Sequence
  chemically synthesized
acatggataacaagactgttac

SEQ ID NO: 1093750 - DNA, 22 bp, Artificial Sequence
  chemically synthesized
aaatgatcattgttgtaacagt

SEQ ID NO: 1093751 - DNA, 22 bp, Artificial Sequence
  chemically synthesized
caaaaagggctgaaatgatcat

SEQ ID NO: 1093752 - DNA, 22 bp, Artificial Sequence
  chemically synthesized
ctacaaaaagggctgaaatgat

SEQ ID NO: 1093753 - DNA, 22 bp, Artificial Sequence
  chemically synthesized
ttacaacaatgatcatttcagc

SEQ ID NO: 1093754 - DNA, 22 bp, Artificial Sequence
  chemically synthesized
caacaatgatcatttcagccct

SEQ ID NO: 1093755 - DNA, 22 bp, Artificial Sequence
  chemically synthesized
attactacaaaaagggctgaaa

SEQ ID NO: 1093756 - DNA, 22 bp, Artificial Sequence
  chemically synthesized
gattactacaaaaagggctgaa

SEQ ID NO: 1093757 - DNA, 22 bp, Artificial Sequence
  chemically synthesized
tgattactacaaaaagggctga

SEQ ID NO: 1093758 - DNA, 22 bp, Artificial Sequence
  chemically synthesized
ttgattactacaaaaagggctg

SEQ ID NO: 1093759 - DNA, 22 bp, Artificial Sequence
  chemically synthesized
tttgattactacaaaaagggct

SEQ ID NO: 1093760 - DNA, 22 bp, Artificial Sequence
  chemically synthesized
ttttgattactacaaaaagggc

SEQ ID NO: 1093761 - DNA, 22 bp, Artificial Sequence
  chemically synthesized
tttttgattactacaaaaaggg

SEQ ID NO: 1093762 - DNA, 22 bp, Artificial Sequence
  chemically synthesized
ttttttgattactacaaaaagg

SEQ ID NO: 1093763 - DNA, 22 bp, Artificial Sequence
  chemically synthesized
cttttttttgattactacaaaa

SEQ ID NO: 1093764 - DNA, 22 bp, Artificial Sequence
  chemically synthesized
ccttttttttgattactacaaa

SEQ ID NO: 1093765 - DNA, 22 bp, Artificial Sequence
  chemically synthesized
tttccttttttttgattactac

SEQ ID NO: 1093766 - DNA, 22 bp, Artificial Sequence
  chemically synthesized
cagccctttttgtagtaatcaa

SEQ ID NO: 1093767 - DNA, 22 bp, Artificial Sequence
  chemically synthesized
agccctttttgtagtaatcaaa

SEQ ID NO: 1093768 - DNA, 22 bp, Artificial Sequence
  chemically synthesized
tttgtagtaatcaaaaaaaagg

SEQ ID NO: 1093769 - DNA, 22 bp, Artificial Sequence
  chemically synthesized
ttgtagtaatcaaaaaaaagga

SEQ ID NO: 1093770 - DNA, 22 bp, Artificial Sequence
  chemically synthesized
tgtagtaatcaaaaaaaaggaa

SEQ ID NO: 1093771 - DNA, 22 bp, Artificial Sequence
  chemically synthesized
gtagtaatcaaaaaaaaggaaa

SEQ ID NO: 1093772 - DNA, 22 bp, Artificial Sequence
  chemically synthesized
cagtggacattatttccttttt

SEQ ID NO: 1093773 - DNA, 22 bp, Artificial Sequence
  chemically synthesized
tagtaatcaaaaaaaaggaaat

SEQ ID NO: 1093774 - DNA, 22 bp, Artificial Sequence
  chemically synthesized
gcagtggacattatttcctttt

SEQ ID NO: 1093775 - DNA, 22 bp, Artificial Sequence
  chemically synthesized
cttgcagtggacattatttcct

SEQ ID NO: 1093776 - DNA, 22 bp, Artificial Sequence
  chemically synthesized
tccttgcagtggacattatttc

SEQ ID NO: 1093777 - DNA, 22 bp, Artificial Sequence
  chemically synthesized
cattctccttgcagtggacatt

SEQ ID NO: 1093778 - DNA, 22 bp, Artificial Sequence
  chemically synthesized
ccattctccttgcagtggacat

SEQ ID NO: 1093779 - DNA, 22 bp, Artificial Sequence
  chemically synthesized
tccattctccttgcagtggaca

SEQ ID NO: 1093780 - DNA, 22 bp, Artificial Sequence
  chemically synthesized
ttccattctccttgcagtggac

SEQ ID NO: 1093781 - DNA, 22 bp, Artificial Sequence
  chemically synthesized
aagatgacggtatatttttcca

SEQ ID NO: 1093782 - DNA, 22 bp, Artificial Sequence
  chemically synthesized
aaagatgacggtatatttttcc

SEQ ID NO: 1093783 - DNA, 22 bp, Artificial Sequence
  chemically synthesized
caaggagaatggaaaaatatac

SEQ ID NO: 1093784 - DNA, 22 bp, Artificial Sequence
  chemically synthesized
tttaaagatgacggtatatttt

SEQ ID NO: 1093785 - DNA, 22 bp, Artificial Sequence
  chemically synthesized
tgtttaaagatgacggtatatt

SEQ ID NO: 1093786 - DNA, 22 bp, Artificial Sequence
  chemically synthesized
tctgtttaaagatgacggtata

SEQ ID NO: 1093787 - DNA, 22 bp, Artificial Sequence
  chemically synthesized
tattctctgtttaaagatgacg

SEQ ID NO: 1093788 - DNA, 22 bp, Artificial Sequence
  chemically synthesized
tcacgtctgtattctctgttta

SEQ ID NO: 1093789 - DNA, 22 bp, Artificial Sequence
  chemically synthesized
attgtcacgtctgtattctctg

SEQ ID NO: 1093790 - DNA, 22 bp, Artificial Sequence
  chemically synthesized
cattgtcacgtctgtattctct

SEQ ID NO: 1093791 - DNA, 22 bp, Artificial Sequence
  chemically synthesized
tcattgtcacgtctgtattctc

SEQ ID NO: 1093792 - DNA, 22 bp, Artificial Sequence
  chemically synthesized
ttcattgtcacgtctgtattct

SEQ ID NO: 1093793 - DNA, 22 bp, Artificial Sequence
  chemically synthesized
taaacagagaatacagacgtga

SEQ ID NO: 1093794 - DNA, 22 bp, Artificial Sequence
  chemically synthesized
aaacagagaatacagacgtgac

SEQ ID NO: 1093795 - DNA, 22 bp, Artificial Sequence
  chemically synthesized
aacagagaatacagacgtgaca

SEQ ID NO: 1093796 - DNA, 22 bp, Artificial Sequence
  chemically synthesized
atgagatttttcattgtcacgt

SEQ ID NO: 1093797 - DNA, 22 bp, Artificial Sequence
  chemically synthesized
gatgagatttttcattgtcacg

SEQ ID NO: 1093798 - DNA, 22 bp, Artificial Sequence
  chemically synthesized
tgatgagatttttcattgtcac

SEQ ID NO: 1093799 - DNA, 22 bp, Artificial Sequence
  chemically synthesized
ttgatgagatttttcattgtca

SEQ ID NO: 1093800 - DNA, 22 bp, Artificial Sequence
  chemically synthesized
tttgatgagatttttcattgtc

SEQ ID NO: 1093801 - DNA, 22 bp, Artificial Sequence
  chemically synthesized
tttttgatgagatttttcattg

SEQ ID NO: 1093802 - DNA, 22 bp, Artificial Sequence
  chemically synthesized
tggttctttttgatgagatttt

SEQ ID NO: 1093803 - DNA, 22 bp, Artificial Sequence
  chemically synthesized
atggttctttttgatgagattt

SEQ ID NO: 1093804 - DNA, 22 bp, Artificial Sequence
  chemically synthesized
ttatggttctttttgatgagat

SEQ ID NO: 1093805 - DNA, 22 bp, Artificial Sequence
  chemically synthesized
attcttatggttctttttgatg

SEQ ID NO: 1093806 - DNA, 22 bp, Artificial Sequence
  chemically synthesized
agattcattcttatggttcttt

SEQ ID NO: 1093807 - DNA, 22 bp, Artificial Sequence
  chemically synthesized
tgtctgagattcattcttatgg

SEQ ID NO: 1093808 - DNA, 22 bp, Artificial Sequence
  chemically synthesized
atcaaaaagaaccataagaatg

SEQ ID NO: 1093809 - DNA, 22 bp, Artificial Sequence
  chemically synthesized
gtgtctgagattcattcttatg

SEQ ID NO: 1093810 - DNA, 22 bp, Artificial Sequence
  chemically synthesized
acccaacatatttgtgtctgag

SEQ ID NO: 1093811 - DNA, 22 bp, Artificial Sequence
  chemically synthesized
cacccaacatatttgtgtctga

SEQ ID NO: 1093812 - DNA, 22 bp, Artificial Sequence
  chemically synthesized
tcacccaacatatttgtgtctg

SEQ ID NO: 1093813 - DNA, 22 bp, Artificial Sequence
  chemically synthesized
tctttcacccaacatatttgtg

SEQ ID NO: 1093814 - DNA, 22 bp, Artificial Sequence
  chemically synthesized
gtctttcacccaacatatttgt

SEQ ID NO: 1093815 - DNA, 22 bp, Artificial Sequence
  chemically synthesized
tgtctttcacccaacatatttg

SEQ ID NO: 1093816 - DNA, 22 bp, Artificial Sequence
  chemically synthesized
gggctttgtctttcacccaaca

SEQ ID NO: 1093817 - DNA, 22 bp, Artificial Sequence
  chemically synthesized
agacacaaatatgttgggtgaa

SEQ ID NO: 1093818 - DNA, 22 bp, Artificial Sequence
  chemically synthesized
agggctttgtctttcacccaac

SEQ ID NO: 1093819 - DNA, 22 bp, Artificial Sequence
  chemically synthesized
tagggctttgtctttcacccaa

SEQ ID NO: 1093820 - DNA, 22 bp, Artificial Sequence
  chemically synthesized
ttagggctttgtctttcaccca

SEQ ID NO: 1093821 - DNA, 22 bp, Artificial Sequence
  chemically synthesized
tttagggctttgtctttcaccc

SEQ ID NO: 1093822 - DNA, 22 bp, Artificial Sequence
  chemically synthesized
ttttagggctttgtctttcacc

SEQ ID NO: 1093823 - DNA, 22 bp, Artificial Sequence
  chemically synthesized
taatatagtttttttagggctt

SEQ ID NO: 1093824 - DNA, 22 bp, Artificial Sequence
  chemically synthesized
ggtgaaagacaaagccctaaaa

SEQ ID NO: 1093825 - DNA, 22 bp, Artificial Sequence
  chemically synthesized
cagtaatggtaaactataatat

SEQ ID NO: 1093826 - DNA, 22 bp, Artificial Sequence
  chemically synthesized
aaaaaactatattatagtttac

SEQ ID NO: 1093827 - DNA, 22 bp, Artificial Sequence
  chemically synthesized
agtattacagtaatggtaaact

SEQ ID NO: 1093828 - DNA, 22 bp, Artificial Sequence
  chemically synthesized
cagtattacagtaatggtaaac

SEQ ID NO: 1093829 - DNA, 22 bp, Artificial Sequence
  chemically synthesized
atttcagtattacagtaatggt

SEQ ID NO: 1093830 - DNA, 22 bp, Artificial Sequence
  chemically synthesized
tattatagtttaccattactgt

SEQ ID NO: 1093831 - DNA, 22 bp, Artificial Sequence
  chemically synthesized
aatttcagtattacagtaatgg

SEQ ID NO: 1093832 - DNA, 22 bp, Artificial Sequence
  chemically synthesized
tagtttaccattactgtaatac

SEQ ID NO: 1093833 - DNA, 22 bp, Artificial Sequence
  chemically synthesized
tgcttaatttcagtattacagt

SEQ ID NO: 1093834 - DNA, 22 bp, Artificial Sequence
  chemically synthesized
accattactgtaatactgaaat

SEQ ID NO: 1093835 - DNA, 22 bp, Artificial Sequence
  chemically synthesized
ccattactgtaatactgaaatt

SEQ ID NO: 1093836 - DNA, 22 bp, Artificial Sequence
  chemically synthesized
ctgtaatactgaaattaagcac

SEQ ID NO: 1093837 - DNA, 22 bp, Artificial Sequence
  chemically synthesized
taatactgaaattaagcacaat

SEQ ID NO: 1093838 - DNA, 22 bp, Artificial Sequence
  chemically synthesized
aaattaagcacaattgtttttt

SEQ ID NO: 1093839 - DNA, 22 bp, Artificial Sequence
  chemically synthesized
agcacaattgttttttcactca

SEQ ID NO: 1093840 - DNA, 22 bp, Artificial Sequence
  chemically synthesized
aaaaaaatccacacacatatga

SEQ ID NO: 1093841 - DNA, 22 bp, Artificial Sequence
  chemically synthesized
aaaaaaaatccacacacatatg

SEQ ID NO: 1093842 - DNA, 22 bp, Artificial Sequence
  chemically synthesized
ttttttcactcatatgtgtgtg

SEQ ID NO: 1093843 - DNA, 22 bp, Artificial Sequence
  chemically synthesized
tttaaaaaaaatccacacacat

SEQ ID NO: 1093844 - DNA, 22 bp, Artificial Sequence
  chemically synthesized
gtttaaaaaaaatccacacaca

SEQ ID NO: 1093845 - DNA, 22 bp, Artificial Sequence
  chemically synthesized
tttcactcatatgtgtgtggat

SEQ ID NO: 1093846 - DNA, 22 bp, Artificial Sequence
  chemically synthesized
tgtttaaaaaaaatccacacac

SEQ ID NO: 1093847 - DNA, 22 bp, Artificial Sequence
  chemically synthesized
ttcactcatatgtgtgtggatt

SEQ ID NO: 1093848 - DNA, 22 bp, Artificial Sequence
  chemically synthesized
tcactcatatgtgtgtggattt

SEQ ID NO: 1093849 - DNA, 22 bp, Artificial Sequence
  chemically synthesized
cactcatatgtgtgtggatttt

SEQ ID NO: 1093850 - DNA, 22 bp, Artificial Sequence
  chemically synthesized
ctttgtttaaaaaaaatccaca

SEQ ID NO: 1093851 - DNA, 22 bp, Artificial Sequence
  chemically synthesized
actcatatgtgtgtggattttt

SEQ ID NO: 1093852 - DNA, 22 bp, Artificial Sequence
  chemically synthesized
ttcctttgtttaaaaaaaatcc

SEQ ID NO: 1093853 - DNA, 22 bp, Artificial Sequence
  chemically synthesized
atatgtgtgtggatttttttta

SEQ ID NO: 1093854 - DNA, 22 bp, Artificial Sequence
  chemically synthesized
ttattcctttgtttaaaaaaaa

SEQ ID NO: 1093855 - DNA, 22 bp, Artificial Sequence
  chemically synthesized
gttattcctttgtttaaaaaaa

SEQ ID NO: 1093856 - DNA, 22 bp, Artificial Sequence
  chemically synthesized
tgttattcctttgtttaaaaaa

SEQ ID NO: 1093857 - DNA, 22 bp, Artificial Sequence
  chemically synthesized
cctttgttattcctttgtttaa

SEQ ID NO: 1093858 - DNA, 22 bp, Artificial Sequence
  chemically synthesized
gaaagctacctttgttattcct

SEQ ID NO: 1093859 - DNA, 22 bp, Artificial Sequence
  chemically synthesized
tttttaaacaaaggaataacaa

SEQ ID NO: 1093860 - DNA, 22 bp, Artificial Sequence
  chemically synthesized
ttttaaacaaaggaataacaaa

SEQ ID NO: 1093861 - DNA, 22 bp, Artificial Sequence
  chemically synthesized
tttaaacaaaggaataacaaag

SEQ ID NO: 1093862 - DNA, 22 bp, Artificial Sequence
  chemically synthesized
ttaaacaaaggaataacaaagg

SEQ ID NO: 1093863 - DNA, 22 bp, Artificial Sequence
  chemically synthesized
taaacaaaggaataacaaaggt

SEQ ID NO: 1093864 - DNA, 22 bp, Artificial Sequence
  chemically synthesized
aaacaaaggaataacaaaggta

SEQ ID NO: 1093865 - DNA, 22 bp, Artificial Sequence
  chemically synthesized
aacaaaggaataacaaaggtag

SEQ ID NO: 1093866 - DNA, 22 bp, Artificial Sequence
  chemically synthesized
cccaatagacataatcaccatc

SEQ ID NO: 1093867 - DNA, 22 bp, Artificial Sequence
  chemically synthesized
ccccaatagacataatcaccat

SEQ ID NO: 1093868 - DNA, 22 bp, Artificial Sequence
  chemically synthesized
tccccaatagacataatcacca

SEQ ID NO: 1093869 - DNA, 22 bp, Artificial Sequence
  chemically synthesized
ttccccaatagacataatcacc

SEQ ID NO: 1093870 - DNA, 22 bp, Artificial Sequence
  chemically synthesized
tcttttccccaatagacataat

SEQ ID NO: 1093871 - DNA, 22 bp, Artificial Sequence
  chemically synthesized
tctagatggtgattatgtctat

SEQ ID NO: 1093872 - DNA, 22 bp, Artificial Sequence
  chemically synthesized
ctagatggtgattatgtctatt

SEQ ID NO: 1093873 - DNA, 22 bp, Artificial Sequence
  chemically synthesized
tagatggtgattatgtctattg

SEQ ID NO: 1093874 - DNA, 22 bp, Artificial Sequence
  chemically synthesized
ctatcttttccccaatagacat

SEQ ID NO: 1093875 - DNA, 22 bp, Artificial Sequence
  chemically synthesized
cctatcttttccccaatagaca

SEQ ID NO: 1093876 - DNA, 22 bp, Artificial Sequence
  chemically synthesized
gatggtgattatgtctattggg

SEQ ID NO: 1093877 - DNA, 22 bp, Artificial Sequence
  chemically synthesized
gcatcttcctatcttttcccca

SEQ ID NO: 1093878 - DNA, 22 bp, Artificial Sequence
  chemically synthesized
tcgcatcttcctatcttttccc

SEQ ID NO: 1093879 - DNA, 22 bp, Artificial Sequence
  chemically synthesized
tctcgcatcttcctatcttttc

SEQ ID NO: 1093880 - DNA, 22 bp, Artificial Sequence
  chemically synthesized
tgtctattggggaaaagatagg

SEQ ID NO: 1093881 - DNA, 22 bp, Artificial Sequence
  chemically synthesized
tcctctctcgcatcttcctatc

SEQ ID NO: 1093882 - DNA, 22 bp, Artificial Sequence
  chemically synthesized
atcctctctcgcatcttcctat

SEQ ID NO: 1093883 - DNA, 22 bp, Artificial Sequence
  chemically synthesized
ttggggaaaagataggaagatg

SEQ ID NO: 1093884 - DNA, 22 bp, Artificial Sequence
  chemically synthesized
ttatcctctctcgcatcttcct

SEQ ID NO: 1093885 - DNA, 22 bp, Artificial Sequence
  chemically synthesized
gggaaaagataggaagatgcga

SEQ ID NO: 1093886 - DNA, 22 bp, Artificial Sequence
  chemically synthesized
cattcttatcctctctcgcatc

SEQ ID NO: 1093887 - DNA, 22 bp, Artificial Sequence
  chemically synthesized
ttacattcttatcctctctcgc

SEQ ID NO: 1093888 - DNA, 22 bp, Artificial Sequence
  chemically synthesized
acagaaaatgaccgttgttaca

SEQ ID NO: 1093889 - DNA, 22 bp, Artificial Sequence
  chemically synthesized
caaagctaacagaaaatgaccg

SEQ ID NO: 1093890 - DNA, 22 bp, Artificial Sequence
  chemically synthesized
aacagttacaaagctaacagaa

SEQ ID NO: 1093891 - DNA, 22 bp, Artificial Sequence
  chemically synthesized
attcaacagttacaaagctaac

SEQ ID NO: 1093892 - DNA, 22 bp, Artificial Sequence
  chemically synthesized
taggttcattcaacagttacaa

SEQ ID NO: 1093893 - DNA, 22 bp, Artificial Sequence
  chemically synthesized
ataggttcattcaacagttaca

SEQ ID NO: 1093894 - DNA, 22 bp, Artificial Sequence
  chemically synthesized
tctgttagctttgtaactgttg

SEQ ID NO: 1093895 - DNA, 22 bp, Artificial Sequence
  chemically synthesized
ctgttagctttgtaactgttga

SEQ ID NO: 1093896 - DNA, 22 bp, Artificial Sequence
  chemically synthesized
tgttagctttgtaactgttgaa

SEQ ID NO: 1093897 - DNA, 22 bp, Artificial Sequence
  chemically synthesized
ttagctttgtaactgttgaatg

SEQ ID NO: 1093898 - DNA, 22 bp, Artificial Sequence
  chemically synthesized
tacttataggttcattcaacag

SEQ ID NO: 1093899 - DNA, 22 bp, Artificial Sequence
  chemically synthesized
gctttgtaactgttgaatgaac

SEQ ID NO: 1093900 - DNA, 22 bp, Artificial Sequence
  chemically synthesized
ctgtacttataggttcattcaa

SEQ ID NO: 1093901 - DNA, 22 bp, Artificial Sequence
  chemically synthesized
actgtacttataggttcattca

SEQ ID NO: 1093902 - DNA, 22 bp, Artificial Sequence
  chemically synthesized
tgtaactgttgaatgaacctat

SEQ ID NO: 1093903 - DNA, 22 bp, Artificial Sequence
  chemically synthesized
gtaactgttgaatgaacctata

SEQ ID NO: 1093904 - DNA, 22 bp, Artificial Sequence
  chemically synthesized
taactgttgaatgaacctataa

SEQ ID NO: 1093905 - DNA, 22 bp, Artificial Sequence
  chemically synthesized
tgtttactgtacttataggttc

SEQ ID NO: 1093906 - DNA, 22 bp, Artificial Sequence
  chemically synthesized
cattgtgtttactgtacttata

SEQ ID NO: 1093907 - DNA, 22 bp, Artificial Sequence
  chemically synthesized
ttgaatgaacctataagtacag

SEQ ID NO: 1093908 - DNA, 22 bp, Artificial Sequence
  chemically synthesized
ctgcattgtgtttactgtactt

SEQ ID NO: 1093909 - DNA, 22 bp, Artificial Sequence
  chemically synthesized
aatgaacctataagtacagtaa

SEQ ID NO: 1093910 - DNA, 22 bp, Artificial Sequence
  chemically synthesized
taagtacagtaaacacaatgca

SEQ ID NO: 1093911 - DNA, 22 bp, Artificial Sequence
  chemically synthesized
gtggtagtgaggcgggggcagg

SEQ ID NO: 1093912 - DNA, 22 bp, Artificial Sequence
  chemically synthesized
ggtggtagtgaggcgggggcag

SEQ ID NO: 1093913 - DNA, 22 bp, Artificial Sequence
  chemically synthesized
tggtggtagtgaggcgggggca

SEQ ID NO: 1093914 - DNA, 22 bp, Artificial Sequence
  chemically synthesized
actaccacctgcccccgcctca

SEQ ID NO: 1093915 - DNA, 22 bp, Artificial Sequence
  chemically synthesized
ctaccacctgcccccgcctcac

SEQ ID NO: 1093916 - DNA, 22 bp, Artificial Sequence
  chemically synthesized
attttggtggtagtgaggcggg

SEQ ID NO: 1093917 - DNA, 22 bp, Artificial Sequence
  chemically synthesized
aattttggtggtagtgaggcgg

SEQ ID NO: 1093918 - DNA, 22 bp, Artificial Sequence
  chemically synthesized
taattttggtggtagtgaggcg

SEQ ID NO: 1093919 - DNA, 22 bp, Artificial Sequence
  chemically synthesized
ccacctgcccccgcctcactac

SEQ ID NO: 1093920 - DNA, 22 bp, Artificial Sequence
  chemically synthesized
aagcctttaattttggtggtag

SEQ ID NO: 1093921 - DNA, 22 bp, Artificial Sequence
  chemically synthesized
cccccgcctcactaccaccaaa

SEQ ID NO: 1093922 - DNA, 22 bp, Artificial Sequence
  chemically synthesized
caagcctttaattttggtggta

SEQ ID NO: 1093923 - DNA, 22 bp, Artificial Sequence
  chemically synthesized
tcaagcctttaattttggtggt

SEQ ID NO: 1093924 - DNA, 22 bp, Artificial Sequence
  chemically synthesized
ctttcaagcctttaattttggt

SEQ ID NO: 1093925 - DNA, 22 bp, Artificial Sequence
  chemically synthesized
cctttcaagcctttaattttgg

SEQ ID NO: 1093926 - DNA, 22 bp, Artificial Sequence
  chemically synthesized
actaccaccaaaattaaaggct

SEQ ID NO: 1093927 - DNA, 22 bp, Artificial Sequence
  chemically synthesized
ccaccaaaattaaaggcttgaa

SEQ ID NO: 1093928 - DNA, 22 bp, Artificial Sequence
  chemically synthesized
aaataaatcttcctttcaagcc

SEQ ID NO: 1093929 - DNA, 22 bp, Artificial Sequence
  chemically synthesized
tgaaataaatcttcctttcaag

SEQ ID NO: 1093930 - DNA, 22 bp, Artificial Sequence
  chemically synthesized
ctgaaataaatcttcctttcaa

SEQ ID NO: 1093931 - DNA, 22 bp, Artificial Sequence
  chemically synthesized
aaggcttgaaaggaagatttat

SEQ ID NO: 1093932 - DNA, 22 bp, Artificial Sequence
  chemically synthesized
gatccttctgaaataaatcttc

SEQ ID NO: 1093933 - DNA, 22 bp, Artificial Sequence
  chemically synthesized
agatccttctgaaataaatctt

SEQ ID NO: 1093934 - DNA, 22 bp, Artificial Sequence
  chemically synthesized
tagatccttctgaaataaatct

SEQ ID NO: 1093935 - DNA, 22 bp, Artificial Sequence
  chemically synthesized
ttagatccttctgaaataaatc

SEQ ID NO: 1093936 - DNA, 22 bp, Artificial Sequence
  chemically synthesized
tttagatccttctgaaataaat

SEQ ID NO: 1093937 - DNA, 22 bp, Artificial Sequence
  chemically synthesized
gaaaggaagatttatttcagaa

SEQ ID NO: 1093938 - DNA, 22 bp, Artificial Sequence
  chemically synthesized
aaaggaagatttatttcagaag

SEQ ID NO: 1093939 - DNA, 22 bp, Artificial Sequence
  chemically synthesized
attttttagatccttctgaaat

SEQ ID NO: 1093940 - DNA, 22 bp, Artificial Sequence
  chemically synthesized
attaattttttagatccttctg

SEQ ID NO: 1093941 - DNA, 22 bp, Artificial Sequence
  chemically synthesized
atttcagaaggatctaaaaaat

SEQ ID NO: 1093942 - DNA, 22 bp, Artificial Sequence
  chemically synthesized
tttcagaaggatctaaaaaatt

SEQ ID NO: 1093943 - DNA, 22 bp, Artificial Sequence
  chemically synthesized
ggaaatctgattaattttttag

SEQ ID NO: 1093944 - DNA, 22 bp, Artificial Sequence
  chemically synthesized
gggaaatctgattaatttttta

SEQ ID NO: 1093945 - DNA, 22 bp, Artificial Sequence
  chemically synthesized
tgggaaatctgattaatttttt

SEQ ID NO: 1093946 - DNA, 22 bp, Artificial Sequence
  chemically synthesized
cagaaggatctaaaaaattaat

SEQ ID NO: 1093947 - DNA, 22 bp, Artificial Sequence
  chemically synthesized
agaaggatctaaaaaattaatc

SEQ ID NO: 1093948 - DNA, 22 bp, Artificial Sequence
  chemically synthesized
aaaaattaatcagatttcccaa

SEQ ID NO: 1093949 - DNA, 22 bp, Artificial Sequence
  chemically synthesized
tgaacatagagaactttgggaa

SEQ ID NO: 1093950 - DNA, 22 bp, Artificial Sequence
  chemically synthesized
atcagatttcccaaagttctct

SEQ ID NO: 1093951 - DNA, 22 bp, Artificial Sequence
  chemically synthesized
agggctatgaacatagagaact

SEQ ID NO: 1093952 - DNA, 22 bp, Artificial Sequence
  chemically synthesized
taagggctatgaacatagagaa

SEQ ID NO: 1093953 - DNA, 22 bp, Artificial Sequence
  chemically synthesized
cccaaagttctctatgttcata

SEQ ID NO: 1093954 - DNA, 22 bp, Artificial Sequence
  chemically synthesized
ccaaagttctctatgttcatag

SEQ ID NO: 1093955 - DNA, 22 bp, Artificial Sequence
  chemically synthesized
tgtcattctaagggctatgaac

SEQ ID NO: 1093956 - DNA, 22 bp, Artificial Sequence
  chemically synthesized
tgtgtcattctaagggctatga

SEQ ID NO: 1093957 - DNA, 22 bp, Artificial Sequence
  chemically synthesized
tctatgttcatagcccttagaa

SEQ ID NO: 1093958 - DNA, 22 bp, Artificial Sequence
  chemically synthesized
tatgttcatagcccttagaatg

SEQ ID NO: 1093959 - DNA, 22 bp, Artificial Sequence
  chemically synthesized
tgttcatagcccttagaatgac

SEQ ID NO: 1093960 - DNA, 22 bp, Artificial Sequence
  chemically synthesized
atagcccttagaatgacacaga

SEQ ID NO: 1093961 - DNA, 22 bp, Artificial Sequence
  chemically synthesized
atcagatagagatcgaatactc

SEQ ID NO: 1093962 - DNA, 22 bp, Artificial Sequence
  chemically synthesized
agaatgacacagagtattcgat

SEQ ID NO: 1093963 - DNA, 22 bp, Artificial Sequence
  chemically synthesized
catcagatagagatcgaatact

SEQ ID NO: 1093964 - DNA, 22 bp, Artificial Sequence
  chemically synthesized
gaatgacacagagtattcgatc

SEQ ID NO: 1093965 - DNA, 22 bp, Artificial Sequence
  chemically synthesized
tcatcagatagagatcgaatac

SEQ ID NO: 1093966 - DNA, 22 bp, Artificial Sequence
  chemically synthesized
ttcatcagatagagatcgaata

SEQ ID NO: 1093967 - DNA, 22 bp, Artificial Sequence
  chemically synthesized
atacttttcatcagatagagat

SEQ ID NO: 1093968 - DNA, 22 bp, Artificial Sequence
  chemically synthesized
gatctctatctgatgaaaagta

SEQ ID NO: 1093969 - DNA, 22 bp, Artificial Sequence
  chemically synthesized
tatctgatgaaaagtatcagtc

SEQ ID NO: 1093970 - DNA, 22 bp, Artificial Sequence
  chemically synthesized
ccaagcaggtgagactgatact

SEQ ID NO: 1093971 - DNA, 22 bp, Artificial Sequence
  chemically synthesized
gccaagcaggtgagactgatac

SEQ ID NO: 1093972 - DNA, 22 bp, Artificial Sequence
  chemically synthesized
tctgatgaaaagtatcagtctc

SEQ ID NO: 1093973 - DNA, 22 bp, Artificial Sequence
  chemically synthesized
atgaaaagtatcagtctcacct

SEQ ID NO: 1093974 - DNA, 22 bp, Artificial Sequence
  chemically synthesized
gtacgtttgccaagcaggtgag

SEQ ID NO: 1093975 - DNA, 22 bp, Artificial Sequence
  chemically synthesized
acctgcttggcaaacgtaccaa

SEQ ID NO: 1093976 - DNA, 22 bp, Artificial Sequence
  chemically synthesized
cttggcaaacgtaccaaccttt

SEQ ID NO: 1093977 - DNA, 22 bp, Artificial Sequence
  chemically synthesized
ggcaaacgtaccaacctttcat

SEQ ID NO: 1093978 - DNA, 22 bp, Artificial Sequence
  chemically synthesized
gcaaacgtaccaacctttcata

SEQ ID NO: 1093979 - DNA, 22 bp, Artificial Sequence
  chemically synthesized
tacataagatatcaagcaggta

SEQ ID NO: 1093980 - DNA, 22 bp, Artificial Sequence
  chemically synthesized
tcatacctgcttgatatcttat

SEQ ID NO: 1093981 - DNA, 22 bp, Artificial Sequence
  chemically synthesized
catacctgcttgatatcttatg

SEQ ID NO: 1093982 - DNA, 22 bp, Artificial Sequence
  chemically synthesized
caataaactgtacataagatat

SEQ ID NO: 1093983 - DNA, 22 bp, Artificial Sequence
  chemically synthesized
atacctgcttgatatcttatgt

SEQ ID NO: 1093984 - DNA, 22 bp, Artificial Sequence
  chemically synthesized
gcaataaactgtacataagata

SEQ ID NO: 1093985 - DNA, 22 bp, Artificial Sequence
  chemically synthesized
tgcaataaactgtacataagat

SEQ ID NO: 1093986 - DNA, 22 bp, Artificial Sequence
  chemically synthesized
ttgcaataaactgtacataaga

SEQ ID NO: 1093987 - DNA, 22 bp, Artificial Sequence
  chemically synthesized
tttgcaataaactgtacataag

SEQ ID NO: 1093988 - DNA, 22 bp, Artificial Sequence
  chemically synthesized
cttgatatcttatgtacagttt

SEQ ID NO: 1093989 - DNA, 22 bp, Artificial Sequence
  chemically synthesized
actttttgcaataaactgtaca

SEQ ID NO: 1093990 - DNA, 22 bp, Artificial Sequence
  chemically synthesized
cactttttgcaataaactgtac

SEQ ID NO: 1093991 - DNA, 22 bp, Artificial Sequence
  chemically synthesized
gatatcttatgtacagtttatt

SEQ ID NO: 1093992 - DNA, 22 bp, Artificial Sequence
  chemically synthesized
atatcttatgtacagtttattg

SEQ ID NO: 1093993 - DNA, 22 bp, Artificial Sequence
  chemically synthesized
atttcactttttgcaataaact

SEQ ID NO: 1093994 - DNA, 22 bp, Artificial Sequence
  chemically synthesized
aatttcactttttgcaataaac

SEQ ID NO: 1093995 - DNA, 22 bp, Artificial Sequence
  chemically synthesized
atgtacagtttattgcaaaaag

SEQ ID NO: 1093996 - DNA, 22 bp, Artificial Sequence
  chemically synthesized
tgtacagtttattgcaaaaagt

SEQ ID NO: 1093997 - DNA, 22 bp, Artificial Sequence
  chemically synthesized
aagcaaaacacttaatttcact

SEQ ID NO: 1093998 - DNA, 22 bp, Artificial Sequence
  chemically synthesized
aaagcaaaacacttaatttcac

SEQ ID NO: 1093999 - DNA, 22 bp, Artificial Sequence
  chemically synthesized
taaagcaaaacacttaatttca

SEQ ID NO: 1094000 - DNA, 22 bp, Artificial Sequence
  chemically synthesized
attgcaaaaagtgaaattaagt

SEQ ID NO: 1094001 - DNA, 22 bp, Artificial Sequence
  chemically synthesized
ttaaagcaaaacacttaatttc

SEQ ID NO: 1094002 - DNA, 22 bp, Artificial Sequence
  chemically synthesized
ttgcaaaaagtgaaattaagtg

SEQ ID NO: 1094003 - DNA, 22 bp, Artificial Sequence
  chemically synthesized
caaaaagtgaaattaagtgttt

SEQ ID NO: 1094004 - DNA, 22 bp, Artificial Sequence
  chemically synthesized
tcaccttttaaagcaaaacact

SEQ ID NO: 1094005 - DNA, 22 bp, Artificial Sequence
  chemically synthesized
tatcaccttttaaagcaaaaca

SEQ ID NO: 1094006 - DNA, 22 bp, Artificial Sequence
  chemically synthesized
ctatcaccttttaaagcaaaac

SEQ ID NO: 1094007 - DNA, 22 bp, Artificial Sequence
  chemically synthesized
gatttctatcaccttttaaagc

SEQ ID NO: 1094008 - DNA, 22 bp, Artificial Sequence
  chemically synthesized
agatttctatcaccttttaaag

SEQ ID NO: 1094009 - DNA, 22 bp, Artificial Sequence
  chemically synthesized
tagatttctatcaccttttaaa

SEQ ID NO: 1094010 - DNA, 22 bp, Artificial Sequence
  chemically synthesized
agtgttttgctttaaaaggtga

SEQ ID NO: 1094011 - DNA, 22 bp, Artificial Sequence
  chemically synthesized
tgctttaaaaggtgatagaaat

SEQ ID NO: 1094012 - DNA, 22 bp, Artificial Sequence
  chemically synthesized
gctttaaaaggtgatagaaatc

SEQ ID NO: 1094013 - DNA, 22 bp, Artificial Sequence
  chemically synthesized
ctttaaaaggtgatagaaatct

SEQ ID NO: 1094014 - DNA, 22 bp, Artificial Sequence
  chemically synthesized
taaaaggtgatagaaatctaaa

SEQ ID NO: 1094015 - DNA, 22 bp, Artificial Sequence
  chemically synthesized
aaaaggtgatagaaatctaaaa

SEQ ID NO: 1094016 - DNA, 22 bp, Artificial Sequence
  chemically synthesized
aaaggtgatagaaatctaaaat

SEQ ID NO: 1094017 - DNA, 22 bp, Artificial Sequence
  chemically synthesized
gaaatgacccagattttagatt

SEQ ID NO: 1094018 - DNA, 22 bp, Artificial Sequence
  chemically synthesized
tagtccagcaggagctggaaat

SEQ ID NO: 1094019 - DNA, 22 bp, Artificial Sequence
  chemically synthesized
aaatctgggtcatttccagctc

SEQ ID NO: 1094020 - DNA, 22 bp, Artificial Sequence
  chemically synthesized
ggtcatttccagctcctgctgg

SEQ ID NO: 1094021 - DNA, 22 bp, Artificial Sequence
  chemically synthesized
ccagctcctgctggactacagg

SEQ ID NO: 1094022 - DNA, 22 bp, Artificial Sequence
  chemically synthesized
cagctcctgctggactacaggc

SEQ ID NO: 1094023 - DNA, 22 bp, Artificial Sequence
  chemically synthesized
cccagaatgaagacagcctgta

SEQ ID NO: 1094024 - DNA, 22 bp, Artificial Sequence
  chemically synthesized
gcccagaatgaagacagcctgt

SEQ ID NO: 1094025 - DNA, 22 bp, Artificial Sequence
  chemically synthesized
tgcccagaatgaagacagcctg

SEQ ID NO: 1094026 - DNA, 22 bp, Artificial Sequence
  chemically synthesized
ctgctggactacaggctgtctt

SEQ ID NO: 1094027 - DNA, 22 bp, Artificial Sequence
  chemically synthesized
ctggactacaggctgtcttcat

SEQ ID NO: 1094028 - DNA, 22 bp, Artificial Sequence
  chemically synthesized
gactacaggctgtcttcattct

SEQ ID NO: 1094029 - DNA, 22 bp, Artificial Sequence
  chemically synthesized
ggatctttgcccagaatgaaga

SEQ ID NO: 1094030 - DNA, 22 bp, Artificial Sequence
  chemically synthesized
caggctgtcttcattctgggca

SEQ ID NO: 1094031 - DNA, 22 bp, Artificial Sequence
  chemically synthesized
ccactgggatctttgcccagaa

SEQ ID NO: 1094032 - DNA, 22 bp, Artificial Sequence
  chemically synthesized
cccactgggatctttgcccaga

SEQ ID NO: 1094033 - DNA, 22 bp, Artificial Sequence
  chemically synthesized
tcccactgggatctttgcccag

SEQ ID NO: 1094034 - DNA, 22 bp, Artificial Sequence
  chemically synthesized
tcttcattctgggcaaagatcc

SEQ ID NO: 1094035 - DNA, 22 bp, Artificial Sequence
  chemically synthesized
tattttcccactgggatctttg

SEQ ID NO: 1094036 - DNA, 22 bp, Artificial Sequence
  chemically synthesized
atattttcccactgggatcttt

SEQ ID NO: 1094037 - DNA, 22 bp, Artificial Sequence
  chemically synthesized
cattctgggcaaagatcccagt

SEQ ID NO: 1094038 - DNA, 22 bp, Artificial Sequence
  chemically synthesized
attctgggcaaagatcccagtg

SEQ ID NO: 1094039 - DNA, 22 bp, Artificial Sequence
  chemically synthesized
tgggcaaagatcccagtgggaa

SEQ ID NO: 1094040 - DNA, 22 bp, Artificial Sequence
  chemically synthesized
ggcaaagatcccagtgggaaaa

SEQ ID NO: 1094041 - DNA, 22 bp, Artificial Sequence
  chemically synthesized
agaagatatttatattttccca

SEQ ID NO: 1094042 - DNA, 22 bp, Artificial Sequence
  chemically synthesized
aagaagatatttatattttccc

SEQ ID NO: 1094043 - DNA, 22 bp, Artificial Sequence
  chemically synthesized
gggtatttaagaagatatttat

SEQ ID NO: 1094044 - DNA, 22 bp, Artificial Sequence
  chemically synthesized
aggtaccctcgggtatttaaga

SEQ ID NO: 1094045 - DNA, 22 bp, Artificial Sequence
  chemically synthesized
taaggtaccctcgggtatttaa

SEQ ID NO: 1094046 - DNA, 22 bp, Artificial Sequence
  chemically synthesized
aaagctctaaggtaccctcggg

SEQ ID NO: 1094047 - DNA, 22 bp, Artificial Sequence
  chemically synthesized
caaagctctaaggtaccctcgg

SEQ ID NO: 1094048 - DNA, 22 bp, Artificial Sequence
  chemically synthesized
cttaaatacccgagggtacctt

SEQ ID NO: 1094049 - DNA, 22 bp, Artificial Sequence
  chemically synthesized
ttaaatacccgagggtacctta

SEQ ID NO: 1094050 - DNA, 22 bp, Artificial Sequence
  chemically synthesized
tcttcaaagctctaaggtaccc

SEQ ID NO: 1094051 - DNA, 22 bp, Artificial Sequence
  chemically synthesized
gtcttcaaagctctaaggtacc

SEQ ID NO: 1094052 - DNA, 22 bp, Artificial Sequence
  chemically synthesized
aaatacccgagggtaccttaga

SEQ ID NO: 1094053 - DNA, 22 bp, Artificial Sequence
  chemically synthesized
aatacccgagggtaccttagag

SEQ ID NO: 1094054 - DNA, 22 bp, Artificial Sequence
  chemically synthesized
cttgtcttcaaagctctaaggt

SEQ ID NO: 1094055 - DNA, 22 bp, Artificial Sequence
  chemically synthesized
ccaatcacgtctccttgtcttc

SEQ ID NO: 1094056 - DNA, 22 bp, Artificial Sequence
  chemically synthesized
agagctttgaagacaaggagac

SEQ ID NO: 1094057 - DNA, 22 bp, Artificial Sequence
  chemically synthesized
gagctttgaagacaaggagacg

SEQ ID NO: 1094058 - DNA, 22 bp, Artificial Sequence
  chemically synthesized
tgaagacaaggagacgtgattg

SEQ ID NO: 1094059 - DNA, 22 bp, Artificial Sequence
  chemically synthesized
gaagacaaggagacgtgattgg

SEQ ID NO: 1094060 - DNA, 22 bp, Artificial Sequence
  chemically synthesized
aagacaaggagacgtgattggt

SEQ ID NO: 1094061 - DNA, 22 bp, Artificial Sequence
  chemically synthesized
ataagacacattaccaatcacg

SEQ ID NO: 1094062 - DNA, 22 bp, Artificial Sequence
  chemically synthesized
caccaaagttaataagacacat

SEQ ID NO: 1094063 - DNA, 22 bp, Artificial Sequence
  chemically synthesized
aatctgcaccaaagttaataag

SEQ ID NO: 1094064 - DNA, 22 bp, Artificial Sequence
  chemically synthesized
gtaatgtgtcttattaactttg

SEQ ID NO: 1094065 - DNA, 22 bp, Artificial Sequence
  chemically synthesized
cctcaatctgcaccaaagttaa

SEQ ID NO: 1094066 - DNA, 22 bp, Artificial Sequence
  chemically synthesized
attacctcaatctgcaccaaag

SEQ ID NO: 1094067 - DNA, 22 bp, Artificial Sequence
  chemically synthesized
attaactttggtgcagattgag

SEQ ID NO: 1094068 - DNA, 22 bp, Artificial Sequence
  chemically synthesized
ttaactttggtgcagattgagg

SEQ ID NO: 1094069 - DNA, 22 bp, Artificial Sequence
  chemically synthesized
actttggtgcagattgaggtaa

SEQ ID NO: 1094070 - DNA, 22 bp, Artificial Sequence
  chemically synthesized
tggtgcagattgaggtaatgaa

SEQ ID NO: 1094071 - DNA, 22 bp, Artificial Sequence
  chemically synthesized
ggtgcagattgaggtaatgaac

SEQ ID NO: 1094072 - DNA, 22 bp, Artificial Sequence
  chemically synthesized
gtgcagattgaggtaatgaact

SEQ ID NO: 1094073 - DNA, 22 bp, Artificial Sequence
  chemically synthesized
aatcagcaaggtagttcattac

SEQ ID NO: 1094074 - DNA, 22 bp, Artificial Sequence
  chemically synthesized
acagttaaatcagcaaggtagt

SEQ ID NO: 1094075 - DNA, 22 bp, Artificial Sequence
  chemically synthesized
tgacagttaaatcagcaaggta

SEQ ID NO: 1094076 - DNA, 22 bp, Artificial Sequence
  chemically synthesized
aggtaatgaactaccttgctga

SEQ ID NO: 1094077 - DNA, 22 bp, Artificial Sequence
  chemically synthesized
tccattctgacagttaaatcag

SEQ ID NO: 1094078 - DNA, 22 bp, Artificial Sequence
  chemically synthesized
ccttgctgatttaactgtcaga

SEQ ID NO: 1094079 - DNA, 22 bp, Artificial Sequence
  chemically synthesized
gctgatttaactgtcagaatgg

SEQ ID NO: 1094080 - DNA, 22 bp, Artificial Sequence
  chemically synthesized
ctgatttaactgtcagaatgga

SEQ ID NO: 1094081 - DNA, 22 bp, Artificial Sequence
  chemically synthesized
atttaactgtcagaatggatag

SEQ ID NO: 1094082 - DNA, 22 bp, Artificial Sequence
  chemically synthesized
aggacagaagaagctatccatt

SEQ ID NO: 1094083 - DNA, 22 bp, Artificial Sequence
  chemically synthesized
aactgtcagaatggatagcttc

SEQ ID NO: 1094084 - DNA, 22 bp, Artificial Sequence
  chemically synthesized
actgtcagaatggatagcttct

SEQ ID NO: 1094085 - DNA, 22 bp, Artificial Sequence
  chemically synthesized
tcagaatggatagcttcttctg

SEQ ID NO: 1094086 - DNA, 22 bp, Artificial Sequence
  chemically synthesized
agatgcattgaggacagaagaa

SEQ ID NO: 1094087 - DNA, 22 bp, Artificial Sequence
  chemically synthesized
cagatgcattgaggacagaaga

SEQ ID NO: 1094088 - DNA, 22 bp, Artificial Sequence
  chemically synthesized
tgtccttcagatgcattgagga

SEQ ID NO: 1094089 - DNA, 22 bp, Artificial Sequence
  chemically synthesized
cttctgtcctcaatgcatctga

SEQ ID NO: 1094090 - DNA, 22 bp, Artificial Sequence
  chemically synthesized
cagctgtgtccttcagatgcat

SEQ ID NO: 1094091 - DNA, 22 bp, Artificial Sequence
  chemically synthesized
ttctgtcctcaatgcatctgaa

SEQ ID NO: 1094092 - DNA, 22 bp, Artificial Sequence
  chemically synthesized
tccagctgtgtccttcagatgc

SEQ ID NO: 1094093 - DNA, 22 bp, Artificial Sequence
  chemically synthesized
ctgtcctcaatgcatctgaagg

SEQ ID NO: 1094094 - DNA, 22 bp, Artificial Sequence
  chemically synthesized
tgtcctcaatgcatctgaagga

SEQ ID NO: 1094095 - DNA, 22 bp, Artificial Sequence
  chemically synthesized
tcctcaatgcatctgaaggaca

SEQ ID NO: 1094096 - DNA, 22 bp, Artificial Sequence
  chemically synthesized
agcctctccagctgtgtccttc

SEQ ID NO: 1094097 - DNA, 22 bp, Artificial Sequence
  chemically synthesized
aatgcatctgaaggacacagct

SEQ ID NO: 1094098 - DNA, 22 bp, Artificial Sequence
  chemically synthesized
gtacattcagcctctccagctg

SEQ ID NO: 1094099 - DNA, 22 bp, Artificial Sequence
  chemically synthesized
aaggacacagctggagaggctg

SEQ ID NO: 1094100 - DNA, 22 bp, Artificial Sequence
  chemically synthesized
taaagctggtacattcagcctc

SEQ ID NO: 1094101 - DNA, 22 bp, Artificial Sequence
  chemically synthesized
gagaggctgaatgtaccagctt

SEQ ID NO: 1094102 - DNA, 22 bp, Artificial Sequence
  chemically synthesized
caaaggtgacctgtaaagctgg

SEQ ID NO: 1094103 - DNA, 22 bp, Artificial Sequence
  chemically synthesized
gcaaaggtgacctgtaaagctg

SEQ ID NO: 1094104 - DNA, 22 bp, Artificial Sequence
  chemically synthesized
tgcaaaggtgacctgtaaagct

SEQ ID NO: 1094105 - DNA, 22 bp, Artificial Sequence
  chemically synthesized
ttttgcaaaggtgacctgtaaa

SEQ ID NO: 1094106 - DNA, 22 bp, Artificial Sequence
  chemically synthesized
aatgtaccagctttacaggtca

SEQ ID NO: 1094107 - DNA, 22 bp, Artificial Sequence
  chemically synthesized
attttgcaaaggtgacctgtaa

SEQ ID NO: 1094108 - DNA, 22 bp, Artificial Sequence
  chemically synthesized
tattttgcaaaggtgacctgta

SEQ ID NO: 1094109 - DNA, 22 bp, Artificial Sequence
  chemically synthesized
tattttattttgcaaaggtgac

SEQ ID NO: 1094110 - DNA, 22 bp, Artificial Sequence
  chemically synthesized
tacaggtcacctttgcaaaata

SEQ ID NO: 1094111 - DNA, 22 bp, Artificial Sequence
  chemically synthesized
aagactatattttattttgcaa

SEQ ID NO: 1094112 - DNA, 22 bp, Artificial Sequence
  chemically synthesized
acaggtcacctttgcaaaataa

SEQ ID NO: 1094113 - DNA, 22 bp, Artificial Sequence
  chemically synthesized
caagactatattttattttgca

SEQ ID NO: 1094114 - DNA, 22 bp, Artificial Sequence
  chemically synthesized
caggtcacctttgcaaaataaa

SEQ ID NO: 1094115 - DNA, 22 bp, Artificial Sequence
  chemically synthesized
gggcttcaagactatattttat

SEQ ID NO: 1094116 - DNA, 22 bp, Artificial Sequence
  chemically synthesized
tgcaaaataaaatatagtcttg

SEQ ID NO: 1094117 - DNA, 22 bp, Artificial Sequence
  chemically synthesized
caattcgggcttcaagactata

SEQ ID NO: 1094118 - DNA, 22 bp, Artificial Sequence
  chemically synthesized
gcaaaataaaatatagtcttga

SEQ ID NO: 1094119 - DNA, 22 bp, Artificial Sequence
  chemically synthesized
caaaataaaatatagtcttgaa

SEQ ID NO: 1094120 - DNA, 22 bp, Artificial Sequence
  chemically synthesized
gctccaattcgggcttcaagac

SEQ ID NO: 1094121 - DNA, 22 bp, Artificial Sequence
  chemically synthesized
agctccaattcgggcttcaaga

SEQ ID NO: 1094122 - DNA, 22 bp, Artificial Sequence
  chemically synthesized
tagctccaattcgggcttcaag

SEQ ID NO: 1094123 - DNA, 22 bp, Artificial Sequence
  chemically synthesized
ttagctccaattcgggcttcaa

SEQ ID NO: 1094124 - DNA, 22 bp, Artificial Sequence
  chemically synthesized
agtggcttttagctccaattcg

SEQ ID NO: 1094125 - DNA, 22 bp, Artificial Sequence
  chemically synthesized
taagtggcttttagctccaatt

SEQ ID NO: 1094126 - DNA, 22 bp, Artificial Sequence
  chemically synthesized
ttctaagtggcttttagctcca

SEQ ID NO: 1094127 - DNA, 22 bp, Artificial Sequence
  chemically synthesized
gaagcccgaattggagctaaaa

SEQ ID NO: 1094128 - DNA, 22 bp, Artificial Sequence
  chemically synthesized
aagcccgaattggagctaaaag

SEQ ID NO: 1094129 - DNA, 22 bp, Artificial Sequence
  chemically synthesized
acagttattctaagtggctttt

SEQ ID NO: 1094130 - DNA, 22 bp, Artificial Sequence
  chemically synthesized
aacagttattctaagtggcttt

SEQ ID NO: 1094131 - DNA, 22 bp, Artificial Sequence
  chemically synthesized
agcttaacagttattctaagtg

SEQ ID NO: 1094132 - DNA, 22 bp, Artificial Sequence
  chemically synthesized
gagctaaaagccacttagaata

SEQ ID NO: 1094133 - DNA, 22 bp, Artificial Sequence
  chemically synthesized
ttaagcttaacagttattctaa

SEQ ID NO: 1094134 - DNA, 22 bp, Artificial Sequence
  chemically synthesized
aaagccacttagaataactgtt

SEQ ID NO: 1094135 - DNA, 22 bp, Artificial Sequence
  chemically synthesized
agatccaaactgttaagcttaa

SEQ ID NO: 1094136 - DNA, 22 bp, Artificial Sequence
  chemically synthesized
aagatccaaactgttaagctta

SEQ ID NO: 1094137 - DNA, 22 bp, Artificial Sequence
  chemically synthesized
agaataactgttaagcttaaca

SEQ ID NO: 1094138 - DNA, 22 bp, Artificial Sequence
  chemically synthesized
taagatccaaactgttaagctt

SEQ ID NO: 1094139 - DNA, 22 bp, Artificial Sequence
  chemically synthesized
gaataactgttaagcttaacag

SEQ ID NO: 1094140 - DNA, 22 bp, Artificial Sequence
  chemically synthesized
ttaagcttaacagtttggatct

SEQ ID NO: 1094141 - DNA, 22 bp, Artificial Sequence
  chemically synthesized
aaagtaattttaagatccaaac

SEQ ID NO: 1094142 - DNA, 22 bp, Artificial Sequence
  chemically synthesized
caaagtaattttaagatccaaa

SEQ ID NO: 1094143 - DNA, 22 bp, Artificial Sequence
  chemically synthesized
agcttaacagtttggatcttaa

SEQ ID NO: 1094144 - DNA, 22 bp, Artificial Sequence
  chemically synthesized
tgatttcaaagtaattttaaga

SEQ ID NO: 1094145 - DNA, 22 bp, Artificial Sequence
  chemically synthesized
aacagtttggatcttaaaatta

SEQ ID NO: 1094146 - DNA, 22 bp, Artificial Sequence
  chemically synthesized
acagtttggatcttaaaattac

SEQ ID NO: 1094147 - DNA, 22 bp, Artificial Sequence
  chemically synthesized
tgtgatttcaaagtaattttaa

SEQ ID NO: 1094148 - DNA, 22 bp, Artificial Sequence
  chemically synthesized
gattctgtgatttcaaagtaat

SEQ ID NO: 1094149 - DNA, 22 bp, Artificial Sequence
  chemically synthesized
ggattctgtgatttcaaagtaa

SEQ ID NO: 1094150 - DNA, 22 bp, Artificial Sequence
  chemically synthesized
ggatcttaaaattactttgaaa

SEQ ID NO: 1094151 - DNA, 22 bp, Artificial Sequence
  chemically synthesized
tggattctgtgatttcaaagta

SEQ ID NO: 1094152 - DNA, 22 bp, Artificial Sequence
  chemically synthesized
gatcttaaaattactttgaaat

SEQ ID NO: 1094153 - DNA, 22 bp, Artificial Sequence
  chemically synthesized
aaaattactttgaaatcacaga

SEQ ID NO: 1094154 - DNA, 22 bp, Artificial Sequence
  chemically synthesized
aaattactttgaaatcacagaa

SEQ ID NO: 1094155 - DNA, 22 bp, Artificial Sequence
  chemically synthesized
aaagccactttggattctgtga

SEQ ID NO: 1094156 - DNA, 22 bp, Artificial Sequence
  chemically synthesized
caaagccactttggattctgtg

SEQ ID NO: 1094157 - DNA, 22 bp, Artificial Sequence
  chemically synthesized
ctttgaaatcacagaatccaaa

SEQ ID NO: 1094158 - DNA, 22 bp, Artificial Sequence
  chemically synthesized
cttcaaagccactttggattct

SEQ ID NO: 1094159 - DNA, 22 bp, Artificial Sequence
  chemically synthesized
ccttcaaagccactttggattc

SEQ ID NO: 1094160 - DNA, 22 bp, Artificial Sequence
  chemically synthesized
tccttcaaagccactttggatt

SEQ ID NO: 1094161 - DNA, 22 bp, Artificial Sequence
  chemically synthesized
tgaaatcacagaatccaaagtg

SEQ ID NO: 1094162 - DNA, 22 bp, Artificial Sequence
  chemically synthesized
gaaatcacagaatccaaagtgg

SEQ ID NO: 1094163 - DNA, 22 bp, Artificial Sequence
  chemically synthesized
aaatcacagaatccaaagtggc

SEQ ID NO: 1094164 - DNA, 22 bp, Artificial Sequence
  chemically synthesized
tactttccttcaaagccacttt

SEQ ID NO: 1094165 - DNA, 22 bp, Artificial Sequence
  chemically synthesized
gtactttccttcaaagccactt

SEQ ID NO: 1094166 - DNA, 22 bp, Artificial Sequence
  chemically synthesized
tttgtactttccttcaaagcca

SEQ ID NO: 1094167 - DNA, 22 bp, Artificial Sequence
  chemically synthesized
atttgtactttccttcaaagcc

SEQ ID NO: 1094168 - DNA, 22 bp, Artificial Sequence
  chemically synthesized
tatttgtactttccttcaaagc

SEQ ID NO: 1094169 - DNA, 22 bp, Artificial Sequence
  chemically synthesized
ttatttgtactttccttcaaag

SEQ ID NO: 1094170 - DNA, 22 bp, Artificial Sequence
  chemically synthesized
tttatttgtactttccttcaaa

SEQ ID NO: 1094171 - DNA, 22 bp, Artificial Sequence
  chemically synthesized
gttttttatttgtactttcctt

SEQ ID NO: 1094172 - DNA, 22 bp, Artificial Sequence
  chemically synthesized
agttttttatttgtactttcct

SEQ ID NO: 1094173 - DNA, 22 bp, Artificial Sequence
  chemically synthesized
tgaaggaaagtacaaataaaaa

SEQ ID NO: 1094174 - DNA, 22 bp, Artificial Sequence
  chemically synthesized
gaaggaaagtacaaataaaaaa

SEQ ID NO: 1094175 - DNA, 22 bp, Artificial Sequence
  chemically synthesized
aaggaaagtacaaataaaaaac

SEQ ID NO: 1094176 - DNA, 22 bp, Artificial Sequence
  chemically synthesized
aacagaagtttagttttttatt

SEQ ID NO: 1094177 - DNA, 22 bp, Artificial Sequence
  chemically synthesized
gaacagaagtttagttttttat

SEQ ID NO: 1094178 - DNA, 22 bp, Artificial Sequence
  chemically synthesized
tgaacagaagtttagtttttta

SEQ ID NO: 1094179 - DNA, 22 bp, Artificial Sequence
  chemically synthesized
ttttgaacagaagtttagtttt

SEQ ID NO: 1094180 - DNA, 22 bp, Artificial Sequence
  chemically synthesized
ctattttgaacagaagtttagt

SEQ ID NO: 1094181 - DNA, 22 bp, Artificial Sequence
  chemically synthesized
catctactattttgaacagaag

SEQ ID NO: 1094182 - DNA, 22 bp, Artificial Sequence
  chemically synthesized
atcagctccatctactattttg

SEQ ID NO: 1094183 - DNA, 22 bp, Artificial Sequence
  chemically synthesized
aacttctgttcaaaatagtaga

SEQ ID NO: 1094184 - DNA, 22 bp, Artificial Sequence
  chemically synthesized
cctcatcagctccatctactat

SEQ ID NO: 1094185 - DNA, 22 bp, Artificial Sequence
  chemically synthesized
ctgttcaaaatagtagatggag

SEQ ID NO: 1094186 - DNA, 22 bp, Artificial Sequence
  chemically synthesized
tgttcaaaatagtagatggagc

SEQ ID NO: 1094187 - DNA, 22 bp, Artificial Sequence
  chemically synthesized
ttcaaaatagtagatggagctg

SEQ ID NO: 1094188 - DNA, 22 bp, Artificial Sequence
  chemically synthesized
ggagttacctcatcagctccat

SEQ ID NO: 1094189 - DNA, 22 bp, Artificial Sequence
  chemically synthesized
aaaatagtagatggagctgatg

SEQ ID NO: 1094190 - DNA, 22 bp, Artificial Sequence
  chemically synthesized
aagcaggatatgttgggagtta

SEQ ID NO: 1094191 - DNA, 22 bp, Artificial Sequence
  chemically synthesized
atgaggtaactcccaacatatc

SEQ ID NO: 1094192 - DNA, 22 bp, Artificial Sequence
  chemically synthesized
gtataactgaagcaggatatgt

SEQ ID NO: 1094193 - DNA, 22 bp, Artificial Sequence
  chemically synthesized
ggtataactgaagcaggatatg

SEQ ID NO: 1094194 - DNA, 22 bp, Artificial Sequence
  chemically synthesized
tggtataactgaagcaggatat

SEQ ID NO: 1094195 - DNA, 22 bp, Artificial Sequence
  chemically synthesized
ccaacatatcctgcttcagtta

SEQ ID NO: 1094196 - DNA, 22 bp, Artificial Sequence
  chemically synthesized
acatgtattttggtataactga

SEQ ID NO: 1094197 - DNA, 22 bp, Artificial Sequence
  chemically synthesized
aacatgtattttggtataactg

SEQ ID NO: 1094198 - DNA, 22 bp, Artificial Sequence
  chemically synthesized
taacatgtattttggtataact

SEQ ID NO: 1094199 - DNA, 22 bp, Artificial Sequence
  chemically synthesized
tattttaacatgtattttggta

SEQ ID NO: 1094200 - DNA, 22 bp, Artificial Sequence
  chemically synthesized
gtattttaacatgtattttggt

SEQ ID NO: 1094201 - DNA, 22 bp, Artificial Sequence
  chemically synthesized
tgtattttaacatgtattttgg

SEQ ID NO: 1094202 - DNA, 22 bp, Artificial Sequence
  chemically synthesized
cttcagttataccaaaatacat

SEQ ID NO: 1094203 - DNA, 22 bp, Artificial Sequence
  chemically synthesized
ctttgtattttaacatgtattt

SEQ ID NO: 1094204 - DNA, 22 bp, Artificial Sequence
  chemically synthesized
cagttataccaaaatacatgtt

SEQ ID NO: 1094205 - DNA, 22 bp, Artificial Sequence
  chemically synthesized
cctttgtattttaacatgtatt

SEQ ID NO: 1094206 - DNA, 22 bp, Artificial Sequence
  chemically synthesized
agttataccaaaatacatgtta

SEQ ID NO: 1094207 - DNA, 22 bp, Artificial Sequence
  chemically synthesized
taccaaaatacatgttaaaata

SEQ ID NO: 1094208 - DNA, 22 bp, Artificial Sequence
  chemically synthesized
aaaatgtttcctttgtatttta

SEQ ID NO: 1094209 - DNA, 22 bp, Artificial Sequence
  chemically synthesized
tgaattaaaaatgtttcctttg

SEQ ID NO: 1094210 - DNA, 22 bp, Artificial Sequence
  chemically synthesized
aaatacaaaggaaacattttta

SEQ ID NO: 1094211 - DNA, 22 bp, Artificial Sequence
  chemically synthesized
cagatcagctatgaattaaaaa

SEQ ID NO: 1094212 - DNA, 22 bp, Artificial Sequence
  chemically synthesized
acagatcagctatgaattaaaa

SEQ ID NO: 1094213 - DNA, 22 bp, Artificial Sequence
  chemically synthesized
tacagatcagctatgaattaaa

SEQ ID NO: 1094214 - DNA, 22 bp, Artificial Sequence
  chemically synthesized
tatacatgttttacagatcagc

SEQ ID NO: 1094215 - DNA, 22 bp, Artificial Sequence
  chemically synthesized
ttaattcatagctgatctgtaa

SEQ ID NO: 1094216 - DNA, 22 bp, Artificial Sequence
  chemically synthesized
tatatacatgttttacagatca

SEQ ID NO: 1094217 - DNA, 22 bp, Artificial Sequence
  chemically synthesized
taattcatagctgatctgtaaa

SEQ ID NO: 1094218 - DNA, 22 bp, Artificial Sequence
  chemically synthesized
aattcatagctgatctgtaaaa

SEQ ID NO: 1094219 - DNA, 22 bp, Artificial Sequence
  chemically synthesized
attcatagctgatctgtaaaac

SEQ ID NO: 1094220 - DNA, 22 bp, Artificial Sequence
  chemically synthesized
aggttctatatacatgttttac

SEQ ID NO: 1094221 - DNA, 22 bp, Artificial Sequence
  chemically synthesized
atagctgatctgtaaaacatgt

SEQ ID NO: 1094222 - DNA, 22 bp, Artificial Sequence
  chemically synthesized
acacctgaggttctatatacat

SEQ ID NO: 1094223 - DNA, 22 bp, Artificial Sequence
  chemically synthesized
atctgtaaaacatgtatataga

SEQ ID NO: 1094224 - DNA, 22 bp, Artificial Sequence
  chemically synthesized
tcacacctgaggttctatatac

SEQ ID NO: 1094225 - DNA, 22 bp, Artificial Sequence
  chemically synthesized
ctcacacctgaggttctatata

SEQ ID NO: 1094226 - DNA, 22 bp, Artificial Sequence
  chemically synthesized
tctcacacctgaggttctatat

SEQ ID NO: 1094227 - DNA, 22 bp, Artificial Sequence
  chemically synthesized
taaaacatgtatatagaacctc

SEQ ID NO: 1094228 - DNA, 22 bp, Artificial Sequence
  chemically synthesized
tttctcacacctgaggttctat

SEQ ID NO: 1094229 - DNA, 22 bp, Artificial Sequence
  chemically synthesized
ctttctcacacctgaggttcta

SEQ ID NO: 1094230 - DNA, 22 bp, Artificial Sequence
  chemically synthesized
tctttctcacacctgaggttct

SEQ ID NO: 1094231 - DNA, 22 bp, Artificial Sequence
  chemically synthesized
ttctttctcacacctgaggttc

SEQ ID NO: 1094232 - DNA, 22 bp, Artificial Sequence
  chemically synthesized
tttctttctcacacctgaggtt

SEQ ID NO: 1094233 - DNA, 22 bp, Artificial Sequence
  chemically synthesized
tttttctttctcacacctgagg

SEQ ID NO: 1094234 - DNA, 22 bp, Artificial Sequence
  chemically synthesized
cctctttttctttctcacacct

SEQ ID NO: 1094235 - DNA, 22 bp, Artificial Sequence
  chemically synthesized
ccctctttttctttctcacacc

SEQ ID NO: 1094236 - DNA, 22 bp, Artificial Sequence
  chemically synthesized
atttccctctttttctttctca

SEQ ID NO: 1094237 - DNA, 22 bp, Artificial Sequence
  chemically synthesized
catttccctctttttctttctc

SEQ ID NO: 1094238 - DNA, 22 bp, Artificial Sequence
  chemically synthesized
tcatttccctctttttctttct

SEQ ID NO: 1094239 - DNA, 22 bp, Artificial Sequence
  chemically synthesized
ctttcatttccctctttttctt

SEQ ID NO: 1094240 - DNA, 22 bp, Artificial Sequence
  chemically synthesized
aggtgtgagaaagaaaaagagg

SEQ ID NO: 1094241 - DNA, 22 bp, Artificial Sequence
  chemically synthesized
tactttcatttccctctttttc

SEQ ID NO: 1094242 - DNA, 22 bp, Artificial Sequence
  chemically synthesized
ctactttcatttccctcttttt

SEQ ID NO: 1094243 - DNA, 22 bp, Artificial Sequence
  chemically synthesized
tctactttcatttccctctttt

SEQ ID NO: 1094244 - DNA, 22 bp, Artificial Sequence
  chemically synthesized
cactttctactttcatttccct

SEQ ID NO: 1094245 - DNA, 22 bp, Artificial Sequence
  chemically synthesized
ccactttctactttcatttccc

SEQ ID NO: 1094246 - DNA, 22 bp, Artificial Sequence
  chemically synthesized
tccactttctactttcatttcc

SEQ ID NO: 1094247 - DNA, 22 bp, Artificial Sequence
  chemically synthesized
attttccactttctactttcat

SEQ ID NO: 1094248 - DNA, 22 bp, Artificial Sequence
  chemically synthesized
gattttccactttctactttca

SEQ ID NO: 1094249 - DNA, 22 bp, Artificial Sequence
  chemically synthesized
taagcttgattttccactttct

SEQ ID NO: 1094250 - DNA, 22 bp, Artificial Sequence
  chemically synthesized
ataagcttgattttccactttc

SEQ ID NO: 1094251 - DNA, 22 bp, Artificial Sequence
  chemically synthesized
tataagcttgattttccacttt

SEQ ID NO: 1094252 - DNA, 22 bp, Artificial Sequence
  chemically synthesized
ttataagcttgattttccactt

SEQ ID NO: 1094253 - DNA, 22 bp, Artificial Sequence
  chemically synthesized
atacgccagtatttttataagc

SEQ ID NO: 1094254 - DNA, 22 bp, Artificial Sequence
  chemically synthesized
tgatacgccagtatttttataa

SEQ ID NO: 1094255 - DNA, 22 bp, Artificial Sequence
  chemically synthesized
ttctgatacgccagtattttta

SEQ ID NO: 1094256 - DNA, 22 bp, Artificial Sequence
  chemically synthesized
ataaaaatactggcgtatcaga

SEQ ID NO: 1094257 - DNA, 22 bp, Artificial Sequence
  chemically synthesized
taaaaatactggcgtatcagaa

SEQ ID NO: 1094258 - DNA, 22 bp, Artificial Sequence
  chemically synthesized
atgtcgtataccctgttctgat

SEQ ID NO: 1094259 - DNA, 22 bp, Artificial Sequence
  chemically synthesized
gatgtcgtataccctgttctga

SEQ ID NO: 1094260 - DNA, 22 bp, Artificial Sequence
  chemically synthesized
tgatgtcgtataccctgttctg

SEQ ID NO: 1094261 - DNA, 22 bp, Artificial Sequence
  chemically synthesized
gcgtatcagaacagggtatacg

SEQ ID NO: 1094262 - DNA, 22 bp, Artificial Sequence
  chemically synthesized
aatgccccagctttgatgtcgt

SEQ ID NO: 1094263 - DNA, 22 bp, Artificial Sequence
  chemically synthesized
gtgttaaatgccccagctttga

SEQ ID NO: 1094264 - DNA, 22 bp, Artificial Sequence
  chemically synthesized
aagttagtgttaaatgccccag

SEQ ID NO: 1094265 - DNA, 22 bp, Artificial Sequence
  chemically synthesized
ccatctcaagttagtgttaaat

SEQ ID NO: 1094266 - DNA, 22 bp, Artificial Sequence
  chemically synthesized
cccatctcaagttagtgttaaa

SEQ ID NO: 1094267 - DNA, 22 bp, Artificial Sequence
  chemically synthesized
atttcccatctcaagttagtgt

SEQ ID NO: 1094268 - DNA, 22 bp, Artificial Sequence
  chemically synthesized
gggcatttaacactaacttgag

SEQ ID NO: 1094269 - DNA, 22 bp, Artificial Sequence
  chemically synthesized
cctcatttcccatctcaagtta

SEQ ID NO: 1094270 - DNA, 22 bp, Artificial Sequence
  chemically synthesized
gcctcatttcccatctcaagtt

SEQ ID NO: 1094271 - DNA, 22 bp, Artificial Sequence
  chemically synthesized
gcttgcctcatttcccatctca

SEQ ID NO: 1094272 - DNA, 22 bp, Artificial Sequence
  chemically synthesized
aacactaacttgagatgggaaa

SEQ ID NO: 1094273 - DNA, 22 bp, Artificial Sequence
  chemically synthesized
acactaacttgagatgggaaat

SEQ ID NO: 1094274 - DNA, 22 bp, Artificial Sequence
  chemically synthesized
cctggcttgcctcatttcccat

SEQ ID NO: 1094275 - DNA, 22 bp, Artificial Sequence
  chemically synthesized
ccctggcttgcctcatttccca

SEQ ID NO: 1094276 - DNA, 22 bp, Artificial Sequence
  chemically synthesized
acttgagatgggaaatgaggca

SEQ ID NO: 1094277 - DNA, 22 bp, Artificial Sequence
  chemically synthesized
ccatttccctggcttgcctcat

SEQ ID NO: 1094278 - DNA, 22 bp, Artificial Sequence
  chemically synthesized
cccatttccctggcttgcctca

SEQ ID NO: 1094279 - DNA, 22 bp, Artificial Sequence
  chemically synthesized
gagatgggaaatgaggcaagcc

SEQ ID NO: 1094280 - DNA, 22 bp, Artificial Sequence
  chemically synthesized
tcccatttccctggcttgcctc

SEQ ID NO: 1094281 - DNA, 22 bp, Artificial Sequence
  chemically synthesized
agatgggaaatgaggcaagcca

SEQ ID NO: 1094282 - DNA, 22 bp, Artificial Sequence
  chemically synthesized
tttcccatttccctggcttgcc

SEQ ID NO: 1094283 - DNA, 22 bp, Artificial Sequence
  chemically synthesized
attctttcccatttccctggct

SEQ ID NO: 1094284 - DNA, 22 bp, Artificial Sequence
  chemically synthesized
cattctttcccatttccctggc

SEQ ID NO: 1094285 - DNA, 22 bp, Artificial Sequence
  chemically synthesized
cttcattctttcccatttccct

SEQ ID NO: 1094286 - DNA, 22 bp, Artificial Sequence
  chemically synthesized
cagggtggatggcacactgctt

SEQ ID NO: 1094287 - DNA, 22 bp, Artificial Sequence
  chemically synthesized
acagggtggatggcacactgct

SEQ ID NO: 1094288 - DNA, 22 bp, Artificial Sequence
  chemically synthesized
cttacagggtggatggcacact

SEQ ID NO: 1094289 - DNA, 22 bp, Artificial Sequence
  chemically synthesized
ccttacagggtggatggcacac

SEQ ID NO: 1094290 - DNA, 22 bp, Artificial Sequence
  chemically synthesized
ttccttacagggtggatggcac

SEQ ID NO: 1094291 - DNA, 22 bp, Artificial Sequence
  chemically synthesized
cttccttacagggtggatggca

SEQ ID NO: 1094292 - DNA, 22 bp, Artificial Sequence
  chemically synthesized
cttcttccttacagggtggatg

SEQ ID NO: 1094293 - DNA, 22 bp, Artificial Sequence
  chemically synthesized
tacttcttccttacagggtgga

SEQ ID NO: 1094294 - DNA, 22 bp, Artificial Sequence
  chemically synthesized
gggatgttctacttcttcctta

SEQ ID NO: 1094295 - DNA, 22 bp, Artificial Sequence
  chemically synthesized
caatggctagggatgttctact

SEQ ID NO: 1094296 - DNA, 22 bp, Artificial Sequence
  chemically synthesized
taaggaagaagtagaacatccc

SEQ ID NO: 1094297 - DNA, 22 bp, Artificial Sequence
  chemically synthesized
aatcataatattccaatggcta

SEQ ID NO: 1094298 - DNA, 22 bp, Artificial Sequence
  chemically synthesized
ctaaatcataatattccaatgg

SEQ ID NO: 1094299 - DNA, 22 bp, Artificial Sequence
  chemically synthesized
gctaaatcataatattccaatg

SEQ ID NO: 1094300 - DNA, 22 bp, Artificial Sequence
  chemically synthesized
cttgctaaatcataatattcca

SEQ ID NO: 1094301 - DNA, 22 bp, Artificial Sequence
  chemically synthesized
ccttgctaaatcataatattcc

SEQ ID NO: 1094302 - DNA, 22 bp, Artificial Sequence
  chemically synthesized
gccattggaatattatgattta

SEQ ID NO: 1094303 - DNA, 22 bp, Artificial Sequence
  chemically synthesized
gaatattatgatttagcaagga

SEQ ID NO: 1094304 - DNA, 22 bp, Artificial Sequence
  chemically synthesized
tgatttagcaaggaaactattg

SEQ ID NO: 1094305 - DNA, 22 bp, Artificial Sequence
  chemically synthesized
agcccaaaatcccccaacaata

SEQ ID NO: 1094306 - DNA, 22 bp, Artificial Sequence
  chemically synthesized
agcaaggaaactattgttgggg

SEQ ID NO: 1094307 - DNA, 22 bp, Artificial Sequence
  chemically synthesized
cagcccaaaatcccccaacaat

SEQ ID NO: 1094308 - DNA, 22 bp, Artificial Sequence
  chemically synthesized
gcaaggaaactattgttggggg

SEQ ID NO: 1094309 - DNA, 22 bp, Artificial Sequence
  chemically synthesized
tcagcccaaaatcccccaacaa

SEQ ID NO: 1094310 - DNA, 22 bp, Artificial Sequence
  chemically synthesized
ttcagcccaaaatcccccaaca

SEQ ID NO: 1094311 - DNA, 22 bp, Artificial Sequence
  chemically synthesized
tttttcagcccaaaatccccca

SEQ ID NO: 1094312 - DNA, 22 bp, Artificial Sequence
  chemically synthesized
atttttcagcccaaaatccccc

SEQ ID NO: 1094313 - DNA, 22 bp, Artificial Sequence
  chemically synthesized
tatttttcagcccaaaatcccc

SEQ ID NO: 1094314 - DNA, 22 bp, Artificial Sequence
  chemically synthesized
ttgttgggggattttgggctga

SEQ ID NO: 1094315 - DNA, 22 bp, Artificial Sequence
  chemically synthesized
ttgggggattttgggctgaaaa

SEQ ID NO: 1094316 - DNA, 22 bp, Artificial Sequence
  chemically synthesized
ggggattttgggctgaaaaata

SEQ ID NO: 1094317 - DNA, 22 bp, Artificial Sequence
  chemically synthesized
tgggtggatctttatttttcag

SEQ ID NO: 1094318 - DNA, 22 bp, Artificial Sequence
  chemically synthesized
ttatgggtggatctttattttt

SEQ ID NO: 1094319 - DNA, 22 bp, Artificial Sequence
  chemically synthesized
gttatgggtggatctttatttt

SEQ ID NO: 1094320 - DNA, 22 bp, Artificial Sequence
  chemically synthesized
tgggctgaaaaataaagatcca

SEQ ID NO: 1094321 - DNA, 22 bp, Artificial Sequence
  chemically synthesized
gggctgaaaaataaagatccac

SEQ ID NO: 1094322 - DNA, 22 bp, Artificial Sequence
  chemically synthesized
cgtttgttatgggtggatcttt

SEQ ID NO: 1094323 - DNA, 22 bp, Artificial Sequence
  chemically synthesized
ggctgaaaaataaagatccacc

SEQ ID NO: 1094324 - DNA, 22 bp, Artificial Sequence
  chemically synthesized
ccgtttgttatgggtggatctt

SEQ ID NO: 1094325 - DNA, 22 bp, Artificial Sequence
  chemically synthesized
aaaaataaagatccacccataa

SEQ ID NO: 1094326 - DNA, 22 bp, Artificial Sequence
  chemically synthesized
agtttccgtttgttatgggtgg

SEQ ID NO: 1094327 - DNA, 22 bp, Artificial Sequence
  chemically synthesized
aagtttccgtttgttatgggtg

SEQ ID NO: 1094328 - DNA, 22 bp, Artificial Sequence
  chemically synthesized
atgtgtgatacaagcttaagtt

SEQ ID NO: 1094329 - DNA, 22 bp, Artificial Sequence
  chemically synthesized
ccctcatgtgtgatacaagctt

SEQ ID NO: 1094330 - DNA, 22 bp, Artificial Sequence
  chemically synthesized
tgccctcatgtgtgatacaagc

SEQ ID NO: 1094331 - DNA, 22 bp, Artificial Sequence
  chemically synthesized
tgctctgccctcatgtgtgata

SEQ ID NO: 1094332 - DNA, 22 bp, Artificial Sequence
  chemically synthesized
atgctctgccctcatgtgtgat

SEQ ID NO: 1094333 - DNA, 22 bp, Artificial Sequence
  chemically synthesized
tatgctctgccctcatgtgtga

SEQ ID NO: 1094334 - DNA, 22 bp, Artificial Sequence
  chemically synthesized
aagcttgtatcacacatgaggg

SEQ ID NO: 1094335 - DNA, 22 bp, Artificial Sequence
  chemically synthesized
agcttgtatcacacatgagggc

SEQ ID NO: 1094336 - DNA, 22 bp, Artificial Sequence
  chemically synthesized
gtatcacacatgagggcagagc

SEQ ID NO: 1094337 - DNA, 22 bp, Artificial Sequence
  chemically synthesized
tagagattttatgctctgccct

SEQ ID NO: 1094338 - DNA, 22 bp, Artificial Sequence
  chemically synthesized
tatcacacatgagggcagagca

SEQ ID NO: 1094339 - DNA, 22 bp, Artificial Sequence
  chemically synthesized
ccatcaggattgtagagatttt

SEQ ID NO: 1094340 - DNA, 22 bp, Artificial Sequence
  chemically synthesized
ttgccatcaggattgtagagat

SEQ ID NO: 1094341 - DNA, 22 bp, Artificial Sequence
  chemically synthesized
tattgttgccatcaggattgta

SEQ ID NO: 1094342 - DNA, 22 bp, Artificial Sequence
  chemically synthesized
gtattgttgccatcaggattgt

SEQ ID NO: 1094343 - DNA, 22 bp, Artificial Sequence
  chemically synthesized
tgtattgttgccatcaggattg

SEQ ID NO: 1094344 - DNA, 22 bp, Artificial Sequence
  chemically synthesized
ttgtattgttgccatcaggatt

SEQ ID NO: 1094345 - DNA, 22 bp, Artificial Sequence
  chemically synthesized
agtttttgtattgttgccatca

SEQ ID NO: 1094346 - DNA, 22 bp, Artificial Sequence
  chemically synthesized
ttgagtttttgtattgttgcca

SEQ ID NO: 1094347 - DNA, 22 bp, Artificial Sequence
  chemically synthesized
tacaatcctgatggcaacaata

SEQ ID NO: 1094348 - DNA, 22 bp, Artificial Sequence
  chemically synthesized
caatcctgatggcaacaataca

SEQ ID NO: 1094349 - DNA, 22 bp, Artificial Sequence
  chemically synthesized
ggctattgagtttttgtattgt

SEQ ID NO: 1094350 - DNA, 22 bp, Artificial Sequence
  chemically synthesized
tgggctattgagtttttgtatt

SEQ ID NO: 1094351 - DNA, 22 bp, Artificial Sequence
  chemically synthesized
tctgggctattgagtttttgta

SEQ ID NO: 1094352 - DNA, 22 bp, Artificial Sequence
  chemically synthesized
ctctgggctattgagtttttgt

SEQ ID NO: 1094353 - DNA, 22 bp, Artificial Sequence
  chemically synthesized
atggcaacaatacaaaaactca

SEQ ID NO: 1094354 - DNA, 22 bp, Artificial Sequence
  chemically synthesized
tctctgggctattgagtttttg

SEQ ID NO: 1094355 - DNA, 22 bp, Artificial Sequence
  chemically synthesized
ttctctgggctattgagttttt

SEQ ID NO: 1094356 - DNA, 22 bp, Artificial Sequence
  chemically synthesized
tttctctgggctattgagtttt

SEQ ID NO: 1094357 - DNA, 22 bp, Artificial Sequence
  chemically synthesized
ttttctctgggctattgagttt

SEQ ID NO: 1094358 - DNA, 22 bp, Artificial Sequence
  chemically synthesized
tttttctctgggctattgagtt

SEQ ID NO: 1094359 - DNA, 22 bp, Artificial Sequence
  chemically synthesized
ttttttctctgggctattgagt

SEQ ID NO: 1094360 - DNA, 22 bp, Artificial Sequence
  chemically synthesized
tttttttctctgggctattgag

SEQ ID NO: 1094361 - DNA, 22 bp, Artificial Sequence
  chemically synthesized
tctttttttttctctgggctat

SEQ ID NO: 1094362 - DNA, 22 bp, Artificial Sequence
  chemically synthesized
gtctttttttttctctgggcta

SEQ ID NO: 1094363 - DNA, 22 bp, Artificial Sequence
  chemically synthesized
tgtctttttttttctctgggct

SEQ ID NO: 1094364 - DNA, 22 bp, Artificial Sequence
  chemically synthesized
ttgtctttttttttctctgggc

SEQ ID NO: 1094365 - DNA, 22 bp, Artificial Sequence
  chemically synthesized
gaatttttgtctttttttttct

SEQ ID NO: 1094366 - DNA, 22 bp, Artificial Sequence
  chemically synthesized
aatagcccagagaaaaaaaaag

SEQ ID NO: 1094367 - DNA, 22 bp, Artificial Sequence
  chemically synthesized
ctggaatttttgtctttttttt

SEQ ID NO: 1094368 - DNA, 22 bp, Artificial Sequence
  chemically synthesized
actggaatttttgtcttttttt

SEQ ID NO: 1094369 - DNA, 22 bp, Artificial Sequence
  chemically synthesized
tactggaatttttgtctttttt

SEQ ID NO: 1094370 - DNA, 22 bp, Artificial Sequence
  chemically synthesized
cctttactggaatttttgtctt

SEQ ID NO: 1094371 - DNA, 22 bp, Artificial Sequence
  chemically synthesized
taataggaattgcctttactgg

SEQ ID NO: 1094372 - DNA, 22 bp, Artificial Sequence
  chemically synthesized
atctataataggaattgccttt

SEQ ID NO: 1094373 - DNA, 22 bp, Artificial Sequence
  chemically synthesized
cgagctcatctataataggaat

SEQ ID NO: 1094374 - DNA, 22 bp, Artificial Sequence
  chemically synthesized
cagtaaaggcaattcctattat

SEQ ID NO: 1094375 - DNA, 22 bp, Artificial Sequence
  chemically synthesized
gcgagctcatctataataggaa

SEQ ID NO: 1094376 - DNA, 22 bp, Artificial Sequence
  chemically synthesized
tttgcgagctcatctataatag

SEQ ID NO: 1094377 - DNA, 22 bp, Artificial Sequence
  chemically synthesized
atttgcgagctcatctataata

SEQ ID NO: 1094378 - DNA, 22 bp, Artificial Sequence
  chemically synthesized
tttatttgcgagctcatctata

SEQ ID NO: 1094379 - DNA, 22 bp, Artificial Sequence
  chemically synthesized
gtttatttgcgagctcatctat

SEQ ID NO: 1094380 - DNA, 22 bp, Artificial Sequence
  chemically synthesized
tttgtttatttgcgagctcatc

SEQ ID NO: 1094381 - DNA, 22 bp, Artificial Sequence
  chemically synthesized
atttgtttatttgcgagctcat

SEQ ID NO: 1094382 - DNA, 22 bp, Artificial Sequence
  chemically synthesized
ctattatagatgagctcgcaaa

SEQ ID NO: 1094383 - DNA, 22 bp, Artificial Sequence
  chemically synthesized
tttatttgtttatttgcgagct

SEQ ID NO: 1094384 - DNA, 22 bp, Artificial Sequence
  chemically synthesized
gtttatttgtttatttgcgagc

SEQ ID NO: 1094385 - DNA, 22 bp, Artificial Sequence
  chemically synthesized
ttatagatgagctcgcaaataa

SEQ ID NO: 1094386 - DNA, 22 bp, Artificial Sequence
  chemically synthesized
tttgtttatttgtttatttgcg

SEQ ID NO: 1094387 - DNA, 22 bp, Artificial Sequence
  chemically synthesized
gtttgtttatttgtttatttgc

SEQ ID NO: 1094388 - DNA, 22 bp, Artificial Sequence
  chemically synthesized
tagatgagctcgcaaataaaca

SEQ ID NO: 1094389 - DNA, 22 bp, Artificial Sequence
  chemically synthesized
tgtttgtttatttgtttatttg

SEQ ID NO: 1094390 - DNA, 22 bp, Artificial Sequence
  chemically synthesized
ttgtttgtttatttgtttattt

SEQ ID NO: 1094391 - DNA, 22 bp, Artificial Sequence
  chemically synthesized
gtaaggtttttgtttgtttatt

SEQ ID NO: 1094392 - DNA, 22 bp, Artificial Sequence
  chemically synthesized
gcaaataaacaaataaacaaac

SEQ ID NO: 1094393 - DNA, 22 bp, Artificial Sequence
  chemically synthesized
cccatgtggctagtaaggtttt

SEQ ID NO: 1094394 - DNA, 22 bp, Artificial Sequence
  chemically synthesized
ccccatgtggctagtaaggttt

SEQ ID NO: 1094395 - DNA, 22 bp, Artificial Sequence
  chemically synthesized
atggaagtgaatttccccatgt

SEQ ID NO: 1094396 - DNA, 22 bp, Artificial Sequence
  chemically synthesized
taatggaagtgaatttccccat

SEQ ID NO: 1094397 - DNA, 22 bp, Artificial Sequence
  chemically synthesized
actagccacatggggaaattca

SEQ ID NO: 1094398 - DNA, 22 bp, Artificial Sequence
  chemically synthesized
ctagccacatggggaaattcac

SEQ ID NO: 1094399 - DNA, 22 bp, Artificial Sequence
  chemically synthesized
cctctaatggaagtgaatttcc

SEQ ID NO: 1094400 - DNA, 22 bp, Artificial Sequence
  chemically synthesized
gccacatggggaaattcacttc

SEQ ID NO: 1094401 - DNA, 22 bp, Artificial Sequence
  chemically synthesized
atgactccctctaatggaagtg

SEQ ID NO: 1094402 - DNA, 22 bp, Artificial Sequence
  chemically synthesized
caactaatgactccctctaatg

SEQ ID NO: 1094403 - DNA, 22 bp, Artificial Sequence
  chemically synthesized
ttacaactaatgactccctcta

SEQ ID NO: 1094404 - DNA, 22 bp, Artificial Sequence
  chemically synthesized
gttacaactaatgactccctct

SEQ ID NO: 1094405 - DNA, 22 bp, Artificial Sequence
  chemically synthesized
acttccattagagggagtcatt

SEQ ID NO: 1094406 - DNA, 22 bp, Artificial Sequence
  chemically synthesized
ccatttgttacaactaatgact

SEQ ID NO: 1094407 - DNA, 22 bp, Artificial Sequence
  chemically synthesized
ccattagagggagtcattagtt

SEQ ID NO: 1094408 - DNA, 22 bp, Artificial Sequence
  chemically synthesized
cattagagggagtcattagttg

SEQ ID NO: 1094409 - DNA, 22 bp, Artificial Sequence
  chemically synthesized
taccatttgttacaactaatga

SEQ ID NO: 1094410 - DNA, 22 bp, Artificial Sequence
  chemically synthesized
gagggagtcattagttgtaaca

SEQ ID NO: 1094411 - DNA, 22 bp, Artificial Sequence
  chemically synthesized
gttgtaacaaatggtagaatcc

SEQ ID NO: 1094412 - DNA, 22 bp, Artificial Sequence
  chemically synthesized
tgtcataaggtatggattctac

SEQ ID NO: 1094413 - DNA, 22 bp, Artificial Sequence
  chemically synthesized
atgtcataaggtatggattcta

SEQ ID NO: 1094414 - DNA, 22 bp, Artificial Sequence
  chemically synthesized
tatgtcataaggtatggattct

SEQ ID NO: 1094415 - DNA, 22 bp, Artificial Sequence
  chemically synthesized
taacaaatggtagaatccatac

SEQ ID NO: 1094416 - DNA, 22 bp, Artificial Sequence
  chemically synthesized
tctttatgtcataaggtatgga

SEQ ID NO: 1094417 - DNA, 22 bp, Artificial Sequence
  chemically synthesized
ttatctttatgtcataaggtat

SEQ ID NO: 1094418 - DNA, 22 bp, Artificial Sequence
  chemically synthesized
tattatctttatgtcataaggt

SEQ ID NO: 1094419 - DNA, 22 bp, Artificial Sequence
  chemically synthesized
ttctattatctttatgtcataa

SEQ ID NO: 1094420 - DNA, 22 bp, Artificial Sequence
  chemically synthesized
caaaattgttctattatcttta

SEQ ID NO: 1094421 - DNA, 22 bp, Artificial Sequence
  chemically synthesized
tccaaaattgttctattatctt

SEQ ID NO: 1094422 - DNA, 22 bp, Artificial Sequence
  chemically synthesized
atgacataaagataatagaaca

SEQ ID NO: 1094423 - DNA, 22 bp, Artificial Sequence
  chemically synthesized
tgacataaagataatagaacaa

SEQ ID NO: 1094424 - DNA, 22 bp, Artificial Sequence
  chemically synthesized
tacagttctccaaaattgttct

SEQ ID NO: 1094425 - DNA, 22 bp, Artificial Sequence
  chemically synthesized
ttgtacagttctccaaaattgt

SEQ ID NO: 1094426 - DNA, 22 bp, Artificial Sequence
  chemically synthesized
attgtacagttctccaaaattg

SEQ ID NO: 1094427 - DNA, 22 bp, Artificial Sequence
  chemically synthesized
ggcatatttattgtacagttct

SEQ ID NO: 1094428 - DNA, 22 bp, Artificial Sequence
  chemically synthesized
tggagaactgtacaataaatat

SEQ ID NO: 1094429 - DNA, 22 bp, Artificial Sequence
  chemically synthesized
ggagaactgtacaataaatatg

SEQ ID NO: 1094430 - DNA, 22 bp, Artificial Sequence
  chemically synthesized
gagaactgtacaataaatatgc

SEQ ID NO: 1094431 - DNA, 22 bp, Artificial Sequence
  chemically synthesized
tacaataaatatgcctagcctc

SEQ ID NO: 1094432 - DNA, 22 bp, Artificial Sequence
  chemically synthesized
tgggaaacatacaccatgaggc

SEQ ID NO: 1094433 - DNA, 22 bp, Artificial Sequence
  chemically synthesized
tatgggaaacatacaccatgag

SEQ ID NO: 1094434 - DNA, 22 bp, Artificial Sequence
  chemically synthesized
gcctcatggtgtatgtttccca

SEQ ID NO: 1094435 - DNA, 22 bp, Artificial Sequence
  chemically synthesized
aagcaaataaactctatgggaa

SEQ ID NO: 1094436 - DNA, 22 bp, Artificial Sequence
  chemically synthesized
atggtgtatgtttcccatagag

SEQ ID NO: 1094437 - DNA, 22 bp, Artificial Sequence
  chemically synthesized
ccagtctcaagcaaataaactc

SEQ ID NO: 1094438 - DNA, 22 bp, Artificial Sequence
  chemically synthesized
gccagtctcaagcaaataaact

SEQ ID NO: 1094439 - DNA, 22 bp, Artificial Sequence
  chemically synthesized
cccatagagtttatttgcttga

SEQ ID NO: 1094440 - DNA, 22 bp, Artificial Sequence
  chemically synthesized
cacttgccagtctcaagcaaat

SEQ ID NO: 1094441 - DNA, 22 bp, Artificial Sequence
  chemically synthesized
ccatagagtttatttgcttgag

SEQ ID NO: 1094442 - DNA, 22 bp, Artificial Sequence
  chemically synthesized
ggtgtgaattccacttgccagt

SEQ ID NO: 1094443 - DNA, 22 bp, Artificial Sequence
  chemically synthesized
atttgcttgagactggcaagtg

SEQ ID NO: 1094444 - DNA, 22 bp, Artificial Sequence
  chemically synthesized
aggtgtgaattccacttgccag

SEQ ID NO: 1094445 - DNA, 22 bp, Artificial Sequence
  chemically synthesized
tttgcttgagactggcaagtgg

SEQ ID NO: 1094446 - DNA, 22 bp, Artificial Sequence
  chemically synthesized
ttaggtgtgaattccacttgcc

SEQ ID NO: 1094447 - DNA, 22 bp, Artificial Sequence
  chemically synthesized
cttaggtgtgaattccacttgc

SEQ ID NO: 1094448 - DNA, 22 bp, Artificial Sequence
  chemically synthesized
gcttgagactggcaagtggaat

SEQ ID NO: 1094449 - DNA, 22 bp, Artificial Sequence
  chemically synthesized
tcttaggtgtgaattccacttg

SEQ ID NO: 1094450 - DNA, 22 bp, Artificial Sequence
  chemically synthesized
cttgagactggcaagtggaatt

SEQ ID NO: 1094451 - DNA, 22 bp, Artificial Sequence
  chemically synthesized
ttcttaggtgtgaattccactt

SEQ ID NO: 1094452 - DNA, 22 bp, Artificial Sequence
  chemically synthesized
tttcttaggtgtgaattccact

SEQ ID NO: 1094453 - DNA, 22 bp, Artificial Sequence
  chemically synthesized
gagactggcaagtggaattcac

SEQ ID NO: 1094454 - DNA, 22 bp, Artificial Sequence
  chemically synthesized
agactggcaagtggaattcaca

SEQ ID NO: 1094455 - DNA, 22 bp, Artificial Sequence
  chemically synthesized
gcaagtggaattcacacctaag

SEQ ID NO: 1094456 - DNA, 22 bp, Artificial Sequence
  chemically synthesized
acacctaagaaaaagggcttgg

SEQ ID NO: 1094457 - DNA, 22 bp, Artificial Sequence
  chemically synthesized
agaaaaagggcttggttgccta

SEQ ID NO: 1094458 - DNA, 22 bp, Artificial Sequence
  chemically synthesized
ccaaaatgaaatgtaggcaacc

SEQ ID NO: 1094459 - DNA, 22 bp, Artificial Sequence
  chemically synthesized
ggttgcctacatttcattttgg

SEQ ID NO: 1094460 - DNA, 22 bp, Artificial Sequence
  chemically synthesized
gttgcctacatttcattttggg

SEQ ID NO: 1094461 - DNA, 22 bp, Artificial Sequence
  chemically synthesized
cctacatttcattttgggagat

SEQ ID NO: 1094462 - DNA, 22 bp, Artificial Sequence
  chemically synthesized
catttcattttgggagatcatc

SEQ ID NO: 1094463 - DNA, 22 bp, Artificial Sequence
  chemically synthesized
tgaaaacaagaaagagatgatc

SEQ ID NO: 1094464 - DNA, 22 bp, Artificial Sequence
  chemically synthesized
gtgaaaacaagaaagagatgat

SEQ ID NO: 1094465 - DNA, 22 bp, Artificial Sequence
  chemically synthesized
cattttgggagatcatctcttt

SEQ ID NO: 1094466 - DNA, 22 bp, Artificial Sequence
  chemically synthesized
attttgggagatcatctctttc

SEQ ID NO: 1094467 - DNA, 22 bp, Artificial Sequence
  chemically synthesized
tgggagatcatctctttcttgt

SEQ ID NO: 1094468 - DNA, 22 bp, Artificial Sequence
  chemically synthesized
gggagatcatctctttcttgtt

SEQ ID NO: 1094469 - DNA, 22 bp, Artificial Sequence
  chemically synthesized
ggagatcatctctttcttgttt

SEQ ID NO: 1094470 - DNA, 22 bp, Artificial Sequence
  chemically synthesized
aaccagggcttgtgaaaacaag

SEQ ID NO: 1094471 - DNA, 22 bp, Artificial Sequence
  chemically synthesized
aaaccagggcttgtgaaaacaa

SEQ ID NO: 1094472 - DNA, 22 bp, Artificial Sequence
  chemically synthesized
tttaaaccagggcttgtgaaaa

SEQ ID NO: 1094473 - DNA, 22 bp, Artificial Sequence
  chemically synthesized
tgtttaaaccagggcttgtgaa

SEQ ID NO: 1094474 - DNA, 22 bp, Artificial Sequence
  chemically synthesized
tctgtttaaaccagggcttgtg

SEQ ID NO: 1094475 - DNA, 22 bp, Artificial Sequence
  chemically synthesized
tttcttgttttcacaagccctg

SEQ ID NO: 1094476 - DNA, 22 bp, Artificial Sequence
  chemically synthesized
tctctgtttaaaccagggcttg

SEQ ID NO: 1094477 - DNA, 22 bp, Artificial Sequence
  chemically synthesized
tcttgttttcacaagccctggt

SEQ ID NO: 1094478 - DNA, 22 bp, Artificial Sequence
  chemically synthesized
cttgttttcacaagccctggtt

SEQ ID NO: 1094479 - DNA, 22 bp, Artificial Sequence
  chemically synthesized
ttgttttcacaagccctggttt

SEQ ID NO: 1094480 - DNA, 22 bp, Artificial Sequence
  chemically synthesized
gttttcacaagccctggtttaa

SEQ ID NO: 1094481 - DNA, 22 bp, Artificial Sequence
  chemically synthesized
ttttcacaagccctggtttaaa

SEQ ID NO: 1094482 - DNA, 22 bp, Artificial Sequence
  chemically synthesized
tcacaagccctggtttaaacag

SEQ ID NO: 1094483 - DNA, 22 bp, Artificial Sequence
  chemically synthesized
cgtcagctctctctgtttaaac

SEQ ID NO: 1094484 - DNA, 22 bp, Artificial Sequence
  chemically synthesized
cacaagccctggtttaaacaga

SEQ ID NO: 1094485 - DNA, 22 bp, Artificial Sequence
  chemically synthesized
acaagccctggtttaaacagag

SEQ ID NO: 1094486 - DNA, 22 bp, Artificial Sequence
  chemically synthesized
aagtctccgtcagctctctctg

SEQ ID NO: 1094487 - DNA, 22 bp, Artificial Sequence
  chemically synthesized
gtttaaacagagagagctgacg

SEQ ID NO: 1094488 - DNA, 22 bp, Artificial Sequence
  chemically synthesized
ccctcaagtctccgtcagctct

SEQ ID NO: 1094489 - DNA, 22 bp, Artificial Sequence
  chemically synthesized
aaacagagagagctgacggaga

SEQ ID NO: 1094490 - DNA, 22 bp, Artificial Sequence
  chemically synthesized
actcccctcaagtctccgtcag

SEQ ID NO: 1094491 - DNA, 22 bp, Artificial Sequence
  chemically synthesized
aacagagagagctgacggagac

SEQ ID NO: 1094492 - DNA, 22 bp, Artificial Sequence
  chemically synthesized
acctcactcccctcaagtctcc

SEQ ID NO: 1094493 - DNA, 22 bp, Artificial Sequence
  chemically synthesized
cacctcactcccctcaagtctc

SEQ ID NO: 1094494 - DNA, 22 bp, Artificial Sequence
  chemically synthesized
ttcacctcactcccctcaagtc

SEQ ID NO: 1094495 - DNA, 22 bp, Artificial Sequence
  chemically synthesized
tcttcacctcactcccctcaag

SEQ ID NO: 1094496 - DNA, 22 bp, Artificial Sequence
  chemically synthesized
acggagacttgaggggagtgag

SEQ ID NO: 1094497 - DNA, 22 bp, Artificial Sequence
  chemically synthesized
aaactctcttcacctcactccc

SEQ ID NO: 1094498 - DNA, 22 bp, Artificial Sequence
  chemically synthesized
ttcaaactctcttcacctcact

SEQ ID NO: 1094499 - DNA, 22 bp, Artificial Sequence
  chemically synthesized
actattcaaactctcttcacct

SEQ ID NO: 1094500 - DNA, 22 bp, Artificial Sequence
  chemically synthesized
gaggggagtgaggtgaagagag

SEQ ID NO: 1094501 - DNA, 22 bp, Artificial Sequence
  chemically synthesized
aggggagtgaggtgaagagagt

SEQ ID NO: 1094502 - DNA, 22 bp, Artificial Sequence
  chemically synthesized
cctaactattcaaactctcttc

SEQ ID NO: 1094503 - DNA, 22 bp, Artificial Sequence
  chemically synthesized
gaatagttaggcaattcttctt

SEQ ID NO: 1094504 - DNA, 22 bp, Artificial Sequence
  chemically synthesized
aatagttaggcaattcttcttt

SEQ ID NO: 1094505 - DNA, 22 bp, Artificial Sequence
  chemically synthesized
tccccataaaagggtgagaaag

SEQ ID NO: 1094506 - DNA, 22 bp, Artificial Sequence
  chemically synthesized
ggcaattcttctttctcaccct

SEQ ID NO: 1094507 - DNA, 22 bp, Artificial Sequence
  chemically synthesized
cctatccccataaaagggtgag

SEQ ID NO: 1094508 - DNA, 22 bp, Artificial Sequence
  chemically synthesized
ccctacctatccccataaaagg

SEQ ID NO: 1094509 - DNA, 22 bp, Artificial Sequence
  chemically synthesized
ttctttctcacccttttatggg

SEQ ID NO: 1094510 - DNA, 22 bp, Artificial Sequence
  chemically synthesized
accctacctatccccataaaag

SEQ ID NO: 1094511 - DNA, 22 bp, Artificial Sequence
  chemically synthesized
ctttctcacccttttatgggga

SEQ ID NO: 1094512 - DNA, 22 bp, Artificial Sequence
  chemically synthesized
tttctcacccttttatggggat

SEQ ID NO: 1094513 - DNA, 22 bp, Artificial Sequence
  chemically synthesized
tctcacccttttatggggatag

SEQ ID NO: 1094514 - DNA, 22 bp, Artificial Sequence
  chemically synthesized
ctcacccttttatggggatagg

SEQ ID NO: 1094515 - DNA, 22 bp, Artificial Sequence
  chemically synthesized
tcacccttttatggggataggt

SEQ ID NO: 1094516 - DNA, 22 bp, Artificial Sequence
  chemically synthesized
acccttttatggggataggtag

SEQ ID NO: 1094517 - DNA, 22 bp, Artificial Sequence
  chemically synthesized
agatgagtttaccctacctatc

SEQ ID NO: 1094518 - DNA, 22 bp, Artificial Sequence
  chemically synthesized
ttatggggataggtagggtaaa

SEQ ID NO: 1094519 - DNA, 22 bp, Artificial Sequence
  chemically synthesized
tatggggataggtagggtaaac

SEQ ID NO: 1094520 - DNA, 22 bp, Artificial Sequence
  chemically synthesized
atggggataggtagggtaaact

SEQ ID NO: 1094521 - DNA, 22 bp, Artificial Sequence
  chemically synthesized
tggggataggtagggtaaactc

SEQ ID NO: 1094522 - DNA, 22 bp, Artificial Sequence
  chemically synthesized
taaataaaatgattcagatgag

SEQ ID NO: 1094523 - DNA, 22 bp, Artificial Sequence
  chemically synthesized
gatcctgtaaataaaatgattc

SEQ ID NO: 1094524 - DNA, 22 bp, Artificial Sequence
  chemically synthesized
agatcctgtaaataaaatgatt

SEQ ID NO: 1094525 - DNA, 22 bp, Artificial Sequence
  chemically synthesized
tagatcctgtaaataaaatgat

SEQ ID NO: 1094526 - DNA, 22 bp, Artificial Sequence
  chemically synthesized
ttttagatcctgtaaataaaat

SEQ ID NO: 1094527 - DNA, 22 bp, Artificial Sequence
  chemically synthesized
gttttagatcctgtaaataaaa

SEQ ID NO: 1094528 - DNA, 22 bp, Artificial Sequence
  chemically synthesized
tgttttagatcctgtaaataaa

SEQ ID NO: 1094529 - DNA, 22 bp, Artificial Sequence
  chemically synthesized
atctgaatcattttatttacag

SEQ ID NO: 1094530 - DNA, 22 bp, Artificial Sequence
  chemically synthesized
aatcattttatttacaggatct

SEQ ID NO: 1094531 - DNA, 22 bp, Artificial Sequence
  chemically synthesized
tatttacaggatctaaaacaaa

SEQ ID NO: 1094532 - DNA, 22 bp, Artificial Sequence
  chemically synthesized
atttacaggatctaaaacaaaa

SEQ ID NO: 1094533 - DNA, 22 bp, Artificial Sequence
  chemically synthesized
tttacaggatctaaaacaaaac

SEQ ID NO: 1094534 - DNA, 22 bp, Artificial Sequence
  chemically synthesized
acaggatctaaaacaaaaccac

SEQ ID NO: 1094535 - DNA, 22 bp, Artificial Sequence
  chemically synthesized
caggatctaaaacaaaaccact

SEQ ID NO: 1094536 - DNA, 22 bp, Artificial Sequence
  chemically synthesized
aaacaaaaccactcatctactg

SEQ ID NO: 1094537 - DNA, 22 bp, Artificial Sequence
  chemically synthesized
aatatatccacccagtagatga

SEQ ID NO: 1094538 - DNA, 22 bp, Artificial Sequence
  chemically synthesized
ctgaatatatccacccagtaga

SEQ ID NO: 1094539 - DNA, 22 bp, Artificial Sequence
  chemically synthesized
cctgaatatatccacccagtag

SEQ ID NO: 1094540 - DNA, 22 bp, Artificial Sequence
  chemically synthesized
atctactgggtggatatattca

SEQ ID NO: 1094541 - DNA, 22 bp, Artificial Sequence
  chemically synthesized
ctgggtggatatattcaggaag

SEQ ID NO: 1094542 - DNA, 22 bp, Artificial Sequence
  chemically synthesized
ggtggatatattcaggaagggg

SEQ ID NO: 1094543 - DNA, 22 bp, Artificial Sequence
  chemically synthesized
aacaggaaatgaataccaacca

SEQ ID NO: 1094544 - DNA, 22 bp, Artificial Sequence
  chemically synthesized
aggaaggggtggttggtattca

SEQ ID NO: 1094545 - DNA, 22 bp, Artificial Sequence
  chemically synthesized
gccataccaacagctcaacagg

SEQ ID NO: 1094546 - DNA, 22 bp, Artificial Sequence
  chemically synthesized
ggccataccaacagctcaacag

SEQ ID NO: 1094547 - DNA, 22 bp, Artificial Sequence
  chemically synthesized
gtattcatttcctgttgagctg

SEQ ID NO: 1094548 - DNA, 22 bp, Artificial Sequence
  chemically synthesized
ttggccataccaacagctcaac

SEQ ID NO: 1094549 - DNA, 22 bp, Artificial Sequence
  chemically synthesized
cttggccataccaacagctcaa

SEQ ID NO: 1094550 - DNA, 22 bp, Artificial Sequence
  chemically synthesized
cttcttggccataccaacagct

SEQ ID NO: 1094551 - DNA, 22 bp, Artificial Sequence
  chemically synthesized
atttcctgttgagctgttggta

SEQ ID NO: 1094552 - DNA, 22 bp, Artificial Sequence
  chemically synthesized
attccttcttggccataccaac

SEQ ID NO: 1094553 - DNA, 22 bp, Artificial Sequence
  chemically synthesized
cctgttgagctgttggtatggc

SEQ ID NO: 1094554 - DNA, 22 bp, Artificial Sequence
  chemically synthesized
gattccttcttggccataccaa

SEQ ID NO: 1094555 - DNA, 22 bp, Artificial Sequence
  chemically synthesized
ctgttgagctgttggtatggcc

SEQ ID NO: 1094556 - DNA, 22 bp, Artificial Sequence
  chemically synthesized
tgattccttcttggccatacca

SEQ ID NO: 1094557 - DNA, 22 bp, Artificial Sequence
  chemically synthesized
ttgattccttcttggccatacc

SEQ ID NO: 1094558 - DNA, 22 bp, Artificial Sequence
  chemically synthesized
ttgagctgttggtatggccaag

SEQ ID NO: 1094559 - DNA, 22 bp, Artificial Sequence
  chemically synthesized
tttttgattccttcttggccat

SEQ ID NO: 1094560 - DNA, 22 bp, Artificial Sequence
  chemically synthesized
agctgttggtatggccaagaag

SEQ ID NO: 1094561 - DNA, 22 bp, Artificial Sequence
  chemically synthesized
ttggtatggccaagaaggaatc

SEQ ID NO: 1094562 - DNA, 22 bp, Artificial Sequence
  chemically synthesized
aaagagttgtttttgattcctt

SEQ ID NO: 1094563 - DNA, 22 bp, Artificial Sequence
  chemically synthesized
gtatggccaagaaggaatcaaa

SEQ ID NO: 1094564 - DNA, 22 bp, Artificial Sequence
  chemically synthesized
gaaagagttgtttttgattcct

SEQ ID NO: 1094565 - DNA, 22 bp, Artificial Sequence
  chemically synthesized
aggaatgagaagtttgaaagag

SEQ ID NO: 1094566 - DNA, 22 bp, Artificial Sequence
  chemically synthesized
caggaatgagaagtttgaaaga

SEQ ID NO: 1094567 - DNA, 22 bp, Artificial Sequence
  chemically synthesized
tcaggaatgagaagtttgaaag

SEQ ID NO: 1094568 - DNA, 22 bp, Artificial Sequence
  chemically synthesized
cgtacctttcaggaatgagaag

SEQ ID NO: 1094569 - DNA, 22 bp, Artificial Sequence
  chemically synthesized
tttcaaacttctcattcctgaa

SEQ ID NO: 1094570 - DNA, 22 bp, Artificial Sequence
  chemically synthesized
tactccgtacctttcaggaatg

SEQ ID NO: 1094571 - DNA, 22 bp, Artificial Sequence
  chemically synthesized
tcaaacttctcattcctgaaag

SEQ ID NO: 1094572 - DNA, 22 bp, Artificial Sequence
  chemically synthesized
caaacttctcattcctgaaagg

SEQ ID NO: 1094573 - DNA, 22 bp, Artificial Sequence
  chemically synthesized
aaacttctcattcctgaaaggt

SEQ ID NO: 1094574 - DNA, 22 bp, Artificial Sequence
  chemically synthesized
ctcattcctgaaaggtacggag

SEQ ID NO: 1094575 - DNA, 22 bp, Artificial Sequence
  chemically synthesized
gaagtacctatactccgtacct

SEQ ID NO: 1094576 - DNA, 22 bp, Artificial Sequence
  chemically synthesized
tcattcctgaaaggtacggagt

SEQ ID NO: 1094577 - DNA, 22 bp, Artificial Sequence
  chemically synthesized
attcctgaaaggtacggagtat

SEQ ID NO: 1094578 - DNA, 22 bp, Artificial Sequence
  chemically synthesized
ctgaaaggtacggagtataggt

SEQ ID NO: 1094579 - DNA, 22 bp, Artificial Sequence
  chemically synthesized
tgggcactggaagtacctatac

SEQ ID NO: 1094580 - DNA, 22 bp, Artificial Sequence
  chemically synthesized
aaaggtacggagtataggtact

SEQ ID NO: 1094581 - DNA, 22 bp, Artificial Sequence
  chemically synthesized
agagcctatgggcactggaagt

SEQ ID NO: 1094582 - DNA, 22 bp, Artificial Sequence
  chemically synthesized
aactcagagcctatgggcactg

SEQ ID NO: 1094583 - DNA, 22 bp, Artificial Sequence
  chemically synthesized
ccatatctcaactcagagccta

SEQ ID NO: 1094584 - DNA, 22 bp, Artificial Sequence
  chemically synthesized
ccagtgcccataggctctgagt

SEQ ID NO: 1094585 - DNA, 22 bp, Artificial Sequence
  chemically synthesized
cagtgcccataggctctgagtt

SEQ ID NO: 1094586 - DNA, 22 bp, Artificial Sequence
  chemically synthesized
cctaccatatctcaactcagag

SEQ ID NO: 1094587 - DNA, 22 bp, Artificial Sequence
  chemically synthesized
acctaccatatctcaactcaga

SEQ ID NO: 1094588 - DNA, 22 bp, Artificial Sequence
  chemically synthesized
atttacctaccatatctcaact

SEQ ID NO: 1094589 - DNA, 22 bp, Artificial Sequence
  chemically synthesized
gagtctaatttacctaccatat

SEQ ID NO: 1094590 - DNA, 22 bp, Artificial Sequence
  chemically synthesized
tgagttgagatatggtaggtaa

SEQ ID NO: 1094591 - DNA, 22 bp, Artificial Sequence
  chemically synthesized
agttgagatatggtaggtaaat

SEQ ID NO: 1094592 - DNA, 22 bp, Artificial Sequence
  chemically synthesized
agatatggtaggtaaattagac

SEQ ID NO: 1094593 - DNA, 22 bp, Artificial Sequence
  chemically synthesized
gtgatgccctggagtctaattt

SEQ ID NO: 1094594 - DNA, 22 bp, Artificial Sequence
  chemically synthesized
agtgatgccctggagtctaatt

SEQ ID NO: 1094595 - DNA, 22 bp, Artificial Sequence
  chemically synthesized
tagtgatgccctggagtctaat

SEQ ID NO: 1094596 - DNA, 22 bp, Artificial Sequence
  chemically synthesized
accaatgctttagtgatgccct

SEQ ID NO: 1094597 - DNA, 22 bp, Artificial Sequence
  chemically synthesized
aaccaatgctttagtgatgccc

SEQ ID NO: 1094598 - DNA, 22 bp, Artificial Sequence
  chemically synthesized
taaccaatgctttagtgatgcc

SEQ ID NO: 1094599 - DNA, 22 bp, Artificial Sequence
  chemically synthesized
ttaaccaatgctttagtgatgc

SEQ ID NO: 1094600 - DNA, 22 bp, Artificial Sequence
  chemically synthesized
tttaaccaatgctttagtgatg

SEQ ID NO: 1094601 - DNA, 22 bp, Artificial Sequence
  chemically synthesized
gactccagggcatcactaaagc

SEQ ID NO: 1094602 - DNA, 22 bp, Artificial Sequence
  chemically synthesized
tgtctttttaaccaatgcttta

SEQ ID NO: 1094603 - DNA, 22 bp, Artificial Sequence
  chemically synthesized
cagggcatcactaaagcattgg

SEQ ID NO: 1094604 - DNA, 22 bp, Artificial Sequence
  chemically synthesized
aatattatgtctttttaaccaa

SEQ ID NO: 1094605 - DNA, 22 bp, Artificial Sequence
  chemically synthesized
gaatattatgtctttttaacca

SEQ ID NO: 1094606 - DNA, 22 bp, Artificial Sequence
  chemically synthesized
ttgaatattatgtctttttaac

SEQ ID NO: 1094607 - DNA, 22 bp, Artificial Sequence
  chemically synthesized
ctcttgaatattatgtcttttt

SEQ ID NO: 1094608 - DNA, 22 bp, Artificial Sequence
  chemically synthesized
aagcattggttaaaaagacata

SEQ ID NO: 1094609 - DNA, 22 bp, Artificial Sequence
  chemically synthesized
gttaaaaagacataatattcaa

SEQ ID NO: 1094610 - DNA, 22 bp, Artificial Sequence
  chemically synthesized
cacaaactgctcttgaatatta

SEQ ID NO: 1094611 - DNA, 22 bp, Artificial Sequence
  chemically synthesized
acacaaactgctcttgaatatt

SEQ ID NO: 1094612 - DNA, 22 bp, Artificial Sequence
  chemically synthesized
tacacaaactgctcttgaatat

SEQ ID NO: 1094613 - DNA, 22 bp, Artificial Sequence
  chemically synthesized
aaaagacataatattcaagagc

SEQ ID NO: 1094614 - DNA, 22 bp, Artificial Sequence
  chemically synthesized
tcaacagctttacacaaactgc

SEQ ID NO: 1094615 - DNA, 22 bp, Artificial Sequence
  chemically synthesized
gtcaacagctttacacaaactg

SEQ ID NO: 1094616 - DNA, 22 bp, Artificial Sequence
  chemically synthesized
acgcttgtcaacagctttacac

SEQ ID NO: 1094617 - DNA, 22 bp, Artificial Sequence
  chemically synthesized
aagagcagtttgtgtaaagctg

SEQ ID NO: 1094618 - DNA, 22 bp, Artificial Sequence
  chemically synthesized
aagctgacgcttgtcaacagct

SEQ ID NO: 1094619 - DNA, 22 bp, Artificial Sequence
  chemically synthesized
caagctgacgcttgtcaacagc

SEQ ID NO: 1094620 - DNA, 22 bp, Artificial Sequence
  chemically synthesized
gtgtaaagctgttgacaagcgt

SEQ ID NO: 1094621 - DNA, 22 bp, Artificial Sequence
  chemically synthesized
tgtaaagctgttgacaagcgtc

SEQ ID NO: 1094622 - DNA, 22 bp, Artificial Sequence
  chemically synthesized
acaagaatttcaagctgacgct

SEQ ID NO: 1094623 - DNA, 22 bp, Artificial Sequence
  chemically synthesized
aacaagaatttcaagctgacgc

SEQ ID NO: 1094624 - DNA, 22 bp, Artificial Sequence
  chemically synthesized
ttgacaagcgtcagcttgaaat

SEQ ID NO: 1094625 - DNA, 22 bp, Artificial Sequence
  chemically synthesized
acaagcgtcagcttgaaattct

SEQ ID NO: 1094626 - DNA, 22 bp, Artificial Sequence
  chemically synthesized
gtagtgtttaacaagaatttca

SEQ ID NO: 1094627 - DNA, 22 bp, Artificial Sequence
  chemically synthesized
tagtacctcgtagtgtttaaca

SEQ ID NO: 1094628 - DNA, 22 bp, Artificial Sequence
  chemically synthesized
atagtacctcgtagtgtttaac

SEQ ID NO: 1094629 - DNA, 22 bp, Artificial Sequence
  chemically synthesized
tatagtacctcgtagtgtttaa

SEQ ID NO: 1094630 - DNA, 22 bp, Artificial Sequence
  chemically synthesized
ttatagtacctcgtagtgttta

SEQ ID NO: 1094631 - DNA, 22 bp, Artificial Sequence
  chemically synthesized
gaaattcttgttaaacactacg

SEQ ID NO: 1094632 - DNA, 22 bp, Artificial Sequence
  chemically synthesized
aaattcttgttaaacactacga

SEQ ID NO: 1094633 - DNA, 22 bp, Artificial Sequence
  chemically synthesized
ggcttttatagtacctcgtagt

SEQ ID NO: 1094634 - DNA, 22 bp, Artificial Sequence
  chemically synthesized
ttgttaaacactacgaggtact

SEQ ID NO: 1094635 - DNA, 22 bp, Artificial Sequence
  chemically synthesized
ctaggcttttatagtacctcgt

SEQ ID NO: 1094636 - DNA, 22 bp, Artificial Sequence
  chemically synthesized
gttaaacactacgaggtactat

SEQ ID NO: 1094637 - DNA, 22 bp, Artificial Sequence
  chemically synthesized
ttaaacactacgaggtactata

SEQ ID NO: 1094638 - DNA, 22 bp, Artificial Sequence
  chemically synthesized
aacactacgaggtactataaaa

SEQ ID NO: 1094639 - DNA, 22 bp, Artificial Sequence
  chemically synthesized
cgaggtactataaaagcctagg

SEQ ID NO: 1094640 - DNA, 22 bp, Artificial Sequence
  chemically synthesized
aaccccccaaaaaagatctcct

SEQ ID NO: 1094641 - DNA, 22 bp, Artificial Sequence
  chemically synthesized
gaaccccccaaaaaagatctcc

SEQ ID NO: 1094642 - DNA, 22 bp, Artificial Sequence
  chemically synthesized
tgaaccccccaaaaaagatctc

SEQ ID NO: 1094643 - DNA, 22 bp, Artificial Sequence
  chemically synthesized
taaaagcctaggagatcttttt

SEQ ID NO: 1094644 - DNA, 22 bp, Artificial Sequence
  chemically synthesized
atatgagctttgaaccccccaa

SEQ ID NO: 1094645 - DNA, 22 bp, Artificial Sequence
  chemically synthesized
ggagatcttttttggggggttc

SEQ ID NO: 1094646 - DNA, 22 bp, Artificial Sequence
  chemically synthesized
ttcatatgagctttgaaccccc

SEQ ID NO: 1094647 - DNA, 22 bp, Artificial Sequence
  chemically synthesized
attcatatgagctttgaacccc

SEQ ID NO: 1094648 - DNA, 22 bp, Artificial Sequence
  chemically synthesized
gccttattcatatgagctttga

SEQ ID NO: 1094649 - DNA, 22 bp, Artificial Sequence
  chemically synthesized
ttttggggggttcaaagctcat

SEQ ID NO: 1094650 - DNA, 22 bp, Artificial Sequence
  chemically synthesized
tttggggggttcaaagctcata

SEQ ID NO: 1094651 - DNA, 22 bp, Artificial Sequence
  chemically synthesized
ttggggggttcaaagctcatat

SEQ ID NO: 1094652 - DNA, 22 bp, Artificial Sequence
  chemically synthesized
tggggggttcaaagctcatatg

SEQ ID NO: 1094653 - DNA, 22 bp, Artificial Sequence
  chemically synthesized
ggggggttcaaagctcatatga

SEQ ID NO: 1094654 - DNA, 22 bp, Artificial Sequence
  chemically synthesized
gggggttcaaagctcatatgaa

SEQ ID NO: 1094655 - DNA, 22 bp, Artificial Sequence
  chemically synthesized
aggatccagattggccttattc

SEQ ID NO: 1094656 - DNA, 22 bp, Artificial Sequence
  chemically synthesized
aaagctcatatgaataaggcca

SEQ ID NO: 1094657 - DNA, 22 bp, Artificial Sequence
  chemically synthesized
ttgaggatccagattggcctta

SEQ ID NO: 1094658 - DNA, 22 bp, Artificial Sequence
  chemically synthesized
tgttgaggatccagattggcct

SEQ ID NO: 1094659 - DNA, 22 bp, Artificial Sequence
  chemically synthesized
atatgaataaggccaatctgga

SEQ ID NO: 1094660 - DNA, 22 bp, Artificial Sequence
  chemically synthesized
gctctgttgaggatccagattg

SEQ ID NO: 1094661 - DNA, 22 bp, Artificial Sequence
  chemically synthesized
attcgctctgttgaggatccag

SEQ ID NO: 1094662 - DNA, 22 bp, Artificial Sequence
  chemically synthesized
gattcgctctgttgaggatcca

SEQ ID NO: 1094663 - DNA, 22 bp, Artificial Sequence
  chemically synthesized
tagacttgattcgctctgttga

SEQ ID NO: 1094664 - DNA, 22 bp, Artificial Sequence
  chemically synthesized
tatagacttgattcgctctgtt

SEQ ID NO: 1094665 - DNA, 22 bp, Artificial Sequence
  chemically synthesized
tctatagacttgattcgctctg

SEQ ID NO: 1094666 - DNA, 22 bp, Artificial Sequence
  chemically synthesized
gatcctcaacagagcgaatcaa

SEQ ID NO: 1094667 - DNA, 22 bp, Artificial Sequence
  chemically synthesized
gttctctatagacttgattcgc

SEQ ID NO: 1094668 - DNA, 22 bp, Artificial Sequence
  chemically synthesized
gctcgttctctatagacttgat

SEQ ID NO: 1094669 - DNA, 22 bp, Artificial Sequence
  chemically synthesized
aacagagcgaatcaagtctata

SEQ ID NO: 1094670 - DNA, 22 bp, Artificial Sequence
  chemically synthesized
acctggctcgttctctatagac

SEQ ID NO: 1094671 - DNA, 22 bp, Artificial Sequence
  chemically synthesized
tcaccactgacctggctcgttc

SEQ ID NO: 1094672 - DNA, 22 bp, Artificial Sequence
  chemically synthesized
tatattatcaccactgacctgg

SEQ ID NO: 1094673 - DNA, 22 bp, Artificial Sequence
  chemically synthesized
tagagaacgagccaggtcagtg

SEQ ID NO: 1094674 - DNA, 22 bp, Artificial Sequence
  chemically synthesized
tatatattatcaccactgacct

SEQ ID NO: 1094675 - DNA, 22 bp, Artificial Sequence
  chemically synthesized
ctatatattatcaccactgacc

SEQ ID NO: 1094676 - DNA, 22 bp, Artificial Sequence
  chemically synthesized
ttctatatattatcaccactga

SEQ ID NO: 1094677 - DNA, 22 bp, Artificial Sequence
  chemically synthesized
tccctcttctatatattatcac

SEQ ID NO: 1094678 - DNA, 22 bp, Artificial Sequence
  chemically synthesized
ttgtccctcttctatatattat

SEQ ID NO: 1094679 - DNA, 22 bp, Artificial Sequence
  chemically synthesized
gtctgttgtccctcttctatat

SEQ ID NO: 1094680 - DNA, 22 bp, Artificial Sequence
  chemically synthesized
taatgcctagtctgttgtccct

SEQ ID NO: 1094681 - DNA, 22 bp, Artificial Sequence
  chemically synthesized
aaacccacacacatctataatg

SEQ ID NO: 1094682 - DNA, 22 bp, Artificial Sequence
  chemically synthesized
ttaaaacccacacacatctata

SEQ ID NO: 1094683 - DNA, 22 bp, Artificial Sequence
  chemically synthesized
gttaaaacccacacacatctat

SEQ ID NO: 1094684 - DNA, 22 bp, Artificial Sequence
  chemically synthesized
tgttaaaacccacacacatcta

SEQ ID NO: 1094685 - DNA, 22 bp, Artificial Sequence
  chemically synthesized
ttgttaaaacccacacacatct

SEQ ID NO: 1094686 - DNA, 22 bp, Artificial Sequence
  chemically synthesized
ggcattatagatgtgtgtgggt

SEQ ID NO: 1094687 - DNA, 22 bp, Artificial Sequence
  chemically synthesized
ccttttgttaaaacccacacac

SEQ ID NO: 1094688 - DNA, 22 bp, Artificial Sequence
  chemically synthesized
ttcccttttgttaaaacccaca

SEQ ID NO: 1094689 - DNA, 22 bp, Artificial Sequence
  chemically synthesized
ctgttcccttttgttaaaaccc

SEQ ID NO: 1094690 - DNA, 22 bp, Artificial Sequence
  chemically synthesized
tagatgtgtgtgggttttaaca

SEQ ID NO: 1094691 - DNA, 22 bp, Artificial Sequence
  chemically synthesized
acaactgctgttcccttttgtt

SEQ ID NO: 1094692 - DNA, 22 bp, Artificial Sequence
  chemically synthesized
ctcacaactgctgttccctttt

SEQ ID NO: 1094693 - DNA, 22 bp, Artificial Sequence
  chemically synthesized
ctgctcacaactgctgttccct

SEQ ID NO: 1094694 - DNA, 22 bp, Artificial Sequence
  chemically synthesized
gctgctcacaactgctgttccc

SEQ ID NO: 1094695 - DNA, 22 bp, Artificial Sequence
  chemically synthesized
tgctgctcacaactgctgttcc

SEQ ID NO: 1094696 - DNA, 22 bp, Artificial Sequence
  chemically synthesized
ttgctgctcacaactgctgttc

SEQ ID NO: 1094697 - DNA, 22 bp, Artificial Sequence
  chemically synthesized
tttgctgctcacaactgctgtt

SEQ ID NO: 1094698 - DNA, 22 bp, Artificial Sequence
  chemically synthesized
taacaaaagggaacagcagttg

SEQ ID NO: 1094699 - DNA, 22 bp, Artificial Sequence
  chemically synthesized
ttttgctgctcacaactgctgt

SEQ ID NO: 1094700 - DNA, 22 bp, Artificial Sequence
  chemically synthesized
aacaaaagggaacagcagttgt

SEQ ID NO: 1094701 - DNA, 22 bp, Artificial Sequence
  chemically synthesized
tttttgctgctcacaactgctg

SEQ ID NO: 1094702 - DNA, 22 bp, Artificial Sequence
  chemically synthesized
acaaaagggaacagcagttgtg

SEQ ID NO: 1094703 - DNA, 22 bp, Artificial Sequence
  chemically synthesized
atgtgaaagtcctttttttgct

SEQ ID NO: 1094704 - DNA, 22 bp, Artificial Sequence
  chemically synthesized
catgtgaaagtcctttttttgc

SEQ ID NO: 1094705 - DNA, 22 bp, Artificial Sequence
  chemically synthesized
ttcatgtgaaagtccttttttt

SEQ ID NO: 1094706 - DNA, 22 bp, Artificial Sequence
  chemically synthesized
tcttcatgtgaaagtccttttt

SEQ ID NO: 1094707 - DNA, 22 bp, Artificial Sequence
  chemically synthesized
tgagcagcaaaaaaaggacttt

SEQ ID NO: 1094708 - DNA, 22 bp, Artificial Sequence
  chemically synthesized
tcacatgaagagagtatttttc

SEQ ID NO: 1094709 - DNA, 22 bp, Artificial Sequence
  chemically synthesized
cacatgaagagagtatttttcc

SEQ ID NO: 1094710 - DNA, 22 bp, Artificial Sequence
  chemically synthesized
acatgaagagagtatttttccc

SEQ ID NO: 1094711 - DNA, 22 bp, Artificial Sequence
  chemically synthesized
tcgatataagggagggtgaaga

SEQ ID NO: 1094712 - DNA, 22 bp, Artificial Sequence
  chemically synthesized
ctgtcgatataagggagggtga

SEQ ID NO: 1094713 - DNA, 22 bp, Artificial Sequence
  chemically synthesized
ttccctcttcaccctcccttat

SEQ ID NO: 1094714 - DNA, 22 bp, Artificial Sequence
  chemically synthesized
tccctcttcaccctcccttata

SEQ ID NO: 1094715 - DNA, 22 bp, Artificial Sequence
  chemically synthesized
ccctcttcaccctcccttatat

SEQ ID NO: 1094716 - DNA, 22 bp, Artificial Sequence
  chemically synthesized
cctcttcaccctcccttatatc

SEQ ID NO: 1094717 - DNA, 22 bp, Artificial Sequence
  chemically synthesized
ttcaccctcccttatatcgaca

SEQ ID NO: 1094718 - DNA, 22 bp, Artificial Sequence
  chemically synthesized
gatacagatctactgtcgatat

SEQ ID NO: 1094719 - DNA, 22 bp, Artificial Sequence
  chemically synthesized
caccctcccttatatcgacagt

SEQ ID NO: 1094720 - DNA, 22 bp, Artificial Sequence
  chemically synthesized
accctcccttatatcgacagta

SEQ ID NO: 1094721 - DNA, 22 bp, Artificial Sequence
  chemically synthesized
tggatacagatctactgtcgat

SEQ ID NO: 1094722 - DNA, 22 bp, Artificial Sequence
  chemically synthesized
ctggatacagatctactgtcga

SEQ ID NO: 1094723 - DNA, 22 bp, Artificial Sequence
  chemically synthesized
ccttatatcgacagtagatctg

SEQ ID NO: 1094724 - DNA, 22 bp, Artificial Sequence
  chemically synthesized
atatcgacagtagatctgtatc

SEQ ID NO: 1094725 - DNA, 22 bp, Artificial Sequence
  chemically synthesized
tatcgacagtagatctgtatcc

SEQ ID NO: 1094726 - DNA, 22 bp, Artificial Sequence
  chemically synthesized
catcccagtttctggatacaga

SEQ ID NO: 1094727 - DNA, 22 bp, Artificial Sequence
  chemically synthesized
ctccatcccagtttctggatac

SEQ ID NO: 1094728 - DNA, 22 bp, Artificial Sequence
  chemically synthesized
ctcctccatcccagtttctgga

SEQ ID NO: 1094729 - DNA, 22 bp, Artificial Sequence
  chemically synthesized
acagtctcctcctccatcccag

SEQ ID NO: 1094730 - DNA, 22 bp, Artificial Sequence
  chemically synthesized
tatccagaaactgggatggagg

SEQ ID NO: 1094731 - DNA, 22 bp, Artificial Sequence
  chemically synthesized
ggatggaggaggagactgtgag

SEQ ID NO: 1094732 - DNA, 22 bp, Artificial Sequence
  chemically synthesized
tacagacgcaggagtgagaata

SEQ ID NO: 1094733 - DNA, 22 bp, Artificial Sequence
  chemically synthesized
atacagacgcaggagtgagaat

SEQ ID NO: 1094734 - DNA, 22 bp, Artificial Sequence
  chemically synthesized
tgagaccatttattctcactcc

SEQ ID NO: 1094735 - DNA, 22 bp, Artificial Sequence
  chemically synthesized
agcaatttatacagacgcagga

SEQ ID NO: 1094736 - DNA, 22 bp, Artificial Sequence
  chemically synthesized
cagcaatttatacagacgcagg

SEQ ID NO: 1094737 - DNA, 22 bp, Artificial Sequence
  chemically synthesized
attctcactcctgcgtctgtat

SEQ ID NO: 1094738 - DNA, 22 bp, Artificial Sequence
  chemically synthesized
cttcagcaatttatacagacgc

SEQ ID NO: 1094739 - DNA, 22 bp, Artificial Sequence
  chemically synthesized
ttctcactcctgcgtctgtata

SEQ ID NO: 1094740 - DNA, 22 bp, Artificial Sequence
  chemically synthesized
ttgcttcagcaatttatacaga

SEQ ID NO: 1094741 - DNA, 22 bp, Artificial Sequence
  chemically synthesized
tcactcctgcgtctgtataaat

SEQ ID NO: 1094742 - DNA, 22 bp, Artificial Sequence
  chemically synthesized
actcctgcgtctgtataaattg

SEQ ID NO: 1094743 - DNA, 22 bp, Artificial Sequence
  chemically synthesized
atctgttgcttcagcaatttat

SEQ ID NO: 1094744 - DNA, 22 bp, Artificial Sequence
  chemically synthesized
ctgcgtctgtataaattgctga

SEQ ID NO: 1094745 - DNA, 22 bp, Artificial Sequence
  chemically synthesized
cgtctgtataaattgctgaagc

SEQ ID NO: 1094746 - DNA, 22 bp, Artificial Sequence
  chemically synthesized
gattaatctgttgcttcagcaa

SEQ ID NO: 1094747 - DNA, 22 bp, Artificial Sequence
  chemically synthesized
agattaatctgttgcttcagca

SEQ ID NO: 1094748 - DNA, 22 bp, Artificial Sequence
  chemically synthesized
tataaattgctgaagcaacaga

SEQ ID NO: 1094749 - DNA, 22 bp, Artificial Sequence
  chemically synthesized
acaagtttagattaatctgttg

SEQ ID NO: 1094750 - DNA, 22 bp, Artificial Sequence
  chemically synthesized
cacaagtttagattaatctgtt

SEQ ID NO: 1094751 - DNA, 22 bp, Artificial Sequence
  chemically synthesized
ctgaagcaacagattaatctaa

SEQ ID NO: 1094752 - DNA, 22 bp, Artificial Sequence
  chemically synthesized
aagcaacagattaatctaaact

SEQ ID NO: 1094753 - DNA, 22 bp, Artificial Sequence
  chemically synthesized
atcaaatatttcacaagtttag

SEQ ID NO: 1094754 - DNA, 22 bp, Artificial Sequence
  chemically synthesized
aatcaaatatttcacaagttta

SEQ ID NO: 1094755 - DNA, 22 bp, Artificial Sequence
  chemically synthesized
atctaaacttgtgaaatatttg

SEQ ID NO: 1094756 - DNA, 22 bp, Artificial Sequence
  chemically synthesized
aatatcataacttaatcaaata

SEQ ID NO: 1094757 - DNA, 22 bp, Artificial Sequence
  chemically synthesized
aacttgtgaaatatttgattaa

SEQ ID NO: 1094758 - DNA, 22 bp, Artificial Sequence
  chemically synthesized
aaatatcataacttaatcaaat

SEQ ID NO: 1094759 - DNA, 22 bp, Artificial Sequence
  chemically synthesized
gtgaaatatttgattaagttat

SEQ ID NO: 1094760 - DNA, 22 bp, Artificial Sequence
  chemically synthesized
aatttaaatatcataacttaat

SEQ ID NO: 1094761 - DNA, 22 bp, Artificial Sequence
  chemically synthesized
tgaaatatttgattaagttatg

SEQ ID NO: 1094762 - DNA, 22 bp, Artificial Sequence
  chemically synthesized
aaatttaaatatcataacttaa

SEQ ID NO: 1094763 - DNA, 22 bp, Artificial Sequence
  chemically synthesized
atttaaatttaaatatcataac

SEQ ID NO: 1094764 - DNA, 22 bp, Artificial Sequence
  chemically synthesized
taatttaaatttaaatatcata

SEQ ID NO: 1094765 - DNA, 22 bp, Artificial Sequence
  chemically synthesized
gattaagttatgatatttaaat

SEQ ID NO: 1094766 - DNA, 22 bp, Artificial Sequence
  chemically synthesized
attaagttatgatatttaaatt

SEQ ID NO: 1094767 - DNA, 22 bp, Artificial Sequence
  chemically synthesized
agttatgatatttaaatttaaa

SEQ ID NO: 1094768 - DNA, 22 bp, Artificial Sequence
  chemically synthesized
aaatgtactctaatttaaattt

SEQ ID NO: 1094769 - DNA, 22 bp, Artificial Sequence
  chemically synthesized
ttaaaatgtactctaatttaaa

SEQ ID NO: 1094770 - DNA, 22 bp, Artificial Sequence
  chemically synthesized
tgatatttaaatttaaattaga

SEQ ID NO: 1094771 - DNA, 22 bp, Artificial Sequence
  chemically synthesized
gttattaaaatgtactctaatt

SEQ ID NO: 1094772 - DNA, 22 bp, Artificial Sequence
  chemically synthesized
agttattaaaatgtactctaat

SEQ ID NO: 1094773 - DNA, 22 bp, Artificial Sequence
  chemically synthesized
tagttattaaaatgtactctaa

SEQ ID NO: 1094774 - DNA, 22 bp, Artificial Sequence
  chemically synthesized
ttagttattaaaatgtactcta

SEQ ID NO: 1094775 - DNA, 22 bp, Artificial Sequence
  chemically synthesized
aaatttaaattagagtacattt

SEQ ID NO: 1094776 - DNA, 22 bp, Artificial Sequence
  chemically synthesized
aatttaaattagagtacatttt

SEQ ID NO: 1094777 - DNA, 22 bp, Artificial Sequence
  chemically synthesized
acttttagttattaaaatgtac

SEQ ID NO: 1094778 - DNA, 22 bp, Artificial Sequence
  chemically synthesized
ttcacttttagttattaaaatg

SEQ ID NO: 1094779 - DNA, 22 bp, Artificial Sequence
  chemically synthesized
aaattagagtacattttaataa

SEQ ID NO: 1094780 - DNA, 22 bp, Artificial Sequence
  chemically synthesized
attcacttttagttattaaaat

SEQ ID NO: 1094781 - DNA, 22 bp, Artificial Sequence
  chemically synthesized
aattagagtacattttaataac

SEQ ID NO: 1094782 - DNA, 22 bp, Artificial Sequence
  chemically synthesized
tattcacttttagttattaaaa

SEQ ID NO: 1094783 - DNA, 22 bp, Artificial Sequence
  chemically synthesized
ttattcacttttagttattaaa

SEQ ID NO: 1094784 - DNA, 22 bp, Artificial Sequence
  chemically synthesized
tttattcacttttagttattaa

SEQ ID NO: 1094785 - DNA, 22 bp, Artificial Sequence
  chemically synthesized
gagtacattttaataactaaaa

SEQ ID NO: 1094786 - DNA, 22 bp, Artificial Sequence
  chemically synthesized
ctttttattcacttttagttat

SEQ ID NO: 1094787 - DNA, 22 bp, Artificial Sequence
  chemically synthesized
attactttttattcacttttag

SEQ ID NO: 1094788 - DNA, 22 bp, Artificial Sequence
  chemically synthesized
taataactaaaagtgaataaaa

SEQ ID NO: 1094789 - DNA, 22 bp, Artificial Sequence
  chemically synthesized
aataactaaaagtgaataaaaa

SEQ ID NO: 1094790 - DNA, 22 bp, Artificial Sequence
  chemically synthesized
ggatctcattactttttattca

SEQ ID NO: 1094791 - DNA, 22 bp, Artificial Sequence
  chemically synthesized
ataactaaaagtgaataaaaag

SEQ ID NO: 1094792 - DNA, 22 bp, Artificial Sequence
  chemically synthesized
tgggatctcattactttttatt

SEQ ID NO: 1094793 - DNA, 22 bp, Artificial Sequence
  chemically synthesized
tctgggatctcattacttttta

SEQ ID NO: 1094794 - DNA, 22 bp, Artificial Sequence
  chemically synthesized
ctctgggatctcattacttttt

SEQ ID NO: 1094795 - DNA, 22 bp, Artificial Sequence
  chemically synthesized
aaagtgaataaaaagtaatgag

SEQ ID NO: 1094796 - DNA, 22 bp, Artificial Sequence
  chemically synthesized
acaatatttctctgggatctca

SEQ ID NO: 1094797 - DNA, 22 bp, Artificial Sequence
  chemically synthesized
aacaatatttctctgggatctc

SEQ ID NO: 1094798 - DNA, 22 bp, Artificial Sequence
  chemically synthesized
taacaatatttctctgggatct

SEQ ID NO: 1094799 - DNA, 22 bp, Artificial Sequence
  chemically synthesized
tttaacaatatttctctgggat

SEQ ID NO: 1094800 - DNA, 22 bp, Artificial Sequence
  chemically synthesized
ctttaacaatatttctctggga

SEQ ID NO: 1094801 - DNA, 22 bp, Artificial Sequence
  chemically synthesized
gcttctttaacaatatttctct

SEQ ID NO: 1094802 - DNA, 22 bp, Artificial Sequence
  chemically synthesized
gtagttggcttctttaacaata

SEQ ID NO: 1094803 - DNA, 22 bp, Artificial Sequence
  chemically synthesized
cctggtagttggcttctttaac

SEQ ID NO: 1094804 - DNA, 22 bp, Artificial Sequence
  chemically synthesized
tgcctggtagttggcttcttta

SEQ ID NO: 1094805 - DNA, 22 bp, Artificial Sequence
  chemically synthesized
ctgcctggtagttggcttcttt

SEQ ID NO: 1094806 - DNA, 22 bp, Artificial Sequence
  chemically synthesized
accttctgcctggtagttggct

SEQ ID NO: 1094807 - DNA, 22 bp, Artificial Sequence
  chemically synthesized
caccttctgcctggtagttggc

SEQ ID NO: 1094808 - DNA, 22 bp, Artificial Sequence
  chemically synthesized
ttaaagaagccaactaccaggc

SEQ ID NO: 1094809 - DNA, 22 bp, Artificial Sequence
  chemically synthesized
aagaagccaactaccaggcaga

SEQ ID NO: 1094810 - DNA, 22 bp, Artificial Sequence
  chemically synthesized
tcaaatttcaccttctgcctgg

SEQ ID NO: 1094811 - DNA, 22 bp, Artificial Sequence
  chemically synthesized
tgtcaaatttcaccttctgcct

SEQ ID NO: 1094812 - DNA, 22 bp, Artificial Sequence
  chemically synthesized
ccaggcagaaggtgaaatttga

SEQ ID NO: 1094813 - DNA, 22 bp, Artificial Sequence
  chemically synthesized
cacccaactctgtcaaatttca

SEQ ID NO: 1094814 - DNA, 22 bp, Artificial Sequence
  chemically synthesized
caataactacacccaactctgt

SEQ ID NO: 1094815 - DNA, 22 bp, Artificial Sequence
  chemically synthesized
ccaataactacacccaactctg

SEQ ID NO: 1094816 - DNA, 22 bp, Artificial Sequence
  chemically synthesized
tccaataactacacccaactct

SEQ ID NO: 1094817 - DNA, 22 bp, Artificial Sequence
  chemically synthesized
ttccaataactacacccaactc

SEQ ID NO: 1094818 - DNA, 22 bp, Artificial Sequence
  chemically synthesized
tttttccaataactacacccaa

SEQ ID NO: 1094819 - DNA, 22 bp, Artificial Sequence
  chemically synthesized
atttttccaataactacaccca

SEQ ID NO: 1094820 - DNA, 22 bp, Artificial Sequence
  chemically synthesized
gacagagttgggtgtagttatt

SEQ ID NO: 1094821 - DNA, 22 bp, Artificial Sequence
  chemically synthesized
acagagttgggtgtagttattg

SEQ ID NO: 1094822 - DNA, 22 bp, Artificial Sequence
  chemically synthesized
ggtgtagttattggaaaaataa

SEQ ID NO: 1094823 - DNA, 22 bp, Artificial Sequence
  chemically synthesized
ttggaaaaataagacggtgtca

SEQ ID NO: 1094824 - DNA, 22 bp, Artificial Sequence
  chemically synthesized
atgagtaataaacatgacaccg

SEQ ID NO: 1094825 - DNA, 22 bp, Artificial Sequence
  chemically synthesized
gaaaaataagacggtgtcatgt

SEQ ID NO: 1094826 - DNA, 22 bp, Artificial Sequence
  chemically synthesized
aatgagtaataaacatgacacc

SEQ ID NO: 1094827 - DNA, 22 bp, Artificial Sequence
  chemically synthesized
aacttaatgagtaataaacatg

SEQ ID NO: 1094828 - DNA, 22 bp, Artificial Sequence
  chemically synthesized
caacttaatgagtaataaacat

SEQ ID NO: 1094829 - DNA, 22 bp, Artificial Sequence
  chemically synthesized
aaatgtttcaacttaatgagta

SEQ ID NO: 1094830 - DNA, 22 bp, Artificial Sequence
  chemically synthesized
actgaaatgtttcaacttaatg

SEQ ID NO: 1094831 - DNA, 22 bp, Artificial Sequence
  chemically synthesized
gactgaaatgtttcaacttaat

SEQ ID NO: 1094832 - DNA, 22 bp, Artificial Sequence
  chemically synthesized
tttgactgaaatgtttcaactt

SEQ ID NO: 1094833 - DNA, 22 bp, Artificial Sequence
  chemically synthesized
attactcattaagttgaaacat

SEQ ID NO: 1094834 - DNA, 22 bp, Artificial Sequence
  chemically synthesized
ttactcattaagttgaaacatt

SEQ ID NO: 1094835 - DNA, 22 bp, Artificial Sequence
  chemically synthesized
ctcattaagttgaaacatttca

SEQ ID NO: 1094836 - DNA, 22 bp, Artificial Sequence
  chemically synthesized
attaagttgaaacatttcagtc

SEQ ID NO: 1094837 - DNA, 22 bp, Artificial Sequence
  chemically synthesized
agttgaaacatttcagtcaaac

SEQ ID NO: 1094838 - DNA, 22 bp, Artificial Sequence
  chemically synthesized
aacagataccatctgtttgact

SEQ ID NO: 1094839 - DNA, 22 bp, Artificial Sequence
  chemically synthesized
aaacagataccatctgtttgac

SEQ ID NO: 1094840 - DNA, 22 bp, Artificial Sequence
  chemically synthesized
aaacatttcagtcaaacagatg

SEQ ID NO: 1094841 - DNA, 22 bp, Artificial Sequence
  chemically synthesized
aacaacttaaacagataccatc

SEQ ID NO: 1094842 - DNA, 22 bp, Artificial Sequence
  chemically synthesized
aaacaacttaaacagataccat

SEQ ID NO: 1094843 - DNA, 22 bp, Artificial Sequence
  chemically synthesized
cagtcaaacagatggtatctgt

SEQ ID NO: 1094844 - DNA, 22 bp, Artificial Sequence
  chemically synthesized
taaacaacttaaacagatacca

SEQ ID NO: 1094845 - DNA, 22 bp, Artificial Sequence
  chemically synthesized
agtcaaacagatggtatctgtt

SEQ ID NO: 1094846 - DNA, 22 bp, Artificial Sequence
  chemically synthesized
ctttaaacaacttaaacagata

SEQ ID NO: 1094847 - DNA, 22 bp, Artificial Sequence
  chemically synthesized
tgtattcctttaaacaacttaa

SEQ ID NO: 1094848 - DNA, 22 bp, Artificial Sequence
  chemically synthesized
tatgtattcctttaaacaactt

SEQ ID NO: 1094849 - DNA, 22 bp, Artificial Sequence
  chemically synthesized
attctatgtattcctttaaaca

SEQ ID NO: 1094850 - DNA, 22 bp, Artificial Sequence
  chemically synthesized
tttaagttgtttaaaggaatac

SEQ ID NO: 1094851 - DNA, 22 bp, Artificial Sequence
  chemically synthesized
tgattaattctatgtattcctt

SEQ ID NO: 1094852 - DNA, 22 bp, Artificial Sequence
  chemically synthesized
gtgattaattctatgtattcct

SEQ ID NO: 1094853 - DNA, 22 bp, Artificial Sequence
  chemically synthesized
aagttgtttaaaggaatacata

SEQ ID NO: 1094854 - DNA, 22 bp, Artificial Sequence
  chemically synthesized
tgtgattaattctatgtattcc

SEQ ID NO: 1094855 - DNA, 22 bp, Artificial Sequence
  chemically synthesized
agttgtttaaaggaatacatag

SEQ ID NO: 1094856 - DNA, 22 bp, Artificial Sequence
  chemically synthesized
ttgtgattaattctatgtattc

SEQ ID NO: 1094857 - DNA, 22 bp, Artificial Sequence
  chemically synthesized
tttgtgattaattctatgtatt

SEQ ID NO: 1094858 - DNA, 22 bp, Artificial Sequence
  chemically synthesized
ttttgtgattaattctatgtat

SEQ ID NO: 1094859 - DNA, 22 bp, Artificial Sequence
  chemically synthesized
ttttttgtgattaattctatgt

SEQ ID NO: 1094860 - DNA, 22 bp, Artificial Sequence
  chemically synthesized
tttaaaggaatacatagaatta

SEQ ID NO: 1094861 - DNA, 22 bp, Artificial Sequence
  chemically synthesized
cttttttgtgattaattctatg

SEQ ID NO: 1094862 - DNA, 22 bp, Artificial Sequence
  chemically synthesized
ttcttttttgtgattaattcta

SEQ ID NO: 1094863 - DNA, 22 bp, Artificial Sequence
  chemically synthesized
aaaggaatacatagaattaatc

SEQ ID NO: 1094864 - DNA, 22 bp, Artificial Sequence
  chemically synthesized
cttcttttttgtgattaattct

SEQ ID NO: 1094865 - DNA, 22 bp, Artificial Sequence
  chemically synthesized
aaggaatacatagaattaatca

SEQ ID NO: 1094866 - DNA, 22 bp, Artificial Sequence
  chemically synthesized
tcttcttttttgtgattaattc

SEQ ID NO: 1094867 - DNA, 22 bp, Artificial Sequence
  chemically synthesized
tggttttcttcttttttgtgat

SEQ ID NO: 1094868 - DNA, 22 bp, Artificial Sequence
  chemically synthesized
ttatggttttcttcttttttgt

SEQ ID NO: 1094869 - DNA, 22 bp, Artificial Sequence
  chemically synthesized
gttatggttttcttcttttttg

SEQ ID NO: 1094870 - DNA, 22 bp, Artificial Sequence
  chemically synthesized
tgttatggttttcttctttttt

SEQ ID NO: 1094871 - DNA, 22 bp, Artificial Sequence
  chemically synthesized
tttgttatggttttcttctttt

SEQ ID NO: 1094872 - DNA, 22 bp, Artificial Sequence
  chemically synthesized
ttctttgttatggttttcttct

SEQ ID NO: 1094873 - DNA, 22 bp, Artificial Sequence
  chemically synthesized
atcacaaaaaagaagaaaacca

SEQ ID NO: 1094874 - DNA, 22 bp, Artificial Sequence
  chemically synthesized
acaaatctgttctttgttatgg

SEQ ID NO: 1094875 - DNA, 22 bp, Artificial Sequence
  chemically synthesized
cacaaatctgttctttgttatg

SEQ ID NO: 1094876 - DNA, 22 bp, Artificial Sequence
  chemically synthesized
tttcacaaatctgttctttgtt

SEQ ID NO: 1094877 - DNA, 22 bp, Artificial Sequence
  chemically synthesized
agttgtttcacaaatctgttct

SEQ ID NO: 1094878 - DNA, 22 bp, Artificial Sequence
  chemically synthesized
ttgagttgtttcacaaatctgt

SEQ ID NO: 1094879 - DNA, 22 bp, Artificial Sequence
  chemically synthesized
attgagttgtttcacaaatctg

SEQ ID NO: 1094880 - DNA, 22 bp, Artificial Sequence
  chemically synthesized
tattgagttgtttcacaaatct

SEQ ID NO: 1094881 - DNA, 22 bp, Artificial Sequence
  chemically synthesized
aatattttattgagttgtttca

SEQ ID NO: 1094882 - DNA, 22 bp, Artificial Sequence
  chemically synthesized
tcaatattttattgagttgttt

SEQ ID NO: 1094883 - DNA, 22 bp, Artificial Sequence
  chemically synthesized
ctcaatattttattgagttgtt

SEQ ID NO: 1094884 - DNA, 22 bp, Artificial Sequence
  chemically synthesized
catttctcaatattttattgag

SEQ ID NO: 1094885 - DNA, 22 bp, Artificial Sequence
  chemically synthesized
ccatttctcaatattttattga

SEQ ID NO: 1094886 - DNA, 22 bp, Artificial Sequence
  chemically synthesized
tccatttctcaatattttattg

SEQ ID NO: 1094887 - DNA, 22 bp, Artificial Sequence
  chemically synthesized
gtgaaacaactcaataaaatat

SEQ ID NO: 1094888 - DNA, 22 bp, Artificial Sequence
  chemically synthesized
tgaaacaactcaataaaatatt

SEQ ID NO: 1094889 - DNA, 22 bp, Artificial Sequence
  chemically synthesized
aataaaatattgagaaatggaa

SEQ ID NO: 1094890 - DNA, 22 bp, Artificial Sequence
  chemically synthesized
aaaaaacatattttccatttct

SEQ ID NO: 1094891 - DNA, 22 bp, Artificial Sequence
  chemically synthesized
caaaaaacatattttccatttc

SEQ ID NO: 1094892 - DNA, 22 bp, Artificial Sequence
  chemically synthesized
tcaaaaaacatattttccattt

SEQ ID NO: 1094893 - DNA, 22 bp, Artificial Sequence
  chemically synthesized
ttcaaaaaacatattttccatt

SEQ ID NO: 1094894 - DNA, 22 bp, Artificial Sequence
  chemically synthesized
tttcaaaaaacatattttccat

SEQ ID NO: 1094895 - DNA, 22 bp, Artificial Sequence
  chemically synthesized
tattttttcaaaaaacatattt

SEQ ID NO: 1094896 - DNA, 22 bp, Artificial Sequence
  chemically synthesized
atattttttcaaaaaacatatt

SEQ ID NO: 1094897 - DNA, 22 bp, Artificial Sequence
  chemically synthesized
agaaatggaaaatatgtttttt

SEQ ID NO: 1094898 - DNA, 22 bp, Artificial Sequence
  chemically synthesized
tgtatgtgtgtttatatttttt

SEQ ID NO: 1094899 - DNA, 22 bp, Artificial Sequence
  chemically synthesized
atgtatgtgtgtttatattttt

SEQ ID NO: 1094900 - DNA, 22 bp, Artificial Sequence
  chemically synthesized
catttatgtatgtgtgtttata

SEQ ID NO: 1094901 - DNA, 22 bp, Artificial Sequence
  chemically synthesized
tttgaaaaaatataaacacaca

SEQ ID NO: 1094902 - DNA, 22 bp, Artificial Sequence
  chemically synthesized
tacatttatgtatgtgtgttta

SEQ ID NO: 1094903 - DNA, 22 bp, Artificial Sequence
  chemically synthesized
ttgaaaaaatataaacacacat

SEQ ID NO: 1094904 - DNA, 22 bp, Artificial Sequence
  chemically synthesized
tgaaaaaatataaacacacata

SEQ ID NO: 1094905 - DNA, 22 bp, Artificial Sequence
  chemically synthesized
tctacatttatgtatgtgtgtt

SEQ ID NO: 1094906 - DNA, 22 bp, Artificial Sequence
  chemically synthesized
gaaaaaatataaacacacatac

SEQ ID NO: 1094907 - DNA, 22 bp, Artificial Sequence
  chemically synthesized
aaaaaatataaacacacataca

SEQ ID NO: 1094908 - DNA, 22 bp, Artificial Sequence
  chemically synthesized
tctctctacatttatgtatgtg

SEQ ID NO: 1094909 - DNA, 22 bp, Artificial Sequence
  chemically synthesized
atctctctacatttatgtatgt

SEQ ID NO: 1094910 - DNA, 22 bp, Artificial Sequence
  chemically synthesized
tatatatatttatctctctaca

SEQ ID NO: 1094911 - DNA, 22 bp, Artificial Sequence
  chemically synthesized
tctgtatatatatttatctctc

SEQ ID NO: 1094912 - DNA, 22 bp, Artificial Sequence
  chemically synthesized
gtctgtatatatatttatctct

SEQ ID NO: 1094913 - DNA, 22 bp, Artificial Sequence
  chemically synthesized
tgtctgtatatatatttatctc

SEQ ID NO: 1094914 - DNA, 22 bp, Artificial Sequence
  chemically synthesized
atctttgtctgtatatatattt

SEQ ID NO: 1094915 - DNA, 22 bp, Artificial Sequence
  chemically synthesized
aatagagaaatagtctcatctt

SEQ ID NO: 1094916 - DNA, 22 bp, Artificial Sequence
  chemically synthesized
caatagagaaatagtctcatct

SEQ ID NO: 1094917 - DNA, 22 bp, Artificial Sequence
  chemically synthesized
tccttcaatagagaaatagtct

SEQ ID NO: 1094918 - DNA, 22 bp, Artificial Sequence
  chemically synthesized
atccttcaatagagaaatagtc

SEQ ID NO: 1094919 - DNA, 22 bp, Artificial Sequence
  chemically synthesized
tggcgtaatttatccttcaata

SEQ ID NO: 1094920 - DNA, 22 bp, Artificial Sequence
  chemically synthesized
cctgtggcgtaatttatccttc

SEQ ID NO: 1094921 - DNA, 22 bp, Artificial Sequence
  chemically synthesized
tttctctattgaaggataaatt

SEQ ID NO: 1094922 - DNA, 22 bp, Artificial Sequence
  chemically synthesized
ctctattgaaggataaattacg

SEQ ID NO: 1094923 - DNA, 22 bp, Artificial Sequence
  chemically synthesized
agctgcctgtggcgtaatttat

SEQ ID NO: 1094924 - DNA, 22 bp, Artificial Sequence
  chemically synthesized
tctattgaaggataaattacgc

SEQ ID NO: 1094925 - DNA, 22 bp, Artificial Sequence
  chemically synthesized
cagctgcctgtggcgtaattta

SEQ ID NO: 1094926 - DNA, 22 bp, Artificial Sequence
  chemically synthesized
tattgaaggataaattacgcca

SEQ ID NO: 1094927 - DNA, 22 bp, Artificial Sequence
  chemically synthesized
ttgaaggataaattacgccaca

SEQ ID NO: 1094928 - DNA, 22 bp, Artificial Sequence
  chemically synthesized
gcttcagctgcctgtggcgtaa

SEQ ID NO: 1094929 - DNA, 22 bp, Artificial Sequence
  chemically synthesized
tcgcttcagctgcctgtggcgt

SEQ ID NO: 1094930 - DNA, 22 bp, Artificial Sequence
  chemically synthesized
aaggataaattacgccacaggc

SEQ ID NO: 1094931 - DNA, 22 bp, Artificial Sequence
  chemically synthesized
aaattctcgcttcagctgcctg

SEQ ID NO: 1094932 - DNA, 22 bp, Artificial Sequence
  chemically synthesized
tcaaattctcgcttcagctgcc

SEQ ID NO: 1094933 - DNA, 22 bp, Artificial Sequence
  chemically synthesized
cgccacaggcagctgaagcgag

SEQ ID NO: 1094934 - DNA, 22 bp, Artificial Sequence
  chemically synthesized
caactctcaaattctcgcttca

SEQ ID NO: 1094935 - DNA, 22 bp, Artificial Sequence
  chemically synthesized
ccaactctcaaattctcgcttc

SEQ ID NO: 1094936 - DNA, 22 bp, Artificial Sequence
  chemically synthesized
tcttccaactctcaaattctcg

SEQ ID NO: 1094937 - DNA, 22 bp, Artificial Sequence
  chemically synthesized
aaatctgtcttccaactctcaa

SEQ ID NO: 1094938 - DNA, 22 bp, Artificial Sequence
  chemically synthesized
aagcgagaatttgagagttgga

SEQ ID NO: 1094939 - DNA, 22 bp, Artificial Sequence
  chemically synthesized
taaaatctgtcttccaactctc

SEQ ID NO: 1094940 - DNA, 22 bp, Artificial Sequence
  chemically synthesized
ctaaaatctgtcttccaactct

SEQ ID NO: 1094941 - DNA, 22 bp, Artificial Sequence
  chemically synthesized
tctaaaatctgtcttccaactc

SEQ ID NO: 1094942 - DNA, 22 bp, Artificial Sequence
  chemically synthesized
ttctaaaatctgtcttccaact

SEQ ID NO: 1094943 - DNA, 22 bp, Artificial Sequence
  chemically synthesized
gatacttttctaaaatctgtct

SEQ ID NO: 1094944 - DNA, 22 bp, Artificial Sequence
  chemically synthesized
ggatacttttctaaaatctgtc

SEQ ID NO: 1094945 - DNA, 22 bp, Artificial Sequence
  chemically synthesized
gagagttggaagacagatttta

SEQ ID NO: 1094946 - DNA, 22 bp, Artificial Sequence
  chemically synthesized
tggatacttttctaaaatctgt

SEQ ID NO: 1094947 - DNA, 22 bp, Artificial Sequence
  chemically synthesized
agagttggaagacagattttag

SEQ ID NO: 1094948 - DNA, 22 bp, Artificial Sequence
  chemically synthesized
aattttggatacttttctaaaa

SEQ ID NO: 1094949 - DNA, 22 bp, Artificial Sequence
  chemically synthesized
gaagacagattttagaaaagta

SEQ ID NO: 1094950 - DNA, 22 bp, Artificial Sequence
  chemically synthesized
ctcaattttggatacttttcta

SEQ ID NO: 1094951 - DNA, 22 bp, Artificial Sequence
  chemically synthesized
tctgctcaattttggatacttt

SEQ ID NO: 1094952 - DNA, 22 bp, Artificial Sequence
  chemically synthesized
tatctgctcaattttggatact

SEQ ID NO: 1094953 - DNA, 22 bp, Artificial Sequence
  chemically synthesized
tctctatctgctcaattttgga

SEQ ID NO: 1094954 - DNA, 22 bp, Artificial Sequence
  chemically synthesized
atctctatctgctcaattttgg

SEQ ID NO: 1094955 - DNA, 22 bp, Artificial Sequence
  chemically synthesized
tagaaaagtatccaaaattgag

SEQ ID NO: 1094956 - DNA, 22 bp, Artificial Sequence
  chemically synthesized
agaaaagtatccaaaattgagc

SEQ ID NO: 1094957 - DNA, 22 bp, Artificial Sequence
  chemically synthesized
ttatctctatctgctcaatttt

SEQ ID NO: 1094958 - DNA, 22 bp, Artificial Sequence
  chemically synthesized
gaaaagtatccaaaattgagca

SEQ ID NO: 1094959 - DNA, 22 bp, Artificial Sequence
  chemically synthesized
tattcttatctctatctgctca

SEQ ID NO: 1094960 - DNA, 22 bp, Artificial Sequence
  chemically synthesized
tatattcttatctctatctgct

SEQ ID NO: 1094961 - DNA, 22 bp, Artificial Sequence
  chemically synthesized
ctatattcttatctctatctgc

SEQ ID NO: 1094962 - DNA, 22 bp, Artificial Sequence
  chemically synthesized
tctatattcttatctctatctg

SEQ ID NO: 1094963 - DNA, 22 bp, Artificial Sequence
  chemically synthesized
atattttctatattcttatctc

SEQ ID NO: 1094964 - DNA, 22 bp, Artificial Sequence
  chemically synthesized
aatattttctatattcttatct

SEQ ID NO: 1094965 - DNA, 22 bp, Artificial Sequence
  chemically synthesized
taatattttctatattcttatc

SEQ ID NO: 1094966 - DNA, 22 bp, Artificial Sequence
  chemically synthesized
agcagatagagataagaatata

SEQ ID NO: 1094967 - DNA, 22 bp, Artificial Sequence
  chemically synthesized
cctttaatattttctatattct

SEQ ID NO: 1094968 - DNA, 22 bp, Artificial Sequence
  chemically synthesized
ccctttaatattttctatattc

SEQ ID NO: 1094969 - DNA, 22 bp, Artificial Sequence
  chemically synthesized
gtttccctttaatattttctat

SEQ ID NO: 1094970 - DNA, 22 bp, Artificial Sequence
  chemically synthesized
ctggtttccctttaatattttc

SEQ ID NO: 1094971 - DNA, 22 bp, Artificial Sequence
  chemically synthesized
cagttactggtttccctttaat

SEQ ID NO: 1094972 - DNA, 22 bp, Artificial Sequence
  chemically synthesized
tattccagttactggtttccct

SEQ ID NO: 1094973 - DNA, 22 bp, Artificial Sequence
  chemically synthesized
atattccagttactggtttccc

SEQ ID NO: 1094974 - DNA, 22 bp, Artificial Sequence
  chemically synthesized
ttatattccagttactggtttc

SEQ ID NO: 1094975 - DNA, 22 bp, Artificial Sequence
  chemically synthesized
cttatattccagttactggttt

SEQ ID NO: 1094976 - DNA, 22 bp, Artificial Sequence
  chemically synthesized
aagggaaaccagtaactggaat

SEQ ID NO: 1094977 - DNA, 22 bp, Artificial Sequence
  chemically synthesized
tccccttcttatattccagtta

SEQ ID NO: 1094978 - DNA, 22 bp, Artificial Sequence
  chemically synthesized
agactatccccttcttatattc

SEQ ID NO: 1094979 - DNA, 22 bp, Artificial Sequence
  chemically synthesized
ttaagactatccccttcttata

SEQ ID NO: 1094980 - DNA, 22 bp, Artificial Sequence
  chemically synthesized
gagctattaagactatcccctt

SEQ ID NO: 1094981 - DNA, 22 bp, Artificial Sequence
  chemically synthesized
agagctattaagactatcccct

SEQ ID NO: 1094982 - DNA, 22 bp, Artificial Sequence
  chemically synthesized
gaatataagaaggggatagtct

SEQ ID NO: 1094983 - DNA, 22 bp, Artificial Sequence
  chemically synthesized
ttagagctattaagactatccc

SEQ ID NO: 1094984 - DNA, 22 bp, Artificial Sequence
  chemically synthesized
cttagagctattaagactatcc

SEQ ID NO: 1094985 - DNA, 22 bp, Artificial Sequence
  chemically synthesized
tcttagagctattaagactatc

SEQ ID NO: 1094986 - DNA, 22 bp, Artificial Sequence
  chemically synthesized
agggaaaactttcttagagcta

SEQ ID NO: 1094987 - DNA, 22 bp, Artificial Sequence
  chemically synthesized
ctaagggaaaactttcttagag

SEQ ID NO: 1094988 - DNA, 22 bp, Artificial Sequence
  chemically synthesized
cctaagggaaaactttcttaga

SEQ ID NO: 1094989 - DNA, 22 bp, Artificial Sequence
  chemically synthesized
cttcctaagggaaaactttctt

SEQ ID NO: 1094990 - DNA, 22 bp, Artificial Sequence
  chemically synthesized
aatagctctaagaaagttttcc

SEQ ID NO: 1094991 - DNA, 22 bp, Artificial Sequence
  chemically synthesized
atagctctaagaaagttttccc

SEQ ID NO: 1094992 - DNA, 22 bp, Artificial Sequence
  chemically synthesized
attccttcctaagggaaaactt

SEQ ID NO: 1094993 - DNA, 22 bp, Artificial Sequence
  chemically synthesized
cattccttcctaagggaaaact

SEQ ID NO: 1094994 - DNA, 22 bp, Artificial Sequence
  chemically synthesized
ttcattccttcctaagggaaaa

SEQ ID NO: 1094995 - DNA, 22 bp, Artificial Sequence
  chemically synthesized
taagaaagttttcccttaggaa

SEQ ID NO: 1094996 - DNA, 22 bp, Artificial Sequence
  chemically synthesized
agaaagttttcccttaggaagg

SEQ ID NO: 1094997 - DNA, 22 bp, Artificial Sequence
  chemically synthesized
ccaatctcttcattccttccta

SEQ ID NO: 1094998 - DNA, 22 bp, Artificial Sequence
  chemically synthesized
cccaatctcttcattccttcct

SEQ ID NO: 1094999 - DNA, 22 bp, Artificial Sequence
  chemically synthesized
tcccaatctcttcattccttcc

SEQ ID NO: 1095000 - DNA, 22 bp, Artificial Sequence
  chemically synthesized
ttcccaatctcttcattccttc

SEQ ID NO: 1095001 - DNA, 22 bp, Artificial Sequence
  chemically synthesized
tttcccaatctcttcattcctt

SEQ ID NO: 1095002 - DNA, 22 bp, Artificial Sequence
  chemically synthesized
tttttcccaatctcttcattcc

SEQ ID NO: 1095003 - DNA, 22 bp, Artificial Sequence
  chemically synthesized
tcccttaggaaggaatgaagag

SEQ ID NO: 1095004 - DNA, 22 bp, Artificial Sequence
  chemically synthesized
ctttttcccaatctcttcattc

SEQ ID NO: 1095005 - DNA, 22 bp, Artificial Sequence
  chemically synthesized
cccttaggaaggaatgaagaga

SEQ ID NO: 1095006 - DNA, 22 bp, Artificial Sequence
  chemically synthesized
tctttttcccaatctcttcatt

SEQ ID NO: 1095007 - DNA, 22 bp, Artificial Sequence
  chemically synthesized
ccttaggaaggaatgaagagat

SEQ ID NO: 1095008 - DNA, 22 bp, Artificial Sequence
  chemically synthesized
aggaaggaatgaagagattggg

SEQ ID NO: 1095009 - DNA, 22 bp, Artificial Sequence
  chemically synthesized
ggaaggaatgaagagattggga

SEQ ID NO: 1095010 - DNA, 22 bp, Artificial Sequence
  chemically synthesized
tgaagattttctttttcccaat

SEQ ID NO: 1095011 - DNA, 22 bp, Artificial Sequence
  chemically synthesized
gtgaagattttctttttcccaa

SEQ ID NO: 1095012 - DNA, 22 bp, Artificial Sequence
  chemically synthesized
tgtgaagattttctttttccca

SEQ ID NO: 1095013 - DNA, 22 bp, Artificial Sequence
  chemically synthesized
tctttgtgaagattttcttttt

SEQ ID NO: 1095014 - DNA, 22 bp, Artificial Sequence
  chemically synthesized
cattgtctttgtgaagattttc

SEQ ID NO: 1095015 - DNA, 22 bp, Artificial Sequence
  chemically synthesized
tgcattgtctttgtgaagattt

SEQ ID NO: 1095016 - DNA, 22 bp, Artificial Sequence
  chemically synthesized
ggaaaaagaaaatcttcacaaa

SEQ ID NO: 1095017 - DNA, 22 bp, Artificial Sequence
  chemically synthesized
gtggttctgcattgtctttgtg

SEQ ID NO: 1095018 - DNA, 22 bp, Artificial Sequence
  chemically synthesized
agtggttctgcattgtctttgt

SEQ ID NO: 1095019 - DNA, 22 bp, Artificial Sequence
  chemically synthesized
tagtggttctgcattgtctttg

SEQ ID NO: 1095020 - DNA, 22 bp, Artificial Sequence
  chemically synthesized
tttagtggttctgcattgtctt

SEQ ID NO: 1095021 - DNA, 22 bp, Artificial Sequence
  chemically synthesized
ctttagtggttctgcattgtct

SEQ ID NO: 1095022 - DNA, 22 bp, Artificial Sequence
  chemically synthesized
tttctttagtggttctgcattg

SEQ ID NO: 1095023 - DNA, 22 bp, Artificial Sequence
  chemically synthesized
cacaaagacaatgcagaaccac

SEQ ID NO: 1095024 - DNA, 22 bp, Artificial Sequence
  chemically synthesized
acaaagacaatgcagaaccact

SEQ ID NO: 1095025 - DNA, 22 bp, Artificial Sequence
  chemically synthesized
gaacagatacgttatttcttta

SEQ ID NO: 1095026 - DNA, 22 bp, Artificial Sequence
  chemically synthesized
attagaacagatacgttatttc

SEQ ID NO: 1095027 - DNA, 22 bp, Artificial Sequence
  chemically synthesized
gtgtgttaattagaacagatac

SEQ ID NO: 1095028 - DNA, 22 bp, Artificial Sequence
  chemically synthesized
aagaaataacgtatctgttcta

SEQ ID NO: 1095029 - DNA, 22 bp, Artificial Sequence
  chemically synthesized
tcacctggtgtgttaattagaa

SEQ ID NO: 1095030 - DNA, 22 bp, Artificial Sequence
  chemically synthesized
gtcacctggtgtgttaattaga

SEQ ID NO: 1095031 - DNA, 22 bp, Artificial Sequence
  chemically synthesized
tgtcacctggtgtgttaattag

SEQ ID NO: 1095032 - DNA, 22 bp, Artificial Sequence
  chemically synthesized
tactttgtcacctggtgtgtta

SEQ ID NO: 1095033 - DNA, 22 bp, Artificial Sequence
  chemically synthesized
atactttgtcacctggtgtgtt

SEQ ID NO: 1095034 - DNA, 22 bp, Artificial Sequence
  chemically synthesized
ttctaattaacacaccaggtga

SEQ ID NO: 1095035 - DNA, 22 bp, Artificial Sequence
  chemically synthesized
atttatactttgtcacctggtg

SEQ ID NO: 1095036 - DNA, 22 bp, Artificial Sequence
  chemically synthesized
catttatactttgtcacctggt

SEQ ID NO: 1095037 - DNA, 22 bp, Artificial Sequence
  chemically synthesized
tcatttatactttgtcacctgg

SEQ ID NO: 1095038 - DNA, 22 bp, Artificial Sequence
  chemically synthesized
taattaacacaccaggtgacaa

SEQ ID NO: 1095039 - DNA, 22 bp, Artificial Sequence
  chemically synthesized
attaacacaccaggtgacaaag

SEQ ID NO: 1095040 - DNA, 22 bp, Artificial Sequence
  chemically synthesized
ctttcatttatactttgtcacc

SEQ ID NO: 1095041 - DNA, 22 bp, Artificial Sequence
  chemically synthesized
gctttcatttatactttgtcac

SEQ ID NO: 1095042 - DNA, 22 bp, Artificial Sequence
  chemically synthesized
acacaccaggtgacaaagtata

SEQ ID NO: 1095043 - DNA, 22 bp, Artificial Sequence
  chemically synthesized
tgtgtaaatttgctttcattta

SEQ ID NO: 1095044 - DNA, 22 bp, Artificial Sequence
  chemically synthesized
tctgtgtgtaaatttgctttca

SEQ ID NO: 1095045 - DNA, 22 bp, Artificial Sequence
  chemically synthesized
gtctgtgtgtaaatttgctttc

SEQ ID NO: 1095046 - DNA, 22 bp, Artificial Sequence
  chemically synthesized
tgtctgtgtgtaaatttgcttt

SEQ ID NO: 1095047 - DNA, 22 bp, Artificial Sequence
  chemically synthesized
aactttgtctgtgtgtaaattt

SEQ ID NO: 1095048 - DNA, 22 bp, Artificial Sequence
  chemically synthesized
actcaactttgtctgtgtgtaa

SEQ ID NO: 1095049 - DNA, 22 bp, Artificial Sequence
  chemically synthesized
cactcaactttgtctgtgtgta

SEQ ID NO: 1095050 - DNA, 22 bp, Artificial Sequence
  chemically synthesized
cagtttcactcaactttgtctg

SEQ ID NO: 1095051 - DNA, 22 bp, Artificial Sequence
  chemically synthesized
tacagtttcactcaactttgtc

SEQ ID NO: 1095052 - DNA, 22 bp, Artificial Sequence
  chemically synthesized
ctacagtttcactcaactttgt

SEQ ID NO: 1095053 - DNA, 22 bp, Artificial Sequence
  chemically synthesized
acacacagacaaagttgagtga

SEQ ID NO: 1095054 - DNA, 22 bp, Artificial Sequence
  chemically synthesized
tcttctacagtttcactcaact

SEQ ID NO: 1095055 - DNA, 22 bp, Artificial Sequence
  chemically synthesized
cacacagacaaagttgagtgaa

SEQ ID NO: 1095056 - DNA, 22 bp, Artificial Sequence
  chemically synthesized
gtcttctacagtttcactcaac

SEQ ID NO: 1095057 - DNA, 22 bp, Artificial Sequence
  chemically synthesized
tgtcttctacagtttcactcaa

SEQ ID NO: 1095058 - DNA, 22 bp, Artificial Sequence
  chemically synthesized
ttttgtcttctacagtttcact

SEQ ID NO: 1095059 - DNA, 22 bp, Artificial Sequence
  chemically synthesized
accctattttgtcttctacagt

SEQ ID NO: 1095060 - DNA, 22 bp, Artificial Sequence
  chemically synthesized
caccctattttgtcttctacag

SEQ ID NO: 1095061 - DNA, 22 bp, Artificial Sequence
  chemically synthesized
agtgaaactgtagaagacaaaa

SEQ ID NO: 1095062 - DNA, 22 bp, Artificial Sequence
  chemically synthesized
cagtttcaccctattttgtctt

SEQ ID NO: 1095063 - DNA, 22 bp, Artificial Sequence
  chemically synthesized
tgcagtttcaccctattttgtc

SEQ ID NO: 1095064 - DNA, 22 bp, Artificial Sequence
  chemically synthesized
ctctgcagtttcaccctatttt

SEQ ID NO: 1095065 - DNA, 22 bp, Artificial Sequence
  chemically synthesized
tagaagacaaaatagggtgaaa

SEQ ID NO: 1095066 - DNA, 22 bp, Artificial Sequence
  chemically synthesized
tctgctctgcagtttcacccta

SEQ ID NO: 1095067 - DNA, 22 bp, Artificial Sequence
  chemically synthesized
gtcctgtctgctctgcagtttc

SEQ ID NO: 1095068 - DNA, 22 bp, Artificial Sequence
  chemically synthesized
cgtcctgtctgctctgcagttt

SEQ ID NO: 1095069 - DNA, 22 bp, Artificial Sequence
  chemically synthesized
ttcgtcctgtctgctctgcagt

SEQ ID NO: 1095070 - DNA, 22 bp, Artificial Sequence
  chemically synthesized
tcttcgtcctgtctgctctgca

SEQ ID NO: 1095071 - DNA, 22 bp, Artificial Sequence
  chemically synthesized
ctcttcgtcctgtctgctctgc

SEQ ID NO: 1095072 - DNA, 22 bp, Artificial Sequence
  chemically synthesized
tctcttcgtcctgtctgctctg

SEQ ID NO: 1095073 - DNA, 22 bp, Artificial Sequence
  chemically synthesized
aattttctcttcgtcctgtctg

SEQ ID NO: 1095074 - DNA, 22 bp, Artificial Sequence
  chemically synthesized
aaattttctcttcgtcctgtct

SEQ ID NO: 1095075 - DNA, 22 bp, Artificial Sequence
  chemically synthesized
taaattttctcttcgtcctgtc

SEQ ID NO: 1095076 - DNA, 22 bp, Artificial Sequence
  chemically synthesized
cagagcagacaggacgaagaga

SEQ ID NO: 1095077 - DNA, 22 bp, Artificial Sequence
  chemically synthesized
gtacctttaaattttctcttcg

SEQ ID NO: 1095078 - DNA, 22 bp, Artificial Sequence
  chemically synthesized
tggtacctttaaattttctctt

SEQ ID NO: 1095079 - DNA, 22 bp, Artificial Sequence
  chemically synthesized
tctggtacctttaaattttctc

SEQ ID NO: 1095080 - DNA, 22 bp, Artificial Sequence
  chemically synthesized
ctctggtacctttaaattttct

SEQ ID NO: 1095081 - DNA, 22 bp, Artificial Sequence
  chemically synthesized
tctctggtacctttaaattttc

SEQ ID NO: 1095082 - DNA, 22 bp, Artificial Sequence
  chemically synthesized
tcattttctctggtacctttaa

SEQ ID NO: 1095083 - DNA, 22 bp, Artificial Sequence
  chemically synthesized
atcattttctctggtaccttta

SEQ ID NO: 1095084 - DNA, 22 bp, Artificial Sequence
  chemically synthesized
tatcattttctctggtaccttt

SEQ ID NO: 1095085 - DNA, 22 bp, Artificial Sequence
  chemically synthesized
tttatcattttctctggtacct

SEQ ID NO: 1095086 - DNA, 22 bp, Artificial Sequence
  chemically synthesized
ctttatcattttctctggtacc

SEQ ID NO: 1095087 - DNA, 22 bp, Artificial Sequence
  chemically synthesized
tttctttatcattttctctggt

SEQ ID NO: 1095088 - DNA, 22 bp, Artificial Sequence
  chemically synthesized
ttgtttctttatcattttctct

SEQ ID NO: 1095089 - DNA, 22 bp, Artificial Sequence
  chemically synthesized
aaaggtaccagagaaaatgata

SEQ ID NO: 1095090 - DNA, 22 bp, Artificial Sequence
  chemically synthesized
aaggtaccagagaaaatgataa

SEQ ID NO: 1095091 - DNA, 22 bp, Artificial Sequence
  chemically synthesized
tcaagttattgtttctttatca

SEQ ID NO: 1095092 - DNA, 22 bp, Artificial Sequence
  chemically synthesized
ctgtcaagttattgtttcttta

SEQ ID NO: 1095093 - DNA, 22 bp, Artificial Sequence
  chemically synthesized
ggaaatctgctgtcaagttatt

SEQ ID NO: 1095094 - DNA, 22 bp, Artificial Sequence
  chemically synthesized
aggaaatctgctgtcaagttat

SEQ ID NO: 1095095 - DNA, 22 bp, Artificial Sequence
  chemically synthesized
taggaaatctgctgtcaagtta

SEQ ID NO: 1095096 - DNA, 22 bp, Artificial Sequence
  chemically synthesized
cctttaggaaatctgctgtcaa

SEQ ID NO: 1095097 - DNA, 22 bp, Artificial Sequence
  chemically synthesized
gcctttaggaaatctgctgtca

SEQ ID NO: 1095098 - DNA, 22 bp, Artificial Sequence
  chemically synthesized
tgcctttaggaaatctgctgtc

SEQ ID NO: 1095099 - DNA, 22 bp, Artificial Sequence
  chemically synthesized
ttgcctttaggaaatctgctgt

SEQ ID NO: 1095100 - DNA, 22 bp, Artificial Sequence
  chemically synthesized
tttgcctttaggaaatctgctg

SEQ ID NO: 1095101 - DNA, 22 bp, Artificial Sequence
  chemically synthesized
aaattttttgcctttaggaaat

SEQ ID NO: 1095102 - DNA, 22 bp, Artificial Sequence
  chemically synthesized
gaaattttttgcctttaggaaa

SEQ ID NO: 1095103 - DNA, 22 bp, Artificial Sequence
  chemically synthesized
tgaaattttttgcctttaggaa

SEQ ID NO: 1095104 - DNA, 22 bp, Artificial Sequence
  chemically synthesized
ttgaaattttttgcctttagga

SEQ ID NO: 1095105 - DNA, 22 bp, Artificial Sequence
  chemically synthesized
gacagcagatttcctaaaggca

SEQ ID NO: 1095106 - DNA, 22 bp, Artificial Sequence
  chemically synthesized
acagcagatttcctaaaggcaa

SEQ ID NO: 1095107 - DNA, 22 bp, Artificial Sequence
  chemically synthesized
tcttttgaaattttttgccttt

SEQ ID NO: 1095108 - DNA, 22 bp, Artificial Sequence
  chemically synthesized
gtcttttgaaattttttgcctt

SEQ ID NO: 1095109 - DNA, 22 bp, Artificial Sequence
  chemically synthesized
tttgtcttttgaaattttttgc

SEQ ID NO: 1095110 - DNA, 22 bp, Artificial Sequence
  chemically synthesized
cctaaaggcaaaaaatttcaaa

SEQ ID NO: 1095111 - DNA, 22 bp, Artificial Sequence
  chemically synthesized
ctaaaggcaaaaaatttcaaaa

SEQ ID NO: 1095112 - DNA, 22 bp, Artificial Sequence
  chemically synthesized
aaggcaaaaaatttcaaaagac

SEQ ID NO: 1095113 - DNA, 22 bp, Artificial Sequence
  chemically synthesized
aaaatattatttgtcttttgaa

SEQ ID NO: 1095114 - DNA, 22 bp, Artificial Sequence
  chemically synthesized
caacactgaaaatattatttgt

SEQ ID NO: 1095115 - DNA, 22 bp, Artificial Sequence
  chemically synthesized
ctacaacactgaaaatattatt

SEQ ID NO: 1095116 - DNA, 22 bp, Artificial Sequence
  chemically synthesized
cctacaacactgaaaatattat

SEQ ID NO: 1095117 - DNA, 22 bp, Artificial Sequence
  chemically synthesized
tcctacaacactgaaaatatta

SEQ ID NO: 1095118 - DNA, 22 bp, Artificial Sequence
  chemically synthesized
caaaagacaaataatattttca

SEQ ID NO: 1095119 - DNA, 22 bp, Artificial Sequence
  chemically synthesized
ttcctacaacactgaaaatatt

SEQ ID NO: 1095120 - DNA, 22 bp, Artificial Sequence
  chemically synthesized
aaaagacaaataatattttcag

SEQ ID NO: 1095121 - DNA, 22 bp, Artificial Sequence
  chemically synthesized
tttcctacaacactgaaaatat

SEQ ID NO: 1095122 - DNA, 22 bp, Artificial Sequence
  chemically synthesized
ttttcctacaacactgaaaata

SEQ ID NO: 1095123 - DNA, 22 bp, Artificial Sequence
  chemically synthesized
tttttcctacaacactgaaaat

SEQ ID NO: 1095124 - DNA, 22 bp, Artificial Sequence
  chemically synthesized
ttttttcctacaacactgaaaa

SEQ ID NO: 1095125 - DNA, 22 bp, Artificial Sequence
  chemically synthesized
tttttttcctacaacactgaaa

SEQ ID NO: 1095126 - DNA, 22 bp, Artificial Sequence
  chemically synthesized
ttttttttcctacaacactgaa

SEQ ID NO: 1095127 - DNA, 22 bp, Artificial Sequence
  chemically synthesized
tcagtgttgtaggaaaaaaaaa

SEQ ID NO: 1095128 - DNA, 22 bp, Artificial Sequence
  chemically synthesized
cagtgttgtaggaaaaaaaaaa

SEQ ID NO: 1095129 - DNA, 22 bp, Artificial Sequence
  chemically synthesized
agtgttgtaggaaaaaaaaaaa

SEQ ID NO: 1095130 - DNA, 22 bp, Artificial Sequence
  chemically synthesized
tgtaaggacaggtttttttttt

SEQ ID NO: 1095131 - DNA, 22 bp, Artificial Sequence
  chemically synthesized
taggaaaaaaaaaaacctgtcc

SEQ ID NO: 1095132 - DNA, 22 bp, Artificial Sequence
  chemically synthesized
agcaggaaattatgtaaggaca

SEQ ID NO: 1095133 - DNA, 22 bp, Artificial Sequence
  chemically synthesized
tccttacataatttcctgctca

SEQ ID NO: 1095134 - DNA, 22 bp, Artificial Sequence
  chemically synthesized
gataatgatgcagttgagcagg

SEQ ID NO: 1095135 - DNA, 22 bp, Artificial Sequence
  chemically synthesized
acataatttcctgctcaactgc

SEQ ID NO: 1095136 - DNA, 22 bp, Artificial Sequence
  chemically synthesized
cataatttcctgctcaactgca

SEQ ID NO: 1095137 - DNA, 22 bp, Artificial Sequence
  chemically synthesized
agtattggataatgatgcagtt

SEQ ID NO: 1095138 - DNA, 22 bp, Artificial Sequence
  chemically synthesized
cctgctcaactgcatcattatc

SEQ ID NO: 1095139 - DNA, 22 bp, Artificial Sequence
  chemically synthesized
ccctgagtattggataatgatg

SEQ ID NO: 1095140 - DNA, 22 bp, Artificial Sequence
  chemically synthesized
ctgctcaactgcatcattatcc

SEQ ID NO: 1095141 - DNA, 22 bp, Artificial Sequence
  chemically synthesized
gccctgagtattggataatgat

SEQ ID NO: 1095142 - DNA, 22 bp, Artificial Sequence
  chemically synthesized
tgccctgagtattggataatga

SEQ ID NO: 1095143 - DNA, 22 bp, Artificial Sequence
  chemically synthesized
ctcaactgcatcattatccaat

SEQ ID NO: 1095144 - DNA, 22 bp, Artificial Sequence
  chemically synthesized
ttttgccctgagtattggataa

SEQ ID NO: 1095145 - DNA, 22 bp, Artificial Sequence
  chemically synthesized
attttgccctgagtattggata

SEQ ID NO: 1095146 - DNA, 22 bp, Artificial Sequence
  chemically synthesized
aactgcatcattatccaatact

SEQ ID NO: 1095147 - DNA, 22 bp, Artificial Sequence
  chemically synthesized
tattttgccctgagtattggat

SEQ ID NO: 1095148 - DNA, 22 bp, Artificial Sequence
  chemically synthesized
catcattatccaatactcaggg

SEQ ID NO: 1095149 - DNA, 22 bp, Artificial Sequence
  chemically synthesized
aaaatgcctttattttgccctg

SEQ ID NO: 1095150 - DNA, 22 bp, Artificial Sequence
  chemically synthesized
tccaatactcagggcaaaataa

SEQ ID NO: 1095151 - DNA, 22 bp, Artificial Sequence
  chemically synthesized
catattgaaaatgcctttattt

SEQ ID NO: 1095152 - DNA, 22 bp, Artificial Sequence
  chemically synthesized
acatattgaaaatgcctttatt

SEQ ID NO: 1095153 - DNA, 22 bp, Artificial Sequence
  chemically synthesized
tacatattgaaaatgcctttat

SEQ ID NO: 1095154 - DNA, 22 bp, Artificial Sequence
  chemically synthesized
agggcaaaataaaggcattttc

SEQ ID NO: 1095155 - DNA, 22 bp, Artificial Sequence
  chemically synthesized
agattttacatattgaaaatgc

SEQ ID NO: 1095156 - DNA, 22 bp, Artificial Sequence
  chemically synthesized
tcaatatgtaaaatctgaacac

SEQ ID NO: 1095157 - DNA, 22 bp, Artificial Sequence
  chemically synthesized
caatatgtaaaatctgaacaca

SEQ ID NO: 1095158 - DNA, 22 bp, Artificial Sequence
  chemically synthesized
aatatgtaaaatctgaacacat

SEQ ID NO: 1095159 - DNA, 22 bp, Artificial Sequence
  chemically synthesized
agtgtgagtagcaaatgtgttc

SEQ ID NO: 1095160 - DNA, 22 bp, Artificial Sequence
  chemically synthesized
gagtgtgagtagcaaatgtgtt

SEQ ID NO: 1095161 - DNA, 22 bp, Artificial Sequence
  chemically synthesized
cttgagtgtgagtagcaaatgt

SEQ ID NO: 1095162 - DNA, 22 bp, Artificial Sequence
  chemically synthesized
ccttgagtgtgagtagcaaatg

SEQ ID NO: 1095163 - DNA, 22 bp, Artificial Sequence
  chemically synthesized
tccttgagtgtgagtagcaaat

SEQ ID NO: 1095164 - DNA, 22 bp, Artificial Sequence
  chemically synthesized
tttccttgagtgtgagtagcaa

SEQ ID NO: 1095165 - DNA, 22 bp, Artificial Sequence
  chemically synthesized
ctctttccttgagtgtgagtag

SEQ ID NO: 1095166 - DNA, 22 bp, Artificial Sequence
  chemically synthesized
gctctttccttgagtgtgagta

SEQ ID NO: 1095167 - DNA, 22 bp, Artificial Sequence
  chemically synthesized
aacacatttgctactcacactc

SEQ ID NO: 1095168 - DNA, 22 bp, Artificial Sequence
  chemically synthesized
ttgctctttccttgagtgtgag

SEQ ID NO: 1095169 - DNA, 22 bp, Artificial Sequence
  chemically synthesized
cttgctctttccttgagtgtga

SEQ ID NO: 1095170 - DNA, 22 bp, Artificial Sequence
  chemically synthesized
tcttgctctttccttgagtgtg

SEQ ID NO: 1095171 - DNA, 22 bp, Artificial Sequence
  chemically synthesized
tttcttgctctttccttgagtg

SEQ ID NO: 1095172 - DNA, 22 bp, Artificial Sequence
  chemically synthesized
ctttcttgctctttccttgagt

SEQ ID NO: 1095173 - DNA, 22 bp, Artificial Sequence
  chemically synthesized
gctactcacactcaaggaaaga

SEQ ID NO: 1095174 - DNA, 22 bp, Artificial Sequence
  chemically synthesized
ctactcacactcaaggaaagag

SEQ ID NO: 1095175 - DNA, 22 bp, Artificial Sequence
  chemically synthesized
agtttctttcttgctctttcct

SEQ ID NO: 1095176 - DNA, 22 bp, Artificial Sequence
  chemically synthesized
ctcacactcaaggaaagagcaa

SEQ ID NO: 1095177 - DNA, 22 bp, Artificial Sequence
  chemically synthesized
acactcaaggaaagagcaagaa

SEQ ID NO: 1095178 - DNA, 22 bp, Artificial Sequence
  chemically synthesized
tgttcagtttctttcttgctct

SEQ ID NO: 1095179 - DNA, 22 bp, Artificial Sequence
  chemically synthesized
tgtgttcagtttctttcttgct

SEQ ID NO: 1095180 - DNA, 22 bp, Artificial Sequence
  chemically synthesized
ctgtgttcagtttctttcttgc

SEQ ID NO: 1095181 - DNA, 22 bp, Artificial Sequence
  chemically synthesized
aaggaaagagcaagaaagaaac

SEQ ID NO: 1095182 - DNA, 22 bp, Artificial Sequence
  chemically synthesized
cttctgtgttcagtttctttct

SEQ ID NO: 1095183 - DNA, 22 bp, Artificial Sequence
  chemically synthesized
gcttctgtgttcagtttctttc

SEQ ID NO: 1095184 - DNA, 22 bp, Artificial Sequence
  chemically synthesized
tgcttctgtgttcagtttcttt

SEQ ID NO: 1095185 - DNA, 22 bp, Artificial Sequence
  chemically synthesized
cctttgcttctgtgttcagttt

SEQ ID NO: 1095186 - DNA, 22 bp, Artificial Sequence
  chemically synthesized
ccctttgcttctgtgttcagtt

SEQ ID NO: 1095187 - DNA, 22 bp, Artificial Sequence
  chemically synthesized
ttccctttgcttctgtgttcag

SEQ ID NO: 1095188 - DNA, 22 bp, Artificial Sequence
  chemically synthesized
ttcttccctttgcttctgtgtt

SEQ ID NO: 1095189 - DNA, 22 bp, Artificial Sequence
  chemically synthesized
gttcttccctttgcttctgtgt

SEQ ID NO: 1095190 - DNA, 22 bp, Artificial Sequence
  chemically synthesized
tgttcttccctttgcttctgtg

SEQ ID NO: 1095191 - DNA, 22 bp, Artificial Sequence
  chemically synthesized
ttgttcttccctttgcttctgt

SEQ ID NO: 1095192 - DNA, 22 bp, Artificial Sequence
  chemically synthesized
ccttttgttcttccctttgctt

SEQ ID NO: 1095193 - DNA, 22 bp, Artificial Sequence
  chemically synthesized
gccttttgttcttccctttgct

SEQ ID NO: 1095194 - DNA, 22 bp, Artificial Sequence
  chemically synthesized
tgccttttgttcttccctttgc

SEQ ID NO: 1095195 - DNA, 22 bp, Artificial Sequence
  chemically synthesized
aacacagaagcaaagggaagaa

SEQ ID NO: 1095196 - DNA, 22 bp, Artificial Sequence
  chemically synthesized
tgatcagttttgccttttgttc

SEQ ID NO: 1095197 - DNA, 22 bp, Artificial Sequence
  chemically synthesized
gtgatcagttttgccttttgtt

SEQ ID NO: 1095198 - DNA, 22 bp, Artificial Sequence
  chemically synthesized
tgtgatcagttttgccttttgt

SEQ ID NO: 1095199 - DNA, 22 bp, Artificial Sequence
  chemically synthesized
ttgtgatcagttttgccttttg

SEQ ID NO: 1095200 - DNA, 22 bp, Artificial Sequence
  chemically synthesized
ccagtttttgtgatcagttttg

SEQ ID NO: 1095201 - DNA, 22 bp, Artificial Sequence
  chemically synthesized
cccagtttttgtgatcagtttt

SEQ ID NO: 1095202 - DNA, 22 bp, Artificial Sequence
  chemically synthesized
tcccagtttttgtgatcagttt

SEQ ID NO: 1095203 - DNA, 22 bp, Artificial Sequence
  chemically synthesized
ttttcccagtttttgtgatcag

SEQ ID NO: 1095204 - DNA, 22 bp, Artificial Sequence
  chemically synthesized
ccgatgctattttcccagtttt

SEQ ID NO: 1095205 - DNA, 22 bp, Artificial Sequence
  chemically synthesized
accgatgctattttcccagttt

SEQ ID NO: 1095206 - DNA, 22 bp, Artificial Sequence
  chemically synthesized
atcacaaaaactgggaaaatag

SEQ ID NO: 1095207 - DNA, 22 bp, Artificial Sequence
  chemically synthesized
gatttaccgatgctattttccc

SEQ ID NO: 1095208 - DNA, 22 bp, Artificial Sequence
  chemically synthesized
agatttaccgatgctattttcc

SEQ ID NO: 1095209 - DNA, 22 bp, Artificial Sequence
  chemically synthesized
tttagatttaccgatgctattt

SEQ ID NO: 1095210 - DNA, 22 bp, Artificial Sequence
  chemically synthesized
atttagatttaccgatgctatt

SEQ ID NO: 1095211 - DNA, 22 bp, Artificial Sequence
  chemically synthesized
ggaaaatagcatcggtaaatct

SEQ ID NO: 1095212 - DNA, 22 bp, Artificial Sequence
  chemically synthesized
atataatatttatttagattta

SEQ ID NO: 1095213 - DNA, 22 bp, Artificial Sequence
  chemically synthesized
catataatatttatttagattt

SEQ ID NO: 1095214 - DNA, 22 bp, Artificial Sequence
  chemically synthesized
tttcatataatatttatttaga

SEQ ID NO: 1095215 - DNA, 22 bp, Artificial Sequence
  chemically synthesized
actatttcatataatatttatt

SEQ ID NO: 1095216 - DNA, 22 bp, Artificial Sequence
  chemically synthesized
aactatttcatataatatttat

SEQ ID NO: 1095217 - DNA, 22 bp, Artificial Sequence
  chemically synthesized
taactatttcatataatattta

SEQ ID NO: 1095218 - DNA, 22 bp, Artificial Sequence
  chemically synthesized
ttttaactatttcatataatat

SEQ ID NO: 1095219 - DNA, 22 bp, Artificial Sequence
  chemically synthesized
ttgttttaactatttcatataa

SEQ ID NO: 1095220 - DNA, 22 bp, Artificial Sequence
  chemically synthesized
ctgttgttttaactatttcata

SEQ ID NO: 1095221 - DNA, 22 bp, Artificial Sequence
  chemically synthesized
aataaatattatatgaaatagt

SEQ ID NO: 1095222 - DNA, 22 bp, Artificial Sequence
  chemically synthesized
ctgctgttgttttaactatttc

SEQ ID NO: 1095223 - DNA, 22 bp, Artificial Sequence
  chemically synthesized
ctgctgctgttgttttaactat

SEQ ID NO: 1095224 - DNA, 22 bp, Artificial Sequence
  chemically synthesized
ttgctgctgctgttgttttaac

SEQ ID NO: 1095225 - DNA, 22 bp, Artificial Sequence
  chemically synthesized
tatgaaatagttaaaacaacag

SEQ ID NO: 1095226 - DNA, 22 bp, Artificial Sequence
  chemically synthesized
ctgttgctgctgctgttgtttt

SEQ ID NO: 1095227 - DNA, 22 bp, Artificial Sequence
  chemically synthesized
aaacaacagcagcagcaacagc

SEQ ID NO: 1095228 - DNA, 22 bp, Artificial Sequence
  chemically synthesized
gtccatataattgctgttgctg

SEQ ID NO: 1095229 - DNA, 22 bp, Artificial Sequence
  chemically synthesized
ccccaaattagtccatataatt

SEQ ID NO: 1095230 - DNA, 22 bp, Artificial Sequence
  chemically synthesized
cccccaaattagtccatataat

SEQ ID NO: 1095231 - DNA, 22 bp, Artificial Sequence
  chemically synthesized
tttcccccaaattagtccatat

SEQ ID NO: 1095232 - DNA, 22 bp, Artificial Sequence
  chemically synthesized
atttcccccaaattagtccata

SEQ ID NO: 1095233 - DNA, 22 bp, Artificial Sequence
  chemically synthesized
accttatttcccccaaattagt

SEQ ID NO: 1095234 - DNA, 22 bp, Artificial Sequence
  chemically synthesized
caccttatttcccccaaattag

SEQ ID NO: 1095235 - DNA, 22 bp, Artificial Sequence
  chemically synthesized
tcaccttatttcccccaaatta

SEQ ID NO: 1095236 - DNA, 22 bp, Artificial Sequence
  chemically synthesized
attttcaccttatttcccccaa

SEQ ID NO: 1095237 - DNA, 22 bp, Artificial Sequence
  chemically synthesized
tatggactaatttgggggaaat

SEQ ID NO: 1095238 - DNA, 22 bp, Artificial Sequence
  chemically synthesized
cattttcaccttatttccccca

SEQ ID NO: 1095239 - DNA, 22 bp, Artificial Sequence
  chemically synthesized
atatttcattttcaccttattt

SEQ ID NO: 1095240 - DNA, 22 bp, Artificial Sequence
  chemically synthesized
atttgggggaaataaggtgaaa

SEQ ID NO: 1095241 - DNA, 22 bp, Artificial Sequence
  chemically synthesized
cctcatatttcattttcacctt

SEQ ID NO: 1095242 - DNA, 22 bp, Artificial Sequence
  chemically synthesized
gggggaaataaggtgaaaatga

SEQ ID NO: 1095243 - DNA, 22 bp, Artificial Sequence
  chemically synthesized
ttgcctcatatttcattttcac

SEQ ID NO: 1095244 - DNA, 22 bp, Artificial Sequence
  chemically synthesized
ggggaaataaggtgaaaatgaa

SEQ ID NO: 1095245 - DNA, 22 bp, Artificial Sequence
  chemically synthesized
ttgttgcctcatatttcatttt

SEQ ID NO: 1095246 - DNA, 22 bp, Artificial Sequence
  chemically synthesized
cgcgttattgttgcctcatatt

SEQ ID NO: 1095247 - DNA, 22 bp, Artificial Sequence
  chemically synthesized
ccgcgttattgttgcctcatat

SEQ ID NO: 1095248 - DNA, 22 bp, Artificial Sequence
  chemically synthesized
tccgcgttattgttgcctcata

SEQ ID NO: 1095249 - DNA, 22 bp, Artificial Sequence
  chemically synthesized
cgttttccgcgttattgttgcc

SEQ ID NO: 1095250 - DNA, 22 bp, Artificial Sequence
  chemically synthesized
ccgttttccgcgttattgttgc

SEQ ID NO: 1095251 - DNA, 22 bp, Artificial Sequence
  chemically synthesized
ttccgttttccgcgttattgtt

SEQ ID NO: 1095252 - DNA, 22 bp, Artificial Sequence
  chemically synthesized
cctcttccgttttccgcgttat

SEQ ID NO: 1095253 - DNA, 22 bp, Artificial Sequence
  chemically synthesized
aacctacctcttccgttttccg

SEQ ID NO: 1095254 - DNA, 22 bp, Artificial Sequence
  chemically synthesized
tgaacctacctcttccgttttc

SEQ ID NO: 1095255 - DNA, 22 bp, Artificial Sequence
  chemically synthesized
actctgaacctacctcttccgt

SEQ ID NO: 1095256 - DNA, 22 bp, Artificial Sequence
  chemically synthesized
aactctgaacctacctcttccg

SEQ ID NO: 1095257 - DNA, 22 bp, Artificial Sequence
  chemically synthesized
gcatagtttaactctgaaccta

SEQ ID NO: 1095258 - DNA, 22 bp, Artificial Sequence
  chemically synthesized
agagttaaactatgctaatgtt

SEQ ID NO: 1095259 - DNA, 22 bp, Artificial Sequence
  chemically synthesized
acaataatatggtggaaacatt

SEQ ID NO: 1095260 - DNA, 22 bp, Artificial Sequence
  chemically synthesized
taacaataatatggtggaaaca

SEQ ID NO: 1095261 - DNA, 22 bp, Artificial Sequence
  chemically synthesized
aactatgctaatgtttccacca

SEQ ID NO: 1095262 - DNA, 22 bp, Artificial Sequence
  chemically synthesized
tctaacaataatatggtggaaa

SEQ ID NO: 1095263 - DNA, 22 bp, Artificial Sequence
  chemically synthesized
tgctaatgtttccaccatatta

SEQ ID NO: 1095264 - DNA, 22 bp, Artificial Sequence
  chemically synthesized
tacctctctaacaataatatgg

SEQ ID NO: 1095265 - DNA, 22 bp, Artificial Sequence
  chemically synthesized
tatacctctctaacaataatat

SEQ ID NO: 1095266 - DNA, 22 bp, Artificial Sequence
  chemically synthesized
atgtttccaccatattattgtt

SEQ ID NO: 1095267 - DNA, 22 bp, Artificial Sequence
  chemically synthesized
tctatacctctctaacaataat

SEQ ID NO: 1095268 - DNA, 22 bp, Artificial Sequence
  chemically synthesized
ctctatacctctctaacaataa

SEQ ID NO: 1095269 - DNA, 22 bp, Artificial Sequence
  chemically synthesized
ccaccatattattgttagagag

SEQ ID NO: 1095270 - DNA, 22 bp, Artificial Sequence
  chemically synthesized
caccatattattgttagagagg

SEQ ID NO: 1095271 - DNA, 22 bp, Artificial Sequence
  chemically synthesized
taaatatttctctatacctctc

SEQ ID NO: 1095272 - DNA, 22 bp, Artificial Sequence
  chemically synthesized
ataaatatttctctatacctct

SEQ ID NO: 1095273 - DNA, 22 bp, Artificial Sequence
  chemically synthesized
tcttataaatatttctctatac

SEQ ID NO: 1095274 - DNA, 22 bp, Artificial Sequence
  chemically synthesized
ttgttagagaggtatagagaaa

SEQ ID NO: 1095275 - DNA, 22 bp, Artificial Sequence
  chemically synthesized
atcttataaatatttctctata

SEQ ID NO: 1095276 - DNA, 22 bp, Artificial Sequence
  chemically synthesized
tatcttataaatatttctctat

SEQ ID NO: 1095277 - DNA, 22 bp, Artificial Sequence
  chemically synthesized
ttagagaggtatagagaaatat

SEQ ID NO: 1095278 - DNA, 22 bp, Artificial Sequence
  chemically synthesized
ttttatcttataaatatttctc

SEQ ID NO: 1095279 - DNA, 22 bp, Artificial Sequence
  chemically synthesized
attttatcttataaatatttct

SEQ ID NO: 1095280 - DNA, 22 bp, Artificial Sequence
  chemically synthesized
gagaggtatagagaaatattta

SEQ ID NO: 1095281 - DNA, 22 bp, Artificial Sequence
  chemically synthesized
tattttatcttataaatatttc

SEQ ID NO: 1095282 - DNA, 22 bp, Artificial Sequence
  chemically synthesized
gaatatgtactttattttatct

SEQ ID NO: 1095283 - DNA, 22 bp, Artificial Sequence
  chemically synthesized
ggaatatgtactttattttatc

SEQ ID NO: 1095284 - DNA, 22 bp, Artificial Sequence
  chemically synthesized
gtttggaatatgtactttattt

SEQ ID NO: 1095285 - DNA, 22 bp, Artificial Sequence
  chemically synthesized
ataagataaaataaagtacata

SEQ ID NO: 1095286 - DNA, 22 bp, Artificial Sequence
  chemically synthesized
actggtttggaatatgtacttt

SEQ ID NO: 1095287 - DNA, 22 bp, Artificial Sequence
  chemically synthesized
taagataaaataaagtacatat

SEQ ID NO: 1095288 - DNA, 22 bp, Artificial Sequence
  chemically synthesized
cactggtttggaatatgtactt

SEQ ID NO: 1095289 - DNA, 22 bp, Artificial Sequence
  chemically synthesized
tcactggtttggaatatgtact

SEQ ID NO: 1095290 - DNA, 22 bp, Artificial Sequence
  chemically synthesized
ttcactggtttggaatatgtac

SEQ ID NO: 1095291 - DNA, 22 bp, Artificial Sequence
  chemically synthesized
tttcactggtttggaatatgta

SEQ ID NO: 1095292 - DNA, 22 bp, Artificial Sequence
  chemically synthesized
gtcctttttcactggtttggaa

SEQ ID NO: 1095293 - DNA, 22 bp, Artificial Sequence
  chemically synthesized
agtcctttttcactggtttgga

SEQ ID NO: 1095294 - DNA, 22 bp, Artificial Sequence
  chemically synthesized
tagtcctttttcactggtttgg

SEQ ID NO: 1095295 - DNA, 22 bp, Artificial Sequence
  chemically synthesized
cattttagtcctttttcactgg

SEQ ID NO: 1095296 - DNA, 22 bp, Artificial Sequence
  chemically synthesized
agttccattttagtcctttttc

SEQ ID NO: 1095297 - DNA, 22 bp, Artificial Sequence
  chemically synthesized
caaaccagtgaaaaaggactaa

SEQ ID NO: 1095298 - DNA, 22 bp, Artificial Sequence
  chemically synthesized
ttgagttccattttagtccttt

SEQ ID NO: 1095299 - DNA, 22 bp, Artificial Sequence
  chemically synthesized
tcaaattattgagttccatttt

SEQ ID NO: 1095300 - DNA, 22 bp, Artificial Sequence
  chemically synthesized
aagttatcaaattattgagttc

SEQ ID NO: 1095301 - DNA, 22 bp, Artificial Sequence
  chemically synthesized
atattgaagttatcaaattatt

SEQ ID NO: 1095302 - DNA, 22 bp, Artificial Sequence
  chemically synthesized
aaatggaactcaataatttgat

SEQ ID NO: 1095303 - DNA, 22 bp, Artificial Sequence
  chemically synthesized
ttcatattgaagttatcaaatt

SEQ ID NO: 1095304 - DNA, 22 bp, Artificial Sequence
  chemically synthesized
cctattcatattgaagttatca

SEQ ID NO: 1095305 - DNA, 22 bp, Artificial Sequence
  chemically synthesized
aataatttgataacttcaatat

SEQ ID NO: 1095306 - DNA, 22 bp, Artificial Sequence
  chemically synthesized
acattccctattcatattgaag

SEQ ID NO: 1095307 - DNA, 22 bp, Artificial Sequence
  chemically synthesized
taacattccctattcatattga

SEQ ID NO: 1095308 - DNA, 22 bp, Artificial Sequence
  chemically synthesized
ctaacattccctattcatattg

SEQ ID NO: 1095309 - DNA, 22 bp, Artificial Sequence
  chemically synthesized
gataacttcaatatgaataggg

SEQ ID NO: 1095310 - DNA, 22 bp, Artificial Sequence
  chemically synthesized
ataacttcaatatgaataggga

SEQ ID NO: 1095311 - DNA, 22 bp, Artificial Sequence
  chemically synthesized
caatatgaatagggaatgttag

SEQ ID NO: 1095312 - DNA, 22 bp, Artificial Sequence
  chemically synthesized
aatatgaatagggaatgttaga

SEQ ID NO: 1095313 - DNA, 22 bp, Artificial Sequence
  chemically synthesized
atgtataataacatttctaaca

SEQ ID NO: 1095314 - DNA, 22 bp, Artificial Sequence
  chemically synthesized
tcatgtataataacatttctaa

SEQ ID NO: 1095315 - DNA, 22 bp, Artificial Sequence
  chemically synthesized
ctcatgtataataacatttcta

SEQ ID NO: 1095316 - DNA, 22 bp, Artificial Sequence
  chemically synthesized
cttctcatgtataataacattt

SEQ ID NO: 1095317 - DNA, 22 bp, Artificial Sequence
  chemically synthesized
ccttctcatgtataataacatt

SEQ ID NO: 1095318 - DNA, 22 bp, Artificial Sequence
  chemically synthesized
catttccttctcatgtataata

SEQ ID NO: 1095319 - DNA, 22 bp, Artificial Sequence
  chemically synthesized
ccatttccttctcatgtataat

SEQ ID NO: 1095320 - DNA, 22 bp, Artificial Sequence
  chemically synthesized
tccatttccttctcatgtataa

SEQ ID NO: 1095321 - DNA, 22 bp, Artificial Sequence
  chemically synthesized
ttccatttccttctcatgtata

SEQ ID NO: 1095322 - DNA, 22 bp, Artificial Sequence
  chemically synthesized
gaaatgttattatacatgagaa

SEQ ID NO: 1095323 - DNA, 22 bp, Artificial Sequence
  chemically synthesized
tttttccatttccttctcatgt

SEQ ID NO: 1095324 - DNA, 22 bp, Artificial Sequence
  chemically synthesized
gattatttttccatttccttct

SEQ ID NO: 1095325 - DNA, 22 bp, Artificial Sequence
  chemically synthesized
ttatacatgagaaggaaatgga

SEQ ID NO: 1095326 - DNA, 22 bp, Artificial Sequence
  chemically synthesized
ttggattatttttccatttcct

SEQ ID NO: 1095327 - DNA, 22 bp, Artificial Sequence
  chemically synthesized
tacatgagaaggaaatggaaaa

SEQ ID NO: 1095328 - DNA, 22 bp, Artificial Sequence
  chemically synthesized
aagaccaattattggattattt

SEQ ID NO: 1095329 - DNA, 22 bp, Artificial Sequence
  chemically synthesized
caagaccaattattggattatt

SEQ ID NO: 1095330 - DNA, 22 bp, Artificial Sequence
  chemically synthesized
tcaagaccaattattggattat

SEQ ID NO: 1095331 - DNA, 22 bp, Artificial Sequence
  chemically synthesized
ttcaagaccaattattggatta

SEQ ID NO: 1095332 - DNA, 22 bp, Artificial Sequence
  chemically synthesized
ataacaaacttttcaagaccaa

SEQ ID NO: 1095333 - DNA, 22 bp, Artificial Sequence
  chemically synthesized
gtattaataacaaacttttcaa

SEQ ID NO: 1095334 - DNA, 22 bp, Artificial Sequence
  chemically synthesized
cgtattaataacaaacttttca

SEQ ID NO: 1095335 - DNA, 22 bp, Artificial Sequence
  chemically synthesized
tcgtattaataacaaacttttc

SEQ ID NO: 1095336 - DNA, 22 bp, Artificial Sequence
  chemically synthesized
agttttcgtattaataacaaac

SEQ ID NO: 1095337 - DNA, 22 bp, Artificial Sequence
  chemically synthesized
aagttttcgtattaataacaaa

SEQ ID NO: 1095338 - DNA, 22 bp, Artificial Sequence
  chemically synthesized
gtcttgaaaagtttgttattaa

SEQ ID NO: 1095339 - DNA, 22 bp, Artificial Sequence
  chemically synthesized
ttaagttttcgtattaataaca

SEQ ID NO: 1095340 - DNA, 22 bp, Artificial Sequence
  chemically synthesized
cttaagttttcgtattaataac

SEQ ID NO: 1095341 - DNA, 22 bp, Artificial Sequence
  chemically synthesized
tcttaagttttcgtattaataa

SEQ ID NO: 1095342 - DNA, 22 bp, Artificial Sequence
  chemically synthesized
gaaaagtttgttattaatacga

SEQ ID NO: 1095343 - DNA, 22 bp, Artificial Sequence
  chemically synthesized
aaaagtttgttattaatacgaa

SEQ ID NO: 1095344 - DNA, 22 bp, Artificial Sequence
  chemically synthesized
gttattaatacgaaaacttaag

SEQ ID NO: 1095345 - DNA, 22 bp, Artificial Sequence
  chemically synthesized
cgaagggattttcttaagtttt

SEQ ID NO: 1095346 - DNA, 22 bp, Artificial Sequence
  chemically synthesized
ttattaatacgaaaacttaaga

SEQ ID NO: 1095347 - DNA, 22 bp, Artificial Sequence
  chemically synthesized
ccgaagggattttcttaagttt

SEQ ID NO: 1095348 - DNA, 22 bp, Artificial Sequence
  chemically synthesized
tccgaagggattttcttaagtt

SEQ ID NO: 1095349 - DNA, 22 bp, Artificial Sequence
  chemically synthesized
ttaatacgaaaacttaagaaaa

SEQ ID NO: 1095350 - DNA, 22 bp, Artificial Sequence
  chemically synthesized
atacgaaaacttaagaaaatcc

SEQ ID NO: 1095351 - DNA, 22 bp, Artificial Sequence
  chemically synthesized
gagtacattttccgaagggatt

SEQ ID NO: 1095352 - DNA, 22 bp, Artificial Sequence
  chemically synthesized
tattggagtacattttccgaag

SEQ ID NO: 1095353 - DNA, 22 bp, Artificial Sequence
  chemically synthesized
atattggagtacattttccgaa

SEQ ID NO: 1095354 - DNA, 22 bp, Artificial Sequence
  chemically synthesized
aagaaaatcccttcggaaaatg

SEQ ID NO: 1095355 - DNA, 22 bp, Artificial Sequence
  chemically synthesized
agaaaatcccttcggaaaatgt

SEQ ID NO: 1095356 - DNA, 22 bp, Artificial Sequence
  chemically synthesized
gaaatttatattggagtacatt

SEQ ID NO: 1095357 - DNA, 22 bp, Artificial Sequence
  chemically synthesized
attagaaatttatattggagta

SEQ ID NO: 1095358 - DNA, 22 bp, Artificial Sequence
  chemically synthesized
cggaaaatgtactccaatataa

SEQ ID NO: 1095359 - DNA, 22 bp, Artificial Sequence
  chemically synthesized
ggaaaatgtactccaatataaa

SEQ ID NO: 1095360 - DNA, 22 bp, Artificial Sequence
  chemically synthesized
cgtgattcattagaaatttata

SEQ ID NO: 1095361 - DNA, 22 bp, Artificial Sequence
  chemically synthesized
caatataaatttctaatgaatc

SEQ ID NO: 1095362 - DNA, 22 bp, Artificial Sequence
  chemically synthesized
aatgatactccgtgattcatta

SEQ ID NO: 1095363 - DNA, 22 bp, Artificial Sequence
  chemically synthesized
aaatgatactccgtgattcatt

SEQ ID NO: 1095364 - DNA, 22 bp, Artificial Sequence
  chemically synthesized
atttaaatgatactccgtgatt

SEQ ID NO: 1095365 - DNA, 22 bp, Artificial Sequence
  chemically synthesized
ttcatttaaatgatactccgtg

SEQ ID NO: 1095366 - DNA, 22 bp, Artificial Sequence
  chemically synthesized
ctaatgaatcacggagtatcat

SEQ ID NO: 1095367 - DNA, 22 bp, Artificial Sequence
  chemically synthesized
taatgaatcacggagtatcatt

SEQ ID NO: 1095368 - DNA, 22 bp, Artificial Sequence
  chemically synthesized
atgaatcacggagtatcattta

SEQ ID NO: 1095369 - DNA, 22 bp, Artificial Sequence
  chemically synthesized
atgttgttcatttaaatgatac

SEQ ID NO: 1095370 - DNA, 22 bp, Artificial Sequence
  chemically synthesized
ttcatgttgttcatttaaatga

SEQ ID NO: 1095371 - DNA, 22 bp, Artificial Sequence
  chemically synthesized
ttattcatgttgttcatttaaa

SEQ ID NO: 1095372 - DNA, 22 bp, Artificial Sequence
  chemically synthesized
cctattattcatgttgttcatt

SEQ ID NO: 1095373 - DNA, 22 bp, Artificial Sequence
  chemically synthesized
ttccctattattcatgttgttc

SEQ ID NO: 1095374 - DNA, 22 bp, Artificial Sequence
  chemically synthesized
aaatgaacaacatgaataatag

SEQ ID NO: 1095375 - DNA, 22 bp, Artificial Sequence
  chemically synthesized
aatgaacaacatgaataatagg

SEQ ID NO: 1095376 - DNA, 22 bp, Artificial Sequence
  chemically synthesized
aataagcatcattgttccctat

SEQ ID NO: 1095377 - DNA, 22 bp, Artificial Sequence
  chemically synthesized
aaataagcatcattgttcccta

SEQ ID NO: 1095378 - DNA, 22 bp, Artificial Sequence
  chemically synthesized
atgtccttaaataagcatcatt

SEQ ID NO: 1095379 - DNA, 22 bp, Artificial Sequence
  chemically synthesized
aatgtccttaaataagcatcat

SEQ ID NO: 1095380 - DNA, 22 bp, Artificial Sequence
  chemically synthesized
ttaatgtccttaaataagcatc

SEQ ID NO: 1095381 - DNA, 22 bp, Artificial Sequence
  chemically synthesized
tgttcttaatgtccttaaataa

SEQ ID NO: 1095382 - DNA, 22 bp, Artificial Sequence
  chemically synthesized
atgttcttaatgtccttaaata

SEQ ID NO: 1095383 - DNA, 22 bp, Artificial Sequence
  chemically synthesized
ttatgttcttaatgtccttaaa

SEQ ID NO: 1095384 - DNA, 22 bp, Artificial Sequence
  chemically synthesized
cttatgttcttaatgtccttaa

SEQ ID NO: 1095385 - DNA, 22 bp, Artificial Sequence
  chemically synthesized
tcttatgttcttaatgtcctta

SEQ ID NO: 1095386 - DNA, 22 bp, Artificial Sequence
  chemically synthesized
ctttcttatgttcttaatgtcc

SEQ ID NO: 1095387 - DNA, 22 bp, Artificial Sequence
  chemically synthesized
ttactttcttatgttcttaatg

SEQ ID NO: 1095388 - DNA, 22 bp, Artificial Sequence
  chemically synthesized
atttaaggacattaagaacata

SEQ ID NO: 1095389 - DNA, 22 bp, Artificial Sequence
  chemically synthesized
ctattactttcttatgttctta

SEQ ID NO: 1095390 - DNA, 22 bp, Artificial Sequence
  chemically synthesized
tttaaggacattaagaacataa

SEQ ID NO: 1095391 - DNA, 22 bp, Artificial Sequence
  chemically synthesized
aaggacattaagaacataagaa

SEQ ID NO: 1095392 - DNA, 22 bp, Artificial Sequence
  chemically synthesized
aggacattaagaacataagaaa

SEQ ID NO: 1095393 - DNA, 22 bp, Artificial Sequence
  chemically synthesized
aataaaacacctactattactt

SEQ ID NO: 1095394 - DNA, 22 bp, Artificial Sequence
  chemically synthesized
agaacataagaaagtaatagta

SEQ ID NO: 1095395 - DNA, 22 bp, Artificial Sequence
  chemically synthesized
aaataaaacacctactattact

SEQ ID NO: 1095396 - DNA, 22 bp, Artificial Sequence
  chemically synthesized
acaatgtttaaataaaacacct

SEQ ID NO: 1095397 - DNA, 22 bp, Artificial Sequence
  chemically synthesized
tgacaatgtttaaataaaacac

SEQ ID NO: 1095398 - DNA, 22 bp, Artificial Sequence
  chemically synthesized
ctgacaatgtttaaataaaaca

SEQ ID NO: 1095399 - DNA, 22 bp, Artificial Sequence
  chemically synthesized
tctgacaatgtttaaataaaac

SEQ ID NO: 1095400 - DNA, 22 bp, Artificial Sequence
  chemically synthesized
tatttaaacattgtcagaaagc

SEQ ID NO: 1095401 - DNA, 22 bp, Artificial Sequence
  chemically synthesized
tacccaggaaatgctttctgac

SEQ ID NO: 1095402 - DNA, 22 bp, Artificial Sequence
  chemically synthesized
atttaaacattgtcagaaagca

SEQ ID NO: 1095403 - DNA, 22 bp, Artificial Sequence
  chemically synthesized
gtacccaggaaatgctttctga

SEQ ID NO: 1095404 - DNA, 22 bp, Artificial Sequence
  chemically synthesized
tttaaacattgtcagaaagcat

SEQ ID NO: 1095405 - DNA, 22 bp, Artificial Sequence
  chemically synthesized
tgtacccaggaaatgctttctg

SEQ ID NO: 1095406 - DNA, 22 bp, Artificial Sequence
  chemically synthesized
ttgtacccaggaaatgctttct

SEQ ID NO: 1095407 - DNA, 22 bp, Artificial Sequence
  chemically synthesized
tttgtacccaggaaatgctttc

SEQ ID NO: 1095408 - DNA, 22 bp, Artificial Sequence
  chemically synthesized
aaacattgtcagaaagcatttc

SEQ ID NO: 1095409 - DNA, 22 bp, Artificial Sequence
  chemically synthesized
aacattgtcagaaagcatttcc

SEQ ID NO: 1095410 - DNA, 22 bp, Artificial Sequence
  chemically synthesized
tcagaaagcatttcctgggtac

SEQ ID NO: 1095411 - DNA, 22 bp, Artificial Sequence
  chemically synthesized
caatagggagggactttttgta

SEQ ID NO: 1095412 - DNA, 22 bp, Artificial Sequence
  chemically synthesized
cctgggtacaaaaagtccctcc

SEQ ID NO: 1095413 - DNA, 22 bp, Artificial Sequence
  chemically synthesized
ctgggtacaaaaagtccctccc

SEQ ID NO: 1095414 - DNA, 22 bp, Artificial Sequence
  chemically synthesized
acatgttacaatagggagggac

SEQ ID NO: 1095415 - DNA, 22 bp, Artificial Sequence
  chemically synthesized
ggtacaaaaagtccctccctat

SEQ ID NO: 1095416 - DNA, 22 bp, Artificial Sequence
  chemically synthesized
actaacatgttacaatagggag

SEQ ID NO: 1095417 - DNA, 22 bp, Artificial Sequence
  chemically synthesized
attcactaacatgttacaatag

SEQ ID NO: 1095418 - DNA, 22 bp, Artificial Sequence
  chemically synthesized
cctattgtaacatgttagtgaa

SEQ ID NO: 1095419 - DNA, 22 bp, Artificial Sequence
  chemically synthesized
ttgtaacatgttagtgaattaa

SEQ ID NO: 1095420 - DNA, 22 bp, Artificial Sequence
  chemically synthesized
aagaaaaccacaattaattcac

SEQ ID NO: 1095421 - DNA, 22 bp, Artificial Sequence
  chemically synthesized
taacatgttagtgaattaattg

SEQ ID NO: 1095422 - DNA, 22 bp, Artificial Sequence
  chemically synthesized
tacatgtctcaagaaaaccaca

SEQ ID NO: 1095423 - DNA, 22 bp, Artificial Sequence
  chemically synthesized
gtgaattaattgtggttttctt

SEQ ID NO: 1095424 - DNA, 22 bp, Artificial Sequence
  chemically synthesized
atggcactgtacatgtctcaag

SEQ ID NO: 1095425 - DNA, 22 bp, Artificial Sequence
  chemically synthesized
attgtggttttcttgagacatg

SEQ ID NO: 1095426 - DNA, 22 bp, Artificial Sequence
  chemically synthesized
tggttttcttgagacatgtaca

SEQ ID NO: 1095427 - DNA, 22 bp, Artificial Sequence
  chemically synthesized
tcttgagacatgtacagtgcca

SEQ ID NO: 1095428 - DNA, 22 bp, Artificial Sequence
  chemically synthesized
cttgagacatgtacagtgccat

SEQ ID NO: 1095429 - DNA, 22 bp, Artificial Sequence
  chemically synthesized
ttgagacatgtacagtgccatc

SEQ ID NO: 1095430 - DNA, 22 bp, Artificial Sequence
  chemically synthesized
gagacatgtacagtgccatcag

SEQ ID NO: 1095431 - DNA, 22 bp, Artificial Sequence
  chemically synthesized
agacatgtacagtgccatcaga

SEQ ID NO: 1095432 - DNA, 22 bp, Artificial Sequence
  chemically synthesized
tataaaatataacaaagaatgg

SEQ ID NO: 1095433 - DNA, 22 bp, Artificial Sequence
  chemically synthesized
cccttcccattctttgttatat

SEQ ID NO: 1095434 - DNA, 22 bp, Artificial Sequence
  chemically synthesized
ccttcccattctttgttatatt

SEQ ID NO: 1095435 - DNA, 22 bp, Artificial Sequence
  chemically synthesized
cccattctttgttatattttat

SEQ ID NO: 1095436 - DNA, 22 bp, Artificial Sequence
  chemically synthesized
tgtgagtgctatataaaatata

SEQ ID NO: 1095437 - DNA, 22 bp, Artificial Sequence
  chemically synthesized
ccattctttgttatattttata

SEQ ID NO: 1095438 - DNA, 22 bp, Artificial Sequence
  chemically synthesized
tttgttatattttatatagcac

SEQ ID NO: 1095439 - DNA, 22 bp, Artificial Sequence
  chemically synthesized
tgttatattttatatagcactc

SEQ ID NO: 1095440 - DNA, 22 bp, Artificial Sequence
  chemically synthesized
gttatattttatatagcactca

SEQ ID NO: 1095441 - DNA, 22 bp, Artificial Sequence
  chemically synthesized
ttatattttatatagcactcac

SEQ ID NO: 1095442 - DNA, 22 bp, Artificial Sequence
  chemically synthesized
tgtatcagtgttatgtgagtgc

SEQ ID NO: 1095443 - DNA, 22 bp, Artificial Sequence
  chemically synthesized
tattttatatagcactcacata

SEQ ID NO: 1095444 - DNA, 22 bp, Artificial Sequence
  chemically synthesized
atgtatcagtgttatgtgagtg

SEQ ID NO: 1095445 - DNA, 22 bp, Artificial Sequence
  chemically synthesized
tatatagcactcacataacact

SEQ ID NO: 1095446 - DNA, 22 bp, Artificial Sequence
  chemically synthesized
atatagcactcacataacactg

SEQ ID NO: 1095447 - DNA, 22 bp, Artificial Sequence
  chemically synthesized
tatagcactcacataacactga

SEQ ID NO: 1095448 - DNA, 22 bp, Artificial Sequence
  chemically synthesized
acataacactgatacataagat

SEQ ID NO: 1095449 - DNA, 22 bp, Artificial Sequence
  chemically synthesized
aggatataatgacgtatcttat

SEQ ID NO: 1095450 - DNA, 22 bp, Artificial Sequence
  chemically synthesized
tgaggatataatgacgtatctt

SEQ ID NO: 1095451 - DNA, 22 bp, Artificial Sequence
  chemically synthesized
ctgaggatataatgacgtatct

SEQ ID NO: 1095452 - DNA, 22 bp, Artificial Sequence
  chemically synthesized
atacataagatacgtcattata

SEQ ID NO: 1095453 - DNA, 22 bp, Artificial Sequence
  chemically synthesized
cagtttctgaggatataatgac

SEQ ID NO: 1095454 - DNA, 22 bp, Artificial Sequence
  chemically synthesized
tatgtcaggaaatattacagtt

SEQ ID NO: 1095455 - DNA, 22 bp, Artificial Sequence
  chemically synthesized
tatcctcagaaactgtaatatt

SEQ ID NO: 1095456 - DNA, 22 bp, Artificial Sequence
  chemically synthesized
tatatgtcaggaaatattacag

SEQ ID NO: 1095457 - DNA, 22 bp, Artificial Sequence
  chemically synthesized
ctatatgtcaggaaatattaca

SEQ ID NO: 1095458 - DNA, 22 bp, Artificial Sequence
  chemically synthesized
agaaactgtaatatttcctgac

SEQ ID NO: 1095459 - DNA, 22 bp, Artificial Sequence
  chemically synthesized
aaaagtgccttctatatgtcag

SEQ ID NO: 1095460 - DNA, 22 bp, Artificial Sequence
  chemically synthesized
gaaaagtgccttctatatgtca

SEQ ID NO: 1095461 - DNA, 22 bp, Artificial Sequence
  chemically synthesized
taatatttcctgacatatagaa

SEQ ID NO: 1095462 - DNA, 22 bp, Artificial Sequence
  chemically synthesized
ttgaaaagtgccttctatatgt

SEQ ID NO: 1095463 - DNA, 22 bp, Artificial Sequence
  chemically synthesized
agactcttgaaaagtgccttct

SEQ ID NO: 1095464 - DNA, 22 bp, Artificial Sequence
  chemically synthesized
cctgacatatagaaggcacttt

SEQ ID NO: 1095465 - DNA, 22 bp, Artificial Sequence
  chemically synthesized
ctgacatatagaaggcactttt

SEQ ID NO: 1095466 - DNA, 22 bp, Artificial Sequence
  chemically synthesized
ctcagactcttgaaaagtgcct

SEQ ID NO: 1095467 - DNA, 22 bp, Artificial Sequence
  chemically synthesized
acatatagaaggcacttttcaa

SEQ ID NO: 1095468 - DNA, 22 bp, Artificial Sequence
  chemically synthesized
actcctcagactcttgaaaagt

SEQ ID NO: 1095469 - DNA, 22 bp, Artificial Sequence
  chemically synthesized
aatgcaattcactcctcagact

SEQ ID NO: 1095470 - DNA, 22 bp, Artificial Sequence
  chemically synthesized
aaatgcaattcactcctcagac

SEQ ID NO: 1095471 - DNA, 22 bp, Artificial Sequence
  chemically synthesized
taaatgcaattcactcctcaga

SEQ ID NO: 1095472 - DNA, 22 bp, Artificial Sequence
  chemically synthesized
ttaaatgcaattcactcctcag

SEQ ID NO: 1095473 - DNA, 22 bp, Artificial Sequence
  chemically synthesized
ttttaaatgcaattcactcctc

SEQ ID NO: 1095474 - DNA, 22 bp, Artificial Sequence
  chemically synthesized
ttcaagagtctgaggagtgaat

SEQ ID NO: 1095475 - DNA, 22 bp, Artificial Sequence
  chemically synthesized
cttttaaatgcaattcactcct

SEQ ID NO: 1095476 - DNA, 22 bp, Artificial Sequence
  chemically synthesized
tcaagagtctgaggagtgaatt

SEQ ID NO: 1095477 - DNA, 22 bp, Artificial Sequence
  chemically synthesized
tcttttaaatgcaattcactcc

SEQ ID NO: 1095478 - DNA, 22 bp, Artificial Sequence
  chemically synthesized
caagagtctgaggagtgaattg

SEQ ID NO: 1095479 - DNA, 22 bp, Artificial Sequence
  chemically synthesized
ttcttttaaatgcaattcactc

SEQ ID NO: 1095480 - DNA, 22 bp, Artificial Sequence
  chemically synthesized
aagagtctgaggagtgaattgc

SEQ ID NO: 1095481 - DNA, 22 bp, Artificial Sequence
  chemically synthesized
ttttcttttaaatgcaattcac

SEQ ID NO: 1095482 - DNA, 22 bp, Artificial Sequence
  chemically synthesized
ttcttttcttttaaatgcaatt

SEQ ID NO: 1095483 - DNA, 22 bp, Artificial Sequence
  chemically synthesized
attcttttcttttaaatgcaat

SEQ ID NO: 1095484 - DNA, 22 bp, Artificial Sequence
  chemically synthesized
aggagtgaattgcatttaaaag

SEQ ID NO: 1095485 - DNA, 22 bp, Artificial Sequence
  chemically synthesized
atccttattcttttcttttaaa

SEQ ID NO: 1095486 - DNA, 22 bp, Artificial Sequence
  chemically synthesized
ctcatccttattcttttctttt

SEQ ID NO: 1095487 - DNA, 22 bp, Artificial Sequence
  chemically synthesized
actcatccttattcttttcttt

SEQ ID NO: 1095488 - DNA, 22 bp, Artificial Sequence
  chemically synthesized
tactcatccttattcttttctt

SEQ ID NO: 1095489 - DNA, 22 bp, Artificial Sequence
  chemically synthesized
tttactcatccttattcttttc

SEQ ID NO: 1095490 - DNA, 22 bp, Artificial Sequence
  chemically synthesized
ctttactcatccttattctttt

SEQ ID NO: 1095491 - DNA, 22 bp, Artificial Sequence
  chemically synthesized
catttaaaagaaaagaataagg

SEQ ID NO: 1095492 - DNA, 22 bp, Artificial Sequence
  chemically synthesized
ttctttactcatccttattctt

SEQ ID NO: 1095493 - DNA, 22 bp, Artificial Sequence
  chemically synthesized
aaaagaaaagaataaggatgag

SEQ ID NO: 1095494 - DNA, 22 bp, Artificial Sequence
  chemically synthesized
agctcttctttactcatcctta

SEQ ID NO: 1095495 - DNA, 22 bp, Artificial Sequence
  chemically synthesized
aaagaaaagaataaggatgagt

SEQ ID NO: 1095496 - DNA, 22 bp, Artificial Sequence
  chemically synthesized
taagctcttctttactcatcct

SEQ ID NO: 1095497 - DNA, 22 bp, Artificial Sequence
  chemically synthesized
tcagttctaagctcttctttac

SEQ ID NO: 1095498 - DNA, 22 bp, Artificial Sequence
  chemically synthesized
cattatcagttctaagctcttc

SEQ ID NO: 1095499 - DNA, 22 bp, Artificial Sequence
  chemically synthesized
tccattatcagttctaagctct

SEQ ID NO: 1095500 - DNA, 22 bp, Artificial Sequence
  chemically synthesized
ctccattatcagttctaagctc

SEQ ID NO: 1095501 - DNA, 22 bp, Artificial Sequence
  chemically synthesized
agaactgataatggagaaactc

SEQ ID NO: 1095502 - DNA, 22 bp, Artificial Sequence
  chemically synthesized
gaactgataatggagaaactcg

SEQ ID NO: 1095503 - DNA, 22 bp, Artificial Sequence
  chemically synthesized
taaaatgtgatccgagtttctc

SEQ ID NO: 1095504 - DNA, 22 bp, Artificial Sequence
  chemically synthesized
ataatggagaaactcggatcac

SEQ ID NO: 1095505 - DNA, 22 bp, Artificial Sequence
  chemically synthesized
caattgtaaaatgtgatccgag

SEQ ID NO: 1095506 - DNA, 22 bp, Artificial Sequence
  chemically synthesized
ccaattgtaaaatgtgatccga

SEQ ID NO: 1095507 - DNA, 22 bp, Artificial Sequence
  chemically synthesized
tccaattgtaaaatgtgatccg

SEQ ID NO: 1095508 - DNA, 22 bp, Artificial Sequence
  chemically synthesized
tcattttccaattgtaaaatgt

SEQ ID NO: 1095509 - DNA, 22 bp, Artificial Sequence
  chemically synthesized
ggatcacattttacaattggaa

SEQ ID NO: 1095510 - DNA, 22 bp, Artificial Sequence
  chemically synthesized
ccaatacagtattatcattttc

SEQ ID NO: 1095511 - DNA, 22 bp, Artificial Sequence
  chemically synthesized
tacaattggaaaatgataatac

SEQ ID NO: 1095512 - DNA, 22 bp, Artificial Sequence
  chemically synthesized
acaattggaaaatgataatact

SEQ ID NO: 1095513 - DNA, 22 bp, Artificial Sequence
  chemically synthesized
caattggaaaatgataatactg

SEQ ID NO: 1095514 - DNA, 22 bp, Artificial Sequence
  chemically synthesized
gaaaatgataatactgtattgg

SEQ ID NO: 1095515 - DNA, 22 bp, Artificial Sequence
  chemically synthesized
aagtaccccatatattcccaat

SEQ ID NO: 1095516 - DNA, 22 bp, Artificial Sequence
  chemically synthesized
tagctaaagtaccccatatatt

SEQ ID NO: 1095517 - DNA, 22 bp, Artificial Sequence
  chemically synthesized
gtagctaaagtaccccatatat

SEQ ID NO: 1095518 - DNA, 22 bp, Artificial Sequence
  chemically synthesized
tattgggaatatatggggtact

SEQ ID NO: 1095519 - DNA, 22 bp, Artificial Sequence
  chemically synthesized
ggaatatatggggtactttagc

SEQ ID NO: 1095520 - DNA, 22 bp, Artificial Sequence
  chemically synthesized
aaatgtatttgtagctaaagta

SEQ ID NO: 1095521 - DNA, 22 bp, Artificial Sequence
  chemically synthesized
aaaatgtatttgtagctaaagt

SEQ ID NO: 1095522 - DNA, 22 bp, Artificial Sequence
  chemically synthesized
taaaatgtatttgtagctaaag

SEQ ID NO: 1095523 - DNA, 22 bp, Artificial Sequence
  chemically synthesized
aaaatattttaaaatgtatttg

SEQ ID NO: 1095524 - DNA, 22 bp, Artificial Sequence
  chemically synthesized
aaaaatattttaaaatgtattt

SEQ ID NO: 1095525 - DNA, 22 bp, Artificial Sequence
  chemically synthesized
taaaaatattttaaaatgtatt

SEQ ID NO: 1095526 - DNA, 22 bp, Artificial Sequence
  chemically synthesized
tagctacaaatacattttaaaa

SEQ ID NO: 1095527 - DNA, 22 bp, Artificial Sequence
  chemically synthesized
agctacaaatacattttaaaat

SEQ ID NO: 1095528 - DNA, 22 bp, Artificial Sequence
  chemically synthesized
gctacaaatacattttaaaata

SEQ ID NO: 1095529 - DNA, 22 bp, Artificial Sequence
  chemically synthesized
caaatacattttaaaatatttt

SEQ ID NO: 1095530 - DNA, 22 bp, Artificial Sequence
  chemically synthesized
taaaatatttttaaaggtgtac

SEQ ID NO: 1095531 - DNA, 22 bp, Artificial Sequence
  chemically synthesized
aaaatatttttaaaggtgtact

SEQ ID NO: 1095532 - DNA, 22 bp, Artificial Sequence
  chemically synthesized
aaatatttttaaaggtgtactt

SEQ ID NO: 1095533 - DNA, 22 bp, Artificial Sequence
  chemically synthesized
agatcaataataaagtacacct

SEQ ID NO: 1095534 - DNA, 22 bp, Artificial Sequence
  chemically synthesized
ttaaaggtgtactttattattg

SEQ ID NO: 1095535 - DNA, 22 bp, Artificial Sequence
  chemically synthesized
taaaggtgtactttattattga

SEQ ID NO: 1095536 - DNA, 22 bp, Artificial Sequence
  chemically synthesized
aaaggtgtactttattattgat

SEQ ID NO: 1095537 - DNA, 22 bp, Artificial Sequence
  chemically synthesized
aaggtgtactttattattgatc

SEQ ID NO: 1095538 - DNA, 22 bp, Artificial Sequence
  chemically synthesized
aagaaagatacgattcagatca

SEQ ID NO: 1095539 - DNA, 22 bp, Artificial Sequence
  chemically synthesized
aaagaaagatacgattcagatc

SEQ ID NO: 1095540 - DNA, 22 bp, Artificial Sequence
  chemically synthesized
tattattgatctgaatcgtatc

SEQ ID NO: 1095541 - DNA, 22 bp, Artificial Sequence
  chemically synthesized
attattgatctgaatcgtatct

SEQ ID NO: 1095542 - DNA, 22 bp, Artificial Sequence
  chemically synthesized
atatttaaagaaagatacgatt

SEQ ID NO: 1095543 - DNA, 22 bp, Artificial Sequence
  chemically synthesized
ttattgatctgaatcgtatctt

SEQ ID NO: 1095544 - DNA, 22 bp, Artificial Sequence
  chemically synthesized
gatatttaaagaaagatacgat

SEQ ID NO: 1095545 - DNA, 22 bp, Artificial Sequence
  chemically synthesized
ttgatctgaatcgtatctttct

SEQ ID NO: 1095546 - DNA, 22 bp, Artificial Sequence
  chemically synthesized
atctgaatcgtatctttcttta

SEQ ID NO: 1095547 - DNA, 22 bp, Artificial Sequence
  chemically synthesized
agggtttgatatttaaagaaag

SEQ ID NO: 1095548 - DNA, 22 bp, Artificial Sequence
  chemically synthesized
aatcgtatctttctttaaatat

SEQ ID NO: 1095549 - DNA, 22 bp, Artificial Sequence
  chemically synthesized
tgttgagggtttgatatttaaa

SEQ ID NO: 1095550 - DNA, 22 bp, Artificial Sequence
  chemically synthesized
ctatgttgagggtttgatattt

SEQ ID NO: 1095551 - DNA, 22 bp, Artificial Sequence
  chemically synthesized
cctatgttgagggtttgatatt

SEQ ID NO: 1095552 - DNA, 22 bp, Artificial Sequence
  chemically synthesized
cttcctatgttgagggtttgat

SEQ ID NO: 1095553 - DNA, 22 bp, Artificial Sequence
  chemically synthesized
gcttcctatgttgagggtttga

SEQ ID NO: 1095554 - DNA, 22 bp, Artificial Sequence
  chemically synthesized
tctttaaatatcaaaccctcaa

SEQ ID NO: 1095555 - DNA, 22 bp, Artificial Sequence
  chemically synthesized
ctttaaatatcaaaccctcaac

SEQ ID NO: 1095556 - DNA, 22 bp, Artificial Sequence
  chemically synthesized
tttaaatatcaaaccctcaaca

SEQ ID NO: 1095557 - DNA, 22 bp, Artificial Sequence
  chemically synthesized
gtttgcttcctatgttgagggt

SEQ ID NO: 1095558 - DNA, 22 bp, Artificial Sequence
  chemically synthesized
agtttgcttcctatgttgaggg

SEQ ID NO: 1095559 - DNA, 22 bp, Artificial Sequence
  chemically synthesized
taaatatcaaaccctcaacata

SEQ ID NO: 1095560 - DNA, 22 bp, Artificial Sequence
  chemically synthesized
aaatatcaaaccctcaacatag

SEQ ID NO: 1095561 - DNA, 22 bp, Artificial Sequence
  chemically synthesized
aatatcaaaccctcaacatagg

SEQ ID NO: 1095562 - DNA, 22 bp, Artificial Sequence
  chemically synthesized
tttagtttgcttcctatgttga

SEQ ID NO: 1095563 - DNA, 22 bp, Artificial Sequence
  chemically synthesized
aaaaacattatttagtttgctt

SEQ ID NO: 1095564 - DNA, 22 bp, Artificial Sequence
  chemically synthesized
gaaaaacattatttagtttgct

SEQ ID NO: 1095565 - DNA, 22 bp, Artificial Sequence
  chemically synthesized
tgaaaaacattatttagtttgc

SEQ ID NO: 1095566 - DNA, 22 bp, Artificial Sequence
  chemically synthesized
ttgaaaaacattatttagtttg

SEQ ID NO: 1095567 - DNA, 22 bp, Artificial Sequence
  chemically synthesized
aacataggaagcaaactaaata

SEQ ID NO: 1095568 - DNA, 22 bp, Artificial Sequence
  chemically synthesized
cttttgaaaaacattatttagt

SEQ ID NO: 1095569 - DNA, 22 bp, Artificial Sequence
  chemically synthesized
acttttgaaaaacattatttag

SEQ ID NO: 1095570 - DNA, 22 bp, Artificial Sequence
  chemically synthesized
tacttttgaaaaacattattta

SEQ ID NO: 1095571 - DNA, 22 bp, Artificial Sequence
  chemically synthesized
tttacttttgaaaaacattatt

SEQ ID NO: 1095572 - DNA, 22 bp, Artificial Sequence
  chemically synthesized
aggtacctctttacttttgaaa

SEQ ID NO: 1095573 - DNA, 22 bp, Artificial Sequence
  chemically synthesized
aataatgtttttcaaaagtaaa

SEQ ID NO: 1095574 - DNA, 22 bp, Artificial Sequence
  chemically synthesized
ataaagtgttcaggtacctctt

SEQ ID NO: 1095575 - DNA, 22 bp, Artificial Sequence
  chemically synthesized
ttcaaaagtaaagaggtacctg

SEQ ID NO: 1095576 - DNA, 22 bp, Artificial Sequence
  chemically synthesized
tcaaaagtaaagaggtacctga

SEQ ID NO: 1095577 - DNA, 22 bp, Artificial Sequence
  chemically synthesized
caaaagtaaagaggtacctgaa

SEQ ID NO: 1095578 - DNA, 22 bp, Artificial Sequence
  chemically synthesized
aaaagtaaagaggtacctgaac

SEQ ID NO: 1095579 - DNA, 22 bp, Artificial Sequence
  chemically synthesized
gtgaatatggttaataaagtgt

SEQ ID NO: 1095580 - DNA, 22 bp, Artificial Sequence
  chemically synthesized
ggtgaatatggttaataaagtg

SEQ ID NO: 1095581 - DNA, 22 bp, Artificial Sequence
  chemically synthesized
tggtgaatatggttaataaagt

SEQ ID NO: 1095582 - DNA, 22 bp, Artificial Sequence
  chemically synthesized
ttttggtgaatatggttaataa

SEQ ID NO: 1095583 - DNA, 22 bp, Artificial Sequence
  chemically synthesized
agttattttggtgaatatggtt

SEQ ID NO: 1095584 - DNA, 22 bp, Artificial Sequence
  chemically synthesized
aacactttattaaccatattca

SEQ ID NO: 1095585 - DNA, 22 bp, Artificial Sequence
  chemically synthesized
tattaaccatattcaccaaaat

SEQ ID NO: 1095586 - DNA, 22 bp, Artificial Sequence
  chemically synthesized
attaaccatattcaccaaaata

SEQ ID NO: 1095587 - DNA, 22 bp, Artificial Sequence
  chemically synthesized
ttaaccatattcaccaaaataa

SEQ ID NO: 1095588 - DNA, 22 bp, Artificial Sequence
  chemically synthesized
acacagactgagttattttggt

SEQ ID NO: 1095589 - DNA, 22 bp, Artificial Sequence
  chemically synthesized
accatattcaccaaaataactc

SEQ ID NO: 1095590 - DNA, 22 bp, Artificial Sequence
  chemically synthesized
cctcacacagactgagttattt

SEQ ID NO: 1095591 - DNA, 22 bp, Artificial Sequence
  chemically synthesized
ccctcacacagactgagttatt

SEQ ID NO: 1095592 - DNA, 22 bp, Artificial Sequence
  chemically synthesized
accaaaataactcagtctgtgt

SEQ ID NO: 1095593 - DNA, 22 bp, Artificial Sequence
  chemically synthesized
agcccccttccctcacacagac

SEQ ID NO: 1095594 - DNA, 22 bp, Artificial Sequence
  chemically synthesized
aagcccccttccctcacacaga

SEQ ID NO: 1095595 - DNA, 22 bp, Artificial Sequence
  chemically synthesized
taagcccccttccctcacacag

SEQ ID NO: 1095596 - DNA, 22 bp, Artificial Sequence
  chemically synthesized
gactttaagcccccttccctca

SEQ ID NO: 1095597 - DNA, 22 bp, Artificial Sequence
  chemically synthesized
agtctgtgtgagggaagggggc

SEQ ID NO: 1095598 - DNA, 22 bp, Artificial Sequence
  chemically synthesized
tgtgagggaagggggcttaaag

SEQ ID NO: 1095599 - DNA, 22 bp, Artificial Sequence
  chemically synthesized
cacatgagttggactttaagcc

SEQ ID NO: 1095600 - DNA, 22 bp, Artificial Sequence
  chemically synthesized
ccagacattgcacatgagttgg

SEQ ID NO: 1095601 - DNA, 22 bp, Artificial Sequence
  chemically synthesized
atgctgccagacattgcacatg

SEQ ID NO: 1095602 - DNA, 22 bp, Artificial Sequence
  chemically synthesized
aaagtccaactcatgtgcaatg

SEQ ID NO: 1095603 - DNA, 22 bp, Artificial Sequence
  chemically synthesized
aagtccaactcatgtgcaatgt

SEQ ID NO: 1095604 - DNA, 22 bp, Artificial Sequence
  chemically synthesized
caaatgctgatgctgccagaca

SEQ ID NO: 1095605 - DNA, 22 bp, Artificial Sequence
  chemically synthesized
atgtgcaatgtctggcagcatc

SEQ ID NO: 1095606 - DNA, 22 bp, Artificial Sequence
  chemically synthesized
tccactacaaatgctgatgctg

SEQ ID NO: 1095607 - DNA, 22 bp, Artificial Sequence
  chemically synthesized
atccactacaaatgctgatgct

SEQ ID NO: 1095608 - DNA, 22 bp, Artificial Sequence
  chemically synthesized
tatccactacaaatgctgatgc

SEQ ID NO: 1095609 - DNA, 22 bp, Artificial Sequence
  chemically synthesized
gcagcatcagcatttgtagtgg

SEQ ID NO: 1095610 - DNA, 22 bp, Artificial Sequence
  chemically synthesized
tgccaaggggcacaaaacttta

SEQ ID NO: 1095611 - DNA, 22 bp, Artificial Sequence
  chemically synthesized
gtagtggataaagttttgtgcc

SEQ ID NO: 1095612 - DNA, 22 bp, Artificial Sequence
  chemically synthesized
tagtggataaagttttgtgccc

SEQ ID NO: 1095613 - DNA, 22 bp, Artificial Sequence
  chemically synthesized
tgaaaatactgtgccaaggggc

SEQ ID NO: 1095614 - DNA, 22 bp, Artificial Sequence
  chemically synthesized
atgaaaatactgtgccaagggg

SEQ ID NO: 1095615 - DNA, 22 bp, Artificial Sequence
  chemically synthesized
ttatgaaaatactgtgccaagg

SEQ ID NO: 1095616 - DNA, 22 bp, Artificial Sequence
  chemically synthesized
cttatgaaaatactgtgccaag

SEQ ID NO: 1095617 - DNA, 22 bp, Artificial Sequence
  chemically synthesized
tcttatgaaaatactgtgccaa

SEQ ID NO: 1095618 - DNA, 22 bp, Artificial Sequence
  chemically synthesized
tgtgccccttggcacagtattt

SEQ ID NO: 1095619 - DNA, 22 bp, Artificial Sequence
  chemically synthesized
gtgccccttggcacagtatttt

SEQ ID NO: 1095620 - DNA, 22 bp, Artificial Sequence
  chemically synthesized
tgccccttggcacagtattttc

SEQ ID NO: 1095621 - DNA, 22 bp, Artificial Sequence
  chemically synthesized
tgacctttcttatgaaaatact

SEQ ID NO: 1095622 - DNA, 22 bp, Artificial Sequence
  chemically synthesized
ggcacagtattttcataagaaa

SEQ ID NO: 1095623 - DNA, 22 bp, Artificial Sequence
  chemically synthesized
gcacagtattttcataagaaag

SEQ ID NO: 1095624 - DNA, 22 bp, Artificial Sequence
  chemically synthesized
catcaaaaataagctatgacct

SEQ ID NO: 1095625 - DNA, 22 bp, Artificial Sequence
  chemically synthesized
tcataagaaaggtcatagctta

SEQ ID NO: 1095626 - DNA, 22 bp, Artificial Sequence
  chemically synthesized
cataagaaaggtcatagcttat

SEQ ID NO: 1095627 - DNA, 22 bp, Artificial Sequence
  chemically synthesized
ataagaaaggtcatagcttatt

SEQ ID NO: 1095628 - DNA, 22 bp, Artificial Sequence
  chemically synthesized
aaatgatggccatgtaattgca

SEQ ID NO: 1095629 - DNA, 22 bp, Artificial Sequence
  chemically synthesized
atttttgatgcaattacatggc

SEQ ID NO: 1095630 - DNA, 22 bp, Artificial Sequence
  chemically synthesized
tttttgatgcaattacatggcc

SEQ ID NO: 1095631 - DNA, 22 bp, Artificial Sequence
  chemically synthesized
ttgatgcaattacatggccatc

SEQ ID NO: 1095632 - DNA, 22 bp, Artificial Sequence
  chemically synthesized
tgatgcaattacatggccatca

SEQ ID NO: 1095633 - DNA, 22 bp, Artificial Sequence
  chemically synthesized
gatgcaattacatggccatcat

SEQ ID NO: 1095634 - DNA, 22 bp, Artificial Sequence
  chemically synthesized
atgcaattacatggccatcatt

SEQ ID NO: 1095635 - DNA, 22 bp, Artificial Sequence
  chemically synthesized
catggccatcatttgaggcacc

SEQ ID NO: 1095636 - DNA, 22 bp, Artificial Sequence
  chemically synthesized
gataaagaaagcaggtgcctca

SEQ ID NO: 1095637 - DNA, 22 bp, Artificial Sequence
  chemically synthesized
agataaagaaagcaggtgcctc

SEQ ID NO: 1095638 - DNA, 22 bp, Artificial Sequence
  chemically synthesized
aatttagataaagaaagcaggt

SEQ ID NO: 1095639 - DNA, 22 bp, Artificial Sequence
  chemically synthesized
tctgaatttagataaagaaagc

SEQ ID NO: 1095640 - DNA, 22 bp, Artificial Sequence
  chemically synthesized
atctgaatttagataaagaaag

SEQ ID NO: 1095641 - DNA, 22 bp, Artificial Sequence
  chemically synthesized
gaggcacctgctttctttatct

SEQ ID NO: 1095642 - DNA, 22 bp, Artificial Sequence
  chemically synthesized
aggcacctgctttctttatcta

SEQ ID NO: 1095643 - DNA, 22 bp, Artificial Sequence
  chemically synthesized
tgcttatctgaatttagataaa

SEQ ID NO: 1095644 - DNA, 22 bp, Artificial Sequence
  chemically synthesized
gattatgcttatctgaatttag

SEQ ID NO: 1095645 - DNA, 22 bp, Artificial Sequence
  chemically synthesized
ctttctttatctaaattcagat

SEQ ID NO: 1095646 - DNA, 22 bp, Artificial Sequence
  chemically synthesized
tctagattatgcttatctgaat

SEQ ID NO: 1095647 - DNA, 22 bp, Artificial Sequence
  chemically synthesized
tctttatctaaattcagataag

SEQ ID NO: 1095648 - DNA, 22 bp, Artificial Sequence
  chemically synthesized
ctttatctaaattcagataagc

SEQ ID NO: 1095649 - DNA, 22 bp, Artificial Sequence
  chemically synthesized
tttatctaaattcagataagca

SEQ ID NO: 1095650 - DNA, 22 bp, Artificial Sequence
  chemically synthesized
ctgtctagattatgcttatctg

SEQ ID NO: 1095651 - DNA, 22 bp, Artificial Sequence
  chemically synthesized
actgtctagattatgcttatct

SEQ ID NO: 1095652 - DNA, 22 bp, Artificial Sequence
  chemically synthesized
tatctaaattcagataagcata

SEQ ID NO: 1095653 - DNA, 22 bp, Artificial Sequence
  chemically synthesized
atctaaattcagataagcataa

SEQ ID NO: 1095654 - DNA, 22 bp, Artificial Sequence
  chemically synthesized
tctaaattcagataagcataat

SEQ ID NO: 1095655 - DNA, 22 bp, Artificial Sequence
  chemically synthesized
aattcagataagcataatctag

SEQ ID NO: 1095656 - DNA, 22 bp, Artificial Sequence
  chemically synthesized
agataagcataatctagacagt

SEQ ID NO: 1095657 - DNA, 22 bp, Artificial Sequence
  chemically synthesized
tggatgggccttactgtctaga

SEQ ID NO: 1095658 - DNA, 22 bp, Artificial Sequence
  chemically synthesized
atggatgggccttactgtctag

SEQ ID NO: 1095659 - DNA, 22 bp, Artificial Sequence
  chemically synthesized
tatggatgggccttactgtcta

SEQ ID NO: 1095660 - DNA, 22 bp, Artificial Sequence
  chemically synthesized
ttatggatgggccttactgtct

SEQ ID NO: 1095661 - DNA, 22 bp, Artificial Sequence
  chemically synthesized
acttttatggatgggccttact

SEQ ID NO: 1095662 - DNA, 22 bp, Artificial Sequence
  chemically synthesized
aacttttatggatgggccttac

SEQ ID NO: 1095663 - DNA, 22 bp, Artificial Sequence
  chemically synthesized
taacttttatggatgggcctta

SEQ ID NO: 1095664 - DNA, 22 bp, Artificial Sequence
  chemically synthesized
ctttaacttttatggatgggcc

SEQ ID NO: 1095665 - DNA, 22 bp, Artificial Sequence
  chemically synthesized
tgctttaacttttatggatggg

SEQ ID NO: 1095666 - DNA, 22 bp, Artificial Sequence
  chemically synthesized
ctgctttaacttttatggatgg

SEQ ID NO: 1095667 - DNA, 22 bp, Artificial Sequence
  chemically synthesized
gacagtaaggcccatccataaa

SEQ ID NO: 1095668 - DNA, 22 bp, Artificial Sequence
  chemically synthesized
tcacaacttctgctttaacttt

SEQ ID NO: 1095669 - DNA, 22 bp, Artificial Sequence
  chemically synthesized
tgtattatcacaacttctgctt

SEQ ID NO: 1095670 - DNA, 22 bp, Artificial Sequence
  chemically synthesized
atgtattatcacaacttctgct

SEQ ID NO: 1095671 - DNA, 22 bp, Artificial Sequence
  chemically synthesized
tatttatgtattatcacaactt

SEQ ID NO: 1095672 - DNA, 22 bp, Artificial Sequence
  chemically synthesized
cattatatttatgtattatcac

SEQ ID NO: 1095673 - DNA, 22 bp, Artificial Sequence
  chemically synthesized
aagcagaagttgtgataataca

SEQ ID NO: 1095674 - DNA, 22 bp, Artificial Sequence
  chemically synthesized
gcattatatttatgtattatca

SEQ ID NO: 1095675 - DNA, 22 bp, Artificial Sequence
  chemically synthesized
atggtttgcattatatttatgt

SEQ ID NO: 1095676 - DNA, 22 bp, Artificial Sequence
  chemically synthesized
gatggtttgcattatatttatg

SEQ ID NO: 1095677 - DNA, 22 bp, Artificial Sequence
  chemically synthesized
tgatggtttgcattatatttat

SEQ ID NO: 1095678 - DNA, 22 bp, Artificial Sequence
  chemically synthesized
ttgatggtttgcattatattta

SEQ ID NO: 1095679 - DNA, 22 bp, Artificial Sequence
  chemically synthesized
tttgatggtttgcattatattt

SEQ ID NO: 1095680 - DNA, 22 bp, Artificial Sequence
  chemically synthesized
tgataatacataaatataatgc

SEQ ID NO: 1095681 - DNA, 22 bp, Artificial Sequence
  chemically synthesized
tattttttgatggtttgcatta

SEQ ID NO: 1095682 - DNA, 22 bp, Artificial Sequence
  chemically synthesized
tatattttttgatggtttgcat

SEQ ID NO: 1095683 - DNA, 22 bp, Artificial Sequence
  chemically synthesized
accagctctatattttttgatg

SEQ ID NO: 1095684 - DNA, 22 bp, Artificial Sequence
  chemically synthesized
cctaaccagctctatatttttt

SEQ ID NO: 1095685 - DNA, 22 bp, Artificial Sequence
  chemically synthesized
gacatgttacctaaccagctct

SEQ ID NO: 1095686 - DNA, 22 bp, Artificial Sequence
  chemically synthesized
ttagacatgttacctaaccagc

SEQ ID NO: 1095687 - DNA, 22 bp, Artificial Sequence
  chemically synthesized
gttagacatgttacctaaccag

SEQ ID NO: 1095688 - DNA, 22 bp, Artificial Sequence
  chemically synthesized
tgttagacatgttacctaacca

SEQ ID NO: 1095689 - DNA, 22 bp, Artificial Sequence
  chemically synthesized
tttgttagacatgttacctaac

SEQ ID NO: 1095690 - DNA, 22 bp, Artificial Sequence
  chemically synthesized
gttaggtaacatgtctaacaaa

SEQ ID NO: 1095691 - DNA, 22 bp, Artificial Sequence
  chemically synthesized
ggtaacatgtctaacaaagaac

SEQ ID NO: 1095692 - DNA, 22 bp, Artificial Sequence
  chemically synthesized
ccgtgccccatagagttctttg

SEQ ID NO: 1095693 - DNA, 22 bp, Artificial Sequence
  chemically synthesized
gtaattgccgtgccccatagag

SEQ ID NO: 1095694 - DNA, 22 bp, Artificial Sequence
  chemically synthesized
agtaattgccgtgccccataga

SEQ ID NO: 1095695 - DNA, 22 bp, Artificial Sequence
  chemically synthesized
tagtaattgccgtgccccatag

SEQ ID NO: 1095696 - DNA, 22 bp, Artificial Sequence
  chemically synthesized
acaaagaactctatggggcacg

SEQ ID NO: 1095697 - DNA, 22 bp, Artificial Sequence
  chemically synthesized
tctttagtaattgccgtgcccc

SEQ ID NO: 1095698 - DNA, 22 bp, Artificial Sequence
  chemically synthesized
caattgtctttagtaattgccg

SEQ ID NO: 1095699 - DNA, 22 bp, Artificial Sequence
  chemically synthesized
tatggggcacggcaattactaa

SEQ ID NO: 1095700 - DNA, 22 bp, Artificial Sequence
  chemically synthesized
ctacaattgtctttagtaattg

SEQ ID NO: 1095701 - DNA, 22 bp, Artificial Sequence
  chemically synthesized
actacaattgtctttagtaatt

SEQ ID NO: 1095702 - DNA, 22 bp, Artificial Sequence
  chemically synthesized
tggggcacggcaattactaaag

SEQ ID NO: 1095703 - DNA, 22 bp, Artificial Sequence
  chemically synthesized
tactacaattgtctttagtaat

SEQ ID NO: 1095704 - DNA, 22 bp, Artificial Sequence
  chemically synthesized
ttactacaattgtctttagtaa

SEQ ID NO: 1095705 - DNA, 22 bp, Artificial Sequence
  chemically synthesized
ctaaagacaattgtagtaaaaa

SEQ ID NO: 1095706 - DNA, 22 bp, Artificial Sequence
  chemically synthesized
tagagaagtatgtttttactac

SEQ ID NO: 1095707 - DNA, 22 bp, Artificial Sequence
  chemically synthesized
tgtagagaagtatgtttttact

SEQ ID NO: 1095708 - DNA, 22 bp, Artificial Sequence
  chemically synthesized
aagacaattgtagtaaaaacat

SEQ ID NO: 1095709 - DNA, 22 bp, Artificial Sequence
  chemically synthesized
tagtaaaaacatacttctctac

SEQ ID NO: 1095710 - DNA, 22 bp, Artificial Sequence
  chemically synthesized
gggaaaagcattctgtagagaa

SEQ ID NO: 1095711 - DNA, 22 bp, Artificial Sequence
  chemically synthesized
ggggaaaagcattctgtagaga

SEQ ID NO: 1095712 - DNA, 22 bp, Artificial Sequence
  chemically synthesized
tggggaaaagcattctgtagag

SEQ ID NO: 1095713 - DNA, 22 bp, Artificial Sequence
  chemically synthesized
agtatctttggggaaaagcatt

SEQ ID NO: 1095714 - DNA, 22 bp, Artificial Sequence
  chemically synthesized
aagtatctttggggaaaagcat

SEQ ID NO: 1095715 - DNA, 22 bp, Artificial Sequence
  chemically synthesized
ctctacagaatgcttttcccca

SEQ ID NO: 1095716 - DNA, 22 bp, Artificial Sequence
  chemically synthesized
tttaagtatctttggggaaaag

SEQ ID NO: 1095717 - DNA, 22 bp, Artificial Sequence
  chemically synthesized
tctacagaatgcttttccccaa

SEQ ID NO: 1095718 - DNA, 22 bp, Artificial Sequence
  chemically synthesized
atttaagtatctttggggaaaa

SEQ ID NO: 1095719 - DNA, 22 bp, Artificial Sequence
  chemically synthesized
tacagaatgcttttccccaaag

SEQ ID NO: 1095720 - DNA, 22 bp, Artificial Sequence
  chemically synthesized
cagaatgcttttccccaaagat

SEQ ID NO: 1095721 - DNA, 22 bp, Artificial Sequence
  chemically synthesized
ttccccaaagatacttaaataa

SEQ ID NO: 1095722 - DNA, 22 bp, Artificial Sequence
  chemically synthesized
tccccaaagatacttaaataag

SEQ ID NO: 1095723 - DNA, 22 bp, Artificial Sequence
  chemically synthesized
tatgtacataaacttatttaag

SEQ ID NO: 1095724 - DNA, 22 bp, Artificial Sequence
  chemically synthesized
ccccaaagatacttaaataagt

SEQ ID NO: 1095725 - DNA, 22 bp, Artificial Sequence
  chemically synthesized
gtatgtacataaacttatttaa

SEQ ID NO: 1095726 - DNA, 22 bp, Artificial Sequence
  chemically synthesized
cccaaagatacttaaataagtt

SEQ ID NO: 1095727 - DNA, 22 bp, Artificial Sequence
  chemically synthesized
tgtatgtacataaacttattta

SEQ ID NO: 1095728 - DNA, 22 bp, Artificial Sequence
  chemically synthesized
ttgtatgtacataaacttattt

SEQ ID NO: 1095729 - DNA, 22 bp, Artificial Sequence
  chemically synthesized
tttttgtatgtacataaactta

SEQ ID NO: 1095730 - DNA, 22 bp, Artificial Sequence
  chemically synthesized
atttttgtatgtacataaactt

SEQ ID NO: 1095731 - DNA, 22 bp, Artificial Sequence
  chemically synthesized
ttatttttgtatgtacataaac

SEQ ID NO: 1095732 - DNA, 22 bp, Artificial Sequence
  chemically synthesized
cttatttttgtatgtacataaa

SEQ ID NO: 1095733 - DNA, 22 bp, Artificial Sequence
  chemically synthesized
tcttatttttgtatgtacataa

SEQ ID NO: 1095734 - DNA, 22 bp, Artificial Sequence
  chemically synthesized
ttcttatttttgtatgtacata

SEQ ID NO: 1095735 - DNA, 22 bp, Artificial Sequence
  chemically synthesized
tttcttatttttgtatgtacat

SEQ ID NO: 1095736 - DNA, 22 bp, Artificial Sequence
  chemically synthesized
aaataagtttatgtacatacaa

SEQ ID NO: 1095737 - DNA, 22 bp, Artificial Sequence
  chemically synthesized
aataagtttatgtacatacaaa

SEQ ID NO: 1095738 - DNA, 22 bp, Artificial Sequence
  chemically synthesized
ttttttcttatttttgtatgta

SEQ ID NO: 1095739 - DNA, 22 bp, Artificial Sequence
  chemically synthesized
attttttcttatttttgtatgt

SEQ ID NO: 1095740 - DNA, 22 bp, Artificial Sequence
  chemically synthesized
tattttttcttatttttgtatg

SEQ ID NO: 1095741 - DNA, 22 bp, Artificial Sequence
  chemically synthesized
atgtacatacaaaaataagaaa

SEQ ID NO: 1095742 - DNA, 22 bp, Artificial Sequence
  chemically synthesized
tgtacatacaaaaataagaaaa

SEQ ID NO: 1095743 - DNA, 22 bp, Artificial Sequence
  chemically synthesized
tagacaatgatctttatttttt

SEQ ID NO: 1095744 - DNA, 22 bp, Artificial Sequence
  chemically synthesized
atagacaatgatctttattttt

SEQ ID NO: 1095745 - DNA, 22 bp, Artificial Sequence
  chemically synthesized
cagatttatagacaatgatctt

SEQ ID NO: 1095746 - DNA, 22 bp, Artificial Sequence
  chemically synthesized
tccagatttatagacaatgatc

SEQ ID NO: 1095747 - DNA, 22 bp, Artificial Sequence
  chemically synthesized
ctccagatttatagacaatgat

SEQ ID NO: 1095748 - DNA, 22 bp, Artificial Sequence
  chemically synthesized
tctccagatttatagacaatga

SEQ ID NO: 1095749 - DNA, 22 bp, Artificial Sequence
  chemically synthesized
taaattttctccagatttatag

SEQ ID NO: 1095750 - DNA, 22 bp, Artificial Sequence
  chemically synthesized
tctataaatctggagaaaattt

SEQ ID NO: 1095751 - DNA, 22 bp, Artificial Sequence
  chemically synthesized
taaatctggagaaaatttatag

SEQ ID NO: 1095752 - DNA, 22 bp, Artificial Sequence
  chemically synthesized
ggtcataaaatcctataaattt

SEQ ID NO: 1095753 - DNA, 22 bp, Artificial Sequence
  chemically synthesized
ttaggtcataaaatcctataaa

SEQ ID NO: 1095754 - DNA, 22 bp, Artificial Sequence
  chemically synthesized
ttattaggtcataaaatcctat

SEQ ID NO: 1095755 - DNA, 22 bp, Artificial Sequence
  chemically synthesized
gagaaaatttataggattttat

SEQ ID NO: 1095756 - DNA, 22 bp, Artificial Sequence
  chemically synthesized
ctattattaggtcataaaatcc

SEQ ID NO: 1095757 - DNA, 22 bp, Artificial Sequence
  chemically synthesized
attactattattaggtcataaa

SEQ ID NO: 1095758 - DNA, 22 bp, Artificial Sequence
  chemically synthesized
tcattactattattaggtcata

SEQ ID NO: 1095759 - DNA, 22 bp, Artificial Sequence
  chemically synthesized
ataggattttatgacctaataa

SEQ ID NO: 1095760 - DNA, 22 bp, Artificial Sequence
  chemically synthesized
taggattttatgacctaataat

SEQ ID NO: 1095761 - DNA, 22 bp, Artificial Sequence
  chemically synthesized
attctcattactattattaggt

SEQ ID NO: 1095762 - DNA, 22 bp, Artificial Sequence
  chemically synthesized
taattctcattactattattag

SEQ ID NO: 1095763 - DNA, 22 bp, Artificial Sequence
  chemically synthesized
ctaattctcattactattatta

SEQ ID NO: 1095764 - DNA, 22 bp, Artificial Sequence
  chemically synthesized
tatgacctaataatagtaatga

SEQ ID NO: 1095765 - DNA, 22 bp, Artificial Sequence
  chemically synthesized
tgcttctaattctcattactat

SEQ ID NO: 1095766 - DNA, 22 bp, Artificial Sequence
  chemically synthesized
atgacctaataatagtaatgag

SEQ ID NO: 1095767 - DNA, 22 bp, Artificial Sequence
  chemically synthesized
tgacctaataatagtaatgaga

SEQ ID NO: 1095768 - DNA, 22 bp, Artificial Sequence
  chemically synthesized
ataatagtaatgagaattagaa

SEQ ID NO: 1095769 - DNA, 22 bp, Artificial Sequence
  chemically synthesized
aatatatgtgagtagctatgct

SEQ ID NO: 1095770 - DNA, 22 bp, Artificial Sequence
  chemically synthesized
gtactcaatatatgtgagtagc

SEQ ID NO: 1095771 - DNA, 22 bp, Artificial Sequence
  chemically synthesized
gaagcatagctactcacatata

SEQ ID NO: 1095772 - DNA, 22 bp, Artificial Sequence
  chemically synthesized
gcctagtactcaatatatgtga

SEQ ID NO: 1095773 - DNA, 22 bp, Artificial Sequence
  chemically synthesized
agcctagtactcaatatatgtg

SEQ ID NO: 1095774 - DNA, 22 bp, Artificial Sequence
  chemically synthesized
cttagcctagtactcaatatat

SEQ ID NO: 1095775 - DNA, 22 bp, Artificial Sequence
  chemically synthesized
aactacttagcctagtactcaa

SEQ ID NO: 1095776 - DNA, 22 bp, Artificial Sequence
  chemically synthesized
aaactacttagcctagtactca

SEQ ID NO: 1095777 - DNA, 22 bp, Artificial Sequence
  chemically synthesized
ctcacatatattgagtactagg

SEQ ID NO: 1095778 - DNA, 22 bp, Artificial Sequence
  chemically synthesized
taaactacttagcctagtactc

SEQ ID NO: 1095779 - DNA, 22 bp, Artificial Sequence
  chemically synthesized
tttaaactacttagcctagtac

SEQ ID NO: 1095780 - DNA, 22 bp, Artificial Sequence
  chemically synthesized
acatatattgagtactaggcta

SEQ ID NO: 1095781 - DNA, 22 bp, Artificial Sequence
  chemically synthesized
tctttaaactacttagcctagt

SEQ ID NO: 1095782 - DNA, 22 bp, Artificial Sequence
  chemically synthesized
ttctctttaaactacttagcct

SEQ ID NO: 1095783 - DNA, 22 bp, Artificial Sequence
  chemically synthesized
agtactaggctaagtagtttaa

SEQ ID NO: 1095784 - DNA, 22 bp, Artificial Sequence
  chemically synthesized
aatgagctattctctttaaact

SEQ ID NO: 1095785 - DNA, 22 bp, Artificial Sequence
  chemically synthesized
ggctaagtagtttaaagagaat

SEQ ID NO: 1095786 - DNA, 22 bp, Artificial Sequence
  chemically synthesized
agtagtttaaagagaatagctc

SEQ ID NO: 1095787 - DNA, 22 bp, Artificial Sequence
  chemically synthesized
agaaaattaaatgagctattct

SEQ ID NO: 1095788 - DNA, 22 bp, Artificial Sequence
  chemically synthesized
ttgagaaaattaaatgagctat

SEQ ID NO: 1095789 - DNA, 22 bp, Artificial Sequence
  chemically synthesized
aaagagaatagctcatttaatt

SEQ ID NO: 1095790 - DNA, 22 bp, Artificial Sequence
  chemically synthesized
aagagaatagctcatttaattt

SEQ ID NO: 1095791 - DNA, 22 bp, Artificial Sequence
  chemically synthesized
ataagttgttgagaaaattaaa

SEQ ID NO: 1095792 - DNA, 22 bp, Artificial Sequence
  chemically synthesized
atttaattttctcaacaactta

SEQ ID NO: 1095793 - DNA, 22 bp, Artificial Sequence
  chemically synthesized
aattttctcaacaacttatgaa

SEQ ID NO: 1095794 - DNA, 22 bp, Artificial Sequence
  chemically synthesized
attttctcaacaacttatgaat

SEQ ID NO: 1095795 - DNA, 22 bp, Artificial Sequence
  chemically synthesized
gacataatacataattcataag

SEQ ID NO: 1095796 - DNA, 22 bp, Artificial Sequence
  chemically synthesized
tctcaacaacttatgaattatg

SEQ ID NO: 1095797 - DNA, 22 bp, Artificial Sequence
  chemically synthesized
ctcaacaacttatgaattatgt

SEQ ID NO: 1095798 - DNA, 22 bp, Artificial Sequence
  chemically synthesized
tcaacaacttatgaattatgta

SEQ ID NO: 1095799 - DNA, 22 bp, Artificial Sequence
  chemically synthesized
aacaacttatgaattatgtatt

SEQ ID NO: 1095800 - DNA, 22 bp, Artificial Sequence
  chemically synthesized
tcaactagacataatacataat

SEQ ID NO: 1095801 - DNA, 22 bp, Artificial Sequence
  chemically synthesized
aatctgtcaactagacataata

SEQ ID NO: 1095802 - DNA, 22 bp, Artificial Sequence
  chemically synthesized
caatctgtcaactagacataat

SEQ ID NO: 1095803 - DNA, 22 bp, Artificial Sequence
  chemically synthesized
atgaattatgtattatgtctag

SEQ ID NO: 1095804 - DNA, 22 bp, Artificial Sequence
  chemically synthesized
tcaatctgtcaactagacataa

SEQ ID NO: 1095805 - DNA, 22 bp, Artificial Sequence
  chemically synthesized
tgaattatgtattatgtctagt

SEQ ID NO: 1095806 - DNA, 22 bp, Artificial Sequence
  chemically synthesized
ttttcaatctgtcaactagaca

SEQ ID NO: 1095807 - DNA, 22 bp, Artificial Sequence
  chemically synthesized
tgtattatgtctagttgacaga

SEQ ID NO: 1095808 - DNA, 22 bp, Artificial Sequence
  chemically synthesized
tgtaaacctgttttcaatctgt

SEQ ID NO: 1095809 - DNA, 22 bp, Artificial Sequence
  chemically synthesized
gtgtaaacctgttttcaatctg

SEQ ID NO: 1095810 - DNA, 22 bp, Artificial Sequence
  chemically synthesized
tgtctagttgacagattgaaaa

SEQ ID NO: 1095811 - DNA, 22 bp, Artificial Sequence
  chemically synthesized
acttgtgtaaacctgttttcaa

SEQ ID NO: 1095812 - DNA, 22 bp, Artificial Sequence
  chemically synthesized
aacttgtgtaaacctgttttca

SEQ ID NO: 1095813 - DNA, 22 bp, Artificial Sequence
  chemically synthesized
gttgacagattgaaaacaggtt

SEQ ID NO: 1095814 - DNA, 22 bp, Artificial Sequence
  chemically synthesized
cttaacttgtgtaaacctgttt

SEQ ID NO: 1095815 - DNA, 22 bp, Artificial Sequence
  chemically synthesized
gcttaacttgtgtaaacctgtt

SEQ ID NO: 1095816 - DNA, 22 bp, Artificial Sequence
  chemically synthesized
acagattgaaaacaggtttaca

SEQ ID NO: 1095817 - DNA, 22 bp, Artificial Sequence
  chemically synthesized
ggccatttgcttaacttgtgta

SEQ ID NO: 1095818 - DNA, 22 bp, Artificial Sequence
  chemically synthesized
gggccatttgcttaacttgtgt

SEQ ID NO: 1095819 - DNA, 22 bp, Artificial Sequence
  chemically synthesized
aaaacaggtttacacaagttaa

SEQ ID NO: 1095820 - DNA, 22 bp, Artificial Sequence
  chemically synthesized
tgggccatttgcttaacttgtg

SEQ ID NO: 1095821 - DNA, 22 bp, Artificial Sequence
  chemically synthesized
tatgactttgggccatttgctt

SEQ ID NO: 1095822 - DNA, 22 bp, Artificial Sequence
  chemically synthesized
acacaagttaagcaaatggccc

SEQ ID NO: 1095823 - DNA, 22 bp, Artificial Sequence
  chemically synthesized
cacaagttaagcaaatggccca

SEQ ID NO: 1095824 - DNA, 22 bp, Artificial Sequence
  chemically synthesized
taagttgtatgactttgggcca

SEQ ID NO: 1095825 - DNA, 22 bp, Artificial Sequence
  chemically synthesized
ataagttgtatgactttgggcc

SEQ ID NO: 1095826 - DNA, 22 bp, Artificial Sequence
  chemically synthesized
agcaaatggcccaaagtcatac

SEQ ID NO: 1095827 - DNA, 22 bp, Artificial Sequence
  chemically synthesized
aggcacttataagttgtatgac

SEQ ID NO: 1095828 - DNA, 22 bp, Artificial Sequence
  chemically synthesized
attcaggcacttataagttgta

SEQ ID NO: 1095829 - DNA, 22 bp, Artificial Sequence
  chemically synthesized
ctcattcaggcacttataagtt

SEQ ID NO: 1095830 - DNA, 22 bp, Artificial Sequence
  chemically synthesized
aattcctcattcaggcacttat

SEQ ID NO: 1095831 - DNA, 22 bp, Artificial Sequence
  chemically synthesized
gaattcctcattcaggcactta

SEQ ID NO: 1095832 - DNA, 22 bp, Artificial Sequence
  chemically synthesized
gcttgaattcctcattcaggca

SEQ ID NO: 1095833 - DNA, 22 bp, Artificial Sequence
  chemically synthesized
ggcttgaattcctcattcaggc

SEQ ID NO: 1095834 - DNA, 22 bp, Artificial Sequence
  chemically synthesized
tggcttgaattcctcattcagg

SEQ ID NO: 1095835 - DNA, 22 bp, Artificial Sequence
  chemically synthesized
ataagtgcctgaatgaggaatt

SEQ ID NO: 1095836 - DNA, 22 bp, Artificial Sequence
  chemically synthesized
taagtgcctgaatgaggaattc

SEQ ID NO: 1095837 - DNA, 22 bp, Artificial Sequence
  chemically synthesized
aatgaggaattcaagccaaagt

SEQ ID NO: 1095838 - DNA, 22 bp, Artificial Sequence
  chemically synthesized
aagccaaagttgttttgcactg

SEQ ID NO: 1095839 - DNA, 22 bp, Artificial Sequence
  chemically synthesized
agaacatggataccagtgcaaa

SEQ ID NO: 1095840 - DNA, 22 bp, Artificial Sequence
  chemically synthesized
ttttgcactggtatccatgttc

SEQ ID NO: 1095841 - DNA, 22 bp, Artificial Sequence
  chemically synthesized
tgcactggtatccatgttctta

SEQ ID NO: 1095842 - DNA, 22 bp, Artificial Sequence
  chemically synthesized
gcactggtatccatgttcttaa

SEQ ID NO: 1095843 - DNA, 22 bp, Artificial Sequence
  chemically synthesized
cactggtatccatgttcttaac

SEQ ID NO: 1095844 - DNA, 22 bp, Artificial Sequence
  chemically synthesized
gtatccatgttcttaaccacta

SEQ ID NO: 1095845 - DNA, 22 bp, Artificial Sequence
  chemically synthesized
ttaaccactatgcctcacatat

SEQ ID NO: 1095846 - DNA, 22 bp, Artificial Sequence
  chemically synthesized
aaccactatgcctcacatatga

SEQ ID NO: 1095847 - DNA, 22 bp, Artificial Sequence
  chemically synthesized
accactatgcctcacatatgac

SEQ ID NO: 1095848 - DNA, 22 bp, Artificial Sequence
  chemically synthesized
tgcctcacatatgaccatgtat

SEQ ID NO: 1095849 - DNA, 22 bp, Artificial Sequence
  chemically synthesized
tcaatgatatgtcaatacatgg

SEQ ID NO: 1095850 - DNA, 22 bp, Artificial Sequence
  chemically synthesized
gtcaatgatatgtcaatacatg

SEQ ID NO: 1095851 - DNA, 22 bp, Artificial Sequence
  chemically synthesized
tgtcaatgatatgtcaatacat

SEQ ID NO: 1095852 - DNA, 22 bp, Artificial Sequence
  chemically synthesized
acatatgaccatgtattgacat

SEQ ID NO: 1095853 - DNA, 22 bp, Artificial Sequence
  chemically synthesized
gtctttgtcaatgatatgtcaa

SEQ ID NO: 1095854 - DNA, 22 bp, Artificial Sequence
  chemically synthesized
ggtctttgtcaatgatatgtca

SEQ ID NO: 1095855 - DNA, 22 bp, Artificial Sequence
  chemically synthesized
ttggtctttgtcaatgatatgt

SEQ ID NO: 1095856 - DNA, 22 bp, Artificial Sequence
  chemically synthesized
cttggtctttgtcaatgatatg

SEQ ID NO: 1095857 - DNA, 22 bp, Artificial Sequence
  chemically synthesized
tcttggtctttgtcaatgatat

SEQ ID NO: 1095858 - DNA, 22 bp, Artificial Sequence
  chemically synthesized
ttcttggtctttgtcaatgata

SEQ ID NO: 1095859 - DNA, 22 bp, Artificial Sequence
  chemically synthesized
cttttcttggtctttgtcaatg

SEQ ID NO: 1095860 - DNA, 22 bp, Artificial Sequence
  chemically synthesized
acatatcattgacaaagaccaa

SEQ ID NO: 1095861 - DNA, 22 bp, Artificial Sequence
  chemically synthesized
gaagtcagttgcttttcttggt

SEQ ID NO: 1095862 - DNA, 22 bp, Artificial Sequence
  chemically synthesized
ggaagtcagttgcttttcttgg

SEQ ID NO: 1095863 - DNA, 22 bp, Artificial Sequence
  chemically synthesized
tggaagtcagttgcttttcttg

SEQ ID NO: 1095864 - DNA, 22 bp, Artificial Sequence
  chemically synthesized
acaaagaccaagaaaagcaact

SEQ ID NO: 1095865 - DNA, 22 bp, Artificial Sequence
  chemically synthesized
aatgggaaatgcaagactttgg

SEQ ID NO: 1095866 - DNA, 22 bp, Artificial Sequence
  chemically synthesized
ggctgaatgggaaatgcaagac

SEQ ID NO: 1095867 - DNA, 22 bp, Artificial Sequence
  chemically synthesized
acttccaaagtcttgcatttcc

SEQ ID NO: 1095868 - DNA, 22 bp, Artificial Sequence
  chemically synthesized
cactaggctgaatgggaaatgc

SEQ ID NO: 1095869 - DNA, 22 bp, Artificial Sequence
  chemically synthesized
ccaaagtcttgcatttcccatt

SEQ ID NO: 1095870 - DNA, 22 bp, Artificial Sequence
  chemically synthesized
tgcactaggctgaatgggaaat

SEQ ID NO: 1095871 - DNA, 22 bp, Artificial Sequence
  chemically synthesized
caaagtcttgcatttcccattc

SEQ ID NO: 1095872 - DNA, 22 bp, Artificial Sequence
  chemically synthesized
gcatttcccattcagcctagtg

SEQ ID NO: 1095873 - DNA, 22 bp, Artificial Sequence
  chemically synthesized
ccagtggctctgcactaggctg

SEQ ID NO: 1095874 - DNA, 22 bp, Artificial Sequence
  chemically synthesized
catttcccattcagcctagtgc

SEQ ID NO: 1095875 - DNA, 22 bp, Artificial Sequence
  chemically synthesized
cccattcagcctagtgcagagc

SEQ ID NO: 1095876 - DNA, 22 bp, Artificial Sequence
  chemically synthesized
ccattcagcctagtgcagagcc

SEQ ID NO: 1095877 - DNA, 22 bp, Artificial Sequence
  chemically synthesized
accaccaactaccagtggctct

SEQ ID NO: 1095878 - DNA, 22 bp, Artificial Sequence
  chemically synthesized
agcctagtgcagagccactggt

SEQ ID NO: 1095879 - DNA, 22 bp, Artificial Sequence
  chemically synthesized
taaccaccaactaccagtggct

SEQ ID NO: 1095880 - DNA, 22 bp, Artificial Sequence
  chemically synthesized
gtgcagagccactggtagttgg

SEQ ID NO: 1095881 - DNA, 22 bp, Artificial Sequence
  chemically synthesized
aaactctaaccaccaactacca

SEQ ID NO: 1095882 - DNA, 22 bp, Artificial Sequence
  chemically synthesized
gaaactctaaccaccaactacc

SEQ ID NO: 1095883 - DNA, 22 bp, Artificial Sequence
  chemically synthesized
aaaaaggaacttgaaactctaa

SEQ ID NO: 1095884 - DNA, 22 bp, Artificial Sequence
  chemically synthesized
gtagttggtggttagagtttca

SEQ ID NO: 1095885 - DNA, 22 bp, Artificial Sequence
  chemically synthesized
aaaaaaggaacttgaaactcta

SEQ ID NO: 1095886 - DNA, 22 bp, Artificial Sequence
  chemically synthesized
gtggttagagtttcaagttcct

SEQ ID NO: 1095887 - DNA, 22 bp, Artificial Sequence
  chemically synthesized
gagtttcaagttccttttttaa

SEQ ID NO: 1095888 - DNA, 22 bp, Artificial Sequence
  chemically synthesized
tagcacaagaggccttaaaaaa

SEQ ID NO: 1095889 - DNA, 22 bp, Artificial Sequence
  chemically synthesized
caagttccttttttaaggcctc

SEQ ID NO: 1095890 - DNA, 22 bp, Artificial Sequence
  chemically synthesized
aagttccttttttaaggcctct

SEQ ID NO: 1095891 - DNA, 22 bp, Artificial Sequence
  chemically synthesized
cacctgtagcacaagaggcctt

SEQ ID NO: 1095892 - DNA, 22 bp, Artificial Sequence
  chemically synthesized
cttttttaaggcctcttgtgct

SEQ ID NO: 1095893 - DNA, 22 bp, Artificial Sequence
  chemically synthesized
aagctccacctgtagcacaaga

SEQ ID NO: 1095894 - DNA, 22 bp, Artificial Sequence
  chemically synthesized
ttttaaggcctcttgtgctaca

SEQ ID NO: 1095895 - DNA, 22 bp, Artificial Sequence
  chemically synthesized
tttaaggcctcttgtgctacag

SEQ ID NO: 1095896 - DNA, 22 bp, Artificial Sequence
  chemically synthesized
ttaaggcctcttgtgctacagg

SEQ ID NO: 1095897 - DNA, 22 bp, Artificial Sequence
  chemically synthesized
taaggcctcttgtgctacaggt

SEQ ID NO: 1095898 - DNA, 22 bp, Artificial Sequence
  chemically synthesized
aaggcctcttgtgctacaggtg

SEQ ID NO: 1095899 - DNA, 22 bp, Artificial Sequence
  chemically synthesized
aggcctcttgtgctacaggtgg

SEQ ID NO: 1095900 - DNA, 22 bp, Artificial Sequence
  chemically synthesized
ttgtgctacaggtggagcttga

SEQ ID NO: 1095901 - DNA, 22 bp, Artificial Sequence
  chemically synthesized
gtgctacaggtggagcttgagc

SEQ ID NO: 1095902 - DNA, 22 bp, Artificial Sequence
  chemically synthesized
tgctacaggtggagcttgagct

SEQ ID NO: 1095903 - DNA, 22 bp, Artificial Sequence
  chemically synthesized
taaatagtgtcatagctcaagc

SEQ ID NO: 1095904 - DNA, 22 bp, Artificial Sequence
  chemically synthesized
caggtggagcttgagctatgac

SEQ ID NO: 1095905 - DNA, 22 bp, Artificial Sequence
  chemically synthesized
agtctgtaaatagtgtcatagc

SEQ ID NO: 1095906 - DNA, 22 bp, Artificial Sequence
  chemically synthesized
ctgagtctgtaaatagtgtcat

SEQ ID NO: 1095907 - DNA, 22 bp, Artificial Sequence
  chemically synthesized
actgagtctgtaaatagtgtca

SEQ ID NO: 1095908 - DNA, 22 bp, Artificial Sequence
  chemically synthesized
cttactgagtctgtaaatagtg

SEQ ID NO: 1095909 - DNA, 22 bp, Artificial Sequence
  chemically synthesized
gagctatgacactatttacaga

SEQ ID NO: 1095910 - DNA, 22 bp, Artificial Sequence
  chemically synthesized
agctatgacactatttacagac

SEQ ID NO: 1095911 - DNA, 22 bp, Artificial Sequence
  chemically synthesized
tgacactatttacagactcagt

SEQ ID NO: 1095912 - DNA, 22 bp, Artificial Sequence
  chemically synthesized
tttacagactcagtaaggagtt

SEQ ID NO: 1095913 - DNA, 22 bp, Artificial Sequence
  chemically synthesized
acagactcagtaaggagtttca

SEQ ID NO: 1095914 - DNA, 22 bp, Artificial Sequence
  chemically synthesized
cagactcagtaaggagtttcac

SEQ ID NO: 1095915 - DNA, 22 bp, Artificial Sequence
  chemically synthesized
agtaaggagtttcactttcgct

SEQ ID NO: 1095916 - DNA, 22 bp, Artificial Sequence
  chemically synthesized
aagaagaggcccaacaaaaaga

SEQ ID NO: 1095917 - DNA, 22 bp, Artificial Sequence
  chemically synthesized
cactttcgcttctttttgttgg

SEQ ID NO: 1095918 - DNA, 22 bp, Artificial Sequence
  chemically synthesized
actttcgcttctttttgttggg

SEQ ID NO: 1095919 - DNA, 22 bp, Artificial Sequence
  chemically synthesized
tcgcttctttttgttgggcctc

SEQ ID NO: 1095920 - DNA, 22 bp, Artificial Sequence
  chemically synthesized
cgcttctttttgttgggcctct

SEQ ID NO: 1095921 - DNA, 22 bp, Artificial Sequence
  chemically synthesized
gcttctttttgttgggcctctt

SEQ ID NO: 1095922 - DNA, 22 bp, Artificial Sequence
  chemically synthesized
agagagctaaagaagaggccca

SEQ ID NO: 1095923 - DNA, 22 bp, Artificial Sequence
  chemically synthesized
cagagagctaaagaagaggccc

SEQ ID NO: 1095924 - DNA, 22 bp, Artificial Sequence
  chemically synthesized
tcagagagctaaagaagaggcc

SEQ ID NO: 1095925 - DNA, 22 bp, Artificial Sequence
  chemically synthesized
ttcagagagctaaagaagaggc

SEQ ID NO: 1095926 - DNA, 22 bp, Artificial Sequence
  chemically synthesized
ctttttgttgggcctcttcttt

SEQ ID NO: 1095927 - DNA, 22 bp, Artificial Sequence
  chemically synthesized
tttttgttgggcctcttcttta

SEQ ID NO: 1095928 - DNA, 22 bp, Artificial Sequence
  chemically synthesized
tttttcagagagctaaagaaga

SEQ ID NO: 1095929 - DNA, 22 bp, Artificial Sequence
  chemically synthesized
tttgttgggcctcttctttagc

SEQ ID NO: 1095930 - DNA, 22 bp, Artificial Sequence
  chemically synthesized
atttttcagagagctaaagaag

SEQ ID NO: 1095931 - DNA, 22 bp, Artificial Sequence
  chemically synthesized
ttgttgggcctcttctttagct

SEQ ID NO: 1095932 - DNA, 22 bp, Artificial Sequence
  chemically synthesized
tatttttcagagagctaaagaa

SEQ ID NO: 1095933 - DNA, 22 bp, Artificial Sequence
  chemically synthesized
tgttgggcctcttctttagctc

SEQ ID NO: 1095934 - DNA, 22 bp, Artificial Sequence
  chemically synthesized
gttgggcctcttctttagctct

SEQ ID NO: 1095935 - DNA, 22 bp, Artificial Sequence
  chemically synthesized
tttatttttcagagagctaaag

SEQ ID NO: 1095936 - DNA, 22 bp, Artificial Sequence
  chemically synthesized
ttgggcctcttctttagctctc

SEQ ID NO: 1095937 - DNA, 22 bp, Artificial Sequence
  chemically synthesized
ggcctcttctttagctctctga

SEQ ID NO: 1095938 - DNA, 22 bp, Artificial Sequence
  chemically synthesized
ttctttagctctctgaaaaata

SEQ ID NO: 1095939 - DNA, 22 bp, Artificial Sequence
  chemically synthesized
agagagcattctttatttttca

SEQ ID NO: 1095940 - DNA, 22 bp, Artificial Sequence
  chemically synthesized
ctttagctctctgaaaaataaa

SEQ ID NO: 1095941 - DNA, 22 bp, Artificial Sequence
  chemically synthesized
tttagctctctgaaaaataaag

SEQ ID NO: 1095942 - DNA, 22 bp, Artificial Sequence
  chemically synthesized
ttaagagagcattctttatttt

SEQ ID NO: 1095943 - DNA, 22 bp, Artificial Sequence
  chemically synthesized
tagctctctgaaaaataaagaa

SEQ ID NO: 1095944 - DNA, 22 bp, Artificial Sequence
  chemically synthesized
agctctctgaaaaataaagaat

SEQ ID NO: 1095945 - DNA, 22 bp, Artificial Sequence
  chemically synthesized
gctctctgaaaaataaagaatg

SEQ ID NO: 1095946 - DNA, 22 bp, Artificial Sequence
  chemically synthesized
atgctattaagagagcattctt

SEQ ID NO: 1095947 - DNA, 22 bp, Artificial Sequence
  chemically synthesized
tctgaaaaataaagaatgctct

SEQ ID NO: 1095948 - DNA, 22 bp, Artificial Sequence
  chemically synthesized
catgctattaagagagcattct

SEQ ID NO: 1095949 - DNA, 22 bp, Artificial Sequence
  chemically synthesized
tcatgctattaagagagcattc

SEQ ID NO: 1095950 - DNA, 22 bp, Artificial Sequence
  chemically synthesized
tgaaaaataaagaatgctctct

SEQ ID NO: 1095951 - DNA, 22 bp, Artificial Sequence
  chemically synthesized
aaaaataaagaatgctctctta

SEQ ID NO: 1095952 - DNA, 22 bp, Artificial Sequence
  chemically synthesized
ttttcatgctattaagagagca

SEQ ID NO: 1095953 - DNA, 22 bp, Artificial Sequence
  chemically synthesized
gatgtaaagttattttcatgct

SEQ ID NO: 1095954 - DNA, 22 bp, Artificial Sequence
  chemically synthesized
ggatgtaaagttattttcatgc

SEQ ID NO: 1095955 - DNA, 22 bp, Artificial Sequence
  chemically synthesized
tggatgtaaagttattttcatg

SEQ ID NO: 1095956 - DNA, 22 bp, Artificial Sequence
  chemically synthesized
tcttaatagcatgaaaataact

SEQ ID NO: 1095957 - DNA, 22 bp, Artificial Sequence
  chemically synthesized
ttaatagcatgaaaataacttt

SEQ ID NO: 1095958 - DNA, 22 bp, Artificial Sequence
  chemically synthesized
aatagcatgaaaataactttac

SEQ ID NO: 1095959 - DNA, 22 bp, Artificial Sequence
  chemically synthesized
atagcatgaaaataactttaca

SEQ ID NO: 1095960 - DNA, 22 bp, Artificial Sequence
  chemically synthesized
atagaaatgcattttggatgta

SEQ ID NO: 1095961 - DNA, 22 bp, Artificial Sequence
  chemically synthesized
tatgattcatagaaatgcattt

SEQ ID NO: 1095962 - DNA, 22 bp, Artificial Sequence
  chemically synthesized
tacatccaaaatgcatttctat

SEQ ID NO: 1095963 - DNA, 22 bp, Artificial Sequence
  chemically synthesized
acatccaaaatgcatttctatg

SEQ ID NO: 1095964 - DNA, 22 bp, Artificial Sequence
  chemically synthesized
catccaaaatgcatttctatga

SEQ ID NO: 1095965 - DNA, 22 bp, Artificial Sequence
  chemically synthesized
tgagaaagaaattatatgattc

SEQ ID NO: 1095966 - DNA, 22 bp, Artificial Sequence
  chemically synthesized
ctatgaatcatataatttcttt

SEQ ID NO: 1095967 - DNA, 22 bp, Artificial Sequence
  chemically synthesized
ggatgttgtgagaaagaaatta

SEQ ID NO: 1095968 - DNA, 22 bp, Artificial Sequence
  chemically synthesized
tatgaatcatataatttctttc

SEQ ID NO: 1095969 - DNA, 22 bp, Artificial Sequence
  chemically synthesized
tgaatcatataatttctttctc

SEQ ID NO: 1095970 - DNA, 22 bp, Artificial Sequence
  chemically synthesized
actgggatgttgtgagaaagaa

SEQ ID NO: 1095971 - DNA, 22 bp, Artificial Sequence
  chemically synthesized
taactgggatgttgtgagaaag

SEQ ID NO: 1095972 - DNA, 22 bp, Artificial Sequence
  chemically synthesized
attctaactgggatgttgtgag

SEQ ID NO: 1095973 - DNA, 22 bp, Artificial Sequence
  chemically synthesized
tcattctaactgggatgttgtg

SEQ ID NO: 1095974 - DNA, 22 bp, Artificial Sequence
  chemically synthesized
ctttctcacaacatcccagtta

SEQ ID NO: 1095975 - DNA, 22 bp, Artificial Sequence
  chemically synthesized
taattctcattctaactgggat

SEQ ID NO: 1095976 - DNA, 22 bp, Artificial Sequence
  chemically synthesized
tttctcacaacatcccagttag

SEQ ID NO: 1095977 - DNA, 22 bp, Artificial Sequence
  chemically synthesized
gtaattctcattctaactggga

SEQ ID NO: 1095978 - DNA, 22 bp, Artificial Sequence
  chemically synthesized
tgtaattctcattctaactggg

SEQ ID NO: 1095979 - DNA, 22 bp, Artificial Sequence
  chemically synthesized
tctcacaacatcccagttagaa

SEQ ID NO: 1095980 - DNA, 22 bp, Artificial Sequence
  chemically synthesized
ttgtaattctcattctaactgg

SEQ ID NO: 1095981 - DNA, 22 bp, Artificial Sequence
  chemically synthesized
ctcacaacatcccagttagaat

SEQ ID NO: 1095982 - DNA, 22 bp, Artificial Sequence
  chemically synthesized
tcacaacatcccagttagaatg

SEQ ID NO: 1095983 - DNA, 22 bp, Artificial Sequence
  chemically synthesized
tttttgtaattctcattctaac

SEQ ID NO: 1095984 - DNA, 22 bp, Artificial Sequence
  chemically synthesized
acaacatcccagttagaatgag

SEQ ID NO: 1095985 - DNA, 22 bp, Artificial Sequence
  chemically synthesized
atttttgtaattctcattctaa

SEQ ID NO: 1095986 - DNA, 22 bp, Artificial Sequence
  chemically synthesized
gatttatttttgtaattctcat

SEQ ID NO: 1095987 - DNA, 22 bp, Artificial Sequence
  chemically synthesized
atattagatttatttttgtaat

SEQ ID NO: 1095988 - DNA, 22 bp, Artificial Sequence
  chemically synthesized
gaatgagaattacaaaaataaa

SEQ ID NO: 1095989 - DNA, 22 bp, Artificial Sequence
  chemically synthesized
gagttcatattagatttatttt

SEQ ID NO: 1095990 - DNA, 22 bp, Artificial Sequence
  chemically synthesized
caaaaataaatctaatatgaac

SEQ ID NO: 1095991 - DNA, 22 bp, Artificial Sequence
  chemically synthesized
tggaagagactggagttcatat

SEQ ID NO: 1095992 - DNA, 22 bp, Artificial Sequence
  chemically synthesized
atggaagagactggagttcata

SEQ ID NO: 1095993 - DNA, 22 bp, Artificial Sequence
  chemically synthesized
aatttatggaagagactggagt

SEQ ID NO: 1095994 - DNA, 22 bp, Artificial Sequence
  chemically synthesized
aaatttatggaagagactggag

SEQ ID NO: 1095995 - DNA, 22 bp, Artificial Sequence
  chemically synthesized
atatgaactccagtctcttcca

SEQ ID NO: 1095996 - DNA, 22 bp, Artificial Sequence
  chemically synthesized
aacttaaatttatggaagagac

SEQ ID NO: 1095997 - DNA, 22 bp, Artificial Sequence
  chemically synthesized
aactaaacttaaatttatggaa

SEQ ID NO: 1095998 - DNA, 22 bp, Artificial Sequence
  chemically synthesized
caactaaacttaaatttatgga

SEQ ID NO: 1095999 - DNA, 22 bp, Artificial Sequence
  chemically synthesized
cagtctcttccataaatttaag

SEQ ID NO: 1096000 - DNA, 22 bp, Artificial Sequence
  chemically synthesized
caatttcaactaaacttaaatt

SEQ ID NO: 1096001 - DNA, 22 bp, Artificial Sequence
  chemically synthesized
ccaatttcaactaaacttaaat

SEQ ID NO: 1096002 - DNA, 22 bp, Artificial Sequence
  chemically synthesized
tccaatttcaactaaacttaaa

SEQ ID NO: 1096003 - DNA, 22 bp, Artificial Sequence
  chemically synthesized
ttccataaatttaagtttagtt

SEQ ID NO: 1096004 - DNA, 22 bp, Artificial Sequence
  chemically synthesized
actttccaatttcaactaaact

SEQ ID NO: 1096005 - DNA, 22 bp, Artificial Sequence
  chemically synthesized
ccataaatttaagtttagttga

SEQ ID NO: 1096006 - DNA, 22 bp, Artificial Sequence
  chemically synthesized
aactttccaatttcaactaaac

SEQ ID NO: 1096007 - DNA, 22 bp, Artificial Sequence
  chemically synthesized
cataaatttaagtttagttgaa

SEQ ID NO: 1096008 - DNA, 22 bp, Artificial Sequence
  chemically synthesized
taactttccaatttcaactaaa

SEQ ID NO: 1096009 - DNA, 22 bp, Artificial Sequence
  chemically synthesized
tttaactttccaatttcaacta

SEQ ID NO: 1096010 - DNA, 22 bp, Artificial Sequence
  chemically synthesized
ctttaactttccaatttcaact

SEQ ID NO: 1096011 - DNA, 22 bp, Artificial Sequence
  chemically synthesized
tttctttaactttccaatttca

SEQ ID NO: 1096012 - DNA, 22 bp, Artificial Sequence
  chemically synthesized
aagtttagttgaaattggaaag

SEQ ID NO: 1096013 - DNA, 22 bp, Artificial Sequence
  chemically synthesized
agtttagttgaaattggaaagt

SEQ ID NO: 1096014 - DNA, 22 bp, Artificial Sequence
  chemically synthesized
agttgaaattggaaagttaaag

SEQ ID NO: 1096015 - DNA, 22 bp, Artificial Sequence
  chemically synthesized
gttgaaattggaaagttaaaga

SEQ ID NO: 1096016 - DNA, 22 bp, Artificial Sequence
  chemically synthesized
taataaattatttctttaactt

SEQ ID NO: 1096017 - DNA, 22 bp, Artificial Sequence
  chemically synthesized
ataataaattatttctttaact

SEQ ID NO: 1096018 - DNA, 22 bp, Artificial Sequence
  chemically synthesized
ttataataaattatttctttaa

SEQ ID NO: 1096019 - DNA, 22 bp, Artificial Sequence
  chemically synthesized
aaattggaaagttaaagaaata

SEQ ID NO: 1096020 - DNA, 22 bp, Artificial Sequence
  chemically synthesized
tattcttataataaattatttc

SEQ ID NO: 1096021 - DNA, 22 bp, Artificial Sequence
  chemically synthesized
gaaagttaaagaaataatttat

SEQ ID NO: 1096022 - DNA, 22 bp, Artificial Sequence
  chemically synthesized
ttgtattcttataataaattat

SEQ ID NO: 1096023 - DNA, 22 bp, Artificial Sequence
  chemically synthesized
aagaaataatttattataagaa

SEQ ID NO: 1096024 - DNA, 22 bp, Artificial Sequence
  chemically synthesized
cagatctgttgtattcttataa

SEQ ID NO: 1096025 - DNA, 22 bp, Artificial Sequence
  chemically synthesized
ttacagatctgttgtattctta

SEQ ID NO: 1096026 - DNA, 22 bp, Artificial Sequence
  chemically synthesized
gttacagatctgttgtattctt

SEQ ID NO: 1096027 - DNA, 22 bp, Artificial Sequence
  chemically synthesized
ttgttacagatctgttgtattc

SEQ ID NO: 1096028 - DNA, 22 bp, Artificial Sequence
  chemically synthesized
ttcttgttacagatctgttgta

SEQ ID NO: 1096029 - DNA, 22 bp, Artificial Sequence
  chemically synthesized
attataagaatacaacagatct

SEQ ID NO: 1096030 - DNA, 22 bp, Artificial Sequence
  chemically synthesized
ttataagaatacaacagatctg

SEQ ID NO: 1096031 - DNA, 22 bp, Artificial Sequence
  chemically synthesized
taagaatacaacagatctgtaa

SEQ ID NO: 1096032 - DNA, 22 bp, Artificial Sequence
  chemically synthesized
agtctattcttgttacagatct

SEQ ID NO: 1096033 - DNA, 22 bp, Artificial Sequence
  chemically synthesized
cagtctattcttgttacagatc

SEQ ID NO: 1096034 - DNA, 22 bp, Artificial Sequence
  chemically synthesized
tcagtctattcttgttacagat

SEQ ID NO: 1096035 - DNA, 22 bp, Artificial Sequence
  chemically synthesized
ttcagtctattcttgttacaga

SEQ ID NO: 1096036 - DNA, 22 bp, Artificial Sequence
  chemically synthesized
cttttcagtctattcttgttac

SEQ ID NO: 1096037 - DNA, 22 bp, Artificial Sequence
  chemically synthesized
catgcagactacttttcagtct

SEQ ID NO: 1096038 - DNA, 22 bp, Artificial Sequence
  chemically synthesized
taacaagaatagactgaaaagt

SEQ ID NO: 1096039 - DNA, 22 bp, Artificial Sequence
  chemically synthesized
aaaagtagtctgcatggaggta

SEQ ID NO: 1096040 - DNA, 22 bp, Artificial Sequence
  chemically synthesized
accacaaatccatacctccatg

SEQ ID NO: 1096041 - DNA, 22 bp, Artificial Sequence
  chemically synthesized
gaccacaaatccatacctccat

SEQ ID NO: 1096042 - DNA, 22 bp, Artificial Sequence
  chemically synthesized
catggaggtatggatttgtggt

SEQ ID NO: 1096043 - DNA, 22 bp, Artificial Sequence
  chemically synthesized
tatcaatgtgtatatatttgac

SEQ ID NO: 1096044 - DNA, 22 bp, Artificial Sequence
  chemically synthesized
atatcaatgtgtatatatttga

SEQ ID NO: 1096045 - DNA, 22 bp, Artificial Sequence
  chemically synthesized
tatttatatcaatgtgtatata

SEQ ID NO: 1096046 - DNA, 22 bp, Artificial Sequence
  chemically synthesized
gtggtcaaatatatacacattg

SEQ ID NO: 1096047 - DNA, 22 bp, Artificial Sequence
  chemically synthesized
tggtcaaatatatacacattga

SEQ ID NO: 1096048 - DNA, 22 bp, Artificial Sequence
  chemically synthesized
caaacaattgtatttatatcaa

SEQ ID NO: 1096049 - DNA, 22 bp, Artificial Sequence
  chemically synthesized
ccaaacaattgtatttatatca

SEQ ID NO: 1096050 - DNA, 22 bp, Artificial Sequence
  chemically synthesized
tccaaacaattgtatttatatc

SEQ ID NO: 1096051 - DNA, 22 bp, Artificial Sequence
  chemically synthesized
ttccaaacaattgtatttatat

SEQ ID NO: 1096052 - DNA, 22 bp, Artificial Sequence
  chemically synthesized
ccttttccaaacaattgtattt

SEQ ID NO: 1096053 - DNA, 22 bp, Artificial Sequence
  chemically synthesized
gccttttccaaacaattgtatt

SEQ ID NO: 1096054 - DNA, 22 bp, Artificial Sequence
  chemically synthesized
ttgccttttccaaacaattgta

SEQ ID NO: 1096055 - DNA, 22 bp, Artificial Sequence
  chemically synthesized
cttgccttttccaaacaattgt

SEQ ID NO: 1096056 - DNA, 22 bp, Artificial Sequence
  chemically synthesized
tttcttgccttttccaaacaat

SEQ ID NO: 1096057 - DNA, 22 bp, Artificial Sequence
  chemically synthesized
atataaatacaattgtttggaa

SEQ ID NO: 1096058 - DNA, 22 bp, Artificial Sequence
  chemically synthesized
gtttcttgccttttccaaacaa

SEQ ID NO: 1096059 - DNA, 22 bp, Artificial Sequence
  chemically synthesized
aaatatttgtttcttgcctttt

SEQ ID NO: 1096060 - DNA, 22 bp, Artificial Sequence
  chemically synthesized
atattgaaatatttgtttcttg

SEQ ID NO: 1096061 - DNA, 22 bp, Artificial Sequence
  chemically synthesized
tttggaaaaggcaagaaacaaa

SEQ ID NO: 1096062 - DNA, 22 bp, Artificial Sequence
  chemically synthesized
ggaaaaggcaagaaacaaatat

SEQ ID NO: 1096063 - DNA, 22 bp, Artificial Sequence
  chemically synthesized
gttaatattgaaatatttgttt

SEQ ID NO: 1096064 - DNA, 22 bp, Artificial Sequence
  chemically synthesized
gaaaaggcaagaaacaaatatt

SEQ ID NO: 1096065 - DNA, 22 bp, Artificial Sequence
  chemically synthesized
acctagttaatattgaaatatt

SEQ ID NO: 1096066 - DNA, 22 bp, Artificial Sequence
  chemically synthesized
aacctagttaatattgaaatat

SEQ ID NO: 1096067 - DNA, 22 bp, Artificial Sequence
  chemically synthesized
taacctagttaatattgaaata

SEQ ID NO: 1096068 - DNA, 22 bp, Artificial Sequence
  chemically synthesized
ttaacctagttaatattgaaat

SEQ ID NO: 1096069 - DNA, 22 bp, Artificial Sequence
  chemically synthesized
tttaacctagttaatattgaaa

SEQ ID NO: 1096070 - DNA, 22 bp, Artificial Sequence
  chemically synthesized
ccaaatattttttaacctagtt

SEQ ID NO: 1096071 - DNA, 22 bp, Artificial Sequence
  chemically synthesized
caatattaactaggttaaaaaa

SEQ ID NO: 1096072 - DNA, 22 bp, Artificial Sequence
  chemically synthesized
gactgccaaatattttttaacc

SEQ ID NO: 1096073 - DNA, 22 bp, Artificial Sequence
  chemically synthesized
aatattaactaggttaaaaaat

SEQ ID NO: 1096074 - DNA, 22 bp, Artificial Sequence
  chemically synthesized
tagactgccaaatattttttaa

SEQ ID NO: 1096075 - DNA, 22 bp, Artificial Sequence
  chemically synthesized
aattctagactgccaaatattt

SEQ ID NO: 1096076 - DNA, 22 bp, Artificial Sequence
  chemically synthesized
actaggttaaaaaatatttggc

SEQ ID NO: 1096077 - DNA, 22 bp, Artificial Sequence
  chemically synthesized
caattctagactgccaaatatt

SEQ ID NO: 1096078 - DNA, 22 bp, Artificial Sequence
  chemically synthesized
ggttaaaaaatatttggcagtc

SEQ ID NO: 1096079 - DNA, 22 bp, Artificial Sequence
  chemically synthesized
aaaaatatttggcagtctagaa

SEQ ID NO: 1096080 - DNA, 22 bp, Artificial Sequence
  chemically synthesized
taagtgatttcaattctagact

SEQ ID NO: 1096081 - DNA, 22 bp, Artificial Sequence
  chemically synthesized
ataagtgatttcaattctagac

SEQ ID NO: 1096082 - DNA, 22 bp, Artificial Sequence
  chemically synthesized
ggcagtctagaattgaaatcac

SEQ ID NO: 1096083 - DNA, 22 bp, Artificial Sequence
  chemically synthesized
gcagtctagaattgaaatcact

SEQ ID NO: 1096084 - DNA, 22 bp, Artificial Sequence
  chemically synthesized
atccaagtaatttataagtgat

SEQ ID NO: 1096085 - DNA, 22 bp, Artificial Sequence
  chemically synthesized
ttcatccaagtaatttataagt

SEQ ID NO: 1096086 - DNA, 22 bp, Artificial Sequence
  chemically synthesized
gaattgaaatcacttataaatt

SEQ ID NO: 1096087 - DNA, 22 bp, Artificial Sequence
  chemically synthesized
aaatcacttataaattacttgg

SEQ ID NO: 1096088 - DNA, 22 bp, Artificial Sequence
  chemically synthesized
aatattattcatccaagtaatt

SEQ ID NO: 1096089 - DNA, 22 bp, Artificial Sequence
  chemically synthesized
caatattattcatccaagtaat

SEQ ID NO: 1096090 - DNA, 22 bp, Artificial Sequence
  chemically synthesized
ataaattacttggatgaataat

SEQ ID NO: 1096091 - DNA, 22 bp, Artificial Sequence
  chemically synthesized
taaattacttggatgaataata

SEQ ID NO: 1096092 - DNA, 22 bp, Artificial Sequence
  chemically synthesized
tgatggtttcaatattattcat

SEQ ID NO: 1096093 - DNA, 22 bp, Artificial Sequence
  chemically synthesized
gtgatggtttcaatattattca

SEQ ID NO: 1096094 - DNA, 22 bp, Artificial Sequence
  chemically synthesized
cttggatgaataatattgaaac

SEQ ID NO: 1096095 - DNA, 22 bp, Artificial Sequence
  chemically synthesized
ggatgaataatattgaaaccat

SEQ ID NO: 1096096 - DNA, 22 bp, Artificial Sequence
  chemically synthesized
gatgaataatattgaaaccatc

SEQ ID NO: 1096097 - DNA, 22 bp, Artificial Sequence
  chemically synthesized
aataatgatatttgtgatggtt

SEQ ID NO: 1096098 - DNA, 22 bp, Artificial Sequence
  chemically synthesized
aaataatgatatttgtgatggt

SEQ ID NO: 1096099 - DNA, 22 bp, Artificial Sequence
  chemically synthesized
acttaaataatgatatttgtga

SEQ ID NO: 1096100 - DNA, 22 bp, Artificial Sequence
  chemically synthesized
aacttaaataatgatatttgtg

SEQ ID NO: 1096101 - DNA, 22 bp, Artificial Sequence
  chemically synthesized
taacttaaataatgatatttgt

SEQ ID NO: 1096102 - DNA, 22 bp, Artificial Sequence
  chemically synthesized
aaaccatcacaaatatcattat

SEQ ID NO: 1096103 - DNA, 22 bp, Artificial Sequence
  chemically synthesized
agtatcctttaacttaaataat

SEQ ID NO: 1096104 - DNA, 22 bp, Artificial Sequence
  chemically synthesized
tgttaagtatcctttaacttaa

SEQ ID NO: 1096105 - DNA, 22 bp, Artificial Sequence
  chemically synthesized
tatgttaagtatcctttaactt

SEQ ID NO: 1096106 - DNA, 22 bp, Artificial Sequence
  chemically synthesized
ctatgttaagtatcctttaact

SEQ ID NO: 1096107 - DNA, 22 bp, Artificial Sequence
  chemically synthesized
tctatgttaagtatcctttaac

SEQ ID NO: 1096108 - DNA, 22 bp, Artificial Sequence
  chemically synthesized
tttaagttaaaggatacttaac

SEQ ID NO: 1096109 - DNA, 22 bp, Artificial Sequence
  chemically synthesized
aagttaaaggatacttaacata

SEQ ID NO: 1096110 - DNA, 22 bp, Artificial Sequence
  chemically synthesized
agttaaaggatacttaacatag

SEQ ID NO: 1096111 - DNA, 22 bp, Artificial Sequence
  chemically synthesized
aaggatacttaacatagaaagg

SEQ ID NO: 1096112 - DNA, 22 bp, Artificial Sequence
  chemically synthesized
aatatagcatcaaggggacctt

SEQ ID NO: 1096113 - DNA, 22 bp, Artificial Sequence
  chemically synthesized
ctaaatatagcatcaaggggac

SEQ ID NO: 1096114 - DNA, 22 bp, Artificial Sequence
  chemically synthesized
aacatagaaaggtccccttgat

SEQ ID NO: 1096115 - DNA, 22 bp, Artificial Sequence
  chemically synthesized
acatagaaaggtccccttgatg

SEQ ID NO: 1096116 - DNA, 22 bp, Artificial Sequence
  chemically synthesized
tcaaaatatgttcctaaatata

SEQ ID NO: 1096117 - DNA, 22 bp, Artificial Sequence
  chemically synthesized
atcaaaatatgttcctaaatat

SEQ ID NO: 1096118 - DNA, 22 bp, Artificial Sequence
  chemically synthesized
tatcaaaatatgttcctaaata

SEQ ID NO: 1096119 - DNA, 22 bp, Artificial Sequence
  chemically synthesized
ttatcaaaatatgttcctaaat

SEQ ID NO: 1096120 - DNA, 22 bp, Artificial Sequence
  chemically synthesized
ttttatcaaaatatgttcctaa

SEQ ID NO: 1096121 - DNA, 22 bp, Artificial Sequence
  chemically synthesized
cttttatcaaaatatgttccta

SEQ ID NO: 1096122 - DNA, 22 bp, Artificial Sequence
  chemically synthesized
gatgctatatttaggaacatat

SEQ ID NO: 1096123 - DNA, 22 bp, Artificial Sequence
  chemically synthesized
tcttttatcaaaatatgttcct

SEQ ID NO: 1096124 - DNA, 22 bp, Artificial Sequence
  chemically synthesized
atgctatatttaggaacatatt

SEQ ID NO: 1096125 - DNA, 22 bp, Artificial Sequence
  chemically synthesized
tatttaggaacatattttgata

SEQ ID NO: 1096126 - DNA, 22 bp, Artificial Sequence
  chemically synthesized
gaacgaaactttcttttatcaa

SEQ ID NO: 1096127 - DNA, 22 bp, Artificial Sequence
  chemically synthesized
aggaacatattttgataaaaga

SEQ ID NO: 1096128 - DNA, 22 bp, Artificial Sequence
  chemically synthesized
ggaacatattttgataaaagaa

SEQ ID NO: 1096129 - DNA, 22 bp, Artificial Sequence
  chemically synthesized
tcgaacgaaactttcttttatc

SEQ ID NO: 1096130 - DNA, 22 bp, Artificial Sequence
  chemically synthesized
aattctcgaacgaaactttctt

SEQ ID NO: 1096131 - DNA, 22 bp, Artificial Sequence
  chemically synthesized
caattctcgaacgaaactttct

SEQ ID NO: 1096132 - DNA, 22 bp, Artificial Sequence
  chemically synthesized
tcaattctcgaacgaaactttc

SEQ ID NO: 1096133 - DNA, 22 bp, Artificial Sequence
  chemically synthesized
tgataaaagaaagtttcgttcg

SEQ ID NO: 1096134 - DNA, 22 bp, Artificial Sequence
  chemically synthesized
gataaaagaaagtttcgttcga

SEQ ID NO: 1096135 - DNA, 22 bp, Artificial Sequence
  chemically synthesized
ataaaagaaagtttcgttcgag

SEQ ID NO: 1096136 - DNA, 22 bp, Artificial Sequence
  chemically synthesized
atgtgttttcaattctcgaacg

SEQ ID NO: 1096137 - DNA, 22 bp, Artificial Sequence
  chemically synthesized
tcatgtgttttcaattctcgaa

SEQ ID NO: 1096138 - DNA, 22 bp, Artificial Sequence
  chemically synthesized
tctcatgtgttttcaattctcg

SEQ ID NO: 1096139 - DNA, 22 bp, Artificial Sequence
  chemically synthesized
ctctcatgtgttttcaattctc

SEQ ID NO: 1096140 - DNA, 22 bp, Artificial Sequence
  chemically synthesized
tctctcatgtgttttcaattct

SEQ ID NO: 1096141 - DNA, 22 bp, Artificial Sequence
  chemically synthesized
tttctctcatgtgttttcaatt

SEQ ID NO: 1096142 - DNA, 22 bp, Artificial Sequence
  chemically synthesized
tctttctctcatgtgttttcaa

SEQ ID NO: 1096143 - DNA, 22 bp, Artificial Sequence
  chemically synthesized
ctctttctctcatgtgttttca

SEQ ID NO: 1096144 - DNA, 22 bp, Artificial Sequence
  chemically synthesized
cgttcgagaattgaaaacacat

SEQ ID NO: 1096145 - DNA, 22 bp, Artificial Sequence
  chemically synthesized
gttcgagaattgaaaacacatg

SEQ ID NO: 1096146 - DNA, 22 bp, Artificial Sequence
  chemically synthesized
gtttctctttctctcatgtgtt

SEQ ID NO: 1096147 - DNA, 22 bp, Artificial Sequence
  chemically synthesized
ggtttctctttctctcatgtgt

SEQ ID NO: 1096148 - DNA, 22 bp, Artificial Sequence
  chemically synthesized
gagaattgaaaacacatgagag

SEQ ID NO: 1096149 - DNA, 22 bp, Artificial Sequence
  chemically synthesized
tggtttctctttctctcatgtg

SEQ ID NO: 1096150 - DNA, 22 bp, Artificial Sequence
  chemically synthesized
ttggtttctctttctctcatgt

SEQ ID NO: 1096151 - DNA, 22 bp, Artificial Sequence
  chemically synthesized
tttggtttctctttctctcatg

SEQ ID NO: 1096152 - DNA, 22 bp, Artificial Sequence
  chemically synthesized
ttttggtttctctttctctcat

SEQ ID NO: 1096153 - DNA, 22 bp, Artificial Sequence
  chemically synthesized
cttttttggtttctctttctct

SEQ ID NO: 1096154 - DNA, 22 bp, Artificial Sequence
  chemically synthesized
aaaacacatgagagaaagagaa

SEQ ID NO: 1096155 - DNA, 22 bp, Artificial Sequence
  chemically synthesized
atatcagcagctccttttttgg

SEQ ID NO: 1096156 - DNA, 22 bp, Artificial Sequence
  chemically synthesized
tgatatcagcagctcctttttt

SEQ ID NO: 1096157 - DNA, 22 bp, Artificial Sequence
  chemically synthesized
ctgatatcagcagctccttttt

SEQ ID NO: 1096158 - DNA, 22 bp, Artificial Sequence
  chemically synthesized
ggtgtcaggccagcttctgata

SEQ ID NO: 1096159 - DNA, 22 bp, Artificial Sequence
  chemically synthesized
ctgatatcagaagctggcctga

SEQ ID NO: 1096160 - DNA, 22 bp, Artificial Sequence
  chemically synthesized
atatcagaagctggcctgacac

SEQ ID NO: 1096161 - DNA, 22 bp, Artificial Sequence
  chemically synthesized
agaagaccaaggcatagctggg

SEQ ID NO: 1096162 - DNA, 22 bp, Artificial Sequence
  chemically synthesized
gagaagaccaaggcatagctgg

SEQ ID NO: 1096163 - DNA, 22 bp, Artificial Sequence
  chemically synthesized
gcctgacacccagctatgcctt

SEQ ID NO: 1096164 - DNA, 22 bp, Artificial Sequence
  chemically synthesized
cacttgagaagaccaaggcata

SEQ ID NO: 1096165 - DNA, 22 bp, Artificial Sequence
  chemically synthesized
ccacttgagaagaccaaggcat

SEQ ID NO: 1096166 - DNA, 22 bp, Artificial Sequence
  chemically synthesized
tccacttgagaagaccaaggca

SEQ ID NO: 1096167 - DNA, 22 bp, Artificial Sequence
  chemically synthesized
acacccagctatgccttggtct

SEQ ID NO: 1096168 - DNA, 22 bp, Artificial Sequence
  chemically synthesized
ttttccacttgagaagaccaag

SEQ ID NO: 1096169 - DNA, 22 bp, Artificial Sequence
  chemically synthesized
attttccacttgagaagaccaa

SEQ ID NO: 1096170 - DNA, 22 bp, Artificial Sequence
  chemically synthesized
tgccttggtcttctcaagtgga

SEQ ID NO: 1096171 - DNA, 22 bp, Artificial Sequence
  chemically synthesized
tgaaacagtttattttccactt

SEQ ID NO: 1096172 - DNA, 22 bp, Artificial Sequence
  chemically synthesized
tgtgaaacagtttattttccac

SEQ ID NO: 1096173 - DNA, 22 bp, Artificial Sequence
  chemically synthesized
ggtcttctcaagtggaaaataa

SEQ ID NO: 1096174 - DNA, 22 bp, Artificial Sequence
  chemically synthesized
gtcttctcaagtggaaaataaa

SEQ ID NO: 1096175 - DNA, 22 bp, Artificial Sequence
  chemically synthesized
aaattctgtgaaacagtttatt

SEQ ID NO: 1096176 - DNA, 22 bp, Artificial Sequence
  chemically synthesized
ctcaagtggaaaataaactgtt

SEQ ID NO: 1096177 - DNA, 22 bp, Artificial Sequence
  chemically synthesized
tcaagtggaaaataaactgttt

SEQ ID NO: 1096178 - DNA, 22 bp, Artificial Sequence
  chemically synthesized
aagtggaaaataaactgtttca

SEQ ID NO: 1096179 - DNA, 22 bp, Artificial Sequence
  chemically synthesized
caatgttgaaattctgtgaaac

SEQ ID NO: 1096180 - DNA, 22 bp, Artificial Sequence
  chemically synthesized
ccaatgttgaaattctgtgaaa

SEQ ID NO: 1096181 - DNA, 22 bp, Artificial Sequence
  chemically synthesized
tccaatgttgaaattctgtgaa

SEQ ID NO: 1096182 - DNA, 22 bp, Artificial Sequence
  chemically synthesized
ttccaatgttgaaattctgtga

SEQ ID NO: 1096183 - DNA, 22 bp, Artificial Sequence
  chemically synthesized
tttcacagaatttcaacattgg

SEQ ID NO: 1096184 - DNA, 22 bp, Artificial Sequence
  chemically synthesized
cacagaatttcaacattggaaa

SEQ ID NO: 1096185 - DNA, 22 bp, Artificial Sequence
  chemically synthesized
acagaatttcaacattggaaaa

SEQ ID NO: 1096186 - DNA, 22 bp, Artificial Sequence
  chemically synthesized
tggaaacaaagtggccttttcc

SEQ ID NO: 1096187 - DNA, 22 bp, Artificial Sequence
  chemically synthesized
caacattggaaaaggccacttt

SEQ ID NO: 1096188 - DNA, 22 bp, Artificial Sequence
  chemically synthesized
aacattggaaaaggccactttg

SEQ ID NO: 1096189 - DNA, 22 bp, Artificial Sequence
  chemically synthesized
atccattatggaaacaaagtgg

SEQ ID NO: 1096190 - DNA, 22 bp, Artificial Sequence
  chemically synthesized
gatccattatggaaacaaagtg

SEQ ID NO: 1096191 - DNA, 22 bp, Artificial Sequence
  chemically synthesized
gaaaaggccactttgtttccat

SEQ ID NO: 1096192 - DNA, 22 bp, Artificial Sequence
  chemically synthesized
tcatggtcttgatccattatgg

SEQ ID NO: 1096193 - DNA, 22 bp, Artificial Sequence
  chemically synthesized
gtcatggtcttgatccattatg

SEQ ID NO: 1096194 - DNA, 22 bp, Artificial Sequence
  chemically synthesized
tgtttccataatggatcaagac

SEQ ID NO: 1096195 - DNA, 22 bp, Artificial Sequence
  chemically synthesized
gtttccataatggatcaagacc

SEQ ID NO: 1096196 - DNA, 22 bp, Artificial Sequence
  chemically synthesized
tttccataatggatcaagacca

SEQ ID NO: 1096197 - DNA, 22 bp, Artificial Sequence
  chemically synthesized
ccataatggatcaagaccatga

SEQ ID NO: 1096198 - DNA, 22 bp, Artificial Sequence
  chemically synthesized
cataatggatcaagaccatgac

SEQ ID NO: 1096199 - DNA, 22 bp, Artificial Sequence
  chemically synthesized
tggaatgatcttgtcatggtct

SEQ ID NO: 1096200 - DNA, 22 bp, Artificial Sequence
  chemically synthesized
agacatgattatggaatgatct

SEQ ID NO: 1096201 - DNA, 22 bp, Artificial Sequence
  chemically synthesized
gattcagacatgattatggaat

SEQ ID NO: 1096202 - DNA, 22 bp, Artificial Sequence
  chemically synthesized
tctggattcagacatgattatg

SEQ ID NO: 1096203 - DNA, 22 bp, Artificial Sequence
  chemically synthesized
gtctggattcagacatgattat

SEQ ID NO: 1096204 - DNA, 22 bp, Artificial Sequence
  chemically synthesized
tgtctggattcagacatgatta

SEQ ID NO: 1096205 - DNA, 22 bp, Artificial Sequence
  chemically synthesized
ttgtctggattcagacatgatt

SEQ ID NO: 1096206 - DNA, 22 bp, Artificial Sequence
  chemically synthesized
atgtttttgtctggattcagac

SEQ ID NO: 1096207 - DNA, 22 bp, Artificial Sequence
  chemically synthesized
cataatcatgtctgaatccaga

SEQ ID NO: 1096208 - DNA, 22 bp, Artificial Sequence
  chemically synthesized
ggtaatgttgatgtttttgtct

SEQ ID NO: 1096209 - DNA, 22 bp, Artificial Sequence
  chemically synthesized
gggtaatgttgatgtttttgtc

SEQ ID NO: 1096210 - DNA, 22 bp, Artificial Sequence
  chemically synthesized
aatccagacaaaaacatcaaca

SEQ ID NO: 1096211 - DNA, 22 bp, Artificial Sequence
  chemically synthesized
tggtttgggtaatgttgatgtt

SEQ ID NO: 1096212 - DNA, 22 bp, Artificial Sequence
  chemically synthesized
gtggtttgggtaatgttgatgt

SEQ ID NO: 1096213 - DNA, 22 bp, Artificial Sequence
  chemically synthesized
tgtggtttgggtaatgttgatg

SEQ ID NO: 1096214 - DNA, 22 bp, Artificial Sequence
  chemically synthesized
ggcgttttgtggtttgggtaat

SEQ ID NO: 1096215 - DNA, 22 bp, Artificial Sequence
  chemically synthesized
cccaaaccacaaaacgcccaac

SEQ ID NO: 1096216 - DNA, 22 bp, Artificial Sequence
  chemically synthesized
accaggataggagagtgttggg

SEQ ID NO: 1096217 - DNA, 22 bp, Artificial Sequence
  chemically synthesized
atattaaccaggataggagagt

SEQ ID NO: 1096218 - DNA, 22 bp, Artificial Sequence
  chemically synthesized
gttcatattaaccaggatagga

SEQ ID NO: 1096219 - DNA, 22 bp, Artificial Sequence
  chemically synthesized
tcctatcctggttaatatgaac

SEQ ID NO: 1096220 - DNA, 22 bp, Artificial Sequence
  chemically synthesized
ctatcctggttaatatgaacga

SEQ ID NO: 1096221 - DNA, 22 bp, Artificial Sequence
  chemically synthesized
tcctggttaatatgaacgaacg

SEQ ID NO: 1096222 - DNA, 22 bp, Artificial Sequence
  chemically synthesized
ataaagaaacggcgttcgttca

SEQ ID NO: 1096223 - DNA, 22 bp, Artificial Sequence
  chemically synthesized
gttaatatgaacgaacgccgtt

SEQ ID NO: 1096224 - DNA, 22 bp, Artificial Sequence
  chemically synthesized
caattaataaagaaacggcgtt

SEQ ID NO: 1096225 - DNA, 22 bp, Artificial Sequence
  chemically synthesized
atatgaacgaacgccgtttctt

SEQ ID NO: 1096226 - DNA, 22 bp, Artificial Sequence
  chemically synthesized
aagttgcaattaataaagaaac

SEQ ID NO: 1096227 - DNA, 22 bp, Artificial Sequence
  chemically synthesized
ctttattaattgcaactttagc

SEQ ID NO: 1096228 - DNA, 22 bp, Artificial Sequence
  chemically synthesized
tttattaattgcaactttagcc

SEQ ID NO: 1096229 - DNA, 22 bp, Artificial Sequence
  chemically synthesized
tattaattgcaactttagcctc

SEQ ID NO: 1096230 - DNA, 22 bp, Artificial Sequence
  chemically synthesized
attaattgcaactttagcctca

SEQ ID NO: 1096231 - DNA, 22 bp, Artificial Sequence
  chemically synthesized
ttaattgcaactttagcctcat

SEQ ID NO: 1096232 - DNA, 22 bp, Artificial Sequence
  chemically synthesized
attgcaactttagcctcattct

SEQ ID NO: 1096233 - DNA, 22 bp, Artificial Sequence
  chemically synthesized
caactttagcctcattctggtc

SEQ ID NO: 1096234 - DNA, 22 bp, Artificial Sequence
  chemically synthesized
tccagaaggagagaagaccaga

SEQ ID NO: 1096235 - DNA, 22 bp, Artificial Sequence
  chemically synthesized
gtccagaaggagagaagaccag

SEQ ID NO: 1096236 - DNA, 22 bp, Artificial Sequence
  chemically synthesized
tagcctcattctggtcttctct

SEQ ID NO: 1096237 - DNA, 22 bp, Artificial Sequence
  chemically synthesized
agcctcattctggtcttctctc

SEQ ID NO: 1096238 - DNA, 22 bp, Artificial Sequence
  chemically synthesized
gcctcattctggtcttctctcc

SEQ ID NO: 1096239 - DNA, 22 bp, Artificial Sequence
  chemically synthesized
attctggtcttctctccttctg

SEQ ID NO: 1096240 - DNA, 22 bp, Artificial Sequence
  chemically synthesized
tggtcttctctccttctggaca

SEQ ID NO: 1096241 - DNA, 22 bp, Artificial Sequence
  chemically synthesized
gtcttctctccttctggacaag

SEQ ID NO: 1096242 - DNA, 22 bp, Artificial Sequence
  chemically synthesized
tatgggtatcgtatcttgtcca

SEQ ID NO: 1096243 - DNA, 22 bp, Artificial Sequence
  chemically synthesized
ctctccttctggacaagatacg

SEQ ID NO: 1096244 - DNA, 22 bp, Artificial Sequence
  chemically synthesized
tctccttctggacaagatacga

SEQ ID NO: 1096245 - DNA, 22 bp, Artificial Sequence
  chemically synthesized
tccttctggacaagatacgata

SEQ ID NO: 1096246 - DNA, 22 bp, Artificial Sequence
  chemically synthesized
cttctggacaagatacgatacc

SEQ ID NO: 1096247 - DNA, 22 bp, Artificial Sequence
  chemically synthesized
ctggacaagatacgatacccat

SEQ ID NO: 1096248 - DNA, 22 bp, Artificial Sequence
  chemically synthesized
tggacaagatacgatacccata

SEQ ID NO: 1096249 - DNA, 22 bp, Artificial Sequence
  chemically synthesized
gacaagatacgatacccatata

SEQ ID NO: 1096250 - DNA, 22 bp, Artificial Sequence
  chemically synthesized
gtgtgtagggatagctatatgg

SEQ ID NO: 1096251 - DNA, 22 bp, Artificial Sequence
  chemically synthesized
tcattagtgtgtagggatagct

SEQ ID NO: 1096252 - DNA, 22 bp, Artificial Sequence
  chemically synthesized
gtcattagtgtgtagggatagc

SEQ ID NO: 1096253 - DNA, 22 bp, Artificial Sequence
  chemically synthesized
cttgtcattagtgtgtagggat

SEQ ID NO: 1096254 - DNA, 22 bp, Artificial Sequence
  chemically synthesized
gattgcttgtcattagtgtgta

SEQ ID NO: 1096255 - DNA, 22 bp, Artificial Sequence
  chemically synthesized
ggattgcttgtcattagtgtgt

SEQ ID NO: 1096256 - DNA, 22 bp, Artificial Sequence
  chemically synthesized
tggattgcttgtcattagtgtg

SEQ ID NO: 1096257 - DNA, 22 bp, Artificial Sequence
  chemically synthesized
ctttggattgcttgtcattagt

SEQ ID NO: 1096258 - DNA, 22 bp, Artificial Sequence
  chemically synthesized
actttggattgcttgtcattag

SEQ ID NO: 1096259 - DNA, 22 bp, Artificial Sequence
  chemically synthesized
tactttggattgcttgtcatta

SEQ ID NO: 1096260 - DNA, 22 bp, Artificial Sequence
  chemically synthesized
tccctacacactaatgacaagc

SEQ ID NO: 1096261 - DNA, 22 bp, Artificial Sequence
  chemically synthesized
cacactaatgacaagcaatcca

SEQ ID NO: 1096262 - DNA, 22 bp, Artificial Sequence
  chemically synthesized
aaagctttactttggattgctt

SEQ ID NO: 1096263 - DNA, 22 bp, Artificial Sequence
  chemically synthesized
aaaagctttactttggattgct

SEQ ID NO: 1096264 - DNA, 22 bp, Artificial Sequence
  chemically synthesized
atgacaagcaatccaaagtaaa

SEQ ID NO: 1096265 - DNA, 22 bp, Artificial Sequence
  chemically synthesized
agggagggtttaaaagctttac

SEQ ID NO: 1096266 - DNA, 22 bp, Artificial Sequence
  chemically synthesized
gagggagggtttaaaagcttta

SEQ ID NO: 1096267 - DNA, 22 bp, Artificial Sequence
  chemically synthesized
ggggatttgagggagggtttaa

SEQ ID NO: 1096268 - DNA, 22 bp, Artificial Sequence
  chemically synthesized
tgttaggggatttgagggaggg

SEQ ID NO: 1096269 - DNA, 22 bp, Artificial Sequence
  chemically synthesized
gtgttaggggatttgagggagg

SEQ ID NO: 1096270 - DNA, 22 bp, Artificial Sequence
  chemically synthesized
tgcttgtgttaggggatttgag

SEQ ID NO: 1096271 - DNA, 22 bp, Artificial Sequence
  chemically synthesized
ttaaaccctccctcaaatcccc

SEQ ID NO: 1096272 - DNA, 22 bp, Artificial Sequence
  chemically synthesized
gtgcttgtgttaggggatttga

SEQ ID NO: 1096273 - DNA, 22 bp, Artificial Sequence
  chemically synthesized
taaaccctccctcaaatcccct

SEQ ID NO: 1096274 - DNA, 22 bp, Artificial Sequence
  chemically synthesized
aaaccctccctcaaatccccta

SEQ ID NO: 1096275 - DNA, 22 bp, Artificial Sequence
  chemically synthesized
aaccctccctcaaatcccctaa

SEQ ID NO: 1096276 - DNA, 22 bp, Artificial Sequence
  chemically synthesized
taggatttgtgcttgtgttagg

SEQ ID NO: 1096277 - DNA, 22 bp, Artificial Sequence
  chemically synthesized
cctcaaatcccctaacacaagc

SEQ ID NO: 1096278 - DNA, 22 bp, Artificial Sequence
  chemically synthesized
aaatcccctaacacaagcacaa

SEQ ID NO: 1096279 - DNA, 22 bp, Artificial Sequence
  chemically synthesized
acacaagcacaaatcctacaat

SEQ ID NO: 1096280 - DNA, 22 bp, Artificial Sequence
  chemically synthesized
caatgttttttttttttttcat

SEQ ID NO: 1096281 - DNA, 22 bp, Artificial Sequence
  chemically synthesized
tttttttttttcatccacacgc

SEQ ID NO: 1096282 - DNA, 22 bp, Artificial Sequence
  chemically synthesized
ttttttttttcatccacacgca

SEQ ID NO: 1096283 - DNA, 22 bp, Artificial Sequence
  chemically synthesized
tttttttttcatccacacgcac

SEQ ID NO: 1096284 - DNA, 22 bp, Artificial Sequence
  chemically synthesized
ttttttttcatccacacgcacc

SEQ ID NO: 1096285 - DNA, 22 bp, Artificial Sequence
  chemically synthesized
tttttttcatccacacgcaccc

SEQ ID NO: 1096286 - DNA, 22 bp, Artificial Sequence
  chemically synthesized
ttttttcatccacacgcacccc

SEQ ID NO: 1096287 - DNA, 22 bp, Artificial Sequence
  chemically synthesized
tttttcatccacacgcaccccc

SEQ ID NO: 1096288 - DNA, 22 bp, Artificial Sequence
  chemically synthesized
ttttcatccacacgcaccccct

SEQ ID NO: 1096289 - DNA, 22 bp, Artificial Sequence
  chemically synthesized
tttcatccacacgcaccccctg

SEQ ID NO: 1096290 - DNA, 22 bp, Artificial Sequence
  chemically synthesized
ttcatccacacgcaccccctgg

SEQ ID NO: 1096291 - DNA, 22 bp, Artificial Sequence
  chemically synthesized
tcatccacacgcaccccctggc

SEQ ID NO: 1096292 - DNA, 22 bp, Artificial Sequence
  chemically synthesized
catccacacgcaccccctggcc

SEQ ID NO: 1096293 - DNA, 22 bp, Artificial Sequence
  chemically synthesized
atccacacgcaccccctggcct

SEQ ID NO: 1096294 - DNA, 22 bp, Artificial Sequence
  chemically synthesized
caatgagggagaatacacaaca

SEQ ID NO: 1096295 - DNA, 22 bp, Artificial Sequence
  chemically synthesized
gcaatgagggagaatacacaac

SEQ ID NO: 1096296 - DNA, 22 bp, Artificial Sequence
  chemically synthesized
tgcaatgagggagaatacacaa

SEQ ID NO: 1096297 - DNA, 22 bp, Artificial Sequence
  chemically synthesized
ttgcaatgagggagaatacaca

SEQ ID NO: 1096298 - DNA, 22 bp, Artificial Sequence
  chemically synthesized
tttgcaatgagggagaatacac

SEQ ID NO: 1096299 - DNA, 22 bp, Artificial Sequence
  chemically synthesized
gcctccatgttgtgtattctcc

SEQ ID NO: 1096300 - DNA, 22 bp, Artificial Sequence
  chemically synthesized
ttttttgcaatgagggagaata

SEQ ID NO: 1096301 - DNA, 22 bp, Artificial Sequence
  chemically synthesized
catgttgtgtattctccctcat

SEQ ID NO: 1096302 - DNA, 22 bp, Artificial Sequence
  chemically synthesized
attattttttgcaatgagggag

SEQ ID NO: 1096303 - DNA, 22 bp, Artificial Sequence
  chemically synthesized
ggttcattattttttgcaatga

SEQ ID NO: 1096304 - DNA, 22 bp, Artificial Sequence
  chemically synthesized
tgtattctccctcattgcaaaa

SEQ ID NO: 1096305 - DNA, 22 bp, Artificial Sequence
  chemically synthesized
tccctcattgcaaaaaataatg

SEQ ID NO: 1096306 - DNA, 22 bp, Artificial Sequence
  chemically synthesized
aacaagttgggttcattatttt

SEQ ID NO: 1096307 - DNA, 22 bp, Artificial Sequence
  chemically synthesized
cctcattgcaaaaaataatgaa

SEQ ID NO: 1096308 - DNA, 22 bp, Artificial Sequence
  chemically synthesized
attgcaaaaaataatgaaccca

SEQ ID NO: 1096309 - DNA, 22 bp, Artificial Sequence
  chemically synthesized
tagctgaacaagttgggttcat

SEQ ID NO: 1096310 - DNA, 22 bp, Artificial Sequence
  chemically synthesized
gtagctgaacaagttgggttca

SEQ ID NO: 1096311 - DNA, 22 bp, Artificial Sequence
  chemically synthesized
caaaaaataatgaacccaactt

SEQ ID NO: 1096312 - DNA, 22 bp, Artificial Sequence
  chemically synthesized
ttgtagctgaacaagttgggtt

SEQ ID NO: 1096313 - DNA, 22 bp, Artificial Sequence
  chemically synthesized
tcttgtagctgaacaagttggg

SEQ ID NO: 1096314 - DNA, 22 bp, Artificial Sequence
  chemically synthesized
gttcagctacaagagagttggt

SEQ ID NO: 1096315 - DNA, 22 bp, Artificial Sequence
  chemically synthesized
ttcagctacaagagagttggtg

SEQ ID NO: 1096316 - DNA, 22 bp, Artificial Sequence
  chemically synthesized
agctacaagagagttggtggtg

SEQ ID NO: 1096317 - DNA, 22 bp, Artificial Sequence
  chemically synthesized
ccaaccgaagaccaccaccaac

SEQ ID NO: 1096318 - DNA, 22 bp, Artificial Sequence
  chemically synthesized
caagagagttggtggtggtctt

SEQ ID NO: 1096319 - DNA, 22 bp, Artificial Sequence
  chemically synthesized
gtggtggtcttcggttgggaga

SEQ ID NO: 1096320 - DNA, 22 bp, Artificial Sequence
  chemically synthesized
aggagtgtaaatgtctcccaac

SEQ ID NO: 1096321 - DNA, 22 bp, Artificial Sequence
  chemically synthesized
aagttaaggagtgtaaatgtct

SEQ ID NO: 1096322 - DNA, 22 bp, Artificial Sequence
  chemically synthesized
gaagttaaggagtgtaaatgtc

SEQ ID NO: 1096323 - DNA, 22 bp, Artificial Sequence
  chemically synthesized
cggttgggagacatttacactc

SEQ ID NO: 1096324 - DNA, 22 bp, Artificial Sequence
  chemically synthesized
ggttgggagacatttacactcc

SEQ ID NO: 1096325 - DNA, 22 bp, Artificial Sequence
  chemically synthesized
ggagacatttacactccttaac

SEQ ID NO: 1096326 - DNA, 22 bp, Artificial Sequence
  chemically synthesized
aaatacatgtacgcatttgaag

SEQ ID NO: 1096327 - DNA, 22 bp, Artificial Sequence
  chemically synthesized
acactccttaacttcaaatgcg

SEQ ID NO: 1096328 - DNA, 22 bp, Artificial Sequence
  chemically synthesized
cactccttaacttcaaatgcgt

SEQ ID NO: 1096329 - DNA, 22 bp, Artificial Sequence
  chemically synthesized
taaaatacatgtacgcatttga

SEQ ID NO: 1096330 - DNA, 22 bp, Artificial Sequence
  chemically synthesized
ctaaaatacatgtacgcatttg

SEQ ID NO: 1096331 - DNA, 22 bp, Artificial Sequence
  chemically synthesized
cttaacttcaaatgcgtacatg

SEQ ID NO: 1096332 - DNA, 22 bp, Artificial Sequence
  chemically synthesized
aacttcaaatgcgtacatgtat

SEQ ID NO: 1096333 - DNA, 22 bp, Artificial Sequence
  chemically synthesized
acttcaaatgcgtacatgtatt

SEQ ID NO: 1096334 - DNA, 22 bp, Artificial Sequence
  chemically synthesized
caaatgcgtacatgtattttag

SEQ ID NO: 1096335 - DNA, 22 bp, Artificial Sequence
  chemically synthesized
aaatgcgtacatgtattttaga

SEQ ID NO: 1096336 - DNA, 22 bp, Artificial Sequence
  chemically synthesized
aagatacagtgtgtatgtgtgt

SEQ ID NO: 1096337 - DNA, 22 bp, Artificial Sequence
  chemically synthesized
tagaaacacacacacatacaca

SEQ ID NO: 1096338 - DNA, 22 bp, Artificial Sequence
  chemically synthesized
agaaacacacacacatacacac

SEQ ID NO: 1096339 - DNA, 22 bp, Artificial Sequence
  chemically synthesized
gaaacacacacacatacacact

SEQ ID NO: 1096340 - DNA, 22 bp, Artificial Sequence
  chemically synthesized
gaggaacacagactaaagatac

SEQ ID NO: 1096341 - DNA, 22 bp, Artificial Sequence
  chemically synthesized
acccctggaggaacacagacta

SEQ ID NO: 1096342 - DNA, 22 bp, Artificial Sequence
  chemically synthesized
gacccctggaggaacacagact

SEQ ID NO: 1096343 - DNA, 22 bp, Artificial Sequence
  chemically synthesized
tatctttagtctgtgttcctcc

SEQ ID NO: 1096344 - DNA, 22 bp, Artificial Sequence
  chemically synthesized
tagtctgtgttcctccaggggt

SEQ ID NO: 1096345 - DNA, 22 bp, Artificial Sequence
  chemically synthesized
atgtcaggtttgacccctggag

SEQ ID NO: 1096346 - DNA, 22 bp, Artificial Sequence
  chemically synthesized
agtctgtgttcctccaggggtc

SEQ ID NO: 1096347 - DNA, 22 bp, Artificial Sequence
  chemically synthesized
gtctgtgttcctccaggggtca

SEQ ID NO: 1096348 - DNA, 22 bp, Artificial Sequence
  chemically synthesized
tgttcctccaggggtcaaacct

SEQ ID NO: 1096349 - DNA, 22 bp, Artificial Sequence
  chemically synthesized
aaagctaatgtcaggtttgacc

SEQ ID NO: 1096350 - DNA, 22 bp, Artificial Sequence
  chemically synthesized
gaaagctaatgtcaggtttgac

SEQ ID NO: 1096351 - DNA, 22 bp, Artificial Sequence
  chemically synthesized
ctccaggggtcaaacctgacat

SEQ ID NO: 1096352 - DNA, 22 bp, Artificial Sequence
  chemically synthesized
tatttgaaagctaatgtcaggt

SEQ ID NO: 1096353 - DNA, 22 bp, Artificial Sequence
  chemically synthesized
atatttgaaagctaatgtcagg

SEQ ID NO: 1096354 - DNA, 22 bp, Artificial Sequence
  chemically synthesized
caggggtcaaacctgacattag

SEQ ID NO: 1096355 - DNA, 22 bp, Artificial Sequence
  chemically synthesized
cttatatttgaaagctaatgtc

SEQ ID NO: 1096356 - DNA, 22 bp, Artificial Sequence
  chemically synthesized
acattagctttcaaatataagt

SEQ ID NO: 1096357 - DNA, 22 bp, Artificial Sequence
  chemically synthesized
gctttcaaatataagtagttta

SEQ ID NO: 1096358 - DNA, 22 bp, Artificial Sequence
  chemically synthesized
catggcacacataaataaacta

SEQ ID NO: 1096359 - DNA, 22 bp, Artificial Sequence
  chemically synthesized
tcaaatataagtagtttattta

SEQ ID NO: 1096360 - DNA, 22 bp, Artificial Sequence
  chemically synthesized
acatggcacacataaataaact

SEQ ID NO: 1096361 - DNA, 22 bp, Artificial Sequence
  chemically synthesized
caaatataagtagtttatttat

SEQ ID NO: 1096362 - DNA, 22 bp, Artificial Sequence
  chemically synthesized
tacatggcacacataaataaac

SEQ ID NO: 1096363 - DNA, 22 bp, Artificial Sequence
  chemically synthesized
aaatataagtagtttatttatg

SEQ ID NO: 1096364 - DNA, 22 bp, Artificial Sequence
  chemically synthesized
ttacatggcacacataaataaa

SEQ ID NO: 1096365 - DNA, 22 bp, Artificial Sequence
  chemically synthesized
ttttacatggcacacataaata

SEQ ID NO: 1096366 - DNA, 22 bp, Artificial Sequence
  chemically synthesized
cttttacatggcacacataaat

SEQ ID NO: 1096367 - DNA, 22 bp, Artificial Sequence
  chemically synthesized
ccagaatttcttttacatggca

SEQ ID NO: 1096368 - DNA, 22 bp, Artificial Sequence
  chemically synthesized
atttatgtgtgccatgtaaaag

SEQ ID NO: 1096369 - DNA, 22 bp, Artificial Sequence
  chemically synthesized
tttatgtgtgccatgtaaaaga

SEQ ID NO: 1096370 - DNA, 22 bp, Artificial Sequence
  chemically synthesized
agctaccagaatttcttttaca

SEQ ID NO: 1096371 - DNA, 22 bp, Artificial Sequence
  chemically synthesized
atgtgtgccatgtaaaagaaat

SEQ ID NO: 1096372 - DNA, 22 bp, Artificial Sequence
  chemically synthesized
tgtgtgccatgtaaaagaaatt

SEQ ID NO: 1096373 - DNA, 22 bp, Artificial Sequence
  chemically synthesized
cccattcagctaccagaatttc

SEQ ID NO: 1096374 - DNA, 22 bp, Artificial Sequence
  chemically synthesized
aattccccattcagctaccaga

SEQ ID NO: 1096375 - DNA, 22 bp, Artificial Sequence
  chemically synthesized
tctcaattccccattcagctac

SEQ ID NO: 1096376 - DNA, 22 bp, Artificial Sequence
  chemically synthesized
gtctcaattccccattcagcta

SEQ ID NO: 1096377 - DNA, 22 bp, Artificial Sequence
  chemically synthesized
ttgtctcaattccccattcagc

SEQ ID NO: 1096378 - DNA, 22 bp, Artificial Sequence
  chemically synthesized
cttgtctcaattccccattcag

SEQ ID NO: 1096379 - DNA, 22 bp, Artificial Sequence
  chemically synthesized
tcttgtctcaattccccattca

SEQ ID NO: 1096380 - DNA, 22 bp, Artificial Sequence
  chemically synthesized
cctttcttgtctcaattcccca

SEQ ID NO: 1096381 - DNA, 22 bp, Artificial Sequence
  chemically synthesized
tggtagctgaatggggaattga

SEQ ID NO: 1096382 - DNA, 22 bp, Artificial Sequence
  chemically synthesized
ccctttcttgtctcaattcccc

SEQ ID NO: 1096383 - DNA, 22 bp, Artificial Sequence
  chemically synthesized
gtagctgaatggggaattgaga

SEQ ID NO: 1096384 - DNA, 22 bp, Artificial Sequence
  chemically synthesized
ttccctttcttgtctcaattcc

SEQ ID NO: 1096385 - DNA, 22 bp, Artificial Sequence
  chemically synthesized
aatggggaattgagacaagaaa

SEQ ID NO: 1096386 - DNA, 22 bp, Artificial Sequence
  chemically synthesized
agacaagaaagggaagagacat

SEQ ID NO: 1096387 - DNA, 22 bp, Artificial Sequence
  chemically synthesized
ataagtatgcccatatggatgt

SEQ ID NO: 1096388 - DNA, 22 bp, Artificial Sequence
  chemically synthesized
ggattaataagtatgcccatat

SEQ ID NO: 1096389 - DNA, 22 bp, Artificial Sequence
  chemically synthesized
ctgggattaataagtatgccca

SEQ ID NO: 1096390 - DNA, 22 bp, Artificial Sequence
  chemically synthesized
gctgggattaataagtatgccc

SEQ ID NO: 1096391 - DNA, 22 bp, Artificial Sequence
  chemically synthesized
acagtgtttgctgggattaata

SEQ ID NO: 1096392 - DNA, 22 bp, Artificial Sequence
  chemically synthesized
gtcattaacagtgtttgctggg

SEQ ID NO: 1096393 - DNA, 22 bp, Artificial Sequence
  chemically synthesized
tagtcattaacagtgtttgctg

SEQ ID NO: 1096394 - DNA, 22 bp, Artificial Sequence
  chemically synthesized
attaatcccagcaaacactgtt

SEQ ID NO: 1096395 - DNA, 22 bp, Artificial Sequence
  chemically synthesized
ttaatcccagcaaacactgtta

SEQ ID NO: 1096396 - DNA, 22 bp, Artificial Sequence
  chemically synthesized
aactctagtcattaacagtgtt

SEQ ID NO: 1096397 - DNA, 22 bp, Artificial Sequence
  chemically synthesized
atcccagcaaacactgttaatg

SEQ ID NO: 1096398 - DNA, 22 bp, Artificial Sequence
  chemically synthesized
acaggattaaactctagtcatt

SEQ ID NO: 1096399 - DNA, 22 bp, Artificial Sequence
  chemically synthesized
taacaggattaaactctagtca

SEQ ID NO: 1096400 - DNA, 22 bp, Artificial Sequence
  chemically synthesized
ctaacaggattaaactctagtc

SEQ ID NO: 1096401 - DNA, 22 bp, Artificial Sequence
  chemically synthesized
tctaacaggattaaactctagt

SEQ ID NO: 1096402 - DNA, 22 bp, Artificial Sequence
  chemically synthesized
ttaatgactagagtttaatcct

SEQ ID NO: 1096403 - DNA, 22 bp, Artificial Sequence
  chemically synthesized
agggctttctaacaggattaaa

SEQ ID NO: 1096404 - DNA, 22 bp, Artificial Sequence
  chemically synthesized
atgactagagtttaatcctgtt

SEQ ID NO: 1096405 - DNA, 22 bp, Artificial Sequence
  chemically synthesized
tcagggctttctaacaggatta

SEQ ID NO: 1096406 - DNA, 22 bp, Artificial Sequence
  chemically synthesized
ctcagggctttctaacaggatt

SEQ ID NO: 1096407 - DNA, 22 bp, Artificial Sequence
  chemically synthesized
gagtttaatcctgttagaaagc

SEQ ID NO: 1096408 - DNA, 22 bp, Artificial Sequence
  chemically synthesized
aatcctgttagaaagccctgag

SEQ ID NO: 1096409 - DNA, 22 bp, Artificial Sequence
  chemically synthesized
atcctgttagaaagccctgaga

SEQ ID NO: 1096410 - DNA, 22 bp, Artificial Sequence
  chemically synthesized
ttagaaagccctgagaaatata

SEQ ID NO: 1096411 - DNA, 22 bp, Artificial Sequence
  chemically synthesized
gaaagccctgagaaatatatgc

SEQ ID NO: 1096412 - DNA, 22 bp, Artificial Sequence
  chemically synthesized
aatgggataacccgcaggcata

SEQ ID NO: 1096413 - DNA, 22 bp, Artificial Sequence
  chemically synthesized
agaaatatatgcctgcgggtta

SEQ ID NO: 1096414 - DNA, 22 bp, Artificial Sequence
  chemically synthesized
acccctgaatgggataacccgc

SEQ ID NO: 1096415 - DNA, 22 bp, Artificial Sequence
  chemically synthesized
cacccctgaatgggataacccg

SEQ ID NO: 1096416 - DNA, 22 bp, Artificial Sequence
  chemically synthesized
ttcacccctgaatgggataacc

SEQ ID NO: 1096417 - DNA, 22 bp, Artificial Sequence
  chemically synthesized
cttcacccctgaatgggataac

SEQ ID NO: 1096418 - DNA, 22 bp, Artificial Sequence
  chemically synthesized
cgggttatcccattcaggggtg

SEQ ID NO: 1096419 - DNA, 22 bp, Artificial Sequence
  chemically synthesized
tcccattcaggggtgaagaaat

SEQ ID NO: 1096420 - DNA, 22 bp, Artificial Sequence
  chemically synthesized
aggggtgaagaaattggggtat

SEQ ID NO: 1096421 - DNA, 22 bp, Artificial Sequence
  chemically synthesized
gggaagatgatacagaaataat

SEQ ID NO: 1096422 - DNA, 22 bp, Artificial Sequence
  chemically synthesized
acaattagggaagatgatacag

SEQ ID NO: 1096423 - DNA, 22 bp, Artificial Sequence
  chemically synthesized
gggtattatttctgtatcatct

SEQ ID NO: 1096424 - DNA, 22 bp, Artificial Sequence
  chemically synthesized
aacaattagggaagatgataca

SEQ ID NO: 1096425 - DNA, 22 bp, Artificial Sequence
  chemically synthesized
taacaattagggaagatgatac

SEQ ID NO: 1096426 - DNA, 22 bp, Artificial Sequence
  chemically synthesized
tttctgtatcatcttccctaat

SEQ ID NO: 1096427 - DNA, 22 bp, Artificial Sequence
  chemically synthesized
ctgtatcatcttccctaattgt

SEQ ID NO: 1096428 - DNA, 22 bp, Artificial Sequence
  chemically synthesized
tgtatcatcttccctaattgtt

SEQ ID NO: 1096429 - DNA, 22 bp, Artificial Sequence
  chemically synthesized
cccaacagcctttaacaattag

SEQ ID NO: 1096430 - DNA, 22 bp, Artificial Sequence
  chemically synthesized
tatcatcttccctaattgttaa

SEQ ID NO: 1096431 - DNA, 22 bp, Artificial Sequence
  chemically synthesized
ccccaacagcctttaacaatta

SEQ ID NO: 1096432 - DNA, 22 bp, Artificial Sequence
  chemically synthesized
acatttccccaacagcctttaa

SEQ ID NO: 1096433 - DNA, 22 bp, Artificial Sequence
  chemically synthesized
ccctaattgttaaaggctgttg

SEQ ID NO: 1096434 - DNA, 22 bp, Artificial Sequence
  chemically synthesized
cctaattgttaaaggctgttgg

SEQ ID NO: 1096435 - DNA, 22 bp, Artificial Sequence
  chemically synthesized
attgttaaaggctgttggggaa

SEQ ID NO: 1096436 - DNA, 22 bp, Artificial Sequence
  chemically synthesized
ggaaattaacatttccccaaca

SEQ ID NO: 1096437 - DNA, 22 bp, Artificial Sequence
  chemically synthesized
ttaaaggctgttggggaaatgt

SEQ ID NO: 1096438 - DNA, 22 bp, Artificial Sequence
  chemically synthesized
aaggctgttggggaaatgttaa

SEQ ID NO: 1096439 - DNA, 22 bp, Artificial Sequence
  chemically synthesized
caagtactgggaaattaacatt

SEQ ID NO: 1096440 - DNA, 22 bp, Artificial Sequence
  chemically synthesized
gcaagtactgggaaattaacat

SEQ ID NO: 1096441 - DNA, 22 bp, Artificial Sequence
  chemically synthesized
ttggggaaatgttaatttccca

SEQ ID NO: 1096442 - DNA, 22 bp, Artificial Sequence
  chemically synthesized
gggaaatgttaatttcccagta

SEQ ID NO: 1096443 - DNA, 22 bp, Artificial Sequence
  chemically synthesized
tgtggtaggcttgcaagtactg

SEQ ID NO: 1096444 - DNA, 22 bp, Artificial Sequence
  chemically synthesized
gtgtggtaggcttgcaagtact

SEQ ID NO: 1096445 - DNA, 22 bp, Artificial Sequence
  chemically synthesized
atttcccagtacttgcaagcct

SEQ ID NO: 1096446 - DNA, 22 bp, Artificial Sequence
  chemically synthesized
cacttgtgtggtaggcttgcaa

SEQ ID NO: 1096447 - DNA, 22 bp, Artificial Sequence
  chemically synthesized
gcacttgtgtggtaggcttgca

SEQ ID NO: 1096448 - DNA, 22 bp, Artificial Sequence
  chemically synthesized
tgcacttgtgtggtaggcttgc

SEQ ID NO: 1096449 - DNA, 22 bp, Artificial Sequence
  chemically synthesized
ttgcacttgtgtggtaggcttg

SEQ ID NO: 1096450 - DNA, 22 bp, Artificial Sequence
  chemically synthesized
cccagtacttgcaagcctacca

SEQ ID NO: 1096451 - DNA, 22 bp, Artificial Sequence
  chemically synthesized
ccagtacttgcaagcctaccac

SEQ ID NO: 1096452 - DNA, 22 bp, Artificial Sequence
  chemically synthesized
aatcccacttttgcacttgtgt

SEQ ID NO: 1096453 - DNA, 22 bp, Artificial Sequence
  chemically synthesized
gcaagcctaccacacaagtgca

SEQ ID NO: 1096454 - DNA, 22 bp, Artificial Sequence
  chemically synthesized
caagcctaccacacaagtgcaa

SEQ ID NO: 1096455 - DNA, 22 bp, Artificial Sequence
  chemically synthesized
tggccactgaatcccacttttg

SEQ ID NO: 1096456 - DNA, 22 bp, Artificial Sequence
  chemically synthesized
ccacacaagtgcaaaagtggga

SEQ ID NO: 1096457 - DNA, 22 bp, Artificial Sequence
  chemically synthesized
tgtggccactgaatcccacttt

SEQ ID NO: 1096458 - DNA, 22 bp, Artificial Sequence
  chemically synthesized
ctgtggccactgaatcccactt

SEQ ID NO: 1096459 - DNA, 22 bp, Artificial Sequence
  chemically synthesized
tctgtggccactgaatcccact

SEQ ID NO: 1096460 - DNA, 22 bp, Artificial Sequence
  chemically synthesized
agggctttctgtggccactgaa

SEQ ID NO: 1096461 - DNA, 22 bp, Artificial Sequence
  chemically synthesized
gagggctttctgtggccactga

SEQ ID NO: 1096462 - DNA, 22 bp, Artificial Sequence
  chemically synthesized
cttgagggctttctgtggccac

SEQ ID NO: 1096463 - DNA, 22 bp, Artificial Sequence
  chemically synthesized
acttgagggctttctgtggcca

SEQ ID NO: 1096464 - DNA, 22 bp, Artificial Sequence
  chemically synthesized
tacttgagggctttctgtggcc

SEQ ID NO: 1096465 - DNA, 22 bp, Artificial Sequence
  chemically synthesized
ctttacttgagggctttctgtg

SEQ ID NO: 1096466 - DNA, 22 bp, Artificial Sequence
  chemically synthesized
agttcctttacttgagggcttt

SEQ ID NO: 1096467 - DNA, 22 bp, Artificial Sequence
  chemically synthesized
agtggccacagaaagccctcaa

SEQ ID NO: 1096468 - DNA, 22 bp, Artificial Sequence
  chemically synthesized
tagaacctgagttcctttactt

SEQ ID NO: 1096469 - DNA, 22 bp, Artificial Sequence
  chemically synthesized
cattatagaacctgagttcctt

SEQ ID NO: 1096470 - DNA, 22 bp, Artificial Sequence
  chemically synthesized
tacattatagaacctgagttcc

SEQ ID NO: 1096471 - DNA, 22 bp, Artificial Sequence
  chemically synthesized
ctacattatagaacctgagttc

SEQ ID NO: 1096472 - DNA, 22 bp, Artificial Sequence
  chemically synthesized
aagtaaaggaactcaggttcta

SEQ ID NO: 1096473 - DNA, 22 bp, Artificial Sequence
  chemically synthesized
tatgcaggcccaacttctacat

SEQ ID NO: 1096474 - DNA, 22 bp, Artificial Sequence
  chemically synthesized
aggttctataatgtagaagttg

SEQ ID NO: 1096475 - DNA, 22 bp, Artificial Sequence
  chemically synthesized
tataatgtagaagttgggcctg

SEQ ID NO: 1096476 - DNA, 22 bp, Artificial Sequence
  chemically synthesized
taatgtagaagttgggcctgca

SEQ ID NO: 1096477 - DNA, 22 bp, Artificial Sequence
  chemically synthesized
accaccgcattgtatgcaggcc

SEQ ID NO: 1096478 - DNA, 22 bp, Artificial Sequence
  chemically synthesized
aaccaccgcattgtatgcaggc

SEQ ID NO: 1096479 - DNA, 22 bp, Artificial Sequence
  chemically synthesized
ccttaaccaccgcattgtatgc

SEQ ID NO: 1096480 - DNA, 22 bp, Artificial Sequence
  chemically synthesized
accttaaccaccgcattgtatg

SEQ ID NO: 1096481 - DNA, 22 bp, Artificial Sequence
  chemically synthesized
ggcctgcatacaatgcggtggt

SEQ ID NO: 1096482 - DNA, 22 bp, Artificial Sequence
  chemically synthesized
catacaatgcggtggttaaggt

SEQ ID NO: 1096483 - DNA, 22 bp, Artificial Sequence
  chemically synthesized
ccaataagcccttaccttaacc

SEQ ID NO: 1096484 - DNA, 22 bp, Artificial Sequence
  chemically synthesized
tccatatcctgccaataagccc

SEQ ID NO: 1096485 - DNA, 22 bp, Artificial Sequence
  chemically synthesized
atccatatcctgccaataagcc

SEQ ID NO: 1096486 - DNA, 22 bp, Artificial Sequence
  chemically synthesized
aggtaagggcttattggcagga

SEQ ID NO: 1096487 - DNA, 22 bp, Artificial Sequence
  chemically synthesized
accttatccatatcctgccaat

SEQ ID NO: 1096488 - DNA, 22 bp, Artificial Sequence
  chemically synthesized
tagctgaccttatccatatcct

SEQ ID NO: 1096489 - DNA, 22 bp, Artificial Sequence
  chemically synthesized
atagctgaccttatccatatcc

SEQ ID NO: 1096490 - DNA, 22 bp, Artificial Sequence
  chemically synthesized
tatagctgaccttatccatatc

SEQ ID NO: 1096491 - DNA, 22 bp, Artificial Sequence
  chemically synthesized
attggcaggatatggataaggt

SEQ ID NO: 1096492 - DNA, 22 bp, Artificial Sequence
  chemically synthesized
ttggcaggatatggataaggtc

SEQ ID NO: 1096493 - DNA, 22 bp, Artificial Sequence
  chemically synthesized
gcaggatatggataaggtcagc

SEQ ID NO: 1096494 - DNA, 22 bp, Artificial Sequence
  chemically synthesized
acacatacaaaggcattttata

SEQ ID NO: 1096495 - DNA, 22 bp, Artificial Sequence
  chemically synthesized
tgctgacacatacaaaggcatt

SEQ ID NO: 1096496 - DNA, 22 bp, Artificial Sequence
  chemically synthesized
taaaatgcctttgtatgtgtca

SEQ ID NO: 1096497 - DNA, 22 bp, Artificial Sequence
  chemically synthesized
tgtatgtgtcagcataatcacc

SEQ ID NO: 1096498 - DNA, 22 bp, Artificial Sequence
  chemically synthesized
gtatgtgtcagcataatcaccc

SEQ ID NO: 1096499 - DNA, 22 bp, Artificial Sequence
  chemically synthesized
tatgtgtcagcataatcaccct

SEQ ID NO: 1096500 - DNA, 22 bp, Artificial Sequence
  chemically synthesized
aatccaaaggagtagggtgatt

SEQ ID NO: 1096501 - DNA, 22 bp, Artificial Sequence
  chemically synthesized
tgggactaaatccaaaggagta

SEQ ID NO: 1096502 - DNA, 22 bp, Artificial Sequence
  chemically synthesized
aggaattgtgggactaaatcca

SEQ ID NO: 1096503 - DNA, 22 bp, Artificial Sequence
  chemically synthesized
aaggaattgtgggactaaatcc

SEQ ID NO: 1096504 - DNA, 22 bp, Artificial Sequence
  chemically synthesized
taaggaattgtgggactaaatc

SEQ ID NO: 1096505 - DNA, 22 bp, Artificial Sequence
  chemically synthesized
ttaaggaattgtgggactaaat

SEQ ID NO: 1096506 - DNA, 22 bp, Artificial Sequence
  chemically synthesized
ctcctttggatttagtcccaca

SEQ ID NO: 1096507 - DNA, 22 bp, Artificial Sequence
  chemically synthesized
ctttggatttagtcccacaatt

SEQ ID NO: 1096508 - DNA, 22 bp, Artificial Sequence
  chemically synthesized
tggatttagtcccacaattcct

SEQ ID NO: 1096509 - DNA, 22 bp, Artificial Sequence
  chemically synthesized
ggatttagtcccacaattcctt

SEQ ID NO: 1096510 - DNA, 22 bp, Artificial Sequence
  chemically synthesized
gatttagtcccacaattcctta

SEQ ID NO: 1096511 - DNA, 22 bp, Artificial Sequence
  chemically synthesized
acataatgcatacttttaagga

SEQ ID NO: 1096512 - DNA, 22 bp, Artificial Sequence
  chemically synthesized
agtcccacaattccttaaaagt

SEQ ID NO: 1096513 - DNA, 22 bp, Artificial Sequence
  chemically synthesized
gtcccacaattccttaaaagta

SEQ ID NO: 1096514 - DNA, 22 bp, Artificial Sequence
  chemically synthesized
tgacataatgcatacttttaag

SEQ ID NO: 1096515 - DNA, 22 bp, Artificial Sequence
  chemically synthesized
ctgacataatgcatacttttaa

SEQ ID NO: 1096516 - DNA, 22 bp, Artificial Sequence
  chemically synthesized
tctgacataatgcatactttta

SEQ ID NO: 1096517 - DNA, 22 bp, Artificial Sequence
  chemically synthesized
cattttctgacataatgcatac

SEQ ID NO: 1096518 - DNA, 22 bp, Artificial Sequence
  chemically synthesized
gcattttctgacataatgcata

SEQ ID NO: 1096519 - DNA, 22 bp, Artificial Sequence
  chemically synthesized
cttaaaagtatgcattatgtca

SEQ ID NO: 1096520 - DNA, 22 bp, Artificial Sequence
  chemically synthesized
aaaagtatgcattatgtcagaa

SEQ ID NO: 1096521 - DNA, 22 bp, Artificial Sequence
  chemically synthesized
aaagtatgcattatgtcagaaa

SEQ ID NO: 1096522 - DNA, 22 bp, Artificial Sequence
  chemically synthesized
tagacaaaacaatttgcatttt

SEQ ID NO: 1096523 - DNA, 22 bp, Artificial Sequence
  chemically synthesized
tatagacaaaacaatttgcatt

SEQ ID NO: 1096524 - DNA, 22 bp, Artificial Sequence
  chemically synthesized
tgtcagaaaatgcaaattgttt

SEQ ID NO: 1096525 - DNA, 22 bp, Artificial Sequence
  chemically synthesized
agcattctatagacaaaacaat

SEQ ID NO: 1096526 - DNA, 22 bp, Artificial Sequence
  chemically synthesized
aaatcggtgaagttaagcattc

SEQ ID NO: 1096527 - DNA, 22 bp, Artificial Sequence
  chemically synthesized
ttttgtctatagaatgcttaac

SEQ ID NO: 1096528 - DNA, 22 bp, Artificial Sequence
  chemically synthesized
tgtctatagaatgcttaacttc

SEQ ID NO: 1096529 - DNA, 22 bp, Artificial Sequence
  chemically synthesized
gtctatagaatgcttaacttca

SEQ ID NO: 1096530 - DNA, 22 bp, Artificial Sequence
  chemically synthesized
tctatagaatgcttaacttcac

SEQ ID NO: 1096531 - DNA, 22 bp, Artificial Sequence
  chemically synthesized
aatcaattaaaatcggtgaagt

SEQ ID NO: 1096532 - DNA, 22 bp, Artificial Sequence
  chemically synthesized
tagaatgcttaacttcaccgat

SEQ ID NO: 1096533 - DNA, 22 bp, Artificial Sequence
  chemically synthesized
caatcaattaaaatcggtgaag

SEQ ID NO: 1096534 - DNA, 22 bp, Artificial Sequence
  chemically synthesized
aagatttcaatcaattaaaatc

SEQ ID NO: 1096535 - DNA, 22 bp, Artificial Sequence
  chemically synthesized
aacttcaccgattttaattgat

SEQ ID NO: 1096536 - DNA, 22 bp, Artificial Sequence
  chemically synthesized
acttcaccgattttaattgatt

SEQ ID NO: 1096537 - DNA, 22 bp, Artificial Sequence
  chemically synthesized
aactaaagatttcaatcaatta

SEQ ID NO: 1096538 - DNA, 22 bp, Artificial Sequence
  chemically synthesized
caccgattttaattgattgaaa

SEQ ID NO: 1096539 - DNA, 22 bp, Artificial Sequence
  chemically synthesized
accgattttaattgattgaaat

SEQ ID NO: 1096540 - DNA, 22 bp, Artificial Sequence
  chemically synthesized
gaatattgaactaaagatttca

SEQ ID NO: 1096541 - DNA, 22 bp, Artificial Sequence
  chemically synthesized
agaatattgaactaaagatttc

SEQ ID NO: 1096542 - DNA, 22 bp, Artificial Sequence
  chemically synthesized
taattgattgaaatctttagtt

SEQ ID NO: 1096543 - DNA, 22 bp, Artificial Sequence
  chemically synthesized
tttagaatattgaactaaagat

SEQ ID NO: 1096544 - DNA, 22 bp, Artificial Sequence
  chemically synthesized
aattgattgaaatctttagttc

SEQ ID NO: 1096545 - DNA, 22 bp, Artificial Sequence
  chemically synthesized
atttagaatattgaactaaaga

SEQ ID NO: 1096546 - DNA, 22 bp, Artificial Sequence
  chemically synthesized
attgattgaaatctttagttca

SEQ ID NO: 1096547 - DNA, 22 bp, Artificial Sequence
  chemically synthesized
atttatttagaatattgaacta

SEQ ID NO: 1096548 - DNA, 22 bp, Artificial Sequence
  chemically synthesized
attgaaatctttagttcaatat

SEQ ID NO: 1096549 - DNA, 22 bp, Artificial Sequence
  chemically synthesized
aaatctttagttcaatattcta

SEQ ID NO: 1096550 - DNA, 22 bp, Artificial Sequence
  chemically synthesized
tagttcaatattctaaataaat

SEQ ID NO: 1096551 - DNA, 22 bp, Artificial Sequence
  chemically synthesized
agttcaatattctaaataaatc

SEQ ID NO: 1096552 - DNA, 22 bp, Artificial Sequence
  chemically synthesized
gttcaatattctaaataaatca

SEQ ID NO: 1096553 - DNA, 22 bp, Artificial Sequence
  chemically synthesized
aatattctaaataaatcagctt

SEQ ID NO: 1096554 - DNA, 22 bp, Artificial Sequence
  chemically synthesized
agtgatgccaaaaagctgattt

SEQ ID NO: 1096555 - DNA, 22 bp, Artificial Sequence
  chemically synthesized
tgctcagtgatgccaaaaagct

SEQ ID NO: 1096556 - DNA, 22 bp, Artificial Sequence
  chemically synthesized
taaataaatcagctttttggca

SEQ ID NO: 1096557 - DNA, 22 bp, Artificial Sequence
  chemically synthesized
tatgctcagtgatgccaaaaag

SEQ ID NO: 1096558 - DNA, 22 bp, Artificial Sequence
  chemically synthesized
aataaatcagctttttggcatc

SEQ ID NO: 1096559 - DNA, 22 bp, Artificial Sequence
  chemically synthesized
tttggcatcactgagcatagag

SEQ ID NO: 1096560 - DNA, 22 bp, Artificial Sequence
  chemically synthesized
tgtaaaaacaatctctatgctc

SEQ ID NO: 1096561 - DNA, 22 bp, Artificial Sequence
  chemically synthesized
ttggcatcactgagcatagaga

SEQ ID NO: 1096562 - DNA, 22 bp, Artificial Sequence
  chemically synthesized
gtgtaaaaacaatctctatgct

SEQ ID NO: 1096563 - DNA, 22 bp, Artificial Sequence
  chemically synthesized
tggcatcactgagcatagagat

SEQ ID NO: 1096564 - DNA, 22 bp, Artificial Sequence
  chemically synthesized
ggcatcactgagcatagagatt

SEQ ID NO: 1096565 - DNA, 22 bp, Artificial Sequence
  chemically synthesized
gcatcactgagcatagagattg

SEQ ID NO: 1096566 - DNA, 22 bp, Artificial Sequence
  chemically synthesized
agcatagagattgtttttacac

SEQ ID NO: 1096567 - DNA, 22 bp, Artificial Sequence
  chemically synthesized
aagtcaaaatgcaatttgtgta

SEQ ID NO: 1096568 - DNA, 22 bp, Artificial Sequence
  chemically synthesized
ctaaagtcaaaatgcaatttgt

SEQ ID NO: 1096569 - DNA, 22 bp, Artificial Sequence
  chemically synthesized
tttttacacaaattgcattttg

SEQ ID NO: 1096570 - DNA, 22 bp, Artificial Sequence
  chemically synthesized
taattactaaagtcaaaatgca

SEQ ID NO: 1096571 - DNA, 22 bp, Artificial Sequence
  chemically synthesized
ttacacaaattgcattttgact

SEQ ID NO: 1096572 - DNA, 22 bp, Artificial Sequence
  chemically synthesized
tacacaaattgcattttgactt

SEQ ID NO: 1096573 - DNA, 22 bp, Artificial Sequence
  chemically synthesized
acacaaattgcattttgacttt

SEQ ID NO: 1096574 - DNA, 22 bp, Artificial Sequence
  chemically synthesized
cacaaattgcattttgacttta

SEQ ID NO: 1096575 - DNA, 22 bp, Artificial Sequence
  chemically synthesized
tactataattactaaagtcaaa

SEQ ID NO: 1096576 - DNA, 22 bp, Artificial Sequence
  chemically synthesized
attatactataattactaaagt

SEQ ID NO: 1096577 - DNA, 22 bp, Artificial Sequence
  chemically synthesized
ttgattatactataattactaa

SEQ ID NO: 1096578 - DNA, 22 bp, Artificial Sequence
  chemically synthesized
gttgattatactataattacta

SEQ ID NO: 1096579 - DNA, 22 bp, Artificial Sequence
  chemically synthesized
cattttgactttagtaattata

SEQ ID NO: 1096580 - DNA, 22 bp, Artificial Sequence
  chemically synthesized
tgactttagtaattatagtata

SEQ ID NO: 1096581 - DNA, 22 bp, Artificial Sequence
  chemically synthesized
gactttagtaattatagtataa

SEQ ID NO: 1096582 - DNA, 22 bp, Artificial Sequence
  chemically synthesized
actttagtaattatagtataat

SEQ ID NO: 1096583 - DNA, 22 bp, Artificial Sequence
  chemically synthesized
tagtaattatagtataatcaac

SEQ ID NO: 1096584 - DNA, 22 bp, Artificial Sequence
  chemically synthesized
agtaattatagtataatcaaca

SEQ ID NO: 1096585 - DNA, 22 bp, Artificial Sequence
  chemically synthesized
gtaattatagtataatcaacaa

SEQ ID NO: 1096586 - DNA, 22 bp, Artificial Sequence
  chemically synthesized
tagtataatcaacaagtttgat

SEQ ID NO: 1096587 - DNA, 22 bp, Artificial Sequence
  chemically synthesized
aatgatgaatggtaatcaaact

SEQ ID NO: 1096588 - DNA, 22 bp, Artificial Sequence
  chemically synthesized
gattaccattcatcatttaata

SEQ ID NO: 1096589 - DNA, 22 bp, Artificial Sequence
  chemically synthesized
attaccattcatcatttaatat

SEQ ID NO: 1096590 - DNA, 22 bp, Artificial Sequence
  chemically synthesized
ccattcatcatttaatatgtgc

SEQ ID NO: 1096591 - DNA, 22 bp, Artificial Sequence
  chemically synthesized
gcacagaacacagtagcacata

SEQ ID NO: 1096592 - DNA, 22 bp, Artificial Sequence
  chemically synthesized
atcatttaatatgtgctactgt

SEQ ID NO: 1096593 - DNA, 22 bp, Artificial Sequence
  chemically synthesized
aatatgtgctactgtgttctgt

SEQ ID NO: 1096594 - DNA, 22 bp, Artificial Sequence
  chemically synthesized
atatgtgctactgtgttctgtg

SEQ ID NO: 1096595 - DNA, 22 bp, Artificial Sequence
  chemically synthesized
tgacatggctggcacagaacac

SEQ ID NO: 1096596 - DNA, 22 bp, Artificial Sequence
  chemically synthesized
atgacatggctggcacagaaca

SEQ ID NO: 1096597 - DNA, 22 bp, Artificial Sequence
  chemically synthesized
ctgtgttctgtgccagccatgt

SEQ ID NO: 1096598 - DNA, 22 bp, Artificial Sequence
  chemically synthesized
tgttctgtgccagccatgtcat

SEQ ID NO: 1096599 - DNA, 22 bp, Artificial Sequence
  chemically synthesized
atgaggtagcacttatgacatg

SEQ ID NO: 1096600 - DNA, 22 bp, Artificial Sequence
  chemically synthesized
tgtgccagccatgtcataagtg

SEQ ID NO: 1096601 - DNA, 22 bp, Artificial Sequence
  chemically synthesized
tgccagccatgtcataagtgct

SEQ ID NO: 1096602 - DNA, 22 bp, Artificial Sequence
  chemically synthesized
ggtaaagatctaatgaggtagc

SEQ ID NO: 1096603 - DNA, 22 bp, Artificial Sequence
  chemically synthesized
gggtaaagatctaatgaggtag

SEQ ID NO: 1096604 - DNA, 22 bp, Artificial Sequence
  chemically synthesized
cctcattagatctttacccaaa

SEQ ID NO: 1096605 - DNA, 22 bp, Artificial Sequence
  chemically synthesized
attagatctttacccaaacctt

SEQ ID NO: 1096606 - DNA, 22 bp, Artificial Sequence
  chemically synthesized
gatctttacccaaaccttctcg

SEQ ID NO: 1096607 - DNA, 22 bp, Artificial Sequence
  chemically synthesized
tacccaaaccttctcggatgtg

SEQ ID NO: 1096608 - DNA, 22 bp, Artificial Sequence
  chemically synthesized
acccaaaccttctcggatgtgt

SEQ ID NO: 1096609 - DNA, 22 bp, Artificial Sequence
  chemically synthesized
cccaaaccttctcggatgtgtt

SEQ ID NO: 1096610 - DNA, 22 bp, Artificial Sequence
  chemically synthesized
ctcggatgtgttttgttacctc

SEQ ID NO: 1096611 - DNA, 22 bp, Artificial Sequence
  chemically synthesized
atgtccaatatagaggtaacaa

SEQ ID NO: 1096612 - DNA, 22 bp, Artificial Sequence
  chemically synthesized
tcggatgtgttttgttacctct

SEQ ID NO: 1096613 - DNA, 22 bp, Artificial Sequence
  chemically synthesized
taatgtccaatatagaggtaac

SEQ ID NO: 1096614 - DNA, 22 bp, Artificial Sequence
  chemically synthesized
ggatgtgttttgttacctctat

SEQ ID NO: 1096615 - DNA, 22 bp, Artificial Sequence
  chemically synthesized
ctaatgtccaatatagaggtaa

SEQ ID NO: 1096616 - DNA, 22 bp, Artificial Sequence
  chemically synthesized
tctaatgtccaatatagaggta

SEQ ID NO: 1096617 - DNA, 22 bp, Artificial Sequence
  chemically synthesized
agttttctaatgtccaatatag

SEQ ID NO: 1096618 - DNA, 22 bp, Artificial Sequence
  chemically synthesized
tgttacctctatattggacatt

SEQ ID NO: 1096619 - DNA, 22 bp, Artificial Sequence
  chemically synthesized
gttacctctatattggacatta

SEQ ID NO: 1096620 - DNA, 22 bp, Artificial Sequence
  chemically synthesized
ttacctctatattggacattag

SEQ ID NO: 1096621 - DNA, 22 bp, Artificial Sequence
  chemically synthesized
aacctcagttttctaatgtcca

SEQ ID NO: 1096622 - DNA, 22 bp, Artificial Sequence
  chemically synthesized
tgaacctcagttttctaatgtc

SEQ ID NO: 1096623 - DNA, 22 bp, Artificial Sequence
  chemically synthesized
cctctatattggacattagaaa

SEQ ID NO: 1096624 - DNA, 22 bp, Artificial Sequence
  chemically synthesized
tctgaacctcagttttctaatg

SEQ ID NO: 1096625 - DNA, 22 bp, Artificial Sequence
  chemically synthesized
tatattggacattagaaaactg

SEQ ID NO: 1096626 - DNA, 22 bp, Artificial Sequence
  chemically synthesized
tattggacattagaaaactgag

SEQ ID NO: 1096627 - DNA, 22 bp, Artificial Sequence
  chemically synthesized
aactctctgaacctcagttttc

SEQ ID NO: 1096628 - DNA, 22 bp, Artificial Sequence
  chemically synthesized
aaactctctgaacctcagtttt

SEQ ID NO: 1096629 - DNA, 22 bp, Artificial Sequence
  chemically synthesized
cttaaactctctgaacctcagt

SEQ ID NO: 1096630 - DNA, 22 bp, Artificial Sequence
  chemically synthesized
gacattagaaaactgaggttca

SEQ ID NO: 1096631 - DNA, 22 bp, Artificial Sequence
  chemically synthesized
ccttaaactctctgaacctcag

SEQ ID NO: 1096632 - DNA, 22 bp, Artificial Sequence
  chemically synthesized
gaaaactgaggttcagagagtt

SEQ ID NO: 1096633 - DNA, 22 bp, Artificial Sequence
  chemically synthesized
aggatgatttccttaaactctc

SEQ ID NO: 1096634 - DNA, 22 bp, Artificial Sequence
  chemically synthesized
tgaggatgatttccttaaactc

SEQ ID NO: 1096635 - DNA, 22 bp, Artificial Sequence
  chemically synthesized
aggttcagagagtttaaggaaa

SEQ ID NO: 1096636 - DNA, 22 bp, Artificial Sequence
  chemically synthesized
agagagtttaaggaaatcatcc

SEQ ID NO: 1096637 - DNA, 22 bp, Artificial Sequence
  chemically synthesized
aaggaaatcatcctcagagtta

SEQ ID NO: 1096638 - DNA, 22 bp, Artificial Sequence
  chemically synthesized
aggaaatcatcctcagagttat

SEQ ID NO: 1096639 - DNA, 22 bp, Artificial Sequence
  chemically synthesized
tgagaaagagaggatataactc

SEQ ID NO: 1096640 - DNA, 22 bp, Artificial Sequence
  chemically synthesized
acagaaactatgagaaagagag

SEQ ID NO: 1096641 - DNA, 22 bp, Artificial Sequence
  chemically synthesized
agagttatatcctctctttctc

SEQ ID NO: 1096642 - DNA, 22 bp, Artificial Sequence
  chemically synthesized
aacagaaactatgagaaagaga

SEQ ID NO: 1096643 - DNA, 22 bp, Artificial Sequence
  chemically synthesized
tatcctctctttctcatagttt

SEQ ID NO: 1096644 - DNA, 22 bp, Artificial Sequence
  chemically synthesized
agacccgcttaacagaaactat

SEQ ID NO: 1096645 - DNA, 22 bp, Artificial Sequence
  chemically synthesized
gagacccgcttaacagaaacta

SEQ ID NO: 1096646 - DNA, 22 bp, Artificial Sequence
  chemically synthesized
tctttctcatagtttctgttaa

SEQ ID NO: 1096647 - DNA, 22 bp, Artificial Sequence
  chemically synthesized
tttctcatagtttctgttaagc

SEQ ID NO: 1096648 - DNA, 22 bp, Artificial Sequence
  chemically synthesized
tctcatagtttctgttaagcgg

SEQ ID NO: 1096649 - DNA, 22 bp, Artificial Sequence
  chemically synthesized
ctcatagtttctgttaagcggg

SEQ ID NO: 1096650 - DNA, 22 bp, Artificial Sequence
  chemically synthesized
tcatagtttctgttaagcgggt

SEQ ID NO: 1096651 - DNA, 22 bp, Artificial Sequence
  chemically synthesized
atagtttctgttaagcgggtct

SEQ ID NO: 1096652 - DNA, 22 bp, Artificial Sequence
  chemically synthesized
atggaacatttgagacccgctt

SEQ ID NO: 1096653 - DNA, 22 bp, Artificial Sequence
  chemically synthesized
agctcatggaacatttgagacc

SEQ ID NO: 1096654 - DNA, 22 bp, Artificial Sequence
  chemically synthesized
cagctcatggaacatttgagac

SEQ ID NO: 1096655 - DNA, 22 bp, Artificial Sequence
  chemically synthesized
ctgttaagcgggtctcaaatgt

SEQ ID NO: 1096656 - DNA, 22 bp, Artificial Sequence
  chemically synthesized
tgttaagcgggtctcaaatgtt

SEQ ID NO: 1096657 - DNA, 22 bp, Artificial Sequence
  chemically synthesized
ttcagctcatggaacatttgag

SEQ ID NO: 1096658 - DNA, 22 bp, Artificial Sequence
  chemically synthesized
cttcagctcatggaacatttga

SEQ ID NO: 1096659 - DNA, 22 bp, Artificial Sequence
  chemically synthesized
ttaagcgggtctcaaatgttcc

SEQ ID NO: 1096660 - DNA, 22 bp, Artificial Sequence
  chemically synthesized
cttcttcagctcatggaacatt

SEQ ID NO: 1096661 - DNA, 22 bp, Artificial Sequence
  chemically synthesized
agcgggtctcaaatgttccatg

SEQ ID NO: 1096662 - DNA, 22 bp, Artificial Sequence
  chemically synthesized
cagcatgctccttcttcagctc

SEQ ID NO: 1096663 - DNA, 22 bp, Artificial Sequence
  chemically synthesized
aaatgttccatgagctgaagaa

SEQ ID NO: 1096664 - DNA, 22 bp, Artificial Sequence
  chemically synthesized
actacagcatgctccttcttca

SEQ ID NO: 1096665 - DNA, 22 bp, Artificial Sequence
  chemically synthesized
catgagctgaagaaggagcatg

SEQ ID NO: 1096666 - DNA, 22 bp, Artificial Sequence
  chemically synthesized
gactgactacagcatgctcctt

SEQ ID NO: 1096667 - DNA, 22 bp, Artificial Sequence
  chemically synthesized
attagactgactacagcatgct

SEQ ID NO: 1096668 - DNA, 22 bp, Artificial Sequence
  chemically synthesized
ttcattagactgactacagcat

SEQ ID NO: 1096669 - DNA, 22 bp, Artificial Sequence
  chemically synthesized
attcattagactgactacagca

SEQ ID NO: 1096670 - DNA, 22 bp, Artificial Sequence
  chemically synthesized
aagaaggagcatgctgtagtca

SEQ ID NO: 1096671 - DNA, 22 bp, Artificial Sequence
  chemically synthesized
tattcattagactgactacagc

SEQ ID NO: 1096672 - DNA, 22 bp, Artificial Sequence
  chemically synthesized
taattttattcattagactgac

SEQ ID NO: 1096673 - DNA, 22 bp, Artificial Sequence
  chemically synthesized
tagtcagtctaatgaataaaat

SEQ ID NO: 1096674 - DNA, 22 bp, Artificial Sequence
  chemically synthesized
taatgagcataaattgtaattt

SEQ ID NO: 1096675 - DNA, 22 bp, Artificial Sequence
  chemically synthesized
ataatgagcataaattgtaatt

SEQ ID NO: 1096676 - DNA, 22 bp, Artificial Sequence
  chemically synthesized
tttataatgagcataaattgta

SEQ ID NO: 1096677 - DNA, 22 bp, Artificial Sequence
  chemically synthesized
atgaataaaattacaatttatg

SEQ ID NO: 1096678 - DNA, 22 bp, Artificial Sequence
  chemically synthesized
ggttatttataatgagcataaa

SEQ ID NO: 1096679 - DNA, 22 bp, Artificial Sequence
  chemically synthesized
gggttatttataatgagcataa

SEQ ID NO: 1096680 - DNA, 22 bp, Artificial Sequence
  chemically synthesized
cttgggttatttataatgagca

SEQ ID NO: 1096681 - DNA, 22 bp, Artificial Sequence
  chemically synthesized
caatttatgctcattataaata

SEQ ID NO: 1096682 - DNA, 22 bp, Artificial Sequence
  chemically synthesized
tatagttgcttgggttatttat

SEQ ID NO: 1096683 - DNA, 22 bp, Artificial Sequence
  chemically synthesized
atatagttgcttgggttattta

SEQ ID NO: 1096684 - DNA, 22 bp, Artificial Sequence
  chemically synthesized
tatatagttgcttgggttattt

SEQ ID NO: 1096685 - DNA, 22 bp, Artificial Sequence
  chemically synthesized
atgctcattataaataacccaa

SEQ ID NO: 1096686 - DNA, 22 bp, Artificial Sequence
  chemically synthesized
ttatatagttgcttgggttatt

SEQ ID NO: 1096687 - DNA, 22 bp, Artificial Sequence
  chemically synthesized
tgctcattataaataacccaag

SEQ ID NO: 1096688 - DNA, 22 bp, Artificial Sequence
  chemically synthesized
catttttatatagttgcttggg

SEQ ID NO: 1096689 - DNA, 22 bp, Artificial Sequence
  chemically synthesized
attataaataacccaagcaact

SEQ ID NO: 1096690 - DNA, 22 bp, Artificial Sequence
  chemically synthesized
tacatttttatatagttgcttg

SEQ ID NO: 1096691 - DNA, 22 bp, Artificial Sequence
  chemically synthesized
taaataacccaagcaactatat

SEQ ID NO: 1096692 - DNA, 22 bp, Artificial Sequence
  chemically synthesized
attctacatttttatatagttg

SEQ ID NO: 1096693 - DNA, 22 bp, Artificial Sequence
  chemically synthesized
cattctacatttttatatagtt

SEQ ID NO: 1096694 - DNA, 22 bp, Artificial Sequence
  chemically synthesized
ttcattctacatttttatatag

SEQ ID NO: 1096695 - DNA, 22 bp, Artificial Sequence
  chemically synthesized
tataaaaatgtagaatgaagaa

SEQ ID NO: 1096696 - DNA, 22 bp, Artificial Sequence
  chemically synthesized
aaaaccatggaaagaagtgttc

SEQ ID NO: 1096697 - DNA, 22 bp, Artificial Sequence
  chemically synthesized
ctttccatggtttttagacttc

SEQ ID NO: 1096698 - DNA, 22 bp, Artificial Sequence
  chemically synthesized
tttccatggtttttagacttca

SEQ ID NO: 1096699 - DNA, 22 bp, Artificial Sequence
  chemically synthesized
aaccaagaatatatgaagtcta

SEQ ID NO: 1096700 - DNA, 22 bp, Artificial Sequence
  chemically synthesized
tccatggtttttagacttcata

SEQ ID NO: 1096701 - DNA, 22 bp, Artificial Sequence
  chemically synthesized
ccatggtttttagacttcatat

SEQ ID NO: 1096702 - DNA, 22 bp, Artificial Sequence
  chemically synthesized
catggtttttagacttcatata

SEQ ID NO: 1096703 - DNA, 22 bp, Artificial Sequence
  chemically synthesized
ttaaaccaagaatatatgaagt

SEQ ID NO: 1096704 - DNA, 22 bp, Artificial Sequence
  chemically synthesized
attaaaccaagaatatatgaag

SEQ ID NO: 1096705 - DNA, 22 bp, Artificial Sequence
  chemically synthesized
ttattaaaccaagaatatatga

SEQ ID NO: 1096706 - DNA, 22 bp, Artificial Sequence
  chemically synthesized
ttagacttcatatattcttggt

SEQ ID NO: 1096707 - DNA, 22 bp, Artificial Sequence
  chemically synthesized
tagacttcatatattcttggtt

SEQ ID NO: 1096708 - DNA, 22 bp, Artificial Sequence
  chemically synthesized
agcctcttattaaaccaagaat

SEQ ID NO: 1096709 - DNA, 22 bp, Artificial Sequence
  chemically synthesized
agacttcatatattcttggttt

SEQ ID NO: 1096710 - DNA, 22 bp, Artificial Sequence
  chemically synthesized
gacttcatatattcttggttta

SEQ ID NO: 1096711 - DNA, 22 bp, Artificial Sequence
  chemically synthesized
catatattcttggtttaataag

SEQ ID NO: 1096712 - DNA, 22 bp, Artificial Sequence
  chemically synthesized
atatattcttggtttaataaga

SEQ ID NO: 1096713 - DNA, 22 bp, Artificial Sequence
  chemically synthesized
ccaagatctgagcctcttatta

SEQ ID NO: 1096714 - DNA, 22 bp, Artificial Sequence
  chemically synthesized
cccaagatctgagcctcttatt

SEQ ID NO: 1096715 - DNA, 22 bp, Artificial Sequence
  chemically synthesized
tcccaagatctgagcctcttat

SEQ ID NO: 1096716 - DNA, 22 bp, Artificial Sequence
  chemically synthesized
ttggtttaataagaggctcaga

SEQ ID NO: 1096717 - DNA, 22 bp, Artificial Sequence
  chemically synthesized
ggtttaataagaggctcagatc

SEQ ID NO: 1096718 - DNA, 22 bp, Artificial Sequence
  chemically synthesized
gtttaataagaggctcagatct

SEQ ID NO: 1096719 - DNA, 22 bp, Artificial Sequence
  chemically synthesized
gaacctttcccaagatctgagc

SEQ ID NO: 1096720 - DNA, 22 bp, Artificial Sequence
  chemically synthesized
cgaacctttcccaagatctgag

SEQ ID NO: 1096721 - DNA, 22 bp, Artificial Sequence
  chemically synthesized
ttcgaacctttcccaagatctg

SEQ ID NO: 1096722 - DNA, 22 bp, Artificial Sequence
  chemically synthesized
aataagaggctcagatcttggg

SEQ ID NO: 1096723 - DNA, 22 bp, Artificial Sequence
  chemically synthesized
ataagaggctcagatcttggga

SEQ ID NO: 1096724 - DNA, 22 bp, Artificial Sequence
  chemically synthesized
ttcttcgaacctttcccaagat

SEQ ID NO: 1096725 - DNA, 22 bp, Artificial Sequence
  chemically synthesized
gttcttcgaacctttcccaaga

SEQ ID NO: 1096726 - DNA, 22 bp, Artificial Sequence
  chemically synthesized
tttgttcttcgaacctttccca

SEQ ID NO: 1096727 - DNA, 22 bp, Artificial Sequence
  chemically synthesized
ctgtttgttcttcgaacctttc

SEQ ID NO: 1096728 - DNA, 22 bp, Artificial Sequence
  chemically synthesized
gctgtttgttcttcgaaccttt

SEQ ID NO: 1096729 - DNA, 22 bp, Artificial Sequence
  chemically synthesized
tgctgtttgttcttcgaacctt

SEQ ID NO: 1096730 - DNA, 22 bp, Artificial Sequence
  chemically synthesized
agatcttgggaaaggttcgaag

SEQ ID NO: 1096731 - DNA, 22 bp, Artificial Sequence
  chemically synthesized
gggaaaggttcgaagaacaaac

SEQ ID NO: 1096732 - DNA, 22 bp, Artificial Sequence
  chemically synthesized
ataaattttgctgtttgttctt

SEQ ID NO: 1096733 - DNA, 22 bp, Artificial Sequence
  chemically synthesized
ggaaaggttcgaagaacaaaca

SEQ ID NO: 1096734 - DNA, 22 bp, Artificial Sequence
  chemically synthesized
gattaataaattttgctgtttg

SEQ ID NO: 1096735 - DNA, 22 bp, Artificial Sequence
  chemically synthesized
gaagaacaaacagcaaaattta

SEQ ID NO: 1096736 - DNA, 22 bp, Artificial Sequence
  chemically synthesized
atatgtacctggattaataaat

SEQ ID NO: 1096737 - DNA, 22 bp, Artificial Sequence
  chemically synthesized
ctcatatgtacctggattaata

SEQ ID NO: 1096738 - DNA, 22 bp, Artificial Sequence
  chemically synthesized
cctcatatgtacctggattaat

SEQ ID NO: 1096739 - DNA, 22 bp, Artificial Sequence
  chemically synthesized
tcctcatatgtacctggattaa

SEQ ID NO: 1096740 - DNA, 22 bp, Artificial Sequence
  chemically synthesized
tttcctcatatgtacctggatt

SEQ ID NO: 1096741 - DNA, 22 bp, Artificial Sequence
  chemically synthesized
ctttcctcatatgtacctggat

SEQ ID NO: 1096742 - DNA, 22 bp, Artificial Sequence
  chemically synthesized
attaatccaggtacatatgagg

SEQ ID NO: 1096743 - DNA, 22 bp, Artificial Sequence
  chemically synthesized
ttaatccaggtacatatgagga

SEQ ID NO: 1096744 - DNA, 22 bp, Artificial Sequence
  chemically synthesized
atcatcatcttctttcctcata

SEQ ID NO: 1096745 - DNA, 22 bp, Artificial Sequence
  chemically synthesized
atccaggtacatatgaggaaag

SEQ ID NO: 1096746 - DNA, 22 bp, Artificial Sequence
  chemically synthesized
gtagagaaattcatcatcatct

SEQ ID NO: 1096747 - DNA, 22 bp, Artificial Sequence
  chemically synthesized
ctagtagagaaattcatcatca

SEQ ID NO: 1096748 - DNA, 22 bp, Artificial Sequence
  chemically synthesized
tcctagtagagaaattcatcat

SEQ ID NO: 1096749 - DNA, 22 bp, Artificial Sequence
  chemically synthesized
ctcctagtagagaaattcatca

SEQ ID NO: 1096750 - DNA, 22 bp, Artificial Sequence
  chemically synthesized
tctcctagtagagaaattcatc

SEQ ID NO: 1096751 - DNA, 22 bp, Artificial Sequence
  chemically synthesized
ttctcctagtagagaaattcat

SEQ ID NO: 1096752 - DNA, 22 bp, Artificial Sequence
  chemically synthesized
ccttttctcctagtagagaaat

SEQ ID NO: 1096753 - DNA, 22 bp, Artificial Sequence
  chemically synthesized
taccttttctcctagtagagaa

SEQ ID NO: 1096754 - DNA, 22 bp, Artificial Sequence
  chemically synthesized
ctaccttttctcctagtagaga

SEQ ID NO: 1096755 - DNA, 22 bp, Artificial Sequence
  chemically synthesized
tctaccttttctcctagtagag

SEQ ID NO: 1096756 - DNA, 22 bp, Artificial Sequence
  chemically synthesized
gctttctaccttttctcctagt

SEQ ID NO: 1096757 - DNA, 22 bp, Artificial Sequence
  chemically synthesized
agctttctaccttttctcctag

SEQ ID NO: 1096758 - DNA, 22 bp, Artificial Sequence
  chemically synthesized
ctctactaggagaaaaggtaga

SEQ ID NO: 1096759 - DNA, 22 bp, Artificial Sequence
  chemically synthesized
tctactaggagaaaaggtagaa

SEQ ID NO: 1096760 - DNA, 22 bp, Artificial Sequence
  chemically synthesized
tactaggagaaaaggtagaaag

SEQ ID NO: 1096761 - DNA, 22 bp, Artificial Sequence
  chemically synthesized
ctaggagaaaaggtagaaagct

SEQ ID NO: 1096762 - DNA, 22 bp, Artificial Sequence
  chemically synthesized
taccagtcatttagctttctac

SEQ ID NO: 1096763 - DNA, 22 bp, Artificial Sequence
  chemically synthesized
ggagaaaaggtagaaagctaaa

SEQ ID NO: 1096764 - DNA, 22 bp, Artificial Sequence
  chemically synthesized
tatagaaactgtaccagtcatt

SEQ ID NO: 1096765 - DNA, 22 bp, Artificial Sequence
  chemically synthesized
gtatagaaactgtaccagtcat

SEQ ID NO: 1096766 - DNA, 22 bp, Artificial Sequence
  chemically synthesized
tgaggatttgtatagaaactgt

SEQ ID NO: 1096767 - DNA, 22 bp, Artificial Sequence
  chemically synthesized
atgaggatttgtatagaaactg

SEQ ID NO: 1096768 - DNA, 22 bp, Artificial Sequence
  chemically synthesized
aatgactggtacagtttctata

SEQ ID NO: 1096769 - DNA, 22 bp, Artificial Sequence
  chemically synthesized
tatgaggatttgtatagaaact

SEQ ID NO: 1096770 - DNA, 22 bp, Artificial Sequence
  chemically synthesized
ttatgaggatttgtatagaaac

SEQ ID NO: 1096771 - DNA, 22 bp, Artificial Sequence
  chemically synthesized
gtacagtttctatacaaatcct

SEQ ID NO: 1096772 - DNA, 22 bp, Artificial Sequence
  chemically synthesized
ctatacaaatcctcataaaaac

SEQ ID NO: 1096773 - DNA, 22 bp, Artificial Sequence
  chemically synthesized
tatacaaatcctcataaaaacg

SEQ ID NO: 1096774 - DNA, 22 bp, Artificial Sequence
  chemically synthesized
tacaaatcctcataaaaacggt

SEQ ID NO: 1096775 - DNA, 22 bp, Artificial Sequence
  chemically synthesized
atggaaagaaacaagagccacc

SEQ ID NO: 1096776 - DNA, 22 bp, Artificial Sequence
  chemically synthesized
ataaaaacggtggctcttgttt

SEQ ID NO: 1096777 - DNA, 22 bp, Artificial Sequence
  chemically synthesized
gattcatggaaagaaacaagag

SEQ ID NO: 1096778 - DNA, 22 bp, Artificial Sequence
  chemically synthesized
ttgtttctttccatgaatctaa

SEQ ID NO: 1096779 - DNA, 22 bp, Artificial Sequence
  chemically synthesized
gtttctttccatgaatctaact

SEQ ID NO: 1096780 - DNA, 22 bp, Artificial Sequence
  chemically synthesized
tttctttccatgaatctaacta

SEQ ID NO: 1096781 - DNA, 22 bp, Artificial Sequence
  chemically synthesized
ctttccatgaatctaactatga

SEQ ID NO: 1096782 - DNA, 22 bp, Artificial Sequence
  chemically synthesized
tttccatgaatctaactatgat

SEQ ID NO: 1096783 - DNA, 22 bp, Artificial Sequence
  chemically synthesized
tccatgaatctaactatgatat

SEQ ID NO: 1096784 - DNA, 22 bp, Artificial Sequence
  chemically synthesized
ccatgaatctaactatgatatg

SEQ ID NO: 1096785 - DNA, 22 bp, Artificial Sequence
  chemically synthesized
catgaatctaactatgatatgc

SEQ ID NO: 1096786 - DNA, 22 bp, Artificial Sequence
  chemically synthesized
gcaatgaaagatggcagagcat

SEQ ID NO: 1096787 - DNA, 22 bp, Artificial Sequence
  chemically synthesized
actatgatatgctctgccatct

SEQ ID NO: 1096788 - DNA, 22 bp, Artificial Sequence
  chemically synthesized
tgatatgctctgccatctttca

SEQ ID NO: 1096789 - DNA, 22 bp, Artificial Sequence
  chemically synthesized
tgccatctttcattgctaggat

SEQ ID NO: 1096790 - DNA, 22 bp, Artificial Sequence
  chemically synthesized
ccatctttcattgctaggattt

SEQ ID NO: 1096791 - DNA, 22 bp, Artificial Sequence
  chemically synthesized
agaagcacgggtgtgaaatcct

SEQ ID NO: 1096792 - DNA, 22 bp, Artificial Sequence
  chemically synthesized
aagaagcacgggtgtgaaatcc

SEQ ID NO: 1096793 - DNA, 22 bp, Artificial Sequence
  chemically synthesized
taagaagcacgggtgtgaaatc

SEQ ID NO: 1096794 - DNA, 22 bp, Artificial Sequence
  chemically synthesized
tcattgctaggatttcacaccc

SEQ ID NO: 1096795 - DNA, 22 bp, Artificial Sequence
  chemically synthesized
cattgctaggatttcacacccg

SEQ ID NO: 1096796 - DNA, 22 bp, Artificial Sequence
  chemically synthesized
attgctaggatttcacacccgt

SEQ ID NO: 1096797 - DNA, 22 bp, Artificial Sequence
  chemically synthesized
actttaagaagcacgggtgtga

SEQ ID NO: 1096798 - DNA, 22 bp, Artificial Sequence
  chemically synthesized
ctaggatttcacacccgtgctt

SEQ ID NO: 1096799 - DNA, 22 bp, Artificial Sequence
  chemically synthesized
ggatttcacacccgtgcttctt

SEQ ID NO: 1096800 - DNA, 22 bp, Artificial Sequence
  chemically synthesized
caagggtgctcactttaagaag

SEQ ID NO: 1096801 - DNA, 22 bp, Artificial Sequence
  chemically synthesized
cacacccgtgcttcttaaagtg

SEQ ID NO: 1096802 - DNA, 22 bp, Artificial Sequence
  chemically synthesized
acacccgtgcttcttaaagtga

SEQ ID NO: 1096803 - DNA, 22 bp, Artificial Sequence
  chemically synthesized
cagagtgattccaagggtgctc

SEQ ID NO: 1096804 - DNA, 22 bp, Artificial Sequence
  chemically synthesized
cttaaagtgagcacccttggaa

SEQ ID NO: 1096805 - DNA, 22 bp, Artificial Sequence
  chemically synthesized
ttaaagtgagcacccttggaat

SEQ ID NO: 1096806 - DNA, 22 bp, Artificial Sequence
  chemically synthesized
aaagtgagcacccttggaatca

SEQ ID NO: 1096807 - DNA, 22 bp, Artificial Sequence
  chemically synthesized
aagtgagcacccttggaatcac

SEQ ID NO: 1096808 - DNA, 22 bp, Artificial Sequence
  chemically synthesized
ataccaaagaacaagttgcaga

SEQ ID NO: 1096809 - DNA, 22 bp, Artificial Sequence
  chemically synthesized
gataccaaagaacaagttgcag

SEQ ID NO: 1096810 - DNA, 22 bp, Artificial Sequence
  chemically synthesized
ggaatcactctgcaacttgttc

SEQ ID NO: 1096811 - DNA, 22 bp, Artificial Sequence
  chemically synthesized
gaatcactctgcaacttgttct

SEQ ID NO: 1096812 - DNA, 22 bp, Artificial Sequence
  chemically synthesized
agtttgataccaaagaacaagt

SEQ ID NO: 1096813 - DNA, 22 bp, Artificial Sequence
  chemically synthesized
gagtttgataccaaagaacaag

SEQ ID NO: 1096814 - DNA, 22 bp, Artificial Sequence
  chemically synthesized
tgcaacttgttctttggtatca

SEQ ID NO: 1096815 - DNA, 22 bp, Artificial Sequence
  chemically synthesized
acaagtttgagtttgataccaa

SEQ ID NO: 1096816 - DNA, 22 bp, Artificial Sequence
  chemically synthesized
caacttgttctttggtatcaaa

SEQ ID NO: 1096817 - DNA, 22 bp, Artificial Sequence
  chemically synthesized
aacaagtttgagtttgatacca

SEQ ID NO: 1096818 - DNA, 22 bp, Artificial Sequence
  chemically synthesized
taacaagtttgagtttgatacc

SEQ ID NO: 1096819 - DNA, 22 bp, Artificial Sequence
  chemically synthesized
ttaacaagtttgagtttgatac

SEQ ID NO: 1096820 - DNA, 22 bp, Artificial Sequence
  chemically synthesized
gttctttggtatcaaactcaaa

SEQ ID NO: 1096821 - DNA, 22 bp, Artificial Sequence
  chemically synthesized
atttttaacaagtttgagtttg

SEQ ID NO: 1096822 - DNA, 22 bp, Artificial Sequence
  chemically synthesized
ttctttggtatcaaactcaaac

SEQ ID NO: 1096823 - DNA, 22 bp, Artificial Sequence
  chemically synthesized
catttttaacaagtttgagttt

SEQ ID NO: 1096824 - DNA, 22 bp, Artificial Sequence
  chemically synthesized
tcatttttaacaagtttgagtt

SEQ ID NO: 1096825 - DNA, 22 bp, Artificial Sequence
  chemically synthesized
ttcatttttaacaagtttgagt

SEQ ID NO: 1096826 - DNA, 22 bp, Artificial Sequence
  chemically synthesized
tttggtatcaaactcaaacttg

SEQ ID NO: 1096827 - DNA, 22 bp, Artificial Sequence
  chemically synthesized
tggtatcaaactcaaacttgtt

SEQ ID NO: 1096828 - DNA, 22 bp, Artificial Sequence
  chemically synthesized
ggtatcaaactcaaacttgtta

SEQ ID NO: 1096829 - DNA, 22 bp, Artificial Sequence
  chemically synthesized
gtatcaaactcaaacttgttaa

SEQ ID NO: 1096830 - DNA, 22 bp, Artificial Sequence
  chemically synthesized
tagtttttcatttttaacaagt

SEQ ID NO: 1096831 - DNA, 22 bp, Artificial Sequence
  chemically synthesized
aaacttgttaaaaatgaaaaac

SEQ ID NO: 1096832 - DNA, 22 bp, Artificial Sequence
  chemically synthesized
ggtgaggcctgtagtttttcat

SEQ ID NO: 1096833 - DNA, 22 bp, Artificial Sequence
  chemically synthesized
gggtgaggcctgtagtttttca

SEQ ID NO: 1096834 - DNA, 22 bp, Artificial Sequence
  chemically synthesized
gttaaaaatgaaaaactacagg

SEQ ID NO: 1096835 - DNA, 22 bp, Artificial Sequence
  chemically synthesized
ttaaaaatgaaaaactacaggc

SEQ ID NO: 1096836 - DNA, 22 bp, Artificial Sequence
  chemically synthesized
aaaatgaaaaactacaggcctc

SEQ ID NO: 1096837 - DNA, 22 bp, Artificial Sequence
  chemically synthesized
agtgagtcttgggtgaggcctg

SEQ ID NO: 1096838 - DNA, 22 bp, Artificial Sequence
  chemically synthesized
attcagtgagtcttgggtgagg

SEQ ID NO: 1096839 - DNA, 22 bp, Artificial Sequence
  chemically synthesized
tgattcagtgagtcttgggtga

SEQ ID NO: 1096840 - DNA, 22 bp, Artificial Sequence
  chemically synthesized
ctgattcagtgagtcttgggtg

SEQ ID NO: 1096841 - DNA, 22 bp, Artificial Sequence
  chemically synthesized
caggcctcacccaagactcact

SEQ ID NO: 1096842 - DNA, 22 bp, Artificial Sequence
  chemically synthesized
accccagaatttctgattcagt

SEQ ID NO: 1096843 - DNA, 22 bp, Artificial Sequence
  chemically synthesized
acccaagactcactgaatcaga

SEQ ID NO: 1096844 - DNA, 22 bp, Artificial Sequence
  chemically synthesized
ggccctgaccccagaatttctg

SEQ ID NO: 1096845 - DNA, 22 bp, Artificial Sequence
  chemically synthesized
actgaatcagaaattctggggt

SEQ ID NO: 1096846 - DNA, 22 bp, Artificial Sequence
  chemically synthesized
aatcagaaattctggggtcagg

SEQ ID NO: 1096847 - DNA, 22 bp, Artificial Sequence
  chemically synthesized
atacacagagtgctgggccctg

SEQ ID NO: 1096848 - DNA, 22 bp, Artificial Sequence
  chemically synthesized
aatacacagagtgctgggccct

SEQ ID NO: 1096849 - DNA, 22 bp, Artificial Sequence
  chemically synthesized
tttaatacacagagtgctgggc

SEQ ID NO: 1096850 - DNA, 22 bp, Artificial Sequence
  chemically synthesized
gtttaatacacagagtgctggg

SEQ ID NO: 1096851 - DNA, 22 bp, Artificial Sequence
  chemically synthesized
tggggtcagggcccagcactct

SEQ ID NO: 1096852 - DNA, 22 bp, Artificial Sequence
  chemically synthesized
gggtcagggcccagcactctgt

SEQ ID NO: 1096853 - DNA, 22 bp, Artificial Sequence
  chemically synthesized
gaagtcttgtttaatacacaga

SEQ ID NO: 1096854 - DNA, 22 bp, Artificial Sequence
  chemically synthesized
tgtgtattaaacaagacttcca

SEQ ID NO: 1096855 - DNA, 22 bp, Artificial Sequence
  chemically synthesized
tgtattaaacaagacttccagg

SEQ ID NO: 1096856 - DNA, 22 bp, Artificial Sequence
  chemically synthesized
aatggacatcagaatcacctgg

SEQ ID NO: 1096857 - DNA, 22 bp, Artificial Sequence
  chemically synthesized
aacaagacttccaggtgattct

SEQ ID NO: 1096858 - DNA, 22 bp, Artificial Sequence
  chemically synthesized
catctgaatggacatcagaatc

SEQ ID NO: 1096859 - DNA, 22 bp, Artificial Sequence
  chemically synthesized
ctgcatctgaatggacatcaga

SEQ ID NO: 1096860 - DNA, 22 bp, Artificial Sequence
  chemically synthesized
ccaggtgattctgatgtccatt

SEQ ID NO: 1096861 - DNA, 22 bp, Artificial Sequence
  chemically synthesized
caggtgattctgatgtccattc

SEQ ID NO: 1096862 - DNA, 22 bp, Artificial Sequence
  chemically synthesized
cagcagtgattcctgcatctga

SEQ ID NO: 1096863 - DNA, 22 bp, Artificial Sequence
  chemically synthesized
tgatgtccattcagatgcagga

SEQ ID NO: 1096864 - DNA, 22 bp, Artificial Sequence
  chemically synthesized
atgtccattcagatgcaggaat

SEQ ID NO: 1096865 - DNA, 22 bp, Artificial Sequence
  chemically synthesized
tataatcactacagcagtgatt

SEQ ID NO: 1096866 - DNA, 22 bp, Artificial Sequence
  chemically synthesized
gtataatcactacagcagtgat

SEQ ID NO: 1096867 - DNA, 22 bp, Artificial Sequence
  chemically synthesized
agatgcaggaatcactgctgta

SEQ ID NO: 1096868 - DNA, 22 bp, Artificial Sequence
  chemically synthesized
ctgtagtgattatacaaattta

SEQ ID NO: 1096869 - DNA, 22 bp, Artificial Sequence
  chemically synthesized
tagtgattatacaaatttattt

SEQ ID NO: 1096870 - DNA, 22 bp, Artificial Sequence
  chemically synthesized
tacaaatttatttgtgtattta

SEQ ID NO: 1096871 - DNA, 22 bp, Artificial Sequence
  chemically synthesized
cacataaagtgagaatagtaaa

SEQ ID NO: 1096872 - DNA, 22 bp, Artificial Sequence
  chemically synthesized
acacataaagtgagaatagtaa

SEQ ID NO: 1096873 - DNA, 22 bp, Artificial Sequence
  chemically synthesized
atttgtgtatttactattctca

SEQ ID NO: 1096874 - DNA, 22 bp, Artificial Sequence
  chemically synthesized
tttgtgtatttactattctcac

SEQ ID NO: 1096875 - DNA, 22 bp, Artificial Sequence
  chemically synthesized
gtgtatttactattctcacttt

SEQ ID NO: 1096876 - DNA, 22 bp, Artificial Sequence
  chemically synthesized
tgtatttactattctcacttta

SEQ ID NO: 1096877 - DNA, 22 bp, Artificial Sequence
  chemically synthesized
ccagaacttacacataaagtga

SEQ ID NO: 1096878 - DNA, 22 bp, Artificial Sequence
  chemically synthesized
accagaacttacacataaagtg

SEQ ID NO: 1096879 - DNA, 22 bp, Artificial Sequence
  chemically synthesized
actattctcactttatgtgtaa

SEQ ID NO: 1096880 - DNA, 22 bp, Artificial Sequence
  chemically synthesized
ctattctcactttatgtgtaag

SEQ ID NO: 1096881 - DNA, 22 bp, Artificial Sequence
  chemically synthesized
gtgcttaccagaacttacacat

SEQ ID NO: 1096882 - DNA, 22 bp, Artificial Sequence
  chemically synthesized
ttctcactttatgtgtaagttc

SEQ ID NO: 1096883 - DNA, 22 bp, Artificial Sequence
  chemically synthesized
tcactttatgtgtaagttctgg

SEQ ID NO: 1096884 - DNA, 22 bp, Artificial Sequence
  chemically synthesized
gtactagtgcttaccagaactt

SEQ ID NO: 1096885 - DNA, 22 bp, Artificial Sequence
  chemically synthesized
actttatgtgtaagttctggta

SEQ ID NO: 1096886 - DNA, 22 bp, Artificial Sequence
  chemically synthesized
tagtactagtgcttaccagaac

SEQ ID NO: 1096887 - DNA, 22 bp, Artificial Sequence
  chemically synthesized
tatgtgtaagttctggtaagca

SEQ ID NO: 1096888 - DNA, 22 bp, Artificial Sequence
  chemically synthesized
atgtgtaagttctggtaagcac

SEQ ID NO: 1096889 - DNA, 22 bp, Artificial Sequence
  chemically synthesized
tgtgtaagttctggtaagcact

SEQ ID NO: 1096890 - DNA, 22 bp, Artificial Sequence
  chemically synthesized
taactctagtactagtgcttac

SEQ ID NO: 1096891 - DNA, 22 bp, Artificial Sequence
  chemically synthesized
ttataactctagtactagtgct

SEQ ID NO: 1096892 - DNA, 22 bp, Artificial Sequence
  chemically synthesized
tattataactctagtactagtg

SEQ ID NO: 1096893 - DNA, 22 bp, Artificial Sequence
  chemically synthesized
ctctattataactctagtacta

SEQ ID NO: 1096894 - DNA, 22 bp, Artificial Sequence
  chemically synthesized
actctattataactctagtact

SEQ ID NO: 1096895 - DNA, 22 bp, Artificial Sequence
  chemically synthesized
tggtaagcactagtactagagt

SEQ ID NO: 1096896 - DNA, 22 bp, Artificial Sequence
  chemically synthesized
tactctattataactctagtac

SEQ ID NO: 1096897 - DNA, 22 bp, Artificial Sequence
  chemically synthesized
ttactctattataactctagta

SEQ ID NO: 1096898 - DNA, 22 bp, Artificial Sequence
  chemically synthesized
gtaagcactagtactagagtta

SEQ ID NO: 1096899 - DNA, 22 bp, Artificial Sequence
  chemically synthesized
atttttactctattataactct

SEQ ID NO: 1096900 - DNA, 22 bp, Artificial Sequence
  chemically synthesized
aatttttactctattataactc

SEQ ID NO: 1096901 - DNA, 22 bp, Artificial Sequence
  chemically synthesized
taatttttactctattataact

SEQ ID NO: 1096902 - DNA, 22 bp, Artificial Sequence
  chemically synthesized
ttaatttttactctattataac

SEQ ID NO: 1096903 - DNA, 22 bp, Artificial Sequence
  chemically synthesized
tttaatttttactctattataa

SEQ ID NO: 1096904 - DNA, 22 bp, Artificial Sequence
  chemically synthesized
ttttaatttttactctattata

SEQ ID NO: 1096905 - DNA, 22 bp, Artificial Sequence
  chemically synthesized
tttttaatttttactctattat

SEQ ID NO: 1096906 - DNA, 22 bp, Artificial Sequence
  chemically synthesized
gtactagagttataatagagta

SEQ ID NO: 1096907 - DNA, 22 bp, Artificial Sequence
  chemically synthesized
ttttttaatttttactctatta

SEQ ID NO: 1096908 - DNA, 22 bp, Artificial Sequence
  chemically synthesized
tttttttttaatttttactcta

SEQ ID NO: 1096909 - DNA, 22 bp, Artificial Sequence
  chemically synthesized
atttttttttaatttttactct

SEQ ID NO: 1096910 - DNA, 22 bp, Artificial Sequence
  chemically synthesized
tatttttttttaatttttactc

SEQ ID NO: 1096911 - DNA, 22 bp, Artificial Sequence
  chemically synthesized
gagttataatagagtaaaaatt

SEQ ID NO: 1096912 - DNA, 22 bp, Artificial Sequence
  chemically synthesized
gttttatttttttttaattttt

SEQ ID NO: 1096913 - DNA, 22 bp, Artificial Sequence
  chemically synthesized
taatagagtaaaaattaaaaaa

SEQ ID NO: 1096914 - DNA, 22 bp, Artificial Sequence
  chemically synthesized
actggttttatttttttttaat

SEQ ID NO: 1096915 - DNA, 22 bp, Artificial Sequence
  chemically synthesized
ttaactggttttattttttttt

SEQ ID NO: 1096916 - DNA, 22 bp, Artificial Sequence
  chemically synthesized
gaaagttattaactggttttat

SEQ ID NO: 1096917 - DNA, 22 bp, Artificial Sequence
  chemically synthesized
tggaaagttattaactggtttt

SEQ ID NO: 1096918 - DNA, 22 bp, Artificial Sequence
  chemically synthesized
aaaaaaaataaaaccagttaat

SEQ ID NO: 1096919 - DNA, 22 bp, Artificial Sequence
  chemically synthesized
aaaaacactctggaaagttatt

SEQ ID NO: 1096920 - DNA, 22 bp, Artificial Sequence
  chemically synthesized
gaaaaacactctggaaagttat

SEQ ID NO: 1096921 - DNA, 22 bp, Artificial Sequence
  chemically synthesized
tgaaaaacactctggaaagtta

SEQ ID NO: 1096922 - DNA, 22 bp, Artificial Sequence
  chemically synthesized
aaaccctttgaaaaacactctg

SEQ ID NO: 1096923 - DNA, 22 bp, Artificial Sequence
  chemically synthesized
ataactttccagagtgtttttc

SEQ ID NO: 1096924 - DNA, 22 bp, Artificial Sequence
  chemically synthesized
tactaaaaccctttgaaaaaca

SEQ ID NO: 1096925 - DNA, 22 bp, Artificial Sequence
  chemically synthesized
atactaaaaccctttgaaaaac

SEQ ID NO: 1096926 - DNA, 22 bp, Artificial Sequence
  chemically synthesized
tatactaaaaccctttgaaaaa

SEQ ID NO: 1096927 - DNA, 22 bp, Artificial Sequence
  chemically synthesized
tccagagtgtttttcaaagggt

SEQ ID NO: 1096928 - DNA, 22 bp, Artificial Sequence
  chemically synthesized
ccagagtgtttttcaaagggtt

SEQ ID NO: 1096929 - DNA, 22 bp, Artificial Sequence
  chemically synthesized
cagagtgtttttcaaagggttt

SEQ ID NO: 1096930 - DNA, 22 bp, Artificial Sequence
  chemically synthesized
tatggtaaaactttatactaaa

SEQ ID NO: 1096931 - DNA, 22 bp, Artificial Sequence
  chemically synthesized
ttcaaagggttttagtataaag

SEQ ID NO: 1096932 - DNA, 22 bp, Artificial Sequence
  chemically synthesized
tcaaagggttttagtataaagt

SEQ ID NO: 1096933 - DNA, 22 bp, Artificial Sequence
  chemically synthesized
caaagggttttagtataaagtt

SEQ ID NO: 1096934 - DNA, 22 bp, Artificial Sequence
  chemically synthesized
aaagggttttagtataaagttt

SEQ ID NO: 1096935 - DNA, 22 bp, Artificial Sequence
  chemically synthesized
tagtataaagttttaccatata

SEQ ID NO: 1096936 - DNA, 22 bp, Artificial Sequence
  chemically synthesized
agtataaagttttaccatatag

SEQ ID NO: 1096937 - DNA, 22 bp, Artificial Sequence
  chemically synthesized
gtataaagttttaccatatagt

SEQ ID NO: 1096938 - DNA, 22 bp, Artificial Sequence
  chemically synthesized
tggagatcagcaatcactatat

SEQ ID NO: 1096939 - DNA, 22 bp, Artificial Sequence
  chemically synthesized
atggagatcagcaatcactata

SEQ ID NO: 1096940 - DNA, 22 bp, Artificial Sequence
  chemically synthesized
tatggagatcagcaatcactat

SEQ ID NO: 1096941 - DNA, 22 bp, Artificial Sequence
  chemically synthesized
ttatggagatcagcaatcacta

SEQ ID NO: 1096942 - DNA, 22 bp, Artificial Sequence
  chemically synthesized
taccatatagtgattgctgatc

SEQ ID NO: 1096943 - DNA, 22 bp, Artificial Sequence
  chemically synthesized
accatatagtgattgctgatct

SEQ ID NO: 1096944 - DNA, 22 bp, Artificial Sequence
  chemically synthesized
aaacttttatggagatcagcaa

SEQ ID NO: 1096945 - DNA, 22 bp, Artificial Sequence
  chemically synthesized
ccatatagtgattgctgatctc

SEQ ID NO: 1096946 - DNA, 22 bp, Artificial Sequence
  chemically synthesized
aaaacttttatggagatcagca

SEQ ID NO: 1096947 - DNA, 22 bp, Artificial Sequence
  chemically synthesized
taaaacttttatggagatcagc

SEQ ID NO: 1096948 - DNA, 22 bp, Artificial Sequence
  chemically synthesized
actttaaaacttttatggagat

SEQ ID NO: 1096949 - DNA, 22 bp, Artificial Sequence
  chemically synthesized
tgactttaaaacttttatggag

SEQ ID NO: 1096950 - DNA, 22 bp, Artificial Sequence
  chemically synthesized
ctgatctccataaaagttttaa

SEQ ID NO: 1096951 - DNA, 22 bp, Artificial Sequence
  chemically synthesized
atctccataaaagttttaaagt

SEQ ID NO: 1096952 - DNA, 22 bp, Artificial Sequence
  chemically synthesized
ataaacaacctctgactttaaa

SEQ ID NO: 1096953 - DNA, 22 bp, Artificial Sequence
  chemically synthesized
gataaacaacctctgactttaa

SEQ ID NO: 1096954 - DNA, 22 bp, Artificial Sequence
  chemically synthesized
cataaaagttttaaagtcagag

SEQ ID NO: 1096955 - DNA, 22 bp, Artificial Sequence
  chemically synthesized
taaagtcagaggttgtttatca

SEQ ID NO: 1096956 - DNA, 22 bp, Artificial Sequence
  chemically synthesized
aaagtcagaggttgtttatcaa

SEQ ID NO: 1096957 - DNA, 22 bp, Artificial Sequence
  chemically synthesized
aagtcagaggttgtttatcaaa

SEQ ID NO: 1096958 - DNA, 22 bp, Artificial Sequence
  chemically synthesized
acataaaagaacccagggtaca

SEQ ID NO: 1096959 - DNA, 22 bp, Artificial Sequence
  chemically synthesized
gacataaaagaacccagggtac

SEQ ID NO: 1096960 - DNA, 22 bp, Artificial Sequence
  chemically synthesized
tttatcaaactgtaccctgggt

SEQ ID NO: 1096961 - DNA, 22 bp, Artificial Sequence
  chemically synthesized
tgacataaaagaacccagggta

SEQ ID NO: 1096962 - DNA, 22 bp, Artificial Sequence
  chemically synthesized
ttgacataaaagaacccagggt

SEQ ID NO: 1096963 - DNA, 22 bp, Artificial Sequence
  chemically synthesized
tttgacataaaagaacccaggg

SEQ ID NO: 1096964 - DNA, 22 bp, Artificial Sequence
  chemically synthesized
atcaaactgtaccctgggttct

SEQ ID NO: 1096965 - DNA, 22 bp, Artificial Sequence
  chemically synthesized
ttttgacataaaagaacccagg

SEQ ID NO: 1096966 - DNA, 22 bp, Artificial Sequence
  chemically synthesized
tcaaactgtaccctgggttctt

SEQ ID NO: 1096967 - DNA, 22 bp, Artificial Sequence
  chemically synthesized
taccctgggttcttttatgtca

SEQ ID NO: 1096968 - DNA, 22 bp, Artificial Sequence
  chemically synthesized
aaaaggaaagtttttttgacat

SEQ ID NO: 1096969 - DNA, 22 bp, Artificial Sequence
  chemically synthesized
ggttcttttatgtcaaaaaaac

SEQ ID NO: 1096970 - DNA, 22 bp, Artificial Sequence
  chemically synthesized
ccctgaaaaggaaagttttttt

SEQ ID NO: 1096971 - DNA, 22 bp, Artificial Sequence
  chemically synthesized
cccctgaaaaggaaagtttttt

SEQ ID NO: 1096972 - DNA, 22 bp, Artificial Sequence
  chemically synthesized
tcccctgaaaaggaaagttttt

SEQ ID NO: 1096973 - DNA, 22 bp, Artificial Sequence
  chemically synthesized
ttttatgtcaaaaaaactttcc

SEQ ID NO: 1096974 - DNA, 22 bp, Artificial Sequence
  chemically synthesized
ttcccctgaaaaggaaagtttt

SEQ ID NO: 1096975 - DNA, 22 bp, Artificial Sequence
  chemically synthesized
ttatgtcaaaaaaactttcctt

SEQ ID NO: 1096976 - DNA, 22 bp, Artificial Sequence
  chemically synthesized
tatgtcaaaaaaactttccttt

SEQ ID NO: 1096977 - DNA, 22 bp, Artificial Sequence
  chemically synthesized
tttttcccctgaaaaggaaagt

SEQ ID NO: 1096978 - DNA, 22 bp, Artificial Sequence
  chemically synthesized
atgtcaaaaaaactttcctttt

SEQ ID NO: 1096979 - DNA, 22 bp, Artificial Sequence
  chemically synthesized
atttttcccctgaaaaggaaag

SEQ ID NO: 1096980 - DNA, 22 bp, Artificial Sequence
  chemically synthesized
tgtcaaaaaaactttccttttc

SEQ ID NO: 1096981 - DNA, 22 bp, Artificial Sequence
  chemically synthesized
ataacttatttttcccctgaaa

SEQ ID NO: 1096982 - DNA, 22 bp, Artificial Sequence
  chemically synthesized
aataacttatttttcccctgaa

SEQ ID NO: 1096983 - DNA, 22 bp, Artificial Sequence
  chemically synthesized
taataacttatttttcccctga

SEQ ID NO: 1096984 - DNA, 22 bp, Artificial Sequence
  chemically synthesized
ttttaataacttatttttcccc

SEQ ID NO: 1096985 - DNA, 22 bp, Artificial Sequence
  chemically synthesized
tccttttcaggggaaaaataag

SEQ ID NO: 1096986 - DNA, 22 bp, Artificial Sequence
  chemically synthesized
ccttttcaggggaaaaataagt

SEQ ID NO: 1096987 - DNA, 22 bp, Artificial Sequence
  chemically synthesized
cttttcaggggaaaaataagtt

SEQ ID NO: 1096988 - DNA, 22 bp, Artificial Sequence
  chemically synthesized
ttcaggggaaaaataagttatt

SEQ ID NO: 1096989 - DNA, 22 bp, Artificial Sequence
  chemically synthesized
tcaggggaaaaataagttatta

SEQ ID NO: 1096990 - DNA, 22 bp, Artificial Sequence
  chemically synthesized
caggggaaaaataagttattaa

SEQ ID NO: 1096991 - DNA, 22 bp, Artificial Sequence
  chemically synthesized
aggggaaaaataagttattaaa

SEQ ID NO: 1096992 - DNA, 22 bp, Artificial Sequence
  chemically synthesized
aaaatggaagtgctgttttaat

SEQ ID NO: 1096993 - DNA, 22 bp, Artificial Sequence
  chemically synthesized
cctgaaaatggaagtgctgttt

SEQ ID NO: 1096994 - DNA, 22 bp, Artificial Sequence
  chemically synthesized
acctgaaaatggaagtgctgtt

SEQ ID NO: 1096995 - DNA, 22 bp, Artificial Sequence
  chemically synthesized
tacctgaaaatggaagtgctgt

SEQ ID NO: 1096996 - DNA, 22 bp, Artificial Sequence
  chemically synthesized
tgttttacctgaaaatggaagt

SEQ ID NO: 1096997 - DNA, 22 bp, Artificial Sequence
  chemically synthesized
ttaaaacagcacttccattttc

SEQ ID NO: 1096998 - DNA, 22 bp, Artificial Sequence
  chemically synthesized
ctgtgttttacctgaaaatgga

SEQ ID NO: 1096999 - DNA, 22 bp, Artificial Sequence
  chemically synthesized
cctgtgttttacctgaaaatgg

SEQ ID NO: 1097000 - DNA, 22 bp, Artificial Sequence
  chemically synthesized
aaacagcacttccattttcagg

SEQ ID NO: 1097001 - DNA, 22 bp, Artificial Sequence
  chemically synthesized
tcctgtgttttacctgaaaatg

SEQ ID NO: 1097002 - DNA, 22 bp, Artificial Sequence
  chemically synthesized
tttcctgtgttttacctgaaaa

SEQ ID NO: 1097003 - DNA, 22 bp, Artificial Sequence
  chemically synthesized
tgttctttcctgtgttttacct

SEQ ID NO: 1097004 - DNA, 22 bp, Artificial Sequence
  chemically synthesized
atgttctttcctgtgttttacc

SEQ ID NO: 1097005 - DNA, 22 bp, Artificial Sequence
  chemically synthesized
ccattttcaggtaaaacacagg

SEQ ID NO: 1097006 - DNA, 22 bp, Artificial Sequence
  chemically synthesized
tttatgttctttcctgtgtttt

SEQ ID NO: 1097007 - DNA, 22 bp, Artificial Sequence
  chemically synthesized
cattttcaggtaaaacacagga

SEQ ID NO: 1097008 - DNA, 22 bp, Artificial Sequence
  chemically synthesized
tgtttatgttctttcctgtgtt

SEQ ID NO: 1097009 - DNA, 22 bp, Artificial Sequence
  chemically synthesized
ctgtttatgttctttcctgtgt

SEQ ID NO: 1097010 - DNA, 22 bp, Artificial Sequence
  chemically synthesized
tcaggtaaaacacaggaaagaa

SEQ ID NO: 1097011 - DNA, 22 bp, Artificial Sequence
  chemically synthesized
caggtaaaacacaggaaagaac

SEQ ID NO: 1097012 - DNA, 22 bp, Artificial Sequence
  chemically synthesized
aggtaaaacacaggaaagaaca

SEQ ID NO: 1097013 - DNA, 22 bp, Artificial Sequence
  chemically synthesized
aaagaagaaatagagacccccc

SEQ ID NO: 1097014 - DNA, 22 bp, Artificial Sequence
  chemically synthesized
atactcaaagaagaaatagaga

SEQ ID NO: 1097015 - DNA, 22 bp, Artificial Sequence
  chemically synthesized
cctgatactcaaagaagaaata

SEQ ID NO: 1097016 - DNA, 22 bp, Artificial Sequence
  chemically synthesized
tccctgatactcaaagaagaaa

SEQ ID NO: 1097017 - DNA, 22 bp, Artificial Sequence
  chemically synthesized
acatctctccctgatactcaaa

SEQ ID NO: 1097018 - DNA, 22 bp, Artificial Sequence
  chemically synthesized
gacatctctccctgatactcaa

SEQ ID NO: 1097019 - DNA, 22 bp, Artificial Sequence
  chemically synthesized
tgacatctctccctgatactca

SEQ ID NO: 1097020 - DNA, 22 bp, Artificial Sequence
  chemically synthesized
tatttcttctttgagtatcagg

SEQ ID NO: 1097021 - DNA, 22 bp, Artificial Sequence
  chemically synthesized
tttcttctttgagtatcaggga

SEQ ID NO: 1097022 - DNA, 22 bp, Artificial Sequence
  chemically synthesized
ttttgacatctctccctgatac

SEQ ID NO: 1097023 - DNA, 22 bp, Artificial Sequence
  chemically synthesized
cttctttgagtatcagggagag

SEQ ID NO: 1097024 - DNA, 22 bp, Artificial Sequence
  chemically synthesized
ttctttgagtatcagggagaga

SEQ ID NO: 1097025 - DNA, 22 bp, Artificial Sequence
  chemically synthesized
ctttgagtatcagggagagatg

SEQ ID NO: 1097026 - DNA, 22 bp, Artificial Sequence
  chemically synthesized
tttgagtatcagggagagatgt

SEQ ID NO: 1097027 - DNA, 22 bp, Artificial Sequence
  chemically synthesized
tgagtatcagggagagatgtca

SEQ ID NO: 1097028 - DNA, 22 bp, Artificial Sequence
  chemically synthesized
acagacctattttgacatctct

SEQ ID NO: 1097029 - DNA, 22 bp, Artificial Sequence
  chemically synthesized
gagtatcagggagagatgtcaa

SEQ ID NO: 1097030 - DNA, 22 bp, Artificial Sequence
  chemically synthesized
agtatcagggagagatgtcaaa

SEQ ID NO: 1097031 - DNA, 22 bp, Artificial Sequence
  chemically synthesized
tcagaagatactaacagaccta

SEQ ID NO: 1097032 - DNA, 22 bp, Artificial Sequence
  chemically synthesized
ttgtcagaagatactaacagac

SEQ ID NO: 1097033 - DNA, 22 bp, Artificial Sequence
  chemically synthesized
attgtcagaagatactaacaga

SEQ ID NO: 1097034 - DNA, 22 bp, Artificial Sequence
  chemically synthesized
tattgtcagaagatactaacag

SEQ ID NO: 1097035 - DNA, 22 bp, Artificial Sequence
  chemically synthesized
tttattgtcagaagatactaac

SEQ ID NO: 1097036 - DNA, 22 bp, Artificial Sequence
  chemically synthesized
ctttattgtcagaagatactaa

SEQ ID NO: 1097037 - DNA, 22 bp, Artificial Sequence
  chemically synthesized
tctttattgtcagaagatacta

SEQ ID NO: 1097038 - DNA, 22 bp, Artificial Sequence
  chemically synthesized
ttctttattgtcagaagatact

SEQ ID NO: 1097039 - DNA, 22 bp, Artificial Sequence
  chemically synthesized
atttttctttattgtcagaaga

SEQ ID NO: 1097040 - DNA, 22 bp, Artificial Sequence
  chemically synthesized
ttagtatcttctgacaataaag

SEQ ID NO: 1097041 - DNA, 22 bp, Artificial Sequence
  chemically synthesized
atagctaatttttctttattgt

SEQ ID NO: 1097042 - DNA, 22 bp, Artificial Sequence
  chemically synthesized
gatagctaatttttctttattg

SEQ ID NO: 1097043 - DNA, 22 bp, Artificial Sequence
  chemically synthesized
gtatcttctgacaataaagaaa

SEQ ID NO: 1097044 - DNA, 22 bp, Artificial Sequence
  chemically synthesized
atttgatagctaatttttcttt

SEQ ID NO: 1097045 - DNA, 22 bp, Artificial Sequence
  chemically synthesized
ctgacaataaagaaaaattagc

SEQ ID NO: 1097046 - DNA, 22 bp, Artificial Sequence
  chemically synthesized
tgacaataaagaaaaattagct

SEQ ID NO: 1097047 - DNA, 22 bp, Artificial Sequence
  chemically synthesized
tgctcatttgatagctaatttt

SEQ ID NO: 1097048 - DNA, 22 bp, Artificial Sequence
  chemically synthesized
acaataaagaaaaattagctat

SEQ ID NO: 1097049 - DNA, 22 bp, Artificial Sequence
  chemically synthesized
cctgtgctcatttgatagctaa

SEQ ID NO: 1097050 - DNA, 22 bp, Artificial Sequence
  chemically synthesized
tacctgtgctcatttgatagct

SEQ ID NO: 1097051 - DNA, 22 bp, Artificial Sequence
  chemically synthesized
ctacctgtgctcatttgatagc

SEQ ID NO: 1097052 - DNA, 22 bp, Artificial Sequence
  chemically synthesized
tccagacttctacctgtgctca

SEQ ID NO: 1097053 - DNA, 22 bp, Artificial Sequence
  chemically synthesized
gtccagacttctacctgtgctc

SEQ ID NO: 1097054 - DNA, 22 bp, Artificial Sequence
  chemically synthesized
gctatcaaatgagcacaggtag

SEQ ID NO: 1097055 - DNA, 22 bp, Artificial Sequence
  chemically synthesized
tcaaatgagcacaggtagaagt

SEQ ID NO: 1097056 - DNA, 22 bp, Artificial Sequence
  chemically synthesized
gcaatagtaccttgtccagact

SEQ ID NO: 1097057 - DNA, 22 bp, Artificial Sequence
  chemically synthesized
gaggttagcaatagtaccttgt

SEQ ID NO: 1097058 - DNA, 22 bp, Artificial Sequence
  chemically synthesized
cctggaggttagcaatagtacc

SEQ ID NO: 1097059 - DNA, 22 bp, Artificial Sequence
  chemically synthesized
actacctggaggttagcaatag

SEQ ID NO: 1097060 - DNA, 22 bp, Artificial Sequence
  chemically synthesized
cactacctggaggttagcaata

SEQ ID NO: 1097061 - DNA, 22 bp, Artificial Sequence
  chemically synthesized
gacaaggtactattgctaacct

SEQ ID NO: 1097062 - DNA, 22 bp, Artificial Sequence
  chemically synthesized
aggcaacttcactacctggagg

SEQ ID NO: 1097063 - DNA, 22 bp, Artificial Sequence
  chemically synthesized
aaggcaacttcactacctggag

SEQ ID NO: 1097064 - DNA, 22 bp, Artificial Sequence
  chemically synthesized
taaggcaacttcactacctgga

SEQ ID NO: 1097065 - DNA, 22 bp, Artificial Sequence
  chemically synthesized
tttaaggcaacttcactacctg

SEQ ID NO: 1097066 - DNA, 22 bp, Artificial Sequence
  chemically synthesized
ttgctaacctccaggtagtgaa

SEQ ID NO: 1097067 - DNA, 22 bp, Artificial Sequence
  chemically synthesized
ctttaaggcaacttcactacct

SEQ ID NO: 1097068 - DNA, 22 bp, Artificial Sequence
  chemically synthesized
ctaacctccaggtagtgaagtt

SEQ ID NO: 1097069 - DNA, 22 bp, Artificial Sequence
  chemically synthesized
acctccaggtagtgaagttgcc

SEQ ID NO: 1097070 - DNA, 22 bp, Artificial Sequence
  chemically synthesized
aagacagtttctttaaggcaac

SEQ ID NO: 1097071 - DNA, 22 bp, Artificial Sequence
  chemically synthesized
caggtagtgaagttgccttaaa

SEQ ID NO: 1097072 - DNA, 22 bp, Artificial Sequence
  chemically synthesized
ctcaagacagtttctttaaggc

SEQ ID NO: 1097073 - DNA, 22 bp, Artificial Sequence
  chemically synthesized
ctactcaagacagtttctttaa

SEQ ID NO: 1097074 - DNA, 22 bp, Artificial Sequence
  chemically synthesized
agcctgctactcaagacagttt

SEQ ID NO: 1097075 - DNA, 22 bp, Artificial Sequence
  chemically synthesized
cagcctgctactcaagacagtt

SEQ ID NO: 1097076 - DNA, 22 bp, Artificial Sequence
  chemically synthesized
tcagcctgctactcaagacagt

SEQ ID NO: 1097077 - DNA, 22 bp, Artificial Sequence
  chemically synthesized
ccttaaagaaactgtcttgagt

SEQ ID NO: 1097078 - DNA, 22 bp, Artificial Sequence
  chemically synthesized
agttttcagcctgctactcaag

SEQ ID NO: 1097079 - DNA, 22 bp, Artificial Sequence
  chemically synthesized
aaagaaactgtcttgagtagca

SEQ ID NO: 1097080 - DNA, 22 bp, Artificial Sequence
  chemically synthesized
gagttttcagcctgctactcaa

SEQ ID NO: 1097081 - DNA, 22 bp, Artificial Sequence
  chemically synthesized
aagaaactgtcttgagtagcag

SEQ ID NO: 1097082 - DNA, 22 bp, Artificial Sequence
  chemically synthesized
ttgagttttcagcctgctactc

SEQ ID NO: 1097083 - DNA, 22 bp, Artificial Sequence
  chemically synthesized
cttgagttttcagcctgctact

SEQ ID NO: 1097084 - DNA, 22 bp, Artificial Sequence
  chemically synthesized
atttcttgagttttcagcctgc

SEQ ID NO: 1097085 - DNA, 22 bp, Artificial Sequence
  chemically synthesized
catttcttgagttttcagcctg

SEQ ID NO: 1097086 - DNA, 22 bp, Artificial Sequence
  chemically synthesized
tcttgagtagcaggctgaaaac

SEQ ID NO: 1097087 - DNA, 22 bp, Artificial Sequence
  chemically synthesized
gagtagcaggctgaaaactcaa

SEQ ID NO: 1097088 - DNA, 22 bp, Artificial Sequence
  chemically synthesized
agtagcaggctgaaaactcaag

SEQ ID NO: 1097089 - DNA, 22 bp, Artificial Sequence
  chemically synthesized
gcaggaagatttcatttcttga

SEQ ID NO: 1097090 - DNA, 22 bp, Artificial Sequence
  chemically synthesized
aaaactcaagaaatgaaatctt

SEQ ID NO: 1097091 - DNA, 22 bp, Artificial Sequence
  chemically synthesized
gaagagttggcaggaagatttc

SEQ ID NO: 1097092 - DNA, 22 bp, Artificial Sequence
  chemically synthesized
aagaaatgaaatcttcctgcca

SEQ ID NO: 1097093 - DNA, 22 bp, Artificial Sequence
  chemically synthesized
gcaacaaccactggaagagttg

SEQ ID NO: 1097094 - DNA, 22 bp, Artificial Sequence
  chemically synthesized
tggcaacaaccactggaagagt

SEQ ID NO: 1097095 - DNA, 22 bp, Artificial Sequence
  chemically synthesized
cctgccaactcttccagtggtt

SEQ ID NO: 1097096 - DNA, 22 bp, Artificial Sequence
  chemically synthesized
ctgccaactcttccagtggttg

SEQ ID NO: 1097097 - DNA, 22 bp, Artificial Sequence
  chemically synthesized
gaagcctctggcaacaaccact

SEQ ID NO: 1097098 - DNA, 22 bp, Artificial Sequence
  chemically synthesized
ccaactcttccagtggttgttg

SEQ ID NO: 1097099 - DNA, 22 bp, Artificial Sequence
  chemically synthesized
tggaagcctctggcaacaacca

SEQ ID NO: 1097100 - DNA, 22 bp, Artificial Sequence
  chemically synthesized
ttccagtggttgttgccagagg

SEQ ID NO: 1097101 - DNA, 22 bp, Artificial Sequence
  chemically synthesized
ccagtggttgttgccagaggct

SEQ ID NO: 1097102 - DNA, 22 bp, Artificial Sequence
  chemically synthesized
cagtggttgttgccagaggctt

SEQ ID NO: 1097103 - DNA, 22 bp, Artificial Sequence
  chemically synthesized
ttgccagaggcttccagagttt

SEQ ID NO: 1097104 - DNA, 22 bp, Artificial Sequence
  chemically synthesized
ccagaggcttccagagtttacc

SEQ ID NO: 1097105 - DNA, 22 bp, Artificial Sequence
  chemically synthesized
ccagagtttacctctttttact

SEQ ID NO: 1097106 - DNA, 22 bp, Artificial Sequence
  chemically synthesized
cagagtttacctctttttacta

SEQ ID NO: 1097107 - DNA, 22 bp, Artificial Sequence
  chemically synthesized
gtatgggggtgatagtaaaaag

SEQ ID NO: 1097108 - DNA, 22 bp, Artificial Sequence
  chemically synthesized
agtatgggggtgatagtaaaaa

SEQ ID NO: 1097109 - DNA, 22 bp, Artificial Sequence
  chemically synthesized
gtttagtatgggggtgatagta

SEQ ID NO: 1097110 - DNA, 22 bp, Artificial Sequence
  chemically synthesized
acctctttttactatcaccccc

SEQ ID NO: 1097111 - DNA, 22 bp, Artificial Sequence
  chemically synthesized
cctctttttactatcaccccca

SEQ ID NO: 1097112 - DNA, 22 bp, Artificial Sequence
  chemically synthesized
tttttactatcacccccatact

SEQ ID NO: 1097113 - DNA, 22 bp, Artificial Sequence
  chemically synthesized
caaaattggtttagtatggggg

SEQ ID NO: 1097114 - DNA, 22 bp, Artificial Sequence
  chemically synthesized
tttactatcacccccatactaa

SEQ ID NO: 1097115 - DNA, 22 bp, Artificial Sequence
  chemically synthesized
ttactatcacccccatactaaa

SEQ ID NO: 1097116 - DNA, 22 bp, Artificial Sequence
  chemically synthesized
tactatcacccccatactaaac

SEQ ID NO: 1097117 - DNA, 22 bp, Artificial Sequence
  chemically synthesized
gctacaaaattggtttagtatg

SEQ ID NO: 1097118 - DNA, 22 bp, Artificial Sequence
  chemically synthesized
actatcacccccatactaaacc

SEQ ID NO: 1097119 - DNA, 22 bp, Artificial Sequence
  chemically synthesized
ctatcacccccatactaaacca

SEQ ID NO: 1097120 - DNA, 22 bp, Artificial Sequence
  chemically synthesized
tcacccccatactaaaccaatt

SEQ ID NO: 1097121 - DNA, 22 bp, Artificial Sequence
  chemically synthesized
gtctagctacaaaattggttta

SEQ ID NO: 1097122 - DNA, 22 bp, Artificial Sequence
  chemically synthesized
ataattggtctagctacaaaat

SEQ ID NO: 1097123 - DNA, 22 bp, Artificial Sequence
  chemically synthesized
gataattggtctagctacaaaa

SEQ ID NO: 1097124 - DNA, 22 bp, Artificial Sequence
  chemically synthesized
tgataattggtctagctacaaa

SEQ ID NO: 1097125 - DNA, 22 bp, Artificial Sequence
  chemically synthesized
aaccaattttgtagctagacca

SEQ ID NO: 1097126 - DNA, 22 bp, Artificial Sequence
  chemically synthesized
acatgttttgataattggtcta

SEQ ID NO: 1097127 - DNA, 22 bp, Artificial Sequence
  chemically synthesized
attgacatgttttgataattgg

SEQ ID NO: 1097128 - DNA, 22 bp, Artificial Sequence
  chemically synthesized
tgtagctagaccaattatcaaa

SEQ ID NO: 1097129 - DNA, 22 bp, Artificial Sequence
  chemically synthesized
gtagctagaccaattatcaaaa

SEQ ID NO: 1097130 - DNA, 22 bp, Artificial Sequence
  chemically synthesized
tagctagaccaattatcaaaac

SEQ ID NO: 1097131 - DNA, 22 bp, Artificial Sequence
  chemically synthesized
cattgattgacatgttttgata

SEQ ID NO: 1097132 - DNA, 22 bp, Artificial Sequence
  chemically synthesized
tctacattgattgacatgtttt

SEQ ID NO: 1097133 - DNA, 22 bp, Artificial Sequence
  chemically synthesized
gaccaattatcaaaacatgtca

SEQ ID NO: 1097134 - DNA, 22 bp, Artificial Sequence
  chemically synthesized
gtctacattgattgacatgttt

SEQ ID NO: 1097135 - DNA, 22 bp, Artificial Sequence
  chemically synthesized
tcaaaacatgtcaatcaatgta

SEQ ID NO: 1097136 - DNA, 22 bp, Artificial Sequence
  chemically synthesized
caacaaatttgtctacattgat

SEQ ID NO: 1097137 - DNA, 22 bp, Artificial Sequence
  chemically synthesized
aaatgagtgttccaacaaattt

SEQ ID NO: 1097138 - DNA, 22 bp, Artificial Sequence
  chemically synthesized
gaaatgagtgttccaacaaatt

SEQ ID NO: 1097139 - DNA, 22 bp, Artificial Sequence
  chemically synthesized
aaaaccatccttgaaatgagtg

SEQ ID NO: 1097140 - DNA, 22 bp, Artificial Sequence
  chemically synthesized
gaaaaccatccttgaaatgagt

SEQ ID NO: 1097141 - DNA, 22 bp, Artificial Sequence
  chemically synthesized
gttggaacactcatttcaagga

SEQ ID NO: 1097142 - DNA, 22 bp, Artificial Sequence
  chemically synthesized
ttggaacactcatttcaaggat

SEQ ID NO: 1097143 - DNA, 22 bp, Artificial Sequence
  chemically synthesized
aaatttgaaaaccatccttgaa

SEQ ID NO: 1097144 - DNA, 22 bp, Artificial Sequence
  chemically synthesized
aaaatttgaaaaccatccttga

SEQ ID NO: 1097145 - DNA, 22 bp, Artificial Sequence
  chemically synthesized
gaacactcatttcaaggatggt

SEQ ID NO: 1097146 - DNA, 22 bp, Artificial Sequence
  chemically synthesized
taaaatttgaaaaccatccttg

SEQ ID NO: 1097147 - DNA, 22 bp, Artificial Sequence
  chemically synthesized
ttaaaatttgaaaaccatcctt

SEQ ID NO: 1097148 - DNA, 22 bp, Artificial Sequence
  chemically synthesized
aaatttttaaaatttgaaaacc

SEQ ID NO: 1097149 - DNA, 22 bp, Artificial Sequence
  chemically synthesized
atttcaaggatggttttcaaat

SEQ ID NO: 1097150 - DNA, 22 bp, Artificial Sequence
  chemically synthesized
tctcaaatttttaaaatttgaa

SEQ ID NO: 1097151 - DNA, 22 bp, Artificial Sequence
  chemically synthesized
caaggatggttttcaaatttta

SEQ ID NO: 1097152 - DNA, 22 bp, Artificial Sequence
  chemically synthesized
aaggatggttttcaaattttaa

SEQ ID NO: 1097153 - DNA, 22 bp, Artificial Sequence
  chemically synthesized
gagtaaactgtctcaaattttt

SEQ ID NO: 1097154 - DNA, 22 bp, Artificial Sequence
  chemically synthesized
tagagtaaactgtctcaaattt

SEQ ID NO: 1097155 - DNA, 22 bp, Artificial Sequence
  chemically synthesized
tcaaattttaaaaatttgagac

SEQ ID NO: 1097156 - DNA, 22 bp, Artificial Sequence
  chemically synthesized
caaattttaaaaatttgagaca

SEQ ID NO: 1097157 - DNA, 22 bp, Artificial Sequence
  chemically synthesized
aaattttaaaaatttgagacag

SEQ ID NO: 1097158 - DNA, 22 bp, Artificial Sequence
  chemically synthesized
tgctctagagtaaactgtctca

SEQ ID NO: 1097159 - DNA, 22 bp, Artificial Sequence
  chemically synthesized
ctgtgctctagagtaaactgtc

SEQ ID NO: 1097160 - DNA, 22 bp, Artificial Sequence
  chemically synthesized
taaaaatttgagacagtttact

SEQ ID NO: 1097161 - DNA, 22 bp, Artificial Sequence
  chemically synthesized
cctgtgctctagagtaaactgt

SEQ ID NO: 1097162 - DNA, 22 bp, Artificial Sequence
  chemically synthesized
aaaaatttgagacagtttactc

SEQ ID NO: 1097163 - DNA, 22 bp, Artificial Sequence
  chemically synthesized
tcctgtgctctagagtaaactg

SEQ ID NO: 1097164 - DNA, 22 bp, Artificial Sequence
  chemically synthesized
aaaatttgagacagtttactct

SEQ ID NO: 1097165 - DNA, 22 bp, Artificial Sequence
  chemically synthesized
ttttcctgtgctctagagtaaa

SEQ ID NO: 1097166 - DNA, 22 bp, Artificial Sequence
  chemically synthesized
attttcctgtgctctagagtaa

SEQ ID NO: 1097167 - DNA, 22 bp, Artificial Sequence
  chemically synthesized
ttattttcctgtgctctagagt

SEQ ID NO: 1097168 - DNA, 22 bp, Artificial Sequence
  chemically synthesized
gagacagtttactctagagcac

SEQ ID NO: 1097169 - DNA, 22 bp, Artificial Sequence
  chemically synthesized
tcttattttcctgtgctctaga

SEQ ID NO: 1097170 - DNA, 22 bp, Artificial Sequence
  chemically synthesized
agacagtttactctagagcaca

SEQ ID NO: 1097171 - DNA, 22 bp, Artificial Sequence
  chemically synthesized
actctagagcacaggaaaataa

SEQ ID NO: 1097172 - DNA, 22 bp, Artificial Sequence
  chemically synthesized
ctctagagcacaggaaaataag

SEQ ID NO: 1097173 - DNA, 22 bp, Artificial Sequence
  chemically synthesized
tagagcacaggaaaataagaga

SEQ ID NO: 1097174 - DNA, 22 bp, Artificial Sequence
  chemically synthesized
gagcacaggaaaataagagaga

SEQ ID NO: 1097175 - DNA, 22 bp, Artificial Sequence
  chemically synthesized
tgtcaccaacaacccagtcaga

SEQ ID NO: 1097176 - DNA, 22 bp, Artificial Sequence
  chemically synthesized
cctatgtcaccaacaacccagt

SEQ ID NO: 1097177 - DNA, 22 bp, Artificial Sequence
  chemically synthesized
gcctatgtcaccaacaacccag

SEQ ID NO: 1097178 - DNA, 22 bp, Artificial Sequence
  chemically synthesized
tgagcgatttgcctatgtcacc

SEQ ID NO: 1097179 - DNA, 22 bp, Artificial Sequence
  chemically synthesized
actgggttgttggtgacatagg

SEQ ID NO: 1097180 - DNA, 22 bp, Artificial Sequence
  chemically synthesized
cctatgagcgatttgcctatgt

SEQ ID NO: 1097181 - DNA, 22 bp, Artificial Sequence
  chemically synthesized
ggttgttggtgacataggcaaa

SEQ ID NO: 1097182 - DNA, 22 bp, Artificial Sequence
  chemically synthesized
tccctatgagcgatttgcctat

SEQ ID NO: 1097183 - DNA, 22 bp, Artificial Sequence
  chemically synthesized
ttggtgacataggcaaatcgct

SEQ ID NO: 1097184 - DNA, 22 bp, Artificial Sequence
  chemically synthesized
cctctccctatgagcgatttgc

SEQ ID NO: 1097185 - DNA, 22 bp, Artificial Sequence
  chemically synthesized
ccctctccctatgagcgatttg

SEQ ID NO: 1097186 - DNA, 22 bp, Artificial Sequence
  chemically synthesized
gtgacataggcaaatcgctcat

SEQ ID NO: 1097187 - DNA, 22 bp, Artificial Sequence
  chemically synthesized
ttccctctccctatgagcgatt

SEQ ID NO: 1097188 - DNA, 22 bp, Artificial Sequence
  chemically synthesized
gccctcttccctctccctatga

SEQ ID NO: 1097189 - DNA, 22 bp, Artificial Sequence
  chemically synthesized
tggccctcttccctctccctat

SEQ ID NO: 1097190 - DNA, 22 bp, Artificial Sequence
  chemically synthesized
ctggccctcttccctctcccta

SEQ ID NO: 1097191 - DNA, 22 bp, Artificial Sequence
  chemically synthesized
ttctggccctcttccctctccc

SEQ ID NO: 1097192 - DNA, 22 bp, Artificial Sequence
  chemically synthesized
agtgcctcttctggccctcttc

SEQ ID NO: 1097193 - DNA, 22 bp, Artificial Sequence
  chemically synthesized
atagggagagggaagagggcca

SEQ ID NO: 1097194 - DNA, 22 bp, Artificial Sequence
  chemically synthesized
gttcagtgcctcttctggccct

SEQ ID NO: 1097195 - DNA, 22 bp, Artificial Sequence
  chemically synthesized
ggttcagtgcctcttctggccc

SEQ ID NO: 1097196 - DNA, 22 bp, Artificial Sequence
  chemically synthesized
tggttcagtgcctcttctggcc

SEQ ID NO: 1097197 - DNA, 22 bp, Artificial Sequence
  chemically synthesized
ctttggttcagtgcctcttctg

SEQ ID NO: 1097198 - DNA, 22 bp, Artificial Sequence
  chemically synthesized
ggttcctttggttcagtgcctc

SEQ ID NO: 1097199 - DNA, 22 bp, Artificial Sequence
  chemically synthesized
tccctgggttcctttggttcag

SEQ ID NO: 1097200 - DNA, 22 bp, Artificial Sequence
  chemically synthesized
attatccctgggttcctttggt

SEQ ID NO: 1097201 - DNA, 22 bp, Artificial Sequence
  chemically synthesized
tgattatccctgggttcctttg

SEQ ID NO: 1097202 - DNA, 22 bp, Artificial Sequence
  chemically synthesized
ctctgattatccctgggttcct

SEQ ID NO: 1097203 - DNA, 22 bp, Artificial Sequence
  chemically synthesized
agctgctctgattatccctggg

SEQ ID NO: 1097204 - DNA, 22 bp, Artificial Sequence
  chemically synthesized
aaccaaaggaacccagggataa

SEQ ID NO: 1097205 - DNA, 22 bp, Artificial Sequence
  chemically synthesized
tgttcagctgctctgattatcc

SEQ ID NO: 1097206 - DNA, 22 bp, Artificial Sequence
  chemically synthesized
gtgttcagctgctctgattatc

SEQ ID NO: 1097207 - DNA, 22 bp, Artificial Sequence
  chemically synthesized
tagagtcatttgtgttcagctg

SEQ ID NO: 1097208 - DNA, 22 bp, Artificial Sequence
  chemically synthesized
aacacaaatgactctatagtat

SEQ ID NO: 1097209 - DNA, 22 bp, Artificial Sequence
  chemically synthesized
agatccgtaagtagatactata

SEQ ID NO: 1097210 - DNA, 22 bp, Artificial Sequence
  chemically synthesized
cctcagatccgtaagtagatac

SEQ ID NO: 1097211 - DNA, 22 bp, Artificial Sequence
  chemically synthesized
tatagtatctacttacggatct

SEQ ID NO: 1097212 - DNA, 22 bp, Artificial Sequence
  chemically synthesized
tagtatctacttacggatctga

SEQ ID NO: 1097213 - DNA, 22 bp, Artificial Sequence
  chemically synthesized
tatatggccactacctcagatc

SEQ ID NO: 1097214 - DNA, 22 bp, Artificial Sequence
  chemically synthesized
atatatggccactacctcagat

SEQ ID NO: 1097215 - DNA, 22 bp, Artificial Sequence
  chemically synthesized
tttatatatggccactacctca

SEQ ID NO: 1097216 - DNA, 22 bp, Artificial Sequence
  chemically synthesized
cttacggatctgaggtagtggc

SEQ ID NO: 1097217 - DNA, 22 bp, Artificial Sequence
  chemically synthesized
acggatctgaggtagtggccat

SEQ ID NO: 1097218 - DNA, 22 bp, Artificial Sequence
  chemically synthesized
cggatctgaggtagtggccata

SEQ ID NO: 1097219 - DNA, 22 bp, Artificial Sequence
  chemically synthesized
cgtctatttatatatggccact

SEQ ID NO: 1097220 - DNA, 22 bp, Artificial Sequence
  chemically synthesized
actgcgtctatttatatatggc

SEQ ID NO: 1097221 - DNA, 22 bp, Artificial Sequence
  chemically synthesized
tcactgcgtctatttatatatg

SEQ ID NO: 1097222 - DNA, 22 bp, Artificial Sequence
  chemically synthesized
ctcactgcgtctatttatatat

SEQ ID NO: 1097223 - DNA, 22 bp, Artificial Sequence
  chemically synthesized
aggtagtggccatatataaata

SEQ ID NO: 1097224 - DNA, 22 bp, Artificial Sequence
  chemically synthesized
tctcactgcgtctatttatata

SEQ ID NO: 1097225 - DNA, 22 bp, Artificial Sequence
  chemically synthesized
ctttctcactgcgtctatttat

SEQ ID NO: 1097226 - DNA, 22 bp, Artificial Sequence
  chemically synthesized
aattcctttctcactgcgtcta

SEQ ID NO: 1097227 - DNA, 22 bp, Artificial Sequence
  chemically synthesized
tatctcaattcctttctcactg

SEQ ID NO: 1097228 - DNA, 22 bp, Artificial Sequence
  chemically synthesized
gtatctcaattcctttctcact

SEQ ID NO: 1097229 - DNA, 22 bp, Artificial Sequence
  chemically synthesized
ttgtatctcaattcctttctca

SEQ ID NO: 1097230 - DNA, 22 bp, Artificial Sequence
  chemically synthesized
tcttgtatctcaattcctttct

SEQ ID NO: 1097231 - DNA, 22 bp, Artificial Sequence
  chemically synthesized
ctcttgtatctcaattcctttc

SEQ ID NO: 1097232 - DNA, 22 bp, Artificial Sequence
  chemically synthesized
tctcttgtatctcaattccttt

SEQ ID NO: 1097233 - DNA, 22 bp, Artificial Sequence
  chemically synthesized
ttctcttgtatctcaattcctt

SEQ ID NO: 1097234 - DNA, 22 bp, Artificial Sequence
  chemically synthesized
atatggccttttctcttgtatc

SEQ ID NO: 1097235 - DNA, 22 bp, Artificial Sequence
  chemically synthesized
tgtgtcactcatatggcctttt

SEQ ID NO: 1097236 - DNA, 22 bp, Artificial Sequence
  chemically synthesized
agatacaagagaaaaggccata

SEQ ID NO: 1097237 - DNA, 22 bp, Artificial Sequence
  chemically synthesized
cattgtgtgtcactcatatggc

SEQ ID NO: 1097238 - DNA, 22 bp, Artificial Sequence
  chemically synthesized
ccattgtgtgtcactcatatgg

SEQ ID NO: 1097239 - DNA, 22 bp, Artificial Sequence
  chemically synthesized
tccattgtgtgtcactcatatg

SEQ ID NO: 1097240 - DNA, 22 bp, Artificial Sequence
  chemically synthesized
ttccattgtgtgtcactcatat

SEQ ID NO: 1097241 - DNA, 22 bp, Artificial Sequence
  chemically synthesized
ttttccattgtgtgtcactcat

SEQ ID NO: 1097242 - DNA, 22 bp, Artificial Sequence
  chemically synthesized
cttttccattgtgtgtcactca

SEQ ID NO: 1097243 - DNA, 22 bp, Artificial Sequence
  chemically synthesized
tcttttccattgtgtgtcactc

SEQ ID NO: 1097244 - DNA, 22 bp, Artificial Sequence
  chemically synthesized
ctttcttttccattgtgtgtca

SEQ ID NO: 1097245 - DNA, 22 bp, Artificial Sequence
  chemically synthesized
cctttcttttccattgtgtgtc

SEQ ID NO: 1097246 - DNA, 22 bp, Artificial Sequence
  chemically synthesized
tcctttcttttccattgtgtgt

SEQ ID NO: 1097247 - DNA, 22 bp, Artificial Sequence
  chemically synthesized
ctttcctttcttttccattgtg

SEQ ID NO: 1097248 - DNA, 22 bp, Artificial Sequence
  chemically synthesized
cctttcctttcttttccattgt

SEQ ID NO: 1097249 - DNA, 22 bp, Artificial Sequence
  chemically synthesized
tcctttcctttcttttccattg

SEQ ID NO: 1097250 - DNA, 22 bp, Artificial Sequence
  chemically synthesized
ttcctttcctttcttttccatt

SEQ ID NO: 1097251 - DNA, 22 bp, Artificial Sequence
  chemically synthesized
cttttcctttcctttcttttcc

SEQ ID NO: 1097252 - DNA, 22 bp, Artificial Sequence
  chemically synthesized
ccttttcctttcctttcttttc

SEQ ID NO: 1097253 - DNA, 22 bp, Artificial Sequence
  chemically synthesized
tccttttcctttcctttctttt

SEQ ID NO: 1097254 - DNA, 22 bp, Artificial Sequence
  chemically synthesized
cctttccttttcctttcctttc

SEQ ID NO: 1097255 - DNA, 22 bp, Artificial Sequence
  chemically synthesized
ccctttccttttcctttccttt

SEQ ID NO: 1097256 - DNA, 22 bp, Artificial Sequence
  chemically synthesized
tccctttccttttcctttcctt

SEQ ID NO: 1097257 - DNA, 22 bp, Artificial Sequence
  chemically synthesized
actttccctttccttttccttt

SEQ ID NO: 1097258 - DNA, 22 bp, Artificial Sequence
  chemically synthesized
cactttccctttccttttcctt

SEQ ID NO: 1097259 - DNA, 22 bp, Artificial Sequence
  chemically synthesized
tcactttccctttccttttcct

SEQ ID NO: 1097260 - DNA, 22 bp, Artificial Sequence
  chemically synthesized
actttcactttccctttccttt

SEQ ID NO: 1097261 - DNA, 22 bp, Artificial Sequence
  chemically synthesized
cactttcactttccctttcctt

SEQ ID NO: 1097262 - DNA, 22 bp, Artificial Sequence
  chemically synthesized
tcactttcactttccctttcct

SEQ ID NO: 1097263 - DNA, 22 bp, Artificial Sequence
  chemically synthesized
actttcactttcactttccctt

SEQ ID NO: 1097264 - DNA, 22 bp, Artificial Sequence
  chemically synthesized
cactttcactttcactttccct

SEQ ID NO: 1097265 - DNA, 22 bp, Artificial Sequence
  chemically synthesized
tcactttcactttcactttccc

SEQ ID NO: 1097266 - DNA, 22 bp, Artificial Sequence
  chemically synthesized
actttcactttcactttcactt

SEQ ID NO: 1097267 - DNA, 22 bp, Artificial Sequence
  chemically synthesized
cactttcactttcactttcact

SEQ ID NO: 1097268 - DNA, 22 bp, Artificial Sequence
  chemically synthesized
tcactttcactttcactttcac

SEQ ID NO: 1097269 - DNA, 22 bp, Artificial Sequence
  chemically synthesized
actttcactttcactttcactt

SEQ ID NO: 1097270 - DNA, 22 bp, Artificial Sequence
  chemically synthesized
cactttcactttcactttcact

SEQ ID NO: 1097271 - DNA, 22 bp, Artificial Sequence
  chemically synthesized
tcactttcactttcactttcac

SEQ ID NO: 1097272 - DNA, 22 bp, Artificial Sequence
  chemically synthesized
cctttcactttcactttcactt

SEQ ID NO: 1097273 - DNA, 22 bp, Artificial Sequence
  chemically synthesized
ccctttcactttcactttcact

SEQ ID NO: 1097274 - DNA, 22 bp, Artificial Sequence
  chemically synthesized
tccctttcactttcactttcac

SEQ ID NO: 1097275 - DNA, 22 bp, Artificial Sequence
  chemically synthesized
cctttccctttcactttcactt

SEQ ID NO: 1097276 - DNA, 22 bp, Artificial Sequence
  chemically synthesized
ccctttccctttcactttcact

SEQ ID NO: 1097277 - DNA, 22 bp, Artificial Sequence
  chemically synthesized
tccctttccctttcactttcac

SEQ ID NO: 1097278 - DNA, 22 bp, Artificial Sequence
  chemically synthesized
cctttccctttccctttcactt

SEQ ID NO: 1097279 - DNA, 22 bp, Artificial Sequence
  chemically synthesized
ccctttccctttccctttcact

SEQ ID NO: 1097280 - DNA, 22 bp, Artificial Sequence
  chemically synthesized
tccctttccctttccctttcac

SEQ ID NO: 1097281 - DNA, 22 bp, Artificial Sequence
  chemically synthesized
cctttccctttccctttccctt

SEQ ID NO: 1097282 - DNA, 22 bp, Artificial Sequence
  chemically synthesized
ccctttccctttccctttccct

SEQ ID NO: 1097283 - DNA, 22 bp, Artificial Sequence
  chemically synthesized
tccctttccctttccctttccc

SEQ ID NO: 1097284 - DNA, 22 bp, Artificial Sequence
  chemically synthesized
cctttccctttccctttccctt

SEQ ID NO: 1097285 - DNA, 22 bp, Artificial Sequence
  chemically synthesized
ccctttccctttccctttccct

SEQ ID NO: 1097286 - DNA, 22 bp, Artificial Sequence
  chemically synthesized
tccctttccctttccctttccc

SEQ ID NO: 1097287 - DNA, 22 bp, Artificial Sequence
  chemically synthesized
cctttccctttccctttccctt

SEQ ID NO: 1097288 - DNA, 22 bp, Artificial Sequence
  chemically synthesized
ccctttccctttccctttccct

SEQ ID NO: 1097289 - DNA, 22 bp, Artificial Sequence
  chemically synthesized
tccctttccctttccctttccc

SEQ ID NO: 1097290 - DNA, 22 bp, Artificial Sequence
  chemically synthesized
cctttccctttccctttccctt

SEQ ID NO: 1097291 - DNA, 22 bp, Artificial Sequence
  chemically synthesized
ccctttccctttccctttccct

SEQ ID NO: 1097292 - DNA, 22 bp, Artificial Sequence
  chemically synthesized
tccctttccctttccctttccc

SEQ ID NO: 1097293 - DNA, 22 bp, Artificial Sequence
  chemically synthesized
cctttccctttccctttccctt

SEQ ID NO: 1097294 - DNA, 22 bp, Artificial Sequence
  chemically synthesized
ccctttccctttccctttccct

SEQ ID NO: 1097295 - DNA, 22 bp, Artificial Sequence
  chemically synthesized
tccctttccctttccctttccc

SEQ ID NO: 1097296 - DNA, 22 bp, Artificial Sequence
  chemically synthesized
cctttccctttccctttccctt

SEQ ID NO: 1097297 - DNA, 22 bp, Artificial Sequence
  chemically synthesized
ccctttccctttccctttccct

SEQ ID NO: 1097298 - DNA, 22 bp, Artificial Sequence
  chemically synthesized
tccctttccctttccctttccc

SEQ ID NO: 1097299 - DNA, 22 bp, Artificial Sequence
  chemically synthesized
cctttccctttccctttccctt

SEQ ID NO: 1097300 - DNA, 22 bp, Artificial Sequence
  chemically synthesized
ccctttccctttccctttccct

SEQ ID NO: 1097301 - DNA, 22 bp, Artificial Sequence
  chemically synthesized
ccttccctttccctttcccttt

SEQ ID NO: 1097302 - DNA, 22 bp, Artificial Sequence
  chemically synthesized
cccttccctttccctttccctt

SEQ ID NO: 1097303 - DNA, 22 bp, Artificial Sequence
  chemically synthesized
tcccttccctttccctttccct

SEQ ID NO: 1097304 - DNA, 22 bp, Artificial Sequence
  chemically synthesized
ctttcccttccctttccctttc

SEQ ID NO: 1097305 - DNA, 22 bp, Artificial Sequence
  chemically synthesized
cctttcccttccctttcccttt

SEQ ID NO: 1097306 - DNA, 22 bp, Artificial Sequence
  chemically synthesized
tcctttcccttccctttccctt

SEQ ID NO: 1097307 - DNA, 22 bp, Artificial Sequence
  chemically synthesized
cctttcctttcccttccctttc

SEQ ID NO: 1097308 - DNA, 22 bp, Artificial Sequence
  chemically synthesized
ccctttcctttcccttcccttt

SEQ ID NO: 1097309 - DNA, 22 bp, Artificial Sequence
  chemically synthesized
tccctttcctttcccttccctt

SEQ ID NO: 1097310 - DNA, 22 bp, Artificial Sequence
  chemically synthesized
cctttccctttcctttcccttc

SEQ ID NO: 1097311 - DNA, 22 bp, Artificial Sequence
  chemically synthesized
ccctttccctttcctttccctt

SEQ ID NO: 1097312 - DNA, 22 bp, Artificial Sequence
  chemically synthesized
tccctttccctttcctttccct

SEQ ID NO: 1097313 - DNA, 22 bp, Artificial Sequence
  chemically synthesized
cctttccctttccctttccttt

SEQ ID NO: 1097314 - DNA, 22 bp, Artificial Sequence
  chemically synthesized
ccctttccctttccctttcctt

SEQ ID NO: 1097315 - DNA, 22 bp, Artificial Sequence
  chemically synthesized
tccctttccctttccctttcct

SEQ ID NO: 1097316 - DNA, 22 bp, Artificial Sequence
  chemically synthesized
cctttccctttccctttccctt

SEQ ID NO: 1097317 - DNA, 22 bp, Artificial Sequence
  chemically synthesized
ccctttccctttccctttccct

SEQ ID NO: 1097318 - DNA, 22 bp, Artificial Sequence
  chemically synthesized
tccctttccctttccctttccc

SEQ ID NO: 1097319 - DNA, 22 bp, Artificial Sequence
  chemically synthesized
cctttccctttccctttccctt

SEQ ID NO: 1097320 - DNA, 22 bp, Artificial Sequence
  chemically synthesized
ccctttccctttccctttccct

SEQ ID NO: 1097321 - DNA, 22 bp, Artificial Sequence
  chemically synthesized
tccctttccctttccctttccc

SEQ ID NO: 1097322 - DNA, 22 bp, Artificial Sequence
  chemically synthesized
cctttccctttccctttccctt

SEQ ID NO: 1097323 - DNA, 22 bp, Artificial Sequence
  chemically synthesized
ccctttccctttccctttccct

SEQ ID NO: 1097324 - DNA, 22 bp, Artificial Sequence
  chemically synthesized
tccctttccctttccctttccc

SEQ ID NO: 1097325 - DNA, 22 bp, Artificial Sequence
  chemically synthesized
ctttccctttccctttcccttt

SEQ ID NO: 1097326 - DNA, 22 bp, Artificial Sequence
  chemically synthesized
cctttccctttccctttccctt

SEQ ID NO: 1097327 - DNA, 22 bp, Artificial Sequence
  chemically synthesized
tcctttccctttccctttccct

SEQ ID NO: 1097328 - DNA, 22 bp, Artificial Sequence
  chemically synthesized
ctttcctttccctttccctttc

SEQ ID NO: 1097329 - DNA, 22 bp, Artificial Sequence
  chemically synthesized
cctttcctttccctttcccttt

SEQ ID NO: 1097330 - DNA, 22 bp, Artificial Sequence
  chemically synthesized
tcctttcctttccctttccctt

SEQ ID NO: 1097331 - DNA, 22 bp, Artificial Sequence
  chemically synthesized
ctttcctttcctttccctttcc

SEQ ID NO: 1097332 - DNA, 22 bp, Artificial Sequence
  chemically synthesized
cctttcctttcctttccctttc

SEQ ID NO: 1097333 - DNA, 22 bp, Artificial Sequence
  chemically synthesized
tcctttcctttcctttcccttt

SEQ ID NO: 1097334 - DNA, 22 bp, Artificial Sequence
  chemically synthesized
ctttcctttcctttcctttccc

SEQ ID NO: 1097335 - DNA, 22 bp, Artificial Sequence
  chemically synthesized
cctttcctttcctttcctttcc

SEQ ID NO: 1097336 - DNA, 22 bp, Artificial Sequence
  chemically synthesized
tcctttcctttcctttcctttc

SEQ ID NO: 1097337 - DNA, 22 bp, Artificial Sequence
  chemically synthesized
ctttcctttcctttcctttcct

SEQ ID NO: 1097338 - DNA, 22 bp, Artificial Sequence
  chemically synthesized
cctttcctttcctttcctttcc

SEQ ID NO: 1097339 - DNA, 22 bp, Artificial Sequence
  chemically synthesized
tcctttcctttcctttcctttc

SEQ ID NO: 1097340 - DNA, 22 bp, Artificial Sequence
  chemically synthesized
ctttcctttcctttcctttcct

SEQ ID NO: 1097341 - DNA, 22 bp, Artificial Sequence
  chemically synthesized
cctttcctttcctttcctttcc

SEQ ID NO: 1097342 - DNA, 22 bp, Artificial Sequence
  chemically synthesized
tcctttcctttcctttcctttc

SEQ ID NO: 1097343 - DNA, 22 bp, Artificial Sequence
  chemically synthesized
ctttcctttcctttcctttcct

SEQ ID NO: 1097344 - DNA, 22 bp, Artificial Sequence
  chemically synthesized
cctttcctttcctttcctttcc

SEQ ID NO: 1097345 - DNA, 22 bp, Artificial Sequence
  chemically synthesized
tcctttcctttcctttcctttc

SEQ ID NO: 1097346 - DNA, 22 bp, Artificial Sequence
  chemically synthesized
ctttcctttcctttcctttcct

SEQ ID NO: 1097347 - DNA, 22 bp, Artificial Sequence
  chemically synthesized
cctttcctttcctttcctttcc

SEQ ID NO: 1097348 - DNA, 22 bp, Artificial Sequence
  chemically synthesized
tcctttcctttcctttcctttc

SEQ ID NO: 1097349 - DNA, 22 bp, Artificial Sequence
  chemically synthesized
ctttcctttcctttcctttcct

SEQ ID NO: 1097350 - DNA, 22 bp, Artificial Sequence
  chemically synthesized
cctttcctttcctttcctttcc

SEQ ID NO: 1097351 - DNA, 22 bp, Artificial Sequence
  chemically synthesized
tcctttcctttcctttcctttc

SEQ ID NO: 1097352 - DNA, 22 bp, Artificial Sequence
  chemically synthesized
ctttcctttcctttcctttcct

SEQ ID NO: 1097353 - DNA, 22 bp, Artificial Sequence
  chemically synthesized
cctttcctttcctttcctttcc

SEQ ID NO: 1097354 - DNA, 22 bp, Artificial Sequence
  chemically synthesized
tcctttcctttcctttcctttc

SEQ ID NO: 1097355 - DNA, 22 bp, Artificial Sequence
  chemically synthesized
ctttcctttcctttcctttcct

SEQ ID NO: 1097356 - DNA, 22 bp, Artificial Sequence
  chemically synthesized
cctttcctttcctttcctttcc

SEQ ID NO: 1097357 - DNA, 22 bp, Artificial Sequence
  chemically synthesized
tcctttcctttcctttcctttc

SEQ ID NO: 1097358 - DNA, 22 bp, Artificial Sequence
  chemically synthesized
ctttcctttcctttcctttcct

SEQ ID NO: 1097359 - DNA, 22 bp, Artificial Sequence
  chemically synthesized
cctttcctttcctttcctttcc

SEQ ID NO: 1097360 - DNA, 22 bp, Artificial Sequence
  chemically synthesized
tcctttcctttcctttcctttc

SEQ ID NO: 1097361 - DNA, 22 bp, Artificial Sequence
  chemically synthesized
ctttcctttcctttcctttcct

SEQ ID NO: 1097362 - DNA, 22 bp, Artificial Sequence
  chemically synthesized
cctttcctttcctttcctttcc

SEQ ID NO: 1097363 - DNA, 22 bp, Artificial Sequence
  chemically synthesized
tcctttcctttcctttcctttc

SEQ ID NO: 1097364 - DNA, 22 bp, Artificial Sequence
  chemically synthesized
ctttcctttcctttcctttcct

SEQ ID NO: 1097365 - DNA, 22 bp, Artificial Sequence
  chemically synthesized
cctttcctttcctttcctttcc

SEQ ID NO: 1097366 - DNA, 22 bp, Artificial Sequence
  chemically synthesized
tcctttcctttcctttcctttc

SEQ ID NO: 1097367 - DNA, 22 bp, Artificial Sequence
  chemically synthesized
ctttcctttcctttcctttcct

SEQ ID NO: 1097368 - DNA, 22 bp, Artificial Sequence
  chemically synthesized
cctttcctttcctttcctttcc

SEQ ID NO: 1097369 - DNA, 22 bp, Artificial Sequence
  chemically synthesized
tcctttcctttcctttcctttc

SEQ ID NO: 1097370 - DNA, 22 bp, Artificial Sequence
  chemically synthesized
ctttcctttcctttcctttcct

SEQ ID NO: 1097371 - DNA, 22 bp, Artificial Sequence
  chemically synthesized
cctttcctttcctttcctttcc

SEQ ID NO: 1097372 - DNA, 22 bp, Artificial Sequence
  chemically synthesized
tcctttcctttcctttcctttc

SEQ ID NO: 1097373 - DNA, 22 bp, Artificial Sequence
  chemically synthesized
ttcctttcctttcctttccttt

SEQ ID NO: 1097374 - DNA, 22 bp, Artificial Sequence
  chemically synthesized
tttcctttcctttcctttcctt

SEQ ID NO: 1097375 - DNA, 22 bp, Artificial Sequence
  chemically synthesized
ttttcctttcctttcctttcct

SEQ ID NO: 1097376 - DNA, 22 bp, Artificial Sequence
  chemically synthesized
ttttttcctttcctttcctttc

SEQ ID NO: 1097377 - DNA, 22 bp, Artificial Sequence
  chemically synthesized
atctcttttttcctttcctttc

SEQ ID NO: 1097378 - DNA, 22 bp, Artificial Sequence
  chemically synthesized
catctcttttttcctttccttt

SEQ ID NO: 1097379 - DNA, 22 bp, Artificial Sequence
  chemically synthesized
tttcatctcttttttcctttcc

SEQ ID NO: 1097380 - DNA, 22 bp, Artificial Sequence
  chemically synthesized
tatttcatctcttttttccttt

SEQ ID NO: 1097381 - DNA, 22 bp, Artificial Sequence
  chemically synthesized
ttctatttcatctcttttttcc

SEQ ID NO: 1097382 - DNA, 22 bp, Artificial Sequence
  chemically synthesized
attctatttcatctcttttttc

SEQ ID NO: 1097383 - DNA, 22 bp, Artificial Sequence
  chemically synthesized
tattctatttcatctctttttt

SEQ ID NO: 1097384 - DNA, 22 bp, Artificial Sequence
  chemically synthesized
aaggtattttattctatttcat

SEQ ID NO: 1097385 - DNA, 22 bp, Artificial Sequence
  chemically synthesized
tggtagagcccacaggattgaa

SEQ ID NO: 1097386 - DNA, 22 bp, Artificial Sequence
  chemically synthesized
gtggtagagcccacaggattga

SEQ ID NO: 1097387 - DNA, 22 bp, Artificial Sequence
  chemically synthesized
tttgtggtagagcccacaggat

SEQ ID NO: 1097388 - DNA, 22 bp, Artificial Sequence
  chemically synthesized
atttgtggtagagcccacagga

SEQ ID NO: 1097389 - DNA, 22 bp, Artificial Sequence
  chemically synthesized
tatttgtggtagagcccacagg

SEQ ID NO: 1097390 - DNA, 22 bp, Artificial Sequence
  chemically synthesized
caatcctgtgggctctaccaca

SEQ ID NO: 1097391 - DNA, 22 bp, Artificial Sequence
  chemically synthesized
aatcctgtgggctctaccacaa

SEQ ID NO: 1097392 - DNA, 22 bp, Artificial Sequence
  chemically synthesized
tgggctctaccacaaataaagt

SEQ ID NO: 1097393 - DNA, 22 bp, Artificial Sequence
  chemically synthesized
gccatagtcacagactttattt

SEQ ID NO: 1097394 - DNA, 22 bp, Artificial Sequence
  chemically synthesized
agccatagtcacagactttatt

SEQ ID NO: 1097395 - DNA, 22 bp, Artificial Sequence
  chemically synthesized
taccacaaataaagtctgtgac

SEQ ID NO: 1097396 - DNA, 22 bp, Artificial Sequence
  chemically synthesized
ccacaaataaagtctgtgacta

SEQ ID NO: 1097397 - DNA, 22 bp, Artificial Sequence
  chemically synthesized
ccagataggtcaaatgatttag

SEQ ID NO: 1097398 - DNA, 22 bp, Artificial Sequence
  chemically synthesized
tgactatggctaaatcatttga

SEQ ID NO: 1097399 - DNA, 22 bp, Artificial Sequence
  chemically synthesized
caattcccagataggtcaaatg

SEQ ID NO: 1097400 - DNA, 22 bp, Artificial Sequence
  chemically synthesized
tggctaaatcatttgacctatc

SEQ ID NO: 1097401 - DNA, 22 bp, Artificial Sequence
  chemically synthesized
aatcatttgacctatctgggaa

SEQ ID NO: 1097402 - DNA, 22 bp, Artificial Sequence
  chemically synthesized
tcagaaaactgcaattcccaga

SEQ ID NO: 1097403 - DNA, 22 bp, Artificial Sequence
  chemically synthesized
atcagaaaactgcaattcccag

SEQ ID NO: 1097404 - DNA, 22 bp, Artificial Sequence
  chemically synthesized
cttatcagaaaactgcaattcc

SEQ ID NO: 1097405 - DNA, 22 bp, Artificial Sequence
  chemically synthesized
gacctatctgggaattgcagtt

SEQ ID NO: 1097406 - DNA, 22 bp, Artificial Sequence
  chemically synthesized
tgcttatcagaaaactgcaatt

SEQ ID NO: 1097407 - DNA, 22 bp, Artificial Sequence
  chemically synthesized
acctatctgggaattgcagttt

SEQ ID NO: 1097408 - DNA, 22 bp, Artificial Sequence
  chemically synthesized
tctgcttatcagaaaactgcaa

SEQ ID NO: 1097409 - DNA, 22 bp, Artificial Sequence
  chemically synthesized
tctctgcttatcagaaaactgc

SEQ ID NO: 1097410 - DNA, 22 bp, Artificial Sequence
  chemically synthesized
tctgggaattgcagttttctga

SEQ ID NO: 1097411 - DNA, 22 bp, Artificial Sequence
  chemically synthesized
tctctctgcttatcagaaaact

SEQ ID NO: 1097412 - DNA, 22 bp, Artificial Sequence
  chemically synthesized
ctctctctgcttatcagaaaac

SEQ ID NO: 1097413 - DNA, 22 bp, Artificial Sequence
  chemically synthesized
ggaattgcagttttctgataag

SEQ ID NO: 1097414 - DNA, 22 bp, Artificial Sequence
  chemically synthesized
acacttctctctctgcttatca

SEQ ID NO: 1097415 - DNA, 22 bp, Artificial Sequence
  chemically synthesized
cagttttctgataagcagagag

SEQ ID NO: 1097416 - DNA, 22 bp, Artificial Sequence
  chemically synthesized
tgtaattcacacttctctctct

SEQ ID NO: 1097417 - DNA, 22 bp, Artificial Sequence
  chemically synthesized
gtgtaattcacacttctctctc

SEQ ID NO: 1097418 - DNA, 22 bp, Artificial Sequence
  chemically synthesized
tctgataagcagagagagaagt

SEQ ID NO: 1097419 - DNA, 22 bp, Artificial Sequence
  chemically synthesized
ctgataagcagagagagaagtg

SEQ ID NO: 1097420 - DNA, 22 bp, Artificial Sequence
  chemically synthesized
tgataagcagagagagaagtgt

SEQ ID NO: 1097421 - DNA, 22 bp, Artificial Sequence
  chemically synthesized
ataagcagagagagaagtgtga

SEQ ID NO: 1097422 - DNA, 22 bp, Artificial Sequence
  chemically synthesized
aaacttgtgtaattcacacttc

SEQ ID NO: 1097423 - DNA, 22 bp, Artificial Sequence
  chemically synthesized
gaaacttgtgtaattcacactt

SEQ ID NO: 1097424 - DNA, 22 bp, Artificial Sequence
  chemically synthesized
tgaaacttgtgtaattcacact

SEQ ID NO: 1097425 - DNA, 22 bp, Artificial Sequence
  chemically synthesized
gaaggtactttgaaacttgtgt

SEQ ID NO: 1097426 - DNA, 22 bp, Artificial Sequence
  chemically synthesized
cacaagtttcaaagtaccttct

SEQ ID NO: 1097427 - DNA, 22 bp, Artificial Sequence
  chemically synthesized
tcagaatgtgagagctagaagg

SEQ ID NO: 1097428 - DNA, 22 bp, Artificial Sequence
  chemically synthesized
atcagaatgtgagagctagaag

SEQ ID NO: 1097429 - DNA, 22 bp, Artificial Sequence
  chemically synthesized
tatcagaatgtgagagctagaa

SEQ ID NO: 1097430 - DNA, 22 bp, Artificial Sequence
  chemically synthesized
caaagtaccttctagctctcac

SEQ ID NO: 1097431 - DNA, 22 bp, Artificial Sequence
  chemically synthesized
aaagtaccttctagctctcaca

SEQ ID NO: 1097432 - DNA, 22 bp, Artificial Sequence
  chemically synthesized
aggaaaactttatcagaatgtg

SEQ ID NO: 1097433 - DNA, 22 bp, Artificial Sequence
  chemically synthesized
ctagctctcacattctgataaa

SEQ ID NO: 1097434 - DNA, 22 bp, Artificial Sequence
  chemically synthesized
tagctctcacattctgataaag

SEQ ID NO: 1097435 - DNA, 22 bp, Artificial Sequence
  chemically synthesized
gctctcacattctgataaagtt

SEQ ID NO: 1097436 - DNA, 22 bp, Artificial Sequence
  chemically synthesized
tcacattctgataaagttttcc

SEQ ID NO: 1097437 - DNA, 22 bp, Artificial Sequence
  chemically synthesized
acattctgataaagttttcctc

SEQ ID NO: 1097438 - DNA, 22 bp, Artificial Sequence
  chemically synthesized
gggaggtcacccctgaggaaaa

SEQ ID NO: 1097439 - DNA, 22 bp, Artificial Sequence
  chemically synthesized
ggggaggtcacccctgaggaaa

SEQ ID NO: 1097440 - DNA, 22 bp, Artificial Sequence
  chemically synthesized
tggggaggtcacccctgaggaa

SEQ ID NO: 1097441 - DNA, 22 bp, Artificial Sequence
  chemically synthesized
tgataaagttttcctcaggggt

SEQ ID NO: 1097442 - DNA, 22 bp, Artificial Sequence
  chemically synthesized
ataaagttttcctcaggggtga

SEQ ID NO: 1097443 - DNA, 22 bp, Artificial Sequence
  chemically synthesized
actttggggaggtcacccctga

SEQ ID NO: 1097444 - DNA, 22 bp, Artificial Sequence
  chemically synthesized
gactttggggaggtcacccctg

SEQ ID NO: 1097445 - DNA, 22 bp, Artificial Sequence
  chemically synthesized
aaatttgactttggggaggtca

SEQ ID NO: 1097446 - DNA, 22 bp, Artificial Sequence
  chemically synthesized
aaaatttgactttggggaggtc

SEQ ID NO: 1097447 - DNA, 22 bp, Artificial Sequence
  chemically synthesized
tcctcaggggtgacctccccaa

SEQ ID NO: 1097448 - DNA, 22 bp, Artificial Sequence
  chemically synthesized
cctcaggggtgacctccccaaa

SEQ ID NO: 1097449 - DNA, 22 bp, Artificial Sequence
  chemically synthesized
ctcaggggtgacctccccaaag

SEQ ID NO: 1097450 - DNA, 22 bp, Artificial Sequence
  chemically synthesized
aggggtgacctccccaaagtca

SEQ ID NO: 1097451 - DNA, 22 bp, Artificial Sequence
  chemically synthesized
cccaaagtcaaattttaaatta

SEQ ID NO: 1097452 - DNA, 22 bp, Artificial Sequence
  chemically synthesized
aaaagaccaaaataatttaaaa

SEQ ID NO: 1097453 - DNA, 22 bp, Artificial Sequence
  chemically synthesized
caaaagaccaaaataatttaaa

SEQ ID NO: 1097454 - DNA, 22 bp, Artificial Sequence
  chemically synthesized
gagtatttcaaaagaccaaaat

SEQ ID NO: 1097455 - DNA, 22 bp, Artificial Sequence
  chemically synthesized
taaattattttggtcttttgaa

SEQ ID NO: 1097456 - DNA, 22 bp, Artificial Sequence
  chemically synthesized
aaattattttggtcttttgaaa

SEQ ID NO: 1097457 - DNA, 22 bp, Artificial Sequence
  chemically synthesized
aattattttggtcttttgaaat

SEQ ID NO: 1097458 - DNA, 22 bp, Artificial Sequence
  chemically synthesized
ttttggtcttttgaaatactcc

SEQ ID NO: 1097459 - DNA, 22 bp, Artificial Sequence
  chemically synthesized
tggtcttttgaaatactccaat

SEQ ID NO: 1097460 - DNA, 22 bp, Artificial Sequence
  chemically synthesized
ggtcttttgaaatactccaatg

SEQ ID NO: 1097461 - DNA, 22 bp, Artificial Sequence
  chemically synthesized
gtcttttgaaatactccaatgg

SEQ ID NO: 1097462 - DNA, 22 bp, Artificial Sequence
  chemically synthesized
aatggacaagaaaaaccattgg

SEQ ID NO: 1097463 - DNA, 22 bp, Artificial Sequence
  chemically synthesized
ttgaaatactccaatggttttt

SEQ ID NO: 1097464 - DNA, 22 bp, Artificial Sequence
  chemically synthesized
taaatggacaagaaaaaccatt

SEQ ID NO: 1097465 - DNA, 22 bp, Artificial Sequence
  chemically synthesized
tgaaatactccaatggtttttc

SEQ ID NO: 1097466 - DNA, 22 bp, Artificial Sequence
  chemically synthesized
gaaatactccaatggtttttct

SEQ ID NO: 1097467 - DNA, 22 bp, Artificial Sequence
  chemically synthesized
aaatactccaatggtttttctt

SEQ ID NO: 1097468 - DNA, 22 bp, Artificial Sequence
  chemically synthesized
ttctaaatggacaagaaaaacc

SEQ ID NO: 1097469 - DNA, 22 bp, Artificial Sequence
  chemically synthesized
attctaaatggacaagaaaaac

SEQ ID NO: 1097470 - DNA, 22 bp, Artificial Sequence
  chemically synthesized
tattctaaatggacaagaaaaa

SEQ ID NO: 1097471 - DNA, 22 bp, Artificial Sequence
  chemically synthesized
ttattctaaatggacaagaaaa

SEQ ID NO: 1097472 - DNA, 22 bp, Artificial Sequence
  chemically synthesized
caatggtttttcttgtccattt

SEQ ID NO: 1097473 - DNA, 22 bp, Artificial Sequence
  chemically synthesized
ttcttgtccatttagaataaaa

SEQ ID NO: 1097474 - DNA, 22 bp, Artificial Sequence
  chemically synthesized
gagtatcacagtttttattcta

SEQ ID NO: 1097475 - DNA, 22 bp, Artificial Sequence
  chemically synthesized
tcttgtccatttagaataaaaa

SEQ ID NO: 1097476 - DNA, 22 bp, Artificial Sequence
  chemically synthesized
cttgtccatttagaataaaaac

SEQ ID NO: 1097477 - DNA, 22 bp, Artificial Sequence
  chemically synthesized
ttgtccatttagaataaaaact

SEQ ID NO: 1097478 - DNA, 22 bp, Artificial Sequence
  chemically synthesized
ttagagtatcacagtttttatt

SEQ ID NO: 1097479 - DNA, 22 bp, Artificial Sequence
  chemically synthesized
gttagagtatcacagtttttat

SEQ ID NO: 1097480 - DNA, 22 bp, Artificial Sequence
  chemically synthesized
gtccatttagaataaaaactgt

SEQ ID NO: 1097481 - DNA, 22 bp, Artificial Sequence
  chemically synthesized
tgttagagtatcacagttttta

SEQ ID NO: 1097482 - DNA, 22 bp, Artificial Sequence
  chemically synthesized
tccatttagaataaaaactgtg

SEQ ID NO: 1097483 - DNA, 22 bp, Artificial Sequence
  chemically synthesized
agaataaaaactgtgatactct

SEQ ID NO: 1097484 - DNA, 22 bp, Artificial Sequence
  chemically synthesized
gaataaaaactgtgatactcta

SEQ ID NO: 1097485 - DNA, 22 bp, Artificial Sequence
  chemically synthesized
acaaacgggttttgttagagta

SEQ ID NO: 1097486 - DNA, 22 bp, Artificial Sequence
  chemically synthesized
ttaacaaacgggttttgttaga

SEQ ID NO: 1097487 - DNA, 22 bp, Artificial Sequence
  chemically synthesized
tgatactctaacaaaacccgtt

SEQ ID NO: 1097488 - DNA, 22 bp, Artificial Sequence
  chemically synthesized
taacaaaacccgtttgttaaca

SEQ ID NO: 1097489 - DNA, 22 bp, Artificial Sequence
  chemically synthesized
acaaaacccgtttgttaacaga

SEQ ID NO: 1097490 - DNA, 22 bp, Artificial Sequence
  chemically synthesized
ggaggtgggcaaatatctgtta

SEQ ID NO: 1097491 - DNA, 22 bp, Artificial Sequence
  chemically synthesized
aggaggtgggcaaatatctgtt

SEQ ID NO: 1097492 - DNA, 22 bp, Artificial Sequence
  chemically synthesized
gttaacagatatttgcccacct

SEQ ID NO: 1097493 - DNA, 22 bp, Artificial Sequence
  chemically synthesized
ttaacagatatttgcccacctc

SEQ ID NO: 1097494 - DNA, 22 bp, Artificial Sequence
  chemically synthesized
agataagtcttaggaggtgggc

SEQ ID NO: 1097495 - DNA, 22 bp, Artificial Sequence
  chemically synthesized
acagatatttgcccacctccta

SEQ ID NO: 1097496 - DNA, 22 bp, Artificial Sequence
  chemically synthesized
cctcagataagtcttaggaggt

SEQ ID NO: 1097497 - DNA, 22 bp, Artificial Sequence
  chemically synthesized
gcccacctcctaagacttatct

SEQ ID NO: 1097498 - DNA, 22 bp, Artificial Sequence
  chemically synthesized
cccacctcctaagacttatctg

SEQ ID NO: 1097499 - DNA, 22 bp, Artificial Sequence
  chemically synthesized
ctaagacttatctgaggtaatt

SEQ ID NO: 1097500 - DNA, 22 bp, Artificial Sequence
  chemically synthesized
agacttatctgaggtaatttta

SEQ ID NO: 1097501 - DNA, 22 bp, Artificial Sequence
  chemically synthesized
aaggaaggaaaatgggataaaa

SEQ ID NO: 1097502 - DNA, 22 bp, Artificial Sequence
  chemically synthesized
atctgaggtaattttatcccat

SEQ ID NO: 1097503 - DNA, 22 bp, Artificial Sequence
  chemically synthesized
tctgaggtaattttatcccatt

SEQ ID NO: 1097504 - DNA, 22 bp, Artificial Sequence
  chemically synthesized
cctgaaggaaggaaaatgggat

SEQ ID NO: 1097505 - DNA, 22 bp, Artificial Sequence
  chemically synthesized
aggtaattttatcccattttcc

SEQ ID NO: 1097506 - DNA, 22 bp, Artificial Sequence
  chemically synthesized
tatcccattttccttccttcag

SEQ ID NO: 1097507 - DNA, 22 bp, Artificial Sequence
  chemically synthesized
atcccattttccttccttcagg

SEQ ID NO: 1097508 - DNA, 22 bp, Artificial Sequence
  chemically synthesized
tcccattttccttccttcaggc

SEQ ID NO: 1097509 - DNA, 22 bp, Artificial Sequence
  chemically synthesized
ggaagagaaagaaatctgcctg

SEQ ID NO: 1097510 - DNA, 22 bp, Artificial Sequence
  chemically synthesized
tccttccttcaggcagatttct

SEQ ID NO: 1097511 - DNA, 22 bp, Artificial Sequence
  chemically synthesized
ccttccttcaggcagatttctt

SEQ ID NO: 1097512 - DNA, 22 bp, Artificial Sequence
  chemically synthesized
attgggaagagaaagaaatctg

SEQ ID NO: 1097513 - DNA, 22 bp, Artificial Sequence
  chemically synthesized
cttccttcaggcagatttcttt

SEQ ID NO: 1097514 - DNA, 22 bp, Artificial Sequence
  chemically synthesized
ccttcaggcagatttctttctc

SEQ ID NO: 1097515 - DNA, 22 bp, Artificial Sequence
  chemically synthesized
cttcaggcagatttctttctct

SEQ ID NO: 1097516 - DNA, 22 bp, Artificial Sequence
  chemically synthesized
aagctaattgggaagagaaaga

SEQ ID NO: 1097517 - DNA, 22 bp, Artificial Sequence
  chemically synthesized
caggcagatttctttctcttcc

SEQ ID NO: 1097518 - DNA, 22 bp, Artificial Sequence
  chemically synthesized
aggcagatttctttctcttccc

SEQ ID NO: 1097519 - DNA, 22 bp, Artificial Sequence
  chemically synthesized
caaagaccctgaagctaattgg

SEQ ID NO: 1097520 - DNA, 22 bp, Artificial Sequence
  chemically synthesized
ctttctcttcccaattagcttc

SEQ ID NO: 1097521 - DNA, 22 bp, Artificial Sequence
  chemically synthesized
tgcaaagaccctgaagctaatt

SEQ ID NO: 1097522 - DNA, 22 bp, Artificial Sequence
  chemically synthesized
tttctcttcccaattagcttca

SEQ ID NO: 1097523 - DNA, 22 bp, Artificial Sequence
  chemically synthesized
ctgcaaagaccctgaagctaat

SEQ ID NO: 1097524 - DNA, 22 bp, Artificial Sequence
  chemically synthesized
tctcttcccaattagcttcagg

SEQ ID NO: 1097525 - DNA, 22 bp, Artificial Sequence
  chemically synthesized
ctcttcccaattagcttcaggg

SEQ ID NO: 1097526 - DNA, 22 bp, Artificial Sequence
  chemically synthesized
tcttcccaattagcttcagggt

SEQ ID NO: 1097527 - DNA, 22 bp, Artificial Sequence
  chemically synthesized
ttcccaattagcttcagggtct

SEQ ID NO: 1097528 - DNA, 22 bp, Artificial Sequence
  chemically synthesized
cccaattagcttcagggtcttt

SEQ ID NO: 1097529 - DNA, 22 bp, Artificial Sequence
  chemically synthesized
ccaattagcttcagggtctttg

SEQ ID NO: 1097530 - DNA, 22 bp, Artificial Sequence
  chemically synthesized
agagagcatagcttctgcaaag

SEQ ID NO: 1097531 - DNA, 22 bp, Artificial Sequence
  chemically synthesized
gcttcagggtctttgcagaagc

SEQ ID NO: 1097532 - DNA, 22 bp, Artificial Sequence
  chemically synthesized
ttcagagagcatagcttctgca

SEQ ID NO: 1097533 - DNA, 22 bp, Artificial Sequence
  chemically synthesized
tattcagagagcatagcttctg

SEQ ID NO: 1097534 - DNA, 22 bp, Artificial Sequence
  chemically synthesized
cagggtctttgcagaagctatg

SEQ ID NO: 1097535 - DNA, 22 bp, Artificial Sequence
  chemically synthesized
agggtctttgcagaagctatgc

SEQ ID NO: 1097536 - DNA, 22 bp, Artificial Sequence
  chemically synthesized
tgcagaagctatgctctctgaa

SEQ ID NO: 1097537 - DNA, 22 bp, Artificial Sequence
  chemically synthesized
gcagaagctatgctctctgaat

SEQ ID NO: 1097538 - DNA, 22 bp, Artificial Sequence
  chemically synthesized
cagaagctatgctctctgaata

SEQ ID NO: 1097539 - DNA, 22 bp, Artificial Sequence
  chemically synthesized
tggaaacacattctattcagag

SEQ ID NO: 1097540 - DNA, 22 bp, Artificial Sequence
  chemically synthesized
atggaaacacattctattcaga

SEQ ID NO: 1097541 - DNA, 22 bp, Artificial Sequence
  chemically synthesized
tatggaaacacattctattcag

SEQ ID NO: 1097542 - DNA, 22 bp, Artificial Sequence
  chemically synthesized
tgctctctgaatagaatgtgtt

SEQ ID NO: 1097543 - DNA, 22 bp, Artificial Sequence
  chemically synthesized
aaaaaatctttatggaaacaca

SEQ ID NO: 1097544 - DNA, 22 bp, Artificial Sequence
  chemically synthesized
tctgaatagaatgtgtttccat

SEQ ID NO: 1097545 - DNA, 22 bp, Artificial Sequence
  chemically synthesized
aaaaaaatctttatggaaacac

SEQ ID NO: 1097546 - DNA, 22 bp, Artificial Sequence
  chemically synthesized
tgaatagaatgtgtttccataa

SEQ ID NO: 1097547 - DNA, 22 bp, Artificial Sequence
  chemically synthesized
aatagaatgtgtttccataaag

SEQ ID NO: 1097548 - DNA, 22 bp, Artificial Sequence
  chemically synthesized
ccataaagatttttttaagtgg

SEQ ID NO: 1097549 - DNA, 22 bp, Artificial Sequence
  chemically synthesized
cataaagatttttttaagtggt

SEQ ID NO: 1097550 - DNA, 22 bp, Artificial Sequence
  chemically synthesized
aatcataaggaaaagccaacca

SEQ ID NO: 1097551 - DNA, 22 bp, Artificial Sequence
  chemically synthesized
ttttaagtggttggcttttcct

SEQ ID NO: 1097552 - DNA, 22 bp, Artificial Sequence
  chemically synthesized
tttaagtggttggcttttcctt

SEQ ID NO: 1097553 - DNA, 22 bp, Artificial Sequence
  chemically synthesized
ttaagtggttggcttttcctta

SEQ ID NO: 1097554 - DNA, 22 bp, Artificial Sequence
  chemically synthesized
taagtggttggcttttccttat

SEQ ID NO: 1097555 - DNA, 22 bp, Artificial Sequence
  chemically synthesized
aagtggttggcttttccttatg

SEQ ID NO: 1097556 - DNA, 22 bp, Artificial Sequence
  chemically synthesized
agtggttggcttttccttatga

SEQ ID NO: 1097557 - DNA, 22 bp, Artificial Sequence
  chemically synthesized
gcttttccttatgattcagttc

SEQ ID NO: 1097558 - DNA, 22 bp, Artificial Sequence
  chemically synthesized
tatgtaatatgagagaactgaa

SEQ ID NO: 1097559 - DNA, 22 bp, Artificial Sequence
  chemically synthesized
ttccttatgattcagttctctc

SEQ ID NO: 1097560 - DNA, 22 bp, Artificial Sequence
  chemically synthesized
tccttatgattcagttctctca

SEQ ID NO: 1097561 - DNA, 22 bp, Artificial Sequence
  chemically synthesized
ccttatgattcagttctctcat

SEQ ID NO: 1097562 - DNA, 22 bp, Artificial Sequence
  chemically synthesized
cttatgattcagttctctcata

SEQ ID NO: 1097563 - DNA, 22 bp, Artificial Sequence
  chemically synthesized
atgattcagttctctcatatta

SEQ ID NO: 1097564 - DNA, 22 bp, Artificial Sequence
  chemically synthesized
tgattcagttctctcatattac

SEQ ID NO: 1097565 - DNA, 22 bp, Artificial Sequence
  chemically synthesized
tgaagaattgtatgtaatatga

SEQ ID NO: 1097566 - DNA, 22 bp, Artificial Sequence
  chemically synthesized
atgaagaattgtatgtaatatg

SEQ ID NO: 1097567 - DNA, 22 bp, Artificial Sequence
  chemically synthesized
agttctctcatattacatacaa

SEQ ID NO: 1097568 - DNA, 22 bp, Artificial Sequence
  chemically synthesized
tctcatattacatacaattctt

SEQ ID NO: 1097569 - DNA, 22 bp, Artificial Sequence
  chemically synthesized
tagagcatttatgaagaattgt

SEQ ID NO: 1097570 - DNA, 22 bp, Artificial Sequence
  chemically synthesized
tcatattacatacaattcttca

SEQ ID NO: 1097571 - DNA, 22 bp, Artificial Sequence
  chemically synthesized
atagagcatttatgaagaattg

SEQ ID NO: 1097572 - DNA, 22 bp, Artificial Sequence
  chemically synthesized
atattacatacaattcttcata

SEQ ID NO: 1097573 - DNA, 22 bp, Artificial Sequence
  chemically synthesized
acttatagagcatttatgaaga

SEQ ID NO: 1097574 - DNA, 22 bp, Artificial Sequence
  chemically synthesized
gacttatagagcatttatgaag

SEQ ID NO: 1097575 - DNA, 22 bp, Artificial Sequence
  chemically synthesized
catacaattcttcataaatgct

SEQ ID NO: 1097576 - DNA, 22 bp, Artificial Sequence
  chemically synthesized
gaaaaacttgacttatagagca

SEQ ID NO: 1097577 - DNA, 22 bp, Artificial Sequence
  chemically synthesized
agaaaaacttgacttatagagc

SEQ ID NO: 1097578 - DNA, 22 bp, Artificial Sequence
  chemically synthesized
tagaaaaacttgacttatagag

SEQ ID NO: 1097579 - DNA, 22 bp, Artificial Sequence
  chemically synthesized
ttcataaatgctctataagtca

SEQ ID NO: 1097580 - DNA, 22 bp, Artificial Sequence
  chemically synthesized
ttttagaaaaacttgacttata

SEQ ID NO: 1097581 - DNA, 22 bp, Artificial Sequence
  chemically synthesized
cataaatgctctataagtcaag

SEQ ID NO: 1097582 - DNA, 22 bp, Artificial Sequence
  chemically synthesized
ataaatgctctataagtcaagt

SEQ ID NO: 1097583 - DNA, 22 bp, Artificial Sequence
  chemically synthesized
tataagtcaagtttttctaaaa

SEQ ID NO: 1097584 - DNA, 22 bp, Artificial Sequence
  chemically synthesized
taagtcaagtttttctaaaata

SEQ ID NO: 1097585 - DNA, 22 bp, Artificial Sequence
  chemically synthesized
agggtggtaggatgctatttta

SEQ ID NO: 1097586 - DNA, 22 bp, Artificial Sequence
  chemically synthesized
gagggtggtaggatgctatttt

SEQ ID NO: 1097587 - DNA, 22 bp, Artificial Sequence
  chemically synthesized
ttctaaaatagcatcctaccac

SEQ ID NO: 1097588 - DNA, 22 bp, Artificial Sequence
  chemically synthesized
tctaaaatagcatcctaccacc

SEQ ID NO: 1097589 - DNA, 22 bp, Artificial Sequence
  chemically synthesized
ctaaaatagcatcctaccaccc

SEQ ID NO: 1097590 - DNA, 22 bp, Artificial Sequence
  chemically synthesized
taaaatagcatcctaccaccct

SEQ ID NO: 1097591 - DNA, 22 bp, Artificial Sequence
  chemically synthesized
aggcaggatttgagggtggtag

SEQ ID NO: 1097592 - DNA, 22 bp, Artificial Sequence
  chemically synthesized
aaatagcatcctaccaccctca

SEQ ID NO: 1097593 - DNA, 22 bp, Artificial Sequence
  chemically synthesized
ccaccctcaaatcctgcctgaa

SEQ ID NO: 1097594 - DNA, 22 bp, Artificial Sequence
  chemically synthesized
aaatcaagaatgaataatgttc

SEQ ID NO: 1097595 - DNA, 22 bp, Artificial Sequence
  chemically synthesized
aaatcctgcctgaacattattc

SEQ ID NO: 1097596 - DNA, 22 bp, Artificial Sequence
  chemically synthesized
gaaatcaagaatgaataatgtt

SEQ ID NO: 1097597 - DNA, 22 bp, Artificial Sequence
  chemically synthesized
tgaaatcaagaatgaataatgt

SEQ ID NO: 1097598 - DNA, 22 bp, Artificial Sequence
  chemically synthesized
cctgaacattattcattcttga

SEQ ID NO: 1097599 - DNA, 22 bp, Artificial Sequence
  chemically synthesized
aacattattcattcttgatttc

SEQ ID NO: 1097600 - DNA, 22 bp, Artificial Sequence
  chemically synthesized
gaagtaaacatggattttgaaa

SEQ ID NO: 1097601 - DNA, 22 bp, Artificial Sequence
  chemically synthesized
ttcattcttgatttcaaaatcc

SEQ ID NO: 1097602 - DNA, 22 bp, Artificial Sequence
  chemically synthesized
attcttgatttcaaaatccatg

SEQ ID NO: 1097603 - DNA, 22 bp, Artificial Sequence
  chemically synthesized
cctagaagtaaacatggatttt

SEQ ID NO: 1097604 - DNA, 22 bp, Artificial Sequence
  chemically synthesized
gcctagaagtaaacatggattt

SEQ ID NO: 1097605 - DNA, 22 bp, Artificial Sequence
  chemically synthesized
ttgatttcaaaatccatgttta

SEQ ID NO: 1097606 - DNA, 22 bp, Artificial Sequence
  chemically synthesized
gatttcaaaatccatgtttact

SEQ ID NO: 1097607 - DNA, 22 bp, Artificial Sequence
  chemically synthesized
atttcaaaatccatgtttactt

SEQ ID NO: 1097608 - DNA, 22 bp, Artificial Sequence
  chemically synthesized
caaaatccatgtttacttctag

SEQ ID NO: 1097609 - DNA, 22 bp, Artificial Sequence
  chemically synthesized
aaaatccatgtttacttctagg

SEQ ID NO: 1097610 - DNA, 22 bp, Artificial Sequence
  chemically synthesized
acttctaggcaaattatcatga

SEQ ID NO: 1097611 - DNA, 22 bp, Artificial Sequence
  chemically synthesized
cttctaggcaaattatcatgat

SEQ ID NO: 1097612 - DNA, 22 bp, Artificial Sequence
  chemically synthesized
ctaggcaaattatcatgatttc

SEQ ID NO: 1097613 - DNA, 22 bp, Artificial Sequence
  chemically synthesized
taggcaaattatcatgatttca

SEQ ID NO: 1097614 - DNA, 22 bp, Artificial Sequence
  chemically synthesized
ggcaaattatcatgatttcatt

SEQ ID NO: 1097615 - DNA, 22 bp, Artificial Sequence
  chemically synthesized
tcatgatttcatttatttttcc

SEQ ID NO: 1097616 - DNA, 22 bp, Artificial Sequence
  chemically synthesized
catttatttttccatttattgc

SEQ ID NO: 1097617 - DNA, 22 bp, Artificial Sequence
  chemically synthesized
atttatttttccatttattgcc

SEQ ID NO: 1097618 - DNA, 22 bp, Artificial Sequence
  chemically synthesized
atttttccatttattgcctgct

SEQ ID NO: 1097619 - DNA, 22 bp, Artificial Sequence
  chemically synthesized
tttttccatttattgcctgctc

SEQ ID NO: 1097620 - DNA, 22 bp, Artificial Sequence
  chemically synthesized
gcgtgtggtgaggagcaggcaa

SEQ ID NO: 1097621 - DNA, 22 bp, Artificial Sequence
  chemically synthesized
tagcgtgtggtgaggagcaggc

SEQ ID NO: 1097622 - DNA, 22 bp, Artificial Sequence
  chemically synthesized
ttccatttattgcctgctcctc

SEQ ID NO: 1097623 - DNA, 22 bp, Artificial Sequence
  chemically synthesized
tccatttattgcctgctcctca

SEQ ID NO: 1097624 - DNA, 22 bp, Artificial Sequence
  chemically synthesized
ccatttattgcctgctcctcac

SEQ ID NO: 1097625 - DNA, 22 bp, Artificial Sequence
  chemically synthesized
catttattgcctgctcctcacc

SEQ ID NO: 1097626 - DNA, 22 bp, Artificial Sequence
  chemically synthesized
gtgttctagcgtgtggtgagga

SEQ ID NO: 1097627 - DNA, 22 bp, Artificial Sequence
  chemically synthesized
tagtgttctagcgtgtggtgag

SEQ ID NO: 1097628 - DNA, 22 bp, Artificial Sequence
  chemically synthesized
attgcctgctcctcaccacacg

SEQ ID NO: 1097629 - DNA, 22 bp, Artificial Sequence
  chemically synthesized
ttgcctgctcctcaccacacgc

SEQ ID NO: 1097630 - DNA, 22 bp, Artificial Sequence
  chemically synthesized
cctgctcctcaccacacgctag

SEQ ID NO: 1097631 - DNA, 22 bp, Artificial Sequence
  chemically synthesized
cattctagtgttctagcgtgtg

SEQ ID NO: 1097632 - DNA, 22 bp, Artificial Sequence
  chemically synthesized
acattctagtgttctagcgtgt

SEQ ID NO: 1097633 - DNA, 22 bp, Artificial Sequence
  chemically synthesized
ctcctcaccacacgctagaaca

SEQ ID NO: 1097634 - DNA, 22 bp, Artificial Sequence
  chemically synthesized
ctcaccacacgctagaacacta

SEQ ID NO: 1097635 - DNA, 22 bp, Artificial Sequence
  chemically synthesized
gaatttacattctagtgttcta

SEQ ID NO: 1097636 - DNA, 22 bp, Artificial Sequence
  chemically synthesized
ggaatttacattctagtgttct

SEQ ID NO: 1097637 - DNA, 22 bp, Artificial Sequence
  chemically synthesized
accacacgctagaacactagaa

SEQ ID NO: 1097638 - DNA, 22 bp, Artificial Sequence
  chemically synthesized
ccttggaatttacattctagtg

SEQ ID NO: 1097639 - DNA, 22 bp, Artificial Sequence
  chemically synthesized
gaacactagaatgtaaattcca

SEQ ID NO: 1097640 - DNA, 22 bp, Artificial Sequence
  chemically synthesized
gaatgtaaattccaaggcagtg

SEQ ID NO: 1097641 - DNA, 22 bp, Artificial Sequence
  chemically synthesized
caaggcagtggtcttgctcacc

SEQ ID NO: 1097642 - DNA, 22 bp, Artificial Sequence
  chemically synthesized
aatatagagggtggtgagcaag

SEQ ID NO: 1097643 - DNA, 22 bp, Artificial Sequence
  chemically synthesized
ctgaatatagagggtggtgagc

SEQ ID NO: 1097644 - DNA, 22 bp, Artificial Sequence
  chemically synthesized
gctactgaatatagagggtggt

SEQ ID NO: 1097645 - DNA, 22 bp, Artificial Sequence
  chemically synthesized
tggctactgaatatagagggtg

SEQ ID NO: 1097646 - DNA, 22 bp, Artificial Sequence
  chemically synthesized
gctcaccaccctctatattcag

SEQ ID NO: 1097647 - DNA, 22 bp, Artificial Sequence
  chemically synthesized
ctcaccaccctctatattcagt

SEQ ID NO: 1097648 - DNA, 22 bp, Artificial Sequence
  chemically synthesized
accaccctctatattcagtagc

SEQ ID NO: 1097649 - DNA, 22 bp, Artificial Sequence
  chemically synthesized
tgtgccaaacaccctctggcta

SEQ ID NO: 1097650 - DNA, 22 bp, Artificial Sequence
  chemically synthesized
tatattcagtagccagagggtg

SEQ ID NO: 1097651 - DNA, 22 bp, Artificial Sequence
  chemically synthesized
ctgtgtgccaaacaccctctgg

SEQ ID NO: 1097652 - DNA, 22 bp, Artificial Sequence
  chemically synthesized
actgtgtgccaaacaccctctg

SEQ ID NO: 1097653 - DNA, 22 bp, Artificial Sequence
  chemically synthesized
tattcagtagccagagggtgtt

SEQ ID NO: 1097654 - DNA, 22 bp, Artificial Sequence
  chemically synthesized
agtagccagagggtgtttggca

SEQ ID NO: 1097655 - DNA, 22 bp, Artificial Sequence
  chemically synthesized
catacttactgtgtgccaaaca

SEQ ID NO: 1097656 - DNA, 22 bp, Artificial Sequence
  chemically synthesized
ttgcatacttactgtgtgccaa

SEQ ID NO: 1097657 - DNA, 22 bp, Artificial Sequence
  chemically synthesized
attgcatacttactgtgtgcca

SEQ ID NO: 1097658 - DNA, 22 bp, Artificial Sequence
  chemically synthesized
aaacttattgcatacttactgt

SEQ ID NO: 1097659 - DNA, 22 bp, Artificial Sequence
  chemically synthesized
ggcacacagtaagtatgcaata

SEQ ID NO: 1097660 - DNA, 22 bp, Artificial Sequence
  chemically synthesized
tcaactaaaacttattgcatac

SEQ ID NO: 1097661 - DNA, 22 bp, Artificial Sequence
  chemically synthesized
gcacacagtaagtatgcaataa

SEQ ID NO: 1097662 - DNA, 22 bp, Artificial Sequence
  chemically synthesized
atcaactaaaacttattgcata

SEQ ID NO: 1097663 - DNA, 22 bp, Artificial Sequence
  chemically synthesized
gcaatagcatatttatcaacta

SEQ ID NO: 1097664 - DNA, 22 bp, Artificial Sequence
  chemically synthesized
atctagcaatagcatatttatc

SEQ ID NO: 1097665 - DNA, 22 bp, Artificial Sequence
  chemically synthesized
taatctagcaatagcatattta

SEQ ID NO: 1097666 - DNA, 22 bp, Artificial Sequence
  chemically synthesized
ttctaatctagcaatagcatat

SEQ ID NO: 1097667 - DNA, 22 bp, Artificial Sequence
  chemically synthesized
tagttgataaatatgctattgc

SEQ ID NO: 1097668 - DNA, 22 bp, Artificial Sequence
  chemically synthesized
agttgataaatatgctattgct

SEQ ID NO: 1097669 - DNA, 22 bp, Artificial Sequence
  chemically synthesized
gttgataaatatgctattgcta

SEQ ID NO: 1097670 - DNA, 22 bp, Artificial Sequence
  chemically synthesized
ataaatatgctattgctagatt

SEQ ID NO: 1097671 - DNA, 22 bp, Artificial Sequence
  chemically synthesized
aaaacacagaattattctaatc

SEQ ID NO: 1097672 - DNA, 22 bp, Artificial Sequence
  chemically synthesized
ttgctagattagaataattctg

SEQ ID NO: 1097673 - DNA, 22 bp, Artificial Sequence
  chemically synthesized
gagtattaaaaacacagaatta

SEQ ID NO: 1097674 - DNA, 22 bp, Artificial Sequence
  chemically synthesized
ctagattagaataattctgtgt

SEQ ID NO: 1097675 - DNA, 22 bp, Artificial Sequence
  chemically synthesized
tagagtattaaaaacacagaat

SEQ ID NO: 1097676 - DNA, 22 bp, Artificial Sequence
  chemically synthesized
ctagagtattaaaaacacagaa

SEQ ID NO: 1097677 - DNA, 22 bp, Artificial Sequence
  chemically synthesized
gattagaataattctgtgtttt

SEQ ID NO: 1097678 - DNA, 22 bp, Artificial Sequence
  chemically synthesized
gaataattctgtgtttttaata

SEQ ID NO: 1097679 - DNA, 22 bp, Artificial Sequence
  chemically synthesized
gtataatcatttctagagtatt

SEQ ID NO: 1097680 - DNA, 22 bp, Artificial Sequence
  chemically synthesized
tgtgtttttaatactctagaaa

SEQ ID NO: 1097681 - DNA, 22 bp, Artificial Sequence
  chemically synthesized
tgtttttaatactctagaaatg

SEQ ID NO: 1097682 - DNA, 22 bp, Artificial Sequence
  chemically synthesized
ttaatactctagaaatgattat

SEQ ID NO: 1097683 - DNA, 22 bp, Artificial Sequence
  chemically synthesized
taatactctagaaatgattata

SEQ ID NO: 1097684 - DNA, 22 bp, Artificial Sequence
  chemically synthesized
aatactctagaaatgattatac

SEQ ID NO: 1097685 - DNA, 22 bp, Artificial Sequence
  chemically synthesized
atactctagaaatgattatact

SEQ ID NO: 1097686 - DNA, 22 bp, Artificial Sequence
  chemically synthesized
taatgaagaaaaaattagtata

SEQ ID NO: 1097687 - DNA, 22 bp, Artificial Sequence
  chemically synthesized
tagaaatgattatactaatttt

SEQ ID NO: 1097688 - DNA, 22 bp, Artificial Sequence
  chemically synthesized
gaaatgattatactaatttttt

SEQ ID NO: 1097689 - DNA, 22 bp, Artificial Sequence
  chemically synthesized
tactaattttttcttcattata

SEQ ID NO: 1097690 - DNA, 22 bp, Artificial Sequence
  chemically synthesized
tgtgtgtataaaactataatga

SEQ ID NO: 1097691 - DNA, 22 bp, Artificial Sequence
  chemically synthesized
attttttcttcattatagtttt

SEQ ID NO: 1097692 - DNA, 22 bp, Artificial Sequence
  chemically synthesized
tttcttcattatagttttatac

SEQ ID NO: 1097693 - DNA, 22 bp, Artificial Sequence
  chemically synthesized
ttcttcattatagttttataca

SEQ ID NO: 1097694 - DNA, 22 bp, Artificial Sequence
  chemically synthesized
tcttcattatagttttatacac

SEQ ID NO: 1097695 - DNA, 22 bp, Artificial Sequence
  chemically synthesized
cttcattatagttttatacaca

SEQ ID NO: 1097696 - DNA, 22 bp, Artificial Sequence
  chemically synthesized
ttcattatagttttatacacac

SEQ ID NO: 1097697 - DNA, 22 bp, Artificial Sequence
  chemically synthesized
cattatagttttatacacacat

SEQ ID NO: 1097698 - DNA, 22 bp, Artificial Sequence
  chemically synthesized
attatagttttatacacacata

SEQ ID NO: 1097699 - DNA, 22 bp, Artificial Sequence
  chemically synthesized
tagttttatacacacataatat

SEQ ID NO: 1097700 - DNA, 22 bp, Artificial Sequence
  chemically synthesized
cataaatatgtataaatattat

SEQ ID NO: 1097701 - DNA, 22 bp, Artificial Sequence
  chemically synthesized
tatacacacataatatttatac

SEQ ID NO: 1097702 - DNA, 22 bp, Artificial Sequence
  chemically synthesized
atacacacataatatttataca

SEQ ID NO: 1097703 - DNA, 22 bp, Artificial Sequence
  chemically synthesized
tacacacataatatttatacat

SEQ ID NO: 1097704 - DNA, 22 bp, Artificial Sequence
  chemically synthesized
atatactccataaatatgtata

SEQ ID NO: 1097705 - DNA, 22 bp, Artificial Sequence
  chemically synthesized
atacatatttatggagtatatt

SEQ ID NO: 1097706 - DNA, 22 bp, Artificial Sequence
  chemically synthesized
tacatatttatggagtatatta

SEQ ID NO: 1097707 - DNA, 22 bp, Artificial Sequence
  chemically synthesized
aaagtaaatatctaatatactc

SEQ ID NO: 1097708 - DNA, 22 bp, Artificial Sequence
  chemically synthesized
atggagtatattagatatttac

SEQ ID NO: 1097709 - DNA, 22 bp, Artificial Sequence
  chemically synthesized
tggagtatattagatatttact

SEQ ID NO: 1097710 - DNA, 22 bp, Artificial Sequence
  chemically synthesized
gtcaaatgttgaaagtaaatat

SEQ ID NO: 1097711 - DNA, 22 bp, Artificial Sequence
  chemically synthesized
agtcaaatgttgaaagtaaata

SEQ ID NO: 1097712 - DNA, 22 bp, Artificial Sequence
  chemically synthesized
tagtcaaatgttgaaagtaaat

SEQ ID NO: 1097713 - DNA, 22 bp, Artificial Sequence
  chemically synthesized
gatatttactttcaacatttga

SEQ ID NO: 1097714 - DNA, 22 bp, Artificial Sequence
  chemically synthesized
tcatacggctttagtcaaatgt

SEQ ID NO: 1097715 - DNA, 22 bp, Artificial Sequence
  chemically synthesized
actttcaacatttgactaaagc

SEQ ID NO: 1097716 - DNA, 22 bp, Artificial Sequence
  chemically synthesized
ctttcaacatttgactaaagcc

SEQ ID NO: 1097717 - DNA, 22 bp, Artificial Sequence
  chemically synthesized
tcaacatttgactaaagccgta

SEQ ID NO: 1097718 - DNA, 22 bp, Artificial Sequence
  chemically synthesized
caacatttgactaaagccgtat

SEQ ID NO: 1097719 - DNA, 22 bp, Artificial Sequence
  chemically synthesized
aacatttgactaaagccgtatg

SEQ ID NO: 1097720 - DNA, 22 bp, Artificial Sequence
  chemically synthesized
aatatcgaatctgtcatacggc

SEQ ID NO: 1097721 - DNA, 22 bp, Artificial Sequence
  chemically synthesized
aaatatcgaatctgtcatacgg

SEQ ID NO: 1097722 - DNA, 22 bp, Artificial Sequence
  chemically synthesized
gactaaagccgtatgacagatt

SEQ ID NO: 1097723 - DNA, 22 bp, Artificial Sequence
  chemically synthesized
actaaagccgtatgacagattc

SEQ ID NO: 1097724 - DNA, 22 bp, Artificial Sequence
  chemically synthesized
agatgtttaaatatcgaatctg

SEQ ID NO: 1097725 - DNA, 22 bp, Artificial Sequence
  chemically synthesized
aagccgtatgacagattcgata

SEQ ID NO: 1097726 - DNA, 22 bp, Artificial Sequence
  chemically synthesized
acatgaaaactcagatgtttaa

SEQ ID NO: 1097727 - DNA, 22 bp, Artificial Sequence
  chemically synthesized
gatatttaaacatctgagtttt

SEQ ID NO: 1097728 - DNA, 22 bp, Artificial Sequence
  chemically synthesized
aaacatctgagttttcatgtga

SEQ ID NO: 1097729 - DNA, 22 bp, Artificial Sequence
  chemically synthesized
aacatctgagttttcatgtgag

SEQ ID NO: 1097730 - DNA, 22 bp, Artificial Sequence
  chemically synthesized
atagcagaaagtaactcacatg

SEQ ID NO: 1097731 - DNA, 22 bp, Artificial Sequence
  chemically synthesized
agttttcatgtgagttactttc

SEQ ID NO: 1097732 - DNA, 22 bp, Artificial Sequence
  chemically synthesized
tagttaatagcagaaagtaact

SEQ ID NO: 1097733 - DNA, 22 bp, Artificial Sequence
  chemically synthesized
ttatagttaatagcagaaagta

SEQ ID NO: 1097734 - DNA, 22 bp, Artificial Sequence
  chemically synthesized
tcatgtgagttactttctgcta

SEQ ID NO: 1097735 - DNA, 22 bp, Artificial Sequence
  chemically synthesized
catgtgagttactttctgctat

SEQ ID NO: 1097736 - DNA, 22 bp, Artificial Sequence
  chemically synthesized
atgtgagttactttctgctatt

SEQ ID NO: 1097737 - DNA, 22 bp, Artificial Sequence
  chemically synthesized
agaaatatctattatagttaat

SEQ ID NO: 1097738 - DNA, 22 bp, Artificial Sequence
  chemically synthesized
ctttctgctattaactataata

SEQ ID NO: 1097739 - DNA, 22 bp, Artificial Sequence
  chemically synthesized
tctgctattaactataatagat

SEQ ID NO: 1097740 - DNA, 22 bp, Artificial Sequence
  chemically synthesized
ctgctattaactataatagata

SEQ ID NO: 1097741 - DNA, 22 bp, Artificial Sequence
  chemically synthesized
tgctattaactataatagatat

SEQ ID NO: 1097742 - DNA, 22 bp, Artificial Sequence
  chemically synthesized
ctattaactataatagatattt

SEQ ID NO: 1097743 - DNA, 22 bp, Artificial Sequence
  chemically synthesized
aatggtaattcagaaatatcta

SEQ ID NO: 1097744 - DNA, 22 bp, Artificial Sequence
  chemically synthesized
ttaactataatagatatttctg

SEQ ID NO: 1097745 - DNA, 22 bp, Artificial Sequence
  chemically synthesized
actataatagatatttctgaat

SEQ ID NO: 1097746 - DNA, 22 bp, Artificial Sequence
  chemically synthesized
tataattaaatggtaattcaga

SEQ ID NO: 1097747 - DNA, 22 bp, Artificial Sequence
  chemically synthesized
taatagatatttctgaattacc

SEQ ID NO: 1097748 - DNA, 22 bp, Artificial Sequence
  chemically synthesized
ctgaattaccatttaattatat

SEQ ID NO: 1097749 - DNA, 22 bp, Artificial Sequence
  chemically synthesized
tgaattaccatttaattatata

SEQ ID NO: 1097750 - DNA, 22 bp, Artificial Sequence
  chemically synthesized
aattaccatttaattatataat

SEQ ID NO: 1097751 - DNA, 22 bp, Artificial Sequence
  chemically synthesized
ccatttaattatataatttttt

SEQ ID NO: 1097752 - DNA, 22 bp, Artificial Sequence
  chemically synthesized
tgaaagggccacatggtaaaaa

SEQ ID NO: 1097753 - DNA, 22 bp, Artificial Sequence
  chemically synthesized
aattatataattttttaccatg

SEQ ID NO: 1097754 - DNA, 22 bp, Artificial Sequence
  chemically synthesized
attatataattttttaccatgt

SEQ ID NO: 1097755 - DNA, 22 bp, Artificial Sequence
  chemically synthesized
attgtgaaagggccacatggta

SEQ ID NO: 1097756 - DNA, 22 bp, Artificial Sequence
  chemically synthesized
aattgtgaaagggccacatggt

SEQ ID NO: 1097757 - DNA, 22 bp, Artificial Sequence
  chemically synthesized
tataattttttaccatgtggcc

SEQ ID NO: 1097758 - DNA, 22 bp, Artificial Sequence
  chemically synthesized
taattgtgaaagggccacatgg

SEQ ID NO: 1097759 - DNA, 22 bp, Artificial Sequence
  chemically synthesized
ttttaattgtgaaagggccaca

SEQ ID NO: 1097760 - DNA, 22 bp, Artificial Sequence
  chemically synthesized
ttattttaattgtgaaagggcc

SEQ ID NO: 1097761 - DNA, 22 bp, Artificial Sequence
  chemically synthesized
attattttaattgtgaaagggc

SEQ ID NO: 1097762 - DNA, 22 bp, Artificial Sequence
  chemically synthesized
tttaccatgtggccctttcaca

SEQ ID NO: 1097763 - DNA, 22 bp, Artificial Sequence
  chemically synthesized
ttaccatgtggccctttcacaa

SEQ ID NO: 1097764 - DNA, 22 bp, Artificial Sequence
  chemically synthesized
taccatgtggccctttcacaat

SEQ ID NO: 1097765 - DNA, 22 bp, Artificial Sequence
  chemically synthesized
tttattattttaattgtgaaag

SEQ ID NO: 1097766 - DNA, 22 bp, Artificial Sequence
  chemically synthesized
accatgtggccctttcacaatt

SEQ ID NO: 1097767 - DNA, 22 bp, Artificial Sequence
  chemically synthesized
ccatgtggccctttcacaatta

SEQ ID NO: 1097768 - DNA, 22 bp, Artificial Sequence
  chemically synthesized
attatttattattttaattgtg

SEQ ID NO: 1097769 - DNA, 22 bp, Artificial Sequence
  chemically synthesized
tcacaattaaaataataaataa

SEQ ID NO: 1097770 - DNA, 22 bp, Artificial Sequence
  chemically synthesized
cacaattaaaataataaataat

SEQ ID NO: 1097771 - DNA, 22 bp, Artificial Sequence
  chemically synthesized
acaattaaaataataaataatg

SEQ ID NO: 1097772 - DNA, 22 bp, Artificial Sequence
  chemically synthesized
aaataataaataatgagtcatg

SEQ ID NO: 1097773 - DNA, 22 bp, Artificial Sequence
  chemically synthesized
gcacagtataaatgaccatgac

SEQ ID NO: 1097774 - DNA, 22 bp, Artificial Sequence
  chemically synthesized
acacaatgcctagcacagtata

SEQ ID NO: 1097775 - DNA, 22 bp, Artificial Sequence
  chemically synthesized
taacacaatgcctagcacagta

SEQ ID NO: 1097776 - DNA, 22 bp, Artificial Sequence
  chemically synthesized
ctaacacaatgcctagcacagt

SEQ ID NO: 1097777 - DNA, 22 bp, Artificial Sequence
  chemically synthesized
atactgtgctaggcattgtgtt

SEQ ID NO: 1097778 - DNA, 22 bp, Artificial Sequence
  chemically synthesized
tactgtgctaggcattgtgtta

SEQ ID NO: 1097779 - DNA, 22 bp, Artificial Sequence
  chemically synthesized
tgctaggcattgtgttagaaat

SEQ ID NO: 1097780 - DNA, 22 bp, Artificial Sequence
  chemically synthesized
ggcattgtgttagaaatttcat

SEQ ID NO: 1097781 - DNA, 22 bp, Artificial Sequence
  chemically synthesized
gagggatgaaatatgaaatttc

SEQ ID NO: 1097782 - DNA, 22 bp, Artificial Sequence
  chemically synthesized
tgttagaaatttcatatttcat

SEQ ID NO: 1097783 - DNA, 22 bp, Artificial Sequence
  chemically synthesized
agaatcattagagggatgaaat

SEQ ID NO: 1097784 - DNA, 22 bp, Artificial Sequence
  chemically synthesized
cagaatcattagagggatgaaa

SEQ ID NO: 1097785 - DNA, 22 bp, Artificial Sequence
  chemically synthesized
gaaatttcatatttcatccctc

SEQ ID NO: 1097786 - DNA, 22 bp, Artificial Sequence
  chemically synthesized
tcagaatcattagagggatgaa

SEQ ID NO: 1097787 - DNA, 22 bp, Artificial Sequence
  chemically synthesized
ctttcagaatcattagagggat

SEQ ID NO: 1097788 - DNA, 22 bp, Artificial Sequence
  chemically synthesized
catatttcatccctctaatgat

SEQ ID NO: 1097789 - DNA, 22 bp, Artificial Sequence
  chemically synthesized
atatttcatccctctaatgatt

SEQ ID NO: 1097790 - DNA, 22 bp, Artificial Sequence
  chemically synthesized
catccctctaatgattctgaaa

SEQ ID NO: 1097791 - DNA, 22 bp, Artificial Sequence
  chemically synthesized
atccctctaatgattctgaaag

SEQ ID NO: 1097792 - DNA, 22 bp, Artificial Sequence
  chemically synthesized
ggtatcagaatgtctgctttca

SEQ ID NO: 1097793 - DNA, 22 bp, Artificial Sequence
  chemically synthesized
taatgattctgaaagcagacat

SEQ ID NO: 1097794 - DNA, 22 bp, Artificial Sequence
  chemically synthesized
atgattctgaaagcagacattc

SEQ ID NO: 1097795 - DNA, 22 bp, Artificial Sequence
  chemically synthesized
tgaactgggtatcagaatgtct

SEQ ID NO: 1097796 - DNA, 22 bp, Artificial Sequence
  chemically synthesized
gtgaactgggtatcagaatgtc

SEQ ID NO: 1097797 - DNA, 22 bp, Artificial Sequence
  chemically synthesized
tgaaagcagacattctgatacc

SEQ ID NO: 1097798 - DNA, 22 bp, Artificial Sequence
  chemically synthesized
gtttgtgaactgggtatcagaa

SEQ ID NO: 1097799 - DNA, 22 bp, Artificial Sequence
  chemically synthesized
cgtttgtgaactgggtatcaga

SEQ ID NO: 1097800 - DNA, 22 bp, Artificial Sequence
  chemically synthesized
aaagcagacattctgataccca

SEQ ID NO: 1097801 - DNA, 22 bp, Artificial Sequence
  chemically synthesized
cttcgtttgtgaactgggtatc

SEQ ID NO: 1097802 - DNA, 22 bp, Artificial Sequence
  chemically synthesized
agccaaattccttcgtttgtga

SEQ ID NO: 1097803 - DNA, 22 bp, Artificial Sequence
  chemically synthesized
tgatacccagttcacaaacgaa

SEQ ID NO: 1097804 - DNA, 22 bp, Artificial Sequence
  chemically synthesized
atacccagttcacaaacgaagg

SEQ ID NO: 1097805 - DNA, 22 bp, Artificial Sequence
  chemically synthesized
ctgagccaaattccttcgtttg

SEQ ID NO: 1097806 - DNA, 22 bp, Artificial Sequence
  chemically synthesized
actgagccaaattccttcgttt

SEQ ID NO: 1097807 - DNA, 22 bp, Artificial Sequence
  chemically synthesized
catgagcttactgagccaaatt

SEQ ID NO: 1097808 - DNA, 22 bp, Artificial Sequence
  chemically synthesized
acaaacgaaggaatttggctca

SEQ ID NO: 1097809 - DNA, 22 bp, Artificial Sequence
  chemically synthesized
gggtgagttacatgagcttact

SEQ ID NO: 1097810 - DNA, 22 bp, Artificial Sequence
  chemically synthesized
ggctcagtaagctcatgtaact

SEQ ID NO: 1097811 - DNA, 22 bp, Artificial Sequence
  chemically synthesized
gctcagtaagctcatgtaactc

SEQ ID NO: 1097812 - DNA, 22 bp, Artificial Sequence
  chemically synthesized
tataaattggggtgagttacat

SEQ ID NO: 1097813 - DNA, 22 bp, Artificial Sequence
  chemically synthesized
agtaagctcatgtaactcaccc

SEQ ID NO: 1097814 - DNA, 22 bp, Artificial Sequence
  chemically synthesized
atgtaactcaccccaatttata

SEQ ID NO: 1097815 - DNA, 22 bp, Artificial Sequence
  chemically synthesized
ggccccatgccaactgtataaa

SEQ ID NO: 1097816 - DNA, 22 bp, Artificial Sequence
  chemically synthesized
gttcggccccatgccaactgta

SEQ ID NO: 1097817 - DNA, 22 bp, Artificial Sequence
  chemically synthesized
accccaatttatacagttggca

SEQ ID NO: 1097818 - DNA, 22 bp, Artificial Sequence
  chemically synthesized
agttcggccccatgccaactgt

SEQ ID NO: 1097819 - DNA, 22 bp, Artificial Sequence
  chemically synthesized
aaacttagttcggccccatgcc

SEQ ID NO: 1097820 - DNA, 22 bp, Artificial Sequence
  chemically synthesized
aaaacttagttcggccccatgc

SEQ ID NO: 1097821 - DNA, 22 bp, Artificial Sequence
  chemically synthesized
atacagttggcatggggccgaa

SEQ ID NO: 1097822 - DNA, 22 bp, Artificial Sequence
  chemically synthesized
tacagttggcatggggccgaac

SEQ ID NO: 1097823 - DNA, 22 bp, Artificial Sequence
  chemically synthesized
agtttaaaacttagttcggccc

SEQ ID NO: 1097824 - DNA, 22 bp, Artificial Sequence
  chemically synthesized
gagtttaaaacttagttcggcc

SEQ ID NO: 1097825 - DNA, 22 bp, Artificial Sequence
  chemically synthesized
gcatggggccgaactaagtttt

SEQ ID NO: 1097826 - DNA, 22 bp, Artificial Sequence
  chemically synthesized
agttttaaactcaagtatctgg

SEQ ID NO: 1097827 - DNA, 22 bp, Artificial Sequence
  chemically synthesized
taaactcaagtatctggctcca

SEQ ID NO: 1097828 - DNA, 22 bp, Artificial Sequence
  chemically synthesized
aaactcaagtatctggctccac

SEQ ID NO: 1097829 - DNA, 22 bp, Artificial Sequence
  chemically synthesized
aactcaagtatctggctccaca

SEQ ID NO: 1097830 - DNA, 22 bp, Artificial Sequence
  chemically synthesized
aagtatctggctccacattgat

SEQ ID NO: 1097831 - DNA, 22 bp, Artificial Sequence
  chemically synthesized
tgacaaggaaaaatcaatgtgg

SEQ ID NO: 1097832 - DNA, 22 bp, Artificial Sequence
  chemically synthesized
aaggattgtgacaaggaaaaat

SEQ ID NO: 1097833 - DNA, 22 bp, Artificial Sequence
  chemically synthesized
gctccacattgatttttccttg

SEQ ID NO: 1097834 - DNA, 22 bp, Artificial Sequence
  chemically synthesized
gttcaaggattgtgacaaggaa

SEQ ID NO: 1097835 - DNA, 22 bp, Artificial Sequence
  chemically synthesized
cacattgatttttccttgtcac

SEQ ID NO: 1097836 - DNA, 22 bp, Artificial Sequence
  chemically synthesized
ggttcaaggattgtgacaagga

SEQ ID NO: 1097837 - DNA, 22 bp, Artificial Sequence
  chemically synthesized
tggttcaaggattgtgacaagg

SEQ ID NO: 1097838 - DNA, 22 bp, Artificial Sequence
  chemically synthesized
ttggttcaaggattgtgacaag

SEQ ID NO: 1097839 - DNA, 22 bp, Artificial Sequence
  chemically synthesized
tttggttcaaggattgtgacaa

SEQ ID NO: 1097840 - DNA, 22 bp, Artificial Sequence
  chemically synthesized
ttttggttcaaggattgtgaca

SEQ ID NO: 1097841 - DNA, 22 bp, Artificial Sequence
  chemically synthesized
tttttggttcaaggattgtgac

SEQ ID NO: 1097842 - DNA, 22 bp, Artificial Sequence
  chemically synthesized
atttttccttgtcacaatcctt

SEQ ID NO: 1097843 - DNA, 22 bp, Artificial Sequence
  chemically synthesized
ttccttgtcacaatccttgaac

SEQ ID NO: 1097844 - DNA, 22 bp, Artificial Sequence
  chemically synthesized
tccttgtcacaatccttgaacc

SEQ ID NO: 1097845 - DNA, 22 bp, Artificial Sequence
  chemically synthesized
ccttgtcacaatccttgaacca

SEQ ID NO: 1097846 - DNA, 22 bp, Artificial Sequence
  chemically synthesized
tagatctttttttggttcaagg

SEQ ID NO: 1097847 - DNA, 22 bp, Artificial Sequence
  chemically synthesized
cttgtcacaatccttgaaccaa

SEQ ID NO: 1097848 - DNA, 22 bp, Artificial Sequence
  chemically synthesized
gtcacaatccttgaaccaaaaa

SEQ ID NO: 1097849 - DNA, 22 bp, Artificial Sequence
  chemically synthesized
tcacaatccttgaaccaaaaaa

SEQ ID NO: 1097850 - DNA, 22 bp, Artificial Sequence
  chemically synthesized
atactgtagatctttttttggt

SEQ ID NO: 1097851 - DNA, 22 bp, Artificial Sequence
  chemically synthesized
aaatattaatactgtagatctt

SEQ ID NO: 1097852 - DNA, 22 bp, Artificial Sequence
  chemically synthesized
gaaatattaatactgtagatct

SEQ ID NO: 1097853 - DNA, 22 bp, Artificial Sequence
  chemically synthesized
gaaccaaaaaaagatctacagt

SEQ ID NO: 1097854 - DNA, 22 bp, Artificial Sequence
  chemically synthesized
aaccaaaaaaagatctacagta

SEQ ID NO: 1097855 - DNA, 22 bp, Artificial Sequence
  chemically synthesized
gagaatgacttgaaatattaat

SEQ ID NO: 1097856 - DNA, 22 bp, Artificial Sequence
  chemically synthesized
agagaatgacttgaaatattaa

SEQ ID NO: 1097857 - DNA, 22 bp, Artificial Sequence
  chemically synthesized
cagtattaatatttcaagtcat

SEQ ID NO: 1097858 - DNA, 22 bp, Artificial Sequence
  chemically synthesized
gcaagaacttagagaatgactt

SEQ ID NO: 1097859 - DNA, 22 bp, Artificial Sequence
  chemically synthesized
atatttcaagtcattctctaag

SEQ ID NO: 1097860 - DNA, 22 bp, Artificial Sequence
  chemically synthesized
tgtgctagcaagaacttagaga

SEQ ID NO: 1097861 - DNA, 22 bp, Artificial Sequence
  chemically synthesized
atgtgctagcaagaacttagag

SEQ ID NO: 1097862 - DNA, 22 bp, Artificial Sequence
  chemically synthesized
tatgtgctagcaagaacttaga

SEQ ID NO: 1097863 - DNA, 22 bp, Artificial Sequence
  chemically synthesized
ttatgtgctagcaagaacttag

SEQ ID NO: 1097864 - DNA, 22 bp, Artificial Sequence
  chemically synthesized
caagtcattctctaagttcttg

SEQ ID NO: 1097865 - DNA, 22 bp, Artificial Sequence
  chemically synthesized
aagtcattctctaagttcttgc

SEQ ID NO: 1097866 - DNA, 22 bp, Artificial Sequence
  chemically synthesized
tttttatgtgctagcaagaact

SEQ ID NO: 1097867 - DNA, 22 bp, Artificial Sequence
  chemically synthesized
ttatttttatgtgctagcaaga

SEQ ID NO: 1097868 - DNA, 22 bp, Artificial Sequence
  chemically synthesized
tctaagttcttgctagcacata

SEQ ID NO: 1097869 - DNA, 22 bp, Artificial Sequence
  chemically synthesized
taagttcttgctagcacataaa

SEQ ID NO: 1097870 - DNA, 22 bp, Artificial Sequence
  chemically synthesized
agttcttgctagcacataaaaa

SEQ ID NO: 1097871 - DNA, 22 bp, Artificial Sequence
  chemically synthesized
taatcataattattatttttat

SEQ ID NO: 1097872 - DNA, 22 bp, Artificial Sequence
  chemically synthesized
ttgctagcacataaaaataata

SEQ ID NO: 1097873 - DNA, 22 bp, Artificial Sequence
  chemically synthesized
gctagcacataaaaataataat

SEQ ID NO: 1097874 - DNA, 22 bp, Artificial Sequence
  chemically synthesized
ctagcacataaaaataataatt

SEQ ID NO: 1097875 - DNA, 22 bp, Artificial Sequence
  chemically synthesized
gtagctataatcataattatta

SEQ ID NO: 1097876 - DNA, 22 bp, Artificial Sequence
  chemically synthesized
gcacataaaaataataattatg

SEQ ID NO: 1097877 - DNA, 22 bp, Artificial Sequence
  chemically synthesized
aattagtagctataatcataat

SEQ ID NO: 1097878 - DNA, 22 bp, Artificial Sequence
  chemically synthesized
gtgctcaattagtagctataat

SEQ ID NO: 1097879 - DNA, 22 bp, Artificial Sequence
  chemically synthesized
agagttggtgctcaattagtag

SEQ ID NO: 1097880 - DNA, 22 bp, Artificial Sequence
  chemically synthesized
tgattatagctactaattgagc

SEQ ID NO: 1097881 - DNA, 22 bp, Artificial Sequence
  chemically synthesized
actcagagttggtgctcaatta

SEQ ID NO: 1097882 - DNA, 22 bp, Artificial Sequence
  chemically synthesized
cctaactcagagttggtgctca

SEQ ID NO: 1097883 - DNA, 22 bp, Artificial Sequence
  chemically synthesized
tagctactaattgagcaccaac

SEQ ID NO: 1097884 - DNA, 22 bp, Artificial Sequence
  chemically synthesized
ctaattgagcaccaactctgag

SEQ ID NO: 1097885 - DNA, 22 bp, Artificial Sequence
  chemically synthesized
attgagcaccaactctgagtta

SEQ ID NO: 1097886 - DNA, 22 bp, Artificial Sequence
  chemically synthesized
agcaccaactctgagttaggca

SEQ ID NO: 1097887 - DNA, 22 bp, Artificial Sequence
  chemically synthesized
ccatgtgagtaaattgcctaac

SEQ ID NO: 1097888 - DNA, 22 bp, Artificial Sequence
  chemically synthesized
taactaccatgtgagtaaattg

SEQ ID NO: 1097889 - DNA, 22 bp, Artificial Sequence
  chemically synthesized
tgagttaggcaatttactcaca

SEQ ID NO: 1097890 - DNA, 22 bp, Artificial Sequence
  chemically synthesized
attgtaactaccatgtgagtaa

SEQ ID NO: 1097891 - DNA, 22 bp, Artificial Sequence
  chemically synthesized
agttaggcaatttactcacatg

SEQ ID NO: 1097892 - DNA, 22 bp, Artificial Sequence
  chemically synthesized
ttgattgtaactaccatgtgag

SEQ ID NO: 1097893 - DNA, 22 bp, Artificial Sequence
  chemically synthesized
ggcaatttactcacatggtagt

SEQ ID NO: 1097894 - DNA, 22 bp, Artificial Sequence
  chemically synthesized
actcacatggtagttacaatca

SEQ ID NO: 1097895 - DNA, 22 bp, Artificial Sequence
  chemically synthesized
ctcacatggtagttacaatcaa

SEQ ID NO: 1097896 - DNA, 22 bp, Artificial Sequence
  chemically synthesized
aatgtatgaactgttgattgta

SEQ ID NO: 1097897 - DNA, 22 bp, Artificial Sequence
  chemically synthesized
gaatgtatgaactgttgattgt

SEQ ID NO: 1097898 - DNA, 22 bp, Artificial Sequence
  chemically synthesized
acatggtagttacaatcaacag

SEQ ID NO: 1097899 - DNA, 22 bp, Artificial Sequence
  chemically synthesized
acttgaatgtatgaactgttga

SEQ ID NO: 1097900 - DNA, 22 bp, Artificial Sequence
  chemically synthesized
ctcacttgaatgtatgaactgt

SEQ ID NO: 1097901 - DNA, 22 bp, Artificial Sequence
  chemically synthesized
cctcacttgaatgtatgaactg

SEQ ID NO: 1097902 - DNA, 22 bp, Artificial Sequence
  chemically synthesized
caatcaacagttcatacattca

SEQ ID NO: 1097903 - DNA, 22 bp, Artificial Sequence
  chemically synthesized
tatcatcatacttcctcacttg

SEQ ID NO: 1097904 - DNA, 22 bp, Artificial Sequence
  chemically synthesized
atatcatcatacttcctcactt

SEQ ID NO: 1097905 - DNA, 22 bp, Artificial Sequence
  chemically synthesized
atacattcaagtgaggaagtat

SEQ ID NO: 1097906 - DNA, 22 bp, Artificial Sequence
  chemically synthesized
tcatgtttatatcatcatactt

SEQ ID NO: 1097907 - DNA, 22 bp, Artificial Sequence
  chemically synthesized
atcatgtttatatcatcatact

SEQ ID NO: 1097908 - DNA, 22 bp, Artificial Sequence
  chemically synthesized
tatcatgtttatatcatcatac

SEQ ID NO: 1097909 - DNA, 22 bp, Artificial Sequence
  chemically synthesized
aagtgaggaagtatgatgatat

SEQ ID NO: 1097910 - DNA, 22 bp, Artificial Sequence
  chemically synthesized
ttttatcatgtttatatcatca

SEQ ID NO: 1097911 - DNA, 22 bp, Artificial Sequence
  chemically synthesized
tgttttatcatgtttatatcat

SEQ ID NO: 1097912 - DNA, 22 bp, Artificial Sequence
  chemically synthesized
ggcaacaatataatagtcaata

SEQ ID NO: 1097913 - DNA, 22 bp, Artificial Sequence
  chemically synthesized
gggcaacaatataatagtcaat

SEQ ID NO: 1097914 - DNA, 22 bp, Artificial Sequence
  chemically synthesized
gtatggccttgggcaacaatat

SEQ ID NO: 1097915 - DNA, 22 bp, Artificial Sequence
  chemically synthesized
tattgactattatattgttgcc

SEQ ID NO: 1097916 - DNA, 22 bp, Artificial Sequence
  chemically synthesized
cgtatggccttgggcaacaata

SEQ ID NO: 1097917 - DNA, 22 bp, Artificial Sequence
  chemically synthesized
actattatattgttgcccaagg

SEQ ID NO: 1097918 - DNA, 22 bp, Artificial Sequence
  chemically synthesized
ttatattgttgcccaaggccat

SEQ ID NO: 1097919 - DNA, 22 bp, Artificial Sequence
  chemically synthesized
tattgttgcccaaggccatacg

SEQ ID NO: 1097920 - DNA, 22 bp, Artificial Sequence
  chemically synthesized
catagtggcatttcgtatggcc

SEQ ID NO: 1097921 - DNA, 22 bp, Artificial Sequence
  chemically synthesized
ttgcccaaggccatacgaaatg

SEQ ID NO: 1097922 - DNA, 22 bp, Artificial Sequence
  chemically synthesized
aacctacatagtggcatttcgt

SEQ ID NO: 1097923 - DNA, 22 bp, Artificial Sequence
  chemically synthesized
cccaaggccatacgaaatgcca

SEQ ID NO: 1097924 - DNA, 22 bp, Artificial Sequence
  chemically synthesized
gaacctacatagtggcatttcg

SEQ ID NO: 1097925 - DNA, 22 bp, Artificial Sequence
  chemically synthesized
gacttgaacctacatagtggca

SEQ ID NO: 1097926 - DNA, 22 bp, Artificial Sequence
  chemically synthesized
gaggtgaagcctggacttgaac

SEQ ID NO: 1097927 - DNA, 22 bp, Artificial Sequence
  chemically synthesized
ggaggtgaagcctggacttgaa

SEQ ID NO: 1097928 - DNA, 22 bp, Artificial Sequence
  chemically synthesized
tgtaggttcaagtccaggcttc

SEQ ID NO: 1097929 - DNA, 22 bp, Artificial Sequence
  chemically synthesized
aagtccaggcttcacctccaaa

SEQ ID NO: 1097930 - DNA, 22 bp, Artificial Sequence
  chemically synthesized
gtatgtagtatgtagtatggat

SEQ ID NO: 1097931 - DNA, 22 bp, Artificial Sequence
  chemically synthesized
cacctccaaatccatactacat

SEQ ID NO: 1097932 - DNA, 22 bp, Artificial Sequence
  chemically synthesized
acctccaaatccatactacata

SEQ ID NO: 1097933 - DNA, 22 bp, Artificial Sequence
  chemically synthesized
caaatccatactacatactaca

SEQ ID NO: 1097934 - DNA, 22 bp, Artificial Sequence
  chemically synthesized
cgaaggaaactggtatgtagta

SEQ ID NO: 1097935 - DNA, 22 bp, Artificial Sequence
  chemically synthesized
ttacgaaggaaactggtatgta

SEQ ID NO: 1097936 - DNA, 22 bp, Artificial Sequence
  chemically synthesized
attacgaaggaaactggtatgt

SEQ ID NO: 1097937 - DNA, 22 bp, Artificial Sequence
  chemically synthesized
acttattacgaaggaaactggt

SEQ ID NO: 1097938 - DNA, 22 bp, Artificial Sequence
  chemically synthesized
catactacataccagtttcctt

SEQ ID NO: 1097939 - DNA, 22 bp, Artificial Sequence
  chemically synthesized
cataccagtttccttcgtaata

SEQ ID NO: 1097940 - DNA, 22 bp, Artificial Sequence
  chemically synthesized
ccttcgtaataagtcaatgtta

SEQ ID NO: 1097941 - DNA, 22 bp, Artificial Sequence
  chemically synthesized
cttcgtaataagtcaatgttat

SEQ ID NO: 1097942 - DNA, 22 bp, Artificial Sequence
  chemically synthesized
cgtaataagtcaatgttatatt

SEQ ID NO: 1097943 - DNA, 22 bp, Artificial Sequence
  chemically synthesized
gtaataagtcaatgttatattt

SEQ ID NO: 1097944 - DNA, 22 bp, Artificial Sequence
  chemically synthesized
aaacaataggacaaaatataac

SEQ ID NO: 1097945 - DNA, 22 bp, Artificial Sequence
  chemically synthesized
gaaacaataggacaaaatataa

SEQ ID NO: 1097946 - DNA, 22 bp, Artificial Sequence
  chemically synthesized
ttgaaacaataggacaaaatat

SEQ ID NO: 1097947 - DNA, 22 bp, Artificial Sequence
  chemically synthesized
cttgaaacaataggacaaaata

SEQ ID NO: 1097948 - DNA, 22 bp, Artificial Sequence
  chemically synthesized
tcttgaaacaataggacaaaat

SEQ ID NO: 1097949 - DNA, 22 bp, Artificial Sequence
  chemically synthesized
ttcttgaaacaataggacaaaa

SEQ ID NO: 1097950 - DNA, 22 bp, Artificial Sequence
  chemically synthesized
catgtacttttcttgaaacaat

SEQ ID NO: 1097951 - DNA, 22 bp, Artificial Sequence
  chemically synthesized
tattttgtcctattgtttcaag

SEQ ID NO: 1097952 - DNA, 22 bp, Artificial Sequence
  chemically synthesized
acatgtacttttcttgaaacaa

SEQ ID NO: 1097953 - DNA, 22 bp, Artificial Sequence
  chemically synthesized
tgtcctattgtttcaagaaaag

SEQ ID NO: 1097954 - DNA, 22 bp, Artificial Sequence
  chemically synthesized
agtttacatgtacttttcttga

SEQ ID NO: 1097955 - DNA, 22 bp, Artificial Sequence
  chemically synthesized
gtcctattgtttcaagaaaagt

SEQ ID NO: 1097956 - DNA, 22 bp, Artificial Sequence
  chemically synthesized
tcctattgtttcaagaaaagta

SEQ ID NO: 1097957 - DNA, 22 bp, Artificial Sequence
  chemically synthesized
ttgtttcaagaaaagtacatgt

SEQ ID NO: 1097958 - DNA, 22 bp, Artificial Sequence
  chemically synthesized
tttcaagaaaagtacatgtaaa

SEQ ID NO: 1097959 - DNA, 22 bp, Artificial Sequence
  chemically synthesized
caagaaaagtacatgtaaactc

SEQ ID NO: 1097960 - DNA, 22 bp, Artificial Sequence
  chemically synthesized
aagaaaagtacatgtaaactca

SEQ ID NO: 1097961 - DNA, 22 bp, Artificial Sequence
  chemically synthesized
atatggatagaaaggactgagt

SEQ ID NO: 1097962 - DNA, 22 bp, Artificial Sequence
  chemically synthesized
aatatggatagaaaggactgag

SEQ ID NO: 1097963 - DNA, 22 bp, Artificial Sequence
  chemically synthesized
taatatggatagaaaggactga

SEQ ID NO: 1097964 - DNA, 22 bp, Artificial Sequence
  chemically synthesized
aacccgtagcctttaatatgga

SEQ ID NO: 1097965 - DNA, 22 bp, Artificial Sequence
  chemically synthesized
agtcctttctatccatattaaa

SEQ ID NO: 1097966 - DNA, 22 bp, Artificial Sequence
  chemically synthesized
gaacccgtagcctttaatatgg

SEQ ID NO: 1097967 - DNA, 22 bp, Artificial Sequence
  chemically synthesized
tctatccatattaaaggctacg

SEQ ID NO: 1097968 - DNA, 22 bp, Artificial Sequence
  chemically synthesized
aatatttgaacccgtagccttt

SEQ ID NO: 1097969 - DNA, 22 bp, Artificial Sequence
  chemically synthesized
ctatccatattaaaggctacgg

SEQ ID NO: 1097970 - DNA, 22 bp, Artificial Sequence
  chemically synthesized
tatccatattaaaggctacggg

SEQ ID NO: 1097971 - DNA, 22 bp, Artificial Sequence
  chemically synthesized
tccatattaaaggctacgggtt

SEQ ID NO: 1097972 - DNA, 22 bp, Artificial Sequence
  chemically synthesized
gaaacactaaatatttgaaccc

SEQ ID NO: 1097973 - DNA, 22 bp, Artificial Sequence
  chemically synthesized
ggaaacactaaatatttgaacc

SEQ ID NO: 1097974 - DNA, 22 bp, Artificial Sequence
  chemically synthesized
aaggctacgggttcaaatattt

SEQ ID NO: 1097975 - DNA, 22 bp, Artificial Sequence
  chemically synthesized
agaatttggaaacactaaatat

SEQ ID NO: 1097976 - DNA, 22 bp, Artificial Sequence
  chemically synthesized
tgagaatttggaaacactaaat

SEQ ID NO: 1097977 - DNA, 22 bp, Artificial Sequence
  chemically synthesized
cgggttcaaatatttagtgttt

SEQ ID NO: 1097978 - DNA, 22 bp, Artificial Sequence
  chemically synthesized
ctgagaatttggaaacactaaa

SEQ ID NO: 1097979 - DNA, 22 bp, Artificial Sequence
  chemically synthesized
aaatatttagtgtttccaaatt

SEQ ID NO: 1097980 - DNA, 22 bp, Artificial Sequence
  chemically synthesized
aaggcatttctgagaatttgga

SEQ ID NO: 1097981 - DNA, 22 bp, Artificial Sequence
  chemically synthesized
gaaggcatttctgagaatttgg

SEQ ID NO: 1097982 - DNA, 22 bp, Artificial Sequence
  chemically synthesized
agtgtttccaaattctcagaaa

SEQ ID NO: 1097983 - DNA, 22 bp, Artificial Sequence
  chemically synthesized
gtgtttccaaattctcagaaat

SEQ ID NO: 1097984 - DNA, 22 bp, Artificial Sequence
  chemically synthesized
gtagtttgaaggcatttctgag

SEQ ID NO: 1097985 - DNA, 22 bp, Artificial Sequence
  chemically synthesized
ggtagtttgaaggcatttctga

SEQ ID NO: 1097986 - DNA, 22 bp, Artificial Sequence
  chemically synthesized
ccaaattctcagaaatgccttc

SEQ ID NO: 1097987 - DNA, 22 bp, Artificial Sequence
  chemically synthesized
atttggtagtttgaaggcattt

SEQ ID NO: 1097988 - DNA, 22 bp, Artificial Sequence
  chemically synthesized
caaattctcagaaatgccttca

SEQ ID NO: 1097989 - DNA, 22 bp, Artificial Sequence
  chemically synthesized
tgttaatttggtagtttgaagg

SEQ ID NO: 1097990 - DNA, 22 bp, Artificial Sequence
  chemically synthesized
tcagaaatgccttcaaactacc

SEQ ID NO: 1097991 - DNA, 22 bp, Artificial Sequence
  chemically synthesized
agaaatgccttcaaactaccaa

SEQ ID NO: 1097992 - DNA, 22 bp, Artificial Sequence
  chemically synthesized
caaactaccaaattaacacagt

SEQ ID NO: 1097993 - DNA, 22 bp, Artificial Sequence
  chemically synthesized
aaactaccaaattaacacagtt

SEQ ID NO: 1097994 - DNA, 22 bp, Artificial Sequence
  chemically synthesized
taatgtagtcaacaaactgtgt

SEQ ID NO: 1097995 - DNA, 22 bp, Artificial Sequence
  chemically synthesized
ataatgtagtcaacaaactgtg

SEQ ID NO: 1097996 - DNA, 22 bp, Artificial Sequence
  chemically synthesized
ccaaattaacacagtttgttga

SEQ ID NO: 1097997 - DNA, 22 bp, Artificial Sequence
  chemically synthesized
acacagtttgttgactacatta

SEQ ID NO: 1097998 - DNA, 22 bp, Artificial Sequence
  chemically synthesized
aaaagacaaatttataatgtag

SEQ ID NO: 1097999 - DNA, 22 bp, Artificial Sequence
  chemically synthesized
gaaaagacaaatttataatgta

SEQ ID NO: 1098000 - DNA, 22 bp, Artificial Sequence
  chemically synthesized
ttgaaaagacaaatttataatg

SEQ ID NO: 1098001 - DNA, 22 bp, Artificial Sequence
  chemically synthesized
gttgactacattataaatttgt

SEQ ID NO: 1098002 - DNA, 22 bp, Artificial Sequence
  chemically synthesized
ttgactacattataaatttgtc

SEQ ID NO: 1098003 - DNA, 22 bp, Artificial Sequence
  chemically synthesized
actacattataaatttgtcttt

SEQ ID NO: 1098004 - DNA, 22 bp, Artificial Sequence
  chemically synthesized
cattataaatttgtcttttcaa

SEQ ID NO: 1098005 - DNA, 22 bp, Artificial Sequence
  chemically synthesized
tgcaaaagtattcttgaaaaga

SEQ ID NO: 1098006 - DNA, 22 bp, Artificial Sequence
  chemically synthesized
taaatttgtcttttcaagaata

SEQ ID NO: 1098007 - DNA, 22 bp, Artificial Sequence
  chemically synthesized
aaactgtgcaaaagtattcttg

SEQ ID NO: 1098008 - DNA, 22 bp, Artificial Sequence
  chemically synthesized
gtcttttcaagaatacttttgc

SEQ ID NO: 1098009 - DNA, 22 bp, Artificial Sequence
  chemically synthesized
tcttttcaagaatacttttgca

SEQ ID NO: 1098010 - DNA, 22 bp, Artificial Sequence
  chemically synthesized
ttcaagaatacttttgcacagt

SEQ ID NO: 1098011 - DNA, 22 bp, Artificial Sequence
  chemically synthesized
tcaagaatacttttgcacagtt

SEQ ID NO: 1098012 - DNA, 22 bp, Artificial Sequence
  chemically synthesized
caagaatacttttgcacagttt

SEQ ID NO: 1098013 - DNA, 22 bp, Artificial Sequence
  chemically synthesized
aagaatacttttgcacagtttc

SEQ ID NO: 1098014 - DNA, 22 bp, Artificial Sequence
  chemically synthesized
atgtaaatgtacgttgaaactg

SEQ ID NO: 1098015 - DNA, 22 bp, Artificial Sequence
  chemically synthesized
tagctgatgtaaatgtacgttg

SEQ ID NO: 1098016 - DNA, 22 bp, Artificial Sequence
  chemically synthesized
ttgcacagtttcaacgtacatt

SEQ ID NO: 1098017 - DNA, 22 bp, Artificial Sequence
  chemically synthesized
tgcacagtttcaacgtacattt

SEQ ID NO: 1098018 - DNA, 22 bp, Artificial Sequence
  chemically synthesized
gcacagtttcaacgtacattta

SEQ ID NO: 1098019 - DNA, 22 bp, Artificial Sequence
  chemically synthesized
cacagtttcaacgtacatttac

SEQ ID NO: 1098020 - DNA, 22 bp, Artificial Sequence
  chemically synthesized
tctgtagctgatgtaaatgtac

SEQ ID NO: 1098021 - DNA, 22 bp, Artificial Sequence
  chemically synthesized
actgtctgtagctgatgtaaat

SEQ ID NO: 1098022 - DNA, 22 bp, Artificial Sequence
  chemically synthesized
caacgtacatttacatcagcta

SEQ ID NO: 1098023 - DNA, 22 bp, Artificial Sequence
  chemically synthesized
attaactgtctgtagctgatgt

SEQ ID NO: 1098024 - DNA, 22 bp, Artificial Sequence
  chemically synthesized
aacgtacatttacatcagctac

SEQ ID NO: 1098025 - DNA, 22 bp, Artificial Sequence
  chemically synthesized
cattaactgtctgtagctgatg

SEQ ID NO: 1098026 - DNA, 22 bp, Artificial Sequence
  chemically synthesized
atttcattaactgtctgtagct

SEQ ID NO: 1098027 - DNA, 22 bp, Artificial Sequence
  chemically synthesized
acatcagctacagacagttaat

SEQ ID NO: 1098028 - DNA, 22 bp, Artificial Sequence
  chemically synthesized
catcagctacagacagttaatg

SEQ ID NO: 1098029 - DNA, 22 bp, Artificial Sequence
  chemically synthesized
cagacagttaatgaaatgagtt

SEQ ID NO: 1098030 - DNA, 22 bp, Artificial Sequence
  chemically synthesized
agagagcagaatcaactcattt

SEQ ID NO: 1098031 - DNA, 22 bp, Artificial Sequence
  chemically synthesized
atgaaatgagttgattctgctc

SEQ ID NO: 1098032 - DNA, 22 bp, Artificial Sequence
  chemically synthesized
aaatcatgtagtattaagagag

SEQ ID NO: 1098033 - DNA, 22 bp, Artificial Sequence
  chemically synthesized
gaaatcatgtagtattaagaga

SEQ ID NO: 1098034 - DNA, 22 bp, Artificial Sequence
  chemically synthesized
ccttgaaatcatgtagtattaa

SEQ ID NO: 1098035 - DNA, 22 bp, Artificial Sequence
  chemically synthesized
attctgctctcttaatactaca

SEQ ID NO: 1098036 - DNA, 22 bp, Artificial Sequence
  chemically synthesized
cccttgaaatcatgtagtatta

SEQ ID NO: 1098037 - DNA, 22 bp, Artificial Sequence
  chemically synthesized
tcccttgaaatcatgtagtatt

SEQ ID NO: 1098038 - DNA, 22 bp, Artificial Sequence
  chemically synthesized
tgctctcttaatactacatgat

SEQ ID NO: 1098039 - DNA, 22 bp, Artificial Sequence
  chemically synthesized
ctctcttaatactacatgattt

SEQ ID NO: 1098040 - DNA, 22 bp, Artificial Sequence
  chemically synthesized
tcttaatactacatgatttcaa

SEQ ID NO: 1098041 - DNA, 22 bp, Artificial Sequence
  chemically synthesized
aaacaattttcccttgaaatca

SEQ ID NO: 1098042 - DNA, 22 bp, Artificial Sequence
  chemically synthesized
ttaatactacatgatttcaagg

SEQ ID NO: 1098043 - DNA, 22 bp, Artificial Sequence
  chemically synthesized
gaaacaattttcccttgaaatc

SEQ ID NO: 1098044 - DNA, 22 bp, Artificial Sequence
  chemically synthesized
aatactacatgatttcaaggga

SEQ ID NO: 1098045 - DNA, 22 bp, Artificial Sequence
  chemically synthesized
atactacatgatttcaagggaa

SEQ ID NO: 1098046 - DNA, 22 bp, Artificial Sequence
  chemically synthesized
catgatttcaagggaaaattgt

SEQ ID NO: 1098047 - DNA, 22 bp, Artificial Sequence
  chemically synthesized
aaaatcacaatttgaaacaatt

SEQ ID NO: 1098048 - DNA, 22 bp, Artificial Sequence
  chemically synthesized
caagggaaaattgtttcaaatt

SEQ ID NO: 1098049 - DNA, 22 bp, Artificial Sequence
  chemically synthesized
aagggaaaattgtttcaaattg

SEQ ID NO: 1098050 - DNA, 22 bp, Artificial Sequence
  chemically synthesized
tgaaaattgaaaatcacaattt

SEQ ID NO: 1098051 - DNA, 22 bp, Artificial Sequence
  chemically synthesized
tttcaaattgtgattttcaatt

SEQ ID NO: 1098052 - DNA, 22 bp, Artificial Sequence
  chemically synthesized
tggtcaattatgaaaattgaaa

SEQ ID NO: 1098053 - DNA, 22 bp, Artificial Sequence
  chemically synthesized
caaattgtgattttcaattttc

SEQ ID NO: 1098054 - DNA, 22 bp, Artificial Sequence
  chemically synthesized
aaattgtgattttcaattttca

SEQ ID NO: 1098055 - DNA, 22 bp, Artificial Sequence
  chemically synthesized
tgattttcaattttcataattg

SEQ ID NO: 1098056 - DNA, 22 bp, Artificial Sequence
  chemically synthesized
atgcattgtggtcaattatgaa

SEQ ID NO: 1098057 - DNA, 22 bp, Artificial Sequence
  chemically synthesized
aatgcattgtggtcaattatga

SEQ ID NO: 1098058 - DNA, 22 bp, Artificial Sequence
  chemically synthesized
taatgcattgtggtcaattatg

SEQ ID NO: 1098059 - DNA, 22 bp, Artificial Sequence
  chemically synthesized
tcaattttcataattgaccaca

SEQ ID NO: 1098060 - DNA, 22 bp, Artificial Sequence
  chemically synthesized
attttaatgcattgtggtcaat

SEQ ID NO: 1098061 - DNA, 22 bp, Artificial Sequence
  chemically synthesized
caattttcataattgaccacaa

SEQ ID NO: 1098062 - DNA, 22 bp, Artificial Sequence
  chemically synthesized
aattttaatgcattgtggtcaa

SEQ ID NO: 1098063 - DNA, 22 bp, Artificial Sequence
  chemically synthesized
aattttcataattgaccacaat

SEQ ID NO: 1098064 - DNA, 22 bp, Artificial Sequence
  chemically synthesized
tttaattttaatgcattgtggt

SEQ ID NO: 1098065 - DNA, 22 bp, Artificial Sequence
  chemically synthesized
tcataattgaccacaatgcatt

SEQ ID NO: 1098066 - DNA, 22 bp, Artificial Sequence
  chemically synthesized
cataattgaccacaatgcatta

SEQ ID NO: 1098067 - DNA, 22 bp, Artificial Sequence
  chemically synthesized
ataattgaccacaatgcattaa

SEQ ID NO: 1098068 - DNA, 22 bp, Artificial Sequence
  chemically synthesized
aactgtttaattttaatgcatt

SEQ ID NO: 1098069 - DNA, 22 bp, Artificial Sequence
  chemically synthesized
aaactgtttaattttaatgcat

SEQ ID NO: 1098070 - DNA, 22 bp, Artificial Sequence
  chemically synthesized
accacaatgcattaaaattaaa

SEQ ID NO: 1098071 - DNA, 22 bp, Artificial Sequence
  chemically synthesized
acaaccttaaactgtttaattt

SEQ ID NO: 1098072 - DNA, 22 bp, Artificial Sequence
  chemically synthesized
aacaaccttaaactgtttaatt

SEQ ID NO: 1098073 - DNA, 22 bp, Artificial Sequence
  chemically synthesized
taacaaccttaaactgtttaat

SEQ ID NO: 1098074 - DNA, 22 bp, Artificial Sequence
  chemically synthesized
aaattaaacagtttaaggttgt

SEQ ID NO: 1098075 - DNA, 22 bp, Artificial Sequence
  chemically synthesized
atatacattttaacaaccttaa

SEQ ID NO: 1098076 - DNA, 22 bp, Artificial Sequence
  chemically synthesized
aatatacattttaacaacctta

SEQ ID NO: 1098077 - DNA, 22 bp, Artificial Sequence
  chemically synthesized
aacagtttaaggttgttaaaat

SEQ ID NO: 1098078 - DNA, 22 bp, Artificial Sequence
  chemically synthesized
aagtttaatatacattttaaca

SEQ ID NO: 1098079 - DNA, 22 bp, Artificial Sequence
  chemically synthesized
caagtttaatatacattttaac

SEQ ID NO: 1098080 - DNA, 22 bp, Artificial Sequence
  chemically synthesized
gcttcaagtttaatatacattt

SEQ ID NO: 1098081 - DNA, 22 bp, Artificial Sequence
  chemically synthesized
agcttcaagtttaatatacatt

SEQ ID NO: 1098082 - DNA, 22 bp, Artificial Sequence
  chemically synthesized
aaggttgttaaaatgtatatta

SEQ ID NO: 1098083 - DNA, 22 bp, Artificial Sequence
  chemically synthesized
aggttgttaaaatgtatattaa

SEQ ID NO: 1098084 - DNA, 22 bp, Artificial Sequence
  chemically synthesized
atttagcttcaagtttaatata

SEQ ID NO: 1098085 - DNA, 22 bp, Artificial Sequence
  chemically synthesized
aatttagcttcaagtttaatat

SEQ ID NO: 1098086 - DNA, 22 bp, Artificial Sequence
  chemically synthesized
taatttagcttcaagtttaata

SEQ ID NO: 1098087 - DNA, 22 bp, Artificial Sequence
  chemically synthesized
ttaaaatgtatattaaacttga

SEQ ID NO: 1098088 - DNA, 22 bp, Artificial Sequence
  chemically synthesized
aaatgtatattaaacttgaagc

SEQ ID NO: 1098089 - DNA, 22 bp, Artificial Sequence
  chemically synthesized
ataattttaatttagcttcaag

SEQ ID NO: 1098090 - DNA, 22 bp, Artificial Sequence
  chemically synthesized
attaataattttaatttagctt

SEQ ID NO: 1098091 - DNA, 22 bp, Artificial Sequence
  chemically synthesized
aattaataattttaatttagct

SEQ ID NO: 1098092 - DNA, 22 bp, Artificial Sequence
  chemically synthesized
taattaataattttaatttagc

SEQ ID NO: 1098093 - DNA, 22 bp, Artificial Sequence
  chemically synthesized
ttaattaataattttaatttag

SEQ ID NO: 1098094 - DNA, 22 bp, Artificial Sequence
  chemically synthesized
aacttgaagctaaattaaaatt

SEQ ID NO: 1098095 - DNA, 22 bp, Artificial Sequence
  chemically synthesized
atttttaattaataattttaat

SEQ ID NO: 1098096 - DNA, 22 bp, Artificial Sequence
  chemically synthesized
gaagctaaattaaaattattaa

SEQ ID NO: 1098097 - DNA, 22 bp, Artificial Sequence
  chemically synthesized
aagctaaattaaaattattaat

SEQ ID NO: 1098098 - DNA, 22 bp, Artificial Sequence
  chemically synthesized
aattaaaattattaattaaaaa

SEQ ID NO: 1098099 - DNA, 22 bp, Artificial Sequence
  chemically synthesized
agagaagaggttgatttttaat

SEQ ID NO: 1098100 - DNA, 22 bp, Artificial Sequence
  chemically synthesized
taagagaagaggttgattttta

SEQ ID NO: 1098101 - DNA, 22 bp, Artificial Sequence
  chemically synthesized
aaattattaattaaaaatcaac

SEQ ID NO: 1098102 - DNA, 22 bp, Artificial Sequence
  chemically synthesized
gttctaagagaagaggttgatt

SEQ ID NO: 1098103 - DNA, 22 bp, Artificial Sequence
  chemically synthesized
ttaattaaaaatcaacctcttc

SEQ ID NO: 1098104 - DNA, 22 bp, Artificial Sequence
  chemically synthesized
ctggttctaagagaagaggttg

SEQ ID NO: 1098105 - DNA, 22 bp, Artificial Sequence
  chemically synthesized
cctggttctaagagaagaggtt

SEQ ID NO: 1098106 - DNA, 22 bp, Artificial Sequence
  chemically synthesized
tcctggttctaagagaagaggt

SEQ ID NO: 1098107 - DNA, 22 bp, Artificial Sequence
  chemically synthesized
attaaaaatcaacctcttctct

SEQ ID NO: 1098108 - DNA, 22 bp, Artificial Sequence
  chemically synthesized
tttcctggttctaagagaagag

SEQ ID NO: 1098109 - DNA, 22 bp, Artificial Sequence
  chemically synthesized
aaaatcaacctcttctcttaga

SEQ ID NO: 1098110 - DNA, 22 bp, Artificial Sequence
  chemically synthesized
ctctttcctggttctaagagaa

SEQ ID NO: 1098111 - DNA, 22 bp, Artificial Sequence
  chemically synthesized
tatacagtctgctctttcctgg

SEQ ID NO: 1098112 - DNA, 22 bp, Artificial Sequence
  chemically synthesized
ttctcttagaaccaggaaagag

SEQ ID NO: 1098113 - DNA, 22 bp, Artificial Sequence
  chemically synthesized
ctcttagaaccaggaaagagca

SEQ ID NO: 1098114 - DNA, 22 bp, Artificial Sequence
  chemically synthesized
tcttagaaccaggaaagagcag

SEQ ID NO: 1098115 - DNA, 22 bp, Artificial Sequence
  chemically synthesized
ttagaaccaggaaagagcagac

SEQ ID NO: 1098116 - DNA, 22 bp, Artificial Sequence
  chemically synthesized
aagttgtatacagtctgctctt

SEQ ID NO: 1098117 - DNA, 22 bp, Artificial Sequence
  chemically synthesized
gaagttgtatacagtctgctct

SEQ ID NO: 1098118 - DNA, 22 bp, Artificial Sequence
  chemically synthesized
agaaccaggaaagagcagactg

SEQ ID NO: 1098119 - DNA, 22 bp, Artificial Sequence
  chemically synthesized
gaaccaggaaagagcagactgt

SEQ ID NO: 1098120 - DNA, 22 bp, Artificial Sequence
  chemically synthesized
tatacaacttcaagcattgttg

SEQ ID NO: 1098121 - DNA, 22 bp, Artificial Sequence
  chemically synthesized
caagcattgttgcatttctttc

SEQ ID NO: 1098122 - DNA, 22 bp, Artificial Sequence
  chemically synthesized
aagcattgttgcatttctttct

SEQ ID NO: 1098123 - DNA, 22 bp, Artificial Sequence
  chemically synthesized
ttgcatttctttctttttccat

SEQ ID NO: 1098124 - DNA, 22 bp, Artificial Sequence
  chemically synthesized
catttctttctttttccattta

SEQ ID NO: 1098125 - DNA, 22 bp, Artificial Sequence
  chemically synthesized
agtaaaacaaaggaaataaatg

SEQ ID NO: 1098126 - DNA, 22 bp, Artificial Sequence
  chemically synthesized
ctttctttttccatttatttcc

SEQ ID NO: 1098127 - DNA, 22 bp, Artificial Sequence
  chemically synthesized
tttctttttccatttatttcct

SEQ ID NO: 1098128 - DNA, 22 bp, Artificial Sequence
  chemically synthesized
tctttttccatttatttccttt

SEQ ID NO: 1098129 - DNA, 22 bp, Artificial Sequence
  chemically synthesized
ctttttccatttatttcctttg

SEQ ID NO: 1098130 - DNA, 22 bp, Artificial Sequence
  chemically synthesized
tttttccatttatttcctttgt

SEQ ID NO: 1098131 - DNA, 22 bp, Artificial Sequence
  chemically synthesized
tttccatttatttcctttgttt

SEQ ID NO: 1098132 - DNA, 22 bp, Artificial Sequence
  chemically synthesized
ttccatttatttcctttgtttt

SEQ ID NO: 1098133 - DNA, 22 bp, Artificial Sequence
  chemically synthesized
tccatttatttcctttgtttta

SEQ ID NO: 1098134 - DNA, 22 bp, Artificial Sequence
  chemically synthesized
ccatttatttcctttgttttac

SEQ ID NO: 1098135 - DNA, 22 bp, Artificial Sequence
  chemically synthesized
catttatttcctttgttttact

SEQ ID NO: 1098136 - DNA, 22 bp, Artificial Sequence
  chemically synthesized
atttcctttgttttacttagtt

SEQ ID NO: 1098137 - DNA, 22 bp, Artificial Sequence
  chemically synthesized
tttcctttgttttacttagttt

SEQ ID NO: 1098138 - DNA, 22 bp, Artificial Sequence
  chemically synthesized
cctttgttttacttagtttttc

SEQ ID NO: 1098139 - DNA, 22 bp, Artificial Sequence
  chemically synthesized
ctttgttttacttagtttttct

SEQ ID NO: 1098140 - DNA, 22 bp, Artificial Sequence
  chemically synthesized
tgttttacttagtttttctttt

SEQ ID NO: 1098141 - DNA, 22 bp, Artificial Sequence
  chemically synthesized
gttttacttagtttttcttttt

SEQ ID NO: 1098142 - DNA, 22 bp, Artificial Sequence
  chemically synthesized
ttttacttagtttttctttttt

SEQ ID NO: 1098143 - DNA, 22 bp, Artificial Sequence
  chemically synthesized
tacttagtttttcttttttttt

SEQ ID NO: 1098144 - DNA, 22 bp, Artificial Sequence
  chemically synthesized
acttagtttttctttttttttt

SEQ ID NO: 1098145 - DNA, 22 bp, Artificial Sequence
  chemically synthesized
cttagtttttcttttttttttt

SEQ ID NO: 1098146 - DNA, 22 bp, Artificial Sequence
  chemically synthesized
agtttttcttttttttttttta

SEQ ID NO: 1098147 - DNA, 22 bp, Artificial Sequence
  chemically synthesized
aagagatgaaggtaaaaaaaaa

SEQ ID NO: 1098148 - DNA, 22 bp, Artificial Sequence
  chemically synthesized
gtttttctttttttttttttac

SEQ ID NO: 1098149 - DNA, 22 bp, Artificial Sequence
  chemically synthesized
ttctttttttttttttaccttc

SEQ ID NO: 1098150 - DNA, 22 bp, Artificial Sequence
  chemically synthesized
tctttttttttttttaccttca

SEQ ID NO: 1098151 - DNA, 22 bp, Artificial Sequence
  chemically synthesized
ctttttttttttttaccttcat

SEQ ID NO: 1098152 - DNA, 22 bp, Artificial Sequence
  chemically synthesized
tttttttttttttaccttcatc

SEQ ID NO: 1098153 - DNA, 22 bp, Artificial Sequence
  chemically synthesized
tttttttttttaccttcatctc

SEQ ID NO: 1098154 - DNA, 22 bp, Artificial Sequence
  chemically synthesized
ttttttttttaccttcatctct

SEQ ID NO: 1098155 - DNA, 22 bp, Artificial Sequence
  chemically synthesized
tttttttttaccttcatctctt

SEQ ID NO: 1098156 - DNA, 22 bp, Artificial Sequence
  chemically synthesized
ttttttttaccttcatctcttc

SEQ ID NO: 1098157 - DNA, 22 bp, Artificial Sequence
  chemically synthesized
cagaaagcagttgaagagatga

SEQ ID NO: 1098158 - DNA, 22 bp, Artificial Sequence
  chemically synthesized
tttttttaccttcatctcttca

SEQ ID NO: 1098159 - DNA, 22 bp, Artificial Sequence
  chemically synthesized
ttttttaccttcatctcttcaa

SEQ ID NO: 1098160 - DNA, 22 bp, Artificial Sequence
  chemically synthesized
tttttaccttcatctcttcaac

SEQ ID NO: 1098161 - DNA, 22 bp, Artificial Sequence
  chemically synthesized
ttttaccttcatctcttcaact

SEQ ID NO: 1098162 - DNA, 22 bp, Artificial Sequence
  chemically synthesized
tttaccttcatctcttcaactg

SEQ ID NO: 1098163 - DNA, 22 bp, Artificial Sequence
  chemically synthesized
ttaccttcatctcttcaactgc

SEQ ID NO: 1098164 - DNA, 22 bp, Artificial Sequence
  chemically synthesized
taccttcatctcttcaactgct

SEQ ID NO: 1098165 - DNA, 22 bp, Artificial Sequence
  chemically synthesized
accttcatctcttcaactgctt

SEQ ID NO: 1098166 - DNA, 22 bp, Artificial Sequence
  chemically synthesized
ccttcatctcttcaactgcttt

SEQ ID NO: 1098167 - DNA, 22 bp, Artificial Sequence
  chemically synthesized
cagatgaattacagaaagcagt

SEQ ID NO: 1098168 - DNA, 22 bp, Artificial Sequence
  chemically synthesized
catctcttcaactgctttctgt

SEQ ID NO: 1098169 - DNA, 22 bp, Artificial Sequence
  chemically synthesized
atctcttcaactgctttctgta

SEQ ID NO: 1098170 - DNA, 22 bp, Artificial Sequence
  chemically synthesized
ttcaactgctttctgtaattca

SEQ ID NO: 1098171 - DNA, 22 bp, Artificial Sequence
  chemically synthesized
caactgctttctgtaattcatc

SEQ ID NO: 1098172 - DNA, 22 bp, Artificial Sequence
  chemically synthesized
aactgctttctgtaattcatct

SEQ ID NO: 1098173 - DNA, 22 bp, Artificial Sequence
  chemically synthesized
aatataaaactccagatgaatt

SEQ ID NO: 1098174 - DNA, 22 bp, Artificial Sequence
  chemically synthesized
gaatataaaactccagatgaat

SEQ ID NO: 1098175 - DNA, 22 bp, Artificial Sequence
  chemically synthesized
tgaatataaaactccagatgaa

SEQ ID NO: 1098176 - DNA, 22 bp, Artificial Sequence
  chemically synthesized
ctttctgtaattcatctggagt

SEQ ID NO: 1098177 - DNA, 22 bp, Artificial Sequence
  chemically synthesized
tctgtaattcatctggagtttt

SEQ ID NO: 1098178 - DNA, 22 bp, Artificial Sequence
  chemically synthesized
ctgtaattcatctggagtttta

SEQ ID NO: 1098179 - DNA, 22 bp, Artificial Sequence
  chemically synthesized
tgtaattcatctggagttttat

SEQ ID NO: 1098180 - DNA, 22 bp, Artificial Sequence
  chemically synthesized
taattcatctggagttttatat

SEQ ID NO: 1098181 - DNA, 22 bp, Artificial Sequence
  chemically synthesized
agagagattttgaatataaaac

SEQ ID NO: 1098182 - DNA, 22 bp, Artificial Sequence
  chemically synthesized
gagagagattttgaatataaaa

SEQ ID NO: 1098183 - DNA, 22 bp, Artificial Sequence
  chemically synthesized
atctggagttttatattcaaaa

SEQ ID NO: 1098184 - DNA, 22 bp, Artificial Sequence
  chemically synthesized
gagttttatattcaaaatctct

SEQ ID NO: 1098185 - DNA, 22 bp, Artificial Sequence
  chemically synthesized
aagaagagtatcttgagagaga

SEQ ID NO: 1098186 - DNA, 22 bp, Artificial Sequence
  chemically synthesized
tatattcaaaatctctctcaag

SEQ ID NO: 1098187 - DNA, 22 bp, Artificial Sequence
  chemically synthesized
atattcaaaatctctctcaaga

SEQ ID NO: 1098188 - DNA, 22 bp, Artificial Sequence
  chemically synthesized
tattcaaaatctctctcaagat

SEQ ID NO: 1098189 - DNA, 22 bp, Artificial Sequence
  chemically synthesized
aaaatctctctcaagatactct

SEQ ID NO: 1098190 - DNA, 22 bp, Artificial Sequence
  chemically synthesized
tctcaagatactcttcttcagc

SEQ ID NO: 1098191 - DNA, 22 bp, Artificial Sequence
  chemically synthesized
tcaagatactcttcttcagctt

SEQ ID NO: 1098192 - DNA, 22 bp, Artificial Sequence
  chemically synthesized
aagatactcttcttcagcttgt

SEQ ID NO: 1098193 - DNA, 22 bp, Artificial Sequence
  chemically synthesized
ttcttcagcttgtgtcatccat

SEQ ID NO: 1098194 - DNA, 22 bp, Artificial Sequence
  chemically synthesized
cttcagcttgtgtcatccattc

SEQ ID NO: 1098195 - DNA, 22 bp, Artificial Sequence
  chemically synthesized
tcagagatgcacgaatggatga

SEQ ID NO: 1098196 - DNA, 22 bp, Artificial Sequence
  chemically synthesized
ttcagcttgtgtcatccattcg

SEQ ID NO: 1098197 - DNA, 22 bp, Artificial Sequence
  chemically synthesized
cagcttgtgtcatccattcgtg

SEQ ID NO: 1098198 - DNA, 22 bp, Artificial Sequence
  chemically synthesized
agcttgtgtcatccattcgtgc

SEQ ID NO: 1098199 - DNA, 22 bp, Artificial Sequence
  chemically synthesized
gtgtcatccattcgtgcatctc

SEQ ID NO: 1098200 - DNA, 22 bp, Artificial Sequence
  chemically synthesized
tgtcatccattcgtgcatctct

SEQ ID NO: 1098201 - DNA, 22 bp, Artificial Sequence
  chemically synthesized
cagaaagatctatcagagatgc

SEQ ID NO: 1098202 - DNA, 22 bp, Artificial Sequence
  chemically synthesized
taagcctccagaaagatctatc

SEQ ID NO: 1098203 - DNA, 22 bp, Artificial Sequence
  chemically synthesized
gtgcatctctgatagatctttc

SEQ ID NO: 1098204 - DNA, 22 bp, Artificial Sequence
  chemically synthesized
gagaaaactgtaagcctccaga

SEQ ID NO: 1098205 - DNA, 22 bp, Artificial Sequence
  chemically synthesized
tgatagatctttctggaggctt

SEQ ID NO: 1098206 - DNA, 22 bp, Artificial Sequence
  chemically synthesized
ggagaaaactgtaagcctccag

SEQ ID NO: 1098207 - DNA, 22 bp, Artificial Sequence
  chemically synthesized
atagatctttctggaggcttac

SEQ ID NO: 1098208 - DNA, 22 bp, Artificial Sequence
  chemically synthesized
tctggaggcttacagttttctc

SEQ ID NO: 1098209 - DNA, 22 bp, Artificial Sequence
  chemically synthesized
aagggaggtttggagaaaactg

SEQ ID NO: 1098210 - DNA, 22 bp, Artificial Sequence
  chemically synthesized
ctggaggcttacagttttctcc

SEQ ID NO: 1098211 - DNA, 22 bp, Artificial Sequence
  chemically synthesized
gaagggaggtttggagaaaact

SEQ ID NO: 1098212 - DNA, 22 bp, Artificial Sequence
  chemically synthesized
tggaggcttacagttttctcca

SEQ ID NO: 1098213 - DNA, 22 bp, Artificial Sequence
  chemically synthesized
gaggcttacagttttctccaaa

SEQ ID NO: 1098214 - DNA, 22 bp, Artificial Sequence
  chemically synthesized
acagttttctccaaacctccct

SEQ ID NO: 1098215 - DNA, 22 bp, Artificial Sequence
  chemically synthesized
cagttttctccaaacctccctt

SEQ ID NO: 1098216 - DNA, 22 bp, Artificial Sequence
  chemically synthesized
tctccaaacctcccttcaaggc

SEQ ID NO: 1098217 - DNA, 22 bp, Artificial Sequence
  chemically synthesized
ctccaaacctcccttcaaggcc

SEQ ID NO: 1098218 - DNA, 22 bp, Artificial Sequence
  chemically synthesized
tgccagaaaggaggccttgaag

SEQ ID NO: 1098219 - DNA, 22 bp, Artificial Sequence
  chemically synthesized
tccaaacctcccttcaaggcct

SEQ ID NO: 1098220 - DNA, 22 bp, Artificial Sequence
  chemically synthesized
caaacctcccttcaaggcctcc

SEQ ID NO: 1098221 - DNA, 22 bp, Artificial Sequence
  chemically synthesized
ccttcaaggcctcctttctggc

SEQ ID NO: 1098222 - DNA, 22 bp, Artificial Sequence
  chemically synthesized
tggaaggtctatgccagaaagg

SEQ ID NO: 1098223 - DNA, 22 bp, Artificial Sequence
  chemically synthesized
gtggaaggtctatgccagaaag

SEQ ID NO: 1098224 - DNA, 22 bp, Artificial Sequence
  chemically synthesized
tgtggaaggtctatgccagaaa

SEQ ID NO: 1098225 - DNA, 22 bp, Artificial Sequence
  chemically synthesized
caaggcctcctttctggcatag

SEQ ID NO: 1098226 - DNA, 22 bp, Artificial Sequence
  chemically synthesized
aaggcctcctttctggcataga

SEQ ID NO: 1098227 - DNA, 22 bp, Artificial Sequence
  chemically synthesized
ttttgtggaaggtctatgccag

SEQ ID NO: 1098228 - DNA, 22 bp, Artificial Sequence
  chemically synthesized
gttttgtggaaggtctatgcca

SEQ ID NO: 1098229 - DNA, 22 bp, Artificial Sequence
  chemically synthesized
tttgttttgtggaaggtctatg

SEQ ID NO: 1098230 - DNA, 22 bp, Artificial Sequence
  chemically synthesized
gtttgttttgtggaaggtctat

SEQ ID NO: 1098231 - DNA, 22 bp, Artificial Sequence
  chemically synthesized
ctttctggcatagaccttccac

SEQ ID NO: 1098232 - DNA, 22 bp, Artificial Sequence
  chemically synthesized
tttgtttgttttgtggaaggtc

SEQ ID NO: 1098233 - DNA, 22 bp, Artificial Sequence
  chemically synthesized
gtttgtttgttttgtggaaggt

SEQ ID NO: 1098234 - DNA, 22 bp, Artificial Sequence
  chemically synthesized
tgtttgtttgttttgtggaagg

SEQ ID NO: 1098235 - DNA, 22 bp, Artificial Sequence
  chemically synthesized
tctggcatagaccttccacaaa

SEQ ID NO: 1098236 - DNA, 22 bp, Artificial Sequence
  chemically synthesized
ctggcatagaccttccacaaaa

SEQ ID NO: 1098237 - DNA, 22 bp, Artificial Sequence
  chemically synthesized
tggcatagaccttccacaaaac

SEQ ID NO: 1098238 - DNA, 22 bp, Artificial Sequence
  chemically synthesized
gcatagaccttccacaaaacaa

SEQ ID NO: 1098239 - DNA, 22 bp, Artificial Sequence
  chemically synthesized
tcaataatcgtgttttgtttgt

SEQ ID NO: 1098240 - DNA, 22 bp, Artificial Sequence
  chemically synthesized
ccacaaaacaaacaaacaaaac

SEQ ID NO: 1098241 - DNA, 22 bp, Artificial Sequence
  chemically synthesized
cacaaaacaaacaaacaaaaca

SEQ ID NO: 1098242 - DNA, 22 bp, Artificial Sequence
  chemically synthesized
atcactgtcaataatcgtgttt

SEQ ID NO: 1098243 - DNA, 22 bp, Artificial Sequence
  chemically synthesized
catcactgtcaataatcgtgtt

SEQ ID NO: 1098244 - DNA, 22 bp, Artificial Sequence
  chemically synthesized
ttgacagtgatgaaacattatt

SEQ ID NO: 1098245 - DNA, 22 bp, Artificial Sequence
  chemically synthesized
acagtgatgaaacattattatt

SEQ ID NO: 1098246 - DNA, 22 bp, Artificial Sequence
  chemically synthesized
atgaaataatataataataatg

SEQ ID NO: 1098247 - DNA, 22 bp, Artificial Sequence
  chemically synthesized
catactgatgaaataatataat

SEQ ID NO: 1098248 - DNA, 22 bp, Artificial Sequence
  chemically synthesized
acatactgatgaaataatataa

SEQ ID NO: 1098249 - DNA, 22 bp, Artificial Sequence
  chemically synthesized
tttacatactgatgaaataata

SEQ ID NO: 1098250 - DNA, 22 bp, Artificial Sequence
  chemically synthesized
ttatttacatactgatgaaata

SEQ ID NO: 1098251 - DNA, 22 bp, Artificial Sequence
  chemically synthesized
tgttatttacatactgatgaaa

SEQ ID NO: 1098252 - DNA, 22 bp, Artificial Sequence
  chemically synthesized
ttattatattatttcatcagta

SEQ ID NO: 1098253 - DNA, 22 bp, Artificial Sequence
  chemically synthesized
ctgttatttacatactgatgaa

SEQ ID NO: 1098254 - DNA, 22 bp, Artificial Sequence
  chemically synthesized
tctgttatttacatactgatga

SEQ ID NO: 1098255 - DNA, 22 bp, Artificial Sequence
  chemically synthesized
ttatattatttcatcagtatgt

SEQ ID NO: 1098256 - DNA, 22 bp, Artificial Sequence
  chemically synthesized
tattatttcatcagtatgtaaa

SEQ ID NO: 1098257 - DNA, 22 bp, Artificial Sequence
  chemically synthesized
agctttctgttatttacatact

SEQ ID NO: 1098258 - DNA, 22 bp, Artificial Sequence
  chemically synthesized
tctaagctttctgttatttaca

SEQ ID NO: 1098259 - DNA, 22 bp, Artificial Sequence
  chemically synthesized
tttcatcagtatgtaaataaca

SEQ ID NO: 1098260 - DNA, 22 bp, Artificial Sequence
  chemically synthesized
ctatctaagctttctgttattt

SEQ ID NO: 1098261 - DNA, 22 bp, Artificial Sequence
  chemically synthesized
catcagtatgtaaataacagaa

SEQ ID NO: 1098262 - DNA, 22 bp, Artificial Sequence
  chemically synthesized
atcagtatgtaaataacagaaa

SEQ ID NO: 1098263 - DNA, 22 bp, Artificial Sequence
  chemically synthesized
tcattactatctaagctttctg

SEQ ID NO: 1098264 - DNA, 22 bp, Artificial Sequence
  chemically synthesized
atcattactatctaagctttct

SEQ ID NO: 1098265 - DNA, 22 bp, Artificial Sequence
  chemically synthesized
tatcattactatctaagctttc

SEQ ID NO: 1098266 - DNA, 22 bp, Artificial Sequence
  chemically synthesized
tttatcattactatctaagctt

SEQ ID NO: 1098267 - DNA, 22 bp, Artificial Sequence
  chemically synthesized
ctttatcattactatctaagct

SEQ ID NO: 1098268 - DNA, 22 bp, Artificial Sequence
  chemically synthesized
cttctttatcattactatctaa

SEQ ID NO: 1098269 - DNA, 22 bp, Artificial Sequence
  chemically synthesized
acttctttatcattactatcta

SEQ ID NO: 1098270 - DNA, 22 bp, Artificial Sequence
  chemically synthesized
tacttctttatcattactatct

SEQ ID NO: 1098271 - DNA, 22 bp, Artificial Sequence
  chemically synthesized
ttacttctttatcattactatc

SEQ ID NO: 1098272 - DNA, 22 bp, Artificial Sequence
  chemically synthesized
tttacttctttatcattactat

SEQ ID NO: 1098273 - DNA, 22 bp, Artificial Sequence
  chemically synthesized
agatagtaatgataaagaagta

SEQ ID NO: 1098274 - DNA, 22 bp, Artificial Sequence
  chemically synthesized
gatagtaatgataaagaagtaa

SEQ ID NO: 1098275 - DNA, 22 bp, Artificial Sequence
  chemically synthesized
tgcatataagctttttacttct

SEQ ID NO: 1098276 - DNA, 22 bp, Artificial Sequence
  chemically synthesized
atgcatataagctttttacttc

SEQ ID NO: 1098277 - DNA, 22 bp, Artificial Sequence
  chemically synthesized
ttatgcatataagctttttact

SEQ ID NO: 1098278 - DNA, 22 bp, Artificial Sequence
  chemically synthesized
cttatgcatataagctttttac

SEQ ID NO: 1098279 - DNA, 22 bp, Artificial Sequence
  chemically synthesized
tcttatgcatataagcttttta

SEQ ID NO: 1098280 - DNA, 22 bp, Artificial Sequence
  chemically synthesized
ttttcttatgcatataagcttt

SEQ ID NO: 1098281 - DNA, 22 bp, Artificial Sequence
  chemically synthesized
atccccatgagttattttctta

SEQ ID NO: 1098282 - DNA, 22 bp, Artificial Sequence
  chemically synthesized
atatgcataagaaaataactca

SEQ ID NO: 1098283 - DNA, 22 bp, Artificial Sequence
  chemically synthesized
tatgcataagaaaataactcat

SEQ ID NO: 1098284 - DNA, 22 bp, Artificial Sequence
  chemically synthesized
agtgtatctgatccccatgagt

SEQ ID NO: 1098285 - DNA, 22 bp, Artificial Sequence
  chemically synthesized
tgggaaattgagtgtatctgat

SEQ ID NO: 1098286 - DNA, 22 bp, Artificial Sequence
  chemically synthesized
atgggaaattgagtgtatctga

SEQ ID NO: 1098287 - DNA, 22 bp, Artificial Sequence
  chemically synthesized
atggggatcagatacactcaat

SEQ ID NO: 1098288 - DNA, 22 bp, Artificial Sequence
  chemically synthesized
acacttatgggaaattgagtgt

SEQ ID NO: 1098289 - DNA, 22 bp, Artificial Sequence
  chemically synthesized
cacacttatgggaaattgagtg

SEQ ID NO: 1098290 - DNA, 22 bp, Artificial Sequence
  chemically synthesized
tcacacttatgggaaattgagt

SEQ ID NO: 1098291 - DNA, 22 bp, Artificial Sequence
  chemically synthesized
ttttcacacttatgggaaattg

SEQ ID NO: 1098292 - DNA, 22 bp, Artificial Sequence
  chemically synthesized
attttcacacttatgggaaatt

SEQ ID NO: 1098293 - DNA, 22 bp, Artificial Sequence
  chemically synthesized
aatttcccataagtgtgaaaat

SEQ ID NO: 1098294 - DNA, 22 bp, Artificial Sequence
  chemically synthesized
cccataagtgtgaaaataagac

SEQ ID NO: 1098295 - DNA, 22 bp, Artificial Sequence
  chemically synthesized
ccataagtgtgaaaataagaca

SEQ ID NO: 1098296 - DNA, 22 bp, Artificial Sequence
  chemically synthesized
agtatgccaaataaacagacat

SEQ ID NO: 1098297 - DNA, 22 bp, Artificial Sequence
  chemically synthesized
ttaagtatgccaaataaacaga

SEQ ID NO: 1098298 - DNA, 22 bp, Artificial Sequence
  chemically synthesized
attaagtatgccaaataaacag

SEQ ID NO: 1098299 - DNA, 22 bp, Artificial Sequence
  chemically synthesized
tattaagtatgccaaataaaca

SEQ ID NO: 1098300 - DNA, 22 bp, Artificial Sequence
  chemically synthesized
attttattaagtatgccaaata

SEQ ID NO: 1098301 - DNA, 22 bp, Artificial Sequence
  chemically synthesized
tttatttggcatacttaataaa

SEQ ID NO: 1098302 - DNA, 22 bp, Artificial Sequence
  chemically synthesized
atttggcatacttaataaaatg

SEQ ID NO: 1098303 - DNA, 22 bp, Artificial Sequence
  chemically synthesized
tttggcatacttaataaaatga

SEQ ID NO: 1098304 - DNA, 22 bp, Artificial Sequence
  chemically synthesized
ggcatacttaataaaatgaacg

SEQ ID NO: 1098305 - DNA, 22 bp, Artificial Sequence
  chemically synthesized
gcatacttaataaaatgaacgt

SEQ ID NO: 1098306 - DNA, 22 bp, Artificial Sequence
  chemically synthesized
tcatcatcgggcaatacgttca

SEQ ID NO: 1098307 - DNA, 22 bp, Artificial Sequence
  chemically synthesized
aataaaatgaacgtattgcccg

SEQ ID NO: 1098308 - DNA, 22 bp, Artificial Sequence
  chemically synthesized
aattatcatcatcgggcaatac

SEQ ID NO: 1098309 - DNA, 22 bp, Artificial Sequence
  chemically synthesized
ataaaatgaacgtattgcccga

SEQ ID NO: 1098310 - DNA, 22 bp, Artificial Sequence
  chemically synthesized
tcacacaaacagctgaattatc

SEQ ID NO: 1098311 - DNA, 22 bp, Artificial Sequence
  chemically synthesized
cccgatgatgataattcagctg

SEQ ID NO: 1098312 - DNA, 22 bp, Artificial Sequence
  chemically synthesized
acagaaaagcattgtcacacaa

SEQ ID NO: 1098313 - DNA, 22 bp, Artificial Sequence
  chemically synthesized
cattcacagaaaagcattgtca

SEQ ID NO: 1098314 - DNA, 22 bp, Artificial Sequence
  chemically synthesized
agctgtttgtgtgacaatgctt

SEQ ID NO: 1098315 - DNA, 22 bp, Artificial Sequence
  chemically synthesized
tccattcacagaaaagcattgt

SEQ ID NO: 1098316 - DNA, 22 bp, Artificial Sequence
  chemically synthesized
ctccattcacagaaaagcattg

SEQ ID NO: 1098317 - DNA, 22 bp, Artificial Sequence
  chemically synthesized
tctccattcacagaaaagcatt

SEQ ID NO: 1098318 - DNA, 22 bp, Artificial Sequence
  chemically synthesized
ttctccattcacagaaaagcat

SEQ ID NO: 1098319 - DNA, 22 bp, Artificial Sequence
  chemically synthesized
tttgtgtgacaatgcttttctg

SEQ ID NO: 1098320 - DNA, 22 bp, Artificial Sequence
  chemically synthesized
tttttctccattcacagaaaag

SEQ ID NO: 1098321 - DNA, 22 bp, Artificial Sequence
  chemically synthesized
gtgtgacaatgcttttctgtga

SEQ ID NO: 1098322 - DNA, 22 bp, Artificial Sequence
  chemically synthesized
gtttttctccattcacagaaaa

SEQ ID NO: 1098323 - DNA, 22 bp, Artificial Sequence
  chemically synthesized
tgtgacaatgcttttctgtgaa

SEQ ID NO: 1098324 - DNA, 22 bp, Artificial Sequence
  chemically synthesized
aaaagccttgtttttctccatt

SEQ ID NO: 1098325 - DNA, 22 bp, Artificial Sequence
  chemically synthesized
aaaaagccttgtttttctccat

SEQ ID NO: 1098326 - DNA, 22 bp, Artificial Sequence
  chemically synthesized
taaaaagccttgtttttctcca

SEQ ID NO: 1098327 - DNA, 22 bp, Artificial Sequence
  chemically synthesized
ttctgtgaatggagaaaaacaa

SEQ ID NO: 1098328 - DNA, 22 bp, Artificial Sequence
  chemically synthesized
ttttaaaaagccttgtttttct

SEQ ID NO: 1098329 - DNA, 22 bp, Artificial Sequence
  chemically synthesized
tctgtgaatggagaaaaacaag

SEQ ID NO: 1098330 - DNA, 22 bp, Artificial Sequence
  chemically synthesized
ctgtgaatggagaaaaacaagg

SEQ ID NO: 1098331 - DNA, 22 bp, Artificial Sequence
  chemically synthesized
tgtgaatggagaaaaacaaggc

SEQ ID NO: 1098332 - DNA, 22 bp, Artificial Sequence
  chemically synthesized
tgaatggagaaaaacaaggctt

SEQ ID NO: 1098333 - DNA, 22 bp, Artificial Sequence
  chemically synthesized
aaacatattattttaaaaagcc

SEQ ID NO: 1098334 - DNA, 22 bp, Artificial Sequence
  chemically synthesized
caactgaaacatattattttaa

SEQ ID NO: 1098335 - DNA, 22 bp, Artificial Sequence
  chemically synthesized
ccaactgaaacatattatttta

SEQ ID NO: 1098336 - DNA, 22 bp, Artificial Sequence
  chemically synthesized
tccaactgaaacatattatttt

SEQ ID NO: 1098337 - DNA, 22 bp, Artificial Sequence
  chemically synthesized
ttccaactgaaacatattattt

SEQ ID NO: 1098338 - DNA, 22 bp, Artificial Sequence
  chemically synthesized
cttttccaactgaaacatatta

SEQ ID NO: 1098339 - DNA, 22 bp, Artificial Sequence
  chemically synthesized
tttaaaataatatgtttcagtt

SEQ ID NO: 1098340 - DNA, 22 bp, Artificial Sequence
  chemically synthesized
ttaaaataatatgtttcagttg

SEQ ID NO: 1098341 - DNA, 22 bp, Artificial Sequence
  chemically synthesized
taaaataatatgtttcagttgg

SEQ ID NO: 1098342 - DNA, 22 bp, Artificial Sequence
  chemically synthesized
aaaataatatgtttcagttgga

SEQ ID NO: 1098343 - DNA, 22 bp, Artificial Sequence
  chemically synthesized
aaataatatgtttcagttggaa

SEQ ID NO: 1098344 - DNA, 22 bp, Artificial Sequence
  chemically synthesized
tgtatgccaataaaattacttt

SEQ ID NO: 1098345 - DNA, 22 bp, Artificial Sequence
  chemically synthesized
tatgtatgccaataaaattact

SEQ ID NO: 1098346 - DNA, 22 bp, Artificial Sequence
  chemically synthesized
ctatgtatgccaataaaattac

SEQ ID NO: 1098347 - DNA, 22 bp, Artificial Sequence
  chemically synthesized
cagttggaaaagtaattttatt

SEQ ID NO: 1098348 - DNA, 22 bp, Artificial Sequence
  chemically synthesized
agttggaaaagtaattttattg

SEQ ID NO: 1098349 - DNA, 22 bp, Artificial Sequence
  chemically synthesized
tttctatgtatgccaataaaat

SEQ ID NO: 1098350 - DNA, 22 bp, Artificial Sequence
  chemically synthesized
gaaaagtaattttattggcata

SEQ ID NO: 1098351 - DNA, 22 bp, Artificial Sequence
  chemically synthesized
tattggcatacatagaaatagt

SEQ ID NO: 1098352 - DNA, 22 bp, Artificial Sequence
  chemically synthesized
attggcatacatagaaatagtt

SEQ ID NO: 1098353 - DNA, 22 bp, Artificial Sequence
  chemically synthesized
ttggcatacatagaaatagtta

SEQ ID NO: 1098354 - DNA, 22 bp, Artificial Sequence
  chemically synthesized
gcatacatagaaatagttattc

SEQ ID NO: 1098355 - DNA, 22 bp, Artificial Sequence
  chemically synthesized
tgaaagaacacaaagaataact

SEQ ID NO: 1098356 - DNA, 22 bp, Artificial Sequence
  chemically synthesized
aaatagtaaaacattatgaaag

SEQ ID NO: 1098357 - DNA, 22 bp, Artificial Sequence
  chemically synthesized
ttctttgtgttctttcataatg

SEQ ID NO: 1098358 - DNA, 22 bp, Artificial Sequence
  chemically synthesized
aaaatagtaaaacattatgaaa

SEQ ID NO: 1098359 - DNA, 22 bp, Artificial Sequence
  chemically synthesized
tttgtgttctttcataatgttt

SEQ ID NO: 1098360 - DNA, 22 bp, Artificial Sequence
  chemically synthesized
tgtgttctttcataatgtttta

SEQ ID NO: 1098361 - DNA, 22 bp, Artificial Sequence
  chemically synthesized
gtgttctttcataatgttttac

SEQ ID NO: 1098362 - DNA, 22 bp, Artificial Sequence
  chemically synthesized
tgttctttcataatgttttact

SEQ ID NO: 1098363 - DNA, 22 bp, Artificial Sequence
  chemically synthesized
gaatatttaaaatagtaaaaca

SEQ ID NO: 1098364 - DNA, 22 bp, Artificial Sequence
  chemically synthesized
agaatatttaaaatagtaaaac

SEQ ID NO: 1098365 - DNA, 22 bp, Artificial Sequence
  chemically synthesized
ttagaatatttaaaatagtaaa

SEQ ID NO: 1098366 - DNA, 22 bp, Artificial Sequence
  chemically synthesized
tttcataatgttttactatttt

SEQ ID NO: 1098367 - DNA, 22 bp, Artificial Sequence
  chemically synthesized
tcataatgttttactattttaa

SEQ ID NO: 1098368 - DNA, 22 bp, Artificial Sequence
  chemically synthesized
cataatgttttactattttaaa

SEQ ID NO: 1098369 - DNA, 22 bp, Artificial Sequence
  chemically synthesized
ataatgttttactattttaaat

SEQ ID NO: 1098370 - DNA, 22 bp, Artificial Sequence
  chemically synthesized
tgaagttcttagaatatttaaa

SEQ ID NO: 1098371 - DNA, 22 bp, Artificial Sequence
  chemically synthesized
tactattttaaatattctaaga

SEQ ID NO: 1098372 - DNA, 22 bp, Artificial Sequence
  chemically synthesized
actattttaaatattctaagaa

SEQ ID NO: 1098373 - DNA, 22 bp, Artificial Sequence
  chemically synthesized
ctattttaaatattctaagaac

SEQ ID NO: 1098374 - DNA, 22 bp, Artificial Sequence
  chemically synthesized
ttttaaatattctaagaacttc

SEQ ID NO: 1098375 - DNA, 22 bp, Artificial Sequence
  chemically synthesized
taaatattctaagaacttcata

SEQ ID NO: 1098376 - DNA, 22 bp, Artificial Sequence
  chemically synthesized
tagatacatgattatgaagttc

SEQ ID NO: 1098377 - DNA, 22 bp, Artificial Sequence
  chemically synthesized
aaatattctaagaacttcataa

SEQ ID NO: 1098378 - DNA, 22 bp, Artificial Sequence
  chemically synthesized
aatattctaagaacttcataat

SEQ ID NO: 1098379 - DNA, 22 bp, Artificial Sequence
  chemically synthesized
tgtagatacatgattatgaagt

SEQ ID NO: 1098380 - DNA, 22 bp, Artificial Sequence
  chemically synthesized
ctgtagatacatgattatgaag

SEQ ID NO: 1098381 - DNA, 22 bp, Artificial Sequence
  chemically synthesized
taagaacttcataatcatgtat

SEQ ID NO: 1098382 - DNA, 22 bp, Artificial Sequence
  chemically synthesized
agaacttcataatcatgtatct

SEQ ID NO: 1098383 - DNA, 22 bp, Artificial Sequence
  chemically synthesized
tgagagtttctgtagatacatg

SEQ ID NO: 1098384 - DNA, 22 bp, Artificial Sequence
  chemically synthesized
atgagagtttctgtagatacat

SEQ ID NO: 1098385 - DNA, 22 bp, Artificial Sequence
  chemically synthesized
atttatgagagtttctgtagat

SEQ ID NO: 1098386 - DNA, 22 bp, Artificial Sequence
  chemically synthesized
cataatcatgtatctacagaaa

SEQ ID NO: 1098387 - DNA, 22 bp, Artificial Sequence
  chemically synthesized
aatttatgagagtttctgtaga

SEQ ID NO: 1098388 - DNA, 22 bp, Artificial Sequence
  chemically synthesized
ataatcatgtatctacagaaac

SEQ ID NO: 1098389 - DNA, 22 bp, Artificial Sequence
  chemically synthesized
taatttatgagagtttctgtag

SEQ ID NO: 1098390 - DNA, 22 bp, Artificial Sequence
  chemically synthesized
ttaatttatgagagtttctgta

SEQ ID NO: 1098391 - DNA, 22 bp, Artificial Sequence
  chemically synthesized
tttaatttatgagagtttctgt

SEQ ID NO: 1098392 - DNA, 22 bp, Artificial Sequence
  chemically synthesized
tttttaatttatgagagtttct

SEQ ID NO: 1098393 - DNA, 22 bp, Artificial Sequence
  chemically synthesized
ctttttaatttatgagagtttc

SEQ ID NO: 1098394 - DNA, 22 bp, Artificial Sequence
  chemically synthesized
tctttttaatttatgagagttt

SEQ ID NO: 1098395 - DNA, 22 bp, Artificial Sequence
  chemically synthesized
ttctttttaatttatgagagtt

SEQ ID NO: 1098396 - DNA, 22 bp, Artificial Sequence
  chemically synthesized
tttctttttaatttatgagagt

SEQ ID NO: 1098397 - DNA, 22 bp, Artificial Sequence
  chemically synthesized
gttttttctttttaatttatga

SEQ ID NO: 1098398 - DNA, 22 bp, Artificial Sequence
  chemically synthesized
cgttttttctttttaatttatg

SEQ ID NO: 1098399 - DNA, 22 bp, Artificial Sequence
  chemically synthesized
tcgttttttctttttaatttat

SEQ ID NO: 1098400 - DNA, 22 bp, Artificial Sequence
  chemically synthesized
cagaaactctcataaattaaaa

SEQ ID NO: 1098401 - DNA, 22 bp, Artificial Sequence
  chemically synthesized
ttcgttttttctttttaattta

SEQ ID NO: 1098402 - DNA, 22 bp, Artificial Sequence
  chemically synthesized
tgcacttttcgttttttctttt

SEQ ID NO: 1098403 - DNA, 22 bp, Artificial Sequence
  chemically synthesized
atgcacttttcgttttttcttt

SEQ ID NO: 1098404 - DNA, 22 bp, Artificial Sequence
  chemically synthesized
tcataaattaaaaagaaaaaac

SEQ ID NO: 1098405 - DNA, 22 bp, Artificial Sequence
  chemically synthesized
tatgcacttttcgttttttctt

SEQ ID NO: 1098406 - DNA, 22 bp, Artificial Sequence
  chemically synthesized
ataaattaaaaagaaaaaacga

SEQ ID NO: 1098407 - DNA, 22 bp, Artificial Sequence
  chemically synthesized
cgttttatgcacttttcgtttt

SEQ ID NO: 1098408 - DNA, 22 bp, Artificial Sequence
  chemically synthesized
aaaagaaaaaacgaaaagtgca

SEQ ID NO: 1098409 - DNA, 22 bp, Artificial Sequence
  chemically synthesized
ccaaactacgttttatgcactt

SEQ ID NO: 1098410 - DNA, 22 bp, Artificial Sequence
  chemically synthesized
tgaattgccaaactacgtttta

SEQ ID NO: 1098411 - DNA, 22 bp, Artificial Sequence
  chemically synthesized
gtgaattgccaaactacgtttt

SEQ ID NO: 1098412 - DNA, 22 bp, Artificial Sequence
  chemically synthesized
tgtgaattgccaaactacgttt

SEQ ID NO: 1098413 - DNA, 22 bp, Artificial Sequence
  chemically synthesized
tttgtgaattgccaaactacgt

SEQ ID NO: 1098414 - DNA, 22 bp, Artificial Sequence
  chemically synthesized
ctttgtgaattgccaaactacg

SEQ ID NO: 1098415 - DNA, 22 bp, Artificial Sequence
  chemically synthesized
tcttctttgtgaattgccaaac

SEQ ID NO: 1098416 - DNA, 22 bp, Artificial Sequence
  chemically synthesized
ccatatattatcttctttgtga

SEQ ID NO: 1098417 - DNA, 22 bp, Artificial Sequence
  chemically synthesized
ggcaattcacaaagaagataat

SEQ ID NO: 1098418 - DNA, 22 bp, Artificial Sequence
  chemically synthesized
gcaattcacaaagaagataata

SEQ ID NO: 1098419 - DNA, 22 bp, Artificial Sequence
  chemically synthesized
tatacatgtattgccatatatt

SEQ ID NO: 1098420 - DNA, 22 bp, Artificial Sequence
  chemically synthesized
acaaagaagataatatatggca

SEQ ID NO: 1098421 - DNA, 22 bp, Artificial Sequence
  chemically synthesized
atatacatgtattgccatatat

SEQ ID NO: 1098422 - DNA, 22 bp, Artificial Sequence
  chemically synthesized
tatatacatgtattgccatata

SEQ ID NO: 1098423 - DNA, 22 bp, Artificial Sequence
  chemically synthesized
ttatatacatgtattgccatat

SEQ ID NO: 1098424 - DNA, 22 bp, Artificial Sequence
  chemically synthesized
gaacatcttttatatacatgta

SEQ ID NO: 1098425 - DNA, 22 bp, Artificial Sequence
  chemically synthesized
taaatggtattagaacatcttt

SEQ ID NO: 1098426 - DNA, 22 bp, Artificial Sequence
  chemically synthesized
actataaatggtattagaacat

SEQ ID NO: 1098427 - DNA, 22 bp, Artificial Sequence
  chemically synthesized
aactataaatggtattagaaca

SEQ ID NO: 1098428 - DNA, 22 bp, Artificial Sequence
  chemically synthesized
caatcatttaactataaatggt

SEQ ID NO: 1098429 - DNA, 22 bp, Artificial Sequence
  chemically synthesized
gcaatcatttaactataaatgg

SEQ ID NO: 1098430 - DNA, 22 bp, Artificial Sequence
  chemically synthesized
gatttgcaatcatttaactata

SEQ ID NO: 1098431 - DNA, 22 bp, Artificial Sequence
  chemically synthesized
cgatttgcaatcatttaactat

SEQ ID NO: 1098432 - DNA, 22 bp, Artificial Sequence
  chemically synthesized
taataccatttatagttaaatg

SEQ ID NO: 1098433 - DNA, 22 bp, Artificial Sequence
  chemically synthesized
ataccatttatagttaaatgat

SEQ ID NO: 1098434 - DNA, 22 bp, Artificial Sequence
  chemically synthesized
acttcgatttgcaatcatttaa

SEQ ID NO: 1098435 - DNA, 22 bp, Artificial Sequence
  chemically synthesized
attcacttcgatttgcaatcat

SEQ ID NO: 1098436 - DNA, 22 bp, Artificial Sequence
  chemically synthesized
atagttaaatgattgcaaatcg

SEQ ID NO: 1098437 - DNA, 22 bp, Artificial Sequence
  chemically synthesized
tagttaaatgattgcaaatcga

SEQ ID NO: 1098438 - DNA, 22 bp, Artificial Sequence
  chemically synthesized
aatgattgcaaatcgaagtgaa

SEQ ID NO: 1098439 - DNA, 22 bp, Artificial Sequence
  chemically synthesized
acatgtgaaaatgcattaattc

SEQ ID NO: 1098440 - DNA, 22 bp, Artificial Sequence
  chemically synthesized
caaatcgaagtgaattaatgca

SEQ ID NO: 1098441 - DNA, 22 bp, Artificial Sequence
  chemically synthesized
aacatgtgaaaatgcattaatt

SEQ ID NO: 1098442 - DNA, 22 bp, Artificial Sequence
  chemically synthesized
tcttaacatgtgaaaatgcatt

SEQ ID NO: 1098443 - DNA, 22 bp, Artificial Sequence
  chemically synthesized
cctgtcttaacatgtgaaaatg

SEQ ID NO: 1098444 - DNA, 22 bp, Artificial Sequence
  chemically synthesized
ccctgtcttaacatgtgaaaat

SEQ ID NO: 1098445 - DNA, 22 bp, Artificial Sequence
  chemically synthesized
tccctgtcttaacatgtgaaaa

SEQ ID NO: 1098446 - DNA, 22 bp, Artificial Sequence
  chemically synthesized
ttccctgtcttaacatgtgaaa

SEQ ID NO: 1098447 - DNA, 22 bp, Artificial Sequence
  chemically synthesized
tttttccctgtcttaacatgtg

SEQ ID NO: 1098448 - DNA, 22 bp, Artificial Sequence
  chemically synthesized
atgcattttcacatgttaagac

SEQ ID NO: 1098449 - DNA, 22 bp, Artificial Sequence
  chemically synthesized
ttatttttccctgtcttaacat

SEQ ID NO: 1098450 - DNA, 22 bp, Artificial Sequence
  chemically synthesized
attattatttttccctgtctta

SEQ ID NO: 1098451 - DNA, 22 bp, Artificial Sequence
  chemically synthesized
ttaattattatttttccctgtc

SEQ ID NO: 1098452 - DNA, 22 bp, Artificial Sequence
  chemically synthesized
tcacatgttaagacagggaaaa

SEQ ID NO: 1098453 - DNA, 22 bp, Artificial Sequence
  chemically synthesized
attaattattatttttccctgt

SEQ ID NO: 1098454 - DNA, 22 bp, Artificial Sequence
  chemically synthesized
cacatgttaagacagggaaaaa

SEQ ID NO: 1098455 - DNA, 22 bp, Artificial Sequence
  chemically synthesized
tattaattattatttttccctg

SEQ ID NO: 1098456 - DNA, 22 bp, Artificial Sequence
  chemically synthesized
acatgttaagacagggaaaaat

SEQ ID NO: 1098457 - DNA, 22 bp, Artificial Sequence
  chemically synthesized
tttattaattattatttttccc

SEQ ID NO: 1098458 - DNA, 22 bp, Artificial Sequence
  chemically synthesized
agacagggaaaaataataatta

SEQ ID NO: 1098459 - DNA, 22 bp, Artificial Sequence
  chemically synthesized
cccaaaatgggctctttattaa

SEQ ID NO: 1098460 - DNA, 22 bp, Artificial Sequence
  chemically synthesized
ccacatccctgcccaaaatggg

SEQ ID NO: 1098461 - DNA, 22 bp, Artificial Sequence
  chemically synthesized
cccacatccctgcccaaaatgg

SEQ ID NO: 1098462 - DNA, 22 bp, Artificial Sequence
  chemically synthesized
tcccacatccctgcccaaaatg

SEQ ID NO: 1098463 - DNA, 22 bp, Artificial Sequence
  chemically synthesized
ataaagagcccattttgggcag

SEQ ID NO: 1098464 - DNA, 22 bp, Artificial Sequence
  chemically synthesized
attttcccacatccctgcccaa

SEQ ID NO: 1098465 - DNA, 22 bp, Artificial Sequence
  chemically synthesized
gattttcccacatccctgccca

SEQ ID NO: 1098466 - DNA, 22 bp, Artificial Sequence
  chemically synthesized
tgattttcccacatccctgccc

SEQ ID NO: 1098467 - DNA, 22 bp, Artificial Sequence
  chemically synthesized
tgggcagggatgtgggaaaatc

SEQ ID NO: 1098468 - DNA, 22 bp, Artificial Sequence
  chemically synthesized
gggcagggatgtgggaaaatca

SEQ ID NO: 1098469 - DNA, 22 bp, Artificial Sequence
  chemically synthesized
ggcagggatgtgggaaaatcaa

SEQ ID NO: 1098470 - DNA, 22 bp, Artificial Sequence
  chemically synthesized
aacaagtataaaaactttgatt

SEQ ID NO: 1098471 - DNA, 22 bp, Artificial Sequence
  chemically synthesized
cctcaacaagtataaaaacttt

SEQ ID NO: 1098472 - DNA, 22 bp, Artificial Sequence
  chemically synthesized
ccctcaacaagtataaaaactt

SEQ ID NO: 1098473 - DNA, 22 bp, Artificial Sequence
  chemically synthesized
gatatttccctcaacaagtata

SEQ ID NO: 1098474 - DNA, 22 bp, Artificial Sequence
  chemically synthesized
tgttggatatttccctcaacaa

SEQ ID NO: 1098475 - DNA, 22 bp, Artificial Sequence
  chemically synthesized
tattatgttggatatttccctc

SEQ ID NO: 1098476 - DNA, 22 bp, Artificial Sequence
  chemically synthesized
ttatacttgttgagggaaatat

SEQ ID NO: 1098477 - DNA, 22 bp, Artificial Sequence
  chemically synthesized
tatacttgttgagggaaatatc

SEQ ID NO: 1098478 - DNA, 22 bp, Artificial Sequence
  chemically synthesized
atacttgttgagggaaatatcc

SEQ ID NO: 1098479 - DNA, 22 bp, Artificial Sequence
  chemically synthesized
tacttgttgagggaaatatcca

SEQ ID NO: 1098480 - DNA, 22 bp, Artificial Sequence
  chemically synthesized
aaaggttgtattatgttggata

SEQ ID NO: 1098481 - DNA, 22 bp, Artificial Sequence
  chemically synthesized
gttgagggaaatatccaacata

SEQ ID NO: 1098482 - DNA, 22 bp, Artificial Sequence
  chemically synthesized
ttgagggaaatatccaacataa

SEQ ID NO: 1098483 - DNA, 22 bp, Artificial Sequence
  chemically synthesized
tctaaaaggttgtattatgttg

SEQ ID NO: 1098484 - DNA, 22 bp, Artificial Sequence
  chemically synthesized
agggaaatatccaacataatac

SEQ ID NO: 1098485 - DNA, 22 bp, Artificial Sequence
  chemically synthesized
ctatctaaaaggttgtattatg

SEQ ID NO: 1098486 - DNA, 22 bp, Artificial Sequence
  chemically synthesized
actatctaaaaggttgtattat

SEQ ID NO: 1098487 - DNA, 22 bp, Artificial Sequence
  chemically synthesized
ccatcttactatctaaaaggtt

SEQ ID NO: 1098488 - DNA, 22 bp, Artificial Sequence
  chemically synthesized
gccatcttactatctaaaaggt

SEQ ID NO: 1098489 - DNA, 22 bp, Artificial Sequence
  chemically synthesized
tgccatcttactatctaaaagg

SEQ ID NO: 1098490 - DNA, 22 bp, Artificial Sequence
  chemically synthesized
tatgttttgccatcttactatc

SEQ ID NO: 1098491 - DNA, 22 bp, Artificial Sequence
  chemically synthesized
atatgttttgccatcttactat

SEQ ID NO: 1098492 - DNA, 22 bp, Artificial Sequence
  chemically synthesized
tatatgttttgccatcttacta

SEQ ID NO: 1098493 - DNA, 22 bp, Artificial Sequence
  chemically synthesized
ttatatgttttgccatcttact

SEQ ID NO: 1098494 - DNA, 22 bp, Artificial Sequence
  chemically synthesized
ttagatagtaagatggcaaaac

SEQ ID NO: 1098495 - DNA, 22 bp, Artificial Sequence
  chemically synthesized
acatttttatatgttttgccat

SEQ ID NO: 1098496 - DNA, 22 bp, Artificial Sequence
  chemically synthesized
tagatagtaagatggcaaaaca

SEQ ID NO: 1098497 - DNA, 22 bp, Artificial Sequence
  chemically synthesized
agatagtaagatggcaaaacat

SEQ ID NO: 1098498 - DNA, 22 bp, Artificial Sequence
  chemically synthesized
gatagtaagatggcaaaacata

SEQ ID NO: 1098499 - DNA, 22 bp, Artificial Sequence
  chemically synthesized
gtggacattaacatttttatat

SEQ ID NO: 1098500 - DNA, 22 bp, Artificial Sequence
  chemically synthesized
agattcgtggacattaacattt

SEQ ID NO: 1098501 - DNA, 22 bp, Artificial Sequence
  chemically synthesized
actcagattcgtggacattaac

SEQ ID NO: 1098502 - DNA, 22 bp, Artificial Sequence
  chemically synthesized
atgtccacgaatctgagtcaac

SEQ ID NO: 1098503 - DNA, 22 bp, Artificial Sequence
  chemically synthesized
aaaaaatggagcagttgactca

SEQ ID NO: 1098504 - DNA, 22 bp, Artificial Sequence
  chemically synthesized
tcaaaaaatggagcagttgact

SEQ ID NO: 1098505 - DNA, 22 bp, Artificial Sequence
  chemically synthesized
actctcaaaaaatggagcagtt

SEQ ID NO: 1098506 - DNA, 22 bp, Artificial Sequence
  chemically synthesized
agtcaactgctccattttttga

SEQ ID NO: 1098507 - DNA, 22 bp, Artificial Sequence
  chemically synthesized
gcatgattcactctcaaaaaat

SEQ ID NO: 1098508 - DNA, 22 bp, Artificial Sequence
  chemically synthesized
gttggcatgattcactctcaaa

SEQ ID NO: 1098509 - DNA, 22 bp, Artificial Sequence
  chemically synthesized
ggttggcatgattcactctcaa

SEQ ID NO: 1098510 - DNA, 22 bp, Artificial Sequence
  chemically synthesized
tggttggcatgattcactctca

SEQ ID NO: 1098511 - DNA, 22 bp, Artificial Sequence
  chemically synthesized
ctccattttttgagagtgaatc

SEQ ID NO: 1098512 - DNA, 22 bp, Artificial Sequence
  chemically synthesized
cattttttgagagtgaatcatg

SEQ ID NO: 1098513 - DNA, 22 bp, Artificial Sequence
  chemically synthesized
cactttggttggcatgattcac

SEQ ID NO: 1098514 - DNA, 22 bp, Artificial Sequence
  chemically synthesized
tacactttggttggcatgattc

SEQ ID NO: 1098515 - DNA, 22 bp, Artificial Sequence
  chemically synthesized
tttgagagtgaatcatgccaac

SEQ ID NO: 1098516 - DNA, 22 bp, Artificial Sequence
  chemically synthesized
ttgagagtgaatcatgccaacc

SEQ ID NO: 1098517 - DNA, 22 bp, Artificial Sequence
  chemically synthesized
tgagagtgaatcatgccaacca

SEQ ID NO: 1098518 - DNA, 22 bp, Artificial Sequence
  chemically synthesized
gtctctacactttggttggcat

SEQ ID NO: 1098519 - DNA, 22 bp, Artificial Sequence
  chemically synthesized
gagagtgaatcatgccaaccaa

SEQ ID NO: 1098520 - DNA, 22 bp, Artificial Sequence
  chemically synthesized
agagtgaatcatgccaaccaaa

SEQ ID NO: 1098521 - DNA, 22 bp, Artificial Sequence
  chemically synthesized
tacatgttagtctctacacttt

SEQ ID NO: 1098522 - DNA, 22 bp, Artificial Sequence
  chemically synthesized
aatattgtacatgttagtctct

SEQ ID NO: 1098523 - DNA, 22 bp, Artificial Sequence
  chemically synthesized
aattaaatattgtacatgttag

SEQ ID NO: 1098524 - DNA, 22 bp, Artificial Sequence
  chemically synthesized
aagctgaattaaatattgtaca

SEQ ID NO: 1098525 - DNA, 22 bp, Artificial Sequence
  chemically synthesized
aaagctgaattaaatattgtac

SEQ ID NO: 1098526 - DNA, 22 bp, Artificial Sequence
  chemically synthesized
taaagctgaattaaatattgta

SEQ ID NO: 1098527 - DNA, 22 bp, Artificial Sequence
  chemically synthesized
gtctttaaagctgaattaaata

SEQ ID NO: 1098528 - DNA, 22 bp, Artificial Sequence
  chemically synthesized
ggtctttaaagctgaattaaat

SEQ ID NO: 1098529 - DNA, 22 bp, Artificial Sequence
  chemically synthesized
acatgtacaatatttaattcag

SEQ ID NO: 1098530 - DNA, 22 bp, Artificial Sequence
  chemically synthesized
aagatgtttggtctttaaagct

SEQ ID NO: 1098531 - DNA, 22 bp, Artificial Sequence
  chemically synthesized
caagatgtttggtctttaaagc

SEQ ID NO: 1098532 - DNA, 22 bp, Artificial Sequence
  chemically synthesized
tcaagatgtttggtctttaaag

SEQ ID NO: 1098533 - DNA, 22 bp, Artificial Sequence
  chemically synthesized
ttttcaagatgtttggtcttta

SEQ ID NO: 1098534 - DNA, 22 bp, Artificial Sequence
  chemically synthesized
gttttcaagatgtttggtcttt

SEQ ID NO: 1098535 - DNA, 22 bp, Artificial Sequence
  chemically synthesized
aattcagctttaaagaccaaac

SEQ ID NO: 1098536 - DNA, 22 bp, Artificial Sequence
  chemically synthesized
attcagctttaaagaccaaaca

SEQ ID NO: 1098537 - DNA, 22 bp, Artificial Sequence
  chemically synthesized
ggtttgttttcaagatgtttgg

SEQ ID NO: 1098538 - DNA, 22 bp, Artificial Sequence
  chemically synthesized
agctttaaagaccaaacatctt

SEQ ID NO: 1098539 - DNA, 22 bp, Artificial Sequence
  chemically synthesized
gggtttgttttcaagatgtttg

SEQ ID NO: 1098540 - DNA, 22 bp, Artificial Sequence
  chemically synthesized
tgggtttgttttcaagatgttt

SEQ ID NO: 1098541 - DNA, 22 bp, Artificial Sequence
  chemically synthesized
taaagaccaaacatcttgaaaa

SEQ ID NO: 1098542 - DNA, 22 bp, Artificial Sequence
  chemically synthesized
aaagaccaaacatcttgaaaac

SEQ ID NO: 1098543 - DNA, 22 bp, Artificial Sequence
  chemically synthesized
aagaccaaacatcttgaaaaca

SEQ ID NO: 1098544 - DNA, 22 bp, Artificial Sequence
  chemically synthesized
atgaaagcacctttgggtttgt

SEQ ID NO: 1098545 - DNA, 22 bp, Artificial Sequence
  chemically synthesized
tcatgaaagcacctttgggttt

SEQ ID NO: 1098546 - DNA, 22 bp, Artificial Sequence
  chemically synthesized
atctctcatgaaagcacctttg

SEQ ID NO: 1098547 - DNA, 22 bp, Artificial Sequence
  chemically synthesized
gaaaacaaacccaaaggtgctt

SEQ ID NO: 1098548 - DNA, 22 bp, Artificial Sequence
  chemically synthesized
aatctctcatgaaagcaccttt

SEQ ID NO: 1098549 - DNA, 22 bp, Artificial Sequence
  chemically synthesized
aaaacaaacccaaaggtgcttt

SEQ ID NO: 1098550 - DNA, 22 bp, Artificial Sequence
  chemically synthesized
tcatgagagattaaattatgac

SEQ ID NO: 1098551 - DNA, 22 bp, Artificial Sequence
  chemically synthesized
catgagagattaaattatgaca

SEQ ID NO: 1098552 - DNA, 22 bp, Artificial Sequence
  chemically synthesized
atgagagattaaattatgacat

SEQ ID NO: 1098553 - DNA, 22 bp, Artificial Sequence
  chemically synthesized
aattatgacatatatatactat

SEQ ID NO: 1098554 - DNA, 22 bp, Artificial Sequence
  chemically synthesized
tgatgcacagtatcccatagta

SEQ ID NO: 1098555 - DNA, 22 bp, Artificial Sequence
  chemically synthesized
tgacatatatatactatgggat

SEQ ID NO: 1098556 - DNA, 22 bp, Artificial Sequence
  chemically synthesized
gtgatgcacagtatcccatagt

SEQ ID NO: 1098557 - DNA, 22 bp, Artificial Sequence
  chemically synthesized
agtaaagatgtatttgtgatgc

SEQ ID NO: 1098558 - DNA, 22 bp, Artificial Sequence
  chemically synthesized
tgggatactgtgcatcacaaat

SEQ ID NO: 1098559 - DNA, 22 bp, Artificial Sequence
  chemically synthesized
cagtaaagatgtatttgtgatg

SEQ ID NO: 1098560 - DNA, 22 bp, Artificial Sequence
  chemically synthesized
atttcagtaaagatgtatttgt

SEQ ID NO: 1098561 - DNA, 22 bp, Artificial Sequence
  chemically synthesized
catttcagtaaagatgtatttg

SEQ ID NO: 1098562 - DNA, 22 bp, Artificial Sequence
  chemically synthesized
tcatttcagtaaagatgtattt

SEQ ID NO: 1098563 - DNA, 22 bp, Artificial Sequence
  chemically synthesized
ttcatttcagtaaagatgtatt

SEQ ID NO: 1098564 - DNA, 22 bp, Artificial Sequence
  chemically synthesized
tgcatcacaaatacatctttac

SEQ ID NO: 1098565 - DNA, 22 bp, Artificial Sequence
  chemically synthesized
agccacttttcatttcagtaaa

SEQ ID NO: 1098566 - DNA, 22 bp, Artificial Sequence
  chemically synthesized
tattgagccacttttcatttca

SEQ ID NO: 1098567 - DNA, 22 bp, Artificial Sequence
  chemically synthesized
atattgagccacttttcatttc

SEQ ID NO: 1098568 - DNA, 22 bp, Artificial Sequence
  chemically synthesized
tatattgagccacttttcattt

SEQ ID NO: 1098569 - DNA, 22 bp, Artificial Sequence
  chemically synthesized
tactgaaatgaaaagtggctca

SEQ ID NO: 1098570 - DNA, 22 bp, Artificial Sequence
  chemically synthesized
actgaaatgaaaagtggctcaa

SEQ ID NO: 1098571 - DNA, 22 bp, Artificial Sequence
  chemically synthesized
ctgaaatgaaaagtggctcaat

SEQ ID NO: 1098572 - DNA, 22 bp, Artificial Sequence
  chemically synthesized
aaatgaaaagtggctcaatata

SEQ ID NO: 1098573 - DNA, 22 bp, Artificial Sequence
  chemically synthesized
cacgtaaaactttatattgagc

SEQ ID NO: 1098574 - DNA, 22 bp, Artificial Sequence
  chemically synthesized
acacgtaaaactttatattgag

SEQ ID NO: 1098575 - DNA, 22 bp, Artificial Sequence
  chemically synthesized
tacacgtaaaactttatattga

SEQ ID NO: 1098576 - DNA, 22 bp, Artificial Sequence
  chemically synthesized
cattttacacgtaaaactttat

SEQ ID NO: 1098577 - DNA, 22 bp, Artificial Sequence
  chemically synthesized
gcattttacacgtaaaacttta

SEQ ID NO: 1098578 - DNA, 22 bp, Artificial Sequence
  chemically synthesized
caacttgcattttacacgtaaa

SEQ ID NO: 1098579 - DNA, 22 bp, Artificial Sequence
  chemically synthesized
gcaacttgcattttacacgtaa

SEQ ID NO: 1098580 - DNA, 22 bp, Artificial Sequence
  chemically synthesized
aatataaagttttacgtgtaaa

SEQ ID NO: 1098581 - DNA, 22 bp, Artificial Sequence
  chemically synthesized
tgcaacttgcattttacacgta

SEQ ID NO: 1098582 - DNA, 22 bp, Artificial Sequence
  chemically synthesized
ttgcaacttgcattttacacgt

SEQ ID NO: 1098583 - DNA, 22 bp, Artificial Sequence
  chemically synthesized
ttttgcaacttgcattttacac

SEQ ID NO: 1098584 - DNA, 22 bp, Artificial Sequence
  chemically synthesized
tacgtgtaaaatgcaagttgca

SEQ ID NO: 1098585 - DNA, 22 bp, Artificial Sequence
  chemically synthesized
acgtgtaaaatgcaagttgcaa

SEQ ID NO: 1098586 - DNA, 22 bp, Artificial Sequence
  chemically synthesized
cgtgtaaaatgcaagttgcaaa

SEQ ID NO: 1098587 - DNA, 22 bp, Artificial Sequence
  chemically synthesized
taaccacagacagactcttttg

SEQ ID NO: 1098588 - DNA, 22 bp, Artificial Sequence
  chemically synthesized
tataaccacagacagactcttt

SEQ ID NO: 1098589 - DNA, 22 bp, Artificial Sequence
  chemically synthesized
ctataaccacagacagactctt

SEQ ID NO: 1098590 - DNA, 22 bp, Artificial Sequence
  chemically synthesized
tctataaccacagacagactct

SEQ ID NO: 1098591 - DNA, 22 bp, Artificial Sequence
  chemically synthesized
caaaagagtctgtctgtggtta

SEQ ID NO: 1098592 - DNA, 22 bp, Artificial Sequence
  chemically synthesized
aatagcagatgttttctataac

SEQ ID NO: 1098593 - DNA, 22 bp, Artificial Sequence
  chemically synthesized
aaatagcagatgttttctataa

SEQ ID NO: 1098594 - DNA, 22 bp, Artificial Sequence
  chemically synthesized
taaatagcagatgttttctata

SEQ ID NO: 1098595 - DNA, 22 bp, Artificial Sequence
  chemically synthesized
tctgtggttatagaaaacatct

SEQ ID NO: 1098596 - DNA, 22 bp, Artificial Sequence
  chemically synthesized
tggttatagaaaacatctgcta

SEQ ID NO: 1098597 - DNA, 22 bp, Artificial Sequence
  chemically synthesized
tagaaaacatctgctatttaaa

SEQ ID NO: 1098598 - DNA, 22 bp, Artificial Sequence
  chemically synthesized
aaaaatgcgtgaggctttaaat

SEQ ID NO: 1098599 - DNA, 22 bp, Artificial Sequence
  chemically synthesized
caaaaatgcgtgaggctttaaa

SEQ ID NO: 1098600 - DNA, 22 bp, Artificial Sequence
  chemically synthesized
tcaaaaatgcgtgaggctttaa

SEQ ID NO: 1098601 - DNA, 22 bp, Artificial Sequence
  chemically synthesized
gttttcaaaaatgcgtgaggct

SEQ ID NO: 1098602 - DNA, 22 bp, Artificial Sequence
  chemically synthesized
agttttcaaaaatgcgtgaggc

SEQ ID NO: 1098603 - DNA, 22 bp, Artificial Sequence
  chemically synthesized
tagttttcaaaaatgcgtgagg

SEQ ID NO: 1098604 - DNA, 22 bp, Artificial Sequence
  chemically synthesized
ctatttaaagcctcacgcattt

SEQ ID NO: 1098605 - DNA, 22 bp, Artificial Sequence
  chemically synthesized
tttaaagcctcacgcatttttg

SEQ ID NO: 1098606 - DNA, 22 bp, Artificial Sequence
  chemically synthesized
aaagcctcacgcatttttgaaa

SEQ ID NO: 1098607 - DNA, 22 bp, Artificial Sequence
  chemically synthesized
aagcctcacgcatttttgaaaa

SEQ ID NO: 1098608 - DNA, 22 bp, Artificial Sequence
  chemically synthesized
tagaaagttttagttttcaaaa

SEQ ID NO: 1098609 - DNA, 22 bp, Artificial Sequence
  chemically synthesized
acgcatttttgaaaactaaaac

SEQ ID NO: 1098610 - DNA, 22 bp, Artificial Sequence
  chemically synthesized
ttgaaaactaaaactttctaca

SEQ ID NO: 1098611 - DNA, 22 bp, Artificial Sequence
  chemically synthesized
tgaaaactaaaactttctacaa

SEQ ID NO: 1098612 - DNA, 22 bp, Artificial Sequence
  chemically synthesized
gaaaactaaaactttctacaat

SEQ ID NO: 1098613 - DNA, 22 bp, Artificial Sequence
  chemically synthesized
aaaactaaaactttctacaatg

SEQ ID NO: 1098614 - DNA, 22 bp, Artificial Sequence
  chemically synthesized
atgagtaatggagtccattgta

SEQ ID NO: 1098615 - DNA, 22 bp, Artificial Sequence
  chemically synthesized
aaactttctacaatggactcca

SEQ ID NO: 1098616 - DNA, 22 bp, Artificial Sequence
  chemically synthesized
gttaatgagtaatggagtccat

SEQ ID NO: 1098617 - DNA, 22 bp, Artificial Sequence
  chemically synthesized
tggttaatgagtaatggagtcc

SEQ ID NO: 1098618 - DNA, 22 bp, Artificial Sequence
  chemically synthesized
ctggttaatgagtaatggagtc

SEQ ID NO: 1098619 - DNA, 22 bp, Artificial Sequence
  chemically synthesized
tctggttaatgagtaatggagt

SEQ ID NO: 1098620 - DNA, 22 bp, Artificial Sequence
  chemically synthesized
ttctggttaatgagtaatggag

SEQ ID NO: 1098621 - DNA, 22 bp, Artificial Sequence
  chemically synthesized
tctacaatggactccattactc

SEQ ID NO: 1098622 - DNA, 22 bp, Artificial Sequence
  chemically synthesized
ctacaatggactccattactca

SEQ ID NO: 1098623 - DNA, 22 bp, Artificial Sequence
  chemically synthesized
tacaatggactccattactcat

SEQ ID NO: 1098624 - DNA, 22 bp, Artificial Sequence
  chemically synthesized
caatggactccattactcatta

SEQ ID NO: 1098625 - DNA, 22 bp, Artificial Sequence
  chemically synthesized
catttttctggttaatgagtaa

SEQ ID NO: 1098626 - DNA, 22 bp, Artificial Sequence
  chemically synthesized
gcatttttctggttaatgagta

SEQ ID NO: 1098627 - DNA, 22 bp, Artificial Sequence
  chemically synthesized
tgcatttttctggttaatgagt

SEQ ID NO: 1098628 - DNA, 22 bp, Artificial Sequence
  chemically synthesized
agttttgcatttttctggttaa

SEQ ID NO: 1098629 - DNA, 22 bp, Artificial Sequence
  chemically synthesized
aagttttgcatttttctggtta

SEQ ID NO: 1098630 - DNA, 22 bp, Artificial Sequence
  chemically synthesized
taagttttgcatttttctggtt

SEQ ID NO: 1098631 - DNA, 22 bp, Artificial Sequence
  chemically synthesized
cattactcattaaccagaaaaa

SEQ ID NO: 1098632 - DNA, 22 bp, Artificial Sequence
  chemically synthesized
ctcattaaccagaaaaatgcaa

SEQ ID NO: 1098633 - DNA, 22 bp, Artificial Sequence
  chemically synthesized
gatgttttaagttttgcatttt

SEQ ID NO: 1098634 - DNA, 22 bp, Artificial Sequence
  chemically synthesized
agatgttttaagttttgcattt

SEQ ID NO: 1098635 - DNA, 22 bp, Artificial Sequence
  chemically synthesized
attaaccagaaaaatgcaaaac

SEQ ID NO: 1098636 - DNA, 22 bp, Artificial Sequence
  chemically synthesized
tagatgttttaagttttgcatt

SEQ ID NO: 1098637 - DNA, 22 bp, Artificial Sequence
  chemically synthesized
ttagatgttttaagttttgcat

SEQ ID NO: 1098638 - DNA, 22 bp, Artificial Sequence
  chemically synthesized
ttttagatgttttaagttttgc

SEQ ID NO: 1098639 - DNA, 22 bp, Artificial Sequence
  chemically synthesized
accagaaaaatgcaaaacttaa

SEQ ID NO: 1098640 - DNA, 22 bp, Artificial Sequence
  chemically synthesized
cttttagatgttttaagttttg

SEQ ID NO: 1098641 - DNA, 22 bp, Artificial Sequence
  chemically synthesized
tcttttagatgttttaagtttt

SEQ ID NO: 1098642 - DNA, 22 bp, Artificial Sequence
  chemically synthesized
taacaaggtgtatgattttctt

SEQ ID NO: 1098643 - DNA, 22 bp, Artificial Sequence
  chemically synthesized
aaaacatctaaaagaaaatcat

SEQ ID NO: 1098644 - DNA, 22 bp, Artificial Sequence
  chemically synthesized
gtaacaaggtgtatgattttct

SEQ ID NO: 1098645 - DNA, 22 bp, Artificial Sequence
  chemically synthesized
aaacatctaaaagaaaatcata

SEQ ID NO: 1098646 - DNA, 22 bp, Artificial Sequence
  chemically synthesized
aaagaaaatcatacaccttgtt

SEQ ID NO: 1098647 - DNA, 22 bp, Artificial Sequence
  chemically synthesized
tagagtgccttgtaacaaggtg

SEQ ID NO: 1098648 - DNA, 22 bp, Artificial Sequence
  chemically synthesized
taatactatagagtgccttgta

SEQ ID NO: 1098649 - DNA, 22 bp, Artificial Sequence
  chemically synthesized
gttacaaggcactctatagtat

SEQ ID NO: 1098650 - DNA, 22 bp, Artificial Sequence
  chemically synthesized
ttacaaggcactctatagtatt

SEQ ID NO: 1098651 - DNA, 22 bp, Artificial Sequence
  chemically synthesized
tgtataatgattgtaatactat

SEQ ID NO: 1098652 - DNA, 22 bp, Artificial Sequence
  chemically synthesized
caaggcactctatagtattaca

SEQ ID NO: 1098653 - DNA, 22 bp, Artificial Sequence
  chemically synthesized
tatagtattacaatcattatac

SEQ ID NO: 1098654 - DNA, 22 bp, Artificial Sequence
  chemically synthesized
tagtattacaatcattatacat

SEQ ID NO: 1098655 - DNA, 22 bp, Artificial Sequence
  chemically synthesized
aagtaaaagcactatgtataat

SEQ ID NO: 1098656 - DNA, 22 bp, Artificial Sequence
  chemically synthesized
aaagtaaaagcactatgtataa

SEQ ID NO: 1098657 - DNA, 22 bp, Artificial Sequence
  chemically synthesized
taaagtaaaagcactatgtata

SEQ ID NO: 1098658 - DNA, 22 bp, Artificial Sequence
  chemically synthesized
ttaaagtaaaagcactatgtat

SEQ ID NO: 1098659 - DNA, 22 bp, Artificial Sequence
  chemically synthesized
tttaaagtaaaagcactatgta

SEQ ID NO: 1098660 - DNA, 22 bp, Artificial Sequence
  chemically synthesized
caatcattatacatagtgcttt

SEQ ID NO: 1098661 - DNA, 22 bp, Artificial Sequence
  chemically synthesized
ctttttaaagtaaaagcactat

SEQ ID NO: 1098662 - DNA, 22 bp, Artificial Sequence
  chemically synthesized
tacatagtgcttttactttaaa

SEQ ID NO: 1098663 - DNA, 22 bp, Artificial Sequence
  chemically synthesized
aatagagttactttttaaagta

SEQ ID NO: 1098664 - DNA, 22 bp, Artificial Sequence
  chemically synthesized
gaatagagttactttttaaagt

SEQ ID NO: 1098665 - DNA, 22 bp, Artificial Sequence
  chemically synthesized
tgaatagagttactttttaaag

SEQ ID NO: 1098666 - DNA, 22 bp, Artificial Sequence
  chemically synthesized
ttgaatagagttactttttaaa

SEQ ID NO: 1098667 - DNA, 22 bp, Artificial Sequence
  chemically synthesized
ttactttaaaaagtaactctat

SEQ ID NO: 1098668 - DNA, 22 bp, Artificial Sequence
  chemically synthesized
tactttaaaaagtaactctatt

SEQ ID NO: 1098669 - DNA, 22 bp, Artificial Sequence
  chemically synthesized
actttaaaaagtaactctattc

SEQ ID NO: 1098670 - DNA, 22 bp, Artificial Sequence
  chemically synthesized
ctttaaaaagtaactctattca

SEQ ID NO: 1098671 - DNA, 22 bp, Artificial Sequence
  chemically synthesized
taaaaagtaactctattcaaaa

SEQ ID NO: 1098672 - DNA, 22 bp, Artificial Sequence
  chemically synthesized
aaaaagtaactctattcaaaag

SEQ ID NO: 1098673 - DNA, 22 bp, Artificial Sequence
  chemically synthesized
aaaagtaactctattcaaaaga

SEQ ID NO: 1098674 - DNA, 22 bp, Artificial Sequence
  chemically synthesized
aaccagagagaagaataccatc

SEQ ID NO: 1098675 - DNA, 22 bp, Artificial Sequence
  chemically synthesized
caaccagagagaagaataccat

SEQ ID NO: 1098676 - DNA, 22 bp, Artificial Sequence
  chemically synthesized
tattcaaaagatggtattcttc

SEQ ID NO: 1098677 - DNA, 22 bp, Artificial Sequence
  chemically synthesized
tttcaaccagagagaagaatac

SEQ ID NO: 1098678 - DNA, 22 bp, Artificial Sequence
  chemically synthesized
ttcaaaagatggtattcttctc

SEQ ID NO: 1098679 - DNA, 22 bp, Artificial Sequence
  chemically synthesized
aaaagatggtattcttctctct

SEQ ID NO: 1098680 - DNA, 22 bp, Artificial Sequence
  chemically synthesized
aaatgtataatgttgtttcaac

SEQ ID NO: 1098681 - DNA, 22 bp, Artificial Sequence
  chemically synthesized
aaaatgtataatgttgtttcaa

SEQ ID NO: 1098682 - DNA, 22 bp, Artificial Sequence
  chemically synthesized
ttctctctggttgaaacaacat

SEQ ID NO: 1098683 - DNA, 22 bp, Artificial Sequence
  chemically synthesized
cttaaaatgtataatgttgttt

SEQ ID NO: 1098684 - DNA, 22 bp, Artificial Sequence
  chemically synthesized
ctctctggttgaaacaacatta

SEQ ID NO: 1098685 - DNA, 22 bp, Artificial Sequence
  chemically synthesized
tctctggttgaaacaacattat

SEQ ID NO: 1098686 - DNA, 22 bp, Artificial Sequence
  chemically synthesized
ttacttaaaatgtataatgttg

SEQ ID NO: 1098687 - DNA, 22 bp, Artificial Sequence
  chemically synthesized
tctggttgaaacaacattatac

SEQ ID NO: 1098688 - DNA, 22 bp, Artificial Sequence
  chemically synthesized
tgttacttaaaatgtataatgt

SEQ ID NO: 1098689 - DNA, 22 bp, Artificial Sequence
  chemically synthesized
tggttgaaacaacattatacat

SEQ ID NO: 1098690 - DNA, 22 bp, Artificial Sequence
  chemically synthesized
gttgaaacaacattatacattt

SEQ ID NO: 1098691 - DNA, 22 bp, Artificial Sequence
  chemically synthesized
aaacaacattatacattttaag

SEQ ID NO: 1098692 - DNA, 22 bp, Artificial Sequence
  chemically synthesized
tgaaaactctgttacttaaaat

SEQ ID NO: 1098693 - DNA, 22 bp, Artificial Sequence
  chemically synthesized
atactatgaaaactctgttact

SEQ ID NO: 1098694 - DNA, 22 bp, Artificial Sequence
  chemically synthesized
tacattttaagtaacagagttt

SEQ ID NO: 1098695 - DNA, 22 bp, Artificial Sequence
  chemically synthesized
tatattaatactatgaaaactc

SEQ ID NO: 1098696 - DNA, 22 bp, Artificial Sequence
  chemically synthesized
taagtaacagagttttcatagt

SEQ ID NO: 1098697 - DNA, 22 bp, Artificial Sequence
  chemically synthesized
aagtaacagagttttcatagta

SEQ ID NO: 1098698 - DNA, 22 bp, Artificial Sequence
  chemically synthesized
agtaacagagttttcatagtat

SEQ ID NO: 1098699 - DNA, 22 bp, Artificial Sequence
  chemically synthesized
tgcattatatattaatactatg

SEQ ID NO: 1098700 - DNA, 22 bp, Artificial Sequence
  chemically synthesized
aaactgtgcattatatattaat

SEQ ID NO: 1098701 - DNA, 22 bp, Artificial Sequence
  chemically synthesized
ctaaaactgtgcattatatatt

SEQ ID NO: 1098702 - DNA, 22 bp, Artificial Sequence
  chemically synthesized
actaaaactgtgcattatatat

SEQ ID NO: 1098703 - DNA, 22 bp, Artificial Sequence
  chemically synthesized
tcatagtattaatatataatgc

SEQ ID NO: 1098704 - DNA, 22 bp, Artificial Sequence
  chemically synthesized
tactaaaactgtgcattatata

SEQ ID NO: 1098705 - DNA, 22 bp, Artificial Sequence
  chemically synthesized
catagtattaatatataatgca

SEQ ID NO: 1098706 - DNA, 22 bp, Artificial Sequence
  chemically synthesized
atagtattaatatataatgcac

SEQ ID NO: 1098707 - DNA, 22 bp, Artificial Sequence
  chemically synthesized
attttactaaaactgtgcatta

SEQ ID NO: 1098708 - DNA, 22 bp, Artificial Sequence
  chemically synthesized
cattttactaaaactgtgcatt

SEQ ID NO: 1098709 - DNA, 22 bp, Artificial Sequence
  chemically synthesized
atatataatgcacagttttagt

SEQ ID NO: 1098710 - DNA, 22 bp, Artificial Sequence
  chemically synthesized
ggcaaagtaccatgaacacttc

SEQ ID NO: 1098711 - DNA, 22 bp, Artificial Sequence
  chemically synthesized
tagtaaaatgaagtgttcatgg

SEQ ID NO: 1098712 - DNA, 22 bp, Artificial Sequence
  chemically synthesized
ttgggcaaagtaccatgaacac

SEQ ID NO: 1098713 - DNA, 22 bp, Artificial Sequence
  chemically synthesized
agtaaaatgaagtgttcatggt

SEQ ID NO: 1098714 - DNA, 22 bp, Artificial Sequence
  chemically synthesized
gtaaaatgaagtgttcatggta

SEQ ID NO: 1098715 - DNA, 22 bp, Artificial Sequence
  chemically synthesized
ctattgggcaaagtaccatgaa

SEQ ID NO: 1098716 - DNA, 22 bp, Artificial Sequence
  chemically synthesized
actattgggcaaagtaccatga

SEQ ID NO: 1098717 - DNA, 22 bp, Artificial Sequence
  chemically synthesized
cacatatttactattgggcaaa

SEQ ID NO: 1098718 - DNA, 22 bp, Artificial Sequence
  chemically synthesized
tacacatatttactattgggca

SEQ ID NO: 1098719 - DNA, 22 bp, Artificial Sequence
  chemically synthesized
atggtactttgcccaatagtaa

SEQ ID NO: 1098720 - DNA, 22 bp, Artificial Sequence
  chemically synthesized
tgcccaatagtaaatatgtgta

SEQ ID NO: 1098721 - DNA, 22 bp, Artificial Sequence
  chemically synthesized
gcccaatagtaaatatgtgtag

SEQ ID NO: 1098722 - DNA, 22 bp, Artificial Sequence
  chemically synthesized
cccaatagtaaatatgtgtaga

SEQ ID NO: 1098723 - DNA, 22 bp, Artificial Sequence
  chemically synthesized
taaggaaaatcaatgcgatagt

SEQ ID NO: 1098724 - DNA, 22 bp, Artificial Sequence
  chemically synthesized
taaattataaggaaaatcaatg

SEQ ID NO: 1098725 - DNA, 22 bp, Artificial Sequence
  chemically synthesized
tcgcattgattttccttataat

SEQ ID NO: 1098726 - DNA, 22 bp, Artificial Sequence
  chemically synthesized
aaaatggttgtaaattataagg

SEQ ID NO: 1098727 - DNA, 22 bp, Artificial Sequence
  chemically synthesized
ggctcaaaatggttgtaaatta

SEQ ID NO: 1098728 - DNA, 22 bp, Artificial Sequence
  chemically synthesized
attttccttataatttacaacc

SEQ ID NO: 1098729 - DNA, 22 bp, Artificial Sequence
  chemically synthesized
tattaggctcaaaatggttgta

SEQ ID NO: 1098730 - DNA, 22 bp, Artificial Sequence
  chemically synthesized
tccttataatttacaaccattt

SEQ ID NO: 1098731 - DNA, 22 bp, Artificial Sequence
  chemically synthesized
ccttataatttacaaccatttt

SEQ ID NO: 1098732 - DNA, 22 bp, Artificial Sequence
  chemically synthesized
cttataatttacaaccattttg

SEQ ID NO: 1098733 - DNA, 22 bp, Artificial Sequence
  chemically synthesized
tctatattaggctcaaaatggt

SEQ ID NO: 1098734 - DNA, 22 bp, Artificial Sequence
  chemically synthesized
ataatttacaaccattttgagc

SEQ ID NO: 1098735 - DNA, 22 bp, Artificial Sequence
  chemically synthesized
taatttacaaccattttgagcc

SEQ ID NO: 1098736 - DNA, 22 bp, Artificial Sequence
  chemically synthesized
acaaccattttgagcctaatat

SEQ ID NO: 1098737 - DNA, 22 bp, Artificial Sequence
  chemically synthesized
caaccattttgagcctaatata

SEQ ID NO: 1098738 - DNA, 22 bp, Artificial Sequence
  chemically synthesized
aaatgaagtattatctatatta

SEQ ID NO: 1098739 - DNA, 22 bp, Artificial Sequence
  chemically synthesized
tgagcctaatatagataatact

SEQ ID NO: 1098740 - DNA, 22 bp, Artificial Sequence
  chemically synthesized
gagcctaatatagataatactt

SEQ ID NO: 1098741 - DNA, 22 bp, Artificial Sequence
  chemically synthesized
agcctaatatagataatacttc

SEQ ID NO: 1098742 - DNA, 22 bp, Artificial Sequence
  chemically synthesized
atatagataatacttcatttta

SEQ ID NO: 1098743 - DNA, 22 bp, Artificial Sequence
  chemically synthesized
ggtaagtaaagaacctaaaatg

SEQ ID NO: 1098744 - DNA, 22 bp, Artificial Sequence
  chemically synthesized
cctaggtaagtaaagaacctaa

SEQ ID NO: 1098745 - DNA, 22 bp, Artificial Sequence
  chemically synthesized
acctaggtaagtaaagaaccta

SEQ ID NO: 1098746 - DNA, 22 bp, Artificial Sequence
  chemically synthesized
catttacctaggtaagtaaaga

SEQ ID NO: 1098747 - DNA, 22 bp, Artificial Sequence
  chemically synthesized
cattttaggttctttacttacc

SEQ ID NO: 1098748 - DNA, 22 bp, Artificial Sequence
  chemically synthesized
attttaggttctttacttacct

SEQ ID NO: 1098749 - DNA, 22 bp, Artificial Sequence
  chemically synthesized
taggttctttacttacctaggt

SEQ ID NO: 1098750 - DNA, 22 bp, Artificial Sequence
  chemically synthesized
aggttctttacttacctaggta

SEQ ID NO: 1098751 - DNA, 22 bp, Artificial Sequence
  chemically synthesized
ggttctttacttacctaggtaa

SEQ ID NO: 1098752 - DNA, 22 bp, Artificial Sequence
  chemically synthesized
tttacttacctaggtaaatgta

SEQ ID NO: 1098753 - DNA, 22 bp, Artificial Sequence
  chemically synthesized
tacttacctaggtaaatgtagt

SEQ ID NO: 1098754 - DNA, 22 bp, Artificial Sequence
  chemically synthesized
acttacctaggtaaatgtagta

SEQ ID NO: 1098755 - DNA, 22 bp, Artificial Sequence
  chemically synthesized
tagtagatcaagtactacattt

SEQ ID NO: 1098756 - DNA, 22 bp, Artificial Sequence
  chemically synthesized
cttacctaggtaaatgtagtac

SEQ ID NO: 1098757 - DNA, 22 bp, Artificial Sequence
  chemically synthesized
acctaggtaaatgtagtacttg

SEQ ID NO: 1098758 - DNA, 22 bp, Artificial Sequence
  chemically synthesized
cctaggtaaatgtagtacttga

SEQ ID NO: 1098759 - DNA, 22 bp, Artificial Sequence
  chemically synthesized
cattgtagtagatcaagtacta

SEQ ID NO: 1098760 - DNA, 22 bp, Artificial Sequence
  chemically synthesized
acattgtagtagatcaagtact

SEQ ID NO: 1098761 - DNA, 22 bp, Artificial Sequence
  chemically synthesized
ggtaaatgtagtacttgatcta

SEQ ID NO: 1098762 - DNA, 22 bp, Artificial Sequence
  chemically synthesized
tttacattgtagtagatcaagt

SEQ ID NO: 1098763 - DNA, 22 bp, Artificial Sequence
  chemically synthesized
atttacattgtagtagatcaag

SEQ ID NO: 1098764 - DNA, 22 bp, Artificial Sequence
  chemically synthesized
gggtgaaacatttatttacatt

SEQ ID NO: 1098765 - DNA, 22 bp, Artificial Sequence
  chemically synthesized
gatctactacaatgtaaataaa

SEQ ID NO: 1098766 - DNA, 22 bp, Artificial Sequence
  chemically synthesized
atctactacaatgtaaataaat

SEQ ID NO: 1098767 - DNA, 22 bp, Artificial Sequence
  chemically synthesized
ctacaatgtaaataaatgtttc

SEQ ID NO: 1098768 - DNA, 22 bp, Artificial Sequence
  chemically synthesized
gatgtgttagggtgaaacattt

SEQ ID NO: 1098769 - DNA, 22 bp, Artificial Sequence
  chemically synthesized
caatgtaaataaatgtttcacc

SEQ ID NO: 1098770 - DNA, 22 bp, Artificial Sequence
  chemically synthesized
tagatgtgttagggtgaaacat

SEQ ID NO: 1098771 - DNA, 22 bp, Artificial Sequence
  chemically synthesized
ttctagatgtgttagggtgaaa

SEQ ID NO: 1098772 - DNA, 22 bp, Artificial Sequence
  chemically synthesized
caagacatattgttctagatgt

SEQ ID NO: 1098773 - DNA, 22 bp, Artificial Sequence
  chemically synthesized
caccctaacacatctagaacaa

SEQ ID NO: 1098774 - DNA, 22 bp, Artificial Sequence
  chemically synthesized
accctaacacatctagaacaat

SEQ ID NO: 1098775 - DNA, 22 bp, Artificial Sequence
  chemically synthesized
gtacaattgcaagacatattgt

SEQ ID NO: 1098776 - DNA, 22 bp, Artificial Sequence
  chemically synthesized
acacatctagaacaatatgtct

SEQ ID NO: 1098777 - DNA, 22 bp, Artificial Sequence
  chemically synthesized
tagtacaattgcaagacatatt

SEQ ID NO: 1098778 - DNA, 22 bp, Artificial Sequence
  chemically synthesized
ctagtacaattgcaagacatat

SEQ ID NO: 1098779 - DNA, 22 bp, Artificial Sequence
  chemically synthesized
tctagtacaattgcaagacata

SEQ ID NO: 1098780 - DNA, 22 bp, Artificial Sequence
  chemically synthesized
ttctagtacaattgcaagacat

SEQ ID NO: 1098781 - DNA, 22 bp, Artificial Sequence
  chemically synthesized
gaacaatatgtcttgcaattgt

SEQ ID NO: 1098782 - DNA, 22 bp, Artificial Sequence
  chemically synthesized
taccttttctagtacaattgca

SEQ ID NO: 1098783 - DNA, 22 bp, Artificial Sequence
  chemically synthesized
ataccttttctagtacaattgc

SEQ ID NO: 1098784 - DNA, 22 bp, Artificial Sequence
  chemically synthesized
gcaattgtactagaaaaggtat

SEQ ID NO: 1098785 - DNA, 22 bp, Artificial Sequence
  chemically synthesized
caattgtactagaaaaggtata

SEQ ID NO: 1098786 - DNA, 22 bp, Artificial Sequence
  chemically synthesized
cacaaaataacatttatacctt

SEQ ID NO: 1098787 - DNA, 22 bp, Artificial Sequence
  chemically synthesized
tactagaaaaggtataaatgtt

SEQ ID NO: 1098788 - DNA, 22 bp, Artificial Sequence
  chemically synthesized
actgcacaaaataacatttata

SEQ ID NO: 1098789 - DNA, 22 bp, Artificial Sequence
  chemically synthesized
attgactgcacaaaataacatt

SEQ ID NO: 1098790 - DNA, 22 bp, Artificial Sequence
  chemically synthesized
gaaaaggtataaatgttatttt

SEQ ID NO: 1098791 - DNA, 22 bp, Artificial Sequence
  chemically synthesized
taggttcattgactgcacaaaa

SEQ ID NO: 1098792 - DNA, 22 bp, Artificial Sequence
  chemically synthesized
ttataggttcattgactgcaca

SEQ ID NO: 1098793 - DNA, 22 bp, Artificial Sequence
  chemically synthesized
attataggttcattgactgcac

SEQ ID NO: 1098794 - DNA, 22 bp, Artificial Sequence
  chemically synthesized
agtttattataggttcattgac

SEQ ID NO: 1098795 - DNA, 22 bp, Artificial Sequence
  chemically synthesized
aagtttattataggttcattga

SEQ ID NO: 1098796 - DNA, 22 bp, Artificial Sequence
  chemically synthesized
ttttgtgcagtcaatgaaccta

SEQ ID NO: 1098797 - DNA, 22 bp, Artificial Sequence
  chemically synthesized
ttaagtttattataggttcatt

SEQ ID NO: 1098798 - DNA, 22 bp, Artificial Sequence
  chemically synthesized
cttaagtttattataggttcat

SEQ ID NO: 1098799 - DNA, 22 bp, Artificial Sequence
  chemically synthesized
tcttaagtttattataggttca

SEQ ID NO: 1098800 - DNA, 22 bp, Artificial Sequence
  chemically synthesized
tgtgcagtcaatgaacctataa

SEQ ID NO: 1098801 - DNA, 22 bp, Artificial Sequence
  chemically synthesized
gtgcagtcaatgaacctataat

SEQ ID NO: 1098802 - DNA, 22 bp, Artificial Sequence
  chemically synthesized
tgcagtcaatgaacctataata

SEQ ID NO: 1098803 - DNA, 22 bp, Artificial Sequence
  chemically synthesized
taataaacttaagaaaacatgc

SEQ ID NO: 1098804 - DNA, 22 bp, Artificial Sequence
  chemically synthesized
taaaatagcaaaaatagcagca

SEQ ID NO: 1098805 - DNA, 22 bp, Artificial Sequence
  chemically synthesized
ataaaatagcaaaaatagcagc

SEQ ID NO: 1098806 - DNA, 22 bp, Artificial Sequence
  chemically synthesized
aagaaaacatgctgctattttt

SEQ ID NO: 1098807 - DNA, 22 bp, Artificial Sequence
  chemically synthesized
agaaaacatgctgctatttttg

SEQ ID NO: 1098808 - DNA, 22 bp, Artificial Sequence
  chemically synthesized
atttataaaatagcaaaaatag

SEQ ID NO: 1098809 - DNA, 22 bp, Artificial Sequence
  chemically synthesized
aatttataaaatagcaaaaata

SEQ ID NO: 1098810 - DNA, 22 bp, Artificial Sequence
  chemically synthesized
ttaatttataaaatagcaaaaa

SEQ ID NO: 1098811 - DNA, 22 bp, Artificial Sequence
  chemically synthesized
cttaatttataaaatagcaaaa

SEQ ID NO: 1098812 - DNA, 22 bp, Artificial Sequence
  chemically synthesized
ctatttttgctattttataaat

SEQ ID NO: 1098813 - DNA, 22 bp, Artificial Sequence
  chemically synthesized
tttttgctattttataaattaa

SEQ ID NO: 1098814 - DNA, 22 bp, Artificial Sequence
  chemically synthesized
gcagcaggatttcttaatttat

SEQ ID NO: 1098815 - DNA, 22 bp, Artificial Sequence
  chemically synthesized
agcagcaggatttcttaattta

SEQ ID NO: 1098816 - DNA, 22 bp, Artificial Sequence
  chemically synthesized
ttgctattttataaattaagaa

SEQ ID NO: 1098817 - DNA, 22 bp, Artificial Sequence
  chemically synthesized
tgctattttataaattaagaaa

SEQ ID NO: 1098818 - DNA, 22 bp, Artificial Sequence
  chemically synthesized
gctattttataaattaagaaat

SEQ ID NO: 1098819 - DNA, 22 bp, Artificial Sequence
  chemically synthesized
ctattttataaattaagaaatc

SEQ ID NO: 1098820 - DNA, 22 bp, Artificial Sequence
  chemically synthesized
ttttataaattaagaaatcctg

SEQ ID NO: 1098821 - DNA, 22 bp, Artificial Sequence
  chemically synthesized
tataaattaagaaatcctgctg

SEQ ID NO: 1098822 - DNA, 22 bp, Artificial Sequence
  chemically synthesized
ataaattaagaaatcctgctgc

SEQ ID NO: 1098823 - DNA, 22 bp, Artificial Sequence
  chemically synthesized
agtagaaatttagcagcaggat

SEQ ID NO: 1098824 - DNA, 22 bp, Artificial Sequence
  chemically synthesized
taaattaagaaatcctgctgct

SEQ ID NO: 1098825 - DNA, 22 bp, Artificial Sequence
  chemically synthesized
taagtagaaatttagcagcagg

SEQ ID NO: 1098826 - DNA, 22 bp, Artificial Sequence
  chemically synthesized
ctaagtagaaatttagcagcag

SEQ ID NO: 1098827 - DNA, 22 bp, Artificial Sequence
  chemically synthesized
agaaatcctgctgctaaatttc

SEQ ID NO: 1098828 - DNA, 22 bp, Artificial Sequence
  chemically synthesized
ctgctaaatttctacttagaaa

SEQ ID NO: 1098829 - DNA, 22 bp, Artificial Sequence
  chemically synthesized
taacagagcagagtttctaagt

SEQ ID NO: 1098830 - DNA, 22 bp, Artificial Sequence
  chemically synthesized
ctaaatttctacttagaaactc

SEQ ID NO: 1098831 - DNA, 22 bp, Artificial Sequence
  chemically synthesized
aatttctacttagaaactctgc

SEQ ID NO: 1098832 - DNA, 22 bp, Artificial Sequence
  chemically synthesized
aaagattataacagagcagagt

SEQ ID NO: 1098833 - DNA, 22 bp, Artificial Sequence
  chemically synthesized
aaaagattataacagagcagag

SEQ ID NO: 1098834 - DNA, 22 bp, Artificial Sequence
  chemically synthesized
ctacttagaaactctgctctgt

SEQ ID NO: 1098835 - DNA, 22 bp, Artificial Sequence
  chemically synthesized
tacttagaaactctgctctgtt

SEQ ID NO: 1098836 - DNA, 22 bp, Artificial Sequence
  chemically synthesized
cttagaaactctgctctgttat

SEQ ID NO: 1098837 - DNA, 22 bp, Artificial Sequence
  chemically synthesized
ccttaaaagattataacagagc

SEQ ID NO: 1098838 - DNA, 22 bp, Artificial Sequence
  chemically synthesized
agaaactctgctctgttataat

SEQ ID NO: 1098839 - DNA, 22 bp, Artificial Sequence
  chemically synthesized
gaaactctgctctgttataatc

SEQ ID NO: 1098840 - DNA, 22 bp, Artificial Sequence
  chemically synthesized
accaactgccttaaaagattat

SEQ ID NO: 1098841 - DNA, 22 bp, Artificial Sequence
  chemically synthesized
caccaactgccttaaaagatta

SEQ ID NO: 1098842 - DNA, 22 bp, Artificial Sequence
  chemically synthesized
tgctctgttataatcttttaag

SEQ ID NO: 1098843 - DNA, 22 bp, Artificial Sequence
  chemically synthesized
ctctgttataatcttttaaggc

SEQ ID NO: 1098844 - DNA, 22 bp, Artificial Sequence
  chemically synthesized
tagcttcaccaactgccttaaa

SEQ ID NO: 1098845 - DNA, 22 bp, Artificial Sequence
  chemically synthesized
tgttataatcttttaaggcagt

SEQ ID NO: 1098846 - DNA, 22 bp, Artificial Sequence
  chemically synthesized
gtagcttcaccaactgccttaa

SEQ ID NO: 1098847 - DNA, 22 bp, Artificial Sequence
  chemically synthesized
tgtagcttcaccaactgcctta

SEQ ID NO: 1098848 - DNA, 22 bp, Artificial Sequence
  chemically synthesized
ttataatcttttaaggcagttg

SEQ ID NO: 1098849 - DNA, 22 bp, Artificial Sequence
  chemically synthesized
ttgtagcttcaccaactgcctt

SEQ ID NO: 1098850 - DNA, 22 bp, Artificial Sequence
  chemically synthesized
taatcttttaaggcagttggtg

SEQ ID NO: 1098851 - DNA, 22 bp, Artificial Sequence
  chemically synthesized
atatttttgtagcttcaccaac

SEQ ID NO: 1098852 - DNA, 22 bp, Artificial Sequence
  chemically synthesized
taatatttttgtagcttcacca

SEQ ID NO: 1098853 - DNA, 22 bp, Artificial Sequence
  chemically synthesized
ttaaggcagttggtgaagctac

SEQ ID NO: 1098854 - DNA, 22 bp, Artificial Sequence
  chemically synthesized
taaggcagttggtgaagctaca

SEQ ID NO: 1098855 - DNA, 22 bp, Artificial Sequence
  chemically synthesized
aaggcagttggtgaagctacaa

SEQ ID NO: 1098856 - DNA, 22 bp, Artificial Sequence
  chemically synthesized
aggcagttggtgaagctacaaa

SEQ ID NO: 1098857 - DNA, 22 bp, Artificial Sequence
  chemically synthesized
gtccctctaatatttttgtagc

SEQ ID NO: 1098858 - DNA, 22 bp, Artificial Sequence
  chemically synthesized
cattagtccctctaatattttt

SEQ ID NO: 1098859 - DNA, 22 bp, Artificial Sequence
  chemically synthesized
gtgaagctacaaaaatattaga

SEQ ID NO: 1098860 - DNA, 22 bp, Artificial Sequence
  chemically synthesized
aattccattagtccctctaata

SEQ ID NO: 1098861 - DNA, 22 bp, Artificial Sequence
  chemically synthesized
gctgaattccattagtccctct

SEQ ID NO: 1098862 - DNA, 22 bp, Artificial Sequence
  chemically synthesized
ggctgaattccattagtccctc

SEQ ID NO: 1098863 - DNA, 22 bp, Artificial Sequence
  chemically synthesized
caaaaatattagagggactaat

SEQ ID NO: 1098864 - DNA, 22 bp, Artificial Sequence
  chemically synthesized
gaagtcttggctgaattccatt

SEQ ID NO: 1098865 - DNA, 22 bp, Artificial Sequence
  chemically synthesized
ctagaagtcttggctgaattcc

SEQ ID NO: 1098866 - DNA, 22 bp, Artificial Sequence
  chemically synthesized
gagggactaatggaattcagcc

SEQ ID NO: 1098867 - DNA, 22 bp, Artificial Sequence
  chemically synthesized
actagaagtcttggctgaattc

SEQ ID NO: 1098868 - DNA, 22 bp, Artificial Sequence
  chemically synthesized
tactagaagtcttggctgaatt

SEQ ID NO: 1098869 - DNA, 22 bp, Artificial Sequence
  chemically synthesized
ttactagaagtcttggctgaat

SEQ ID NO: 1098870 - DNA, 22 bp, Artificial Sequence
  chemically synthesized
atggaattcagccaagacttct

SEQ ID NO: 1098871 - DNA, 22 bp, Artificial Sequence
  chemically synthesized
agccaagacttctagtaaaaac

SEQ ID NO: 1098872 - DNA, 22 bp, Artificial Sequence
  chemically synthesized
ctagtaaaaactatacattcac

SEQ ID NO: 1098873 - DNA, 22 bp, Artificial Sequence
  chemically synthesized
tagtaaaaactatacattcaca

SEQ ID NO: 1098874 - DNA, 22 bp, Artificial Sequence
  chemically synthesized
gtaaaaactatacattcacata

SEQ ID NO: 1098875 - DNA, 22 bp, Artificial Sequence
  chemically synthesized
tacattcacatacatactttgt

SEQ ID NO: 1098876 - DNA, 22 bp, Artificial Sequence
  chemically synthesized
acatacatactttgtgtgtgtg

SEQ ID NO: 1098877 - DNA, 22 bp, Artificial Sequence
  chemically synthesized
tgtgtgtgtgtgtgtgtgtgtg

SEQ ID NO: 1098878 - DNA, 22 bp, Artificial Sequence
  chemically synthesized
gtgtgtgtgtgtgtgtgtgtgt

SEQ ID NO: 1098879 - DNA, 22 bp, Artificial Sequence
  chemically synthesized
tgtgtgtgtgtgtgtgtgtgtg

SEQ ID NO: 1098880 - DNA, 22 bp, Artificial Sequence
  chemically synthesized
agcacgtgcacacacacacaca

SEQ ID NO: 1098881 - DNA, 22 bp, Artificial Sequence
  chemically synthesized
gagcacgtgcacacacacacac

SEQ ID NO: 1098882 - DNA, 22 bp, Artificial Sequence
  chemically synthesized
accatacttgagcacgtgcaca

SEQ ID NO: 1098883 - DNA, 22 bp, Artificial Sequence
  chemically synthesized
caggatccaacaatatctcacc

SEQ ID NO: 1098884 - DNA, 22 bp, Artificial Sequence
  chemically synthesized
ccaggatccaacaatatctcac

SEQ ID NO: 1098885 - DNA, 22 bp, Artificial Sequence
  chemically synthesized
aagtatggtgagatattgttgg

SEQ ID NO: 1098886 - DNA, 22 bp, Artificial Sequence
  chemically synthesized
aaaatttccaggatccaacaat

SEQ ID NO: 1098887 - DNA, 22 bp, Artificial Sequence
  chemically synthesized
caaaatttccaggatccaacaa

SEQ ID NO: 1098888 - DNA, 22 bp, Artificial Sequence
  chemically synthesized
ccttcaaaatttccaggatcca

SEQ ID NO: 1098889 - DNA, 22 bp, Artificial Sequence
  chemically synthesized
gccttcaaaatttccaggatcc

SEQ ID NO: 1098890 - DNA, 22 bp, Artificial Sequence
  chemically synthesized
tgccttcaaaatttccaggatc

SEQ ID NO: 1098891 - DNA, 22 bp, Artificial Sequence
  chemically synthesized
ttgccttcaaaatttccaggat

SEQ ID NO: 1098892 - DNA, 22 bp, Artificial Sequence
  chemically synthesized
tcgtttttgccttcaaaatttc

SEQ ID NO: 1098893 - DNA, 22 bp, Artificial Sequence
  chemically synthesized
ttggatcctggaaattttgaag

SEQ ID NO: 1098894 - DNA, 22 bp, Artificial Sequence
  chemically synthesized
gatcctggaaattttgaaggca

SEQ ID NO: 1098895 - DNA, 22 bp, Artificial Sequence
  chemically synthesized
gaaattttgaaggcaaaaacga

SEQ ID NO: 1098896 - DNA, 22 bp, Artificial Sequence
  chemically synthesized
tcaccaaatgctgtcgtttttg

SEQ ID NO: 1098897 - DNA, 22 bp, Artificial Sequence
  chemically synthesized
tgaaggcaaaaacgacagcatt

SEQ ID NO: 1098898 - DNA, 22 bp, Artificial Sequence
  chemically synthesized
gaaggcaaaaacgacagcattt

SEQ ID NO: 1098899 - DNA, 22 bp, Artificial Sequence
  chemically synthesized
aaggcaaaaacgacagcatttg

SEQ ID NO: 1098900 - DNA, 22 bp, Artificial Sequence
  chemically synthesized
cagccgaacatcaaatctatca

SEQ ID NO: 1098901 - DNA, 22 bp, Artificial Sequence
  chemically synthesized
acagccgaacatcaaatctatc

SEQ ID NO: 1098902 - DNA, 22 bp, Artificial Sequence
  chemically synthesized
ttacagccgaacatcaaatcta

SEQ ID NO: 1098903 - DNA, 22 bp, Artificial Sequence
  chemically synthesized
tcttacagccgaacatcaaatc

SEQ ID NO: 1098904 - DNA, 22 bp, Artificial Sequence
  chemically synthesized
ctcttacagccgaacatcaaat

SEQ ID NO: 1098905 - DNA, 22 bp, Artificial Sequence
  chemically synthesized
ggtgatagatttgatgttcggc

SEQ ID NO: 1098906 - DNA, 22 bp, Artificial Sequence
  chemically synthesized
gtgatagatttgatgttcggct

SEQ ID NO: 1098907 - DNA, 22 bp, Artificial Sequence
  chemically synthesized
tatttctcttacagccgaacat

SEQ ID NO: 1098908 - DNA, 22 bp, Artificial Sequence
  chemically synthesized
ctatatttctcttacagccgaa

SEQ ID NO: 1098909 - DNA, 22 bp, Artificial Sequence
  chemically synthesized
tctcctatatttctcttacagc

SEQ ID NO: 1098910 - DNA, 22 bp, Artificial Sequence
  chemically synthesized
gtctcctatatttctcttacag

SEQ ID NO: 1098911 - DNA, 22 bp, Artificial Sequence
  chemically synthesized
ttgtctcctatatttctcttac

SEQ ID NO: 1098912 - DNA, 22 bp, Artificial Sequence
  chemically synthesized
gatgttcggctgtaagagaaat

SEQ ID NO: 1098913 - DNA, 22 bp, Artificial Sequence
  chemically synthesized
cttgtctcctatatttctctta

SEQ ID NO: 1098914 - DNA, 22 bp, Artificial Sequence
  chemically synthesized
atgttcggctgtaagagaaata

SEQ ID NO: 1098915 - DNA, 22 bp, Artificial Sequence
  chemically synthesized
tcttgtctcctatatttctctt

SEQ ID NO: 1098916 - DNA, 22 bp, Artificial Sequence
  chemically synthesized
ggctgtaagagaaatataggag

SEQ ID NO: 1098917 - DNA, 22 bp, Artificial Sequence
  chemically synthesized
taagagaaatataggagacaag

SEQ ID NO: 1098918 - DNA, 22 bp, Artificial Sequence
  chemically synthesized
aagccaaatcccacgagatttt

SEQ ID NO: 1098919 - DNA, 22 bp, Artificial Sequence
  chemically synthesized
ttcaagccaaatcccacgagat

SEQ ID NO: 1098920 - DNA, 22 bp, Artificial Sequence
  chemically synthesized
attcaagccaaatcccacgaga

SEQ ID NO: 1098921 - DNA, 22 bp, Artificial Sequence
  chemically synthesized
cacttattcaagccaaatccca

SEQ ID NO: 1098922 - DNA, 22 bp, Artificial Sequence
  chemically synthesized
ccacttattcaagccaaatccc

SEQ ID NO: 1098923 - DNA, 22 bp, Artificial Sequence
  chemically synthesized
tccacttattcaagccaaatcc

SEQ ID NO: 1098924 - DNA, 22 bp, Artificial Sequence
  chemically synthesized
catctttccacttattcaagcc

SEQ ID NO: 1098925 - DNA, 22 bp, Artificial Sequence
  chemically synthesized
gtgggatttggcttgaataagt

SEQ ID NO: 1098926 - DNA, 22 bp, Artificial Sequence
  chemically synthesized
ggcttgaataagtggaaagatg

SEQ ID NO: 1098927 - DNA, 22 bp, Artificial Sequence
  chemically synthesized
gcttgaataagtggaaagatgg

SEQ ID NO: 1098928 - DNA, 22 bp, Artificial Sequence
  chemically synthesized
caaatggcacctccatctttcc

SEQ ID NO: 1098929 - DNA, 22 bp, Artificial Sequence
  chemically synthesized
ttacaaatggcacctccatctt

SEQ ID NO: 1098930 - DNA, 22 bp, Artificial Sequence
  chemically synthesized
gaataagtggaaagatggaggt

SEQ ID NO: 1098931 - DNA, 22 bp, Artificial Sequence
  chemically synthesized
aataagtggaaagatggaggtg

SEQ ID NO: 1098932 - DNA, 22 bp, Artificial Sequence
  chemically synthesized
ttattacaaatggcacctccat

SEQ ID NO: 1098933 - DNA, 22 bp, Artificial Sequence
  chemically synthesized
cctgttattacaaatggcacct

SEQ ID NO: 1098934 - DNA, 22 bp, Artificial Sequence
  chemically synthesized
gcctgttattacaaatggcacc

SEQ ID NO: 1098935 - DNA, 22 bp, Artificial Sequence
  chemically synthesized
gaaatttgcctgttattacaaa

SEQ ID NO: 1098936 - DNA, 22 bp, Artificial Sequence
  chemically synthesized
ccctagaaatttgcctgttatt

SEQ ID NO: 1098937 - DNA, 22 bp, Artificial Sequence
  chemically synthesized
ctaccctagaaatttgcctgtt

SEQ ID NO: 1098938 - DNA, 22 bp, Artificial Sequence
  chemically synthesized
gtaataacaggcaaatttctag

SEQ ID NO: 1098939 - DNA, 22 bp, Artificial Sequence
  chemically synthesized
taataacaggcaaatttctagg

SEQ ID NO: 1098940 - DNA, 22 bp, Artificial Sequence
  chemically synthesized
atgtataccccagtctactacc

SEQ ID NO: 1098941 - DNA, 22 bp, Artificial Sequence
  chemically synthesized
ctgatgtataccccagtctact

SEQ ID NO: 1098942 - DNA, 22 bp, Artificial Sequence
  chemically synthesized
ctagggtagtagactggggtat

SEQ ID NO: 1098943 - DNA, 22 bp, Artificial Sequence
  chemically synthesized
tagggtagtagactggggtata

SEQ ID NO: 1098944 - DNA, 22 bp, Artificial Sequence
  chemically synthesized
gggtagtagactggggtataca

SEQ ID NO: 1098945 - DNA, 22 bp, Artificial Sequence
  chemically synthesized
aaacaaaattcctgatgtatac

SEQ ID NO: 1098946 - DNA, 22 bp, Artificial Sequence
  chemically synthesized
acatgttaaaacaaaattcctg

SEQ ID NO: 1098947 - DNA, 22 bp, Artificial Sequence
  chemically synthesized
gggtatacatcaggaattttgt

SEQ ID NO: 1098948 - DNA, 22 bp, Artificial Sequence
  chemically synthesized
aatctaacatgttaaaacaaaa

SEQ ID NO: 1098949 - DNA, 22 bp, Artificial Sequence
  chemically synthesized
tgttttaacatgttagatttaa

SEQ ID NO: 1098950 - DNA, 22 bp, Artificial Sequence
  chemically synthesized
ataataggcatattaaatctaa

SEQ ID NO: 1098951 - DNA, 22 bp, Artificial Sequence
  chemically synthesized
gttttaacatgttagatttaat

SEQ ID NO: 1098952 - DNA, 22 bp, Artificial Sequence
  chemically synthesized
ttttaacatgttagatttaata

SEQ ID NO: 1098953 - DNA, 22 bp, Artificial Sequence
  chemically synthesized
taacatgttagatttaatatgc

SEQ ID NO: 1098954 - DNA, 22 bp, Artificial Sequence
  chemically synthesized
aacatgttagatttaatatgcc

SEQ ID NO: 1098955 - DNA, 22 bp, Artificial Sequence
  chemically synthesized
acatgttagatttaatatgcct

SEQ ID NO: 1098956 - DNA, 22 bp, Artificial Sequence
  chemically synthesized
cacatcaattaataataggcat

SEQ ID NO: 1098957 - DNA, 22 bp, Artificial Sequence
  chemically synthesized
gatttaatatgcctattattaa

SEQ ID NO: 1098958 - DNA, 22 bp, Artificial Sequence
  chemically synthesized
aacacctccacatcaattaata

SEQ ID NO: 1098959 - DNA, 22 bp, Artificial Sequence
  chemically synthesized
aatatgcctattattaattgat

SEQ ID NO: 1098960 - DNA, 22 bp, Artificial Sequence
  chemically synthesized
atatgcctattattaattgatg

SEQ ID NO: 1098961 - DNA, 22 bp, Artificial Sequence
  chemically synthesized
cccactcaacacctccacatca

SEQ ID NO: 1098962 - DNA, 22 bp, Artificial Sequence
  chemically synthesized
gcccactcaacacctccacatc

SEQ ID NO: 1098963 - DNA, 22 bp, Artificial Sequence
  chemically synthesized
ttattaattgatgtggaggtgt

SEQ ID NO: 1098964 - DNA, 22 bp, Artificial Sequence
  chemically synthesized
ttaattgatgtggaggtgttga

SEQ ID NO: 1098965 - DNA, 22 bp, Artificial Sequence
  chemically synthesized
attgatgtggaggtgttgagtg

SEQ ID NO: 1098966 - DNA, 22 bp, Artificial Sequence
  chemically synthesized
catacccatttgcccactcaac

SEQ ID NO: 1098967 - DNA, 22 bp, Artificial Sequence
  chemically synthesized
atgtggaggtgttgagtgggca

SEQ ID NO: 1098968 - DNA, 22 bp, Artificial Sequence
  chemically synthesized
gacctgcatacccatttgccca

SEQ ID NO: 1098969 - DNA, 22 bp, Artificial Sequence
  chemically synthesized
atgatcctagacctgcataccc

SEQ ID NO: 1098970 - DNA, 22 bp, Artificial Sequence
  chemically synthesized
agtgggcaaatgggtatgcagg

SEQ ID NO: 1098971 - DNA, 22 bp, Artificial Sequence
  chemically synthesized
taatgatcctagacctgcatac

SEQ ID NO: 1098972 - DNA, 22 bp, Artificial Sequence
  chemically synthesized
ctaatgatcctagacctgcata

SEQ ID NO: 1098973 - DNA, 22 bp, Artificial Sequence
  chemically synthesized
tctaatgatcctagacctgcat

SEQ ID NO: 1098974 - DNA, 22 bp, Artificial Sequence
  chemically synthesized
gaccctttctaatgatcctaga

SEQ ID NO: 1098975 - DNA, 22 bp, Artificial Sequence
  chemically synthesized
acaatctggaccctttctaatg

SEQ ID NO: 1098976 - DNA, 22 bp, Artificial Sequence
  chemically synthesized
aacaatctggaccctttctaat

SEQ ID NO: 1098977 - DNA, 22 bp, Artificial Sequence
  chemically synthesized
taacaatctggaccctttctaa

SEQ ID NO: 1098978 - DNA, 22 bp, Artificial Sequence
  chemically synthesized
ttaacaatctggaccctttcta

SEQ ID NO: 1098979 - DNA, 22 bp, Artificial Sequence
  chemically synthesized
tttaacaatctggaccctttct

SEQ ID NO: 1098980 - DNA, 22 bp, Artificial Sequence
  chemically synthesized
ttttaacaatctggaccctttc

SEQ ID NO: 1098981 - DNA, 22 bp, Artificial Sequence
  chemically synthesized
tttttaacaatctggacccttt

SEQ ID NO: 1098982 - DNA, 22 bp, Artificial Sequence
  chemically synthesized
ttttttaacaatctggaccctt

SEQ ID NO: 1098983 - DNA, 22 bp, Artificial Sequence
  chemically synthesized
ggatcattagaaagggtccaga

SEQ ID NO: 1098984 - DNA, 22 bp, Artificial Sequence
  chemically synthesized
tttttttaacaatctggaccct

SEQ ID NO: 1098985 - DNA, 22 bp, Artificial Sequence
  chemically synthesized
ttttttttaacaatctggaccc

SEQ ID NO: 1098986 - DNA, 22 bp, Artificial Sequence
  chemically synthesized
tttttttttaacaatctggacc

SEQ ID NO: 1098987 - DNA, 22 bp, Artificial Sequence
  chemically synthesized
ttttttttttaacaatctggac

SEQ ID NO: 1098988 - DNA, 22 bp, Artificial Sequence
  chemically synthesized
tttttttttttaacaatctgga

SEQ ID NO: 1098989 - DNA, 22 bp, Artificial Sequence
  chemically synthesized
ttttttttttttaacaatctgg

SEQ ID NO: 1098990 - DNA, 22 bp, Artificial Sequence
  chemically synthesized
tttttttttttttaacaatctg

SEQ ID NO: 1098991 - DNA, 22 bp, Artificial Sequence
  chemically synthesized
ttttttttttttttaacaatct

SEQ ID NO: 1098992 - DNA, 22 bp, Artificial Sequence
  chemically synthesized
tttttttttttttttaacaatc

SEQ ID NO: 1098993 - DNA, 22 bp, Artificial Sequence
  chemically synthesized
gaaagggtccagattgttaaaa

SEQ ID NO: 1098994 - DNA, 22 bp, Artificial Sequence
  chemically synthesized
ttttttttttttttttaacaat

SEQ ID NO: 1098995 - DNA, 22 bp, Artificial Sequence
  chemically synthesized
tttttttttttttttttaacaa

SEQ ID NO: 1098996 - DNA, 22 bp, Artificial Sequence
  chemically synthesized
taagtttttttttttttttttt

SEQ ID NO: 1098997 - DNA, 22 bp, Artificial Sequence
  chemically synthesized
ctgtaagttttttttttttttt

SEQ ID NO: 1098998 - DNA, 22 bp, Artificial Sequence
  chemically synthesized
ctgctgtaagtttttttttttt

SEQ ID NO: 1098999 - DNA, 22 bp, Artificial Sequence
  chemically synthesized
ttaaaaaaaaaaaaaaaaaaaa

SEQ ID NO: 1099000 - DNA, 22 bp, Artificial Sequence
  chemically synthesized
ttcctgctgtaagttttttttt

SEQ ID NO: 1099001 - DNA, 22 bp, Artificial Sequence
  chemically synthesized
aaaaaaaaaaaaaaaaaaactt

SEQ ID NO: 1099002 - DNA, 22 bp, Artificial Sequence
  chemically synthesized
taagttgttcctgctgtaagtt

SEQ ID NO: 1099003 - DNA, 22 bp, Artificial Sequence
  chemically synthesized
aatgtaatctgtaagttgttcc

SEQ ID NO: 1099004 - DNA, 22 bp, Artificial Sequence
  chemically synthesized
aaatgtaatctgtaagttgttc

SEQ ID NO: 1099005 - DNA, 22 bp, Artificial Sequence
  chemically synthesized
taaatgtaatctgtaagttgtt

SEQ ID NO: 1099006 - DNA, 22 bp, Artificial Sequence
  chemically synthesized
acagcaggaacaacttacagat

SEQ ID NO: 1099007 - DNA, 22 bp, Artificial Sequence
  chemically synthesized
cagcaggaacaacttacagatt

SEQ ID NO: 1099008 - DNA, 22 bp, Artificial Sequence
  chemically synthesized
catagttttaaatgtaatctgt

SEQ ID NO: 1099009 - DNA, 22 bp, Artificial Sequence
  chemically synthesized
tcaagctccatagttttaaatg

SEQ ID NO: 1099010 - DNA, 22 bp, Artificial Sequence
  chemically synthesized
atcaagctccatagttttaaat

SEQ ID NO: 1099011 - DNA, 22 bp, Artificial Sequence
  chemically synthesized
acagattacatttaaaactatg

SEQ ID NO: 1099012 - DNA, 22 bp, Artificial Sequence
  chemically synthesized
cagattacatttaaaactatgg

SEQ ID NO: 1099013 - DNA, 22 bp, Artificial Sequence
  chemically synthesized
catttaaaactatggagcttga

SEQ ID NO: 1099014 - DNA, 22 bp, Artificial Sequence
  chemically synthesized
cgggtcaacttatcaagctcca

SEQ ID NO: 1099015 - DNA, 22 bp, Artificial Sequence
  chemically synthesized
tccgggtcaacttatcaagctc

SEQ ID NO: 1099016 - DNA, 22 bp, Artificial Sequence
  chemically synthesized
aaaactatggagcttgataagt

SEQ ID NO: 1099017 - DNA, 22 bp, Artificial Sequence
  chemically synthesized
aaactatggagcttgataagtt

SEQ ID NO: 1099018 - DNA, 22 bp, Artificial Sequence
  chemically synthesized
tggagcttgataagttgacccg

SEQ ID NO: 1099019 - DNA, 22 bp, Artificial Sequence
  chemically synthesized
ccacccactctccgggtcaact

SEQ ID NO: 1099020 - DNA, 22 bp, Artificial Sequence
  chemically synthesized
ttaccacccactctccgggtca

SEQ ID NO: 1099021 - DNA, 22 bp, Artificial Sequence
  chemically synthesized
gataagttgacccggagagtgg

SEQ ID NO: 1099022 - DNA, 22 bp, Artificial Sequence
  chemically synthesized
ataagttgacccggagagtggg

SEQ ID NO: 1099023 - DNA, 22 bp, Artificial Sequence
  chemically synthesized
cccctattaccacccactctcc

SEQ ID NO: 1099024 - DNA, 22 bp, Artificial Sequence
  chemically synthesized
ccccctattaccacccactctc

SEQ ID NO: 1099025 - DNA, 22 bp, Artificial Sequence
  chemically synthesized
tccccctattaccacccactct

SEQ ID NO: 1099026 - DNA, 22 bp, Artificial Sequence
  chemically synthesized
ttccccctattaccacccactc

SEQ ID NO: 1099027 - DNA, 22 bp, Artificial Sequence
  chemically synthesized
tttccccctattaccacccact

SEQ ID NO: 1099028 - DNA, 22 bp, Artificial Sequence
  chemically synthesized
ttttccccctattaccacccac

SEQ ID NO: 1099029 - DNA, 22 bp, Artificial Sequence
  chemically synthesized
tttttccccctattaccaccca

SEQ ID NO: 1099030 - DNA, 22 bp, Artificial Sequence
  chemically synthesized
ttttttccccctattaccaccc

SEQ ID NO: 1099031 - DNA, 22 bp, Artificial Sequence
  chemically synthesized
acccggagagtgggtggtaata

SEQ ID NO: 1099032 - DNA, 22 bp, Artificial Sequence
  chemically synthesized
tttttttccccctattaccacc

SEQ ID NO: 1099033 - DNA, 22 bp, Artificial Sequence
  chemically synthesized
ttttttttccccctattaccac

SEQ ID NO: 1099034 - DNA, 22 bp, Artificial Sequence
  chemically synthesized
cttttttttttccccctattac

SEQ ID NO: 1099035 - DNA, 22 bp, Artificial Sequence
  chemically synthesized
tggactccttttttttttcccc

SEQ ID NO: 1099036 - DNA, 22 bp, Artificial Sequence
  chemically synthesized
agtctgtggactcctttttttt

SEQ ID NO: 1099037 - DNA, 22 bp, Artificial Sequence
  chemically synthesized
cagggctcagtctgtggactcc

SEQ ID NO: 1099038 - DNA, 22 bp, Artificial Sequence
  chemically synthesized
aaagtgttccagggctcagtct

SEQ ID NO: 1099039 - DNA, 22 bp, Artificial Sequence
  chemically synthesized
gaaagtgttccagggctcagtc

SEQ ID NO: 1099040 - DNA, 22 bp, Artificial Sequence
  chemically synthesized
aatttgaaagtgttccagggct

SEQ ID NO: 1099041 - DNA, 22 bp, Artificial Sequence
  chemically synthesized
accactaaatttgaaagtgttc

SEQ ID NO: 1099042 - DNA, 22 bp, Artificial Sequence
  chemically synthesized
agccctggaacactttcaaatt

SEQ ID NO: 1099043 - DNA, 22 bp, Artificial Sequence
  chemically synthesized
ccctgaccactaaatttgaaag

SEQ ID NO: 1099044 - DNA, 22 bp, Artificial Sequence
  chemically synthesized
ttgccctgaccactaaatttga

SEQ ID NO: 1099045 - DNA, 22 bp, Artificial Sequence
  chemically synthesized
tattgccctgaccactaaattt

SEQ ID NO: 1099046 - DNA, 22 bp, Artificial Sequence
  chemically synthesized
gaacactttcaaatttagtggt

SEQ ID NO: 1099047 - DNA, 22 bp, Artificial Sequence
  chemically synthesized
gtggttctattgccctgaccac

SEQ ID NO: 1099048 - DNA, 22 bp, Artificial Sequence
  chemically synthesized
ggtggttctattgccctgacca

SEQ ID NO: 1099049 - DNA, 22 bp, Artificial Sequence
  chemically synthesized
tcaaatttagtggtcagggcaa

SEQ ID NO: 1099050 - DNA, 22 bp, Artificial Sequence
  chemically synthesized
caaatttagtggtcagggcaat

SEQ ID NO: 1099051 - DNA, 22 bp, Artificial Sequence
  chemically synthesized
aaatttagtggtcagggcaata

SEQ ID NO: 1099052 - DNA, 22 bp, Artificial Sequence
  chemically synthesized
agtggtcagggcaatagaacca

SEQ ID NO: 1099053 - DNA, 22 bp, Artificial Sequence
  chemically synthesized
gtggtcagggcaatagaaccac

SEQ ID NO: 1099054 - DNA, 22 bp, Artificial Sequence
  chemically synthesized
tcaatatccttggtggttctat

SEQ ID NO: 1099055 - DNA, 22 bp, Artificial Sequence
  chemically synthesized
accactgtcaatatccttggtg

SEQ ID NO: 1099056 - DNA, 22 bp, Artificial Sequence
  chemically synthesized
cctgaccactgtcaatatcctt

SEQ ID NO: 1099057 - DNA, 22 bp, Artificial Sequence
  chemically synthesized
ccctgaccactgtcaatatcct

SEQ ID NO: 1099058 - DNA, 22 bp, Artificial Sequence
  chemically synthesized
tccctgaccactgtcaatatcc

SEQ ID NO: 1099059 - DNA, 22 bp, Artificial Sequence
  chemically synthesized
gttttccctgaccactgtcaat

SEQ ID NO: 1099060 - DNA, 22 bp, Artificial Sequence
  chemically synthesized
agttttccctgaccactgtcaa

SEQ ID NO: 1099061 - DNA, 22 bp, Artificial Sequence
  chemically synthesized
ttagttttccctgaccactgtc

SEQ ID NO: 1099062 - DNA, 22 bp, Artificial Sequence
  chemically synthesized
tctcttagttttccctgaccac

SEQ ID NO: 1099063 - DNA, 22 bp, Artificial Sequence
  chemically synthesized
attatctcttagttttccctga

SEQ ID NO: 1099064 - DNA, 22 bp, Artificial Sequence
  chemically synthesized
aattatctcttagttttccctg

SEQ ID NO: 1099065 - DNA, 22 bp, Artificial Sequence
  chemically synthesized
ttaattatctcttagttttccc

SEQ ID NO: 1099066 - DNA, 22 bp, Artificial Sequence
  chemically synthesized
cttaattatctcttagttttcc

SEQ ID NO: 1099067 - DNA, 22 bp, Artificial Sequence
  chemically synthesized
acagtggtcagggaaaactaag

SEQ ID NO: 1099068 - DNA, 22 bp, Artificial Sequence
  chemically synthesized
tcttaattatctcttagttttc

SEQ ID NO: 1099069 - DNA, 22 bp, Artificial Sequence
  chemically synthesized
tttcttaattatctcttagttt

SEQ ID NO: 1099070 - DNA, 22 bp, Artificial Sequence
  chemically synthesized
tgtcatcattctttcttaatta

SEQ ID NO: 1099071 - DNA, 22 bp, Artificial Sequence
  chemically synthesized
tgtgtcatcattctttcttaat

SEQ ID NO: 1099072 - DNA, 22 bp, Artificial Sequence
  chemically synthesized
ctgtgtcatcattctttcttaa

SEQ ID NO: 1099073 - DNA, 22 bp, Artificial Sequence
  chemically synthesized
agagataattaagaaagaatga

SEQ ID NO: 1099074 - DNA, 22 bp, Artificial Sequence
  chemically synthesized
gcttctgtgtcatcattctttc

SEQ ID NO: 1099075 - DNA, 22 bp, Artificial Sequence
  chemically synthesized
agttggcttctgtgtcatcatt

SEQ ID NO: 1099076 - DNA, 22 bp, Artificial Sequence
  chemically synthesized
aattcagttggcttctgtgtca

SEQ ID NO: 1099077 - DNA, 22 bp, Artificial Sequence
  chemically synthesized
agaaagaatgatgacacagaag

SEQ ID NO: 1099078 - DNA, 22 bp, Artificial Sequence
  chemically synthesized
aatcgctaaattcagttggctt

SEQ ID NO: 1099079 - DNA, 22 bp, Artificial Sequence
  chemically synthesized
ctaaatcgctaaattcagttgg

SEQ ID NO: 1099080 - DNA, 22 bp, Artificial Sequence
  chemically synthesized
gtattactaaatcgctaaattc

SEQ ID NO: 1099081 - DNA, 22 bp, Artificial Sequence
  chemically synthesized
aatttagcgatttagtaatacg

SEQ ID NO: 1099082 - DNA, 22 bp, Artificial Sequence
  chemically synthesized
agcgatttagtaatacgaattc

SEQ ID NO: 1099083 - DNA, 22 bp, Artificial Sequence
  chemically synthesized
gcgatttagtaatacgaattca

SEQ ID NO: 1099084 - DNA, 22 bp, Artificial Sequence
  chemically synthesized
tcagggtcatcagtgaattcgt

SEQ ID NO: 1099085 - DNA, 22 bp, Artificial Sequence
  chemically synthesized
gtcagggtcatcagtgaattcg

SEQ ID NO: 1099086 - DNA, 22 bp, Artificial Sequence
  chemically synthesized
tgtcagggtcatcagtgaattc

SEQ ID NO: 1099087 - DNA, 22 bp, Artificial Sequence
  chemically synthesized
agtaatacgaattcactgatga

SEQ ID NO: 1099088 - DNA, 22 bp, Artificial Sequence
  chemically synthesized
gtaatacgaattcactgatgac

SEQ ID NO: 1099089 - DNA, 22 bp, Artificial Sequence
  chemically synthesized
aagcagattttgtcagggtcat

SEQ ID NO: 1099090 - DNA, 22 bp, Artificial Sequence
  chemically synthesized
ttaaagcagattttgtcagggt

SEQ ID NO: 1099091 - DNA, 22 bp, Artificial Sequence
  chemically synthesized
tattaaagcagattttgtcagg

SEQ ID NO: 1099092 - DNA, 22 bp, Artificial Sequence
  chemically synthesized
actgatgaccctgacaaaatct

SEQ ID NO: 1099093 - DNA, 22 bp, Artificial Sequence
  chemically synthesized
ttctattaaagcagattttgtc

SEQ ID NO: 1099094 - DNA, 22 bp, Artificial Sequence
  chemically synthesized
atgaccctgacaaaatctgctt

SEQ ID NO: 1099095 - DNA, 22 bp, Artificial Sequence
  chemically synthesized
actattctattaaagcagattt

SEQ ID NO: 1099096 - DNA, 22 bp, Artificial Sequence
  chemically synthesized
tcctcactattctattaaagca

SEQ ID NO: 1099097 - DNA, 22 bp, Artificial Sequence
  chemically synthesized
ttatcctcactattctattaaa

SEQ ID NO: 1099098 - DNA, 22 bp, Artificial Sequence
  chemically synthesized
acaaaatctgctttaatagaat

SEQ ID NO: 1099099 - DNA, 22 bp, Artificial Sequence
  chemically synthesized
atcaaactgttatcctcactat

SEQ ID NO: 1099100 - DNA, 22 bp, Artificial Sequence
  chemically synthesized
ctttaatagaatagtgaggata

SEQ ID NO: 1099101 - DNA, 22 bp, Artificial Sequence
  chemically synthesized
taatagaatagtgaggataaca

SEQ ID NO: 1099102 - DNA, 22 bp, Artificial Sequence
  chemically synthesized
aatagaatagtgaggataacag

SEQ ID NO: 1099103 - DNA, 22 bp, Artificial Sequence
  chemically synthesized
atagaatagtgaggataacagt

SEQ ID NO: 1099104 - DNA, 22 bp, Artificial Sequence
  chemically synthesized
agagagctaatcaaactgttat

SEQ ID NO: 1099105 - DNA, 22 bp, Artificial Sequence
  chemically synthesized
atgccaattaagagagctaatc

SEQ ID NO: 1099106 - DNA, 22 bp, Artificial Sequence
  chemically synthesized
gatgccaattaagagagctaat

SEQ ID NO: 1099107 - DNA, 22 bp, Artificial Sequence
  chemically synthesized
ttgatgccaattaagagagcta

SEQ ID NO: 1099108 - DNA, 22 bp, Artificial Sequence
  chemically synthesized
tcttgatgccaattaagagagc

SEQ ID NO: 1099109 - DNA, 22 bp, Artificial Sequence
  chemically synthesized
tctcttgatgccaattaagaga

SEQ ID NO: 1099110 - DNA, 22 bp, Artificial Sequence
  chemically synthesized
ctctcttgatgccaattaagag

SEQ ID NO: 1099111 - DNA, 22 bp, Artificial Sequence
  chemically synthesized
gattagctctcttaattggcat

SEQ ID NO: 1099112 - DNA, 22 bp, Artificial Sequence
  chemically synthesized
ccttctctcttgatgccaatta

SEQ ID NO: 1099113 - DNA, 22 bp, Artificial Sequence
  chemically synthesized
attagctctcttaattggcatc

SEQ ID NO: 1099114 - DNA, 22 bp, Artificial Sequence
  chemically synthesized
cccttctctcttgatgccaatt

SEQ ID NO: 1099115 - DNA, 22 bp, Artificial Sequence
  chemically synthesized
cttcccttctctcttgatgcca

SEQ ID NO: 1099116 - DNA, 22 bp, Artificial Sequence
  chemically synthesized
gctctcttaattggcatcaaga

SEQ ID NO: 1099117 - DNA, 22 bp, Artificial Sequence
  chemically synthesized
actccttcccttctctcttgat

SEQ ID NO: 1099118 - DNA, 22 bp, Artificial Sequence
  chemically synthesized
tcttaattggcatcaagagaga

SEQ ID NO: 1099119 - DNA, 22 bp, Artificial Sequence
  chemically synthesized
cactccttcccttctctcttga

SEQ ID NO: 1099120 - DNA, 22 bp, Artificial Sequence
  chemically synthesized
ttaattggcatcaagagagaag

SEQ ID NO: 1099121 - DNA, 22 bp, Artificial Sequence
  chemically synthesized
aattggcatcaagagagaaggg

SEQ ID NO: 1099122 - DNA, 22 bp, Artificial Sequence
  chemically synthesized
attggcatcaagagagaaggga

SEQ ID NO: 1099123 - DNA, 22 bp, Artificial Sequence
  chemically synthesized
catttcactccttcccttctct

SEQ ID NO: 1099124 - DNA, 22 bp, Artificial Sequence
  chemically synthesized
tccatttcactccttcccttct

SEQ ID NO: 1099125 - DNA, 22 bp, Artificial Sequence
  chemically synthesized
gcatcaagagagaagggaagga

SEQ ID NO: 1099126 - DNA, 22 bp, Artificial Sequence
  chemically synthesized
tctccatttcactccttccctt

SEQ ID NO: 1099127 - DNA, 22 bp, Artificial Sequence
  chemically synthesized
ctctccatttcactccttccct

SEQ ID NO: 1099128 - DNA, 22 bp, Artificial Sequence
  chemically synthesized
tctctccatttcactccttccc

SEQ ID NO: 1099129 - DNA, 22 bp, Artificial Sequence
  chemically synthesized
ctttctctccatttcactcctt

SEQ ID NO: 1099130 - DNA, 22 bp, Artificial Sequence
  chemically synthesized
cagacattcctttctctccatt

SEQ ID NO: 1099131 - DNA, 22 bp, Artificial Sequence
  chemically synthesized
acagacattcctttctctccat

SEQ ID NO: 1099132 - DNA, 22 bp, Artificial Sequence
  chemically synthesized
tacagacattcctttctctcca

SEQ ID NO: 1099133 - DNA, 22 bp, Artificial Sequence
  chemically synthesized
cctttacagacattcctttctc

SEQ ID NO: 1099134 - DNA, 22 bp, Artificial Sequence
  chemically synthesized
ccctttacagacattcctttct

SEQ ID NO: 1099135 - DNA, 22 bp, Artificial Sequence
  chemically synthesized
ccgtttccctttacagacattc

SEQ ID NO: 1099136 - DNA, 22 bp, Artificial Sequence
  chemically synthesized
cattcccgtttccctttacaga

SEQ ID NO: 1099137 - DNA, 22 bp, Artificial Sequence
  chemically synthesized
tccattcccgtttccctttaca

SEQ ID NO: 1099138 - DNA, 22 bp, Artificial Sequence
  chemically synthesized
gcaacctctccattcccgtttc

SEQ ID NO: 1099139 - DNA, 22 bp, Artificial Sequence
  chemically synthesized
tagcaacctctccattcccgtt

SEQ ID NO: 1099140 - DNA, 22 bp, Artificial Sequence
  chemically synthesized
tctagcaacctctccattcccg

SEQ ID NO: 1099141 - DNA, 22 bp, Artificial Sequence
  chemically synthesized
taaagggaaacgggaatggaga

SEQ ID NO: 1099142 - DNA, 22 bp, Artificial Sequence
  chemically synthesized
gacaacaatctctctagcaacc

SEQ ID NO: 1099143 - DNA, 22 bp, Artificial Sequence
  chemically synthesized
aattggacaacaatctctctag

SEQ ID NO: 1099144 - DNA, 22 bp, Artificial Sequence
  chemically synthesized
aaagaatcctcaattggacaac

SEQ ID NO: 1099145 - DNA, 22 bp, Artificial Sequence
  chemically synthesized
ctagagagattgttgtccaatt

SEQ ID NO: 1099146 - DNA, 22 bp, Artificial Sequence
  chemically synthesized
aaaagaatcctcaattggacaa

SEQ ID NO: 1099147 - DNA, 22 bp, Artificial Sequence
  chemically synthesized
gagagattgttgtccaattgag

SEQ ID NO: 1099148 - DNA, 22 bp, Artificial Sequence
  chemically synthesized
tcatttaaaagaatcctcaatt

SEQ ID NO: 1099149 - DNA, 22 bp, Artificial Sequence
  chemically synthesized
ctgtcatttaaaagaatcctca

SEQ ID NO: 1099150 - DNA, 22 bp, Artificial Sequence
  chemically synthesized
ttgtccaattgaggattctttt

SEQ ID NO: 1099151 - DNA, 22 bp, Artificial Sequence
  chemically synthesized
tccaattgaggattcttttaaa

SEQ ID NO: 1099152 - DNA, 22 bp, Artificial Sequence
  chemically synthesized
taatatctcctgtcatttaaaa

SEQ ID NO: 1099153 - DNA, 22 bp, Artificial Sequence
  chemically synthesized
tgtaatatctcctgtcatttaa

SEQ ID NO: 1099154 - DNA, 22 bp, Artificial Sequence
  chemically synthesized
aggattcttttaaatgacagga

SEQ ID NO: 1099155 - DNA, 22 bp, Artificial Sequence
  chemically synthesized
ttctgtaatatctcctgtcatt

SEQ ID NO: 1099156 - DNA, 22 bp, Artificial Sequence
  chemically synthesized
ttttaaatgacaggagatatta

SEQ ID NO: 1099157 - DNA, 22 bp, Artificial Sequence
  chemically synthesized
ttaaatgacaggagatattaca

SEQ ID NO: 1099158 - DNA, 22 bp, Artificial Sequence
  chemically synthesized
taaatgacaggagatattacag

SEQ ID NO: 1099159 - DNA, 22 bp, Artificial Sequence
  chemically synthesized
aaatgacaggagatattacaga

SEQ ID NO: 1099160 - DNA, 22 bp, Artificial Sequence
  chemically synthesized
aatgacaggagatattacagaa

SEQ ID NO: 1099161 - DNA, 22 bp, Artificial Sequence
  chemically synthesized
ccatcagtagagaattattctg

SEQ ID NO: 1099162 - DNA, 22 bp, Artificial Sequence
  chemically synthesized
ccatcattcccatcagtagaga

SEQ ID NO: 1099163 - DNA, 22 bp, Artificial Sequence
  chemically synthesized
cagaataattctctactgatgg

SEQ ID NO: 1099164 - DNA, 22 bp, Artificial Sequence
  chemically synthesized
catcattcccatcattcccatc

SEQ ID NO: 1099165 - DNA, 22 bp, Artificial Sequence
  chemically synthesized
tctactgatgggaatgatggga

SEQ ID NO: 1099166 - DNA, 22 bp, Artificial Sequence
  chemically synthesized
cacgctacatcattcccatcat

SEQ ID NO: 1099167 - DNA, 22 bp, Artificial Sequence
  chemically synthesized
tactgatgggaatgatgggaat

SEQ ID NO: 1099168 - DNA, 22 bp, Artificial Sequence
  chemically synthesized
tccacgctacatcattcccatc

SEQ ID NO: 1099169 - DNA, 22 bp, Artificial Sequence
  chemically synthesized
ctgatgggaatgatgggaatga

SEQ ID NO: 1099170 - DNA, 22 bp, Artificial Sequence
  chemically synthesized
ctccacgctacatcattcccat

SEQ ID NO: 1099171 - DNA, 22 bp, Artificial Sequence
  chemically synthesized
atgggaatgatgggaatgatgt

SEQ ID NO: 1099172 - DNA, 22 bp, Artificial Sequence
  chemically synthesized
catcttctccacgctacatcat

SEQ ID NO: 1099173 - DNA, 22 bp, Artificial Sequence
  chemically synthesized
ctacatcttctccacgctacat

SEQ ID NO: 1099174 - DNA, 22 bp, Artificial Sequence
  chemically synthesized
cctcctacatcttctccacgct

SEQ ID NO: 1099175 - DNA, 22 bp, Artificial Sequence
  chemically synthesized
tacctcctacatcttctccacg

SEQ ID NO: 1099176 - DNA, 22 bp, Artificial Sequence
  chemically synthesized
atgaacagccctctacctccta

SEQ ID NO: 1099177 - DNA, 22 bp, Artificial Sequence
  chemically synthesized
taacagctaatgaacagccctc

SEQ ID NO: 1099178 - DNA, 22 bp, Artificial Sequence
  chemically synthesized
cacaaggacattgtaacagcta

SEQ ID NO: 1099179 - DNA, 22 bp, Artificial Sequence
  chemically synthesized
tgcacaaggacattgtaacagc

SEQ ID NO: 1099180 - DNA, 22 bp, Artificial Sequence
  chemically synthesized
tctctgcacaaggacattgtaa

SEQ ID NO: 1099181 - DNA, 22 bp, Artificial Sequence
  chemically synthesized
ttcattagctgttacaatgtcc

SEQ ID NO: 1099182 - DNA, 22 bp, Artificial Sequence
  chemically synthesized
gtctctgcacaaggacattgta

SEQ ID NO: 1099183 - DNA, 22 bp, Artificial Sequence
  chemically synthesized
attagctgttacaatgtccttg

SEQ ID NO: 1099184 - DNA, 22 bp, Artificial Sequence
  chemically synthesized
ccttgtctctgcacaaggacat

SEQ ID NO: 1099185 - DNA, 22 bp, Artificial Sequence
  chemically synthesized
cccttgtctctgcacaaggaca

SEQ ID NO: 1099186 - DNA, 22 bp, Artificial Sequence
  chemically synthesized
tcccttgtctctgcacaaggac

SEQ ID NO: 1099187 - DNA, 22 bp, Artificial Sequence
  chemically synthesized
gctgttacaatgtccttgtgca

SEQ ID NO: 1099188 - DNA, 22 bp, Artificial Sequence
  chemically synthesized
ttacaatgtccttgtgcagaga

SEQ ID NO: 1099189 - DNA, 22 bp, Artificial Sequence
  chemically synthesized
caatgtccttgtgcagagacaa

SEQ ID NO: 1099190 - DNA, 22 bp, Artificial Sequence
  chemically synthesized
gatccctttcccttgtctctgc

SEQ ID NO: 1099191 - DNA, 22 bp, Artificial Sequence
  chemically synthesized
cgtacctggatccctttccctt

SEQ ID NO: 1099192 - DNA, 22 bp, Artificial Sequence
  chemically synthesized
acgtacctggatccctttccct

SEQ ID NO: 1099193 - DNA, 22 bp, Artificial Sequence
  chemically synthesized
gtgcagagacaagggaaaggga

SEQ ID NO: 1099194 - DNA, 22 bp, Artificial Sequence
  chemically synthesized
tgcagagacaagggaaagggat

SEQ ID NO: 1099195 - DNA, 22 bp, Artificial Sequence
  chemically synthesized
cacttacgtacctggatccctt

SEQ ID NO: 1099196 - DNA, 22 bp, Artificial Sequence
  chemically synthesized
ccacttacgtacctggatccct

SEQ ID NO: 1099197 - DNA, 22 bp, Artificial Sequence
  chemically synthesized
tccacttacgtacctggatccc

SEQ ID NO: 1099198 - DNA, 22 bp, Artificial Sequence
  chemically synthesized
ttccacttacgtacctggatcc

SEQ ID NO: 1099199 - DNA, 22 bp, Artificial Sequence
  chemically synthesized
aggccagcttttccacttacgt

SEQ ID NO: 1099200 - DNA, 22 bp, Artificial Sequence
  chemically synthesized
tctaaggccagcttttccactt

SEQ ID NO: 1099201 - DNA, 22 bp, Artificial Sequence
  chemically synthesized
gtctaaggccagcttttccact

SEQ ID NO: 1099202 - DNA, 22 bp, Artificial Sequence
  chemically synthesized
tgtctaaggccagcttttccac

SEQ ID NO: 1099203 - DNA, 22 bp, Artificial Sequence
  chemically synthesized
ttgtctaaggccagcttttcca

SEQ ID NO: 1099204 - DNA, 22 bp, Artificial Sequence
  chemically synthesized
tgcttttgtctaaggccagctt

SEQ ID NO: 1099205 - DNA, 22 bp, Artificial Sequence
  chemically synthesized
tgtgcttttgtctaaggccagc

SEQ ID NO: 1099206 - DNA, 22 bp, Artificial Sequence
  chemically synthesized
ctgtgcttttgtctaaggccag

SEQ ID NO: 1099207 - DNA, 22 bp, Artificial Sequence
  chemically synthesized
tctgtgcttttgtctaaggcca

SEQ ID NO: 1099208 - DNA, 22 bp, Artificial Sequence
  chemically synthesized
catagatgaactttctgtgctt

SEQ ID NO: 1099209 - DNA, 22 bp, Artificial Sequence
  chemically synthesized
gccttagacaaaagcacagaaa

SEQ ID NO: 1099210 - DNA, 22 bp, Artificial Sequence
  chemically synthesized
acatagatgaactttctgtgct

SEQ ID NO: 1099211 - DNA, 22 bp, Artificial Sequence
  chemically synthesized
tttacatagatgaactttctgt

SEQ ID NO: 1099212 - DNA, 22 bp, Artificial Sequence
  chemically synthesized
gtttacatagatgaactttctg

SEQ ID NO: 1099213 - DNA, 22 bp, Artificial Sequence
  chemically synthesized
agacaaaagcacagaaagttca

SEQ ID NO: 1099214 - DNA, 22 bp, Artificial Sequence
  chemically synthesized
tgtttacatagatgaactttct

SEQ ID NO: 1099215 - DNA, 22 bp, Artificial Sequence
  chemically synthesized
gacaaaagcacagaaagttcat

SEQ ID NO: 1099216 - DNA, 22 bp, Artificial Sequence
  chemically synthesized
cctttgtttacatagatgaact

SEQ ID NO: 1099217 - DNA, 22 bp, Artificial Sequence
  chemically synthesized
ccctttgtttacatagatgaac

SEQ ID NO: 1099218 - DNA, 22 bp, Artificial Sequence
  chemically synthesized
tccctttgtttacatagatgaa

SEQ ID NO: 1099219 - DNA, 22 bp, Artificial Sequence
  chemically synthesized
ctttccctttgtttacatagat

SEQ ID NO: 1099220 - DNA, 22 bp, Artificial Sequence
  chemically synthesized
tactttccctttgtttacatag

SEQ ID NO: 1099221 - DNA, 22 bp, Artificial Sequence
  chemically synthesized
acagactctactttccctttgt

SEQ ID NO: 1099222 - DNA, 22 bp, Artificial Sequence
  chemically synthesized
atctatgtaaacaaagggaaag

SEQ ID NO: 1099223 - DNA, 22 bp, Artificial Sequence
  chemically synthesized
tgtaaacaaagggaaagtagag

SEQ ID NO: 1099224 - DNA, 22 bp, Artificial Sequence
  chemically synthesized
catataagctcacagactctac

SEQ ID NO: 1099225 - DNA, 22 bp, Artificial Sequence
  chemically synthesized
acctgcatataagctcacagac

SEQ ID NO: 1099226 - DNA, 22 bp, Artificial Sequence
  chemically synthesized
ccactgacctgcatataagctc

SEQ ID NO: 1099227 - DNA, 22 bp, Artificial Sequence
  chemically synthesized
cagtactcccactgacctgcat

SEQ ID NO: 1099228 - DNA, 22 bp, Artificial Sequence
  chemically synthesized
tgagcttatatgcaggtcagtg

SEQ ID NO: 1099229 - DNA, 22 bp, Artificial Sequence
  chemically synthesized
atatgcaggtcagtgggagtac

SEQ ID NO: 1099230 - DNA, 22 bp, Artificial Sequence
  chemically synthesized
tatgcaggtcagtgggagtact

SEQ ID NO: 1099231 - DNA, 22 bp, Artificial Sequence
  chemically synthesized
ccgagaaaatataagcaatcag

SEQ ID NO: 1099232 - DNA, 22 bp, Artificial Sequence
  chemically synthesized
caacttctattctgattgctta

SEQ ID NO: 1099233 - DNA, 22 bp, Artificial Sequence
  chemically synthesized
accgagaaaatataagcaatca

SEQ ID NO: 1099234 - DNA, 22 bp, Artificial Sequence
  chemically synthesized
taccgagaaaatataagcaatc

SEQ ID NO: 1099235 - DNA, 22 bp, Artificial Sequence
  chemically synthesized
ttttaccgagaaaatataagca

SEQ ID NO: 1099236 - DNA, 22 bp, Artificial Sequence
  chemically synthesized
gttttaccgagaaaatataagc

SEQ ID NO: 1099237 - DNA, 22 bp, Artificial Sequence
  chemically synthesized
ctattctgattgcttatatttt

SEQ ID NO: 1099238 - DNA, 22 bp, Artificial Sequence
  chemically synthesized
tattctgattgcttatattttc

SEQ ID NO: 1099239 - DNA, 22 bp, Artificial Sequence
  chemically synthesized
ttgttttaccgagaaaatataa

SEQ ID NO: 1099240 - DNA, 22 bp, Artificial Sequence
  chemically synthesized
cttgttttaccgagaaaatata

SEQ ID NO: 1099241 - DNA, 22 bp, Artificial Sequence
  chemically synthesized
ttctgattgcttatattttctc

SEQ ID NO: 1099242 - DNA, 22 bp, Artificial Sequence
  chemically synthesized
tgattgcttatattttctcggt

SEQ ID NO: 1099243 - DNA, 22 bp, Artificial Sequence
  chemically synthesized
gcttcttgttttaccgagaaaa

SEQ ID NO: 1099244 - DNA, 22 bp, Artificial Sequence
  chemically synthesized
attgcttatattttctcggtaa

SEQ ID NO: 1099245 - DNA, 22 bp, Artificial Sequence
  chemically synthesized
cttatattttctcggtaaaaca

SEQ ID NO: 1099246 - DNA, 22 bp, Artificial Sequence
  chemically synthesized
atattttctcggtaaaacaaga

SEQ ID NO: 1099247 - DNA, 22 bp, Artificial Sequence
  chemically synthesized
tattttctcggtaaaacaagaa

SEQ ID NO: 1099248 - DNA, 22 bp, Artificial Sequence
  chemically synthesized
caaaaaactagcttcttgtttt

SEQ ID NO: 1099249 - DNA, 22 bp, Artificial Sequence
  chemically synthesized
tgcaaaaaactagcttcttgtt

SEQ ID NO: 1099250 - DNA, 22 bp, Artificial Sequence
  chemically synthesized
ctgcaaaaaactagcttcttgt

SEQ ID NO: 1099251 - DNA, 22 bp, Artificial Sequence
  chemically synthesized
tctgcaaaaaactagcttcttg

SEQ ID NO: 1099252 - DNA, 22 bp, Artificial Sequence
  chemically synthesized
tctcggtaaaacaagaagctag

SEQ ID NO: 1099253 - DNA, 22 bp, Artificial Sequence
  chemically synthesized
ctcggtaaaacaagaagctagt

SEQ ID NO: 1099254 - DNA, 22 bp, Artificial Sequence
  chemically synthesized
tcggtaaaacaagaagctagtt

SEQ ID NO: 1099255 - DNA, 22 bp, Artificial Sequence
  chemically synthesized
ggtaaaacaagaagctagtttt

SEQ ID NO: 1099256 - DNA, 22 bp, Artificial Sequence
  chemically synthesized
catctttctgcaaaaaactagc

SEQ ID NO: 1099257 - DNA, 22 bp, Artificial Sequence
  chemically synthesized
ccatctttctgcaaaaaactag

SEQ ID NO: 1099258 - DNA, 22 bp, Artificial Sequence
  chemically synthesized
tccatctttctgcaaaaaacta

SEQ ID NO: 1099259 - DNA, 22 bp, Artificial Sequence
  chemically synthesized
ttccatctttctgcaaaaaact

SEQ ID NO: 1099260 - DNA, 22 bp, Artificial Sequence
  chemically synthesized
tttttccatctttctgcaaaaa

SEQ ID NO: 1099261 - DNA, 22 bp, Artificial Sequence
  chemically synthesized
acagtctgtttttccatctttc

SEQ ID NO: 1099262 - DNA, 22 bp, Artificial Sequence
  chemically synthesized
gttttttgcagaaagatggaaa

SEQ ID NO: 1099263 - DNA, 22 bp, Artificial Sequence
  chemically synthesized
taacagtctgtttttccatctt

SEQ ID NO: 1099264 - DNA, 22 bp, Artificial Sequence
  chemically synthesized
tttgcagaaagatggaaaaaca

SEQ ID NO: 1099265 - DNA, 22 bp, Artificial Sequence
  chemically synthesized
ttgcagaaagatggaaaaacag

SEQ ID NO: 1099266 - DNA, 22 bp, Artificial Sequence
  chemically synthesized
tgcagaaagatggaaaaacaga

SEQ ID NO: 1099267 - DNA, 22 bp, Artificial Sequence
  chemically synthesized
gcagaaagatggaaaaacagac

SEQ ID NO: 1099268 - DNA, 22 bp, Artificial Sequence
  chemically synthesized
cagaaagatggaaaaacagact

SEQ ID NO: 1099269 - DNA, 22 bp, Artificial Sequence
  chemically synthesized
gtcagatctctaacagtctgtt

SEQ ID NO: 1099270 - DNA, 22 bp, Artificial Sequence
  chemically synthesized
cgtcagatctctaacagtctgt

SEQ ID NO: 1099271 - DNA, 22 bp, Artificial Sequence
  chemically synthesized
tcgtcagatctctaacagtctg

SEQ ID NO: 1099272 - DNA, 22 bp, Artificial Sequence
  chemically synthesized
tttcgtcagatctctaacagtc

SEQ ID NO: 1099273 - DNA, 22 bp, Artificial Sequence
  chemically synthesized
ttagagatctgacgaaagagat

SEQ ID NO: 1099274 - DNA, 22 bp, Artificial Sequence
  chemically synthesized
gagatctgacgaaagagatctg

SEQ ID NO: 1099275 - DNA, 22 bp, Artificial Sequence
  chemically synthesized
ggtgtagtgatccccagatctc

SEQ ID NO: 1099276 - DNA, 22 bp, Artificial Sequence
  chemically synthesized
gggtgtagtgatccccagatct

SEQ ID NO: 1099277 - DNA, 22 bp, Artificial Sequence
  chemically synthesized
tgggtgtagtgatccccagatc

SEQ ID NO: 1099278 - DNA, 22 bp, Artificial Sequence
  chemically synthesized
tttgggtgtagtgatccccaga

SEQ ID NO: 1099279 - DNA, 22 bp, Artificial Sequence
  chemically synthesized
acgaaagagatctggggatcac

SEQ ID NO: 1099280 - DNA, 22 bp, Artificial Sequence
  chemically synthesized
ggtcagtatactctttgggtgt

SEQ ID NO: 1099281 - DNA, 22 bp, Artificial Sequence
  chemically synthesized
tgggtcagtatactctttgggt

SEQ ID NO: 1099282 - DNA, 22 bp, Artificial Sequence
  chemically synthesized
gggatcactacacccaaagagt

SEQ ID NO: 1099283 - DNA, 22 bp, Artificial Sequence
  chemically synthesized
tctgggtcagtatactctttgg

SEQ ID NO: 1099284 - DNA, 22 bp, Artificial Sequence
  chemically synthesized
ctctgggtcagtatactctttg

SEQ ID NO: 1099285 - DNA, 22 bp, Artificial Sequence
  chemically synthesized
tctctgggtcagtatactcttt

SEQ ID NO: 1099286 - DNA, 22 bp, Artificial Sequence
  chemically synthesized
tctttctctgggtcagtatact

SEQ ID NO: 1099287 - DNA, 22 bp, Artificial Sequence
  chemically synthesized
cacccaaagagtatactgaccc

SEQ ID NO: 1099288 - DNA, 22 bp, Artificial Sequence
  chemically synthesized
cagatcattgtctttctctggg

SEQ ID NO: 1099289 - DNA, 22 bp, Artificial Sequence
  chemically synthesized
gcagatcattgtctttctctgg

SEQ ID NO: 1099290 - DNA, 22 bp, Artificial Sequence
  chemically synthesized
ccagcttgcagatcattgtctt

SEQ ID NO: 1099291 - DNA, 22 bp, Artificial Sequence
  chemically synthesized
tgccagcttgcagatcattgtc

SEQ ID NO: 1099292 - DNA, 22 bp, Artificial Sequence
  chemically synthesized
acccagagaaagacaatgatct

SEQ ID NO: 1099293 - DNA, 22 bp, Artificial Sequence
  chemically synthesized
ctgccagcttgcagatcattgt

SEQ ID NO: 1099294 - DNA, 22 bp, Artificial Sequence
  chemically synthesized
tctgccagcttgcagatcattg

SEQ ID NO: 1099295 - DNA, 22 bp, Artificial Sequence
  chemically synthesized
cgtggatgtctttctgccagct

SEQ ID NO: 1099296 - DNA, 22 bp, Artificial Sequence
  chemically synthesized
gaggttacgtggatgtctttct

SEQ ID NO: 1099297 - DNA, 22 bp, Artificial Sequence
  chemically synthesized
agaggttacgtggatgtctttc

SEQ ID NO: 1099298 - DNA, 22 bp, Artificial Sequence
  chemically synthesized
caagctggcagaaagacatcca

SEQ ID NO: 1099299 - DNA, 22 bp, Artificial Sequence
  chemically synthesized
gcagaaagacatccacgtaacc

SEQ ID NO: 1099300 - DNA, 22 bp, Artificial Sequence
  chemically synthesized
tcaataaatgggatttagaggt

SEQ ID NO: 1099301 - DNA, 22 bp, Artificial Sequence
  chemically synthesized
tagtaaatagttatcaataaat

SEQ ID NO: 1099302 - DNA, 22 bp, Artificial Sequence
  chemically synthesized
atagtaaatagttatcaataaa

SEQ ID NO: 1099303 - DNA, 22 bp, Artificial Sequence
  chemically synthesized
taaatcccatttattgataact

SEQ ID NO: 1099304 - DNA, 22 bp, Artificial Sequence
  chemically synthesized
aatcccatttattgataactat

SEQ ID NO: 1099305 - DNA, 22 bp, Artificial Sequence
  chemically synthesized
aatttatagtaaatagttatca

SEQ ID NO: 1099306 - DNA, 22 bp, Artificial Sequence
  chemically synthesized
aaatttatagtaaatagttatc

SEQ ID NO: 1099307 - DNA, 22 bp, Artificial Sequence
  chemically synthesized
taaatttatagtaaatagttat

SEQ ID NO: 1099308 - DNA, 22 bp, Artificial Sequence
  chemically synthesized
gtggctttaaatttatagtaaa

SEQ ID NO: 1099309 - DNA, 22 bp, Artificial Sequence
  chemically synthesized
attgataactatttactataaa

SEQ ID NO: 1099310 - DNA, 22 bp, Artificial Sequence
  chemically synthesized
ttgataactatttactataaat

SEQ ID NO: 1099311 - DNA, 22 bp, Artificial Sequence
  chemically synthesized
ttagtggctttaaatttatagt

SEQ ID NO: 1099312 - DNA, 22 bp, Artificial Sequence
  chemically synthesized
ataactatttactataaattta

SEQ ID NO: 1099313 - DNA, 22 bp, Artificial Sequence
  chemically synthesized
attattagtggctttaaattta

SEQ ID NO: 1099314 - DNA, 22 bp, Artificial Sequence
  chemically synthesized
aattattagtggctttaaattt

SEQ ID NO: 1099315 - DNA, 22 bp, Artificial Sequence
  chemically synthesized
taattattagtggctttaaatt

SEQ ID NO: 1099316 - DNA, 22 bp, Artificial Sequence
  chemically synthesized
tttactataaatttaaagccac

SEQ ID NO: 1099317 - DNA, 22 bp, Artificial Sequence
  chemically synthesized
actataaatttaaagccactaa

SEQ ID NO: 1099318 - DNA, 22 bp, Artificial Sequence
  chemically synthesized
ctataaatttaaagccactaat

SEQ ID NO: 1099319 - DNA, 22 bp, Artificial Sequence
  chemically synthesized
tatattttaattattagtggct

SEQ ID NO: 1099320 - DNA, 22 bp, Artificial Sequence
  chemically synthesized
taaatttaaagccactaataat

SEQ ID NO: 1099321 - DNA, 22 bp, Artificial Sequence
  chemically synthesized
aaagccactaataattaaaata

SEQ ID NO: 1099322 - DNA, 22 bp, Artificial Sequence
  chemically synthesized
aagccactaataattaaaatat

SEQ ID NO: 1099323 - DNA, 22 bp, Artificial Sequence
  chemically synthesized
agtaaataatatatggttatat

SEQ ID NO: 1099324 - DNA, 22 bp, Artificial Sequence
  chemically synthesized
ataattaaaatatataaccata

SEQ ID NO: 1099325 - DNA, 22 bp, Artificial Sequence
  chemically synthesized
taagtaaataatatatggttat

SEQ ID NO: 1099326 - DNA, 22 bp, Artificial Sequence
  chemically synthesized
ctaagtaaataatatatggtta

SEQ ID NO: 1099327 - DNA, 22 bp, Artificial Sequence
  chemically synthesized
tctaagtaaataatatatggtt

SEQ ID NO: 1099328 - DNA, 22 bp, Artificial Sequence
  chemically synthesized
aaatatataaccatatattatt

SEQ ID NO: 1099329 - DNA, 22 bp, Artificial Sequence
  chemically synthesized
taaaacatgtatactttctaag

SEQ ID NO: 1099330 - DNA, 22 bp, Artificial Sequence
  chemically synthesized
tttacttagaaagtatacatgt

SEQ ID NO: 1099331 - DNA, 22 bp, Artificial Sequence
  chemically synthesized
acttagaaagtatacatgtttt

SEQ ID NO: 1099332 - DNA, 22 bp, Artificial Sequence
  chemically synthesized
cttagaaagtatacatgtttta

SEQ ID NO: 1099333 - DNA, 22 bp, Artificial Sequence
  chemically synthesized
catatatagaattataaaacat

SEQ ID NO: 1099334 - DNA, 22 bp, Artificial Sequence
  chemically synthesized
agaaagtatacatgttttataa

SEQ ID NO: 1099335 - DNA, 22 bp, Artificial Sequence
  chemically synthesized
gaaagtatacatgttttataat

SEQ ID NO: 1099336 - DNA, 22 bp, Artificial Sequence
  chemically synthesized
tataattctatatatgtaggtt

SEQ ID NO: 1099337 - DNA, 22 bp, Artificial Sequence
  chemically synthesized
ataattctatatatgtaggttt

SEQ ID NO: 1099338 - DNA, 22 bp, Artificial Sequence
  chemically synthesized
taattctatatatgtaggtttc

SEQ ID NO: 1099339 - DNA, 22 bp, Artificial Sequence
  chemically synthesized
gatagaaaacaaatagaaacct

SEQ ID NO: 1099340 - DNA, 22 bp, Artificial Sequence
  chemically synthesized
tatatatgtaggtttctatttg

SEQ ID NO: 1099341 - DNA, 22 bp, Artificial Sequence
  chemically synthesized
ttagatagaaaacaaatagaaa

SEQ ID NO: 1099342 - DNA, 22 bp, Artificial Sequence
  chemically synthesized
gttagatagaaaacaaatagaa

SEQ ID NO: 1099343 - DNA, 22 bp, Artificial Sequence
  chemically synthesized
tatatgtaggtttctatttgtt

SEQ ID NO: 1099344 - DNA, 22 bp, Artificial Sequence
  chemically synthesized
tacatgtttgttagatagaaaa

SEQ ID NO: 1099345 - DNA, 22 bp, Artificial Sequence
  chemically synthesized
ctatttgttttctatctaacaa

SEQ ID NO: 1099346 - DNA, 22 bp, Artificial Sequence
  chemically synthesized
tatttgttttctatctaacaaa

SEQ ID NO: 1099347 - DNA, 22 bp, Artificial Sequence
  chemically synthesized
atcactgtacatgtttgttaga

SEQ ID NO: 1099348 - DNA, 22 bp, Artificial Sequence
  chemically synthesized
tttgttttctatctaacaaaca

SEQ ID NO: 1099349 - DNA, 22 bp, Artificial Sequence
  chemically synthesized
gttttctatctaacaaacatgt

SEQ ID NO: 1099350 - DNA, 22 bp, Artificial Sequence
  chemically synthesized
ttttctatctaacaaacatgta

SEQ ID NO: 1099351 - DNA, 22 bp, Artificial Sequence
  chemically synthesized
gattaatcactgtacatgtttg

SEQ ID NO: 1099352 - DNA, 22 bp, Artificial Sequence
  chemically synthesized
tctatctaacaaacatgtacag

SEQ ID NO: 1099353 - DNA, 22 bp, Artificial Sequence
  chemically synthesized
ctatctaacaaacatgtacagt

SEQ ID NO: 1099354 - DNA, 22 bp, Artificial Sequence
  chemically synthesized
tatctaacaaacatgtacagtg

SEQ ID NO: 1099355 - DNA, 22 bp, Artificial Sequence
  chemically synthesized
acctagattaatcactgtacat

SEQ ID NO: 1099356 - DNA, 22 bp, Artificial Sequence
  chemically synthesized
tctaacaaacatgtacagtgat

SEQ ID NO: 1099357 - DNA, 22 bp, Artificial Sequence
  chemically synthesized
atctaacctagattaatcactg

SEQ ID NO: 1099358 - DNA, 22 bp, Artificial Sequence
  chemically synthesized
acaaacatgtacagtgattaat

SEQ ID NO: 1099359 - DNA, 22 bp, Artificial Sequence
  chemically synthesized
aaggtgtatagagcctcatcta

SEQ ID NO: 1099360 - DNA, 22 bp, Artificial Sequence
  chemically synthesized
caaggtgtatagagcctcatct

SEQ ID NO: 1099361 - DNA, 22 bp, Artificial Sequence
  chemically synthesized
tcaaggtgtatagagcctcatc

SEQ ID NO: 1099362 - DNA, 22 bp, Artificial Sequence
  chemically synthesized
ttcaaggtgtatagagcctcat

SEQ ID NO: 1099363 - DNA, 22 bp, Artificial Sequence
  chemically synthesized
atctaggttagatgaggctcta

SEQ ID NO: 1099364 - DNA, 22 bp, Artificial Sequence
  chemically synthesized
atcttttcaaggtgtatagagc

SEQ ID NO: 1099365 - DNA, 22 bp, Artificial Sequence
  chemically synthesized
ggttagatgaggctctatacac

SEQ ID NO: 1099366 - DNA, 22 bp, Artificial Sequence
  chemically synthesized
gatgaggctctatacaccttga

SEQ ID NO: 1099367 - DNA, 22 bp, Artificial Sequence
  chemically synthesized
aatgaattcatcttttcaaggt

SEQ ID NO: 1099368 - DNA, 22 bp, Artificial Sequence
  chemically synthesized
tatacaccttgaaaagatgaat

SEQ ID NO: 1099369 - DNA, 22 bp, Artificial Sequence
  chemically synthesized
tacaccttgaaaagatgaattc

SEQ ID NO: 1099370 - DNA, 22 bp, Artificial Sequence
  chemically synthesized
gaaaagatgaattcatttaatt

SEQ ID NO: 1099371 - DNA, 22 bp, Artificial Sequence
  chemically synthesized
aaaagatgaattcatttaatta

SEQ ID NO: 1099372 - DNA, 22 bp, Artificial Sequence
  chemically synthesized
ataagtatataataattaaatg

SEQ ID NO: 1099373 - DNA, 22 bp, Artificial Sequence
  chemically synthesized
atacataattcataagtatata

SEQ ID NO: 1099374 - DNA, 22 bp, Artificial Sequence
  chemically synthesized
atttaattattatatacttatg

SEQ ID NO: 1099375 - DNA, 22 bp, Artificial Sequence
  chemically synthesized
aattattatatacttatgaatt

SEQ ID NO: 1099376 - DNA, 22 bp, Artificial Sequence
  chemically synthesized
attattatatacttatgaatta

SEQ ID NO: 1099377 - DNA, 22 bp, Artificial Sequence
  chemically synthesized
ttatatacttatgaattatgta

SEQ ID NO: 1099378 - DNA, 22 bp, Artificial Sequence
  chemically synthesized
tatacttatgaattatgtatta

SEQ ID NO: 1099379 - DNA, 22 bp, Artificial Sequence
  chemically synthesized
aaatgtgatgatattaatacat

SEQ ID NO: 1099380 - DNA, 22 bp, Artificial Sequence
  chemically synthesized
aaaatgtgatgatattaataca

SEQ ID NO: 1099381 - DNA, 22 bp, Artificial Sequence
  chemically synthesized
taaaatgtgatgatattaatac

SEQ ID NO: 1099382 - DNA, 22 bp, Artificial Sequence
  chemically synthesized
atgaattatgtattaatatcat

SEQ ID NO: 1099383 - DNA, 22 bp, Artificial Sequence
  chemically synthesized
tgaattatgtattaatatcatc

SEQ ID NO: 1099384 - DNA, 22 bp, Artificial Sequence
  chemically synthesized
ccaatctttaaaatgtgatgat

SEQ ID NO: 1099385 - DNA, 22 bp, Artificial Sequence
  chemically synthesized
tgtattaatatcatcacatttt

SEQ ID NO: 1099386 - DNA, 22 bp, Artificial Sequence
  chemically synthesized
agtctcccaatctttaaaatgt

SEQ ID NO: 1099387 - DNA, 22 bp, Artificial Sequence
  chemically synthesized
gagtctcccaatctttaaaatg

SEQ ID NO: 1099388 - DNA, 22 bp, Artificial Sequence
  chemically synthesized
atatcatcacattttaaagatt

SEQ ID NO: 1099389 - DNA, 22 bp, Artificial Sequence
  chemically synthesized
tgcttgagtctcccaatcttta

SEQ ID NO: 1099390 - DNA, 22 bp, Artificial Sequence
  chemically synthesized
gtgcttgagtctcccaatcttt

SEQ ID NO: 1099391 - DNA, 22 bp, Artificial Sequence
  chemically synthesized
tgtgcttgagtctcccaatctt

SEQ ID NO: 1099392 - DNA, 22 bp, Artificial Sequence
  chemically synthesized
ttgtgcttgagtctcccaatct

SEQ ID NO: 1099393 - DNA, 22 bp, Artificial Sequence
  chemically synthesized
tttgtgcttgagtctcccaatc

SEQ ID NO: 1099394 - DNA, 22 bp, Artificial Sequence
  chemically synthesized
acctttttgtgcttgagtctcc

SEQ ID NO: 1099395 - DNA, 22 bp, Artificial Sequence
  chemically synthesized
aacctttttgtgcttgagtctc

SEQ ID NO: 1099396 - DNA, 22 bp, Artificial Sequence
  chemically synthesized
taaagattgggagactcaagca

SEQ ID NO: 1099397 - DNA, 22 bp, Artificial Sequence
  chemically synthesized
aaagattgggagactcaagcac

SEQ ID NO: 1099398 - DNA, 22 bp, Artificial Sequence
  chemically synthesized
tttaacctttttgtgcttgagt

SEQ ID NO: 1099399 - DNA, 22 bp, Artificial Sequence
  chemically synthesized
aagattgggagactcaagcaca

SEQ ID NO: 1099400 - DNA, 22 bp, Artificial Sequence
  chemically synthesized
ggagactcaagcacaaaaaggt

SEQ ID NO: 1099401 - DNA, 22 bp, Artificial Sequence
  chemically synthesized
gaaaagttgtttaacctttttg

SEQ ID NO: 1099402 - DNA, 22 bp, Artificial Sequence
  chemically synthesized
tagaaaagttgtttaacctttt

SEQ ID NO: 1099403 - DNA, 22 bp, Artificial Sequence
  chemically synthesized
aagcacaaaaaggttaaacaac

SEQ ID NO: 1099404 - DNA, 22 bp, Artificial Sequence
  chemically synthesized
tgtgattctagaaaagttgttt

SEQ ID NO: 1099405 - DNA, 22 bp, Artificial Sequence
  chemically synthesized
cctgtgtgattctagaaaagtt

SEQ ID NO: 1099406 - DNA, 22 bp, Artificial Sequence
  chemically synthesized
aacaacttttctagaatcacac

SEQ ID NO: 1099407 - DNA, 22 bp, Artificial Sequence
  chemically synthesized
tccacatcataaactgcctgtg

SEQ ID NO: 1099408 - DNA, 22 bp, Artificial Sequence
  chemically synthesized
ttctagaatcacacaggcagtt

SEQ ID NO: 1099409 - DNA, 22 bp, Artificial Sequence
  chemically synthesized
tctagaatcacacaggcagttt

SEQ ID NO: 1099410 - DNA, 22 bp, Artificial Sequence
  chemically synthesized
ctagaatcacacaggcagttta

SEQ ID NO: 1099411 - DNA, 22 bp, Artificial Sequence
  chemically synthesized
tagaatcacacaggcagtttat

SEQ ID NO: 1099412 - DNA, 22 bp, Artificial Sequence
  chemically synthesized
gaatcacacaggcagtttatga

SEQ ID NO: 1099413 - DNA, 22 bp, Artificial Sequence
  chemically synthesized
agtctatccacatcataaactg

SEQ ID NO: 1099414 - DNA, 22 bp, Artificial Sequence
  chemically synthesized
aagtctatccacatcataaact

SEQ ID NO: 1099415 - DNA, 22 bp, Artificial Sequence
  chemically synthesized
ggtttaagtctatccacatcat

SEQ ID NO: 1099416 - DNA, 22 bp, Artificial Sequence
  chemically synthesized
atgatgtggatagacttaaacc

SEQ ID NO: 1099417 - DNA, 22 bp, Artificial Sequence
  chemically synthesized
tgatgtggatagacttaaaccc

SEQ ID NO: 1099418 - DNA, 22 bp, Artificial Sequence
  chemically synthesized
agatcagatcgcctgggtttaa

SEQ ID NO: 1099419 - DNA, 22 bp, Artificial Sequence
  chemically synthesized
tgagatcagatcgcctgggttt

SEQ ID NO: 1099420 - DNA, 22 bp, Artificial Sequence
  chemically synthesized
aaacccaggcgatctgatctca

SEQ ID NO: 1099421 - DNA, 22 bp, Artificial Sequence
  chemically synthesized
aacccaggcgatctgatctcag

SEQ ID NO: 1099422 - DNA, 22 bp, Artificial Sequence
  chemically synthesized
atctcagagcttctggtcttac

SEQ ID NO: 1099423 - DNA, 22 bp, Artificial Sequence
  chemically synthesized
agagcttctggtcttacacact

SEQ ID NO: 1099424 - DNA, 22 bp, Artificial Sequence
  chemically synthesized
tggatggaaaggcacagtgtgt

SEQ ID NO: 1099425 - DNA, 22 bp, Artificial Sequence
  chemically synthesized
gtggatggaaaggcacagtgtg

SEQ ID NO: 1099426 - DNA, 22 bp, Artificial Sequence
  chemically synthesized
tgtggatggaaaggcacagtgt

SEQ ID NO: 1099427 - DNA, 22 bp, Artificial Sequence
  chemically synthesized
ttgtggatggaaaggcacagtg

SEQ ID NO: 1099428 - DNA, 22 bp, Artificial Sequence
  chemically synthesized
ctggtcttacacactgtgcctt

SEQ ID NO: 1099429 - DNA, 22 bp, Artificial Sequence
  chemically synthesized
tttgtggatggaaaggcacagt

SEQ ID NO: 1099430 - DNA, 22 bp, Artificial Sequence
  chemically synthesized
tggtcttacacactgtgccttt

SEQ ID NO: 1099431 - DNA, 22 bp, Artificial Sequence
  chemically synthesized
ttttgtggatggaaaggcacag

SEQ ID NO: 1099432 - DNA, 22 bp, Artificial Sequence
  chemically synthesized
tttttgtggatggaaaggcaca

SEQ ID NO: 1099433 - DNA, 22 bp, Artificial Sequence
  chemically synthesized
gtcttacacactgtgcctttcc

SEQ ID NO: 1099434 - DNA, 22 bp, Artificial Sequence
  chemically synthesized
acacactgtgcctttccatcca

SEQ ID NO: 1099435 - DNA, 22 bp, Artificial Sequence
  chemically synthesized
cacactgtgcctttccatccac

SEQ ID NO: 1099436 - DNA, 22 bp, Artificial Sequence
  chemically synthesized
gagaatattttttttgtggatg

SEQ ID NO: 1099437 - DNA, 22 bp, Artificial Sequence
  chemically synthesized
tgcctttccatccacaaaaaaa

SEQ ID NO: 1099438 - DNA, 22 bp, Artificial Sequence
  chemically synthesized
tccatccacaaaaaaaatattc

SEQ ID NO: 1099439 - DNA, 22 bp, Artificial Sequence
  chemically synthesized
ccatccacaaaaaaaatattct

SEQ ID NO: 1099440 - DNA, 22 bp, Artificial Sequence
  chemically synthesized
catccacaaaaaaaatattctc

SEQ ID NO: 1099441 - DNA, 22 bp, Artificial Sequence
  chemically synthesized
tccagtatttgaccgcgtgtgt

SEQ ID NO: 1099442 - DNA, 22 bp, Artificial Sequence
  chemically synthesized
cagtatttgaccgcgtgtgtct

SEQ ID NO: 1099443 - DNA, 22 bp, Artificial Sequence
  chemically synthesized
agtgaaataaaccagacacacg

SEQ ID NO: 1099444 - DNA, 22 bp, Artificial Sequence
  chemically synthesized
gaccgcgtgtgtctggtttatt

SEQ ID NO: 1099445 - DNA, 22 bp, Artificial Sequence
  chemically synthesized
accgcgtgtgtctggtttattt

SEQ ID NO: 1099446 - DNA, 22 bp, Artificial Sequence
  chemically synthesized
gaggatagtatgctaagtgaaa

SEQ ID NO: 1099447 - DNA, 22 bp, Artificial Sequence
  chemically synthesized
ggaggatagtatgctaagtgaa

SEQ ID NO: 1099448 - DNA, 22 bp, Artificial Sequence
  chemically synthesized
gtttatttcacttagcatacta

SEQ ID NO: 1099449 - DNA, 22 bp, Artificial Sequence
  chemically synthesized
atttcacttagcatactatcct

SEQ ID NO: 1099450 - DNA, 22 bp, Artificial Sequence
  chemically synthesized
tttcacttagcatactatcctc

SEQ ID NO: 1099451 - DNA, 22 bp, Artificial Sequence
  chemically synthesized
cacttagcatactatcctccaa

SEQ ID NO: 1099452 - DNA, 22 bp, Artificial Sequence
  chemically synthesized
acttagcatactatcctccaag

SEQ ID NO: 1099453 - DNA, 22 bp, Artificial Sequence
  chemically synthesized
agcatactatcctccaagttca

SEQ ID NO: 1099454 - DNA, 22 bp, Artificial Sequence
  chemically synthesized
cagcagcatagatgaacttgga

SEQ ID NO: 1099455 - DNA, 22 bp, Artificial Sequence
  chemically synthesized
gcatactatcctccaagttcat

SEQ ID NO: 1099456 - DNA, 22 bp, Artificial Sequence
  chemically synthesized
gcagcagcatagatgaacttgg

SEQ ID NO: 1099457 - DNA, 22 bp, Artificial Sequence
  chemically synthesized
catttgcagcagcatagatgaa

SEQ ID NO: 1099458 - DNA, 22 bp, Artificial Sequence
  chemically synthesized
ccatttgcagcagcatagatga

SEQ ID NO: 1099459 - DNA, 22 bp, Artificial Sequence
  chemically synthesized
tcctccaagttcatctatgctg

SEQ ID NO: 1099460 - DNA, 22 bp, Artificial Sequence
  chemically synthesized
ttccatttgcagcagcatagat

SEQ ID NO: 1099461 - DNA, 22 bp, Artificial Sequence
  chemically synthesized
caagttcatctatgctgctgca

SEQ ID NO: 1099462 - DNA, 22 bp, Artificial Sequence
  chemically synthesized
atctatgctgctgcaaatggaa

SEQ ID NO: 1099463 - DNA, 22 bp, Artificial Sequence
  chemically synthesized
aaaaagaaaattcttccatttg

SEQ ID NO: 1099464 - DNA, 22 bp, Artificial Sequence
  chemically synthesized
aaaaaagaaaattcttccattt

SEQ ID NO: 1099465 - DNA, 22 bp, Artificial Sequence
  chemically synthesized
taaaaaagaaaattcttccatt

SEQ ID NO: 1099466 - DNA, 22 bp, Artificial Sequence
  chemically synthesized
tgctgctgcaaatggaagaatt

SEQ ID NO: 1099467 - DNA, 22 bp, Artificial Sequence
  chemically synthesized
ctgcaaatggaagaattttctt

SEQ ID NO: 1099468 - DNA, 22 bp, Artificial Sequence
  chemically synthesized
tgtagctttaaaaaagaaaatt

SEQ ID NO: 1099469 - DNA, 22 bp, Artificial Sequence
  chemically synthesized
caaatggaagaattttcttttt

SEQ ID NO: 1099470 - DNA, 22 bp, Artificial Sequence
  chemically synthesized
tcttttttaaagctacataata

SEQ ID NO: 1099471 - DNA, 22 bp, Artificial Sequence
  chemically synthesized
cttttttaaagctacataatat

SEQ ID NO: 1099472 - DNA, 22 bp, Artificial Sequence
  chemically synthesized
ttttttaaagctacataatatt

SEQ ID NO: 1099473 - DNA, 22 bp, Artificial Sequence
  chemically synthesized
ttttaaagctacataatattcc

SEQ ID NO: 1099474 - DNA, 22 bp, Artificial Sequence
  chemically synthesized
tttaaagctacataatattccg

SEQ ID NO: 1099475 - DNA, 22 bp, Artificial Sequence
  chemically synthesized
ttaaagctacataatattccgt

SEQ ID NO: 1099476 - DNA, 22 bp, Artificial Sequence
  chemically synthesized
taaagctacataatattccgtt

SEQ ID NO: 1099477 - DNA, 22 bp, Artificial Sequence
  chemically synthesized
aaagctacataatattccgtta

SEQ ID NO: 1099478 - DNA, 22 bp, Artificial Sequence
  chemically synthesized
aagctacataatattccgttat

SEQ ID NO: 1099479 - DNA, 22 bp, Artificial Sequence
  chemically synthesized
cataatattccgttatatgcat

SEQ ID NO: 1099480 - DNA, 22 bp, Artificial Sequence
  chemically synthesized
cgttatatgcatataccatgtt

SEQ ID NO: 1099481 - DNA, 22 bp, Artificial Sequence
  chemically synthesized
tcaaataaataaaacatggtat

SEQ ID NO: 1099482 - DNA, 22 bp, Artificial Sequence
  chemically synthesized
tatgcatataccatgttttatt

SEQ ID NO: 1099483 - DNA, 22 bp, Artificial Sequence
  chemically synthesized
aatgtatattgtcaaataaata

SEQ ID NO: 1099484 - DNA, 22 bp, Artificial Sequence
  chemically synthesized
tatttatttgacaatatacatt

SEQ ID NO: 1099485 - DNA, 22 bp, Artificial Sequence
  chemically synthesized
atttatttgacaatatacattt

SEQ ID NO: 1099486 - DNA, 22 bp, Artificial Sequence
  chemically synthesized
tttatttgacaatatacattta

SEQ ID NO: 1099487 - DNA, 22 bp, Artificial Sequence
  chemically synthesized
atttgacaatatacatttagat

SEQ ID NO: 1099488 - DNA, 22 bp, Artificial Sequence
  chemically synthesized
tttgacaatatacatttagatt

SEQ ID NO: 1099489 - DNA, 22 bp, Artificial Sequence
  chemically synthesized
gacaatatacatttagattgtt

SEQ ID NO: 1099490 - DNA, 22 bp, Artificial Sequence
  chemically synthesized
acaatatacatttagattgttt

SEQ ID NO: 1099491 - DNA, 22 bp, Artificial Sequence
  chemically synthesized
caatagccaagacatggaaaca

SEQ ID NO: 1099492 - DNA, 22 bp, Artificial Sequence
  chemically synthesized
acaatagccaagacatggaaac

SEQ ID NO: 1099493 - DNA, 22 bp, Artificial Sequence
  chemically synthesized
agattgtttccatgtcttggct

SEQ ID NO: 1099494 - DNA, 22 bp, Artificial Sequence
  chemically synthesized
gattgtttccatgtcttggcta

SEQ ID NO: 1099495 - DNA, 22 bp, Artificial Sequence
  chemically synthesized
tttccatgtcttggctattgta

SEQ ID NO: 1099496 - DNA, 22 bp, Artificial Sequence
  chemically synthesized
cagcagcaatatttacaatagc

SEQ ID NO: 1099497 - DNA, 22 bp, Artificial Sequence
  chemically synthesized
acagcagcaatatttacaatag

SEQ ID NO: 1099498 - DNA, 22 bp, Artificial Sequence
  chemically synthesized
ccatgtcttggctattgtaaat

SEQ ID NO: 1099499 - DNA, 22 bp, Artificial Sequence
  chemically synthesized
catgtcttggctattgtaaata

SEQ ID NO: 1099500 - DNA, 22 bp, Artificial Sequence
  chemically synthesized
tgtttacagcagcaatatttac

SEQ ID NO: 1099501 - DNA, 22 bp, Artificial Sequence
  chemically synthesized
ggctattgtaaatattgctgct

SEQ ID NO: 1099502 - DNA, 22 bp, Artificial Sequence
  chemically synthesized
gctattgtaaatattgctgctg

SEQ ID NO: 1099503 - DNA, 22 bp, Artificial Sequence
  chemically synthesized
cacccctatgtttacagcagca

SEQ ID NO: 1099504 - DNA, 22 bp, Artificial Sequence
  chemically synthesized
ttgtaaatattgctgctgtaaa

SEQ ID NO: 1099505 - DNA, 22 bp, Artificial Sequence
  chemically synthesized
taaatattgctgctgtaaacat

SEQ ID NO: 1099506 - DNA, 22 bp, Artificial Sequence
  chemically synthesized
aaggaggtatctgcacccctat

SEQ ID NO: 1099507 - DNA, 22 bp, Artificial Sequence
  chemically synthesized
ctgctgtaaacataggggtgca

SEQ ID NO: 1099508 - DNA, 22 bp, Artificial Sequence
  chemically synthesized
ctgtaaacataggggtgcagat

SEQ ID NO: 1099509 - DNA, 22 bp, Artificial Sequence
  chemically synthesized
taaacataggggtgcagatacc

SEQ ID NO: 1099510 - DNA, 22 bp, Artificial Sequence
  chemically synthesized
cttgagatcctgattttatttc

SEQ ID NO: 1099511 - DNA, 22 bp, Artificial Sequence
  chemically synthesized
gagatcctgattttatttcctt

SEQ ID NO: 1099512 - DNA, 22 bp, Artificial Sequence
  chemically synthesized
gatatatatccaaaggaaataa

SEQ ID NO: 1099513 - DNA, 22 bp, Artificial Sequence
  chemically synthesized
agatcctgattttatttccttt

SEQ ID NO: 1099514 - DNA, 22 bp, Artificial Sequence
  chemically synthesized
tggatatatatccaaaggaaat

SEQ ID NO: 1099515 - DNA, 22 bp, Artificial Sequence
  chemically synthesized
ctggatatatatccaaaggaaa

SEQ ID NO: 1099516 - DNA, 22 bp, Artificial Sequence
  chemically synthesized
attttatttcctttggatatat

SEQ ID NO: 1099517 - DNA, 22 bp, Artificial Sequence
  chemically synthesized
tatttcctttggatatatatcc

SEQ ID NO: 1099518 - DNA, 22 bp, Artificial Sequence
  chemically synthesized
atttcctttggatatatatcca

SEQ ID NO: 1099519 - DNA, 22 bp, Artificial Sequence
  chemically synthesized
tttcctttggatatatatccag

SEQ ID NO: 1099520 - DNA, 22 bp, Artificial Sequence
  chemically synthesized
accaatcccgcttctggatata

SEQ ID NO: 1099521 - DNA, 22 bp, Artificial Sequence
  chemically synthesized
cctttggatatatatccagaag

SEQ ID NO: 1099522 - DNA, 22 bp, Artificial Sequence
  chemically synthesized
ctttggatatatatccagaagc

SEQ ID NO: 1099523 - DNA, 22 bp, Artificial Sequence
  chemically synthesized
attcaccaatcccgcttctgga

SEQ ID NO: 1099524 - DNA, 22 bp, Artificial Sequence
  chemically synthesized
gattcaccaatcccgcttctgg

SEQ ID NO: 1099525 - DNA, 22 bp, Artificial Sequence
  chemically synthesized
tggatatatatccagaagcggg

SEQ ID NO: 1099526 - DNA, 22 bp, Artificial Sequence
  chemically synthesized
ggatatatatccagaagcggga

SEQ ID NO: 1099527 - DNA, 22 bp, Artificial Sequence
  chemically synthesized
gatatatatccagaagcgggat

SEQ ID NO: 1099528 - DNA, 22 bp, Artificial Sequence
  chemically synthesized
ccatttgattcaccaatcccgc

SEQ ID NO: 1099529 - DNA, 22 bp, Artificial Sequence
  chemically synthesized
caaatagaattcccatttgatt

SEQ ID NO: 1099530 - DNA, 22 bp, Artificial Sequence
  chemically synthesized
gtgaatcaaatgggaattctat

SEQ ID NO: 1099531 - DNA, 22 bp, Artificial Sequence
  chemically synthesized
aaaaaattacaaatagaattcc

SEQ ID NO: 1099532 - DNA, 22 bp, Artificial Sequence
  chemically synthesized
ctcaaaaaattacaaatagaat

SEQ ID NO: 1099533 - DNA, 22 bp, Artificial Sequence
  chemically synthesized
gaggttcctcaaaaaattacaa

SEQ ID NO: 1099534 - DNA, 22 bp, Artificial Sequence
  chemically synthesized
ggaggttcctcaaaaaattaca

SEQ ID NO: 1099535 - DNA, 22 bp, Artificial Sequence
  chemically synthesized
tatttgtaattttttgaggaac

SEQ ID NO: 1099536 - DNA, 22 bp, Artificial Sequence
  chemically synthesized
tttgtaattttttgaggaacct

SEQ ID NO: 1099537 - DNA, 22 bp, Artificial Sequence
  chemically synthesized
ggagaacagtttggaggttcct

SEQ ID NO: 1099538 - DNA, 22 bp, Artificial Sequence
  chemically synthesized
gtaattttttgaggaacctcca

SEQ ID NO: 1099539 - DNA, 22 bp, Artificial Sequence
  chemically synthesized
gggagaacagtttggaggttcc

SEQ ID NO: 1099540 - DNA, 22 bp, Artificial Sequence
  chemically synthesized
taattttttgaggaacctccaa

SEQ ID NO: 1099541 - DNA, 22 bp, Artificial Sequence
  chemically synthesized
tttgaggaacctccaaactgtt

SEQ ID NO: 1099542 - DNA, 22 bp, Artificial Sequence
  chemically synthesized
ttgaggaacctccaaactgttc

SEQ ID NO: 1099543 - DNA, 22 bp, Artificial Sequence
  chemically synthesized
tgaggaacctccaaactgttct

SEQ ID NO: 1099544 - DNA, 22 bp, Artificial Sequence
  chemically synthesized
gaggaacctccaaactgttctc

SEQ ID NO: 1099545 - DNA, 22 bp, Artificial Sequence
  chemically synthesized
aggaacctccaaactgttctcc

SEQ ID NO: 1099546 - DNA, 22 bp, Artificial Sequence
  chemically synthesized
gtgcagccatttgggagaacag

SEQ ID NO: 1099547 - DNA, 22 bp, Artificial Sequence
  chemically synthesized
caaactgttctcccaaatggct

SEQ ID NO: 1099548 - DNA, 22 bp, Artificial Sequence
  chemically synthesized
gaatgtaaattggtgcagccat

SEQ ID NO: 1099549 - DNA, 22 bp, Artificial Sequence
  chemically synthesized
ttctcccaaatggctgcaccaa

SEQ ID NO: 1099550 - DNA, 22 bp, Artificial Sequence
  chemically synthesized
gttggaatgtaaattggtgcag

SEQ ID NO: 1099551 - DNA, 22 bp, Artificial Sequence
  chemically synthesized
tcccaaatggctgcaccaattt

SEQ ID NO: 1099552 - DNA, 22 bp, Artificial Sequence
  chemically synthesized
ccaaatggctgcaccaatttac

SEQ ID NO: 1099553 - DNA, 22 bp, Artificial Sequence
  chemically synthesized
tggtgttggttggaatgtaaat

SEQ ID NO: 1099554 - DNA, 22 bp, Artificial Sequence
  chemically synthesized
atggtgttggttggaatgtaaa

SEQ ID NO: 1099555 - DNA, 22 bp, Artificial Sequence
  chemically synthesized
tatggtgttggttggaatgtaa

SEQ ID NO: 1099556 - DNA, 22 bp, Artificial Sequence
  chemically synthesized
ttatggtgttggttggaatgta

SEQ ID NO: 1099557 - DNA, 22 bp, Artificial Sequence
  chemically synthesized
ttttatggtgttggttggaatg

SEQ ID NO: 1099558 - DNA, 22 bp, Artificial Sequence
  chemically synthesized
caccaatttacattccaaccaa

SEQ ID NO: 1099559 - DNA, 22 bp, Artificial Sequence
  chemically synthesized
acattccaaccaacaccataaa

SEQ ID NO: 1099560 - DNA, 22 bp, Artificial Sequence
  chemically synthesized
cattccaaccaacaccataaaa

SEQ ID NO: 1099561 - DNA, 22 bp, Artificial Sequence
  chemically synthesized
caaccaacaccataaaagaatt

SEQ ID NO: 1099562 - DNA, 22 bp, Artificial Sequence
  chemically synthesized
gcaagaatgtggagaaaaggga

SEQ ID NO: 1099563 - DNA, 22 bp, Artificial Sequence
  chemically synthesized
agtgttggcaagaatgtggaga

SEQ ID NO: 1099564 - DNA, 22 bp, Artificial Sequence
  chemically synthesized
ccttttctccacattcttgcca

SEQ ID NO: 1099565 - DNA, 22 bp, Artificial Sequence
  chemically synthesized
ttctccacattcttgccaacac

SEQ ID NO: 1099566 - DNA, 22 bp, Artificial Sequence
  chemically synthesized
tctccacattcttgccaacact

SEQ ID NO: 1099567 - DNA, 22 bp, Artificial Sequence
  chemically synthesized
ctccacattcttgccaacactt

SEQ ID NO: 1099568 - DNA, 22 bp, Artificial Sequence
  chemically synthesized
tccacattcttgccaacactta

SEQ ID NO: 1099569 - DNA, 22 bp, Artificial Sequence
  chemically synthesized
cacattcttgccaacacttagt

SEQ ID NO: 1099570 - DNA, 22 bp, Artificial Sequence
  chemically synthesized
ttgccaacacttagtatctttt

SEQ ID NO: 1099571 - DNA, 22 bp, Artificial Sequence
  chemically synthesized
gccaacacttagtatcttttgc

SEQ ID NO: 1099572 - DNA, 22 bp, Artificial Sequence
  chemically synthesized
ccaacacttagtatcttttgct

SEQ ID NO: 1099573 - DNA, 22 bp, Artificial Sequence
  chemically synthesized
tcagaacaaaacaaagcaaaag

SEQ ID NO: 1099574 - DNA, 22 bp, Artificial Sequence
  chemically synthesized
ttatcagaacaaaacaaagcaa

SEQ ID NO: 1099575 - DNA, 22 bp, Artificial Sequence
  chemically synthesized
agtatcttttgctttgttttgt

SEQ ID NO: 1099576 - DNA, 22 bp, Artificial Sequence
  chemically synthesized
gtatcttttgctttgttttgtt

SEQ ID NO: 1099577 - DNA, 22 bp, Artificial Sequence
  chemically synthesized
gggtggctattatcagaacaaa

SEQ ID NO: 1099578 - DNA, 22 bp, Artificial Sequence
  chemically synthesized
ttgctttgttttgttctgataa

SEQ ID NO: 1099579 - DNA, 22 bp, Artificial Sequence
  chemically synthesized
ttagggtggctattatcagaac

SEQ ID NO: 1099580 - DNA, 22 bp, Artificial Sequence
  chemically synthesized
tgctttgttttgttctgataat

SEQ ID NO: 1099581 - DNA, 22 bp, Artificial Sequence
  chemically synthesized
gctttgttttgttctgataata

SEQ ID NO: 1099582 - DNA, 22 bp, Artificial Sequence
  chemically synthesized
ctttgttttgttctgataatag

SEQ ID NO: 1099583 - DNA, 22 bp, Artificial Sequence
  chemically synthesized
tgttttgttctgataatagcca

SEQ ID NO: 1099584 - DNA, 22 bp, Artificial Sequence
  chemically synthesized
gttttgttctgataatagccac

SEQ ID NO: 1099585 - DNA, 22 bp, Artificial Sequence
  chemically synthesized
atacctgttagggtggctatta

SEQ ID NO: 1099586 - DNA, 22 bp, Artificial Sequence
  chemically synthesized
ttttgttctgataatagccacc

SEQ ID NO: 1099587 - DNA, 22 bp, Artificial Sequence
  chemically synthesized
catacctgttagggtggctatt

SEQ ID NO: 1099588 - DNA, 22 bp, Artificial Sequence
  chemically synthesized
ttcatacctgttagggtggcta

SEQ ID NO: 1099589 - DNA, 22 bp, Artificial Sequence
  chemically synthesized
tgttctgataatagccacccta

SEQ ID NO: 1099590 - DNA, 22 bp, Artificial Sequence
  chemically synthesized
gttctgataatagccaccctaa

SEQ ID NO: 1099591 - DNA, 22 bp, Artificial Sequence
  chemically synthesized
ttctgataatagccaccctaac

SEQ ID NO: 1099592 - DNA, 22 bp, Artificial Sequence
  chemically synthesized
tgataatagccaccctaacagg

SEQ ID NO: 1099593 - DNA, 22 bp, Artificial Sequence
  chemically synthesized
ataatagccaccctaacaggta

SEQ ID NO: 1099594 - DNA, 22 bp, Artificial Sequence
  chemically synthesized
aaagccacaagaacctcttcat

SEQ ID NO: 1099595 - DNA, 22 bp, Artificial Sequence
  chemically synthesized
acaggtatgaagaggttcttgt

SEQ ID NO: 1099596 - DNA, 22 bp, Artificial Sequence
  chemically synthesized
aaaaatgcagttaaaagccaca

SEQ ID NO: 1099597 - DNA, 22 bp, Artificial Sequence
  chemically synthesized
atcatctgaaaaatgcagttaa

SEQ ID NO: 1099598 - DNA, 22 bp, Artificial Sequence
  chemically synthesized
ttgtggcttttaactgcatttt

SEQ ID NO: 1099599 - DNA, 22 bp, Artificial Sequence
  chemically synthesized
gtggcttttaactgcatttttc

SEQ ID NO: 1099600 - DNA, 22 bp, Artificial Sequence
  chemically synthesized
tggcttttaactgcatttttca

SEQ ID NO: 1099601 - DNA, 22 bp, Artificial Sequence
  chemically synthesized
ttaactgcatttttcagatgat

SEQ ID NO: 1099602 - DNA, 22 bp, Artificial Sequence
  chemically synthesized
taactgcatttttcagatgatt

SEQ ID NO: 1099603 - DNA, 22 bp, Artificial Sequence
  chemically synthesized
aactgcatttttcagatgatta

SEQ ID NO: 1099604 - DNA, 22 bp, Artificial Sequence
  chemically synthesized
actgcatttttcagatgattag

SEQ ID NO: 1099605 - DNA, 22 bp, Artificial Sequence
  chemically synthesized
catttttcagatgattagtgat

SEQ ID NO: 1099606 - DNA, 22 bp, Artificial Sequence
  chemically synthesized
ttcagatgattagtgatgcacc

SEQ ID NO: 1099607 - DNA, 22 bp, Artificial Sequence
  chemically synthesized
tcagatgattagtgatgcacct

SEQ ID NO: 1099608 - DNA, 22 bp, Artificial Sequence
  chemically synthesized
cagatgattagtgatgcacctt

SEQ ID NO: 1099609 - DNA, 22 bp, Artificial Sequence
  chemically synthesized
agatgattagtgatgcaccttt

SEQ ID NO: 1099610 - DNA, 22 bp, Artificial Sequence
  chemically synthesized
gtgatgcaccttttcatatacc

SEQ ID NO: 1099611 - DNA, 22 bp, Artificial Sequence
  chemically synthesized
ttcatatacctgttggtcattt

SEQ ID NO: 1099612 - DNA, 22 bp, Artificial Sequence
  chemically synthesized
aagaatacgtagaaatgaccaa

SEQ ID NO: 1099613 - DNA, 22 bp, Artificial Sequence
  chemically synthesized
tcatatacctgttggtcatttc

SEQ ID NO: 1099614 - DNA, 22 bp, Artificial Sequence
  chemically synthesized
catatacctgttggtcatttct

SEQ ID NO: 1099615 - DNA, 22 bp, Artificial Sequence
  chemically synthesized
taaagaatacgtagaaatgacc

SEQ ID NO: 1099616 - DNA, 22 bp, Artificial Sequence
  chemically synthesized
atatacctgttggtcatttcta

SEQ ID NO: 1099617 - DNA, 22 bp, Artificial Sequence
  chemically synthesized
tctaaagaatacgtagaaatga

SEQ ID NO: 1099618 - DNA, 22 bp, Artificial Sequence
  chemically synthesized
ctctaaagaatacgtagaaatg

SEQ ID NO: 1099619 - DNA, 22 bp, Artificial Sequence
  chemically synthesized
ttggtcatttctacgtattctt

SEQ ID NO: 1099620 - DNA, 22 bp, Artificial Sequence
  chemically synthesized
gtcatttctacgtattctttag

SEQ ID NO: 1099621 - DNA, 22 bp, Artificial Sequence
  chemically synthesized
aatagtcatttctctaaagaat

SEQ ID NO: 1099622 - DNA, 22 bp, Artificial Sequence
  chemically synthesized
gaatagtcatttctctaaagaa

SEQ ID NO: 1099623 - DNA, 22 bp, Artificial Sequence
  chemically synthesized
ctacgtattctttagagaaatg

SEQ ID NO: 1099624 - DNA, 22 bp, Artificial Sequence
  chemically synthesized
tacgtattctttagagaaatga

SEQ ID NO: 1099625 - DNA, 22 bp, Artificial Sequence
  chemically synthesized
cgtattctttagagaaatgact

SEQ ID NO: 1099626 - DNA, 22 bp, Artificial Sequence
  chemically synthesized
tttagagaaatgactattcaag

SEQ ID NO: 1099627 - DNA, 22 bp, Artificial Sequence
  chemically synthesized
tagagaaatgactattcaagtc

SEQ ID NO: 1099628 - DNA, 22 bp, Artificial Sequence
  chemically synthesized
agagaaatgactattcaagtcc

SEQ ID NO: 1099629 - DNA, 22 bp, Artificial Sequence
  chemically synthesized
aaaatgagcacaggacttgaat

SEQ ID NO: 1099630 - DNA, 22 bp, Artificial Sequence
  chemically synthesized
gagaaatgactattcaagtcct

SEQ ID NO: 1099631 - DNA, 22 bp, Artificial Sequence
  chemically synthesized
attaaaaatgagcacaggactt

SEQ ID NO: 1099632 - DNA, 22 bp, Artificial Sequence
  chemically synthesized
ttcaagtcctgtgctcattttt

SEQ ID NO: 1099633 - DNA, 22 bp, Artificial Sequence
  chemically synthesized
aagtcctgtgctcatttttaat

SEQ ID NO: 1099634 - DNA, 22 bp, Artificial Sequence
  chemically synthesized
aaaaataacctgattaaaaatg

SEQ ID NO: 1099635 - DNA, 22 bp, Artificial Sequence
  chemically synthesized
tgctcatttttaatcaggttat

SEQ ID NO: 1099636 - DNA, 22 bp, Artificial Sequence
  chemically synthesized
atttttaatcaggttatttttc

SEQ ID NO: 1099637 - DNA, 22 bp, Artificial Sequence
  chemically synthesized
ttaatcaggttatttttcagtt

SEQ ID NO: 1099638 - DNA, 22 bp, Artificial Sequence
  chemically synthesized
taatcaggttatttttcagttt

SEQ ID NO: 1099639 - DNA, 22 bp, Artificial Sequence
  chemically synthesized
aatcaggttatttttcagtttt

SEQ ID NO: 1099640 - DNA, 22 bp, Artificial Sequence
  chemically synthesized
aatagcaaaaataaaactgaaa

SEQ ID NO: 1099641 - DNA, 22 bp, Artificial Sequence
  chemically synthesized
atcaggttatttttcagtttta

SEQ ID NO: 1099642 - DNA, 22 bp, Artificial Sequence
  chemically synthesized
aaattcaatagcaaaaataaaa

SEQ ID NO: 1099643 - DNA, 22 bp, Artificial Sequence
  chemically synthesized
taaaattcaatagcaaaaataa

SEQ ID NO: 1099644 - DNA, 22 bp, Artificial Sequence
  chemically synthesized
ctaaaattcaatagcaaaaata

SEQ ID NO: 1099645 - DNA, 22 bp, Artificial Sequence
  chemically synthesized
tttttcagttttatttttgcta

SEQ ID NO: 1099646 - DNA, 22 bp, Artificial Sequence
  chemically synthesized
ttcagttttatttttgctattg

SEQ ID NO: 1099647 - DNA, 22 bp, Artificial Sequence
  chemically synthesized
tcagttttatttttgctattga

SEQ ID NO: 1099648 - DNA, 22 bp, Artificial Sequence
  chemically synthesized
cagttttatttttgctattgaa

SEQ ID NO: 1099649 - DNA, 22 bp, Artificial Sequence
  chemically synthesized
agttttatttttgctattgaat

SEQ ID NO: 1099650 - DNA, 22 bp, Artificial Sequence
  chemically synthesized
tatttttgctattgaattttag

SEQ ID NO: 1099651 - DNA, 22 bp, Artificial Sequence
  chemically synthesized
atttttgctattgaattttaga

SEQ ID NO: 1099652 - DNA, 22 bp, Artificial Sequence
  chemically synthesized
tttttgctattgaattttagaa

SEQ ID NO: 1099653 - DNA, 22 bp, Artificial Sequence
  chemically synthesized
ttgctattgaattttagaagtt

SEQ ID NO: 1099654 - DNA, 22 bp, Artificial Sequence
  chemically synthesized
tgctattgaattttagaagttc

SEQ ID NO: 1099655 - DNA, 22 bp, Artificial Sequence
  chemically synthesized
gctattgaattttagaagttcc

SEQ ID NO: 1099656 - DNA, 22 bp, Artificial Sequence
  chemically synthesized
ctattgaattttagaagttcct

SEQ ID NO: 1099657 - DNA, 22 bp, Artificial Sequence
  chemically synthesized
ttgaattttagaagttccttat

SEQ ID NO: 1099658 - DNA, 22 bp, Artificial Sequence
  chemically synthesized
atatccaaaatatataaggaac

SEQ ID NO: 1099659 - DNA, 22 bp, Artificial Sequence
  chemically synthesized
aattttagaagttccttatata

SEQ ID NO: 1099660 - DNA, 22 bp, Artificial Sequence
  chemically synthesized
tagaagttccttatatattttg

SEQ ID NO: 1099661 - DNA, 22 bp, Artificial Sequence
  chemically synthesized
agaagttccttatatattttgg

SEQ ID NO: 1099662 - DNA, 22 bp, Artificial Sequence
  chemically synthesized
gaagttccttatatattttgga

SEQ ID NO: 1099663 - DNA, 22 bp, Artificial Sequence
  chemically synthesized
gcaaatgattaatatccaaaat

SEQ ID NO: 1099664 - DNA, 22 bp, Artificial Sequence
  chemically synthesized
cttatatattttggatattaat

SEQ ID NO: 1099665 - DNA, 22 bp, Artificial Sequence
  chemically synthesized
atatattttggatattaatcat

SEQ ID NO: 1099666 - DNA, 22 bp, Artificial Sequence
  chemically synthesized
tatattttggatattaatcatt

SEQ ID NO: 1099667 - DNA, 22 bp, Artificial Sequence
  chemically synthesized
tggatattaatcatttgccaga

SEQ ID NO: 1099668 - DNA, 22 bp, Artificial Sequence
  chemically synthesized
acaaatcatatgtctggcaaat

SEQ ID NO: 1099669 - DNA, 22 bp, Artificial Sequence
  chemically synthesized
ggatattaatcatttgccagac

SEQ ID NO: 1099670 - DNA, 22 bp, Artificial Sequence
  chemically synthesized
gatattaatcatttgccagaca

SEQ ID NO: 1099671 - DNA, 22 bp, Artificial Sequence
  chemically synthesized
atcatttgccagacatatgatt

SEQ ID NO: 1099672 - DNA, 22 bp, Artificial Sequence
  chemically synthesized
gccagacatatgatttgtgaat

SEQ ID NO: 1099673 - DNA, 22 bp, Artificial Sequence
  chemically synthesized
ccagacatatgatttgtgaata

SEQ ID NO: 1099674 - DNA, 22 bp, Artificial Sequence
  chemically synthesized
gggaatggaaggaaatattcac

SEQ ID NO: 1099675 - DNA, 22 bp, Artificial Sequence
  chemically synthesized
tagggaatggaaggaaatattc

SEQ ID NO: 1099676 - DNA, 22 bp, Artificial Sequence
  chemically synthesized
gattctagggaatggaaggaaa

SEQ ID NO: 1099677 - DNA, 22 bp, Artificial Sequence
  chemically synthesized
agattctagggaatggaaggaa

SEQ ID NO: 1099678 - DNA, 22 bp, Artificial Sequence
  chemically synthesized
tagattctagggaatggaagga

SEQ ID NO: 1099679 - DNA, 22 bp, Artificial Sequence
  chemically synthesized
gtgaatatttccttccattccc

SEQ ID NO: 1099680 - DNA, 22 bp, Artificial Sequence
  chemically synthesized
ttttagattctagggaatggaa

SEQ ID NO: 1099681 - DNA, 22 bp, Artificial Sequence
  chemically synthesized
tgaatatttccttccattccct

SEQ ID NO: 1099682 - DNA, 22 bp, Artificial Sequence
  chemically synthesized
actattttagattctagggaat

SEQ ID NO: 1099683 - DNA, 22 bp, Artificial Sequence
  chemically synthesized
gactattttagattctagggaa

SEQ ID NO: 1099684 - DNA, 22 bp, Artificial Sequence
  chemically synthesized
ccttccattccctagaatctaa

SEQ ID NO: 1099685 - DNA, 22 bp, Artificial Sequence
  chemically synthesized
cttccattccctagaatctaaa

SEQ ID NO: 1099686 - DNA, 22 bp, Artificial Sequence
  chemically synthesized
tgagtttgactattttagattc

SEQ ID NO: 1099687 - DNA, 22 bp, Artificial Sequence
  chemically synthesized
ccattccctagaatctaaaata

SEQ ID NO: 1099688 - DNA, 22 bp, Artificial Sequence
  chemically synthesized
tgtgagtttgactattttagat

SEQ ID NO: 1099689 - DNA, 22 bp, Artificial Sequence
  chemically synthesized
cattccctagaatctaaaatag

SEQ ID NO: 1099690 - DNA, 22 bp, Artificial Sequence
  chemically synthesized
gttctgtgagtttgactatttt

SEQ ID NO: 1099691 - DNA, 22 bp, Artificial Sequence
  chemically synthesized
cctagaatctaaaatagtcaaa

SEQ ID NO: 1099692 - DNA, 22 bp, Artificial Sequence
  chemically synthesized
tagttctgtgagtttgactatt

SEQ ID NO: 1099693 - DNA, 22 bp, Artificial Sequence
  chemically synthesized
tctagttctgtgagtttgacta

SEQ ID NO: 1099694 - DNA, 22 bp, Artificial Sequence
  chemically synthesized
gaatctaaaatagtcaaactca

SEQ ID NO: 1099695 - DNA, 22 bp, Artificial Sequence
  chemically synthesized
ctctctagttctgtgagtttga

SEQ ID NO: 1099696 - DNA, 22 bp, Artificial Sequence
  chemically synthesized
tactctctagttctgtgagttt

SEQ ID NO: 1099697 - DNA, 22 bp, Artificial Sequence
  chemically synthesized
ttctactctctagttctgtgag

SEQ ID NO: 1099698 - DNA, 22 bp, Artificial Sequence
  chemically synthesized
aaatagtcaaactcacagaact

SEQ ID NO: 1099699 - DNA, 22 bp, Artificial Sequence
  chemically synthesized
gaaaccactattctactctcta

SEQ ID NO: 1099700 - DNA, 22 bp, Artificial Sequence
  chemically synthesized
ggaaaccactattctactctct

SEQ ID NO: 1099701 - DNA, 22 bp, Artificial Sequence
  chemically synthesized
tggaaaccactattctactctc

SEQ ID NO: 1099702 - DNA, 22 bp, Artificial Sequence
  chemically synthesized
acagaactagagagtagaatag

SEQ ID NO: 1099703 - DNA, 22 bp, Artificial Sequence
  chemically synthesized
agcctttggaaaccactattct

SEQ ID NO: 1099704 - DNA, 22 bp, Artificial Sequence
  chemically synthesized
tcagcctttggaaaccactatt

SEQ ID NO: 1099705 - DNA, 22 bp, Artificial Sequence
  chemically synthesized
tctcagcctttggaaaccacta

SEQ ID NO: 1099706 - DNA, 22 bp, Artificial Sequence
  chemically synthesized
gagagtagaatagtggtttcca

SEQ ID NO: 1099707 - DNA, 22 bp, Artificial Sequence
  chemically synthesized
ccctctctcagcctttggaaac

SEQ ID NO: 1099708 - DNA, 22 bp, Artificial Sequence
  chemically synthesized
cccctctctcagcctttggaaa

SEQ ID NO: 1099709 - DNA, 22 bp, Artificial Sequence
  chemically synthesized
tcccctctctcagcctttggaa

SEQ ID NO: 1099710 - DNA, 22 bp, Artificial Sequence
  chemically synthesized
ccattttcccctctctcagcct

SEQ ID NO: 1099711 - DNA, 22 bp, Artificial Sequence
  chemically synthesized
gccattttcccctctctcagcc

SEQ ID NO: 1099712 - DNA, 22 bp, Artificial Sequence
  chemically synthesized
tgccattttcccctctctcagc

SEQ ID NO: 1099713 - DNA, 22 bp, Artificial Sequence
  chemically synthesized
ccaaaggctgagagaggggaaa

SEQ ID NO: 1099714 - DNA, 22 bp, Artificial Sequence
  chemically synthesized
caaaggctgagagaggggaaaa

SEQ ID NO: 1099715 - DNA, 22 bp, Artificial Sequence
  chemically synthesized
ggcatcattttgccattttccc

SEQ ID NO: 1099716 - DNA, 22 bp, Artificial Sequence
  chemically synthesized
gggcatcattttgccattttcc

SEQ ID NO: 1099717 - DNA, 22 bp, Artificial Sequence
  chemically synthesized
tgggcatcattttgccattttc

SEQ ID NO: 1099718 - DNA, 22 bp, Artificial Sequence
  chemically synthesized
agagaggggaaaatggcaaaat

SEQ ID NO: 1099719 - DNA, 22 bp, Artificial Sequence
  chemically synthesized
tatcctttgggcatcattttgc

SEQ ID NO: 1099720 - DNA, 22 bp, Artificial Sequence
  chemically synthesized
gtatcctttgggcatcattttg

SEQ ID NO: 1099721 - DNA, 22 bp, Artificial Sequence
  chemically synthesized
tgtatcctttgggcatcatttt

SEQ ID NO: 1099722 - DNA, 22 bp, Artificial Sequence
  chemically synthesized
aagctttgtatcctttgggcat

SEQ ID NO: 1099723 - DNA, 22 bp, Artificial Sequence
  chemically synthesized
cataactgaagctttgtatcct

SEQ ID NO: 1099724 - DNA, 22 bp, Artificial Sequence
  chemically synthesized
gcataactgaagctttgtatcc

SEQ ID NO: 1099725 - DNA, 22 bp, Artificial Sequence
  chemically synthesized
atcttgcataactgaagctttg

SEQ ID NO: 1099726 - DNA, 22 bp, Artificial Sequence
  chemically synthesized
attcatcttgcataactgaagc

SEQ ID NO: 1099727 - DNA, 22 bp, Artificial Sequence
  chemically synthesized
cagagctaattcatcttgcata

SEQ ID NO: 1099728 - DNA, 22 bp, Artificial Sequence
  chemically synthesized
cagttatgcaagatgaattagc

SEQ ID NO: 1099729 - DNA, 22 bp, Artificial Sequence
  chemically synthesized
agttatgcaagatgaattagct

SEQ ID NO: 1099730 - DNA, 22 bp, Artificial Sequence
  chemically synthesized
tacagtagatctgcagagctaa

SEQ ID NO: 1099731 - DNA, 22 bp, Artificial Sequence
  chemically synthesized
tgcaagatgaattagctctgca

SEQ ID NO: 1099732 - DNA, 22 bp, Artificial Sequence
  chemically synthesized
taggcccaatgttgtacagtag

SEQ ID NO: 1099733 - DNA, 22 bp, Artificial Sequence
  chemically synthesized
gctctgcagatctactgtacaa

SEQ ID NO: 1099734 - DNA, 22 bp, Artificial Sequence
  chemically synthesized
actataggcccaatgttgtaca

SEQ ID NO: 1099735 - DNA, 22 bp, Artificial Sequence
  chemically synthesized
tgcagatctactgtacaacatt

SEQ ID NO: 1099736 - DNA, 22 bp, Artificial Sequence
  chemically synthesized
aactataggcccaatgttgtac

SEQ ID NO: 1099737 - DNA, 22 bp, Artificial Sequence
  chemically synthesized
taactataggcccaatgttgta

SEQ ID NO: 1099738 - DNA, 22 bp, Artificial Sequence
  chemically synthesized
cagatctactgtacaacattgg

SEQ ID NO: 1099739 - DNA, 22 bp, Artificial Sequence
  chemically synthesized
ttaactataggcccaatgttgt

SEQ ID NO: 1099740 - DNA, 22 bp, Artificial Sequence
  chemically synthesized
ctgtacaacattgggcctatag

SEQ ID NO: 1099741 - DNA, 22 bp, Artificial Sequence
  chemically synthesized
tacaacattgggcctatagtta

SEQ ID NO: 1099742 - DNA, 22 bp, Artificial Sequence
  chemically synthesized
acaatacagtatttttaactat

SEQ ID NO: 1099743 - DNA, 22 bp, Artificial Sequence
  chemically synthesized
aacaatacagtatttttaacta

SEQ ID NO: 1099744 - DNA, 22 bp, Artificial Sequence
  chemically synthesized
taacaatacagtatttttaact

SEQ ID NO: 1099745 - DNA, 22 bp, Artificial Sequence
  chemically synthesized
ttaacaatacagtatttttaac

SEQ ID NO: 1099746 - DNA, 22 bp, Artificial Sequence
  chemically synthesized
ggcctatagttaaaaatactgt

SEQ ID NO: 1099747 - DNA, 22 bp, Artificial Sequence
  chemically synthesized
gaatatttttaacaatacagta

SEQ ID NO: 1099748 - DNA, 22 bp, Artificial Sequence
  chemically synthesized
ggaatatttttaacaatacagt

SEQ ID NO: 1099749 - DNA, 22 bp, Artificial Sequence
  chemically synthesized
tagttaaaaatactgtattgtt

SEQ ID NO: 1099750 - DNA, 22 bp, Artificial Sequence
  chemically synthesized
ttggaatatttttaacaataca

SEQ ID NO: 1099751 - DNA, 22 bp, Artificial Sequence
  chemically synthesized
aaaatactgtattgttaaaaat

SEQ ID NO: 1099752 - DNA, 22 bp, Artificial Sequence
  chemically synthesized
tcctcttggaatatttttaaca

SEQ ID NO: 1099753 - DNA, 22 bp, Artificial Sequence
  chemically synthesized
agatctatcctcttggaatatt

SEQ ID NO: 1099754 - DNA, 22 bp, Artificial Sequence
  chemically synthesized
tattgttaaaaatattccaaga

SEQ ID NO: 1099755 - DNA, 22 bp, Artificial Sequence
  chemically synthesized
ctaagatctatcctcttggaat

SEQ ID NO: 1099756 - DNA, 22 bp, Artificial Sequence
  chemically synthesized
ttaaaaatattccaagaggata

SEQ ID NO: 1099757 - DNA, 22 bp, Artificial Sequence
  chemically synthesized
aaaatattccaagaggatagat

SEQ ID NO: 1099758 - DNA, 22 bp, Artificial Sequence
  chemically synthesized
tgataagagctcctaagatcta

SEQ ID NO: 1099759 - DNA, 22 bp, Artificial Sequence
  chemically synthesized
gtgataagagctcctaagatct

SEQ ID NO: 1099760 - DNA, 22 bp, Artificial Sequence
  chemically synthesized
tgtgataagagctcctaagatc

SEQ ID NO: 1099761 - DNA, 22 bp, Artificial Sequence
  chemically synthesized
caagaggatagatcttaggagc

SEQ ID NO: 1099762 - DNA, 22 bp, Artificial Sequence
  chemically synthesized
ttttgtgataagagctcctaag

SEQ ID NO: 1099763 - DNA, 22 bp, Artificial Sequence
  chemically synthesized
gttttgtgataagagctcctaa

SEQ ID NO: 1099764 - DNA, 22 bp, Artificial Sequence
  chemically synthesized
tgttttgtgataagagctccta

SEQ ID NO: 1099765 - DNA, 22 bp, Artificial Sequence
  chemically synthesized
ttgttttgtgataagagctcct

SEQ ID NO: 1099766 - DNA, 22 bp, Artificial Sequence
  chemically synthesized
tttgttttgtgataagagctcc

SEQ ID NO: 1099767 - DNA, 22 bp, Artificial Sequence
  chemically synthesized
ttttgttttgtgataagagctc

SEQ ID NO: 1099768 - DNA, 22 bp, Artificial Sequence
  chemically synthesized
tttttgttttgtgataagagct

SEQ ID NO: 1099769 - DNA, 22 bp, Artificial Sequence
  chemically synthesized
ttttttttgttttgtgataaga

SEQ ID NO: 1099770 - DNA, 22 bp, Artificial Sequence
  chemically synthesized
attttttttgttttgtgataag

SEQ ID NO: 1099771 - DNA, 22 bp, Artificial Sequence
  chemically synthesized
tttattttttttgttttgtgat

SEQ ID NO: 1099772 - DNA, 22 bp, Artificial Sequence
  chemically synthesized
atttattttttttgttttgtga

SEQ ID NO: 1099773 - DNA, 22 bp, Artificial Sequence
  chemically synthesized
aggagctcttatcacaaaacaa

SEQ ID NO: 1099774 - DNA, 22 bp, Artificial Sequence
  chemically synthesized
ggagctcttatcacaaaacaaa

SEQ ID NO: 1099775 - DNA, 22 bp, Artificial Sequence
  chemically synthesized
atttatttattttttttgtttt

SEQ ID NO: 1099776 - DNA, 22 bp, Artificial Sequence
  chemically synthesized
aatttatttattttttttgttt

SEQ ID NO: 1099777 - DNA, 22 bp, Artificial Sequence
  chemically synthesized
ttatcacaaaacaaaaaaaata

SEQ ID NO: 1099778 - DNA, 22 bp, Artificial Sequence
  chemically synthesized
atcacaaaacaaaaaaaataaa

SEQ ID NO: 1099779 - DNA, 22 bp, Artificial Sequence
  chemically synthesized
ccccttaatttatttatttttt

SEQ ID NO: 1099780 - DNA, 22 bp, Artificial Sequence
  chemically synthesized
tcacaaaacaaaaaaaataaat

SEQ ID NO: 1099781 - DNA, 22 bp, Artificial Sequence
  chemically synthesized
tgccccttaatttatttatttt

SEQ ID NO: 1099782 - DNA, 22 bp, Artificial Sequence
  chemically synthesized
ctgccccttaatttatttattt

SEQ ID NO: 1099783 - DNA, 22 bp, Artificial Sequence
  chemically synthesized
cttctgccccttaatttattta

SEQ ID NO: 1099784 - DNA, 22 bp, Artificial Sequence
  chemically synthesized
ccttctgccccttaatttattt

SEQ ID NO: 1099785 - DNA, 22 bp, Artificial Sequence
  chemically synthesized
caaaagtttccttctgcccctt

SEQ ID NO: 1099786 - DNA, 22 bp, Artificial Sequence
  chemically synthesized
tcacctccaaaagtttccttct

SEQ ID NO: 1099787 - DNA, 22 bp, Artificial Sequence
  chemically synthesized
cctatcacctccaaaagtttcc

SEQ ID NO: 1099788 - DNA, 22 bp, Artificial Sequence
  chemically synthesized
acctatcacctccaaaagtttc

SEQ ID NO: 1099789 - DNA, 22 bp, Artificial Sequence
  chemically synthesized
aggggcagaaggaaacttttgg

SEQ ID NO: 1099790 - DNA, 22 bp, Artificial Sequence
  chemically synthesized
aagatgataaacttacctatca

SEQ ID NO: 1099791 - DNA, 22 bp, Artificial Sequence
  chemically synthesized
ttggaggtgataggtaagttta

SEQ ID NO: 1099792 - DNA, 22 bp, Artificial Sequence
  chemically synthesized
tggaggtgataggtaagtttat

SEQ ID NO: 1099793 - DNA, 22 bp, Artificial Sequence
  chemically synthesized
ggaggtgataggtaagtttatc

SEQ ID NO: 1099794 - DNA, 22 bp, Artificial Sequence
  chemically synthesized
gaggtgataggtaagtttatca

SEQ ID NO: 1099795 - DNA, 22 bp, Artificial Sequence
  chemically synthesized
ccacattcaagatgataaactt

SEQ ID NO: 1099796 - DNA, 22 bp, Artificial Sequence
  chemically synthesized
ttaccacattcaagatgataaa

SEQ ID NO: 1099797 - DNA, 22 bp, Artificial Sequence
  chemically synthesized
attaccacattcaagatgataa

SEQ ID NO: 1099798 - DNA, 22 bp, Artificial Sequence
  chemically synthesized
atcatcttgaatgtggtaataa

SEQ ID NO: 1099799 - DNA, 22 bp, Artificial Sequence
  chemically synthesized
tcatcttgaatgtggtaataag

SEQ ID NO: 1099800 - DNA, 22 bp, Artificial Sequence
  chemically synthesized
gaatgtggtaataagtctcatg

SEQ ID NO: 1099801 - DNA, 22 bp, Artificial Sequence
  chemically synthesized
aatgtggtaataagtctcatgg

SEQ ID NO: 1099802 - DNA, 22 bp, Artificial Sequence
  chemically synthesized
gggataagcgtatacccatgag

SEQ ID NO: 1099803 - DNA, 22 bp, Artificial Sequence
  chemically synthesized
ggggataagcgtatacccatga

SEQ ID NO: 1099804 - DNA, 22 bp, Artificial Sequence
  chemically synthesized
gtttggggataagcgtataccc

SEQ ID NO: 1099805 - DNA, 22 bp, Artificial Sequence
  chemically synthesized
attagtttggggataagcgtat

SEQ ID NO: 1099806 - DNA, 22 bp, Artificial Sequence
  chemically synthesized
gattagtttggggataagcgta

SEQ ID NO: 1099807 - DNA, 22 bp, Artificial Sequence
  chemically synthesized
atgggtatacgcttatccccaa

SEQ ID NO: 1099808 - DNA, 22 bp, Artificial Sequence
  chemically synthesized
tacaacttgattagtttgggga

SEQ ID NO: 1099809 - DNA, 22 bp, Artificial Sequence
  chemically synthesized
atacaacttgattagtttgggg

SEQ ID NO: 1099810 - DNA, 22 bp, Artificial Sequence
  chemically synthesized
atttatacaacttgattagttt

SEQ ID NO: 1099811 - DNA, 22 bp, Artificial Sequence
  chemically synthesized
aatttatacaacttgattagtt

SEQ ID NO: 1099812 - DNA, 22 bp, Artificial Sequence
  chemically synthesized
atccccaaactaatcaagttgt

SEQ ID NO: 1099813 - DNA, 22 bp, Artificial Sequence
  chemically synthesized
tccccaaactaatcaagttgta

SEQ ID NO: 1099814 - DNA, 22 bp, Artificial Sequence
  chemically synthesized
tacatatttaatttatacaact

SEQ ID NO: 1099815 - DNA, 22 bp, Artificial Sequence
  chemically synthesized
atcaagttgtataaattaaata

SEQ ID NO: 1099816 - DNA, 22 bp, Artificial Sequence
  chemically synthesized
acataccaaaagctgtacatat

SEQ ID NO: 1099817 - DNA, 22 bp, Artificial Sequence
  chemically synthesized
tataaattaaatatgtacagct

SEQ ID NO: 1099818 - DNA, 22 bp, Artificial Sequence
  chemically synthesized
aatatgtacagcttttggtatg

SEQ ID NO: 1099819 - DNA, 22 bp, Artificial Sequence
  chemically synthesized
aggtatgactgacataccaaaa

SEQ ID NO: 1099820 - DNA, 22 bp, Artificial Sequence
  chemically synthesized
ttgaggtatgactgacatacca

SEQ ID NO: 1099821 - DNA, 22 bp, Artificial Sequence
  chemically synthesized
gttgaggtatgactgacatacc

SEQ ID NO: 1099822 - DNA, 22 bp, Artificial Sequence
  chemically synthesized
tgttgaggtatgactgacatac

SEQ ID NO: 1099823 - DNA, 22 bp, Artificial Sequence
  chemically synthesized
aaccactttgttgaggtatgac

SEQ ID NO: 1099824 - DNA, 22 bp, Artificial Sequence
  chemically synthesized
ttggtatgtcagtcatacctca

SEQ ID NO: 1099825 - DNA, 22 bp, Artificial Sequence
  chemically synthesized
aaaccactttgttgaggtatga

SEQ ID NO: 1099826 - DNA, 22 bp, Artificial Sequence
  chemically synthesized
tggtatgtcagtcatacctcaa

SEQ ID NO: 1099827 - DNA, 22 bp, Artificial Sequence
  chemically synthesized
ggtatgtcagtcatacctcaac

SEQ ID NO: 1099828 - DNA, 22 bp, Artificial Sequence
  chemically synthesized
gtatgtcagtcatacctcaaca

SEQ ID NO: 1099829 - DNA, 22 bp, Artificial Sequence
  chemically synthesized
tttaaaccactttgttgaggta

SEQ ID NO: 1099830 - DNA, 22 bp, Artificial Sequence
  chemically synthesized
gtttaaaccactttgttgaggt

SEQ ID NO: 1099831 - DNA, 22 bp, Artificial Sequence
  chemically synthesized
tgtttaaaccactttgttgagg

SEQ ID NO: 1099832 - DNA, 22 bp, Artificial Sequence
  chemically synthesized
ttgtttaaaccactttgttgag

SEQ ID NO: 1099833 - DNA, 22 bp, Artificial Sequence
  chemically synthesized
tttttgtttaaaccactttgtt

SEQ ID NO: 1099834 - DNA, 22 bp, Artificial Sequence
  chemically synthesized
aacaaagtggtttaaacaaaaa

SEQ ID NO: 1099835 - DNA, 22 bp, Artificial Sequence
  chemically synthesized
gagatggaagagaatctatttt

SEQ ID NO: 1099836 - DNA, 22 bp, Artificial Sequence
  chemically synthesized
agagatggaagagaatctattt

SEQ ID NO: 1099837 - DNA, 22 bp, Artificial Sequence
  chemically synthesized
ttagagatggaagagaatctat

SEQ ID NO: 1099838 - DNA, 22 bp, Artificial Sequence
  chemically synthesized
aaacaaaaatagattctcttcc

SEQ ID NO: 1099839 - DNA, 22 bp, Artificial Sequence
  chemically synthesized
aacaaaaatagattctcttcca

SEQ ID NO: 1099840 - DNA, 22 bp, Artificial Sequence
  chemically synthesized
gtaaactcttagagatggaaga

SEQ ID NO: 1099841 - DNA, 22 bp, Artificial Sequence
  chemically synthesized
gataattcgtaaactcttagag

SEQ ID NO: 1099842 - DNA, 22 bp, Artificial Sequence
  chemically synthesized
tcttccatctctaagagtttac

SEQ ID NO: 1099843 - DNA, 22 bp, Artificial Sequence
  chemically synthesized
ttccatctctaagagtttacga

SEQ ID NO: 1099844 - DNA, 22 bp, Artificial Sequence
  chemically synthesized
ccatctctaagagtttacgaat

SEQ ID NO: 1099845 - DNA, 22 bp, Artificial Sequence
  chemically synthesized
catctctaagagtttacgaatt

SEQ ID NO: 1099846 - DNA, 22 bp, Artificial Sequence
  chemically synthesized
gtcaaattggataattcgtaaa

SEQ ID NO: 1099847 - DNA, 22 bp, Artificial Sequence
  chemically synthesized
ggtcaaattggataattcgtaa

SEQ ID NO: 1099848 - DNA, 22 bp, Artificial Sequence
  chemically synthesized
taagagtttacgaattatccaa

SEQ ID NO: 1099849 - DNA, 22 bp, Artificial Sequence
  chemically synthesized
agagtttacgaattatccaatt

SEQ ID NO: 1099850 - DNA, 22 bp, Artificial Sequence
  chemically synthesized
aaatgcttggtcaaattggata

SEQ ID NO: 1099851 - DNA, 22 bp, Artificial Sequence
  chemically synthesized
acgaattatccaatttgaccaa

SEQ ID NO: 1099852 - DNA, 22 bp, Artificial Sequence
  chemically synthesized
cgaattatccaatttgaccaag

SEQ ID NO: 1099853 - DNA, 22 bp, Artificial Sequence
  chemically synthesized
ccatccctaaaatgcttggtca

SEQ ID NO: 1099854 - DNA, 22 bp, Artificial Sequence
  chemically synthesized
tccaatttgaccaagcatttta

SEQ ID NO: 1099855 - DNA, 22 bp, Artificial Sequence
  chemically synthesized
cccatgctcccatccctaaaat

SEQ ID NO: 1099856 - DNA, 22 bp, Artificial Sequence
  chemically synthesized
ccccatgctcccatccctaaaa

SEQ ID NO: 1099857 - DNA, 22 bp, Artificial Sequence
  chemically synthesized
gaccaagcattttagggatggg

SEQ ID NO: 1099858 - DNA, 22 bp, Artificial Sequence
  chemically synthesized
accaagcattttagggatggga

SEQ ID NO: 1099859 - DNA, 22 bp, Artificial Sequence
  chemically synthesized
agaagatttccccatgctccca

SEQ ID NO: 1099860 - DNA, 22 bp, Artificial Sequence
  chemically synthesized
ttgagaagatttccccatgctc

SEQ ID NO: 1099861 - DNA, 22 bp, Artificial Sequence
  chemically synthesized
tagggatgggagcatggggaaa

SEQ ID NO: 1099862 - DNA, 22 bp, Artificial Sequence
  chemically synthesized
agggatgggagcatggggaaat

SEQ ID NO: 1099863 - DNA, 22 bp, Artificial Sequence
  chemically synthesized
cctattgagaagatttccccat

SEQ ID NO: 1099864 - DNA, 22 bp, Artificial Sequence
  chemically synthesized
gggatgggagcatggggaaatc

SEQ ID NO: 1099865 - DNA, 22 bp, Artificial Sequence
  chemically synthesized
gcctattgagaagatttcccca

SEQ ID NO: 1099866 - DNA, 22 bp, Artificial Sequence
  chemically synthesized
ttgcctattgagaagatttccc

SEQ ID NO: 1099867 - DNA, 22 bp, Artificial Sequence
  chemically synthesized
cttgcctattgagaagatttcc

SEQ ID NO: 1099868 - DNA, 22 bp, Artificial Sequence
  chemically synthesized
tttcttgcctattgagaagatt

SEQ ID NO: 1099869 - DNA, 22 bp, Artificial Sequence
  chemically synthesized
ctcaataggcaagaaacagtat

SEQ ID NO: 1099870 - DNA, 22 bp, Artificial Sequence
  chemically synthesized
tcaataggcaagaaacagtatc

SEQ ID NO: 1099871 - DNA, 22 bp, Artificial Sequence
  chemically synthesized
aataggcaagaaacagtatctt

SEQ ID NO: 1099872 - DNA, 22 bp, Artificial Sequence
  chemically synthesized
atatacatgttatctttatttt

SEQ ID NO: 1099873 - DNA, 22 bp, Artificial Sequence
  chemically synthesized
tatacatgttatctttattttt

SEQ ID NO: 1099874 - DNA, 22 bp, Artificial Sequence
  chemically synthesized
ggcatataaacgaggtacataa

SEQ ID NO: 1099875 - DNA, 22 bp, Artificial Sequence
  chemically synthesized
tctttatttttatgtacctcgt

SEQ ID NO: 1099876 - DNA, 22 bp, Artificial Sequence
  chemically synthesized
aaactgggcatataaacgaggt

SEQ ID NO: 1099877 - DNA, 22 bp, Artificial Sequence
  chemically synthesized
tatttttatgtacctcgtttat

SEQ ID NO: 1099878 - DNA, 22 bp, Artificial Sequence
  chemically synthesized
caaactgggcatataaacgagg

SEQ ID NO: 1099879 - DNA, 22 bp, Artificial Sequence
  chemically synthesized
atttttatgtacctcgtttata

SEQ ID NO: 1099880 - DNA, 22 bp, Artificial Sequence
  chemically synthesized
tcaaactgggcatataaacgag

SEQ ID NO: 1099881 - DNA, 22 bp, Artificial Sequence
  chemically synthesized
tttttatgtacctcgtttatat

SEQ ID NO: 1099882 - DNA, 22 bp, Artificial Sequence
  chemically synthesized
ttcaaactgggcatataaacga

SEQ ID NO: 1099883 - DNA, 22 bp, Artificial Sequence
  chemically synthesized
ttatgtacctcgtttatatgcc

SEQ ID NO: 1099884 - DNA, 22 bp, Artificial Sequence
  chemically synthesized
tatgtacctcgtttatatgccc

SEQ ID NO: 1099885 - DNA, 22 bp, Artificial Sequence
  chemically synthesized
atgtacctcgtttatatgccca

SEQ ID NO: 1099886 - DNA, 22 bp, Artificial Sequence
  chemically synthesized
tgtacctcgtttatatgcccag

SEQ ID NO: 1099887 - DNA, 22 bp, Artificial Sequence
  chemically synthesized
gtttatatgcccagtttgaaaa

SEQ ID NO: 1099888 - DNA, 22 bp, Artificial Sequence
  chemically synthesized
gaagtcaagtacacttttcaaa

SEQ ID NO: 1099889 - DNA, 22 bp, Artificial Sequence
  chemically synthesized
atatgcccagtttgaaaagtgt

SEQ ID NO: 1099890 - DNA, 22 bp, Artificial Sequence
  chemically synthesized
tatgcccagtttgaaaagtgta

SEQ ID NO: 1099891 - DNA, 22 bp, Artificial Sequence
  chemically synthesized
gaaaagtgtacttgacttccag

SEQ ID NO: 1099892 - DNA, 22 bp, Artificial Sequence
  chemically synthesized
aaaagtgtacttgacttccaga

SEQ ID NO: 1099893 - DNA, 22 bp, Artificial Sequence
  chemically synthesized
gacttccagatacatgtctgat

SEQ ID NO: 1099894 - DNA, 22 bp, Artificial Sequence
  chemically synthesized
acttccagatacatgtctgatt

SEQ ID NO: 1099895 - DNA, 22 bp, Artificial Sequence
  chemically synthesized
ggagaaaaagacaatcagacat

SEQ ID NO: 1099896 - DNA, 22 bp, Artificial Sequence
  chemically synthesized
cggagaaaaagacaatcagaca

SEQ ID NO: 1099897 - DNA, 22 bp, Artificial Sequence
  chemically synthesized
ccagatacatgtctgattgtct

SEQ ID NO: 1099898 - DNA, 22 bp, Artificial Sequence
  chemically synthesized
tttcggagaaaaagacaatcag

SEQ ID NO: 1099899 - DNA, 22 bp, Artificial Sequence
  chemically synthesized
cagatacatgtctgattgtctt

SEQ ID NO: 1099900 - DNA, 22 bp, Artificial Sequence
  chemically synthesized
atttcggagaaaaagacaatca

SEQ ID NO: 1099901 - DNA, 22 bp, Artificial Sequence
  chemically synthesized
gccatatttatttcggagaaaa

SEQ ID NO: 1099902 - DNA, 22 bp, Artificial Sequence
  chemically synthesized
agccatatttatttcggagaaa

SEQ ID NO: 1099903 - DNA, 22 bp, Artificial Sequence
  chemically synthesized
attgtctttttctccgaaataa

SEQ ID NO: 1099904 - DNA, 22 bp, Artificial Sequence
  chemically synthesized
catcttagccatatttatttcg

SEQ ID NO: 1099905 - DNA, 22 bp, Artificial Sequence
  chemically synthesized
tctttttctccgaaataaatat

SEQ ID NO: 1099906 - DNA, 22 bp, Artificial Sequence
  chemically synthesized
tttctccgaaataaatatggct

SEQ ID NO: 1099907 - DNA, 22 bp, Artificial Sequence
  chemically synthesized
ttctccgaaataaatatggcta

SEQ ID NO: 1099908 - DNA, 22 bp, Artificial Sequence
  chemically synthesized
gcggttccatcttagccatatt

SEQ ID NO: 1099909 - DNA, 22 bp, Artificial Sequence
  chemically synthesized
tctccgaaataaatatggctaa

SEQ ID NO: 1099910 - DNA, 22 bp, Artificial Sequence
  chemically synthesized
ctccgaaataaatatggctaag

SEQ ID NO: 1099911 - DNA, 22 bp, Artificial Sequence
  chemically synthesized
tccgaaataaatatggctaaga

SEQ ID NO: 1099912 - DNA, 22 bp, Artificial Sequence
  chemically synthesized
cgaaataaatatggctaagatg

SEQ ID NO: 1099913 - DNA, 22 bp, Artificial Sequence
  chemically synthesized
gagtgactagcggttccatctt

SEQ ID NO: 1099914 - DNA, 22 bp, Artificial Sequence
  chemically synthesized
ctagagtgactagcggttccat

SEQ ID NO: 1099915 - DNA, 22 bp, Artificial Sequence
  chemically synthesized
actagagtgactagcggttcca

SEQ ID NO: 1099916 - DNA, 22 bp, Artificial Sequence
  chemically synthesized
agatggaaccgctagtcactct

SEQ ID NO: 1099917 - DNA, 22 bp, Artificial Sequence
  chemically synthesized
gtcactctagtaagctattcca

SEQ ID NO: 1099918 - DNA, 22 bp, Artificial Sequence
  chemically synthesized
agagaagaacaaaatggaatag

SEQ ID NO: 1099919 - DNA, 22 bp, Artificial Sequence
  chemically synthesized
tagtaagctattccattttgtt

SEQ ID NO: 1099920 - DNA, 22 bp, Artificial Sequence
  chemically synthesized
gtaagctattccattttgttct

SEQ ID NO: 1099921 - DNA, 22 bp, Artificial Sequence
  chemically synthesized
ttccattttgttcttctcttag

SEQ ID NO: 1099922 - DNA, 22 bp, Artificial Sequence
  chemically synthesized
cattttgttcttctcttagtac

SEQ ID NO: 1099923 - DNA, 22 bp, Artificial Sequence
  chemically synthesized
aagaaagagtgggtactaagag

SEQ ID NO: 1099924 - DNA, 22 bp, Artificial Sequence
  chemically synthesized
aaagaaagagtgggtactaaga

SEQ ID NO: 1099925 - DNA, 22 bp, Artificial Sequence
  chemically synthesized
taaagaaagagtgggtactaag

SEQ ID NO: 1099926 - DNA, 22 bp, Artificial Sequence
  chemically synthesized
tgttcttctcttagtacccact

SEQ ID NO: 1099927 - DNA, 22 bp, Artificial Sequence
  chemically synthesized
gttcttctcttagtacccactc

SEQ ID NO: 1099928 - DNA, 22 bp, Artificial Sequence
  chemically synthesized
ttcttctcttagtacccactct

SEQ ID NO: 1099929 - DNA, 22 bp, Artificial Sequence
  chemically synthesized
tgattttaaagaaagagtgggt

SEQ ID NO: 1099930 - DNA, 22 bp, Artificial Sequence
  chemically synthesized
ttctcttagtacccactctttc

SEQ ID NO: 1099931 - DNA, 22 bp, Artificial Sequence
  chemically synthesized
ctcttagtacccactctttctt

SEQ ID NO: 1099932 - DNA, 22 bp, Artificial Sequence
  chemically synthesized
tcttagtacccactctttcttt

SEQ ID NO: 1099933 - DNA, 22 bp, Artificial Sequence
  chemically synthesized
ttagtacccactctttctttaa

SEQ ID NO: 1099934 - DNA, 22 bp, Artificial Sequence
  chemically synthesized
agtacccactctttctttaaaa

SEQ ID NO: 1099935 - DNA, 22 bp, Artificial Sequence
  chemically synthesized
gtacccactctttctttaaaat

SEQ ID NO: 1099936 - DNA, 22 bp, Artificial Sequence
  chemically synthesized
taggtcattgtgattttaaaga

SEQ ID NO: 1099937 - DNA, 22 bp, Artificial Sequence
  chemically synthesized
cattgtaggtcattgtgatttt

SEQ ID NO: 1099938 - DNA, 22 bp, Artificial Sequence
  chemically synthesized
tttctttaaaatcacaatgacc

SEQ ID NO: 1099939 - DNA, 22 bp, Artificial Sequence
  chemically synthesized
tctttaaaatcacaatgaccta

SEQ ID NO: 1099940 - DNA, 22 bp, Artificial Sequence
  chemically synthesized
tgagctacattgtaggtcattg

SEQ ID NO: 1099941 - DNA, 22 bp, Artificial Sequence
  chemically synthesized
ctttaaaatcacaatgacctac

SEQ ID NO: 1099942 - DNA, 22 bp, Artificial Sequence
  chemically synthesized
tttaaaatcacaatgacctaca

SEQ ID NO: 1099943 - DNA, 22 bp, Artificial Sequence
  chemically synthesized
ttatgagctacattgtaggtca

SEQ ID NO: 1099944 - DNA, 22 bp, Artificial Sequence
  chemically synthesized
taaaatcacaatgacctacaat

SEQ ID NO: 1099945 - DNA, 22 bp, Artificial Sequence
  chemically synthesized
aaaatcacaatgacctacaatg

SEQ ID NO: 1099946 - DNA, 22 bp, Artificial Sequence
  chemically synthesized
tgttatgagctacattgtaggt

SEQ ID NO: 1099947 - DNA, 22 bp, Artificial Sequence
  chemically synthesized
aaatcacaatgacctacaatgt

SEQ ID NO: 1099948 - DNA, 22 bp, Artificial Sequence
  chemically synthesized
ctgttatgagctacattgtagg

SEQ ID NO: 1099949 - DNA, 22 bp, Artificial Sequence
  chemically synthesized
agatatatttctgttatgagct

SEQ ID NO: 1099950 - DNA, 22 bp, Artificial Sequence
  chemically synthesized
cagatatatttctgttatgagc

SEQ ID NO: 1099951 - DNA, 22 bp, Artificial Sequence
  chemically synthesized
tcagatatatttctgttatgag

SEQ ID NO: 1099952 - DNA, 22 bp, Artificial Sequence
  chemically synthesized
caatgtagctcataacagaaat

SEQ ID NO: 1099953 - DNA, 22 bp, Artificial Sequence
  chemically synthesized
ataacagaaatatatctgaaaa

SEQ ID NO: 1099954 - DNA, 22 bp, Artificial Sequence
  chemically synthesized
gaggaagaatgagggaagaatc

SEQ ID NO: 1099955 - DNA, 22 bp, Artificial Sequence
  chemically synthesized
aaaacactttgattcttccctc

SEQ ID NO: 1099956 - DNA, 22 bp, Artificial Sequence
  chemically synthesized
atagtctagaggaagaatgagg

SEQ ID NO: 1099957 - DNA, 22 bp, Artificial Sequence
  chemically synthesized
tgattcttccctcattcttcct

SEQ ID NO: 1099958 - DNA, 22 bp, Artificial Sequence
  chemically synthesized
ttgatagtctagaggaagaatg

SEQ ID NO: 1099959 - DNA, 22 bp, Artificial Sequence
  chemically synthesized
gattcttccctcattcttcctc

SEQ ID NO: 1099960 - DNA, 22 bp, Artificial Sequence
  chemically synthesized
gttgatagtctagaggaagaat

SEQ ID NO: 1099961 - DNA, 22 bp, Artificial Sequence
  chemically synthesized
attcttccctcattcttcctct

SEQ ID NO: 1099962 - DNA, 22 bp, Artificial Sequence
  chemically synthesized
ttccctcattcttcctctagac

SEQ ID NO: 1099963 - DNA, 22 bp, Artificial Sequence
  chemically synthesized
ccctcattcttcctctagacta

SEQ ID NO: 1099964 - DNA, 22 bp, Artificial Sequence
  chemically synthesized
cctcattcttcctctagactat

SEQ ID NO: 1099965 - DNA, 22 bp, Artificial Sequence
  chemically synthesized
attcttcctctagactatcaac

SEQ ID NO: 1099966 - DNA, 22 bp, Artificial Sequence
  chemically synthesized
aaggagagtgtttgttgatagt

SEQ ID NO: 1099967 - DNA, 22 bp, Artificial Sequence
  chemically synthesized
ttcctctagactatcaacaaac

SEQ ID NO: 1099968 - DNA, 22 bp, Artificial Sequence
  chemically synthesized
ctgaaggagagtgtttgttgat

SEQ ID NO: 1099969 - DNA, 22 bp, Artificial Sequence
  chemically synthesized
gctgaaggagagtgtttgttga

SEQ ID NO: 1099970 - DNA, 22 bp, Artificial Sequence
  chemically synthesized
cctctagactatcaacaaacac

SEQ ID NO: 1099971 - DNA, 22 bp, Artificial Sequence
  chemically synthesized
ctctagactatcaacaaacact

SEQ ID NO: 1099972 - DNA, 22 bp, Artificial Sequence
  chemically synthesized
tagactatcaacaaacactctc

SEQ ID NO: 1099973 - DNA, 22 bp, Artificial Sequence
  chemically synthesized
gactatcaacaaacactctcct

SEQ ID NO: 1099974 - DNA, 22 bp, Artificial Sequence
  chemically synthesized
gcagtacttgctgaaggagagt

SEQ ID NO: 1099975 - DNA, 22 bp, Artificial Sequence
  chemically synthesized
tcaacaaacactctccttcagc

SEQ ID NO: 1099976 - DNA, 22 bp, Artificial Sequence
  chemically synthesized
gatctggcagtacttgctgaag

SEQ ID NO: 1099977 - DNA, 22 bp, Artificial Sequence
  chemically synthesized
tccttcagcaagtactgccaga

SEQ ID NO: 1099978 - DNA, 22 bp, Artificial Sequence
  chemically synthesized
cttcagcaagtactgccagatc

SEQ ID NO: 1099979 - DNA, 22 bp, Artificial Sequence
  chemically synthesized
acagatcccattagatctggca

SEQ ID NO: 1099980 - DNA, 22 bp, Artificial Sequence
  chemically synthesized
aacagatcccattagatctggc

SEQ ID NO: 1099981 - DNA, 22 bp, Artificial Sequence
  chemically synthesized
cagcaagtactgccagatctaa

SEQ ID NO: 1099982 - DNA, 22 bp, Artificial Sequence
  chemically synthesized
taacagatcccattagatctgg

SEQ ID NO: 1099983 - DNA, 22 bp, Artificial Sequence
  chemically synthesized
agcaagtactgccagatctaat

SEQ ID NO: 1099984 - DNA, 22 bp, Artificial Sequence
  chemically synthesized
ttaacagatcccattagatctg

SEQ ID NO: 1099985 - DNA, 22 bp, Artificial Sequence
  chemically synthesized
tttaacagatcccattagatct

SEQ ID NO: 1099986 - DNA, 22 bp, Artificial Sequence
  chemically synthesized
tttttaacagatcccattagat

SEQ ID NO: 1099987 - DNA, 22 bp, Artificial Sequence
  chemically synthesized
ttctttttaacagatcccatta

SEQ ID NO: 1099988 - DNA, 22 bp, Artificial Sequence
  chemically synthesized
attctttttaacagatcccatt

SEQ ID NO: 1099989 - DNA, 22 bp, Artificial Sequence
  chemically synthesized
tattctttttaacagatcccat

SEQ ID NO: 1099990 - DNA, 22 bp, Artificial Sequence
  chemically synthesized
ccagatctaatgggatctgtta

SEQ ID NO: 1099991 - DNA, 22 bp, Artificial Sequence
  chemically synthesized
ctttattctttttaacagatcc

SEQ ID NO: 1099992 - DNA, 22 bp, Artificial Sequence
  chemically synthesized
atgggatctgttaaaaagaata

SEQ ID NO: 1099993 - DNA, 22 bp, Artificial Sequence
  chemically synthesized
acatgacacattcctttattct

SEQ ID NO: 1099994 - DNA, 22 bp, Artificial Sequence
  chemically synthesized
tcctaacatgacacattccttt

SEQ ID NO: 1099995 - DNA, 22 bp, Artificial Sequence
  chemically synthesized
ttaaaaagaataaaggaatgtg

SEQ ID NO: 1099996 - DNA, 22 bp, Artificial Sequence
  chemically synthesized
ctatcctaacatgacacattcc

SEQ ID NO: 1099997 - DNA, 22 bp, Artificial Sequence
  chemically synthesized
aaaagaataaaggaatgtgtca

SEQ ID NO: 1099998 - DNA, 22 bp, Artificial Sequence
  chemically synthesized
ttcctatcctaacatgacacat

SEQ ID NO: 1099999 - DNA, 22 bp, Artificial Sequence
  chemically synthesized
cccagaagtattattcctatcc

SEQ ID NO: 1100000 - DNA, 22 bp, Artificial Sequence
  chemically synthesized
catctacccagaagtattattc

SEQ ID NO: 1100001 - DNA, 22 bp, Artificial Sequence
  chemically synthesized
acatctacccagaagtattatt

SEQ ID NO: 1100002 - DNA, 22 bp, Artificial Sequence
  chemically synthesized
ggataggaataatacttctggg

SEQ ID NO: 1100003 - DNA, 22 bp, Artificial Sequence
  chemically synthesized
acacttacatctacccagaagt

SEQ ID NO: 1100004 - DNA, 22 bp, Artificial Sequence
  chemically synthesized
cacacttacatctacccagaag

SEQ ID NO: 1100005 - DNA, 22 bp, Artificial Sequence
  chemically synthesized
tcacacttacatctacccagaa

SEQ ID NO: 1100006 - DNA, 22 bp, Artificial Sequence
  chemically synthesized
atgaggactttcacacttacat

SEQ ID NO: 1100007 - DNA, 22 bp, Artificial Sequence
  chemically synthesized
gatgaggactttcacacttaca

SEQ ID NO: 1100008 - DNA, 22 bp, Artificial Sequence
  chemically synthesized
tgatgaggactttcacacttac

SEQ ID NO: 1100009 - DNA, 22 bp, Artificial Sequence
  chemically synthesized
ttgatgaggactttcacactta

SEQ ID NO: 1100010 - DNA, 22 bp, Artificial Sequence
  chemically synthesized
ctgggtagatgtaagtgtgaaa

SEQ ID NO: 1100011 - DNA, 22 bp, Artificial Sequence
  chemically synthesized
tgggtagatgtaagtgtgaaag

SEQ ID NO: 1100012 - DNA, 22 bp, Artificial Sequence
  chemically synthesized
ggtagatgtaagtgtgaaagtc

SEQ ID NO: 1100013 - DNA, 22 bp, Artificial Sequence
  chemically synthesized
catttttgatgaggactttcac

SEQ ID NO: 1100014 - DNA, 22 bp, Artificial Sequence
  chemically synthesized
attacatttttgatgaggactt

SEQ ID NO: 1100015 - DNA, 22 bp, Artificial Sequence
  chemically synthesized
gtatcctcattacatttttgat

SEQ ID NO: 1100016 - DNA, 22 bp, Artificial Sequence
  chemically synthesized
atcaaaaatgtaatgaggatac

SEQ ID NO: 1100017 - DNA, 22 bp, Artificial Sequence
  chemically synthesized
atccaacagaggattagtatcc

SEQ ID NO: 1100018 - DNA, 22 bp, Artificial Sequence
  chemically synthesized
ctcatccaacagaggattagta

SEQ ID NO: 1100019 - DNA, 22 bp, Artificial Sequence
  chemically synthesized
caaactactcatccaacagagg

SEQ ID NO: 1100020 - DNA, 22 bp, Artificial Sequence
  chemically synthesized
gcaaactactcatccaacagag

SEQ ID NO: 1100021 - DNA, 22 bp, Artificial Sequence
  chemically synthesized
atcctctgttggatgagtagtt

SEQ ID NO: 1100022 - DNA, 22 bp, Artificial Sequence
  chemically synthesized
tgttggatgagtagtttgcaaa

SEQ ID NO: 1100023 - DNA, 22 bp, Artificial Sequence
  chemically synthesized
ttggatgagtagtttgcaaata

SEQ ID NO: 1100024 - DNA, 22 bp, Artificial Sequence
  chemically synthesized
gatgagtagtttgcaaatattt

SEQ ID NO: 1100025 - DNA, 22 bp, Artificial Sequence
  chemically synthesized
gcaaatattttttcccattctg

SEQ ID NO: 1100026 - DNA, 22 bp, Artificial Sequence
  chemically synthesized
caaatattttttcccattctgt

SEQ ID NO: 1100027 - DNA, 22 bp, Artificial Sequence
  chemically synthesized
tttcccattctgtggattgtct

SEQ ID NO: 1100028 - DNA, 22 bp, Artificial Sequence
  chemically synthesized
ttcccattctgtggattgtctt

SEQ ID NO: 1100029 - DNA, 22 bp, Artificial Sequence
  chemically synthesized
tcccattctgtggattgtcttt

SEQ ID NO: 1100030 - DNA, 22 bp, Artificial Sequence
  chemically synthesized
cccattctgtggattgtctttt

SEQ ID NO: 1100031 - DNA, 22 bp, Artificial Sequence
  chemically synthesized
ccattctgtggattgtcttttc

SEQ ID NO: 1100032 - DNA, 22 bp, Artificial Sequence
  chemically synthesized
tgtggattgtcttttcattctg

SEQ ID NO: 1100033 - DNA, 22 bp, Artificial Sequence
  chemically synthesized
tggattgtcttttcattctgtt

SEQ ID NO: 1100034 - DNA, 22 bp, Artificial Sequence
  chemically synthesized
tcttttcattctgtttactgtt

SEQ ID NO: 1100035 - DNA, 22 bp, Artificial Sequence
  chemically synthesized
cacagcaaaggaaacagtaaac

SEQ ID NO: 1100036 - DNA, 22 bp, Artificial Sequence
  chemically synthesized
tgcacagcaaaggaaacagtaa

SEQ ID NO: 1100037 - DNA, 22 bp, Artificial Sequence
  chemically synthesized
ctgcacagcaaaggaaacagta

SEQ ID NO: 1100038 - DNA, 22 bp, Artificial Sequence
  chemically synthesized
ttcattctgtttactgtttcct

SEQ ID NO: 1100039 - DNA, 22 bp, Artificial Sequence
  chemically synthesized
tcattctgtttactgtttcctt

SEQ ID NO: 1100040 - DNA, 22 bp, Artificial Sequence
  chemically synthesized
cattctgtttactgtttccttt

SEQ ID NO: 1100041 - DNA, 22 bp, Artificial Sequence
  chemically synthesized
attctgtttactgtttcctttg

SEQ ID NO: 1100042 - DNA, 22 bp, Artificial Sequence
  chemically synthesized
gcttctgcacagcaaaggaaac

SEQ ID NO: 1100043 - DNA, 22 bp, Artificial Sequence
  chemically synthesized
tagcttctgcacagcaaaggaa

SEQ ID NO: 1100044 - DNA, 22 bp, Artificial Sequence
  chemically synthesized
ctagcttctgcacagcaaagga

SEQ ID NO: 1100045 - DNA, 22 bp, Artificial Sequence
  chemically synthesized
tgtttactgtttcctttgctgt

SEQ ID NO: 1100046 - DNA, 22 bp, Artificial Sequence
  chemically synthesized
tttactgtttcctttgctgtgc

SEQ ID NO: 1100047 - DNA, 22 bp, Artificial Sequence
  chemically synthesized
agtttctagcttctgcacagca

SEQ ID NO: 1100048 - DNA, 22 bp, Artificial Sequence
  chemically synthesized
actgtttcctttgctgtgcaga

SEQ ID NO: 1100049 - DNA, 22 bp, Artificial Sequence
  chemically synthesized
ctgtttcctttgctgtgcagaa

SEQ ID NO: 1100050 - DNA, 22 bp, Artificial Sequence
  chemically synthesized
tttcctttgctgtgcagaagct

SEQ ID NO: 1100051 - DNA, 22 bp, Artificial Sequence
  chemically synthesized
cctttgctgtgcagaagctaga

SEQ ID NO: 1100052 - DNA, 22 bp, Artificial Sequence
  chemically synthesized
ctttgctgtgcagaagctagaa

SEQ ID NO: 1100053 - DNA, 22 bp, Artificial Sequence
  chemically synthesized
tgatatctgagtttctagcttc

SEQ ID NO: 1100054 - DNA, 22 bp, Artificial Sequence
  chemically synthesized
atgatatctgagtttctagctt

SEQ ID NO: 1100055 - DNA, 22 bp, Artificial Sequence
  chemically synthesized
tatgatatctgagtttctagct

SEQ ID NO: 1100056 - DNA, 22 bp, Artificial Sequence
  chemically synthesized
tgctgtgcagaagctagaaact

SEQ ID NO: 1100057 - DNA, 22 bp, Artificial Sequence
  chemically synthesized
ttatgatatctgagtttctagc

SEQ ID NO: 1100058 - DNA, 22 bp, Artificial Sequence
  chemically synthesized
gctgtgcagaagctagaaactc

SEQ ID NO: 1100059 - DNA, 22 bp, Artificial Sequence
  chemically synthesized
tttatgatatctgagtttctag

SEQ ID NO: 1100060 - DNA, 22 bp, Artificial Sequence
  chemically synthesized
ctgtgcagaagctagaaactca

SEQ ID NO: 1100061 - DNA, 22 bp, Artificial Sequence
  chemically synthesized
tttttatgatatctgagtttct

SEQ ID NO: 1100062 - DNA, 22 bp, Artificial Sequence
  chemically synthesized
ctttttatgatatctgagtttc

SEQ ID NO: 1100063 - DNA, 22 bp, Artificial Sequence
  chemically synthesized
tgcagaagctagaaactcagat

SEQ ID NO: 1100064 - DNA, 22 bp, Artificial Sequence
  chemically synthesized
tctttttatgatatctgagttt

SEQ ID NO: 1100065 - DNA, 22 bp, Artificial Sequence
  chemically synthesized
ttctttttatgatatctgagtt

SEQ ID NO: 1100066 - DNA, 22 bp, Artificial Sequence
  chemically synthesized
tttttctttttatgatatctga

SEQ ID NO: 1100067 - DNA, 22 bp, Artificial Sequence
  chemically synthesized
gaaactcagatatcataaaaag

SEQ ID NO: 1100068 - DNA, 22 bp, Artificial Sequence
  chemically synthesized
agatatcataaaaagaaaaata

SEQ ID NO: 1100069 - DNA, 22 bp, Artificial Sequence
  chemically synthesized
tatcataaaatcgttatttttc

SEQ ID NO: 1100070 - DNA, 22 bp, Artificial Sequence
  chemically synthesized
atatcataaaatcgttattttt

SEQ ID NO: 1100071 - DNA, 22 bp, Artificial Sequence
  chemically synthesized
tatatcataaaatcgttatttt

SEQ ID NO: 1100072 - DNA, 22 bp, Artificial Sequence
  chemically synthesized
tatgatataaaacatcatatca

SEQ ID NO: 1100073 - DNA, 22 bp, Artificial Sequence
  chemically synthesized
atgatataaaacatcatatcat

SEQ ID NO: 1100074 - DNA, 22 bp, Artificial Sequence
  chemically synthesized
tgatataaaacatcatatcata

SEQ ID NO: 1100075 - DNA, 22 bp, Artificial Sequence
  chemically synthesized
aatcccatcacatccacatatg

SEQ ID NO: 1100076 - DNA, 22 bp, Artificial Sequence
  chemically synthesized
gaatcccatcacatccacatat

SEQ ID NO: 1100077 - DNA, 22 bp, Artificial Sequence
  chemically synthesized
tgaatcccatcacatccacata

SEQ ID NO: 1100078 - DNA, 22 bp, Artificial Sequence
  chemically synthesized
ttgaatcccatcacatccacat

SEQ ID NO: 1100079 - DNA, 22 bp, Artificial Sequence
  chemically synthesized
cccatttttgaatcccatcaca

SEQ ID NO: 1100080 - DNA, 22 bp, Artificial Sequence
  chemically synthesized
gcccatttttgaatcccatcac

SEQ ID NO: 1100081 - DNA, 22 bp, Artificial Sequence
  chemically synthesized
tttgcccatttttgaatcccat

SEQ ID NO: 1100082 - DNA, 22 bp, Artificial Sequence
  chemically synthesized
agattatttgcccatttttgaa

SEQ ID NO: 1100083 - DNA, 22 bp, Artificial Sequence
  chemically synthesized
ttcagattatttgcccattttt

SEQ ID NO: 1100084 - DNA, 22 bp, Artificial Sequence
  chemically synthesized
gaaataactgttcagattattt

SEQ ID NO: 1100085 - DNA, 22 bp, Artificial Sequence
  chemically synthesized
ggaaataactgttcagattatt

SEQ ID NO: 1100086 - DNA, 22 bp, Artificial Sequence
  chemically synthesized
aaaaatgggcaaataatctgaa

SEQ ID NO: 1100087 - DNA, 22 bp, Artificial Sequence
  chemically synthesized
tggaaataactgttcagattat

SEQ ID NO: 1100088 - DNA, 22 bp, Artificial Sequence
  chemically synthesized
ttggaaataactgttcagatta

SEQ ID NO: 1100089 - DNA, 22 bp, Artificial Sequence
  chemically synthesized
ttttggaaataactgttcagat

SEQ ID NO: 1100090 - DNA, 22 bp, Artificial Sequence
  chemically synthesized
cttttggaaataactgttcaga

SEQ ID NO: 1100091 - DNA, 22 bp, Artificial Sequence
  chemically synthesized
ttcttttggaaataactgttca

SEQ ID NO: 1100092 - DNA, 22 bp, Artificial Sequence
  chemically synthesized
cttcttttggaaataactgttc

SEQ ID NO: 1100093 - DNA, 22 bp, Artificial Sequence
  chemically synthesized
tcttcttttggaaataactgtt

SEQ ID NO: 1100094 - DNA, 22 bp, Artificial Sequence
  chemically synthesized
ttcttcttttggaaataactgt

SEQ ID NO: 1100095 - DNA, 22 bp, Artificial Sequence
  chemically synthesized
tttcttcttttggaaataactg

SEQ ID NO: 1100096 - DNA, 22 bp, Artificial Sequence
  chemically synthesized
ttttcttcttttggaaataact

SEQ ID NO: 1100097 - DNA, 22 bp, Artificial Sequence
  chemically synthesized
gccatttttttcttcttttgga

SEQ ID NO: 1100098 - DNA, 22 bp, Artificial Sequence
  chemically synthesized
aacagttatttccaaaagaaga

SEQ ID NO: 1100099 - DNA, 22 bp, Artificial Sequence
  chemically synthesized
attggccatttttttcttcttt

SEQ ID NO: 1100100 - DNA, 22 bp, Artificial Sequence
  chemically synthesized
tttccaaaagaagaaaaaaatg

SEQ ID NO: 1100101 - DNA, 22 bp, Artificial Sequence
  chemically synthesized
atatattaattggccatttttt

SEQ ID NO: 1100102 - DNA, 22 bp, Artificial Sequence
  chemically synthesized
ccaaaagaagaaaaaaatggcc

SEQ ID NO: 1100103 - DNA, 22 bp, Artificial Sequence
  chemically synthesized
catatattaattggccattttt

SEQ ID NO: 1100104 - DNA, 22 bp, Artificial Sequence
  chemically synthesized
caaaagaagaaaaaaatggcca

SEQ ID NO: 1100105 - DNA, 22 bp, Artificial Sequence
  chemically synthesized
tcatatattaattggccatttt

SEQ ID NO: 1100106 - DNA, 22 bp, Artificial Sequence
  chemically synthesized
ttcatatattaattggccattt

SEQ ID NO: 1100107 - DNA, 22 bp, Artificial Sequence
  chemically synthesized
tttcatatattaattggccatt

SEQ ID NO: 1100108 - DNA, 22 bp, Artificial Sequence
  chemically synthesized
ttttcatatattaattggccat

SEQ ID NO: 1100109 - DNA, 22 bp, Artificial Sequence
  chemically synthesized
tttttcatatattaattggcca

SEQ ID NO: 1100110 - DNA, 22 bp, Artificial Sequence
  chemically synthesized
ttttttcatatattaattggcc

SEQ ID NO: 1100111 - DNA, 22 bp, Artificial Sequence
  chemically synthesized
ccgatgtggaatttttttttca

SEQ ID NO: 1100112 - DNA, 22 bp, Artificial Sequence
  chemically synthesized
atatatgaaaaaaaaattccac

SEQ ID NO: 1100113 - DNA, 22 bp, Artificial Sequence
  chemically synthesized
atgattaccgatgtggaatttt

SEQ ID NO: 1100114 - DNA, 22 bp, Artificial Sequence
  chemically synthesized
gatgattaccgatgtggaattt

SEQ ID NO: 1100115 - DNA, 22 bp, Artificial Sequence
  chemically synthesized
tttgatgattaccgatgtggaa

SEQ ID NO: 1100116 - DNA, 22 bp, Artificial Sequence
  chemically synthesized
atttgatgattaccgatgtgga

SEQ ID NO: 1100117 - DNA, 22 bp, Artificial Sequence
  chemically synthesized
catttatttgatgattaccgat

SEQ ID NO: 1100118 - DNA, 22 bp, Artificial Sequence
  chemically synthesized
gcatttatttgatgattaccga

SEQ ID NO: 1100119 - DNA, 22 bp, Artificial Sequence
  chemically synthesized
gtttgcatttatttgatgatta

SEQ ID NO: 1100120 - DNA, 22 bp, Artificial Sequence
  chemically synthesized
ggtttgcatttatttgatgatt

SEQ ID NO: 1100121 - DNA, 22 bp, Artificial Sequence
  chemically synthesized
tggtttgcatttatttgatgat

SEQ ID NO: 1100122 - DNA, 22 bp, Artificial Sequence
  chemically synthesized
cacatcggtaatcatcaaataa

SEQ ID NO: 1100123 - DNA, 22 bp, Artificial Sequence
  chemically synthesized
tggttttggtttgcatttattt

SEQ ID NO: 1100124 - DNA, 22 bp, Artificial Sequence
  chemically synthesized
attgtggttttggtttgcattt

SEQ ID NO: 1100125 - DNA, 22 bp, Artificial Sequence
  chemically synthesized
gggtgaggtgatacctcattgt

SEQ ID NO: 1100126 - DNA, 22 bp, Artificial Sequence
  chemically synthesized
gctggggtgaggtgatacctca

SEQ ID NO: 1100127 - DNA, 22 bp, Artificial Sequence
  chemically synthesized
gcaatatacatcctagctgggg

SEQ ID NO: 1100128 - DNA, 22 bp, Artificial Sequence
  chemically synthesized
ggcaatatacatcctagctggg

SEQ ID NO: 1100129 - DNA, 22 bp, Artificial Sequence
  chemically synthesized
tggcaatatacatcctagctgg

SEQ ID NO: 1100130 - DNA, 22 bp, Artificial Sequence
  chemically synthesized
ttggcaatatacatcctagctg

SEQ ID NO: 1100131 - DNA, 22 bp, Artificial Sequence
  chemically synthesized
tttggcaatatacatcctagct

SEQ ID NO: 1100132 - DNA, 22 bp, Artificial Sequence
  chemically synthesized
tctttttggcaatatacatcct

SEQ ID NO: 1100133 - DNA, 22 bp, Artificial Sequence
  chemically synthesized
gtctttttggcaatatacatcc

SEQ ID NO: 1100134 - DNA, 22 bp, Artificial Sequence
  chemically synthesized
tgtctttttggcaatatacatc

SEQ ID NO: 1100135 - DNA, 22 bp, Artificial Sequence
  chemically synthesized
accccagctaggatgtatattg

SEQ ID NO: 1100136 - DNA, 22 bp, Artificial Sequence
  chemically synthesized
ttgtctttttggcaatatacat

SEQ ID NO: 1100137 - DNA, 22 bp, Artificial Sequence
  chemically synthesized
tttgtctttttggcaatataca

SEQ ID NO: 1100138 - DNA, 22 bp, Artificial Sequence
  chemically synthesized
ttttttgtctttttggcaatat

SEQ ID NO: 1100139 - DNA, 22 bp, Artificial Sequence
  chemically synthesized
ggatgtatattgccaaaaagac

SEQ ID NO: 1100140 - DNA, 22 bp, Artificial Sequence
  chemically synthesized
ccaaaaagacaaaaaataattg

SEQ ID NO: 1100141 - DNA, 22 bp, Artificial Sequence
  chemically synthesized
catccgtgccaacaattatttt

SEQ ID NO: 1100142 - DNA, 22 bp, Artificial Sequence
  chemically synthesized
tctgcatccgtgccaacaatta

SEQ ID NO: 1100143 - DNA, 22 bp, Artificial Sequence
  chemically synthesized
atctgcatccgtgccaacaatt

SEQ ID NO: 1100144 - DNA, 22 bp, Artificial Sequence
  chemically synthesized
tatctgcatccgtgccaacaat

SEQ ID NO: 1100145 - DNA, 22 bp, Artificial Sequence
  chemically synthesized
ttatctgcatccgtgccaacaa

SEQ ID NO: 1100146 - DNA, 22 bp, Artificial Sequence
  chemically synthesized
tttatctgcatccgtgccaaca

SEQ ID NO: 1100147 - DNA, 22 bp, Artificial Sequence
  chemically synthesized
ctttttatctgcatccgtgcca

SEQ ID NO: 1100148 - DNA, 22 bp, Artificial Sequence
  chemically synthesized
ttggcacggatgcagataaaaa

SEQ ID NO: 1100149 - DNA, 22 bp, Artificial Sequence
  chemically synthesized
gcacggatgcagataaaaagga

SEQ ID NO: 1100150 - DNA, 22 bp, Artificial Sequence
  chemically synthesized
acagtgtagtgtagttcctttt

SEQ ID NO: 1100151 - DNA, 22 bp, Artificial Sequence
  chemically synthesized
ccactaacagtgtagtgtagtt

SEQ ID NO: 1100152 - DNA, 22 bp, Artificial Sequence
  chemically synthesized
tattcccactaacagtgtagtg

SEQ ID NO: 1100153 - DNA, 22 bp, Artificial Sequence
  chemically synthesized
atattcccactaacagtgtagt

SEQ ID NO: 1100154 - DNA, 22 bp, Artificial Sequence
  chemically synthesized
taccatttatattcccactaac

SEQ ID NO: 1100155 - DNA, 22 bp, Artificial Sequence
  chemically synthesized
cactacactgttagtgggaata

SEQ ID NO: 1100156 - DNA, 22 bp, Artificial Sequence
  chemically synthesized
cactgttagtgggaatataaat

SEQ ID NO: 1100157 - DNA, 22 bp, Artificial Sequence
  chemically synthesized
cagtgactgtaccatttatatt

SEQ ID NO: 1100158 - DNA, 22 bp, Artificial Sequence
  chemically synthesized
tacagtgactgtaccatttata

SEQ ID NO: 1100159 - DNA, 22 bp, Artificial Sequence
  chemically synthesized
ttagtgggaatataaatggtac

SEQ ID NO: 1100160 - DNA, 22 bp, Artificial Sequence
  chemically synthesized
tctacagtgactgtaccattta

SEQ ID NO: 1100161 - DNA, 22 bp, Artificial Sequence
  chemically synthesized
gtgggaatataaatggtacagt

SEQ ID NO: 1100162 - DNA, 22 bp, Artificial Sequence
  chemically synthesized
ttctctacagtgactgtaccat

SEQ ID NO: 1100163 - DNA, 22 bp, Artificial Sequence
  chemically synthesized
catgctgttctctacagtgact

SEQ ID NO: 1100164 - DNA, 22 bp, Artificial Sequence
  chemically synthesized
aggaacctccatgctgttctct

SEQ ID NO: 1100165 - DNA, 22 bp, Artificial Sequence
  chemically synthesized
tgaggaacctccatgctgttct

SEQ ID NO: 1100166 - DNA, 22 bp, Artificial Sequence
  chemically synthesized
ctgaggaacctccatgctgttc

SEQ ID NO: 1100167 - DNA, 22 bp, Artificial Sequence
  chemically synthesized
tctgaggaacctccatgctgtt

SEQ ID NO: 1100168 - DNA, 22 bp, Artificial Sequence
  chemically synthesized
tagttttctgaggaacctccat

SEQ ID NO: 1100169 - DNA, 22 bp, Artificial Sequence
  chemically synthesized
tagagaacagcatggaggttcc

SEQ ID NO: 1100170 - DNA, 22 bp, Artificial Sequence
  chemically synthesized
tggatattgtagttttctgagg

SEQ ID NO: 1100171 - DNA, 22 bp, Artificial Sequence
  chemically synthesized
gtggatattgtagttttctgag

SEQ ID NO: 1100172 - DNA, 22 bp, Artificial Sequence
  chemically synthesized
ctcagaaaactacaatatccac

SEQ ID NO: 1100173 - DNA, 22 bp, Artificial Sequence
  chemically synthesized
agaaaactacaatatccacaaa

SEQ ID NO: 1100174 - DNA, 22 bp, Artificial Sequence
  chemically synthesized
caatatccacaaatatcccctt

SEQ ID NO: 1100175 - DNA, 22 bp, Artificial Sequence
  chemically synthesized
tccaggtagaaaaaaaaaacag

SEQ ID NO: 1100176 - DNA, 22 bp, Artificial Sequence
  chemically synthesized
tttcctgcctgttttttttttc

SEQ ID NO: 1100177 - DNA, 22 bp, Artificial Sequence
  chemically synthesized
ttcctgcctgttttttttttct

SEQ ID NO: 1100178 - DNA, 22 bp, Artificial Sequence
  chemically synthesized
tcctgcctgttttttttttcta

SEQ ID NO: 1100179 - DNA, 22 bp, Artificial Sequence
  chemically synthesized
caattgtccaggtagaaaaaaa

SEQ ID NO: 1100180 - DNA, 22 bp, Artificial Sequence
  chemically synthesized
cctgcctgttttttttttctac

SEQ ID NO: 1100181 - DNA, 22 bp, Artificial Sequence
  chemically synthesized
ctgcctgttttttttttctacc

SEQ ID NO: 1100182 - DNA, 22 bp, Artificial Sequence
  chemically synthesized
cctgttttttttttctacctgg

SEQ ID NO: 1100183 - DNA, 22 bp, Artificial Sequence
  chemically synthesized
ttttttttttctacctggacaa

SEQ ID NO: 1100184 - DNA, 22 bp, Artificial Sequence
  chemically synthesized
tttttttctacctggacaattg

SEQ ID NO: 1100185 - DNA, 22 bp, Artificial Sequence
  chemically synthesized
ttttttctacctggacaattgc

SEQ ID NO: 1100186 - DNA, 22 bp, Artificial Sequence
  chemically synthesized
tttttctacctggacaattgca

SEQ ID NO: 1100187 - DNA, 22 bp, Artificial Sequence
  chemically synthesized
ttttctacctggacaattgcaa

SEQ ID NO: 1100188 - DNA, 22 bp, Artificial Sequence
  chemically synthesized
tttctacctggacaattgcaat

SEQ ID NO: 1100189 - DNA, 22 bp, Artificial Sequence
  chemically synthesized
ttctacctggacaattgcaatc

SEQ ID NO: 1100190 - DNA, 22 bp, Artificial Sequence
  chemically synthesized
tctacctggacaattgcaatcc

SEQ ID NO: 1100191 - DNA, 22 bp, Artificial Sequence
  chemically synthesized
ctacctggacaattgcaatccc

SEQ ID NO: 1100192 - DNA, 22 bp, Artificial Sequence
  chemically synthesized
tacctggacaattgcaatccct

SEQ ID NO: 1100193 - DNA, 22 bp, Artificial Sequence
  chemically synthesized
cctggacaattgcaatccctac

SEQ ID NO: 1100194 - DNA, 22 bp, Artificial Sequence
  chemically synthesized
aagtggaagcaggtagggattg

SEQ ID NO: 1100195 - DNA, 22 bp, Artificial Sequence
  chemically synthesized
gacaattgcaatccctacctgc

SEQ ID NO: 1100196 - DNA, 22 bp, Artificial Sequence
  chemically synthesized
caatccctacctgcttccactt

SEQ ID NO: 1100197 - DNA, 22 bp, Artificial Sequence
  chemically synthesized
cctgcttccacttcagcccttt

SEQ ID NO: 1100198 - DNA, 22 bp, Artificial Sequence
  chemically synthesized
cttccacttcagcccttttgat

SEQ ID NO: 1100199 - DNA, 22 bp, Artificial Sequence
  chemically synthesized
gaagaagaataaatcaaaaggg

SEQ ID NO: 1100200 - DNA, 22 bp, Artificial Sequence
  chemically synthesized
ccacttcagcccttttgattta

SEQ ID NO: 1100201 - DNA, 22 bp, Artificial Sequence
  chemically synthesized
ttagaagaagaataaatcaaaa

SEQ ID NO: 1100202 - DNA, 22 bp, Artificial Sequence
  chemically synthesized
cacttcagcccttttgatttat

SEQ ID NO: 1100203 - DNA, 22 bp, Artificial Sequence
  chemically synthesized
ctattagaagaagaataaatca

SEQ ID NO: 1100204 - DNA, 22 bp, Artificial Sequence
  chemically synthesized
cagcccttttgatttattcttc

SEQ ID NO: 1100205 - DNA, 22 bp, Artificial Sequence
  chemically synthesized
agcccttttgatttattcttct

SEQ ID NO: 1100206 - DNA, 22 bp, Artificial Sequence
  chemically synthesized
catattcctattagaagaagaa

SEQ ID NO: 1100207 - DNA, 22 bp, Artificial Sequence
  chemically synthesized
ctgcatattcctattagaagaa

SEQ ID NO: 1100208 - DNA, 22 bp, Artificial Sequence
  chemically synthesized
ttgatttattcttcttctaata

SEQ ID NO: 1100209 - DNA, 22 bp, Artificial Sequence
  chemically synthesized
gctgcatattcctattagaaga

SEQ ID NO: 1100210 - DNA, 22 bp, Artificial Sequence
  chemically synthesized
tgatttattcttcttctaatag

SEQ ID NO: 1100211 - DNA, 22 bp, Artificial Sequence
  chemically synthesized
gatttattcttcttctaatagg

SEQ ID NO: 1100212 - DNA, 22 bp, Artificial Sequence
  chemically synthesized
atttattcttcttctaatagga

SEQ ID NO: 1100213 - DNA, 22 bp, Artificial Sequence
  chemically synthesized
agtttgctgcatattcctatta

SEQ ID NO: 1100214 - DNA, 22 bp, Artificial Sequence
  chemically synthesized
aagtttgctgcatattcctatt

SEQ ID NO: 1100215 - DNA, 22 bp, Artificial Sequence
  chemically synthesized
attcttcttctaataggaatat

SEQ ID NO: 1100216 - DNA, 22 bp, Artificial Sequence
  chemically synthesized
taagtttgctgcatattcctat

SEQ ID NO: 1100217 - DNA, 22 bp, Artificial Sequence
  chemically synthesized
ttcttcttctaataggaatatg

SEQ ID NO: 1100218 - DNA, 22 bp, Artificial Sequence
  chemically synthesized
ttttaagtttgctgcatattcc

SEQ ID NO: 1100219 - DNA, 22 bp, Artificial Sequence
  chemically synthesized
ttcttctaataggaatatgcag

SEQ ID NO: 1100220 - DNA, 22 bp, Artificial Sequence
  chemically synthesized
cttctaataggaatatgcagca

SEQ ID NO: 1100221 - DNA, 22 bp, Artificial Sequence
  chemically synthesized
ttctaataggaatatgcagcaa

SEQ ID NO: 1100222 - DNA, 22 bp, Artificial Sequence
  chemically synthesized
ctaataggaatatgcagcaaac

SEQ ID NO: 1100223 - DNA, 22 bp, Artificial Sequence
  chemically synthesized
taataggaatatgcagcaaact

SEQ ID NO: 1100224 - DNA, 22 bp, Artificial Sequence
  chemically synthesized
ataggaatatgcagcaaactta

SEQ ID NO: 1100225 - DNA, 22 bp, Artificial Sequence
  chemically synthesized
aaatggttgttttaagtttgct

SEQ ID NO: 1100226 - DNA, 22 bp, Artificial Sequence
  chemically synthesized
aaaatggttgttttaagtttgc

SEQ ID NO: 1100227 - DNA, 22 bp, Artificial Sequence
  chemically synthesized
atttaaaatggttgttttaagt

SEQ ID NO: 1100228 - DNA, 22 bp, Artificial Sequence
  chemically synthesized
catttaaaatggttgttttaag

SEQ ID NO: 1100229 - DNA, 22 bp, Artificial Sequence
  chemically synthesized
atttcatttaaaatggttgttt

SEQ ID NO: 1100230 - DNA, 22 bp, Artificial Sequence
  chemically synthesized
catttcatttaaaatggttgtt

SEQ ID NO: 1100231 - DNA, 22 bp, Artificial Sequence
  chemically synthesized
aaaacaaccattttaaatgaaa

SEQ ID NO: 1100232 - DNA, 22 bp, Artificial Sequence
  chemically synthesized
aaacaaccattttaaatgaaat

SEQ ID NO: 1100233 - DNA, 22 bp, Artificial Sequence
  chemically synthesized
agcataggagtggcatcatttc

SEQ ID NO: 1100234 - DNA, 22 bp, Artificial Sequence
  chemically synthesized
aagcataggagtggcatcattt

SEQ ID NO: 1100235 - DNA, 22 bp, Artificial Sequence
  chemically synthesized
taaatgaaatgaaatgatgcca

SEQ ID NO: 1100236 - DNA, 22 bp, Artificial Sequence
  chemically synthesized
taagcataggagtggcatcatt

SEQ ID NO: 1100237 - DNA, 22 bp, Artificial Sequence
  chemically synthesized
aaatgaaatgaaatgatgccac

SEQ ID NO: 1100238 - DNA, 22 bp, Artificial Sequence
  chemically synthesized
ttaagcataggagtggcatcat

SEQ ID NO: 1100239 - DNA, 22 bp, Artificial Sequence
  chemically synthesized
aatgaaatgaaatgatgccact

SEQ ID NO: 1100240 - DNA, 22 bp, Artificial Sequence
  chemically synthesized
acttttaagcataggagtggca

SEQ ID NO: 1100241 - DNA, 22 bp, Artificial Sequence
  chemically synthesized
gaaagtcatctgacttttaagc

SEQ ID NO: 1100242 - DNA, 22 bp, Artificial Sequence
  chemically synthesized
ggaaagtcatctgacttttaag

SEQ ID NO: 1100243 - DNA, 22 bp, Artificial Sequence
  chemically synthesized
tggaaagtcatctgacttttaa

SEQ ID NO: 1100244 - DNA, 22 bp, Artificial Sequence
  chemically synthesized
ctatgcttaaaagtcagatgac

SEQ ID NO: 1100245 - DNA, 22 bp, Artificial Sequence
  chemically synthesized
tgcttaaaagtcagatgacttt

SEQ ID NO: 1100246 - DNA, 22 bp, Artificial Sequence
  chemically synthesized
tgtcaagtactttggaaagtca

SEQ ID NO: 1100247 - DNA, 22 bp, Artificial Sequence
  chemically synthesized
aaaagtcagatgactttccaaa

SEQ ID NO: 1100248 - DNA, 22 bp, Artificial Sequence
  chemically synthesized
aaagtcagatgactttccaaag

SEQ ID NO: 1100249 - DNA, 22 bp, Artificial Sequence
  chemically synthesized
gtcattatgtcaagtactttgg

SEQ ID NO: 1100250 - DNA, 22 bp, Artificial Sequence
  chemically synthesized
agtcattatgtcaagtactttg

SEQ ID NO: 1100251 - DNA, 22 bp, Artificial Sequence
  chemically synthesized
tccaaagtacttgacataatga

SEQ ID NO: 1100252 - DNA, 22 bp, Artificial Sequence
  chemically synthesized
ccaaagtacttgacataatgac

SEQ ID NO: 1100253 - DNA, 22 bp, Artificial Sequence
  chemically synthesized
caaagtacttgacataatgact

SEQ ID NO: 1100254 - DNA, 22 bp, Artificial Sequence
  chemically synthesized
gacataatgactaaatcatcac

SEQ ID NO: 1100255 - DNA, 22 bp, Artificial Sequence
  chemically synthesized
acataatgactaaatcatcact

SEQ ID NO: 1100256 - DNA, 22 bp, Artificial Sequence
  chemically synthesized
aatcatcactgtggcttccata

SEQ ID NO: 1100257 - DNA, 22 bp, Artificial Sequence
  chemically synthesized
tggcttccatattcctttctga

SEQ ID NO: 1100258 - DNA, 22 bp, Artificial Sequence
  chemically synthesized
ccatattcctttctgactcatt

SEQ ID NO: 1100259 - DNA, 22 bp, Artificial Sequence
  chemically synthesized
catattcctttctgactcattt

SEQ ID NO: 1100260 - DNA, 22 bp, Artificial Sequence
  chemically synthesized
ctttctgactcattttcccact

SEQ ID NO: 1100261 - DNA, 22 bp, Artificial Sequence
  chemically synthesized
tctgactcattttcccactctt

SEQ ID NO: 1100262 - DNA, 22 bp, Artificial Sequence
  chemically synthesized
ctgactcattttcccactcttt

SEQ ID NO: 1100263 - DNA, 22 bp, Artificial Sequence
  chemically synthesized
tgactcattttcccactctttt

SEQ ID NO: 1100264 - DNA, 22 bp, Artificial Sequence
  chemically synthesized
actcattttcccactctttttc

SEQ ID NO: 1100265 - DNA, 22 bp, Artificial Sequence
  chemically synthesized
aaaggaagccaggagaaaaaga

SEQ ID NO: 1100266 - DNA, 22 bp, Artificial Sequence
  chemically synthesized
attttcccactctttttctcct

SEQ ID NO: 1100267 - DNA, 22 bp, Artificial Sequence
  chemically synthesized
tcccactctttttctcctggct

SEQ ID NO: 1100268 - DNA, 22 bp, Artificial Sequence
  chemically synthesized
cccactctttttctcctggctt

SEQ ID NO: 1100269 - DNA, 22 bp, Artificial Sequence
  chemically synthesized
ccactctttttctcctggcttc

SEQ ID NO: 1100270 - DNA, 22 bp, Artificial Sequence
  chemically synthesized
aggagctcaaaggaagccagga

SEQ ID NO: 1100271 - DNA, 22 bp, Artificial Sequence
  chemically synthesized
gaggagctcaaaggaagccagg

SEQ ID NO: 1100272 - DNA, 22 bp, Artificial Sequence
  chemically synthesized
tttttctcctggcttcctttga

SEQ ID NO: 1100273 - DNA, 22 bp, Artificial Sequence
  chemically synthesized
tttctcctggcttcctttgagc

SEQ ID NO: 1100274 - DNA, 22 bp, Artificial Sequence
  chemically synthesized
ttctcctggcttcctttgagct

SEQ ID NO: 1100275 - DNA, 22 bp, Artificial Sequence
  chemically synthesized
gcatgtttgaggagctcaaagg

SEQ ID NO: 1100276 - DNA, 22 bp, Artificial Sequence
  chemically synthesized
tctcctggcttcctttgagctc

SEQ ID NO: 1100277 - DNA, 22 bp, Artificial Sequence
  chemically synthesized
agcatgtttgaggagctcaaag

SEQ ID NO: 1100278 - DNA, 22 bp, Artificial Sequence
  chemically synthesized
ctcctggcttcctttgagctcc

SEQ ID NO: 1100279 - DNA, 22 bp, Artificial Sequence
  chemically synthesized
tcctggcttcctttgagctcct

SEQ ID NO: 1100280 - DNA, 22 bp, Artificial Sequence
  chemically synthesized
ctggcttcctttgagctcctca

SEQ ID NO: 1100281 - DNA, 22 bp, Artificial Sequence
  chemically synthesized
gcttcctttgagctcctcaaac

SEQ ID NO: 1100282 - DNA, 22 bp, Artificial Sequence
  chemically synthesized
cctttgagctcctcaaacatgc

SEQ ID NO: 1100283 - DNA, 22 bp, Artificial Sequence
  chemically synthesized
ctttgagctcctcaaacatgct

SEQ ID NO: 1100284 - DNA, 22 bp, Artificial Sequence
  chemically synthesized
tgagctcctcaaacatgctaag

SEQ ID NO: 1100285 - DNA, 22 bp, Artificial Sequence
  chemically synthesized
gagctcctcaaacatgctaagc

SEQ ID NO: 1100286 - DNA, 22 bp, Artificial Sequence
  chemically synthesized
aggcaagagagggcttagcatg

SEQ ID NO: 1100287 - DNA, 22 bp, Artificial Sequence
  chemically synthesized
agctcctcaaacatgctaagcc

SEQ ID NO: 1100288 - DNA, 22 bp, Artificial Sequence
  chemically synthesized
ctcaaacatgctaagccctctc

SEQ ID NO: 1100289 - DNA, 22 bp, Artificial Sequence
  chemically synthesized
aaacatgctaagccctctcttg

SEQ ID NO: 1100290 - DNA, 22 bp, Artificial Sequence
  chemically synthesized
agccctctcttgcctcagatgt

SEQ ID NO: 1100291 - DNA, 22 bp, Artificial Sequence
  chemically synthesized
tcttgcctcagatgttttctcc

SEQ ID NO: 1100292 - DNA, 22 bp, Artificial Sequence
  chemically synthesized
ttgcctcagatgttttctccac

SEQ ID NO: 1100293 - DNA, 22 bp, Artificial Sequence
  chemically synthesized
ccagaaaatgaagtggagaaaa

SEQ ID NO: 1100294 - DNA, 22 bp, Artificial Sequence
  chemically synthesized
gcctcagatgttttctccactt

SEQ ID NO: 1100295 - DNA, 22 bp, Artificial Sequence
  chemically synthesized
tgccagaaaatgaagtggagaa

SEQ ID NO: 1100296 - DNA, 22 bp, Artificial Sequence
  chemically synthesized
cctcagatgttttctccacttc

SEQ ID NO: 1100297 - DNA, 22 bp, Artificial Sequence
  chemically synthesized
agatgttttctccacttcattt

SEQ ID NO: 1100298 - DNA, 22 bp, Artificial Sequence
  chemically synthesized
tctccacttcattttctggcag

SEQ ID NO: 1100299 - DNA, 22 bp, Artificial Sequence
  chemically synthesized
tgtcaaggaattctgccagaaa

SEQ ID NO: 1100300 - DNA, 22 bp, Artificial Sequence
  chemically synthesized
ctccacttcattttctggcaga

SEQ ID NO: 1100301 - DNA, 22 bp, Artificial Sequence
  chemically synthesized
tccacttcattttctggcagaa

SEQ ID NO: 1100302 - DNA, 22 bp, Artificial Sequence
  chemically synthesized
ttgtgtcaaggaattctgccag

SEQ ID NO: 1100303 - DNA, 22 bp, Artificial Sequence
  chemically synthesized
cacttcattttctggcagaatt

SEQ ID NO: 1100304 - DNA, 22 bp, Artificial Sequence
  chemically synthesized
gttgtgtcaaggaattctgcca

SEQ ID NO: 1100305 - DNA, 22 bp, Artificial Sequence
  chemically synthesized
cattttctggcagaattccttg

SEQ ID NO: 1100306 - DNA, 22 bp, Artificial Sequence
  chemically synthesized
attttctggcagaattccttga

SEQ ID NO: 1100307 - DNA, 22 bp, Artificial Sequence
  chemically synthesized
acaatttgttgtgtcaaggaat

SEQ ID NO: 1100308 - DNA, 22 bp, Artificial Sequence
  chemically synthesized
gacaatttgttgtgtcaaggaa

SEQ ID NO: 1100309 - DNA, 22 bp, Artificial Sequence
  chemically synthesized
tctggcagaattccttgacaca

SEQ ID NO: 1100310 - DNA, 22 bp, Artificial Sequence
  chemically synthesized
ctggcagaattccttgacacaa

SEQ ID NO: 1100311 - DNA, 22 bp, Artificial Sequence
  chemically synthesized
tggcagaattccttgacacaac

SEQ ID NO: 1100312 - DNA, 22 bp, Artificial Sequence
  chemically synthesized
gcagaattccttgacacaacaa

SEQ ID NO: 1100313 - DNA, 22 bp, Artificial Sequence
  chemically synthesized
cttgacacaacaaattgtcaag

SEQ ID NO: 1100314 - DNA, 22 bp, Artificial Sequence
  chemically synthesized
gacacaacaaattgtcaagttc

SEQ ID NO: 1100315 - DNA, 22 bp, Artificial Sequence
  chemically synthesized
acacaacaaattgtcaagttcc

SEQ ID NO: 1100316 - DNA, 22 bp, Artificial Sequence
  chemically synthesized
atacccgagtagtaggaacttg

SEQ ID NO: 1100317 - DNA, 22 bp, Artificial Sequence
  chemically synthesized
aagctgatacccgagtagtagg

SEQ ID NO: 1100318 - DNA, 22 bp, Artificial Sequence
  chemically synthesized
tcaagttcctactactcgggta

SEQ ID NO: 1100319 - DNA, 22 bp, Artificial Sequence
  chemically synthesized
ctactactcgggtatcagcttt

SEQ ID NO: 1100320 - DNA, 22 bp, Artificial Sequence
  chemically synthesized
aagaggcgaaattaaagctgat

SEQ ID NO: 1100321 - DNA, 22 bp, Artificial Sequence
  chemically synthesized
ctactcgggtatcagctttaat

SEQ ID NO: 1100322 - DNA, 22 bp, Artificial Sequence
  chemically synthesized
tgaagaggcgaaattaaagctg

SEQ ID NO: 1100323 - DNA, 22 bp, Artificial Sequence
  chemically synthesized
ctgaagaggcgaaattaaagct

SEQ ID NO: 1100324 - DNA, 22 bp, Artificial Sequence
  chemically synthesized
tctgaagaggcgaaattaaagc

SEQ ID NO: 1100325 - DNA, 22 bp, Artificial Sequence
  chemically synthesized
ctcgggtatcagctttaatttc

SEQ ID NO: 1100326 - DNA, 22 bp, Artificial Sequence
  chemically synthesized
gggtatcagctttaatttcgcc

SEQ ID NO: 1100327 - DNA, 22 bp, Artificial Sequence
  chemically synthesized
taatttcgcctcttcagaaaac

SEQ ID NO: 1100328 - DNA, 22 bp, Artificial Sequence
  chemically synthesized
aatttcgcctcttcagaaaaca

SEQ ID NO: 1100329 - DNA, 22 bp, Artificial Sequence
  chemically synthesized
atttcgcctcttcagaaaacac

SEQ ID NO: 1100330 - DNA, 22 bp, Artificial Sequence
  chemically synthesized
ggtagtcagtagagtgttttct

SEQ ID NO: 1100331 - DNA, 22 bp, Artificial Sequence
  chemically synthesized
cgcctcttcagaaaacactcta

SEQ ID NO: 1100332 - DNA, 22 bp, Artificial Sequence
  chemically synthesized
ttgggtagtcagtagagtgttt

SEQ ID NO: 1100333 - DNA, 22 bp, Artificial Sequence
  chemically synthesized
gcctcttcagaaaacactctac

SEQ ID NO: 1100334 - DNA, 22 bp, Artificial Sequence
  chemically synthesized
tattgggtagtcagtagagtgt

SEQ ID NO: 1100335 - DNA, 22 bp, Artificial Sequence
  chemically synthesized
ctattgggtagtcagtagagtg

SEQ ID NO: 1100336 - DNA, 22 bp, Artificial Sequence
  chemically synthesized
tctattgggtagtcagtagagt

SEQ ID NO: 1100337 - DNA, 22 bp, Artificial Sequence
  chemically synthesized
ttcagaaaacactctactgact

SEQ ID NO: 1100338 - DNA, 22 bp, Artificial Sequence
  chemically synthesized
ctttctattgggtagtcagtag

SEQ ID NO: 1100339 - DNA, 22 bp, Artificial Sequence
  chemically synthesized
cagaaaacactctactgactac

SEQ ID NO: 1100340 - DNA, 22 bp, Artificial Sequence
  chemically synthesized
agaaaacactctactgactacc

SEQ ID NO: 1100341 - DNA, 22 bp, Artificial Sequence
  chemically synthesized
tactgactacccaatagaaagt

SEQ ID NO: 1100342 - DNA, 22 bp, Artificial Sequence
  chemically synthesized
ctgactacccaatagaaagtag

SEQ ID NO: 1100343 - DNA, 22 bp, Artificial Sequence
  chemically synthesized
actacccaatagaaagtagttt

SEQ ID NO: 1100344 - DNA, 22 bp, Artificial Sequence
  chemically synthesized
cccaatagaaagtagttttcct

SEQ ID NO: 1100345 - DNA, 22 bp, Artificial Sequence
  chemically synthesized
aatgagagtgacaggagcagga

SEQ ID NO: 1100346 - DNA, 22 bp, Artificial Sequence
  chemically synthesized
aaatgagagtgacaggagcagg

SEQ ID NO: 1100347 - DNA, 22 bp, Artificial Sequence
  chemically synthesized
taaatgagagtgacaggagcag

SEQ ID NO: 1100348 - DNA, 22 bp, Artificial Sequence
  chemically synthesized
tcctgctcctgtcactctcatt

SEQ ID NO: 1100349 - DNA, 22 bp, Artificial Sequence
  chemically synthesized
cctgctcctgtcactctcattt

SEQ ID NO: 1100350 - DNA, 22 bp, Artificial Sequence
  chemically synthesized
ctgctcctgtcactctcattta

SEQ ID NO: 1100351 - DNA, 22 bp, Artificial Sequence
  chemically synthesized
ctcctgtcactctcatttaaag

SEQ ID NO: 1100352 - DNA, 22 bp, Artificial Sequence
  chemically synthesized
ctgtcactctcatttaaagggt

SEQ ID NO: 1100353 - DNA, 22 bp, Artificial Sequence
  chemically synthesized
tcactctcatttaaagggttct

SEQ ID NO: 1100354 - DNA, 22 bp, Artificial Sequence
  chemically synthesized
aatgtagcaataagaacccttt

SEQ ID NO: 1100355 - DNA, 22 bp, Artificial Sequence
  chemically synthesized
tgaatgtagcaataagaaccct

SEQ ID NO: 1100356 - DNA, 22 bp, Artificial Sequence
  chemically synthesized
tcatttaaagggttcttattgc

SEQ ID NO: 1100357 - DNA, 22 bp, Artificial Sequence
  chemically synthesized
cactctgaatgtagcaataaga

SEQ ID NO: 1100358 - DNA, 22 bp, Artificial Sequence
  chemically synthesized
atttaaagggttcttattgcta

SEQ ID NO: 1100359 - DNA, 22 bp, Artificial Sequence
  chemically synthesized
acactctgaatgtagcaataag

SEQ ID NO: 1100360 - DNA, 22 bp, Artificial Sequence
  chemically synthesized
cttacactctgaatgtagcaat

SEQ ID NO: 1100361 - DNA, 22 bp, Artificial Sequence
  chemically synthesized
aaagggttcttattgctacatt

SEQ ID NO: 1100362 - DNA, 22 bp, Artificial Sequence
  chemically synthesized
gcttacactctgaatgtagcaa

SEQ ID NO: 1100363 - DNA, 22 bp, Artificial Sequence
  chemically synthesized
aagggttcttattgctacattc

SEQ ID NO: 1100364 - DNA, 22 bp, Artificial Sequence
  chemically synthesized
aagtcttgcttacactctgaat

SEQ ID NO: 1100365 - DNA, 22 bp, Artificial Sequence
  chemically synthesized
gaagtcttgcttacactctgaa

SEQ ID NO: 1100366 - DNA, 22 bp, Artificial Sequence
  chemically synthesized
ttattgctacattcagagtgta

SEQ ID NO: 1100367 - DNA, 22 bp, Artificial Sequence
  chemically synthesized
attgctacattcagagtgtaag

SEQ ID NO: 1100368 - DNA, 22 bp, Artificial Sequence
  chemically synthesized
tttgaagtcttgcttacactct

SEQ ID NO: 1100369 - DNA, 22 bp, Artificial Sequence
  chemically synthesized
ttgctacattcagagtgtaagc

SEQ ID NO: 1100370 - DNA, 22 bp, Artificial Sequence
  chemically synthesized
gtttgaagtcttgcttacactc

SEQ ID NO: 1100371 - DNA, 22 bp, Artificial Sequence
  chemically synthesized
ctacattcagagtgtaagcaag

SEQ ID NO: 1100372 - DNA, 22 bp, Artificial Sequence
  chemically synthesized
cattcagagtgtaagcaagact

SEQ ID NO: 1100373 - DNA, 22 bp, Artificial Sequence
  chemically synthesized
agagtgtaagcaagacttcaaa

SEQ ID NO: 1100374 - DNA, 22 bp, Artificial Sequence
  chemically synthesized
tcacaacaatgtcttgtttgaa

SEQ ID NO: 1100375 - DNA, 22 bp, Artificial Sequence
  chemically synthesized
acacattatcacaacaatgtct

SEQ ID NO: 1100376 - DNA, 22 bp, Artificial Sequence
  chemically synthesized
caaacaagacattgttgtgata

SEQ ID NO: 1100377 - DNA, 22 bp, Artificial Sequence
  chemically synthesized
aaacaagacattgttgtgataa

SEQ ID NO: 1100378 - DNA, 22 bp, Artificial Sequence
  chemically synthesized
ttgtgataatgtgttaacctat

SEQ ID NO: 1100379 - DNA, 22 bp, Artificial Sequence
  chemically synthesized
tgataatgtgttaacctattta

SEQ ID NO: 1100380 - DNA, 22 bp, Artificial Sequence
  chemically synthesized
gtggtgaaaatggaaagtaaat

SEQ ID NO: 1100381 - DNA, 22 bp, Artificial Sequence
  chemically synthesized
agtggtgaaaatggaaagtaaa

SEQ ID NO: 1100382 - DNA, 22 bp, Artificial Sequence
  chemically synthesized
acctatttactttccattttca

SEQ ID NO: 1100383 - DNA, 22 bp, Artificial Sequence
  chemically synthesized
tttactttccattttcaccact

SEQ ID NO: 1100384 - DNA, 22 bp, Artificial Sequence
  chemically synthesized
actttccattttcaccactaaa

SEQ ID NO: 1100385 - DNA, 22 bp, Artificial Sequence
  chemically synthesized
ctttccattttcaccactaaac

SEQ ID NO: 1100386 - DNA, 22 bp, Artificial Sequence
  chemically synthesized
acggagataatagtttagtggt

SEQ ID NO: 1100387 - DNA, 22 bp, Artificial Sequence
  chemically synthesized
cacggagataatagtttagtgg

SEQ ID NO: 1100388 - DNA, 22 bp, Artificial Sequence
  chemically synthesized
tccattttcaccactaaactat

SEQ ID NO: 1100389 - DNA, 22 bp, Artificial Sequence
  chemically synthesized
ccattttcaccactaaactatt

SEQ ID NO: 1100390 - DNA, 22 bp, Artificial Sequence
  chemically synthesized
cattttcaccactaaactatta

SEQ ID NO: 1100391 - DNA, 22 bp, Artificial Sequence
  chemically synthesized
ccttcacggagataatagttta

SEQ ID NO: 1100392 - DNA, 22 bp, Artificial Sequence
  chemically synthesized
tcaccactaaactattatctcc

SEQ ID NO: 1100393 - DNA, 22 bp, Artificial Sequence
  chemically synthesized
caccactaaactattatctccg

SEQ ID NO: 1100394 - DNA, 22 bp, Artificial Sequence
  chemically synthesized
tagttaccttcacggagataat

SEQ ID NO: 1100395 - DNA, 22 bp, Artificial Sequence
  chemically synthesized
accactaaactattatctccgt

SEQ ID NO: 1100396 - DNA, 22 bp, Artificial Sequence
  chemically synthesized
aactattatctccgtgaaggta

SEQ ID NO: 1100397 - DNA, 22 bp, Artificial Sequence
  chemically synthesized
ttatctccgtgaaggtaactac

SEQ ID NO: 1100398 - DNA, 22 bp, Artificial Sequence
  chemically synthesized
tctccgtgaaggtaactacaat

SEQ ID NO: 1100399 - DNA, 22 bp, Artificial Sequence
  chemically synthesized
cgtgaaggtaactacaatgtct

SEQ ID NO: 1100400 - DNA, 22 bp, Artificial Sequence
  chemically synthesized
caatgtctattttattccctca

SEQ ID NO: 1100401 - DNA, 22 bp, Artificial Sequence
  chemically synthesized
aaaaaatgatcagatataagtg

SEQ ID NO: 1100402 - DNA, 22 bp, Artificial Sequence
  chemically synthesized
ttttattccctcacttatatct

SEQ ID NO: 1100403 - DNA, 22 bp, Artificial Sequence
  chemically synthesized
taaaaaaatgatcagatataag

SEQ ID NO: 1100404 - DNA, 22 bp, Artificial Sequence
  chemically synthesized
ctaaaaaaatgatcagatataa

SEQ ID NO: 1100405 - DNA, 22 bp, Artificial Sequence
  chemically synthesized
tattccctcacttatatctgat

SEQ ID NO: 1100406 - DNA, 22 bp, Artificial Sequence
  chemically synthesized
attccctcacttatatctgatc

SEQ ID NO: 1100407 - DNA, 22 bp, Artificial Sequence
  chemically synthesized
ttccctcacttatatctgatca

SEQ ID NO: 1100408 - DNA, 22 bp, Artificial Sequence
  chemically synthesized
tttctaaaaaaatgatcagata

SEQ ID NO: 1100409 - DNA, 22 bp, Artificial Sequence
  chemically synthesized
cctcacttatatctgatcattt

SEQ ID NO: 1100410 - DNA, 22 bp, Artificial Sequence
  chemically synthesized
gctatttctaaaaaaatgatca

SEQ ID NO: 1100411 - DNA, 22 bp, Artificial Sequence
  chemically synthesized
tagctatttctaaaaaaatgat

SEQ ID NO: 1100412 - DNA, 22 bp, Artificial Sequence
  chemically synthesized
acttatatctgatcattttttt

SEQ ID NO: 1100413 - DNA, 22 bp, Artificial Sequence
  chemically synthesized
atatctgatcatttttttagaa

SEQ ID NO: 1100414 - DNA, 22 bp, Artificial Sequence
  chemically synthesized
gattctagctatttctaaaaaa

SEQ ID NO: 1100415 - DNA, 22 bp, Artificial Sequence
  chemically synthesized
tatctgatcatttttttagaaa

SEQ ID NO: 1100416 - DNA, 22 bp, Artificial Sequence
  chemically synthesized
atcatttttttagaaatagcta

SEQ ID NO: 1100417 - DNA, 22 bp, Artificial Sequence
  chemically synthesized
aaaatctagattctagctattt

SEQ ID NO: 1100418 - DNA, 22 bp, Artificial Sequence
  chemically synthesized
aaaaatctagattctagctatt

SEQ ID NO: 1100419 - DNA, 22 bp, Artificial Sequence
  chemically synthesized
ttttagaaatagctagaatcta

SEQ ID NO: 1100420 - DNA, 22 bp, Artificial Sequence
  chemically synthesized
tttagaaatagctagaatctag

SEQ ID NO: 1100421 - DNA, 22 bp, Artificial Sequence
  chemically synthesized
ttagaaatagctagaatctaga

SEQ ID NO: 1100422 - DNA, 22 bp, Artificial Sequence
  chemically synthesized
tagaaatagctagaatctagat

SEQ ID NO: 1100423 - DNA, 22 bp, Artificial Sequence
  chemically synthesized
agaaatagctagaatctagatt

SEQ ID NO: 1100424 - DNA, 22 bp, Artificial Sequence
  chemically synthesized
gaaatagctagaatctagattt

SEQ ID NO: 1100425 - DNA, 22 bp, Artificial Sequence
  chemically synthesized
gaatctagatttttaaacttat

SEQ ID NO: 1100426 - DNA, 22 bp, Artificial Sequence
  chemically synthesized
aagggtatgtatataagtttaa

SEQ ID NO: 1100427 - DNA, 22 bp, Artificial Sequence
  chemically synthesized
aaagggtatgtatataagttta

SEQ ID NO: 1100428 - DNA, 22 bp, Artificial Sequence
  chemically synthesized
taaagggtatgtatataagttt

SEQ ID NO: 1100429 - DNA, 22 bp, Artificial Sequence
  chemically synthesized
gatttttaaacttatatacata

SEQ ID NO: 1100430 - DNA, 22 bp, Artificial Sequence
  chemically synthesized
aattttaaagggtatgtatata

SEQ ID NO: 1100431 - DNA, 22 bp, Artificial Sequence
  chemically synthesized
aaattttaaagggtatgtatat

SEQ ID NO: 1100432 - DNA, 22 bp, Artificial Sequence
  chemically synthesized
taaattttaaagggtatgtata

SEQ ID NO: 1100433 - DNA, 22 bp, Artificial Sequence
  chemically synthesized
ttaaacttatatacataccctt

SEQ ID NO: 1100434 - DNA, 22 bp, Artificial Sequence
  chemically synthesized
ttttaaattttaaagggtatgt

SEQ ID NO: 1100435 - DNA, 22 bp, Artificial Sequence
  chemically synthesized
taaacttatatacatacccttt

SEQ ID NO: 1100436 - DNA, 22 bp, Artificial Sequence
  chemically synthesized
aaacttatatacatacccttta

SEQ ID NO: 1100437 - DNA, 22 bp, Artificial Sequence
  chemically synthesized
aacttatatacataccctttaa

SEQ ID NO: 1100438 - DNA, 22 bp, Artificial Sequence
  chemically synthesized
ttattttaaattttaaagggta

SEQ ID NO: 1100439 - DNA, 22 bp, Artificial Sequence
  chemically synthesized
atatacataccctttaaaattt

SEQ ID NO: 1100440 - DNA, 22 bp, Artificial Sequence
  chemically synthesized
tatacataccctttaaaattta

SEQ ID NO: 1100441 - DNA, 22 bp, Artificial Sequence
  chemically synthesized
ggtatataaaatggttattatt

SEQ ID NO: 1100442 - DNA, 22 bp, Artificial Sequence
  chemically synthesized
gggtatataaaatggttattat

SEQ ID NO: 1100443 - DNA, 22 bp, Artificial Sequence
  chemically synthesized
taaaatttaaaataataaccat

SEQ ID NO: 1100444 - DNA, 22 bp, Artificial Sequence
  chemically synthesized
tgggtatataaaatggttatta

SEQ ID NO: 1100445 - DNA, 22 bp, Artificial Sequence
  chemically synthesized
aaaatttaaaataataaccatt

SEQ ID NO: 1100446 - DNA, 22 bp, Artificial Sequence
  chemically synthesized
aaatttaaaataataaccattt

SEQ ID NO: 1100447 - DNA, 22 bp, Artificial Sequence
  chemically synthesized
attttgggtatataaaatggtt

SEQ ID NO: 1100448 - DNA, 22 bp, Artificial Sequence
  chemically synthesized
aaaataataaccattttatata

SEQ ID NO: 1100449 - DNA, 22 bp, Artificial Sequence
  chemically synthesized
aaataataaccattttatatac

SEQ ID NO: 1100450 - DNA, 22 bp, Artificial Sequence
  chemically synthesized
acatcccatgatctaattttgg

SEQ ID NO: 1100451 - DNA, 22 bp, Artificial Sequence
  chemically synthesized
cacatcccatgatctaattttg

SEQ ID NO: 1100452 - DNA, 22 bp, Artificial Sequence
  chemically synthesized
tcacatcccatgatctaatttt

SEQ ID NO: 1100453 - DNA, 22 bp, Artificial Sequence
  chemically synthesized
tatatacccaaaattagatcat

SEQ ID NO: 1100454 - DNA, 22 bp, Artificial Sequence
  chemically synthesized
atatacccaaaattagatcatg

SEQ ID NO: 1100455 - DNA, 22 bp, Artificial Sequence
  chemically synthesized
tatacccaaaattagatcatgg

SEQ ID NO: 1100456 - DNA, 22 bp, Artificial Sequence
  chemically synthesized
aagatgctttcacatcccatga

SEQ ID NO: 1100457 - DNA, 22 bp, Artificial Sequence
  chemically synthesized
gaagatgctttcacatcccatg

SEQ ID NO: 1100458 - DNA, 22 bp, Artificial Sequence
  chemically synthesized
atacatttgaagatgctttcac

SEQ ID NO: 1100459 - DNA, 22 bp, Artificial Sequence
  chemically synthesized
gatcatgggatgtgaaagcatc

SEQ ID NO: 1100460 - DNA, 22 bp, Artificial Sequence
  chemically synthesized
tccaaatatctgatacatttga

SEQ ID NO: 1100461 - DNA, 22 bp, Artificial Sequence
  chemically synthesized
aaacaaaattgtccaaatatct

SEQ ID NO: 1100462 - DNA, 22 bp, Artificial Sequence
  chemically synthesized
gaaacaaaattgtccaaatatc

SEQ ID NO: 1100463 - DNA, 22 bp, Artificial Sequence
  chemically synthesized
caaatgtatcagatatttggac

SEQ ID NO: 1100464 - DNA, 22 bp, Artificial Sequence
  chemically synthesized
aaatgtatcagatatttggaca

SEQ ID NO: 1100465 - DNA, 22 bp, Artificial Sequence
  chemically synthesized
cgaaaacataaataatttgaaa

SEQ ID NO: 1100466 - DNA, 22 bp, Artificial Sequence
  chemically synthesized
ggacaattttgtttcaaattat

SEQ ID NO: 1100467 - DNA, 22 bp, Artificial Sequence
  chemically synthesized
gacaattttgtttcaaattatt

SEQ ID NO: 1100468 - DNA, 22 bp, Artificial Sequence
  chemically synthesized
tgtttcaaattatttatgtttt

SEQ ID NO: 1100469 - DNA, 22 bp, Artificial Sequence
  chemically synthesized
gtttcaaattatttatgttttc

SEQ ID NO: 1100470 - DNA, 22 bp, Artificial Sequence
  chemically synthesized
tttcaaattatttatgttttcg

SEQ ID NO: 1100471 - DNA, 22 bp, Artificial Sequence
  chemically synthesized
caaattatttatgttttcgcag

SEQ ID NO: 1100472 - DNA, 22 bp, Artificial Sequence
  chemically synthesized
aaattatttatgttttcgcaga

SEQ ID NO: 1100473 - DNA, 22 bp, Artificial Sequence
  chemically synthesized
tcaccagatgccaatgtctgcg

SEQ ID NO: 1100474 - DNA, 22 bp, Artificial Sequence
  chemically synthesized
gtcaccagatgccaatgtctgc

SEQ ID NO: 1100475 - DNA, 22 bp, Artificial Sequence
  chemically synthesized
tttatgttttcgcagacattgg

SEQ ID NO: 1100476 - DNA, 22 bp, Artificial Sequence
  chemically synthesized
tgtcaccagatgccaatgtctg

SEQ ID NO: 1100477 - DNA, 22 bp, Artificial Sequence
  chemically synthesized
ttgtcaccagatgccaatgtct

SEQ ID NO: 1100478 - DNA, 22 bp, Artificial Sequence
  chemically synthesized
tttgtcaccagatgccaatgtc

SEQ ID NO: 1100479 - DNA, 22 bp, Artificial Sequence
  chemically synthesized
atgttttcgcagacattggcat

SEQ ID NO: 1100480 - DNA, 22 bp, Artificial Sequence
  chemically synthesized
ttttgtcaccagatgccaatgt

SEQ ID NO: 1100481 - DNA, 22 bp, Artificial Sequence
  chemically synthesized
tgttttcgcagacattggcatc

SEQ ID NO: 1100482 - DNA, 22 bp, Artificial Sequence
  chemically synthesized
cttttttgtcaccagatgccaa

SEQ ID NO: 1100483 - DNA, 22 bp, Artificial Sequence
  chemically synthesized
tcgcagacattggcatctggtg

SEQ ID NO: 1100484 - DNA, 22 bp, Artificial Sequence
  chemically synthesized
cgcagacattggcatctggtga

SEQ ID NO: 1100485 - DNA, 22 bp, Artificial Sequence
  chemically synthesized
gcagacattggcatctggtgac

SEQ ID NO: 1100486 - DNA, 22 bp, Artificial Sequence
  chemically synthesized
aagataattccttttttgtcac

SEQ ID NO: 1100487 - DNA, 22 bp, Artificial Sequence
  chemically synthesized
gcatctggtgacaaaaaaggaa

SEQ ID NO: 1100488 - DNA, 22 bp, Artificial Sequence
  chemically synthesized
ggttaaagataattcctttttt

SEQ ID NO: 1100489 - DNA, 22 bp, Artificial Sequence
  chemically synthesized
gggttaaagataattccttttt

SEQ ID NO: 1100490 - DNA, 22 bp, Artificial Sequence
  chemically synthesized
tgggttaaagataattcctttt

SEQ ID NO: 1100491 - DNA, 22 bp, Artificial Sequence
  chemically synthesized
ttgggttaaagataattccttt

SEQ ID NO: 1100492 - DNA, 22 bp, Artificial Sequence
  chemically synthesized
ttttgggttaaagataattcct

SEQ ID NO: 1100493 - DNA, 22 bp, Artificial Sequence
  chemically synthesized
gtgacaaaaaaggaattatctt

SEQ ID NO: 1100494 - DNA, 22 bp, Artificial Sequence
  chemically synthesized
tctttaacccaaaagagtgtat

SEQ ID NO: 1100495 - DNA, 22 bp, Artificial Sequence
  chemically synthesized
taacccaaaagagtgtatcaca

SEQ ID NO: 1100496 - DNA, 22 bp, Artificial Sequence
  chemically synthesized
aacccaaaagagtgtatcacac

SEQ ID NO: 1100497 - DNA, 22 bp, Artificial Sequence
  chemically synthesized
acccaaaagagtgtatcacaca

SEQ ID NO: 1100498 - DNA, 22 bp, Artificial Sequence
  chemically synthesized
cagacaaaataagtgtgtgata

SEQ ID NO: 1100499 - DNA, 22 bp, Artificial Sequence
  chemically synthesized
cagaaatatctacagacaaaat

SEQ ID NO: 1100500 - DNA, 22 bp, Artificial Sequence
  chemically synthesized
tgcattacagaaatatctacag

SEQ ID NO: 1100501 - DNA, 22 bp, Artificial Sequence
  chemically synthesized
attttgtctgtagatatttctg

SEQ ID NO: 1100502 - DNA, 22 bp, Artificial Sequence
  chemically synthesized
ttttgtctgtagatatttctgt

SEQ ID NO: 1100503 - DNA, 22 bp, Artificial Sequence
  chemically synthesized
tgtctgtagatatttctgtaat

SEQ ID NO: 1100504 - DNA, 22 bp, Artificial Sequence
  chemically synthesized
gtctgtagatatttctgtaatg

SEQ ID NO: 1100505 - DNA, 22 bp, Artificial Sequence
  chemically synthesized
tctgtagatatttctgtaatgc

SEQ ID NO: 1100506 - DNA, 22 bp, Artificial Sequence
  chemically synthesized
tagatatttctgtaatgcatag

SEQ ID NO: 1100507 - DNA, 22 bp, Artificial Sequence
  chemically synthesized
ctgtaatgcatagatttacact

SEQ ID NO: 1100508 - DNA, 22 bp, Artificial Sequence
  chemically synthesized
tgtaatgcatagatttacactt

SEQ ID NO: 1100509 - DNA, 22 bp, Artificial Sequence
  chemically synthesized
taatgcatagatttacacttca

SEQ ID NO: 1100510 - DNA, 22 bp, Artificial Sequence
  chemically synthesized
cagagagaataatggaaatgaa

SEQ ID NO: 1100511 - DNA, 22 bp, Artificial Sequence
  chemically synthesized
agcattccagagagaataatgg

SEQ ID NO: 1100512 - DNA, 22 bp, Artificial Sequence
  chemically synthesized
acacttcatttccattattctc

SEQ ID NO: 1100513 - DNA, 22 bp, Artificial Sequence
  chemically synthesized
cacttcatttccattattctct

SEQ ID NO: 1100514 - DNA, 22 bp, Artificial Sequence
  chemically synthesized
catttccattattctctctgga

SEQ ID NO: 1100515 - DNA, 22 bp, Artificial Sequence
  chemically synthesized
ccaattcagcattccagagaga

SEQ ID NO: 1100516 - DNA, 22 bp, Artificial Sequence
  chemically synthesized
atttccattattctctctggaa

SEQ ID NO: 1100517 - DNA, 22 bp, Artificial Sequence
  chemically synthesized
ttaccaattcagcattccagag

SEQ ID NO: 1100518 - DNA, 22 bp, Artificial Sequence
  chemically synthesized
ccattattctctctggaatgct

SEQ ID NO: 1100519 - DNA, 22 bp, Artificial Sequence
  chemically synthesized
cattattctctctggaatgctg

SEQ ID NO: 1100520 - DNA, 22 bp, Artificial Sequence
  chemically synthesized
ttctctctggaatgctgaattg

SEQ ID NO: 1100521 - DNA, 22 bp, Artificial Sequence
  chemically synthesized
tctctggaatgctgaattggta

SEQ ID NO: 1100522 - DNA, 22 bp, Artificial Sequence
  chemically synthesized
tctggaatgctgaattggtaac

SEQ ID NO: 1100523 - DNA, 22 bp, Artificial Sequence
  chemically synthesized
tggaatgctgaattggtaacaa

SEQ ID NO: 1100524 - DNA, 22 bp, Artificial Sequence
  chemically synthesized
gaatgctgaattggtaacaata

SEQ ID NO: 1100525 - DNA, 22 bp, Artificial Sequence
  chemically synthesized
aattggtaacaatattcacata

SEQ ID NO: 1100526 - DNA, 22 bp, Artificial Sequence
  chemically synthesized
gtaacaatattcacatatggct

SEQ ID NO: 1100527 - DNA, 22 bp, Artificial Sequence
  chemically synthesized
acatatggcttccttgttttta

SEQ ID NO: 1100528 - DNA, 22 bp, Artificial Sequence
  chemically synthesized
ccttgtttttaccgcatcgtct

SEQ ID NO: 1100529 - DNA, 22 bp, Artificial Sequence
  chemically synthesized
cttgtttttaccgcatcgtctt

SEQ ID NO: 1100530 - DNA, 22 bp, Artificial Sequence
  chemically synthesized
aaggagaagaagaagacgatgc

SEQ ID NO: 1100531 - DNA, 22 bp, Artificial Sequence
  chemically synthesized
gtttttaccgcatcgtcttctt

SEQ ID NO: 1100532 - DNA, 22 bp, Artificial Sequence
  chemically synthesized
tttttaccgcatcgtcttcttc

SEQ ID NO: 1100533 - DNA, 22 bp, Artificial Sequence
  chemically synthesized
ttaccgcatcgtcttcttcttc

SEQ ID NO: 1100534 - DNA, 22 bp, Artificial Sequence
  chemically synthesized
taccgcatcgtcttcttcttct

SEQ ID NO: 1100535 - DNA, 22 bp, Artificial Sequence
  chemically synthesized
accgcatcgtcttcttcttctc

SEQ ID NO: 1100536 - DNA, 22 bp, Artificial Sequence
  chemically synthesized
ccgcatcgtcttcttcttctcc

SEQ ID NO: 1100537 - DNA, 22 bp, Artificial Sequence
  chemically synthesized
cttcttctccttgagcgccatt

SEQ ID NO: 1100538 - DNA, 22 bp, Artificial Sequence
  chemically synthesized
ttcttctccttgagcgccattg

SEQ ID NO: 1100539 - DNA, 22 bp, Artificial Sequence
  chemically synthesized
taaaaggaaggaacaatggcgc

SEQ ID NO: 1100540 - DNA, 22 bp, Artificial Sequence
  chemically synthesized
cttctccttgagcgccattgtt

SEQ ID NO: 1100541 - DNA, 22 bp, Artificial Sequence
  chemically synthesized
ttctccttgagcgccattgttc

SEQ ID NO: 1100542 - DNA, 22 bp, Artificial Sequence
  chemically synthesized
ctccttgagcgccattgttcct

SEQ ID NO: 1100543 - DNA, 22 bp, Artificial Sequence
  chemically synthesized
tccttgagcgccattgttcctt

SEQ ID NO: 1100544 - DNA, 22 bp, Artificial Sequence
  chemically synthesized
ggttgtaaaaggaaggaacaat

SEQ ID NO: 1100545 - DNA, 22 bp, Artificial Sequence
  chemically synthesized
cttgagcgccattgttccttcc

SEQ ID NO: 1100546 - DNA, 22 bp, Artificial Sequence
  chemically synthesized
gagcgccattgttccttccttt

SEQ ID NO: 1100547 - DNA, 22 bp, Artificial Sequence
  chemically synthesized
agcgccattgttccttcctttt

SEQ ID NO: 1100548 - DNA, 22 bp, Artificial Sequence
  chemically synthesized
tagccaaatgagttaggttgta

SEQ ID NO: 1100549 - DNA, 22 bp, Artificial Sequence
  chemically synthesized
ttccttccttttacaacctaac

SEQ ID NO: 1100550 - DNA, 22 bp, Artificial Sequence
  chemically synthesized
gtagccaaatgagttaggttgt

SEQ ID NO: 1100551 - DNA, 22 bp, Artificial Sequence
  chemically synthesized
tgtagccaaatgagttaggttg

SEQ ID NO: 1100552 - DNA, 22 bp, Artificial Sequence
  chemically synthesized
cttccttttacaacctaactca

SEQ ID NO: 1100553 - DNA, 22 bp, Artificial Sequence
  chemically synthesized
actttgtagccaaatgagttag

SEQ ID NO: 1100554 - DNA, 22 bp, Artificial Sequence
  chemically synthesized
ccttttacaacctaactcattt

SEQ ID NO: 1100555 - DNA, 22 bp, Artificial Sequence
  chemically synthesized
cttttacaacctaactcatttg

SEQ ID NO: 1100556 - DNA, 22 bp, Artificial Sequence
  chemically synthesized
tgactttgtagccaaatgagtt

SEQ ID NO: 1100557 - DNA, 22 bp, Artificial Sequence
  chemically synthesized
ttacaacctaactcatttggct

SEQ ID NO: 1100558 - DNA, 22 bp, Artificial Sequence
  chemically synthesized
tacaacctaactcatttggcta

SEQ ID NO: 1100559 - DNA, 22 bp, Artificial Sequence
  chemically synthesized
acaacctaactcatttggctac

SEQ ID NO: 1100560 - DNA, 22 bp, Artificial Sequence
  chemically synthesized
caacctaactcatttggctaca

SEQ ID NO: 1100561 - DNA, 22 bp, Artificial Sequence
  chemically synthesized
gccatgttctgactttgtagcc

SEQ ID NO: 1100562 - DNA, 22 bp, Artificial Sequence
  chemically synthesized
tggccatgttctgactttgtag

SEQ ID NO: 1100563 - DNA, 22 bp, Artificial Sequence
  chemically synthesized
actcatttggctacaaagtcag

SEQ ID NO: 1100564 - DNA, 22 bp, Artificial Sequence
  chemically synthesized
atttggctacaaagtcagaaca

SEQ ID NO: 1100565 - DNA, 22 bp, Artificial Sequence
  chemically synthesized
ggctacaaagtcagaacatggc

SEQ ID NO: 1100566 - DNA, 22 bp, Artificial Sequence
  chemically synthesized
gctacaaagtcagaacatggcc

SEQ ID NO: 1100567 - DNA, 22 bp, Artificial Sequence
  chemically synthesized
caagtatcactctggccatgtt

SEQ ID NO: 1100568 - DNA, 22 bp, Artificial Sequence
  chemically synthesized
caaagtcagaacatggccagag

SEQ ID NO: 1100569 - DNA, 22 bp, Artificial Sequence
  chemically synthesized
ctacaagtatcactctggccat

SEQ ID NO: 1100570 - DNA, 22 bp, Artificial Sequence
  chemically synthesized
cctacaagtatcactctggcca

SEQ ID NO: 1100571 - DNA, 22 bp, Artificial Sequence
  chemically synthesized
tcctacaagtatcactctggcc

SEQ ID NO: 1100572 - DNA, 22 bp, Artificial Sequence
  chemically synthesized
ttcctacaagtatcactctggc

SEQ ID NO: 1100573 - DNA, 22 bp, Artificial Sequence
  chemically synthesized
tgcttttcctacaagtatcact

SEQ ID NO: 1100574 - DNA, 22 bp, Artificial Sequence
  chemically synthesized
tatgtatctgtgcttttcctac

SEQ ID NO: 1100575 - DNA, 22 bp, Artificial Sequence
  chemically synthesized
gaatattatatgtatctgtgct

SEQ ID NO: 1100576 - DNA, 22 bp, Artificial Sequence
  chemically synthesized
agaatattatatgtatctgtgc

SEQ ID NO: 1100577 - DNA, 22 bp, Artificial Sequence
  chemically synthesized
gtaggaaaagcacagatacata

SEQ ID NO: 1100578 - DNA, 22 bp, Artificial Sequence
  chemically synthesized
taggaaaagcacagatacatat

SEQ ID NO: 1100579 - DNA, 22 bp, Artificial Sequence
  chemically synthesized
atcttagaatattatatgtatc

SEQ ID NO: 1100580 - DNA, 22 bp, Artificial Sequence
  chemically synthesized
taatcttagaatattatatgta

SEQ ID NO: 1100581 - DNA, 22 bp, Artificial Sequence
  chemically synthesized
ctaatcttagaatattatatgt

SEQ ID NO: 1100582 - DNA, 22 bp, Artificial Sequence
  chemically synthesized
tctaatcttagaatattatatg

SEQ ID NO: 1100583 - DNA, 22 bp, Artificial Sequence
  chemically synthesized
cattttctaatcttagaatatt

SEQ ID NO: 1100584 - DNA, 22 bp, Artificial Sequence
  chemically synthesized
atctccattttctaatcttaga

SEQ ID NO: 1100585 - DNA, 22 bp, Artificial Sequence
  chemically synthesized
tgatctccattttctaatctta

SEQ ID NO: 1100586 - DNA, 22 bp, Artificial Sequence
  chemically synthesized
tgttctgatctccattttctaa

SEQ ID NO: 1100587 - DNA, 22 bp, Artificial Sequence
  chemically synthesized
taagattagaaaatggagatca

SEQ ID NO: 1100588 - DNA, 22 bp, Artificial Sequence
  chemically synthesized
agattagaaaatggagatcaga

SEQ ID NO: 1100589 - DNA, 22 bp, Artificial Sequence
  chemically synthesized
tagatccaagctatgttctgat

SEQ ID NO: 1100590 - DNA, 22 bp, Artificial Sequence
  chemically synthesized
gaaaatggagatcagaacatag

SEQ ID NO: 1100591 - DNA, 22 bp, Artificial Sequence
  chemically synthesized
catagcaaaaaagctatagatc

SEQ ID NO: 1100592 - DNA, 22 bp, Artificial Sequence
  chemically synthesized
ttgcatagcaaaaaagctatag

SEQ ID NO: 1100593 - DNA, 22 bp, Artificial Sequence
  chemically synthesized
atctgttgcatagcaaaaaagc

SEQ ID NO: 1100594 - DNA, 22 bp, Artificial Sequence
  chemically synthesized
ggatctatagcttttttgctat

SEQ ID NO: 1100595 - DNA, 22 bp, Artificial Sequence
  chemically synthesized
gatctatagcttttttgctatg

SEQ ID NO: 1100596 - DNA, 22 bp, Artificial Sequence
  chemically synthesized
aacacactcatctgttgcatag

SEQ ID NO: 1100597 - DNA, 22 bp, Artificial Sequence
  chemically synthesized
tagcttttttgctatgcaacag

SEQ ID NO: 1100598 - DNA, 22 bp, Artificial Sequence
  chemically synthesized
aaacacactcatctgttgcata

SEQ ID NO: 1100599 - DNA, 22 bp, Artificial Sequence
  chemically synthesized
taaacacactcatctgttgcat

SEQ ID NO: 1100600 - DNA, 22 bp, Artificial Sequence
  chemically synthesized
ttttgctatgcaacagatgagt

SEQ ID NO: 1100601 - DNA, 22 bp, Artificial Sequence
  chemically synthesized
tttgctatgcaacagatgagtg

SEQ ID NO: 1100602 - DNA, 22 bp, Artificial Sequence
  chemically synthesized
ttgctatgcaacagatgagtgt

SEQ ID NO: 1100603 - DNA, 22 bp, Artificial Sequence
  chemically synthesized
tgctatgcaacagatgagtgtg

SEQ ID NO: 1100604 - DNA, 22 bp, Artificial Sequence
  chemically synthesized
gctatgcaacagatgagtgtgt

SEQ ID NO: 1100605 - DNA, 22 bp, Artificial Sequence
  chemically synthesized
ctatgcaacagatgagtgtgtt

SEQ ID NO: 1100606 - DNA, 22 bp, Artificial Sequence
  chemically synthesized
tgcaacagatgagtgtgtttaa

SEQ ID NO: 1100607 - DNA, 22 bp, Artificial Sequence
  chemically synthesized
aagagatatattttaaacacac

SEQ ID NO: 1100608 - DNA, 22 bp, Artificial Sequence
  chemically synthesized
ttcaagagatatattttaaaca

SEQ ID NO: 1100609 - DNA, 22 bp, Artificial Sequence
  chemically synthesized
ttgttcaagagatatattttaa

SEQ ID NO: 1100610 - DNA, 22 bp, Artificial Sequence
  chemically synthesized
gttgttcaagagatatatttta

SEQ ID NO: 1100611 - DNA, 22 bp, Artificial Sequence
  chemically synthesized
agaatttgttgttcaagagata

SEQ ID NO: 1100612 - DNA, 22 bp, Artificial Sequence
  chemically synthesized
aaaatatatctcttgaacaaca

SEQ ID NO: 1100613 - DNA, 22 bp, Artificial Sequence
  chemically synthesized
aaatatatctcttgaacaacaa

SEQ ID NO: 1100614 - DNA, 22 bp, Artificial Sequence
  chemically synthesized
tatgtactaagaatttgttgtt

SEQ ID NO: 1100615 - DNA, 22 bp, Artificial Sequence
  chemically synthesized
ttatatgtactaagaatttgtt

SEQ ID NO: 1100616 - DNA, 22 bp, Artificial Sequence
  chemically synthesized
ttgaacaacaaattcttagtac

SEQ ID NO: 1100617 - DNA, 22 bp, Artificial Sequence
  chemically synthesized
tgtctgttatatgtactaagaa

SEQ ID NO: 1100618 - DNA, 22 bp, Artificial Sequence
  chemically synthesized
atgtctgttatatgtactaaga

SEQ ID NO: 1100619 - DNA, 22 bp, Artificial Sequence
  chemically synthesized
gaacaacaaattcttagtacat

SEQ ID NO: 1100620 - DNA, 22 bp, Artificial Sequence
  chemically synthesized
aacaacaaattcttagtacata

SEQ ID NO: 1100621 - DNA, 22 bp, Artificial Sequence
  chemically synthesized
agaccttatgtctgttatatgt

SEQ ID NO: 1100622 - DNA, 22 bp, Artificial Sequence
  chemically synthesized
aagaccttatgtctgttatatg

SEQ ID NO: 1100623 - DNA, 22 bp, Artificial Sequence
  chemically synthesized
cttaagaccttatgtctgttat

SEQ ID NO: 1100624 - DNA, 22 bp, Artificial Sequence
  chemically synthesized
gcttaagaccttatgtctgtta

SEQ ID NO: 1100625 - DNA, 22 bp, Artificial Sequence
  chemically synthesized
tgcttaagaccttatgtctgtt

SEQ ID NO: 1100626 - DNA, 22 bp, Artificial Sequence
  chemically synthesized
ttagtacatataacagacataa

SEQ ID NO: 1100627 - DNA, 22 bp, Artificial Sequence
  chemically synthesized
agtacatataacagacataagg

SEQ ID NO: 1100628 - DNA, 22 bp, Artificial Sequence
  chemically synthesized
gtacatataacagacataaggt

SEQ ID NO: 1100629 - DNA, 22 bp, Artificial Sequence
  chemically synthesized
aaaatgtctttgcttaagacct

SEQ ID NO: 1100630 - DNA, 22 bp, Artificial Sequence
  chemically synthesized
taaaaatgtctttgcttaagac

SEQ ID NO: 1100631 - DNA, 22 bp, Artificial Sequence
  chemically synthesized
tctaaaaatgtctttgcttaag

SEQ ID NO: 1100632 - DNA, 22 bp, Artificial Sequence
  chemically synthesized
taaaggctctctaaaaatgtct

SEQ ID NO: 1100633 - DNA, 22 bp, Artificial Sequence
  chemically synthesized
gtaaaggctctctaaaaatgtc

SEQ ID NO: 1100634 - DNA, 22 bp, Artificial Sequence
  chemically synthesized
aagcaaagacatttttagagag

SEQ ID NO: 1100635 - DNA, 22 bp, Artificial Sequence
  chemically synthesized
agcaaagacatttttagagagc

SEQ ID NO: 1100636 - DNA, 22 bp, Artificial Sequence
  chemically synthesized
caggagtacaatttgtaaaggc

SEQ ID NO: 1100637 - DNA, 22 bp, Artificial Sequence
  chemically synthesized
acaggagtacaatttgtaaagg

SEQ ID NO: 1100638 - DNA, 22 bp, Artificial Sequence
  chemically synthesized
tacaggagtacaatttgtaaag

SEQ ID NO: 1100639 - DNA, 22 bp, Artificial Sequence
  chemically synthesized
ttagagagcctttacaaattgt

SEQ ID NO: 1100640 - DNA, 22 bp, Artificial Sequence
  chemically synthesized
tagagagcctttacaaattgta

SEQ ID NO: 1100641 - DNA, 22 bp, Artificial Sequence
  chemically synthesized
agagagcctttacaaattgtac

SEQ ID NO: 1100642 - DNA, 22 bp, Artificial Sequence
  chemically synthesized
cattttacaggagtacaatttg

SEQ ID NO: 1100643 - DNA, 22 bp, Artificial Sequence
  chemically synthesized
gagagcctttacaaattgtact

SEQ ID NO: 1100644 - DNA, 22 bp, Artificial Sequence
  chemically synthesized
acattttacaggagtacaattt

SEQ ID NO: 1100645 - DNA, 22 bp, Artificial Sequence
  chemically synthesized
tacattttacaggagtacaatt

SEQ ID NO: 1100646 - DNA, 22 bp, Artificial Sequence
  chemically synthesized
ttacattttacaggagtacaat

SEQ ID NO: 1100647 - DNA, 22 bp, Artificial Sequence
  chemically synthesized
tacaaattgtactcctgtaaaa

SEQ ID NO: 1100648 - DNA, 22 bp, Artificial Sequence
  chemically synthesized
aaggtttttacattttacagga

SEQ ID NO: 1100649 - DNA, 22 bp, Artificial Sequence
  chemically synthesized
acaaattgtactcctgtaaaat

SEQ ID NO: 1100650 - DNA, 22 bp, Artificial Sequence
  chemically synthesized
caaattgtactcctgtaaaatg

SEQ ID NO: 1100651 - DNA, 22 bp, Artificial Sequence
  chemically synthesized
aaacctcaaggtttttacattt

SEQ ID NO: 1100652 - DNA, 22 bp, Artificial Sequence
  chemically synthesized
tactcctgtaaaatgtaaaaac

SEQ ID NO: 1100653 - DNA, 22 bp, Artificial Sequence
  chemically synthesized
ctaaaacctcaaggtttttaca

SEQ ID NO: 1100654 - DNA, 22 bp, Artificial Sequence
  chemically synthesized
ctgtaaaatgtaaaaaccttga

SEQ ID NO: 1100655 - DNA, 22 bp, Artificial Sequence
  chemically synthesized
taaaatgtaaaaaccttgaggt

SEQ ID NO: 1100656 - DNA, 22 bp, Artificial Sequence
  chemically synthesized
gaggttttagtaatattgttgg

SEQ ID NO: 1100657 - DNA, 22 bp, Artificial Sequence
  chemically synthesized
aggttttagtaatattgttggt

SEQ ID NO: 1100658 - DNA, 22 bp, Artificial Sequence
  chemically synthesized
tagtaatattgttggttttata

SEQ ID NO: 1100659 - DNA, 22 bp, Artificial Sequence
  chemically synthesized
agtaatattgttggttttatac

SEQ ID NO: 1100660 - DNA, 22 bp, Artificial Sequence
  chemically synthesized
gtaatattgttggttttatact

SEQ ID NO: 1100661 - DNA, 22 bp, Artificial Sequence
  chemically synthesized
ttggttttatactttttttttt

SEQ ID NO: 1100662 - DNA, 22 bp, Artificial Sequence
  chemically synthesized
gttttatactttttttttttgg

SEQ ID NO: 1100663 - DNA, 22 bp, Artificial Sequence
  chemically synthesized
tatactttttttttttggctga

SEQ ID NO: 1100664 - DNA, 22 bp, Artificial Sequence
  chemically synthesized
atactttttttttttggctgat

SEQ ID NO: 1100665 - DNA, 22 bp, Artificial Sequence
  chemically synthesized
tactttttttttttggctgatg

SEQ ID NO: 1100666 - DNA, 22 bp, Artificial Sequence
  chemically synthesized
tttttttttggctgatgttttc

SEQ ID NO: 1100667 - DNA, 22 bp, Artificial Sequence
  chemically synthesized
ttttttttggctgatgttttcc

SEQ ID NO: 1100668 - DNA, 22 bp, Artificial Sequence
  chemically synthesized
tgtagagcaaggggaaaacatc

SEQ ID NO: 1100669 - DNA, 22 bp, Artificial Sequence
  chemically synthesized
tttttttggctgatgttttccc

SEQ ID NO: 1100670 - DNA, 22 bp, Artificial Sequence
  chemically synthesized
atgtagagcaaggggaaaacat

SEQ ID NO: 1100671 - DNA, 22 bp, Artificial Sequence
  chemically synthesized
ttttttggctgatgttttcccc

SEQ ID NO: 1100672 - DNA, 22 bp, Artificial Sequence
  chemically synthesized
tttttggctgatgttttcccct

SEQ ID NO: 1100673 - DNA, 22 bp, Artificial Sequence
  chemically synthesized
ttttggctgatgttttcccctt

SEQ ID NO: 1100674 - DNA, 22 bp, Artificial Sequence
  chemically synthesized
tttggctgatgttttccccttg

SEQ ID NO: 1100675 - DNA, 22 bp, Artificial Sequence
  chemically synthesized
ttggctgatgttttccccttgc

SEQ ID NO: 1100676 - DNA, 22 bp, Artificial Sequence
  chemically synthesized
tggctgatgttttccccttgct

SEQ ID NO: 1100677 - DNA, 22 bp, Artificial Sequence
  chemically synthesized
ggctgatgttttccccttgctc

SEQ ID NO: 1100678 - DNA, 22 bp, Artificial Sequence
  chemically synthesized
gctgatgttttccccttgctct

SEQ ID NO: 1100679 - DNA, 22 bp, Artificial Sequence
  chemically synthesized
atgttttccccttgctctacat

SEQ ID NO: 1100680 - DNA, 22 bp, Artificial Sequence
  chemically synthesized
tccccttgctctacataaattg

SEQ ID NO: 1100681 - DNA, 22 bp, Artificial Sequence
  chemically synthesized
ccccttgctctacataaattgg

SEQ ID NO: 1100682 - DNA, 22 bp, Artificial Sequence
  chemically synthesized
cccttgctctacataaattggt

SEQ ID NO: 1100683 - DNA, 22 bp, Artificial Sequence
  chemically synthesized
gctctacataaattggtgatgt

SEQ ID NO: 1100684 - DNA, 22 bp, Artificial Sequence
  chemically synthesized
ctctacataaattggtgatgtt

SEQ ID NO: 1100685 - DNA, 22 bp, Artificial Sequence
  chemically synthesized
tacataaattggtgatgttctt

SEQ ID NO: 1100686 - DNA, 22 bp, Artificial Sequence
  chemically synthesized
atggatgaataaaaagaacatc

SEQ ID NO: 1100687 - DNA, 22 bp, Artificial Sequence
  chemically synthesized
cataaattggtgatgttctttt

SEQ ID NO: 1100688 - DNA, 22 bp, Artificial Sequence
  chemically synthesized
aatggatgaataaaaagaacat

SEQ ID NO: 1100689 - DNA, 22 bp, Artificial Sequence
  chemically synthesized
ttaatggatgaataaaaagaac

SEQ ID NO: 1100690 - DNA, 22 bp, Artificial Sequence
  chemically synthesized
gtgatgttctttttattcatcc

SEQ ID NO: 1100691 - DNA, 22 bp, Artificial Sequence
  chemically synthesized
aatgttcttaatggatgaataa

SEQ ID NO: 1100692 - DNA, 22 bp, Artificial Sequence
  chemically synthesized
ttgaatgttcttaatggatgaa

SEQ ID NO: 1100693 - DNA, 22 bp, Artificial Sequence
  chemically synthesized
gttgaatgttcttaatggatga

SEQ ID NO: 1100694 - DNA, 22 bp, Artificial Sequence
  chemically synthesized
tttgttgaatgttcttaatgga

SEQ ID NO: 1100695 - DNA, 22 bp, Artificial Sequence
  chemically synthesized
gtttgttgaatgttcttaatgg

SEQ ID NO: 1100696 - DNA, 22 bp, Artificial Sequence
  chemically synthesized
tttttattcatccattaagaac

SEQ ID NO: 1100697 - DNA, 22 bp, Artificial Sequence
  chemically synthesized
tgtttgttgaatgttcttaatg

SEQ ID NO: 1100698 - DNA, 22 bp, Artificial Sequence
  chemically synthesized
ttgtttgttgaatgttcttaat

SEQ ID NO: 1100699 - DNA, 22 bp, Artificial Sequence
  chemically synthesized
tttattcatccattaagaacat

SEQ ID NO: 1100700 - DNA, 22 bp, Artificial Sequence
  chemically synthesized
tttgtttgttgaatgttcttaa

SEQ ID NO: 1100701 - DNA, 22 bp, Artificial Sequence
  chemically synthesized
ttattcatccattaagaacatt

SEQ ID NO: 1100702 - DNA, 22 bp, Artificial Sequence
  chemically synthesized
tattcatccattaagaacattc

SEQ ID NO: 1100703 - DNA, 22 bp, Artificial Sequence
  chemically synthesized
attcatccattaagaacattca

SEQ ID NO: 1100704 - DNA, 22 bp, Artificial Sequence
  chemically synthesized
ttttttgtttgttgaatgttct

SEQ ID NO: 1100705 - DNA, 22 bp, Artificial Sequence
  chemically synthesized
ttcatccattaagaacattcaa

SEQ ID NO: 1100706 - DNA, 22 bp, Artificial Sequence
  chemically synthesized
gttttttgtttgttgaatgttc

SEQ ID NO: 1100707 - DNA, 22 bp, Artificial Sequence
  chemically synthesized
atccattaagaacattcaacaa

SEQ ID NO: 1100708 - DNA, 22 bp, Artificial Sequence
  chemically synthesized
agaacattcaacaaacaaaaaa

SEQ ID NO: 1100709 - DNA, 22 bp, Artificial Sequence
  chemically synthesized
aacaaacaaaaaacaaatacct

SEQ ID NO: 1100710 - DNA, 22 bp, Artificial Sequence
  chemically synthesized
gaaggccagtgtgaaaggtatt

SEQ ID NO: 1100711 - DNA, 22 bp, Artificial Sequence
  chemically synthesized
ctggaaggccagtgtgaaaggt

SEQ ID NO: 1100712 - DNA, 22 bp, Artificial Sequence
  chemically synthesized
cctggaaggccagtgtgaaagg

SEQ ID NO: 1100713 - DNA, 22 bp, Artificial Sequence
  chemically synthesized
tcctggaaggccagtgtgaaag

SEQ ID NO: 1100714 - DNA, 22 bp, Artificial Sequence
  chemically synthesized
atgttttcctggaaggccagtg

SEQ ID NO: 1100715 - DNA, 22 bp, Artificial Sequence
  chemically synthesized
taccattgatgttttcctggaa

SEQ ID NO: 1100716 - DNA, 22 bp, Artificial Sequence
  chemically synthesized
tcacactggccttccaggaaaa

SEQ ID NO: 1100717 - DNA, 22 bp, Artificial Sequence
  chemically synthesized
cacactggccttccaggaaaac

SEQ ID NO: 1100718 - DNA, 22 bp, Artificial Sequence
  chemically synthesized
acactggccttccaggaaaaca

SEQ ID NO: 1100719 - DNA, 22 bp, Artificial Sequence
  chemically synthesized
gccttccaggaaaacatcaatg

SEQ ID NO: 1100720 - DNA, 22 bp, Artificial Sequence
  chemically synthesized
aataatagattataccattgat

SEQ ID NO: 1100721 - DNA, 22 bp, Artificial Sequence
  chemically synthesized
aaataatagattataccattga

SEQ ID NO: 1100722 - DNA, 22 bp, Artificial Sequence
  chemically synthesized
ccaggaaaacatcaatggtata

SEQ ID NO: 1100723 - DNA, 22 bp, Artificial Sequence
  chemically synthesized
caggaaaacatcaatggtataa

SEQ ID NO: 1100724 - DNA, 22 bp, Artificial Sequence
  chemically synthesized
cttaaataatagattataccat

SEQ ID NO: 1100725 - DNA, 22 bp, Artificial Sequence
  chemically synthesized
ggaaaaaaaaaaaatattactt

SEQ ID NO: 1100726 - DNA, 22 bp, Artificial Sequence
  chemically synthesized
aggaaaaaaaaaaaatattact

SEQ ID NO: 1100727 - DNA, 22 bp, Artificial Sequence
  chemically synthesized
tttaggaaaaaaaaaaaatatt

SEQ ID NO: 1100728 - DNA, 22 bp, Artificial Sequence
  chemically synthesized
ttatttaagtaatatttttttt

SEQ ID NO: 1100729 - DNA, 22 bp, Artificial Sequence
  chemically synthesized
tttaagtaatattttttttttt

SEQ ID NO: 1100730 - DNA, 22 bp, Artificial Sequence
  chemically synthesized
aagtaatattttttttttttcc

SEQ ID NO: 1100731 - DNA, 22 bp, Artificial Sequence
  chemically synthesized
agtaatattttttttttttcct

SEQ ID NO: 1100732 - DNA, 22 bp, Artificial Sequence
  chemically synthesized
gaagagttgtttaggaaaaaaa

SEQ ID NO: 1100733 - DNA, 22 bp, Artificial Sequence
  chemically synthesized
tttttttttcctaaacaactct

SEQ ID NO: 1100734 - DNA, 22 bp, Artificial Sequence
  chemically synthesized
ttttttttcctaaacaactctt

SEQ ID NO: 1100735 - DNA, 22 bp, Artificial Sequence
  chemically synthesized
tttttttcctaaacaactcttc

SEQ ID NO: 1100736 - DNA, 22 bp, Artificial Sequence
  chemically synthesized
ttttttcctaaacaactcttct

SEQ ID NO: 1100737 - DNA, 22 bp, Artificial Sequence
  chemically synthesized
tttttcctaaacaactcttcta

SEQ ID NO: 1100738 - DNA, 22 bp, Artificial Sequence
  chemically synthesized
ttttcctaaacaactcttctag

SEQ ID NO: 1100739 - DNA, 22 bp, Artificial Sequence
  chemically synthesized
tttcctaaacaactcttctagc

SEQ ID NO: 1100740 - DNA, 22 bp, Artificial Sequence
  chemically synthesized
aagtaagtcagtgctagaagag

SEQ ID NO: 1100741 - DNA, 22 bp, Artificial Sequence
  chemically synthesized
ttcctaaacaactcttctagca

SEQ ID NO: 1100742 - DNA, 22 bp, Artificial Sequence
  chemically synthesized
tcctaaacaactcttctagcac

SEQ ID NO: 1100743 - DNA, 22 bp, Artificial Sequence
  chemically synthesized
cctaaacaactcttctagcact

SEQ ID NO: 1100744 - DNA, 22 bp, Artificial Sequence
  chemically synthesized
ctgaagtaagtcagtgctagaa

SEQ ID NO: 1100745 - DNA, 22 bp, Artificial Sequence
  chemically synthesized
ctaaacaactcttctagcactg

SEQ ID NO: 1100746 - DNA, 22 bp, Artificial Sequence
  chemically synthesized
tcctgaagtaagtcagtgctag

SEQ ID NO: 1100747 - DNA, 22 bp, Artificial Sequence
  chemically synthesized
ctcctgaagtaagtcagtgcta

SEQ ID NO: 1100748 - DNA, 22 bp, Artificial Sequence
  chemically synthesized
aacaactcttctagcactgact

SEQ ID NO: 1100749 - DNA, 22 bp, Artificial Sequence
  chemically synthesized
ttctcctgaagtaagtcagtgc

SEQ ID NO: 1100750 - DNA, 22 bp, Artificial Sequence
  chemically synthesized
acattcttctcctgaagtaagt

SEQ ID NO: 1100751 - DNA, 22 bp, Artificial Sequence
  chemically synthesized
ttctagcactgacttacttcag

SEQ ID NO: 1100752 - DNA, 22 bp, Artificial Sequence
  chemically synthesized
ctagcactgacttacttcagga

SEQ ID NO: 1100753 - DNA, 22 bp, Artificial Sequence
  chemically synthesized
tagcactgacttacttcaggag

SEQ ID NO: 1100754 - DNA, 22 bp, Artificial Sequence
  chemically synthesized
gctcacattcttctcctgaagt

SEQ ID NO: 1100755 - DNA, 22 bp, Artificial Sequence
  chemically synthesized
gcactgacttacttcaggagaa

SEQ ID NO: 1100756 - DNA, 22 bp, Artificial Sequence
  chemically synthesized
acttacttcaggagaagaatgt

SEQ ID NO: 1100757 - DNA, 22 bp, Artificial Sequence
  chemically synthesized
ggtcagctagctcacattcttc

SEQ ID NO: 1100758 - DNA, 22 bp, Artificial Sequence
  chemically synthesized
acttcaggagaagaatgtgagc

SEQ ID NO: 1100759 - DNA, 22 bp, Artificial Sequence
  chemically synthesized
cttcaggagaagaatgtgagct

SEQ ID NO: 1100760 - DNA, 22 bp, Artificial Sequence
  chemically synthesized
tccctgggtcagctagctcaca

SEQ ID NO: 1100761 - DNA, 22 bp, Artificial Sequence
  chemically synthesized
caggagaagaatgtgagctagc

SEQ ID NO: 1100762 - DNA, 22 bp, Artificial Sequence
  chemically synthesized
aggagaagaatgtgagctagct

SEQ ID NO: 1100763 - DNA, 22 bp, Artificial Sequence
  chemically synthesized
acagatgagctgtccctgggtc

SEQ ID NO: 1100764 - DNA, 22 bp, Artificial Sequence
  chemically synthesized
attcacagatgagctgtccctg

SEQ ID NO: 1100765 - DNA, 22 bp, Artificial Sequence
  chemically synthesized
ttaattcacagatgagctgtcc

SEQ ID NO: 1100766 - DNA, 22 bp, Artificial Sequence
  chemically synthesized
gctgacccagggacagctcatc

SEQ ID NO: 1100767 - DNA, 22 bp, Artificial Sequence
  chemically synthesized
tgttaattcacagatgagctgt

SEQ ID NO: 1100768 - DNA, 22 bp, Artificial Sequence
  chemically synthesized
acccagggacagctcatctgtg

SEQ ID NO: 1100769 - DNA, 22 bp, Artificial Sequence
  chemically synthesized
gttctgttaattcacagatgag

SEQ ID NO: 1100770 - DNA, 22 bp, Artificial Sequence
  chemically synthesized
attggttctgttaattcacaga

SEQ ID NO: 1100771 - DNA, 22 bp, Artificial Sequence
  chemically synthesized
acaagtgttcattggttctgtt

SEQ ID NO: 1100772 - DNA, 22 bp, Artificial Sequence
  chemically synthesized
atctgtgaattaacagaaccaa

SEQ ID NO: 1100773 - DNA, 22 bp, Artificial Sequence
  chemically synthesized
tgaattaacagaaccaatgaac

SEQ ID NO: 1100774 - DNA, 22 bp, Artificial Sequence
  chemically synthesized
atacaatcactgacaagtgttc

SEQ ID NO: 1100775 - DNA, 22 bp, Artificial Sequence
  chemically synthesized
acagaaccaatgaacacttgtc

SEQ ID NO: 1100776 - DNA, 22 bp, Artificial Sequence
  chemically synthesized
agctaatacaatcactgacaag

SEQ ID NO: 1100777 - DNA, 22 bp, Artificial Sequence
  chemically synthesized
gtcagtgattgtattagctgag

SEQ ID NO: 1100778 - DNA, 22 bp, Artificial Sequence
  chemically synthesized
tcagtgattgtattagctgagt

SEQ ID NO: 1100779 - DNA, 22 bp, Artificial Sequence
  chemically synthesized
gaaaagtcaagggaaatcactc

SEQ ID NO: 1100780 - DNA, 22 bp, Artificial Sequence
  chemically synthesized
tattagctgagtgatttccctt

SEQ ID NO: 1100781 - DNA, 22 bp, Artificial Sequence
  chemically synthesized
gctgagtgatttcccttgactt

SEQ ID NO: 1100782 - DNA, 22 bp, Artificial Sequence
  chemically synthesized
agtgatttcccttgacttttct

SEQ ID NO: 1100783 - DNA, 22 bp, Artificial Sequence
  chemically synthesized
aaaatgaaaaaaaaaattagaa

SEQ ID NO: 1100784 - DNA, 22 bp, Artificial Sequence
  chemically synthesized
gaaaatgaaaaaaaaaattaga

SEQ ID NO: 1100785 - DNA, 22 bp, Artificial Sequence
  chemically synthesized
cccttgacttttctaatttttt

SEQ ID NO: 1100786 - DNA, 22 bp, Artificial Sequence
  chemically synthesized
ccttgacttttctaattttttt

SEQ ID NO: 1100787 - DNA, 22 bp, Artificial Sequence
  chemically synthesized
catttgaaaatgaaaaaaaaaa

SEQ ID NO: 1100788 - DNA, 22 bp, Artificial Sequence
  chemically synthesized
gacttttctaattttttttttc

SEQ ID NO: 1100789 - DNA, 22 bp, Artificial Sequence
  chemically synthesized
acttttctaattttttttttca

SEQ ID NO: 1100790 - DNA, 22 bp, Artificial Sequence
  chemically synthesized
ttctaattttttttttcatttt

SEQ ID NO: 1100791 - DNA, 22 bp, Artificial Sequence
  chemically synthesized
tctaattttttttttcattttc

SEQ ID NO: 1100792 - DNA, 22 bp, Artificial Sequence
  chemically synthesized
ctaattttttttttcattttca

SEQ ID NO: 1100793 - DNA, 22 bp, Artificial Sequence
  chemically synthesized
taattttttttttcattttcaa

SEQ ID NO: 1100794 - DNA, 22 bp, Artificial Sequence
  chemically synthesized
attttttttttcattttcaaat

SEQ ID NO: 1100795 - DNA, 22 bp, Artificial Sequence
  chemically synthesized
tttttttcattttcaaatgtag

SEQ ID NO: 1100796 - DNA, 22 bp, Artificial Sequence
  chemically synthesized
ttttttcattttcaaatgtagc

SEQ ID NO: 1100797 - DNA, 22 bp, Artificial Sequence
  chemically synthesized
tttttcattttcaaatgtagct

SEQ ID NO: 1100798 - DNA, 22 bp, Artificial Sequence
  chemically synthesized
ttttcattttcaaatgtagctt

SEQ ID NO: 1100799 - DNA, 22 bp, Artificial Sequence
  chemically synthesized
tttcattttcaaatgtagcttt

SEQ ID NO: 1100800 - DNA, 22 bp, Artificial Sequence
  chemically synthesized
ttcattttcaaatgtagctttt

SEQ ID NO: 1100801 - DNA, 22 bp, Artificial Sequence
  chemically synthesized
tcattttcaaatgtagcttttg

SEQ ID NO: 1100802 - DNA, 22 bp, Artificial Sequence
  chemically synthesized
cattttcaaatgtagcttttgc

SEQ ID NO: 1100803 - DNA, 22 bp, Artificial Sequence
  chemically synthesized
attttcaaatgtagcttttgcc

SEQ ID NO: 1100804 - DNA, 22 bp, Artificial Sequence
  chemically synthesized
tcaaatgtagcttttgcctttt

SEQ ID NO: 1100805 - DNA, 22 bp, Artificial Sequence
  chemically synthesized
caaatgtagcttttgccttttg

SEQ ID NO: 1100806 - DNA, 22 bp, Artificial Sequence
  chemically synthesized
aaatgtagcttttgccttttga

SEQ ID NO: 1100807 - DNA, 22 bp, Artificial Sequence
  chemically synthesized
aaaatagaaaagaagtaatgtc

SEQ ID NO: 1100808 - DNA, 22 bp, Artificial Sequence
  chemically synthesized
caaaatagaaaagaagtaatgt

SEQ ID NO: 1100809 - DNA, 22 bp, Artificial Sequence
  chemically synthesized
tcaaaatagaaaagaagtaatg

SEQ ID NO: 1100810 - DNA, 22 bp, Artificial Sequence
  chemically synthesized
ttgccttttgacattacttctt

SEQ ID NO: 1100811 - DNA, 22 bp, Artificial Sequence
  chemically synthesized
tgccttttgacattacttcttt

SEQ ID NO: 1100812 - DNA, 22 bp, Artificial Sequence
  chemically synthesized
gccttttgacattacttctttt

SEQ ID NO: 1100813 - DNA, 22 bp, Artificial Sequence
  chemically synthesized
ccttttgacattacttcttttc

SEQ ID NO: 1100814 - DNA, 22 bp, Artificial Sequence
  chemically synthesized
ttgacattacttcttttctatt

SEQ ID NO: 1100815 - DNA, 22 bp, Artificial Sequence
  chemically synthesized
tgacattacttcttttctattt

SEQ ID NO: 1100816 - DNA, 22 bp, Artificial Sequence
  chemically synthesized
agtaaactttcaaaatagaaaa

SEQ ID NO: 1100817 - DNA, 22 bp, Artificial Sequence
  chemically synthesized
gacattacttcttttctatttt

SEQ ID NO: 1100818 - DNA, 22 bp, Artificial Sequence
  chemically synthesized
acattacttcttttctattttg

SEQ ID NO: 1100819 - DNA, 22 bp, Artificial Sequence
  chemically synthesized
ctaagtaaactttcaaaataga

SEQ ID NO: 1100820 - DNA, 22 bp, Artificial Sequence
  chemically synthesized
ctgctaagtaaactttcaaaat

SEQ ID NO: 1100821 - DNA, 22 bp, Artificial Sequence
  chemically synthesized
cttcttttctattttgaaagtt

SEQ ID NO: 1100822 - DNA, 22 bp, Artificial Sequence
  chemically synthesized
gttactgctaagtaaactttca

SEQ ID NO: 1100823 - DNA, 22 bp, Artificial Sequence
  chemically synthesized
cttttctattttgaaagtttac

SEQ ID NO: 1100824 - DNA, 22 bp, Artificial Sequence
  chemically synthesized
ggttactgctaagtaaactttc

SEQ ID NO: 1100825 - DNA, 22 bp, Artificial Sequence
  chemically synthesized
ttttctattttgaaagtttact

SEQ ID NO: 1100826 - DNA, 22 bp, Artificial Sequence
  chemically synthesized
tggttactgctaagtaaacttt

SEQ ID NO: 1100827 - DNA, 22 bp, Artificial Sequence
  chemically synthesized
ttctattttgaaagtttactta

SEQ ID NO: 1100828 - DNA, 22 bp, Artificial Sequence
  chemically synthesized
tctattttgaaagtttacttag

SEQ ID NO: 1100829 - DNA, 22 bp, Artificial Sequence
  chemically synthesized
ctattttgaaagtttacttagc

SEQ ID NO: 1100830 - DNA, 22 bp, Artificial Sequence
  chemically synthesized
tattttgaaagtttacttagca

SEQ ID NO: 1100831 - DNA, 22 bp, Artificial Sequence
  chemically synthesized
gtctttggttactgctaagtaa

SEQ ID NO: 1100832 - DNA, 22 bp, Artificial Sequence
  chemically synthesized
ttttgaaagtttacttagcagt

SEQ ID NO: 1100833 - DNA, 22 bp, Artificial Sequence
  chemically synthesized
tgaaagtttacttagcagtaac

SEQ ID NO: 1100834 - DNA, 22 bp, Artificial Sequence
  chemically synthesized
gaaagtttacttagcagtaacc

SEQ ID NO: 1100835 - DNA, 22 bp, Artificial Sequence
  chemically synthesized
aaagtttacttagcagtaacca

SEQ ID NO: 1100836 - DNA, 22 bp, Artificial Sequence
  chemically synthesized
gaggcagttggtctttggttac

SEQ ID NO: 1100837 - DNA, 22 bp, Artificial Sequence
  chemically synthesized
acttagcagtaaccaaagacca

SEQ ID NO: 1100838 - DNA, 22 bp, Artificial Sequence
  chemically synthesized
cttagcagtaaccaaagaccaa

SEQ ID NO: 1100839 - DNA, 22 bp, Artificial Sequence
  chemically synthesized
cgtgttagaggcagttggtctt

SEQ ID NO: 1100840 - DNA, 22 bp, Artificial Sequence
  chemically synthesized
agcagtaaccaaagaccaactg

SEQ ID NO: 1100841 - DNA, 22 bp, Artificial Sequence
  chemically synthesized
acgtgttagaggcagttggtct

SEQ ID NO: 1100842 - DNA, 22 bp, Artificial Sequence
  chemically synthesized
gcagtaaccaaagaccaactgc

SEQ ID NO: 1100843 - DNA, 22 bp, Artificial Sequence
  chemically synthesized
aatttacgtgttagaggcagtt

SEQ ID NO: 1100844 - DNA, 22 bp, Artificial Sequence
  chemically synthesized
caatttacgtgttagaggcagt

SEQ ID NO: 1100845 - DNA, 22 bp, Artificial Sequence
  chemically synthesized
ataaggggtttcaatttacgtg

SEQ ID NO: 1100846 - DNA, 22 bp, Artificial Sequence
  chemically synthesized
cctctaacacgtaaattgaaac

SEQ ID NO: 1100847 - DNA, 22 bp, Artificial Sequence
  chemically synthesized
gaaattaataaggggtttcaat

SEQ ID NO: 1100848 - DNA, 22 bp, Artificial Sequence
  chemically synthesized
ggaaattaataaggggtttcaa

SEQ ID NO: 1100849 - DNA, 22 bp, Artificial Sequence
  chemically synthesized
taacacgtaaattgaaacccct

SEQ ID NO: 1100850 - DNA, 22 bp, Artificial Sequence
  chemically synthesized
tggaaattaataaggggtttca

SEQ ID NO: 1100851 - DNA, 22 bp, Artificial Sequence
  chemically synthesized
ttggaaattaataaggggtttc

SEQ ID NO: 1100852 - DNA, 22 bp, Artificial Sequence
  chemically synthesized
acacgtaaattgaaacccctta

SEQ ID NO: 1100853 - DNA, 22 bp, Artificial Sequence
  chemically synthesized
tttggaaattaataaggggttt

SEQ ID NO: 1100854 - DNA, 22 bp, Artificial Sequence
  chemically synthesized
tacctttttggaaattaataag

SEQ ID NO: 1100855 - DNA, 22 bp, Artificial Sequence
  chemically synthesized
ctgtacctttttggaaattaat

SEQ ID NO: 1100856 - DNA, 22 bp, Artificial Sequence
  chemically synthesized
aaaccccttattaatttccaaa

SEQ ID NO: 1100857 - DNA, 22 bp, Artificial Sequence
  chemically synthesized
attaatttccaaaaaggtacag

SEQ ID NO: 1100858 - DNA, 22 bp, Artificial Sequence
  chemically synthesized
ttaatttccaaaaaggtacagt

SEQ ID NO: 1100859 - DNA, 22 bp, Artificial Sequence
  chemically synthesized
atttccaaaaaggtacagtagt

SEQ ID NO: 1100860 - DNA, 22 bp, Artificial Sequence
  chemically synthesized
caaagatacaagggaactactg

SEQ ID NO: 1100861 - DNA, 22 bp, Artificial Sequence
  chemically synthesized
ccaaaaaggtacagtagttccc

SEQ ID NO: 1100862 - DNA, 22 bp, Artificial Sequence
  chemically synthesized
ccaaagatacaagggaactact

SEQ ID NO: 1100863 - DNA, 22 bp, Artificial Sequence
  chemically synthesized
caaaaaggtacagtagttccct

SEQ ID NO: 1100864 - DNA, 22 bp, Artificial Sequence
  chemically synthesized
gtatgaacatatcttccaaaga

SEQ ID NO: 1100865 - DNA, 22 bp, Artificial Sequence
  chemically synthesized
ggtatgaacatatcttccaaag

SEQ ID NO: 1100866 - DNA, 22 bp, Artificial Sequence
  chemically synthesized
ccttgtatctttggaagatatg

SEQ ID NO: 1100867 - DNA, 22 bp, Artificial Sequence
  chemically synthesized
gtatctttggaagatatgttca

SEQ ID NO: 1100868 - DNA, 22 bp, Artificial Sequence
  chemically synthesized
gaggtcttggtatgaacatatc

SEQ ID NO: 1100869 - DNA, 22 bp, Artificial Sequence
  chemically synthesized
tatctttggaagatatgttcat

SEQ ID NO: 1100870 - DNA, 22 bp, Artificial Sequence
  chemically synthesized
ttggaggtcttggtatgaacat

SEQ ID NO: 1100871 - DNA, 22 bp, Artificial Sequence
  chemically synthesized
tggaagatatgttcataccaag

SEQ ID NO: 1100872 - DNA, 22 bp, Artificial Sequence
  chemically synthesized
ggaagatatgttcataccaaga

SEQ ID NO: 1100873 - DNA, 22 bp, Artificial Sequence
  chemically synthesized
gaagatatgttcataccaagac

SEQ ID NO: 1100874 - DNA, 22 bp, Artificial Sequence
  chemically synthesized
aggcatctattggaggtcttgg

SEQ ID NO: 1100875 - DNA, 22 bp, Artificial Sequence
  chemically synthesized
caggcatctattggaggtcttg

SEQ ID NO: 1100876 - DNA, 22 bp, Artificial Sequence
  chemically synthesized
tggtttcaggcatctattggag

SEQ ID NO: 1100877 - DNA, 22 bp, Artificial Sequence
  chemically synthesized
ataccaagacctccaatagatg

SEQ ID NO: 1100878 - DNA, 22 bp, Artificial Sequence
  chemically synthesized
ggtatcatctatggtttcaggc

SEQ ID NO: 1100879 - DNA, 22 bp, Artificial Sequence
  chemically synthesized
caatagatgcctgaaaccatag

SEQ ID NO: 1100880 - DNA, 22 bp, Artificial Sequence
  chemically synthesized
gtgtatatagggttaggtatca

SEQ ID NO: 1100881 - DNA, 22 bp, Artificial Sequence
  chemically synthesized
aaaccatagatgatacctaacc

SEQ ID NO: 1100882 - DNA, 22 bp, Artificial Sequence
  chemically synthesized
accctatatacactagattttt

SEQ ID NO: 1100883 - DNA, 22 bp, Artificial Sequence
  chemically synthesized
tatacactagattttttcctac

SEQ ID NO: 1100884 - DNA, 22 bp, Artificial Sequence
  chemically synthesized
taggtatgtatgagtaggaaaa

SEQ ID NO: 1100885 - DNA, 22 bp, Artificial Sequence
  chemically synthesized
ataggtatgtatgagtaggaaa

SEQ ID NO: 1100886 - DNA, 22 bp, Artificial Sequence
  chemically synthesized
tataggtatgtatgagtaggaa

SEQ ID NO: 1100887 - DNA, 22 bp, Artificial Sequence
  chemically synthesized
aattttataggtatgtatgagt

SEQ ID NO: 1100888 - DNA, 22 bp, Artificial Sequence
  chemically synthesized
gattttttcctactcatacata

SEQ ID NO: 1100889 - DNA, 22 bp, Artificial Sequence
  chemically synthesized
tttcctactcatacatacctat

SEQ ID NO: 1100890 - DNA, 22 bp, Artificial Sequence
  chemically synthesized
ttcctactcatacatacctata

SEQ ID NO: 1100891 - DNA, 22 bp, Artificial Sequence
  chemically synthesized
taaattaaattttataggtatg

SEQ ID NO: 1100892 - DNA, 22 bp, Artificial Sequence
  chemically synthesized
tcctactcatacatacctataa

SEQ ID NO: 1100893 - DNA, 22 bp, Artificial Sequence
  chemically synthesized
ataaattaaattttataggtat

SEQ ID NO: 1100894 - DNA, 22 bp, Artificial Sequence
  chemically synthesized
cctactcatacatacctataaa

SEQ ID NO: 1100895 - DNA, 22 bp, Artificial Sequence
  chemically synthesized
ctactcatacatacctataaaa

SEQ ID NO: 1100896 - DNA, 22 bp, Artificial Sequence
  chemically synthesized
atttataaattaaattttatag

SEQ ID NO: 1100897 - DNA, 22 bp, Artificial Sequence
  chemically synthesized
ctcatacatacctataaaattt

SEQ ID NO: 1100898 - DNA, 22 bp, Artificial Sequence
  chemically synthesized
atacatacctataaaatttaat

SEQ ID NO: 1100899 - DNA, 22 bp, Artificial Sequence
  chemically synthesized
tgcctaatttataaattaaatt

SEQ ID NO: 1100900 - DNA, 22 bp, Artificial Sequence
  chemically synthesized
ctatgcctaatttataaattaa

SEQ ID NO: 1100901 - DNA, 22 bp, Artificial Sequence
  chemically synthesized
actatgcctaatttataaatta

SEQ ID NO: 1100902 - DNA, 22 bp, Artificial Sequence
  chemically synthesized
ttactatgcctaatttataaat

SEQ ID NO: 1100903 - DNA, 22 bp, Artificial Sequence
  chemically synthesized
taaaatttaatttataaattag

SEQ ID NO: 1100904 - DNA, 22 bp, Artificial Sequence
  chemically synthesized
atctcttactatgcctaattta

SEQ ID NO: 1100905 - DNA, 22 bp, Artificial Sequence
  chemically synthesized
ttaatctcttactatgcctaat

SEQ ID NO: 1100906 - DNA, 22 bp, Artificial Sequence
  chemically synthesized
aatttataaattaggcatagta

SEQ ID NO: 1100907 - DNA, 22 bp, Artificial Sequence
  chemically synthesized
atttataaattaggcatagtaa

SEQ ID NO: 1100908 - DNA, 22 bp, Artificial Sequence
  chemically synthesized
gttgttaatctcttactatgcc

SEQ ID NO: 1100909 - DNA, 22 bp, Artificial Sequence
  chemically synthesized
ttagttgttaatctcttactat

SEQ ID NO: 1100910 - DNA, 22 bp, Artificial Sequence
  chemically synthesized
ataaattaggcatagtaagaga

SEQ ID NO: 1100911 - DNA, 22 bp, Artificial Sequence
  chemically synthesized
attagttgttaatctcttacta

SEQ ID NO: 1100912 - DNA, 22 bp, Artificial Sequence
  chemically synthesized
taaattaggcatagtaagagat

SEQ ID NO: 1100913 - DNA, 22 bp, Artificial Sequence
  chemically synthesized
tattagttgttaatctcttact

SEQ ID NO: 1100914 - DNA, 22 bp, Artificial Sequence
  chemically synthesized
ttttattagttgttaatctctt

SEQ ID NO: 1100915 - DNA, 22 bp, Artificial Sequence
  chemically synthesized
tattttattagttgttaatctc

SEQ ID NO: 1100916 - DNA, 22 bp, Artificial Sequence
  chemically synthesized
ggcatagtaagagattaacaac

SEQ ID NO: 1100917 - DNA, 22 bp, Artificial Sequence
  chemically synthesized
ttctattttattagttgttaat

SEQ ID NO: 1100918 - DNA, 22 bp, Artificial Sequence
  chemically synthesized
gttctattttattagttgttaa

SEQ ID NO: 1100919 - DNA, 22 bp, Artificial Sequence
  chemically synthesized
acaactaataaaatagaacaag

SEQ ID NO: 1100920 - DNA, 22 bp, Artificial Sequence
  chemically synthesized
ataaaatagaacaagttatctc

SEQ ID NO: 1100921 - DNA, 22 bp, Artificial Sequence
  chemically synthesized
agagggagaagaagagagataa

SEQ ID NO: 1100922 - DNA, 22 bp, Artificial Sequence
  chemically synthesized
gagagggagaagaagagagata

SEQ ID NO: 1100923 - DNA, 22 bp, Artificial Sequence
  chemically synthesized
tgagagggagaagaagagagat

SEQ ID NO: 1100924 - DNA, 22 bp, Artificial Sequence
  chemically synthesized
tctctcttcttctccctctcaa

SEQ ID NO: 1100925 - DNA, 22 bp, Artificial Sequence
  chemically synthesized
tcttcttctccctctcaaaata

SEQ ID NO: 1100926 - DNA, 22 bp, Artificial Sequence
  chemically synthesized
ttcttctccctctcaaaatatc

SEQ ID NO: 1100927 - DNA, 22 bp, Artificial Sequence
  chemically synthesized
cttctccctctcaaaatatctt

SEQ ID NO: 1100928 - DNA, 22 bp, Artificial Sequence
  chemically synthesized
ttctccctctcaaaatatctta

SEQ ID NO: 1100929 - DNA, 22 bp, Artificial Sequence
  chemically synthesized
ctccctctcaaaatatcttatt

SEQ ID NO: 1100930 - DNA, 22 bp, Artificial Sequence
  chemically synthesized
tccctctcaaaatatcttattt

SEQ ID NO: 1100931 - DNA, 22 bp, Artificial Sequence
  chemically synthesized
cctctcaaaatatcttatttta

SEQ ID NO: 1100932 - DNA, 22 bp, Artificial Sequence
  chemically synthesized
tcaaaatatcttattttactgt

SEQ ID NO: 1100933 - DNA, 22 bp, Artificial Sequence
  chemically synthesized
aaatcggtgagcacagtaaaat

SEQ ID NO: 1100934 - DNA, 22 bp, Artificial Sequence
  chemically synthesized
aaaatatcttattttactgtgc

SEQ ID NO: 1100935 - DNA, 22 bp, Artificial Sequence
  chemically synthesized
gaatcctaaaatcggtgagcac

SEQ ID NO: 1100936 - DNA, 22 bp, Artificial Sequence
  chemically synthesized
attttactgtgctcaccgattt

SEQ ID NO: 1100937 - DNA, 22 bp, Artificial Sequence
  chemically synthesized
ttttactgtgctcaccgatttt

SEQ ID NO: 1100938 - DNA, 22 bp, Artificial Sequence
  chemically synthesized
tactgtgctcaccgattttagg

SEQ ID NO: 1100939 - DNA, 22 bp, Artificial Sequence
  chemically synthesized
actgtgctcaccgattttagga

SEQ ID NO: 1100940 - DNA, 22 bp, Artificial Sequence
  chemically synthesized
ctgtgctcaccgattttaggat

SEQ ID NO: 1100941 - DNA, 22 bp, Artificial Sequence
  chemically synthesized
tggtcaattggaatcctaaaat

SEQ ID NO: 1100942 - DNA, 22 bp, Artificial Sequence
  chemically synthesized
gtggtcaattggaatcctaaaa

SEQ ID NO: 1100943 - DNA, 22 bp, Artificial Sequence
  chemically synthesized
tgctcaccgattttaggattcc

SEQ ID NO: 1100944 - DNA, 22 bp, Artificial Sequence
  chemically synthesized
accgattttaggattccaattg

SEQ ID NO: 1100945 - DNA, 22 bp, Artificial Sequence
  chemically synthesized
aaatgcttgtggtcaattggaa

SEQ ID NO: 1100946 - DNA, 22 bp, Artificial Sequence
  chemically synthesized
caaatgcttgtggtcaattgga

SEQ ID NO: 1100947 - DNA, 22 bp, Artificial Sequence
  chemically synthesized
gtttcaaatgcttgtggtcaat

SEQ ID NO: 1100948 - DNA, 22 bp, Artificial Sequence
  chemically synthesized
taggattccaattgaccacaag

SEQ ID NO: 1100949 - DNA, 22 bp, Artificial Sequence
  chemically synthesized
aggattccaattgaccacaagc

SEQ ID NO: 1100950 - DNA, 22 bp, Artificial Sequence
  chemically synthesized
ggattccaattgaccacaagca

SEQ ID NO: 1100951 - DNA, 22 bp, Artificial Sequence
  chemically synthesized
cctggtttcaaatgcttgtggt

SEQ ID NO: 1100952 - DNA, 22 bp, Artificial Sequence
  chemically synthesized
ccctggtttcaaatgcttgtgg

SEQ ID NO: 1100953 - DNA, 22 bp, Artificial Sequence
  chemically synthesized
tccctggtttcaaatgcttgtg

SEQ ID NO: 1100954 - DNA, 22 bp, Artificial Sequence
  chemically synthesized
ctttccctggtttcaaatgctt

SEQ ID NO: 1100955 - DNA, 22 bp, Artificial Sequence
  chemically synthesized
caattgaccacaagcatttgaa

SEQ ID NO: 1100956 - DNA, 22 bp, Artificial Sequence
  chemically synthesized
gctttccctggtttcaaatgct

SEQ ID NO: 1100957 - DNA, 22 bp, Artificial Sequence
  chemically synthesized
tgctttccctggtttcaaatgc

SEQ ID NO: 1100958 - DNA, 22 bp, Artificial Sequence
  chemically synthesized
accacaagcatttgaaaccagg

SEQ ID NO: 1100959 - DNA, 22 bp, Artificial Sequence
  chemically synthesized
cagttttgctttccctggtttc

SEQ ID NO: 1100960 - DNA, 22 bp, Artificial Sequence
  chemically synthesized
gaaaccagggaaagcaaaactg

SEQ ID NO: 1100961 - DNA, 22 bp, Artificial Sequence
  chemically synthesized
aaaccagggaaagcaaaactgc

SEQ ID NO: 1100962 - DNA, 22 bp, Artificial Sequence
  chemically synthesized
gtccccgatcatctgcagtttt

SEQ ID NO: 1100963 - DNA, 22 bp, Artificial Sequence
  chemically synthesized
accaatacattagtccccgatc

SEQ ID NO: 1100964 - DNA, 22 bp, Artificial Sequence
  chemically synthesized
agttcaccaatacattagtccc

SEQ ID NO: 1100965 - DNA, 22 bp, Artificial Sequence
  chemically synthesized
aagttcaccaatacattagtcc

SEQ ID NO: 1100966 - DNA, 22 bp, Artificial Sequence
  chemically synthesized
cagatgatcggggactaatgta

SEQ ID NO: 1100967 - DNA, 22 bp, Artificial Sequence
  chemically synthesized
taagttcaccaatacattagtc

SEQ ID NO: 1100968 - DNA, 22 bp, Artificial Sequence
  chemically synthesized
ttaagttcaccaatacattagt

SEQ ID NO: 1100969 - DNA, 22 bp, Artificial Sequence
  chemically synthesized
aagcaatgaatacttttaagtt

SEQ ID NO: 1100970 - DNA, 22 bp, Artificial Sequence
  chemically synthesized
atgtattggtgaacttaaaagt

SEQ ID NO: 1100971 - DNA, 22 bp, Artificial Sequence
  chemically synthesized
aactaaagcaatgaatactttt

SEQ ID NO: 1100972 - DNA, 22 bp, Artificial Sequence
  chemically synthesized
gaactaaagcaatgaatacttt

SEQ ID NO: 1100973 - DNA, 22 bp, Artificial Sequence
  chemically synthesized
tgaactaaagcaatgaatactt

SEQ ID NO: 1100974 - DNA, 22 bp, Artificial Sequence
  chemically synthesized
gtgaacttaaaagtattcattg

SEQ ID NO: 1100975 - DNA, 22 bp, Artificial Sequence
  chemically synthesized
aaaagtattcattgctttagtt

SEQ ID NO: 1100976 - DNA, 22 bp, Artificial Sequence
  chemically synthesized
aaagtattcattgctttagttc

SEQ ID NO: 1100977 - DNA, 22 bp, Artificial Sequence
  chemically synthesized
gaaagataaaattttgaactaa

SEQ ID NO: 1100978 - DNA, 22 bp, Artificial Sequence
  chemically synthesized
ttcgaaagataaaattttgaac

SEQ ID NO: 1100979 - DNA, 22 bp, Artificial Sequence
  chemically synthesized
gttcgaaagataaaattttgaa

SEQ ID NO: 1100980 - DNA, 22 bp, Artificial Sequence
  chemically synthesized
attgctttagttcaaaatttta

SEQ ID NO: 1100981 - DNA, 22 bp, Artificial Sequence
  chemically synthesized
ttgttcgaaagataaaattttg

SEQ ID NO: 1100982 - DNA, 22 bp, Artificial Sequence
  chemically synthesized
cttgttcgaaagataaaatttt

SEQ ID NO: 1100983 - DNA, 22 bp, Artificial Sequence
  chemically synthesized
ctttagttcaaaattttatctt

SEQ ID NO: 1100984 - DNA, 22 bp, Artificial Sequence
  chemically synthesized
tagttcaaaattttatctttcg

SEQ ID NO: 1100985 - DNA, 22 bp, Artificial Sequence
  chemically synthesized
agttcaaaattttatctttcga

SEQ ID NO: 1100986 - DNA, 22 bp, Artificial Sequence
  chemically synthesized
gttcaaaattttatctttcgaa

SEQ ID NO: 1100987 - DNA, 22 bp, Artificial Sequence
  chemically synthesized
aaaattttatctttcgaacaag

SEQ ID NO: 1100988 - DNA, 22 bp, Artificial Sequence
  chemically synthesized
tatctttcgaacaagaagtatt

SEQ ID NO: 1100989 - DNA, 22 bp, Artificial Sequence
  chemically synthesized
atctttcgaacaagaagtattt

SEQ ID NO: 1100990 - DNA, 22 bp, Artificial Sequence
  chemically synthesized
tctttcgaacaagaagtatttg

SEQ ID NO: 1100991 - DNA, 22 bp, Artificial Sequence
  chemically synthesized
aaaaatagtgtatatcaaatac

SEQ ID NO: 1100992 - DNA, 22 bp, Artificial Sequence
  chemically synthesized
tcgaacaagaagtatttgatat

SEQ ID NO: 1100993 - DNA, 22 bp, Artificial Sequence
  chemically synthesized
cgaacaagaagtatttgatata

SEQ ID NO: 1100994 - DNA, 22 bp, Artificial Sequence
  chemically synthesized
gaacaagaagtatttgatatac

SEQ ID NO: 1100995 - DNA, 22 bp, Artificial Sequence
  chemically synthesized
gatatacactatttttgaatat

SEQ ID NO: 1100996 - DNA, 22 bp, Artificial Sequence
  chemically synthesized
atatacactatttttgaatata

SEQ ID NO: 1100997 - DNA, 22 bp, Artificial Sequence
  chemically synthesized
cggatagtaagatatattcaaa

SEQ ID NO: 1100998 - DNA, 22 bp, Artificial Sequence
  chemically synthesized
aattacggatagtaagatatat

SEQ ID NO: 1100999 - DNA, 22 bp, Artificial Sequence
  chemically synthesized
tttttgaatatatcttactatc

SEQ ID NO: 1101000 - DNA, 22 bp, Artificial Sequence
  chemically synthesized
aatattcaattacggatagtaa

SEQ ID NO: 1101001 - DNA, 22 bp, Artificial Sequence
  chemically synthesized
ttgaatatatcttactatccgt

SEQ ID NO: 1101002 - DNA, 22 bp, Artificial Sequence
  chemically synthesized
aaatattcaattacggatagta

SEQ ID NO: 1101003 - DNA, 22 bp, Artificial Sequence
  chemically synthesized
tgaatatatcttactatccgta

SEQ ID NO: 1101004 - DNA, 22 bp, Artificial Sequence
  chemically synthesized
gaatatatcttactatccgtaa

SEQ ID NO: 1101005 - DNA, 22 bp, Artificial Sequence
  chemically synthesized
aatatatcttactatccgtaat

SEQ ID NO: 1101006 - DNA, 22 bp, Artificial Sequence
  chemically synthesized
tatttaaatattcaattacgga

SEQ ID NO: 1101007 - DNA, 22 bp, Artificial Sequence
  chemically synthesized
atatttaaatattcaattacgg

SEQ ID NO: 1101008 - DNA, 22 bp, Artificial Sequence
  chemically synthesized
ttatatttaaatattcaattac

SEQ ID NO: 1101009 - DNA, 22 bp, Artificial Sequence
  chemically synthesized
tcttatatttaaatattcaatt

SEQ ID NO: 1101010 - DNA, 22 bp, Artificial Sequence
  chemically synthesized
actatccgtaattgaatattta

SEQ ID NO: 1101011 - DNA, 22 bp, Artificial Sequence
  chemically synthesized
ctatccgtaattgaatatttaa

SEQ ID NO: 1101012 - DNA, 22 bp, Artificial Sequence
  chemically synthesized
tccgtaattgaatatttaaata

SEQ ID NO: 1101013 - DNA, 22 bp, Artificial Sequence
  chemically synthesized
tagatatctctcttatatttaa

SEQ ID NO: 1101014 - DNA, 22 bp, Artificial Sequence
  chemically synthesized
atagatatctctcttatattta

SEQ ID NO: 1101015 - DNA, 22 bp, Artificial Sequence
  chemically synthesized
tatagatatctctcttatattt

SEQ ID NO: 1101016 - DNA, 22 bp, Artificial Sequence
  chemically synthesized
aatatttaaatataagagagat

SEQ ID NO: 1101017 - DNA, 22 bp, Artificial Sequence
  chemically synthesized
aaatataagagagatatctata

SEQ ID NO: 1101018 - DNA, 22 bp, Artificial Sequence
  chemically synthesized
aatataagagagatatctataa

SEQ ID NO: 1101019 - DNA, 22 bp, Artificial Sequence
  chemically synthesized
cagaagaatattttatagatat

SEQ ID NO: 1101020 - DNA, 22 bp, Artificial Sequence
  chemically synthesized
tacagaagaatattttatagat

SEQ ID NO: 1101021 - DNA, 22 bp, Artificial Sequence
  chemically synthesized
ctacagaagaatattttataga

SEQ ID NO: 1101022 - DNA, 22 bp, Artificial Sequence
  chemically synthesized
tctacagaagaatattttatag

SEQ ID NO: 1101023 - DNA, 22 bp, Artificial Sequence
  chemically synthesized
ttctacagaagaatattttata

SEQ ID NO: 1101024 - DNA, 22 bp, Artificial Sequence
  chemically synthesized
atttttctacagaagaatattt

SEQ ID NO: 1101025 - DNA, 22 bp, Artificial Sequence
  chemically synthesized
tcatttttctacagaagaatat

SEQ ID NO: 1101026 - DNA, 22 bp, Artificial Sequence
  chemically synthesized
ctcatttttctacagaagaata

SEQ ID NO: 1101027 - DNA, 22 bp, Artificial Sequence
  chemically synthesized
agtttctcatttttctacagaa

SEQ ID NO: 1101028 - DNA, 22 bp, Artificial Sequence
  chemically synthesized
gagtttctcatttttctacaga

SEQ ID NO: 1101029 - DNA, 22 bp, Artificial Sequence
  chemically synthesized
taaaatattcttctgtagaaaa

SEQ ID NO: 1101030 - DNA, 22 bp, Artificial Sequence
  chemically synthesized
atatttgagtttctcatttttc

SEQ ID NO: 1101031 - DNA, 22 bp, Artificial Sequence
  chemically synthesized
ttctgtagaaaaatgagaaact

SEQ ID NO: 1101032 - DNA, 22 bp, Artificial Sequence
  chemically synthesized
ctgtagaaaaatgagaaactca

SEQ ID NO: 1101033 - DNA, 22 bp, Artificial Sequence
  chemically synthesized
tacactcatatttgagtttctc

SEQ ID NO: 1101034 - DNA, 22 bp, Artificial Sequence
  chemically synthesized
tgtagaaaaatgagaaactcaa

SEQ ID NO: 1101035 - DNA, 22 bp, Artificial Sequence
  chemically synthesized
tagaaaaatgagaaactcaaat

SEQ ID NO: 1101036 - DNA, 22 bp, Artificial Sequence
  chemically synthesized
aaatatgagtgtacagtcattt

SEQ ID NO: 1101037 - DNA, 22 bp, Artificial Sequence
  chemically synthesized
aaaaaaaaacacacacaaaatg

SEQ ID NO: 1101038 - DNA, 22 bp, Artificial Sequence
  chemically synthesized
caaaaaaaaacacacacaaaat

SEQ ID NO: 1101039 - DNA, 22 bp, Artificial Sequence
  chemically synthesized
aatttcaaaaaaaaacacacac

SEQ ID NO: 1101040 - DNA, 22 bp, Artificial Sequence
  chemically synthesized
agaatagctgaatttcaaaaaa

SEQ ID NO: 1101041 - DNA, 22 bp, Artificial Sequence
  chemically synthesized
tgtgtgtgtttttttttgaaat

SEQ ID NO: 1101042 - DNA, 22 bp, Artificial Sequence
  chemically synthesized
gtgtgtgtttttttttgaaatt

SEQ ID NO: 1101043 - DNA, 22 bp, Artificial Sequence
  chemically synthesized
tgtgtgtttttttttgaaattc

SEQ ID NO: 1101044 - DNA, 22 bp, Artificial Sequence
  chemically synthesized
agtaaccattaagaatagctga

SEQ ID NO: 1101045 - DNA, 22 bp, Artificial Sequence
  chemically synthesized
ttttttgaaattcagctattct

SEQ ID NO: 1101046 - DNA, 22 bp, Artificial Sequence
  chemically synthesized
tttttgaaattcagctattctt

SEQ ID NO: 1101047 - DNA, 22 bp, Artificial Sequence
  chemically synthesized
ttttgaaattcagctattctta

SEQ ID NO: 1101048 - DNA, 22 bp, Artificial Sequence
  chemically synthesized
tttgaaattcagctattcttaa

SEQ ID NO: 1101049 - DNA, 22 bp, Artificial Sequence
  chemically synthesized
ttgaaattcagctattcttaat

SEQ ID NO: 1101050 - DNA, 22 bp, Artificial Sequence
  chemically synthesized
tgaaattcagctattcttaatg

SEQ ID NO: 1101051 - DNA, 22 bp, Artificial Sequence
  chemically synthesized
agattcagtaaccattaagaat

SEQ ID NO: 1101052 - DNA, 22 bp, Artificial Sequence
  chemically synthesized
gaaattcagctattcttaatgg

SEQ ID NO: 1101053 - DNA, 22 bp, Artificial Sequence
  chemically synthesized
aaattcagctattcttaatggt

SEQ ID NO: 1101054 - DNA, 22 bp, Artificial Sequence
  chemically synthesized
agctattcttaatggttactga

SEQ ID NO: 1101055 - DNA, 22 bp, Artificial Sequence
  chemically synthesized
aataacaattaagattcagtaa

SEQ ID NO: 1101056 - DNA, 22 bp, Artificial Sequence
  chemically synthesized
aaataacaattaagattcagta

SEQ ID NO: 1101057 - DNA, 22 bp, Artificial Sequence
  chemically synthesized
ttcttaatggttactgaatctt

SEQ ID NO: 1101058 - DNA, 22 bp, Artificial Sequence
  chemically synthesized
taaataacaattaagattcagt

SEQ ID NO: 1101059 - DNA, 22 bp, Artificial Sequence
  chemically synthesized
ttaatggttactgaatcttaat

SEQ ID NO: 1101060 - DNA, 22 bp, Artificial Sequence
  chemically synthesized
gttttaaataacaattaagatt

SEQ ID NO: 1101061 - DNA, 22 bp, Artificial Sequence
  chemically synthesized
aatggttactgaatcttaattg

SEQ ID NO: 1101062 - DNA, 22 bp, Artificial Sequence
  chemically synthesized
atggttactgaatcttaattgt

SEQ ID NO: 1101063 - DNA, 22 bp, Artificial Sequence
  chemically synthesized
acatctagttttaaataacaat

SEQ ID NO: 1101064 - DNA, 22 bp, Artificial Sequence
  chemically synthesized
ctgaatcttaattgttatttaa

SEQ ID NO: 1101065 - DNA, 22 bp, Artificial Sequence
  chemically synthesized
gctgacatctagttttaaataa

SEQ ID NO: 1101066 - DNA, 22 bp, Artificial Sequence
  chemically synthesized
aatcttaattgttatttaaaac

SEQ ID NO: 1101067 - DNA, 22 bp, Artificial Sequence
  chemically synthesized
aattgttatttaaaactagatg

SEQ ID NO: 1101068 - DNA, 22 bp, Artificial Sequence
  chemically synthesized
attgttatttaaaactagatgt

SEQ ID NO: 1101069 - DNA, 22 bp, Artificial Sequence
  chemically synthesized
ccacacctggctgacatctagt

SEQ ID NO: 1101070 - DNA, 22 bp, Artificial Sequence
  chemically synthesized
ttatttaaaactagatgtcagc

SEQ ID NO: 1101071 - DNA, 22 bp, Artificial Sequence
  chemically synthesized
tttaaaactagatgtcagccag

SEQ ID NO: 1101072 - DNA, 22 bp, Artificial Sequence
  chemically synthesized
aaaactagatgtcagccaggtg

SEQ ID NO: 1101073 - DNA, 22 bp, Artificial Sequence
  chemically synthesized
aaactagatgtcagccaggtgt

SEQ ID NO: 1101074 - DNA, 22 bp, Artificial Sequence
  chemically synthesized
taggtgtgagttaccacacctg

SEQ ID NO: 1101075 - DNA, 22 bp, Artificial Sequence
  chemically synthesized
gatgtcagccaggtgtggtaac

SEQ ID NO: 1101076 - DNA, 22 bp, Artificial Sequence
  chemically synthesized
gaattataggtgtgagttacca

SEQ ID NO: 1101077 - DNA, 22 bp, Artificial Sequence
  chemically synthesized
ccaaaatgctggaattataggt

SEQ ID NO: 1101078 - DNA, 22 bp, Artificial Sequence
  chemically synthesized
gcctcccaaaatgctggaatta

SEQ ID NO: 1101079 - DNA, 22 bp, Artificial Sequence
  chemically synthesized
ggcctcccaaaatgctggaatt

SEQ ID NO: 1101080 - DNA, 22 bp, Artificial Sequence
  chemically synthesized
cttggcctcccaaaatgctgga

SEQ ID NO: 1101081 - DNA, 22 bp, Artificial Sequence
  chemically synthesized
acacctataattccagcatttt

SEQ ID NO: 1101082 - DNA, 22 bp, Artificial Sequence
  chemically synthesized
ccttggcctcccaaaatgctgg

SEQ ID NO: 1101083 - DNA, 22 bp, Artificial Sequence
  chemically synthesized
tccttggcctcccaaaatgctg

SEQ ID NO: 1101084 - DNA, 22 bp, Artificial Sequence
  chemically synthesized
tttccttggcctcccaaaatgc

SEQ ID NO: 1101085 - DNA, 22 bp, Artificial Sequence
  chemically synthesized
taattccagcattttgggaggc

SEQ ID NO: 1101086 - DNA, 22 bp, Artificial Sequence
  chemically synthesized
cagcattttgggaggccaagga

SEQ ID NO: 1101087 - DNA, 22 bp, Artificial Sequence
  chemically synthesized
aaacaatgctctttccttggcc

SEQ ID NO: 1101088 - DNA, 22 bp, Artificial Sequence
  chemically synthesized
ggctcaaacaatgctctttcct

SEQ ID NO: 1101089 - DNA, 22 bp, Artificial Sequence
  chemically synthesized
tgggaggccaaggaaagagcat

SEQ ID NO: 1101090 - DNA, 22 bp, Artificial Sequence
  chemically synthesized
gggaggccaaggaaagagcatt

SEQ ID NO: 1101091 - DNA, 22 bp, Artificial Sequence
  chemically synthesized
ctgggctcaaacaatgctcttt

SEQ ID NO: 1101092 - DNA, 22 bp, Artificial Sequence
  chemically synthesized
ggaggccaaggaaagagcattg

SEQ ID NO: 1101093 - DNA, 22 bp, Artificial Sequence
  chemically synthesized
aattcctgggctcaaacaatgc

SEQ ID NO: 1101094 - DNA, 22 bp, Artificial Sequence
  chemically synthesized
gaattcctgggctcaaacaatg

SEQ ID NO: 1101095 - DNA, 22 bp, Artificial Sequence
  chemically synthesized
tgaattcctgggctcaaacaat

SEQ ID NO: 1101096 - DNA, 22 bp, Artificial Sequence
  chemically synthesized
gttttgaattcctgggctcaaa

SEQ ID NO: 1101097 - DNA, 22 bp, Artificial Sequence
  chemically synthesized
ccaggctggttttgaattcctg

SEQ ID NO: 1101098 - DNA, 22 bp, Artificial Sequence
  chemically synthesized
cccaggctggttttgaattcct

SEQ ID NO: 1101099 - DNA, 22 bp, Artificial Sequence
  chemically synthesized
tttgagcccaggaattcaaaac

SEQ ID NO: 1101100 - DNA, 22 bp, Artificial Sequence
  chemically synthesized
tgtttcccaggctggttttgaa

SEQ ID NO: 1101101 - DNA, 22 bp, Artificial Sequence
  chemically synthesized
gagcccaggaattcaaaaccag

SEQ ID NO: 1101102 - DNA, 22 bp, Artificial Sequence
  chemically synthesized
agcccaggaattcaaaaccagc

SEQ ID NO: 1101103 - DNA, 22 bp, Artificial Sequence
  chemically synthesized
ctgtgtttcccaggctggtttt

SEQ ID NO: 1101104 - DNA, 22 bp, Artificial Sequence
  chemically synthesized
gctgtgtttcccaggctggttt

SEQ ID NO: 1101105 - DNA, 22 bp, Artificial Sequence
  chemically synthesized
aaaaccagcctgggaaacacag

SEQ ID NO: 1101106 - DNA, 22 bp, Artificial Sequence
  chemically synthesized
gtagagacagggtcttgctgtg

SEQ ID NO: 1101107 - DNA, 22 bp, Artificial Sequence
  chemically synthesized
ggtagagacagggtcttgctgt

SEQ ID NO: 1101108 - DNA, 22 bp, Artificial Sequence
  chemically synthesized
tggtagagacagggtcttgctg

SEQ ID NO: 1101109 - DNA, 22 bp, Artificial Sequence
  chemically synthesized
ttggtagagacagggtcttgct

SEQ ID NO: 1101110 - DNA, 22 bp, Artificial Sequence
  chemically synthesized
tttggtagagacagggtcttgc

SEQ ID NO: 1101111 - DNA, 22 bp, Artificial Sequence
  chemically synthesized
ggaaacacagcaagaccctgtc

SEQ ID NO: 1101112 - DNA, 22 bp, Artificial Sequence
  chemically synthesized
ttttttggtagagacagggtct

SEQ ID NO: 1101113 - DNA, 22 bp, Artificial Sequence
  chemically synthesized
ttattttttggtagagacaggg

SEQ ID NO: 1101114 - DNA, 22 bp, Artificial Sequence
  chemically synthesized
gttattttttggtagagacagg

SEQ ID NO: 1101115 - DNA, 22 bp, Artificial Sequence
  chemically synthesized
tgttattttttggtagagacag

SEQ ID NO: 1101116 - DNA, 22 bp, Artificial Sequence
  chemically synthesized
ttgttattttttggtagagaca

SEQ ID NO: 1101117 - DNA, 22 bp, Artificial Sequence
  chemically synthesized
tttgttattttttggtagagac

SEQ ID NO: 1101118 - DNA, 22 bp, Artificial Sequence
  chemically synthesized
attttttgttattttttggtag

SEQ ID NO: 1101119 - DNA, 22 bp, Artificial Sequence
  chemically synthesized
gctaattttttgttattttttg

SEQ ID NO: 1101120 - DNA, 22 bp, Artificial Sequence
  chemically synthesized
tctctaccaaaaaataacaaaa

SEQ ID NO: 1101121 - DNA, 22 bp, Artificial Sequence
  chemically synthesized
taccaaaaaataacaaaaaatt

SEQ ID NO: 1101122 - DNA, 22 bp, Artificial Sequence
  chemically synthesized
ccaaaaaataacaaaaaattag

SEQ ID NO: 1101123 - DNA, 22 bp, Artificial Sequence
  chemically synthesized
gaagtacaggtgtgtgccacca

SEQ ID NO: 1101124 - DNA, 22 bp, Artificial Sequence
  chemically synthesized
gccaggcatggtggcacacacc

SEQ ID NO: 1101125 - DNA, 22 bp, Artificial Sequence
  chemically synthesized
agtccccacaagtagctagaag

SEQ ID NO: 1101126 - DNA, 22 bp, Artificial Sequence
  chemically synthesized
ccatctcagtccccacaagtag

SEQ ID NO: 1101127 - DNA, 22 bp, Artificial Sequence
  chemically synthesized
tcccatctcagtccccacaagt

SEQ ID NO: 1101128 - DNA, 22 bp, Artificial Sequence
  chemically synthesized
tacttctagctacttgtgggga

SEQ ID NO: 1101129 - DNA, 22 bp, Artificial Sequence
  chemically synthesized
ctagctacttgtggggactgag

SEQ ID NO: 1101130 - DNA, 22 bp, Artificial Sequence
  chemically synthesized
tagctacttgtggggactgaga

SEQ ID NO: 1101131 - DNA, 22 bp, Artificial Sequence
  chemically synthesized
gctacttgtggggactgagatg

SEQ ID NO: 1101132 - DNA, 22 bp, Artificial Sequence
  chemically synthesized
aagcaattctcccatctcagtc

SEQ ID NO: 1101133 - DNA, 22 bp, Artificial Sequence
  chemically synthesized
cttgtggggactgagatgggag

SEQ ID NO: 1101134 - DNA, 22 bp, Artificial Sequence
  chemically synthesized
ggctcaagcaattctcccatct

SEQ ID NO: 1101135 - DNA, 22 bp, Artificial Sequence
  chemically synthesized
gtggggactgagatgggagaat

SEQ ID NO: 1101136 - DNA, 22 bp, Artificial Sequence
  chemically synthesized
tggggactgagatgggagaatt

SEQ ID NO: 1101137 - DNA, 22 bp, Artificial Sequence
  chemically synthesized
ctgggctcaagcaattctccca

SEQ ID NO: 1101138 - DNA, 22 bp, Artificial Sequence
  chemically synthesized
aacctcctgggctcaagcaatt

SEQ ID NO: 1101139 - DNA, 22 bp, Artificial Sequence
  chemically synthesized
agatgggagaattgcttgagcc

SEQ ID NO: 1101140 - DNA, 22 bp, Artificial Sequence
  chemically synthesized
cagcctcaacctcctgggctca

SEQ ID NO: 1101141 - DNA, 22 bp, Artificial Sequence
  chemically synthesized
actgcagcctcaacctcctggg

SEQ ID NO: 1101142 - DNA, 22 bp, Artificial Sequence
  chemically synthesized
ggctcactgcagcctcaacctc

SEQ ID NO: 1101143 - DNA, 22 bp, Artificial Sequence
  chemically synthesized
cttgagcccaggaggttgaggc

SEQ ID NO: 1101144 - DNA, 22 bp, Artificial Sequence
  chemically synthesized
gagcccaggaggttgaggctgc

SEQ ID NO: 1101145 - DNA, 22 bp, Artificial Sequence
  chemically synthesized
agcccaggaggttgaggctgca

SEQ ID NO: 1101146 - DNA, 22 bp, Artificial Sequence
  chemically synthesized
aggctgcagtgagccgagttca

SEQ ID NO: 1101147 - DNA, 22 bp, Artificial Sequence
  chemically synthesized
gagtgcagtggtgtgaactcgg

SEQ ID NO: 1101148 - DNA, 22 bp, Artificial Sequence
  chemically synthesized
cagtgagccgagttcacaccac

SEQ ID NO: 1101149 - DNA, 22 bp, Artificial Sequence
  chemically synthesized
tcacccaggctggagtgcagtg

SEQ ID NO: 1101150 - DNA, 22 bp, Artificial Sequence
  chemically synthesized
tgtcacccaggctggagtgcag

SEQ ID NO: 1101151 - DNA, 22 bp, Artificial Sequence
  chemically synthesized
cctctgtcacccaggctggagt

SEQ ID NO: 1101152 - DNA, 22 bp, Artificial Sequence
  chemically synthesized
acaccactgcactccagcctgg

SEQ ID NO: 1101153 - DNA, 22 bp, Artificial Sequence
  chemically synthesized
cactccagcctgggtgacagag

SEQ ID NO: 1101154 - DNA, 22 bp, Artificial Sequence
  chemically synthesized
ggacagggtctccctctgtcac

SEQ ID NO: 1101155 - DNA, 22 bp, Artificial Sequence
  chemically synthesized
gggacagggtctccctctgtca

SEQ ID NO: 1101156 - DNA, 22 bp, Artificial Sequence
  chemically synthesized
tgggacagggtctccctctgtc

SEQ ID NO: 1101157 - DNA, 22 bp, Artificial Sequence
  chemically synthesized
ttgggacagggtctccctctgt

SEQ ID NO: 1101158 - DNA, 22 bp, Artificial Sequence
  chemically synthesized
cagcctgggtgacagagggaga

SEQ ID NO: 1101159 - DNA, 22 bp, Artificial Sequence
  chemically synthesized
tttgggacagggtctccctctg

SEQ ID NO: 1101160 - DNA, 22 bp, Artificial Sequence
  chemically synthesized
ttttttgggacagggtctccct

SEQ ID NO: 1101161 - DNA, 22 bp, Artificial Sequence
  chemically synthesized
attttttgggacagggtctccc

SEQ ID NO: 1101162 - DNA, 22 bp, Artificial Sequence
  chemically synthesized
tattttttgggacagggtctcc

SEQ ID NO: 1101163 - DNA, 22 bp, Artificial Sequence
  chemically synthesized
ggtgacagagggagaccctgtc

SEQ ID NO: 1101164 - DNA, 22 bp, Artificial Sequence
  chemically synthesized
ttttattttttgggacagggtc

SEQ ID NO: 1101165 - DNA, 22 bp, Artificial Sequence
  chemically synthesized
attttattttttgggacagggt

SEQ ID NO: 1101166 - DNA, 22 bp, Artificial Sequence
  chemically synthesized
tttattttattttttgggacag

SEQ ID NO: 1101167 - DNA, 22 bp, Artificial Sequence
  chemically synthesized
atttattttattttttgggaca

SEQ ID NO: 1101168 - DNA, 22 bp, Artificial Sequence
  chemically synthesized
tttatttattttattttttggg

SEQ ID NO: 1101169 - DNA, 22 bp, Artificial Sequence
  chemically synthesized
ttatttatttattttatttttt

SEQ ID NO: 1101170 - DNA, 22 bp, Artificial Sequence
  chemically synthesized
attatttatttattttattttt

SEQ ID NO: 1101171 - DNA, 22 bp, Artificial Sequence
  chemically synthesized
tcccaaaaaataaaataaataa

SEQ ID NO: 1101172 - DNA, 22 bp, Artificial Sequence
  chemically synthesized
gacacatttattatttatttat

SEQ ID NO: 1101173 - DNA, 22 bp, Artificial Sequence
  chemically synthesized
cgacacatttattatttattta

SEQ ID NO: 1101174 - DNA, 22 bp, Artificial Sequence
  chemically synthesized
ttcgacacatttattatttatt

SEQ ID NO: 1101175 - DNA, 22 bp, Artificial Sequence
  chemically synthesized
gcctcttcgacacatttattat

SEQ ID NO: 1101176 - DNA, 22 bp, Artificial Sequence
  chemically synthesized
ggcctcttcgacacatttatta

SEQ ID NO: 1101177 - DNA, 22 bp, Artificial Sequence
  chemically synthesized
caagtttggcctcttcgacaca

SEQ ID NO: 1101178 - DNA, 22 bp, Artificial Sequence
  chemically synthesized
ccaagtttggcctcttcgacac

SEQ ID NO: 1101179 - DNA, 22 bp, Artificial Sequence
  chemically synthesized
acatttccaagtttggcctctt

SEQ ID NO: 1101180 - DNA, 22 bp, Artificial Sequence
  chemically synthesized
gattaacatttccaagtttggc

SEQ ID NO: 1101181 - DNA, 22 bp, Artificial Sequence
  chemically synthesized
cgattaacatttccaagtttgg

SEQ ID NO: 1101182 - DNA, 22 bp, Artificial Sequence
  chemically synthesized
tcgattaacatttccaagtttg

SEQ ID NO: 1101183 - DNA, 22 bp, Artificial Sequence
  chemically synthesized
taactttcgattaacatttcca

SEQ ID NO: 1101184 - DNA, 22 bp, Artificial Sequence
  chemically synthesized
ggaaatgttaatcgaaagttat

SEQ ID NO: 1101185 - DNA, 22 bp, Artificial Sequence
  chemically synthesized
gaaatgttaatcgaaagttata

SEQ ID NO: 1101186 - DNA, 22 bp, Artificial Sequence
  chemically synthesized
atcgaaagttataattatttat

SEQ ID NO: 1101187 - DNA, 22 bp, Artificial Sequence
  chemically synthesized
taattatttatcctatttctac

SEQ ID NO: 1101188 - DNA, 22 bp, Artificial Sequence
  chemically synthesized
atatatgtgtatgtagaaatag

SEQ ID NO: 1101189 - DNA, 22 bp, Artificial Sequence
  chemically synthesized
tttatcctatttctacatacac

SEQ ID NO: 1101190 - DNA, 22 bp, Artificial Sequence
  chemically synthesized
atcctatttctacatacacata

SEQ ID NO: 1101191 - DNA, 22 bp, Artificial Sequence
  chemically synthesized
tcctatttctacatacacatat

SEQ ID NO: 1101192 - DNA, 22 bp, Artificial Sequence
  chemically synthesized
tttctacatacacatatattag

SEQ ID NO: 1101193 - DNA, 22 bp, Artificial Sequence
  chemically synthesized
ctacatacacatatattagcca

SEQ ID NO: 1101194 - DNA, 22 bp, Artificial Sequence
  chemically synthesized
tacatacacatatattagccat

SEQ ID NO: 1101195 - DNA, 22 bp, Artificial Sequence
  chemically synthesized
catacacatatattagccatgc

SEQ ID NO: 1101196 - DNA, 22 bp, Artificial Sequence
  chemically synthesized
gtacaaaataaaatgcatggct

SEQ ID NO: 1101197 - DNA, 22 bp, Artificial Sequence
  chemically synthesized
ggtacaaaataaaatgcatggc

SEQ ID NO: 1101198 - DNA, 22 bp, Artificial Sequence
  chemically synthesized
gccatgcattttattttgtacc

SEQ ID NO: 1101199 - DNA, 22 bp, Artificial Sequence
  chemically synthesized
cacggagatatttggtacaaaa

SEQ ID NO: 1101200 - DNA, 22 bp, Artificial Sequence
  chemically synthesized
ttacacggagatatttggtaca

SEQ ID NO: 1101201 - DNA, 22 bp, Artificial Sequence
  chemically synthesized
gttacacggagatatttggtac

SEQ ID NO: 1101202 - DNA, 22 bp, Artificial Sequence
  chemically synthesized
tattttgtaccaaatatctccg

SEQ ID NO: 1101203 - DNA, 22 bp, Artificial Sequence
  chemically synthesized
attttgtaccaaatatctccgt

SEQ ID NO: 1101204 - DNA, 22 bp, Artificial Sequence
  chemically synthesized
ttttgtaccaaatatctccgtg

SEQ ID NO: 1101205 - DNA, 22 bp, Artificial Sequence
  chemically synthesized
agaaaaatttgttacacggaga

SEQ ID NO: 1101206 - DNA, 22 bp, Artificial Sequence
  chemically synthesized
tgtaccaaatatctccgtgtaa

SEQ ID NO: 1101207 - DNA, 22 bp, Artificial Sequence
  chemically synthesized
gtaccaaatatctccgtgtaac

SEQ ID NO: 1101208 - DNA, 22 bp, Artificial Sequence
  chemically synthesized
taccaaatatctccgtgtaaca

SEQ ID NO: 1101209 - DNA, 22 bp, Artificial Sequence
  chemically synthesized
cgtgtaacaaatttttcttaat

SEQ ID NO: 1101210 - DNA, 22 bp, Artificial Sequence
  chemically synthesized
ttcttaatcccattattattat

SEQ ID NO: 1101211 - DNA, 22 bp, Artificial Sequence
  chemically synthesized
tcttaatcccattattattata

SEQ ID NO: 1101212 - DNA, 22 bp, Artificial Sequence
  chemically synthesized
agaacataaatgtataataata

SEQ ID NO: 1101213 - DNA, 22 bp, Artificial Sequence
  chemically synthesized
cttaatcccattattattatac

SEQ ID NO: 1101214 - DNA, 22 bp, Artificial Sequence
  chemically synthesized
cagaacataaatgtataataat

SEQ ID NO: 1101215 - DNA, 22 bp, Artificial Sequence
  chemically synthesized
ttaatcccattattattataca

SEQ ID NO: 1101216 - DNA, 22 bp, Artificial Sequence
  chemically synthesized
ttcagaacataaatgtataata

SEQ ID NO: 1101217 - DNA, 22 bp, Artificial Sequence
  chemically synthesized
aatcccattattattatacatt

SEQ ID NO: 1101218 - DNA, 22 bp, Artificial Sequence
  chemically synthesized
cttcagaacataaatgtataat

SEQ ID NO: 1101219 - DNA, 22 bp, Artificial Sequence
  chemically synthesized
atcccattattattatacattt

SEQ ID NO: 1101220 - DNA, 22 bp, Artificial Sequence
  chemically synthesized
tcttcagaacataaatgtataa

SEQ ID NO: 1101221 - DNA, 22 bp, Artificial Sequence
  chemically synthesized
ttattatacatttatgttctga

SEQ ID NO: 1101222 - DNA, 22 bp, Artificial Sequence
  chemically synthesized
ttatacatttatgttctgaaga

SEQ ID NO: 1101223 - DNA, 22 bp, Artificial Sequence
  chemically synthesized
caatccatgttttcttcagaac

SEQ ID NO: 1101224 - DNA, 22 bp, Artificial Sequence
  chemically synthesized
ccaatccatgttttcttcagaa

SEQ ID NO: 1101225 - DNA, 22 bp, Artificial Sequence
  chemically synthesized
tacatttatgttctgaagaaaa

SEQ ID NO: 1101226 - DNA, 22 bp, Artificial Sequence
  chemically synthesized
tttccaatccatgttttcttca

SEQ ID NO: 1101227 - DNA, 22 bp, Artificial Sequence
  chemically synthesized
atgttctgaagaaaacatggat

SEQ ID NO: 1101228 - DNA, 22 bp, Artificial Sequence
  chemically synthesized
tgttctgaagaaaacatggatt

SEQ ID NO: 1101229 - DNA, 22 bp, Artificial Sequence
  chemically synthesized
gtcattatttccaatccatgtt

SEQ ID NO: 1101230 - DNA, 22 bp, Artificial Sequence
  chemically synthesized
agtcattatttccaatccatgt

SEQ ID NO: 1101231 - DNA, 22 bp, Artificial Sequence
  chemically synthesized
ttagtcattatttccaatccat

SEQ ID NO: 1101232 - DNA, 22 bp, Artificial Sequence
  chemically synthesized
tgaagaaaacatggattggaaa

SEQ ID NO: 1101233 - DNA, 22 bp, Artificial Sequence
  chemically synthesized
ttcttagtcattatttccaatc

SEQ ID NO: 1101234 - DNA, 22 bp, Artificial Sequence
  chemically synthesized
aagaaaacatggattggaaata

SEQ ID NO: 1101235 - DNA, 22 bp, Artificial Sequence
  chemically synthesized
aaaaatgaaatcctattcttag

SEQ ID NO: 1101236 - DNA, 22 bp, Artificial Sequence
  chemically synthesized
gaaataatgactaagaatagga

SEQ ID NO: 1101237 - DNA, 22 bp, Artificial Sequence
  chemically synthesized
tcatactaaaaaatgaaatcct

SEQ ID NO: 1101238 - DNA, 22 bp, Artificial Sequence
  chemically synthesized
agaataggatttcattttttag

SEQ ID NO: 1101239 - DNA, 22 bp, Artificial Sequence
  chemically synthesized
aacacaactgtcatactaaaaa

SEQ ID NO: 1101240 - DNA, 22 bp, Artificial Sequence
  chemically synthesized
gaacacaactgtcatactaaaa

SEQ ID NO: 1101241 - DNA, 22 bp, Artificial Sequence
  chemically synthesized
ttgaacacaactgtcatactaa

SEQ ID NO: 1101242 - DNA, 22 bp, Artificial Sequence
  chemically synthesized
cttgaacacaactgtcatacta

SEQ ID NO: 1101243 - DNA, 22 bp, Artificial Sequence
  chemically synthesized
tcttgaacacaactgtcatact

SEQ ID NO: 1101244 - DNA, 22 bp, Artificial Sequence
  chemically synthesized
cattttttagtatgacagttgt

SEQ ID NO: 1101245 - DNA, 22 bp, Artificial Sequence
  chemically synthesized
attttttagtatgacagttgtg

SEQ ID NO: 1101246 - DNA, 22 bp, Artificial Sequence
  chemically synthesized
tttagtatgacagttgtgttca

SEQ ID NO: 1101247 - DNA, 22 bp, Artificial Sequence
  chemically synthesized
aaatgactttcttgaacacaac

SEQ ID NO: 1101248 - DNA, 22 bp, Artificial Sequence
  chemically synthesized
ttagtatgacagttgtgttcaa

SEQ ID NO: 1101249 - DNA, 22 bp, Artificial Sequence
  chemically synthesized
tagtatgacagttgtgttcaag

SEQ ID NO: 1101250 - DNA, 22 bp, Artificial Sequence
  chemically synthesized
agtatgacagttgtgttcaaga

SEQ ID NO: 1101251 - DNA, 22 bp, Artificial Sequence
  chemically synthesized
gtatgacagttgtgttcaagaa

SEQ ID NO: 1101252 - DNA, 22 bp, Artificial Sequence
  chemically synthesized
atcctaaaatgactttcttgaa

SEQ ID NO: 1101253 - DNA, 22 bp, Artificial Sequence
  chemically synthesized
gatcctaaaatgactttcttga

SEQ ID NO: 1101254 - DNA, 22 bp, Artificial Sequence
  chemically synthesized
tgatcctaaaatgactttcttg

SEQ ID NO: 1101255 - DNA, 22 bp, Artificial Sequence
  chemically synthesized
ttttgatcctaaaatgactttc

SEQ ID NO: 1101256 - DNA, 22 bp, Artificial Sequence
  chemically synthesized
attttgatcctaaaatgacttt

SEQ ID NO: 1101257 - DNA, 22 bp, Artificial Sequence
  chemically synthesized
tgttcaagaaagtcattttagg

SEQ ID NO: 1101258 - DNA, 22 bp, Artificial Sequence
  chemically synthesized
atcttattttgatcctaaaatg

SEQ ID NO: 1101259 - DNA, 22 bp, Artificial Sequence
  chemically synthesized
aagaaagtcattttaggatcaa

SEQ ID NO: 1101260 - DNA, 22 bp, Artificial Sequence
  chemically synthesized
aatagtacacattcatcttatt

SEQ ID NO: 1101261 - DNA, 22 bp, Artificial Sequence
  chemically synthesized
aaatagtacacattcatcttat

SEQ ID NO: 1101262 - DNA, 22 bp, Artificial Sequence
  chemically synthesized
taaatagtacacattcatctta

SEQ ID NO: 1101263 - DNA, 22 bp, Artificial Sequence
  chemically synthesized
taggatcaaaataagatgaatg

SEQ ID NO: 1101264 - DNA, 22 bp, Artificial Sequence
  chemically synthesized
aggatcaaaataagatgaatgt

SEQ ID NO: 1101265 - DNA, 22 bp, Artificial Sequence
  chemically synthesized
ggatcaaaataagatgaatgtg

SEQ ID NO: 1101266 - DNA, 22 bp, Artificial Sequence
  chemically synthesized
atggtatatattttaaatagta

SEQ ID NO: 1101267 - DNA, 22 bp, Artificial Sequence
  chemically synthesized
catggtatatattttaaatagt

SEQ ID NO: 1101268 - DNA, 22 bp, Artificial Sequence
  chemically synthesized
tcatggtatatattttaaatag

SEQ ID NO: 1101269 - DNA, 22 bp, Artificial Sequence
  chemically synthesized
aatattttcatggtatatattt

SEQ ID NO: 1101270 - DNA, 22 bp, Artificial Sequence
  chemically synthesized
tttaaaatatataccatgaaaa

SEQ ID NO: 1101271 - DNA, 22 bp, Artificial Sequence
  chemically synthesized
gcatatctaaatattttcatgg

SEQ ID NO: 1101272 - DNA, 22 bp, Artificial Sequence
  chemically synthesized
aaaatatataccatgaaaatat

SEQ ID NO: 1101273 - DNA, 22 bp, Artificial Sequence
  chemically synthesized
tagcatatctaaatattttcat

SEQ ID NO: 1101274 - DNA, 22 bp, Artificial Sequence
  chemically synthesized
aaatatataccatgaaaatatt

SEQ ID NO: 1101275 - DNA, 22 bp, Artificial Sequence
  chemically synthesized
ctagcatatctaaatattttca

SEQ ID NO: 1101276 - DNA, 22 bp, Artificial Sequence
  chemically synthesized
tctagcatatctaaatattttc

SEQ ID NO: 1101277 - DNA, 22 bp, Artificial Sequence
  chemically synthesized
ttctagcatatctaaatatttt

SEQ ID NO: 1101278 - DNA, 22 bp, Artificial Sequence
  chemically synthesized
tttctagcatatctaaatattt

SEQ ID NO: 1101279 - DNA, 22 bp, Artificial Sequence
  chemically synthesized
ttttctagcatatctaaatatt

SEQ ID NO: 1101280 - DNA, 22 bp, Artificial Sequence
  chemically synthesized
atcttttttctagcatatctaa

SEQ ID NO: 1101281 - DNA, 22 bp, Artificial Sequence
  chemically synthesized
acaaattaatcttttttctagc

SEQ ID NO: 1101282 - DNA, 22 bp, Artificial Sequence
  chemically synthesized
tgacaaattaatcttttttcta

SEQ ID NO: 1101283 - DNA, 22 bp, Artificial Sequence
  chemically synthesized
agatatgctagaaaaaagatta

SEQ ID NO: 1101284 - DNA, 22 bp, Artificial Sequence
  chemically synthesized
attctgacaaattaatcttttt

SEQ ID NO: 1101285 - DNA, 22 bp, Artificial Sequence
  chemically synthesized
gatatgctagaaaaaagattaa

SEQ ID NO: 1101286 - DNA, 22 bp, Artificial Sequence
  chemically synthesized
gaaaaaagattaatttgtcaga

SEQ ID NO: 1101287 - DNA, 22 bp, Artificial Sequence
  chemically synthesized
aagcacaattaattctgacaaa

SEQ ID NO: 1101288 - DNA, 22 bp, Artificial Sequence
  chemically synthesized
aaagcacaattaattctgacaa

SEQ ID NO: 1101289 - DNA, 22 bp, Artificial Sequence
  chemically synthesized
taaagcacaattaattctgaca

SEQ ID NO: 1101290 - DNA, 22 bp, Artificial Sequence
  chemically synthesized
ctttaaagcacaattaattctg

SEQ ID NO: 1101291 - DNA, 22 bp, Artificial Sequence
  chemically synthesized
gctttaaagcacaattaattct

SEQ ID NO: 1101292 - DNA, 22 bp, Artificial Sequence
  chemically synthesized
tgctttaaagcacaattaattc

SEQ ID NO: 1101293 - DNA, 22 bp, Artificial Sequence
  chemically synthesized
ttgctttaaagcacaattaatt

SEQ ID NO: 1101294 - DNA, 22 bp, Artificial Sequence
  chemically synthesized
atttgtcagaattaattgtgct

SEQ ID NO: 1101295 - DNA, 22 bp, Artificial Sequence
  chemically synthesized
tgtttttgctttaaagcacaat

SEQ ID NO: 1101296 - DNA, 22 bp, Artificial Sequence
  chemically synthesized
gtcagaattaattgtgctttaa

SEQ ID NO: 1101297 - DNA, 22 bp, Artificial Sequence
  chemically synthesized
tcagaattaattgtgctttaaa

SEQ ID NO: 1101298 - DNA, 22 bp, Artificial Sequence
  chemically synthesized
ctatgtttttgctttaaagcac

SEQ ID NO: 1101299 - DNA, 22 bp, Artificial Sequence
  chemically synthesized
ttcctatgtttttgctttaaag

SEQ ID NO: 1101300 - DNA, 22 bp, Artificial Sequence
  chemically synthesized
gttcctatgtttttgctttaaa

SEQ ID NO: 1101301 - DNA, 22 bp, Artificial Sequence
  chemically synthesized
tgttcctatgtttttgctttaa

SEQ ID NO: 1101302 - DNA, 22 bp, Artificial Sequence
  chemically synthesized
attgtgctttaaagcaaaaaca

SEQ ID NO: 1101303 - DNA, 22 bp, Artificial Sequence
  chemically synthesized
aggctttgttcctatgtttttg

SEQ ID NO: 1101304 - DNA, 22 bp, Artificial Sequence
  chemically synthesized
tgctttaaagcaaaaacatagg

SEQ ID NO: 1101305 - DNA, 22 bp, Artificial Sequence
  chemically synthesized
gttaaggctttgttcctatgtt

SEQ ID NO: 1101306 - DNA, 22 bp, Artificial Sequence
  chemically synthesized
ggttaaggctttgttcctatgt

SEQ ID NO: 1101307 - DNA, 22 bp, Artificial Sequence
  chemically synthesized
tggttaaggctttgttcctatg

SEQ ID NO: 1101308 - DNA, 22 bp, Artificial Sequence
  chemically synthesized
taaagcaaaaacataggaacaa

SEQ ID NO: 1101309 - DNA, 22 bp, Artificial Sequence
  chemically synthesized
ttggttaaggctttgttcctat

SEQ ID NO: 1101310 - DNA, 22 bp, Artificial Sequence
  chemically synthesized
aaagcaaaaacataggaacaaa

SEQ ID NO: 1101311 - DNA, 22 bp, Artificial Sequence
  chemically synthesized
aagcaaaaacataggaacaaag

SEQ ID NO: 1101312 - DNA, 22 bp, Artificial Sequence
  chemically synthesized
cttttggttaaggctttgttcc

SEQ ID NO: 1101313 - DNA, 22 bp, Artificial Sequence
  chemically synthesized
accgttacttttggttaaggct

SEQ ID NO: 1101314 - DNA, 22 bp, Artificial Sequence
  chemically synthesized
caccgttacttttggttaaggc

SEQ ID NO: 1101315 - DNA, 22 bp, Artificial Sequence
  chemically synthesized
ccttcaccgttacttttggtta

SEQ ID NO: 1101316 - DNA, 22 bp, Artificial Sequence
  chemically synthesized
atgtctcccttcaccgttactt

SEQ ID NO: 1101317 - DNA, 22 bp, Artificial Sequence
  chemically synthesized
ctaatgtctcccttcaccgtta

SEQ ID NO: 1101318 - DNA, 22 bp, Artificial Sequence
  chemically synthesized
cctaatgtctcccttcaccgtt

SEQ ID NO: 1101319 - DNA, 22 bp, Artificial Sequence
  chemically synthesized
aaccaaaagtaacggtgaaggg

SEQ ID NO: 1101320 - DNA, 22 bp, Artificial Sequence
  chemically synthesized
accaaaagtaacggtgaaggga

SEQ ID NO: 1101321 - DNA, 22 bp, Artificial Sequence
  chemically synthesized
agatttcctaatgtctcccttc

SEQ ID NO: 1101322 - DNA, 22 bp, Artificial Sequence
  chemically synthesized
actaagatttcctaatgtctcc

SEQ ID NO: 1101323 - DNA, 22 bp, Artificial Sequence
  chemically synthesized
aactaagatttcctaatgtctc

SEQ ID NO: 1101324 - DNA, 22 bp, Artificial Sequence
  chemically synthesized
aacgtacttaactaagatttcc

SEQ ID NO: 1101325 - DNA, 22 bp, Artificial Sequence
  chemically synthesized
cctcaacgtacttaactaagat

SEQ ID NO: 1101326 - DNA, 22 bp, Artificial Sequence
  chemically synthesized
gcctcaacgtacttaactaaga

SEQ ID NO: 1101327 - DNA, 22 bp, Artificial Sequence
  chemically synthesized
tggcttgcctcaacgtacttaa

SEQ ID NO: 1101328 - DNA, 22 bp, Artificial Sequence
  chemically synthesized
ggaaatcttagttaagtacgtt

SEQ ID NO: 1101329 - DNA, 22 bp, Artificial Sequence
  chemically synthesized
actgtggcttgcctcaacgtac

SEQ ID NO: 1101330 - DNA, 22 bp, Artificial Sequence
  chemically synthesized
cactgtggcttgcctcaacgta

SEQ ID NO: 1101331 - DNA, 22 bp, Artificial Sequence
  chemically synthesized
tcactgtggcttgcctcaacgt

SEQ ID NO: 1101332 - DNA, 22 bp, Artificial Sequence
  chemically synthesized
tttcactgtggcttgcctcaac

SEQ ID NO: 1101333 - DNA, 22 bp, Artificial Sequence
  chemically synthesized
agttaagtacgttgaggcaagc

SEQ ID NO: 1101334 - DNA, 22 bp, Artificial Sequence
  chemically synthesized
gttaagtacgttgaggcaagcc

SEQ ID NO: 1101335 - DNA, 22 bp, Artificial Sequence
  chemically synthesized
agtacgttgaggcaagccacag

SEQ ID NO: 1101336 - DNA, 22 bp, Artificial Sequence
  chemically synthesized
aggcaagccacagtgaaagaga

SEQ ID NO: 1101337 - DNA, 22 bp, Artificial Sequence
  chemically synthesized
agtgggatcacatgtgccaaca

SEQ ID NO: 1101338 - DNA, 22 bp, Artificial Sequence
  chemically synthesized
tctatacctgttggcacatgtg

SEQ ID NO: 1101339 - DNA, 22 bp, Artificial Sequence
  chemically synthesized
acactcagtgggatcacatgtg

SEQ ID NO: 1101340 - DNA, 22 bp, Artificial Sequence
  chemically synthesized
aacactcagtgggatcacatgt

SEQ ID NO: 1101341 - DNA, 22 bp, Artificial Sequence
  chemically synthesized
tacctgttggcacatgtgatcc

SEQ ID NO: 1101342 - DNA, 22 bp, Artificial Sequence
  chemically synthesized
ttggcacatgtgatcccactga

SEQ ID NO: 1101343 - DNA, 22 bp, Artificial Sequence
  chemically synthesized
aaagaacttaacactcagtggg

SEQ ID NO: 1101344 - DNA, 22 bp, Artificial Sequence
  chemically synthesized
gcacatgtgatcccactgagtg

SEQ ID NO: 1101345 - DNA, 22 bp, Artificial Sequence
  chemically synthesized
agacagaactcaaagaacttaa

SEQ ID NO: 1101346 - DNA, 22 bp, Artificial Sequence
  chemically synthesized
gagacagaactcaaagaactta

SEQ ID NO: 1101347 - DNA, 22 bp, Artificial Sequence
  chemically synthesized
agtgttaagttctttgagttct

SEQ ID NO: 1101348 - DNA, 22 bp, Artificial Sequence
  chemically synthesized
gagacttgagacagaactcaaa

SEQ ID NO: 1101349 - DNA, 22 bp, Artificial Sequence
  chemically synthesized
cgagacttgagacagaactcaa

SEQ ID NO: 1101350 - DNA, 22 bp, Artificial Sequence
  chemically synthesized
cttcgagacttgagacagaact

SEQ ID NO: 1101351 - DNA, 22 bp, Artificial Sequence
  chemically synthesized
gcttcgagacttgagacagaac

SEQ ID NO: 1101352 - DNA, 22 bp, Artificial Sequence
  chemically synthesized
agttctttgagttctgtctcaa

SEQ ID NO: 1101353 - DNA, 22 bp, Artificial Sequence
  chemically synthesized
tttgagttctgtctcaagtctc

SEQ ID NO: 1101354 - DNA, 22 bp, Artificial Sequence
  chemically synthesized
tgagttctgtctcaagtctcga

SEQ ID NO: 1101355 - DNA, 22 bp, Artificial Sequence
  chemically synthesized
gagttctgtctcaagtctcgaa

SEQ ID NO: 1101356 - DNA, 22 bp, Artificial Sequence
  chemically synthesized
agttctgtctcaagtctcgaag

SEQ ID NO: 1101357 - DNA, 22 bp, Artificial Sequence
  chemically synthesized
tgtctcaagtctcgaagcaaac

SEQ ID NO: 1101358 - DNA, 22 bp, Artificial Sequence
  chemically synthesized
tctcaagtctcgaagcaaactc

SEQ ID NO: 1101359 - DNA, 22 bp, Artificial Sequence
  chemically synthesized
aagtctcgaagcaaactctggc

SEQ ID NO: 1101360 - DNA, 22 bp, Artificial Sequence
  chemically synthesized
gaagcaaactctggctctgctt

SEQ ID NO: 1101361 - DNA, 22 bp, Artificial Sequence
  chemically synthesized
tggctctgcttcattctttatc

SEQ ID NO: 1101362 - DNA, 22 bp, Artificial Sequence
  chemically synthesized
gctctgcttcattctttatctt

SEQ ID NO: 1101363 - DNA, 22 bp, Artificial Sequence
  chemically synthesized
tgcttcattctttatcttctgc

SEQ ID NO: 1101364 - DNA, 22 bp, Artificial Sequence
  chemically synthesized
cttcattctttatcttctgccc

SEQ ID NO: 1101365 - DNA, 22 bp, Artificial Sequence
  chemically synthesized
cattctttatcttctgcccacc

SEQ ID NO: 1101366 - DNA, 22 bp, Artificial Sequence
  chemically synthesized
attctttatcttctgcccacct

SEQ ID NO: 1101367 - DNA, 22 bp, Artificial Sequence
  chemically synthesized
aacagtgtcaatgaaggtgggc

SEQ ID NO: 1101368 - DNA, 22 bp, Artificial Sequence
  chemically synthesized
tttatcttctgcccaccttcat

SEQ ID NO: 1101369 - DNA, 22 bp, Artificial Sequence
  chemically synthesized
tatcttctgcccaccttcattg

SEQ ID NO: 1101370 - DNA, 22 bp, Artificial Sequence
  chemically synthesized
atcttctgcccaccttcattga

SEQ ID NO: 1101371 - DNA, 22 bp, Artificial Sequence
  chemically synthesized
tcttctgcccaccttcattgac

SEQ ID NO: 1101372 - DNA, 22 bp, Artificial Sequence
  chemically synthesized
ctgcccaccttcattgacactg

SEQ ID NO: 1101373 - DNA, 22 bp, Artificial Sequence
  chemically synthesized
tgcccaccttcattgacactgt

SEQ ID NO: 1101374 - DNA, 22 bp, Artificial Sequence
  chemically synthesized
agcccagtctaaacagtgtcaa

SEQ ID NO: 1101375 - DNA, 22 bp, Artificial Sequence
  chemically synthesized
cccaccttcattgacactgttt

SEQ ID NO: 1101376 - DNA, 22 bp, Artificial Sequence
  chemically synthesized
agacaattcagcccagtctaaa

SEQ ID NO: 1101377 - DNA, 22 bp, Artificial Sequence
  chemically synthesized
cattgacactgtttagactggg

SEQ ID NO: 1101378 - DNA, 22 bp, Artificial Sequence
  chemically synthesized
attgacactgtttagactgggc

SEQ ID NO: 1101379 - DNA, 22 bp, Artificial Sequence
  chemically synthesized
acactgtttagactgggctgaa

SEQ ID NO: 1101380 - DNA, 22 bp, Artificial Sequence
  chemically synthesized
tttagactgggctgaattgtct

SEQ ID NO: 1101381 - DNA, 22 bp, Artificial Sequence
  chemically synthesized
gtcagtgatattcagacaattc

SEQ ID NO: 1101382 - DNA, 22 bp, Artificial Sequence
  chemically synthesized
agtcagtgatattcagacaatt

SEQ ID NO: 1101383 - DNA, 22 bp, Artificial Sequence
  chemically synthesized
agactgggctgaattgtctgaa

SEQ ID NO: 1101384 - DNA, 22 bp, Artificial Sequence
  chemically synthesized
tagtcagtgatattcagacaat

SEQ ID NO: 1101385 - DNA, 22 bp, Artificial Sequence
  chemically synthesized
gactgggctgaattgtctgaat

SEQ ID NO: 1101386 - DNA, 22 bp, Artificial Sequence
  chemically synthesized
ttagtcagtgatattcagacaa

SEQ ID NO: 1101387 - DNA, 22 bp, Artificial Sequence
  chemically synthesized
gcttttagtcagtgatattcag

SEQ ID NO: 1101388 - DNA, 22 bp, Artificial Sequence
  chemically synthesized
ggctgaattgtctgaatatcac

SEQ ID NO: 1101389 - DNA, 22 bp, Artificial Sequence
  chemically synthesized
agcttttagtcagtgatattca

SEQ ID NO: 1101390 - DNA, 22 bp, Artificial Sequence
  chemically synthesized
ttagcttttagtcagtgatatt

SEQ ID NO: 1101391 - DNA, 22 bp, Artificial Sequence
  chemically synthesized
cttagcttttagtcagtgatat

SEQ ID NO: 1101392 - DNA, 22 bp, Artificial Sequence
  chemically synthesized
tcttagcttttagtcagtgata

SEQ ID NO: 1101393 - DNA, 22 bp, Artificial Sequence
  chemically synthesized
aattgtctgaatatcactgact

SEQ ID NO: 1101394 - DNA, 22 bp, Artificial Sequence
  chemically synthesized
ttttcttagcttttagtcagtg

SEQ ID NO: 1101395 - DNA, 22 bp, Artificial Sequence
  chemically synthesized
attttcttagcttttagtcagt

SEQ ID NO: 1101396 - DNA, 22 bp, Artificial Sequence
  chemically synthesized
tctgaatatcactgactaaaag

SEQ ID NO: 1101397 - DNA, 22 bp, Artificial Sequence
  chemically synthesized
atttattttcttagcttttagt

SEQ ID NO: 1101398 - DNA, 22 bp, Artificial Sequence
  chemically synthesized
aatatcactgactaaaagctaa

SEQ ID NO: 1101399 - DNA, 22 bp, Artificial Sequence
  chemically synthesized
aattgatttattttcttagctt

SEQ ID NO: 1101400 - DNA, 22 bp, Artificial Sequence
  chemically synthesized
aaattgatttattttcttagct

SEQ ID NO: 1101401 - DNA, 22 bp, Artificial Sequence
  chemically synthesized
gcttaaattgatttattttctt

SEQ ID NO: 1101402 - DNA, 22 bp, Artificial Sequence
  chemically synthesized
actaaaagctaagaaaataaat

SEQ ID NO: 1101403 - DNA, 22 bp, Artificial Sequence
  chemically synthesized
agctggcttaaattgatttatt

SEQ ID NO: 1101404 - DNA, 22 bp, Artificial Sequence
  chemically synthesized
aaagctaagaaaataaatcaat

SEQ ID NO: 1101405 - DNA, 22 bp, Artificial Sequence
  chemically synthesized
cagctggcttaaattgatttat

SEQ ID NO: 1101406 - DNA, 22 bp, Artificial Sequence
  chemically synthesized
tcagctggcttaaattgattta

SEQ ID NO: 1101407 - DNA, 22 bp, Artificial Sequence
  chemically synthesized
ttcagctggcttaaattgattt

SEQ ID NO: 1101408 - DNA, 22 bp, Artificial Sequence
  chemically synthesized
tttcagctggcttaaattgatt

SEQ ID NO: 1101409 - DNA, 22 bp, Artificial Sequence
  chemically synthesized
ttttcagctggcttaaattgat

SEQ ID NO: 1101410 - DNA, 22 bp, Artificial Sequence
  chemically synthesized
agaaaataaatcaatttaagcc

SEQ ID NO: 1101411 - DNA, 22 bp, Artificial Sequence
  chemically synthesized
atatgtggcagtaatttttttc

SEQ ID NO: 1101412 - DNA, 22 bp, Artificial Sequence
  chemically synthesized
aagccagctgaaaaaaattact

SEQ ID NO: 1101413 - DNA, 22 bp, Artificial Sequence
  chemically synthesized
agccagctgaaaaaaattactg

SEQ ID NO: 1101414 - DNA, 22 bp, Artificial Sequence
  chemically synthesized
atatctaatatgtggcagtaat

SEQ ID NO: 1101415 - DNA, 22 bp, Artificial Sequence
  chemically synthesized
catatctaatatgtggcagtaa

SEQ ID NO: 1101416 - DNA, 22 bp, Artificial Sequence
  chemically synthesized
aaaaaaattactgccacatatt

SEQ ID NO: 1101417 - DNA, 22 bp, Artificial Sequence
  chemically synthesized
tgtttcatatctaatatgtggc

SEQ ID NO: 1101418 - DNA, 22 bp, Artificial Sequence
  chemically synthesized
gctatgtttcatatctaatatg

SEQ ID NO: 1101419 - DNA, 22 bp, Artificial Sequence
  chemically synthesized
tagctatgtttcatatctaata

SEQ ID NO: 1101420 - DNA, 22 bp, Artificial Sequence
  chemically synthesized
ctagctatgtttcatatctaat

SEQ ID NO: 1101421 - DNA, 22 bp, Artificial Sequence
  chemically synthesized
tctagctatgtttcatatctaa

SEQ ID NO: 1101422 - DNA, 22 bp, Artificial Sequence
  chemically synthesized
ctgccacatattagatatgaaa

SEQ ID NO: 1101423 - DNA, 22 bp, Artificial Sequence
  chemically synthesized
ccacatattagatatgaaacat

SEQ ID NO: 1101424 - DNA, 22 bp, Artificial Sequence
  chemically synthesized
cattttctagctatgtttcata

SEQ ID NO: 1101425 - DNA, 22 bp, Artificial Sequence
  chemically synthesized
acattttctagctatgtttcat

SEQ ID NO: 1101426 - DNA, 22 bp, Artificial Sequence
  chemically synthesized
tacattttctagctatgtttca

SEQ ID NO: 1101427 - DNA, 22 bp, Artificial Sequence
  chemically synthesized
gatatgaaacatagctagaaaa

SEQ ID NO: 1101428 - DNA, 22 bp, Artificial Sequence
  chemically synthesized
gaaaatgtaaaattgggactga

SEQ ID NO: 1101429 - DNA, 22 bp, Artificial Sequence
  chemically synthesized
ggactgatggcattgcatatgg

SEQ ID NO: 1101430 - DNA, 22 bp, Artificial Sequence
  chemically synthesized
aaagacaaaaatccatatgcaa

SEQ ID NO: 1101431 - DNA, 22 bp, Artificial Sequence
  chemically synthesized
aaaagacaaaaatccatatgca

SEQ ID NO: 1101432 - DNA, 22 bp, Artificial Sequence
  chemically synthesized
taaaagacaaaaatccatatgc

SEQ ID NO: 1101433 - DNA, 22 bp, Artificial Sequence
  chemically synthesized
atggcattgcatatggattttt

SEQ ID NO: 1101434 - DNA, 22 bp, Artificial Sequence
  chemically synthesized
agattttaaaagacaaaaatcc

SEQ ID NO: 1101435 - DNA, 22 bp, Artificial Sequence
  chemically synthesized
tatctcagattttaaaagacaa

SEQ ID NO: 1101436 - DNA, 22 bp, Artificial Sequence
  chemically synthesized
catatggatttttgtcttttaa

SEQ ID NO: 1101437 - DNA, 22 bp, Artificial Sequence
  chemically synthesized
tgtatctcagattttaaaagac

SEQ ID NO: 1101438 - DNA, 22 bp, Artificial Sequence
  chemically synthesized
ttgtcttttaaaatctgagata

SEQ ID NO: 1101439 - DNA, 22 bp, Artificial Sequence
  chemically synthesized
tgtcttttaaaatctgagatac

SEQ ID NO: 1101440 - DNA, 22 bp, Artificial Sequence
  chemically synthesized
gtcttttaaaatctgagataca

SEQ ID NO: 1101441 - DNA, 22 bp, Artificial Sequence
  chemically synthesized
tatcaatatctctgtatctcag

SEQ ID NO: 1101442 - DNA, 22 bp, Artificial Sequence
  chemically synthesized
tcttttaaaatctgagatacag

SEQ ID NO: 1101443 - DNA, 22 bp, Artificial Sequence
  chemically synthesized
ttaaaatctgagatacagagat

SEQ ID NO: 1101444 - DNA, 22 bp, Artificial Sequence
  chemically synthesized
taaaatctgagatacagagata

SEQ ID NO: 1101445 - DNA, 22 bp, Artificial Sequence
  chemically synthesized
aaaatctgagatacagagatat

SEQ ID NO: 1101446 - DNA, 22 bp, Artificial Sequence
  chemically synthesized
aaatctgagatacagagatatt

SEQ ID NO: 1101447 - DNA, 22 bp, Artificial Sequence
  chemically synthesized
ggcagtcatctatatcaatatc

SEQ ID NO: 1101448 - DNA, 22 bp, Artificial Sequence
  chemically synthesized
agatacagagatattgatatag

SEQ ID NO: 1101449 - DNA, 22 bp, Artificial Sequence
  chemically synthesized
ttaggcagtcatctatatcaat

SEQ ID NO: 1101450 - DNA, 22 bp, Artificial Sequence
  chemically synthesized
caagactgttaggcagtcatct

SEQ ID NO: 1101451 - DNA, 22 bp, Artificial Sequence
  chemically synthesized
gcaagactgttaggcagtcatc

SEQ ID NO: 1101452 - DNA, 22 bp, Artificial Sequence
  chemically synthesized
tgcaagactgttaggcagtcat

SEQ ID NO: 1101453 - DNA, 22 bp, Artificial Sequence
  chemically synthesized
ttgcaagactgttaggcagtca

SEQ ID NO: 1101454 - DNA, 22 bp, Artificial Sequence
  chemically synthesized
atatagatgactgcctaacagt

SEQ ID NO: 1101455 - DNA, 22 bp, Artificial Sequence
  chemically synthesized
aacatttttgcaagactgttag

SEQ ID NO: 1101456 - DNA, 22 bp, Artificial Sequence
  chemically synthesized
cctaacagtcttgcaaaaatgt

SEQ ID NO: 1101457 - DNA, 22 bp, Artificial Sequence
  chemically synthesized
acagtcttgcaaaaatgttcaa

SEQ ID NO: 1101458 - DNA, 22 bp, Artificial Sequence
  chemically synthesized
atgccataataaccattgaaca

SEQ ID NO: 1101459 - DNA, 22 bp, Artificial Sequence
  chemically synthesized
gcaaaaatgttcaatggttatt

SEQ ID NO: 1101460 - DNA, 22 bp, Artificial Sequence
  chemically synthesized
gattcatgccataataaccatt

SEQ ID NO: 1101461 - DNA, 22 bp, Artificial Sequence
  chemically synthesized
caaaaatgttcaatggttatta

SEQ ID NO: 1101462 - DNA, 22 bp, Artificial Sequence
  chemically synthesized
cccactggattcatgccataat

SEQ ID NO: 1101463 - DNA, 22 bp, Artificial Sequence
  chemically synthesized
aatggttattatggcatgaatc

SEQ ID NO: 1101464 - DNA, 22 bp, Artificial Sequence
  chemically synthesized
ttatggcatgaatccagtgggg

SEQ ID NO: 1101465 - DNA, 22 bp, Artificial Sequence
  chemically synthesized
tggcatgaatccagtggggaat

SEQ ID NO: 1101466 - DNA, 22 bp, Artificial Sequence
  chemically synthesized
atataagtagaatacaaataat

SEQ ID NO: 1101467 - DNA, 22 bp, Artificial Sequence
  chemically synthesized
tgatataagtagaatacaaata

SEQ ID NO: 1101468 - DNA, 22 bp, Artificial Sequence
  chemically synthesized
ctgatataagtagaatacaaat

SEQ ID NO: 1101469 - DNA, 22 bp, Artificial Sequence
  chemically synthesized
tttctgatataagtagaataca

SEQ ID NO: 1101470 - DNA, 22 bp, Artificial Sequence
  chemically synthesized
gtttctgatataagtagaatac

SEQ ID NO: 1101471 - DNA, 22 bp, Artificial Sequence
  chemically synthesized
tgtttctgatataagtagaata

SEQ ID NO: 1101472 - DNA, 22 bp, Artificial Sequence
  chemically synthesized
ttgtttctgatataagtagaat

SEQ ID NO: 1101473 - DNA, 22 bp, Artificial Sequence
  chemically synthesized
cttttgtttctgatataagtag

SEQ ID NO: 1101474 - DNA, 22 bp, Artificial Sequence
  chemically synthesized
ccttttgtttctgatataagta

SEQ ID NO: 1101475 - DNA, 22 bp, Artificial Sequence
  chemically synthesized
tttgtattctacttatatcaga

SEQ ID NO: 1101476 - DNA, 22 bp, Artificial Sequence
  chemically synthesized
tttccttttgtttctgatataa

SEQ ID NO: 1101477 - DNA, 22 bp, Artificial Sequence
  chemically synthesized
atttccttttgtttctgatata

SEQ ID NO: 1101478 - DNA, 22 bp, Artificial Sequence
  chemically synthesized
gtattctacttatatcagaaac

SEQ ID NO: 1101479 - DNA, 22 bp, Artificial Sequence
  chemically synthesized
tattctacttatatcagaaaca

SEQ ID NO: 1101480 - DNA, 22 bp, Artificial Sequence
  chemically synthesized
aatttatttccttttgtttctg

SEQ ID NO: 1101481 - DNA, 22 bp, Artificial Sequence
  chemically synthesized
tacttatatcagaaacaaaagg

SEQ ID NO: 1101482 - DNA, 22 bp, Artificial Sequence
  chemically synthesized
cttatatcagaaacaaaaggaa

SEQ ID NO: 1101483 - DNA, 22 bp, Artificial Sequence
  chemically synthesized
atatcagaaacaaaaggaaata

SEQ ID NO: 1101484 - DNA, 22 bp, Artificial Sequence
  chemically synthesized
tatcagaaacaaaaggaaataa

SEQ ID NO: 1101485 - DNA, 22 bp, Artificial Sequence
  chemically synthesized
accagaaatattaaatttattt

SEQ ID NO: 1101486 - DNA, 22 bp, Artificial Sequence
  chemically synthesized
taaccagaaatattaaatttat

SEQ ID NO: 1101487 - DNA, 22 bp, Artificial Sequence
  chemically synthesized
ctaaccagaaatattaaattta

SEQ ID NO: 1101488 - DNA, 22 bp, Artificial Sequence
  chemically synthesized
tctaaccagaaatattaaattt

SEQ ID NO: 1101489 - DNA, 22 bp, Artificial Sequence
  chemically synthesized
ttctaaccagaaatattaaatt

SEQ ID NO: 1101490 - DNA, 22 bp, Artificial Sequence
  chemically synthesized
acacatttttctaaccagaaat

SEQ ID NO: 1101491 - DNA, 22 bp, Artificial Sequence
  chemically synthesized
cacacatttttctaaccagaaa

SEQ ID NO: 1101492 - DNA, 22 bp, Artificial Sequence
  chemically synthesized
tcacacatttttctaaccagaa

SEQ ID NO: 1101493 - DNA, 22 bp, Artificial Sequence
  chemically synthesized
aatatttctggttagaaaaatg

SEQ ID NO: 1101494 - DNA, 22 bp, Artificial Sequence
  chemically synthesized
atatttctggttagaaaaatgt

SEQ ID NO: 1101495 - DNA, 22 bp, Artificial Sequence
  chemically synthesized
ctggttagaaaaatgtgtgaaa

SEQ ID NO: 1101496 - DNA, 22 bp, Artificial Sequence
  chemically synthesized
tggttagaaaaatgtgtgaaaa

SEQ ID NO: 1101497 - DNA, 22 bp, Artificial Sequence
  chemically synthesized
gttagaaaaatgtgtgaaaatg

SEQ ID NO: 1101498 - DNA, 22 bp, Artificial Sequence
  chemically synthesized
gaaaaatgtgtgaaaatgatgg

SEQ ID NO: 1101499 - DNA, 22 bp, Artificial Sequence
  chemically synthesized
acaaagataataaagtatgaag

SEQ ID NO: 1101500 - DNA, 22 bp, Artificial Sequence
  chemically synthesized
catactttattatctttgttag

SEQ ID NO: 1101501 - DNA, 22 bp, Artificial Sequence
  chemically synthesized
aaaatgaaaatactaacaaaga

SEQ ID NO: 1101502 - DNA, 22 bp, Artificial Sequence
  chemically synthesized
atactttattatctttgttagt

SEQ ID NO: 1101503 - DNA, 22 bp, Artificial Sequence
  chemically synthesized
gaaaatgaaaatactaacaaag

SEQ ID NO: 1101504 - DNA, 22 bp, Artificial Sequence
  chemically synthesized
tgtttgaaaatgaaaatactaa

SEQ ID NO: 1101505 - DNA, 22 bp, Artificial Sequence
  chemically synthesized
tattatctttgttagtattttc

SEQ ID NO: 1101506 - DNA, 22 bp, Artificial Sequence
  chemically synthesized
attatctttgttagtattttca

SEQ ID NO: 1101507 - DNA, 22 bp, Artificial Sequence
  chemically synthesized
ttatctttgttagtattttcat

SEQ ID NO: 1101508 - DNA, 22 bp, Artificial Sequence
  chemically synthesized
tctttgttagtattttcatttt

SEQ ID NO: 1101509 - DNA, 22 bp, Artificial Sequence
  chemically synthesized
tgttagtattttcattttcaaa

SEQ ID NO: 1101510 - DNA, 22 bp, Artificial Sequence
  chemically synthesized
cagtatcctgtgtttgaaaatg

SEQ ID NO: 1101511 - DNA, 22 bp, Artificial Sequence
  chemically synthesized
gttagtattttcattttcaaac

SEQ ID NO: 1101512 - DNA, 22 bp, Artificial Sequence
  chemically synthesized
ttagtattttcattttcaaaca

SEQ ID NO: 1101513 - DNA, 22 bp, Artificial Sequence
  chemically synthesized
tgcagtatcctgtgtttgaaaa

SEQ ID NO: 1101514 - DNA, 22 bp, Artificial Sequence
  chemically synthesized
ctgcagtatcctgtgtttgaaa

SEQ ID NO: 1101515 - DNA, 22 bp, Artificial Sequence
  chemically synthesized
gtattttcattttcaaacacag

SEQ ID NO: 1101516 - DNA, 22 bp, Artificial Sequence
  chemically synthesized
tcattttcaaacacaggatact

SEQ ID NO: 1101517 - DNA, 22 bp, Artificial Sequence
  chemically synthesized
cattttcaaacacaggatactg

SEQ ID NO: 1101518 - DNA, 22 bp, Artificial Sequence
  chemically synthesized
attttcaaacacaggatactgc

SEQ ID NO: 1101519 - DNA, 22 bp, Artificial Sequence
  chemically synthesized
taaacaatttctgcagtatcct

SEQ ID NO: 1101520 - DNA, 22 bp, Artificial Sequence
  chemically synthesized
tcaaacacaggatactgcagaa

SEQ ID NO: 1101521 - DNA, 22 bp, Artificial Sequence
  chemically synthesized
caaacacaggatactgcagaaa

SEQ ID NO: 1101522 - DNA, 22 bp, Artificial Sequence
  chemically synthesized
cactgtaaacaatttctgcagt

SEQ ID NO: 1101523 - DNA, 22 bp, Artificial Sequence
  chemically synthesized
aaacacaggatactgcagaaat

SEQ ID NO: 1101524 - DNA, 22 bp, Artificial Sequence
  chemically synthesized
acacccattacactgtaaacaa

SEQ ID NO: 1101525 - DNA, 22 bp, Artificial Sequence
  chemically synthesized
cacacccattacactgtaaaca

SEQ ID NO: 1101526 - DNA, 22 bp, Artificial Sequence
  chemically synthesized
cagaaattgtttacagtgtaat

SEQ ID NO: 1101527 - DNA, 22 bp, Artificial Sequence
  chemically synthesized
acaaataaccttcacacccatt

SEQ ID NO: 1101528 - DNA, 22 bp, Artificial Sequence
  chemically synthesized
tttacagtgtaatgggtgtgaa

SEQ ID NO: 1101529 - DNA, 22 bp, Artificial Sequence
  chemically synthesized
acagtgtaatgggtgtgaaggt

SEQ ID NO: 1101530 - DNA, 22 bp, Artificial Sequence
  chemically synthesized
cagtgtaatgggtgtgaaggtt

SEQ ID NO: 1101531 - DNA, 22 bp, Artificial Sequence
  chemically synthesized
aaaaagcaaatccacctcacaa

SEQ ID NO: 1101532 - DNA, 22 bp, Artificial Sequence
  chemically synthesized
tttgtgaggtggatttgctttt

SEQ ID NO: 1101533 - DNA, 22 bp, Artificial Sequence
  chemically synthesized
caatacaagctaaaaaagcaaa

SEQ ID NO: 1101534 - DNA, 22 bp, Artificial Sequence
  chemically synthesized
acaatacaagctaaaaaagcaa

SEQ ID NO: 1101535 - DNA, 22 bp, Artificial Sequence
  chemically synthesized
gtgaggtggatttgctttttta

SEQ ID NO: 1101536 - DNA, 22 bp, Artificial Sequence
  chemically synthesized
tacaatacaagctaaaaaagca

SEQ ID NO: 1101537 - DNA, 22 bp, Artificial Sequence
  chemically synthesized
tgaggtggatttgcttttttag

SEQ ID NO: 1101538 - DNA, 22 bp, Artificial Sequence
  chemically synthesized
ttacaatacaagctaaaaaagc

SEQ ID NO: 1101539 - DNA, 22 bp, Artificial Sequence
  chemically synthesized
tttacaatacaagctaaaaaag

SEQ ID NO: 1101540 - DNA, 22 bp, Artificial Sequence
  chemically synthesized
ttttacaatacaagctaaaaaa

SEQ ID NO: 1101541 - DNA, 22 bp, Artificial Sequence
  chemically synthesized
aggaaatttttttacaatacaa

SEQ ID NO: 1101542 - DNA, 22 bp, Artificial Sequence
  chemically synthesized
gcttttttagcttgtattgtaa

SEQ ID NO: 1101543 - DNA, 22 bp, Artificial Sequence
  chemically synthesized
aaggaaatttttttacaataca

SEQ ID NO: 1101544 - DNA, 22 bp, Artificial Sequence
  chemically synthesized
cttttttagcttgtattgtaaa

SEQ ID NO: 1101545 - DNA, 22 bp, Artificial Sequence
  chemically synthesized
taaggaaatttttttacaatac

SEQ ID NO: 1101546 - DNA, 22 bp, Artificial Sequence
  chemically synthesized
tttaaggaaatttttttacaat

SEQ ID NO: 1101547 - DNA, 22 bp, Artificial Sequence
  chemically synthesized
ttttagcttgtattgtaaaaaa

SEQ ID NO: 1101548 - DNA, 22 bp, Artificial Sequence
  chemically synthesized
tttagcttgtattgtaaaaaaa

SEQ ID NO: 1101549 - DNA, 22 bp, Artificial Sequence
  chemically synthesized
ttagcttgtattgtaaaaaaat

SEQ ID NO: 1101550 - DNA, 22 bp, Artificial Sequence
  chemically synthesized
ctctttaaggaaatttttttac

SEQ ID NO: 1101551 - DNA, 22 bp, Artificial Sequence
  chemically synthesized
tagcttgtattgtaaaaaaatt

SEQ ID NO: 1101552 - DNA, 22 bp, Artificial Sequence
  chemically synthesized
gctctttaaggaaattttttta

SEQ ID NO: 1101553 - DNA, 22 bp, Artificial Sequence
  chemically synthesized
agcttgtattgtaaaaaaattt

SEQ ID NO: 1101554 - DNA, 22 bp, Artificial Sequence
  chemically synthesized
gcttgtattgtaaaaaaatttc

SEQ ID NO: 1101555 - DNA, 22 bp, Artificial Sequence
  chemically synthesized
gtattgtaaaaaaatttcctta

SEQ ID NO: 1101556 - DNA, 22 bp, Artificial Sequence
  chemically synthesized
tattgtaaaaaaatttccttaa

SEQ ID NO: 1101557 - DNA, 22 bp, Artificial Sequence
  chemically synthesized
taaaaaaatttccttaaagagc

SEQ ID NO: 1101558 - DNA, 22 bp, Artificial Sequence
  chemically synthesized
ccttaaagagcaagattgtttt

SEQ ID NO: 1101559 - DNA, 22 bp, Artificial Sequence
  chemically synthesized
cttaaagagcaagattgttttc

SEQ ID NO: 1101560 - DNA, 22 bp, Artificial Sequence
  chemically synthesized
tcatgcagcaggaagaaaacaa

SEQ ID NO: 1101561 - DNA, 22 bp, Artificial Sequence
  chemically synthesized
aaagagcaagattgttttcttc

SEQ ID NO: 1101562 - DNA, 22 bp, Artificial Sequence
  chemically synthesized
aagagcaagattgttttcttcc

SEQ ID NO: 1101563 - DNA, 22 bp, Artificial Sequence
  chemically synthesized
taccattgtcatgcagcaggaa

SEQ ID NO: 1101564 - DNA, 22 bp, Artificial Sequence
  chemically synthesized
attataccattgtcatgcagca

SEQ ID NO: 1101565 - DNA, 22 bp, Artificial Sequence
  chemically synthesized
ttttcttcctgctgcatgacaa

SEQ ID NO: 1101566 - DNA, 22 bp, Artificial Sequence
  chemically synthesized
tcttcctgctgcatgacaatgg

SEQ ID NO: 1101567 - DNA, 22 bp, Artificial Sequence
  chemically synthesized
cttcctgctgcatgacaatggt

SEQ ID NO: 1101568 - DNA, 22 bp, Artificial Sequence
  chemically synthesized
ttcctgctgcatgacaatggta

SEQ ID NO: 1101569 - DNA, 22 bp, Artificial Sequence
  chemically synthesized
cctgctgcatgacaatggtata

SEQ ID NO: 1101570 - DNA, 22 bp, Artificial Sequence
  chemically synthesized
ctgctgcatgacaatggtataa

SEQ ID NO: 1101571 - DNA, 22 bp, Artificial Sequence
  chemically synthesized
aaataatattcattataccatt

SEQ ID NO: 1101572 - DNA, 22 bp, Artificial Sequence
  chemically synthesized
gaaataatattcattataccat

SEQ ID NO: 1101573 - DNA, 22 bp, Artificial Sequence
  chemically synthesized
tgaaataatattcattatacca

SEQ ID NO: 1101574 - DNA, 22 bp, Artificial Sequence
  chemically synthesized
ctgcatgacaatggtataatga

SEQ ID NO: 1101575 - DNA, 22 bp, Artificial Sequence
  chemically synthesized
catgacaatggtataatgaata

SEQ ID NO: 1101576 - DNA, 22 bp, Artificial Sequence
  chemically synthesized
taatataacacagtatgcattt

SEQ ID NO: 1101577 - DNA, 22 bp, Artificial Sequence
  chemically synthesized
tactataatataacacagtatg

SEQ ID NO: 1101578 - DNA, 22 bp, Artificial Sequence
  chemically synthesized
tttcaaaatgcatactgtgtta

SEQ ID NO: 1101579 - DNA, 22 bp, Artificial Sequence
  chemically synthesized
caaaatgcatactgtgttatat

SEQ ID NO: 1101580 - DNA, 22 bp, Artificial Sequence
  chemically synthesized
aaaatgcatactgtgttatatt

SEQ ID NO: 1101581 - DNA, 22 bp, Artificial Sequence
  chemically synthesized
taatgcactgtactataatata

SEQ ID NO: 1101582 - DNA, 22 bp, Artificial Sequence
  chemically synthesized
atctataatgcactgtactata

SEQ ID NO: 1101583 - DNA, 22 bp, Artificial Sequence
  chemically synthesized
catctataatgcactgtactat

SEQ ID NO: 1101584 - DNA, 22 bp, Artificial Sequence
  chemically synthesized
ttcatctataatgcactgtact

SEQ ID NO: 1101585 - DNA, 22 bp, Artificial Sequence
  chemically synthesized
tgttatattatagtacagtgca

SEQ ID NO: 1101586 - DNA, 22 bp, Artificial Sequence
  chemically synthesized
tcttcatctataatgcactgta

SEQ ID NO: 1101587 - DNA, 22 bp, Artificial Sequence
  chemically synthesized
ttctcttcatctataatgcact

SEQ ID NO: 1101588 - DNA, 22 bp, Artificial Sequence
  chemically synthesized
tattatagtacagtgcattata

SEQ ID NO: 1101589 - DNA, 22 bp, Artificial Sequence
  chemically synthesized
tgttgttctcttcatctataat

SEQ ID NO: 1101590 - DNA, 22 bp, Artificial Sequence
  chemically synthesized
tagtacagtgcattatagatga

SEQ ID NO: 1101591 - DNA, 22 bp, Artificial Sequence
  chemically synthesized
atactgtgttgttctcttcatc

SEQ ID NO: 1101592 - DNA, 22 bp, Artificial Sequence
  chemically synthesized
ttcatactgtgttgttctcttc

SEQ ID NO: 1101593 - DNA, 22 bp, Artificial Sequence
  chemically synthesized
ctattcatactgtgttgttctc

SEQ ID NO: 1101594 - DNA, 22 bp, Artificial Sequence
  chemically synthesized
tagatgaagagaacaacacagt

SEQ ID NO: 1101595 - DNA, 22 bp, Artificial Sequence
  chemically synthesized
tgataaattactattcatactg

SEQ ID NO: 1101596 - DNA, 22 bp, Artificial Sequence
  chemically synthesized
atgataaattactattcatact

SEQ ID NO: 1101597 - DNA, 22 bp, Artificial Sequence
  chemically synthesized
ttatgataaattactattcata

SEQ ID NO: 1101598 - DNA, 22 bp, Artificial Sequence
  chemically synthesized
cttatgataaattactattcat

SEQ ID NO: 1101599 - DNA, 22 bp, Artificial Sequence
  chemically synthesized
tttcttatgataaattactatt

SEQ ID NO: 1101600 - DNA, 22 bp, Artificial Sequence
  chemically synthesized
ttatttcttatgataaattact

SEQ ID NO: 1101601 - DNA, 22 bp, Artificial Sequence
  chemically synthesized
gttatttcttatgataaattac

SEQ ID NO: 1101602 - DNA, 22 bp, Artificial Sequence
  chemically synthesized
cttgttatttcttatgataaat

SEQ ID NO: 1101603 - DNA, 22 bp, Artificial Sequence
  chemically synthesized
agctacttgttatttcttatga

SEQ ID NO: 1101604 - DNA, 22 bp, Artificial Sequence
  chemically synthesized
gagctacttgttatttcttatg

SEQ ID NO: 1101605 - DNA, 22 bp, Artificial Sequence
  chemically synthesized
tgagctacttgttatttcttat

SEQ ID NO: 1101606 - DNA, 22 bp, Artificial Sequence
  chemically synthesized
atcataagaaataacaagtagc

SEQ ID NO: 1101607 - DNA, 22 bp, Artificial Sequence
  chemically synthesized
tcataagaaataacaagtagct

SEQ ID NO: 1101608 - DNA, 22 bp, Artificial Sequence
  chemically synthesized
aaggtaaagaatcctttgagct

SEQ ID NO: 1101609 - DNA, 22 bp, Artificial Sequence
  chemically synthesized
aaaggtaaagaatcctttgagc

SEQ ID NO: 1101610 - DNA, 22 bp, Artificial Sequence
  chemically synthesized
aaaggattctttacctttaaat

SEQ ID NO: 1101611 - DNA, 22 bp, Artificial Sequence
  chemically synthesized
taaaatgcagtataatttaaag

SEQ ID NO: 1101612 - DNA, 22 bp, Artificial Sequence
  chemically synthesized
ctataaaatgcagtataattta

SEQ ID NO: 1101613 - DNA, 22 bp, Artificial Sequence
  chemically synthesized
actataaaatgcagtataattt

SEQ ID NO: 1101614 - DNA, 22 bp, Artificial Sequence
  chemically synthesized
tactataaaatgcagtataatt

SEQ ID NO: 1101615 - DNA, 22 bp, Artificial Sequence
  chemically synthesized
tttacctttaaattatactgca

SEQ ID NO: 1101616 - DNA, 22 bp, Artificial Sequence
  chemically synthesized
ttttactataaaatgcagtata

SEQ ID NO: 1101617 - DNA, 22 bp, Artificial Sequence
  chemically synthesized
tacctttaaattatactgcatt

SEQ ID NO: 1101618 - DNA, 22 bp, Artificial Sequence
  chemically synthesized
acctttaaattatactgcattt

SEQ ID NO: 1101619 - DNA, 22 bp, Artificial Sequence
  chemically synthesized
cctttaaattatactgcatttt

SEQ ID NO: 1101620 - DNA, 22 bp, Artificial Sequence
  chemically synthesized
taaattatactgcattttatag

SEQ ID NO: 1101621 - DNA, 22 bp, Artificial Sequence
  chemically synthesized
aaattatactgcattttatagt

SEQ ID NO: 1101622 - DNA, 22 bp, Artificial Sequence
  chemically synthesized
aattatactgcattttatagta

SEQ ID NO: 1101623 - DNA, 22 bp, Artificial Sequence
  chemically synthesized
ataacattattttactataaaa

SEQ ID NO: 1101624 - DNA, 22 bp, Artificial Sequence
  chemically synthesized
gataacattattttactataaa

SEQ ID NO: 1101625 - DNA, 22 bp, Artificial Sequence
  chemically synthesized
tactgcattttatagtaaaata

SEQ ID NO: 1101626 - DNA, 22 bp, Artificial Sequence
  chemically synthesized
atttgataacattattttacta

SEQ ID NO: 1101627 - DNA, 22 bp, Artificial Sequence
  chemically synthesized
cattttatagtaaaataatgtt

SEQ ID NO: 1101628 - DNA, 22 bp, Artificial Sequence
  chemically synthesized
aacctcatttgataacattatt

SEQ ID NO: 1101629 - DNA, 22 bp, Artificial Sequence
  chemically synthesized
tatagtaaaataatgttatcaa

SEQ ID NO: 1101630 - DNA, 22 bp, Artificial Sequence
  chemically synthesized
atagtaaaataatgttatcaaa

SEQ ID NO: 1101631 - DNA, 22 bp, Artificial Sequence
  chemically synthesized
tactcaacctcatttgataaca

SEQ ID NO: 1101632 - DNA, 22 bp, Artificial Sequence
  chemically synthesized
tagtaaaataatgttatcaaat

SEQ ID NO: 1101633 - DNA, 22 bp, Artificial Sequence
  chemically synthesized
gtactcaacctcatttgataac

SEQ ID NO: 1101634 - DNA, 22 bp, Artificial Sequence
  chemically synthesized
ccttgtactcaacctcatttga

SEQ ID NO: 1101635 - DNA, 22 bp, Artificial Sequence
  chemically synthesized
acaaaacattgccttgtactca

SEQ ID NO: 1101636 - DNA, 22 bp, Artificial Sequence
  chemically synthesized
tcaaatgaggttgagtacaagg

SEQ ID NO: 1101637 - DNA, 22 bp, Artificial Sequence
  chemically synthesized
agtacaaggcaatgttttgtca

SEQ ID NO: 1101638 - DNA, 22 bp, Artificial Sequence
  chemically synthesized
agtaaatgaggaactgacaaaa

SEQ ID NO: 1101639 - DNA, 22 bp, Artificial Sequence
  chemically synthesized
ggttgagtaaatgaggaactga

SEQ ID NO: 1101640 - DNA, 22 bp, Artificial Sequence
  chemically synthesized
tgtcagttcctcatttactcaa

SEQ ID NO: 1101641 - DNA, 22 bp, Artificial Sequence
  chemically synthesized
agaaaccctgggttgagtaaat

SEQ ID NO: 1101642 - DNA, 22 bp, Artificial Sequence
  chemically synthesized
gtcagttcctcatttactcaac

SEQ ID NO: 1101643 - DNA, 22 bp, Artificial Sequence
  chemically synthesized
tcagttcctcatttactcaacc

SEQ ID NO: 1101644 - DNA, 22 bp, Artificial Sequence
  chemically synthesized
ctcatttactcaacccagggtt

SEQ ID NO: 1101645 - DNA, 22 bp, Artificial Sequence
  chemically synthesized
atttactcaacccagggtttct

SEQ ID NO: 1101646 - DNA, 22 bp, Artificial Sequence
  chemically synthesized
gtgccaatgttgagaaaccctg

SEQ ID NO: 1101647 - DNA, 22 bp, Artificial Sequence
  chemically synthesized
actcaacccagggtttctcaac

SEQ ID NO: 1101648 - DNA, 22 bp, Artificial Sequence
  chemically synthesized
ctcaacccagggtttctcaaca

SEQ ID NO: 1101649 - DNA, 22 bp, Artificial Sequence
  chemically synthesized
aacccagggtttctcaacattg

SEQ ID NO: 1101650 - DNA, 22 bp, Artificial Sequence
  chemically synthesized
aaatgtcactagtgccaatgtt

SEQ ID NO: 1101651 - DNA, 22 bp, Artificial Sequence
  chemically synthesized
ctcaacattggcactagtgaca

SEQ ID NO: 1101652 - DNA, 22 bp, Artificial Sequence
  chemically synthesized
cacaatctaaaatgtcactagt

SEQ ID NO: 1101653 - DNA, 22 bp, Artificial Sequence
  chemically synthesized
tcaacattggcactagtgacat

SEQ ID NO: 1101654 - DNA, 22 bp, Artificial Sequence
  chemically synthesized
aacattggcactagtgacattt

SEQ ID NO: 1101655 - DNA, 22 bp, Artificial Sequence
  chemically synthesized
gcactagtgacattttagattg

SEQ ID NO: 1101656 - DNA, 22 bp, Artificial Sequence
  chemically synthesized
cagaacaaggaactgcacaatc

SEQ ID NO: 1101657 - DNA, 22 bp, Artificial Sequence
  chemically synthesized
gtgacattttagattgtgcagt

SEQ ID NO: 1101658 - DNA, 22 bp, Artificial Sequence
  chemically synthesized
ctccagaacaaggaactgcaca

SEQ ID NO: 1101659 - DNA, 22 bp, Artificial Sequence
  chemically synthesized
tagattgtgcagttccttgttc

SEQ ID NO: 1101660 - DNA, 22 bp, Artificial Sequence
  chemically synthesized
agattgtgcagttccttgttct

SEQ ID NO: 1101661 - DNA, 22 bp, Artificial Sequence
  chemically synthesized
gattgtgcagttccttgttctg

SEQ ID NO: 1101662 - DNA, 22 bp, Artificial Sequence
  chemically synthesized
tgcagttccttgttctggagga

SEQ ID NO: 1101663 - DNA, 22 bp, Artificial Sequence
  chemically synthesized
cttgttctggaggaatgttcta

SEQ ID NO: 1101664 - DNA, 22 bp, Artificial Sequence
  chemically synthesized
gttctggaggaatgttctatgg

SEQ ID NO: 1101665 - DNA, 22 bp, Artificial Sequence
  chemically synthesized
ttctggaggaatgttctatgga

SEQ ID NO: 1101666 - DNA, 22 bp, Artificial Sequence
  chemically synthesized
aatatcgtacagtccatagaac

SEQ ID NO: 1101667 - DNA, 22 bp, Artificial Sequence
  chemically synthesized
tggaggaatgttctatggactg

SEQ ID NO: 1101668 - DNA, 22 bp, Artificial Sequence
  chemically synthesized
ctaaatatcgtacagtccatag

SEQ ID NO: 1101669 - DNA, 22 bp, Artificial Sequence
  chemically synthesized
gaggaatgttctatggactgta

SEQ ID NO: 1101670 - DNA, 22 bp, Artificial Sequence
  chemically synthesized
tatggactgtacgatatttagc

SEQ ID NO: 1101671 - DNA, 22 bp, Artificial Sequence
  chemically synthesized
tggactgtacgatatttagcag

SEQ ID NO: 1101672 - DNA, 22 bp, Artificial Sequence
  chemically synthesized
tacgatatttagcagcatctct

SEQ ID NO: 1101673 - DNA, 22 bp, Artificial Sequence
  chemically synthesized
ataggtagaggagagagatgct

SEQ ID NO: 1101674 - DNA, 22 bp, Artificial Sequence
  chemically synthesized
gtgtctaataggtagaggagag

SEQ ID NO: 1101675 - DNA, 22 bp, Artificial Sequence
  chemically synthesized
agcagcatctctctcctctacc

SEQ ID NO: 1101676 - DNA, 22 bp, Artificial Sequence
  chemically synthesized
gcagcatctctctcctctacct

SEQ ID NO: 1101677 - DNA, 22 bp, Artificial Sequence
  chemically synthesized
ctggtgtctaataggtagagga

SEQ ID NO: 1101678 - DNA, 22 bp, Artificial Sequence
  chemically synthesized
gatgctactggtgtctaatagg

SEQ ID NO: 1101679 - DNA, 22 bp, Artificial Sequence
  chemically synthesized
tctcctctacctattagacacc

SEQ ID NO: 1101680 - DNA, 22 bp, Artificial Sequence
  chemically synthesized
tcctctacctattagacaccag

SEQ ID NO: 1101681 - DNA, 22 bp, Artificial Sequence
  chemically synthesized
ctctacctattagacaccagta

SEQ ID NO: 1101682 - DNA, 22 bp, Artificial Sequence
  chemically synthesized
tacctattagacaccagtagca

SEQ ID NO: 1101683 - DNA, 22 bp, Artificial Sequence
  chemically synthesized
cctattagacaccagtagcatc

SEQ ID NO: 1101684 - DNA, 22 bp, Artificial Sequence
  chemically synthesized
ggggtggtggttagatgctact

SEQ ID NO: 1101685 - DNA, 22 bp, Artificial Sequence
  chemically synthesized
ttagacaccagtagcatctaac

SEQ ID NO: 1101686 - DNA, 22 bp, Artificial Sequence
  chemically synthesized
ggttgggggtggtggttagatg

SEQ ID NO: 1101687 - DNA, 22 bp, Artificial Sequence
  chemically synthesized
gacaccagtagcatctaaccac

SEQ ID NO: 1101688 - DNA, 22 bp, Artificial Sequence
  chemically synthesized
tcacagctgggttgggggtggt

SEQ ID NO: 1101689 - DNA, 22 bp, Artificial Sequence
  chemically synthesized
attgtcacagctgggttggggg

SEQ ID NO: 1101690 - DNA, 22 bp, Artificial Sequence
  chemically synthesized
gattgtcacagctgggttgggg

SEQ ID NO: 1101691 - DNA, 22 bp, Artificial Sequence
  chemically synthesized
tgattgtcacagctgggttggg

SEQ ID NO: 1101692 - DNA, 22 bp, Artificial Sequence
  chemically synthesized
ttgattgtcacagctgggttgg

SEQ ID NO: 1101693 - DNA, 22 bp, Artificial Sequence
  chemically synthesized
accaccacccccaacccagctg

SEQ ID NO: 1101694 - DNA, 22 bp, Artificial Sequence
  chemically synthesized
gacgtttttgattgtcacagct

SEQ ID NO: 1101695 - DNA, 22 bp, Artificial Sequence
  chemically synthesized
tagacgtttttgattgtcacag

SEQ ID NO: 1101696 - DNA, 22 bp, Artificial Sequence
  chemically synthesized
ctagacgtttttgattgtcaca

SEQ ID NO: 1101697 - DNA, 22 bp, Artificial Sequence
  chemically synthesized
atgtttctagacgtttttgatt

SEQ ID NO: 1101698 - DNA, 22 bp, Artificial Sequence
  chemically synthesized
aatgtttctagacgtttttgat

SEQ ID NO: 1101699 - DNA, 22 bp, Artificial Sequence
  chemically synthesized
taatgtttctagacgtttttga

SEQ ID NO: 1101700 - DNA, 22 bp, Artificial Sequence
  chemically synthesized
ttaatgtttctagacgtttttg

SEQ ID NO: 1101701 - DNA, 22 bp, Artificial Sequence
  chemically synthesized
tttaatgtttctagacgttttt

SEQ ID NO: 1101702 - DNA, 22 bp, Artificial Sequence
  chemically synthesized
ttttaatgtttctagacgtttt

SEQ ID NO: 1101703 - DNA, 22 bp, Artificial Sequence
  chemically synthesized
tttttaatgtttctagacgttt

SEQ ID NO: 1101704 - DNA, 22 bp, Artificial Sequence
  chemically synthesized
tgacaatcaaaaacgtctagaa

SEQ ID NO: 1101705 - DNA, 22 bp, Artificial Sequence
  chemically synthesized
cccagtggattttttttaatgt

SEQ ID NO: 1101706 - DNA, 22 bp, Artificial Sequence
  chemically synthesized
tccccagtggattttttttaat

SEQ ID NO: 1101707 - DNA, 22 bp, Artificial Sequence
  chemically synthesized
ctctccccagtggatttttttt

SEQ ID NO: 1101708 - DNA, 22 bp, Artificial Sequence
  chemically synthesized
tcctctccccagtggatttttt

SEQ ID NO: 1101709 - DNA, 22 bp, Artificial Sequence
  chemically synthesized
gaaacattaaaaaaaatccact

SEQ ID NO: 1101710 - DNA, 22 bp, Artificial Sequence
  chemically synthesized
ctctcctctccccagtggattt

SEQ ID NO: 1101711 - DNA, 22 bp, Artificial Sequence
  chemically synthesized
gctctcctctccccagtggatt

SEQ ID NO: 1101712 - DNA, 22 bp, Artificial Sequence
  chemically synthesized
tgctctcctctccccagtggat

SEQ ID NO: 1101713 - DNA, 22 bp, Artificial Sequence
  chemically synthesized
aaaaaaatccactggggagagg

SEQ ID NO: 1101714 - DNA, 22 bp, Artificial Sequence
  chemically synthesized
gggtggattttgctctcctctc

SEQ ID NO: 1101715 - DNA, 22 bp, Artificial Sequence
  chemically synthesized
cagctggggtggattttgctct

SEQ ID NO: 1101716 - DNA, 22 bp, Artificial Sequence
  chemically synthesized
acagctggggtggattttgctc

SEQ ID NO: 1101717 - DNA, 22 bp, Artificial Sequence
  chemically synthesized
tacagctggggtggattttgct

SEQ ID NO: 1101718 - DNA, 22 bp, Artificial Sequence
  chemically synthesized
gggagaggagagcaaaatccac

SEQ ID NO: 1101719 - DNA, 22 bp, Artificial Sequence
  chemically synthesized
gatcagtgttttacagctgggg

SEQ ID NO: 1101720 - DNA, 22 bp, Artificial Sequence
  chemically synthesized
gttagatcagtgttttacagct

SEQ ID NO: 1101721 - DNA, 22 bp, Artificial Sequence
  chemically synthesized
ggttagatcagtgttttacagc

SEQ ID NO: 1101722 - DNA, 22 bp, Artificial Sequence
  chemically synthesized
tttggttagatcagtgttttac

SEQ ID NO: 1101723 - DNA, 22 bp, Artificial Sequence
  chemically synthesized
tatgaatattatttggttagat

SEQ ID NO: 1101724 - DNA, 22 bp, Artificial Sequence
  chemically synthesized
gtatgaatattatttggttaga

SEQ ID NO: 1101725 - DNA, 22 bp, Artificial Sequence
  chemically synthesized
taaaacactgatctaaccaaat

SEQ ID NO: 1101726 - DNA, 22 bp, Artificial Sequence
  chemically synthesized
tgtatgaatattatttggttag

SEQ ID NO: 1101727 - DNA, 22 bp, Artificial Sequence
  chemically synthesized
atctaaccaaataatattcata

SEQ ID NO: 1101728 - DNA, 22 bp, Artificial Sequence
  chemically synthesized
atatgaataattttgtatgaat

SEQ ID NO: 1101729 - DNA, 22 bp, Artificial Sequence
  chemically synthesized
aatatgaataattttgtatgaa

SEQ ID NO: 1101730 - DNA, 22 bp, Artificial Sequence
  chemically synthesized
accaaataatattcatacaaaa

SEQ ID NO: 1101731 - DNA, 22 bp, Artificial Sequence
  chemically synthesized
taatatgaataattttgtatga

SEQ ID NO: 1101732 - DNA, 22 bp, Artificial Sequence
  chemically synthesized
tatgatgcctttaatatgaata

SEQ ID NO: 1101733 - DNA, 22 bp, Artificial Sequence
  chemically synthesized
atatgatgcctttaatatgaat

SEQ ID NO: 1101734 - DNA, 22 bp, Artificial Sequence
  chemically synthesized
tatatgatgcctttaatatgaa

SEQ ID NO: 1101735 - DNA, 22 bp, Artificial Sequence
  chemically synthesized
atacaaaattattcatattaaa

SEQ ID NO: 1101736 - DNA, 22 bp, Artificial Sequence
  chemically synthesized
ttatatgatgcctttaatatga

SEQ ID NO: 1101737 - DNA, 22 bp, Artificial Sequence
  chemically synthesized
ttcatattaaaggcatcatata

SEQ ID NO: 1101738 - DNA, 22 bp, Artificial Sequence
  chemically synthesized
atattaaaggcatcatataaaa

SEQ ID NO: 1101739 - DNA, 22 bp, Artificial Sequence
  chemically synthesized
aaggcatcatataaaaatctta

SEQ ID NO: 1101740 - DNA, 22 bp, Artificial Sequence
  chemically synthesized
aaacagtgcagagtaagatttt

SEQ ID NO: 1101741 - DNA, 22 bp, Artificial Sequence
  chemically synthesized
aaaaagcagctgaaacagtgca

SEQ ID NO: 1101742 - DNA, 22 bp, Artificial Sequence
  chemically synthesized
taaaaaagcagctgaaacagtg

SEQ ID NO: 1101743 - DNA, 22 bp, Artificial Sequence
  chemically synthesized
actctgcactgtttcagctgct

SEQ ID NO: 1101744 - DNA, 22 bp, Artificial Sequence
  chemically synthesized
ctctgcactgtttcagctgctt

SEQ ID NO: 1101745 - DNA, 22 bp, Artificial Sequence
  chemically synthesized
agaaattctaaaaaagcagctg

SEQ ID NO: 1101746 - DNA, 22 bp, Artificial Sequence
  chemically synthesized
tgcactgtttcagctgcttttt

SEQ ID NO: 1101747 - DNA, 22 bp, Artificial Sequence
  chemically synthesized
cactgtttcagctgctttttta

SEQ ID NO: 1101748 - DNA, 22 bp, Artificial Sequence
  chemically synthesized
gggattcagaaattctaaaaaa

SEQ ID NO: 1101749 - DNA, 22 bp, Artificial Sequence
  chemically synthesized
ggggattcagaaattctaaaaa

SEQ ID NO: 1101750 - DNA, 22 bp, Artificial Sequence
  chemically synthesized
tttcagctgcttttttagaatt

SEQ ID NO: 1101751 - DNA, 22 bp, Artificial Sequence
  chemically synthesized
cagctgcttttttagaatttct

SEQ ID NO: 1101752 - DNA, 22 bp, Artificial Sequence
  chemically synthesized
agctgcttttttagaatttctg

SEQ ID NO: 1101753 - DNA, 22 bp, Artificial Sequence
  chemically synthesized
cccttggggattcagaaattct

SEQ ID NO: 1101754 - DNA, 22 bp, Artificial Sequence
  chemically synthesized
cttttttagaatttctgaatcc

SEQ ID NO: 1101755 - DNA, 22 bp, Artificial Sequence
  chemically synthesized
ttttagaatttctgaatcccca

SEQ ID NO: 1101756 - DNA, 22 bp, Artificial Sequence
  chemically synthesized
tttagaatttctgaatccccaa

SEQ ID NO: 1101757 - DNA, 22 bp, Artificial Sequence
  chemically synthesized
ttagaatttctgaatccccaag

SEQ ID NO: 1101758 - DNA, 22 bp, Artificial Sequence
  chemically synthesized
tagaatttctgaatccccaagg

SEQ ID NO: 1101759 - DNA, 22 bp, Artificial Sequence
  chemically synthesized
agaatttctgaatccccaaggg

SEQ ID NO: 1101760 - DNA, 22 bp, Artificial Sequence
  chemically synthesized
gaatttctgaatccccaagggc

SEQ ID NO: 1101761 - DNA, 22 bp, Artificial Sequence
  chemically synthesized
aaggaggaatggcctgcccttg

SEQ ID NO: 1101762 - DNA, 22 bp, Artificial Sequence
  chemically synthesized
tgaaggaggaatggcctgccct

SEQ ID NO: 1101763 - DNA, 22 bp, Artificial Sequence
  chemically synthesized
ctgaatccccaagggcaggcca

SEQ ID NO: 1101764 - DNA, 22 bp, Artificial Sequence
  chemically synthesized
ctgaaggaggaatggcctgccc

SEQ ID NO: 1101765 - DNA, 22 bp, Artificial Sequence
  chemically synthesized
tgaatccccaagggcaggccat

SEQ ID NO: 1101766 - DNA, 22 bp, Artificial Sequence
  chemically synthesized
tctgaaggaggaatggcctgcc

SEQ ID NO: 1101767 - DNA, 22 bp, Artificial Sequence
  chemically synthesized
ttctgaaggaggaatggcctgc

SEQ ID NO: 1101768 - DNA, 22 bp, Artificial Sequence
  chemically synthesized
aatccccaagggcaggccattc

SEQ ID NO: 1101769 - DNA, 22 bp, Artificial Sequence
  chemically synthesized
atgtttttctgaaggaggaatg

SEQ ID NO: 1101770 - DNA, 22 bp, Artificial Sequence
  chemically synthesized
aagttgatgtttttctgaagga

SEQ ID NO: 1101771 - DNA, 22 bp, Artificial Sequence
  chemically synthesized
ctccttcagaaaaacatcaact

SEQ ID NO: 1101772 - DNA, 22 bp, Artificial Sequence
  chemically synthesized
cttcagaaaaacatcaacttca

SEQ ID NO: 1101773 - DNA, 22 bp, Artificial Sequence
  chemically synthesized
aagaaatggatggctgaagttg

SEQ ID NO: 1101774 - DNA, 22 bp, Artificial Sequence
  chemically synthesized
cagaaaaacatcaacttcagcc

SEQ ID NO: 1101775 - DNA, 22 bp, Artificial Sequence
  chemically synthesized
agaaaaacatcaacttcagcca

SEQ ID NO: 1101776 - DNA, 22 bp, Artificial Sequence
  chemically synthesized
cagccatccatttcttcagggt

SEQ ID NO: 1101777 - DNA, 22 bp, Artificial Sequence
  chemically synthesized
agccatccatttcttcagggtt

SEQ ID NO: 1101778 - DNA, 22 bp, Artificial Sequence
  chemically synthesized
agaatcacatacaaaccctgaa

SEQ ID NO: 1101779 - DNA, 22 bp, Artificial Sequence
  chemically synthesized
cagaatcacatacaaaccctga

SEQ ID NO: 1101780 - DNA, 22 bp, Artificial Sequence
  chemically synthesized
gtttcagaatcacatacaaacc

SEQ ID NO: 1101781 - DNA, 22 bp, Artificial Sequence
  chemically synthesized
cttcagggtttgtatgtgattc

SEQ ID NO: 1101782 - DNA, 22 bp, Artificial Sequence
  chemically synthesized
ttcagggtttgtatgtgattct

SEQ ID NO: 1101783 - DNA, 22 bp, Artificial Sequence
  chemically synthesized
cagggtttgtatgtgattctga

SEQ ID NO: 1101784 - DNA, 22 bp, Artificial Sequence
  chemically synthesized
agggtttgtatgtgattctgaa

SEQ ID NO: 1101785 - DNA, 22 bp, Artificial Sequence
  chemically synthesized
taacgggtctcgtttcagaatc

SEQ ID NO: 1101786 - DNA, 22 bp, Artificial Sequence
  chemically synthesized
ataacgggtctcgtttcagaat

SEQ ID NO: 1101787 - DNA, 22 bp, Artificial Sequence
  chemically synthesized
gtatgtgattctgaaacgagac

SEQ ID NO: 1101788 - DNA, 22 bp, Artificial Sequence
  chemically synthesized
tatgtgattctgaaacgagacc

SEQ ID NO: 1101789 - DNA, 22 bp, Artificial Sequence
  chemically synthesized
tgaaacgagacccgttataagg

SEQ ID NO: 1101790 - DNA, 22 bp, Artificial Sequence
  chemically synthesized
aaacgagacccgttataaggca

SEQ ID NO: 1101791 - DNA, 22 bp, Artificial Sequence
  chemically synthesized
aaagtaatcagcacaccagtaa

SEQ ID NO: 1101792 - DNA, 22 bp, Artificial Sequence
  chemically synthesized
taaggcattactggtgtgctga

SEQ ID NO: 1101793 - DNA, 22 bp, Artificial Sequence
  chemically synthesized
tgttaaaagtaatcagcacacc

SEQ ID NO: 1101794 - DNA, 22 bp, Artificial Sequence
  chemically synthesized
ctggtgtgctgattacttttaa

SEQ ID NO: 1101795 - DNA, 22 bp, Artificial Sequence
  chemically synthesized
gtgtgctgattacttttaacac

SEQ ID NO: 1101796 - DNA, 22 bp, Artificial Sequence
  chemically synthesized
attacttttaacacaattcatc

SEQ ID NO: 1101797 - DNA, 22 bp, Artificial Sequence
  chemically synthesized
gacataacacaatgatgaattg

SEQ ID NO: 1101798 - DNA, 22 bp, Artificial Sequence
  chemically synthesized
agacataacacaatgatgaatt

SEQ ID NO: 1101799 - DNA, 22 bp, Artificial Sequence
  chemically synthesized
cttttaacacaattcatcattg

SEQ ID NO: 1101800 - DNA, 22 bp, Artificial Sequence
  chemically synthesized
ttaacacaattcatcattgtgt

SEQ ID NO: 1101801 - DNA, 22 bp, Artificial Sequence
  chemically synthesized
tgtttagacataacacaatgat

SEQ ID NO: 1101802 - DNA, 22 bp, Artificial Sequence
  chemically synthesized
taacacaattcatcattgtgtt

SEQ ID NO: 1101803 - DNA, 22 bp, Artificial Sequence
  chemically synthesized
aacacaattcatcattgtgtta

SEQ ID NO: 1101804 - DNA, 22 bp, Artificial Sequence
  chemically synthesized
acacaattcatcattgtgttat

SEQ ID NO: 1101805 - DNA, 22 bp, Artificial Sequence
  chemically synthesized
ggcctgtgtttagacataacac

SEQ ID NO: 1101806 - DNA, 22 bp, Artificial Sequence
  chemically synthesized
gggcctgtgtttagacataaca

SEQ ID NO: 1101807 - DNA, 22 bp, Artificial Sequence
  chemically synthesized
tgggcctgtgtttagacataac

SEQ ID NO: 1101808 - DNA, 22 bp, Artificial Sequence
  chemically synthesized
ttgggcctgtgtttagacataa

SEQ ID NO: 1101809 - DNA, 22 bp, Artificial Sequence
  chemically synthesized
atcattgtgttatgtctaaaca

SEQ ID NO: 1101810 - DNA, 22 bp, Artificial Sequence
  chemically synthesized
tttttgggcctgtgtttagaca

SEQ ID NO: 1101811 - DNA, 22 bp, Artificial Sequence
  chemically synthesized
tgttatgtctaaacacaggccc

SEQ ID NO: 1101812 - DNA, 22 bp, Artificial Sequence
  chemically synthesized
tgtctaaacacaggcccaaaaa

SEQ ID NO: 1101813 - DNA, 22 bp, Artificial Sequence
  chemically synthesized
aacatgggaattgtttttgggc

SEQ ID NO: 1101814 - DNA, 22 bp, Artificial Sequence
  chemically synthesized
aaacatgggaattgtttttggg

SEQ ID NO: 1101815 - DNA, 22 bp, Artificial Sequence
  chemically synthesized
taaacatgggaattgtttttgg

SEQ ID NO: 1101816 - DNA, 22 bp, Artificial Sequence
  chemically synthesized
aacacaggcccaaaaacaattc

SEQ ID NO: 1101817 - DNA, 22 bp, Artificial Sequence
  chemically synthesized
gagacatcctttaaacatggga

SEQ ID NO: 1101818 - DNA, 22 bp, Artificial Sequence
  chemically synthesized
agagacatcctttaaacatggg

SEQ ID NO: 1101819 - DNA, 22 bp, Artificial Sequence
  chemically synthesized
cttagagacatcctttaaacat

SEQ ID NO: 1101820 - DNA, 22 bp, Artificial Sequence
  chemically synthesized
aagaactacttagagacatcct

SEQ ID NO: 1101821 - DNA, 22 bp, Artificial Sequence
  chemically synthesized
ccatgtttaaaggatgtctcta

SEQ ID NO: 1101822 - DNA, 22 bp, Artificial Sequence
  chemically synthesized
cctcaagaactacttagagaca

SEQ ID NO: 1101823 - DNA, 22 bp, Artificial Sequence
  chemically synthesized
gcctcaagaactacttagagac

SEQ ID NO: 1101824 - DNA, 22 bp, Artificial Sequence
  chemically synthesized
tgcctcaagaactacttagaga

SEQ ID NO: 1101825 - DNA, 22 bp, Artificial Sequence
  chemically synthesized
tttgcctcaagaactacttaga

SEQ ID NO: 1101826 - DNA, 22 bp, Artificial Sequence
  chemically synthesized
aaaggatgtctctaagtagttc

SEQ ID NO: 1101827 - DNA, 22 bp, Artificial Sequence
  chemically synthesized
aaggatgtctctaagtagttct

SEQ ID NO: 1101828 - DNA, 22 bp, Artificial Sequence
  chemically synthesized
gtaaaaatattctttgcctcaa

SEQ ID NO: 1101829 - DNA, 22 bp, Artificial Sequence
  chemically synthesized
agtaaaaatattctttgcctca

SEQ ID NO: 1101830 - DNA, 22 bp, Artificial Sequence
  chemically synthesized
taagtagttcttgaggcaaaga

SEQ ID NO: 1101831 - DNA, 22 bp, Artificial Sequence
  chemically synthesized
agtagttcttgaggcaaagaat

SEQ ID NO: 1101832 - DNA, 22 bp, Artificial Sequence
  chemically synthesized
ttgaggcaaagaatatttttac

SEQ ID NO: 1101833 - DNA, 22 bp, Artificial Sequence
  chemically synthesized
gaggcaaagaatatttttacta

SEQ ID NO: 1101834 - DNA, 22 bp, Artificial Sequence
  chemically synthesized
aggcaaagaatatttttactaa

SEQ ID NO: 1101835 - DNA, 22 bp, Artificial Sequence
  chemically synthesized
atacagtagaccataaaaatgc

SEQ ID NO: 1101836 - DNA, 22 bp, Artificial Sequence
  chemically synthesized
ttactaagactgcatttttatg

SEQ ID NO: 1101837 - DNA, 22 bp, Artificial Sequence
  chemically synthesized
tactaagactgcatttttatgg

SEQ ID NO: 1101838 - DNA, 22 bp, Artificial Sequence
  chemically synthesized
actaagactgcatttttatggt

SEQ ID NO: 1101839 - DNA, 22 bp, Artificial Sequence
  chemically synthesized
ctaagactgcatttttatggtc

SEQ ID NO: 1101840 - DNA, 22 bp, Artificial Sequence
  chemically synthesized
agactgcatttttatggtctac

SEQ ID NO: 1101841 - DNA, 22 bp, Artificial Sequence
  chemically synthesized
catttttatggtctactgtatg

SEQ ID NO: 1101842 - DNA, 22 bp, Artificial Sequence
  chemically synthesized
acacaccagtgctcatacagta

SEQ ID NO: 1101843 - DNA, 22 bp, Artificial Sequence
  chemically synthesized
cacacaccagtgctcatacagt

SEQ ID NO: 1101844 - DNA, 22 bp, Artificial Sequence
  chemically synthesized
ttatggtctactgtatgagcac

SEQ ID NO: 1101845 - DNA, 22 bp, Artificial Sequence
  chemically synthesized
tatggtctactgtatgagcact

SEQ ID NO: 1101846 - DNA, 22 bp, Artificial Sequence
  chemically synthesized
atggtctactgtatgagcactg

SEQ ID NO: 1101847 - DNA, 22 bp, Artificial Sequence
  chemically synthesized
tggtctactgtatgagcactgg

SEQ ID NO: 1101848 - DNA, 22 bp, Artificial Sequence
  chemically synthesized
ctgtatgagcactggtgtgtga

SEQ ID NO: 1101849 - DNA, 22 bp, Artificial Sequence
  chemically synthesized
acaatagcagacttcacacacc

SEQ ID NO: 1101850 - DNA, 22 bp, Artificial Sequence
  chemically synthesized
aacaatagcagacttcacacac

SEQ ID NO: 1101851 - DNA, 22 bp, Artificial Sequence
  chemically synthesized
tatgagcactggtgtgtgaagt

SEQ ID NO: 1101852 - DNA, 22 bp, Artificial Sequence
  chemically synthesized
taacaatagcagacttcacaca

SEQ ID NO: 1101853 - DNA, 22 bp, Artificial Sequence
  chemically synthesized
ttaacaatagcagacttcacac

SEQ ID NO: 1101854 - DNA, 22 bp, Artificial Sequence
  chemically synthesized
tatttttaacaatagcagactt

SEQ ID NO: 1101855 - DNA, 22 bp, Artificial Sequence
  chemically synthesized
gtatttttaacaatagcagact

SEQ ID NO: 1101856 - DNA, 22 bp, Artificial Sequence
  chemically synthesized
tgtatttttaacaatagcagac

SEQ ID NO: 1101857 - DNA, 22 bp, Artificial Sequence
  chemically synthesized
gtgtgtgaagtctgctattgtt

SEQ ID NO: 1101858 - DNA, 22 bp, Artificial Sequence
  chemically synthesized
gtagtaattttgtatttttaac

SEQ ID NO: 1101859 - DNA, 22 bp, Artificial Sequence
  chemically synthesized
ggtagtaattttgtatttttaa

SEQ ID NO: 1101860 - DNA, 22 bp, Artificial Sequence
  chemically synthesized
ctattgttaaaaatacaaaatt

SEQ ID NO: 1101861 - DNA, 22 bp, Artificial Sequence
  chemically synthesized
ttgttaaaaatacaaaattact

SEQ ID NO: 1101862 - DNA, 22 bp, Artificial Sequence
  chemically synthesized
ttaaaaatacaaaattactacc

SEQ ID NO: 1101863 - DNA, 22 bp, Artificial Sequence
  chemically synthesized
aaaatacaaaattactaccaaa

SEQ ID NO: 1101864 - DNA, 22 bp, Artificial Sequence
  chemically synthesized
gagagtaacatcataaaaccac

SEQ ID NO: 1101865 - DNA, 22 bp, Artificial Sequence
  chemically synthesized
tcgagagtaacatcataaaacc

SEQ ID NO: 1101866 - DNA, 22 bp, Artificial Sequence
  chemically synthesized
ctaccaaatgtggttttatgat

SEQ ID NO: 1101867 - DNA, 22 bp, Artificial Sequence
  chemically synthesized
ccaaatgtggttttatgatgtt

SEQ ID NO: 1101868 - DNA, 22 bp, Artificial Sequence
  chemically synthesized
atgttctcgagagtaacatcat

SEQ ID NO: 1101869 - DNA, 22 bp, Artificial Sequence
  chemically synthesized
aatgttctcgagagtaacatca

SEQ ID NO: 1101870 - DNA, 22 bp, Artificial Sequence
  chemically synthesized
tatgatgttactctcgagaaca

SEQ ID NO: 1101871 - DNA, 22 bp, Artificial Sequence
  chemically synthesized
atgatgttactctcgagaacat

SEQ ID NO: 1101872 - DNA, 22 bp, Artificial Sequence
  chemically synthesized
tgatgttactctcgagaacatt

SEQ ID NO: 1101873 - DNA, 22 bp, Artificial Sequence
  chemically synthesized
gagggggatatgatttaatgtt

SEQ ID NO: 1101874 - DNA, 22 bp, Artificial Sequence
  chemically synthesized
tagagggggatatgatttaatg

SEQ ID NO: 1101875 - DNA, 22 bp, Artificial Sequence
  chemically synthesized
ctctcgagaacattaaatcata

SEQ ID NO: 1101876 - DNA, 22 bp, Artificial Sequence
  chemically synthesized
tctagagggggatatgatttaa

SEQ ID NO: 1101877 - DNA, 22 bp, Artificial Sequence
  chemically synthesized
ctctagagggggatatgattta

SEQ ID NO: 1101878 - DNA, 22 bp, Artificial Sequence
  chemically synthesized
tcgagaacattaaatcatatcc

SEQ ID NO: 1101879 - DNA, 22 bp, Artificial Sequence
  chemically synthesized
gagaacattaaatcatatcccc

SEQ ID NO: 1101880 - DNA, 22 bp, Artificial Sequence
  chemically synthesized
aaatttctctagagggggatat

SEQ ID NO: 1101881 - DNA, 22 bp, Artificial Sequence
  chemically synthesized
aaaatttctctagagggggata

SEQ ID NO: 1101882 - DNA, 22 bp, Artificial Sequence
  chemically synthesized
taacttaaaatttctctagagg

SEQ ID NO: 1101883 - DNA, 22 bp, Artificial Sequence
  chemically synthesized
aatcatatccccctctagagaa

SEQ ID NO: 1101884 - DNA, 22 bp, Artificial Sequence
  chemically synthesized
gtaacttaaaatttctctagag

SEQ ID NO: 1101885 - DNA, 22 bp, Artificial Sequence
  chemically synthesized
tgtaacttaaaatttctctaga

SEQ ID NO: 1101886 - DNA, 22 bp, Artificial Sequence
  chemically synthesized
ttttgtaacttaaaatttctct

SEQ ID NO: 1101887 - DNA, 22 bp, Artificial Sequence
  chemically synthesized
atgagttgttttgtaacttaaa

SEQ ID NO: 1101888 - DNA, 22 bp, Artificial Sequence
  chemically synthesized
tcatgagttgttttgtaactta

SEQ ID NO: 1101889 - DNA, 22 bp, Artificial Sequence
  chemically synthesized
tagagaaattttaagttacaaa

SEQ ID NO: 1101890 - DNA, 22 bp, Artificial Sequence
  chemically synthesized
gagaaattttaagttacaaaac

SEQ ID NO: 1101891 - DNA, 22 bp, Artificial Sequence
  chemically synthesized
gtattctcatgagttgttttgt

SEQ ID NO: 1101892 - DNA, 22 bp, Artificial Sequence
  chemically synthesized
agtattctcatgagttgttttg

SEQ ID NO: 1101893 - DNA, 22 bp, Artificial Sequence
  chemically synthesized
tagtattctcatgagttgtttt

SEQ ID NO: 1101894 - DNA, 22 bp, Artificial Sequence
  chemically synthesized
ttagtattctcatgagttgttt

SEQ ID NO: 1101895 - DNA, 22 bp, Artificial Sequence
  chemically synthesized
taagttacaaaacaactcatga

SEQ ID NO: 1101896 - DNA, 22 bp, Artificial Sequence
  chemically synthesized
aagttacaaaacaactcatgag

SEQ ID NO: 1101897 - DNA, 22 bp, Artificial Sequence
  chemically synthesized
agttacaaaacaactcatgaga

SEQ ID NO: 1101898 - DNA, 22 bp, Artificial Sequence
  chemically synthesized
caaaacaactcatgagaatact

SEQ ID NO: 1101899 - DNA, 22 bp, Artificial Sequence
  chemically synthesized
taaggacacatttttagtattc

SEQ ID NO: 1101900 - DNA, 22 bp, Artificial Sequence
  chemically synthesized
tgtactgtaaggacacattttt

SEQ ID NO: 1101901 - DNA, 22 bp, Artificial Sequence
  chemically synthesized
atgagaatactaaaaatgtgtc

SEQ ID NO: 1101902 - DNA, 22 bp, Artificial Sequence
  chemically synthesized
atgtactgtaaggacacatttt

SEQ ID NO: 1101903 - DNA, 22 bp, Artificial Sequence
  chemically synthesized
tatgtactgtaaggacacattt

SEQ ID NO: 1101904 - DNA, 22 bp, Artificial Sequence
  chemically synthesized
ttttatgtactgtaaggacaca

SEQ ID NO: 1101905 - DNA, 22 bp, Artificial Sequence
  chemically synthesized
gttttatgtactgtaaggacac

SEQ ID NO: 1101906 - DNA, 22 bp, Artificial Sequence
  chemically synthesized
aaaatgtgtccttacagtacat

SEQ ID NO: 1101907 - DNA, 22 bp, Artificial Sequence
  chemically synthesized
atagtttgttttatgtactgta

SEQ ID NO: 1101908 - DNA, 22 bp, Artificial Sequence
  chemically synthesized
ttcatagtttgttttatgtact

SEQ ID NO: 1101909 - DNA, 22 bp, Artificial Sequence
  chemically synthesized
ttgttcatagtttgttttatgt

SEQ ID NO: 1101910 - DNA, 22 bp, Artificial Sequence
  chemically synthesized
attgttcatagtttgttttatg

SEQ ID NO: 1101911 - DNA, 22 bp, Artificial Sequence
  chemically synthesized
agtttattgttcatagtttgtt

SEQ ID NO: 1101912 - DNA, 22 bp, Artificial Sequence
  chemically synthesized
acagtacataaaacaaactatg

SEQ ID NO: 1101913 - DNA, 22 bp, Artificial Sequence
  chemically synthesized
cagtacataaaacaaactatga

SEQ ID NO: 1101914 - DNA, 22 bp, Artificial Sequence
  chemically synthesized
cattgagtttattgttcatagt

SEQ ID NO: 1101915 - DNA, 22 bp, Artificial Sequence
  chemically synthesized
taaagacaccattacattgagt

SEQ ID NO: 1101916 - DNA, 22 bp, Artificial Sequence
  chemically synthesized
tgaacaataaactcaatgtaat

SEQ ID NO: 1101917 - DNA, 22 bp, Artificial Sequence
  chemically synthesized
gggaggctataaagacaccatt

SEQ ID NO: 1101918 - DNA, 22 bp, Artificial Sequence
  chemically synthesized
agggaggctataaagacaccat

SEQ ID NO: 1101919 - DNA, 22 bp, Artificial Sequence
  chemically synthesized
aatgtaatggtgtctttatagc

SEQ ID NO: 1101920 - DNA, 22 bp, Artificial Sequence
  chemically synthesized
gggtttagggaggctataaaga

SEQ ID NO: 1101921 - DNA, 22 bp, Artificial Sequence
  chemically synthesized
tgaaagttcgggtttagggagg

SEQ ID NO: 1101922 - DNA, 22 bp, Artificial Sequence
  chemically synthesized
gtgaaagttcgggtttagggag

SEQ ID NO: 1101923 - DNA, 22 bp, Artificial Sequence
  chemically synthesized
tatagcctccctaaacccgaac

SEQ ID NO: 1101924 - DNA, 22 bp, Artificial Sequence
  chemically synthesized
atagcctccctaaacccgaact

SEQ ID NO: 1101925 - DNA, 22 bp, Artificial Sequence
  chemically synthesized
tagcctccctaaacccgaactt

SEQ ID NO: 1101926 - DNA, 22 bp, Artificial Sequence
  chemically synthesized
tagaaaataatttgtgaaagtt

SEQ ID NO: 1101927 - DNA, 22 bp, Artificial Sequence
  chemically synthesized
cctaaacccgaactttcacaaa

SEQ ID NO: 1101928 - DNA, 22 bp, Artificial Sequence
  chemically synthesized
aacccgaactttcacaaattat

SEQ ID NO: 1101929 - DNA, 22 bp, Artificial Sequence
  chemically synthesized
tcatctgtagaaaataatttgt

SEQ ID NO: 1101930 - DNA, 22 bp, Artificial Sequence
  chemically synthesized
aactgtcatctgtagaaaataa

SEQ ID NO: 1101931 - DNA, 22 bp, Artificial Sequence
  chemically synthesized
aaactgtcatctgtagaaaata

SEQ ID NO: 1101932 - DNA, 22 bp, Artificial Sequence
  chemically synthesized
tttaaactgtcatctgtagaaa

SEQ ID NO: 1101933 - DNA, 22 bp, Artificial Sequence
  chemically synthesized
tcacaaattattttctacagat

SEQ ID NO: 1101934 - DNA, 22 bp, Artificial Sequence
  chemically synthesized
cacaaattattttctacagatg

SEQ ID NO: 1101935 - DNA, 22 bp, Artificial Sequence
  chemically synthesized
acaaattattttctacagatga

SEQ ID NO: 1101936 - DNA, 22 bp, Artificial Sequence
  chemically synthesized
gaaggactatttaaactgtcat

SEQ ID NO: 1101937 - DNA, 22 bp, Artificial Sequence
  chemically synthesized
ttttctacagatgacagtttaa

SEQ ID NO: 1101938 - DNA, 22 bp, Artificial Sequence
  chemically synthesized
tctacagatgacagtttaaata

SEQ ID NO: 1101939 - DNA, 22 bp, Artificial Sequence
  chemically synthesized
ctacagatgacagtttaaatag

SEQ ID NO: 1101940 - DNA, 22 bp, Artificial Sequence
  chemically synthesized
tacagatgacagtttaaatagt

SEQ ID NO: 1101941 - DNA, 22 bp, Artificial Sequence
  chemically synthesized
ccaactggaaggactatttaaa

SEQ ID NO: 1101942 - DNA, 22 bp, Artificial Sequence
  chemically synthesized
cagatgacagtttaaatagtcc

SEQ ID NO: 1101943 - DNA, 22 bp, Artificial Sequence
  chemically synthesized
gtccaaaagttcccaactggaa

SEQ ID NO: 1101944 - DNA, 22 bp, Artificial Sequence
  chemically synthesized
aaatagtccttccagttgggaa

SEQ ID NO: 1101945 - DNA, 22 bp, Artificial Sequence
  chemically synthesized
aatagtccttccagttgggaac

SEQ ID NO: 1101946 - DNA, 22 bp, Artificial Sequence
  chemically synthesized
ccagttgggaacttttggacta

SEQ ID NO: 1101947 - DNA, 22 bp, Artificial Sequence
  chemically synthesized
cagttgggaacttttggactaa

SEQ ID NO: 1101948 - DNA, 22 bp, Artificial Sequence
  chemically synthesized
aagatgacaaaatattagtcca

SEQ ID NO: 1101949 - DNA, 22 bp, Artificial Sequence
  chemically synthesized
gaagatgacaaaatattagtcc

SEQ ID NO: 1101950 - DNA, 22 bp, Artificial Sequence
  chemically synthesized
tgaagatgacaaaatattagtc

SEQ ID NO: 1101951 - DNA, 22 bp, Artificial Sequence
  chemically synthesized
ggaacttttggactaatatttt

SEQ ID NO: 1101952 - DNA, 22 bp, Artificial Sequence
  chemically synthesized
tctttgaagatgacaaaatatt

SEQ ID NO: 1101953 - DNA, 22 bp, Artificial Sequence
  chemically synthesized
tgtctttgaagatgacaaaata

SEQ ID NO: 1101954 - DNA, 22 bp, Artificial Sequence
  chemically synthesized
ttggactaatattttgtcatct

SEQ ID NO: 1101955 - DNA, 22 bp, Artificial Sequence
  chemically synthesized
tggactaatattttgtcatctt

SEQ ID NO: 1101956 - DNA, 22 bp, Artificial Sequence
  chemically synthesized
ggactaatattttgtcatcttc

SEQ ID NO: 1101957 - DNA, 22 bp, Artificial Sequence
  chemically synthesized
gactaatattttgtcatcttca

SEQ ID NO: 1101958 - DNA, 22 bp, Artificial Sequence
  chemically synthesized
atattttgtcatcttcaaagac

SEQ ID NO: 1101959 - DNA, 22 bp, Artificial Sequence
  chemically synthesized
tgtcatcttcaaagacagagct

SEQ ID NO: 1101960 - DNA, 22 bp, Artificial Sequence
  chemically synthesized
gtcatcttcaaagacagagctt

SEQ ID NO: 1101961 - DNA, 22 bp, Artificial Sequence
  chemically synthesized
tcatcttcaaagacagagcttt

SEQ ID NO: 1101962 - DNA, 22 bp, Artificial Sequence
  chemically synthesized
gtcagacaaataaaagcaaaag

SEQ ID NO: 1101963 - DNA, 22 bp, Artificial Sequence
  chemically synthesized
caaagacagagcttttgctttt

SEQ ID NO: 1101964 - DNA, 22 bp, Artificial Sequence
  chemically synthesized
aaagacagagcttttgctttta

SEQ ID NO: 1101965 - DNA, 22 bp, Artificial Sequence
  chemically synthesized
gtactggtcagacaaataaaag

SEQ ID NO: 1101966 - DNA, 22 bp, Artificial Sequence
  chemically synthesized
cgtactggtcagacaaataaaa

SEQ ID NO: 1101967 - DNA, 22 bp, Artificial Sequence
  chemically synthesized
cttcgtactggtcagacaaata

SEQ ID NO: 1101968 - DNA, 22 bp, Artificial Sequence
  chemically synthesized
ttgcttttatttgtctgaccag

SEQ ID NO: 1101969 - DNA, 22 bp, Artificial Sequence
  chemically synthesized
tgcttttatttgtctgaccagt

SEQ ID NO: 1101970 - DNA, 22 bp, Artificial Sequence
  chemically synthesized
gcttttatttgtctgaccagta

SEQ ID NO: 1101971 - DNA, 22 bp, Artificial Sequence
  chemically synthesized
atcattacttcgtactggtcag

SEQ ID NO: 1101972 - DNA, 22 bp, Artificial Sequence
  chemically synthesized
cttttatttgtctgaccagtac

SEQ ID NO: 1101973 - DNA, 22 bp, Artificial Sequence
  chemically synthesized
ttatttgtctgaccagtacgaa

SEQ ID NO: 1101974 - DNA, 22 bp, Artificial Sequence
  chemically synthesized
cctgatcattacttcgtactgg

SEQ ID NO: 1101975 - DNA, 22 bp, Artificial Sequence
  chemically synthesized
tatttgtctgaccagtacgaag

SEQ ID NO: 1101976 - DNA, 22 bp, Artificial Sequence
  chemically synthesized
acctgatcattacttcgtactg

SEQ ID NO: 1101977 - DNA, 22 bp, Artificial Sequence
  chemically synthesized
atttgtctgaccagtacgaagt

SEQ ID NO: 1101978 - DNA, 22 bp, Artificial Sequence
  chemically synthesized
tacctgatcattacttcgtact

SEQ ID NO: 1101979 - DNA, 22 bp, Artificial Sequence
  chemically synthesized
tttgtctgaccagtacgaagta

SEQ ID NO: 1101980 - DNA, 22 bp, Artificial Sequence
  chemically synthesized
ttacctgatcattacttcgtac

SEQ ID NO: 1101981 - DNA, 22 bp, Artificial Sequence
  chemically synthesized
gtctgaccagtacgaagtaatg

SEQ ID NO: 1101982 - DNA, 22 bp, Artificial Sequence
  chemically synthesized
tctgaccagtacgaagtaatga

SEQ ID NO: 1101983 - DNA, 22 bp, Artificial Sequence
  chemically synthesized
accagtacgaagtaatgatcag

SEQ ID NO: 1101984 - DNA, 22 bp, Artificial Sequence
  chemically synthesized
taaatgataaaagatgatgatt

SEQ ID NO: 1101985 - DNA, 22 bp, Artificial Sequence
  chemically synthesized
ataaatgataaaagatgatgat

SEQ ID NO: 1101986 - DNA, 22 bp, Artificial Sequence
  chemically synthesized
tttataaatgataaaagatgat

SEQ ID NO: 1101987 - DNA, 22 bp, Artificial Sequence
  chemically synthesized
gctatttataaatgataaaaga

SEQ ID NO: 1101988 - DNA, 22 bp, Artificial Sequence
  chemically synthesized
ttatcatttataaatagccagt

SEQ ID NO: 1101989 - DNA, 22 bp, Artificial Sequence
  chemically synthesized
tatcatttataaatagccagta

SEQ ID NO: 1101990 - DNA, 22 bp, Artificial Sequence
  chemically synthesized
atcatttataaatagccagtat

SEQ ID NO: 1101991 - DNA, 22 bp, Artificial Sequence
  chemically synthesized
tcatttataaatagccagtatc

SEQ ID NO: 1101992 - DNA, 22 bp, Artificial Sequence
  chemically synthesized
ataaatagccagtatctctcac

SEQ ID NO: 1101993 - DNA, 22 bp, Artificial Sequence
  chemically synthesized
taaatagccagtatctctcacc

SEQ ID NO: 1101994 - DNA, 22 bp, Artificial Sequence
  chemically synthesized
tcacccatgattctttcccgta

SEQ ID NO: 1101995 - DNA, 22 bp, Artificial Sequence
  chemically synthesized
acccatgattctttcccgtatt

SEQ ID NO: 1101996 - DNA, 22 bp, Artificial Sequence
  chemically synthesized
tttcccgtattacctttttttc

SEQ ID NO: 1101997 - DNA, 22 bp, Artificial Sequence
  chemically synthesized
tcccgtattacctttttttctg

SEQ ID NO: 1101998 - DNA, 22 bp, Artificial Sequence
  chemically synthesized
cccgtattacctttttttctgc

SEQ ID NO: 1101999 - DNA, 22 bp, Artificial Sequence
  chemically synthesized
ccgtattacctttttttctgct

SEQ ID NO: 1102000 - DNA, 22 bp, Artificial Sequence
  chemically synthesized
gaagtggcaaaacagcagaaaa

SEQ ID NO: 1102001 - DNA, 22 bp, Artificial Sequence
  chemically synthesized
agaagtggcaaaacagcagaaa

SEQ ID NO: 1102002 - DNA, 22 bp, Artificial Sequence
  chemically synthesized
tagaagtggcaaaacagcagaa

SEQ ID NO: 1102003 - DNA, 22 bp, Artificial Sequence
  chemically synthesized
ttagaagtggcaaaacagcaga

SEQ ID NO: 1102004 - DNA, 22 bp, Artificial Sequence
  chemically synthesized
tttagaagtggcaaaacagcag

SEQ ID NO: 1102005 - DNA, 22 bp, Artificial Sequence
  chemically synthesized
cctttttttctgctgttttgcc

SEQ ID NO: 1102006 - DNA, 22 bp, Artificial Sequence
  chemically synthesized
tttttctgctgttttgccactt

SEQ ID NO: 1102007 - DNA, 22 bp, Artificial Sequence
  chemically synthesized
ttttctgctgttttgccacttc

SEQ ID NO: 1102008 - DNA, 22 bp, Artificial Sequence
  chemically synthesized
tttctgctgttttgccacttct

SEQ ID NO: 1102009 - DNA, 22 bp, Artificial Sequence
  chemically synthesized
ttctgctgttttgccacttcta

SEQ ID NO: 1102010 - DNA, 22 bp, Artificial Sequence
  chemically synthesized
aatcatactttttagaagtggc

SEQ ID NO: 1102011 - DNA, 22 bp, Artificial Sequence
  chemically synthesized
tctgctgttttgccacttctaa

SEQ ID NO: 1102012 - DNA, 22 bp, Artificial Sequence
  chemically synthesized
ctgctgttttgccacttctaaa

SEQ ID NO: 1102013 - DNA, 22 bp, Artificial Sequence
  chemically synthesized
tgctgttttgccacttctaaaa

SEQ ID NO: 1102014 - DNA, 22 bp, Artificial Sequence
  chemically synthesized
ctgttttgccacttctaaaaag

SEQ ID NO: 1102015 - DNA, 22 bp, Artificial Sequence
  chemically synthesized
ttttgccacttctaaaaagtat

SEQ ID NO: 1102016 - DNA, 22 bp, Artificial Sequence
  chemically synthesized
tgccacttctaaaaagtatgat

SEQ ID NO: 1102017 - DNA, 22 bp, Artificial Sequence
  chemically synthesized
gccacttctaaaaagtatgatt

SEQ ID NO: 1102018 - DNA, 22 bp, Artificial Sequence
  chemically synthesized
ccacttctaaaaagtatgattc

SEQ ID NO: 1102019 - DNA, 22 bp, Artificial Sequence
  chemically synthesized
ctaaaaagtatgattcaactat

SEQ ID NO: 1102020 - DNA, 22 bp, Artificial Sequence
  chemically synthesized
taaaaagtatgattcaactatg

SEQ ID NO: 1102021 - DNA, 22 bp, Artificial Sequence
  chemically synthesized
aaaagtatgattcaactatgct

SEQ ID NO: 1102022 - DNA, 22 bp, Artificial Sequence
  chemically synthesized
aactatgctgtctacatgtgtt

SEQ ID NO: 1102023 - DNA, 22 bp, Artificial Sequence
  chemically synthesized
tgctgtctacatgtgttatttt

SEQ ID NO: 1102024 - DNA, 22 bp, Artificial Sequence
  chemically synthesized
agtaaaacagaagaaaataaca

SEQ ID NO: 1102025 - DNA, 22 bp, Artificial Sequence
  chemically synthesized
aagtaaaacagaagaaaataac

SEQ ID NO: 1102026 - DNA, 22 bp, Artificial Sequence
  chemically synthesized
tctacatgtgttattttcttct

SEQ ID NO: 1102027 - DNA, 22 bp, Artificial Sequence
  chemically synthesized
catgtgttattttcttctgttt

SEQ ID NO: 1102028 - DNA, 22 bp, Artificial Sequence
  chemically synthesized
aatgtaaatttaagtaaaacag

SEQ ID NO: 1102029 - DNA, 22 bp, Artificial Sequence
  chemically synthesized
caatgtaaatttaagtaaaaca

SEQ ID NO: 1102030 - DNA, 22 bp, Artificial Sequence
  chemically synthesized
tcaatgtaaatttaagtaaaac

SEQ ID NO: 1102031 - DNA, 22 bp, Artificial Sequence
  chemically synthesized
ttttcttctgttttacttaaat

SEQ ID NO: 1102032 - DNA, 22 bp, Artificial Sequence
  chemically synthesized
tcttctgttttacttaaattta

SEQ ID NO: 1102033 - DNA, 22 bp, Artificial Sequence
  chemically synthesized
cttctgttttacttaaatttac

SEQ ID NO: 1102034 - DNA, 22 bp, Artificial Sequence
  chemically synthesized
ttctgttttacttaaatttaca

SEQ ID NO: 1102035 - DNA, 22 bp, Artificial Sequence
  chemically synthesized
ctgttttacttaaatttacatt

SEQ ID NO: 1102036 - DNA, 22 bp, Artificial Sequence
  chemically synthesized
tgttttacttaaatttacattg

SEQ ID NO: 1102037 - DNA, 22 bp, Artificial Sequence
  chemically synthesized
ttttacttaaatttacattgaa

SEQ ID NO: 1102038 - DNA, 22 bp, Artificial Sequence
  chemically synthesized
tggagcacatattttcaatgta

SEQ ID NO: 1102039 - DNA, 22 bp, Artificial Sequence
  chemically synthesized
tacttaaatttacattgaaaat

SEQ ID NO: 1102040 - DNA, 22 bp, Artificial Sequence
  chemically synthesized
tgtggagcacatattttcaatg

SEQ ID NO: 1102041 - DNA, 22 bp, Artificial Sequence
  chemically synthesized
acttaaatttacattgaaaata

SEQ ID NO: 1102042 - DNA, 22 bp, Artificial Sequence
  chemically synthesized
ctgtggagcacatattttcaat

SEQ ID NO: 1102043 - DNA, 22 bp, Artificial Sequence
  chemically synthesized
cttaaatttacattgaaaatat

SEQ ID NO: 1102044 - DNA, 22 bp, Artificial Sequence
  chemically synthesized
tctgtggagcacatattttcaa

SEQ ID NO: 1102045 - DNA, 22 bp, Artificial Sequence
  chemically synthesized
aaatttacattgaaaatatgtg

SEQ ID NO: 1102046 - DNA, 22 bp, Artificial Sequence
  chemically synthesized
aatttacattgaaaatatgtgc

SEQ ID NO: 1102047 - DNA, 22 bp, Artificial Sequence
  chemically synthesized
acattgaaaatatgtgctccac

SEQ ID NO: 1102048 - DNA, 22 bp, Artificial Sequence
  chemically synthesized
cattgaaaatatgtgctccaca

SEQ ID NO: 1102049 - DNA, 22 bp, Artificial Sequence
  chemically synthesized
aaggggaaactttctgtggagc

SEQ ID NO: 1102050 - DNA, 22 bp, Artificial Sequence
  chemically synthesized
aaaatatgtgctccacagaaag

SEQ ID NO: 1102051 - DNA, 22 bp, Artificial Sequence
  chemically synthesized
ataatcacattaaaggggaaac

SEQ ID NO: 1102052 - DNA, 22 bp, Artificial Sequence
  chemically synthesized
ttaataatcacattaaagggga

SEQ ID NO: 1102053 - DNA, 22 bp, Artificial Sequence
  chemically synthesized
cacagaaagtttcccctttaat

SEQ ID NO: 1102054 - DNA, 22 bp, Artificial Sequence
  chemically synthesized
ttattaataatcacattaaagg

SEQ ID NO: 1102055 - DNA, 22 bp, Artificial Sequence
  chemically synthesized
aaaattattattaataatcaca

SEQ ID NO: 1102056 - DNA, 22 bp, Artificial Sequence
  chemically synthesized
aaaaattattattaataatcac

SEQ ID NO: 1102057 - DNA, 22 bp, Artificial Sequence
  chemically synthesized
cccctttaatgtgattattaat

SEQ ID NO: 1102058 - DNA, 22 bp, Artificial Sequence
  chemically synthesized
ccctttaatgtgattattaata

SEQ ID NO: 1102059 - DNA, 22 bp, Artificial Sequence
  chemically synthesized
taatgtgattattaataataat

SEQ ID NO: 1102060 - DNA, 22 bp, Artificial Sequence
  chemically synthesized
aatgtgattattaataataatt

SEQ ID NO: 1102061 - DNA, 22 bp, Artificial Sequence
  chemically synthesized
atgtgattattaataataattt

SEQ ID NO: 1102062 - DNA, 22 bp, Artificial Sequence
  chemically synthesized
gataaatagtttaaaaattatt

SEQ ID NO: 1102063 - DNA, 22 bp, Artificial Sequence
  chemically synthesized
agataaatagtttaaaaattat

SEQ ID NO: 1102064 - DNA, 22 bp, Artificial Sequence
  chemically synthesized
ttagataaatagtttaaaaatt

SEQ ID NO: 1102065 - DNA, 22 bp, Artificial Sequence
  chemically synthesized
tcttagataaatagtttaaaaa

SEQ ID NO: 1102066 - DNA, 22 bp, Artificial Sequence
  chemically synthesized
ttaataataatttttaaactat

SEQ ID NO: 1102067 - DNA, 22 bp, Artificial Sequence
  chemically synthesized
ataataatttttaaactattta

SEQ ID NO: 1102068 - DNA, 22 bp, Artificial Sequence
  chemically synthesized
aagttctcttagataaatagtt

SEQ ID NO: 1102069 - DNA, 22 bp, Artificial Sequence
  chemically synthesized
gaagttctcttagataaatagt

SEQ ID NO: 1102070 - DNA, 22 bp, Artificial Sequence
  chemically synthesized
ttaaactatttatctaagagaa

SEQ ID NO: 1102071 - DNA, 22 bp, Artificial Sequence
  chemically synthesized
taaactatttatctaagagaac

SEQ ID NO: 1102072 - DNA, 22 bp, Artificial Sequence
  chemically synthesized
aaactatttatctaagagaact

SEQ ID NO: 1102073 - DNA, 22 bp, Artificial Sequence
  chemically synthesized
aactatttatctaagagaactt

SEQ ID NO: 1102074 - DNA, 22 bp, Artificial Sequence
  chemically synthesized
tttatctaagagaacttcaaga

SEQ ID NO: 1102075 - DNA, 22 bp, Artificial Sequence
  chemically synthesized
atctaagagaacttcaagacga

SEQ ID NO: 1102076 - DNA, 22 bp, Artificial Sequence
  chemically synthesized
tctaagagaacttcaagacgat

SEQ ID NO: 1102077 - DNA, 22 bp, Artificial Sequence
  chemically synthesized
agagaacttcaagacgatcacc

SEQ ID NO: 1102078 - DNA, 22 bp, Artificial Sequence
  chemically synthesized
aaagataacagcaaggtgatcg

SEQ ID NO: 1102079 - DNA, 22 bp, Artificial Sequence
  chemically synthesized
gaaagataacagcaaggtgatc

SEQ ID NO: 1102080 - DNA, 22 bp, Artificial Sequence
  chemically synthesized
caagacgatcaccttgctgtta

SEQ ID NO: 1102081 - DNA, 22 bp, Artificial Sequence
  chemically synthesized
aagacgatcaccttgctgttat

SEQ ID NO: 1102082 - DNA, 22 bp, Artificial Sequence
  chemically synthesized
gctgttatctttcaagtctaca

SEQ ID NO: 1102083 - DNA, 22 bp, Artificial Sequence
  chemically synthesized
ctgttatctttcaagtctacat

SEQ ID NO: 1102084 - DNA, 22 bp, Artificial Sequence
  chemically synthesized
ttatctttcaagtctacatttg

SEQ ID NO: 1102085 - DNA, 22 bp, Artificial Sequence
  chemically synthesized
tctttcaagtctacatttgttc

SEQ ID NO: 1102086 - DNA, 22 bp, Artificial Sequence
  chemically synthesized
tcaagtctacatttgttcttat

SEQ ID NO: 1102087 - DNA, 22 bp, Artificial Sequence
  chemically synthesized
caagtctacatttgttcttatt

SEQ ID NO: 1102088 - DNA, 22 bp, Artificial Sequence
  chemically synthesized
aagtctacatttgttcttattt

SEQ ID NO: 1102089 - DNA, 22 bp, Artificial Sequence
  chemically synthesized
catttgttcttatttcacatct

SEQ ID NO: 1102090 - DNA, 22 bp, Artificial Sequence
  chemically synthesized
aacaaggacagtgaagatgtga

SEQ ID NO: 1102091 - DNA, 22 bp, Artificial Sequence
  chemically synthesized
gttcttatttcacatcttcact

SEQ ID NO: 1102092 - DNA, 22 bp, Artificial Sequence
  chemically synthesized
ttcttatttcacatcttcactg

SEQ ID NO: 1102093 - DNA, 22 bp, Artificial Sequence
  chemically synthesized
ttatttcacatcttcactgtcc

SEQ ID NO: 1102094 - DNA, 22 bp, Artificial Sequence
  chemically synthesized
atttcacatcttcactgtcctt

SEQ ID NO: 1102095 - DNA, 22 bp, Artificial Sequence
  chemically synthesized
tttcacatcttcactgtccttg

SEQ ID NO: 1102096 - DNA, 22 bp, Artificial Sequence
  chemically synthesized
cacatcttcactgtccttgttc

SEQ ID NO: 1102097 - DNA, 22 bp, Artificial Sequence
  chemically synthesized
acatcttcactgtccttgttca

SEQ ID NO: 1102098 - DNA, 22 bp, Artificial Sequence
  chemically synthesized
cactgtccttgttcaggtcttt

SEQ ID NO: 1102099 - DNA, 22 bp, Artificial Sequence
  chemically synthesized
actgtccttgttcaggtctttt

SEQ ID NO: 1102100 - DNA, 22 bp, Artificial Sequence
  chemically synthesized
tccttgttcaggtctttttttt

SEQ ID NO: 1102101 - DNA, 22 bp, Artificial Sequence
  chemically synthesized
gttcaggtctttttttttttgt

SEQ ID NO: 1102102 - DNA, 22 bp, Artificial Sequence
  chemically synthesized
ttcaggtctttttttttttgtt

SEQ ID NO: 1102103 - DNA, 22 bp, Artificial Sequence
  chemically synthesized
aggtctttttttttttgtttgt

SEQ ID NO: 1102104 - DNA, 22 bp, Artificial Sequence
  chemically synthesized
tttttttttgtttgttttttgt

SEQ ID NO: 1102105 - DNA, 22 bp, Artificial Sequence
  chemically synthesized
ttttttttgtttgttttttgtt

SEQ ID NO: 1102106 - DNA, 22 bp, Artificial Sequence
  chemically synthesized
tttttttgtttgttttttgttt

SEQ ID NO: 1102107 - DNA, 22 bp, Artificial Sequence
  chemically synthesized
ttttttgtttgttttttgtttt

SEQ ID NO: 1102108 - DNA, 22 bp, Artificial Sequence
  chemically synthesized
tttttgtttgttttttgttttt

SEQ ID NO: 1102109 - DNA, 22 bp, Artificial Sequence
  chemically synthesized
ttttgtttgttttttgtttttt

SEQ ID NO: 1102110 - DNA, 22 bp, Artificial Sequence
  chemically synthesized
tttgtttgttttttgttttttt

SEQ ID NO: 1102111 - DNA, 22 bp, Artificial Sequence
  chemically synthesized
ttgtttgttttttgtttttttt

SEQ ID NO: 1102112 - DNA, 22 bp, Artificial Sequence
  chemically synthesized
tgtttgttttttgttttttttt

SEQ ID NO: 1102113 - DNA, 22 bp, Artificial Sequence
  chemically synthesized
aaaaaaaaaaaaaaaaaaaaac

SEQ ID NO: 1102114 - DNA, 22 bp, Artificial Sequence
  chemically synthesized
gtttgttttttgtttttttttt

SEQ ID NO: 1102115 - DNA, 22 bp, Artificial Sequence
  chemically synthesized
tttgttttttgttttttttttt

SEQ ID NO: 1102116 - DNA, 22 bp, Artificial Sequence
  chemically synthesized
gttttttgtttttttttttttt

SEQ ID NO: 1102117 - DNA, 22 bp, Artificial Sequence
  chemically synthesized
ttttttgttttttttttttttt

SEQ ID NO: 1102118 - DNA, 22 bp, Artificial Sequence
  chemically synthesized
catctcaaaaaaaaaaaaaaaa

SEQ ID NO: 1102119 - DNA, 22 bp, Artificial Sequence
  chemically synthesized
tttgtttttttttttttttttt

SEQ ID NO: 1102120 - DNA, 22 bp, Artificial Sequence
  chemically synthesized
ttgttttttttttttttttttt

SEQ ID NO: 1102121 - DNA, 22 bp, Artificial Sequence
  chemically synthesized
tgtttttttttttttttttttt

SEQ ID NO: 1102122 - DNA, 22 bp, Artificial Sequence
  chemically synthesized
gttttttttttttttttttttt

SEQ ID NO: 1102123 - DNA, 22 bp, Artificial Sequence
  chemically synthesized
tttttttttttttttttttttg

SEQ ID NO: 1102124 - DNA, 22 bp, Artificial Sequence
  chemically synthesized
ttttttttttttttttttgaga

SEQ ID NO: 1102125 - DNA, 22 bp, Artificial Sequence
  chemically synthesized
tttttttttttttttttgagat

SEQ ID NO: 1102126 - DNA, 22 bp, Artificial Sequence
  chemically synthesized
ttttttttttttttttgagatg

SEQ ID NO: 1102127 - DNA, 22 bp, Artificial Sequence
  chemically synthesized
tttttttttttttttgagatgg

SEQ ID NO: 1102128 - DNA, 22 bp, Artificial Sequence
  chemically synthesized
ttttttttttttttgagatgga

SEQ ID NO: 1102129 - DNA, 22 bp, Artificial Sequence
  chemically synthesized
tttttttttttttgagatggag

SEQ ID NO: 1102130 - DNA, 22 bp, Artificial Sequence
  chemically synthesized
ttttttttttttgagatggagt

SEQ ID NO: 1102131 - DNA, 22 bp, Artificial Sequence
  chemically synthesized
tttttttttttgagatggagtc

SEQ ID NO: 1102132 - DNA, 22 bp, Artificial Sequence
  chemically synthesized
ttttttttttgagatggagtct

SEQ ID NO: 1102133 - DNA, 22 bp, Artificial Sequence
  chemically synthesized
ggcgacagagcaagactccatc

SEQ ID NO: 1102134 - DNA, 22 bp, Artificial Sequence
  chemically synthesized
tttttttttgagatggagtctt

SEQ ID NO: 1102135 - DNA, 22 bp, Artificial Sequence
  chemically synthesized
ttttttttgagatggagtcttg

SEQ ID NO: 1102136 - DNA, 22 bp, Artificial Sequence
  chemically synthesized
tttttttgagatggagtcttgc

SEQ ID NO: 1102137 - DNA, 22 bp, Artificial Sequence
  chemically synthesized
ttttttgagatggagtcttgct

SEQ ID NO: 1102138 - DNA, 22 bp, Artificial Sequence
  chemically synthesized
tttttgagatggagtcttgctc

SEQ ID NO: 1102139 - DNA, 22 bp, Artificial Sequence
  chemically synthesized
ttttgagatggagtcttgctct

SEQ ID NO: 1102140 - DNA, 22 bp, Artificial Sequence
  chemically synthesized
tttgagatggagtcttgctctg

SEQ ID NO: 1102141 - DNA, 22 bp, Artificial Sequence
  chemically synthesized
cagcctgggcgacagagcaaga

SEQ ID NO: 1102142 - DNA, 22 bp, Artificial Sequence
  chemically synthesized
ttgagatggagtcttgctctgt

SEQ ID NO: 1102143 - DNA, 22 bp, Artificial Sequence
  chemically synthesized
tgagatggagtcttgctctgtc

SEQ ID NO: 1102144 - DNA, 22 bp, Artificial Sequence
  chemically synthesized
gagatggagtcttgctctgtcg

SEQ ID NO: 1102145 - DNA, 22 bp, Artificial Sequence
  chemically synthesized
agatggagtcttgctctgtcgc

SEQ ID NO: 1102146 - DNA, 22 bp, Artificial Sequence
  chemically synthesized
actccagcctgggcgacagagc

SEQ ID NO: 1102147 - DNA, 22 bp, Artificial Sequence
  chemically synthesized
cactccagcctgggcgacagag

SEQ ID NO: 1102148 - DNA, 22 bp, Artificial Sequence
  chemically synthesized
tgccacttcactccagcctggg

SEQ ID NO: 1102149 - DNA, 22 bp, Artificial Sequence
  chemically synthesized
gctctgtcgcccaggctggagt

SEQ ID NO: 1102150 - DNA, 22 bp, Artificial Sequence
  chemically synthesized
ctctgtcgcccaggctggagtg

SEQ ID NO: 1102151 - DNA, 22 bp, Artificial Sequence
  chemically synthesized
tgtcgcccaggctggagtgaag

SEQ ID NO: 1102152 - DNA, 22 bp, Artificial Sequence
  chemically synthesized
tcgcccaggctggagtgaagtg

SEQ ID NO: 1102153 - DNA, 22 bp, Artificial Sequence
  chemically synthesized
cagtgagccaagattgtgccac

SEQ ID NO: 1102154 - DNA, 22 bp, Artificial Sequence
  chemically synthesized
gagtgaagtggcacaatcttgg

SEQ ID NO: 1102155 - DNA, 22 bp, Artificial Sequence
  chemically synthesized
ggaggtggaggctgcagtgagc

SEQ ID NO: 1102156 - DNA, 22 bp, Artificial Sequence
  chemically synthesized
ggctcactgcagcctccacctc

SEQ ID NO: 1102157 - DNA, 22 bp, Artificial Sequence
  chemically synthesized
gctcactgcagcctccacctcc

SEQ ID NO: 1102158 - DNA, 22 bp, Artificial Sequence
  chemically synthesized
actgcagcctccacctcccagg

SEQ ID NO: 1102159 - DNA, 22 bp, Artificial Sequence
  chemically synthesized
cagcctccacctcccaggttca

SEQ ID NO: 1102160 - DNA, 22 bp, Artificial Sequence
  chemically synthesized
aggcaggagaatggcgtgaacc

SEQ ID NO: 1102161 - DNA, 22 bp, Artificial Sequence
  chemically synthesized
cacctcccaggttcacgccatt

SEQ ID NO: 1102162 - DNA, 22 bp, Artificial Sequence
  chemically synthesized
ggaggctgaggcaggagaatgg

SEQ ID NO: 1102163 - DNA, 22 bp, Artificial Sequence
  chemically synthesized
ccaggttcacgccattctcctg

SEQ ID NO: 1102164 - DNA, 22 bp, Artificial Sequence
  chemically synthesized
gggaggctgaggcaggagaatg

SEQ ID NO: 1102165 - DNA, 22 bp, Artificial Sequence
  chemically synthesized
cttgggaggctgaggcaggaga

SEQ ID NO: 1102166 - DNA, 22 bp, Artificial Sequence
  chemically synthesized
acgccattctcctgcctcagcc

SEQ ID NO: 1102167 - DNA, 22 bp, Artificial Sequence
  chemically synthesized
taatcccagctacttgggaggc

SEQ ID NO: 1102168 - DNA, 22 bp, Artificial Sequence
  chemically synthesized
tcctgcctcagcctcccaagta

SEQ ID NO: 1102169 - DNA, 22 bp, Artificial Sequence
  chemically synthesized
ctgcctcagcctcccaagtagc

SEQ ID NO: 1102170 - DNA, 22 bp, Artificial Sequence
  chemically synthesized
cctcagcctcccaagtagctgg

SEQ ID NO: 1102171 - DNA, 22 bp, Artificial Sequence
  chemically synthesized
agcctcccaagtagctgggatt

SEQ ID NO: 1102172 - DNA, 22 bp, Artificial Sequence
  chemically synthesized
ccaagtagctgggattacaggc

SEQ ID NO: 1102173 - DNA, 22 bp, Artificial Sequence
  chemically synthesized
ggcatggtagtgcacgcctgta

SEQ ID NO: 1102174 - DNA, 22 bp, Artificial Sequence
  chemically synthesized
gctgggcatggtagtgcacgcc

SEQ ID NO: 1102175 - DNA, 22 bp, Artificial Sequence
  chemically synthesized
ggattacaggcgtgcactacca

SEQ ID NO: 1102176 - DNA, 22 bp, Artificial Sequence
  chemically synthesized
caggcgtgcactaccatgccca

SEQ ID NO: 1102177 - DNA, 22 bp, Artificial Sequence
  chemically synthesized
aaaacacaaaaattagctgggc

SEQ ID NO: 1102178 - DNA, 22 bp, Artificial Sequence
  chemically synthesized
ctaaaaacacaaaaattagctg

SEQ ID NO: 1102179 - DNA, 22 bp, Artificial Sequence
  chemically synthesized
tactaaaaacacaaaaattagc

SEQ ID NO: 1102180 - DNA, 22 bp, Artificial Sequence
  chemically synthesized
ccatgcccagctaatttttgtg

SEQ ID NO: 1102181 - DNA, 22 bp, Artificial Sequence
  chemically synthesized
tctctactaaaaacacaaaaat

SEQ ID NO: 1102182 - DNA, 22 bp, Artificial Sequence
  chemically synthesized
atttttgtgtttttagtagaga

SEQ ID NO: 1102183 - DNA, 22 bp, Artificial Sequence
  chemically synthesized
ttgtgtttttagtagagacagg

SEQ ID NO: 1102184 - DNA, 22 bp, Artificial Sequence
  chemically synthesized
tgtgtttttagtagagacaggg

SEQ ID NO: 1102185 - DNA, 22 bp, Artificial Sequence
  chemically synthesized
gtgtttttagtagagacagggt

SEQ ID NO: 1102186 - DNA, 22 bp, Artificial Sequence
  chemically synthesized
tgtttttagtagagacagggtt

SEQ ID NO: 1102187 - DNA, 22 bp, Artificial Sequence
  chemically synthesized
gccaacatggcgaaaccctgtc

SEQ ID NO: 1102188 - DNA, 22 bp, Artificial Sequence
  chemically synthesized
ttagtagagacagggtttcgcc

SEQ ID NO: 1102189 - DNA, 22 bp, Artificial Sequence
  chemically synthesized
tagtagagacagggtttcgcca

SEQ ID NO: 1102190 - DNA, 22 bp, Artificial Sequence
  chemically synthesized
agtagagacagggtttcgccat

SEQ ID NO: 1102191 - DNA, 22 bp, Artificial Sequence
  chemically synthesized
gtagagacagggtttcgccatg

SEQ ID NO: 1102192 - DNA, 22 bp, Artificial Sequence
  chemically synthesized
cgccatgttggccagcatggtc

SEQ ID NO: 1102193 - DNA, 22 bp, Artificial Sequence
  chemically synthesized
gccatgttggccagcatggtct

SEQ ID NO: 1102194 - DNA, 22 bp, Artificial Sequence
  chemically synthesized
gccagcatggtcttgatctctt

SEQ ID NO: 1102195 - DNA, 22 bp, Artificial Sequence
  chemically synthesized
aggcaggtagatcacgaggtca

SEQ ID NO: 1102196 - DNA, 22 bp, Artificial Sequence
  chemically synthesized
gatctcttgacctcgtgatcta

SEQ ID NO: 1102197 - DNA, 22 bp, Artificial Sequence
  chemically synthesized
atctcttgacctcgtgatctac

SEQ ID NO: 1102198 - DNA, 22 bp, Artificial Sequence
  chemically synthesized
ggcagctgaggcaggtagatca

SEQ ID NO: 1102199 - DNA, 22 bp, Artificial Sequence
  chemically synthesized
tgggcagctgaggcaggtagat

SEQ ID NO: 1102200 - DNA, 22 bp, Artificial Sequence
  chemically synthesized
ttgacctcgtgatctacctgcc

SEQ ID NO: 1102201 - DNA, 22 bp, Artificial Sequence
  chemically synthesized
gacctcgtgatctacctgcctc

SEQ ID NO: 1102202 - DNA, 22 bp, Artificial Sequence
  chemically synthesized
acctcgtgatctacctgcctca

SEQ ID NO: 1102203 - DNA, 22 bp, Artificial Sequence
  chemically synthesized
gtgatctacctgcctcagctgc

SEQ ID NO: 1102204 - DNA, 22 bp, Artificial Sequence
  chemically synthesized
taatcccagcactctgggcagc

SEQ ID NO: 1102205 - DNA, 22 bp, Artificial Sequence
  chemically synthesized
cctgcctcagctgcccagagtg

SEQ ID NO: 1102206 - DNA, 22 bp, Artificial Sequence
  chemically synthesized
cctcagctgcccagagtgctgg

SEQ ID NO: 1102207 - DNA, 22 bp, Artificial Sequence
  chemically synthesized
atgcctataatcccagcactct

SEQ ID NO: 1102208 - DNA, 22 bp, Artificial Sequence
  chemically synthesized
agctgcccagagtgctgggatt

SEQ ID NO: 1102209 - DNA, 22 bp, Artificial Sequence
  chemically synthesized
cccagagtgctgggattatagg

SEQ ID NO: 1102210 - DNA, 22 bp, Artificial Sequence
  chemically synthesized
ggattataggcatgagccacta

SEQ ID NO: 1102211 - DNA, 22 bp, Artificial Sequence
  chemically synthesized
aacagcccaggcgtagtggctc

SEQ ID NO: 1102212 - DNA, 22 bp, Artificial Sequence
  chemically synthesized
taggcatgagccactacgcctg

SEQ ID NO: 1102213 - DNA, 22 bp, Artificial Sequence
  chemically synthesized
atgagacctgaacagcccaggc

SEQ ID NO: 1102214 - DNA, 22 bp, Artificial Sequence
  chemically synthesized
cgcctgggctgttcaggtctca

SEQ ID NO: 1102215 - DNA, 22 bp, Artificial Sequence
  chemically synthesized
atggagtcactaatgagacctg

SEQ ID NO: 1102216 - DNA, 22 bp, Artificial Sequence
  chemically synthesized
ggctgttcaggtctcattagtg

SEQ ID NO: 1102217 - DNA, 22 bp, Artificial Sequence
  chemically synthesized
ttcaggtctcattagtgactcc

SEQ ID NO: 1102218 - DNA, 22 bp, Artificial Sequence
  chemically synthesized
aggtctcattagtgactccatt

SEQ ID NO: 1102219 - DNA, 22 bp, Artificial Sequence
  chemically synthesized
attagtgactccattaatgcac

SEQ ID NO: 1102220 - DNA, 22 bp, Artificial Sequence
  chemically synthesized
gtgactccattaatgcactggc

SEQ ID NO: 1102221 - DNA, 22 bp, Artificial Sequence
  chemically synthesized
cattaatgcactggctcgtttt

SEQ ID NO: 1102222 - DNA, 22 bp, Artificial Sequence
  chemically synthesized
atgcactggctcgttttgatat

SEQ ID NO: 1102223 - DNA, 22 bp, Artificial Sequence
  chemically synthesized
gctcgttttgatatctgcctcg

SEQ ID NO: 1102224 - DNA, 22 bp, Artificial Sequence
  chemically synthesized
gaatgaggtgagaccgaggcag

SEQ ID NO: 1102225 - DNA, 22 bp, Artificial Sequence
  chemically synthesized
gttttgatatctgcctcggtct

SEQ ID NO: 1102226 - DNA, 22 bp, Artificial Sequence
  chemically synthesized
tgatatctgcctcggtctcacc

SEQ ID NO: 1102227 - DNA, 22 bp, Artificial Sequence
  chemically synthesized
gatatctgcctcggtctcacct

SEQ ID NO: 1102228 - DNA, 22 bp, Artificial Sequence
  chemically synthesized
atatctgcctcggtctcacctc

SEQ ID NO: 1102229 - DNA, 22 bp, Artificial Sequence
  chemically synthesized
tagatcagtaattagaatgagg

SEQ ID NO: 1102230 - DNA, 22 bp, Artificial Sequence
  chemically synthesized
cctcggtctcacctcattctaa

SEQ ID NO: 1102231 - DNA, 22 bp, Artificial Sequence
  chemically synthesized
ggtctcacctcattctaattac

SEQ ID NO: 1102232 - DNA, 22 bp, Artificial Sequence
  chemically synthesized
gcatcactgtagatcagtaatt

SEQ ID NO: 1102233 - DNA, 22 bp, Artificial Sequence
  chemically synthesized
acctcattctaattactgatct

SEQ ID NO: 1102234 - DNA, 22 bp, Artificial Sequence
  chemically synthesized
ctggcatcactgtagatcagta

SEQ ID NO: 1102235 - DNA, 22 bp, Artificial Sequence
  chemically synthesized
attctaattactgatctacagt

SEQ ID NO: 1102236 - DNA, 22 bp, Artificial Sequence
  chemically synthesized
taattactgatctacagtgatg

SEQ ID NO: 1102237 - DNA, 22 bp, Artificial Sequence
  chemically synthesized
attactgatctacagtgatgcc

SEQ ID NO: 1102238 - DNA, 22 bp, Artificial Sequence
  chemically synthesized
ctgatctacagtgatgccagta

SEQ ID NO: 1102239 - DNA, 22 bp, Artificial Sequence
  chemically synthesized
atctacagtgatgccagtaatc

SEQ ID NO: 1102240 - DNA, 22 bp, Artificial Sequence
  chemically synthesized
cagtgatgccagtaatctcctc

SEQ ID NO: 1102241 - DNA, 22 bp, Artificial Sequence
  chemically synthesized
ccaagatgagaggaaggaggag

SEQ ID NO: 1102242 - DNA, 22 bp, Artificial Sequence
  chemically synthesized
aaaacattcccaagatgagagg

SEQ ID NO: 1102243 - DNA, 22 bp, Artificial Sequence
  chemically synthesized
ctctcctccttcctctcatctt

SEQ ID NO: 1102244 - DNA, 22 bp, Artificial Sequence
  chemically synthesized
caaaacattcccaagatgagag

SEQ ID NO: 1102245 - DNA, 22 bp, Artificial Sequence
  chemically synthesized
tcaaaacattcccaagatgaga

SEQ ID NO: 1102246 - DNA, 22 bp, Artificial Sequence
  chemically synthesized
tcctccttcctctcatcttggg

SEQ ID NO: 1102247 - DNA, 22 bp, Artificial Sequence
  chemically synthesized
ctccttcctctcatcttgggaa

SEQ ID NO: 1102248 - DNA, 22 bp, Artificial Sequence
  chemically synthesized
tgttttcaaaacattcccaaga

SEQ ID NO: 1102249 - DNA, 22 bp, Artificial Sequence
  chemically synthesized
gtgttttcaaaacattcccaag

SEQ ID NO: 1102250 - DNA, 22 bp, Artificial Sequence
  chemically synthesized
cttcctctcatcttgggaatgt

SEQ ID NO: 1102251 - DNA, 22 bp, Artificial Sequence
  chemically synthesized
cctctcatcttgggaatgtttt

SEQ ID NO: 1102252 - DNA, 22 bp, Artificial Sequence
  chemically synthesized
ctctcatcttgggaatgttttg

SEQ ID NO: 1102253 - DNA, 22 bp, Artificial Sequence
  chemically synthesized
cacttgtgttttcaaaacattc

SEQ ID NO: 1102254 - DNA, 22 bp, Artificial Sequence
  chemically synthesized
tcatcttgggaatgttttgaaa

SEQ ID NO: 1102255 - DNA, 22 bp, Artificial Sequence
  chemically synthesized
atcttgggaatgttttgaaaac

SEQ ID NO: 1102256 - DNA, 22 bp, Artificial Sequence
  chemically synthesized
gggaatgttttgaaaacacaag

SEQ ID NO: 1102257 - DNA, 22 bp, Artificial Sequence
  chemically synthesized
ggaatgttttgaaaacacaagt

SEQ ID NO: 1102258 - DNA, 22 bp, Artificial Sequence
  chemically synthesized
tgaaaacacaagtggaatcata

SEQ ID NO: 1102259 - DNA, 22 bp, Artificial Sequence
  chemically synthesized
gaaaacacaagtggaatcatat

SEQ ID NO: 1102260 - DNA, 22 bp, Artificial Sequence
  chemically synthesized
aagagggaaataatatgattcc

SEQ ID NO: 1102261 - DNA, 22 bp, Artificial Sequence
  chemically synthesized
aaaacacaagtggaatcatatt

SEQ ID NO: 1102262 - DNA, 22 bp, Artificial Sequence
  chemically synthesized
gttaaagagggaaataatatga

SEQ ID NO: 1102263 - DNA, 22 bp, Artificial Sequence
  chemically synthesized
ttggttaaagagggaaataata

SEQ ID NO: 1102264 - DNA, 22 bp, Artificial Sequence
  chemically synthesized
ctattggttaaagagggaaata

SEQ ID NO: 1102265 - DNA, 22 bp, Artificial Sequence
  chemically synthesized
tttccctctttaaccaatagca

SEQ ID NO: 1102266 - DNA, 22 bp, Artificial Sequence
  chemically synthesized
ataagaaaaaactgctattggt

SEQ ID NO: 1102267 - DNA, 22 bp, Artificial Sequence
  chemically synthesized
aataagaaaaaactgctattgg

SEQ ID NO: 1102268 - DNA, 22 bp, Artificial Sequence
  chemically synthesized
ccctctttaaccaatagcagtt

SEQ ID NO: 1102269 - DNA, 22 bp, Artificial Sequence
  chemically synthesized
cctctttaaccaatagcagttt

SEQ ID NO: 1102270 - DNA, 22 bp, Artificial Sequence
  chemically synthesized
tttaaccaatagcagttttttc

SEQ ID NO: 1102271 - DNA, 22 bp, Artificial Sequence
  chemically synthesized
taaccaatagcagttttttctt

SEQ ID NO: 1102272 - DNA, 22 bp, Artificial Sequence
  chemically synthesized
aaccaatagcagttttttctta

SEQ ID NO: 1102273 - DNA, 22 bp, Artificial Sequence
  chemically synthesized
accaatagcagttttttcttat

SEQ ID NO: 1102274 - DNA, 22 bp, Artificial Sequence
  chemically synthesized
ataataataacaataaaaactt

SEQ ID NO: 1102275 - DNA, 22 bp, Artificial Sequence
  chemically synthesized
tttcttattaagtttttattgt

SEQ ID NO: 1102276 - DNA, 22 bp, Artificial Sequence
  chemically synthesized
ttcttattaagtttttattgtt

SEQ ID NO: 1102277 - DNA, 22 bp, Artificial Sequence
  chemically synthesized
tcttattaagtttttattgtta

SEQ ID NO: 1102278 - DNA, 22 bp, Artificial Sequence
  chemically synthesized
cttattaagtttttattgttat

SEQ ID NO: 1102279 - DNA, 22 bp, Artificial Sequence
  chemically synthesized
ttattaagtttttattgttatt

SEQ ID NO: 1102280 - DNA, 22 bp, Artificial Sequence
  chemically synthesized
attaagtttttattgttattat

SEQ ID NO: 1102281 - DNA, 22 bp, Artificial Sequence
  chemically synthesized
ttaagtttttattgttattatt

SEQ ID NO: 1102282 - DNA, 22 bp, Artificial Sequence
  chemically synthesized
agtttttattgttattattatc

SEQ ID NO: 1102283 - DNA, 22 bp, Artificial Sequence
  chemically synthesized
gtggtgatgggactgataataa

SEQ ID NO: 1102284 - DNA, 22 bp, Artificial Sequence
  chemically synthesized
ttattgttattattatcagtcc

SEQ ID NO: 1102285 - DNA, 22 bp, Artificial Sequence
  chemically synthesized
tattgttattattatcagtccc

SEQ ID NO: 1102286 - DNA, 22 bp, Artificial Sequence
  chemically synthesized
attgttattattatcagtccca

SEQ ID NO: 1102287 - DNA, 22 bp, Artificial Sequence
  chemically synthesized
atctagtggtgatgggactgat

SEQ ID NO: 1102288 - DNA, 22 bp, Artificial Sequence
  chemically synthesized
ttgttattattatcagtcccat

SEQ ID NO: 1102289 - DNA, 22 bp, Artificial Sequence
  chemically synthesized
aatctagtggtgatgggactga

SEQ ID NO: 1102290 - DNA, 22 bp, Artificial Sequence
  chemically synthesized
taatctagtggtgatgggactg

SEQ ID NO: 1102291 - DNA, 22 bp, Artificial Sequence
  chemically synthesized
ttattattatcagtcccatcac

SEQ ID NO: 1102292 - DNA, 22 bp, Artificial Sequence
  chemically synthesized
ttattatcagtcccatcaccac

SEQ ID NO: 1102293 - DNA, 22 bp, Artificial Sequence
  chemically synthesized
agttttaatctagtggtgatgg

SEQ ID NO: 1102294 - DNA, 22 bp, Artificial Sequence
  chemically synthesized
ttatcagtcccatcaccactag

SEQ ID NO: 1102295 - DNA, 22 bp, Artificial Sequence
  chemically synthesized
tcagtcccatcaccactagatt

SEQ ID NO: 1102296 - DNA, 22 bp, Artificial Sequence
  chemically synthesized
caatctgagttttaatctagtg

SEQ ID NO: 1102297 - DNA, 22 bp, Artificial Sequence
  chemically synthesized
acaatctgagttttaatctagt

SEQ ID NO: 1102298 - DNA, 22 bp, Artificial Sequence
  chemically synthesized
tacaatctgagttttaatctag

SEQ ID NO: 1102299 - DNA, 22 bp, Artificial Sequence
  chemically synthesized
tgttttacaatctgagttttaa

SEQ ID NO: 1102300 - DNA, 22 bp, Artificial Sequence
  chemically synthesized
gatgctatgttttacaatctga

SEQ ID NO: 1102301 - DNA, 22 bp, Artificial Sequence
  chemically synthesized
ggatgctatgttttacaatctg

SEQ ID NO: 1102302 - DNA, 22 bp, Artificial Sequence
  chemically synthesized
gattaaaactcagattgtaaaa

SEQ ID NO: 1102303 - DNA, 22 bp, Artificial Sequence
  chemically synthesized
aaactcagattgtaaaacatag

SEQ ID NO: 1102304 - DNA, 22 bp, Artificial Sequence
  chemically synthesized
agattgtaaaacatagcatcca

SEQ ID NO: 1102305 - DNA, 22 bp, Artificial Sequence
  chemically synthesized
taaaacatagcatccaaggaca

SEQ ID NO: 1102306 - DNA, 22 bp, Artificial Sequence
  chemically synthesized
agagtagacagtgaatgtcctt

SEQ ID NO: 1102307 - DNA, 22 bp, Artificial Sequence
  chemically synthesized
gattgagagtagacagtgaatg

SEQ ID NO: 1102308 - DNA, 22 bp, Artificial Sequence
  chemically synthesized
gaaaactggattgagagtagac

SEQ ID NO: 1102309 - DNA, 22 bp, Artificial Sequence
  chemically synthesized
tggttggaaaactggattgaga

SEQ ID NO: 1102310 - DNA, 22 bp, Artificial Sequence
  chemically synthesized
actgtctactctcaatccagtt

SEQ ID NO: 1102311 - DNA, 22 bp, Artificial Sequence
  chemically synthesized
tctactctcaatccagttttcc

SEQ ID NO: 1102312 - DNA, 22 bp, Artificial Sequence
  chemically synthesized
ctctcaatccagttttccaacc

SEQ ID NO: 1102313 - DNA, 22 bp, Artificial Sequence
  chemically synthesized
ataaaatattatggttggaaaa

SEQ ID NO: 1102314 - DNA, 22 bp, Artificial Sequence
  chemically synthesized
tcaatccagttttccaaccata

SEQ ID NO: 1102315 - DNA, 22 bp, Artificial Sequence
  chemically synthesized
aatccagttttccaaccataat

SEQ ID NO: 1102316 - DNA, 22 bp, Artificial Sequence
  chemically synthesized
tccaaccataatattttattaa

SEQ ID NO: 1102317 - DNA, 22 bp, Artificial Sequence
  chemically synthesized
ccaaccataatattttattaat

SEQ ID NO: 1102318 - DNA, 22 bp, Artificial Sequence
  chemically synthesized
caaccataatattttattaatc

SEQ ID NO: 1102319 - DNA, 22 bp, Artificial Sequence
  chemically synthesized
ggtagacaatatatatggggat

SEQ ID NO: 1102320 - DNA, 22 bp, Artificial Sequence
  chemically synthesized
tattaatccccatatatattgt

SEQ ID NO: 1102321 - DNA, 22 bp, Artificial Sequence
  chemically synthesized
aacactgggtagacaatatata

SEQ ID NO: 1102322 - DNA, 22 bp, Artificial Sequence
  chemically synthesized
attaatccccatatatattgtc

SEQ ID NO: 1102323 - DNA, 22 bp, Artificial Sequence
  chemically synthesized
ttaatccccatatatattgtct

SEQ ID NO: 1102324 - DNA, 22 bp, Artificial Sequence
  chemically synthesized
atccccatatatattgtctacc

SEQ ID NO: 1102325 - DNA, 22 bp, Artificial Sequence
  chemically synthesized
aatgatataagttcaacactgg

SEQ ID NO: 1102326 - DNA, 22 bp, Artificial Sequence
  chemically synthesized
agttaaatgatataagttcaac

SEQ ID NO: 1102327 - DNA, 22 bp, Artificial Sequence
  chemically synthesized
cagttaaatgatataagttcaa

SEQ ID NO: 1102328 - DNA, 22 bp, Artificial Sequence
  chemically synthesized
tctacccagtgttgaacttata

SEQ ID NO: 1102329 - DNA, 22 bp, Artificial Sequence
  chemically synthesized
tcagttaaatgatataagttca

SEQ ID NO: 1102330 - DNA, 22 bp, Artificial Sequence
  chemically synthesized
cccagtgttgaacttatatcat

SEQ ID NO: 1102331 - DNA, 22 bp, Artificial Sequence
  chemically synthesized
aacttatatcatttaactgaaa

SEQ ID NO: 1102332 - DNA, 22 bp, Artificial Sequence
  chemically synthesized
atatcatttaactgaaaatgct

SEQ ID NO: 1102333 - DNA, 22 bp, Artificial Sequence
  chemically synthesized
agaaagcatagcagcattttca

SEQ ID NO: 1102334 - DNA, 22 bp, Artificial Sequence
  chemically synthesized
tatcatttaactgaaaatgctg

SEQ ID NO: 1102335 - DNA, 22 bp, Artificial Sequence
  chemically synthesized
gagaaagcatagcagcattttc

SEQ ID NO: 1102336 - DNA, 22 bp, Artificial Sequence
  chemically synthesized
ttgagaaagcatagcagcattt

SEQ ID NO: 1102337 - DNA, 22 bp, Artificial Sequence
  chemically synthesized
aactgaaaatgctgctatgctt

SEQ ID NO: 1102338 - DNA, 22 bp, Artificial Sequence
  chemically synthesized
actgaaaatgctgctatgcttt

SEQ ID NO: 1102339 - DNA, 22 bp, Artificial Sequence
  chemically synthesized
aaaatgctgctatgctttctca

SEQ ID NO: 1102340 - DNA, 22 bp, Artificial Sequence
  chemically synthesized
ctatgctttctcaagaactctt

SEQ ID NO: 1102341 - DNA, 22 bp, Artificial Sequence
  chemically synthesized
ataccgagaaagaaagagttct

SEQ ID NO: 1102342 - DNA, 22 bp, Artificial Sequence
  chemically synthesized
tgctttctcaagaactctttct

SEQ ID NO: 1102343 - DNA, 22 bp, Artificial Sequence
  chemically synthesized
gctaataccgagaaagaaagag

SEQ ID NO: 1102344 - DNA, 22 bp, Artificial Sequence
  chemically synthesized
tctcaagaactctttctttctc

SEQ ID NO: 1102345 - DNA, 22 bp, Artificial Sequence
  chemically synthesized
ctcaagaactctttctttctcg

SEQ ID NO: 1102346 - DNA, 22 bp, Artificial Sequence
  chemically synthesized
gttagctaataccgagaaagaa

SEQ ID NO: 1102347 - DNA, 22 bp, Artificial Sequence
  chemically synthesized
tcaagaactctttctttctcgg

SEQ ID NO: 1102348 - DNA, 22 bp, Artificial Sequence
  chemically synthesized
agttagctaataccgagaaaga

SEQ ID NO: 1102349 - DNA, 22 bp, Artificial Sequence
  chemically synthesized
aagaactctttctttctcggta

SEQ ID NO: 1102350 - DNA, 22 bp, Artificial Sequence
  chemically synthesized
tttctttctcggtattagctaa

SEQ ID NO: 1102351 - DNA, 22 bp, Artificial Sequence
  chemically synthesized
tctttctcggtattagctaact

SEQ ID NO: 1102352 - DNA, 22 bp, Artificial Sequence
  chemically synthesized
ctttctcggtattagctaacta

SEQ ID NO: 1102353 - DNA, 22 bp, Artificial Sequence
  chemically synthesized
tttctcggtattagctaactaa

SEQ ID NO: 1102354 - DNA, 22 bp, Artificial Sequence
  chemically synthesized
aataggtagaatttagttagct

SEQ ID NO: 1102355 - DNA, 22 bp, Artificial Sequence
  chemically synthesized
tctcggtattagctaactaaat

SEQ ID NO: 1102356 - DNA, 22 bp, Artificial Sequence
  chemically synthesized
ctcggtattagctaactaaatt

SEQ ID NO: 1102357 - DNA, 22 bp, Artificial Sequence
  chemically synthesized
tcggtattagctaactaaattc

SEQ ID NO: 1102358 - DNA, 22 bp, Artificial Sequence
  chemically synthesized
ggtattagctaactaaattcta

SEQ ID NO: 1102359 - DNA, 22 bp, Artificial Sequence
  chemically synthesized
tagattaaataggtagaattta

SEQ ID NO: 1102360 - DNA, 22 bp, Artificial Sequence
  chemically synthesized
ctatagattaaataggtagaat

SEQ ID NO: 1102361 - DNA, 22 bp, Artificial Sequence
  chemically synthesized
tgctatagattaaataggtaga

SEQ ID NO: 1102362 - DNA, 22 bp, Artificial Sequence
  chemically synthesized
gctaactaaattctacctattt

SEQ ID NO: 1102363 - DNA, 22 bp, Artificial Sequence
  chemically synthesized
tctctgctatagattaaatagg

SEQ ID NO: 1102364 - DNA, 22 bp, Artificial Sequence
  chemically synthesized
actaaattctacctatttaatc

SEQ ID NO: 1102365 - DNA, 22 bp, Artificial Sequence
  chemically synthesized
aattctacctatttaatctata

SEQ ID NO: 1102366 - DNA, 22 bp, Artificial Sequence
  chemically synthesized
tacctatttaatctatagcaga

SEQ ID NO: 1102367 - DNA, 22 bp, Artificial Sequence
  chemically synthesized
cctatttaatctatagcagaga

SEQ ID NO: 1102368 - DNA, 22 bp, Artificial Sequence
  chemically synthesized
tcggaacataggttgtctctgc

SEQ ID NO: 1102369 - DNA, 22 bp, Artificial Sequence
  chemically synthesized
tttaatctatagcagagacaac

SEQ ID NO: 1102370 - DNA, 22 bp, Artificial Sequence
  chemically synthesized
aatctatagcagagacaaccta

SEQ ID NO: 1102371 - DNA, 22 bp, Artificial Sequence
  chemically synthesized
atctatagcagagacaacctat

SEQ ID NO: 1102372 - DNA, 22 bp, Artificial Sequence
  chemically synthesized
tagcagagacaacctatgttcc

SEQ ID NO: 1102373 - DNA, 22 bp, Artificial Sequence
  chemically synthesized
tgaaatattatcggaacatagg

SEQ ID NO: 1102374 - DNA, 22 bp, Artificial Sequence
  chemically synthesized
ggaaaaaggattatgaaatatt

SEQ ID NO: 1102375 - DNA, 22 bp, Artificial Sequence
  chemically synthesized
tgttccgataatatttcataat

SEQ ID NO: 1102376 - DNA, 22 bp, Artificial Sequence
  chemically synthesized
cgataatatttcataatccttt

SEQ ID NO: 1102377 - DNA, 22 bp, Artificial Sequence
  chemically synthesized
cataatcctttttcctagttta

SEQ ID NO: 1102378 - DNA, 22 bp, Artificial Sequence
  chemically synthesized
ataatcctttttcctagtttat

SEQ ID NO: 1102379 - DNA, 22 bp, Artificial Sequence
  chemically synthesized
tttcctagtttatgttggattt

SEQ ID NO: 1102380 - DNA, 22 bp, Artificial Sequence
  chemically synthesized
ttcctagtttatgttggatttc

SEQ ID NO: 1102381 - DNA, 22 bp, Artificial Sequence
  chemically synthesized
tcctagtttatgttggatttcc

SEQ ID NO: 1102382 - DNA, 22 bp, Artificial Sequence
  chemically synthesized
cctagtttatgttggatttcct

SEQ ID NO: 1102383 - DNA, 22 bp, Artificial Sequence
  chemically synthesized
ctagtttatgttggatttcctt

SEQ ID NO: 1102384 - DNA, 22 bp, Artificial Sequence
  chemically synthesized
tcacagtaggcaggaaggaaat

SEQ ID NO: 1102385 - DNA, 22 bp, Artificial Sequence
  chemically synthesized
gtttatgttggatttccttcct

SEQ ID NO: 1102386 - DNA, 22 bp, Artificial Sequence
  chemically synthesized
atgttggatttccttcctgcct

SEQ ID NO: 1102387 - DNA, 22 bp, Artificial Sequence
  chemically synthesized
tgttggatttccttcctgccta

SEQ ID NO: 1102388 - DNA, 22 bp, Artificial Sequence
  chemically synthesized
gatttccttcctgcctactgtg

SEQ ID NO: 1102389 - DNA, 22 bp, Artificial Sequence
  chemically synthesized
ccttcctgcctactgtgacaac

SEQ ID NO: 1102390 - DNA, 22 bp, Artificial Sequence
  chemically synthesized
cttcctgcctactgtgacaacc

SEQ ID NO: 1102391 - DNA, 22 bp, Artificial Sequence
  chemically synthesized
aacagtatgggaaaggttgtca

SEQ ID NO: 1102392 - DNA, 22 bp, Artificial Sequence
  chemically synthesized
cctgcctactgtgacaaccttt

SEQ ID NO: 1102393 - DNA, 22 bp, Artificial Sequence
  chemically synthesized
ctgcctactgtgacaacctttc

SEQ ID NO: 1102394 - DNA, 22 bp, Artificial Sequence
  chemically synthesized
cctactgtgacaacctttccca

SEQ ID NO: 1102395 - DNA, 22 bp, Artificial Sequence
  chemically synthesized
ctgtgacaacctttcccatact

SEQ ID NO: 1102396 - DNA, 22 bp, Artificial Sequence
  chemically synthesized
tgacaacctttcccatactgtt

SEQ ID NO: 1102397 - DNA, 22 bp, Artificial Sequence
  chemically synthesized
catggtaaataaattaaacagt

SEQ ID NO: 1102398 - DNA, 22 bp, Artificial Sequence
  chemically synthesized
gcatggtaaataaattaaacag

SEQ ID NO: 1102399 - DNA, 22 bp, Artificial Sequence
  chemically synthesized
tcccatactgtttaatttattt

SEQ ID NO: 1102400 - DNA, 22 bp, Artificial Sequence
  chemically synthesized
cccatactgtttaatttattta

SEQ ID NO: 1102401 - DNA, 22 bp, Artificial Sequence
  chemically synthesized
agccttgcatggtaaataaatt

SEQ ID NO: 1102402 - DNA, 22 bp, Artificial Sequence
  chemically synthesized
ccatactgtttaatttatttac

SEQ ID NO: 1102403 - DNA, 22 bp, Artificial Sequence
  chemically synthesized
ttcagccttgcatggtaaataa

SEQ ID NO: 1102404 - DNA, 22 bp, Artificial Sequence
  chemically synthesized
tttaatttatttaccatgcaag

SEQ ID NO: 1102405 - DNA, 22 bp, Artificial Sequence
  chemically synthesized
aatttatttaccatgcaaggct

SEQ ID NO: 1102406 - DNA, 22 bp, Artificial Sequence
  chemically synthesized
atttatttaccatgcaaggctg

SEQ ID NO: 1102407 - DNA, 22 bp, Artificial Sequence
  chemically synthesized
ggggtagcattattcagccttg

SEQ ID NO: 1102408 - DNA, 22 bp, Artificial Sequence
  chemically synthesized
gggggtagcattattcagcctt

SEQ ID NO: 1102409 - DNA, 22 bp, Artificial Sequence
  chemically synthesized
atttaccatgcaaggctgaata

SEQ ID NO: 1102410 - DNA, 22 bp, Artificial Sequence
  chemically synthesized
tttaccatgcaaggctgaataa

SEQ ID NO: 1102411 - DNA, 22 bp, Artificial Sequence
  chemically synthesized
accatgcaaggctgaataatgc

SEQ ID NO: 1102412 - DNA, 22 bp, Artificial Sequence
  chemically synthesized
ccatgcaaggctgaataatgct

SEQ ID NO: 1102413 - DNA, 22 bp, Artificial Sequence
  chemically synthesized
gggtgaggacatcttgggggta

SEQ ID NO: 1102414 - DNA, 22 bp, Artificial Sequence
  chemically synthesized
aataatgctacccccaagatgt

SEQ ID NO: 1102415 - DNA, 22 bp, Artificial Sequence
  chemically synthesized
agagattagggtgaggacatct

SEQ ID NO: 1102416 - DNA, 22 bp, Artificial Sequence
  chemically synthesized
cagagattagggtgaggacatc

SEQ ID NO: 1102417 - DNA, 22 bp, Artificial Sequence
  chemically synthesized
cccccaagatgtcctcacccta

SEQ ID NO: 1102418 - DNA, 22 bp, Artificial Sequence
  chemically synthesized
acaggtttcagagattagggtg

SEQ ID NO: 1102419 - DNA, 22 bp, Artificial Sequence
  chemically synthesized
gtaatatactcacaggtttcag

SEQ ID NO: 1102420 - DNA, 22 bp, Artificial Sequence
  chemically synthesized
accctaatctctgaaacctgtg

SEQ ID NO: 1102421 - DNA, 22 bp, Artificial Sequence
  chemically synthesized
tggtaatatactcacaggtttc

SEQ ID NO: 1102422 - DNA, 22 bp, Artificial Sequence
  chemically synthesized
ctggtaatatactcacaggttt

SEQ ID NO: 1102423 - DNA, 22 bp, Artificial Sequence
  chemically synthesized
tctggtaatatactcacaggtt

SEQ ID NO: 1102424 - DNA, 22 bp, Artificial Sequence
  chemically synthesized
atctctgaaacctgtgagtata

SEQ ID NO: 1102425 - DNA, 22 bp, Artificial Sequence
  chemically synthesized
tgaaacctgtgagtatattacc

SEQ ID NO: 1102426 - DNA, 22 bp, Artificial Sequence
  chemically synthesized
caaagtcctttctggtaatata

SEQ ID NO: 1102427 - DNA, 22 bp, Artificial Sequence
  chemically synthesized
aaacctgtgagtatattaccag

SEQ ID NO: 1102428 - DNA, 22 bp, Artificial Sequence
  chemically synthesized
tgagtatattaccagaaaggac

SEQ ID NO: 1102429 - DNA, 22 bp, Artificial Sequence
  chemically synthesized
atgtaatcacatctgcaaagtc

SEQ ID NO: 1102430 - DNA, 22 bp, Artificial Sequence
  chemically synthesized
aatgtaatcacatctgcaaagt

SEQ ID NO: 1102431 - DNA, 22 bp, Artificial Sequence
  chemically synthesized
ccagaaaggactttgcagatgt

SEQ ID NO: 1102432 - DNA, 22 bp, Artificial Sequence
  chemically synthesized
agaatccttaatgtaatcacat

SEQ ID NO: 1102433 - DNA, 22 bp, Artificial Sequence
  chemically synthesized
tgcagatgtgattacattaagg

SEQ ID NO: 1102434 - DNA, 22 bp, Artificial Sequence
  chemically synthesized
gcagatgtgattacattaagga

SEQ ID NO: 1102435 - DNA, 22 bp, Artificial Sequence
  chemically synthesized
cccatctcagaatccttaatgt

SEQ ID NO: 1102436 - DNA, 22 bp, Artificial Sequence
  chemically synthesized
cagatgtgattacattaaggat

SEQ ID NO: 1102437 - DNA, 22 bp, Artificial Sequence
  chemically synthesized
cattaaggattctgagatgggg

SEQ ID NO: 1102438 - DNA, 22 bp, Artificial Sequence
  chemically synthesized
aggattctgagatggggagatt

SEQ ID NO: 1102439 - DNA, 22 bp, Artificial Sequence
  chemically synthesized
gtggatgatccagtataatctc

SEQ ID NO: 1102440 - DNA, 22 bp, Artificial Sequence
  chemically synthesized
tgagatggggagattatactgg

SEQ ID NO: 1102441 - DNA, 22 bp, Artificial Sequence
  chemically synthesized
agatggggagattatactggat

SEQ ID NO: 1102442 - DNA, 22 bp, Artificial Sequence
  chemically synthesized
tgccctggtggatgatccagta

SEQ ID NO: 1102443 - DNA, 22 bp, Artificial Sequence
  chemically synthesized
cattatgccctggtggatgatc

SEQ ID NO: 1102444 - DNA, 22 bp, Artificial Sequence
  chemically synthesized
tgattacattatgccctggtgg

SEQ ID NO: 1102445 - DNA, 22 bp, Artificial Sequence
  chemically synthesized
tactggatcatccaccagggca

SEQ ID NO: 1102446 - DNA, 22 bp, Artificial Sequence
  chemically synthesized
gtgattacattatgccctggtg

SEQ ID NO: 1102447 - DNA, 22 bp, Artificial Sequence
  chemically synthesized
tgtgattacattatgccctggt

SEQ ID NO: 1102448 - DNA, 22 bp, Artificial Sequence
  chemically synthesized
gatcatccaccagggcataatg

SEQ ID NO: 1102449 - DNA, 22 bp, Artificial Sequence
  chemically synthesized
ggacctttgtgattacattatg

SEQ ID NO: 1102450 - DNA, 22 bp, Artificial Sequence
  chemically synthesized
attaggacctttgtgattacat

SEQ ID NO: 1102451 - DNA, 22 bp, Artificial Sequence
  chemically synthesized
aattaggacctttgtgattaca

SEQ ID NO: 1102452 - DNA, 22 bp, Artificial Sequence
  chemically synthesized
taattaggacctttgtgattac

SEQ ID NO: 1102453 - DNA, 22 bp, Artificial Sequence
  chemically synthesized
ttaattaggacctttgtgatta

SEQ ID NO: 1102454 - DNA, 22 bp, Artificial Sequence
  chemically synthesized
cttttaattaggacctttgtga

SEQ ID NO: 1102455 - DNA, 22 bp, Artificial Sequence
  chemically synthesized
ccttttaattaggacctttgtg

SEQ ID NO: 1102456 - DNA, 22 bp, Artificial Sequence
  chemically synthesized
acttccttttaattaggacctt

SEQ ID NO: 1102457 - DNA, 22 bp, Artificial Sequence
  chemically synthesized
tgttgacttccttttaattagg

SEQ ID NO: 1102458 - DNA, 22 bp, Artificial Sequence
  chemically synthesized
cctgtgttgacttccttttaat

SEQ ID NO: 1102459 - DNA, 22 bp, Artificial Sequence
  chemically synthesized
ttccctgtgttgacttcctttt

SEQ ID NO: 1102460 - DNA, 22 bp, Artificial Sequence
  chemically synthesized
tcctgttccctgtgttgacttc

SEQ ID NO: 1102461 - DNA, 22 bp, Artificial Sequence
  chemically synthesized
attaaaaggaagtcaacacagg

SEQ ID NO: 1102462 - DNA, 22 bp, Artificial Sequence
  chemically synthesized
cctatcctgttccctgtgttga

SEQ ID NO: 1102463 - DNA, 22 bp, Artificial Sequence
  chemically synthesized
ccctatcctgttccctgtgttg

SEQ ID NO: 1102464 - DNA, 22 bp, Artificial Sequence
  chemically synthesized
tccctatcctgttccctgtgtt

SEQ ID NO: 1102465 - DNA, 22 bp, Artificial Sequence
  chemically synthesized
aaaggaagtcaacacagggaac

SEQ ID NO: 1102466 - DNA, 22 bp, Artificial Sequence
  chemically synthesized
ctttccctatcctgttccctgt

SEQ ID NO: 1102467 - DNA, 22 bp, Artificial Sequence
  chemically synthesized
cctttccctatcctgttccctg

SEQ ID NO: 1102468 - DNA, 22 bp, Artificial Sequence
  chemically synthesized
accttcctttccctatcctgtt

SEQ ID NO: 1102469 - DNA, 22 bp, Artificial Sequence
  chemically synthesized
tcaccttcctttccctatcctg

SEQ ID NO: 1102470 - DNA, 22 bp, Artificial Sequence
  chemically synthesized
ctcaccttcctttccctatcct

SEQ ID NO: 1102471 - DNA, 22 bp, Artificial Sequence
  chemically synthesized
cttctcaccttcctttccctat

SEQ ID NO: 1102472 - DNA, 22 bp, Artificial Sequence
  chemically synthesized
tccttctcaccttcctttccct

SEQ ID NO: 1102473 - DNA, 22 bp, Artificial Sequence
  chemically synthesized
cctctccttctcaccttccttt

SEQ ID NO: 1102474 - DNA, 22 bp, Artificial Sequence
  chemically synthesized
tacctctccttctcaccttcct

SEQ ID NO: 1102475 - DNA, 22 bp, Artificial Sequence
  chemically synthesized
ctacctctccttctcaccttcc

SEQ ID NO: 1102476 - DNA, 22 bp, Artificial Sequence
  chemically synthesized
tctacctctccttctcaccttc

SEQ ID NO: 1102477 - DNA, 22 bp, Artificial Sequence
  chemically synthesized
tttctacctctccttctcacct

SEQ ID NO: 1102478 - DNA, 22 bp, Artificial Sequence
  chemically synthesized
tctttctacctctccttctcac

SEQ ID NO: 1102479 - DNA, 22 bp, Artificial Sequence
  chemically synthesized
cctctctttctacctctccttc

SEQ ID NO: 1102480 - DNA, 22 bp, Artificial Sequence
  chemically synthesized
tccctctctttctacctctcct

SEQ ID NO: 1102481 - DNA, 22 bp, Artificial Sequence
  chemically synthesized
cctctccctctctttctacctc

SEQ ID NO: 1102482 - DNA, 22 bp, Artificial Sequence
  chemically synthesized
tctccctctccctctctttcta

SEQ ID NO: 1102483 - DNA, 22 bp, Artificial Sequence
  chemically synthesized
tctatctccctctccctctctt

SEQ ID NO: 1102484 - DNA, 22 bp, Artificial Sequence
  chemically synthesized
cctgtctatctccctctccctc

SEQ ID NO: 1102485 - DNA, 22 bp, Artificial Sequence
  chemically synthesized
tccctgtctatctccctctccc

SEQ ID NO: 1102486 - DNA, 22 bp, Artificial Sequence
  chemically synthesized
tctccctgtctatctccctctc

SEQ ID NO: 1102487 - DNA, 22 bp, Artificial Sequence
  chemically synthesized
tctctccctgtctatctccctc

SEQ ID NO: 1102488 - DNA, 22 bp, Artificial Sequence
  chemically synthesized
ctctctccctgtctatctccct

SEQ ID NO: 1102489 - DNA, 22 bp, Artificial Sequence
  chemically synthesized
gtgtcaatttctctctccctgt

SEQ ID NO: 1102490 - DNA, 22 bp, Artificial Sequence
  chemically synthesized
aaagtcagcagtgtaacatcat

SEQ ID NO: 1102491 - DNA, 22 bp, Artificial Sequence
  chemically synthesized
caaagtcagcagtgtaacatca

SEQ ID NO: 1102492 - DNA, 22 bp, Artificial Sequence
  chemically synthesized
acactagatgatgttacactgc

SEQ ID NO: 1102493 - DNA, 22 bp, Artificial Sequence
  chemically synthesized
catcttcaaagtcagcagtgta

SEQ ID NO: 1102494 - DNA, 22 bp, Artificial Sequence
  chemically synthesized
gatgatgttacactgctgactt

SEQ ID NO: 1102495 - DNA, 22 bp, Artificial Sequence
  chemically synthesized
cactgctgactttgaagatgga

SEQ ID NO: 1102496 - DNA, 22 bp, Artificial Sequence
  chemically synthesized
atgtccccatcctccatcttca

SEQ ID NO: 1102497 - DNA, 22 bp, Artificial Sequence
  chemically synthesized
tctcatgtccccatcctccatc

SEQ ID NO: 1102498 - DNA, 22 bp, Artificial Sequence
  chemically synthesized
ctgactttgaagatggaggatg

SEQ ID NO: 1102499 - DNA, 22 bp, Artificial Sequence
  chemically synthesized
gtctcatgtccccatcctccat

SEQ ID NO: 1102500 - DNA, 22 bp, Artificial Sequence
  chemically synthesized
actttgaagatggaggatgggg

SEQ ID NO: 1102501 - DNA, 22 bp, Artificial Sequence
  chemically synthesized
cttgtctcatgtccccatcctc

SEQ ID NO: 1102502 - DNA, 22 bp, Artificial Sequence
  chemically synthesized
tgaagatggaggatggggacat

SEQ ID NO: 1102503 - DNA, 22 bp, Artificial Sequence
  chemically synthesized
gaagatggaggatggggacatg

SEQ ID NO: 1102504 - DNA, 22 bp, Artificial Sequence
  chemically synthesized
aagatggaggatggggacatga

SEQ ID NO: 1102505 - DNA, 22 bp, Artificial Sequence
  chemically synthesized
gaagcattccttgtctcatgtc

SEQ ID NO: 1102506 - DNA, 22 bp, Artificial Sequence
  chemically synthesized
tagaagcattccttgtctcatg

SEQ ID NO: 1102507 - DNA, 22 bp, Artificial Sequence
  chemically synthesized
ctagaagcattccttgtctcat

SEQ ID NO: 1102508 - DNA, 22 bp, Artificial Sequence
  chemically synthesized
gcttctagaagcattccttgtc

SEQ ID NO: 1102509 - DNA, 22 bp, Artificial Sequence
  chemically synthesized
agcttctagaagcattccttgt

SEQ ID NO: 1102510 - DNA, 22 bp, Artificial Sequence
  chemically synthesized
tagcttctagaagcattccttg

SEQ ID NO: 1102511 - DNA, 22 bp, Artificial Sequence
  chemically synthesized
ttagcttctagaagcattcctt

SEQ ID NO: 1102512 - DNA, 22 bp, Artificial Sequence
  chemically synthesized
gcatttttagcttctagaagca

SEQ ID NO: 1102513 - DNA, 22 bp, Artificial Sequence
  chemically synthesized
ttggcatttttagcttctagaa

SEQ ID NO: 1102514 - DNA, 22 bp, Artificial Sequence
  chemically synthesized
attggcatttttagcttctaga

SEQ ID NO: 1102515 - DNA, 22 bp, Artificial Sequence
  chemically synthesized
tattggcatttttagcttctag

SEQ ID NO: 1102516 - DNA, 22 bp, Artificial Sequence
  chemically synthesized
ttttattggcatttttagcttc

SEQ ID NO: 1102517 - DNA, 22 bp, Artificial Sequence
  chemically synthesized
ctagaagctaaaaatgccaata

SEQ ID NO: 1102518 - DNA, 22 bp, Artificial Sequence
  chemically synthesized
tagaagctaaaaatgccaataa

SEQ ID NO: 1102519 - DNA, 22 bp, Artificial Sequence
  chemically synthesized
gaagctaaaaatgccaataaaa

SEQ ID NO: 1102520 - DNA, 22 bp, Artificial Sequence
  chemically synthesized
cgacagagtctgttttattggc

SEQ ID NO: 1102521 - DNA, 22 bp, Artificial Sequence
  chemically synthesized
gcgacagagtctgttttattgg

SEQ ID NO: 1102522 - DNA, 22 bp, Artificial Sequence
  chemically synthesized
tgcgacagagtctgttttattg

SEQ ID NO: 1102523 - DNA, 22 bp, Artificial Sequence
  chemically synthesized
aaaatgccaataaaacagactc

SEQ ID NO: 1102524 - DNA, 22 bp, Artificial Sequence
  chemically synthesized
gaggctttgcgacagagtctgt

SEQ ID NO: 1102525 - DNA, 22 bp, Artificial Sequence
  chemically synthesized
ggaggctttgcgacagagtctg

SEQ ID NO: 1102526 - DNA, 22 bp, Artificial Sequence
  chemically synthesized
tggaggctttgcgacagagtct

SEQ ID NO: 1102527 - DNA, 22 bp, Artificial Sequence
  chemically synthesized
ttttggaggctttgcgacagag

SEQ ID NO: 1102528 - DNA, 22 bp, Artificial Sequence
  chemically synthesized
tctgttttggaggctttgcgac

SEQ ID NO: 1102529 - DNA, 22 bp, Artificial Sequence
  chemically synthesized
gtctgttttggaggctttgcga

SEQ ID NO: 1102530 - DNA, 22 bp, Artificial Sequence
  chemically synthesized
tgtctgttttggaggctttgcg

SEQ ID NO: 1102531 - DNA, 22 bp, Artificial Sequence
  chemically synthesized
tgtcgcaaagcctccaaaacag

SEQ ID NO: 1102532 - DNA, 22 bp, Artificial Sequence
  chemically synthesized
tcgcaaagcctccaaaacagac

SEQ ID NO: 1102533 - DNA, 22 bp, Artificial Sequence
  chemically synthesized
aggtgtcagcaggactttgtct

SEQ ID NO: 1102534 - DNA, 22 bp, Artificial Sequence
  chemically synthesized
caaaacagacaaagtcctgctg

SEQ ID NO: 1102535 - DNA, 22 bp, Artificial Sequence
  chemically synthesized
aaattaaggtgtcagcaggact

SEQ ID NO: 1102536 - DNA, 22 bp, Artificial Sequence
  chemically synthesized
agtgggctaaaattaaggtgtc

SEQ ID NO: 1102537 - DNA, 22 bp, Artificial Sequence
  chemically synthesized
gtctcagtgggctaaaattaag

SEQ ID NO: 1102538 - DNA, 22 bp, Artificial Sequence
  chemically synthesized
ctgacaccttaattttagccca

SEQ ID NO: 1102539 - DNA, 22 bp, Artificial Sequence
  chemically synthesized
aggattagtctcagtgggctaa

SEQ ID NO: 1102540 - DNA, 22 bp, Artificial Sequence
  chemically synthesized
acaccttaattttagcccactg

SEQ ID NO: 1102541 - DNA, 22 bp, Artificial Sequence
  chemically synthesized
aattttagcccactgagactaa

SEQ ID NO: 1102542 - DNA, 22 bp, Artificial Sequence
  chemically synthesized
attttagcccactgagactaat

SEQ ID NO: 1102543 - DNA, 22 bp, Artificial Sequence
  chemically synthesized
tagcccactgagactaatcctg

SEQ ID NO: 1102544 - DNA, 22 bp, Artificial Sequence
  chemically synthesized
agcccactgagactaatcctga

SEQ ID NO: 1102545 - DNA, 22 bp, Artificial Sequence
  chemically synthesized
gaagtcaaaagttcaggattag

SEQ ID NO: 1102546 - DNA, 22 bp, Artificial Sequence
  chemically synthesized
gcccactgagactaatcctgaa

SEQ ID NO: 1102547 - DNA, 22 bp, Artificial Sequence
  chemically synthesized
tggaagtcaaaagttcaggatt

SEQ ID NO: 1102548 - DNA, 22 bp, Artificial Sequence
  chemically synthesized
gagttctggaagtcaaaagttc

SEQ ID NO: 1102549 - DNA, 22 bp, Artificial Sequence
  chemically synthesized
agactaatcctgaacttttgac

SEQ ID NO: 1102550 - DNA, 22 bp, Artificial Sequence
  chemically synthesized
ttagagttctggaagtcaaaag

SEQ ID NO: 1102551 - DNA, 22 bp, Artificial Sequence
  chemically synthesized
attagagttctggaagtcaaaa

SEQ ID NO: 1102552 - DNA, 22 bp, Artificial Sequence
  chemically synthesized
atcctgaacttttgacttccag

SEQ ID NO: 1102553 - DNA, 22 bp, Artificial Sequence
  chemically synthesized
aacttttgacttccagaactct

SEQ ID NO: 1102554 - DNA, 22 bp, Artificial Sequence
  chemically synthesized
ttgacttccagaactctaataa

SEQ ID NO: 1102555 - DNA, 22 bp, Artificial Sequence
  chemically synthesized
tgacttccagaactctaataaa

SEQ ID NO: 1102556 - DNA, 22 bp, Artificial Sequence
  chemically synthesized
aagcaacacaaatttattagag

SEQ ID NO: 1102557 - DNA, 22 bp, Artificial Sequence
  chemically synthesized
gacttccagaactctaataaat

SEQ ID NO: 1102558 - DNA, 22 bp, Artificial Sequence
  chemically synthesized
caagcaacacaaatttattaga

SEQ ID NO: 1102559 - DNA, 22 bp, Artificial Sequence
  chemically synthesized
acttccagaactctaataaatt

SEQ ID NO: 1102560 - DNA, 22 bp, Artificial Sequence
  chemically synthesized
ccagaactctaataaatttgtg

SEQ ID NO: 1102561 - DNA, 22 bp, Artificial Sequence
  chemically synthesized
cagaactctaataaatttgtgt

SEQ ID NO: 1102562 - DNA, 22 bp, Artificial Sequence
  chemically synthesized
ataacttcaagcaacacaaatt

SEQ ID NO: 1102563 - DNA, 22 bp, Artificial Sequence
  chemically synthesized
aataacttcaagcaacacaaat

SEQ ID NO: 1102564 - DNA, 22 bp, Artificial Sequence
  chemically synthesized
taataaatttgtgttgcttgaa

SEQ ID NO: 1102565 - DNA, 22 bp, Artificial Sequence
  chemically synthesized
ataaatttgtgttgcttgaagt

SEQ ID NO: 1102566 - DNA, 22 bp, Artificial Sequence
  chemically synthesized
ccggaaatttaataacttcaag

SEQ ID NO: 1102567 - DNA, 22 bp, Artificial Sequence
  chemically synthesized
gtgttgcttgaagttattaaat

SEQ ID NO: 1102568 - DNA, 22 bp, Artificial Sequence
  chemically synthesized
tgttgcttgaagttattaaatt

SEQ ID NO: 1102569 - DNA, 22 bp, Artificial Sequence
  chemically synthesized
acaaattgccggaaatttaata

SEQ ID NO: 1102570 - DNA, 22 bp, Artificial Sequence
  chemically synthesized
ctaacaaattgccggaaattta

SEQ ID NO: 1102571 - DNA, 22 bp, Artificial Sequence
  chemically synthesized
cttgaagttattaaatttccgg

SEQ ID NO: 1102572 - DNA, 22 bp, Artificial Sequence
  chemically synthesized
gaagttattaaatttccggcaa

SEQ ID NO: 1102573 - DNA, 22 bp, Artificial Sequence
  chemically synthesized
aagttattaaatttccggcaat

SEQ ID NO: 1102574 - DNA, 22 bp, Artificial Sequence
  chemically synthesized
tggcactcctaacaaattgccg

SEQ ID NO: 1102575 - DNA, 22 bp, Artificial Sequence
  chemically synthesized
ttaaatttccggcaatttgtta

SEQ ID NO: 1102576 - DNA, 22 bp, Artificial Sequence
  chemically synthesized
ctatggcactcctaacaaattg

SEQ ID NO: 1102577 - DNA, 22 bp, Artificial Sequence
  chemically synthesized
cctatggcactcctaacaaatt

SEQ ID NO: 1102578 - DNA, 22 bp, Artificial Sequence
  chemically synthesized
aatttccggcaatttgttagga

SEQ ID NO: 1102579 - DNA, 22 bp, Artificial Sequence
  chemically synthesized
atttcctatggcactcctaaca

SEQ ID NO: 1102580 - DNA, 22 bp, Artificial Sequence
  chemically synthesized
ccggcaatttgttaggagtgcc

SEQ ID NO: 1102581 - DNA, 22 bp, Artificial Sequence
  chemically synthesized
cggcaatttgttaggagtgcca

SEQ ID NO: 1102582 - DNA, 22 bp, Artificial Sequence
  chemically synthesized
gttaggagtgccataggaaatg

SEQ ID NO: 1102583 - DNA, 22 bp, Artificial Sequence
  chemically synthesized
ttaggagtgccataggaaatga

SEQ ID NO: 1102584 - DNA, 22 bp, Artificial Sequence
  chemically synthesized
ggagtgccataggaaatgaata

SEQ ID NO: 1102585 - DNA, 22 bp, Artificial Sequence
  chemically synthesized
gtgaaggaggaaggtaggtgta

SEQ ID NO: 1102586 - DNA, 22 bp, Artificial Sequence
  chemically synthesized
tagtgaaggaggaaggtaggtg

SEQ ID NO: 1102587 - DNA, 22 bp, Artificial Sequence
  chemically synthesized
tcaaggagcccacattctagtg

SEQ ID NO: 1102588 - DNA, 22 bp, Artificial Sequence
  chemically synthesized
ccttcctccttcactagaatgt

SEQ ID NO: 1102589 - DNA, 22 bp, Artificial Sequence
  chemically synthesized
ttatcaaggagcccacattcta

SEQ ID NO: 1102590 - DNA, 22 bp, Artificial Sequence
  chemically synthesized
gttatcaaggagcccacattct

SEQ ID NO: 1102591 - DNA, 22 bp, Artificial Sequence
  chemically synthesized
cctccttcactagaatgtgggc

SEQ ID NO: 1102592 - DNA, 22 bp, Artificial Sequence
  chemically synthesized
ctccttcactagaatgtgggct

SEQ ID NO: 1102593 - DNA, 22 bp, Artificial Sequence
  chemically synthesized
ttgttatcaaggagcccacatt

SEQ ID NO: 1102594 - DNA, 22 bp, Artificial Sequence
  chemically synthesized
cttcactagaatgtgggctcct

SEQ ID NO: 1102595 - DNA, 22 bp, Artificial Sequence
  chemically synthesized
cactagaatgtgggctccttga

SEQ ID NO: 1102596 - DNA, 22 bp, Artificial Sequence
  chemically synthesized
actagaatgtgggctccttgat

SEQ ID NO: 1102597 - DNA, 22 bp, Artificial Sequence
  chemically synthesized
catggctcttgttatcaaggag

SEQ ID NO: 1102598 - DNA, 22 bp, Artificial Sequence
  chemically synthesized
gaatgtgggctccttgataaca

SEQ ID NO: 1102599 - DNA, 22 bp, Artificial Sequence
  chemically synthesized
agagggcacaattacatggctc

SEQ ID NO: 1102600 - DNA, 22 bp, Artificial Sequence
  chemically synthesized
cttgataacaagagccatgtaa

SEQ ID NO: 1102601 - DNA, 22 bp, Artificial Sequence
  chemically synthesized
gataacaagagccatgtaattg

SEQ ID NO: 1102602 - DNA, 22 bp, Artificial Sequence
  chemically synthesized
ataacaagagccatgtaattgt

SEQ ID NO: 1102603 - DNA, 22 bp, Artificial Sequence
  chemically synthesized
tcaagaccagtggcctaagagg

SEQ ID NO: 1102604 - DNA, 22 bp, Artificial Sequence
  chemically synthesized
gtcaagaccagtggcctaagag

SEQ ID NO: 1102605 - DNA, 22 bp, Artificial Sequence
  chemically synthesized
tttgtcaagaccagtggcctaa

SEQ ID NO: 1102606 - DNA, 22 bp, Artificial Sequence
  chemically synthesized
ttatttgtcaagaccagtggcc

SEQ ID NO: 1102607 - DNA, 22 bp, Artificial Sequence
  chemically synthesized
tgccctcttaggccactggtct

SEQ ID NO: 1102608 - DNA, 22 bp, Artificial Sequence
  chemically synthesized
ttaggccactggtcttgacaaa

SEQ ID NO: 1102609 - DNA, 22 bp, Artificial Sequence
  chemically synthesized
aggccactggtcttgacaaata

SEQ ID NO: 1102610 - DNA, 22 bp, Artificial Sequence
  chemically synthesized
ggccactggtcttgacaaataa

SEQ ID NO: 1102611 - DNA, 22 bp, Artificial Sequence
  chemically synthesized
catgaaaatatctattatttgt

SEQ ID NO: 1102612 - DNA, 22 bp, Artificial Sequence
  chemically synthesized
gtcttgacaaataatagatatt

SEQ ID NO: 1102613 - DNA, 22 bp, Artificial Sequence
  chemically synthesized
gacaaataatagatattttcat

SEQ ID NO: 1102614 - DNA, 22 bp, Artificial Sequence
  chemically synthesized
tgtaaatactgcatgaaaatat

SEQ ID NO: 1102615 - DNA, 22 bp, Artificial Sequence
  chemically synthesized
acaaataatagatattttcatg

SEQ ID NO: 1102616 - DNA, 22 bp, Artificial Sequence
  chemically synthesized
tcatgcagtatttacataggta

SEQ ID NO: 1102617 - DNA, 22 bp, Artificial Sequence
  chemically synthesized
catgcagtatttacataggtat

SEQ ID NO: 1102618 - DNA, 22 bp, Artificial Sequence
  chemically synthesized
atgcagtatttacataggtatg

SEQ ID NO: 1102619 - DNA, 22 bp, Artificial Sequence
  chemically synthesized
taaacatatgtgtacatgcata

SEQ ID NO: 1102620 - DNA, 22 bp, Artificial Sequence
  chemically synthesized
ataaacatatgtgtacatgcat

SEQ ID NO: 1102621 - DNA, 22 bp, Artificial Sequence
  chemically synthesized
cttataaacatatgtgtacatg

SEQ ID NO: 1102622 - DNA, 22 bp, Artificial Sequence
  chemically synthesized
acataggtatgcatgtacacat

SEQ ID NO: 1102623 - DNA, 22 bp, Artificial Sequence
  chemically synthesized
acttataaacatatgtgtacat

SEQ ID NO: 1102624 - DNA, 22 bp, Artificial Sequence
  chemically synthesized
cataggtatgcatgtacacata

SEQ ID NO: 1102625 - DNA, 22 bp, Artificial Sequence
  chemically synthesized
tacttataaacatatgtgtaca

SEQ ID NO: 1102626 - DNA, 22 bp, Artificial Sequence
  chemically synthesized
tttacttataaacatatgtgta

SEQ ID NO: 1102627 - DNA, 22 bp, Artificial Sequence
  chemically synthesized
ctttacttataaacatatgtgt

SEQ ID NO: 1102628 - DNA, 22 bp, Artificial Sequence
  chemically synthesized
atgcatagcatttctttactta

SEQ ID NO: 1102629 - DNA, 22 bp, Artificial Sequence
  chemically synthesized
aatgcatagcatttctttactt

SEQ ID NO: 1102630 - DNA, 22 bp, Artificial Sequence
  chemically synthesized
taatgcatagcatttctttact

SEQ ID NO: 1102631 - DNA, 22 bp, Artificial Sequence
  chemically synthesized
ttaatgcatagcatttctttac

SEQ ID NO: 1102632 - DNA, 22 bp, Artificial Sequence
  chemically synthesized
tttaatgcatagcatttcttta

SEQ ID NO: 1102633 - DNA, 22 bp, Artificial Sequence
  chemically synthesized
ataagtaaagaaatgctatgca

SEQ ID NO: 1102634 - DNA, 22 bp, Artificial Sequence
  chemically synthesized
taagtaaagaaatgctatgcat

SEQ ID NO: 1102635 - DNA, 22 bp, Artificial Sequence
  chemically synthesized
aaacattttttaatgcatagca

SEQ ID NO: 1102636 - DNA, 22 bp, Artificial Sequence
  chemically synthesized
agcaaacctaaaacatttttta

SEQ ID NO: 1102637 - DNA, 22 bp, Artificial Sequence
  chemically synthesized
tgcattaaaaaatgttttaggt

SEQ ID NO: 1102638 - DNA, 22 bp, Artificial Sequence
  chemically synthesized
aaaaatgttttaggtttgctta

SEQ ID NO: 1102639 - DNA, 22 bp, Artificial Sequence
  chemically synthesized
caaaccaaagcactaagcaaac

SEQ ID NO: 1102640 - DNA, 22 bp, Artificial Sequence
  chemically synthesized
acaaaccaaagcactaagcaaa

SEQ ID NO: 1102641 - DNA, 22 bp, Artificial Sequence
  chemically synthesized
tacaaaccaaagcactaagcaa

SEQ ID NO: 1102642 - DNA, 22 bp, Artificial Sequence
  chemically synthesized
ttacaaaccaaagcactaagca

SEQ ID NO: 1102643 - DNA, 22 bp, Artificial Sequence
  chemically synthesized
ccttttacaaaccaaagcacta

SEQ ID NO: 1102644 - DNA, 22 bp, Artificial Sequence
  chemically synthesized
accttttacaaaccaaagcact

SEQ ID NO: 1102645 - DNA, 22 bp, Artificial Sequence
  chemically synthesized
taggtttgcttagtgctttggt

SEQ ID NO: 1102646 - DNA, 22 bp, Artificial Sequence
  chemically synthesized
aggtttgcttagtgctttggtt

SEQ ID NO: 1102647 - DNA, 22 bp, Artificial Sequence
  chemically synthesized
ggtttgcttagtgctttggttt

SEQ ID NO: 1102648 - DNA, 22 bp, Artificial Sequence
  chemically synthesized
tgcttaccttttacaaaccaaa

SEQ ID NO: 1102649 - DNA, 22 bp, Artificial Sequence
  chemically synthesized
gtgcttaccttttacaaaccaa

SEQ ID NO: 1102650 - DNA, 22 bp, Artificial Sequence
  chemically synthesized
tgtgcttaccttttacaaacca

SEQ ID NO: 1102651 - DNA, 22 bp, Artificial Sequence
  chemically synthesized
gcttagtgctttggtttgtaaa

SEQ ID NO: 1102652 - DNA, 22 bp, Artificial Sequence
  chemically synthesized
ttgtgcttaccttttacaaacc

SEQ ID NO: 1102653 - DNA, 22 bp, Artificial Sequence
  chemically synthesized
cttagtgctttggtttgtaaaa

SEQ ID NO: 1102654 - DNA, 22 bp, Artificial Sequence
  chemically synthesized
agtgctttggtttgtaaaaggt

SEQ ID NO: 1102655 - DNA, 22 bp, Artificial Sequence
  chemically synthesized
gtttttgtgcttaccttttaca

SEQ ID NO: 1102656 - DNA, 22 bp, Artificial Sequence
  chemically synthesized
gtgctttggtttgtaaaaggta

SEQ ID NO: 1102657 - DNA, 22 bp, Artificial Sequence
  chemically synthesized
agtttttgtgcttaccttttac

SEQ ID NO: 1102658 - DNA, 22 bp, Artificial Sequence
  chemically synthesized
cttagtttttgtgcttaccttt

SEQ ID NO: 1102659 - DNA, 22 bp, Artificial Sequence
  chemically synthesized
tggtttgtaaaaggtaagcaca

SEQ ID NO: 1102660 - DNA, 22 bp, Artificial Sequence
  chemically synthesized
ggtttgtaaaaggtaagcacaa

SEQ ID NO: 1102661 - DNA, 22 bp, Artificial Sequence
  chemically synthesized
gctgcttagtttttgtgcttac

SEQ ID NO: 1102662 - DNA, 22 bp, Artificial Sequence
  chemically synthesized
gtttgtaaaaggtaagcacaaa

SEQ ID NO: 1102663 - DNA, 22 bp, Artificial Sequence
  chemically synthesized
gtaaaaggtaagcacaaaaact

SEQ ID NO: 1102664 - DNA, 22 bp, Artificial Sequence
  chemically synthesized
taaaaggtaagcacaaaaacta

SEQ ID NO: 1102665 - DNA, 22 bp, Artificial Sequence
  chemically synthesized
aatcccagtctagctgcttagt

SEQ ID NO: 1102666 - DNA, 22 bp, Artificial Sequence
  chemically synthesized
aaatcccagtctagctgcttag

SEQ ID NO: 1102667 - DNA, 22 bp, Artificial Sequence
  chemically synthesized
gatttaaatcccagtctagctg

SEQ ID NO: 1102668 - DNA, 22 bp, Artificial Sequence
  chemically synthesized
ctggatttaaatcccagtctag

SEQ ID NO: 1102669 - DNA, 22 bp, Artificial Sequence
  chemically synthesized
agcagctagactgggatttaaa

SEQ ID NO: 1102670 - DNA, 22 bp, Artificial Sequence
  chemically synthesized
caacaatatgctcctggattta

SEQ ID NO: 1102671 - DNA, 22 bp, Artificial Sequence
  chemically synthesized
gactgggatttaaatccaggag

SEQ ID NO: 1102672 - DNA, 22 bp, Artificial Sequence
  chemically synthesized
ggatttaaatccaggagcatat

SEQ ID NO: 1102673 - DNA, 22 bp, Artificial Sequence
  chemically synthesized
aaatccaggagcatattgttgc

SEQ ID NO: 1102674 - DNA, 22 bp, Artificial Sequence
  chemically synthesized
aatccaggagcatattgttgca

SEQ ID NO: 1102675 - DNA, 22 bp, Artificial Sequence
  chemically synthesized
tggtatgatggaaaaacattgc

SEQ ID NO: 1102676 - DNA, 22 bp, Artificial Sequence
  chemically synthesized
ttgcaatgtttttccatcatac

SEQ ID NO: 1102677 - DNA, 22 bp, Artificial Sequence
  chemically synthesized
caatgtttttccatcataccat

SEQ ID NO: 1102678 - DNA, 22 bp, Artificial Sequence
  chemically synthesized
ttccatcataccataacgtttt

SEQ ID NO: 1102679 - DNA, 22 bp, Artificial Sequence
  chemically synthesized
tccatcataccataacgttttc

SEQ ID NO: 1102680 - DNA, 22 bp, Artificial Sequence
  chemically synthesized
ccatcataccataacgttttcg

SEQ ID NO: 1102681 - DNA, 22 bp, Artificial Sequence
  chemically synthesized
ggaaggaaatgtcgaaaacgtt

SEQ ID NO: 1102682 - DNA, 22 bp, Artificial Sequence
  chemically synthesized
catcataccataacgttttcga

SEQ ID NO: 1102683 - DNA, 22 bp, Artificial Sequence
  chemically synthesized
atgctgggaaggaaatgtcgaa

SEQ ID NO: 1102684 - DNA, 22 bp, Artificial Sequence
  chemically synthesized
tgacaaatgttaatgctgggaa

SEQ ID NO: 1102685 - DNA, 22 bp, Artificial Sequence
  chemically synthesized
tcgacatttccttcccagcatt

SEQ ID NO: 1102686 - DNA, 22 bp, Artificial Sequence
  chemically synthesized
cgacatttccttcccagcatta

SEQ ID NO: 1102687 - DNA, 22 bp, Artificial Sequence
  chemically synthesized
gacatttccttcccagcattaa

SEQ ID NO: 1102688 - DNA, 22 bp, Artificial Sequence
  chemically synthesized
ttgtgacaaatgttaatgctgg

SEQ ID NO: 1102689 - DNA, 22 bp, Artificial Sequence
  chemically synthesized
ccttcccagcattaacatttgt

SEQ ID NO: 1102690 - DNA, 22 bp, Artificial Sequence
  chemically synthesized
cttcccagcattaacatttgtc

SEQ ID NO: 1102691 - DNA, 22 bp, Artificial Sequence
  chemically synthesized
cccagcattaacatttgtcaca

SEQ ID NO: 1102692 - DNA, 22 bp, Artificial Sequence
  chemically synthesized
ccagcattaacatttgtcacaa

SEQ ID NO: 1102693 - DNA, 22 bp, Artificial Sequence
  chemically synthesized
agtggtcaattattgtgacaaa

SEQ ID NO: 1102694 - DNA, 22 bp, Artificial Sequence
  chemically synthesized
gagtggtcaattattgtgacaa

SEQ ID NO: 1102695 - DNA, 22 bp, Artificial Sequence
  chemically synthesized
acatttgtcacaataattgacc

SEQ ID NO: 1102696 - DNA, 22 bp, Artificial Sequence
  chemically synthesized
gtcacaataattgaccactcaa

SEQ ID NO: 1102697 - DNA, 22 bp, Artificial Sequence
  chemically synthesized
tcacaataattgaccactcaag

SEQ ID NO: 1102698 - DNA, 22 bp, Artificial Sequence
  chemically synthesized
aataaggtaagtaatgtgtccc

SEQ ID NO: 1102699 - DNA, 22 bp, Artificial Sequence
  chemically synthesized
accactcaagggacacattact

SEQ ID NO: 1102700 - DNA, 22 bp, Artificial Sequence
  chemically synthesized
aaatattcaataaggtaagtaa

SEQ ID NO: 1102701 - DNA, 22 bp, Artificial Sequence
  chemically synthesized
aagggacacattacttacctta

SEQ ID NO: 1102702 - DNA, 22 bp, Artificial Sequence
  chemically synthesized
aaagcctaaaatattcaataag

SEQ ID NO: 1102703 - DNA, 22 bp, Artificial Sequence
  chemically synthesized
cttaccttattgaatattttag

SEQ ID NO: 1102704 - DNA, 22 bp, Artificial Sequence
  chemically synthesized
aggtctaaaagcctaaaatatt

SEQ ID NO: 1102705 - DNA, 22 bp, Artificial Sequence
  chemically synthesized
accttattgaatattttaggct

SEQ ID NO: 1102706 - DNA, 22 bp, Artificial Sequence
  chemically synthesized
ccttattgaatattttaggctt

SEQ ID NO: 1102707 - DNA, 22 bp, Artificial Sequence
  chemically synthesized
cattaaggtctaaaagcctaaa

SEQ ID NO: 1102708 - DNA, 22 bp, Artificial Sequence
  chemically synthesized
attgaatattttaggcttttag

SEQ ID NO: 1102709 - DNA, 22 bp, Artificial Sequence
  chemically synthesized
ttgaatattttaggcttttaga

SEQ ID NO: 1102710 - DNA, 22 bp, Artificial Sequence
  chemically synthesized
aatattttaggcttttagacct

SEQ ID NO: 1102711 - DNA, 22 bp, Artificial Sequence
  chemically synthesized
taggcttttagaccttaatgca

SEQ ID NO: 1102712 - DNA, 22 bp, Artificial Sequence
  chemically synthesized
aggcttttagaccttaatgcaa

SEQ ID NO: 1102713 - DNA, 22 bp, Artificial Sequence
  chemically synthesized
ggcttttagaccttaatgcaat

SEQ ID NO: 1102714 - DNA, 22 bp, Artificial Sequence
  chemically synthesized
ttagaccttaatgcaattgttg

SEQ ID NO: 1102715 - DNA, 22 bp, Artificial Sequence
  chemically synthesized
tagaccttaatgcaattgttgg

SEQ ID NO: 1102716 - DNA, 22 bp, Artificial Sequence
  chemically synthesized
agaccttaatgcaattgttggt

SEQ ID NO: 1102717 - DNA, 22 bp, Artificial Sequence
  chemically synthesized
gaccttaatgcaattgttggtt

SEQ ID NO: 1102718 - DNA, 22 bp, Artificial Sequence
  chemically synthesized
aagaaaaacagtaaaccaacaa

SEQ ID NO: 1102719 - DNA, 22 bp, Artificial Sequence
  chemically synthesized
aatgcaattgttggtttactgt

SEQ ID NO: 1102720 - DNA, 22 bp, Artificial Sequence
  chemically synthesized
atgcaattgttggtttactgtt

SEQ ID NO: 1102721 - DNA, 22 bp, Artificial Sequence
  chemically synthesized
aagctaaagaaaaacagtaaac

SEQ ID NO: 1102722 - DNA, 22 bp, Artificial Sequence
  chemically synthesized
ttggtttactgtttttctttag

SEQ ID NO: 1102723 - DNA, 22 bp, Artificial Sequence
  chemically synthesized
ataaccactcaagctaaagaaa

SEQ ID NO: 1102724 - DNA, 22 bp, Artificial Sequence
  chemically synthesized
gtttactgtttttctttagctt

SEQ ID NO: 1102725 - DNA, 22 bp, Artificial Sequence
  chemically synthesized
actgtttttctttagcttgagt

SEQ ID NO: 1102726 - DNA, 22 bp, Artificial Sequence
  chemically synthesized
ctgtttttctttagcttgagtg

SEQ ID NO: 1102727 - DNA, 22 bp, Artificial Sequence
  chemically synthesized
tttttctttagcttgagtggtt

SEQ ID NO: 1102728 - DNA, 22 bp, Artificial Sequence
  chemically synthesized
ttctttagcttgagtggttatt

SEQ ID NO: 1102729 - DNA, 22 bp, Artificial Sequence
  chemically synthesized
tctttagcttgagtggttatta

SEQ ID NO: 1102730 - DNA, 22 bp, Artificial Sequence
  chemically synthesized
ctttagcttgagtggttattag

SEQ ID NO: 1102731 - DNA, 22 bp, Artificial Sequence
  chemically synthesized
tttagcttgagtggttattagt

SEQ ID NO: 1102732 - DNA, 22 bp, Artificial Sequence
  chemically synthesized
tagcttgagtggttattagtat

SEQ ID NO: 1102733 - DNA, 22 bp, Artificial Sequence
  chemically synthesized
aatagtgccaccatactaataa

SEQ ID NO: 1102734 - DNA, 22 bp, Artificial Sequence
  chemically synthesized
agcttgagtggttattagtatg

SEQ ID NO: 1102735 - DNA, 22 bp, Artificial Sequence
  chemically synthesized
gaatagtgccaccatactaata

SEQ ID NO: 1102736 - DNA, 22 bp, Artificial Sequence
  chemically synthesized
gcttgagtggttattagtatgg

SEQ ID NO: 1102737 - DNA, 22 bp, Artificial Sequence
  chemically synthesized
tttgaatagtgccaccatacta

SEQ ID NO: 1102738 - DNA, 22 bp, Artificial Sequence
  chemically synthesized
gtttgaatagtgccaccatact

SEQ ID NO: 1102739 - DNA, 22 bp, Artificial Sequence
  chemically synthesized
gagtggttattagtatggtggc

SEQ ID NO: 1102740 - DNA, 22 bp, Artificial Sequence
  chemically synthesized
agtggttattagtatggtggca

SEQ ID NO: 1102741 - DNA, 22 bp, Artificial Sequence
  chemically synthesized
atttgtttgaatagtgccacca

SEQ ID NO: 1102742 - DNA, 22 bp, Artificial Sequence
  chemically synthesized
aatttgtttgaatagtgccacc

SEQ ID NO: 1102743 - DNA, 22 bp, Artificial Sequence
  chemically synthesized
acttaatttgtttgaatagtgc

SEQ ID NO: 1102744 - DNA, 22 bp, Artificial Sequence
  chemically synthesized
ttagtatggtggcactattcaa

SEQ ID NO: 1102745 - DNA, 22 bp, Artificial Sequence
  chemically synthesized
gacttaatttgtttgaatagtg

SEQ ID NO: 1102746 - DNA, 22 bp, Artificial Sequence
  chemically synthesized
gtatggtggcactattcaaaca

SEQ ID NO: 1102747 - DNA, 22 bp, Artificial Sequence
  chemically synthesized
ccttgacttaatttgtttgaat

SEQ ID NO: 1102748 - DNA, 22 bp, Artificial Sequence
  chemically synthesized
aaaccaaattcccttgacttaa

SEQ ID NO: 1102749 - DNA, 22 bp, Artificial Sequence
  chemically synthesized
ttcaaacaaattaagtcaaggg

SEQ ID NO: 1102750 - DNA, 22 bp, Artificial Sequence
  chemically synthesized
ctgaaaccaaattcccttgact

SEQ ID NO: 1102751 - DNA, 22 bp, Artificial Sequence
  chemically synthesized
cctgaaaccaaattcccttgac

SEQ ID NO: 1102752 - DNA, 22 bp, Artificial Sequence
  chemically synthesized
aaacaaattaagtcaagggaat

SEQ ID NO: 1102753 - DNA, 22 bp, Artificial Sequence
  chemically synthesized
ttcctgaaaccaaattcccttg

SEQ ID NO: 1102754 - DNA, 22 bp, Artificial Sequence
  chemically synthesized
cttcctgaaaccaaattccctt

SEQ ID NO: 1102755 - DNA, 22 bp, Artificial Sequence
  chemically synthesized
agtcaagggaatttggtttcag

SEQ ID NO: 1102756 - DNA, 22 bp, Artificial Sequence
  chemically synthesized
ccacatcaccttcttcctgaaa

SEQ ID NO: 1102757 - DNA, 22 bp, Artificial Sequence
  chemically synthesized
accacatcaccttcttcctgaa

SEQ ID NO: 1102758 - DNA, 22 bp, Artificial Sequence
  chemically synthesized
taccacatcaccttcttcctga

SEQ ID NO: 1102759 - DNA, 22 bp, Artificial Sequence
  chemically synthesized
aattttaccacatcaccttctt

SEQ ID NO: 1102760 - DNA, 22 bp, Artificial Sequence
  chemically synthesized
aaattttaccacatcaccttct

SEQ ID NO: 1102761 - DNA, 22 bp, Artificial Sequence
  chemically synthesized
ggtttcaggaagaaggtgatgt

SEQ ID NO: 1102762 - DNA, 22 bp, Artificial Sequence
  chemically synthesized
gtttcaggaagaaggtgatgtg

SEQ ID NO: 1102763 - DNA, 22 bp, Artificial Sequence
  chemically synthesized
caggaagaaggtgatgtggtaa

SEQ ID NO: 1102764 - DNA, 22 bp, Artificial Sequence
  chemically synthesized
tatgcttaaattttaccacatc

SEQ ID NO: 1102765 - DNA, 22 bp, Artificial Sequence
  chemically synthesized
aggaagaaggtgatgtggtaaa

SEQ ID NO: 1102766 - DNA, 22 bp, Artificial Sequence
  chemically synthesized
taattatatgcttaaattttac

SEQ ID NO: 1102767 - DNA, 22 bp, Artificial Sequence
  chemically synthesized
gtaattatatgcttaaatttta

SEQ ID NO: 1102768 - DNA, 22 bp, Artificial Sequence
  chemically synthesized
tcaccatatcgaatttgtaatt

SEQ ID NO: 1102769 - DNA, 22 bp, Artificial Sequence
  chemically synthesized
atcaccatatcgaatttgtaat

SEQ ID NO: 1102770 - DNA, 22 bp, Artificial Sequence
  chemically synthesized
tatcaccatatcgaatttgtaa

SEQ ID NO: 1102771 - DNA, 22 bp, Artificial Sequence
  chemically synthesized
aagcatataattacaaattcga

SEQ ID NO: 1102772 - DNA, 22 bp, Artificial Sequence
  chemically synthesized
agcatataattacaaattcgat

SEQ ID NO: 1102773 - DNA, 22 bp, Artificial Sequence
  chemically synthesized
ttttatcaccatatcgaatttg

SEQ ID NO: 1102774 - DNA, 22 bp, Artificial Sequence
  chemically synthesized
attttatcaccatatcgaattt

SEQ ID NO: 1102775 - DNA, 22 bp, Artificial Sequence
  chemically synthesized
caaattcgatatggtgataaaa

SEQ ID NO: 1102776 - DNA, 22 bp, Artificial Sequence
  chemically synthesized
gatatggtgataaaataagtta

SEQ ID NO: 1102777 - DNA, 22 bp, Artificial Sequence
  chemically synthesized
catatgtaatatatagtaataa

SEQ ID NO: 1102778 - DNA, 22 bp, Artificial Sequence
  chemically synthesized
atgttacatatgtaatatatag

SEQ ID NO: 1102779 - DNA, 22 bp, Artificial Sequence
  chemically synthesized
ttactatatattacatatgtaa

SEQ ID NO: 1102780 - DNA, 22 bp, Artificial Sequence
  chemically synthesized
ctatatattacatatgtaacat

SEQ ID NO: 1102781 - DNA, 22 bp, Artificial Sequence
  chemically synthesized
tatatgtatattaatgttacat

SEQ ID NO: 1102782 - DNA, 22 bp, Artificial Sequence
  chemically synthesized
tatattacatatgtaacattaa

SEQ ID NO: 1102783 - DNA, 22 bp, Artificial Sequence
  chemically synthesized
ttgtatatgtatattaatgtta

SEQ ID NO: 1102784 - DNA, 22 bp, Artificial Sequence
  chemically synthesized
catatgtaacattaatatacat

SEQ ID NO: 1102785 - DNA, 22 bp, Artificial Sequence
  chemically synthesized
atatacatatacaacaggttac

SEQ ID NO: 1102786 - DNA, 22 bp, Artificial Sequence
  chemically synthesized
atgtaatatatatcacatatgt

SEQ ID NO: 1102787 - DNA, 22 bp, Artificial Sequence
  chemically synthesized
catatgtgatatatattacatt

SEQ ID NO: 1102788 - DNA, 22 bp, Artificial Sequence
  chemically synthesized
tatatcatgtacatatatacat

SEQ ID NO: 1102789 - DNA, 22 bp, Artificial Sequence
  chemically synthesized
cattagatatgtatatatgtac

SEQ ID NO: 1102790 - DNA, 22 bp, Artificial Sequence
  chemically synthesized
gatatgtatatatgtacatgat

SEQ ID NO: 1102791 - DNA, 22 bp, Artificial Sequence
  chemically synthesized
cattatacacgtatatatatat

SEQ ID NO: 1102792 - DNA, 22 bp, Artificial Sequence
  chemically synthesized
tacacgtatatatatatatata

SEQ ID NO: 1102793 - DNA, 22 bp, Artificial Sequence
  chemically synthesized
tatgtatgtgtgtgtatatata

SEQ ID NO: 1102794 - DNA, 22 bp, Artificial Sequence
  chemically synthesized
catatatatatgtatatatata

SEQ ID NO: 1102795 - DNA, 22 bp, Artificial Sequence
  chemically synthesized
ccatatatatatgtatatatat

SEQ ID NO: 1102796 - DNA, 22 bp, Artificial Sequence
  chemically synthesized
gcttccatatatatatgtatat

SEQ ID NO: 1102797 - DNA, 22 bp, Artificial Sequence
  chemically synthesized
agcttccatatatatatgtata

SEQ ID NO: 1102798 - DNA, 22 bp, Artificial Sequence
  chemically synthesized
tagcttccatatatatatgtat

SEQ ID NO: 1102799 - DNA, 22 bp, Artificial Sequence
  chemically synthesized
ttagcttccatatatatatgta

SEQ ID NO: 1102800 - DNA, 22 bp, Artificial Sequence
  chemically synthesized
gcatttttagcttccatatata

SEQ ID NO: 1102801 - DNA, 22 bp, Artificial Sequence
  chemically synthesized
ttggcatttttagcttccatat

SEQ ID NO: 1102802 - DNA, 22 bp, Artificial Sequence
  chemically synthesized
aaagagaatgtgtgttattggc

SEQ ID NO: 1102803 - DNA, 22 bp, Artificial Sequence
  chemically synthesized
gaaagagaatgtgtgttattgg

SEQ ID NO: 1102804 - DNA, 22 bp, Artificial Sequence
  chemically synthesized
tgaaagagaatgtgtgttattg

SEQ ID NO: 1102805 - DNA, 22 bp, Artificial Sequence
  chemically synthesized
aaaatgccaataacacacattc

SEQ ID NO: 1102806 - DNA, 22 bp, Artificial Sequence
  chemically synthesized
gagactttgaaagagaatgtgt

SEQ ID NO: 1102807 - DNA, 22 bp, Artificial Sequence
  chemically synthesized
ggagactttgaaagagaatgtg

SEQ ID NO: 1102808 - DNA, 22 bp, Artificial Sequence
  chemically synthesized
tggagactttgaaagagaatgt

SEQ ID NO: 1102809 - DNA, 22 bp, Artificial Sequence
  chemically synthesized
ttttggagactttgaaagagaa

SEQ ID NO: 1102810 - DNA, 22 bp, Artificial Sequence
  chemically synthesized
tgtctgttttggagactttgaa

SEQ ID NO: 1102811 - DNA, 22 bp, Artificial Sequence
  chemically synthesized
tctttcaaagtctccaaaacag

SEQ ID NO: 1102812 - DNA, 22 bp, Artificial Sequence
  chemically synthesized
gcagaactgtgtctgttttgga

SEQ ID NO: 1102813 - DNA, 22 bp, Artificial Sequence
  chemically synthesized
tttcaaagtctccaaaacagac

SEQ ID NO: 1102814 - DNA, 22 bp, Artificial Sequence
  chemically synthesized
tcaaagtctccaaaacagacac

SEQ ID NO: 1102815 - DNA, 22 bp, Artificial Sequence
  chemically synthesized
caaagtctccaaaacagacaca

SEQ ID NO: 1102816 - DNA, 22 bp, Artificial Sequence
  chemically synthesized
aaagtctccaaaacagacacag

SEQ ID NO: 1102817 - DNA, 22 bp, Artificial Sequence
  chemically synthesized
aggtgttagcagaactgtgtct

SEQ ID NO: 1102818 - DNA, 22 bp, Artificial Sequence
  chemically synthesized
caaaacagacacagttctgcta

SEQ ID NO: 1102819 - DNA, 22 bp, Artificial Sequence
  chemically synthesized
aaattaaggtgttagcagaact

SEQ ID NO: 1102820 - DNA, 22 bp, Artificial Sequence
  chemically synthesized
tgggctaaaattaaggtgttag

SEQ ID NO: 1102821 - DNA, 22 bp, Artificial Sequence
  chemically synthesized
tgtgggctaaaattaaggtgtt

SEQ ID NO: 1102822 - DNA, 22 bp, Artificial Sequence
  chemically synthesized
atctctgtgggctaaaattaag

SEQ ID NO: 1102823 - DNA, 22 bp, Artificial Sequence
  chemically synthesized
tgctaacaccttaattttagcc

SEQ ID NO: 1102824 - DNA, 22 bp, Artificial Sequence
  chemically synthesized
ctaacaccttaattttagccca

SEQ ID NO: 1102825 - DNA, 22 bp, Artificial Sequence
  chemically synthesized
agaattaatctctgtgggctaa

SEQ ID NO: 1102826 - DNA, 22 bp, Artificial Sequence
  chemically synthesized
acaccttaattttagcccacag

SEQ ID NO: 1102827 - DNA, 22 bp, Artificial Sequence
  chemically synthesized
aattttagcccacagagattaa

SEQ ID NO: 1102828 - DNA, 22 bp, Artificial Sequence
  chemically synthesized
attttagcccacagagattaat

SEQ ID NO: 1102829 - DNA, 22 bp, Artificial Sequence
  chemically synthesized
tagcccacagagattaattctg

SEQ ID NO: 1102830 - DNA, 22 bp, Artificial Sequence
  chemically synthesized
agcccacagagattaattctga

SEQ ID NO: 1102831 - DNA, 22 bp, Artificial Sequence
  chemically synthesized
gaggtcagaagttcagaattaa

SEQ ID NO: 1102832 - DNA, 22 bp, Artificial Sequence
  chemically synthesized
gcccacagagattaattctgaa

SEQ ID NO: 1102833 - DNA, 22 bp, Artificial Sequence
  chemically synthesized
tggaggtcagaagttcagaatt

SEQ ID NO: 1102834 - DNA, 22 bp, Artificial Sequence
  chemically synthesized
ttctggaggtcagaagttcaga

SEQ ID NO: 1102835 - DNA, 22 bp, Artificial Sequence
  chemically synthesized
ctgttctggaggtcagaagttc

SEQ ID NO: 1102836 - DNA, 22 bp, Artificial Sequence
  chemically synthesized
cattactgttctggaggtcaga

SEQ ID NO: 1102837 - DNA, 22 bp, Artificial Sequence
  chemically synthesized
attctgaacttctgacctccag

SEQ ID NO: 1102838 - DNA, 22 bp, Artificial Sequence
  chemically synthesized
ttacattactgttctggaggtc

SEQ ID NO: 1102839 - DNA, 22 bp, Artificial Sequence
  chemically synthesized
attacattactgttctggaggt

SEQ ID NO: 1102840 - DNA, 22 bp, Artificial Sequence
  chemically synthesized
tgaacttctgacctccagaaca

SEQ ID NO: 1102841 - DNA, 22 bp, Artificial Sequence
  chemically synthesized
aacttctgacctccagaacagt

SEQ ID NO: 1102842 - DNA, 22 bp, Artificial Sequence
  chemically synthesized
ctgacctccagaacagtaatgt

SEQ ID NO: 1102843 - DNA, 22 bp, Artificial Sequence
  chemically synthesized
tgacctccagaacagtaatgta

SEQ ID NO: 1102844 - DNA, 22 bp, Artificial Sequence
  chemically synthesized
acctccagaacagtaatgtaat

SEQ ID NO: 1102845 - DNA, 22 bp, Artificial Sequence
  chemically synthesized
aaacaacacaaatttattacat

SEQ ID NO: 1102846 - DNA, 22 bp, Artificial Sequence
  chemically synthesized
caaacaacacaaatttattaca

SEQ ID NO: 1102847 - DNA, 22 bp, Artificial Sequence
  chemically synthesized
cagaacagtaatgtaataaatt

SEQ ID NO: 1102848 - DNA, 22 bp, Artificial Sequence
  chemically synthesized
atggcttcaaacaacacaaatt

SEQ ID NO: 1102849 - DNA, 22 bp, Artificial Sequence
  chemically synthesized
aatggcttcaaacaacacaaat

SEQ ID NO: 1102850 - DNA, 22 bp, Artificial Sequence
  chemically synthesized
gcagaaatttaatggcttcaaa

SEQ ID NO: 1102851 - DNA, 22 bp, Artificial Sequence
  chemically synthesized
gtgttgtttgaagccattaaat

SEQ ID NO: 1102852 - DNA, 22 bp, Artificial Sequence
  chemically synthesized
tgttgtttgaagccattaaatt

SEQ ID NO: 1102853 - DNA, 22 bp, Artificial Sequence
  chemically synthesized
agaaattagcagaaatttaatg

SEQ ID NO: 1102854 - DNA, 22 bp, Artificial Sequence
  chemically synthesized
ctaagaaattagcagaaattta

SEQ ID NO: 1102855 - DNA, 22 bp, Artificial Sequence
  chemically synthesized
tttgaagccattaaatttctgc

SEQ ID NO: 1102856 - DNA, 22 bp, Artificial Sequence
  chemically synthesized
gaagccattaaatttctgctaa

SEQ ID NO: 1102857 - DNA, 22 bp, Artificial Sequence
  chemically synthesized
aagccattaaatttctgctaat

SEQ ID NO: 1102858 - DNA, 22 bp, Artificial Sequence
  chemically synthesized
tgatactcctaagaaattagca

SEQ ID NO: 1102859 - DNA, 22 bp, Artificial Sequence
  chemically synthesized
aatttctgctaatttcttagga

SEQ ID NO: 1102860 - DNA, 22 bp, Artificial Sequence
  chemically synthesized
atgtcctatgatactcctaaga

SEQ ID NO: 1102861 - DNA, 22 bp, Artificial Sequence
  chemically synthesized
ctgctaatttcttaggagtatc

SEQ ID NO: 1102862 - DNA, 22 bp, Artificial Sequence
  chemically synthesized
tgctaatttcttaggagtatca

SEQ ID NO: 1102863 - DNA, 22 bp, Artificial Sequence
  chemically synthesized
ctaatttcttaggagtatcata

SEQ ID NO: 1102864 - DNA, 22 bp, Artificial Sequence
  chemically synthesized
atttcttaggagtatcatagga

SEQ ID NO: 1102865 - DNA, 22 bp, Artificial Sequence
  chemically synthesized
cttaggagtatcataggacatt

SEQ ID NO: 1102866 - DNA, 22 bp, Artificial Sequence
  chemically synthesized
ttaggagtatcataggacatta

SEQ ID NO: 1102867 - DNA, 22 bp, Artificial Sequence
  chemically synthesized
aggagtatcataggacattaat

SEQ ID NO: 1102868 - DNA, 22 bp, Artificial Sequence
  chemically synthesized
ggagtatcataggacattaata

SEQ ID NO: 1102869 - DNA, 22 bp, Artificial Sequence
  chemically synthesized
atacacctacatttctactgca

SEQ ID NO: 1102870 - DNA, 22 bp, Artificial Sequence
  chemically synthesized
catatatgtatatgtgcagtag

SEQ ID NO: 1102871 - DNA, 22 bp, Artificial Sequence
  chemically synthesized
catttctactgcacatatacat

SEQ ID NO: 1102872 - DNA, 22 bp, Artificial Sequence
  chemically synthesized
tgtataactccatatatgtata

SEQ ID NO: 1102873 - DNA, 22 bp, Artificial Sequence
  chemically synthesized
ctactgcacatatacatatatg

SEQ ID NO: 1102874 - DNA, 22 bp, Artificial Sequence
  chemically synthesized
tactgcacatatacatatatgg

SEQ ID NO: 1102875 - DNA, 22 bp, Artificial Sequence
  chemically synthesized
ctgcacatatacatatatggag

SEQ ID NO: 1102876 - DNA, 22 bp, Artificial Sequence
  chemically synthesized
cacatatacatatatggagtta

SEQ ID NO: 1102877 - DNA, 22 bp, Artificial Sequence
  chemically synthesized
atcccattatgtataactccat

SEQ ID NO: 1102878 - DNA, 22 bp, Artificial Sequence
  chemically synthesized
tatattcatcccattatgtata

SEQ ID NO: 1102879 - DNA, 22 bp, Artificial Sequence
  chemically synthesized
cattatatattcatcccattat

SEQ ID NO: 1102880 - DNA, 22 bp, Artificial Sequence
  chemically synthesized
tacataatgggatgaatatata

SEQ ID NO: 1102881 - DNA, 22 bp, Artificial Sequence
  chemically synthesized
ataaaattgcattatatattca

SEQ ID NO: 1102882 - DNA, 22 bp, Artificial Sequence
  chemically synthesized
tatataaaatatggtgatatgt

SEQ ID NO: 1102883 - DNA, 22 bp, Artificial Sequence
  chemically synthesized
ttatatataaaatatggtgata

SEQ ID NO: 1102884 - DNA, 22 bp, Artificial Sequence
  chemically synthesized
tatgaacatatcaccatatttt

SEQ ID NO: 1102885 - DNA, 22 bp, Artificial Sequence
  chemically synthesized
atgaacatatcaccatatttta

SEQ ID NO: 1102886 - DNA, 22 bp, Artificial Sequence
  chemically synthesized
tgaacatatcaccatattttat

SEQ ID NO: 1102887 - DNA, 22 bp, Artificial Sequence
  chemically synthesized
tatgtgctattatatataaaat

SEQ ID NO: 1102888 - DNA, 22 bp, Artificial Sequence
  chemically synthesized
tctatatgtgctattatatata

SEQ ID NO: 1102889 - DNA, 22 bp, Artificial Sequence
  chemically synthesized
tgctgtctatatgtgctattat

SEQ ID NO: 1102890 - DNA, 22 bp, Artificial Sequence
  chemically synthesized
tatatataatagcacatataga

SEQ ID NO: 1102891 - DNA, 22 bp, Artificial Sequence
  chemically synthesized
atatataatagcacatatagac

SEQ ID NO: 1102892 - DNA, 22 bp, Artificial Sequence
  chemically synthesized
tatataatagcacatatagaca

SEQ ID NO: 1102893 - DNA, 22 bp, Artificial Sequence
  chemically synthesized
taaaaagtaggagtcaactatg

SEQ ID NO: 1102894 - DNA, 22 bp, Artificial Sequence
  chemically synthesized
ataaaaagtaggagtcaactat

SEQ ID NO: 1102895 - DNA, 22 bp, Artificial Sequence
  chemically synthesized
cttataaaaagtaggagtcaac

SEQ ID NO: 1102896 - DNA, 22 bp, Artificial Sequence
  chemically synthesized
ctacttataaaaagtaggagtc

SEQ ID NO: 1102897 - DNA, 22 bp, Artificial Sequence
  chemically synthesized
gctacttataaaaagtaggagt

SEQ ID NO: 1102898 - DNA, 22 bp, Artificial Sequence
  chemically synthesized
tgctacttataaaaagtaggag

SEQ ID NO: 1102899 - DNA, 22 bp, Artificial Sequence
  chemically synthesized
ttttgctacttataaaaagtag

SEQ ID NO: 1102900 - DNA, 22 bp, Artificial Sequence
  chemically synthesized
ctgttttgctacttataaaaag

SEQ ID NO: 1102901 - DNA, 22 bp, Artificial Sequence
  chemically synthesized
tgctgttttgctacttataaaa

SEQ ID NO: 1102902 - DNA, 22 bp, Artificial Sequence
  chemically synthesized
ctgctgttttgctacttataaa

SEQ ID NO: 1102903 - DNA, 22 bp, Artificial Sequence
  chemically synthesized
actcctactttttataagtagc

SEQ ID NO: 1102904 - DNA, 22 bp, Artificial Sequence
  chemically synthesized
atttctgctgttttgctactta

SEQ ID NO: 1102905 - DNA, 22 bp, Artificial Sequence
  chemically synthesized
catttctgctgttttgctactt

SEQ ID NO: 1102906 - DNA, 22 bp, Artificial Sequence
  chemically synthesized
ctactttttataagtagcaaaa

SEQ ID NO: 1102907 - DNA, 22 bp, Artificial Sequence
  chemically synthesized
tcatttctgctgttttgctact

SEQ ID NO: 1102908 - DNA, 22 bp, Artificial Sequence
  chemically synthesized
ctttttataagtagcaaaacag

SEQ ID NO: 1102909 - DNA, 22 bp, Artificial Sequence
  chemically synthesized
cctttcatttctgctgttttgc

SEQ ID NO: 1102910 - DNA, 22 bp, Artificial Sequence
  chemically synthesized
tttataagtagcaaaacagcag

SEQ ID NO: 1102911 - DNA, 22 bp, Artificial Sequence
  chemically synthesized
ttataagtagcaaaacagcaga

SEQ ID NO: 1102912 - DNA, 22 bp, Artificial Sequence
  chemically synthesized
tataagtagcaaaacagcagaa

SEQ ID NO: 1102913 - DNA, 22 bp, Artificial Sequence
  chemically synthesized
ataagtagcaaaacagcagaaa

SEQ ID NO: 1102914 - DNA, 22 bp, Artificial Sequence
  chemically synthesized
tattacctttcatttctgctgt

SEQ ID NO: 1102915 - DNA, 22 bp, Artificial Sequence
  chemically synthesized
taagtagcaaaacagcagaaat

SEQ ID NO: 1102916 - DNA, 22 bp, Artificial Sequence
  chemically synthesized
ctatattacctttcatttctgc

SEQ ID NO: 1102917 - DNA, 22 bp, Artificial Sequence
  chemically synthesized
cctatattacctttcatttctg

SEQ ID NO: 1102918 - DNA, 22 bp, Artificial Sequence
  chemically synthesized
tttcctatattacctttcattt

SEQ ID NO: 1102919 - DNA, 22 bp, Artificial Sequence
  chemically synthesized
tatatataatgtatagtatgta

SEQ ID NO: 1102920 - DNA, 22 bp, Artificial Sequence
  chemically synthesized
atatatataatgtatagtatgt

SEQ ID NO: 1102921 - DNA, 22 bp, Artificial Sequence
  chemically synthesized
tatatatataatgtatagtatg

SEQ ID NO: 1102922 - DNA, 22 bp, Artificial Sequence
  chemically synthesized
taatcattttatatatataatg

SEQ ID NO: 1102923 - DNA, 22 bp, Artificial Sequence
  chemically synthesized
tacattatatatataaaatgat

SEQ ID NO: 1102924 - DNA, 22 bp, Artificial Sequence
  chemically synthesized
tacagaggtatattgtaatcat

SEQ ID NO: 1102925 - DNA, 22 bp, Artificial Sequence
  chemically synthesized
tatatataaaatgattacaata

SEQ ID NO: 1102926 - DNA, 22 bp, Artificial Sequence
  chemically synthesized
tgtatatatacattatacagag

SEQ ID NO: 1102927 - DNA, 22 bp, Artificial Sequence
  chemically synthesized
caatatacctctgtataatgta

SEQ ID NO: 1102928 - DNA, 22 bp, Artificial Sequence
  chemically synthesized
gaaaaaagttatgtatatatac

SEQ ID NO: 1102929 - DNA, 22 bp, Artificial Sequence
  chemically synthesized
tgtataatgtatatatacataa

SEQ ID NO: 1102930 - DNA, 22 bp, Artificial Sequence
  chemically synthesized
tataatgtatatatacataact

SEQ ID NO: 1102931 - DNA, 22 bp, Artificial Sequence
  chemically synthesized
tgactagaaaaaagttatgtat

SEQ ID NO: 1102932 - DNA, 22 bp, Artificial Sequence
  chemically synthesized
atgactagaaaaaagttatgta

SEQ ID NO: 1102933 - DNA, 22 bp, Artificial Sequence
  chemically synthesized
gcttatgactagaaaaaagtta

SEQ ID NO: 1102934 - DNA, 22 bp, Artificial Sequence
  chemically synthesized
agcttatgactagaaaaaagtt

SEQ ID NO: 1102935 - DNA, 22 bp, Artificial Sequence
  chemically synthesized
ttttctagtcataagctaaatg

SEQ ID NO: 1102936 - DNA, 22 bp, Artificial Sequence
  chemically synthesized
tttctagtcataagctaaatga

SEQ ID NO: 1102937 - DNA, 22 bp, Artificial Sequence
  chemically synthesized
agatacgggtaatcatttagct

SEQ ID NO: 1102938 - DNA, 22 bp, Artificial Sequence
  chemically synthesized
ttctagtcataagctaaatgat

SEQ ID NO: 1102939 - DNA, 22 bp, Artificial Sequence
  chemically synthesized
aagatacgggtaatcatttagc

SEQ ID NO: 1102940 - DNA, 22 bp, Artificial Sequence
  chemically synthesized
tctagtcataagctaaatgatt

SEQ ID NO: 1102941 - DNA, 22 bp, Artificial Sequence
  chemically synthesized
taagatacgggtaatcatttag

SEQ ID NO: 1102942 - DNA, 22 bp, Artificial Sequence
  chemically synthesized
ctagtcataagctaaatgatta

SEQ ID NO: 1102943 - DNA, 22 bp, Artificial Sequence
  chemically synthesized
ttaagatacgggtaatcattta

SEQ ID NO: 1102944 - DNA, 22 bp, Artificial Sequence
  chemically synthesized
tagtcataagctaaatgattac

SEQ ID NO: 1102945 - DNA, 22 bp, Artificial Sequence
  chemically synthesized
gtcataagctaaatgattaccc

SEQ ID NO: 1102946 - DNA, 22 bp, Artificial Sequence
  chemically synthesized
tcttttaagatacgggtaatca

SEQ ID NO: 1102947 - DNA, 22 bp, Artificial Sequence
  chemically synthesized
gttgtcttttaagatacgggta

SEQ ID NO: 1102948 - DNA, 22 bp, Artificial Sequence
  chemically synthesized
gtctggttgtcttttaagatac

SEQ ID NO: 1102949 - DNA, 22 bp, Artificial Sequence
  chemically synthesized
aatgattacccgtatcttaaaa

SEQ ID NO: 1102950 - DNA, 22 bp, Artificial Sequence
  chemically synthesized
agtctggttgtcttttaagata

SEQ ID NO: 1102951 - DNA, 22 bp, Artificial Sequence
  chemically synthesized
cccgtatcttaaaagacaacca

SEQ ID NO: 1102952 - DNA, 22 bp, Artificial Sequence
  chemically synthesized
aaaagacaaccagactaaatgg

SEQ ID NO: 1102953 - DNA, 22 bp, Artificial Sequence
  chemically synthesized
aaaaccaatcatccatttagtc

SEQ ID NO: 1102954 - DNA, 22 bp, Artificial Sequence
  chemically synthesized
aaagacaaccagactaaatgga

SEQ ID NO: 1102955 - DNA, 22 bp, Artificial Sequence
  chemically synthesized
caaaaccaatcatccatttagt

SEQ ID NO: 1102956 - DNA, 22 bp, Artificial Sequence
  chemically synthesized
tcaaaaccaatcatccatttag

SEQ ID NO: 1102957 - DNA, 22 bp, Artificial Sequence
  chemically synthesized
ataattttcaaaaccaatcatc

SEQ ID NO: 1102958 - DNA, 22 bp, Artificial Sequence
  chemically synthesized
aataattttcaaaaccaatcat

SEQ ID NO: 1102959 - DNA, 22 bp, Artificial Sequence
  chemically synthesized
gtttaataattttcaaaaccaa

SEQ ID NO: 1102960 - DNA, 22 bp, Artificial Sequence
  chemically synthesized
agtttaataattttcaaaacca

SEQ ID NO: 1102961 - DNA, 22 bp, Artificial Sequence
  chemically synthesized
tagtttaataattttcaaaacc

SEQ ID NO: 1102962 - DNA, 22 bp, Artificial Sequence
  chemically synthesized
aatggatgattggttttgaaaa

SEQ ID NO: 1102963 - DNA, 22 bp, Artificial Sequence
  chemically synthesized
ttagtttaataattttcaaaac

SEQ ID NO: 1102964 - DNA, 22 bp, Artificial Sequence
  chemically synthesized
aacatgtttttagtttaataat

SEQ ID NO: 1102965 - DNA, 22 bp, Artificial Sequence
  chemically synthesized
gttttgaaaattattaaactaa

SEQ ID NO: 1102966 - DNA, 22 bp, Artificial Sequence
  chemically synthesized
tgaaaattattaaactaaaaac

SEQ ID NO: 1102967 - DNA, 22 bp, Artificial Sequence
  chemically synthesized
gaaaattattaaactaaaaaca

SEQ ID NO: 1102968 - DNA, 22 bp, Artificial Sequence
  chemically synthesized
aaaattattaaactaaaaacat

SEQ ID NO: 1102969 - DNA, 22 bp, Artificial Sequence
  chemically synthesized
ccaataggaattaaacatgttt

SEQ ID NO: 1102970 - DNA, 22 bp, Artificial Sequence
  chemically synthesized
ttaaactaaaaacatgtttaat

SEQ ID NO: 1102971 - DNA, 22 bp, Artificial Sequence
  chemically synthesized
aactaaaaacatgtttaattcc

SEQ ID NO: 1102972 - DNA, 22 bp, Artificial Sequence
  chemically synthesized
accattaccaataggaattaaa

SEQ ID NO: 1102973 - DNA, 22 bp, Artificial Sequence
  chemically synthesized
caccattaccaataggaattaa

SEQ ID NO: 1102974 - DNA, 22 bp, Artificial Sequence
  chemically synthesized
tcaccattaccaataggaatta

SEQ ID NO: 1102975 - DNA, 22 bp, Artificial Sequence
  chemically synthesized
aaaacatgtttaattcctattg

SEQ ID NO: 1102976 - DNA, 22 bp, Artificial Sequence
  chemically synthesized
ttttcaccattaccaataggaa

SEQ ID NO: 1102977 - DNA, 22 bp, Artificial Sequence
  chemically synthesized
tattttcaccattaccaatagg

SEQ ID NO: 1102978 - DNA, 22 bp, Artificial Sequence
  chemically synthesized
ctattttcaccattaccaatag

SEQ ID NO: 1102979 - DNA, 22 bp, Artificial Sequence
  chemically synthesized
tctattttcaccattaccaata

SEQ ID NO: 1102980 - DNA, 22 bp, Artificial Sequence
  chemically synthesized
aattcctattggtaatggtgaa

SEQ ID NO: 1102981 - DNA, 22 bp, Artificial Sequence
  chemically synthesized
attcctattggtaatggtgaaa

SEQ ID NO: 1102982 - DNA, 22 bp, Artificial Sequence
  chemically synthesized
gaatgaattttctattttcacc

SEQ ID NO: 1102983 - DNA, 22 bp, Artificial Sequence
  chemically synthesized
ctattggtaatggtgaaaatag

SEQ ID NO: 1102984 - DNA, 22 bp, Artificial Sequence
  chemically synthesized
agaatgaattttctattttcac

SEQ ID NO: 1102985 - DNA, 22 bp, Artificial Sequence
  chemically synthesized
tagaatgaattttctattttca

SEQ ID NO: 1102986 - DNA, 22 bp, Artificial Sequence
  chemically synthesized
ttagaatgaattttctattttc

SEQ ID NO: 1102987 - DNA, 22 bp, Artificial Sequence
  chemically synthesized
ttggtaatggtgaaaatagaaa

SEQ ID NO: 1102988 - DNA, 22 bp, Artificial Sequence
  chemically synthesized
gtaatggtgaaaatagaaaatt

SEQ ID NO: 1102989 - DNA, 22 bp, Artificial Sequence
  chemically synthesized
agtgtttttagaatgaattttc

SEQ ID NO: 1102990 - DNA, 22 bp, Artificial Sequence
  chemically synthesized
tcagtgtttttagaatgaattt

SEQ ID NO: 1102991 - DNA, 22 bp, Artificial Sequence
  chemically synthesized
ctcagtgtttttagaatgaatt

SEQ ID NO: 1102992 - DNA, 22 bp, Artificial Sequence
  chemically synthesized
tctcagtgtttttagaatgaat

SEQ ID NO: 1102993 - DNA, 22 bp, Artificial Sequence
  chemically synthesized
attctaaaaacactgagaaaac

SEQ ID NO: 1102994 - DNA, 22 bp, Artificial Sequence
  chemically synthesized
ggaaaagaataggagttttctc

SEQ ID NO: 1102995 - DNA, 22 bp, Artificial Sequence
  chemically synthesized
taaaaacactgagaaaactcct

SEQ ID NO: 1102996 - DNA, 22 bp, Artificial Sequence
  chemically synthesized
taggaaaagaataggagttttc

SEQ ID NO: 1102997 - DNA, 22 bp, Artificial Sequence
  chemically synthesized
ctaggaaaagaataggagtttt

SEQ ID NO: 1102998 - DNA, 22 bp, Artificial Sequence
  chemically synthesized
aaaacactgagaaaactcctat

SEQ ID NO: 1102999 - DNA, 22 bp, Artificial Sequence
  chemically synthesized
cttctaggaaaagaataggagt

SEQ ID NO: 1103000 - DNA, 22 bp, Artificial Sequence
  chemically synthesized
ttccttctaggaaaagaatagg

SEQ ID NO: 1103001 - DNA, 22 bp, Artificial Sequence
  chemically synthesized
attccttctaggaaaagaatag

SEQ ID NO: 1103002 - DNA, 22 bp, Artificial Sequence
  chemically synthesized
agaaaactcctattcttttcct

SEQ ID NO: 1103003 - DNA, 22 bp, Artificial Sequence
  chemically synthesized
cttattccttctaggaaaagaa

SEQ ID NO: 1103004 - DNA, 22 bp, Artificial Sequence
  chemically synthesized
gcttattccttctaggaaaaga

SEQ ID NO: 1103005 - DNA, 22 bp, Artificial Sequence
  chemically synthesized
ctattcttttcctagaaggaat

SEQ ID NO: 1103006 - DNA, 22 bp, Artificial Sequence
  chemically synthesized
ttcttttcctagaaggaataag

SEQ ID NO: 1103007 - DNA, 22 bp, Artificial Sequence
  chemically synthesized
ttttcctagaaggaataagcaa

SEQ ID NO: 1103008 - DNA, 22 bp, Artificial Sequence
  chemically synthesized
ttcctagaaggaataagcaaat

SEQ ID NO: 1103009 - DNA, 22 bp, Artificial Sequence
  chemically synthesized
caaaggatggcgatttgcttat

SEQ ID NO: 1103010 - DNA, 22 bp, Artificial Sequence
  chemically synthesized
tcctagaaggaataagcaaatc

SEQ ID NO: 1103011 - DNA, 22 bp, Artificial Sequence
  chemically synthesized
acaaaggatggcgatttgctta

SEQ ID NO: 1103012 - DNA, 22 bp, Artificial Sequence
  chemically synthesized
cctagaaggaataagcaaatcg

SEQ ID NO: 1103013 - DNA, 22 bp, Artificial Sequence
  chemically synthesized
tacaaaggatggcgatttgctt

SEQ ID NO: 1103014 - DNA, 22 bp, Artificial Sequence
  chemically synthesized
ctagaaggaataagcaaatcgc

SEQ ID NO: 1103015 - DNA, 22 bp, Artificial Sequence
  chemically synthesized
ttacaaaggatggcgatttgct

SEQ ID NO: 1103016 - DNA, 22 bp, Artificial Sequence
  chemically synthesized
gaaggaataagcaaatcgccat

SEQ ID NO: 1103017 - DNA, 22 bp, Artificial Sequence
  chemically synthesized
gtgagaagatgaaaagacatga

SEQ ID NO: 1103018 - DNA, 22 bp, Artificial Sequence
  chemically synthesized
tgtaaaagactcatgtcttttc

SEQ ID NO: 1103019 - DNA, 22 bp, Artificial Sequence
  chemically synthesized
gtaaaagactcatgtcttttca

SEQ ID NO: 1103020 - DNA, 22 bp, Artificial Sequence
  chemically synthesized
taaaagactcatgtcttttcat

SEQ ID NO: 1103021 - DNA, 22 bp, Artificial Sequence
  chemically synthesized
aaagttagtgagaagatgaaaa

SEQ ID NO: 1103022 - DNA, 22 bp, Artificial Sequence
  chemically synthesized
caaagttagtgagaagatgaaa

SEQ ID NO: 1103023 - DNA, 22 bp, Artificial Sequence
  chemically synthesized
tcaaagttagtgagaagatgaa

SEQ ID NO: 1103024 - DNA, 22 bp, Artificial Sequence
  chemically synthesized
atgtcttttcatcttctcacta

SEQ ID NO: 1103025 - DNA, 22 bp, Artificial Sequence
  chemically synthesized
agcatctttcaaagttagtgag

SEQ ID NO: 1103026 - DNA, 22 bp, Artificial Sequence
  chemically synthesized
cagcatctttcaaagttagtga

SEQ ID NO: 1103027 - DNA, 22 bp, Artificial Sequence
  chemically synthesized
ttcatcttctcactaactttga

SEQ ID NO: 1103028 - DNA, 22 bp, Artificial Sequence
  chemically synthesized
tcatcttctcactaactttgaa

SEQ ID NO: 1103029 - DNA, 22 bp, Artificial Sequence
  chemically synthesized
catcttctcactaactttgaaa

SEQ ID NO: 1103030 - DNA, 22 bp, Artificial Sequence
  chemically synthesized
accttcagcatctttcaaagtt

SEQ ID NO: 1103031 - DNA, 22 bp, Artificial Sequence
  chemically synthesized
atcttctcactaactttgaaag

SEQ ID NO: 1103032 - DNA, 22 bp, Artificial Sequence
  chemically synthesized
gaccttcagcatctttcaaagt

SEQ ID NO: 1103033 - DNA, 22 bp, Artificial Sequence
  chemically synthesized
ctcactaactttgaaagatgct

SEQ ID NO: 1103034 - DNA, 22 bp, Artificial Sequence
  chemically synthesized
tcactaactttgaaagatgctg

SEQ ID NO: 1103035 - DNA, 22 bp, Artificial Sequence
  chemically synthesized
actaactttgaaagatgctgaa

SEQ ID NO: 1103036 - DNA, 22 bp, Artificial Sequence
  chemically synthesized
actttgaaagatgctgaaggtc

SEQ ID NO: 1103037 - DNA, 22 bp, Artificial Sequence
  chemically synthesized
tgaaagatgctgaaggtcaaat

SEQ ID NO: 1103038 - DNA, 22 bp, Artificial Sequence
  chemically synthesized
gaaagatgctgaaggtcaaatg

SEQ ID NO: 1103039 - DNA, 22 bp, Artificial Sequence
  chemically synthesized
aaagatgctgaaggtcaaatgc

SEQ ID NO: 1103040 - DNA, 22 bp, Artificial Sequence
  chemically synthesized
taaaggtacataagcatttgac

SEQ ID NO: 1103041 - DNA, 22 bp, Artificial Sequence
  chemically synthesized
taaactgtaaaggtacataagc

SEQ ID NO: 1103042 - DNA, 22 bp, Artificial Sequence
  chemically synthesized
aaggtcaaatgcttatgtacct

SEQ ID NO: 1103043 - DNA, 22 bp, Artificial Sequence
  chemically synthesized
acgatacactgtaaactgtaaa

SEQ ID NO: 1103044 - DNA, 22 bp, Artificial Sequence
  chemically synthesized
cctaacgatacactgtaaactg

SEQ ID NO: 1103045 - DNA, 22 bp, Artificial Sequence
  chemically synthesized
atgtacctttacagtttacagt

SEQ ID NO: 1103046 - DNA, 22 bp, Artificial Sequence
  chemically synthesized
ccctaacgatacactgtaaact

SEQ ID NO: 1103047 - DNA, 22 bp, Artificial Sequence
  chemically synthesized
tgtacctttacagtttacagtg

SEQ ID NO: 1103048 - DNA, 22 bp, Artificial Sequence
  chemically synthesized
tccctaacgatacactgtaaac

SEQ ID NO: 1103049 - DNA, 22 bp, Artificial Sequence
  chemically synthesized
ttccctaacgatacactgtaaa

SEQ ID NO: 1103050 - DNA, 22 bp, Artificial Sequence
  chemically synthesized
tttccctaacgatacactgtaa

SEQ ID NO: 1103051 - DNA, 22 bp, Artificial Sequence
  chemically synthesized
ttttttccctaacgatacactg

SEQ ID NO: 1103052 - DNA, 22 bp, Artificial Sequence
  chemically synthesized
gttttttccctaacgatacact

SEQ ID NO: 1103053 - DNA, 22 bp, Artificial Sequence
  chemically synthesized
tacagtttacagtgtatcgtta

SEQ ID NO: 1103054 - DNA, 22 bp, Artificial Sequence
  chemically synthesized
acagtttacagtgtatcgttag

SEQ ID NO: 1103055 - DNA, 22 bp, Artificial Sequence
  chemically synthesized
cttgttttttccctaacgatac

SEQ ID NO: 1103056 - DNA, 22 bp, Artificial Sequence
  chemically synthesized
cagtttacagtgtatcgttagg

SEQ ID NO: 1103057 - DNA, 22 bp, Artificial Sequence
  chemically synthesized
acttgttttttccctaacgata

SEQ ID NO: 1103058 - DNA, 22 bp, Artificial Sequence
  chemically synthesized
tttacttgttttttccctaacg

SEQ ID NO: 1103059 - DNA, 22 bp, Artificial Sequence
  chemically synthesized
atttacttgttttttccctaac

SEQ ID NO: 1103060 - DNA, 22 bp, Artificial Sequence
  chemically synthesized
tatttacttgttttttccctaa

SEQ ID NO: 1103061 - DNA, 22 bp, Artificial Sequence
  chemically synthesized
acagtgtatcgttagggaaaaa

SEQ ID NO: 1103062 - DNA, 22 bp, Artificial Sequence
  chemically synthesized
ttatttacttgttttttcccta

SEQ ID NO: 1103063 - DNA, 22 bp, Artificial Sequence
  chemically synthesized
cagtgtatcgttagggaaaaaa

SEQ ID NO: 1103064 - DNA, 22 bp, Artificial Sequence
  chemically synthesized
atttttatttacttgttttttc

SEQ ID NO: 1103065 - DNA, 22 bp, Artificial Sequence
  chemically synthesized
ccctcatttttatttacttgtt

SEQ ID NO: 1103066 - DNA, 22 bp, Artificial Sequence
  chemically synthesized
taccctcatttttatttacttg

SEQ ID NO: 1103067 - DNA, 22 bp, Artificial Sequence
  chemically synthesized
ctaccctcatttttatttactt

SEQ ID NO: 1103068 - DNA, 22 bp, Artificial Sequence
  chemically synthesized
tctaccctcatttttatttact

SEQ ID NO: 1103069 - DNA, 22 bp, Artificial Sequence
  chemically synthesized
gggaaaaaacaagtaaataaaa

SEQ ID NO: 1103070 - DNA, 22 bp, Artificial Sequence
  chemically synthesized
ctttctaccctcatttttattt

SEQ ID NO: 1103071 - DNA, 22 bp, Artificial Sequence
  chemically synthesized
actttctaccctcatttttatt

SEQ ID NO: 1103072 - DNA, 22 bp, Artificial Sequence
  chemically synthesized
tactttctaccctcatttttat

SEQ ID NO: 1103073 - DNA, 22 bp, Artificial Sequence
  chemically synthesized
aagattttactttctaccctca

SEQ ID NO: 1103074 - DNA, 22 bp, Artificial Sequence
  chemically synthesized
aggtaattcaagattttacttt

SEQ ID NO: 1103075 - DNA, 22 bp, Artificial Sequence
  chemically synthesized
cgaaaaattcaggtaattcaag

SEQ ID NO: 1103076 - DNA, 22 bp, Artificial Sequence
  chemically synthesized
gaattacctgaatttttcggag

SEQ ID NO: 1103077 - DNA, 22 bp, Artificial Sequence
  chemically synthesized
aattacctgaatttttcggagt

SEQ ID NO: 1103078 - DNA, 22 bp, Artificial Sequence
  chemically synthesized
cctgaatttttcggagtttatt

SEQ ID NO: 1103079 - DNA, 22 bp, Artificial Sequence
  chemically synthesized
gaggagcaaatgaataaactcc

SEQ ID NO: 1103080 - DNA, 22 bp, Artificial Sequence
  chemically synthesized
aatttttcggagtttattcatt

SEQ ID NO: 1103081 - DNA, 22 bp, Artificial Sequence
  chemically synthesized
ttcggagtttattcatttgctc

SEQ ID NO: 1103082 - DNA, 22 bp, Artificial Sequence
  chemically synthesized
tcggagtttattcatttgctcc

SEQ ID NO: 1103083 - DNA, 22 bp, Artificial Sequence
  chemically synthesized
tcaaaagctagaggagcaaatg

SEQ ID NO: 1103084 - DNA, 22 bp, Artificial Sequence
  chemically synthesized
cggagtttattcatttgctcct

SEQ ID NO: 1103085 - DNA, 22 bp, Artificial Sequence
  chemically synthesized
ggagtttattcatttgctcctc

SEQ ID NO: 1103086 - DNA, 22 bp, Artificial Sequence
  chemically synthesized
agcattgtcaaaagctagagga

SEQ ID NO: 1103087 - DNA, 22 bp, Artificial Sequence
  chemically synthesized
attcatttgctcctctagcttt

SEQ ID NO: 1103088 - DNA, 22 bp, Artificial Sequence
  chemically synthesized
ttcatttgctcctctagctttt

SEQ ID NO: 1103089 - DNA, 22 bp, Artificial Sequence
  chemically synthesized
gttgagcattgtcaaaagctag

SEQ ID NO: 1103090 - DNA, 22 bp, Artificial Sequence
  chemically synthesized
atttgctcctctagcttttgac

SEQ ID NO: 1103091 - DNA, 22 bp, Artificial Sequence
  chemically synthesized
gctcctctagcttttgacaatg

SEQ ID NO: 1103092 - DNA, 22 bp, Artificial Sequence
  chemically synthesized
ctcctctagcttttgacaatgc

SEQ ID NO: 1103093 - DNA, 22 bp, Artificial Sequence
  chemically synthesized
ccagctggttgagcattgtcaa

SEQ ID NO: 1103094 - DNA, 22 bp, Artificial Sequence
  chemically synthesized
ctctagcttttgacaatgctca

SEQ ID NO: 1103095 - DNA, 22 bp, Artificial Sequence
  chemically synthesized
ctcccagctggttgagcattgt

SEQ ID NO: 1103096 - DNA, 22 bp, Artificial Sequence
  chemically synthesized
tcctcccagctggttgagcatt

SEQ ID NO: 1103097 - DNA, 22 bp, Artificial Sequence
  chemically synthesized
tagcttttgacaatgctcaacc

SEQ ID NO: 1103098 - DNA, 22 bp, Artificial Sequence
  chemically synthesized
gcttttgacaatgctcaaccag

SEQ ID NO: 1103099 - DNA, 22 bp, Artificial Sequence
  chemically synthesized
ttgacaatgctcaaccagctgg

SEQ ID NO: 1103100 - DNA, 22 bp, Artificial Sequence
  chemically synthesized
tgacaatgctcaaccagctggg

SEQ ID NO: 1103101 - DNA, 22 bp, Artificial Sequence
  chemically synthesized
gacaatgctcaaccagctggga

SEQ ID NO: 1103102 - DNA, 22 bp, Artificial Sequence
  chemically synthesized
acaatgctcaaccagctgggag

SEQ ID NO: 1103103 - DNA, 22 bp, Artificial Sequence
  chemically synthesized
gaagaagctctcctcccagctg

SEQ ID NO: 1103104 - DNA, 22 bp, Artificial Sequence
  chemically synthesized
aaccagctgggaggagagcttc

SEQ ID NO: 1103105 - DNA, 22 bp, Artificial Sequence
  chemically synthesized
agggacgctggaagaagctctc

SEQ ID NO: 1103106 - DNA, 22 bp, Artificial Sequence
  chemically synthesized
ggaggagagcttcttccagcgt

SEQ ID NO: 1103107 - DNA, 22 bp, Artificial Sequence
  chemically synthesized
aagaaattgagggacgctggaa

SEQ ID NO: 1103108 - DNA, 22 bp, Artificial Sequence
  chemically synthesized
gaagaaattgagggacgctgga

SEQ ID NO: 1103109 - DNA, 22 bp, Artificial Sequence
  chemically synthesized
cttccagcgtccctcaatttct

SEQ ID NO: 1103110 - DNA, 22 bp, Artificial Sequence
  chemically synthesized
ttccagcgtccctcaatttctt

SEQ ID NO: 1103111 - DNA, 22 bp, Artificial Sequence
  chemically synthesized
ccagcgtccctcaatttcttca

SEQ ID NO: 1103112 - DNA, 22 bp, Artificial Sequence
  chemically synthesized
cagcgtccctcaatttcttcaa

SEQ ID NO: 1103113 - DNA, 22 bp, Artificial Sequence
  chemically synthesized
gccggaaatatcaatcagaatt

SEQ ID NO: 1103114 - DNA, 22 bp, Artificial Sequence
  chemically synthesized
aatttcttcaaattctgattga

SEQ ID NO: 1103115 - DNA, 22 bp, Artificial Sequence
  chemically synthesized
aaattagccggaaatatcaatc

SEQ ID NO: 1103116 - DNA, 22 bp, Artificial Sequence
  chemically synthesized
cttcaaattctgattgatattt

SEQ ID NO: 1103117 - DNA, 22 bp, Artificial Sequence
  chemically synthesized
ttcaaattctgattgatatttc

SEQ ID NO: 1103118 - DNA, 22 bp, Artificial Sequence
  chemically synthesized
tgaaattagccggaaatatcaa

SEQ ID NO: 1103119 - DNA, 22 bp, Artificial Sequence
  chemically synthesized
caaattctgattgatatttccg

SEQ ID NO: 1103120 - DNA, 22 bp, Artificial Sequence
  chemically synthesized
aaattctgattgatatttccgg

SEQ ID NO: 1103121 - DNA, 22 bp, Artificial Sequence
  chemically synthesized
tgattgatatttccggctaatt

SEQ ID NO: 1103122 - DNA, 22 bp, Artificial Sequence
  chemically synthesized
attgatatttccggctaatttc

SEQ ID NO: 1103123 - DNA, 22 bp, Artificial Sequence
  chemically synthesized
atatttccggctaatttcagag

SEQ ID NO: 1103124 - DNA, 22 bp, Artificial Sequence
  chemically synthesized
ccggctaatttcagagggcgct

SEQ ID NO: 1103125 - DNA, 22 bp, Artificial Sequence
  chemically synthesized
cggctaatttcagagggcgctt

SEQ ID NO: 1103126 - DNA, 22 bp, Artificial Sequence
  chemically synthesized
atttcagagggcgctttcttcg

SEQ ID NO: 1103127 - DNA, 22 bp, Artificial Sequence
  chemically synthesized
tgaaagagatgtcgaagaaagc

SEQ ID NO: 1103128 - DNA, 22 bp, Artificial Sequence
  chemically synthesized
cagagggcgctttcttcgacat

SEQ ID NO: 1103129 - DNA, 22 bp, Artificial Sequence
  chemically synthesized
agagggcgctttcttcgacatc

SEQ ID NO: 1103130 - DNA, 22 bp, Artificial Sequence
  chemically synthesized
agcaccactgtgaaagagatgt

SEQ ID NO: 1103131 - DNA, 22 bp, Artificial Sequence
  chemically synthesized
tctcagcaccactgtgaaagag

SEQ ID NO: 1103132 - DNA, 22 bp, Artificial Sequence
  chemically synthesized
tcttcgacatctctttcacagt

SEQ ID NO: 1103133 - DNA, 22 bp, Artificial Sequence
  chemically synthesized
cttcgacatctctttcacagtg

SEQ ID NO: 1103134 - DNA, 22 bp, Artificial Sequence
  chemically synthesized
ttcgacatctctttcacagtgg

SEQ ID NO: 1103135 - DNA, 22 bp, Artificial Sequence
  chemically synthesized
tactatctcagcaccactgtga

SEQ ID NO: 1103136 - DNA, 22 bp, Artificial Sequence
  chemically synthesized
cgacatctctttcacagtggtg

SEQ ID NO: 1103137 - DNA, 22 bp, Artificial Sequence
  chemically synthesized
gacatctctttcacagtggtgc

SEQ ID NO: 1103138 - DNA, 22 bp, Artificial Sequence
  chemically synthesized
tttcacagtggtgctgagatag

SEQ ID NO: 1103139 - DNA, 22 bp, Artificial Sequence
  chemically synthesized
tcacagtggtgctgagatagta

SEQ ID NO: 1103140 - DNA, 22 bp, Artificial Sequence
  chemically synthesized
cacagtggtgctgagatagtat

SEQ ID NO: 1103141 - DNA, 22 bp, Artificial Sequence
  chemically synthesized
acagtggtgctgagatagtata

SEQ ID NO: 1103142 - DNA, 22 bp, Artificial Sequence
  chemically synthesized
caagagcaacaaagtggcctat

SEQ ID NO: 1103143 - DNA, 22 bp, Artificial Sequence
  chemically synthesized
tgcaagagcaacaaagtggcct

SEQ ID NO: 1103144 - DNA, 22 bp, Artificial Sequence
  chemically synthesized
tctgcaagagcaacaaagtggc

SEQ ID NO: 1103145 - DNA, 22 bp, Artificial Sequence
  chemically synthesized
agatagtataggccactttgtt

SEQ ID NO: 1103146 - DNA, 22 bp, Artificial Sequence
  chemically synthesized
caaagttctctgcaagagcaac

SEQ ID NO: 1103147 - DNA, 22 bp, Artificial Sequence
  chemically synthesized
acaaagttctctgcaagagcaa

SEQ ID NO: 1103148 - DNA, 22 bp, Artificial Sequence
  chemically synthesized
tacaaagttctctgcaagagca

SEQ ID NO: 1103149 - DNA, 22 bp, Artificial Sequence
  chemically synthesized
ggctttacaaagttctctgcaa

SEQ ID NO: 1103150 - DNA, 22 bp, Artificial Sequence
  chemically synthesized
aggctttacaaagttctctgca

SEQ ID NO: 1103151 - DNA, 22 bp, Artificial Sequence
  chemically synthesized
taggctttacaaagttctctgc

SEQ ID NO: 1103152 - DNA, 22 bp, Artificial Sequence
  chemically synthesized
ttaggctttacaaagttctctg

SEQ ID NO: 1103153 - DNA, 22 bp, Artificial Sequence
  chemically synthesized
tgttgctcttgcagagaacttt

SEQ ID NO: 1103154 - DNA, 22 bp, Artificial Sequence
  chemically synthesized
tttaggctttacaaagttctct

SEQ ID NO: 1103155 - DNA, 22 bp, Artificial Sequence
  chemically synthesized
gttgctcttgcagagaactttg

SEQ ID NO: 1103156 - DNA, 22 bp, Artificial Sequence
  chemically synthesized
ttgctcttgcagagaactttgt

SEQ ID NO: 1103157 - DNA, 22 bp, Artificial Sequence
  chemically synthesized
ttttttaggctttacaaagttc

SEQ ID NO: 1103158 - DNA, 22 bp, Artificial Sequence
  chemically synthesized
ctcttgcagagaactttgtaaa

SEQ ID NO: 1103159 - DNA, 22 bp, Artificial Sequence
  chemically synthesized
ttgcagagaactttgtaaagcc

SEQ ID NO: 1103160 - DNA, 22 bp, Artificial Sequence
  chemically synthesized
gcagagaactttgtaaagccta

SEQ ID NO: 1103161 - DNA, 22 bp, Artificial Sequence
  chemically synthesized
cagagaactttgtaaagcctaa

SEQ ID NO: 1103162 - DNA, 22 bp, Artificial Sequence
  chemically synthesized
aaaaattgttttttaggcttta

SEQ ID NO: 1103163 - DNA, 22 bp, Artificial Sequence
  chemically synthesized
aaaaaattgttttttaggcttt

SEQ ID NO: 1103164 - DNA, 22 bp, Artificial Sequence
  chemically synthesized
tgtaaagcctaaaaaacaattt

SEQ ID NO: 1103165 - DNA, 22 bp, Artificial Sequence
  chemically synthesized
gtaaagcctaaaaaacaatttt

SEQ ID NO: 1103166 - DNA, 22 bp, Artificial Sequence
  chemically synthesized
taaagcctaaaaaacaattttt

SEQ ID NO: 1103167 - DNA, 22 bp, Artificial Sequence
  chemically synthesized
gggtaaatgtatttaaaaaatt

SEQ ID NO: 1103168 - DNA, 22 bp, Artificial Sequence
  chemically synthesized
aaaaacaattttttaaatacat

SEQ ID NO: 1103169 - DNA, 22 bp, Artificial Sequence
  chemically synthesized
atcaattagggtaaatgtattt

SEQ ID NO: 1103170 - DNA, 22 bp, Artificial Sequence
  chemically synthesized
ttcatcaattagggtaaatgta

SEQ ID NO: 1103171 - DNA, 22 bp, Artificial Sequence
  chemically synthesized
ttattcatcaattagggtaaat

SEQ ID NO: 1103172 - DNA, 22 bp, Artificial Sequence
  chemically synthesized
tttaaatacatttaccctaatt

SEQ ID NO: 1103173 - DNA, 22 bp, Artificial Sequence
  chemically synthesized
ttaaatacatttaccctaattg

SEQ ID NO: 1103174 - DNA, 22 bp, Artificial Sequence
  chemically synthesized
taaatacatttaccctaattga

SEQ ID NO: 1103175 - DNA, 22 bp, Artificial Sequence
  chemically synthesized
aaatacatttaccctaattgat

SEQ ID NO: 1103176 - DNA, 22 bp, Artificial Sequence
  chemically synthesized
aatacatttaccctaattgatg

SEQ ID NO: 1103177 - DNA, 22 bp, Artificial Sequence
  chemically synthesized
atcaattattattcatcaatta

SEQ ID NO: 1103178 - DNA, 22 bp, Artificial Sequence
  chemically synthesized
aaactcatcaattattattcat

SEQ ID NO: 1103179 - DNA, 22 bp, Artificial Sequence
  chemically synthesized
accctaattgatgaataataat

SEQ ID NO: 1103180 - DNA, 22 bp, Artificial Sequence
  chemically synthesized
ccctaattgatgaataataatt

SEQ ID NO: 1103181 - DNA, 22 bp, Artificial Sequence
  chemically synthesized
actaaaactcatcaattattat

SEQ ID NO: 1103182 - DNA, 22 bp, Artificial Sequence
  chemically synthesized
cactaaaactcatcaattatta

SEQ ID NO: 1103183 - DNA, 22 bp, Artificial Sequence
  chemically synthesized
attgatgaataataattgatga

SEQ ID NO: 1103184 - DNA, 22 bp, Artificial Sequence
  chemically synthesized
atttcactaaaactcatcaatt

SEQ ID NO: 1103185 - DNA, 22 bp, Artificial Sequence
  chemically synthesized
atgaataataattgatgagttt

SEQ ID NO: 1103186 - DNA, 22 bp, Artificial Sequence
  chemically synthesized
aagtacagttaatttcactaaa

SEQ ID NO: 1103187 - DNA, 22 bp, Artificial Sequence
  chemically synthesized
caagtacagttaatttcactaa

SEQ ID NO: 1103188 - DNA, 22 bp, Artificial Sequence
  chemically synthesized
atgagttttagtgaaattaact

SEQ ID NO: 1103189 - DNA, 22 bp, Artificial Sequence
  chemically synthesized
tagtgaaattaactgtacttga

SEQ ID NO: 1103190 - DNA, 22 bp, Artificial Sequence
  chemically synthesized
agtgaaattaactgtacttgaa

SEQ ID NO: 1103191 - DNA, 22 bp, Artificial Sequence
  chemically synthesized
aatcatatagatttcaagtaca

SEQ ID NO: 1103192 - DNA, 22 bp, Artificial Sequence
  chemically synthesized
gtgaaattaactgtacttgaaa

SEQ ID NO: 1103193 - DNA, 22 bp, Artificial Sequence
  chemically synthesized
gaatcatatagatttcaagtac

SEQ ID NO: 1103194 - DNA, 22 bp, Artificial Sequence
  chemically synthesized
catgtttgaatcatatagattt

SEQ ID NO: 1103195 - DNA, 22 bp, Artificial Sequence
  chemically synthesized
acatgtttgaatcatatagatt

SEQ ID NO: 1103196 - DNA, 22 bp, Artificial Sequence
  chemically synthesized
actgtacttgaaatctatatga

SEQ ID NO: 1103197 - DNA, 22 bp, Artificial Sequence
  chemically synthesized
tttacatgtttgaatcatatag

SEQ ID NO: 1103198 - DNA, 22 bp, Artificial Sequence
  chemically synthesized
gtttacatgtttgaatcatata

SEQ ID NO: 1103199 - DNA, 22 bp, Artificial Sequence
  chemically synthesized
tacttgaaatctatatgattca

SEQ ID NO: 1103200 - DNA, 22 bp, Artificial Sequence
  chemically synthesized
tgtttacatgtttgaatcatat

SEQ ID NO: 1103201 - DNA, 22 bp, Artificial Sequence
  chemically synthesized
ctttgtttacatgtttgaatca

SEQ ID NO: 1103202 - DNA, 22 bp, Artificial Sequence
  chemically synthesized
gaaatctatatgattcaaacat

SEQ ID NO: 1103203 - DNA, 22 bp, Artificial Sequence
  chemically synthesized
aaatctatatgattcaaacatg

SEQ ID NO: 1103204 - DNA, 22 bp, Artificial Sequence
  chemically synthesized
tatgattcaaacatgtaaacaa

SEQ ID NO: 1103205 - DNA, 22 bp, Artificial Sequence
  chemically synthesized
atagaagatcatctactttgtt

SEQ ID NO: 1103206 - DNA, 22 bp, Artificial Sequence
  chemically synthesized
aaacatgtaaacaaagtagatg

SEQ ID NO: 1103207 - DNA, 22 bp, Artificial Sequence
  chemically synthesized
taactgatagaagatcatctac

SEQ ID NO: 1103208 - DNA, 22 bp, Artificial Sequence
  chemically synthesized
ataactgatagaagatcatcta

SEQ ID NO: 1103209 - DNA, 22 bp, Artificial Sequence
  chemically synthesized
gaagtttataactgatagaaga

SEQ ID NO: 1103210 - DNA, 22 bp, Artificial Sequence
  chemically synthesized
ccactagaagtttataactgat

SEQ ID NO: 1103211 - DNA, 22 bp, Artificial Sequence
  chemically synthesized
aattaccactagaagtttataa

SEQ ID NO: 1103212 - DNA, 22 bp, Artificial Sequence
  chemically synthesized
aaattaccactagaagtttata

SEQ ID NO: 1103213 - DNA, 22 bp, Artificial Sequence
  chemically synthesized
ctatcagttataaacttctagt

SEQ ID NO: 1103214 - DNA, 22 bp, Artificial Sequence
  chemically synthesized
tatcagttataaacttctagtg

SEQ ID NO: 1103215 - DNA, 22 bp, Artificial Sequence
  chemically synthesized
tcagttataaacttctagtggt

SEQ ID NO: 1103216 - DNA, 22 bp, Artificial Sequence
  chemically synthesized
taaacttctagtggtaatttaa

SEQ ID NO: 1103217 - DNA, 22 bp, Artificial Sequence
  chemically synthesized
ggataatatgtaaaatttaaat

SEQ ID NO: 1103218 - DNA, 22 bp, Artificial Sequence
  chemically synthesized
aggataatatgtaaaatttaaa

SEQ ID NO: 1103219 - DNA, 22 bp, Artificial Sequence
  chemically synthesized
ctagtggtaatttaaattttac

SEQ ID NO: 1103220 - DNA, 22 bp, Artificial Sequence
  chemically synthesized
ttaggataatatgtaaaattta

SEQ ID NO: 1103221 - DNA, 22 bp, Artificial Sequence
  chemically synthesized
tagtggtaatttaaattttaca

SEQ ID NO: 1103222 - DNA, 22 bp, Artificial Sequence
  chemically synthesized
gtggtaatttaaattttacata

SEQ ID NO: 1103223 - DNA, 22 bp, Artificial Sequence
  chemically synthesized
ctcttaggataatatgtaaaat

SEQ ID NO: 1103224 - DNA, 22 bp, Artificial Sequence
  chemically synthesized
aagttactcttaggataatatg

SEQ ID NO: 1103225 - DNA, 22 bp, Artificial Sequence
  chemically synthesized
aaattttacatattatcctaag

SEQ ID NO: 1103226 - DNA, 22 bp, Artificial Sequence
  chemically synthesized
aattttacatattatcctaaga

SEQ ID NO: 1103227 - DNA, 22 bp, Artificial Sequence
  chemically synthesized
tacatattatcctaagagtaac

SEQ ID NO: 1103228 - DNA, 22 bp, Artificial Sequence
  chemically synthesized
aataatattcaagttactctta

SEQ ID NO: 1103229 - DNA, 22 bp, Artificial Sequence
  chemically synthesized
acatattatcctaagagtaact

SEQ ID NO: 1103230 - DNA, 22 bp, Artificial Sequence
  chemically synthesized
catattatcctaagagtaactt

SEQ ID NO: 1103231 - DNA, 22 bp, Artificial Sequence
  chemically synthesized
tcctaagagtaacttgaatatt

SEQ ID NO: 1103232 - DNA, 22 bp, Artificial Sequence
  chemically synthesized
aataccactaaataatattcaa

SEQ ID NO: 1103233 - DNA, 22 bp, Artificial Sequence
  chemically synthesized
agagtaacttgaatattattta

SEQ ID NO: 1103234 - DNA, 22 bp, Artificial Sequence
  chemically synthesized
gaatattatttagtggtattta

SEQ ID NO: 1103235 - DNA, 22 bp, Artificial Sequence
  chemically synthesized
aatattatttagtggtatttaa

SEQ ID NO: 1103236 - DNA, 22 bp, Artificial Sequence
  chemically synthesized
tttagtggtatttaacactcca

SEQ ID NO: 1103237 - DNA, 22 bp, Artificial Sequence
  chemically synthesized
agaaaaatacatatggagtgtt

SEQ ID NO: 1103238 - DNA, 22 bp, Artificial Sequence
  chemically synthesized
agtggtatttaacactccatat

SEQ ID NO: 1103239 - DNA, 22 bp, Artificial Sequence
  chemically synthesized
gtggtatttaacactccatatg

SEQ ID NO: 1103240 - DNA, 22 bp, Artificial Sequence
  chemically synthesized
ttcagaaaaatacatatggagt

SEQ ID NO: 1103241 - DNA, 22 bp, Artificial Sequence
  chemically synthesized
acattgttcagaaaaatacata

SEQ ID NO: 1103242 - DNA, 22 bp, Artificial Sequence
  chemically synthesized
gacattgttcagaaaaatacat

SEQ ID NO: 1103243 - DNA, 22 bp, Artificial Sequence
  chemically synthesized
aacactccatatgtatttttct

SEQ ID NO: 1103244 - DNA, 22 bp, Artificial Sequence
  chemically synthesized
acactccatatgtatttttctg

SEQ ID NO: 1103245 - DNA, 22 bp, Artificial Sequence
  chemically synthesized
catatgtatttttctgaacaat

SEQ ID NO: 1103246 - DNA, 22 bp, Artificial Sequence
  chemically synthesized
agatatatttgacattgttcag

SEQ ID NO: 1103247 - DNA, 22 bp, Artificial Sequence
  chemically synthesized
gagatatatttgacattgttca

SEQ ID NO: 1103248 - DNA, 22 bp, Artificial Sequence
  chemically synthesized
tgagatatatttgacattgttc

SEQ ID NO: 1103249 - DNA, 22 bp, Artificial Sequence
  chemically synthesized
ttctgaacaatgtcaaatatat

SEQ ID NO: 1103250 - DNA, 22 bp, Artificial Sequence
  chemically synthesized
tctgaacaatgtcaaatatatc

SEQ ID NO: 1103251 - DNA, 22 bp, Artificial Sequence
  chemically synthesized
ctgaacaatgtcaaatatatct

SEQ ID NO: 1103252 - DNA, 22 bp, Artificial Sequence
  chemically synthesized
tgaacaatgtcaaatatatctc

SEQ ID NO: 1103253 - DNA, 22 bp, Artificial Sequence
  chemically synthesized
aacaatgtcaaatatatctcaa

SEQ ID NO: 1103254 - DNA, 22 bp, Artificial Sequence
  chemically synthesized
taagatatagttttgagatata

SEQ ID NO: 1103255 - DNA, 22 bp, Artificial Sequence
  chemically synthesized
tgtaagatatagttttgagata

SEQ ID NO: 1103256 - DNA, 22 bp, Artificial Sequence
  chemically synthesized
gctctgtaagatatagttttga

SEQ ID NO: 1103257 - DNA, 22 bp, Artificial Sequence
  chemically synthesized
ggctctgtaagatatagttttg

SEQ ID NO: 1103258 - DNA, 22 bp, Artificial Sequence
  chemically synthesized
tggctctgtaagatatagtttt

SEQ ID NO: 1103259 - DNA, 22 bp, Artificial Sequence
  chemically synthesized
ttggctctgtaagatatagttt

SEQ ID NO: 1103260 - DNA, 22 bp, Artificial Sequence
  chemically synthesized
tttggctctgtaagatatagtt

SEQ ID NO: 1103261 - DNA, 22 bp, Artificial Sequence
  chemically synthesized
aaaactatatcttacagagcca

SEQ ID NO: 1103262 - DNA, 22 bp, Artificial Sequence
  chemically synthesized
gatgcaccaaaactttttggct

SEQ ID NO: 1103263 - DNA, 22 bp, Artificial Sequence
  chemically synthesized
tatcttacagagccaaaaagtt

SEQ ID NO: 1103264 - DNA, 22 bp, Artificial Sequence
  chemically synthesized
acagagccaaaaagttttggtg

SEQ ID NO: 1103265 - DNA, 22 bp, Artificial Sequence
  chemically synthesized
cagagccaaaaagttttggtgc

SEQ ID NO: 1103266 - DNA, 22 bp, Artificial Sequence
  chemically synthesized
agtaaaattagatgcaccaaaa

SEQ ID NO: 1103267 - DNA, 22 bp, Artificial Sequence
  chemically synthesized
attcagtaaaattagatgcacc

SEQ ID NO: 1103268 - DNA, 22 bp, Artificial Sequence
  chemically synthesized
aattcagtaaaattagatgcac

SEQ ID NO: 1103269 - DNA, 22 bp, Artificial Sequence
  chemically synthesized
tggtgcatctaattttactgaa

SEQ ID NO: 1103270 - DNA, 22 bp, Artificial Sequence
  chemically synthesized
ggtgcatctaattttactgaat

SEQ ID NO: 1103271 - DNA, 22 bp, Artificial Sequence
  chemically synthesized
gtgcatctaattttactgaatt

SEQ ID NO: 1103272 - DNA, 22 bp, Artificial Sequence
  chemically synthesized
atatatatacttaattcagtaa

SEQ ID NO: 1103273 - DNA, 22 bp, Artificial Sequence
  chemically synthesized
ttaatatatatacttaattcag

SEQ ID NO: 1103274 - DNA, 22 bp, Artificial Sequence
  chemically synthesized
attttactgaattaagtatata

SEQ ID NO: 1103275 - DNA, 22 bp, Artificial Sequence
  chemically synthesized
tactgaattaagtatatatatt

SEQ ID NO: 1103276 - DNA, 22 bp, Artificial Sequence
  chemically synthesized
actgaattaagtatatatatta

SEQ ID NO: 1103277 - DNA, 22 bp, Artificial Sequence
  chemically synthesized
ctgaattaagtatatatattaa

SEQ ID NO: 1103278 - DNA, 22 bp, Artificial Sequence
  chemically synthesized
aattaagtatatatattaataa

SEQ ID NO: 1103279 - DNA, 22 bp, Artificial Sequence
  chemically synthesized
tatcacaaatgcagttattaat

SEQ ID NO: 1103280 - DNA, 22 bp, Artificial Sequence
  chemically synthesized
agtatatatattaataactgca

SEQ ID NO: 1103281 - DNA, 22 bp, Artificial Sequence
  chemically synthesized
actgtatcacaaatgcagttat

SEQ ID NO: 1103282 - DNA, 22 bp, Artificial Sequence
  chemically synthesized
cattaactgtatcacaaatgca

SEQ ID NO: 1103283 - DNA, 22 bp, Artificial Sequence
  chemically synthesized
aactccattaactgtatcacaa

SEQ ID NO: 1103284 - DNA, 22 bp, Artificial Sequence
  chemically synthesized
caactccattaactgtatcaca

SEQ ID NO: 1103285 - DNA, 22 bp, Artificial Sequence
  chemically synthesized
ataactgcatttgtgatacagt

SEQ ID NO: 1103286 - DNA, 22 bp, Artificial Sequence
  chemically synthesized
atttcaactccattaactgtat

SEQ ID NO: 1103287 - DNA, 22 bp, Artificial Sequence
  chemically synthesized
catttgtgatacagttaatgga

SEQ ID NO: 1103288 - DNA, 22 bp, Artificial Sequence
  chemically synthesized
gtgatacagttaatggagttga

SEQ ID NO: 1103289 - DNA, 22 bp, Artificial Sequence
  chemically synthesized
tgatacagttaatggagttgaa

SEQ ID NO: 1103290 - DNA, 22 bp, Artificial Sequence
  chemically synthesized
agtataattaatttcaactcca

SEQ ID NO: 1103291 - DNA, 22 bp, Artificial Sequence
  chemically synthesized
aaagctcagtataattaatttc

SEQ ID NO: 1103292 - DNA, 22 bp, Artificial Sequence
  chemically synthesized
ctgaaagctcagtataattaat

SEQ ID NO: 1103293 - DNA, 22 bp, Artificial Sequence
  chemically synthesized
atggagttgaaattaattatac

SEQ ID NO: 1103294 - DNA, 22 bp, Artificial Sequence
  chemically synthesized
cctgaaagctcagtataattaa

SEQ ID NO: 1103295 - DNA, 22 bp, Artificial Sequence
  chemically synthesized
tcctgaaagctcagtataatta

SEQ ID NO: 1103296 - DNA, 22 bp, Artificial Sequence
  chemically synthesized
ctttcctgaaagctcagtataa

SEQ ID NO: 1103297 - DNA, 22 bp, Artificial Sequence
  chemically synthesized
actttcctgaaagctcagtata

SEQ ID NO: 1103298 - DNA, 22 bp, Artificial Sequence
  chemically synthesized
aaattaattatactgagctttc

SEQ ID NO: 1103299 - DNA, 22 bp, Artificial Sequence
  chemically synthesized
attatactgagctttcaggaaa

SEQ ID NO: 1103300 - DNA, 22 bp, Artificial Sequence
  chemically synthesized
tgtagagtttactttcctgaaa

SEQ ID NO: 1103301 - DNA, 22 bp, Artificial Sequence
  chemically synthesized
atgtagagtttactttcctgaa

SEQ ID NO: 1103302 - DNA, 22 bp, Artificial Sequence
  chemically synthesized
tatgtagagtttactttcctga

SEQ ID NO: 1103303 - DNA, 22 bp, Artificial Sequence
  chemically synthesized
tactgagctttcaggaaagtaa

SEQ ID NO: 1103304 - DNA, 22 bp, Artificial Sequence
  chemically synthesized
tagttttatgtagagtttactt

SEQ ID NO: 1103305 - DNA, 22 bp, Artificial Sequence
  chemically synthesized
agctttcaggaaagtaaactct

SEQ ID NO: 1103306 - DNA, 22 bp, Artificial Sequence
  chemically synthesized
gctatagttttatgtagagttt

SEQ ID NO: 1103307 - DNA, 22 bp, Artificial Sequence
  chemically synthesized
tcaggaaagtaaactctacata

SEQ ID NO: 1103308 - DNA, 22 bp, Artificial Sequence
  chemically synthesized
caggaaagtaaactctacataa

SEQ ID NO: 1103309 - DNA, 22 bp, Artificial Sequence
  chemically synthesized
ttagctatagttttatgtagag

SEQ ID NO: 1103310 - DNA, 22 bp, Artificial Sequence
  chemically synthesized
aggaaagtaaactctacataaa

SEQ ID NO: 1103311 - DNA, 22 bp, Artificial Sequence
  chemically synthesized
tacataaaactatagctaataa

SEQ ID NO: 1103312 - DNA, 22 bp, Artificial Sequence
  chemically synthesized
catatatcaatattattagcta

SEQ ID NO: 1103313 - DNA, 22 bp, Artificial Sequence
  chemically synthesized
cataaaactatagctaataata

SEQ ID NO: 1103314 - DNA, 22 bp, Artificial Sequence
  chemically synthesized
ttccatatatcaatattattag

SEQ ID NO: 1103315 - DNA, 22 bp, Artificial Sequence
  chemically synthesized
tattccatatatcaatattatt

SEQ ID NO: 1103316 - DNA, 22 bp, Artificial Sequence
  chemically synthesized
ctattccatatatcaatattat

SEQ ID NO: 1103317 - DNA, 22 bp, Artificial Sequence
  chemically synthesized
tctattccatatatcaatatta

SEQ ID NO: 1103318 - DNA, 22 bp, Artificial Sequence
  chemically synthesized
ttctattccatatatcaatatt

SEQ ID NO: 1103319 - DNA, 22 bp, Artificial Sequence
  chemically synthesized
tagctaataatattgatatatg

SEQ ID NO: 1103320 - DNA, 22 bp, Artificial Sequence
  chemically synthesized
aataagtttttctattccatat

SEQ ID NO: 1103321 - DNA, 22 bp, Artificial Sequence
  chemically synthesized
ataatattgatatatggaatag

SEQ ID NO: 1103322 - DNA, 22 bp, Artificial Sequence
  chemically synthesized
ttcaataagtttttctattcca

SEQ ID NO: 1103323 - DNA, 22 bp, Artificial Sequence
  chemically synthesized
atatatggaatagaaaaactta

SEQ ID NO: 1103324 - DNA, 22 bp, Artificial Sequence
  chemically synthesized
agtacatagattgttcaataag

SEQ ID NO: 1103325 - DNA, 22 bp, Artificial Sequence
  chemically synthesized
aaaatatattaagtacatagat

SEQ ID NO: 1103326 - DNA, 22 bp, Artificial Sequence
  chemically synthesized
gaaaatatattaagtacataga

SEQ ID NO: 1103327 - DNA, 22 bp, Artificial Sequence
  chemically synthesized
tgaaaatatattaagtacatag

SEQ ID NO: 1103328 - DNA, 22 bp, Artificial Sequence
  chemically synthesized
ttgaaaatatattaagtacata

SEQ ID NO: 1103329 - DNA, 22 bp, Artificial Sequence
  chemically synthesized
attgaacaatctatgtacttaa

SEQ ID NO: 1103330 - DNA, 22 bp, Artificial Sequence
  chemically synthesized
tttgaaaatatattaagtacat

SEQ ID NO: 1103331 - DNA, 22 bp, Artificial Sequence
  chemically synthesized
ttgaacaatctatgtacttaat

SEQ ID NO: 1103332 - DNA, 22 bp, Artificial Sequence
  chemically synthesized
aacaatctatgtacttaatata

SEQ ID NO: 1103333 - DNA, 22 bp, Artificial Sequence
  chemically synthesized
tgtacttaatatattttcaaaa

SEQ ID NO: 1103334 - DNA, 22 bp, Artificial Sequence
  chemically synthesized
cataacagaataacattttttg

SEQ ID NO: 1103335 - DNA, 22 bp, Artificial Sequence
  chemically synthesized
aatatattttcaaaaaatgtta

SEQ ID NO: 1103336 - DNA, 22 bp, Artificial Sequence
  chemically synthesized
atatattttcaaaaaatgttat

SEQ ID NO: 1103337 - DNA, 22 bp, Artificial Sequence
  chemically synthesized
tcaaaaaatgttattctgttat

SEQ ID NO: 1103338 - DNA, 22 bp, Artificial Sequence
  chemically synthesized
caaaaaatgttattctgttatg

SEQ ID NO: 1103339 - DNA, 22 bp, Artificial Sequence
  chemically synthesized
aaaaaatgttattctgttatgt

SEQ ID NO: 1103340 - DNA, 22 bp, Artificial Sequence
  chemically synthesized
aatcccaccataatactacata

SEQ ID NO: 1103341 - DNA, 22 bp, Artificial Sequence
  chemically synthesized
gaatcccaccataatactacat

SEQ ID NO: 1103342 - DNA, 22 bp, Artificial Sequence
  chemically synthesized
ttctgttatgtagtattatggt

SEQ ID NO: 1103343 - DNA, 22 bp, Artificial Sequence
  chemically synthesized
tccttgaatcccaccataatac

SEQ ID NO: 1103344 - DNA, 22 bp, Artificial Sequence
  chemically synthesized
tgttatgtagtattatggtggg

SEQ ID NO: 1103345 - DNA, 22 bp, Artificial Sequence
  chemically synthesized
ttatgtagtattatggtgggat

SEQ ID NO: 1103346 - DNA, 22 bp, Artificial Sequence
  chemically synthesized
tgtagtattatggtgggattca

SEQ ID NO: 1103347 - DNA, 22 bp, Artificial Sequence
  chemically synthesized
cacaaaactatccttgaatccc

SEQ ID NO: 1103348 - DNA, 22 bp, Artificial Sequence
  chemically synthesized
tccacaaaactatccttgaatc

SEQ ID NO: 1103349 - DNA, 22 bp, Artificial Sequence
  chemically synthesized
tggtgggattcaaggatagttt

SEQ ID NO: 1103350 - DNA, 22 bp, Artificial Sequence
  chemically synthesized
taaattctccacaaaactatcc

SEQ ID NO: 1103351 - DNA, 22 bp, Artificial Sequence
  chemically synthesized
ataaattctccacaaaactatc

SEQ ID NO: 1103352 - DNA, 22 bp, Artificial Sequence
  chemically synthesized
tataaattctccacaaaactat

SEQ ID NO: 1103353 - DNA, 22 bp, Artificial Sequence
  chemically synthesized
aaggatagttttgtggagaatt

SEQ ID NO: 1103354 - DNA, 22 bp, Artificial Sequence
  chemically synthesized
tgtggagaatttataaaattta

SEQ ID NO: 1103355 - DNA, 22 bp, Artificial Sequence
  chemically synthesized
gtggagaatttataaaatttat

SEQ ID NO: 1103356 - DNA, 22 bp, Artificial Sequence
  chemically synthesized
tggagaatttataaaatttatt

SEQ ID NO: 1103357 - DNA, 22 bp, Artificial Sequence
  chemically synthesized
tacagaataagtataaataaat

SEQ ID NO: 1103358 - DNA, 22 bp, Artificial Sequence
  chemically synthesized
ataaaatttatttatacttatt

SEQ ID NO: 1103359 - DNA, 22 bp, Artificial Sequence
  chemically synthesized
taaaatttatttatacttattc

SEQ ID NO: 1103360 - DNA, 22 bp, Artificial Sequence
  chemically synthesized
catgtgttatacagaataagta

SEQ ID NO: 1103361 - DNA, 22 bp, Artificial Sequence
  chemically synthesized
atttatacttattctgtataac

SEQ ID NO: 1103362 - DNA, 22 bp, Artificial Sequence
  chemically synthesized
tttatacttattctgtataaca

SEQ ID NO: 1103363 - DNA, 22 bp, Artificial Sequence
  chemically synthesized
taagaaattacatgtgttatac

SEQ ID NO: 1103364 - DNA, 22 bp, Artificial Sequence
  chemically synthesized
atacttattctgtataacacat

SEQ ID NO: 1103365 - DNA, 22 bp, Artificial Sequence
  chemically synthesized
tacttattctgtataacacatg

SEQ ID NO: 1103366 - DNA, 22 bp, Artificial Sequence
  chemically synthesized
ctgtaagaaattacatgtgtta

SEQ ID NO: 1103367 - DNA, 22 bp, Artificial Sequence
  chemically synthesized
attctgtataacacatgtaatt

SEQ ID NO: 1103368 - DNA, 22 bp, Artificial Sequence
  chemically synthesized
ttctgtataacacatgtaattt

SEQ ID NO: 1103369 - DNA, 22 bp, Artificial Sequence
  chemically synthesized
tgtataacacatgtaatttctt

SEQ ID NO: 1103370 - DNA, 22 bp, Artificial Sequence
  chemically synthesized
tgatcctactgtaagaaattac

SEQ ID NO: 1103371 - DNA, 22 bp, Artificial Sequence
  chemically synthesized
tataacacatgtaatttcttac

SEQ ID NO: 1103372 - DNA, 22 bp, Artificial Sequence
  chemically synthesized
aagttatgatcctactgtaaga

SEQ ID NO: 1103373 - DNA, 22 bp, Artificial Sequence
  chemically synthesized
cttacagtaggatcataacttt

SEQ ID NO: 1103374 - DNA, 22 bp, Artificial Sequence
  chemically synthesized
ttacagtaggatcataacttta

SEQ ID NO: 1103375 - DNA, 22 bp, Artificial Sequence
  chemically synthesized
aacaggggaagtctaaagttat

SEQ ID NO: 1103376 - DNA, 22 bp, Artificial Sequence
  chemically synthesized
acagtaggatcataactttaga

SEQ ID NO: 1103377 - DNA, 22 bp, Artificial Sequence
  chemically synthesized
cagtaggatcataactttagac

SEQ ID NO: 1103378 - DNA, 22 bp, Artificial Sequence
  chemically synthesized
aagtaaatattgaacaggggaa

SEQ ID NO: 1103379 - DNA, 22 bp, Artificial Sequence
  chemically synthesized
tagacttcccctgttcaatatt

SEQ ID NO: 1103380 - DNA, 22 bp, Artificial Sequence
  chemically synthesized
agacttcccctgttcaatattt

SEQ ID NO: 1103381 - DNA, 22 bp, Artificial Sequence
  chemically synthesized
gacttcccctgttcaatattta

SEQ ID NO: 1103382 - DNA, 22 bp, Artificial Sequence
  chemically synthesized
cccctgttcaatatttacttta

SEQ ID NO: 1103383 - DNA, 22 bp, Artificial Sequence
  chemically synthesized
ccctgttcaatatttactttaa

SEQ ID NO: 1103384 - DNA, 22 bp, Artificial Sequence
  chemically synthesized
taaagtaaaagtaacattaaag

SEQ ID NO: 1103385 - DNA, 22 bp, Artificial Sequence
  chemically synthesized
ttcaatatttactttaatgtta

SEQ ID NO: 1103386 - DNA, 22 bp, Artificial Sequence
  chemically synthesized
ataaagtaaaagtaacattaaa

SEQ ID NO: 1103387 - DNA, 22 bp, Artificial Sequence
  chemically synthesized
tataaagtaaaagtaacattaa

SEQ ID NO: 1103388 - DNA, 22 bp, Artificial Sequence
  chemically synthesized
aatatttactttaatgttactt

SEQ ID NO: 1103389 - DNA, 22 bp, Artificial Sequence
  chemically synthesized
ttttataaagtaaaagtaacat

SEQ ID NO: 1103390 - DNA, 22 bp, Artificial Sequence
  chemically synthesized
ttattttataaagtaaaagtaa

SEQ ID NO: 1103391 - DNA, 22 bp, Artificial Sequence
  chemically synthesized
attattttataaagtaaaagta

SEQ ID NO: 1103392 - DNA, 22 bp, Artificial Sequence
  chemically synthesized
tattattttataaagtaaaagt

SEQ ID NO: 1103393 - DNA, 22 bp, Artificial Sequence
  chemically synthesized
actttaatgttacttttacttt

SEQ ID NO: 1103394 - DNA, 22 bp, Artificial Sequence
  chemically synthesized
ctttaatgttacttttacttta

SEQ ID NO: 1103395 - DNA, 22 bp, Artificial Sequence
  chemically synthesized
taatgttacttttactttataa

SEQ ID NO: 1103396 - DNA, 22 bp, Artificial Sequence
  chemically synthesized
aatgttacttttactttataaa

SEQ ID NO: 1103397 - DNA, 22 bp, Artificial Sequence
  chemically synthesized
atgttacttttactttataaaa

SEQ ID NO: 1103398 - DNA, 22 bp, Artificial Sequence
  chemically synthesized
tcatgagcctttattattttat

SEQ ID NO: 1103399 - DNA, 22 bp, Artificial Sequence
  chemically synthesized
gtcatgagcctttattatttta

SEQ ID NO: 1103400 - DNA, 22 bp, Artificial Sequence
  chemically synthesized
cttttactttataaaataataa

SEQ ID NO: 1103401 - DNA, 22 bp, Artificial Sequence
  chemically synthesized
tgtcatgagcctttattatttt

SEQ ID NO: 1103402 - DNA, 22 bp, Artificial Sequence
  chemically synthesized
ttgtcatgagcctttattattt

SEQ ID NO: 1103403 - DNA, 22 bp, Artificial Sequence
  chemically synthesized
ttactttataaaataataaagg

SEQ ID NO: 1103404 - DNA, 22 bp, Artificial Sequence
  chemically synthesized
tactttataaaataataaaggc

SEQ ID NO: 1103405 - DNA, 22 bp, Artificial Sequence
  chemically synthesized
actttataaaataataaaggct

SEQ ID NO: 1103406 - DNA, 22 bp, Artificial Sequence
  chemically synthesized
ctttataaaataataaaggctc

SEQ ID NO: 1103407 - DNA, 22 bp, Artificial Sequence
  chemically synthesized
catttttgtcatgagcctttat

SEQ ID NO: 1103408 - DNA, 22 bp, Artificial Sequence
  chemically synthesized
ccatttttgtcatgagccttta

SEQ ID NO: 1103409 - DNA, 22 bp, Artificial Sequence
  chemically synthesized
tccatttttgtcatgagccttt

SEQ ID NO: 1103410 - DNA, 22 bp, Artificial Sequence
  chemically synthesized
tataaaataataaaggctcatg

SEQ ID NO: 1103411 - DNA, 22 bp, Artificial Sequence
  chemically synthesized
ttccatttttgtcatgagcctt

SEQ ID NO: 1103412 - DNA, 22 bp, Artificial Sequence
  chemically synthesized
ataaaataataaaggctcatga

SEQ ID NO: 1103413 - DNA, 22 bp, Artificial Sequence
  chemically synthesized
tttccatttttgtcatgagcct

SEQ ID NO: 1103414 - DNA, 22 bp, Artificial Sequence
  chemically synthesized
taaaataataaaggctcatgac

SEQ ID NO: 1103415 - DNA, 22 bp, Artificial Sequence
  chemically synthesized
ttttccatttttgtcatgagcc

SEQ ID NO: 1103416 - DNA, 22 bp, Artificial Sequence
  chemically synthesized
tttttccatttttgtcatgagc

SEQ ID NO: 1103417 - DNA, 22 bp, Artificial Sequence
  chemically synthesized
ttttttccatttttgtcatgag

SEQ ID NO: 1103418 - DNA, 22 bp, Artificial Sequence
  chemically synthesized
gtttttttttccatttttgtca

SEQ ID NO: 1103419 - DNA, 22 bp, Artificial Sequence
  chemically synthesized
tggtttttttttccatttttgt

SEQ ID NO: 1103420 - DNA, 22 bp, Artificial Sequence
  chemically synthesized
gtagttctggtttttttttcca

SEQ ID NO: 1103421 - DNA, 22 bp, Artificial Sequence
  chemically synthesized
atgacaaaaatggaaaaaaaaa

SEQ ID NO: 1103422 - DNA, 22 bp, Artificial Sequence
  chemically synthesized
tataaagtactagtagttctgg

SEQ ID NO: 1103423 - DNA, 22 bp, Artificial Sequence
  chemically synthesized
atataaagtactagtagttctg

SEQ ID NO: 1103424 - DNA, 22 bp, Artificial Sequence
  chemically synthesized
aaaatttatataaagtactagt

SEQ ID NO: 1103425 - DNA, 22 bp, Artificial Sequence
  chemically synthesized
ctagtactttatataaattttc

SEQ ID NO: 1103426 - DNA, 22 bp, Artificial Sequence
  chemically synthesized
gtactttatataaattttcaat

SEQ ID NO: 1103427 - DNA, 22 bp, Artificial Sequence
  chemically synthesized
tacatagaacaaattgaaaatt

SEQ ID NO: 1103428 - DNA, 22 bp, Artificial Sequence
  chemically synthesized
gctatacatagaacaaattgaa

SEQ ID NO: 1103429 - DNA, 22 bp, Artificial Sequence
  chemically synthesized
agctatacatagaacaaattga

SEQ ID NO: 1103430 - DNA, 22 bp, Artificial Sequence
  chemically synthesized
tatataaattttcaatttgttc

SEQ ID NO: 1103431 - DNA, 22 bp, Artificial Sequence
  chemically synthesized
atataaattttcaatttgttct

SEQ ID NO: 1103432 - DNA, 22 bp, Artificial Sequence
  chemically synthesized
tataaattttcaatttgttcta

SEQ ID NO: 1103433 - DNA, 22 bp, Artificial Sequence
  chemically synthesized
atatttagctatacatagaaca

SEQ ID NO: 1103434 - DNA, 22 bp, Artificial Sequence
  chemically synthesized
aatatttagctatacatagaac

SEQ ID NO: 1103435 - DNA, 22 bp, Artificial Sequence
  chemically synthesized
tcaatttgttctatgtatagct

SEQ ID NO: 1103436 - DNA, 22 bp, Artificial Sequence
  chemically synthesized
caatttgttctatgtatagcta

SEQ ID NO: 1103437 - DNA, 22 bp, Artificial Sequence
  chemically synthesized
aatttgttctatgtatagctaa

SEQ ID NO: 1103438 - DNA, 22 bp, Artificial Sequence
  chemically synthesized
gttctatgtatagctaaatatt

SEQ ID NO: 1103439 - DNA, 22 bp, Artificial Sequence
  chemically synthesized
ttctatgtatagctaaatatta

SEQ ID NO: 1103440 - DNA, 22 bp, Artificial Sequence
  chemically synthesized
tatgtatagctaaatattaaat

SEQ ID NO: 1103441 - DNA, 22 bp, Artificial Sequence
  chemically synthesized
tgtatagctaaatattaaatat

SEQ ID NO: 1103442 - DNA, 22 bp, Artificial Sequence
  chemically synthesized
tatgtgcatacatgatcatata

SEQ ID NO: 1103443 - DNA, 22 bp, Artificial Sequence
  chemically synthesized
atatgtgcatacatgatcatat

SEQ ID NO: 1103444 - DNA, 22 bp, Artificial Sequence
  chemically synthesized
aatattaaatatatgatcatgt

SEQ ID NO: 1103445 - DNA, 22 bp, Artificial Sequence
  chemically synthesized
tttatatgtgcatacatgatca

SEQ ID NO: 1103446 - DNA, 22 bp, Artificial Sequence
  chemically synthesized
aatatatgatcatgtatgcaca

SEQ ID NO: 1103447 - DNA, 22 bp, Artificial Sequence
  chemically synthesized
taggggaaagaataactgttta

SEQ ID NO: 1103448 - DNA, 22 bp, Artificial Sequence
  chemically synthesized
atataggtcacattatagggga

SEQ ID NO: 1103449 - DNA, 22 bp, Artificial Sequence
  chemically synthesized
ggttgatataggtcacattata

SEQ ID NO: 1103450 - DNA, 22 bp, Artificial Sequence
  chemically synthesized
gggttgatataggtcacattat

SEQ ID NO: 1103451 - DNA, 22 bp, Artificial Sequence
  chemically synthesized
ttctttcccctataatgtgacc

SEQ ID NO: 1103452 - DNA, 22 bp, Artificial Sequence
  chemically synthesized
tgggttgatataggtcacatta

SEQ ID NO: 1103453 - DNA, 22 bp, Artificial Sequence
  chemically synthesized
tttcccctataatgtgacctat

SEQ ID NO: 1103454 - DNA, 22 bp, Artificial Sequence
  chemically synthesized
tcccctataatgtgacctatat

SEQ ID NO: 1103455 - DNA, 22 bp, Artificial Sequence
  chemically synthesized
cccctataatgtgacctatatc

SEQ ID NO: 1103456 - DNA, 22 bp, Artificial Sequence
  chemically synthesized
ccctataatgtgacctatatca

SEQ ID NO: 1103457 - DNA, 22 bp, Artificial Sequence
  chemically synthesized
acaaattttgggttgatatagg

SEQ ID NO: 1103458 - DNA, 22 bp, Artificial Sequence
  chemically synthesized
gacaaattttgggttgatatag

SEQ ID NO: 1103459 - DNA, 22 bp, Artificial Sequence
  chemically synthesized
taatgtgacctatatcaaccca

SEQ ID NO: 1103460 - DNA, 22 bp, Artificial Sequence
  chemically synthesized
gatatttgacaaattttgggtt

SEQ ID NO: 1103461 - DNA, 22 bp, Artificial Sequence
  chemically synthesized
agatatttgacaaattttgggt

SEQ ID NO: 1103462 - DNA, 22 bp, Artificial Sequence
  chemically synthesized
tatcaacccaaaatttgtcaaa

SEQ ID NO: 1103463 - DNA, 22 bp, Artificial Sequence
  chemically synthesized
taaaacttagatatttgacaaa

SEQ ID NO: 1103464 - DNA, 22 bp, Artificial Sequence
  chemically synthesized
tgaaactataaaacttagatat

SEQ ID NO: 1103465 - DNA, 22 bp, Artificial Sequence
  chemically synthesized
gtcaaatatctaagttttatag

SEQ ID NO: 1103466 - DNA, 22 bp, Artificial Sequence
  chemically synthesized
tcaaatatctaagttttatagt

SEQ ID NO: 1103467 - DNA, 22 bp, Artificial Sequence
  chemically synthesized
agttttatagtttcatagtatc

SEQ ID NO: 1103468 - DNA, 22 bp, Artificial Sequence
  chemically synthesized
tatagtttcatagtatcctatg

SEQ ID NO: 1103469 - DNA, 22 bp, Artificial Sequence
  chemically synthesized
atagtttcatagtatcctatgc

SEQ ID NO: 1103470 - DNA, 22 bp, Artificial Sequence
  chemically synthesized
tagtttcatagtatcctatgcc

SEQ ID NO: 1103471 - DNA, 22 bp, Artificial Sequence
  chemically synthesized
agtaccaccaaataggcatagg

SEQ ID NO: 1103472 - DNA, 22 bp, Artificial Sequence
  chemically synthesized
catagtatcctatgcctatttg

SEQ ID NO: 1103473 - DNA, 22 bp, Artificial Sequence
  chemically synthesized
atagtatcctatgcctatttgg

SEQ ID NO: 1103474 - DNA, 22 bp, Artificial Sequence
  chemically synthesized
tgcctatttggtggtacttaat

SEQ ID NO: 1103475 - DNA, 22 bp, Artificial Sequence
  chemically synthesized
tttggtggtacttaatttgttt

SEQ ID NO: 1103476 - DNA, 22 bp, Artificial Sequence
  chemically synthesized
ggtggtacttaatttgtttttt

SEQ ID NO: 1103477 - DNA, 22 bp, Artificial Sequence
  chemically synthesized
gtggtacttaatttgttttttt

SEQ ID NO: 1103478 - DNA, 22 bp, Artificial Sequence
  chemically synthesized
aaaaagtaaagtaaaaaaacaa

SEQ ID NO: 1103479 - DNA, 22 bp, Artificial Sequence
  chemically synthesized
aaaaaagtaaagtaaaaaaaca

SEQ ID NO: 1103480 - DNA, 22 bp, Artificial Sequence
  chemically synthesized
aatttgtttttttactttactt

SEQ ID NO: 1103481 - DNA, 22 bp, Artificial Sequence
  chemically synthesized
atttgtttttttactttacttt

SEQ ID NO: 1103482 - DNA, 22 bp, Artificial Sequence
  chemically synthesized
gtttttttactttactttttta

SEQ ID NO: 1103483 - DNA, 22 bp, Artificial Sequence
  chemically synthesized
tttttttactttacttttttaa

SEQ ID NO: 1103484 - DNA, 22 bp, Artificial Sequence
  chemically synthesized
ttttactttacttttttaagtt

SEQ ID NO: 1103485 - DNA, 22 bp, Artificial Sequence
  chemically synthesized
tttactttacttttttaagttt

SEQ ID NO: 1103486 - DNA, 22 bp, Artificial Sequence
  chemically synthesized
aaaaagtgaaataaacttaaaa

SEQ ID NO: 1103487 - DNA, 22 bp, Artificial Sequence
  chemically synthesized
ttactttacttttttaagttta

SEQ ID NO: 1103488 - DNA, 22 bp, Artificial Sequence
  chemically synthesized
gaaaaagtgaaataaacttaaa

SEQ ID NO: 1103489 - DNA, 22 bp, Artificial Sequence
  chemically synthesized
tactttacttttttaagtttat

SEQ ID NO: 1103490 - DNA, 22 bp, Artificial Sequence
  chemically synthesized
actttacttttttaagtttatt

SEQ ID NO: 1103491 - DNA, 22 bp, Artificial Sequence
  chemically synthesized
ctttacttttttaagtttattt

SEQ ID NO: 1103492 - DNA, 22 bp, Artificial Sequence
  chemically synthesized
tacttttttaagtttatttcac

SEQ ID NO: 1103493 - DNA, 22 bp, Artificial Sequence
  chemically synthesized
acttttttaagtttatttcact

SEQ ID NO: 1103494 - DNA, 22 bp, Artificial Sequence
  chemically synthesized
cttttttaagtttatttcactt

SEQ ID NO: 1103495 - DNA, 22 bp, Artificial Sequence
  chemically synthesized
ttttaagtttatttcacttttt

SEQ ID NO: 1103496 - DNA, 22 bp, Artificial Sequence
  chemically synthesized
tttaagtttatttcactttttc

SEQ ID NO: 1103497 - DNA, 22 bp, Artificial Sequence
  chemically synthesized
ttaagtttatttcactttttca

SEQ ID NO: 1103498 - DNA, 22 bp, Artificial Sequence
  chemically synthesized
taagtttatttcactttttcaa

SEQ ID NO: 1103499 - DNA, 22 bp, Artificial Sequence
  chemically synthesized
aagtttatttcactttttcaaa

SEQ ID NO: 1103500 - DNA, 22 bp, Artificial Sequence
  chemically synthesized
agtttatttcactttttcaaat

SEQ ID NO: 1103501 - DNA, 22 bp, Artificial Sequence
  chemically synthesized
atttcactttttcaaattgttc

SEQ ID NO: 1103502 - DNA, 22 bp, Artificial Sequence
  chemically synthesized
tttcactttttcaaattgttcc

SEQ ID NO: 1103503 - DNA, 22 bp, Artificial Sequence
  chemically synthesized
cactttttcaaattgttcccct

SEQ ID NO: 1103504 - DNA, 22 bp, Artificial Sequence
  chemically synthesized
actttttcaaattgttccccta

SEQ ID NO: 1103505 - DNA, 22 bp, Artificial Sequence
  chemically synthesized
aataatcagtcataggggaaca

SEQ ID NO: 1103506 - DNA, 22 bp, Artificial Sequence
  chemically synthesized
tttcaaattgttcccctatgac

SEQ ID NO: 1103507 - DNA, 22 bp, Artificial Sequence
  chemically synthesized
tctaaataatcagtcatagggg

SEQ ID NO: 1103508 - DNA, 22 bp, Artificial Sequence
  chemically synthesized
ttcaaattgttcccctatgact

SEQ ID NO: 1103509 - DNA, 22 bp, Artificial Sequence
  chemically synthesized
tcaaattgttcccctatgactg

SEQ ID NO: 1103510 - DNA, 22 bp, Artificial Sequence
  chemically synthesized
caaattgttcccctatgactga

SEQ ID NO: 1103511 - DNA, 22 bp, Artificial Sequence
  chemically synthesized
aaattgttcccctatgactgat

SEQ ID NO: 1103512 - DNA, 22 bp, Artificial Sequence
  chemically synthesized
gatattgtctaaataatcagtc

SEQ ID NO: 1103513 - DNA, 22 bp, Artificial Sequence
  chemically synthesized
ttcccctatgactgattattta

SEQ ID NO: 1103514 - DNA, 22 bp, Artificial Sequence
  chemically synthesized
ccctatgactgattatttagac

SEQ ID NO: 1103515 - DNA, 22 bp, Artificial Sequence
  chemically synthesized
tatgctagatattgtctaaata

SEQ ID NO: 1103516 - DNA, 22 bp, Artificial Sequence
  chemically synthesized
tgactgattatttagacaatat

SEQ ID NO: 1103517 - DNA, 22 bp, Artificial Sequence
  chemically synthesized
attatttagacaatatctagca

SEQ ID NO: 1103518 - DNA, 22 bp, Artificial Sequence
  chemically synthesized
aaagtgtagttatatgctagat

SEQ ID NO: 1103519 - DNA, 22 bp, Artificial Sequence
  chemically synthesized
tttagacaatatctagcatata

SEQ ID NO: 1103520 - DNA, 22 bp, Artificial Sequence
  chemically synthesized
gctcaaagtgtagttatatgct

SEQ ID NO: 1103521 - DNA, 22 bp, Artificial Sequence
  chemically synthesized
agacaatatctagcatataact

SEQ ID NO: 1103522 - DNA, 22 bp, Artificial Sequence
  chemically synthesized
gacaatatctagcatataacta

SEQ ID NO: 1103523 - DNA, 22 bp, Artificial Sequence
  chemically synthesized
aaacacctagctcaaagtgtag

SEQ ID NO: 1103524 - DNA, 22 bp, Artificial Sequence
  chemically synthesized
gcatataactacactttgagct

SEQ ID NO: 1103525 - DNA, 22 bp, Artificial Sequence
  chemically synthesized
acactaaaacacctagctcaaa

SEQ ID NO: 1103526 - DNA, 22 bp, Artificial Sequence
  chemically synthesized
cactttgagctaggtgttttag

SEQ ID NO: 1103527 - DNA, 22 bp, Artificial Sequence
  chemically synthesized
tgagctaggtgttttagtgtga

SEQ ID NO: 1103528 - DNA, 22 bp, Artificial Sequence
  chemically synthesized
gagctaggtgttttagtgtgag

SEQ ID NO: 1103529 - DNA, 22 bp, Artificial Sequence
  chemically synthesized
agctaggtgttttagtgtgagc

SEQ ID NO: 1103530 - DNA, 22 bp, Artificial Sequence
  chemically synthesized
acatgggcaaatgctcacacta

SEQ ID NO: 1103531 - DNA, 22 bp, Artificial Sequence
  chemically synthesized
gacatgggcaaatgctcacact

SEQ ID NO: 1103532 - DNA, 22 bp, Artificial Sequence
  chemically synthesized
tttgacatgggcaaatgctcac

SEQ ID NO: 1103533 - DNA, 22 bp, Artificial Sequence
  chemically synthesized
ggtgttttagtgtgagcatttg

SEQ ID NO: 1103534 - DNA, 22 bp, Artificial Sequence
  chemically synthesized
tagtgtgagcatttgcccatgt

SEQ ID NO: 1103535 - DNA, 22 bp, Artificial Sequence
  chemically synthesized
agtgtgagcatttgcccatgtc

SEQ ID NO: 1103536 - DNA, 22 bp, Artificial Sequence
  chemically synthesized
gtgtgagcatttgcccatgtca

SEQ ID NO: 1103537 - DNA, 22 bp, Artificial Sequence
  chemically synthesized
aaaaaataattatttgacatgg

SEQ ID NO: 1103538 - DNA, 22 bp, Artificial Sequence
  chemically synthesized
gaaaaaataattatttgacatg

SEQ ID NO: 1103539 - DNA, 22 bp, Artificial Sequence
  chemically synthesized
tgaaaaaataattatttgacat

SEQ ID NO: 1103540 - DNA, 22 bp, Artificial Sequence
  chemically synthesized
ttgaaaaaataattatttgaca

SEQ ID NO: 1103541 - DNA, 22 bp, Artificial Sequence
  chemically synthesized
tttttgaaaaaataattatttg

SEQ ID NO: 1103542 - DNA, 22 bp, Artificial Sequence
  chemically synthesized
gtttttgaaaaaataattattt

SEQ ID NO: 1103543 - DNA, 22 bp, Artificial Sequence
  chemically synthesized
tgtttttgaaaaaataattatt

SEQ ID NO: 1103544 - DNA, 22 bp, Artificial Sequence
  chemically synthesized
ttgtttttgaaaaaataattat

SEQ ID NO: 1103545 - DNA, 22 bp, Artificial Sequence
  chemically synthesized
gcccatgtcaaataattatttt

SEQ ID NO: 1103546 - DNA, 22 bp, Artificial Sequence
  chemically synthesized
cccatgtcaaataattattttt

SEQ ID NO: 1103547 - DNA, 22 bp, Artificial Sequence
  chemically synthesized
caatttttgtttttgaaaaaat

SEQ ID NO: 1103548 - DNA, 22 bp, Artificial Sequence
  chemically synthesized
gaaaagccattacaatttttgt

SEQ ID NO: 1103549 - DNA, 22 bp, Artificial Sequence
  chemically synthesized
ttttttcaaaaacaaaaattgt

SEQ ID NO: 1103550 - DNA, 22 bp, Artificial Sequence
  chemically synthesized
tttcaaaaacaaaaattgtaat

SEQ ID NO: 1103551 - DNA, 22 bp, Artificial Sequence
  chemically synthesized
ttcaaaaacaaaaattgtaatg

SEQ ID NO: 1103552 - DNA, 22 bp, Artificial Sequence
  chemically synthesized
aactagaaaagccattacaatt

SEQ ID NO: 1103553 - DNA, 22 bp, Artificial Sequence
  chemically synthesized
tcaaaaacaaaaattgtaatgg

SEQ ID NO: 1103554 - DNA, 22 bp, Artificial Sequence
  chemically synthesized
caaaaacaaaaattgtaatggc

SEQ ID NO: 1103555 - DNA, 22 bp, Artificial Sequence
  chemically synthesized
aaaaacaaaaattgtaatggct

SEQ ID NO: 1103556 - DNA, 22 bp, Artificial Sequence
  chemically synthesized
ttgaactagaaaagccattaca

SEQ ID NO: 1103557 - DNA, 22 bp, Artificial Sequence
  chemically synthesized
ataatggaaattgttgaactag

SEQ ID NO: 1103558 - DNA, 22 bp, Artificial Sequence
  chemically synthesized
taatggcttttctagttcaaca

SEQ ID NO: 1103559 - DNA, 22 bp, Artificial Sequence
  chemically synthesized
ttctagttcaacaatttccatt

SEQ ID NO: 1103560 - DNA, 22 bp, Artificial Sequence
  chemically synthesized
tctagttcaacaatttccatta

SEQ ID NO: 1103561 - DNA, 22 bp, Artificial Sequence
  chemically synthesized
ctagttcaacaatttccattat

SEQ ID NO: 1103562 - DNA, 22 bp, Artificial Sequence
  chemically synthesized
tagttcaacaatttccattatt

SEQ ID NO: 1103563 - DNA, 22 bp, Artificial Sequence
  chemically synthesized
gttcaacaatttccattattag

SEQ ID NO: 1103564 - DNA, 22 bp, Artificial Sequence
  chemically synthesized
aacaatttccattattagttct

SEQ ID NO: 1103565 - DNA, 22 bp, Artificial Sequence
  chemically synthesized
gaaatgaatgtgtagaactaat

SEQ ID NO: 1103566 - DNA, 22 bp, Artificial Sequence
  chemically synthesized
ccattattagttctacacattc

SEQ ID NO: 1103567 - DNA, 22 bp, Artificial Sequence
  chemically synthesized
cattattagttctacacattca

SEQ ID NO: 1103568 - DNA, 22 bp, Artificial Sequence
  chemically synthesized
ttagttctacacattcatttct

SEQ ID NO: 1103569 - DNA, 22 bp, Artificial Sequence
  chemically synthesized
gttctacacattcatttctagt

SEQ ID NO: 1103570 - DNA, 22 bp, Artificial Sequence
  chemically synthesized
caggagtggaaaactagaaatg

SEQ ID NO: 1103571 - DNA, 22 bp, Artificial Sequence
  chemically synthesized
acaggagtggaaaactagaaat

SEQ ID NO: 1103572 - DNA, 22 bp, Artificial Sequence
  chemically synthesized
tacacattcatttctagttttc

SEQ ID NO: 1103573 - DNA, 22 bp, Artificial Sequence
  chemically synthesized
cacattcatttctagttttcca

SEQ ID NO: 1103574 - DNA, 22 bp, Artificial Sequence
  chemically synthesized
atttctagttttccactcctgt

SEQ ID NO: 1103575 - DNA, 22 bp, Artificial Sequence
  chemically synthesized
ctagttttccactcctgtaaat

SEQ ID NO: 1103576 - DNA, 22 bp, Artificial Sequence
  chemically synthesized
tagttttccactcctgtaaatt

SEQ ID NO: 1103577 - DNA, 22 bp, Artificial Sequence
  chemically synthesized
gttttccactcctgtaaattat

SEQ ID NO: 1103578 - DNA, 22 bp, Artificial Sequence
  chemically synthesized
tccactcctgtaaattatgttt

SEQ ID NO: 1103579 - DNA, 22 bp, Artificial Sequence
  chemically synthesized
ccactcctgtaaattatgttta

SEQ ID NO: 1103580 - DNA, 22 bp, Artificial Sequence
  chemically synthesized
cactcctgtaaattatgtttat

SEQ ID NO: 1103581 - DNA, 22 bp, Artificial Sequence
  chemically synthesized
ctgtaaattatgtttatctcta

SEQ ID NO: 1103582 - DNA, 22 bp, Artificial Sequence
  chemically synthesized
gataggtaggtagatagagata

SEQ ID NO: 1103583 - DNA, 22 bp, Artificial Sequence
  chemically synthesized
taaattatgtttatctctatct

SEQ ID NO: 1103584 - DNA, 22 bp, Artificial Sequence
  chemically synthesized
tgtttatctctatctacctacc

SEQ ID NO: 1103585 - DNA, 22 bp, Artificial Sequence
  chemically synthesized
atctctatctacctacctatct

SEQ ID NO: 1103586 - DNA, 22 bp, Artificial Sequence
  chemically synthesized
tctctatctacctacctatcta

SEQ ID NO: 1103587 - DNA, 22 bp, Artificial Sequence
  chemically synthesized
tatctacctacctatctaatcc

SEQ ID NO: 1103588 - DNA, 22 bp, Artificial Sequence
  chemically synthesized
tctacctacctatctaatccat

SEQ ID NO: 1103589 - DNA, 22 bp, Artificial Sequence
  chemically synthesized
agggatggatggatggattaga

SEQ ID NO: 1103590 - DNA, 22 bp, Artificial Sequence
  chemically synthesized
cctacctatctaatccatccat

SEQ ID NO: 1103591 - DNA, 22 bp, Artificial Sequence
  chemically synthesized
attgagggatggatggatggat

SEQ ID NO: 1103592 - DNA, 22 bp, Artificial Sequence
  chemically synthesized
cctatctaatccatccatccat

SEQ ID NO: 1103593 - DNA, 22 bp, Artificial Sequence
  chemically synthesized
attgattgagggatggatggat

SEQ ID NO: 1103594 - DNA, 22 bp, Artificial Sequence
  chemically synthesized
tctaatccatccatccatccct

SEQ ID NO: 1103595 - DNA, 22 bp, Artificial Sequence
  chemically synthesized
atccatccatccatccctcaat

SEQ ID NO: 1103596 - DNA, 22 bp, Artificial Sequence
  chemically synthesized
gagatagataggatattgattg

SEQ ID NO: 1103597 - DNA, 22 bp, Artificial Sequence
  chemically synthesized
aatcaatcaatatcctatctat

SEQ ID NO: 1103598 - DNA, 22 bp, Artificial Sequence
  chemically synthesized
aaagatgtaaatggaactggag

SEQ ID NO: 1103599 - DNA, 22 bp, Artificial Sequence
  chemically synthesized
tctatctccagttccatttaca

SEQ ID NO: 1103600 - DNA, 22 bp, Artificial Sequence
  chemically synthesized
tctccagttccatttacatctt

SEQ ID NO: 1103601 - DNA, 22 bp, Artificial Sequence
  chemically synthesized
cagttccatttacatctttgag

SEQ ID NO: 1103602 - DNA, 22 bp, Artificial Sequence
  chemically synthesized
catttacatctttgagtgtatt

SEQ ID NO: 1103603 - DNA, 22 bp, Artificial Sequence
  chemically synthesized
atggaaataatcagaatacact

SEQ ID NO: 1103604 - DNA, 22 bp, Artificial Sequence
  chemically synthesized
acatctttgagtgtattctgat

SEQ ID NO: 1103605 - DNA, 22 bp, Artificial Sequence
  chemically synthesized
catctttgagtgtattctgatt

SEQ ID NO: 1103606 - DNA, 22 bp, Artificial Sequence
  chemically synthesized
tatctgatggaaataatcagaa

SEQ ID NO: 1103607 - DNA, 22 bp, Artificial Sequence
  chemically synthesized
tgagtgtattctgattatttcc

SEQ ID NO: 1103608 - DNA, 22 bp, Artificial Sequence
  chemically synthesized
gagtgtattctgattatttcca

SEQ ID NO: 1103609 - DNA, 22 bp, Artificial Sequence
  chemically synthesized
agtgtattctgattatttccat

SEQ ID NO: 1103610 - DNA, 22 bp, Artificial Sequence
  chemically synthesized
catgaaatctgtatctgatgga

SEQ ID NO: 1103611 - DNA, 22 bp, Artificial Sequence
  chemically synthesized
ccatgaaatctgtatctgatgg

SEQ ID NO: 1103612 - DNA, 22 bp, Artificial Sequence
  chemically synthesized
tgattatttccatcagatacag

SEQ ID NO: 1103613 - DNA, 22 bp, Artificial Sequence
  chemically synthesized
attatttccatcagatacagat

SEQ ID NO: 1103614 - DNA, 22 bp, Artificial Sequence
  chemically synthesized
tttccatcagatacagatttca

SEQ ID NO: 1103615 - DNA, 22 bp, Artificial Sequence
  chemically synthesized
atataatttccatgaaatctgt

SEQ ID NO: 1103616 - DNA, 22 bp, Artificial Sequence
  chemically synthesized
ccatcagatacagatttcatgg

SEQ ID NO: 1103617 - DNA, 22 bp, Artificial Sequence
  chemically synthesized
catcagatacagatttcatgga

SEQ ID NO: 1103618 - DNA, 22 bp, Artificial Sequence
  chemically synthesized
ataacatacaacattaatataa

SEQ ID NO: 1103619 - DNA, 22 bp, Artificial Sequence
  chemically synthesized
catggaaattatattaatgttg

SEQ ID NO: 1103620 - DNA, 22 bp, Artificial Sequence
  chemically synthesized
atggaaattatattaatgttgt

SEQ ID NO: 1103621 - DNA, 22 bp, Artificial Sequence
  chemically synthesized
agtgcatcctaataacatacaa

SEQ ID NO: 1103622 - DNA, 22 bp, Artificial Sequence
  chemically synthesized
cagtgcatcctaataacataca

SEQ ID NO: 1103623 - DNA, 22 bp, Artificial Sequence
  chemically synthesized
ttcagtgcatcctaataacata

SEQ ID NO: 1103624 - DNA, 22 bp, Artificial Sequence
  chemically synthesized
tattaatgttgtatgttattag

SEQ ID NO: 1103625 - DNA, 22 bp, Artificial Sequence
  chemically synthesized
actcttcagtgcatcctaataa

SEQ ID NO: 1103626 - DNA, 22 bp, Artificial Sequence
  chemically synthesized
atgttgtatgttattaggatgc

SEQ ID NO: 1103627 - DNA, 22 bp, Artificial Sequence
  chemically synthesized
aggttaactcttcagtgcatcc

SEQ ID NO: 1103628 - DNA, 22 bp, Artificial Sequence
  chemically synthesized
tatgttattaggatgcactgaa

SEQ ID NO: 1103629 - DNA, 22 bp, Artificial Sequence
  chemically synthesized
ctgaggttaactcttcagtgca

SEQ ID NO: 1103630 - DNA, 22 bp, Artificial Sequence
  chemically synthesized
actgaggttaactcttcagtgc

SEQ ID NO: 1103631 - DNA, 22 bp, Artificial Sequence
  chemically synthesized
tactgaggttaactcttcagtg

SEQ ID NO: 1103632 - DNA, 22 bp, Artificial Sequence
  chemically synthesized
ttaggatgcactgaagagttaa

SEQ ID NO: 1103633 - DNA, 22 bp, Artificial Sequence
  chemically synthesized
ggatgcactgaagagttaacct

SEQ ID NO: 1103634 - DNA, 22 bp, Artificial Sequence
  chemically synthesized
aatatgaattttactgaggtta

SEQ ID NO: 1103635 - DNA, 22 bp, Artificial Sequence
  chemically synthesized
aagagttaacctcagtaaaatt

SEQ ID NO: 1103636 - DNA, 22 bp, Artificial Sequence
  chemically synthesized
gaaatgtaaattcaatatgaat

SEQ ID NO: 1103637 - DNA, 22 bp, Artificial Sequence
  chemically synthesized
acctcagtaaaattcatattga

SEQ ID NO: 1103638 - DNA, 22 bp, Artificial Sequence
  chemically synthesized
ctggaaatgtaaattcaatatg

SEQ ID NO: 1103639 - DNA, 22 bp, Artificial Sequence
  chemically synthesized
agtaaaattcatattgaattta

SEQ ID NO: 1103640 - DNA, 22 bp, Artificial Sequence
  chemically synthesized
ctgctggaaatgtaaattcaat

SEQ ID NO: 1103641 - DNA, 22 bp, Artificial Sequence
  chemically synthesized
actgctggaaatgtaaattcaa

SEQ ID NO: 1103642 - DNA, 22 bp, Artificial Sequence
  chemically synthesized
ttactgctggaaatgtaaattc

SEQ ID NO: 1103643 - DNA, 22 bp, Artificial Sequence
  chemically synthesized
tctcttactgctggaaatgtaa

SEQ ID NO: 1103644 - DNA, 22 bp, Artificial Sequence
  chemically synthesized
atattgaatttacatttccagc

SEQ ID NO: 1103645 - DNA, 22 bp, Artificial Sequence
  chemically synthesized
aatttacatttccagcagtaag

SEQ ID NO: 1103646 - DNA, 22 bp, Artificial Sequence
  chemically synthesized
acatttccagcagtaagagaca

SEQ ID NO: 1103647 - DNA, 22 bp, Artificial Sequence
  chemically synthesized
catttccagcagtaagagacaa

SEQ ID NO: 1103648 - DNA, 22 bp, Artificial Sequence
  chemically synthesized
ccagcagtaagagacaattttt

SEQ ID NO: 1103649 - DNA, 22 bp, Artificial Sequence
  chemically synthesized
cagcagtaagagacaattttta

SEQ ID NO: 1103650 - DNA, 22 bp, Artificial Sequence
  chemically synthesized
caagtggtgaaataaaaattgt

SEQ ID NO: 1103651 - DNA, 22 bp, Artificial Sequence
  chemically synthesized
gcaagtggtgaaataaaaattg

SEQ ID NO: 1103652 - DNA, 22 bp, Artificial Sequence
  chemically synthesized
ttatttcaccacttgcaaattg

SEQ ID NO: 1103653 - DNA, 22 bp, Artificial Sequence
  chemically synthesized
tatttcaccacttgcaaattgg

SEQ ID NO: 1103654 - DNA, 22 bp, Artificial Sequence
  chemically synthesized
atttcaccacttgcaaattggt

SEQ ID NO: 1103655 - DNA, 22 bp, Artificial Sequence
  chemically synthesized
tttcaccacttgcaaattggta

SEQ ID NO: 1103656 - DNA, 22 bp, Artificial Sequence
  chemically synthesized
caccacttgcaaattggtactt

SEQ ID NO: 1103657 - DNA, 22 bp, Artificial Sequence
  chemically synthesized
accacttgcaaattggtactta

SEQ ID NO: 1103658 - DNA, 22 bp, Artificial Sequence
  chemically synthesized
catacacacaaaagatataagt

SEQ ID NO: 1103659 - DNA, 22 bp, Artificial Sequence
  chemically synthesized
gcaaattggtacttatatcttt

SEQ ID NO: 1103660 - DNA, 22 bp, Artificial Sequence
  chemically synthesized
caaattggtacttatatctttt

SEQ ID NO: 1103661 - DNA, 22 bp, Artificial Sequence
  chemically synthesized
aattgcatacacacaaaagata

SEQ ID NO: 1103662 - DNA, 22 bp, Artificial Sequence
  chemically synthesized
gtacttatatcttttgtgtgta

SEQ ID NO: 1103663 - DNA, 22 bp, Artificial Sequence
  chemically synthesized
catactaaattgcatacacaca

SEQ ID NO: 1103664 - DNA, 22 bp, Artificial Sequence
  chemically synthesized
gcatactaaattgcatacacac

SEQ ID NO: 1103665 - DNA, 22 bp, Artificial Sequence
  chemically synthesized
tgcatactaaattgcatacaca

SEQ ID NO: 1103666 - DNA, 22 bp, Artificial Sequence
  chemically synthesized
ttgcatactaaattgcatacac

SEQ ID NO: 1103667 - DNA, 22 bp, Artificial Sequence
  chemically synthesized
atatcttttgtgtgtatgcaat

SEQ ID NO: 1103668 - DNA, 22 bp, Artificial Sequence
  chemically synthesized
tttgcatactaaattgcataca

SEQ ID NO: 1103669 - DNA, 22 bp, Artificial Sequence
  chemically synthesized
tatcttttgtgtgtatgcaatt

SEQ ID NO: 1103670 - DNA, 22 bp, Artificial Sequence
  chemically synthesized
ttttgcatactaaattgcatac

SEQ ID NO: 1103671 - DNA, 22 bp, Artificial Sequence
  chemically synthesized
tttttgcatactaaattgcata

SEQ ID NO: 1103672 - DNA, 22 bp, Artificial Sequence
  chemically synthesized
ttgtgtgtatgcaatttagtat

SEQ ID NO: 1103673 - DNA, 22 bp, Artificial Sequence
  chemically synthesized
tgtgtgtatgcaatttagtatg

SEQ ID NO: 1103674 - DNA, 22 bp, Artificial Sequence
  chemically synthesized
gtgtgtatgcaatttagtatgc

SEQ ID NO: 1103675 - DNA, 22 bp, Artificial Sequence
  chemically synthesized
tgtgtatgcaatttagtatgca

SEQ ID NO: 1103676 - DNA, 22 bp, Artificial Sequence
  chemically synthesized
caagatgagaattttttttgca

SEQ ID NO: 1103677 - DNA, 22 bp, Artificial Sequence
  chemically synthesized
agtatgcaaaaaaaattctcat

SEQ ID NO: 1103678 - DNA, 22 bp, Artificial Sequence
  chemically synthesized
gtatgcaaaaaaaattctcatc

SEQ ID NO: 1103679 - DNA, 22 bp, Artificial Sequence
  chemically synthesized
taaaggaagaagtaaaaaaatt

SEQ ID NO: 1103680 - DNA, 22 bp, Artificial Sequence
  chemically synthesized
tcatcttgtaatttttttactt

SEQ ID NO: 1103681 - DNA, 22 bp, Artificial Sequence
  chemically synthesized
atcttgtaatttttttacttct

SEQ ID NO: 1103682 - DNA, 22 bp, Artificial Sequence
  chemically synthesized
aattgtaaaggaagaagtaaaa

SEQ ID NO: 1103683 - DNA, 22 bp, Artificial Sequence
  chemically synthesized
aaattgtaaaggaagaagtaaa

SEQ ID NO: 1103684 - DNA, 22 bp, Artificial Sequence
  chemically synthesized
gtaatttttttacttcttcctt

SEQ ID NO: 1103685 - DNA, 22 bp, Artificial Sequence
  chemically synthesized
taatttttttacttcttccttt

SEQ ID NO: 1103686 - DNA, 22 bp, Artificial Sequence
  chemically synthesized
taacttaaattgtaaaggaaga

SEQ ID NO: 1103687 - DNA, 22 bp, Artificial Sequence
  chemically synthesized
ttttacttcttcctttacaatt

SEQ ID NO: 1103688 - DNA, 22 bp, Artificial Sequence
  chemically synthesized
tttacttcttcctttacaattt

SEQ ID NO: 1103689 - DNA, 22 bp, Artificial Sequence
  chemically synthesized
ttacttcttcctttacaattta

SEQ ID NO: 1103690 - DNA, 22 bp, Artificial Sequence
  chemically synthesized
tacttcttcctttacaatttaa

SEQ ID NO: 1103691 - DNA, 22 bp, Artificial Sequence
  chemically synthesized
acttcttcctttacaatttaag

SEQ ID NO: 1103692 - DNA, 22 bp, Artificial Sequence
  chemically synthesized
cttcttcctttacaatttaagt

SEQ ID NO: 1103693 - DNA, 22 bp, Artificial Sequence
  chemically synthesized
tgaataattgtaacttaaattg

SEQ ID NO: 1103694 - DNA, 22 bp, Artificial Sequence
  chemically synthesized
cttcctttacaatttaagttac

SEQ ID NO: 1103695 - DNA, 22 bp, Artificial Sequence
  chemically synthesized
ttcctttacaatttaagttaca

SEQ ID NO: 1103696 - DNA, 22 bp, Artificial Sequence
  chemically synthesized
cctttacaatttaagttacaat

SEQ ID NO: 1103697 - DNA, 22 bp, Artificial Sequence
  chemically synthesized
ctttacaatttaagttacaatt

SEQ ID NO: 1103698 - DNA, 22 bp, Artificial Sequence
  chemically synthesized
tacaatttaagttacaattatt

SEQ ID NO: 1103699 - DNA, 22 bp, Artificial Sequence
  chemically synthesized
acaatttaagttacaattattc

SEQ ID NO: 1103700 - DNA, 22 bp, Artificial Sequence
  chemically synthesized
caatttaagttacaattattca

SEQ ID NO: 1103701 - DNA, 22 bp, Artificial Sequence
  chemically synthesized
aagttacaattattcataggtt

SEQ ID NO: 1103702 - DNA, 22 bp, Artificial Sequence
  chemically synthesized
agttacaattattcataggttt

SEQ ID NO: 1103703 - DNA, 22 bp, Artificial Sequence
  chemically synthesized
caattattcataggtttattat

SEQ ID NO: 1103704 - DNA, 22 bp, Artificial Sequence
  chemically synthesized
ttcataggtttattattcatat

SEQ ID NO: 1103705 - DNA, 22 bp, Artificial Sequence
  chemically synthesized
caaaaagagacatatatgaata

SEQ ID NO: 1103706 - DNA, 22 bp, Artificial Sequence
  chemically synthesized
ataggtttattattcatatatg

SEQ ID NO: 1103707 - DNA, 22 bp, Artificial Sequence
  chemically synthesized
attattcatatatgtctctttt

SEQ ID NO: 1103708 - DNA, 22 bp, Artificial Sequence
  chemically synthesized
ttattcatatatgtctcttttt

SEQ ID NO: 1103709 - DNA, 22 bp, Artificial Sequence
  chemically synthesized
ttcatatatgtctctttttgga

SEQ ID NO: 1103710 - DNA, 22 bp, Artificial Sequence
  chemically synthesized
agtaaggtatcctccaaaaaga

SEQ ID NO: 1103711 - DNA, 22 bp, Artificial Sequence
  chemically synthesized
gagtaaggtatcctccaaaaag

SEQ ID NO: 1103712 - DNA, 22 bp, Artificial Sequence
  chemically synthesized
atatatgtctctttttggagga

SEQ ID NO: 1103713 - DNA, 22 bp, Artificial Sequence
  chemically synthesized
tttttggaggataccttactca

SEQ ID NO: 1103714 - DNA, 22 bp, Artificial Sequence
  chemically synthesized
tttggaggataccttactcaag

SEQ ID NO: 1103715 - DNA, 22 bp, Artificial Sequence
  chemically synthesized
ttggaggataccttactcaaga

SEQ ID NO: 1103716 - DNA, 22 bp, Artificial Sequence
  chemically synthesized
tggaggataccttactcaagac

SEQ ID NO: 1103717 - DNA, 22 bp, Artificial Sequence
  chemically synthesized
ggaggataccttactcaagact

SEQ ID NO: 1103718 - DNA, 22 bp, Artificial Sequence
  chemically synthesized
gaggataccttactcaagactt

SEQ ID NO: 1103719 - DNA, 22 bp, Artificial Sequence
  chemically synthesized
tgagtaaggaagaaagtcttga

SEQ ID NO: 1103720 - DNA, 22 bp, Artificial Sequence
  chemically synthesized
tgtgagtaaggaagaaagtctt

SEQ ID NO: 1103721 - DNA, 22 bp, Artificial Sequence
  chemically synthesized
ctgtgagtaaggaagaaagtct

SEQ ID NO: 1103722 - DNA, 22 bp, Artificial Sequence
  chemically synthesized
tctgtgagtaaggaagaaagtc

SEQ ID NO: 1103723 - DNA, 22 bp, Artificial Sequence
  chemically synthesized
ttctgtgagtaaggaagaaagt

SEQ ID NO: 1103724 - DNA, 22 bp, Artificial Sequence
  chemically synthesized
tttctgtgagtaaggaagaaag

SEQ ID NO: 1103725 - DNA, 22 bp, Artificial Sequence
  chemically synthesized
ttttctgtgagtaaggaagaaa

SEQ ID NO: 1103726 - DNA, 22 bp, Artificial Sequence
  chemically synthesized
tttttctgtgagtaaggaagaa

SEQ ID NO: 1103727 - DNA, 22 bp, Artificial Sequence
  chemically synthesized
ttttttctgtgagtaaggaaga

SEQ ID NO: 1103728 - DNA, 22 bp, Artificial Sequence
  chemically synthesized
actcaagactttcttccttact

SEQ ID NO: 1103729 - DNA, 22 bp, Artificial Sequence
  chemically synthesized
tttttttctgtgagtaaggaag

SEQ ID NO: 1103730 - DNA, 22 bp, Artificial Sequence
  chemically synthesized
ctcaagactttcttccttactc

SEQ ID NO: 1103731 - DNA, 22 bp, Artificial Sequence
  chemically synthesized
aagactttcttccttactcaca

SEQ ID NO: 1103732 - DNA, 22 bp, Artificial Sequence
  chemically synthesized
tcttccttactcacagaaaaaa

SEQ ID NO: 1103733 - DNA, 22 bp, Artificial Sequence
  chemically synthesized
cttccttactcacagaaaaaaa

SEQ ID NO: 1103734 - DNA, 22 bp, Artificial Sequence
  chemically synthesized
ttccttactcacagaaaaaaaa

SEQ ID NO: 1103735 - DNA, 22 bp, Artificial Sequence
  chemically synthesized
ccttactcacagaaaaaaaaag

SEQ ID NO: 1103736 - DNA, 22 bp, Artificial Sequence
  chemically synthesized
cttactcacagaaaaaaaaaga

SEQ ID NO: 1103737 - DNA, 22 bp, Artificial Sequence
  chemically synthesized
actcacagaaaaaaaaagattc

SEQ ID NO: 1103738 - DNA, 22 bp, Artificial Sequence
  chemically synthesized
ctcacagaaaaaaaaagattcc

SEQ ID NO: 1103739 - DNA, 22 bp, Artificial Sequence
  chemically synthesized
acagaaaaaaaaagattccttg

SEQ ID NO: 1103740 - DNA, 22 bp, Artificial Sequence
  chemically synthesized
aagaaatatgataccaaggaat

SEQ ID NO: 1103741 - DNA, 22 bp, Artificial Sequence
  chemically synthesized
aaagaaatatgataccaaggaa

SEQ ID NO: 1103742 - DNA, 22 bp, Artificial Sequence
  chemically synthesized
taaagaaatatgataccaagga

SEQ ID NO: 1103743 - DNA, 22 bp, Artificial Sequence
  chemically synthesized
cttggtatcatatttctttaaa

SEQ ID NO: 1103744 - DNA, 22 bp, Artificial Sequence
  chemically synthesized
ggtatcatatttctttaaaatt

SEQ ID NO: 1103745 - DNA, 22 bp, Artificial Sequence
  chemically synthesized
gtatcatatttctttaaaattg

SEQ ID NO: 1103746 - DNA, 22 bp, Artificial Sequence
  chemically synthesized
taaaaacaccagagacaatttt

SEQ ID NO: 1103747 - DNA, 22 bp, Artificial Sequence
  chemically synthesized
ctttaaaattgtctctggtgtt

SEQ ID NO: 1103748 - DNA, 22 bp, Artificial Sequence
  chemically synthesized
tttaaaattgtctctggtgttt

SEQ ID NO: 1103749 - DNA, 22 bp, Artificial Sequence
  chemically synthesized
taaaattgtctctggtgttttt

SEQ ID NO: 1103750 - DNA, 22 bp, Artificial Sequence
  chemically synthesized
aaaattgtctctggtgttttta

SEQ ID NO: 1103751 - DNA, 22 bp, Artificial Sequence
  chemically synthesized
aaattgtctctggtgtttttac

SEQ ID NO: 1103752 - DNA, 22 bp, Artificial Sequence
  chemically synthesized
tctctggtgtttttacaatgtt

SEQ ID NO: 1103753 - DNA, 22 bp, Artificial Sequence
  chemically synthesized
tggtgtttttacaatgtttgtg

SEQ ID NO: 1103754 - DNA, 22 bp, Artificial Sequence
  chemically synthesized
gtgtttttacaatgtttgtgat

SEQ ID NO: 1103755 - DNA, 22 bp, Artificial Sequence
  chemically synthesized
ttacaatgtttgtgattgtttc

SEQ ID NO: 1103756 - DNA, 22 bp, Artificial Sequence
  chemically synthesized
tacaatgtttgtgattgtttcc

SEQ ID NO: 1103757 - DNA, 22 bp, Artificial Sequence
  chemically synthesized
acaatgtttgtgattgtttcca

SEQ ID NO: 1103758 - DNA, 22 bp, Artificial Sequence
  chemically synthesized
caatgtttgtgattgtttccat

SEQ ID NO: 1103759 - DNA, 22 bp, Artificial Sequence
  chemically synthesized
gtgattgtttccatcgattttt

SEQ ID NO: 1103760 - DNA, 22 bp, Artificial Sequence
  chemically synthesized
tgattgtttccatcgattttta

SEQ ID NO: 1103761 - DNA, 22 bp, Artificial Sequence
  chemically synthesized
ggtggagaagcataaaaatcga

SEQ ID NO: 1103762 - DNA, 22 bp, Artificial Sequence
  chemically synthesized
aggtggagaagcataaaaatcg

SEQ ID NO: 1103763 - DNA, 22 bp, Artificial Sequence
  chemically synthesized
tttccatcgatttttatgcttc

SEQ ID NO: 1103764 - DNA, 22 bp, Artificial Sequence
  chemically synthesized
ccatcgatttttatgcttctcc

SEQ ID NO: 1103765 - DNA, 22 bp, Artificial Sequence
  chemically synthesized
catcgatttttatgcttctcca

SEQ ID NO: 1103766 - DNA, 22 bp, Artificial Sequence
  chemically synthesized
taaaaatttaggtggagaagca

SEQ ID NO: 1103767 - DNA, 22 bp, Artificial Sequence
  chemically synthesized
ttatgcttctccacctaaattt

SEQ ID NO: 1103768 - DNA, 22 bp, Artificial Sequence
  chemically synthesized
tatgcttctccacctaaatttt

SEQ ID NO: 1103769 - DNA, 22 bp, Artificial Sequence
  chemically synthesized
atgcttctccacctaaattttt

SEQ ID NO: 1103770 - DNA, 22 bp, Artificial Sequence
  chemically synthesized
tgcttctccacctaaattttta

SEQ ID NO: 1103771 - DNA, 22 bp, Artificial Sequence
  chemically synthesized
aaataataatgttataaaaatt

SEQ ID NO: 1103772 - DNA, 22 bp, Artificial Sequence
  chemically synthesized
aaaataataatgttataaaaat

SEQ ID NO: 1103773 - DNA, 22 bp, Artificial Sequence
  chemically synthesized
ctccacctaaatttttataaca

SEQ ID NO: 1103774 - DNA, 22 bp, Artificial Sequence
  chemically synthesized
tccacctaaatttttataacat

SEQ ID NO: 1103775 - DNA, 22 bp, Artificial Sequence
  chemically synthesized
cacctaaatttttataacatta

SEQ ID NO: 1103776 - DNA, 22 bp, Artificial Sequence
  chemically synthesized
gaaaatatttaaaataataatg

SEQ ID NO: 1103777 - DNA, 22 bp, Artificial Sequence
  chemically synthesized
aatttttataacattattattt

SEQ ID NO: 1103778 - DNA, 22 bp, Artificial Sequence
  chemically synthesized
ggaaaatatttaaaataataat

SEQ ID NO: 1103779 - DNA, 22 bp, Artificial Sequence
  chemically synthesized
tggaaaatatttaaaataataa

SEQ ID NO: 1103780 - DNA, 22 bp, Artificial Sequence
  chemically synthesized
ttataacattattattttaaat

SEQ ID NO: 1103781 - DNA, 22 bp, Artificial Sequence
  chemically synthesized
tataacattattattttaaata

SEQ ID NO: 1103782 - DNA, 22 bp, Artificial Sequence
  chemically synthesized
ataacattattattttaaatat

SEQ ID NO: 1103783 - DNA, 22 bp, Artificial Sequence
  chemically synthesized
taacattattattttaaatatt

SEQ ID NO: 1103784 - DNA, 22 bp, Artificial Sequence
  chemically synthesized
ttattttaaatattttccaaaa

SEQ ID NO: 1103785 - DNA, 22 bp, Artificial Sequence
  chemically synthesized
ttttaaatattttccaaaattt

SEQ ID NO: 1103786 - DNA, 22 bp, Artificial Sequence
  chemically synthesized
taaatattttccaaaatttggg

SEQ ID NO: 1103787 - DNA, 22 bp, Artificial Sequence
  chemically synthesized
aaatattttccaaaatttgggc

SEQ ID NO: 1103788 - DNA, 22 bp, Artificial Sequence
  chemically synthesized
aatattttccaaaatttgggct

SEQ ID NO: 1103789 - DNA, 22 bp, Artificial Sequence
  chemically synthesized
aaaaaatgtggggaagcccaaa

SEQ ID NO: 1103790 - DNA, 22 bp, Artificial Sequence
  chemically synthesized
tccaaaatttgggcttccccac

SEQ ID NO: 1103791 - DNA, 22 bp, Artificial Sequence
  chemically synthesized
ccaaaatttgggcttccccaca

SEQ ID NO: 1103792 - DNA, 22 bp, Artificial Sequence
  chemically synthesized
caaaatttgggcttccccacat

SEQ ID NO: 1103793 - DNA, 22 bp, Artificial Sequence
  chemically synthesized
gggcttccccacattttttgaa

SEQ ID NO: 1103794 - DNA, 22 bp, Artificial Sequence
  chemically synthesized
ggcttccccacattttttgaac

SEQ ID NO: 1103795 - DNA, 22 bp, Artificial Sequence
  chemically synthesized
ccccacattttttgaacatttt

SEQ ID NO: 1103796 - DNA, 22 bp, Artificial Sequence
  chemically synthesized
cccacattttttgaacatttta

SEQ ID NO: 1103797 - DNA, 22 bp, Artificial Sequence
  chemically synthesized
tttgaacattttattgtatgtg

SEQ ID NO: 1103798 - DNA, 22 bp, Artificial Sequence
  chemically synthesized
ttgaacattttattgtatgtgg

SEQ ID NO: 1103799 - DNA, 22 bp, Artificial Sequence
  chemically synthesized
tgaacattttattgtatgtggt

SEQ ID NO: 1103800 - DNA, 22 bp, Artificial Sequence
  chemically synthesized
gaacattttattgtatgtggtt

SEQ ID NO: 1103801 - DNA, 22 bp, Artificial Sequence
  chemically synthesized
caccaaaataaaaaccacatac

SEQ ID NO: 1103802 - DNA, 22 bp, Artificial Sequence
  chemically synthesized
aacattttattgtatgtggttt

SEQ ID NO: 1103803 - DNA, 22 bp, Artificial Sequence
  chemically synthesized
tattgtatgtggtttttatttt

SEQ ID NO: 1103804 - DNA, 22 bp, Artificial Sequence
  chemically synthesized
attgtatgtggtttttattttg

SEQ ID NO: 1103805 - DNA, 22 bp, Artificial Sequence
  chemically synthesized
ttgtatgtggtttttattttgg

SEQ ID NO: 1103806 - DNA, 22 bp, Artificial Sequence
  chemically synthesized
ccccaaagttacaccaaaataa

SEQ ID NO: 1103807 - DNA, 22 bp, Artificial Sequence
  chemically synthesized
cccccaaagttacaccaaaata

SEQ ID NO: 1103808 - DNA, 22 bp, Artificial Sequence
  chemically synthesized
tatgtggtttttattttggtgt

SEQ ID NO: 1103809 - DNA, 22 bp, Artificial Sequence
  chemically synthesized
ttattttggtgtaactttgggg

SEQ ID NO: 1103810 - DNA, 22 bp, Artificial Sequence
  chemically synthesized
tattttggtgtaactttggggg

SEQ ID NO: 1103811 - DNA, 22 bp, Artificial Sequence
  chemically synthesized
attttggtgtaactttggggga

SEQ ID NO: 1103812 - DNA, 22 bp, Artificial Sequence
  chemically synthesized
ttttggtgtaactttgggggaa

SEQ ID NO: 1103813 - DNA, 22 bp, Artificial Sequence
  chemically synthesized
tggtgtaactttgggggaaatg

SEQ ID NO: 1103814 - DNA, 22 bp, Artificial Sequence
  chemically synthesized
ggtgtaactttgggggaaatgt

SEQ ID NO: 1103815 - DNA, 22 bp, Artificial Sequence
  chemically synthesized
gtgtaactttgggggaaatgtt

SEQ ID NO: 1103816 - DNA, 22 bp, Artificial Sequence
  chemically synthesized
aaaaaaaagatatgaacatttc

SEQ ID NO: 1103817 - DNA, 22 bp, Artificial Sequence
  chemically synthesized
actaaaaaaaaagatatgaaca

SEQ ID NO: 1103818 - DNA, 22 bp, Artificial Sequence
  chemically synthesized
tgggggaaatgttcatatcttt

SEQ ID NO: 1103819 - DNA, 22 bp, Artificial Sequence
  chemically synthesized
gggggaaatgttcatatctttt

SEQ ID NO: 1103820 - DNA, 22 bp, Artificial Sequence
  chemically synthesized
actaactaaaaaaaaagatatg

SEQ ID NO: 1103821 - DNA, 22 bp, Artificial Sequence
  chemically synthesized
ggggaaatgttcatatcttttt

SEQ ID NO: 1103822 - DNA, 22 bp, Artificial Sequence
  chemically synthesized
ggaaatgtattaactaactaaa

SEQ ID NO: 1103823 - DNA, 22 bp, Artificial Sequence
  chemically synthesized
atatctttttttttagttagtt

SEQ ID NO: 1103824 - DNA, 22 bp, Artificial Sequence
  chemically synthesized
ttgggaaatgtattaactaact

SEQ ID NO: 1103825 - DNA, 22 bp, Artificial Sequence
  chemically synthesized
tttttttagttagttaatacat

SEQ ID NO: 1103826 - DNA, 22 bp, Artificial Sequence
  chemically synthesized
ttttttagttagttaatacatt

SEQ ID NO: 1103827 - DNA, 22 bp, Artificial Sequence
  chemically synthesized
tttttagttagttaatacattt

SEQ ID NO: 1103828 - DNA, 22 bp, Artificial Sequence
  chemically synthesized
ttttagttagttaatacatttc

SEQ ID NO: 1103829 - DNA, 22 bp, Artificial Sequence
  chemically synthesized
tttagttagttaatacatttcc

SEQ ID NO: 1103830 - DNA, 22 bp, Artificial Sequence
  chemically synthesized
ttagttagttaatacatttccc

SEQ ID NO: 1103831 - DNA, 22 bp, Artificial Sequence
  chemically synthesized
ataaatattattgggaaatgta

SEQ ID NO: 1103832 - DNA, 22 bp, Artificial Sequence
  chemically synthesized
tagttagttaatacatttccca

SEQ ID NO: 1103833 - DNA, 22 bp, Artificial Sequence
  chemically synthesized
agttagttaatacatttcccaa

SEQ ID NO: 1103834 - DNA, 22 bp, Artificial Sequence
  chemically synthesized
gttagttaatacatttcccaat

SEQ ID NO: 1103835 - DNA, 22 bp, Artificial Sequence
  chemically synthesized
ttcataaatattattgggaaat

SEQ ID NO: 1103836 - DNA, 22 bp, Artificial Sequence
  chemically synthesized
gttaatacatttcccaataata

SEQ ID NO: 1103837 - DNA, 22 bp, Artificial Sequence
  chemically synthesized
atacatttcccaataatattta

SEQ ID NO: 1103838 - DNA, 22 bp, Artificial Sequence
  chemically synthesized
cccaataatatttatgaacaat

SEQ ID NO: 1103839 - DNA, 22 bp, Artificial Sequence
  chemically synthesized
ccaataatatttatgaacaatt

SEQ ID NO: 1103840 - DNA, 22 bp, Artificial Sequence
  chemically synthesized
aaaaagataggaaagaaaataa

SEQ ID NO: 1103841 - DNA, 22 bp, Artificial Sequence
  chemically synthesized
atgaacaattattttctttcct

SEQ ID NO: 1103842 - DNA, 22 bp, Artificial Sequence
  chemically synthesized
tgaacaattattttctttccta

SEQ ID NO: 1103843 - DNA, 22 bp, Artificial Sequence
  chemically synthesized
cactgaaaaagataggaaagaa

SEQ ID NO: 1103844 - DNA, 22 bp, Artificial Sequence
  chemically synthesized
ccactgaaaaagataggaaaga

SEQ ID NO: 1103845 - DNA, 22 bp, Artificial Sequence
  chemically synthesized
tttccactgaaaaagataggaa

SEQ ID NO: 1103846 - DNA, 22 bp, Artificial Sequence
  chemically synthesized
ttttctttcctatctttttcag

SEQ ID NO: 1103847 - DNA, 22 bp, Artificial Sequence
  chemically synthesized
tctttcctatctttttcagtgg

SEQ ID NO: 1103848 - DNA, 22 bp, Artificial Sequence
  chemically synthesized
ctttcctatctttttcagtgga

SEQ ID NO: 1103849 - DNA, 22 bp, Artificial Sequence
  chemically synthesized
tttcctatctttttcagtggaa

SEQ ID NO: 1103850 - DNA, 22 bp, Artificial Sequence
  chemically synthesized
tcctatctttttcagtggaaat

SEQ ID NO: 1103851 - DNA, 22 bp, Artificial Sequence
  chemically synthesized
cctatctttttcagtggaaata

SEQ ID NO: 1103852 - DNA, 22 bp, Artificial Sequence
  chemically synthesized
ctatctttttcagtggaaatag

SEQ ID NO: 1103853 - DNA, 22 bp, Artificial Sequence
  chemically synthesized
tctttttcagtggaaatagtct

SEQ ID NO: 1103854 - DNA, 22 bp, Artificial Sequence
  chemically synthesized
gatgagcagaagagactatttc

SEQ ID NO: 1103855 - DNA, 22 bp, Artificial Sequence
  chemically synthesized
tttcagtggaaatagtctcttc

SEQ ID NO: 1103856 - DNA, 22 bp, Artificial Sequence
  chemically synthesized
ttcagtggaaatagtctcttct

SEQ ID NO: 1103857 - DNA, 22 bp, Artificial Sequence
  chemically synthesized
tcagtggaaatagtctcttctg

SEQ ID NO: 1103858 - DNA, 22 bp, Artificial Sequence
  chemically synthesized
cagtggaaatagtctcttctgc

SEQ ID NO: 1103859 - DNA, 22 bp, Artificial Sequence
  chemically synthesized
agtggaaatagtctcttctgct

SEQ ID NO: 1103860 - DNA, 22 bp, Artificial Sequence
  chemically synthesized
ttctgctcatctaactgccttt

SEQ ID NO: 1103861 - DNA, 22 bp, Artificial Sequence
  chemically synthesized
ctgctcatctaactgccttttc

SEQ ID NO: 1103862 - DNA, 22 bp, Artificial Sequence
  chemically synthesized
tgctcatctaactgccttttct

SEQ ID NO: 1103863 - DNA, 22 bp, Artificial Sequence
  chemically synthesized
ctcatctaactgccttttcttg

SEQ ID NO: 1103864 - DNA, 22 bp, Artificial Sequence
  chemically synthesized
atctaactgccttttcttgtgt

SEQ ID NO: 1103865 - DNA, 22 bp, Artificial Sequence
  chemically synthesized
actgccttttcttgtgttttct

SEQ ID NO: 1103866 - DNA, 22 bp, Artificial Sequence
  chemically synthesized
ccttttcttgtgttttctccac

SEQ ID NO: 1103867 - DNA, 22 bp, Artificial Sequence
  chemically synthesized
ttcttgtgttttctccactctt

SEQ ID NO: 1103868 - DNA, 22 bp, Artificial Sequence
  chemically synthesized
tcttgtgttttctccactctta

SEQ ID NO: 1103869 - DNA, 22 bp, Artificial Sequence
  chemically synthesized
cttgtgttttctccactcttat

SEQ ID NO: 1103870 - DNA, 22 bp, Artificial Sequence
  chemically synthesized
ttgtgttttctccactcttatt

SEQ ID NO: 1103871 - DNA, 22 bp, Artificial Sequence
  chemically synthesized
gtgttttctccactcttattct

SEQ ID NO: 1103872 - DNA, 22 bp, Artificial Sequence
  chemically synthesized
tgttttctccactcttattctt

SEQ ID NO: 1103873 - DNA, 22 bp, Artificial Sequence
  chemically synthesized
tctccactcttattcttgcaca

SEQ ID NO: 1103874 - DNA, 22 bp, Artificial Sequence
  chemically synthesized
ctccactcttattcttgcacat

SEQ ID NO: 1103875 - DNA, 22 bp, Artificial Sequence
  chemically synthesized
tccactcttattcttgcacatt

SEQ ID NO: 1103876 - DNA, 22 bp, Artificial Sequence
  chemically synthesized
cactcttattcttgcacatttt

SEQ ID NO: 1103877 - DNA, 22 bp, Artificial Sequence
  chemically synthesized
aacataagaataaaaatgtgca

SEQ ID NO: 1103878 - DNA, 22 bp, Artificial Sequence
  chemically synthesized
aaacataagaataaaaatgtgc

SEQ ID NO: 1103879 - DNA, 22 bp, Artificial Sequence
  chemically synthesized
taaacataagaataaaaatgtg

SEQ ID NO: 1103880 - DNA, 22 bp, Artificial Sequence
  chemically synthesized
ttaaacataagaataaaaatgt

SEQ ID NO: 1103881 - DNA, 22 bp, Artificial Sequence
  chemically synthesized
ttattcttgcacatttttattc

SEQ ID NO: 1103882 - DNA, 22 bp, Artificial Sequence
  chemically synthesized
attcttgcacatttttattctt

SEQ ID NO: 1103883 - DNA, 22 bp, Artificial Sequence
  chemically synthesized
ttcttgcacatttttattctta

SEQ ID NO: 1103884 - DNA, 22 bp, Artificial Sequence
  chemically synthesized
ttgcacatttttattcttatgt

SEQ ID NO: 1103885 - DNA, 22 bp, Artificial Sequence
  chemically synthesized
gtaaacttttaaacataagaat

SEQ ID NO: 1103886 - DNA, 22 bp, Artificial Sequence
  chemically synthesized
gcacatttttattcttatgttt

SEQ ID NO: 1103887 - DNA, 22 bp, Artificial Sequence
  chemically synthesized
cacatttttattcttatgttta

SEQ ID NO: 1103888 - DNA, 22 bp, Artificial Sequence
  chemically synthesized
atagaactagtaaacttttaaa

SEQ ID NO: 1103889 - DNA, 22 bp, Artificial Sequence
  chemically synthesized
ttattcttatgtttaaaagttt

SEQ ID NO: 1103890 - DNA, 22 bp, Artificial Sequence
  chemically synthesized
tattcttatgtttaaaagttta

SEQ ID NO: 1103891 - DNA, 22 bp, Artificial Sequence
  chemically synthesized
attcttatgtttaaaagtttac

SEQ ID NO: 1103892 - DNA, 22 bp, Artificial Sequence
  chemically synthesized
ttcttatgtttaaaagtttact

SEQ ID NO: 1103893 - DNA, 22 bp, Artificial Sequence
  chemically synthesized
cctaatagaactagtaaacttt

SEQ ID NO: 1103894 - DNA, 22 bp, Artificial Sequence
  chemically synthesized
ttatgtttaaaagtttactagt

SEQ ID NO: 1103895 - DNA, 22 bp, Artificial Sequence
  chemically synthesized
atgtttaaaagtttactagttc

SEQ ID NO: 1103896 - DNA, 22 bp, Artificial Sequence
  chemically synthesized
tgtttaaaagtttactagttct

SEQ ID NO: 1103897 - DNA, 22 bp, Artificial Sequence
  chemically synthesized
aaaagtttactagttctattag

SEQ ID NO: 1103898 - DNA, 22 bp, Artificial Sequence
  chemically synthesized
aaagtttactagttctattagg

SEQ ID NO: 1103899 - DNA, 22 bp, Artificial Sequence
  chemically synthesized
gaaaaatgtgttgcctaataga

SEQ ID NO: 1103900 - DNA, 22 bp, Artificial Sequence
  chemically synthesized
tctggaaaaatgtgttgcctaa

SEQ ID NO: 1103901 - DNA, 22 bp, Artificial Sequence
  chemically synthesized
actagttctattaggcaacaca

SEQ ID NO: 1103902 - DNA, 22 bp, Artificial Sequence
  chemically synthesized
ctagttctattaggcaacacat

SEQ ID NO: 1103903 - DNA, 22 bp, Artificial Sequence
  chemically synthesized
gttctattaggcaacacatttt

SEQ ID NO: 1103904 - DNA, 22 bp, Artificial Sequence
  chemically synthesized
caaagtctatctggaaaaatgt

SEQ ID NO: 1103905 - DNA, 22 bp, Artificial Sequence
  chemically synthesized
tattaggcaacacatttttcca

SEQ ID NO: 1103906 - DNA, 22 bp, Artificial Sequence
  chemically synthesized
ttaggcaacacatttttccaga

SEQ ID NO: 1103907 - DNA, 22 bp, Artificial Sequence
  chemically synthesized
ggcaacacatttttccagatag

SEQ ID NO: 1103908 - DNA, 22 bp, Artificial Sequence
  chemically synthesized
gcataatgattccaaagtctat

SEQ ID NO: 1103909 - DNA, 22 bp, Artificial Sequence
  chemically synthesized
ggcataatgattccaaagtcta

SEQ ID NO: 1103910 - DNA, 22 bp, Artificial Sequence
  chemically synthesized
ttccagatagactttggaatca

SEQ ID NO: 1103911 - DNA, 22 bp, Artificial Sequence
  chemically synthesized
tccagatagactttggaatcat

SEQ ID NO: 1103912 - DNA, 22 bp, Artificial Sequence
  chemically synthesized
atgcttggcataatgattccaa

SEQ ID NO: 1103913 - DNA, 22 bp, Artificial Sequence
  chemically synthesized
ccagatagactttggaatcatt

SEQ ID NO: 1103914 - DNA, 22 bp, Artificial Sequence
  chemically synthesized
aatgcttggcataatgattcca

SEQ ID NO: 1103915 - DNA, 22 bp, Artificial Sequence
  chemically synthesized
cagatagactttggaatcatta

SEQ ID NO: 1103916 - DNA, 22 bp, Artificial Sequence
  chemically synthesized
taatgcttggcataatgattcc

SEQ ID NO: 1103917 - DNA, 22 bp, Artificial Sequence
  chemically synthesized
ttaatgcttggcataatgattc

SEQ ID NO: 1103918 - DNA, 22 bp, Artificial Sequence
  chemically synthesized
tggtttttaatgcttggcataa

SEQ ID NO: 1103919 - DNA, 22 bp, Artificial Sequence
  chemically synthesized
ttgtggtttttaatgcttggca

SEQ ID NO: 1103920 - DNA, 22 bp, Artificial Sequence
  chemically synthesized
tggaatcattatgccaagcatt

SEQ ID NO: 1103921 - DNA, 22 bp, Artificial Sequence
  chemically synthesized
gttgtggtttttaatgcttggc

SEQ ID NO: 1103922 - DNA, 22 bp, Artificial Sequence
  chemically synthesized
ggaatcattatgccaagcatta

SEQ ID NO: 1103923 - DNA, 22 bp, Artificial Sequence
  chemically synthesized
tgttgtggtttttaatgcttgg

SEQ ID NO: 1103924 - DNA, 22 bp, Artificial Sequence
  chemically synthesized
gaatcattatgccaagcattaa

SEQ ID NO: 1103925 - DNA, 22 bp, Artificial Sequence
  chemically synthesized
ttgttgtggtttttaatgcttg

SEQ ID NO: 1103926 - DNA, 22 bp, Artificial Sequence
  chemically synthesized
cttttgttgtggtttttaatgc

SEQ ID NO: 1103927 - DNA, 22 bp, Artificial Sequence
  chemically synthesized
ccttttgttgtggtttttaatg

SEQ ID NO: 1103928 - DNA, 22 bp, Artificial Sequence
  chemically synthesized
tttccttttgttgtggttttta

SEQ ID NO: 1103929 - DNA, 22 bp, Artificial Sequence
  chemically synthesized
gtttccttttgttgtggttttt

SEQ ID NO: 1103930 - DNA, 22 bp, Artificial Sequence
  chemically synthesized
tgccaagcattaaaaaccacaa

SEQ ID NO: 1103931 - DNA, 22 bp, Artificial Sequence
  chemically synthesized
tgtttccttttgttgtggtttt

SEQ ID NO: 1103932 - DNA, 22 bp, Artificial Sequence
  chemically synthesized
ttgtttccttttgttgtggttt

SEQ ID NO: 1103933 - DNA, 22 bp, Artificial Sequence
  chemically synthesized
tttgtttccttttgttgtggtt

SEQ ID NO: 1103934 - DNA, 22 bp, Artificial Sequence
  chemically synthesized
ttttgtttccttttgttgtggt

SEQ ID NO: 1103935 - DNA, 22 bp, Artificial Sequence
  chemically synthesized
accttttttgtttccttttgtt

SEQ ID NO: 1103936 - DNA, 22 bp, Artificial Sequence
  chemically synthesized
caccttttttgtttccttttgt

SEQ ID NO: 1103937 - DNA, 22 bp, Artificial Sequence
  chemically synthesized
aaaaccacaacaaaaggaaaca

SEQ ID NO: 1103938 - DNA, 22 bp, Artificial Sequence
  chemically synthesized
tttcaccttttttgtttccttt

SEQ ID NO: 1103939 - DNA, 22 bp, Artificial Sequence
  chemically synthesized
caataccaaatggtagctgttt

SEQ ID NO: 1103940 - DNA, 22 bp, Artificial Sequence
  chemically synthesized
ctacaataccaaatggtagctg

SEQ ID NO: 1103941 - DNA, 22 bp, Artificial Sequence
  chemically synthesized
tactacaataccaaatggtagc

SEQ ID NO: 1103942 - DNA, 22 bp, Artificial Sequence
  chemically synthesized
ttctactacaataccaaatggt

SEQ ID NO: 1103943 - DNA, 22 bp, Artificial Sequence
  chemically synthesized
attctactacaataccaaatgg

SEQ ID NO: 1103944 - DNA, 22 bp, Artificial Sequence
  chemically synthesized
gatatttattctactacaatac

SEQ ID NO: 1103945 - DNA, 22 bp, Artificial Sequence
  chemically synthesized
agatatttattctactacaata

SEQ ID NO: 1103946 - DNA, 22 bp, Artificial Sequence
  chemically synthesized
tttagatatttattctactaca

SEQ ID NO: 1103947 - DNA, 22 bp, Artificial Sequence
  chemically synthesized
ccatttggtattgtagtagaat

SEQ ID NO: 1103948 - DNA, 22 bp, Artificial Sequence
  chemically synthesized
tcctatttagatatttattcta

SEQ ID NO: 1103949 - DNA, 22 bp, Artificial Sequence
  chemically synthesized
ggtattgtagtagaataaatat

SEQ ID NO: 1103950 - DNA, 22 bp, Artificial Sequence
  chemically synthesized
gtattgtagtagaataaatatc

SEQ ID NO: 1103951 - DNA, 22 bp, Artificial Sequence
  chemically synthesized
tgtattgtcctatttagatatt

SEQ ID NO: 1103952 - DNA, 22 bp, Artificial Sequence
  chemically synthesized
tagtagaataaatatctaaata

SEQ ID NO: 1103953 - DNA, 22 bp, Artificial Sequence
  chemically synthesized
attatgtattgtcctatttaga

SEQ ID NO: 1103954 - DNA, 22 bp, Artificial Sequence
  chemically synthesized
cattatgtattgtcctatttag

SEQ ID NO: 1103955 - DNA, 22 bp, Artificial Sequence
  chemically synthesized
tcattatgtattgtcctattta

SEQ ID NO: 1103956 - DNA, 22 bp, Artificial Sequence
  chemically synthesized
aacaactttcattatgtattgt

SEQ ID NO: 1103957 - DNA, 22 bp, Artificial Sequence
  chemically synthesized
aaacaactttcattatgtattg

SEQ ID NO: 1103958 - DNA, 22 bp, Artificial Sequence
  chemically synthesized
aataggacaatacataatgaaa

SEQ ID NO: 1103959 - DNA, 22 bp, Artificial Sequence
  chemically synthesized
aaagaaaaatacatttaaacaa

SEQ ID NO: 1103960 - DNA, 22 bp, Artificial Sequence
  chemically synthesized
aagtaatgtattcaaagaaaaa

SEQ ID NO: 1103961 - DNA, 22 bp, Artificial Sequence
  chemically synthesized
gaagtaatgtattcaaagaaaa

SEQ ID NO: 1103962 - DNA, 22 bp, Artificial Sequence
  chemically synthesized
tttaaatgtatttttctttgaa

SEQ ID NO: 1103963 - DNA, 22 bp, Artificial Sequence
  chemically synthesized
tgaagtaatgtattcaaagaaa

SEQ ID NO: 1103964 - DNA, 22 bp, Artificial Sequence
  chemically synthesized
ttgaagtaatgtattcaaagaa

SEQ ID NO: 1103965 - DNA, 22 bp, Artificial Sequence
  chemically synthesized
tttgaagtaatgtattcaaaga

SEQ ID NO: 1103966 - DNA, 22 bp, Artificial Sequence
  chemically synthesized
aaatgtatttttctttgaatac

SEQ ID NO: 1103967 - DNA, 22 bp, Artificial Sequence
  chemically synthesized
ttttgaagtaatgtattcaaag

SEQ ID NO: 1103968 - DNA, 22 bp, Artificial Sequence
  chemically synthesized
aatgtatttttctttgaataca

SEQ ID NO: 1103969 - DNA, 22 bp, Artificial Sequence
  chemically synthesized
aatatttttttgaagtaatgta

SEQ ID NO: 1103970 - DNA, 22 bp, Artificial Sequence
  chemically synthesized
ttctttgaatacattacttcaa

SEQ ID NO: 1103971 - DNA, 22 bp, Artificial Sequence
  chemically synthesized
tctttgaatacattacttcaaa

SEQ ID NO: 1103972 - DNA, 22 bp, Artificial Sequence
  chemically synthesized
ctttgaatacattacttcaaaa

SEQ ID NO: 1103973 - DNA, 22 bp, Artificial Sequence
  chemically synthesized
tttgaatacattacttcaaaaa

SEQ ID NO: 1103974 - DNA, 22 bp, Artificial Sequence
  chemically synthesized
tgaatacattacttcaaaaaaa

SEQ ID NO: 1103975 - DNA, 22 bp, Artificial Sequence
  chemically synthesized
gataattaaatatttttttgaa

SEQ ID NO: 1103976 - DNA, 22 bp, Artificial Sequence
  chemically synthesized
gaatacattacttcaaaaaaat

SEQ ID NO: 1103977 - DNA, 22 bp, Artificial Sequence
  chemically synthesized
ggataattaaatatttttttga

SEQ ID NO: 1103978 - DNA, 22 bp, Artificial Sequence
  chemically synthesized
aatacattacttcaaaaaaata

SEQ ID NO: 1103979 - DNA, 22 bp, Artificial Sequence
  chemically synthesized
tggataattaaatatttttttg

SEQ ID NO: 1103980 - DNA, 22 bp, Artificial Sequence
  chemically synthesized
ttggataattaaatattttttt

SEQ ID NO: 1103981 - DNA, 22 bp, Artificial Sequence
  chemically synthesized
tttggataattaaatatttttt

SEQ ID NO: 1103982 - DNA, 22 bp, Artificial Sequence
  chemically synthesized
ttttggataattaaatattttt

SEQ ID NO: 1103983 - DNA, 22 bp, Artificial Sequence
  chemically synthesized
tttttggataattaaatatttt

SEQ ID NO: 1103984 - DNA, 22 bp, Artificial Sequence
  chemically synthesized
cttcaaaaaaatatttaattat

SEQ ID NO: 1103985 - DNA, 22 bp, Artificial Sequence
  chemically synthesized
caaaaaaatatttaattatcca

SEQ ID NO: 1103986 - DNA, 22 bp, Artificial Sequence
  chemically synthesized
aaaaaaatatttaattatccaa

SEQ ID NO: 1103987 - DNA, 22 bp, Artificial Sequence
  chemically synthesized
tcacatagaattttttttggat

SEQ ID NO: 1103988 - DNA, 22 bp, Artificial Sequence
  chemically synthesized
atcacatagaattttttttgga

SEQ ID NO: 1103989 - DNA, 22 bp, Artificial Sequence
  chemically synthesized
tatcacatagaattttttttgg

SEQ ID NO: 1103990 - DNA, 22 bp, Artificial Sequence
  chemically synthesized
aactttatcacatagaattttt

SEQ ID NO: 1103991 - DNA, 22 bp, Artificial Sequence
  chemically synthesized
aattatccaaaaaaaattctat

SEQ ID NO: 1103992 - DNA, 22 bp, Artificial Sequence
  chemically synthesized
aaactttatcacatagaatttt

SEQ ID NO: 1103993 - DNA, 22 bp, Artificial Sequence
  chemically synthesized
attatccaaaaaaaattctatg

SEQ ID NO: 1103994 - DNA, 22 bp, Artificial Sequence
  chemically synthesized
tccaaaaaaaattctatgtgat

SEQ ID NO: 1103995 - DNA, 22 bp, Artificial Sequence
  chemically synthesized
aaatttaaactttatcacatag

SEQ ID NO: 1103996 - DNA, 22 bp, Artificial Sequence
  chemically synthesized
aaaattcaaatttaaactttat

SEQ ID NO: 1103997 - DNA, 22 bp, Artificial Sequence
  chemically synthesized
aaaaattcaaatttaaacttta

SEQ ID NO: 1103998 - DNA, 22 bp, Artificial Sequence
  chemically synthesized
tatgtgataaagtttaaatttg

SEQ ID NO: 1103999 - DNA, 22 bp, Artificial Sequence
  chemically synthesized
tgtgataaagtttaaatttgaa

SEQ ID NO: 1104000 - DNA, 22 bp, Artificial Sequence
  chemically synthesized
agaaaaatgtttaaaaattcaa

SEQ ID NO: 1104001 - DNA, 22 bp, Artificial Sequence
  chemically synthesized
aagaaaaatgtttaaaaattca

SEQ ID NO: 1104002 - DNA, 22 bp, Artificial Sequence
  chemically synthesized
taagaaaaatgtttaaaaattc

SEQ ID NO: 1104003 - DNA, 22 bp, Artificial Sequence
  chemically synthesized
aaatttgaatttttaaacattt

SEQ ID NO: 1104004 - DNA, 22 bp, Artificial Sequence
  chemically synthesized
aatttgaatttttaaacatttt

SEQ ID NO: 1104005 - DNA, 22 bp, Artificial Sequence
  chemically synthesized
gaatttttaaacatttttctta

SEQ ID NO: 1104006 - DNA, 22 bp, Artificial Sequence
  chemically synthesized
aatttttaaacatttttcttaa

SEQ ID NO: 1104007 - DNA, 22 bp, Artificial Sequence
  chemically synthesized
agataatatgtgcattttaaga

SEQ ID NO: 1104008 - DNA, 22 bp, Artificial Sequence
  chemically synthesized
ttaaacatttttcttaaaatgc

SEQ ID NO: 1104009 - DNA, 22 bp, Artificial Sequence
  chemically synthesized
taaacatttttcttaaaatgca

SEQ ID NO: 1104010 - DNA, 22 bp, Artificial Sequence
  chemically synthesized
aaacatttttcttaaaatgcac

SEQ ID NO: 1104011 - DNA, 22 bp, Artificial Sequence
  chemically synthesized
aacatttttcttaaaatgcaca

SEQ ID NO: 1104012 - DNA, 22 bp, Artificial Sequence
  chemically synthesized
gaagctgagataatatgtgcat

SEQ ID NO: 1104013 - DNA, 22 bp, Artificial Sequence
  chemically synthesized
agaagctgagataatatgtgca

SEQ ID NO: 1104014 - DNA, 22 bp, Artificial Sequence
  chemically synthesized
ttcttaaaatgcacatattatc

SEQ ID NO: 1104015 - DNA, 22 bp, Artificial Sequence
  chemically synthesized
tcttaaaatgcacatattatct

SEQ ID NO: 1104016 - DNA, 22 bp, Artificial Sequence
  chemically synthesized
cttaaaatgcacatattatctc

SEQ ID NO: 1104017 - DNA, 22 bp, Artificial Sequence
  chemically synthesized
tatttagaagctgagataatat

SEQ ID NO: 1104018 - DNA, 22 bp, Artificial Sequence
  chemically synthesized
ttaaaatgcacatattatctca

SEQ ID NO: 1104019 - DNA, 22 bp, Artificial Sequence
  chemically synthesized
aaaatgcacatattatctcagc

SEQ ID NO: 1104020 - DNA, 22 bp, Artificial Sequence
  chemically synthesized
aaatgcacatattatctcagct

SEQ ID NO: 1104021 - DNA, 22 bp, Artificial Sequence
  chemically synthesized
gttatatttagaagctgagata

SEQ ID NO: 1104022 - DNA, 22 bp, Artificial Sequence
  chemically synthesized
tctcagcttctaaatataacta

SEQ ID NO: 1104023 - DNA, 22 bp, Artificial Sequence
  chemically synthesized
agcttctaaatataactaatac

SEQ ID NO: 1104024 - DNA, 22 bp, Artificial Sequence
  chemically synthesized
aagacatgaaaacgtattagtt

SEQ ID NO: 1104025 - DNA, 22 bp, Artificial Sequence
  chemically synthesized
tgaagacatgaaaacgtattag

SEQ ID NO: 1104026 - DNA, 22 bp, Artificial Sequence
  chemically synthesized
ctgaagacatgaaaacgtatta

SEQ ID NO: 1104027 - DNA, 22 bp, Artificial Sequence
  chemically synthesized
ctaaatataactaatacgtttt

SEQ ID NO: 1104028 - DNA, 22 bp, Artificial Sequence
  chemically synthesized
taaatataactaatacgttttc

SEQ ID NO: 1104029 - DNA, 22 bp, Artificial Sequence
  chemically synthesized
tttctgaagacatgaaaacgta

SEQ ID NO: 1104030 - DNA, 22 bp, Artificial Sequence
  chemically synthesized
aatataactaatacgttttcat

SEQ ID NO: 1104031 - DNA, 22 bp, Artificial Sequence
  chemically synthesized
atttctgaagacatgaaaacgt

SEQ ID NO: 1104032 - DNA, 22 bp, Artificial Sequence
  chemically synthesized
tatttctgaagacatgaaaacg

SEQ ID NO: 1104033 - DNA, 22 bp, Artificial Sequence
  chemically synthesized
ttatttctgaagacatgaaaac

SEQ ID NO: 1104034 - DNA, 22 bp, Artificial Sequence
  chemically synthesized
tttatttctgaagacatgaaaa

SEQ ID NO: 1104035 - DNA, 22 bp, Artificial Sequence
  chemically synthesized
atacgttttcatgtcttcagaa

SEQ ID NO: 1104036 - DNA, 22 bp, Artificial Sequence
  chemically synthesized
aataactttttatttctgaaga

SEQ ID NO: 1104037 - DNA, 22 bp, Artificial Sequence
  chemically synthesized
tcatgtcttcagaaataaaaag

SEQ ID NO: 1104038 - DNA, 22 bp, Artificial Sequence
  chemically synthesized
tatgttcaataactttttattt

SEQ ID NO: 1104039 - DNA, 22 bp, Artificial Sequence
  chemically synthesized
catgtcttcagaaataaaaagt

SEQ ID NO: 1104040 - DNA, 22 bp, Artificial Sequence
  chemically synthesized
atgtcttcagaaataaaaagtt

SEQ ID NO: 1104041 - DNA, 22 bp, Artificial Sequence
  chemically synthesized
cattatatgttcaataactttt

SEQ ID NO: 1104042 - DNA, 22 bp, Artificial Sequence
  chemically synthesized
cagaaataaaaagttattgaac

SEQ ID NO: 1104043 - DNA, 22 bp, Artificial Sequence
  chemically synthesized
agaaataaaaagttattgaaca

SEQ ID NO: 1104044 - DNA, 22 bp, Artificial Sequence
  chemically synthesized
taaaatactacattatatgttc

SEQ ID NO: 1104045 - DNA, 22 bp, Artificial Sequence
  chemically synthesized
ttataaaatactacattatatg

SEQ ID NO: 1104046 - DNA, 22 bp, Artificial Sequence
  chemically synthesized
attataaaatactacattatat

SEQ ID NO: 1104047 - DNA, 22 bp, Artificial Sequence
  chemically synthesized
cttattataaaatactacatta

SEQ ID NO: 1104048 - DNA, 22 bp, Artificial Sequence
  chemically synthesized
ttgaacatataatgtagtattt

SEQ ID NO: 1104049 - DNA, 22 bp, Artificial Sequence
  chemically synthesized
ctacttattataaaatactaca

SEQ ID NO: 1104050 - DNA, 22 bp, Artificial Sequence
  chemically synthesized
cctacttattataaaatactac

SEQ ID NO: 1104051 - DNA, 22 bp, Artificial Sequence
  chemically synthesized
tcctacttattataaaatacta

SEQ ID NO: 1104052 - DNA, 22 bp, Artificial Sequence
  chemically synthesized
aacatataatgtagtattttat

SEQ ID NO: 1104053 - DNA, 22 bp, Artificial Sequence
  chemically synthesized
ttcctacttattataaaatact

SEQ ID NO: 1104054 - DNA, 22 bp, Artificial Sequence
  chemically synthesized
cgcccagcccttttcctactta

SEQ ID NO: 1104055 - DNA, 22 bp, Artificial Sequence
  chemically synthesized
tataataagtaggaaaagggct

SEQ ID NO: 1104056 - DNA, 22 bp, Artificial Sequence
  chemically synthesized
ataataagtaggaaaagggctg

SEQ ID NO: 1104057 - DNA, 22 bp, Artificial Sequence
  chemically synthesized
taataagtaggaaaagggctgg

SEQ ID NO: 1104058 - DNA, 22 bp, Artificial Sequence
  chemically synthesized
caggtgtgagccactgcgccca

SEQ ID NO: 1104059 - DNA, 22 bp, Artificial Sequence
  chemically synthesized
ggattacaggtgtgagccactg

SEQ ID NO: 1104060 - DNA, 22 bp, Artificial Sequence
  chemically synthesized
ggcgcagtggctcacacctgta

SEQ ID NO: 1104061 - DNA, 22 bp, Artificial Sequence
  chemically synthesized
ccaaagtgctgggattacaggt

SEQ ID NO: 1104062 - DNA, 22 bp, Artificial Sequence
  chemically synthesized
agcctcccaaagtgctgggatt

SEQ ID NO: 1104063 - DNA, 22 bp, Artificial Sequence
  chemically synthesized
acacctgtaatcccagcacttt

SEQ ID NO: 1104064 - DNA, 22 bp, Artificial Sequence
  chemically synthesized
cctcagcctcccaaagtgctgg

SEQ ID NO: 1104065 - DNA, 22 bp, Artificial Sequence
  chemically synthesized
cctgcctcagcctcccaaagtg

SEQ ID NO: 1104066 - DNA, 22 bp, Artificial Sequence
  chemically synthesized
taatcccagcactttgggaggc

SEQ ID NO: 1104067 - DNA, 22 bp, Artificial Sequence
  chemically synthesized
agatgatctgcctgcctcagcc

SEQ ID NO: 1104068 - DNA, 22 bp, Artificial Sequence
  chemically synthesized
acctcagatgatctgcctgcct

SEQ ID NO: 1104069 - DNA, 22 bp, Artificial Sequence
  chemically synthesized
tgggaggctgaggcaggcagat

SEQ ID NO: 1104070 - DNA, 22 bp, Artificial Sequence
  chemically synthesized
gggaggctgaggcaggcagatc

SEQ ID NO: 1104071 - DNA, 22 bp, Artificial Sequence
  chemically synthesized
ctgacctcagatgatctgcctg

SEQ ID NO: 1104072 - DNA, 22 bp, Artificial Sequence
  chemically synthesized
ggaggctgaggcaggcagatca

SEQ ID NO: 1104073 - DNA, 22 bp, Artificial Sequence
  chemically synthesized
aaactcctgacctcagatgatc

SEQ ID NO: 1104074 - DNA, 22 bp, Artificial Sequence
  chemically synthesized
aggcaggcagatcatctgaggt

SEQ ID NO: 1104075 - DNA, 22 bp, Artificial Sequence
  chemically synthesized
gtctcaaactcctgacctcaga

SEQ ID NO: 1104076 - DNA, 22 bp, Artificial Sequence
  chemically synthesized
gccatgctggtctcaaactcct

SEQ ID NO: 1104077 - DNA, 22 bp, Artificial Sequence
  chemically synthesized
ggccatgctggtctcaaactcc

SEQ ID NO: 1104078 - DNA, 22 bp, Artificial Sequence
  chemically synthesized
aggtcaggagtttgagaccagc

SEQ ID NO: 1104079 - DNA, 22 bp, Artificial Sequence
  chemically synthesized
accatcttggccatgctggtct

SEQ ID NO: 1104080 - DNA, 22 bp, Artificial Sequence
  chemically synthesized
caccatcttggccatgctggtc

SEQ ID NO: 1104081 - DNA, 22 bp, Artificial Sequence
  chemically synthesized
gagaccagcatggccaagatgg

SEQ ID NO: 1104082 - DNA, 22 bp, Artificial Sequence
  chemically synthesized
agaccagcatggccaagatggt

SEQ ID NO: 1104083 - DNA, 22 bp, Artificial Sequence
  chemically synthesized
aagtaaagatggggtttcacca

SEQ ID NO: 1104084 - DNA, 22 bp, Artificial Sequence
  chemically synthesized
aaagtaaagatggggtttcacc

SEQ ID NO: 1104085 - DNA, 22 bp, Artificial Sequence
  chemically synthesized
taaagtaaagatggggtttcac

SEQ ID NO: 1104086 - DNA, 22 bp, Artificial Sequence
  chemically synthesized
ttaaagtaaagatggggtttca

SEQ ID NO: 1104087 - DNA, 22 bp, Artificial Sequence
  chemically synthesized
tatttttaaagtaaagatgggg

SEQ ID NO: 1104088 - DNA, 22 bp, Artificial Sequence
  chemically synthesized
gtatttttaaagtaaagatggg

SEQ ID NO: 1104089 - DNA, 22 bp, Artificial Sequence
  chemically synthesized
tgtatttttaaagtaaagatgg

SEQ ID NO: 1104090 - DNA, 22 bp, Artificial Sequence
  chemically synthesized
ttgtatttttaaagtaaagatg

SEQ ID NO: 1104091 - DNA, 22 bp, Artificial Sequence
  chemically synthesized
atttttgtatttttaaagtaaa

SEQ ID NO: 1104092 - DNA, 22 bp, Artificial Sequence
  chemically synthesized
gctaatttttgtatttttaaag

SEQ ID NO: 1104093 - DNA, 22 bp, Artificial Sequence
  chemically synthesized
tactttaaaaatacaaaaatta

SEQ ID NO: 1104094 - DNA, 22 bp, Artificial Sequence
  chemically synthesized
actttaaaaatacaaaaattag

SEQ ID NO: 1104095 - DNA, 22 bp, Artificial Sequence
  chemically synthesized
ctttaaaaatacaaaaattagc

SEQ ID NO: 1104096 - DNA, 22 bp, Artificial Sequence
  chemically synthesized
taaaaatacaaaaattagccag

SEQ ID NO: 1104097 - DNA, 22 bp, Artificial Sequence
  chemically synthesized
aaaaatacaaaaattagccagg

SEQ ID NO: 1104098 - DNA, 22 bp, Artificial Sequence
  chemically synthesized
aaaatacaaaaattagccaggc

SEQ ID NO: 1104099 - DNA, 22 bp, Artificial Sequence
  chemically synthesized
tagtgcgtgccatcacgcctgg

SEQ ID NO: 1104100 - DNA, 22 bp, Artificial Sequence
  chemically synthesized
ggattatagtgcgtgccatcac

SEQ ID NO: 1104101 - DNA, 22 bp, Artificial Sequence
  chemically synthesized
gccaggcgtgatggcacgcact

SEQ ID NO: 1104102 - DNA, 22 bp, Artificial Sequence
  chemically synthesized
agtagctgggattatagtgcgt

SEQ ID NO: 1104103 - DNA, 22 bp, Artificial Sequence
  chemically synthesized
ctgagtagctgggattatagtg

SEQ ID NO: 1104104 - DNA, 22 bp, Artificial Sequence
  chemically synthesized
gcctcctgagtagctgggatta

SEQ ID NO: 1104105 - DNA, 22 bp, Artificial Sequence
  chemically synthesized
agcctcctgagtagctgggatt

SEQ ID NO: 1104106 - DNA, 22 bp, Artificial Sequence
  chemically synthesized
ccttagcctcctgagtagctgg

SEQ ID NO: 1104107 - DNA, 22 bp, Artificial Sequence
  chemically synthesized
ctgccttagcctcctgagtagc

SEQ ID NO: 1104108 - DNA, 22 bp, Artificial Sequence
  chemically synthesized
tcctgccttagcctcctgagta

SEQ ID NO: 1104109 - DNA, 22 bp, Artificial Sequence
  chemically synthesized
taatcccagctactcaggaggc

SEQ ID NO: 1104110 - DNA, 22 bp, Artificial Sequence
  chemically synthesized
aagtgattctcctgccttagcc

SEQ ID NO: 1104111 - DNA, 22 bp, Artificial Sequence
  chemically synthesized
ctcaggaggctaaggcaggaga

SEQ ID NO: 1104112 - DNA, 22 bp, Artificial Sequence
  chemically synthesized
aggaggctaaggcaggagaatc

SEQ ID NO: 1104113 - DNA, 22 bp, Artificial Sequence
  chemically synthesized
ccgggttcaagtgattctcctg

SEQ ID NO: 1104114 - DNA, 22 bp, Artificial Sequence
  chemically synthesized
cgcctcccgggttcaagtgatt

SEQ ID NO: 1104115 - DNA, 22 bp, Artificial Sequence
  chemically synthesized
aggcaggagaatcacttgaacc

SEQ ID NO: 1104116 - DNA, 22 bp, Artificial Sequence
  chemically synthesized
caacctacgcctcccgggttca

SEQ ID NO: 1104117 - DNA, 22 bp, Artificial Sequence
  chemically synthesized
actgcaacctacgcctcccggg

SEQ ID NO: 1104118 - DNA, 22 bp, Artificial Sequence
  chemically synthesized
ggctcactgcaacctacgcctc

SEQ ID NO: 1104119 - DNA, 22 bp, Artificial Sequence
  chemically synthesized
gaacccgggaggcgtaggttgc

SEQ ID NO: 1104120 - DNA, 22 bp, Artificial Sequence
  chemically synthesized
tctcggctcactgcaacctacg

SEQ ID NO: 1104121 - DNA, 22 bp, Artificial Sequence
  chemically synthesized
aacccgggaggcgtaggttgca

SEQ ID NO: 1104122 - DNA, 22 bp, Artificial Sequence
  chemically synthesized
gagtgcagcagtgctatctcgg

SEQ ID NO: 1104123 - DNA, 22 bp, Artificial Sequence
  chemically synthesized
cagtgagccgagatagcactgc

SEQ ID NO: 1104124 - DNA, 22 bp, Artificial Sequence
  chemically synthesized
cccaggctggagtgcagcagtg

SEQ ID NO: 1104125 - DNA, 22 bp, Artificial Sequence
  chemically synthesized
ttgcccaggctggagtgcagca

SEQ ID NO: 1104126 - DNA, 22 bp, Artificial Sequence
  chemically synthesized
gttgcccaggctggagtgcagc

SEQ ID NO: 1104127 - DNA, 22 bp, Artificial Sequence
  chemically synthesized
ttgttgcccaggctggagtgca

SEQ ID NO: 1104128 - DNA, 22 bp, Artificial Sequence
  chemically synthesized
attcttgttgcccaggctggag

SEQ ID NO: 1104129 - DNA, 22 bp, Artificial Sequence
  chemically synthesized
cattcttgttgcccaggctgga

SEQ ID NO: 1104130 - DNA, 22 bp, Artificial Sequence
  chemically synthesized
ctgcactccagcctgggcaaca

SEQ ID NO: 1104131 - DNA, 22 bp, Artificial Sequence
  chemically synthesized
cactccagcctgggcaacaaga

SEQ ID NO: 1104132 - DNA, 22 bp, Artificial Sequence
  chemically synthesized
gacggagtttcattcttgttgc

SEQ ID NO: 1104133 - DNA, 22 bp, Artificial Sequence
  chemically synthesized
agacggagtttcattcttgttg

SEQ ID NO: 1104134 - DNA, 22 bp, Artificial Sequence
  chemically synthesized
tagacggagtttcattcttgtt

SEQ ID NO: 1104135 - DNA, 22 bp, Artificial Sequence
  chemically synthesized
ttagacggagtttcattcttgt

SEQ ID NO: 1104136 - DNA, 22 bp, Artificial Sequence
  chemically synthesized
cagcctgggcaacaagaatgaa

SEQ ID NO: 1104137 - DNA, 22 bp, Artificial Sequence
  chemically synthesized
tttttagacggagtttcattct

SEQ ID NO: 1104138 - DNA, 22 bp, Artificial Sequence
  chemically synthesized
atttttagacggagtttcattc

SEQ ID NO: 1104139 - DNA, 22 bp, Artificial Sequence
  chemically synthesized
tatttttagacggagtttcatt

SEQ ID NO: 1104140 - DNA, 22 bp, Artificial Sequence
  chemically synthesized
ggcaacaagaatgaaactccgt

SEQ ID NO: 1104141 - DNA, 22 bp, Artificial Sequence
  chemically synthesized
ttttatttttagacggagtttc

SEQ ID NO: 1104142 - DNA, 22 bp, Artificial Sequence
  chemically synthesized
attttatttttagacggagttt

SEQ ID NO: 1104143 - DNA, 22 bp, Artificial Sequence
  chemically synthesized
tattttatttttagacggagtt

SEQ ID NO: 1104144 - DNA, 22 bp, Artificial Sequence
  chemically synthesized
ctttattttatttttagacgga

SEQ ID NO: 1104145 - DNA, 22 bp, Artificial Sequence
  chemically synthesized
ctactttattttatttttagac

SEQ ID NO: 1104146 - DNA, 22 bp, Artificial Sequence
  chemically synthesized
cctactttattttatttttaga

SEQ ID NO: 1104147 - DNA, 22 bp, Artificial Sequence
  chemically synthesized
tcctactttattttatttttag

SEQ ID NO: 1104148 - DNA, 22 bp, Artificial Sequence
  chemically synthesized
ttcctactttattttattttta

SEQ ID NO: 1104149 - DNA, 22 bp, Artificial Sequence
  chemically synthesized
cgtctaaaaataaaataaagta

SEQ ID NO: 1104150 - DNA, 22 bp, Artificial Sequence
  chemically synthesized
taatacttttcctactttattt

SEQ ID NO: 1104151 - DNA, 22 bp, Artificial Sequence
  chemically synthesized
ataatacttttcctactttatt

SEQ ID NO: 1104152 - DNA, 22 bp, Artificial Sequence
  chemically synthesized
tataatacttttcctactttat

SEQ ID NO: 1104153 - DNA, 22 bp, Artificial Sequence
  chemically synthesized
aaaataaaataaagtaggaaaa

SEQ ID NO: 1104154 - DNA, 22 bp, Artificial Sequence
  chemically synthesized
taagagattttataatactttt

SEQ ID NO: 1104155 - DNA, 22 bp, Artificial Sequence
  chemically synthesized
gtaagagattttataatacttt

SEQ ID NO: 1104156 - DNA, 22 bp, Artificial Sequence
  chemically synthesized
taaaatctcttacaaattattt

SEQ ID NO: 1104157 - DNA, 22 bp, Artificial Sequence
  chemically synthesized
atatgggaaatgaaagaaataa

SEQ ID NO: 1104158 - DNA, 22 bp, Artificial Sequence
  chemically synthesized
ttacaaattatttctttcattt

SEQ ID NO: 1104159 - DNA, 22 bp, Artificial Sequence
  chemically synthesized
acaaattatttctttcatttcc

SEQ ID NO: 1104160 - DNA, 22 bp, Artificial Sequence
  chemically synthesized
caaattatttctttcatttccc

SEQ ID NO: 1104161 - DNA, 22 bp, Artificial Sequence
  chemically synthesized
tttctttcatttcccatattag

SEQ ID NO: 1104162 - DNA, 22 bp, Artificial Sequence
  chemically synthesized
tcaggaaagatatactaatatg

SEQ ID NO: 1104163 - DNA, 22 bp, Artificial Sequence
  chemically synthesized
ctttcatttcccatattagtat

SEQ ID NO: 1104164 - DNA, 22 bp, Artificial Sequence
  chemically synthesized
tttcatttcccatattagtata

SEQ ID NO: 1104165 - DNA, 22 bp, Artificial Sequence
  chemically synthesized
tatcaggaaagatatactaata

SEQ ID NO: 1104166 - DNA, 22 bp, Artificial Sequence
  chemically synthesized
ctatcaggaaagatatactaat

SEQ ID NO: 1104167 - DNA, 22 bp, Artificial Sequence
  chemically synthesized
tcatttcccatattagtatatc

SEQ ID NO: 1104168 - DNA, 22 bp, Artificial Sequence
  chemically synthesized
catttcccatattagtatatct

SEQ ID NO: 1104169 - DNA, 22 bp, Artificial Sequence
  chemically synthesized
atttcccatattagtatatctt

SEQ ID NO: 1104170 - DNA, 22 bp, Artificial Sequence
  chemically synthesized
cccatattagtatatctttcct

SEQ ID NO: 1104171 - DNA, 22 bp, Artificial Sequence
  chemically synthesized
ccatattagtatatctttcctg

SEQ ID NO: 1104172 - DNA, 22 bp, Artificial Sequence
  chemically synthesized
acatccttctatcaggaaagat

SEQ ID NO: 1104173 - DNA, 22 bp, Artificial Sequence
  chemically synthesized
aacatccttctatcaggaaaga

SEQ ID NO: 1104174 - DNA, 22 bp, Artificial Sequence
  chemically synthesized
taacatccttctatcaggaaag

SEQ ID NO: 1104175 - DNA, 22 bp, Artificial Sequence
  chemically synthesized
ttaacatccttctatcaggaaa

SEQ ID NO: 1104176 - DNA, 22 bp, Artificial Sequence
  chemically synthesized
tttaacatccttctatcaggaa

SEQ ID NO: 1104177 - DNA, 22 bp, Artificial Sequence
  chemically synthesized
ttttaacatccttctatcagga

SEQ ID NO: 1104178 - DNA, 22 bp, Artificial Sequence
  chemically synthesized
gtatatctttcctgatagaagg

SEQ ID NO: 1104179 - DNA, 22 bp, Artificial Sequence
  chemically synthesized
catttttttaacatccttctat

SEQ ID NO: 1104180 - DNA, 22 bp, Artificial Sequence
  chemically synthesized
tcctgatagaaggatgttaaaa

SEQ ID NO: 1104181 - DNA, 22 bp, Artificial Sequence
  chemically synthesized
atagctacatttttttaacatc

SEQ ID NO: 1104182 - DNA, 22 bp, Artificial Sequence
  chemically synthesized
cctgatagaaggatgttaaaaa

SEQ ID NO: 1104183 - DNA, 22 bp, Artificial Sequence
  chemically synthesized
ctgatagaaggatgttaaaaaa

SEQ ID NO: 1104184 - DNA, 22 bp, Artificial Sequence
  chemically synthesized
taatagctacatttttttaaca

SEQ ID NO: 1104185 - DNA, 22 bp, Artificial Sequence
  chemically synthesized
atagaaggatgttaaaaaaatg

SEQ ID NO: 1104186 - DNA, 22 bp, Artificial Sequence
  chemically synthesized
aattctaatagctacatttttt

SEQ ID NO: 1104187 - DNA, 22 bp, Artificial Sequence
  chemically synthesized
gaattctaatagctacattttt

SEQ ID NO: 1104188 - DNA, 22 bp, Artificial Sequence
  chemically synthesized
aaaaaatgtagctattagaatt

SEQ ID NO: 1104189 - DNA, 22 bp, Artificial Sequence
  chemically synthesized
taatgtaatgagacatttgaat

SEQ ID NO: 1104190 - DNA, 22 bp, Artificial Sequence
  chemically synthesized
tgtaatgtaatgagacatttga

SEQ ID NO: 1104191 - DNA, 22 bp, Artificial Sequence
  chemically synthesized
ctgtaatgtaatgagacatttg

SEQ ID NO: 1104192 - DNA, 22 bp, Artificial Sequence
  chemically synthesized
tctgtaatgtaatgagacattt

SEQ ID NO: 1104193 - DNA, 22 bp, Artificial Sequence
  chemically synthesized
ttagaattcaaatgtctcatta

SEQ ID NO: 1104194 - DNA, 22 bp, Artificial Sequence
  chemically synthesized
attttctgtaatgtaatgagac

SEQ ID NO: 1104195 - DNA, 22 bp, Artificial Sequence
  chemically synthesized
gaattcaaatgtctcattacat

SEQ ID NO: 1104196 - DNA, 22 bp, Artificial Sequence
  chemically synthesized
aacattaattttctgtaatgta

SEQ ID NO: 1104197 - DNA, 22 bp, Artificial Sequence
  chemically synthesized
aaatgtctcattacattacaga

SEQ ID NO: 1104198 - DNA, 22 bp, Artificial Sequence
  chemically synthesized
aaacattaattttctgtaatgt

SEQ ID NO: 1104199 - DNA, 22 bp, Artificial Sequence
  chemically synthesized
aatttaaacattaattttctgt

SEQ ID NO: 1104200 - DNA, 22 bp, Artificial Sequence
  chemically synthesized
aaatttaaacattaattttctg

SEQ ID NO: 1104201 - DNA, 22 bp, Artificial Sequence
  chemically synthesized
attacattacagaaaattaatg

SEQ ID NO: 1104202 - DNA, 22 bp, Artificial Sequence
  chemically synthesized
gtttaaatttaaacattaattt

SEQ ID NO: 1104203 - DNA, 22 bp, Artificial Sequence
  chemically synthesized
cattacagaaaattaatgttta

SEQ ID NO: 1104204 - DNA, 22 bp, Artificial Sequence
  chemically synthesized
cagaaaattaatgtttaaattt

SEQ ID NO: 1104205 - DNA, 22 bp, Artificial Sequence
  chemically synthesized
taaaattggtttaaatttaaac

SEQ ID NO: 1104206 - DNA, 22 bp, Artificial Sequence
  chemically synthesized
ataaaattggtttaaatttaaa

SEQ ID NO: 1104207 - DNA, 22 bp, Artificial Sequence
  chemically synthesized
tatttataaaattggtttaaat

SEQ ID NO: 1104208 - DNA, 22 bp, Artificial Sequence
  chemically synthesized
atgtttaaatttaaaccaattt

SEQ ID NO: 1104209 - DNA, 22 bp, Artificial Sequence
  chemically synthesized
gctatatttataaaattggttt

SEQ ID NO: 1104210 - DNA, 22 bp, Artificial Sequence
  chemically synthesized
aaatttaaaccaattttataaa

SEQ ID NO: 1104211 - DNA, 22 bp, Artificial Sequence
  chemically synthesized
aatttaaaccaattttataaat

SEQ ID NO: 1104212 - DNA, 22 bp, Artificial Sequence
  chemically synthesized
aaaccaattttataaatatagc

SEQ ID NO: 1104213 - DNA, 22 bp, Artificial Sequence
  chemically synthesized
aaccaattttataaatatagcc

SEQ ID NO: 1104214 - DNA, 22 bp, Artificial Sequence
  chemically synthesized
tataaatatagccagccctcca

SEQ ID NO: 1104215 - DNA, 22 bp, Artificial Sequence
  chemically synthesized
ataaatatagccagccctccat

SEQ ID NO: 1104216 - DNA, 22 bp, Artificial Sequence
  chemically synthesized
taaatatagccagccctccata

SEQ ID NO: 1104217 - DNA, 22 bp, Artificial Sequence
  chemically synthesized
agaatccacaaatatggagggc

SEQ ID NO: 1104218 - DNA, 22 bp, Artificial Sequence
  chemically synthesized
attcagaatccacaaatatgga

SEQ ID NO: 1104219 - DNA, 22 bp, Artificial Sequence
  chemically synthesized
aatccactcattcagaatccac

SEQ ID NO: 1104220 - DNA, 22 bp, Artificial Sequence
  chemically synthesized
actgaatccactcattcagaat

SEQ ID NO: 1104221 - DNA, 22 bp, Artificial Sequence
  chemically synthesized
catatttgtggattctgaatga

SEQ ID NO: 1104222 - DNA, 22 bp, Artificial Sequence
  chemically synthesized
gtagttgactgaatccactcat

SEQ ID NO: 1104223 - DNA, 22 bp, Artificial Sequence
  chemically synthesized
gtggattctgaatgagtggatt

SEQ ID NO: 1104224 - DNA, 22 bp, Artificial Sequence
  chemically synthesized
tggattctgaatgagtggattc

SEQ ID NO: 1104225 - DNA, 22 bp, Artificial Sequence
  chemically synthesized
ttagtagttgactgaatccact

SEQ ID NO: 1104226 - DNA, 22 bp, Artificial Sequence
  chemically synthesized
tctattagtagttgactgaatc

SEQ ID NO: 1104227 - DNA, 22 bp, Artificial Sequence
  chemically synthesized
tgaatgagtggattcagtcaac

SEQ ID NO: 1104228 - DNA, 22 bp, Artificial Sequence
  chemically synthesized
aatgagtggattcagtcaacta

SEQ ID NO: 1104229 - DNA, 22 bp, Artificial Sequence
  chemically synthesized
tcaaatattatctattagtagt

SEQ ID NO: 1104230 - DNA, 22 bp, Artificial Sequence
  chemically synthesized
gtcaaatattatctattagtag

SEQ ID NO: 1104231 - DNA, 22 bp, Artificial Sequence
  chemically synthesized
tgtcaaatattatctattagta

SEQ ID NO: 1104232 - DNA, 22 bp, Artificial Sequence
  chemically synthesized
ttgtcaaatattatctattagt

SEQ ID NO: 1104233 - DNA, 22 bp, Artificial Sequence
  chemically synthesized
tttttgtcaaatattatctatt

SEQ ID NO: 1104234 - DNA, 22 bp, Artificial Sequence
  chemically synthesized
agtcaactactaatagataata

SEQ ID NO: 1104235 - DNA, 22 bp, Artificial Sequence
  chemically synthesized
ctaatagataatatttgacaaa

SEQ ID NO: 1104236 - DNA, 22 bp, Artificial Sequence
  chemically synthesized
atagataatatttgacaaaaat

SEQ ID NO: 1104237 - DNA, 22 bp, Artificial Sequence
  chemically synthesized
gtacagatgtagttatttttgt

SEQ ID NO: 1104238 - DNA, 22 bp, Artificial Sequence
  chemically synthesized
agtacagatgtagttatttttg

SEQ ID NO: 1104239 - DNA, 22 bp, Artificial Sequence
  chemically synthesized
catgtttagtacagatgtagtt

SEQ ID NO: 1104240 - DNA, 22 bp, Artificial Sequence
  chemically synthesized
acatgtttagtacagatgtagt

SEQ ID NO: 1104241 - DNA, 22 bp, Artificial Sequence
  chemically synthesized
gacaaaaataactacatctgta

SEQ ID NO: 1104242 - DNA, 22 bp, Artificial Sequence
  chemically synthesized
acaaaaataactacatctgtac

SEQ ID NO: 1104243 - DNA, 22 bp, Artificial Sequence
  chemically synthesized
catctgtactaaacatgtaaga

SEQ ID NO: 1104244 - DNA, 22 bp, Artificial Sequence
  chemically synthesized
tactaaacatgtaagacttttt

SEQ ID NO: 1104245 - DNA, 22 bp, Artificial Sequence
  chemically synthesized
ggaagtagtgacaatgaaaaag

SEQ ID NO: 1104246 - DNA, 22 bp, Artificial Sequence
  chemically synthesized
aacatgtaagactttttcattg

SEQ ID NO: 1104247 - DNA, 22 bp, Artificial Sequence
  chemically synthesized
aggaagtagtgacaatgaaaaa

SEQ ID NO: 1104248 - DNA, 22 bp, Artificial Sequence
  chemically synthesized
tttaggaagtagtgacaatgaa

SEQ ID NO: 1104249 - DNA, 22 bp, Artificial Sequence
  chemically synthesized
tattatttaggaagtagtgaca

SEQ ID NO: 1104250 - DNA, 22 bp, Artificial Sequence
  chemically synthesized
tactgtattatttaggaagtag

SEQ ID NO: 1104251 - DNA, 22 bp, Artificial Sequence
  chemically synthesized
tttcattgtcactacttcctaa

SEQ ID NO: 1104252 - DNA, 22 bp, Artificial Sequence
  chemically synthesized
ttcattgtcactacttcctaaa

SEQ ID NO: 1104253 - DNA, 22 bp, Artificial Sequence
  chemically synthesized
tcattgtcactacttcctaaat

SEQ ID NO: 1104254 - DNA, 22 bp, Artificial Sequence
  chemically synthesized
cattgtcactacttcctaaata

SEQ ID NO: 1104255 - DNA, 22 bp, Artificial Sequence
  chemically synthesized
attgtcactacttcctaaataa

SEQ ID NO: 1104256 - DNA, 22 bp, Artificial Sequence
  chemically synthesized
tcactacttcctaaataataca

SEQ ID NO: 1104257 - DNA, 22 bp, Artificial Sequence
  chemically synthesized
cttcctaaataatacagtataa

SEQ ID NO: 1104258 - DNA, 22 bp, Artificial Sequence
  chemically synthesized
tgaaaatatgtgttatactgta

SEQ ID NO: 1104259 - DNA, 22 bp, Artificial Sequence
  chemically synthesized
cctaaataatacagtataacac

SEQ ID NO: 1104260 - DNA, 22 bp, Artificial Sequence
  chemically synthesized
ctaaataatacagtataacaca

SEQ ID NO: 1104261 - DNA, 22 bp, Artificial Sequence
  chemically synthesized
aataatacagtataacacatat

SEQ ID NO: 1104262 - DNA, 22 bp, Artificial Sequence
  chemically synthesized
atacaatgtaaatattatgaaa

SEQ ID NO: 1104263 - DNA, 22 bp, Artificial Sequence
  chemically synthesized
taatgcctaatacaatgtaaat

SEQ ID NO: 1104264 - DNA, 22 bp, Artificial Sequence
  chemically synthesized
ataatgcctaatacaatgtaaa

SEQ ID NO: 1104265 - DNA, 22 bp, Artificial Sequence
  chemically synthesized
cttataatgcctaatacaatgt

SEQ ID NO: 1104266 - DNA, 22 bp, Artificial Sequence
  chemically synthesized
tcataatatttacattgtatta

SEQ ID NO: 1104267 - DNA, 22 bp, Artificial Sequence
  chemically synthesized
cataatatttacattgtattag

SEQ ID NO: 1104268 - DNA, 22 bp, Artificial Sequence
  chemically synthesized
ataatatttacattgtattagg

SEQ ID NO: 1104269 - DNA, 22 bp, Artificial Sequence
  chemically synthesized
gattacttataatgcctaatac

SEQ ID NO: 1104270 - DNA, 22 bp, Artificial Sequence
  chemically synthesized
tggattacttataatgcctaat

SEQ ID NO: 1104271 - DNA, 22 bp, Artificial Sequence
  chemically synthesized
acattgtattaggcattataag

SEQ ID NO: 1104272 - DNA, 22 bp, Artificial Sequence
  chemically synthesized
atctctggattacttataatgc

SEQ ID NO: 1104273 - DNA, 22 bp, Artificial Sequence
  chemically synthesized
cattgtattaggcattataagt

SEQ ID NO: 1104274 - DNA, 22 bp, Artificial Sequence
  chemically synthesized
actcatctctggattacttata

SEQ ID NO: 1104275 - DNA, 22 bp, Artificial Sequence
  chemically synthesized
aactcatctctggattacttat

SEQ ID NO: 1104276 - DNA, 22 bp, Artificial Sequence
  chemically synthesized
tattaggcattataagtaatcc

SEQ ID NO: 1104277 - DNA, 22 bp, Artificial Sequence
  chemically synthesized
taactcatctctggattactta

SEQ ID NO: 1104278 - DNA, 22 bp, Artificial Sequence
  chemically synthesized
ggcattataagtaatccagaga

SEQ ID NO: 1104279 - DNA, 22 bp, Artificial Sequence
  chemically synthesized
ccatatactttaactcatctct

SEQ ID NO: 1104280 - DNA, 22 bp, Artificial Sequence
  chemically synthesized
taagtaatccagagatgagtta

SEQ ID NO: 1104281 - DNA, 22 bp, Artificial Sequence
  chemically synthesized
tgaacatgctcccatatacttt

SEQ ID NO: 1104282 - DNA, 22 bp, Artificial Sequence
  chemically synthesized
atgaacatgctcccatatactt

SEQ ID NO: 1104283 - DNA, 22 bp, Artificial Sequence
  chemically synthesized
catataacttatgaacatgctc

SEQ ID NO: 1104284 - DNA, 22 bp, Artificial Sequence
  chemically synthesized
gcatataacttatgaacatgct

SEQ ID NO: 1104285 - DNA, 22 bp, Artificial Sequence
  chemically synthesized
aagtatatgggagcatgttcat

SEQ ID NO: 1104286 - DNA, 22 bp, Artificial Sequence
  chemically synthesized
tatgaatggtgtaatatttgca

SEQ ID NO: 1104287 - DNA, 22 bp, Artificial Sequence
  chemically synthesized
atatgaatggtgtaatatttgc

SEQ ID NO: 1104288 - DNA, 22 bp, Artificial Sequence
  chemically synthesized
ataagttatatgcaaatattac

SEQ ID NO: 1104289 - DNA, 22 bp, Artificial Sequence
  chemically synthesized
tatatgaatggtgtaatatttg

SEQ ID NO: 1104290 - DNA, 22 bp, Artificial Sequence
  chemically synthesized
tatgcaaatattacaccattca

SEQ ID NO: 1104291 - DNA, 22 bp, Artificial Sequence
  chemically synthesized
aagtcctttatatgaatggtgt

SEQ ID NO: 1104292 - DNA, 22 bp, Artificial Sequence
  chemically synthesized
acagatgttcaagtcctttata

SEQ ID NO: 1104293 - DNA, 22 bp, Artificial Sequence
  chemically synthesized
caccattcatataaaggacttg

SEQ ID NO: 1104294 - DNA, 22 bp, Artificial Sequence
  chemically synthesized
atataaaggacttgaacatctg

SEQ ID NO: 1104295 - DNA, 22 bp, Artificial Sequence
  chemically synthesized
tgaatatcagaattcacagatg

SEQ ID NO: 1104296 - DNA, 22 bp, Artificial Sequence
  chemically synthesized
ctatgaatatcagaattcacag

SEQ ID NO: 1104297 - DNA, 22 bp, Artificial Sequence
  chemically synthesized
gaacatctgtgaattctgatat

SEQ ID NO: 1104298 - DNA, 22 bp, Artificial Sequence
  chemically synthesized
aacatctgtgaattctgatatt

SEQ ID NO: 1104299 - DNA, 22 bp, Artificial Sequence
  chemically synthesized
caggaactcctatgaatatcag

SEQ ID NO: 1104300 - DNA, 22 bp, Artificial Sequence
  chemically synthesized
tgaattctgatattcataggag

SEQ ID NO: 1104301 - DNA, 22 bp, Artificial Sequence
  chemically synthesized
tgatattcataggagttcctgg

SEQ ID NO: 1104302 - DNA, 22 bp, Artificial Sequence
  chemically synthesized
atattcataggagttcctggaa

SEQ ID NO: 1104303 - DNA, 22 bp, Artificial Sequence
  chemically synthesized
ataggagttcctggaaccactt

SEQ ID NO: 1104304 - DNA, 22 bp, Artificial Sequence
  chemically synthesized
gtatccatggggaagtggttcc

SEQ ID NO: 1104305 - DNA, 22 bp, Artificial Sequence
  chemically synthesized
cgtatccatggggaagtggttc

SEQ ID NO: 1104306 - DNA, 22 bp, Artificial Sequence
  chemically synthesized
ctggaaccacttccccatggat

SEQ ID NO: 1104307 - DNA, 22 bp, Artificial Sequence
  chemically synthesized
gaaccacttccccatggatacg

SEQ ID NO: 1104308 - DNA, 22 bp, Artificial Sequence
  chemically synthesized
ccccatggatacgaagggatga

SEQ ID NO: 1104309 - DNA, 22 bp, Artificial Sequence
  chemically synthesized
cccatggatacgaagggatgac

SEQ ID NO: 1104310 - DNA, 22 bp, Artificial Sequence
  chemically synthesized
gtgggtaaaatcagtgtacagt

SEQ ID NO: 1104311 - DNA, 22 bp, Artificial Sequence
  chemically synthesized
aaactggtgggtaaaatcagtg

SEQ ID NO: 1104312 - DNA, 22 bp, Artificial Sequence
  chemically synthesized
tcaaactggtgggtaaaatcag

SEQ ID NO: 1104313 - DNA, 22 bp, Artificial Sequence
  chemically synthesized
tacactgattttacccaccagt

SEQ ID NO: 1104314 - DNA, 22 bp, Artificial Sequence
  chemically synthesized
tcacattctcaaactggtgggt

SEQ ID NO: 1104315 - DNA, 22 bp, Artificial Sequence
  chemically synthesized
ctgtcacattctcaaactggtg

SEQ ID NO: 1104316 - DNA, 22 bp, Artificial Sequence
  chemically synthesized
attttacccaccagtttgagaa

SEQ ID NO: 1104317 - DNA, 22 bp, Artificial Sequence
  chemically synthesized
taactcctgtcacattctcaaa

SEQ ID NO: 1104318 - DNA, 22 bp, Artificial Sequence
  chemically synthesized
gtaactcctgtcacattctcaa

SEQ ID NO: 1104319 - DNA, 22 bp, Artificial Sequence
  chemically synthesized
tacccaccagtttgagaatgtg

SEQ ID NO: 1104320 - DNA, 22 bp, Artificial Sequence
  chemically synthesized
acccaccagtttgagaatgtga

SEQ ID NO: 1104321 - DNA, 22 bp, Artificial Sequence
  chemically synthesized
cccaccagtttgagaatgtgac

SEQ ID NO: 1104322 - DNA, 22 bp, Artificial Sequence
  chemically synthesized
tttgtaactcctgtcacattct

SEQ ID NO: 1104323 - DNA, 22 bp, Artificial Sequence
  chemically synthesized
atttgtaactcctgtcacattc

SEQ ID NO: 1104324 - DNA, 22 bp, Artificial Sequence
  chemically synthesized
tatttgtaactcctgtcacatt

SEQ ID NO: 1104325 - DNA, 22 bp, Artificial Sequence
  chemically synthesized
tttatttgtaactcctgtcaca

SEQ ID NO: 1104326 - DNA, 22 bp, Artificial Sequence
  chemically synthesized
ctttatttgtaactcctgtcac

SEQ ID NO: 1104327 - DNA, 22 bp, Artificial Sequence
  chemically synthesized
cttctttatttgtaactcctgt

SEQ ID NO: 1104328 - DNA, 22 bp, Artificial Sequence
  chemically synthesized
gcttctttatttgtaactcctg

SEQ ID NO: 1104329 - DNA, 22 bp, Artificial Sequence
  chemically synthesized
tgcttctttatttgtaactcct

SEQ ID NO: 1104330 - DNA, 22 bp, Artificial Sequence
  chemically synthesized
gagaatgtgacaggagttacaa

SEQ ID NO: 1104331 - DNA, 22 bp, Artificial Sequence
  chemically synthesized
agaatgtgacaggagttacaaa

SEQ ID NO: 1104332 - DNA, 22 bp, Artificial Sequence
  chemically synthesized
cccacctttgcttctttatttg

SEQ ID NO: 1104333 - DNA, 22 bp, Artificial Sequence
  chemically synthesized
ttccccacctttgcttctttat

SEQ ID NO: 1104334 - DNA, 22 bp, Artificial Sequence
  chemically synthesized
attccccacctttgcttcttta

SEQ ID NO: 1104335 - DNA, 22 bp, Artificial Sequence
  chemically synthesized
tattccccacctttgcttcttt

SEQ ID NO: 1104336 - DNA, 22 bp, Artificial Sequence
  chemically synthesized
ttttattccccacctttgcttc

SEQ ID NO: 1104337 - DNA, 22 bp, Artificial Sequence
  chemically synthesized
caaataaagaagcaaaggtggg

SEQ ID NO: 1104338 - DNA, 22 bp, Artificial Sequence
  chemically synthesized
gaaaaaccattgttttattccc

SEQ ID NO: 1104339 - DNA, 22 bp, Artificial Sequence
  chemically synthesized
ttagaaaaaccattgttttatt

SEQ ID NO: 1104340 - DNA, 22 bp, Artificial Sequence
  chemically synthesized
attattagaaaaaccattgttt

SEQ ID NO: 1104341 - DNA, 22 bp, Artificial Sequence
  chemically synthesized
gattattagaaaaaccattgtt

SEQ ID NO: 1104342 - DNA, 22 bp, Artificial Sequence
  chemically synthesized
tgattattagaaaaaccattgt

SEQ ID NO: 1104343 - DNA, 22 bp, Artificial Sequence
  chemically synthesized
attttgattattagaaaaacca

SEQ ID NO: 1104344 - DNA, 22 bp, Artificial Sequence
  chemically synthesized
agatgtattgattttgattatt

SEQ ID NO: 1104345 - DNA, 22 bp, Artificial Sequence
  chemically synthesized
cagatgtattgattttgattat

SEQ ID NO: 1104346 - DNA, 22 bp, Artificial Sequence
  chemically synthesized
tcagatgtattgattttgatta

SEQ ID NO: 1104347 - DNA, 22 bp, Artificial Sequence
  chemically synthesized
ttctaataatcaaaatcaatac

SEQ ID NO: 1104348 - DNA, 22 bp, Artificial Sequence
  chemically synthesized
tctaataatcaaaatcaataca

SEQ ID NO: 1104349 - DNA, 22 bp, Artificial Sequence
  chemically synthesized
ctaataatcaaaatcaatacat

SEQ ID NO: 1104350 - DNA, 22 bp, Artificial Sequence
  chemically synthesized
taataatcaaaatcaatacatc

SEQ ID NO: 1104351 - DNA, 22 bp, Artificial Sequence
  chemically synthesized
gcatgcattttcagatgtattg

SEQ ID NO: 1104352 - DNA, 22 bp, Artificial Sequence
  chemically synthesized
ataatcaaaatcaatacatctg

SEQ ID NO: 1104353 - DNA, 22 bp, Artificial Sequence
  chemically synthesized
agcatgcattttcagatgtatt

SEQ ID NO: 1104354 - DNA, 22 bp, Artificial Sequence
  chemically synthesized
atttagcatgcattttcagatg

SEQ ID NO: 1104355 - DNA, 22 bp, Artificial Sequence
  chemically synthesized
aatttagcatgcattttcagat

SEQ ID NO: 1104356 - DNA, 22 bp, Artificial Sequence
  chemically synthesized
taatttagcatgcattttcaga

SEQ ID NO: 1104357 - DNA, 22 bp, Artificial Sequence
  chemically synthesized
ttaatttagcatgcattttcag

SEQ ID NO: 1104358 - DNA, 22 bp, Artificial Sequence
  chemically synthesized
tgaagtatatttttaatttagc

SEQ ID NO: 1104359 - DNA, 22 bp, Artificial Sequence
  chemically synthesized
atgaagtatatttttaatttag

SEQ ID NO: 1104360 - DNA, 22 bp, Artificial Sequence
  chemically synthesized
aaaatgcatgctaaattaaaaa

SEQ ID NO: 1104361 - DNA, 22 bp, Artificial Sequence
  chemically synthesized
tttatgaagtatatttttaatt

SEQ ID NO: 1104362 - DNA, 22 bp, Artificial Sequence
  chemically synthesized
tatgatctatttatgaagtata

SEQ ID NO: 1104363 - DNA, 22 bp, Artificial Sequence
  chemically synthesized
aattaaaaatatacttcataaa

SEQ ID NO: 1104364 - DNA, 22 bp, Artificial Sequence
  chemically synthesized
aaaatatacttcataaatagat

SEQ ID NO: 1104365 - DNA, 22 bp, Artificial Sequence
  chemically synthesized
aaaacaattgtatgatctattt

SEQ ID NO: 1104366 - DNA, 22 bp, Artificial Sequence
  chemically synthesized
gaaaacaattgtatgatctatt

SEQ ID NO: 1104367 - DNA, 22 bp, Artificial Sequence
  chemically synthesized
tgaaaacaattgtatgatctat

SEQ ID NO: 1104368 - DNA, 22 bp, Artificial Sequence
  chemically synthesized
ttgaaaacaattgtatgatcta

SEQ ID NO: 1104369 - DNA, 22 bp, Artificial Sequence
  chemically synthesized
tttttgaaaacaattgtatgat

SEQ ID NO: 1104370 - DNA, 22 bp, Artificial Sequence
  chemically synthesized
cataaatagatcatacaattgt

SEQ ID NO: 1104371 - DNA, 22 bp, Artificial Sequence
  chemically synthesized
ataaatagatcatacaattgtt

SEQ ID NO: 1104372 - DNA, 22 bp, Artificial Sequence
  chemically synthesized
ttttcaaaaacagcatgtatat

SEQ ID NO: 1104373 - DNA, 22 bp, Artificial Sequence
  chemically synthesized
tcaaaaacagcatgtatatatg

SEQ ID NO: 1104374 - DNA, 22 bp, Artificial Sequence
  chemically synthesized
caaaaacagcatgtatatatgc

SEQ ID NO: 1104375 - DNA, 22 bp, Artificial Sequence
  chemically synthesized
aaaaacagcatgtatatatgcc

SEQ ID NO: 1104376 - DNA, 22 bp, Artificial Sequence
  chemically synthesized
tggatatatatgtatgggcata

SEQ ID NO: 1104377 - DNA, 22 bp, Artificial Sequence
  chemically synthesized
tctatggatatatatgtatggg

SEQ ID NO: 1104378 - DNA, 22 bp, Artificial Sequence
  chemically synthesized
tatctatggatatatatgtatg

SEQ ID NO: 1104379 - DNA, 22 bp, Artificial Sequence
  chemically synthesized
tgcatatactctatctatggat

SEQ ID NO: 1104380 - DNA, 22 bp, Artificial Sequence
  chemically synthesized
atgcatatactctatctatgga

SEQ ID NO: 1104381 - DNA, 22 bp, Artificial Sequence
  chemically synthesized
tttatgcatatactctatctat

SEQ ID NO: 1104382 - DNA, 22 bp, Artificial Sequence
  chemically synthesized
cagtattatttatgcatatact

SEQ ID NO: 1104383 - DNA, 22 bp, Artificial Sequence
  chemically synthesized
acagtattatttatgcatatac

SEQ ID NO: 1104384 - DNA, 22 bp, Artificial Sequence
  chemically synthesized
tacagtattatttatgcatata

SEQ ID NO: 1104385 - DNA, 22 bp, Artificial Sequence
  chemically synthesized
agcaaatgaaaatgagacttta

SEQ ID NO: 1104386 - DNA, 22 bp, Artificial Sequence
  chemically synthesized
cccattgagcaaatgaaaatga

SEQ ID NO: 1104387 - DNA, 22 bp, Artificial Sequence
  chemically synthesized
gcccattgagcaaatgaaaatg

SEQ ID NO: 1104388 - DNA, 22 bp, Artificial Sequence
  chemically synthesized
taaagtctcattttcatttgct

SEQ ID NO: 1104389 - DNA, 22 bp, Artificial Sequence
  chemically synthesized
attttcatttgctcaatgggca

SEQ ID NO: 1104390 - DNA, 22 bp, Artificial Sequence
  chemically synthesized
acaagtatggtagtttgcccat

SEQ ID NO: 1104391 - DNA, 22 bp, Artificial Sequence
  chemically synthesized
tcatttgctcaatgggcaaact

SEQ ID NO: 1104392 - DNA, 22 bp, Artificial Sequence
  chemically synthesized
catttgctcaatgggcaaacta

SEQ ID NO: 1104393 - DNA, 22 bp, Artificial Sequence
  chemically synthesized
tgacaagtatggtagtttgccc

SEQ ID NO: 1104394 - DNA, 22 bp, Artificial Sequence
  chemically synthesized
atttgctcaatgggcaaactac

SEQ ID NO: 1104395 - DNA, 22 bp, Artificial Sequence
  chemically synthesized
gctcaatgggcaaactaccata

SEQ ID NO: 1104396 - DNA, 22 bp, Artificial Sequence
  chemically synthesized
ctcaatgggcaaactaccatac

SEQ ID NO: 1104397 - DNA, 22 bp, Artificial Sequence
  chemically synthesized
agtcattctgacaagtatggta

SEQ ID NO: 1104398 - DNA, 22 bp, Artificial Sequence
  chemically synthesized
aatgggcaaactaccatacttg

SEQ ID NO: 1104399 - DNA, 22 bp, Artificial Sequence
  chemically synthesized
aagtcattctgacaagtatggt

SEQ ID NO: 1104400 - DNA, 22 bp, Artificial Sequence
  chemically synthesized
gaatttaagtcattctgacaag

SEQ ID NO: 1104401 - DNA, 22 bp, Artificial Sequence
  chemically synthesized
ccatacttgtcagaatgactta

SEQ ID NO: 1104402 - DNA, 22 bp, Artificial Sequence
  chemically synthesized
aataatattagaatttaagtca

SEQ ID NO: 1104403 - DNA, 22 bp, Artificial Sequence
  chemically synthesized
aaataatattagaatttaagtc

SEQ ID NO: 1104404 - DNA, 22 bp, Artificial Sequence
  chemically synthesized
taaataatattagaatttaagt

SEQ ID NO: 1104405 - DNA, 22 bp, Artificial Sequence
  chemically synthesized
gtcagaatgacttaaattctaa

SEQ ID NO: 1104406 - DNA, 22 bp, Artificial Sequence
  chemically synthesized
tcagaatgacttaaattctaat

SEQ ID NO: 1104407 - DNA, 22 bp, Artificial Sequence
  chemically synthesized
atataacctttaaataatatta

SEQ ID NO: 1104408 - DNA, 22 bp, Artificial Sequence
  chemically synthesized
aaattctaatattatttaaagg

SEQ ID NO: 1104409 - DNA, 22 bp, Artificial Sequence
  chemically synthesized
acattgatataacctttaaata

SEQ ID NO: 1104410 - DNA, 22 bp, Artificial Sequence
  chemically synthesized
aattctaatattatttaaaggt

SEQ ID NO: 1104411 - DNA, 22 bp, Artificial Sequence
  chemically synthesized
taatattatttaaaggttatat

SEQ ID NO: 1104412 - DNA, 22 bp, Artificial Sequence
  chemically synthesized
atattatttaaaggttatatca

SEQ ID NO: 1104413 - DNA, 22 bp, Artificial Sequence
  chemically synthesized
tcaagcattcacattgatataa

SEQ ID NO: 1104414 - DNA, 22 bp, Artificial Sequence
  chemically synthesized
atcaagcattcacattgatata

SEQ ID NO: 1104415 - DNA, 22 bp, Artificial Sequence
  chemically synthesized
tttaaaggttatatcaatgtga

SEQ ID NO: 1104416 - DNA, 22 bp, Artificial Sequence
  chemically synthesized
aaaggttatatcaatgtgaatg

SEQ ID NO: 1104417 - DNA, 22 bp, Artificial Sequence
  chemically synthesized
aaggttatatcaatgtgaatgc

SEQ ID NO: 1104418 - DNA, 22 bp, Artificial Sequence
  chemically synthesized
tatcaatgtgaatgcttgataa

SEQ ID NO: 1104419 - DNA, 22 bp, Artificial Sequence
  chemically synthesized
aatgtcaaaacaataaagcacg

SEQ ID NO: 1104420 - DNA, 22 bp, Artificial Sequence
  chemically synthesized
gaatgtcaaaacaataaagcac

SEQ ID NO: 1104421 - DNA, 22 bp, Artificial Sequence
  chemically synthesized
gataagcgtgctttattgtttt

SEQ ID NO: 1104422 - DNA, 22 bp, Artificial Sequence
  chemically synthesized
ataagcgtgctttattgttttg

SEQ ID NO: 1104423 - DNA, 22 bp, Artificial Sequence
  chemically synthesized
tgaatatttgaatgtcaaaaca

SEQ ID NO: 1104424 - DNA, 22 bp, Artificial Sequence
  chemically synthesized
caggtctgtgaatatttgaatg

SEQ ID NO: 1104425 - DNA, 22 bp, Artificial Sequence
  chemically synthesized
tattgttttgacattcaaatat

SEQ ID NO: 1104426 - DNA, 22 bp, Artificial Sequence
  chemically synthesized
attgttttgacattcaaatatt

SEQ ID NO: 1104427 - DNA, 22 bp, Artificial Sequence
  chemically synthesized
ttgttttgacattcaaatattc

SEQ ID NO: 1104428 - DNA, 22 bp, Artificial Sequence
  chemically synthesized
ttttgacattcaaatattcaca

SEQ ID NO: 1104429 - DNA, 22 bp, Artificial Sequence
  chemically synthesized
tgacattcaaatattcacagac

SEQ ID NO: 1104430 - DNA, 22 bp, Artificial Sequence
  chemically synthesized
ggggaattgcaggtctgtgaat

SEQ ID NO: 1104431 - DNA, 22 bp, Artificial Sequence
  chemically synthesized
gacattcaaatattcacagacc

SEQ ID NO: 1104432 - DNA, 22 bp, Artificial Sequence
  chemically synthesized
acattcaaatattcacagacct

SEQ ID NO: 1104433 - DNA, 22 bp, Artificial Sequence
  chemically synthesized
aaatattcacagacctgcaatt

SEQ ID NO: 1104434 - DNA, 22 bp, Artificial Sequence
  chemically synthesized
acagacctgcaattccccgagt

SEQ ID NO: 1104435 - DNA, 22 bp, Artificial Sequence
  chemically synthesized
tgaaatcatggagcagagactc

SEQ ID NO: 1104436 - DNA, 22 bp, Artificial Sequence
  chemically synthesized
caattccccgagtctctgctcc

SEQ ID NO: 1104437 - DNA, 22 bp, Artificial Sequence
  chemically synthesized
cccgagtctctgctccatgatt

SEQ ID NO: 1104438 - DNA, 22 bp, Artificial Sequence
  chemically synthesized
gtgtcaccgactatgaaatcat

SEQ ID NO: 1104439 - DNA, 22 bp, Artificial Sequence
  chemically synthesized
agtgtcaccgactatgaaatca

SEQ ID NO: 1104440 - DNA, 22 bp, Artificial Sequence
  chemically synthesized
tgctccatgatttcatagtcgg

SEQ ID NO: 1104441 - DNA, 22 bp, Artificial Sequence
  chemically synthesized
aacttagtgtcaccgactatga

SEQ ID NO: 1104442 - DNA, 22 bp, Artificial Sequence
  chemically synthesized
ctccatgatttcatagtcggtg

SEQ ID NO: 1104443 - DNA, 22 bp, Artificial Sequence
  chemically synthesized
catgatttcatagtcggtgaca

SEQ ID NO: 1104444 - DNA, 22 bp, Artificial Sequence
  chemically synthesized
catacctcaacttagtgtcacc

SEQ ID NO: 1104445 - DNA, 22 bp, Artificial Sequence
  chemically synthesized
tccatacctcaacttagtgtca

SEQ ID NO: 1104446 - DNA, 22 bp, Artificial Sequence
  chemically synthesized
catagtcggtgacactaagttg

SEQ ID NO: 1104447 - DNA, 22 bp, Artificial Sequence
  chemically synthesized
atagtcggtgacactaagttga

SEQ ID NO: 1104448 - DNA, 22 bp, Artificial Sequence
  chemically synthesized
agttgaggtatggagagtttgg

SEQ ID NO: 1104449 - DNA, 22 bp, Artificial Sequence
  chemically synthesized
aggtatggagagtttggtttct

SEQ ID NO: 1104450 - DNA, 22 bp, Artificial Sequence
  chemically synthesized
ggtttctgactgctggacccat

SEQ ID NO: 1104451 - DNA, 22 bp, Artificial Sequence
  chemically synthesized
gtttctgactgctggacccatg

SEQ ID NO: 1104452 - DNA, 22 bp, Artificial Sequence
  chemically synthesized
ctgactgctggacccatgtcct

SEQ ID NO: 1104453 - DNA, 22 bp, Artificial Sequence
  chemically synthesized
tgactgctggacccatgtcctg

SEQ ID NO: 1104454 - DNA, 22 bp, Artificial Sequence
  chemically synthesized
actgctggacccatgtcctgat

SEQ ID NO: 1104455 - DNA, 22 bp, Artificial Sequence
  chemically synthesized
ctggacccatgtcctgatggca

SEQ ID NO: 1104456 - DNA, 22 bp, Artificial Sequence
  chemically synthesized
gacccatgtcctgatggcactc

SEQ ID NO: 1104457 - DNA, 22 bp, Artificial Sequence
  chemically synthesized
tcaggagaccatgagtgccatc

SEQ ID NO: 1104458 - DNA, 22 bp, Artificial Sequence
  chemically synthesized
atggcactcatggtctcctgat

SEQ ID NO: 1104459 - DNA, 22 bp, Artificial Sequence
  chemically synthesized
ccaccaatgcgctatcaggaga

SEQ ID NO: 1104460 - DNA, 22 bp, Artificial Sequence
  chemically synthesized
gccaccaatgcgctatcaggag

SEQ ID NO: 1104461 - DNA, 22 bp, Artificial Sequence
  chemically synthesized
tgccaccaatgcgctatcagga

SEQ ID NO: 1104462 - DNA, 22 bp, Artificial Sequence
  chemically synthesized
atggtctcctgatagcgcattg

SEQ ID NO: 1104463 - DNA, 22 bp, Artificial Sequence
  chemically synthesized
acactttgccaccaatgcgcta

SEQ ID NO: 1104464 - DNA, 22 bp, Artificial Sequence
  chemically synthesized
gacactttgccaccaatgcgct

SEQ ID NO: 1104465 - DNA, 22 bp, Artificial Sequence
  chemically synthesized
tgacactttgccaccaatgcgc

SEQ ID NO: 1104466 - DNA, 22 bp, Artificial Sequence
  chemically synthesized
ttgacactttgccaccaatgcg

SEQ ID NO: 1104467 - DNA, 22 bp, Artificial Sequence
  chemically synthesized
ctgatagcgcattggtggcaaa

SEQ ID NO: 1104468 - DNA, 22 bp, Artificial Sequence
  chemically synthesized
atagcgcattggtggcaaagtg

SEQ ID NO: 1104469 - DNA, 22 bp, Artificial Sequence
  chemically synthesized
ataaagtttttgacactttgcc

SEQ ID NO: 1104470 - DNA, 22 bp, Artificial Sequence
  chemically synthesized
gataaagtttttgacactttgc

SEQ ID NO: 1104471 - DNA, 22 bp, Artificial Sequence
  chemically synthesized
tgataaagtttttgacactttg

SEQ ID NO: 1104472 - DNA, 22 bp, Artificial Sequence
  chemically synthesized
ttgataaagtttttgacacttt

SEQ ID NO: 1104473 - DNA, 22 bp, Artificial Sequence
  chemically synthesized
ccttttgataaagtttttgaca

SEQ ID NO: 1104474 - DNA, 22 bp, Artificial Sequence
  chemically synthesized
cccttttgataaagtttttgac

SEQ ID NO: 1104475 - DNA, 22 bp, Artificial Sequence
  chemically synthesized
tcccttttgataaagtttttga

SEQ ID NO: 1104476 - DNA, 22 bp, Artificial Sequence
  chemically synthesized
gtggcaaagtgtcaaaaacttt

SEQ ID NO: 1104477 - DNA, 22 bp, Artificial Sequence
  chemically synthesized
ttcccttttgataaagtttttg

SEQ ID NO: 1104478 - DNA, 22 bp, Artificial Sequence
  chemically synthesized
tttcccttttgataaagttttt

SEQ ID NO: 1104479 - DNA, 22 bp, Artificial Sequence
  chemically synthesized
ttttcccttttgataaagtttt

SEQ ID NO: 1104480 - DNA, 22 bp, Artificial Sequence
  chemically synthesized
ttttttcccttttgataaagtt

SEQ ID NO: 1104481 - DNA, 22 bp, Artificial Sequence
  chemically synthesized
attcttttttcccttttgataa

SEQ ID NO: 1104482 - DNA, 22 bp, Artificial Sequence
  chemically synthesized
tcattcttttttcccttttgat

SEQ ID NO: 1104483 - DNA, 22 bp, Artificial Sequence
  chemically synthesized
agtgattctcattcttttttcc

SEQ ID NO: 1104484 - DNA, 22 bp, Artificial Sequence
  chemically synthesized
tatcaaaagggaaaaaagaatg

SEQ ID NO: 1104485 - DNA, 22 bp, Artificial Sequence
  chemically synthesized
atcaaaagggaaaaaagaatga

SEQ ID NO: 1104486 - DNA, 22 bp, Artificial Sequence
  chemically synthesized
tcaaaagggaaaaaagaatgag

SEQ ID NO: 1104487 - DNA, 22 bp, Artificial Sequence
  chemically synthesized
ggaaaacatggcaaagtgtgaa

SEQ ID NO: 1104488 - DNA, 22 bp, Artificial Sequence
  chemically synthesized
aggaaaacatggcaaagtgtga

SEQ ID NO: 1104489 - DNA, 22 bp, Artificial Sequence
  chemically synthesized
aattgtttcacactttgccatg

SEQ ID NO: 1104490 - DNA, 22 bp, Artificial Sequence
  chemically synthesized
attgtttcacactttgccatgt

SEQ ID NO: 1104491 - DNA, 22 bp, Artificial Sequence
  chemically synthesized
acaatttaggaaaacatggcaa

SEQ ID NO: 1104492 - DNA, 22 bp, Artificial Sequence
  chemically synthesized
tttcacactttgccatgttttc

SEQ ID NO: 1104493 - DNA, 22 bp, Artificial Sequence
  chemically synthesized
ctgacaatttaggaaaacatgg

SEQ ID NO: 1104494 - DNA, 22 bp, Artificial Sequence
  chemically synthesized
gctgacaatttaggaaaacatg

SEQ ID NO: 1104495 - DNA, 22 bp, Artificial Sequence
  chemically synthesized
cacactttgccatgttttccta

SEQ ID NO: 1104496 - DNA, 22 bp, Artificial Sequence
  chemically synthesized
acactttgccatgttttcctaa

SEQ ID NO: 1104497 - DNA, 22 bp, Artificial Sequence
  chemically synthesized
agtttgctgacaatttaggaaa

SEQ ID NO: 1104498 - DNA, 22 bp, Artificial Sequence
  chemically synthesized
tgccatgttttcctaaattgtc

SEQ ID NO: 1104499 - DNA, 22 bp, Artificial Sequence
  chemically synthesized
gccatgttttcctaaattgtca

SEQ ID NO: 1104500 - DNA, 22 bp, Artificial Sequence
  chemically synthesized
ccatgttttcctaaattgtcag

SEQ ID NO: 1104501 - DNA, 22 bp, Artificial Sequence
  chemically synthesized
gtaatataattgagtttgctga

SEQ ID NO: 1104502 - DNA, 22 bp, Artificial Sequence
  chemically synthesized
tcctaaattgtcagcaaactca

SEQ ID NO: 1104503 - DNA, 22 bp, Artificial Sequence
  chemically synthesized
cctaaattgtcagcaaactcaa

SEQ ID NO: 1104504 - DNA, 22 bp, Artificial Sequence
  chemically synthesized
ctaaattgtcagcaaactcaat

SEQ ID NO: 1104505 - DNA, 22 bp, Artificial Sequence
  chemically synthesized
aaactagtaatataattgagtt

SEQ ID NO: 1104506 - DNA, 22 bp, Artificial Sequence
  chemically synthesized
aattgtcagcaaactcaattat

SEQ ID NO: 1104507 - DNA, 22 bp, Artificial Sequence
  chemically synthesized
gaaactagtaatataattgagt

SEQ ID NO: 1104508 - DNA, 22 bp, Artificial Sequence
  chemically synthesized
tcagcaaactcaattatattac

SEQ ID NO: 1104509 - DNA, 22 bp, Artificial Sequence
  chemically synthesized
atatttgaaactagtaatataa

SEQ ID NO: 1104510 - DNA, 22 bp, Artificial Sequence
  chemically synthesized
ttaatatttgaaactagtaata

SEQ ID NO: 1104511 - DNA, 22 bp, Artificial Sequence
  chemically synthesized
gttaatatttgaaactagtaat

SEQ ID NO: 1104512 - DNA, 22 bp, Artificial Sequence
  chemically synthesized
tgttaatatttgaaactagtaa

SEQ ID NO: 1104513 - DNA, 22 bp, Artificial Sequence
  chemically synthesized
attttgttaatatttgaaacta

SEQ ID NO: 1104514 - DNA, 22 bp, Artificial Sequence
  chemically synthesized
aattatattactagtttcaaat

SEQ ID NO: 1104515 - DNA, 22 bp, Artificial Sequence
  chemically synthesized
taattttgttaatatttgaaac

SEQ ID NO: 1104516 - DNA, 22 bp, Artificial Sequence
  chemically synthesized
ctaattttgttaatatttgaaa

SEQ ID NO: 1104517 - DNA, 22 bp, Artificial Sequence
  chemically synthesized
tctaattttgttaatatttgaa

SEQ ID NO: 1104518 - DNA, 22 bp, Artificial Sequence
  chemically synthesized
tattactagtttcaaatattaa

SEQ ID NO: 1104519 - DNA, 22 bp, Artificial Sequence
  chemically synthesized
agattttctaattttgttaata

SEQ ID NO: 1104520 - DNA, 22 bp, Artificial Sequence
  chemically synthesized
ctagtttcaaatattaacaaaa

SEQ ID NO: 1104521 - DNA, 22 bp, Artificial Sequence
  chemically synthesized
cagattttctaattttgttaat

SEQ ID NO: 1104522 - DNA, 22 bp, Artificial Sequence
  chemically synthesized
tcagattttctaattttgttaa

SEQ ID NO: 1104523 - DNA, 22 bp, Artificial Sequence
  chemically synthesized
ttcagattttctaattttgtta

SEQ ID NO: 1104524 - DNA, 22 bp, Artificial Sequence
  chemically synthesized
gtttcaaatattaacaaaatta

SEQ ID NO: 1104525 - DNA, 22 bp, Artificial Sequence
  chemically synthesized
caaatattaacaaaattagaaa

SEQ ID NO: 1104526 - DNA, 22 bp, Artificial Sequence
  chemically synthesized
aaatattaacaaaattagaaaa

SEQ ID NO: 1104527 - DNA, 22 bp, Artificial Sequence
  chemically synthesized
aatatatttttcagattttcta

SEQ ID NO: 1104528 - DNA, 22 bp, Artificial Sequence
  chemically synthesized
acaaaattagaaaatctgaaaa

SEQ ID NO: 1104529 - DNA, 22 bp, Artificial Sequence
  chemically synthesized
ataatcatattaaatatatttt

SEQ ID NO: 1104530 - DNA, 22 bp, Artificial Sequence
  chemically synthesized
cataatcatattaaatatattt

SEQ ID NO: 1104531 - DNA, 22 bp, Artificial Sequence
  chemically synthesized
gaaaatctgaaaaatatattta

SEQ ID NO: 1104532 - DNA, 22 bp, Artificial Sequence
  chemically synthesized
aaaaatatatttaatatgatta

SEQ ID NO: 1104533 - DNA, 22 bp, Artificial Sequence
  chemically synthesized
aatatgattatgaagatacatt

SEQ ID NO: 1104534 - DNA, 22 bp, Artificial Sequence
  chemically synthesized
atatgattatgaagatacattc

SEQ ID NO: 1104535 - DNA, 22 bp, Artificial Sequence
  chemically synthesized
cacatgtagcaggaatgtatct

SEQ ID NO: 1104536 - DNA, 22 bp, Artificial Sequence
  chemically synthesized
gcatattacacatgtagcagga

SEQ ID NO: 1104537 - DNA, 22 bp, Artificial Sequence
  chemically synthesized
tgaagatacattcctgctacat

SEQ ID NO: 1104538 - DNA, 22 bp, Artificial Sequence
  chemically synthesized
ctgctacatgtgtaatatgcca

SEQ ID NO: 1104539 - DNA, 22 bp, Artificial Sequence
  chemically synthesized
ctacatgtgtaatatgccaggg

SEQ ID NO: 1104540 - DNA, 22 bp, Artificial Sequence
  chemically synthesized
catgtgtaatatgccagggacc

SEQ ID NO: 1104541 - DNA, 22 bp, Artificial Sequence
  chemically synthesized
atgtaatatgtgtaaggtccct

SEQ ID NO: 1104542 - DNA, 22 bp, Artificial Sequence
  chemically synthesized
aatgtaatatgtgtaaggtccc

SEQ ID NO: 1104543 - DNA, 22 bp, Artificial Sequence
  chemically synthesized
tgaatttaatgtaatatgtgta

SEQ ID NO: 1104544 - DNA, 22 bp, Artificial Sequence
  chemically synthesized
gtgaatttaatgtaatatgtgt

SEQ ID NO: 1104545 - DNA, 22 bp, Artificial Sequence
  chemically synthesized
atttgtgaatttaatgtaatat

SEQ ID NO: 1104546 - DNA, 22 bp, Artificial Sequence
  chemically synthesized
caggctgatttgtgaatttaat

SEQ ID NO: 1104547 - DNA, 22 bp, Artificial Sequence
  chemically synthesized
acacatattacattaaattcac

SEQ ID NO: 1104548 - DNA, 22 bp, Artificial Sequence
  chemically synthesized
acaggctgatttgtgaatttaa

SEQ ID NO: 1104549 - DNA, 22 bp, Artificial Sequence
  chemically synthesized
cacatattacattaaattcaca

SEQ ID NO: 1104550 - DNA, 22 bp, Artificial Sequence
  chemically synthesized
tacaggctgatttgtgaattta

SEQ ID NO: 1104551 - DNA, 22 bp, Artificial Sequence
  chemically synthesized
cattaaattcacaaatcagcct

SEQ ID NO: 1104552 - DNA, 22 bp, Artificial Sequence
  chemically synthesized
aattcacaaatcagcctgtaaa

SEQ ID NO: 1104553 - DNA, 22 bp, Artificial Sequence
  chemically synthesized
aacaatatagattttacaggct

SEQ ID NO: 1104554 - DNA, 22 bp, Artificial Sequence
  chemically synthesized
acaaatcagcctgtaaaatcta

SEQ ID NO: 1104555 - DNA, 22 bp, Artificial Sequence
  chemically synthesized
taaaacgaattgaacaatatag

SEQ ID NO: 1104556 - DNA, 22 bp, Artificial Sequence
  chemically synthesized
ataaaacgaattgaacaatata

SEQ ID NO: 1104557 - DNA, 22 bp, Artificial Sequence
  chemically synthesized
taaaatctatattgttcaattc

SEQ ID NO: 1104558 - DNA, 22 bp, Artificial Sequence
  chemically synthesized
accttataaaacgaattgaaca

SEQ ID NO: 1104559 - DNA, 22 bp, Artificial Sequence
  chemically synthesized
ctgaccttataaaacgaattga

SEQ ID NO: 1104560 - DNA, 22 bp, Artificial Sequence
  chemically synthesized
cctgaccttataaaacgaattg

SEQ ID NO: 1104561 - DNA, 22 bp, Artificial Sequence
  chemically synthesized
tttcctgaccttataaaacgaa

SEQ ID NO: 1104562 - DNA, 22 bp, Artificial Sequence
  chemically synthesized
tattgttcaattcgttttataa

SEQ ID NO: 1104563 - DNA, 22 bp, Artificial Sequence
  chemically synthesized
tgtttcctgaccttataaaacg

SEQ ID NO: 1104564 - DNA, 22 bp, Artificial Sequence
  chemically synthesized
ctgtttcctgaccttataaaac

SEQ ID NO: 1104565 - DNA, 22 bp, Artificial Sequence
  chemically synthesized
tctgtttcctgaccttataaaa

SEQ ID NO: 1104566 - DNA, 22 bp, Artificial Sequence
  chemically synthesized
ttctgtttcctgaccttataaa

SEQ ID NO: 1104567 - DNA, 22 bp, Artificial Sequence
  chemically synthesized
ttcaattcgttttataaggtca

SEQ ID NO: 1104568 - DNA, 22 bp, Artificial Sequence
  chemically synthesized
tttttctgtttcctgaccttat

SEQ ID NO: 1104569 - DNA, 22 bp, Artificial Sequence
  chemically synthesized
aattcgttttataaggtcagga

SEQ ID NO: 1104570 - DNA, 22 bp, Artificial Sequence
  chemically synthesized
tctgtttttctgtttcctgacc

SEQ ID NO: 1104571 - DNA, 22 bp, Artificial Sequence
  chemically synthesized
atctgtttttctgtttcctgac

SEQ ID NO: 1104572 - DNA, 22 bp, Artificial Sequence
  chemically synthesized
gttttataaggtcaggaaacag

SEQ ID NO: 1104573 - DNA, 22 bp, Artificial Sequence
  chemically synthesized
cccttatctgtttttctgtttc

SEQ ID NO: 1104574 - DNA, 22 bp, Artificial Sequence
  chemically synthesized
tataaggtcaggaaacagaaaa

SEQ ID NO: 1104575 - DNA, 22 bp, Artificial Sequence
  chemically synthesized
ataaggtcaggaaacagaaaaa

SEQ ID NO: 1104576 - DNA, 22 bp, Artificial Sequence
  chemically synthesized
taaggtcaggaaacagaaaaac

SEQ ID NO: 1104577 - DNA, 22 bp, Artificial Sequence
  chemically synthesized
ctgcccttatctgtttttctgt

SEQ ID NO: 1104578 - DNA, 22 bp, Artificial Sequence
  chemically synthesized
cctgcccttatctgtttttctg

SEQ ID NO: 1104579 - DNA, 22 bp, Artificial Sequence
  chemically synthesized
tttcctgcccttatctgttttt

SEQ ID NO: 1104580 - DNA, 22 bp, Artificial Sequence
  chemically synthesized
tgtttcctgcccttatctgttt

SEQ ID NO: 1104581 - DNA, 22 bp, Artificial Sequence
  chemically synthesized
ctgtttcctgcccttatctgtt

SEQ ID NO: 1104582 - DNA, 22 bp, Artificial Sequence
  chemically synthesized
tctgtttcctgcccttatctgt

SEQ ID NO: 1104583 - DNA, 22 bp, Artificial Sequence
  chemically synthesized
ttctgtttcctgcccttatctg

SEQ ID NO: 1104584 - DNA, 22 bp, Artificial Sequence
  chemically synthesized
tttttctgtttcctgcccttat

SEQ ID NO: 1104585 - DNA, 22 bp, Artificial Sequence
  chemically synthesized
tgtttttctgtttcctgccctt

SEQ ID NO: 1104586 - DNA, 22 bp, Artificial Sequence
  chemically synthesized
tctgtttttctgtttcctgccc

SEQ ID NO: 1104587 - DNA, 22 bp, Artificial Sequence
  chemically synthesized
ctctgtttttctgtttcctgcc

SEQ ID NO: 1104588 - DNA, 22 bp, Artificial Sequence
  chemically synthesized
gcttctctgtttttctgtttcc

SEQ ID NO: 1104589 - DNA, 22 bp, Artificial Sequence
  chemically synthesized
agcttctctgtttttctgtttc

SEQ ID NO: 1104590 - DNA, 22 bp, Artificial Sequence
  chemically synthesized
cttagcttctctgtttttctgt

SEQ ID NO: 1104591 - DNA, 22 bp, Artificial Sequence
  chemically synthesized
acttagcttctctgtttttctg

SEQ ID NO: 1104592 - DNA, 22 bp, Artificial Sequence
  chemically synthesized
ggcaatttacttagcttctctg

SEQ ID NO: 1104593 - DNA, 22 bp, Artificial Sequence
  chemically synthesized
gggcaatttacttagcttctct

SEQ ID NO: 1104594 - DNA, 22 bp, Artificial Sequence
  chemically synthesized
tatcaccttgggcaatttactt

SEQ ID NO: 1104595 - DNA, 22 bp, Artificial Sequence
  chemically synthesized
agtaaattgcccaaggtgatac

SEQ ID NO: 1104596 - DNA, 22 bp, Artificial Sequence
  chemically synthesized
caaataccatctgtatcacctt

SEQ ID NO: 1104597 - DNA, 22 bp, Artificial Sequence
  chemically synthesized
tgcaaataccatctgtatcacc

SEQ ID NO: 1104598 - DNA, 22 bp, Artificial Sequence
  chemically synthesized
ctgcaaataccatctgtatcac

SEQ ID NO: 1104599 - DNA, 22 bp, Artificial Sequence
  chemically synthesized
ggtttctgcaaataccatctgt

SEQ ID NO: 1104600 - DNA, 22 bp, Artificial Sequence
  chemically synthesized
cccaaggtgatacagatggtat

SEQ ID NO: 1104601 - DNA, 22 bp, Artificial Sequence
  chemically synthesized
ctcggtttctgcaaataccatc

SEQ ID NO: 1104602 - DNA, 22 bp, Artificial Sequence
  chemically synthesized
gaccctgctcggtttctgcaaa

SEQ ID NO: 1104603 - DNA, 22 bp, Artificial Sequence
  chemically synthesized
gcagaaaccgagcagggtccaa

SEQ ID NO: 1104604 - DNA, 22 bp, Artificial Sequence
  chemically synthesized
cagaaaccgagcagggtccaat

SEQ ID NO: 1104605 - DNA, 22 bp, Artificial Sequence
  chemically synthesized
agtatcagatacaattggaccc

SEQ ID NO: 1104606 - DNA, 22 bp, Artificial Sequence
  chemically synthesized
cagtatcagatacaattggacc

SEQ ID NO: 1104607 - DNA, 22 bp, Artificial Sequence
  chemically synthesized
tcagtatcagatacaattggac

SEQ ID NO: 1104608 - DNA, 22 bp, Artificial Sequence
  chemically synthesized
agagagagtagcctttcagtat

SEQ ID NO: 1104609 - DNA, 22 bp, Artificial Sequence
  chemically synthesized
tatctgatactgaaaggctact

SEQ ID NO: 1104610 - DNA, 22 bp, Artificial Sequence
  chemically synthesized
atactgaaaggctactctctct

SEQ ID NO: 1104611 - DNA, 22 bp, Artificial Sequence
  chemically synthesized
aaaggctactctctctcagtgt

SEQ ID NO: 1104612 - DNA, 22 bp, Artificial Sequence
  chemically synthesized
caaggcaaatgataacactgag

SEQ ID NO: 1104613 - DNA, 22 bp, Artificial Sequence
  chemically synthesized
ccaaggcaaatgataacactga

SEQ ID NO: 1104614 - DNA, 22 bp, Artificial Sequence
  chemically synthesized
tccaaggcaaatgataacactg

SEQ ID NO: 1104615 - DNA, 22 bp, Artificial Sequence
  chemically synthesized
ttccaaggcaaatgataacact

SEQ ID NO: 1104616 - DNA, 22 bp, Artificial Sequence
  chemically synthesized
tttccaaggcaaatgataacac

SEQ ID NO: 1104617 - DNA, 22 bp, Artificial Sequence
  chemically synthesized
ttttccaaggcaaatgataaca

SEQ ID NO: 1104618 - DNA, 22 bp, Artificial Sequence
  chemically synthesized
ctctctctcagtgttatcattt

SEQ ID NO: 1104619 - DNA, 22 bp, Artificial Sequence
  chemically synthesized
tttttccaaggcaaatgataac

SEQ ID NO: 1104620 - DNA, 22 bp, Artificial Sequence
  chemically synthesized
tctctcagtgttatcatttgcc

SEQ ID NO: 1104621 - DNA, 22 bp, Artificial Sequence
  chemically synthesized
ttttttttccaaggcaaatgat

SEQ ID NO: 1104622 - DNA, 22 bp, Artificial Sequence
  chemically synthesized
tctcagtgttatcatttgcctt

SEQ ID NO: 1104623 - DNA, 22 bp, Artificial Sequence
  chemically synthesized
tcagtgttatcatttgccttgg

SEQ ID NO: 1104624 - DNA, 22 bp, Artificial Sequence
  chemically synthesized
agtgttatcatttgccttggaa

SEQ ID NO: 1104625 - DNA, 22 bp, Artificial Sequence
  chemically synthesized
tcatttgccttggaaaaaaaat

SEQ ID NO: 1104626 - DNA, 22 bp, Artificial Sequence
  chemically synthesized
ggataatgatactatttttttt

SEQ ID NO: 1104627 - DNA, 22 bp, Artificial Sequence
  chemically synthesized
cggataatgatactattttttt

SEQ ID NO: 1104628 - DNA, 22 bp, Artificial Sequence
  chemically synthesized
gccttggaaaaaaaatagtatc

SEQ ID NO: 1104629 - DNA, 22 bp, Artificial Sequence
  chemically synthesized
ccttggaaaaaaaatagtatca

SEQ ID NO: 1104630 - DNA, 22 bp, Artificial Sequence
  chemically synthesized
ggaaaaaaaatagtatcattat

SEQ ID NO: 1104631 - DNA, 22 bp, Artificial Sequence
  chemically synthesized
gaaaaaaaatagtatcattatc

SEQ ID NO: 1104632 - DNA, 22 bp, Artificial Sequence
  chemically synthesized
aaaatcaaggtcttcggataat

SEQ ID NO: 1104633 - DNA, 22 bp, Artificial Sequence
  chemically synthesized
aaaaatcaaggtcttcggataa

SEQ ID NO: 1104634 - DNA, 22 bp, Artificial Sequence
  chemically synthesized
tccgaagaccttgatttttaaa

SEQ ID NO: 1104635 - DNA, 22 bp, Artificial Sequence
  chemically synthesized
gacatgacatgatataatttaa

SEQ ID NO: 1104636 - DNA, 22 bp, Artificial Sequence
  chemically synthesized
gatttttaaattatatcatgtc

SEQ ID NO: 1104637 - DNA, 22 bp, Artificial Sequence
  chemically synthesized
atttttaaattatatcatgtca

SEQ ID NO: 1104638 - DNA, 22 bp, Artificial Sequence
  chemically synthesized
agtaaaattagacatgacatga

SEQ ID NO: 1104639 - DNA, 22 bp, Artificial Sequence
  chemically synthesized
cagtaaaattagacatgacatg

SEQ ID NO: 1104640 - DNA, 22 bp, Artificial Sequence
  chemically synthesized
ttaaattatatcatgtcatgtc

SEQ ID NO: 1104641 - DNA, 22 bp, Artificial Sequence
  chemically synthesized
tcagtaaaattagacatgacat

SEQ ID NO: 1104642 - DNA, 22 bp, Artificial Sequence
  chemically synthesized
taaattatatcatgtcatgtct

SEQ ID NO: 1104643 - DNA, 22 bp, Artificial Sequence
  chemically synthesized
aaattatatcatgtcatgtcta

SEQ ID NO: 1104644 - DNA, 22 bp, Artificial Sequence
  chemically synthesized
tttcagtaaaattagacatgac

SEQ ID NO: 1104645 - DNA, 22 bp, Artificial Sequence
  chemically synthesized
aattatatcatgtcatgtctaa

SEQ ID NO: 1104646 - DNA, 22 bp, Artificial Sequence
  chemically synthesized
tatcatgtcatgtctaatttta

SEQ ID NO: 1104647 - DNA, 22 bp, Artificial Sequence
  chemically synthesized
agcatgcgtacatgggtgttct

SEQ ID NO: 1104648 - DNA, 22 bp, Artificial Sequence
  chemically synthesized
attttactgaaagaacacccat

SEQ ID NO: 1104649 - DNA, 22 bp, Artificial Sequence
  chemically synthesized
tactgaaagaacacccatgtac

SEQ ID NO: 1104650 - DNA, 22 bp, Artificial Sequence
  chemically synthesized
actgaaagaacacccatgtacg

SEQ ID NO: 1104651 - DNA, 22 bp, Artificial Sequence
  chemically synthesized
ctgaaagaacacccatgtacgc

SEQ ID NO: 1104652 - DNA, 22 bp, Artificial Sequence
  chemically synthesized
aaagaacacccatgtacgcatg

SEQ ID NO: 1104653 - DNA, 22 bp, Artificial Sequence
  chemically synthesized
atacatatactaagcatgcgta

SEQ ID NO: 1104654 - DNA, 22 bp, Artificial Sequence
  chemically synthesized
gatacatatactaagcatgcgt

SEQ ID NO: 1104655 - DNA, 22 bp, Artificial Sequence
  chemically synthesized
ttgatacatatactaagcatgc

SEQ ID NO: 1104656 - DNA, 22 bp, Artificial Sequence
  chemically synthesized
gagttcttgatacatatactaa

SEQ ID NO: 1104657 - DNA, 22 bp, Artificial Sequence
  chemically synthesized
ctagagttcttgatacatatac

SEQ ID NO: 1104658 - DNA, 22 bp, Artificial Sequence
  chemically synthesized
ttactagagttcttgatacata

SEQ ID NO: 1104659 - DNA, 22 bp, Artificial Sequence
  chemically synthesized
agtatatgtatcaagaactcta

SEQ ID NO: 1104660 - DNA, 22 bp, Artificial Sequence
  chemically synthesized
tggggttattactagagttctt

SEQ ID NO: 1104661 - DNA, 22 bp, Artificial Sequence
  chemically synthesized
gtatatgtatcaagaactctag

SEQ ID NO: 1104662 - DNA, 22 bp, Artificial Sequence
  chemically synthesized
atggggttattactagagttct

SEQ ID NO: 1104663 - DNA, 22 bp, Artificial Sequence
  chemically synthesized
agaatgataatatttatggggt

SEQ ID NO: 1104664 - DNA, 22 bp, Artificial Sequence
  chemically synthesized
tagtaataaccccataaatatt

SEQ ID NO: 1104665 - DNA, 22 bp, Artificial Sequence
  chemically synthesized
gtaataaccccataaatattat

SEQ ID NO: 1104666 - DNA, 22 bp, Artificial Sequence
  chemically synthesized
taagaattaagaatgataatat

SEQ ID NO: 1104667 - DNA, 22 bp, Artificial Sequence
  chemically synthesized
ttataagaattaagaatgataa

SEQ ID NO: 1104668 - DNA, 22 bp, Artificial Sequence
  chemically synthesized
attataagaattaagaatgata

SEQ ID NO: 1104669 - DNA, 22 bp, Artificial Sequence
  chemically synthesized
acaggtttattataagaattaa

SEQ ID NO: 1104670 - DNA, 22 bp, Artificial Sequence
  chemically synthesized
tcattcttaattcttataataa

SEQ ID NO: 1104671 - DNA, 22 bp, Artificial Sequence
  chemically synthesized
ttaattcttataataaacctgt

SEQ ID NO: 1104672 - DNA, 22 bp, Artificial Sequence
  chemically synthesized
aattcttataataaacctgtga

SEQ ID NO: 1104673 - DNA, 22 bp, Artificial Sequence
  chemically synthesized
attcttataataaacctgtgag

SEQ ID NO: 1104674 - DNA, 22 bp, Artificial Sequence
  chemically synthesized
acaatgtatatgtctcacaggt

SEQ ID NO: 1104675 - DNA, 22 bp, Artificial Sequence
  chemically synthesized
ttataataaacctgtgagacat

SEQ ID NO: 1104676 - DNA, 22 bp, Artificial Sequence
  chemically synthesized
ataataaacctgtgagacatat

SEQ ID NO: 1104677 - DNA, 22 bp, Artificial Sequence
  chemically synthesized
taataaacctgtgagacatata

SEQ ID NO: 1104678 - DNA, 22 bp, Artificial Sequence
  chemically synthesized
ggattaacaatgtatatgtctc

SEQ ID NO: 1104679 - DNA, 22 bp, Artificial Sequence
  chemically synthesized
caattgggattaacaatgtata

SEQ ID NO: 1104680 - DNA, 22 bp, Artificial Sequence
  chemically synthesized
tgagacatatacattgttaatc

SEQ ID NO: 1104681 - DNA, 22 bp, Artificial Sequence
  chemically synthesized
aattgcaattgggattaacaat

SEQ ID NO: 1104682 - DNA, 22 bp, Artificial Sequence
  chemically synthesized
tcaattgcaattgggattaaca

SEQ ID NO: 1104683 - DNA, 22 bp, Artificial Sequence
  chemically synthesized
ctcaattgcaattgggattaac

SEQ ID NO: 1104684 - DNA, 22 bp, Artificial Sequence
  chemically synthesized
tctcaattgcaattgggattaa

SEQ ID NO: 1104685 - DNA, 22 bp, Artificial Sequence
  chemically synthesized
ttttctcaattgcaattgggat

SEQ ID NO: 1104686 - DNA, 22 bp, Artificial Sequence
  chemically synthesized
atagcctgttttctcaattgca

SEQ ID NO: 1104687 - DNA, 22 bp, Artificial Sequence
  chemically synthesized
ttaatcccaattgcaattgaga

SEQ ID NO: 1104688 - DNA, 22 bp, Artificial Sequence
  chemically synthesized
aatagcctgttttctcaattgc

SEQ ID NO: 1104689 - DNA, 22 bp, Artificial Sequence
  chemically synthesized
taatagcctgttttctcaattg

SEQ ID NO: 1104690 - DNA, 22 bp, Artificial Sequence
  chemically synthesized
atcccaattgcaattgagaaaa

SEQ ID NO: 1104691 - DNA, 22 bp, Artificial Sequence
  chemically synthesized
tttaatagcctgttttctcaat

SEQ ID NO: 1104692 - DNA, 22 bp, Artificial Sequence
  chemically synthesized
caattgagaaaacaggctatta

SEQ ID NO: 1104693 - DNA, 22 bp, Artificial Sequence
  chemically synthesized
agaaaacaggctattaaagagg

SEQ ID NO: 1104694 - DNA, 22 bp, Artificial Sequence
  chemically synthesized
ttaaagaggcatatgtgtatgt

SEQ ID NO: 1104695 - DNA, 22 bp, Artificial Sequence
  chemically synthesized
aagaggcatatgtgtatgtata

SEQ ID NO: 1104696 - DNA, 22 bp, Artificial Sequence
  chemically synthesized
tacatataaaagtatatacata

SEQ ID NO: 1104697 - DNA, 22 bp, Artificial Sequence
  chemically synthesized
atataattatacatataaaagt

SEQ ID NO: 1104698 - DNA, 22 bp, Artificial Sequence
  chemically synthesized
cctaatataattatacatataa

SEQ ID NO: 1104699 - DNA, 22 bp, Artificial Sequence
  chemically synthesized
ccctaatataattatacatata

SEQ ID NO: 1104700 - DNA, 22 bp, Artificial Sequence
  chemically synthesized
tccctaatataattatacatat

SEQ ID NO: 1104701 - DNA, 22 bp, Artificial Sequence
  chemically synthesized
ttatatgtataattatattagg

SEQ ID NO: 1104702 - DNA, 22 bp, Artificial Sequence
  chemically synthesized
tataatactttccctaatataa

SEQ ID NO: 1104703 - DNA, 22 bp, Artificial Sequence
  chemically synthesized
tatatgtataattatattaggg

SEQ ID NO: 1104704 - DNA, 22 bp, Artificial Sequence
  chemically synthesized
atatgtataattatattaggga

SEQ ID NO: 1104705 - DNA, 22 bp, Artificial Sequence
  chemically synthesized
tatataatactttccctaatat

SEQ ID NO: 1104706 - DNA, 22 bp, Artificial Sequence
  chemically synthesized
tatgtataattatattagggaa

SEQ ID NO: 1104707 - DNA, 22 bp, Artificial Sequence
  chemically synthesized
tatatctctatataatactttc

SEQ ID NO: 1104708 - DNA, 22 bp, Artificial Sequence
  chemically synthesized
tattagggaaagtattatatag

SEQ ID NO: 1104709 - DNA, 22 bp, Artificial Sequence
  chemically synthesized
gggaaagtattatatagagata

SEQ ID NO: 1104710 - DNA, 22 bp, Artificial Sequence
  chemically synthesized
tatatacatactgtatatctct

SEQ ID NO: 1104711 - DNA, 22 bp, Artificial Sequence
  chemically synthesized
gtatatacatactgtatatctc

SEQ ID NO: 1104712 - DNA, 22 bp, Artificial Sequence
  chemically synthesized
tttgtatatacatactgtatat

SEQ ID NO: 1104713 - DNA, 22 bp, Artificial Sequence
  chemically synthesized
gtttgtatatacatactgtata

SEQ ID NO: 1104714 - DNA, 22 bp, Artificial Sequence
  chemically synthesized
tatagagatatacagtatgtat

SEQ ID NO: 1104715 - DNA, 22 bp, Artificial Sequence
  chemically synthesized
aaacgtataaacttgtttgtat

SEQ ID NO: 1104716 - DNA, 22 bp, Artificial Sequence
  chemically synthesized
aaaacgtataaacttgtttgta

SEQ ID NO: 1104717 - DNA, 22 bp, Artificial Sequence
  chemically synthesized
taaaacgtataaacttgtttgt

SEQ ID NO: 1104718 - DNA, 22 bp, Artificial Sequence
  chemically synthesized
atacgttttaaagtatgtatgt

SEQ ID NO: 1104719 - DNA, 22 bp, Artificial Sequence
  chemically synthesized
tacgttttaaagtatgtatgtg

SEQ ID NO: 1104720 - DNA, 22 bp, Artificial Sequence
  chemically synthesized
atatatatacatatacacatac

SEQ ID NO: 1104721 - DNA, 22 bp, Artificial Sequence
  chemically synthesized
catatatatacatatacacata

SEQ ID NO: 1104722 - DNA, 22 bp, Artificial Sequence
  chemically synthesized
taaagtatgtatgtgtatatgt

SEQ ID NO: 1104723 - DNA, 22 bp, Artificial Sequence
  chemically synthesized
aaagtatgtatgtgtatatgta

SEQ ID NO: 1104724 - DNA, 22 bp, Artificial Sequence
  chemically synthesized
aagtatgtatgtgtatatgtat

SEQ ID NO: 1104725 - DNA, 22 bp, Artificial Sequence
  chemically synthesized
agtcacatttcatatatataca

SEQ ID NO: 1104726 - DNA, 22 bp, Artificial Sequence
  chemically synthesized
aagtcacatttcatatatatac

SEQ ID NO: 1104727 - DNA, 22 bp, Artificial Sequence
  chemically synthesized
cttaagtcacatttcatatata

SEQ ID NO: 1104728 - DNA, 22 bp, Artificial Sequence
  chemically synthesized
aatatagtccatgtggctgctt

SEQ ID NO: 1104729 - DNA, 22 bp, Artificial Sequence
  chemically synthesized
caatatagtccatgtggctgct

SEQ ID NO: 1104730 - DNA, 22 bp, Artificial Sequence
  chemically synthesized
tcaatatagtccatgtggctgc

SEQ ID NO: 1104731 - DNA, 22 bp, Artificial Sequence
  chemically synthesized
tttcaatatagtccatgtggct

SEQ ID NO: 1104732 - DNA, 22 bp, Artificial Sequence
  chemically synthesized
atctctttcaatatagtccatg

SEQ ID NO: 1104733 - DNA, 22 bp, Artificial Sequence
  chemically synthesized
aagcagccacatggactatatt

SEQ ID NO: 1104734 - DNA, 22 bp, Artificial Sequence
  chemically synthesized
agcagccacatggactatattg

SEQ ID NO: 1104735 - DNA, 22 bp, Artificial Sequence
  chemically synthesized
tgtctaatctctttcaatatag

SEQ ID NO: 1104736 - DNA, 22 bp, Artificial Sequence
  chemically synthesized
gtgtctaatctctttcaatata

SEQ ID NO: 1104737 - DNA, 22 bp, Artificial Sequence
  chemically synthesized
aatcttgtgtctaatctctttc

SEQ ID NO: 1104738 - DNA, 22 bp, Artificial Sequence
  chemically synthesized
tcaatcttgtgtctaatctctt

SEQ ID NO: 1104739 - DNA, 22 bp, Artificial Sequence
  chemically synthesized
tattgaaagagattagacacaa

SEQ ID NO: 1104740 - DNA, 22 bp, Artificial Sequence
  chemically synthesized
cagcgttctcaatcttgtgtct

SEQ ID NO: 1104741 - DNA, 22 bp, Artificial Sequence
  chemically synthesized
tgcagcgttctcaatcttgtgt

SEQ ID NO: 1104742 - DNA, 22 bp, Artificial Sequence
  chemically synthesized
aaagagattagacacaagattg

SEQ ID NO: 1104743 - DNA, 22 bp, Artificial Sequence
  chemically synthesized
tctgcagcgttctcaatcttgt

SEQ ID NO: 1104744 - DNA, 22 bp, Artificial Sequence
  chemically synthesized
cagttctctgcagcgttctcaa

SEQ ID NO: 1104745 - DNA, 22 bp, Artificial Sequence
  chemically synthesized
acagttctctgcagcgttctca

SEQ ID NO: 1104746 - DNA, 22 bp, Artificial Sequence
  chemically synthesized
gacacaagattgagaacgctgc

SEQ ID NO: 1104747 - DNA, 22 bp, Artificial Sequence
  chemically synthesized
tggtttacagttctctgcagcg

SEQ ID NO: 1104748 - DNA, 22 bp, Artificial Sequence
  chemically synthesized
atggtttacagttctctgcagc

SEQ ID NO: 1104749 - DNA, 22 bp, Artificial Sequence
  chemically synthesized
tatggtttacagttctctgcag

SEQ ID NO: 1104750 - DNA, 22 bp, Artificial Sequence
  chemically synthesized
ttatggtttacagttctctgca

SEQ ID NO: 1104751 - DNA, 22 bp, Artificial Sequence
  chemically synthesized
tttatggtttacagttctctgc

SEQ ID NO: 1104752 - DNA, 22 bp, Artificial Sequence
  chemically synthesized
agaacgctgcagagaactgtaa

SEQ ID NO: 1104753 - DNA, 22 bp, Artificial Sequence
  chemically synthesized
tgtcctttttatggtttacagt

SEQ ID NO: 1104754 - DNA, 22 bp, Artificial Sequence
  chemically synthesized
cagagaactgtaaaccataaaa

SEQ ID NO: 1104755 - DNA, 22 bp, Artificial Sequence
  chemically synthesized
aaatatgttatgtcctttttat

SEQ ID NO: 1104756 - DNA, 22 bp, Artificial Sequence
  chemically synthesized
taaaccataaaaaggacataac

SEQ ID NO: 1104757 - DNA, 22 bp, Artificial Sequence
  chemically synthesized
tccctaaaatatgttatgtcct

SEQ ID NO: 1104758 - DNA, 22 bp, Artificial Sequence
  chemically synthesized
gattatccctaaaatatgttat

SEQ ID NO: 1104759 - DNA, 22 bp, Artificial Sequence
  chemically synthesized
ggattatccctaaaatatgtta

SEQ ID NO: 1104760 - DNA, 22 bp, Artificial Sequence
  chemically synthesized
tggattatccctaaaatatgtt

SEQ ID NO: 1104761 - DNA, 22 bp, Artificial Sequence
  chemically synthesized
ttggattatccctaaaatatgt

SEQ ID NO: 1104762 - DNA, 22 bp, Artificial Sequence
  chemically synthesized
ttttggattatccctaaaatat

SEQ ID NO: 1104763 - DNA, 22 bp, Artificial Sequence
  chemically synthesized
cttttggattatccctaaaata

SEQ ID NO: 1104764 - DNA, 22 bp, Artificial Sequence
  chemically synthesized
gaatttcttttggattatccct

SEQ ID NO: 1104765 - DNA, 22 bp, Artificial Sequence
  chemically synthesized
tagaatttcttttggattatcc

SEQ ID NO: 1104766 - DNA, 22 bp, Artificial Sequence
  chemically synthesized
attctagaatttcttttggatt

SEQ ID NO: 1104767 - DNA, 22 bp, Artificial Sequence
  chemically synthesized
aattctagaatttcttttggat

SEQ ID NO: 1104768 - DNA, 22 bp, Artificial Sequence
  chemically synthesized
taattctagaatttcttttgga

SEQ ID NO: 1104769 - DNA, 22 bp, Artificial Sequence
  chemically synthesized
ttaattctagaatttcttttgg

SEQ ID NO: 1104770 - DNA, 22 bp, Artificial Sequence
  chemically synthesized
tagggataatccaaaagaaatt

SEQ ID NO: 1104771 - DNA, 22 bp, Artificial Sequence
  chemically synthesized
agggataatccaaaagaaattc

SEQ ID NO: 1104772 - DNA, 22 bp, Artificial Sequence
  chemically synthesized
gggataatccaaaagaaattct

SEQ ID NO: 1104773 - DNA, 22 bp, Artificial Sequence
  chemically synthesized
tatttttaattctagaatttct

SEQ ID NO: 1104774 - DNA, 22 bp, Artificial Sequence
  chemically synthesized
ctgtatttttaattctagaatt

SEQ ID NO: 1104775 - DNA, 22 bp, Artificial Sequence
  chemically synthesized
actgtatttttaattctagaat

SEQ ID NO: 1104776 - DNA, 22 bp, Artificial Sequence
  chemically synthesized
acttactgtatttttaattcta

SEQ ID NO: 1104777 - DNA, 22 bp, Artificial Sequence
  chemically synthesized
cacttactgtatttttaattct

SEQ ID NO: 1104778 - DNA, 22 bp, Artificial Sequence
  chemically synthesized
tcacttactgtatttttaattc

SEQ ID NO: 1104779 - DNA, 22 bp, Artificial Sequence
  chemically synthesized
ttcacttactgtatttttaatt

SEQ ID NO: 1104780 - DNA, 22 bp, Artificial Sequence
  chemically synthesized
tttttcacttactgtattttta

SEQ ID NO: 1104781 - DNA, 22 bp, Artificial Sequence
  chemically synthesized
atttttcacttactgtattttt

SEQ ID NO: 1104782 - DNA, 22 bp, Artificial Sequence
  chemically synthesized
ttatttttcacttactgtattt

SEQ ID NO: 1104783 - DNA, 22 bp, Artificial Sequence
  chemically synthesized
tagaattaaaaatacagtaagt

SEQ ID NO: 1104784 - DNA, 22 bp, Artificial Sequence
  chemically synthesized
attcttatttttcacttactgt

SEQ ID NO: 1104785 - DNA, 22 bp, Artificial Sequence
  chemically synthesized
gaattaaaaatacagtaagtga

SEQ ID NO: 1104786 - DNA, 22 bp, Artificial Sequence
  chemically synthesized
aattcttatttttcacttactg

SEQ ID NO: 1104787 - DNA, 22 bp, Artificial Sequence
  chemically synthesized
aaaatacagtaagtgaaaaata

SEQ ID NO: 1104788 - DNA, 22 bp, Artificial Sequence
  chemically synthesized
aacccatgcacttaattcttat

SEQ ID NO: 1104789 - DNA, 22 bp, Artificial Sequence
  chemically synthesized
ttaaacccatgcacttaattct

SEQ ID NO: 1104790 - DNA, 22 bp, Artificial Sequence
  chemically synthesized
ctgttaaacccatgcacttaat

SEQ ID NO: 1104791 - DNA, 22 bp, Artificial Sequence
  chemically synthesized
gctgttaaacccatgcacttaa

SEQ ID NO: 1104792 - DNA, 22 bp, Artificial Sequence
  chemically synthesized
tcaaatttgctgttaaacccat

SEQ ID NO: 1104793 - DNA, 22 bp, Artificial Sequence
  chemically synthesized
cccctgtcaaatttgctgttaa

SEQ ID NO: 1104794 - DNA, 22 bp, Artificial Sequence
  chemically synthesized
agtgcatgggtttaacagcaaa

SEQ ID NO: 1104795 - DNA, 22 bp, Artificial Sequence
  chemically synthesized
acccctgtcaaatttgctgtta

SEQ ID NO: 1104796 - DNA, 22 bp, Artificial Sequence
  chemically synthesized
tttacccctgtcaaatttgctg

SEQ ID NO: 1104797 - DNA, 22 bp, Artificial Sequence
  chemically synthesized
tatttacccctgtcaaatttgc

SEQ ID NO: 1104798 - DNA, 22 bp, Artificial Sequence
  chemically synthesized
ctatttacccctgtcaaatttg

SEQ ID NO: 1104799 - DNA, 22 bp, Artificial Sequence
  chemically synthesized
tctatttacccctgtcaaattt

SEQ ID NO: 1104800 - DNA, 22 bp, Artificial Sequence
  chemically synthesized
aacagcaaatttgacaggggta

SEQ ID NO: 1104801 - DNA, 22 bp, Artificial Sequence
  chemically synthesized
acagcaaatttgacaggggtaa

SEQ ID NO: 1104802 - DNA, 22 bp, Artificial Sequence
  chemically synthesized
gtaattttctatttacccctgt

SEQ ID NO: 1104803 - DNA, 22 bp, Artificial Sequence
  chemically synthesized
agtaattttctatttacccctg

SEQ ID NO: 1104804 - DNA, 22 bp, Artificial Sequence
  chemically synthesized
agatttagtaattttctattta

SEQ ID NO: 1104805 - DNA, 22 bp, Artificial Sequence
  chemically synthesized
aagatttagtaattttctattt

SEQ ID NO: 1104806 - DNA, 22 bp, Artificial Sequence
  chemically synthesized
gacaggggtaaatagaaaatta

SEQ ID NO: 1104807 - DNA, 22 bp, Artificial Sequence
  chemically synthesized
acaggggtaaatagaaaattac

SEQ ID NO: 1104808 - DNA, 22 bp, Artificial Sequence
  chemically synthesized
aatcttaagatttagtaatttt

SEQ ID NO: 1104809 - DNA, 22 bp, Artificial Sequence
  chemically synthesized
tgaatcttaagatttagtaatt

SEQ ID NO: 1104810 - DNA, 22 bp, Artificial Sequence
  chemically synthesized
ctgaatcttaagatttagtaat

SEQ ID NO: 1104811 - DNA, 22 bp, Artificial Sequence
  chemically synthesized
cttctgaatcttaagatttagt

SEQ ID NO: 1104812 - DNA, 22 bp, Artificial Sequence
  chemically synthesized
ccttctgaatcttaagatttag

SEQ ID NO: 1104813 - DNA, 22 bp, Artificial Sequence
  chemically synthesized
caggtatttccttctgaatctt

SEQ ID NO: 1104814 - DNA, 22 bp, Artificial Sequence
  chemically synthesized
ctaaatcttaagattcagaagg

SEQ ID NO: 1104815 - DNA, 22 bp, Artificial Sequence
  chemically synthesized
attccaggtatttccttctgaa

SEQ ID NO: 1104816 - DNA, 22 bp, Artificial Sequence
  chemically synthesized
cattccaggtatttccttctga

SEQ ID NO: 1104817 - DNA, 22 bp, Artificial Sequence
  chemically synthesized
aatcttaagattcagaaggaaa

SEQ ID NO: 1104818 - DNA, 22 bp, Artificial Sequence
  chemically synthesized
aagattcagaaggaaatacctg

SEQ ID NO: 1104819 - DNA, 22 bp, Artificial Sequence
  chemically synthesized
catgcttcattccaggtatttc

SEQ ID NO: 1104820 - DNA, 22 bp, Artificial Sequence
  chemically synthesized
agattcagaaggaaatacctgg

SEQ ID NO: 1104821 - DNA, 22 bp, Artificial Sequence
  chemically synthesized
tgtctccatgcttcattccagg

SEQ ID NO: 1104822 - DNA, 22 bp, Artificial Sequence
  chemically synthesized
agaaggaaatacctggaatgaa

SEQ ID NO: 1104823 - DNA, 22 bp, Artificial Sequence
  chemically synthesized
gtgtctccatgcttcattccag

SEQ ID NO: 1104824 - DNA, 22 bp, Artificial Sequence
  chemically synthesized
tgtgtctccatgcttcattcca

SEQ ID NO: 1104825 - DNA, 22 bp, Artificial Sequence
  chemically synthesized
ttgtgtctccatgcttcattcc

SEQ ID NO: 1104826 - DNA, 22 bp, Artificial Sequence
  chemically synthesized
tttgtgtctccatgcttcattc

SEQ ID NO: 1104827 - DNA, 22 bp, Artificial Sequence
  chemically synthesized
tctttttgtgtctccatgcttc

SEQ ID NO: 1104828 - DNA, 22 bp, Artificial Sequence
  chemically synthesized
tatctttttgtgtctccatgct

SEQ ID NO: 1104829 - DNA, 22 bp, Artificial Sequence
  chemically synthesized
tctatctttttgtgtctccatg

SEQ ID NO: 1104830 - DNA, 22 bp, Artificial Sequence
  chemically synthesized
gaatgaagcatggagacacaaa

SEQ ID NO: 1104831 - DNA, 22 bp, Artificial Sequence
  chemically synthesized
tgttctctatctttttgtgtct

SEQ ID NO: 1104832 - DNA, 22 bp, Artificial Sequence
  chemically synthesized
ctgtgttctctatctttttgtg

SEQ ID NO: 1104833 - DNA, 22 bp, Artificial Sequence
  chemically synthesized
actgtgttctctatctttttgt

SEQ ID NO: 1104834 - DNA, 22 bp, Artificial Sequence
  chemically synthesized
tactgtgttctctatctttttg

SEQ ID NO: 1104835 - DNA, 22 bp, Artificial Sequence
  chemically synthesized
gaccgttttactgtgttctcta

SEQ ID NO: 1104836 - DNA, 22 bp, Artificial Sequence
  chemically synthesized
ggatgcatatatattagaccgt

SEQ ID NO: 1104837 - DNA, 22 bp, Artificial Sequence
  chemically synthesized
tgggatgcatatatattagacc

SEQ ID NO: 1104838 - DNA, 22 bp, Artificial Sequence
  chemically synthesized
ccacattctgggatgcatatat

SEQ ID NO: 1104839 - DNA, 22 bp, Artificial Sequence
  chemically synthesized
tgccacattctgggatgcatat

SEQ ID NO: 1104840 - DNA, 22 bp, Artificial Sequence
  chemically synthesized
ctgccacattctgggatgcata

SEQ ID NO: 1104841 - DNA, 22 bp, Artificial Sequence
  chemically synthesized
atatatatgcatcccagaatgt

SEQ ID NO: 1104842 - DNA, 22 bp, Artificial Sequence
  chemically synthesized
aatatggcttctgccacattct

SEQ ID NO: 1104843 - DNA, 22 bp, Artificial Sequence
  chemically synthesized
aaatatggcttctgccacattc

SEQ ID NO: 1104844 - DNA, 22 bp, Artificial Sequence
  chemically synthesized
tttaaatatggcttctgccaca

SEQ ID NO: 1104845 - DNA, 22 bp, Artificial Sequence
  chemically synthesized
tctgtttaaatatggcttctgc

SEQ ID NO: 1104846 - DNA, 22 bp, Artificial Sequence
  chemically synthesized
gccattatctgtttaaatatgg

SEQ ID NO: 1104847 - DNA, 22 bp, Artificial Sequence
  chemically synthesized
ttagccattatctgtttaaata

SEQ ID NO: 1104848 - DNA, 22 bp, Artificial Sequence
  chemically synthesized
gaaacattattagccattatct

SEQ ID NO: 1104849 - DNA, 22 bp, Artificial Sequence
  chemically synthesized
agaaacattattagccattatc

SEQ ID NO: 1104850 - DNA, 22 bp, Artificial Sequence
  chemically synthesized
aaacagataatggctaataatg

SEQ ID NO: 1104851 - DNA, 22 bp, Artificial Sequence
  chemically synthesized
aacagataatggctaataatgt

SEQ ID NO: 1104852 - DNA, 22 bp, Artificial Sequence
  chemically synthesized
atgtatttagaaacattattag

SEQ ID NO: 1104853 - DNA, 22 bp, Artificial Sequence
  chemically synthesized
catgtatttagaaacattatta

SEQ ID NO: 1104854 - DNA, 22 bp, Artificial Sequence
  chemically synthesized
cagtgtgatttcatgtatttag

SEQ ID NO: 1104855 - DNA, 22 bp, Artificial Sequence
  chemically synthesized
gcagtgtgatttcatgtattta

SEQ ID NO: 1104856 - DNA, 22 bp, Artificial Sequence
  chemically synthesized
tgcagtgtgatttcatgtattt

SEQ ID NO: 1104857 - DNA, 22 bp, Artificial Sequence
  chemically synthesized
ataatgtttctaaatacatgaa

SEQ ID NO: 1104858 - DNA, 22 bp, Artificial Sequence
  chemically synthesized
ctaaatacatgaaatcacactg

SEQ ID NO: 1104859 - DNA, 22 bp, Artificial Sequence
  chemically synthesized
taaatacatgaaatcacactgc

SEQ ID NO: 1104860 - DNA, 22 bp, Artificial Sequence
  chemically synthesized
aatacatgaaatcacactgcaa

SEQ ID NO: 1104861 - DNA, 22 bp, Artificial Sequence
  chemically synthesized
atgtggtgatataaaccaggac

SEQ ID NO: 1104862 - DNA, 22 bp, Artificial Sequence
  chemically synthesized
gatgtggtgatataaaccagga

SEQ ID NO: 1104863 - DNA, 22 bp, Artificial Sequence
  chemically synthesized
tttgatgtggtgatataaacca

SEQ ID NO: 1104864 - DNA, 22 bp, Artificial Sequence
  chemically synthesized
caaagtcctggtttatatcacc

SEQ ID NO: 1104865 - DNA, 22 bp, Artificial Sequence
  chemically synthesized
gataatgttatttgatgtggtg

SEQ ID NO: 1104866 - DNA, 22 bp, Artificial Sequence
  chemically synthesized
agataatgttatttgatgtggt

SEQ ID NO: 1104867 - DNA, 22 bp, Artificial Sequence
  chemically synthesized
gtttatatcaccacatcaaata

SEQ ID NO: 1104868 - DNA, 22 bp, Artificial Sequence
  chemically synthesized
atatcaccacatcaaataacat

SEQ ID NO: 1104869 - DNA, 22 bp, Artificial Sequence
  chemically synthesized
tatcaccacatcaaataacatt

SEQ ID NO: 1104870 - DNA, 22 bp, Artificial Sequence
  chemically synthesized
aaataatatgatttagataatg

SEQ ID NO: 1104871 - DNA, 22 bp, Artificial Sequence
  chemically synthesized
atatcccagcaattaaaataat

SEQ ID NO: 1104872 - DNA, 22 bp, Artificial Sequence
  chemically synthesized
tctaaatcatattattttaatt

SEQ ID NO: 1104873 - DNA, 22 bp, Artificial Sequence
  chemically synthesized
aatcatattattttaattgctg

SEQ ID NO: 1104874 - DNA, 22 bp, Artificial Sequence
  chemically synthesized
aaatgacattcatatcccagca

SEQ ID NO: 1104875 - DNA, 22 bp, Artificial Sequence
  chemically synthesized
ttttaattgctgggatatgaat

SEQ ID NO: 1104876 - DNA, 22 bp, Artificial Sequence
  chemically synthesized
taattgctgggatatgaatgtc

SEQ ID NO: 1104877 - DNA, 22 bp, Artificial Sequence
  chemically synthesized
gtatattgaaatgacattcata

SEQ ID NO: 1104878 - DNA, 22 bp, Artificial Sequence
  chemically synthesized
aattgctgggatatgaatgtca

SEQ ID NO: 1104879 - DNA, 22 bp, Artificial Sequence
  chemically synthesized
attgctgggatatgaatgtcat

SEQ ID NO: 1104880 - DNA, 22 bp, Artificial Sequence
  chemically synthesized
ctgggatatgaatgtcatttca

SEQ ID NO: 1104881 - DNA, 22 bp, Artificial Sequence
  chemically synthesized
ggatatgaatgtcatttcaata

SEQ ID NO: 1104882 - DNA, 22 bp, Artificial Sequence
  chemically synthesized
gtgtagaaggaattggtatatt

SEQ ID NO: 1104883 - DNA, 22 bp, Artificial Sequence
  chemically synthesized
agtgtagaaggaattggtatat

SEQ ID NO: 1104884 - DNA, 22 bp, Artificial Sequence
  chemically synthesized
atttagtgtagaaggaattggt

SEQ ID NO: 1104885 - DNA, 22 bp, Artificial Sequence
  chemically synthesized
tcatttagtgtagaaggaattg

SEQ ID NO: 1104886 - DNA, 22 bp, Artificial Sequence
  chemically synthesized
ctcatttagtgtagaaggaatt

SEQ ID NO: 1104887 - DNA, 22 bp, Artificial Sequence
  chemically synthesized
ttctcatttagtgtagaaggaa

SEQ ID NO: 1104888 - DNA, 22 bp, Artificial Sequence
  chemically synthesized
caatataccaattccttctaca

SEQ ID NO: 1104889 - DNA, 22 bp, Artificial Sequence
  chemically synthesized
aatataccaattccttctacac

SEQ ID NO: 1104890 - DNA, 22 bp, Artificial Sequence
  chemically synthesized
tattcttctcatttagtgtaga

SEQ ID NO: 1104891 - DNA, 22 bp, Artificial Sequence
  chemically synthesized
ctatattcttctcatttagtgt

SEQ ID NO: 1104892 - DNA, 22 bp, Artificial Sequence
  chemically synthesized
cctatattcttctcatttagtg

SEQ ID NO: 1104893 - DNA, 22 bp, Artificial Sequence
  chemically synthesized
tcctatattcttctcatttagt

SEQ ID NO: 1104894 - DNA, 22 bp, Artificial Sequence
  chemically synthesized
cttctacactaaatgagaagaa

SEQ ID NO: 1104895 - DNA, 22 bp, Artificial Sequence
  chemically synthesized
ctacactaaatgagaagaatat

SEQ ID NO: 1104896 - DNA, 22 bp, Artificial Sequence
  chemically synthesized
tacactaaatgagaagaatata

SEQ ID NO: 1104897 - DNA, 22 bp, Artificial Sequence
  chemically synthesized
cactaaatgagaagaatatagg

SEQ ID NO: 1104898 - DNA, 22 bp, Artificial Sequence
  chemically synthesized
aatgagaagaatataggaaagt

SEQ ID NO: 1104899 - DNA, 22 bp, Artificial Sequence
  chemically synthesized
aatacatgcaaaatactttcct

SEQ ID NO: 1104900 - DNA, 22 bp, Artificial Sequence
  chemically synthesized
cattaaatacatgcaaaatact

SEQ ID NO: 1104901 - DNA, 22 bp, Artificial Sequence
  chemically synthesized
aatactacattaaatacatgca

SEQ ID NO: 1104902 - DNA, 22 bp, Artificial Sequence
  chemically synthesized
tgcatgtatttaatgtagtatt

SEQ ID NO: 1104903 - DNA, 22 bp, Artificial Sequence
  chemically synthesized
gcatgtatttaatgtagtattc

SEQ ID NO: 1104904 - DNA, 22 bp, Artificial Sequence
  chemically synthesized
tcgcaaccatctgaatactaca

SEQ ID NO: 1104905 - DNA, 22 bp, Artificial Sequence
  chemically synthesized
catgtatttaatgtagtattca

SEQ ID NO: 1104906 - DNA, 22 bp, Artificial Sequence
  chemically synthesized
agattatcgcaaccatctgaat

SEQ ID NO: 1104907 - DNA, 22 bp, Artificial Sequence
  chemically synthesized
taagattatcgcaaccatctga

SEQ ID NO: 1104908 - DNA, 22 bp, Artificial Sequence
  chemically synthesized
aatgtagtattcagatggttgc

SEQ ID NO: 1104909 - DNA, 22 bp, Artificial Sequence
  chemically synthesized
tctaagattatcgcaaccatct

SEQ ID NO: 1104910 - DNA, 22 bp, Artificial Sequence
  chemically synthesized
atgtagtattcagatggttgcg

SEQ ID NO: 1104911 - DNA, 22 bp, Artificial Sequence
  chemically synthesized
ccaacacactctctaagattat

SEQ ID NO: 1104912 - DNA, 22 bp, Artificial Sequence
  chemically synthesized
agatggttgcgataatcttaga

SEQ ID NO: 1104913 - DNA, 22 bp, Artificial Sequence
  chemically synthesized
cgataatcttagagagtgtgtt

SEQ ID NO: 1104914 - DNA, 22 bp, Artificial Sequence
  chemically synthesized
agcatccattgccaacacactc

SEQ ID NO: 1104915 - DNA, 22 bp, Artificial Sequence
  chemically synthesized
cagcatccattgccaacacact

SEQ ID NO: 1104916 - DNA, 22 bp, Artificial Sequence
  chemically synthesized
acatttcagcatccattgccaa

SEQ ID NO: 1104917 - DNA, 22 bp, Artificial Sequence
  chemically synthesized
agagagtgtgttggcaatggat

SEQ ID NO: 1104918 - DNA, 22 bp, Artificial Sequence
  chemically synthesized
taacatttcagcatccattgcc

SEQ ID NO: 1104919 - DNA, 22 bp, Artificial Sequence
  chemically synthesized
gagagtgtgttggcaatggatg

SEQ ID NO: 1104920 - DNA, 22 bp, Artificial Sequence
  chemically synthesized
ctaacatttcagcatccattgc

SEQ ID NO: 1104921 - DNA, 22 bp, Artificial Sequence
  chemically synthesized
tccatttctaacatttcagcat

SEQ ID NO: 1104922 - DNA, 22 bp, Artificial Sequence
  chemically synthesized
gcaatggatgctgaaatgttag

SEQ ID NO: 1104923 - DNA, 22 bp, Artificial Sequence
  chemically synthesized
aaaaaaattatccatttctaac

SEQ ID NO: 1104924 - DNA, 22 bp, Artificial Sequence
  chemically synthesized
aaatgttagaaatggataattt

SEQ ID NO: 1104925 - DNA, 22 bp, Artificial Sequence
  chemically synthesized
gaaatggataatttttttcaat

SEQ ID NO: 1104926 - DNA, 22 bp, Artificial Sequence
  chemically synthesized
ccaaataaatgcaatataaaca

SEQ ID NO: 1104927 - DNA, 22 bp, Artificial Sequence
  chemically synthesized
ttttcaatatgtttatattgca

SEQ ID NO: 1104928 - DNA, 22 bp, Artificial Sequence
  chemically synthesized
tttcaatatgtttatattgcat

SEQ ID NO: 1104929 - DNA, 22 bp, Artificial Sequence
  chemically synthesized
ttcaatatgtttatattgcatt

SEQ ID NO: 1104930 - DNA, 22 bp, Artificial Sequence
  chemically synthesized
tcaatatgtttatattgcattt

SEQ ID NO: 1104931 - DNA, 22 bp, Artificial Sequence
  chemically synthesized
caatatgtttatattgcattta

SEQ ID NO: 1104932 - DNA, 22 bp, Artificial Sequence
  chemically synthesized
tgagttcccaaataaatgcaat

SEQ ID NO: 1104933 - DNA, 22 bp, Artificial Sequence
  chemically synthesized
aatatgtttatattgcatttat

SEQ ID NO: 1104934 - DNA, 22 bp, Artificial Sequence
  chemically synthesized
atgagttcccaaataaatgcaa

SEQ ID NO: 1104935 - DNA, 22 bp, Artificial Sequence
  chemically synthesized
tatgagttcccaaataaatgca

SEQ ID NO: 1104936 - DNA, 22 bp, Artificial Sequence
  chemically synthesized
ttatgagttcccaaataaatgc

SEQ ID NO: 1104937 - DNA, 22 bp, Artificial Sequence
  chemically synthesized
acatttttatgagttcccaaat

SEQ ID NO: 1104938 - DNA, 22 bp, Artificial Sequence
  chemically synthesized
atattgcatttatttgggaact

SEQ ID NO: 1104939 - DNA, 22 bp, Artificial Sequence
  chemically synthesized
aacatttttatgagttcccaaa

SEQ ID NO: 1104940 - DNA, 22 bp, Artificial Sequence
  chemically synthesized
tattgcatttatttgggaactc

SEQ ID NO: 1104941 - DNA, 22 bp, Artificial Sequence
  chemically synthesized
ttaacatttttatgagttccca

SEQ ID NO: 1104942 - DNA, 22 bp, Artificial Sequence
  chemically synthesized
catttatttgggaactcataaa

SEQ ID NO: 1104943 - DNA, 22 bp, Artificial Sequence
  chemically synthesized
atttgggaactcataaaaatgt

SEQ ID NO: 1104944 - DNA, 22 bp, Artificial Sequence
  chemically synthesized
tttgggaactcataaaaatgtt

SEQ ID NO: 1104945 - DNA, 22 bp, Artificial Sequence
  chemically synthesized
aatataatctcttaacattttt

SEQ ID NO: 1104946 - DNA, 22 bp, Artificial Sequence
  chemically synthesized
gggaactcataaaaatgttaag

SEQ ID NO: 1104947 - DNA, 22 bp, Artificial Sequence
  chemically synthesized
ggaactcataaaaatgttaaga

SEQ ID NO: 1104948 - DNA, 22 bp, Artificial Sequence
  chemically synthesized
agattaaatataatctcttaac

SEQ ID NO: 1104949 - DNA, 22 bp, Artificial Sequence
  chemically synthesized
ataaaaatgttaagagattata

SEQ ID NO: 1104950 - DNA, 22 bp, Artificial Sequence
  chemically synthesized
agagattatatttaatctgagc

SEQ ID NO: 1104951 - DNA, 22 bp, Artificial Sequence
  chemically synthesized
ataagaaatcagaagtgctcag

SEQ ID NO: 1104952 - DNA, 22 bp, Artificial Sequence
  chemically synthesized
aataagaaatcagaagtgctca

SEQ ID NO: 1104953 - DNA, 22 bp, Artificial Sequence
  chemically synthesized
taataagaaatcagaagtgctc

SEQ ID NO: 1104954 - DNA, 22 bp, Artificial Sequence
  chemically synthesized
ttaataagaaatcagaagtgct

SEQ ID NO: 1104955 - DNA, 22 bp, Artificial Sequence
  chemically synthesized
tatttaatctgagcacttctga

SEQ ID NO: 1104956 - DNA, 22 bp, Artificial Sequence
  chemically synthesized
aatctgagcacttctgatttct

SEQ ID NO: 1104957 - DNA, 22 bp, Artificial Sequence
  chemically synthesized
atctgagcacttctgatttctt

SEQ ID NO: 1104958 - DNA, 22 bp, Artificial Sequence
  chemically synthesized
caaatatcttttaataagaaat

SEQ ID NO: 1104959 - DNA, 22 bp, Artificial Sequence
  chemically synthesized
agcacttctgatttcttattaa

SEQ ID NO: 1104960 - DNA, 22 bp, Artificial Sequence
  chemically synthesized
agtactacaaatatcttttaat

SEQ ID NO: 1104961 - DNA, 22 bp, Artificial Sequence
  chemically synthesized
aagtactacaaatatcttttaa

SEQ ID NO: 1104962 - DNA, 22 bp, Artificial Sequence
  chemically synthesized
ctgatttcttattaaaagatat

SEQ ID NO: 1104963 - DNA, 22 bp, Artificial Sequence
  chemically synthesized
taagtactacaaatatctttta

SEQ ID NO: 1104964 - DNA, 22 bp, Artificial Sequence
  chemically synthesized
tgatttcttattaaaagatatt

SEQ ID NO: 1104965 - DNA, 22 bp, Artificial Sequence
  chemically synthesized
atttcttattaaaagatatttg

SEQ ID NO: 1104966 - DNA, 22 bp, Artificial Sequence
  chemically synthesized
cttattaaaagatatttgtagt

SEQ ID NO: 1104967 - DNA, 22 bp, Artificial Sequence
  chemically synthesized
ttattaaaagatatttgtagta

SEQ ID NO: 1104968 - DNA, 22 bp, Artificial Sequence
  chemically synthesized
attaaaagatatttgtagtact

SEQ ID NO: 1104969 - DNA, 22 bp, Artificial Sequence
  chemically synthesized
aaacagattttaagtactacaa

SEQ ID NO: 1104970 - DNA, 22 bp, Artificial Sequence
  chemically synthesized
ttaaaagatatttgtagtactt

SEQ ID NO: 1104971 - DNA, 22 bp, Artificial Sequence
  chemically synthesized
aaagatatttgtagtacttaaa

SEQ ID NO: 1104972 - DNA, 22 bp, Artificial Sequence
  chemically synthesized
tgtaaattaaaacagattttaa

SEQ ID NO: 1104973 - DNA, 22 bp, Artificial Sequence
  chemically synthesized
atgtaaattaaaacagatttta

SEQ ID NO: 1104974 - DNA, 22 bp, Artificial Sequence
  chemically synthesized
tttatgtaaattaaaacagatt

SEQ ID NO: 1104975 - DNA, 22 bp, Artificial Sequence
  chemically synthesized
gtagtacttaaaatctgtttta

SEQ ID NO: 1104976 - DNA, 22 bp, Artificial Sequence
  chemically synthesized
tagtacttaaaatctgttttaa

SEQ ID NO: 1104977 - DNA, 22 bp, Artificial Sequence
  chemically synthesized
aaaatctgttttaatttacata

SEQ ID NO: 1104978 - DNA, 22 bp, Artificial Sequence
  chemically synthesized
aaatctgttttaatttacataa

SEQ ID NO: 1104979 - DNA, 22 bp, Artificial Sequence
  chemically synthesized
atagagaaacatattatttatg

SEQ ID NO: 1104980 - DNA, 22 bp, Artificial Sequence
  chemically synthesized
ttttaatttacataaataatat

SEQ ID NO: 1104981 - DNA, 22 bp, Artificial Sequence
  chemically synthesized
taatttacataaataatatgtt

SEQ ID NO: 1104982 - DNA, 22 bp, Artificial Sequence
  chemically synthesized
aatttacataaataatatgttt

SEQ ID NO: 1104983 - DNA, 22 bp, Artificial Sequence
  chemically synthesized
atttacataaataatatgtttc

SEQ ID NO: 1104984 - DNA, 22 bp, Artificial Sequence
  chemically synthesized
acataaataatatgtttctcta

SEQ ID NO: 1104985 - DNA, 22 bp, Artificial Sequence
  chemically synthesized
cataaataatatgtttctctat

SEQ ID NO: 1104986 - DNA, 22 bp, Artificial Sequence
  chemically synthesized
ctctattaacctgatgcattta

SEQ ID NO: 1104987 - DNA, 22 bp, Artificial Sequence
  chemically synthesized
tctattaacctgatgcatttat

SEQ ID NO: 1104988 - DNA, 22 bp, Artificial Sequence
  chemically synthesized
tattaacctgatgcatttattt

SEQ ID NO: 1104989 - DNA, 22 bp, Artificial Sequence
  chemically synthesized
tggaaaaataaaaaataaatgc

SEQ ID NO: 1104990 - DNA, 22 bp, Artificial Sequence
  chemically synthesized
atggaaaaataaaaaataaatg

SEQ ID NO: 1104991 - DNA, 22 bp, Artificial Sequence
  chemically synthesized
ttaacctgatgcatttattttt

SEQ ID NO: 1104992 - DNA, 22 bp, Artificial Sequence
  chemically synthesized
acctgatgcatttattttttat

SEQ ID NO: 1104993 - DNA, 22 bp, Artificial Sequence
  chemically synthesized
atgcatttattttttatttttc

SEQ ID NO: 1104994 - DNA, 22 bp, Artificial Sequence
  chemically synthesized
cccccaataacttatggaaaaa

SEQ ID NO: 1104995 - DNA, 22 bp, Artificial Sequence
  chemically synthesized
acccccaataacttatggaaaa

SEQ ID NO: 1104996 - DNA, 22 bp, Artificial Sequence
  chemically synthesized
tacccccaataacttatggaaa

SEQ ID NO: 1104997 - DNA, 22 bp, Artificial Sequence
  chemically synthesized
attttttatttttccataagtt

SEQ ID NO: 1104998 - DNA, 22 bp, Artificial Sequence
  chemically synthesized
ttttttatttttccataagtta

SEQ ID NO: 1104999 - DNA, 22 bp, Artificial Sequence
  chemically synthesized
tttatttttccataagttattg

SEQ ID NO: 1105000 - DNA, 22 bp, Artificial Sequence
  chemically synthesized
ttatttttccataagttattgg

SEQ ID NO: 1105001 - DNA, 22 bp, Artificial Sequence
  chemically synthesized
tatttttccataagttattggg

SEQ ID NO: 1105002 - DNA, 22 bp, Artificial Sequence
  chemically synthesized
atttttccataagttattgggg

SEQ ID NO: 1105003 - DNA, 22 bp, Artificial Sequence
  chemically synthesized
tttttccataagttattggggg

SEQ ID NO: 1105004 - DNA, 22 bp, Artificial Sequence
  chemically synthesized
ttccataagttattgggggtaa

SEQ ID NO: 1105005 - DNA, 22 bp, Artificial Sequence
  chemically synthesized
tccataagttattgggggtaaa

SEQ ID NO: 1105006 - DNA, 22 bp, Artificial Sequence
  chemically synthesized
ccataagttattgggggtaaag

SEQ ID NO: 1105007 - DNA, 22 bp, Artificial Sequence
  chemically synthesized
cataagttattgggggtaaagg

SEQ ID NO: 1105008 - DNA, 22 bp, Artificial Sequence
  chemically synthesized
atgtaaccaaataccaccttta

SEQ ID NO: 1105009 - DNA, 22 bp, Artificial Sequence
  chemically synthesized
ctcatgtaaccaaataccacct

SEQ ID NO: 1105010 - DNA, 22 bp, Artificial Sequence
  chemically synthesized
actcatgtaaccaaataccacc

SEQ ID NO: 1105011 - DNA, 22 bp, Artificial Sequence
  chemically synthesized
ttgggggtaaaggtggtatttg

SEQ ID NO: 1105012 - DNA, 22 bp, Artificial Sequence
  chemically synthesized
ggggtaaaggtggtatttggtt

SEQ ID NO: 1105013 - DNA, 22 bp, Artificial Sequence
  chemically synthesized
aagaacttactcatgtaaccaa

SEQ ID NO: 1105014 - DNA, 22 bp, Artificial Sequence
  chemically synthesized
ggttacatgagtaagttcttta

SEQ ID NO: 1105015 - DNA, 22 bp, Artificial Sequence
  chemically synthesized
acaaatcaccactaaagaactt

SEQ ID NO: 1105016 - DNA, 22 bp, Artificial Sequence
  chemically synthesized
gttacatgagtaagttctttag

SEQ ID NO: 1105017 - DNA, 22 bp, Artificial Sequence
  chemically synthesized
catgagtaagttctttagtggt

SEQ ID NO: 1105018 - DNA, 22 bp, Artificial Sequence
  chemically synthesized
tttagtggtgatttgtgagatt

SEQ ID NO: 1105019 - DNA, 22 bp, Artificial Sequence
  chemically synthesized
tagtggtgatttgtgagatttt

SEQ ID NO: 1105020 - DNA, 22 bp, Artificial Sequence
  chemically synthesized
agtggtgatttgtgagattttg

SEQ ID NO: 1105021 - DNA, 22 bp, Artificial Sequence
  chemically synthesized
gtggtgatttgtgagattttgg

SEQ ID NO: 1105022 - DNA, 22 bp, Artificial Sequence
  chemically synthesized
ggtgatgggtgcaccaaaatct

SEQ ID NO: 1105023 - DNA, 22 bp, Artificial Sequence
  chemically synthesized
aggtgatgggtgcaccaaaatc

SEQ ID NO: 1105024 - DNA, 22 bp, Artificial Sequence
  chemically synthesized
cttaggtgatgggtgcaccaaa

SEQ ID NO: 1105025 - DNA, 22 bp, Artificial Sequence
  chemically synthesized
gtgagattttggtgcacccatc

SEQ ID NO: 1105026 - DNA, 22 bp, Artificial Sequence
  chemically synthesized
tgagattttggtgcacccatca

SEQ ID NO: 1105027 - DNA, 22 bp, Artificial Sequence
  chemically synthesized
tggtgcacccatcacctaagca

SEQ ID NO: 1105028 - DNA, 22 bp, Artificial Sequence
  chemically synthesized
ggtgcacccatcacctaagcag

SEQ ID NO: 1105029 - DNA, 22 bp, Artificial Sequence
  chemically synthesized
gtgcacccatcacctaagcagt

SEQ ID NO: 1105030 - DNA, 22 bp, Artificial Sequence
  chemically synthesized
caaatagggtacagtgtatact

SEQ ID NO: 1105031 - DNA, 22 bp, Artificial Sequence
  chemically synthesized
agcagtatacactgtaccctat

SEQ ID NO: 1105032 - DNA, 22 bp, Artificial Sequence
  chemically synthesized
gggggagagagaaaagactaca

SEQ ID NO: 1105033 - DNA, 22 bp, Artificial Sequence
  chemically synthesized
taccctatttgtagtcttttct

SEQ ID NO: 1105034 - DNA, 22 bp, Artificial Sequence
  chemically synthesized
tttgtagtcttttctctctccc

SEQ ID NO: 1105035 - DNA, 22 bp, Artificial Sequence
  chemically synthesized
tggggaaggttggggggagaga

SEQ ID NO: 1105036 - DNA, 22 bp, Artificial Sequence
  chemically synthesized
gtagtcttttctctctcccccc

SEQ ID NO: 1105037 - DNA, 22 bp, Artificial Sequence
  chemically synthesized
gtggggaaggttggggggagag

SEQ ID NO: 1105038 - DNA, 22 bp, Artificial Sequence
  chemically synthesized
tagtcttttctctctcccccca

SEQ ID NO: 1105039 - DNA, 22 bp, Artificial Sequence
  chemically synthesized
ggaacttgtggggaaggttggg

SEQ ID NO: 1105040 - DNA, 22 bp, Artificial Sequence
  chemically synthesized
ttctctctccccccaaccttcc

SEQ ID NO: 1105041 - DNA, 22 bp, Artificial Sequence
  chemically synthesized
gggaacttgtggggaaggttgg

SEQ ID NO: 1105042 - DNA, 22 bp, Artificial Sequence
  chemically synthesized
tctctctccccccaaccttccc

SEQ ID NO: 1105043 - DNA, 22 bp, Artificial Sequence
  chemically synthesized
tgggaacttgtggggaaggttg

SEQ ID NO: 1105044 - DNA, 22 bp, Artificial Sequence
  chemically synthesized
ctctctccccccaaccttcccc

SEQ ID NO: 1105045 - DNA, 22 bp, Artificial Sequence
  chemically synthesized
tctctccccccaaccttcccca

SEQ ID NO: 1105046 - DNA, 22 bp, Artificial Sequence
  chemically synthesized
tctccccccaaccttccccaca

SEQ ID NO: 1105047 - DNA, 22 bp, Artificial Sequence
  chemically synthesized
tccccccaaccttccccacaag

SEQ ID NO: 1105048 - DNA, 22 bp, Artificial Sequence
  chemically synthesized
cccccaaccttccccacaagtt

SEQ ID NO: 1105049 - DNA, 22 bp, Artificial Sequence
  chemically synthesized
gaatgatataatggactttggg

SEQ ID NO: 1105050 - DNA, 22 bp, Artificial Sequence
  chemically synthesized
ccccacaagttcccaaagtcca

SEQ ID NO: 1105051 - DNA, 22 bp, Artificial Sequence
  chemically synthesized
cccacaagttcccaaagtccat

SEQ ID NO: 1105052 - DNA, 22 bp, Artificial Sequence
  chemically synthesized
ccaaagtccattatatcattct

SEQ ID NO: 1105053 - DNA, 22 bp, Artificial Sequence
  chemically synthesized
tgaggacacacaggcattagaa

SEQ ID NO: 1105054 - DNA, 22 bp, Artificial Sequence
  chemically synthesized
tatcattctaatgcctgtgtgt

SEQ ID NO: 1105055 - DNA, 22 bp, Artificial Sequence
  chemically synthesized
taatgcctgtgtgtcctcatag

SEQ ID NO: 1105056 - DNA, 22 bp, Artificial Sequence
  chemically synthesized
atgcctgtgtgtcctcatagat

SEQ ID NO: 1105057 - DNA, 22 bp, Artificial Sequence
  chemically synthesized
atatgtgggagataatctatga

SEQ ID NO: 1105058 - DNA, 22 bp, Artificial Sequence
  chemically synthesized
actgatatgtgggagataatct

SEQ ID NO: 1105059 - DNA, 22 bp, Artificial Sequence
  chemically synthesized
tgtgtcctcatagattatctcc

SEQ ID NO: 1105060 - DNA, 22 bp, Artificial Sequence
  chemically synthesized
tcactgatatgtgggagataat

SEQ ID NO: 1105061 - DNA, 22 bp, Artificial Sequence
  chemically synthesized
tatgttctcactgatatgtggg

SEQ ID NO: 1105062 - DNA, 22 bp, Artificial Sequence
  chemically synthesized
atagattatctcccacatatca

SEQ ID NO: 1105063 - DNA, 22 bp, Artificial Sequence
  chemically synthesized
tctcccacatatcagtgagaac

SEQ ID NO: 1105064 - DNA, 22 bp, Artificial Sequence
  chemically synthesized
ccacatatcagtgagaacatac

SEQ ID NO: 1105065 - DNA, 22 bp, Artificial Sequence
  chemically synthesized
aggaatggaaaaccaaacattg

SEQ ID NO: 1105066 - DNA, 22 bp, Artificial Sequence
  chemically synthesized
agtgaagtaactcaggaatgga

SEQ ID NO: 1105067 - DNA, 22 bp, Artificial Sequence
  chemically synthesized
taagtgaagtaactcaggaatg

SEQ ID NO: 1105068 - DNA, 22 bp, Artificial Sequence
  chemically synthesized
ttctaagtgaagtaactcagga

SEQ ID NO: 1105069 - DNA, 22 bp, Artificial Sequence
  chemically synthesized
ggttttccattcctgagttact

SEQ ID NO: 1105070 - DNA, 22 bp, Artificial Sequence
  chemically synthesized
gttttccattcctgagttactt

SEQ ID NO: 1105071 - DNA, 22 bp, Artificial Sequence
  chemically synthesized
ttattctaagtgaagtaactca

SEQ ID NO: 1105072 - DNA, 22 bp, Artificial Sequence
  chemically synthesized
tccattcctgagttacttcact

SEQ ID NO: 1105073 - DNA, 22 bp, Artificial Sequence
  chemically synthesized
ccattcctgagttacttcactt

SEQ ID NO: 1105074 - DNA, 22 bp, Artificial Sequence
  chemically synthesized
cattcctgagttacttcactta

SEQ ID NO: 1105075 - DNA, 22 bp, Artificial Sequence
  chemically synthesized
gagactattattctaagtgaag

SEQ ID NO: 1105076 - DNA, 22 bp, Artificial Sequence
  chemically synthesized
ctgagttacttcacttagaata

SEQ ID NO: 1105077 - DNA, 22 bp, Artificial Sequence
  chemically synthesized
agttacttcacttagaataata

SEQ ID NO: 1105078 - DNA, 22 bp, Artificial Sequence
  chemically synthesized
aatgagattggagactattatt

SEQ ID NO: 1105079 - DNA, 22 bp, Artificial Sequence
  chemically synthesized
cttcacttagaataatagtctc

SEQ ID NO: 1105080 - DNA, 22 bp, Artificial Sequence
  chemically synthesized
cacttagaataatagtctccaa

SEQ ID NO: 1105081 - DNA, 22 bp, Artificial Sequence
  chemically synthesized
acttagaataatagtctccaat

SEQ ID NO: 1105082 - DNA, 22 bp, Artificial Sequence
  chemically synthesized
agaataatagtctccaatctca

SEQ ID NO: 1105083 - DNA, 22 bp, Artificial Sequence
  chemically synthesized
cagtgacctgaatgagattgga

SEQ ID NO: 1105084 - DNA, 22 bp, Artificial Sequence
  chemically synthesized
gaataatagtctccaatctcat

SEQ ID NO: 1105085 - DNA, 22 bp, Artificial Sequence
  chemically synthesized
gcagtgacctgaatgagattgg

SEQ ID NO: 1105086 - DNA, 22 bp, Artificial Sequence
  chemically synthesized
acagcatttgcagtgacctgaa

SEQ ID NO: 1105087 - DNA, 22 bp, Artificial Sequence
  chemically synthesized
caatctcattcaggtcactgca

SEQ ID NO: 1105088 - DNA, 22 bp, Artificial Sequence
  chemically synthesized
attcaggtcactgcaaatgctg

SEQ ID NO: 1105089 - DNA, 22 bp, Artificial Sequence
  chemically synthesized
aggtcactgcaaatgctgttaa

SEQ ID NO: 1105090 - DNA, 22 bp, Artificial Sequence
  chemically synthesized
agtcataaaaatgaatgaatta

SEQ ID NO: 1105091 - DNA, 22 bp, Artificial Sequence
  chemically synthesized
caaatgctgttaattcattcat

SEQ ID NO: 1105092 - DNA, 22 bp, Artificial Sequence
  chemically synthesized
ctcagtcataaaaatgaatgaa

SEQ ID NO: 1105093 - DNA, 22 bp, Artificial Sequence
  chemically synthesized
ttaattcattcatttttatgac

SEQ ID NO: 1105094 - DNA, 22 bp, Artificial Sequence
  chemically synthesized
attcattcatttttatgactga

SEQ ID NO: 1105095 - DNA, 22 bp, Artificial Sequence
  chemically synthesized
attcatttttatgactgagtag

SEQ ID NO: 1105096 - DNA, 22 bp, Artificial Sequence
  chemically synthesized
atttttatgactgagtagtatt

SEQ ID NO: 1105097 - DNA, 22 bp, Artificial Sequence
  chemically synthesized
ttatgactgagtagtattccat

SEQ ID NO: 1105098 - DNA, 22 bp, Artificial Sequence
  chemically synthesized
tatgactgagtagtattccatc

SEQ ID NO: 1105099 - DNA, 22 bp, Artificial Sequence
  chemically synthesized
atgactgagtagtattccatca

SEQ ID NO: 1105100 - DNA, 22 bp, Artificial Sequence
  chemically synthesized
tgactgagtagtattccatcat

SEQ ID NO: 1105101 - DNA, 22 bp, Artificial Sequence
  chemically synthesized
agtagtattccatcatatatac

SEQ ID NO: 1105102 - DNA, 22 bp, Artificial Sequence
  chemically synthesized
catcatatatacatacatacat

SEQ ID NO: 1105103 - DNA, 22 bp, Artificial Sequence
  chemically synthesized
tggtgagtgtgtgtgtgtgtgt

SEQ ID NO: 1105104 - DNA, 22 bp, Artificial Sequence
  chemically synthesized
aagaaactgtggtgagtgtgtg

SEQ ID NO: 1105105 - DNA, 22 bp, Artificial Sequence
  chemically synthesized
aatgagtggttaaagaaactgt

SEQ ID NO: 1105106 - DNA, 22 bp, Artificial Sequence
  chemically synthesized
accacagtttctttaaccactc

SEQ ID NO: 1105107 - DNA, 22 bp, Artificial Sequence
  chemically synthesized
ctttaaccactcattcagtgat

SEQ ID NO: 1105108 - DNA, 22 bp, Artificial Sequence
  chemically synthesized
tttaaccactcattcagtgatg

SEQ ID NO: 1105109 - DNA, 22 bp, Artificial Sequence
  chemically synthesized
taaccactcattcagtgatggg

SEQ ID NO: 1105110 - DNA, 22 bp, Artificial Sequence
  chemically synthesized
aaccactcattcagtgatgggc

SEQ ID NO: 1105111 - DNA, 22 bp, Artificial Sequence
  chemically synthesized
accactcattcagtgatgggca

SEQ ID NO: 1105112 - DNA, 22 bp, Artificial Sequence
  chemically synthesized
attcagtgatgggcatttggat

SEQ ID NO: 1105113 - DNA, 22 bp, Artificial Sequence
  chemically synthesized
agtgatgggcatttggattggt

SEQ ID NO: 1105114 - DNA, 22 bp, Artificial Sequence
  chemically synthesized
acaccagcacaatcgtggaacc

SEQ ID NO: 1105115 - DNA, 22 bp, Artificial Sequence
  chemically synthesized
ggattggttccacgattgtgct

SEQ ID NO: 1105116 - DNA, 22 bp, Artificial Sequence
  chemically synthesized
gattggttccacgattgtgctg

SEQ ID NO: 1105117 - DNA, 22 bp, Artificial Sequence
  chemically synthesized
gttccacgattgtgctggtgtg

SEQ ID NO: 1105118 - DNA, 22 bp, Artificial Sequence
  chemically synthesized
tagcagcacagttcacaccagc

SEQ ID NO: 1105119 - DNA, 22 bp, Artificial Sequence
  chemically synthesized
atagcagcacagttcacaccag

SEQ ID NO: 1105120 - DNA, 22 bp, Artificial Sequence
  chemically synthesized
cacgattgtgctggtgtgaact

SEQ ID NO: 1105121 - DNA, 22 bp, Artificial Sequence
  chemically synthesized
tgctggtgtgaactgtgctgct

SEQ ID NO: 1105122 - DNA, 22 bp, Artificial Sequence
  chemically synthesized
cacatgcatgtttatagcagca

SEQ ID NO: 1105123 - DNA, 22 bp, Artificial Sequence
  chemically synthesized
gcacatgcatgtttatagcagc

SEQ ID NO: 1105124 - DNA, 22 bp, Artificial Sequence
  chemically synthesized
gtgtgaactgtgctgctataaa

SEQ ID NO: 1105125 - DNA, 22 bp, Artificial Sequence
  chemically synthesized
tgctgctataaacatgcatgtg

SEQ ID NO: 1105126 - DNA, 22 bp, Artificial Sequence
  chemically synthesized
aaaaaagatacttgcacatgca

SEQ ID NO: 1105127 - DNA, 22 bp, Artificial Sequence
  chemically synthesized
ctataaacatgcatgtgcaagt

SEQ ID NO: 1105128 - DNA, 22 bp, Artificial Sequence
  chemically synthesized
ttcaaaaaagatacttgcacat

SEQ ID NO: 1105129 - DNA, 22 bp, Artificial Sequence
  chemically synthesized
taaacatgcatgtgcaagtatc

SEQ ID NO: 1105130 - DNA, 22 bp, Artificial Sequence
  chemically synthesized
cccagaggaaaaaaagtcatta

SEQ ID NO: 1105131 - DNA, 22 bp, Artificial Sequence
  chemically synthesized
ttttgaataatgactttttttc

SEQ ID NO: 1105132 - DNA, 22 bp, Artificial Sequence
  chemically synthesized
tttgaataatgactttttttcc

SEQ ID NO: 1105133 - DNA, 22 bp, Artificial Sequence
  chemically synthesized
ttgaataatgactttttttcct

SEQ ID NO: 1105134 - DNA, 22 bp, Artificial Sequence
  chemically synthesized
tgaataatgactttttttcctc

SEQ ID NO: 1105135 - DNA, 22 bp, Artificial Sequence
  chemically synthesized
ggtatctacccagaggaaaaaa

SEQ ID NO: 1105136 - DNA, 22 bp, Artificial Sequence
  chemically synthesized
gaataatgactttttttcctct

SEQ ID NO: 1105137 - DNA, 22 bp, Artificial Sequence
  chemically synthesized
aataatgactttttttcctctg

SEQ ID NO: 1105138 - DNA, 22 bp, Artificial Sequence
  chemically synthesized
ctgggtatctacccagaggaaa

SEQ ID NO: 1105139 - DNA, 22 bp, Artificial Sequence
  chemically synthesized
tttttcctctgggtagataccc

SEQ ID NO: 1105140 - DNA, 22 bp, Artificial Sequence
  chemically synthesized
ttttcctctgggtagataccca

SEQ ID NO: 1105141 - DNA, 22 bp, Artificial Sequence
  chemically synthesized
tttcctctgggtagatacccag

SEQ ID NO: 1105142 - DNA, 22 bp, Artificial Sequence
  chemically synthesized
ttcctctgggtagatacccagt

SEQ ID NO: 1105143 - DNA, 22 bp, Artificial Sequence
  chemically synthesized
tcctctgggtagatacccagta

SEQ ID NO: 1105144 - DNA, 22 bp, Artificial Sequence
  chemically synthesized
cctctgggtagatacccagtaa

SEQ ID NO: 1105145 - DNA, 22 bp, Artificial Sequence
  chemically synthesized
ctctgggtagatacccagtaat

SEQ ID NO: 1105146 - DNA, 22 bp, Artificial Sequence
  chemically synthesized
gatccagcaatcccattactgg

SEQ ID NO: 1105147 - DNA, 22 bp, Artificial Sequence
  chemically synthesized
tgggtagatacccagtaatggg

SEQ ID NO: 1105148 - DNA, 22 bp, Artificial Sequence
  chemically synthesized
ggtagatacccagtaatgggat

SEQ ID NO: 1105149 - DNA, 22 bp, Artificial Sequence
  chemically synthesized
ccactcgatccagcaatcccat

SEQ ID NO: 1105150 - DNA, 22 bp, Artificial Sequence
  chemically synthesized
aaagtagaactaccactcgatc

SEQ ID NO: 1105151 - DNA, 22 bp, Artificial Sequence
  chemically synthesized
actaaaagtagaactaccactc

SEQ ID NO: 1105152 - DNA, 22 bp, Artificial Sequence
  chemically synthesized
aactaaaagtagaactaccact

SEQ ID NO: 1105153 - DNA, 22 bp, Artificial Sequence
  chemically synthesized
cttaactaaaagtagaactacc

SEQ ID NO: 1105154 - DNA, 22 bp, Artificial Sequence
  chemically synthesized
ctggatcgagtggtagttctac

SEQ ID NO: 1105155 - DNA, 22 bp, Artificial Sequence
  chemically synthesized
gatcgagtggtagttctacttt

SEQ ID NO: 1105156 - DNA, 22 bp, Artificial Sequence
  chemically synthesized
tacttttagttaaggaatctcc

SEQ ID NO: 1105157 - DNA, 22 bp, Artificial Sequence
  chemically synthesized
tggaaaagagtgtggagattcc

SEQ ID NO: 1105158 - DNA, 22 bp, Artificial Sequence
  chemically synthesized
cttttagttaaggaatctccac

SEQ ID NO: 1105159 - DNA, 22 bp, Artificial Sequence
  chemically synthesized
ttagttaaggaatctccacact

SEQ ID NO: 1105160 - DNA, 22 bp, Artificial Sequence
  chemically synthesized
tagttaaggaatctccacactc

SEQ ID NO: 1105161 - DNA, 22 bp, Artificial Sequence
  chemically synthesized
agttaaggaatctccacactct

SEQ ID NO: 1105162 - DNA, 22 bp, Artificial Sequence
  chemically synthesized
gttaaggaatctccacactctt

SEQ ID NO: 1105163 - DNA, 22 bp, Artificial Sequence
  chemically synthesized
aggaatctccacactcttttcc

SEQ ID NO: 1105164 - DNA, 22 bp, Artificial Sequence
  chemically synthesized
aacaagtacagccactatggaa

SEQ ID NO: 1105165 - DNA, 22 bp, Artificial Sequence
  chemically synthesized
aaacaagtacagccactatgga

SEQ ID NO: 1105166 - DNA, 22 bp, Artificial Sequence
  chemically synthesized
cacactcttttccatagtggct

SEQ ID NO: 1105167 - DNA, 22 bp, Artificial Sequence
  chemically synthesized
ttttccatagtggctgtacttg

SEQ ID NO: 1105168 - DNA, 22 bp, Artificial Sequence
  chemically synthesized
atggggatttaaacaagtacag

SEQ ID NO: 1105169 - DNA, 22 bp, Artificial Sequence
  chemically synthesized
ttccatagtggctgtacttgtt

SEQ ID NO: 1105170 - DNA, 22 bp, Artificial Sequence
  chemically synthesized
tccatagtggctgtacttgttt

SEQ ID NO: 1105171 - DNA, 22 bp, Artificial Sequence
  chemically synthesized
ccatagtggctgtacttgttta

SEQ ID NO: 1105172 - DNA, 22 bp, Artificial Sequence
  chemically synthesized
ctgatggggatttaaacaagta

SEQ ID NO: 1105173 - DNA, 22 bp, Artificial Sequence
  chemically synthesized
catagtggctgtacttgtttaa

SEQ ID NO: 1105174 - DNA, 22 bp, Artificial Sequence
  chemically synthesized
cactgctgatggggatttaaac

SEQ ID NO: 1105175 - DNA, 22 bp, Artificial Sequence
  chemically synthesized
tacactgctgatggggatttaa

SEQ ID NO: 1105176 - DNA, 22 bp, Artificial Sequence
  chemically synthesized
ctacactgctgatggggattta

SEQ ID NO: 1105177 - DNA, 22 bp, Artificial Sequence
  chemically synthesized
tacttgtttaaatccccatcag

SEQ ID NO: 1105178 - DNA, 22 bp, Artificial Sequence
  chemically synthesized
gtttaaatccccatcagcagtg

SEQ ID NO: 1105179 - DNA, 22 bp, Artificial Sequence
  chemically synthesized
tttaaatccccatcagcagtgt

SEQ ID NO: 1105180 - DNA, 22 bp, Artificial Sequence
  chemically synthesized
aaatccccatcagcagtgtaga

SEQ ID NO: 1105181 - DNA, 22 bp, Artificial Sequence
  chemically synthesized
aatccccatcagcagtgtagaa

SEQ ID NO: 1105182 - DNA, 22 bp, Artificial Sequence
  chemically synthesized
cgtggatgtggtgatcaggtaa

SEQ ID NO: 1105183 - DNA, 22 bp, Artificial Sequence
  chemically synthesized
gcgtggatgtggtgatcaggta

SEQ ID NO: 1105184 - DNA, 22 bp, Artificial Sequence
  chemically synthesized
cctgatcaccacatccacgcaa

SEQ ID NO: 1105185 - DNA, 22 bp, Artificial Sequence
  chemically synthesized
aaaagtacatgtttgcgtggat

SEQ ID NO: 1105186 - DNA, 22 bp, Artificial Sequence
  chemically synthesized
aaaaagtacatgtttgcgtgga

SEQ ID NO: 1105187 - DNA, 22 bp, Artificial Sequence
  chemically synthesized
taaaaagtacatgtttgcgtgg

SEQ ID NO: 1105188 - DNA, 22 bp, Artificial Sequence
  chemically synthesized
atcaccacatccacgcaaacat

SEQ ID NO: 1105189 - DNA, 22 bp, Artificial Sequence
  chemically synthesized
caagaatgaccataatcaaaaa

SEQ ID NO: 1105190 - DNA, 22 bp, Artificial Sequence
  chemically synthesized
gcaagaatgaccataatcaaaa

SEQ ID NO: 1105191 - DNA, 22 bp, Artificial Sequence
  chemically synthesized
tttaaaatttttttgattatgg

SEQ ID NO: 1105192 - DNA, 22 bp, Artificial Sequence
  chemically synthesized
ttgcaagaatgaccataatcaa

SEQ ID NO: 1105193 - DNA, 22 bp, Artificial Sequence
  chemically synthesized
ttaaaatttttttgattatggt

SEQ ID NO: 1105194 - DNA, 22 bp, Artificial Sequence
  chemically synthesized
taaaatttttttgattatggtc

SEQ ID NO: 1105195 - DNA, 22 bp, Artificial Sequence
  chemically synthesized
aaaatttttttgattatggtca

SEQ ID NO: 1105196 - DNA, 22 bp, Artificial Sequence
  chemically synthesized
ctcttgcaagaatgaccataat

SEQ ID NO: 1105197 - DNA, 22 bp, Artificial Sequence
  chemically synthesized
aaatttttttgattatggtcat

SEQ ID NO: 1105198 - DNA, 22 bp, Artificial Sequence
  chemically synthesized
actcttgcaagaatgaccataa

SEQ ID NO: 1105199 - DNA, 22 bp, Artificial Sequence
  chemically synthesized
ttttgattatggtcattcttgc

SEQ ID NO: 1105200 - DNA, 22 bp, Artificial Sequence
  chemically synthesized
tttgattatggtcattcttgca

SEQ ID NO: 1105201 - DNA, 22 bp, Artificial Sequence
  chemically synthesized
ttgattatggtcattcttgcaa

SEQ ID NO: 1105202 - DNA, 22 bp, Artificial Sequence
  chemically synthesized
tgattatggtcattcttgcaag

SEQ ID NO: 1105203 - DNA, 22 bp, Artificial Sequence
  chemically synthesized
gattatggtcattcttgcaaga

SEQ ID NO: 1105204 - DNA, 22 bp, Artificial Sequence
  chemically synthesized
attatggtcattcttgcaagag

SEQ ID NO: 1105205 - DNA, 22 bp, Artificial Sequence
  chemically synthesized
tggtcattcttgcaagagtaag

SEQ ID NO: 1105206 - DNA, 22 bp, Artificial Sequence
  chemically synthesized
ttgcaagagtaaggtggtatca

SEQ ID NO: 1105207 - DNA, 22 bp, Artificial Sequence
  chemically synthesized
gcaagagtaaggtggtatcaca

SEQ ID NO: 1105208 - DNA, 22 bp, Artificial Sequence
  chemically synthesized
caagagtaaggtggtatcacat

SEQ ID NO: 1105209 - DNA, 22 bp, Artificial Sequence
  chemically synthesized
tgaatgatcagggaaatgcaaa

SEQ ID NO: 1105210 - DNA, 22 bp, Artificial Sequence
  chemically synthesized
acattatgaatgatcagggaaa

SEQ ID NO: 1105211 - DNA, 22 bp, Artificial Sequence
  chemically synthesized
tgatttgcatttccctgatcat

SEQ ID NO: 1105212 - DNA, 22 bp, Artificial Sequence
  chemically synthesized
gatttgcatttccctgatcatt

SEQ ID NO: 1105213 - DNA, 22 bp, Artificial Sequence
  chemically synthesized
atttgcatttccctgatcattc

SEQ ID NO: 1105214 - DNA, 22 bp, Artificial Sequence
  chemically synthesized
gcatttccctgatcattcataa

SEQ ID NO: 1105215 - DNA, 22 bp, Artificial Sequence
  chemically synthesized
catttccctgatcattcataat

SEQ ID NO: 1105216 - DNA, 22 bp, Artificial Sequence
  chemically synthesized
tgaaaaaatgctaacattatga

SEQ ID NO: 1105217 - DNA, 22 bp, Artificial Sequence
  chemically synthesized
atgaaaaaatgctaacattatg

SEQ ID NO: 1105218 - DNA, 22 bp, Artificial Sequence
  chemically synthesized
ccctgatcattcataatgttag

SEQ ID NO: 1105219 - DNA, 22 bp, Artificial Sequence
  chemically synthesized
cctgatcattcataatgttagc

SEQ ID NO: 1105220 - DNA, 22 bp, Artificial Sequence
  chemically synthesized
atcattcataatgttagcattt

SEQ ID NO: 1105221 - DNA, 22 bp, Artificial Sequence
  chemically synthesized
ataatgttagcattttttcata

SEQ ID NO: 1105222 - DNA, 22 bp, Artificial Sequence
  chemically synthesized
gcattttttcataagtttgttg

SEQ ID NO: 1105223 - DNA, 22 bp, Artificial Sequence
  chemically synthesized
tttcataagtttgttgaccatt

SEQ ID NO: 1105224 - DNA, 22 bp, Artificial Sequence
  chemically synthesized
ttcataagtttgttgaccattt

SEQ ID NO: 1105225 - DNA, 22 bp, Artificial Sequence
  chemically synthesized
tcataagtttgttgaccatttg

SEQ ID NO: 1105226 - DNA, 22 bp, Artificial Sequence
  chemically synthesized
cataagtttgttgaccatttgt

SEQ ID NO: 1105227 - DNA, 22 bp, Artificial Sequence
  chemically synthesized
aaaaggagatatacaaatggtc

SEQ ID NO: 1105228 - DNA, 22 bp, Artificial Sequence
  chemically synthesized
ataagtttgttgaccatttgta

SEQ ID NO: 1105229 - DNA, 22 bp, Artificial Sequence
  chemically synthesized
tcaaaaggagatatacaaatgg

SEQ ID NO: 1105230 - DNA, 22 bp, Artificial Sequence
  chemically synthesized
gttgaccatttgtatatctcct

SEQ ID NO: 1105231 - DNA, 22 bp, Artificial Sequence
  chemically synthesized
ttgaccatttgtatatctcctt

SEQ ID NO: 1105232 - DNA, 22 bp, Artificial Sequence
  chemically synthesized
accatttgtatatctccttttg

SEQ ID NO: 1105233 - DNA, 22 bp, Artificial Sequence
  chemically synthesized
gtatatctccttttgagaactg

SEQ ID NO: 1105234 - DNA, 22 bp, Artificial Sequence
  chemically synthesized
tatatctccttttgagaactgt

SEQ ID NO: 1105235 - DNA, 22 bp, Artificial Sequence
  chemically synthesized
aggacatgaatagacagttctc

SEQ ID NO: 1105236 - DNA, 22 bp, Artificial Sequence
  chemically synthesized
cttttgagaactgtctattcat

SEQ ID NO: 1105237 - DNA, 22 bp, Artificial Sequence
  chemically synthesized
ttgagaactgtctattcatgtc

SEQ ID NO: 1105238 - DNA, 22 bp, Artificial Sequence
  chemically synthesized
tgagaactgtctattcatgtcc

SEQ ID NO: 1105239 - DNA, 22 bp, Artificial Sequence
  chemically synthesized
gagaactgtctattcatgtcct

SEQ ID NO: 1105240 - DNA, 22 bp, Artificial Sequence
  chemically synthesized
agaactgtctattcatgtcctt

SEQ ID NO: 1105241 - DNA, 22 bp, Artificial Sequence
  chemically synthesized
tctattcatgtccttagcccac

SEQ ID NO: 1105242 - DNA, 22 bp, Artificial Sequence
  chemically synthesized
ttcatgtccttagcccactttt

SEQ ID NO: 1105243 - DNA, 22 bp, Artificial Sequence
  chemically synthesized
atgtccttagcccactttttga

SEQ ID NO: 1105244 - DNA, 22 bp, Artificial Sequence
  chemically synthesized
agcccactttttgatgggattg

SEQ ID NO: 1105245 - DNA, 22 bp, Artificial Sequence
  chemically synthesized
gcccactttttgatgggattgt

SEQ ID NO: 1105246 - DNA, 22 bp, Artificial Sequence
  chemically synthesized
aaatcagtaagaaaaatacaat

SEQ ID NO: 1105247 - DNA, 22 bp, Artificial Sequence
  chemically synthesized
tttgatgggattgtatttttct

SEQ ID NO: 1105248 - DNA, 22 bp, Artificial Sequence
  chemically synthesized
ttgatgggattgtatttttctt

SEQ ID NO: 1105249 - DNA, 22 bp, Artificial Sequence
  chemically synthesized
tgatgggattgtatttttctta

SEQ ID NO: 1105250 - DNA, 22 bp, Artificial Sequence
  chemically synthesized
gatgggattgtatttttcttac

SEQ ID NO: 1105251 - DNA, 22 bp, Artificial Sequence
  chemically synthesized
atgggattgtatttttcttact

SEQ ID NO: 1105252 - DNA, 22 bp, Artificial Sequence
  chemically synthesized
caacaaactcaaatcagtaaga

SEQ ID NO: 1105253 - DNA, 22 bp, Artificial Sequence
  chemically synthesized
tatttttcttactgatttgagt

SEQ ID NO: 1105254 - DNA, 22 bp, Artificial Sequence
  chemically synthesized
ttcttactgatttgagtttgtt

SEQ ID NO: 1105255 - DNA, 22 bp, Artificial Sequence
  chemically synthesized
tcttactgatttgagtttgttg

SEQ ID NO: 1105256 - DNA, 22 bp, Artificial Sequence
  chemically synthesized
cttactgatttgagtttgttgt

SEQ ID NO: 1105257 - DNA, 22 bp, Artificial Sequence
  chemically synthesized
ttactgatttgagtttgttgta

SEQ ID NO: 1105258 - DNA, 22 bp, Artificial Sequence
  chemically synthesized
atatccagaatctacaacaaac

SEQ ID NO: 1105259 - DNA, 22 bp, Artificial Sequence
  chemically synthesized
actgatttgagtttgttgtaga

SEQ ID NO: 1105260 - DNA, 22 bp, Artificial Sequence
  chemically synthesized
ctgatttgagtttgttgtagat

SEQ ID NO: 1105261 - DNA, 22 bp, Artificial Sequence
  chemically synthesized
atttgagtttgttgtagattct

SEQ ID NO: 1105262 - DNA, 22 bp, Artificial Sequence
  chemically synthesized
gagtttgttgtagattctggat

SEQ ID NO: 1105263 - DNA, 22 bp, Artificial Sequence
  chemically synthesized
agtttgttgtagattctggata

SEQ ID NO: 1105264 - DNA, 22 bp, Artificial Sequence
  chemically synthesized
acaaaggactaatatccagaat

SEQ ID NO: 1105265 - DNA, 22 bp, Artificial Sequence
  chemically synthesized
gttgtagattctggatattagt

SEQ ID NO: 1105266 - DNA, 22 bp, Artificial Sequence
  chemically synthesized
ttgtagattctggatattagtc

SEQ ID NO: 1105267 - DNA, 22 bp, Artificial Sequence
  chemically synthesized
tacatctgacaaaggactaata

SEQ ID NO: 1105268 - DNA, 22 bp, Artificial Sequence
  chemically synthesized
tagattctggatattagtcctt

SEQ ID NO: 1105269 - DNA, 22 bp, Artificial Sequence
  chemically synthesized
tggatattagtcctttgtcaga

SEQ ID NO: 1105270 - DNA, 22 bp, Artificial Sequence
  chemically synthesized
acaatctatacatctgacaaag

SEQ ID NO: 1105271 - DNA, 22 bp, Artificial Sequence
  chemically synthesized
cacaatctatacatctgacaaa

SEQ ID NO: 1105272 - DNA, 22 bp, Artificial Sequence
  chemically synthesized
gatattagtcctttgtcagatg

SEQ ID NO: 1105273 - DNA, 22 bp, Artificial Sequence
  chemically synthesized
gtcctttgtcagatgtatagat

SEQ ID NO: 1105274 - DNA, 22 bp, Artificial Sequence
  chemically synthesized
tgtcagatgtatagattgtgaa

SEQ ID NO: 1105275 - DNA, 22 bp, Artificial Sequence
  chemically synthesized
gtcagatgtatagattgtgaag

SEQ ID NO: 1105276 - DNA, 22 bp, Artificial Sequence
  chemically synthesized
tcagatgtatagattgtgaaga

SEQ ID NO: 1105277 - DNA, 22 bp, Artificial Sequence
  chemically synthesized
tgaagattttatcccactccat

SEQ ID NO: 1105278 - DNA, 22 bp, Artificial Sequence
  chemically synthesized
tatcccactccatgggttgcct

SEQ ID NO: 1105279 - DNA, 22 bp, Artificial Sequence
  chemically synthesized
atcccactccatgggttgcctg

SEQ ID NO: 1105280 - DNA, 22 bp, Artificial Sequence
  chemically synthesized
tcccactccatgggttgcctgt

SEQ ID NO: 1105281 - DNA, 22 bp, Artificial Sequence
  chemically synthesized
catgggttgcctgtttgctgtg

SEQ ID NO: 1105282 - DNA, 22 bp, Artificial Sequence
  chemically synthesized
cctgtttgctgtgctgattgtt

SEQ ID NO: 1105283 - DNA, 22 bp, Artificial Sequence
  chemically synthesized
cacagcaaaaggaacaatcagc

SEQ ID NO: 1105284 - DNA, 22 bp, Artificial Sequence
  chemically synthesized
gcacagcaaaaggaacaatcag

SEQ ID NO: 1105285 - DNA, 22 bp, Artificial Sequence
  chemically synthesized
tgcacagcaaaaggaacaatca

SEQ ID NO: 1105286 - DNA, 22 bp, Artificial Sequence
  chemically synthesized
ttgcacagcaaaaggaacaatc

SEQ ID NO: 1105287 - DNA, 22 bp, Artificial Sequence
  chemically synthesized
tttgctgtgctgattgttcctt

SEQ ID NO: 1105288 - DNA, 22 bp, Artificial Sequence
  chemically synthesized
gctgtgctgattgttccttttg

SEQ ID NO: 1105289 - DNA, 22 bp, Artificial Sequence
  chemically synthesized
ctgtgctgattgttccttttgc

SEQ ID NO: 1105290 - DNA, 22 bp, Artificial Sequence
  chemically synthesized
tgctgattgttccttttgctgt

SEQ ID NO: 1105291 - DNA, 22 bp, Artificial Sequence
  chemically synthesized
aaaagcttttgcacagcaaaag

SEQ ID NO: 1105292 - DNA, 22 bp, Artificial Sequence
  chemically synthesized
attgttccttttgctgtgcaaa

SEQ ID NO: 1105293 - DNA, 22 bp, Artificial Sequence
  chemically synthesized
aattaaaaagcttttgcacagc

SEQ ID NO: 1105294 - DNA, 22 bp, Artificial Sequence
  chemically synthesized
aaattaaaaagcttttgcacag

SEQ ID NO: 1105295 - DNA, 22 bp, Artificial Sequence
  chemically synthesized
ttccttttgctgtgcaaaagct

SEQ ID NO: 1105296 - DNA, 22 bp, Artificial Sequence
  chemically synthesized
atttaaattaaaaagcttttgc

SEQ ID NO: 1105297 - DNA, 22 bp, Artificial Sequence
  chemically synthesized
cttttgctgtgcaaaagctttt

SEQ ID NO: 1105298 - DNA, 22 bp, Artificial Sequence
  chemically synthesized
ttgctgtgcaaaagctttttaa

SEQ ID NO: 1105299 - DNA, 22 bp, Artificial Sequence
  chemically synthesized
tgctgtgcaaaagctttttaat

SEQ ID NO: 1105300 - DNA, 22 bp, Artificial Sequence
  chemically synthesized
gctgtgcaaaagctttttaatt

SEQ ID NO: 1105301 - DNA, 22 bp, Artificial Sequence
  chemically synthesized
gtacctaatttaaattaaaaag

SEQ ID NO: 1105302 - DNA, 22 bp, Artificial Sequence
  chemically synthesized
ctgtgcaaaagctttttaattt

SEQ ID NO: 1105303 - DNA, 22 bp, Artificial Sequence
  chemically synthesized
tgcaaaagctttttaatttaaa

SEQ ID NO: 1105304 - DNA, 22 bp, Artificial Sequence
  chemically synthesized
tttaatttaaattaggtaccag

SEQ ID NO: 1105305 - DNA, 22 bp, Artificial Sequence
  chemically synthesized
ttaatttaaattaggtaccagc

SEQ ID NO: 1105306 - DNA, 22 bp, Artificial Sequence
  chemically synthesized
taatttaaattaggtaccagct

SEQ ID NO: 1105307 - DNA, 22 bp, Artificial Sequence
  chemically synthesized
aatttaaattaggtaccagcta

SEQ ID NO: 1105308 - DNA, 22 bp, Artificial Sequence
  chemically synthesized
atttaaattaggtaccagctat

SEQ ID NO: 1105309 - DNA, 22 bp, Artificial Sequence
  chemically synthesized
aaattaggtaccagctatttat

SEQ ID NO: 1105310 - DNA, 22 bp, Artificial Sequence
  chemically synthesized
aattaggtaccagctatttatc

SEQ ID NO: 1105311 - DNA, 22 bp, Artificial Sequence
  chemically synthesized
ggtaccagctatttatctttgt

SEQ ID NO: 1105312 - DNA, 22 bp, Artificial Sequence
  chemically synthesized
tttatctttgtttttattacat

SEQ ID NO: 1105313 - DNA, 22 bp, Artificial Sequence
  chemically synthesized
atctttgtttttattacatttg

SEQ ID NO: 1105314 - DNA, 22 bp, Artificial Sequence
  chemically synthesized
tctttgtttttattacatttgc

SEQ ID NO: 1105315 - DNA, 22 bp, Artificial Sequence
  chemically synthesized
tgtttttattacatttgctttt

SEQ ID NO: 1105316 - DNA, 22 bp, Artificial Sequence
  chemically synthesized
gtttttattacatttgcttttg

SEQ ID NO: 1105317 - DNA, 22 bp, Artificial Sequence
  chemically synthesized
tttttattacatttgcttttgg

SEQ ID NO: 1105318 - DNA, 22 bp, Artificial Sequence
  chemically synthesized
atgaccaggaacccaaaagcaa

SEQ ID NO: 1105319 - DNA, 22 bp, Artificial Sequence
  chemically synthesized
catgaccaggaacccaaaagca

SEQ ID NO: 1105320 - DNA, 22 bp, Artificial Sequence
  chemically synthesized
ttattacatttgcttttgggtt

SEQ ID NO: 1105321 - DNA, 22 bp, Artificial Sequence
  chemically synthesized
tattacatttgcttttgggttc

SEQ ID NO: 1105322 - DNA, 22 bp, Artificial Sequence
  chemically synthesized
attacatttgcttttgggttcc

SEQ ID NO: 1105323 - DNA, 22 bp, Artificial Sequence
  chemically synthesized
ttacatttgcttttgggttcct

SEQ ID NO: 1105324 - DNA, 22 bp, Artificial Sequence
  chemically synthesized
catttgcttttgggttcctggt

SEQ ID NO: 1105325 - DNA, 22 bp, Artificial Sequence
  chemically synthesized
ggcaaggatttcatgaccagga

SEQ ID NO: 1105326 - DNA, 22 bp, Artificial Sequence
  chemically synthesized
aggcaaggatttcatgaccagg

SEQ ID NO: 1105327 - DNA, 22 bp, Artificial Sequence
  chemically synthesized
gcttttgggttcctggtcatga

SEQ ID NO: 1105328 - DNA, 22 bp, Artificial Sequence
  chemically synthesized
cttttgggttcctggtcatgaa

SEQ ID NO: 1105329 - DNA, 22 bp, Artificial Sequence
  chemically synthesized
gcttaggcaaggatttcatgac

SEQ ID NO: 1105330 - DNA, 22 bp, Artificial Sequence
  chemically synthesized
ttgggttcctggtcatgaaatc

SEQ ID NO: 1105331 - DNA, 22 bp, Artificial Sequence
  chemically synthesized
tgggttcctggtcatgaaatcc

SEQ ID NO: 1105332 - DNA, 22 bp, Artificial Sequence
  chemically synthesized
gggttcctggtcatgaaatcct

SEQ ID NO: 1105333 - DNA, 22 bp, Artificial Sequence
  chemically synthesized
ggttcctggtcatgaaatcctt

SEQ ID NO: 1105334 - DNA, 22 bp, Artificial Sequence
  chemically synthesized
gacattggcttaggcaaggatt

SEQ ID NO: 1105335 - DNA, 22 bp, Artificial Sequence
  chemically synthesized
ctggtcatgaaatccttgccta

SEQ ID NO: 1105336 - DNA, 22 bp, Artificial Sequence
  chemically synthesized
tagacattggcttaggcaagga

SEQ ID NO: 1105337 - DNA, 22 bp, Artificial Sequence
  chemically synthesized
ctagacattggcttaggcaagg

SEQ ID NO: 1105338 - DNA, 22 bp, Artificial Sequence
  chemically synthesized
tctagacattggcttaggcaag

SEQ ID NO: 1105339 - DNA, 22 bp, Artificial Sequence
  chemically synthesized
gtcatgaaatccttgcctaagc

SEQ ID NO: 1105340 - DNA, 22 bp, Artificial Sequence
  chemically synthesized
gaaaaaactttctagacattgg

SEQ ID NO: 1105341 - DNA, 22 bp, Artificial Sequence
  chemically synthesized
gcctaagccaatgtctagaaag

SEQ ID NO: 1105342 - DNA, 22 bp, Artificial Sequence
  chemically synthesized
cctaagccaatgtctagaaagt

SEQ ID NO: 1105343 - DNA, 22 bp, Artificial Sequence
  chemically synthesized
agccaatgtctagaaagttttt

SEQ ID NO: 1105344 - DNA, 22 bp, Artificial Sequence
  chemically synthesized
gaagataacattggaaaaaact

SEQ ID NO: 1105345 - DNA, 22 bp, Artificial Sequence
  chemically synthesized
tagaagataacattggaaaaaa

SEQ ID NO: 1105346 - DNA, 22 bp, Artificial Sequence
  chemically synthesized
gaaagttttttccaatgttatc

SEQ ID NO: 1105347 - DNA, 22 bp, Artificial Sequence
  chemically synthesized
taaaaattctagaagataacat

SEQ ID NO: 1105348 - DNA, 22 bp, Artificial Sequence
  chemically synthesized
tttccaatgttatcttctagaa

SEQ ID NO: 1105349 - DNA, 22 bp, Artificial Sequence
  chemically synthesized
aaactataaaaattctagaaga

SEQ ID NO: 1105350 - DNA, 22 bp, Artificial Sequence
  chemically synthesized
ttccaatgttatcttctagaat

SEQ ID NO: 1105351 - DNA, 22 bp, Artificial Sequence
  chemically synthesized
tccaatgttatcttctagaatt

SEQ ID NO: 1105352 - DNA, 22 bp, Artificial Sequence
  chemically synthesized
ccaatgttatcttctagaattt

SEQ ID NO: 1105353 - DNA, 22 bp, Artificial Sequence
  chemically synthesized
caatgttatcttctagaatttt

SEQ ID NO: 1105354 - DNA, 22 bp, Artificial Sequence
  chemically synthesized
agacctgaaactataaaaattc

SEQ ID NO: 1105355 - DNA, 22 bp, Artificial Sequence
  chemically synthesized
tcttctagaatttttatagttt

SEQ ID NO: 1105356 - DNA, 22 bp, Artificial Sequence
  chemically synthesized
aacctaagacctgaaactataa

SEQ ID NO: 1105357 - DNA, 22 bp, Artificial Sequence
  chemically synthesized
aaacctaagacctgaaactata

SEQ ID NO: 1105358 - DNA, 22 bp, Artificial Sequence
  chemically synthesized
ctagaatttttatagtttcagg

SEQ ID NO: 1105359 - DNA, 22 bp, Artificial Sequence
  chemically synthesized
tagaatttttatagtttcaggt

SEQ ID NO: 1105360 - DNA, 22 bp, Artificial Sequence
  chemically synthesized
gaatttttatagtttcaggtct

SEQ ID NO: 1105361 - DNA, 22 bp, Artificial Sequence
  chemically synthesized
aagacttaaacctaagacctga

SEQ ID NO: 1105362 - DNA, 22 bp, Artificial Sequence
  chemically synthesized
aaagacttaaacctaagacctg

SEQ ID NO: 1105363 - DNA, 22 bp, Artificial Sequence
  chemically synthesized
ttatagtttcaggtcttaggtt

SEQ ID NO: 1105364 - DNA, 22 bp, Artificial Sequence
  chemically synthesized
tatagtttcaggtcttaggttt

SEQ ID NO: 1105365 - DNA, 22 bp, Artificial Sequence
  chemically synthesized
atagtttcaggtcttaggttta

SEQ ID NO: 1105366 - DNA, 22 bp, Artificial Sequence
  chemically synthesized
tagtttcaggtcttaggtttaa

SEQ ID NO: 1105367 - DNA, 22 bp, Artificial Sequence
  chemically synthesized
aagatggtttaaagacttaaac

SEQ ID NO: 1105368 - DNA, 22 bp, Artificial Sequence
  chemically synthesized
caggtcttaggtttaagtcttt

SEQ ID NO: 1105369 - DNA, 22 bp, Artificial Sequence
  chemically synthesized
aggtcttaggtttaagtcttta

SEQ ID NO: 1105370 - DNA, 22 bp, Artificial Sequence
  chemically synthesized
aggtttaagtctttaaaccatc

SEQ ID NO: 1105371 - DNA, 22 bp, Artificial Sequence
  chemically synthesized
ggtttaagtctttaaaccatct

SEQ ID NO: 1105372 - DNA, 22 bp, Artificial Sequence
  chemically synthesized
tacaaaaaccaactaaagatgg

SEQ ID NO: 1105373 - DNA, 22 bp, Artificial Sequence
  chemically synthesized
aagtctttaaaccatctttagt

SEQ ID NO: 1105374 - DNA, 22 bp, Artificial Sequence
  chemically synthesized
agtctttaaaccatctttagtt

SEQ ID NO: 1105375 - DNA, 22 bp, Artificial Sequence
  chemically synthesized
acattatacaaaaaccaactaa

SEQ ID NO: 1105376 - DNA, 22 bp, Artificial Sequence
  chemically synthesized
taaaccatctttagttggtttt

SEQ ID NO: 1105377 - DNA, 22 bp, Artificial Sequence
  chemically synthesized
tcacattatacaaaaaccaact

SEQ ID NO: 1105378 - DNA, 22 bp, Artificial Sequence
  chemically synthesized
aaaccatctttagttggttttt

SEQ ID NO: 1105379 - DNA, 22 bp, Artificial Sequence
  chemically synthesized
aaccatctttagttggtttttg

SEQ ID NO: 1105380 - DNA, 22 bp, Artificial Sequence
  chemically synthesized
atctctcacattatacaaaaac

SEQ ID NO: 1105381 - DNA, 22 bp, Artificial Sequence
  chemically synthesized
ctcatctctcacattatacaaa

SEQ ID NO: 1105382 - DNA, 22 bp, Artificial Sequence
  chemically synthesized
tagttggtttttgtataatgtg

SEQ ID NO: 1105383 - DNA, 22 bp, Artificial Sequence
  chemically synthesized
agttggtttttgtataatgtga

SEQ ID NO: 1105384 - DNA, 22 bp, Artificial Sequence
  chemically synthesized
gctcctcatctctcacattata

SEQ ID NO: 1105385 - DNA, 22 bp, Artificial Sequence
  chemically synthesized
gttggtttttgtataatgtgag

SEQ ID NO: 1105386 - DNA, 22 bp, Artificial Sequence
  chemically synthesized
gtttttgtataatgtgagagat

SEQ ID NO: 1105387 - DNA, 22 bp, Artificial Sequence
  chemically synthesized
aaattggctcctcatctctcac

SEQ ID NO: 1105388 - DNA, 22 bp, Artificial Sequence
  chemically synthesized
ttgtataatgtgagagatgagg

SEQ ID NO: 1105389 - DNA, 22 bp, Artificial Sequence
  chemically synthesized
tgtataatgtgagagatgagga

SEQ ID NO: 1105390 - DNA, 22 bp, Artificial Sequence
  chemically synthesized
gtataatgtgagagatgaggag

SEQ ID NO: 1105391 - DNA, 22 bp, Artificial Sequence
  chemically synthesized
tataatgtgagagatgaggagc

SEQ ID NO: 1105392 - DNA, 22 bp, Artificial Sequence
  chemically synthesized
gccacatgtgggagactgaaat

SEQ ID NO: 1105393 - DNA, 22 bp, Artificial Sequence
  chemically synthesized
gctagccacatgtgggagactg

SEQ ID NO: 1105394 - DNA, 22 bp, Artificial Sequence
  chemically synthesized
ggataattggctagccacatgt

SEQ ID NO: 1105395 - DNA, 22 bp, Artificial Sequence
  chemically synthesized
cagtctcccacatgtggctagc

SEQ ID NO: 1105396 - DNA, 22 bp, Artificial Sequence
  chemically synthesized
agtctcccacatgtggctagcc

SEQ ID NO: 1105397 - DNA, 22 bp, Artificial Sequence
  chemically synthesized
ccacatgtggctagccaattat

SEQ ID NO: 1105398 - DNA, 22 bp, Artificial Sequence
  chemically synthesized
atcaaatggtgctgggataatt

SEQ ID NO: 1105399 - DNA, 22 bp, Artificial Sequence
  chemically synthesized
catcaaatggtgctgggataat

SEQ ID NO: 1105400 - DNA, 22 bp, Artificial Sequence
  chemically synthesized
tcatcaaatggtgctgggataa

SEQ ID NO: 1105401 - DNA, 22 bp, Artificial Sequence
  chemically synthesized
ttcatcaaatggtgctgggata

SEQ ID NO: 1105402 - DNA, 22 bp, Artificial Sequence
  chemically synthesized
gccaattatcccagcaccattt

SEQ ID NO: 1105403 - DNA, 22 bp, Artificial Sequence
  chemically synthesized
tcccagcaccatttgatgaaaa

SEQ ID NO: 1105404 - DNA, 22 bp, Artificial Sequence
  chemically synthesized
gatgaaaagggtgtcctttctt

SEQ ID NO: 1105405 - DNA, 22 bp, Artificial Sequence
  chemically synthesized
atgaaaagggtgtcctttcttt

SEQ ID NO: 1105406 - DNA, 22 bp, Artificial Sequence
  chemically synthesized
aacaaagcaaacaaaaacatac

SEQ ID NO: 1105407 - DNA, 22 bp, Artificial Sequence
  chemically synthesized
caacaaagcaaacaaaaacata

SEQ ID NO: 1105408 - DNA, 22 bp, Artificial Sequence
  chemically synthesized
tctttactgtatgtttttgttt

SEQ ID NO: 1105409 - DNA, 22 bp, Artificial Sequence
  chemically synthesized
ctttactgtatgtttttgtttg

SEQ ID NO: 1105410 - DNA, 22 bp, Artificial Sequence
  chemically synthesized
tttactgtatgtttttgtttgc

SEQ ID NO: 1105411 - DNA, 22 bp, Artificial Sequence
  chemically synthesized
atcttcaacaaagcaaacaaaa

SEQ ID NO: 1105412 - DNA, 22 bp, Artificial Sequence
  chemically synthesized
tactgtatgtttttgtttgctt

SEQ ID NO: 1105413 - DNA, 22 bp, Artificial Sequence
  chemically synthesized
actgtatgtttttgtttgcttt

SEQ ID NO: 1105414 - DNA, 22 bp, Artificial Sequence
  chemically synthesized
ctgtatgtttttgtttgctttg

SEQ ID NO: 1105415 - DNA, 22 bp, Artificial Sequence
  chemically synthesized
tatgtttttgtttgctttgttg

SEQ ID NO: 1105416 - DNA, 22 bp, Artificial Sequence
  chemically synthesized
cacaaactgatcttcaacaaag

SEQ ID NO: 1105417 - DNA, 22 bp, Artificial Sequence
  chemically synthesized
acacaaactgatcttcaacaaa

SEQ ID NO: 1105418 - DNA, 22 bp, Artificial Sequence
  chemically synthesized
ttgtttgctttgttgaagatca

SEQ ID NO: 1105419 - DNA, 22 bp, Artificial Sequence
  chemically synthesized
tgtttgctttgttgaagatcag

SEQ ID NO: 1105420 - DNA, 22 bp, Artificial Sequence
  chemically synthesized
gtttgctttgttgaagatcagt

SEQ ID NO: 1105421 - DNA, 22 bp, Artificial Sequence
  chemically synthesized
tttgctttgttgaagatcagtt

SEQ ID NO: 1105422 - DNA, 22 bp, Artificial Sequence
  chemically synthesized
gctttgttgaagatcagtttgt

SEQ ID NO: 1105423 - DNA, 22 bp, Artificial Sequence
  chemically synthesized
ctttgttgaagatcagtttgtg

SEQ ID NO: 1105424 - DNA, 22 bp, Artificial Sequence
  chemically synthesized
tgttgaagatcagtttgtgtaa

SEQ ID NO: 1105425 - DNA, 22 bp, Artificial Sequence
  chemically synthesized
gttgaagatcagtttgtgtaag

SEQ ID NO: 1105426 - DNA, 22 bp, Artificial Sequence
  chemically synthesized
ttgaagatcagtttgtgtaagt

SEQ ID NO: 1105427 - DNA, 22 bp, Artificial Sequence
  chemically synthesized
aagatcagtttgtgtaagtatt

SEQ ID NO: 1105428 - DNA, 22 bp, Artificial Sequence
  chemically synthesized
gtgtaagtattttggtttattt

SEQ ID NO: 1105429 - DNA, 22 bp, Artificial Sequence
  chemically synthesized
tgtaagtattttggtttatttc

SEQ ID NO: 1105430 - DNA, 22 bp, Artificial Sequence
  chemically synthesized
tggtttatttctgggttctcta

SEQ ID NO: 1105431 - DNA, 22 bp, Artificial Sequence
  chemically synthesized
ggtttatttctgggttctctat

SEQ ID NO: 1105432 - DNA, 22 bp, Artificial Sequence
  chemically synthesized
gtttatttctgggttctctatt

SEQ ID NO: 1105433 - DNA, 22 bp, Artificial Sequence
  chemically synthesized
atttctgggttctctattctgt

SEQ ID NO: 1105434 - DNA, 22 bp, Artificial Sequence
  chemically synthesized
tttctgggttctctattctgtt

SEQ ID NO: 1105435 - DNA, 22 bp, Artificial Sequence
  chemically synthesized
ctgggttctctattctgttctg

SEQ ID NO: 1105436 - DNA, 22 bp, Artificial Sequence
  chemically synthesized
tgggttctctattctgttctgt

SEQ ID NO: 1105437 - DNA, 22 bp, Artificial Sequence
  chemically synthesized
ggttctctattctgttctgttg

SEQ ID NO: 1105438 - DNA, 22 bp, Artificial Sequence
  chemically synthesized
tctattctgttctgttggtcta

SEQ ID NO: 1105439 - DNA, 22 bp, Artificial Sequence
  chemically synthesized
tattctgttctgttggtctatg

SEQ ID NO: 1105440 - DNA, 22 bp, Artificial Sequence
  chemically synthesized
ttctgttctgttggtctatgtg

SEQ ID NO: 1105441 - DNA, 22 bp, Artificial Sequence
  chemically synthesized
gtataaatataggcacatagac

SEQ ID NO: 1105442 - DNA, 22 bp, Artificial Sequence
  chemically synthesized
tgttctgttggtctatgtgcct

SEQ ID NO: 1105443 - DNA, 22 bp, Artificial Sequence
  chemically synthesized
ttctgttggtctatgtgcctat

SEQ ID NO: 1105444 - DNA, 22 bp, Artificial Sequence
  chemically synthesized
tgttggtctatgtgcctatatt

SEQ ID NO: 1105445 - DNA, 22 bp, Artificial Sequence
  chemically synthesized
ttggtctatgtgcctatattta

SEQ ID NO: 1105446 - DNA, 22 bp, Artificial Sequence
  chemically synthesized
gtctatgtgcctatatttatac

SEQ ID NO: 1105447 - DNA, 22 bp, Artificial Sequence
  chemically synthesized
tgtgcctatatttataccagta

SEQ ID NO: 1105448 - DNA, 22 bp, Artificial Sequence
  chemically synthesized
tatttataccagtaccatgctg

SEQ ID NO: 1105449 - DNA, 22 bp, Artificial Sequence
  chemically synthesized
ataccagtaccatgctgttttg

SEQ ID NO: 1105450 - DNA, 22 bp, Artificial Sequence
  chemically synthesized
taccagtaccatgctgttttgg

SEQ ID NO: 1105451 - DNA, 22 bp, Artificial Sequence
  chemically synthesized
taaggccatagtcaccaaaaca

SEQ ID NO: 1105452 - DNA, 22 bp, Artificial Sequence
  chemically synthesized
tactataaggccatagtcacca

SEQ ID NO: 1105453 - DNA, 22 bp, Artificial Sequence
  chemically synthesized
aaactatactataaggccatag

SEQ ID NO: 1105454 - DNA, 22 bp, Artificial Sequence
  chemically synthesized
caaactatactataaggccata

SEQ ID NO: 1105455 - DNA, 22 bp, Artificial Sequence
  chemically synthesized
ttttggtgactatggccttata

SEQ ID NO: 1105456 - DNA, 22 bp, Artificial Sequence
  chemically synthesized
atttcaaactatactataaggc

SEQ ID NO: 1105457 - DNA, 22 bp, Artificial Sequence
  chemically synthesized
tggtgactatggccttatagta

SEQ ID NO: 1105458 - DNA, 22 bp, Artificial Sequence
  chemically synthesized
ggtgactatggccttatagtat

SEQ ID NO: 1105459 - DNA, 22 bp, Artificial Sequence
  chemically synthesized
gtgactatggccttatagtata

SEQ ID NO: 1105460 - DNA, 22 bp, Artificial Sequence
  chemically synthesized
cctgatttcaaactatactata

SEQ ID NO: 1105461 - DNA, 22 bp, Artificial Sequence
  chemically synthesized
tggccttatagtatagtttgaa

SEQ ID NO: 1105462 - DNA, 22 bp, Artificial Sequence
  chemically synthesized
atagtatagtttgaaatcaggt

SEQ ID NO: 1105463 - DNA, 22 bp, Artificial Sequence
  chemically synthesized
tagtatagtttgaaatcaggta

SEQ ID NO: 1105464 - DNA, 22 bp, Artificial Sequence
  chemically synthesized
gaggcatcacactacctgattt

SEQ ID NO: 1105465 - DNA, 22 bp, Artificial Sequence
  chemically synthesized
gaaatcaggtagtgtgatgcct

SEQ ID NO: 1105466 - DNA, 22 bp, Artificial Sequence
  chemically synthesized
aaatcaggtagtgtgatgcctc

SEQ ID NO: 1105467 - DNA, 22 bp, Artificial Sequence
  chemically synthesized
agcaaaaagaacaaatctggag

SEQ ID NO: 1105468 - DNA, 22 bp, Artificial Sequence
  chemically synthesized
cagatttgttctttttgcttag

SEQ ID NO: 1105469 - DNA, 22 bp, Artificial Sequence
  chemically synthesized
cacagccaaagcaagactaagc

SEQ ID NO: 1105470 - DNA, 22 bp, Artificial Sequence
  chemically synthesized
gttctttttgcttagtcttgct

SEQ ID NO: 1105471 - DNA, 22 bp, Artificial Sequence
  chemically synthesized
ttctttttgcttagtcttgctt

SEQ ID NO: 1105472 - DNA, 22 bp, Artificial Sequence
  chemically synthesized
tttttgcttagtcttgctttgg

SEQ ID NO: 1105473 - DNA, 22 bp, Artificial Sequence
  chemically synthesized
tttgcttagtcttgctttggct

SEQ ID NO: 1105474 - DNA, 22 bp, Artificial Sequence
  chemically synthesized
ttgcttagtcttgctttggctg

SEQ ID NO: 1105475 - DNA, 22 bp, Artificial Sequence
  chemically synthesized
tgcttagtcttgctttggctgt

SEQ ID NO: 1105476 - DNA, 22 bp, Artificial Sequence
  chemically synthesized
gcttagtcttgctttggctgtg

SEQ ID NO: 1105477 - DNA, 22 bp, Artificial Sequence
  chemically synthesized
cttagtcttgctttggctgtgc

SEQ ID NO: 1105478 - DNA, 22 bp, Artificial Sequence
  chemically synthesized
agtcttgctttggctgtgcagg

SEQ ID NO: 1105479 - DNA, 22 bp, Artificial Sequence
  chemically synthesized
gtcttgctttggctgtgcaggc

SEQ ID NO: 1105480 - DNA, 22 bp, Artificial Sequence
  chemically synthesized
gctttggctgtgcaggctcctt

SEQ ID NO: 1105481 - DNA, 22 bp, Artificial Sequence
  chemically synthesized
ctttggctgtgcaggctccttt

SEQ ID NO: 1105482 - DNA, 22 bp, Artificial Sequence
  chemically synthesized
atatggaaccaaaaaggagcct

SEQ ID NO: 1105483 - DNA, 22 bp, Artificial Sequence
  chemically synthesized
tggctgtgcaggctcctttttg

SEQ ID NO: 1105484 - DNA, 22 bp, Artificial Sequence
  chemically synthesized
ggctgtgcaggctcctttttgg

SEQ ID NO: 1105485 - DNA, 22 bp, Artificial Sequence
  chemically synthesized
gctgtgcaggctcctttttggt

SEQ ID NO: 1105486 - DNA, 22 bp, Artificial Sequence
  chemically synthesized
aaattaatatggaaccaaaaag

SEQ ID NO: 1105487 - DNA, 22 bp, Artificial Sequence
  chemically synthesized
taaaattaatatggaaccaaaa

SEQ ID NO: 1105488 - DNA, 22 bp, Artificial Sequence
  chemically synthesized
tgcaggctcctttttggttcca

SEQ ID NO: 1105489 - DNA, 22 bp, Artificial Sequence
  chemically synthesized
ctttttggttccatattaattt

SEQ ID NO: 1105490 - DNA, 22 bp, Artificial Sequence
  chemically synthesized
gaaaaaaaattctaaaattaat

SEQ ID NO: 1105491 - DNA, 22 bp, Artificial Sequence
  chemically synthesized
tttggttccatattaattttag

SEQ ID NO: 1105492 - DNA, 22 bp, Artificial Sequence
  chemically synthesized
ttggttccatattaattttaga

SEQ ID NO: 1105493 - DNA, 22 bp, Artificial Sequence
  chemically synthesized
tggttccatattaattttagaa

SEQ ID NO: 1105494 - DNA, 22 bp, Artificial Sequence
  chemically synthesized
ggttccatattaattttagaat

SEQ ID NO: 1105495 - DNA, 22 bp, Artificial Sequence
  chemically synthesized
gttccatattaattttagaatt

SEQ ID NO: 1105496 - DNA, 22 bp, Artificial Sequence
  chemically synthesized
catattaattttagaatttttt

SEQ ID NO: 1105497 - DNA, 22 bp, Artificial Sequence
  chemically synthesized
acagaattagaaaaaaaattct

SEQ ID NO: 1105498 - DNA, 22 bp, Artificial Sequence
  chemically synthesized
cacagaattagaaaaaaaattc

SEQ ID NO: 1105499 - DNA, 22 bp, Artificial Sequence
  chemically synthesized
ttcacagaattagaaaaaaaat

SEQ ID NO: 1105500 - DNA, 22 bp, Artificial Sequence
  chemically synthesized
attttagaattttttttctaat

SEQ ID NO: 1105501 - DNA, 22 bp, Artificial Sequence
  chemically synthesized
tagaattttttttctaattctg

SEQ ID NO: 1105502 - DNA, 22 bp, Artificial Sequence
  chemically synthesized
agaattttttttctaattctgt

SEQ ID NO: 1105503 - DNA, 22 bp, Artificial Sequence
  chemically synthesized
gaattttttttctaattctgtg

SEQ ID NO: 1105504 - DNA, 22 bp, Artificial Sequence
  chemically synthesized
tttttctaattctgtgaagaat

SEQ ID NO: 1105505 - DNA, 22 bp, Artificial Sequence
  chemically synthesized
ttttctaattctgtgaagaatg

SEQ ID NO: 1105506 - DNA, 22 bp, Artificial Sequence
  chemically synthesized
tttctaattctgtgaagaatga

SEQ ID NO: 1105507 - DNA, 22 bp, Artificial Sequence
  chemically synthesized
ttctaattctgtgaagaatgat

SEQ ID NO: 1105508 - DNA, 22 bp, Artificial Sequence
  chemically synthesized
tctaattctgtgaagaatgatg

SEQ ID NO: 1105509 - DNA, 22 bp, Artificial Sequence
  chemically synthesized
ctaattctgtgaagaatgatgc

SEQ ID NO: 1105510 - DNA, 22 bp, Artificial Sequence
  chemically synthesized
taattctgtgaagaatgatgct

SEQ ID NO: 1105511 - DNA, 22 bp, Artificial Sequence
  chemically synthesized
attctgtgaagaatgatgctgt

SEQ ID NO: 1105512 - DNA, 22 bp, Artificial Sequence
  chemically synthesized
tgtgaagaatgatgctgttatt

SEQ ID NO: 1105513 - DNA, 22 bp, Artificial Sequence
  chemically synthesized
tgaagaatgatgctgttatttt

SEQ ID NO: 1105514 - DNA, 22 bp, Artificial Sequence
  chemically synthesized
agtgcaatccccatcaaaataa

SEQ ID NO: 1105515 - DNA, 22 bp, Artificial Sequence
  chemically synthesized
caaattcagtgcaatccccatc

SEQ ID NO: 1105516 - DNA, 22 bp, Artificial Sequence
  chemically synthesized
ttattttgatggggattgcact

SEQ ID NO: 1105517 - DNA, 22 bp, Artificial Sequence
  chemically synthesized
ttttgatggggattgcactgaa

SEQ ID NO: 1105518 - DNA, 22 bp, Artificial Sequence
  chemically synthesized
tgatggggattgcactgaattt

SEQ ID NO: 1105519 - DNA, 22 bp, Artificial Sequence
  chemically synthesized
gatggggattgcactgaatttg

SEQ ID NO: 1105520 - DNA, 22 bp, Artificial Sequence
  chemically synthesized
atggggattgcactgaatttgt

SEQ ID NO: 1105521 - DNA, 22 bp, Artificial Sequence
  chemically synthesized
ccaaaggcaatctacaaattca

SEQ ID NO: 1105522 - DNA, 22 bp, Artificial Sequence
  chemically synthesized
cactgaatttgtagattgcctt

SEQ ID NO: 1105523 - DNA, 22 bp, Artificial Sequence
  chemically synthesized
aatttgtagattgcctttggca

SEQ ID NO: 1105524 - DNA, 22 bp, Artificial Sequence
  chemically synthesized
tgaaaatgaccatactgccaaa

SEQ ID NO: 1105525 - DNA, 22 bp, Artificial Sequence
  chemically synthesized
gtagattgcctttggcagtatg

SEQ ID NO: 1105526 - DNA, 22 bp, Artificial Sequence
  chemically synthesized
tagattgcctttggcagtatgg

SEQ ID NO: 1105527 - DNA, 22 bp, Artificial Sequence
  chemically synthesized
cctttggcagtatggtcatttt

SEQ ID NO: 1105528 - DNA, 22 bp, Artificial Sequence
  chemically synthesized
tggcagtatggtcattttcaca

SEQ ID NO: 1105529 - DNA, 22 bp, Artificial Sequence
  chemically synthesized
ggcagtatggtcattttcacaa

SEQ ID NO: 1105530 - DNA, 22 bp, Artificial Sequence
  chemically synthesized
gcagtatggtcattttcacaat

SEQ ID NO: 1105531 - DNA, 22 bp, Artificial Sequence
  chemically synthesized
tcacaatactgattgtacccat

SEQ ID NO: 1105532 - DNA, 22 bp, Artificial Sequence
  chemically synthesized
cacaatactgattgtacccatc

SEQ ID NO: 1105533 - DNA, 22 bp, Artificial Sequence
  chemically synthesized
acaatactgattgtacccatcc

SEQ ID NO: 1105534 - DNA, 22 bp, Artificial Sequence
  chemically synthesized
attgtacccatccacgactatg

SEQ ID NO: 1105535 - DNA, 22 bp, Artificial Sequence
  chemically synthesized
tacccatccacgactatgggat

SEQ ID NO: 1105536 - DNA, 22 bp, Artificial Sequence
  chemically synthesized
tgggatgtgttttcatttgttt

SEQ ID NO: 1105537 - DNA, 22 bp, Artificial Sequence
  chemically synthesized
aaagaaatcatagatgacacaa

SEQ ID NO: 1105538 - DNA, 22 bp, Artificial Sequence
  chemically synthesized
ctgaaagaaatcatagatgaca

SEQ ID NO: 1105539 - DNA, 22 bp, Artificial Sequence
  chemically synthesized
tcatttgtttgtgtcatctatg

SEQ ID NO: 1105540 - DNA, 22 bp, Artificial Sequence
  chemically synthesized
catttgtttgtgtcatctatga

SEQ ID NO: 1105541 - DNA, 22 bp, Artificial Sequence
  chemically synthesized
atttgtttgtgtcatctatgat

SEQ ID NO: 1105542 - DNA, 22 bp, Artificial Sequence
  chemically synthesized
gtttgtgtcatctatgatttct

SEQ ID NO: 1105543 - DNA, 22 bp, Artificial Sequence
  chemically synthesized
tttgtgtcatctatgatttctt

SEQ ID NO: 1105544 - DNA, 22 bp, Artificial Sequence
  chemically synthesized
ccaaacactgctgaaagaaatc

SEQ ID NO: 1105545 - DNA, 22 bp, Artificial Sequence
  chemically synthesized
gtgtcatctatgatttctttca

SEQ ID NO: 1105546 - DNA, 22 bp, Artificial Sequence
  chemically synthesized
tgtcatctatgatttctttcag

SEQ ID NO: 1105547 - DNA, 22 bp, Artificial Sequence
  chemically synthesized
tgatttctttcagcagtgtttg

SEQ ID NO: 1105548 - DNA, 22 bp, Artificial Sequence
  chemically synthesized
caaggaaaactaccaaacactg

SEQ ID NO: 1105549 - DNA, 22 bp, Artificial Sequence
  chemically synthesized
tccaaggaaaactaccaaacac

SEQ ID NO: 1105550 - DNA, 22 bp, Artificial Sequence
  chemically synthesized
ctttcagcagtgtttggtagtt

SEQ ID NO: 1105551 - DNA, 22 bp, Artificial Sequence
  chemically synthesized
tttcagcagtgtttggtagttt

SEQ ID NO: 1105552 - DNA, 22 bp, Artificial Sequence
  chemically synthesized
tcagcagtgtttggtagttttc

SEQ ID NO: 1105553 - DNA, 22 bp, Artificial Sequence
  chemically synthesized
cagcagtgtttggtagttttcc

SEQ ID NO: 1105554 - DNA, 22 bp, Artificial Sequence
  chemically synthesized
agcagtgtttggtagttttcct

SEQ ID NO: 1105555 - DNA, 22 bp, Artificial Sequence
  chemically synthesized
ggtagttttccttggagaggtc

SEQ ID NO: 1105556 - DNA, 22 bp, Artificial Sequence
  chemically synthesized
gtagttttccttggagaggtct

SEQ ID NO: 1105557 - DNA, 22 bp, Artificial Sequence
  chemically synthesized
accaaggagtcgaaagacctct

SEQ ID NO: 1105558 - DNA, 22 bp, Artificial Sequence
  chemically synthesized
tccttggagaggtctttcgact

SEQ ID NO: 1105559 - DNA, 22 bp, Artificial Sequence
  chemically synthesized
ccttggagaggtctttcgactc

SEQ ID NO: 1105560 - DNA, 22 bp, Artificial Sequence
  chemically synthesized
cttggagaggtctttcgactcc

SEQ ID NO: 1105561 - DNA, 22 bp, Artificial Sequence
  chemically synthesized
ggagaggtctttcgactccttg

SEQ ID NO: 1105562 - DNA, 22 bp, Artificial Sequence
  chemically synthesized
gagaggtctttcgactccttgg

SEQ ID NO: 1105563 - DNA, 22 bp, Artificial Sequence
  chemically synthesized
ggaatatacctaaccaaggagt

SEQ ID NO: 1105564 - DNA, 22 bp, Artificial Sequence
  chemically synthesized
aggaatatacctaaccaaggag

SEQ ID NO: 1105565 - DNA, 22 bp, Artificial Sequence
  chemically synthesized
tcgactccttggttaggtatat

SEQ ID NO: 1105566 - DNA, 22 bp, Artificial Sequence
  chemically synthesized
cgactccttggttaggtatatt

SEQ ID NO: 1105567 - DNA, 22 bp, Artificial Sequence
  chemically synthesized
gactccttggttaggtatattc

SEQ ID NO: 1105568 - DNA, 22 bp, Artificial Sequence
  chemically synthesized
cttggttaggtatattcctaag

SEQ ID NO: 1105569 - DNA, 22 bp, Artificial Sequence
  chemically synthesized
ggttaggtatattcctaagttt

SEQ ID NO: 1105570 - DNA, 22 bp, Artificial Sequence
  chemically synthesized
gttaggtatattcctaagtttt

SEQ ID NO: 1105571 - DNA, 22 bp, Artificial Sequence
  chemically synthesized
ggtatattcctaagttttttgt

SEQ ID NO: 1105572 - DNA, 22 bp, Artificial Sequence
  chemically synthesized
ctaagttttttgttgttgttgt

SEQ ID NO: 1105573 - DNA, 22 bp, Artificial Sequence
  chemically synthesized
agttttttgttgttgttgttgt

SEQ ID NO: 1105574 - DNA, 22 bp, Artificial Sequence
  chemically synthesized
tttgttgttgttgttgttattt

SEQ ID NO: 1105575 - DNA, 22 bp, Artificial Sequence
  chemically synthesized
ttgttgttgttgttgttatttt

SEQ ID NO: 1105576 - DNA, 22 bp, Artificial Sequence
  chemically synthesized
tgttgttgttgttgttatttta

SEQ ID NO: 1105577 - DNA, 22 bp, Artificial Sequence
  chemically synthesized
caaaaaataaaataaaataaca

SEQ ID NO: 1105578 - DNA, 22 bp, Artificial Sequence
  chemically synthesized
gttgttgttgttgttattttat

SEQ ID NO: 1105579 - DNA, 22 bp, Artificial Sequence
  chemically synthesized
ttgttgttgttgttattttatt

SEQ ID NO: 1105580 - DNA, 22 bp, Artificial Sequence
  chemically synthesized
ttgttgttgttattttatttta

SEQ ID NO: 1105581 - DNA, 22 bp, Artificial Sequence
  chemically synthesized
ttgttgttattttattttattt

SEQ ID NO: 1105582 - DNA, 22 bp, Artificial Sequence
  chemically synthesized
caatagctgcaaaaaataaaat

SEQ ID NO: 1105583 - DNA, 22 bp, Artificial Sequence
  chemically synthesized
acaatagctgcaaaaaataaaa

SEQ ID NO: 1105584 - DNA, 22 bp, Artificial Sequence
  chemically synthesized
ttgttattttattttatttttt

SEQ ID NO: 1105585 - DNA, 22 bp, Artificial Sequence
  chemically synthesized
tacaatagctgcaaaaaataaa

SEQ ID NO: 1105586 - DNA, 22 bp, Artificial Sequence
  chemically synthesized
ttacaatagctgcaaaaaataa

SEQ ID NO: 1105587 - DNA, 22 bp, Artificial Sequence
  chemically synthesized
ttattttattttattttttgca

SEQ ID NO: 1105588 - DNA, 22 bp, Artificial Sequence
  chemically synthesized
ttttattttattttttgcagct

SEQ ID NO: 1105589 - DNA, 22 bp, Artificial Sequence
  chemically synthesized
tattttattttttgcagctatt

SEQ ID NO: 1105590 - DNA, 22 bp, Artificial Sequence
  chemically synthesized
aaccccttttacaatagctgca

SEQ ID NO: 1105591 - DNA, 22 bp, Artificial Sequence
  chemically synthesized
attttattttttgcagctattg

SEQ ID NO: 1105592 - DNA, 22 bp, Artificial Sequence
  chemically synthesized
ttttattttttgcagctattgt

SEQ ID NO: 1105593 - DNA, 22 bp, Artificial Sequence
  chemically synthesized
tattttttgcagctattgtaaa

SEQ ID NO: 1105594 - DNA, 22 bp, Artificial Sequence
  chemically synthesized
attttttgcagctattgtaaaa

SEQ ID NO: 1105595 - DNA, 22 bp, Artificial Sequence
  chemically synthesized
ttttttgcagctattgtaaaag

SEQ ID NO: 1105596 - DNA, 22 bp, Artificial Sequence
  chemically synthesized
agaactcaaccccttttacaat

SEQ ID NO: 1105597 - DNA, 22 bp, Artificial Sequence
  chemically synthesized
tttgcagctattgtaaaagggg

SEQ ID NO: 1105598 - DNA, 22 bp, Artificial Sequence
  chemically synthesized
ttgcagctattgtaaaaggggt

SEQ ID NO: 1105599 - DNA, 22 bp, Artificial Sequence
  chemically synthesized
tgcagctattgtaaaaggggtt

SEQ ID NO: 1105600 - DNA, 22 bp, Artificial Sequence
  chemically synthesized
gcagctattgtaaaaggggttg

SEQ ID NO: 1105601 - DNA, 22 bp, Artificial Sequence
  chemically synthesized
cagctattgtaaaaggggttga

SEQ ID NO: 1105602 - DNA, 22 bp, Artificial Sequence
  chemically synthesized
ttgtaaaaggggttgagttctt

SEQ ID NO: 1105603 - DNA, 22 bp, Artificial Sequence
  chemically synthesized
taaaaggggttgagttcttaat

SEQ ID NO: 1105604 - DNA, 22 bp, Artificial Sequence
  chemically synthesized
agttcttaatttgattctctgc

SEQ ID NO: 1105605 - DNA, 22 bp, Artificial Sequence
  chemically synthesized
ttaatttgattctctgcttggt

SEQ ID NO: 1105606 - DNA, 22 bp, Artificial Sequence
  chemically synthesized
tataccaacaacgaccaagcag

SEQ ID NO: 1105607 - DNA, 22 bp, Artificial Sequence
  chemically synthesized
aatttgattctctgcttggtcg

SEQ ID NO: 1105608 - DNA, 22 bp, Artificial Sequence
  chemically synthesized
atttgattctctgcttggtcgt

SEQ ID NO: 1105609 - DNA, 22 bp, Artificial Sequence
  chemically synthesized
tgtataccaacaacgaccaagc

SEQ ID NO: 1105610 - DNA, 22 bp, Artificial Sequence
  chemically synthesized
ctgtataccaacaacgaccaag

SEQ ID NO: 1105611 - DNA, 22 bp, Artificial Sequence
  chemically synthesized
ttctgtataccaacaacgacca

SEQ ID NO: 1105612 - DNA, 22 bp, Artificial Sequence
  chemically synthesized
gattctctgcttggtcgttgtt

SEQ ID NO: 1105613 - DNA, 22 bp, Artificial Sequence
  chemically synthesized
attctctgcttggtcgttgttg

SEQ ID NO: 1105614 - DNA, 22 bp, Artificial Sequence
  chemically synthesized
tctgcttggtcgttgttggtat

SEQ ID NO: 1105615 - DNA, 22 bp, Artificial Sequence
  chemically synthesized
tgcttggtcgttgttggtatac

SEQ ID NO: 1105616 - DNA, 22 bp, Artificial Sequence
  chemically synthesized
cttggtcgttgttggtatacag

SEQ ID NO: 1105617 - DNA, 22 bp, Artificial Sequence
  chemically synthesized
ggtcgttgttggtatacagaag

SEQ ID NO: 1105618 - DNA, 22 bp, Artificial Sequence
  chemically synthesized
gtcgttgttggtatacagaaga

SEQ ID NO: 1105619 - DNA, 22 bp, Artificial Sequence
  chemically synthesized
ttggtatacagaagagctactg

SEQ ID NO: 1105620 - DNA, 22 bp, Artificial Sequence
  chemically synthesized
atgtacaaaaatcagtagctct

SEQ ID NO: 1105621 - DNA, 22 bp, Artificial Sequence
  chemically synthesized
gtatacagaagagctactgatt

SEQ ID NO: 1105622 - DNA, 22 bp, Artificial Sequence
  chemically synthesized
cagatacaagattaatgtacaa

SEQ ID NO: 1105623 - DNA, 22 bp, Artificial Sequence
  chemically synthesized
ccagatacaagattaatgtaca

SEQ ID NO: 1105624 - DNA, 22 bp, Artificial Sequence
  chemically synthesized
ctgatttttgtacattaatctt

SEQ ID NO: 1105625 - DNA, 22 bp, Artificial Sequence
  chemically synthesized
atttttgtacattaatcttgta

SEQ ID NO: 1105626 - DNA, 22 bp, Artificial Sequence
  chemically synthesized
agcaacatttccagatacaaga

SEQ ID NO: 1105627 - DNA, 22 bp, Artificial Sequence
  chemically synthesized
ttgtacattaatcttgtatctg

SEQ ID NO: 1105628 - DNA, 22 bp, Artificial Sequence
  chemically synthesized
tgtacattaatcttgtatctgg

SEQ ID NO: 1105629 - DNA, 22 bp, Artificial Sequence
  chemically synthesized
gtacattaatcttgtatctgga

SEQ ID NO: 1105630 - DNA, 22 bp, Artificial Sequence
  chemically synthesized
tacattaatcttgtatctggaa

SEQ ID NO: 1105631 - DNA, 22 bp, Artificial Sequence
  chemically synthesized
atcttgtatctggaaatgttgc

SEQ ID NO: 1105632 - DNA, 22 bp, Artificial Sequence
  chemically synthesized
ataaaataattcagcaacattt

SEQ ID NO: 1105633 - DNA, 22 bp, Artificial Sequence
  chemically synthesized
gtatctggaaatgttgctgaat

SEQ ID NO: 1105634 - DNA, 22 bp, Artificial Sequence
  chemically synthesized
tatctggaaatgttgctgaatt

SEQ ID NO: 1105635 - DNA, 22 bp, Artificial Sequence
  chemically synthesized
gaactgataaaataattcagca

SEQ ID NO: 1105636 - DNA, 22 bp, Artificial Sequence
  chemically synthesized
tagaactgataaaataattcag

SEQ ID NO: 1105637 - DNA, 22 bp, Artificial Sequence
  chemically synthesized
ctagaactgataaaataattca

SEQ ID NO: 1105638 - DNA, 22 bp, Artificial Sequence
  chemically synthesized
gaaatgttgctgaattatttta

SEQ ID NO: 1105639 - DNA, 22 bp, Artificial Sequence
  chemically synthesized
cagaaagtttctagaactgata

SEQ ID NO: 1105640 - DNA, 22 bp, Artificial Sequence
  chemically synthesized
ctgaattattttatcagttcta

SEQ ID NO: 1105641 - DNA, 22 bp, Artificial Sequence
  chemically synthesized
ctccagaaagtttctagaactg

SEQ ID NO: 1105642 - DNA, 22 bp, Artificial Sequence
  chemically synthesized
aattattttatcagttctagaa

SEQ ID NO: 1105643 - DNA, 22 bp, Artificial Sequence
  chemically synthesized
ttttatcagttctagaaacttt

SEQ ID NO: 1105644 - DNA, 22 bp, Artificial Sequence
  chemically synthesized
aggattcctccagaaagtttct

SEQ ID NO: 1105645 - DNA, 22 bp, Artificial Sequence
  chemically synthesized
tatcagttctagaaactttctg

SEQ ID NO: 1105646 - DNA, 22 bp, Artificial Sequence
  chemically synthesized
atcagttctagaaactttctgg

SEQ ID NO: 1105647 - DNA, 22 bp, Artificial Sequence
  chemically synthesized
tcagttctagaaactttctgga

SEQ ID NO: 1105648 - DNA, 22 bp, Artificial Sequence
  chemically synthesized
aaaaccctaaggattcctccag

SEQ ID NO: 1105649 - DNA, 22 bp, Artificial Sequence
  chemically synthesized
caaaaccctaaggattcctcca

SEQ ID NO: 1105650 - DNA, 22 bp, Artificial Sequence
  chemically synthesized
tagaaactttctggaggaatcc

SEQ ID NO: 1105651 - DNA, 22 bp, Artificial Sequence
  chemically synthesized
gaaactttctggaggaatcctt

SEQ ID NO: 1105652 - DNA, 22 bp, Artificial Sequence
  chemically synthesized
ccttcaaaaccctaaggattcc

SEQ ID NO: 1105653 - DNA, 22 bp, Artificial Sequence
  chemically synthesized
accttcaaaaccctaaggattc

SEQ ID NO: 1105654 - DNA, 22 bp, Artificial Sequence
  chemically synthesized
tctggaggaatccttagggttt

SEQ ID NO: 1105655 - DNA, 22 bp, Artificial Sequence
  chemically synthesized
ctggaggaatccttagggtttt

SEQ ID NO: 1105656 - DNA, 22 bp, Artificial Sequence
  chemically synthesized
tggaggaatccttagggttttg

SEQ ID NO: 1105657 - DNA, 22 bp, Artificial Sequence
  chemically synthesized
gaggaatccttagggttttgaa

SEQ ID NO: 1105658 - DNA, 22 bp, Artificial Sequence
  chemically synthesized
tatgatcatttaccttcaaaac

SEQ ID NO: 1105659 - DNA, 22 bp, Artificial Sequence
  chemically synthesized
ccgactatatgatcatttacct

SEQ ID NO: 1105660 - DNA, 22 bp, Artificial Sequence
  chemically synthesized
gccgactatatgatcatttacc

SEQ ID NO: 1105661 - DNA, 22 bp, Artificial Sequence
  chemically synthesized
agggttttgaaggtaaatgatc

SEQ ID NO: 1105662 - DNA, 22 bp, Artificial Sequence
  chemically synthesized
gggttttgaaggtaaatgatca

SEQ ID NO: 1105663 - DNA, 22 bp, Artificial Sequence
  chemically synthesized
tgaaggtaaatgatcatatagt

SEQ ID NO: 1105664 - DNA, 22 bp, Artificial Sequence
  chemically synthesized
gaaggtaaatgatcatatagtc

SEQ ID NO: 1105665 - DNA, 22 bp, Artificial Sequence
  chemically synthesized
tcagtgtttgccgactatatga

SEQ ID NO: 1105666 - DNA, 22 bp, Artificial Sequence
  chemically synthesized
aaggtaaatgatcatatagtcg

SEQ ID NO: 1105667 - DNA, 22 bp, Artificial Sequence
  chemically synthesized
acagtttgacttcctctttacc

SEQ ID NO: 1105668 - DNA, 22 bp, Artificial Sequence
  chemically synthesized
gacttcctctttaccgatttgg

SEQ ID NO: 1105669 - DNA, 22 bp, Artificial Sequence
  chemically synthesized
acttcctctttaccgatttgga

SEQ ID NO: 1105670 - DNA, 22 bp, Artificial Sequence
  chemically synthesized
cctctttaccgatttggatgcc

SEQ ID NO: 1105671 - DNA, 22 bp, Artificial Sequence
  chemically synthesized
ctctttaccgatttggatgccc

SEQ ID NO: 1105672 - DNA, 22 bp, Artificial Sequence
  chemically synthesized
tttaccgatttggatgcccttt

SEQ ID NO: 1105673 - DNA, 22 bp, Artificial Sequence
  chemically synthesized
taccgatttggatgccctttat

SEQ ID NO: 1105674 - DNA, 22 bp, Artificial Sequence
  chemically synthesized
accgatttggatgccctttatt

SEQ ID NO: 1105675 - DNA, 22 bp, Artificial Sequence
  chemically synthesized
ccgatttggatgccctttattt

SEQ ID NO: 1105676 - DNA, 22 bp, Artificial Sequence
  chemically synthesized
ggatgccctttatttctttctc

SEQ ID NO: 1105677 - DNA, 22 bp, Artificial Sequence
  chemically synthesized
gatgccctttatttctttctct

SEQ ID NO: 1105678 - DNA, 22 bp, Artificial Sequence
  chemically synthesized
gccagagcagtcagacaagaga

SEQ ID NO: 1105679 - DNA, 22 bp, Artificial Sequence
  chemically synthesized
tatttctttctcttgtctgact

SEQ ID NO: 1105680 - DNA, 22 bp, Artificial Sequence
  chemically synthesized
atttctttctcttgtctgactg

SEQ ID NO: 1105681 - DNA, 22 bp, Artificial Sequence
  chemically synthesized
tttctttctcttgtctgactgc

SEQ ID NO: 1105682 - DNA, 22 bp, Artificial Sequence
  chemically synthesized
ctttctcttgtctgactgctct

SEQ ID NO: 1105683 - DNA, 22 bp, Artificial Sequence
  chemically synthesized
gaagtcctagccagagcagtca

SEQ ID NO: 1105684 - DNA, 22 bp, Artificial Sequence
  chemically synthesized
tttctcttgtctgactgctctg

SEQ ID NO: 1105685 - DNA, 22 bp, Artificial Sequence
  chemically synthesized
tctcttgtctgactgctctggc

SEQ ID NO: 1105686 - DNA, 22 bp, Artificial Sequence
  chemically synthesized
ctcttgtctgactgctctggct

SEQ ID NO: 1105687 - DNA, 22 bp, Artificial Sequence
  chemically synthesized
tcttgtctgactgctctggcta

SEQ ID NO: 1105688 - DNA, 22 bp, Artificial Sequence
  chemically synthesized
ttgtctgactgctctggctagg

SEQ ID NO: 1105689 - DNA, 22 bp, Artificial Sequence
  chemically synthesized
gtctgactgctctggctaggac

SEQ ID NO: 1105690 - DNA, 22 bp, Artificial Sequence
  chemically synthesized
tctgactgctctggctaggact

SEQ ID NO: 1105691 - DNA, 22 bp, Artificial Sequence
  chemically synthesized
agcatagtactagaagtcctag

SEQ ID NO: 1105692 - DNA, 22 bp, Artificial Sequence
  chemically synthesized
cagcatagtactagaagtccta

SEQ ID NO: 1105693 - DNA, 22 bp, Artificial Sequence
  chemically synthesized
actgctctggctaggacttcta

SEQ ID NO: 1105694 - DNA, 22 bp, Artificial Sequence
  chemically synthesized
ttcagcatagtactagaagtcc

SEQ ID NO: 1105695 - DNA, 22 bp, Artificial Sequence
  chemically synthesized
ctctggctaggacttctagtac

SEQ ID NO: 1105696 - DNA, 22 bp, Artificial Sequence
  chemically synthesized
ctcttcagcatagtactagaag

SEQ ID NO: 1105697 - DNA, 22 bp, Artificial Sequence
  chemically synthesized
tggctaggacttctagtactat

SEQ ID NO: 1105698 - DNA, 22 bp, Artificial Sequence
  chemically synthesized
gctaggacttctagtactatgc

SEQ ID NO: 1105699 - DNA, 22 bp, Artificial Sequence
  chemically synthesized
ccactcctcttcagcatagtac

SEQ ID NO: 1105700 - DNA, 22 bp, Artificial Sequence
  chemically synthesized
gccactcctcttcagcatagta

SEQ ID NO: 1105701 - DNA, 22 bp, Artificial Sequence
  chemically synthesized
ggacttctagtactatgctgaa

SEQ ID NO: 1105702 - DNA, 22 bp, Artificial Sequence
  chemically synthesized
ttgccactcctcttcagcatag

SEQ ID NO: 1105703 - DNA, 22 bp, Artificial Sequence
  chemically synthesized
ctagtactatgctgaagaggag

SEQ ID NO: 1105704 - DNA, 22 bp, Artificial Sequence
  chemically synthesized
tagtactatgctgaagaggagt

SEQ ID NO: 1105705 - DNA, 22 bp, Artificial Sequence
  chemically synthesized
gtactatgctgaagaggagtgg

SEQ ID NO: 1105706 - DNA, 22 bp, Artificial Sequence
  chemically synthesized
tgctgaagaggagtggcaagag

SEQ ID NO: 1105707 - DNA, 22 bp, Artificial Sequence
  chemically synthesized
aagaggagtggcaagagtggca

SEQ ID NO: 1105708 - DNA, 22 bp, Artificial Sequence
  chemically synthesized
aaataaatgcatatgccactct

SEQ ID NO: 1105709 - DNA, 22 bp, Artificial Sequence
  chemically synthesized
gaattcaaataaatgcatatgc

SEQ ID NO: 1105710 - DNA, 22 bp, Artificial Sequence
  chemically synthesized
ataatcatctagaattcaaata

SEQ ID NO: 1105711 - DNA, 22 bp, Artificial Sequence
  chemically synthesized
ttaataatcatctagaattcaa

SEQ ID NO: 1105712 - DNA, 22 bp, Artificial Sequence
  chemically synthesized
attaataatcatctagaattca

SEQ ID NO: 1105713 - DNA, 22 bp, Artificial Sequence
  chemically synthesized
tttattaataatcatctagaat

SEQ ID NO: 1105714 - DNA, 22 bp, Artificial Sequence
  chemically synthesized
gtttattaataatcatctagaa

SEQ ID NO: 1105715 - DNA, 22 bp, Artificial Sequence
  chemically synthesized
tgtttattaataatcatctaga

SEQ ID NO: 1105716 - DNA, 22 bp, Artificial Sequence
  chemically synthesized
atttgaattctagatgattatt

SEQ ID NO: 1105717 - DNA, 22 bp, Artificial Sequence
  chemically synthesized
tttgaattctagatgattatta

SEQ ID NO: 1105718 - DNA, 22 bp, Artificial Sequence
  chemically synthesized
gattttgtttattaataatcat

SEQ ID NO: 1105719 - DNA, 22 bp, Artificial Sequence
  chemically synthesized
ggattttgtttattaataatca

SEQ ID NO: 1105720 - DNA, 22 bp, Artificial Sequence
  chemically synthesized
tggattttgtttattaataatc

SEQ ID NO: 1105721 - DNA, 22 bp, Artificial Sequence
  chemically synthesized
gaattctagatgattattaata

SEQ ID NO: 1105722 - DNA, 22 bp, Artificial Sequence
  chemically synthesized
ttggattttgtttattaataat

SEQ ID NO: 1105723 - DNA, 22 bp, Artificial Sequence
  chemically synthesized
aattctagatgattattaataa

SEQ ID NO: 1105724 - DNA, 22 bp, Artificial Sequence
  chemically synthesized
tagatgattattaataaacaaa

SEQ ID NO: 1105725 - DNA, 22 bp, Artificial Sequence
  chemically synthesized
gatgattattaataaacaaaat

SEQ ID NO: 1105726 - DNA, 22 bp, Artificial Sequence
  chemically synthesized
taaggtcccttttggattttgt

SEQ ID NO: 1105727 - DNA, 22 bp, Artificial Sequence
  chemically synthesized
ataaggtcccttttggattttg

SEQ ID NO: 1105728 - DNA, 22 bp, Artificial Sequence
  chemically synthesized
tttataaggtcccttttggatt

SEQ ID NO: 1105729 - DNA, 22 bp, Artificial Sequence
  chemically synthesized
ttaataaacaaaatccaaaagg

SEQ ID NO: 1105730 - DNA, 22 bp, Artificial Sequence
  chemically synthesized
ctatttataaggtcccttttgg

SEQ ID NO: 1105731 - DNA, 22 bp, Artificial Sequence
  chemically synthesized
ataaacaaaatccaaaagggac

SEQ ID NO: 1105732 - DNA, 22 bp, Artificial Sequence
  chemically synthesized
actgctatttataaggtccctt

SEQ ID NO: 1105733 - DNA, 22 bp, Artificial Sequence
  chemically synthesized
cactgctatttataaggtccct

SEQ ID NO: 1105734 - DNA, 22 bp, Artificial Sequence
  chemically synthesized
cttcactgctatttataaggtc

SEQ ID NO: 1105735 - DNA, 22 bp, Artificial Sequence
  chemically synthesized
acttcactgctatttataaggt

SEQ ID NO: 1105736 - DNA, 22 bp, Artificial Sequence
  chemically synthesized
tacttcactgctatttataagg

SEQ ID NO: 1105737 - DNA, 22 bp, Artificial Sequence
  chemically synthesized
tttacttcactgctatttataa

SEQ ID NO: 1105738 - DNA, 22 bp, Artificial Sequence
  chemically synthesized
aatacctctttacttcactgct

SEQ ID NO: 1105739 - DNA, 22 bp, Artificial Sequence
  chemically synthesized
ataaatagcagtgaagtaaaga

SEQ ID NO: 1105740 - DNA, 22 bp, Artificial Sequence
  chemically synthesized
taactaaatacctctttacttc

SEQ ID NO: 1105741 - DNA, 22 bp, Artificial Sequence
  chemically synthesized
taaatagcagtgaagtaaagag

SEQ ID NO: 1105742 - DNA, 22 bp, Artificial Sequence
  chemically synthesized
attgtaactaaatacctcttta

SEQ ID NO: 1105743 - DNA, 22 bp, Artificial Sequence
  chemically synthesized
cattgtaactaaatacctcttt

SEQ ID NO: 1105744 - DNA, 22 bp, Artificial Sequence
  chemically synthesized
cttcattgtaactaaatacctc

SEQ ID NO: 1105745 - DNA, 22 bp, Artificial Sequence
  chemically synthesized
gcttcattgtaactaaatacct

SEQ ID NO: 1105746 - DNA, 22 bp, Artificial Sequence
  chemically synthesized
agacacaatcatttgcttcatt

SEQ ID NO: 1105747 - DNA, 22 bp, Artificial Sequence
  chemically synthesized
agttacaatgaagcaaatgatt

SEQ ID NO: 1105748 - DNA, 22 bp, Artificial Sequence
  chemically synthesized
gttacaatgaagcaaatgattg

SEQ ID NO: 1105749 - DNA, 22 bp, Artificial Sequence
  chemically synthesized
caatgaagcaaatgattgtgtc

SEQ ID NO: 1105750 - DNA, 22 bp, Artificial Sequence
  chemically synthesized
aaatgacatctcagacacaatc

SEQ ID NO: 1105751 - DNA, 22 bp, Artificial Sequence
  chemically synthesized
ctgaaatgacatctcagacaca

SEQ ID NO: 1105752 - DNA, 22 bp, Artificial Sequence
  chemically synthesized
gctgaaatgacatctcagacac

SEQ ID NO: 1105753 - DNA, 22 bp, Artificial Sequence
  chemically synthesized
gatcatttgctgaaatgacatc

SEQ ID NO: 1105754 - DNA, 22 bp, Artificial Sequence
  chemically synthesized
tagatcatttgctgaaatgaca

SEQ ID NO: 1105755 - DNA, 22 bp, Artificial Sequence
  chemically synthesized
ctagatcatttgctgaaatgac

SEQ ID NO: 1105756 - DNA, 22 bp, Artificial Sequence
  chemically synthesized
tgtctgagatgtcatttcagca

SEQ ID NO: 1105757 - DNA, 22 bp, Artificial Sequence
  chemically synthesized
cttctagatcatttgctgaaat

SEQ ID NO: 1105758 - DNA, 22 bp, Artificial Sequence
  chemically synthesized
tccttctagatcatttgctgaa

SEQ ID NO: 1105759 - DNA, 22 bp, Artificial Sequence
  chemically synthesized
agatgtcatttcagcaaatgat

SEQ ID NO: 1105760 - DNA, 22 bp, Artificial Sequence
  chemically synthesized
cagcaaatgatctagaaggaga

SEQ ID NO: 1105761 - DNA, 22 bp, Artificial Sequence
  chemically synthesized
cccatagtcccctctccttcta

SEQ ID NO: 1105762 - DNA, 22 bp, Artificial Sequence
  chemically synthesized
agcaaatgatctagaaggagag

SEQ ID NO: 1105763 - DNA, 22 bp, Artificial Sequence
  chemically synthesized
gaaggagaggggactatgggca

SEQ ID NO: 1105764 - DNA, 22 bp, Artificial Sequence
  chemically synthesized
atccaacataccgccatgtgtc

SEQ ID NO: 1105765 - DNA, 22 bp, Artificial Sequence
  chemically synthesized
tgggcagacacatggcggtatg

SEQ ID NO: 1105766 - DNA, 22 bp, Artificial Sequence
  chemically synthesized
tgattcatccaacataccgcca

SEQ ID NO: 1105767 - DNA, 22 bp, Artificial Sequence
  chemically synthesized
atgattcatccaacataccgcc

SEQ ID NO: 1105768 - DNA, 22 bp, Artificial Sequence
  chemically synthesized
tgaagcttatgattcatccaac

SEQ ID NO: 1105769 - DNA, 22 bp, Artificial Sequence
  chemically synthesized
atgaagcttatgattcatccaa

SEQ ID NO: 1105770 - DNA, 22 bp, Artificial Sequence
  chemically synthesized
tatgaagcttatgattcatcca

SEQ ID NO: 1105771 - DNA, 22 bp, Artificial Sequence
  chemically synthesized
aaccaaattttatgaagcttat

SEQ ID NO: 1105772 - DNA, 22 bp, Artificial Sequence
  chemically synthesized
gatgaatcataagcttcataaa

SEQ ID NO: 1105773 - DNA, 22 bp, Artificial Sequence
  chemically synthesized
aattaaaccaaattttatgaag

SEQ ID NO: 1105774 - DNA, 22 bp, Artificial Sequence
  chemically synthesized
aagttcaattaaaccaaatttt

SEQ ID NO: 1105775 - DNA, 22 bp, Artificial Sequence
  chemically synthesized
cataaaatttggtttaattgaa

SEQ ID NO: 1105776 - DNA, 22 bp, Artificial Sequence
  chemically synthesized
ataaaatttggtttaattgaac

SEQ ID NO: 1105777 - DNA, 22 bp, Artificial Sequence
  chemically synthesized
aagaggagacatgttcaagttc

SEQ ID NO: 1105778 - DNA, 22 bp, Artificial Sequence
  chemically synthesized
ggtttaattgaacttgaacatg

SEQ ID NO: 1105779 - DNA, 22 bp, Artificial Sequence
  chemically synthesized
gtttaattgaacttgaacatgt

SEQ ID NO: 1105780 - DNA, 22 bp, Artificial Sequence
  chemically synthesized
aattgaacttgaacatgtctcc

SEQ ID NO: 1105781 - DNA, 22 bp, Artificial Sequence
  chemically synthesized
attgaacttgaacatgtctcct

SEQ ID NO: 1105782 - DNA, 22 bp, Artificial Sequence
  chemically synthesized
aacttgaacatgtctcctcttt

SEQ ID NO: 1105783 - DNA, 22 bp, Artificial Sequence
  chemically synthesized
gaacatgtctcctctttaactt

SEQ ID NO: 1105784 - DNA, 22 bp, Artificial Sequence
  chemically synthesized
aacatgtctcctctttaacttc

SEQ ID NO: 1105785 - DNA, 22 bp, Artificial Sequence
  chemically synthesized
aacagaaagaccagaaagaagt

SEQ ID NO: 1105786 - DNA, 22 bp, Artificial Sequence
  chemically synthesized
attaaacagaaagaccagaaag

SEQ ID NO: 1105787 - DNA, 22 bp, Artificial Sequence
  chemically synthesized
ctctttaacttctttctggtct

SEQ ID NO: 1105788 - DNA, 22 bp, Artificial Sequence
  chemically synthesized
cattaaacagaaagaccagaaa

SEQ ID NO: 1105789 - DNA, 22 bp, Artificial Sequence
  chemically synthesized
tcattaaacagaaagaccagaa

SEQ ID NO: 1105790 - DNA, 22 bp, Artificial Sequence
  chemically synthesized
tttaacttctttctggtctttc

SEQ ID NO: 1105791 - DNA, 22 bp, Artificial Sequence
  chemically synthesized
taacttctttctggtctttctg

SEQ ID NO: 1105792 - DNA, 22 bp, Artificial Sequence
  chemically synthesized
aacttctttctggtctttctgt

SEQ ID NO: 1105793 - DNA, 22 bp, Artificial Sequence
  chemically synthesized
agttttcattaaacagaaagac

SEQ ID NO: 1105794 - DNA, 22 bp, Artificial Sequence
  chemically synthesized
acttctttctggtctttctgtt

SEQ ID NO: 1105795 - DNA, 22 bp, Artificial Sequence
  chemically synthesized
cagttttcattaaacagaaaga

SEQ ID NO: 1105796 - DNA, 22 bp, Artificial Sequence
  chemically synthesized
ctttctggtctttctgtttaat

SEQ ID NO: 1105797 - DNA, 22 bp, Artificial Sequence
  chemically synthesized
tttctggtctttctgtttaatg

SEQ ID NO: 1105798 - DNA, 22 bp, Artificial Sequence
  chemically synthesized
tctggtctttctgtttaatgaa

SEQ ID NO: 1105799 - DNA, 22 bp, Artificial Sequence
  chemically synthesized
ctggtctttctgtttaatgaaa

SEQ ID NO: 1105800 - DNA, 22 bp, Artificial Sequence
  chemically synthesized
aagtgtttcagttttcattaaa

SEQ ID NO: 1105801 - DNA, 22 bp, Artificial Sequence
  chemically synthesized
tggtctttctgtttaatgaaaa

SEQ ID NO: 1105802 - DNA, 22 bp, Artificial Sequence
  chemically synthesized
gtctttctgtttaatgaaaact

SEQ ID NO: 1105803 - DNA, 22 bp, Artificial Sequence
  chemically synthesized
tctgtttaatgaaaactgaaac

SEQ ID NO: 1105804 - DNA, 22 bp, Artificial Sequence
  chemically synthesized
agagactgaagtgtttcagttt

SEQ ID NO: 1105805 - DNA, 22 bp, Artificial Sequence
  chemically synthesized
ctgtttaatgaaaactgaaaca

SEQ ID NO: 1105806 - DNA, 22 bp, Artificial Sequence
  chemically synthesized
tgtttaatgaaaactgaaacac

SEQ ID NO: 1105807 - DNA, 22 bp, Artificial Sequence
  chemically synthesized
tttaatgaaaactgaaacactt

SEQ ID NO: 1105808 - DNA, 22 bp, Artificial Sequence
  chemically synthesized
aatgaaaactgaaacacttcag

SEQ ID NO: 1105809 - DNA, 22 bp, Artificial Sequence
  chemically synthesized
atgaaaactgaaacacttcagt

SEQ ID NO: 1105810 - DNA, 22 bp, Artificial Sequence
  chemically synthesized
aaacacttcagtctctgaatta

SEQ ID NO: 1105811 - DNA, 22 bp, Artificial Sequence
  chemically synthesized
tacagaaaaagatcaataattc

SEQ ID NO: 1105812 - DNA, 22 bp, Artificial Sequence
  chemically synthesized
cagtctctgaattattgatctt

SEQ ID NO: 1105813 - DNA, 22 bp, Artificial Sequence
  chemically synthesized
agtctctgaattattgatcttt

SEQ ID NO: 1105814 - DNA, 22 bp, Artificial Sequence
  chemically synthesized
tgaattattgatctttttctgt

SEQ ID NO: 1105815 - DNA, 22 bp, Artificial Sequence
  chemically synthesized
aattattgatctttttctgtat

SEQ ID NO: 1105816 - DNA, 22 bp, Artificial Sequence
  chemically synthesized
gacagatcagaagttatacaga

SEQ ID NO: 1105817 - DNA, 22 bp, Artificial Sequence
  chemically synthesized
ttgatctttttctgtataactt

SEQ ID NO: 1105818 - DNA, 22 bp, Artificial Sequence
  chemically synthesized
ttggacagatcagaagttatac

SEQ ID NO: 1105819 - DNA, 22 bp, Artificial Sequence
  chemically synthesized
atctttttctgtataacttctg

SEQ ID NO: 1105820 - DNA, 22 bp, Artificial Sequence
  chemically synthesized
agttgttggacagatcagaagt

SEQ ID NO: 1105821 - DNA, 22 bp, Artificial Sequence
  chemically synthesized
tttctgtataacttctgatctg

SEQ ID NO: 1105822 - DNA, 22 bp, Artificial Sequence
  chemically synthesized
ttctgtataacttctgatctgt

SEQ ID NO: 1105823 - DNA, 22 bp, Artificial Sequence
  chemically synthesized
tctgtataacttctgatctgtc

SEQ ID NO: 1105824 - DNA, 22 bp, Artificial Sequence
  chemically synthesized
ctgtataacttctgatctgtcc

SEQ ID NO: 1105825 - DNA, 22 bp, Artificial Sequence
  chemically synthesized
tgtataacttctgatctgtcca

SEQ ID NO: 1105826 - DNA, 22 bp, Artificial Sequence
  chemically synthesized
tataacttctgatctgtccaac

SEQ ID NO: 1105827 - DNA, 22 bp, Artificial Sequence
  chemically synthesized
tgagattcagttgttggacaga

SEQ ID NO: 1105828 - DNA, 22 bp, Artificial Sequence
  chemically synthesized
ctgtgagattcagttgttggac

SEQ ID NO: 1105829 - DNA, 22 bp, Artificial Sequence
  chemically synthesized
ctgatctgtccaacaactgaat

SEQ ID NO: 1105830 - DNA, 22 bp, Artificial Sequence
  chemically synthesized
tgatctgtccaacaactgaatc

SEQ ID NO: 1105831 - DNA, 22 bp, Artificial Sequence
  chemically synthesized
atctgtccaacaactgaatctc

SEQ ID NO: 1105832 - DNA, 22 bp, Artificial Sequence
  chemically synthesized
tccaacaactgaatctcacagg

SEQ ID NO: 1105833 - DNA, 22 bp, Artificial Sequence
  chemically synthesized
ccaatatgaagtgattcctgtg

SEQ ID NO: 1105834 - DNA, 22 bp, Artificial Sequence
  chemically synthesized
accaatatgaagtgattcctgt

SEQ ID NO: 1105835 - DNA, 22 bp, Artificial Sequence
  chemically synthesized
aatctcacaggaatcacttcat

SEQ ID NO: 1105836 - DNA, 22 bp, Artificial Sequence
  chemically synthesized
tagtttaccaatatgaagtgat

SEQ ID NO: 1105837 - DNA, 22 bp, Artificial Sequence
  chemically synthesized
attatagtttaccaatatgaag

SEQ ID NO: 1105838 - DNA, 22 bp, Artificial Sequence
  chemically synthesized
aattatagtttaccaatatgaa

SEQ ID NO: 1105839 - DNA, 22 bp, Artificial Sequence
  chemically synthesized
acaggaatcacttcatattggt

SEQ ID NO: 1105840 - DNA, 22 bp, Artificial Sequence
  chemically synthesized
taattatagtttaccaatatga

SEQ ID NO: 1105841 - DNA, 22 bp, Artificial Sequence
  chemically synthesized
catattggtaaactataattaa

SEQ ID NO: 1105842 - DNA, 22 bp, Artificial Sequence
  chemically synthesized
atattggtaaactataattaaa

SEQ ID NO: 1105843 - DNA, 22 bp, Artificial Sequence
  chemically synthesized
aaatatgcatgttttaattata

SEQ ID NO: 1105844 - DNA, 22 bp, Artificial Sequence
  chemically synthesized
gtaaactataattaaaacatgc

SEQ ID NO: 1105845 - DNA, 22 bp, Artificial Sequence
  chemically synthesized
taattaaaacatgcatatttta

SEQ ID NO: 1105846 - DNA, 22 bp, Artificial Sequence
  chemically synthesized
gaatgcaaggaggaattaaaat

SEQ ID NO: 1105847 - DNA, 22 bp, Artificial Sequence
  chemically synthesized
aaacatgcatattttaattcct

SEQ ID NO: 1105848 - DNA, 22 bp, Artificial Sequence
  chemically synthesized
ggatgagggttggaatgcaagg

SEQ ID NO: 1105849 - DNA, 22 bp, Artificial Sequence
  chemically synthesized
taattcctccttgcattccaac

SEQ ID NO: 1105850 - DNA, 22 bp, Artificial Sequence
  chemically synthesized
aattcctccttgcattccaacc

SEQ ID NO: 1105851 - DNA, 22 bp, Artificial Sequence
  chemically synthesized
attcctccttgcattccaaccc

SEQ ID NO: 1105852 - DNA, 22 bp, Artificial Sequence
  chemically synthesized
ctccttgcattccaaccctcat

SEQ ID NO: 1105853 - DNA, 22 bp, Artificial Sequence
  chemically synthesized
atacaaaactaggatgagggtt

SEQ ID NO: 1105854 - DNA, 22 bp, Artificial Sequence
  chemically synthesized
aatacaaaactaggatgagggt

SEQ ID NO: 1105855 - DNA, 22 bp, Artificial Sequence
  chemically synthesized
cttgcattccaaccctcatcct

SEQ ID NO: 1105856 - DNA, 22 bp, Artificial Sequence
  chemically synthesized
gcattccaaccctcatcctagt

SEQ ID NO: 1105857 - DNA, 22 bp, Artificial Sequence
  chemically synthesized
cattccaaccctcatcctagtt

SEQ ID NO: 1105858 - DNA, 22 bp, Artificial Sequence
  chemically synthesized
caaccctcatcctagttttgta

SEQ ID NO: 1105859 - DNA, 22 bp, Artificial Sequence
  chemically synthesized
aaatgaatttaatacaaaacta

SEQ ID NO: 1105860 - DNA, 22 bp, Artificial Sequence
  chemically synthesized
caaatgaatttaatacaaaact

SEQ ID NO: 1105861 - DNA, 22 bp, Artificial Sequence
  chemically synthesized
atcctagttttgtattaaattc

SEQ ID NO: 1105862 - DNA, 22 bp, Artificial Sequence
  chemically synthesized
gttttgtattaaattcatttga

SEQ ID NO: 1105863 - DNA, 22 bp, Artificial Sequence
  chemically synthesized
aaatgaccagtttcaaatgaat

SEQ ID NO: 1105864 - DNA, 22 bp, Artificial Sequence
  chemically synthesized
gaaatgaccagtttcaaatgaa

SEQ ID NO: 1105865 - DNA, 22 bp, Artificial Sequence
  chemically synthesized
tgaaatgaccagtttcaaatga

SEQ ID NO: 1105866 - DNA, 22 bp, Artificial Sequence
  chemically synthesized
ttgaaatgaccagtttcaaatg

SEQ ID NO: 1105867 - DNA, 22 bp, Artificial Sequence
  chemically synthesized
tgtattaaattcatttgaaact

SEQ ID NO: 1105868 - DNA, 22 bp, Artificial Sequence
  chemically synthesized
tttgaaatgaccagtttcaaat

SEQ ID NO: 1105869 - DNA, 22 bp, Artificial Sequence
  chemically synthesized
gtattaaattcatttgaaactg

SEQ ID NO: 1105870 - DNA, 22 bp, Artificial Sequence
  chemically synthesized
tattaaattcatttgaaactgg

SEQ ID NO: 1105871 - DNA, 22 bp, Artificial Sequence
  chemically synthesized
gattttttgaaatgaccagttt

SEQ ID NO: 1105872 - DNA, 22 bp, Artificial Sequence
  chemically synthesized
aattcatttgaaactggtcatt

SEQ ID NO: 1105873 - DNA, 22 bp, Artificial Sequence
  chemically synthesized
atttgaaactggtcatttcaaa

SEQ ID NO: 1105874 - DNA, 22 bp, Artificial Sequence
  chemically synthesized
caagagattagattttttgaaa

SEQ ID NO: 1105875 - DNA, 22 bp, Artificial Sequence
  chemically synthesized
gaaactggtcatttcaaaaaat

SEQ ID NO: 1105876 - DNA, 22 bp, Artificial Sequence
  chemically synthesized
ccaagagattagattttttgaa

SEQ ID NO: 1105877 - DNA, 22 bp, Artificial Sequence
  chemically synthesized
aaactggtcatttcaaaaaatc

SEQ ID NO: 1105878 - DNA, 22 bp, Artificial Sequence
  chemically synthesized
gtcatttcaaaaaatctaatct

SEQ ID NO: 1105879 - DNA, 22 bp, Artificial Sequence
  chemically synthesized
caaaagaatttccaagagatta

SEQ ID NO: 1105880 - DNA, 22 bp, Artificial Sequence
  chemically synthesized
caaaaaatctaatctcttggaa

SEQ ID NO: 1105881 - DNA, 22 bp, Artificial Sequence
  chemically synthesized
aaaaaatctaatctcttggaaa

SEQ ID NO: 1105882 - DNA, 22 bp, Artificial Sequence
  chemically synthesized
aagctacaaaagaatttccaag

SEQ ID NO: 1105883 - DNA, 22 bp, Artificial Sequence
  chemically synthesized
aaagctacaaaagaatttccaa

SEQ ID NO: 1105884 - DNA, 22 bp, Artificial Sequence
  chemically synthesized
ttaaagctacaaaagaatttcc

SEQ ID NO: 1105885 - DNA, 22 bp, Artificial Sequence
  chemically synthesized
cttaaagctacaaaagaatttc

SEQ ID NO: 1105886 - DNA, 22 bp, Artificial Sequence
  chemically synthesized
tttcttaaagctacaaaagaat

SEQ ID NO: 1105887 - DNA, 22 bp, Artificial Sequence
  chemically synthesized
atctcttggaaattcttttgta

SEQ ID NO: 1105888 - DNA, 22 bp, Artificial Sequence
  chemically synthesized
atttcttaaagctacaaaagaa

SEQ ID NO: 1105889 - DNA, 22 bp, Artificial Sequence
  chemically synthesized
ttggaaattcttttgtagcttt

SEQ ID NO: 1105890 - DNA, 22 bp, Artificial Sequence
  chemically synthesized
ggaaattcttttgtagctttaa

SEQ ID NO: 1105891 - DNA, 22 bp, Artificial Sequence
  chemically synthesized
gaagtttatttcttaaagctac

SEQ ID NO: 1105892 - DNA, 22 bp, Artificial Sequence
  chemically synthesized
gaaattcttttgtagctttaag

SEQ ID NO: 1105893 - DNA, 22 bp, Artificial Sequence
  chemically synthesized
ggaagtttatttcttaaagcta

SEQ ID NO: 1105894 - DNA, 22 bp, Artificial Sequence
  chemically synthesized
tggaagtttatttcttaaagct

SEQ ID NO: 1105895 - DNA, 22 bp, Artificial Sequence
  chemically synthesized
ttttgtagctttaagaaataaa

SEQ ID NO: 1105896 - DNA, 22 bp, Artificial Sequence
  chemically synthesized
ttgtagctttaagaaataaact

SEQ ID NO: 1105897 - DNA, 22 bp, Artificial Sequence
  chemically synthesized
tgtagctttaagaaataaactt

SEQ ID NO: 1105898 - DNA, 22 bp, Artificial Sequence
  chemically synthesized
gtagctttaagaaataaacttc

SEQ ID NO: 1105899 - DNA, 22 bp, Artificial Sequence
  chemically synthesized
tagctttaagaaataaacttcc

SEQ ID NO: 1105900 - DNA, 22 bp, Artificial Sequence
  chemically synthesized
ccaaaccaatctttggaagttt

SEQ ID NO: 1105901 - DNA, 22 bp, Artificial Sequence
  chemically synthesized
taagaaataaacttccaaagat

SEQ ID NO: 1105902 - DNA, 22 bp, Artificial Sequence
  chemically synthesized
aagaaataaacttccaaagatt

SEQ ID NO: 1105903 - DNA, 22 bp, Artificial Sequence
  chemically synthesized
agaaataaacttccaaagattg

SEQ ID NO: 1105904 - DNA, 22 bp, Artificial Sequence
  chemically synthesized
gatggacaagttcccaaaccaa

SEQ ID NO: 1105905 - DNA, 22 bp, Artificial Sequence
  chemically synthesized
ccaaagattggtttgggaactt

SEQ ID NO: 1105906 - DNA, 22 bp, Artificial Sequence
  chemically synthesized
tattagatggacaagttcccaa

SEQ ID NO: 1105907 - DNA, 22 bp, Artificial Sequence
  chemically synthesized
caaagattggtttgggaacttg

SEQ ID NO: 1105908 - DNA, 22 bp, Artificial Sequence
  chemically synthesized
acaaactatattagatggacaa

SEQ ID NO: 1105909 - DNA, 22 bp, Artificial Sequence
  chemically synthesized
gtttgggaacttgtccatctaa

SEQ ID NO: 1105910 - DNA, 22 bp, Artificial Sequence
  chemically synthesized
cctcacaaactatattagatgg

SEQ ID NO: 1105911 - DNA, 22 bp, Artificial Sequence
  chemically synthesized
gcctcacaaactatattagatg

SEQ ID NO: 1105912 - DNA, 22 bp, Artificial Sequence
  chemically synthesized
gggaacttgtccatctaatata

SEQ ID NO: 1105913 - DNA, 22 bp, Artificial Sequence
  chemically synthesized
ggaacttgtccatctaatatag

SEQ ID NO: 1105914 - DNA, 22 bp, Artificial Sequence
  chemically synthesized
cagcttgcctcacaaactatat

SEQ ID NO: 1105915 - DNA, 22 bp, Artificial Sequence
  chemically synthesized
ccagcttgcctcacaaactata

SEQ ID NO: 1105916 - DNA, 22 bp, Artificial Sequence
  chemically synthesized
tccagcttgcctcacaaactat

SEQ ID NO: 1105917 - DNA, 22 bp, Artificial Sequence
  chemically synthesized
gtccatctaatatagtttgtga

SEQ ID NO: 1105918 - DNA, 22 bp, Artificial Sequence
  chemically synthesized
ttccagcttgcctcacaaacta

SEQ ID NO: 1105919 - DNA, 22 bp, Artificial Sequence
  chemically synthesized
tccatctaatatagtttgtgag

SEQ ID NO: 1105920 - DNA, 22 bp, Artificial Sequence
  chemically synthesized
tttccagcttgcctcacaaact

SEQ ID NO: 1105921 - DNA, 22 bp, Artificial Sequence
  chemically synthesized
ttttccagcttgcctcacaaac

SEQ ID NO: 1105922 - DNA, 22 bp, Artificial Sequence
  chemically synthesized
tttttccagcttgcctcacaaa

SEQ ID NO: 1105923 - DNA, 22 bp, Artificial Sequence
  chemically synthesized
ttttttccagcttgcctcacaa

SEQ ID NO: 1105924 - DNA, 22 bp, Artificial Sequence
  chemically synthesized
atatagtttgtgaggcaagctg

SEQ ID NO: 1105925 - DNA, 22 bp, Artificial Sequence
  chemically synthesized
gtgaggcaagctggaaaaaaaa

SEQ ID NO: 1105926 - DNA, 22 bp, Artificial Sequence
  chemically synthesized
gtaggtgtgtatttttttttcc

SEQ ID NO: 1105927 - DNA, 22 bp, Artificial Sequence
  chemically synthesized
tgaggcaagctggaaaaaaaaa

SEQ ID NO: 1105928 - DNA, 22 bp, Artificial Sequence
  chemically synthesized
tgttagtaggtgtgtatttttt

SEQ ID NO: 1105929 - DNA, 22 bp, Artificial Sequence
  chemically synthesized
atgttagtaggtgtgtattttt

SEQ ID NO: 1105930 - DNA, 22 bp, Artificial Sequence
  chemically synthesized
gaaaaaaaaatacacacctact

SEQ ID NO: 1105931 - DNA, 22 bp, Artificial Sequence
  chemically synthesized
tgatatttatgttagtaggtgt

SEQ ID NO: 1105932 - DNA, 22 bp, Artificial Sequence
  chemically synthesized
ctaacataaatatcacaatttc

SEQ ID NO: 1105933 - DNA, 22 bp, Artificial Sequence
  chemically synthesized
acataaatatcacaatttcttt

SEQ ID NO: 1105934 - DNA, 22 bp, Artificial Sequence
  chemically synthesized
cacataagaaaatcagaaaaag

SEQ ID NO: 1105935 - DNA, 22 bp, Artificial Sequence
  chemically synthesized
cattccacataagaaaatcaga

SEQ ID NO: 1105936 - DNA, 22 bp, Artificial Sequence
  chemically synthesized
ctttttctgattttcttatgtg

SEQ ID NO: 1105937 - DNA, 22 bp, Artificial Sequence
  chemically synthesized
tttttctgattttcttatgtgg

SEQ ID NO: 1105938 - DNA, 22 bp, Artificial Sequence
  chemically synthesized
tttctgattttcttatgtggaa

SEQ ID NO: 1105939 - DNA, 22 bp, Artificial Sequence
  chemically synthesized
ttctgattttcttatgtggaat

SEQ ID NO: 1105940 - DNA, 22 bp, Artificial Sequence
  chemically synthesized
tctgattttcttatgtggaatg

SEQ ID NO: 1105941 - DNA, 22 bp, Artificial Sequence
  chemically synthesized
ctgattttcttatgtggaatgt

SEQ ID NO: 1105942 - DNA, 22 bp, Artificial Sequence
  chemically synthesized
catagtgtcattacattccaca

SEQ ID NO: 1105943 - DNA, 22 bp, Artificial Sequence
  chemically synthesized
tgattttcttatgtggaatgta

SEQ ID NO: 1105944 - DNA, 22 bp, Artificial Sequence
  chemically synthesized
attttcttatgtggaatgtaat

SEQ ID NO: 1105945 - DNA, 22 bp, Artificial Sequence
  chemically synthesized
tcattacatagtgtcattacat

SEQ ID NO: 1105946 - DNA, 22 bp, Artificial Sequence
  chemically synthesized
tcttatgtggaatgtaatgaca

SEQ ID NO: 1105947 - DNA, 22 bp, Artificial Sequence
  chemically synthesized
cttatgtggaatgtaatgacac

SEQ ID NO: 1105948 - DNA, 22 bp, Artificial Sequence
  chemically synthesized
ttatgtggaatgtaatgacact

SEQ ID NO: 1105949 - DNA, 22 bp, Artificial Sequence
  chemically synthesized
ctgtcattacatagtgtcatta

SEQ ID NO: 1105950 - DNA, 22 bp, Artificial Sequence
  chemically synthesized
atgtggaatgtaatgacactat

SEQ ID NO: 1105951 - DNA, 22 bp, Artificial Sequence
  chemically synthesized
tgtggaatgtaatgacactatg

SEQ ID NO: 1105952 - DNA, 22 bp, Artificial Sequence
  chemically synthesized
ctgctgtcattacatagtgtca

SEQ ID NO: 1105953 - DNA, 22 bp, Artificial Sequence
  chemically synthesized
atagcaattactgctgtcatta

SEQ ID NO: 1105954 - DNA, 22 bp, Artificial Sequence
  chemically synthesized
gatagcaattactgctgtcatt

SEQ ID NO: 1105955 - DNA, 22 bp, Artificial Sequence
  chemically synthesized
aaccttgatagcaattactgct

SEQ ID NO: 1105956 - DNA, 22 bp, Artificial Sequence
  chemically synthesized
tgtaatgacagcagtaattgct

SEQ ID NO: 1105957 - DNA, 22 bp, Artificial Sequence
  chemically synthesized
ctgaaccttgatagcaattact

SEQ ID NO: 1105958 - DNA, 22 bp, Artificial Sequence
  chemically synthesized
cctgaaccttgatagcaattac

SEQ ID NO: 1105959 - DNA, 22 bp, Artificial Sequence
  chemically synthesized
tcaagcatttcctgaaccttga

SEQ ID NO: 1105960 - DNA, 22 bp, Artificial Sequence
  chemically synthesized
gtcaagcatttcctgaaccttg

SEQ ID NO: 1105961 - DNA, 22 bp, Artificial Sequence
  chemically synthesized
caaatttgtcaagcatttcctg

SEQ ID NO: 1105962 - DNA, 22 bp, Artificial Sequence
  chemically synthesized
ctatcaaggttcaggaaatgct

SEQ ID NO: 1105963 - DNA, 22 bp, Artificial Sequence
  chemically synthesized
tcaaggttcaggaaatgcttga

SEQ ID NO: 1105964 - DNA, 22 bp, Artificial Sequence
  chemically synthesized
taccgttgcaaatttgtcaagc

SEQ ID NO: 1105965 - DNA, 22 bp, Artificial Sequence
  chemically synthesized
tataccgttgcaaatttgtcaa

SEQ ID NO: 1105966 - DNA, 22 bp, Artificial Sequence
  chemically synthesized
aggaaatgcttgacaaatttgc

SEQ ID NO: 1105967 - DNA, 22 bp, Artificial Sequence
  chemically synthesized
aatgagatactctataccgttg

SEQ ID NO: 1105968 - DNA, 22 bp, Artificial Sequence
  chemically synthesized
aaatgagatactctataccgtt

SEQ ID NO: 1105969 - DNA, 22 bp, Artificial Sequence
  chemically synthesized
gacaaatttgcaacggtataga

SEQ ID NO: 1105970 - DNA, 22 bp, Artificial Sequence
  chemically synthesized
acaaatttgcaacggtatagag

SEQ ID NO: 1105971 - DNA, 22 bp, Artificial Sequence
  chemically synthesized
catggtttaaatgagatactct

SEQ ID NO: 1105972 - DNA, 22 bp, Artificial Sequence
  chemically synthesized
gcaacggtatagagtatctcat

SEQ ID NO: 1105973 - DNA, 22 bp, Artificial Sequence
  chemically synthesized
caacggtatagagtatctcatt

SEQ ID NO: 1105974 - DNA, 22 bp, Artificial Sequence
  chemically synthesized
gcctgcatggtttaaatgagat

SEQ ID NO: 1105975 - DNA, 22 bp, Artificial Sequence
  chemically synthesized
cctggcctgcatggtttaaatg

SEQ ID NO: 1105976 - DNA, 22 bp, Artificial Sequence
  chemically synthesized
gcattccctggcctgcatggtt

SEQ ID NO: 1105977 - DNA, 22 bp, Artificial Sequence
  chemically synthesized
actggcattccctggcctgcat

SEQ ID NO: 1105978 - DNA, 22 bp, Artificial Sequence
  chemically synthesized
cactggcattccctggcctgca

SEQ ID NO: 1105979 - DNA, 22 bp, Artificial Sequence
  chemically synthesized
atttaaaccatgcaggccaggg

SEQ ID NO: 1105980 - DNA, 22 bp, Artificial Sequence
  chemically synthesized
ttcactggcattccctggcctg

SEQ ID NO: 1105981 - DNA, 22 bp, Artificial Sequence
  chemically synthesized
aaaccatgcaggccagggaatg

SEQ ID NO: 1105982 - DNA, 22 bp, Artificial Sequence
  chemically synthesized
aaccatgcaggccagggaatgc

SEQ ID NO: 1105983 - DNA, 22 bp, Artificial Sequence
  chemically synthesized
gaattcttcactggcattccct

SEQ ID NO: 1105984 - DNA, 22 bp, Artificial Sequence
  chemically synthesized
agaattcttcactggcattccc

SEQ ID NO: 1105985 - DNA, 22 bp, Artificial Sequence
  chemically synthesized
aaacagatttagaattcttcac

SEQ ID NO: 1105986 - DNA, 22 bp, Artificial Sequence
  chemically synthesized
tctgaaacagatttagaattct

SEQ ID NO: 1105987 - DNA, 22 bp, Artificial Sequence
  chemically synthesized
atctgaaacagatttagaattc

SEQ ID NO: 1105988 - DNA, 22 bp, Artificial Sequence
  chemically synthesized
ttatctgaaacagatttagaat

SEQ ID NO: 1105989 - DNA, 22 bp, Artificial Sequence
  chemically synthesized
cttatctgaaacagatttagaa

SEQ ID NO: 1105990 - DNA, 22 bp, Artificial Sequence
  chemically synthesized
ttcttatctgaaacagatttag

SEQ ID NO: 1105991 - DNA, 22 bp, Artificial Sequence
  chemically synthesized
cttcttatctgaaacagattta

SEQ ID NO: 1105992 - DNA, 22 bp, Artificial Sequence
  chemically synthesized
tcttcttatctgaaacagattt

SEQ ID NO: 1105993 - DNA, 22 bp, Artificial Sequence
  chemically synthesized
tttcttcttatctgaaacagat

SEQ ID NO: 1105994 - DNA, 22 bp, Artificial Sequence
  chemically synthesized
ctttcttcttatctgaaacaga

SEQ ID NO: 1105995 - DNA, 22 bp, Artificial Sequence
  chemically synthesized
tctttcttcttatctgaaacag

SEQ ID NO: 1105996 - DNA, 22 bp, Artificial Sequence
  chemically synthesized
ttctttcttcttatctgaaaca

SEQ ID NO: 1105997 - DNA, 22 bp, Artificial Sequence
  chemically synthesized
tttctttcttcttatctgaaac

SEQ ID NO: 1105998 - DNA, 22 bp, Artificial Sequence
  chemically synthesized
taaatctgtttcagataagaag

SEQ ID NO: 1105999 - DNA, 22 bp, Artificial Sequence
  chemically synthesized
aatctgtttcagataagaagaa

SEQ ID NO: 1106000 - DNA, 22 bp, Artificial Sequence
  chemically synthesized
tataagactttttctttcttct

SEQ ID NO: 1106001 - DNA, 22 bp, Artificial Sequence
  chemically synthesized
tgtataagactttttctttctt

SEQ ID NO: 1106002 - DNA, 22 bp, Artificial Sequence
  chemically synthesized
tttcagataagaagaaagaaaa

SEQ ID NO: 1106003 - DNA, 22 bp, Artificial Sequence
  chemically synthesized
ctgtataagactttttctttct

SEQ ID NO: 1106004 - DNA, 22 bp, Artificial Sequence
  chemically synthesized
cagataagaagaaagaaaaagt

SEQ ID NO: 1106005 - DNA, 22 bp, Artificial Sequence
  chemically synthesized
agataagaagaaagaaaaagtc

SEQ ID NO: 1106006 - DNA, 22 bp, Artificial Sequence
  chemically synthesized
gcttctgtataagactttttct

SEQ ID NO: 1106007 - DNA, 22 bp, Artificial Sequence
  chemically synthesized
ggtacattagcttctgtataag

SEQ ID NO: 1106008 - DNA, 22 bp, Artificial Sequence
  chemically synthesized
gggtacattagcttctgtataa

SEQ ID NO: 1106009 - DNA, 22 bp, Artificial Sequence
  chemically synthesized
cccttgggtacattagcttctg

SEQ ID NO: 1106010 - DNA, 22 bp, Artificial Sequence
  chemically synthesized
gcccttgggtacattagcttct

SEQ ID NO: 1106011 - DNA, 22 bp, Artificial Sequence
  chemically synthesized
tgtttgcccttgggtacattag

SEQ ID NO: 1106012 - DNA, 22 bp, Artificial Sequence
  chemically synthesized
atacagaagctaatgtacccaa

SEQ ID NO: 1106013 - DNA, 22 bp, Artificial Sequence
  chemically synthesized
tacagaagctaatgtacccaag

SEQ ID NO: 1106014 - DNA, 22 bp, Artificial Sequence
  chemically synthesized
atactgtgtttgcccttgggta

SEQ ID NO: 1106015 - DNA, 22 bp, Artificial Sequence
  chemically synthesized
atgtacccaagggcaaacacag

SEQ ID NO: 1106016 - DNA, 22 bp, Artificial Sequence
  chemically synthesized
gtaggtggggcagctcatactg

SEQ ID NO: 1106017 - DNA, 22 bp, Artificial Sequence
  chemically synthesized
accagctagtaggtggggcagc

SEQ ID NO: 1106018 - DNA, 22 bp, Artificial Sequence
  chemically synthesized
cagatatctcaccagctagtag

SEQ ID NO: 1106019 - DNA, 22 bp, Artificial Sequence
  chemically synthesized
ccccacctactagctggtgaga

SEQ ID NO: 1106020 - DNA, 22 bp, Artificial Sequence
  chemically synthesized
ctagctggtgagatatctgtag

SEQ ID NO: 1106021 - DNA, 22 bp, Artificial Sequence
  chemically synthesized
gctggtgagatatctgtagatg

SEQ ID NO: 1106022 - DNA, 22 bp, Artificial Sequence
  chemically synthesized
ggatcacaagggcagcatctac

SEQ ID NO: 1106023 - DNA, 22 bp, Artificial Sequence
  chemically synthesized
gtgagatatctgtagatgctgc

SEQ ID NO: 1106024 - DNA, 22 bp, Artificial Sequence
  chemically synthesized
tgttgggatcacaagggcagca

SEQ ID NO: 1106025 - DNA, 22 bp, Artificial Sequence
  chemically synthesized
ctatgttgggatcacaagggca

SEQ ID NO: 1106026 - DNA, 22 bp, Artificial Sequence
  chemically synthesized
ctcctatgttgggatcacaagg

SEQ ID NO: 1106027 - DNA, 22 bp, Artificial Sequence
  chemically synthesized
tagatgctgcccttgtgatccc

SEQ ID NO: 1106028 - DNA, 22 bp, Artificial Sequence
  chemically synthesized
tgctcctatgttgggatcacaa

SEQ ID NO: 1106029 - DNA, 22 bp, Artificial Sequence
  chemically synthesized
ctgctcctatgttgggatcaca

SEQ ID NO: 1106030 - DNA, 22 bp, Artificial Sequence
  chemically synthesized
tttctgctcctatgttgggatc

SEQ ID NO: 1106031 - DNA, 22 bp, Artificial Sequence
  chemically synthesized
cccttgtgatcccaacatagga

SEQ ID NO: 1106032 - DNA, 22 bp, Artificial Sequence
  chemically synthesized
gtctatttctgctcctatgttg

SEQ ID NO: 1106033 - DNA, 22 bp, Artificial Sequence
  chemically synthesized
gtgatcccaacataggagcaga

SEQ ID NO: 1106034 - DNA, 22 bp, Artificial Sequence
  chemically synthesized
tgatcccaacataggagcagaa

SEQ ID NO: 1106035 - DNA, 22 bp, Artificial Sequence
  chemically synthesized
cgtagatggagctggtctattt

SEQ ID NO: 1106036 - DNA, 22 bp, Artificial Sequence
  chemically synthesized
ccgtagatggagctggtctatt

SEQ ID NO: 1106037 - DNA, 22 bp, Artificial Sequence
  chemically synthesized
cataaaaggaaaaaaagtgagt

SEQ ID NO: 1106038 - DNA, 22 bp, Artificial Sequence
  chemically synthesized
catctacggaaactcacttttt

SEQ ID NO: 1106039 - DNA, 22 bp, Artificial Sequence
  chemically synthesized
tacataaaaggaaaaaaagtga

SEQ ID NO: 1106040 - DNA, 22 bp, Artificial Sequence
  chemically synthesized
ctacataaaaggaaaaaaagtg

SEQ ID NO: 1106041 - DNA, 22 bp, Artificial Sequence
  chemically synthesized
tttctacataaaaggaaaaaaa

SEQ ID NO: 1106042 - DNA, 22 bp, Artificial Sequence
  chemically synthesized
cggaaactcactttttttcctt

SEQ ID NO: 1106043 - DNA, 22 bp, Artificial Sequence
  chemically synthesized
tatttctacataaaaggaaaaa

SEQ ID NO: 1106044 - DNA, 22 bp, Artificial Sequence
  chemically synthesized
atctctatttctacataaaagg

SEQ ID NO: 1106045 - DNA, 22 bp, Artificial Sequence
  chemically synthesized
actttttttccttttatgtaga

SEQ ID NO: 1106046 - DNA, 22 bp, Artificial Sequence
  chemically synthesized
ttaatctctatttctacataaa

SEQ ID NO: 1106047 - DNA, 22 bp, Artificial Sequence
  chemically synthesized
tttttccttttatgtagaaata

SEQ ID NO: 1106048 - DNA, 22 bp, Artificial Sequence
  chemically synthesized
ttttccttttatgtagaaatag

SEQ ID NO: 1106049 - DNA, 22 bp, Artificial Sequence
  chemically synthesized
gattattaatctctatttctac

SEQ ID NO: 1106050 - DNA, 22 bp, Artificial Sequence
  chemically synthesized
tttccttttatgtagaaataga

SEQ ID NO: 1106051 - DNA, 22 bp, Artificial Sequence
  chemically synthesized
ttccttttatgtagaaatagag

SEQ ID NO: 1106052 - DNA, 22 bp, Artificial Sequence
  chemically synthesized
tccttttatgtagaaatagaga

SEQ ID NO: 1106053 - DNA, 22 bp, Artificial Sequence
  chemically synthesized
ttggattattaatctctatttc

SEQ ID NO: 1106054 - DNA, 22 bp, Artificial Sequence
  chemically synthesized
ccttttatgtagaaatagagat

SEQ ID NO: 1106055 - DNA, 22 bp, Artificial Sequence
  chemically synthesized
cttttatgtagaaatagagatt

SEQ ID NO: 1106056 - DNA, 22 bp, Artificial Sequence
  chemically synthesized
tctgttggattattaatctcta

SEQ ID NO: 1106057 - DNA, 22 bp, Artificial Sequence
  chemically synthesized
ttatgtagaaatagagattaat

SEQ ID NO: 1106058 - DNA, 22 bp, Artificial Sequence
  chemically synthesized
atctgttggattattaatctct

SEQ ID NO: 1106059 - DNA, 22 bp, Artificial Sequence
  chemically synthesized
tatgtagaaatagagattaata

SEQ ID NO: 1106060 - DNA, 22 bp, Artificial Sequence
  chemically synthesized
atgtagaaatagagattaataa

SEQ ID NO: 1106061 - DNA, 22 bp, Artificial Sequence
  chemically synthesized
tgtagaaatagagattaataat

SEQ ID NO: 1106062 - DNA, 22 bp, Artificial Sequence
  chemically synthesized
tcagtaaagataaacttatctg

SEQ ID NO: 1106063 - DNA, 22 bp, Artificial Sequence
  chemically synthesized
ataatccaacagataagtttat

SEQ ID NO: 1106064 - DNA, 22 bp, Artificial Sequence
  chemically synthesized
ctgtcagtaaagataaacttat

SEQ ID NO: 1106065 - DNA, 22 bp, Artificial Sequence
  chemically synthesized
ttgctgtcagtaaagataaact

SEQ ID NO: 1106066 - DNA, 22 bp, Artificial Sequence
  chemically synthesized
attgctgtcagtaaagataaac

SEQ ID NO: 1106067 - DNA, 22 bp, Artificial Sequence
  chemically synthesized
tcttattgctgtcagtaaagat

SEQ ID NO: 1106068 - DNA, 22 bp, Artificial Sequence
  chemically synthesized
ttgtcttattgctgtcagtaaa

SEQ ID NO: 1106069 - DNA, 22 bp, Artificial Sequence
  chemically synthesized
attgtcttattgctgtcagtaa

SEQ ID NO: 1106070 - DNA, 22 bp, Artificial Sequence
  chemically synthesized
atctttactgacagcaataaga

SEQ ID NO: 1106071 - DNA, 22 bp, Artificial Sequence
  chemically synthesized
tctttactgacagcaataagac

SEQ ID NO: 1106072 - DNA, 22 bp, Artificial Sequence
  chemically synthesized
gatatgtttattgtcttattgc

SEQ ID NO: 1106073 - DNA, 22 bp, Artificial Sequence
  chemically synthesized
tactgacagcaataagacaata

SEQ ID NO: 1106074 - DNA, 22 bp, Artificial Sequence
  chemically synthesized
actgacagcaataagacaataa

SEQ ID NO: 1106075 - DNA, 22 bp, Artificial Sequence
  chemically synthesized
gattggatatgtttattgtctt

SEQ ID NO: 1106076 - DNA, 22 bp, Artificial Sequence
  chemically synthesized
ctgacagcaataagacaataaa

SEQ ID NO: 1106077 - DNA, 22 bp, Artificial Sequence
  chemically synthesized
ttagattggatatgtttattgt

SEQ ID NO: 1106078 - DNA, 22 bp, Artificial Sequence
  chemically synthesized
acagcaataagacaataaacat

SEQ ID NO: 1106079 - DNA, 22 bp, Artificial Sequence
  chemically synthesized
agatggtaggttattagattgg

SEQ ID NO: 1106080 - DNA, 22 bp, Artificial Sequence
  chemically synthesized
aagatggtaggttattagattg

SEQ ID NO: 1106081 - DNA, 22 bp, Artificial Sequence
  chemically synthesized
taagatggtaggttattagatt

SEQ ID NO: 1106082 - DNA, 22 bp, Artificial Sequence
  chemically synthesized
ttaagatggtaggttattagat

SEQ ID NO: 1106083 - DNA, 22 bp, Artificial Sequence
  chemically synthesized
gaggtcttttaagatggtaggt

SEQ ID NO: 1106084 - DNA, 22 bp, Artificial Sequence
  chemically synthesized
tcgaggtcttttaagatggtag

SEQ ID NO: 1106085 - DNA, 22 bp, Artificial Sequence
  chemically synthesized
ataacctaccatcttaaaagac

SEQ ID NO: 1106086 - DNA, 22 bp, Artificial Sequence
  chemically synthesized
ccatcttaaaagacctcgagag

SEQ ID NO: 1106087 - DNA, 22 bp, Artificial Sequence
  chemically synthesized
atgatgtcagtagaactctcga

SEQ ID NO: 1106088 - DNA, 22 bp, Artificial Sequence
  chemically synthesized
aaaagacctcgagagttctact

SEQ ID NO: 1106089 - DNA, 22 bp, Artificial Sequence
  chemically synthesized
aaagacctcgagagttctactg

SEQ ID NO: 1106090 - DNA, 22 bp, Artificial Sequence
  chemically synthesized
agtctaatgatgtcagtagaac

SEQ ID NO: 1106091 - DNA, 22 bp, Artificial Sequence
  chemically synthesized
tgctgagtctaatgatgtcagt

SEQ ID NO: 1106092 - DNA, 22 bp, Artificial Sequence
  chemically synthesized
gagagttctactgacatcatta

SEQ ID NO: 1106093 - DNA, 22 bp, Artificial Sequence
  chemically synthesized
agtctgtgctgagtctaatgat

SEQ ID NO: 1106094 - DNA, 22 bp, Artificial Sequence
  chemically synthesized
ctgagtctgtgctgagtctaat

SEQ ID NO: 1106095 - DNA, 22 bp, Artificial Sequence
  chemically synthesized
cctgagtctgtgctgagtctaa

SEQ ID NO: 1106096 - DNA, 22 bp, Artificial Sequence
  chemically synthesized
tactgacatcattagactcagc

SEQ ID NO: 1106097 - DNA, 22 bp, Artificial Sequence
  chemically synthesized
tcctgagtctgtgctgagtcta

SEQ ID NO: 1106098 - DNA, 22 bp, Artificial Sequence
  chemically synthesized
ttcctgagtctgtgctgagtct

SEQ ID NO: 1106099 - DNA, 22 bp, Artificial Sequence
  chemically synthesized
ctgacatcattagactcagcac

SEQ ID NO: 1106100 - DNA, 22 bp, Artificial Sequence
  chemically synthesized
acatcattagactcagcacaga

SEQ ID NO: 1106101 - DNA, 22 bp, Artificial Sequence
  chemically synthesized
aggccatatttttcctgagtct

SEQ ID NO: 1106102 - DNA, 22 bp, Artificial Sequence
  chemically synthesized
caggccatatttttcctgagtc

SEQ ID NO: 1106103 - DNA, 22 bp, Artificial Sequence
  chemically synthesized
gactcagcacagactcaggaaa

SEQ ID NO: 1106104 - DNA, 22 bp, Artificial Sequence
  chemically synthesized
agcacagactcaggaaaaatat

SEQ ID NO: 1106105 - DNA, 22 bp, Artificial Sequence
  chemically synthesized
aatcttcaggccatatttttcc

SEQ ID NO: 1106106 - DNA, 22 bp, Artificial Sequence
  chemically synthesized
aacgttaaatcttcaggccata

SEQ ID NO: 1106107 - DNA, 22 bp, Artificial Sequence
  chemically synthesized
aggaaaaatatggcctgaagat

SEQ ID NO: 1106108 - DNA, 22 bp, Artificial Sequence
  chemically synthesized
gctaaacgttaaatcttcaggc

SEQ ID NO: 1106109 - DNA, 22 bp, Artificial Sequence
  chemically synthesized
taagcaatatattggctaaacg

SEQ ID NO: 1106110 - DNA, 22 bp, Artificial Sequence
  chemically synthesized
ataagcaatatattggctaaac

SEQ ID NO: 1106111 - DNA, 22 bp, Artificial Sequence
  chemically synthesized
aagatttaacgtttagccaata

SEQ ID NO: 1106112 - DNA, 22 bp, Artificial Sequence
  chemically synthesized
catatttataagcaatatattg

SEQ ID NO: 1106113 - DNA, 22 bp, Artificial Sequence
  chemically synthesized
aacgtttagccaatatattgct

SEQ ID NO: 1106114 - DNA, 22 bp, Artificial Sequence
  chemically synthesized
acgtttagccaatatattgctt

SEQ ID NO: 1106115 - DNA, 22 bp, Artificial Sequence
  chemically synthesized
agccaatatattgcttataaat

SEQ ID NO: 1106116 - DNA, 22 bp, Artificial Sequence
  chemically synthesized
gccaatatattgcttataaata

SEQ ID NO: 1106117 - DNA, 22 bp, Artificial Sequence
  chemically synthesized
gagaaaaaagttacatatttat

SEQ ID NO: 1106118 - DNA, 22 bp, Artificial Sequence
  chemically synthesized
agagaaaaaagttacatattta

SEQ ID NO: 1106119 - DNA, 22 bp, Artificial Sequence
  chemically synthesized
tagagaaaaaagttacatattt

SEQ ID NO: 1106120 - DNA, 22 bp, Artificial Sequence
  chemically synthesized
tttagagaaaaaagttacatat

SEQ ID NO: 1106121 - DNA, 22 bp, Artificial Sequence
  chemically synthesized
ctttagagaaaaaagttacata

SEQ ID NO: 1106122 - DNA, 22 bp, Artificial Sequence
  chemically synthesized
tctttagagaaaaaagttacat

SEQ ID NO: 1106123 - DNA, 22 bp, Artificial Sequence
  chemically synthesized
cttataaatatgtaactttttt

SEQ ID NO: 1106124 - DNA, 22 bp, Artificial Sequence
  chemically synthesized
ataaatatgtaacttttttctc

SEQ ID NO: 1106125 - DNA, 22 bp, Artificial Sequence
  chemically synthesized
taaatatgtaacttttttctct

SEQ ID NO: 1106126 - DNA, 22 bp, Artificial Sequence
  chemically synthesized
tcataggaatactttctttaga

SEQ ID NO: 1106127 - DNA, 22 bp, Artificial Sequence
  chemically synthesized
ttttctctaaagaaagtattcc

SEQ ID NO: 1106128 - DNA, 22 bp, Artificial Sequence
  chemically synthesized
tttctctaaagaaagtattcct

SEQ ID NO: 1106129 - DNA, 22 bp, Artificial Sequence
  chemically synthesized
ttctctaaagaaagtattccta

SEQ ID NO: 1106130 - DNA, 22 bp, Artificial Sequence
  chemically synthesized
tctctaaagaaagtattcctat

SEQ ID NO: 1106131 - DNA, 22 bp, Artificial Sequence
  chemically synthesized
ctctaaagaaagtattcctatg

SEQ ID NO: 1106132 - DNA, 22 bp, Artificial Sequence
  chemically synthesized
tctaaagaaagtattcctatga

SEQ ID NO: 1106133 - DNA, 22 bp, Artificial Sequence
  chemically synthesized
taaagaaagtattcctatgaca

SEQ ID NO: 1106134 - DNA, 22 bp, Artificial Sequence
  chemically synthesized
aagaaagtattcctatgacagt

SEQ ID NO: 1106135 - DNA, 22 bp, Artificial Sequence
  chemically synthesized
gcagccgaatagtagaaactgt

SEQ ID NO: 1106136 - DNA, 22 bp, Artificial Sequence
  chemically synthesized
agcagccgaatagtagaaactg

SEQ ID NO: 1106137 - DNA, 22 bp, Artificial Sequence
  chemically synthesized
tagcagccgaatagtagaaact

SEQ ID NO: 1106138 - DNA, 22 bp, Artificial Sequence
  chemically synthesized
ctatgacagtttctactattcg

SEQ ID NO: 1106139 - DNA, 22 bp, Artificial Sequence
  chemically synthesized
tgacagtttctactattcggct

SEQ ID NO: 1106140 - DNA, 22 bp, Artificial Sequence
  chemically synthesized
aagtggtcctttagcagccgaa

SEQ ID NO: 1106141 - DNA, 22 bp, Artificial Sequence
  chemically synthesized
aaagtggtcctttagcagccga

SEQ ID NO: 1106142 - DNA, 22 bp, Artificial Sequence
  chemically synthesized
taaagtggtcctttagcagccg

SEQ ID NO: 1106143 - DNA, 22 bp, Artificial Sequence
  chemically synthesized
ttaaagtggtcctttagcagcc

SEQ ID NO: 1106144 - DNA, 22 bp, Artificial Sequence
  chemically synthesized
ctactattcggctgctaaagga

SEQ ID NO: 1106145 - DNA, 22 bp, Artificial Sequence
  chemically synthesized
tactattcggctgctaaaggac

SEQ ID NO: 1106146 - DNA, 22 bp, Artificial Sequence
  chemically synthesized
catttttaaagtggtcctttag

SEQ ID NO: 1106147 - DNA, 22 bp, Artificial Sequence
  chemically synthesized
ctattcggctgctaaaggacca

SEQ ID NO: 1106148 - DNA, 22 bp, Artificial Sequence
  chemically synthesized
ttcggctgctaaaggaccactt

SEQ ID NO: 1106149 - DNA, 22 bp, Artificial Sequence
  chemically synthesized
ggctgctaaaggaccactttaa

SEQ ID NO: 1106150 - DNA, 22 bp, Artificial Sequence
  chemically synthesized
ctaaaggaccactttaaaaatg

SEQ ID NO: 1106151 - DNA, 22 bp, Artificial Sequence
  chemically synthesized
aaggaccactttaaaaatgcag

SEQ ID NO: 1106152 - DNA, 22 bp, Artificial Sequence
  chemically synthesized
ataaaaccaaaaagatatctgc

SEQ ID NO: 1106153 - DNA, 22 bp, Artificial Sequence
  chemically synthesized
actaataaaaccaaaaagatat

SEQ ID NO: 1106154 - DNA, 22 bp, Artificial Sequence
  chemically synthesized
taaaaatgcagatatctttttg

SEQ ID NO: 1106155 - DNA, 22 bp, Artificial Sequence
  chemically synthesized
cactaataaaaccaaaaagata

SEQ ID NO: 1106156 - DNA, 22 bp, Artificial Sequence
  chemically synthesized
aaaaatgcagatatctttttgg

SEQ ID NO: 1106157 - DNA, 22 bp, Artificial Sequence
  chemically synthesized
aaaatgcagatatctttttggt

SEQ ID NO: 1106158 - DNA, 22 bp, Artificial Sequence
  chemically synthesized
aatatatttcactaataaaacc

SEQ ID NO: 1106159 - DNA, 22 bp, Artificial Sequence
  chemically synthesized
ttgaatatatttcactaataaa

SEQ ID NO: 1106160 - DNA, 22 bp, Artificial Sequence
  chemically synthesized
gttgaatatatttcactaataa

SEQ ID NO: 1106161 - DNA, 22 bp, Artificial Sequence
  chemically synthesized
tgttgaatatatttcactaata

SEQ ID NO: 1106162 - DNA, 22 bp, Artificial Sequence
  chemically synthesized
tttggttttattagtgaaatat

SEQ ID NO: 1106163 - DNA, 22 bp, Artificial Sequence
  chemically synthesized
attttgttgaatatatttcact

SEQ ID NO: 1106164 - DNA, 22 bp, Artificial Sequence
  chemically synthesized
ttggttttattagtgaaatata

SEQ ID NO: 1106165 - DNA, 22 bp, Artificial Sequence
  chemically synthesized
cattttgttgaatatatttcac

SEQ ID NO: 1106166 - DNA, 22 bp, Artificial Sequence
  chemically synthesized
tggttttattagtgaaatatat

SEQ ID NO: 1106167 - DNA, 22 bp, Artificial Sequence
  chemically synthesized
tcattttgttgaatatatttca

SEQ ID NO: 1106168 - DNA, 22 bp, Artificial Sequence
  chemically synthesized
ggttttattagtgaaatatatt

SEQ ID NO: 1106169 - DNA, 22 bp, Artificial Sequence
  chemically synthesized
gttttattagtgaaatatattc

SEQ ID NO: 1106170 - DNA, 22 bp, Artificial Sequence
  chemically synthesized
attttcattttgttgaatatat

SEQ ID NO: 1106171 - DNA, 22 bp, Artificial Sequence
  chemically synthesized
tattagtgaaatatattcaaca

SEQ ID NO: 1106172 - DNA, 22 bp, Artificial Sequence
  chemically synthesized
attagtgaaatatattcaacaa

SEQ ID NO: 1106173 - DNA, 22 bp, Artificial Sequence
  chemically synthesized
ttagtgaaatatattcaacaaa

SEQ ID NO: 1106174 - DNA, 22 bp, Artificial Sequence
  chemically synthesized
tattgattttcattttgttgaa

SEQ ID NO: 1106175 - DNA, 22 bp, Artificial Sequence
  chemically synthesized
atattgattttcattttgttga

SEQ ID NO: 1106176 - DNA, 22 bp, Artificial Sequence
  chemically synthesized
gtgaaatatattcaacaaaatg

SEQ ID NO: 1106177 - DNA, 22 bp, Artificial Sequence
  chemically synthesized
caatcacttatattgattttca

SEQ ID NO: 1106178 - DNA, 22 bp, Artificial Sequence
  chemically synthesized
gcaatcacttatattgattttc

SEQ ID NO: 1106179 - DNA, 22 bp, Artificial Sequence
  chemically synthesized
aacaaaatgaaaatcaatataa

SEQ ID NO: 1106180 - DNA, 22 bp, Artificial Sequence
  chemically synthesized
caagcttgcaatcacttatatt

SEQ ID NO: 1106181 - DNA, 22 bp, Artificial Sequence
  chemically synthesized
ccaagcttgcaatcacttatat

SEQ ID NO: 1106182 - DNA, 22 bp, Artificial Sequence
  chemically synthesized
cagcacgtgcttccaagcttgc

SEQ ID NO: 1106183 - DNA, 22 bp, Artificial Sequence
  chemically synthesized
acagcacgtgcttccaagcttg

SEQ ID NO: 1106184 - DNA, 22 bp, Artificial Sequence
  chemically synthesized
ccaataatttacagcacgtgct

SEQ ID NO: 1106185 - DNA, 22 bp, Artificial Sequence
  chemically synthesized
cccaataatttacagcacgtgc

SEQ ID NO: 1106186 - DNA, 22 bp, Artificial Sequence
  chemically synthesized
caagcttggaagcacgtgctgt

SEQ ID NO: 1106187 - DNA, 22 bp, Artificial Sequence
  chemically synthesized
tcccaataatttacagcacgtg

SEQ ID NO: 1106188 - DNA, 22 bp, Artificial Sequence
  chemically synthesized
ttttcccaataatttacagcac

SEQ ID NO: 1106189 - DNA, 22 bp, Artificial Sequence
  chemically synthesized
attttcccaataatttacagca

SEQ ID NO: 1106190 - DNA, 22 bp, Artificial Sequence
  chemically synthesized
tattttcccaataatttacagc

SEQ ID NO: 1106191 - DNA, 22 bp, Artificial Sequence
  chemically synthesized
ttattttcccaataatttacag

SEQ ID NO: 1106192 - DNA, 22 bp, Artificial Sequence
  chemically synthesized
ggaagcacgtgctgtaaattat

SEQ ID NO: 1106193 - DNA, 22 bp, Artificial Sequence
  chemically synthesized
gaagcacgtgctgtaaattatt

SEQ ID NO: 1106194 - DNA, 22 bp, Artificial Sequence
  chemically synthesized
atttttattttcccaataattt

SEQ ID NO: 1106195 - DNA, 22 bp, Artificial Sequence
  chemically synthesized
aatttttattttcccaataatt

SEQ ID NO: 1106196 - DNA, 22 bp, Artificial Sequence
  chemically synthesized
taaattattgggaaaataaaaa

SEQ ID NO: 1106197 - DNA, 22 bp, Artificial Sequence
  chemically synthesized
ttgggaaaataaaaattaaggg

SEQ ID NO: 1106198 - DNA, 22 bp, Artificial Sequence
  chemically synthesized
ggaaaataaaaattaagggctc

SEQ ID NO: 1106199 - DNA, 22 bp, Artificial Sequence
  chemically synthesized
aagataaacagtagtgcaggat

SEQ ID NO: 1106200 - DNA, 22 bp, Artificial Sequence
  chemically synthesized
caagataaacagtagtgcagga

SEQ ID NO: 1106201 - DNA, 22 bp, Artificial Sequence
  chemically synthesized
tcaagataaacagtagtgcagg

SEQ ID NO: 1106202 - DNA, 22 bp, Artificial Sequence
  chemically synthesized
agggctcctatcctgcactact

SEQ ID NO: 1106203 - DNA, 22 bp, Artificial Sequence
  chemically synthesized
ttcaagataaacagtagtgcag

SEQ ID NO: 1106204 - DNA, 22 bp, Artificial Sequence
  chemically synthesized
cttttcaagataaacagtagtg

SEQ ID NO: 1106205 - DNA, 22 bp, Artificial Sequence
  chemically synthesized
acttttcaagataaacagtagt

SEQ ID NO: 1106206 - DNA, 22 bp, Artificial Sequence
  chemically synthesized
tacttttcaagataaacagtag

SEQ ID NO: 1106207 - DNA, 22 bp, Artificial Sequence
  chemically synthesized
ttacttttcaagataaacagta

SEQ ID NO: 1106208 - DNA, 22 bp, Artificial Sequence
  chemically synthesized
ctatcctgcactactgtttatc

SEQ ID NO: 1106209 - DNA, 22 bp, Artificial Sequence
  chemically synthesized
tttacttttcaagataaacagt

SEQ ID NO: 1106210 - DNA, 22 bp, Artificial Sequence
  chemically synthesized
ttttacttttcaagataaacag

SEQ ID NO: 1106211 - DNA, 22 bp, Artificial Sequence
  chemically synthesized
tttttacttttcaagataaaca

SEQ ID NO: 1106212 - DNA, 22 bp, Artificial Sequence
  chemically synthesized
tcctgcactactgtttatcttg

SEQ ID NO: 1106213 - DNA, 22 bp, Artificial Sequence
  chemically synthesized
ttttttacttttcaagataaac

SEQ ID NO: 1106214 - DNA, 22 bp, Artificial Sequence
  chemically synthesized
tttttttacttttcaagataaa

SEQ ID NO: 1106215 - DNA, 22 bp, Artificial Sequence
  chemically synthesized
ttttttttacttttcaagataa

SEQ ID NO: 1106216 - DNA, 22 bp, Artificial Sequence
  chemically synthesized
cactactgtttatcttgaaaag

SEQ ID NO: 1106217 - DNA, 22 bp, Artificial Sequence
  chemically synthesized
ctgtttatcttgaaaagtaaaa

SEQ ID NO: 1106218 - DNA, 22 bp, Artificial Sequence
  chemically synthesized
atggaatttttttttttacttt

SEQ ID NO: 1106219 - DNA, 22 bp, Artificial Sequence
  chemically synthesized
tttatcttgaaaagtaaaaaaa

SEQ ID NO: 1106220 - DNA, 22 bp, Artificial Sequence
  chemically synthesized
atcttgaaaagtaaaaaaaaaa

SEQ ID NO: 1106221 - DNA, 22 bp, Artificial Sequence
  chemically synthesized
tcttgaaaagtaaaaaaaaaaa

SEQ ID NO: 1106222 - DNA, 22 bp, Artificial Sequence
  chemically synthesized
gatattaatggaattttttttt

SEQ ID NO: 1106223 - DNA, 22 bp, Artificial Sequence
  chemically synthesized
gaaaagtaaaaaaaaaaattcc

SEQ ID NO: 1106224 - DNA, 22 bp, Artificial Sequence
  chemically synthesized
aaaagtaaaaaaaaaaattcca

SEQ ID NO: 1106225 - DNA, 22 bp, Artificial Sequence
  chemically synthesized
aatgtctagatattaatggaat

SEQ ID NO: 1106226 - DNA, 22 bp, Artificial Sequence
  chemically synthesized
tattaaatgtctagatattaat

SEQ ID NO: 1106227 - DNA, 22 bp, Artificial Sequence
  chemically synthesized
acatggctatattaaatgtcta

SEQ ID NO: 1106228 - DNA, 22 bp, Artificial Sequence
  chemically synthesized
cattaatatctagacatttaat

SEQ ID NO: 1106229 - DNA, 22 bp, Artificial Sequence
  chemically synthesized
atatctagacatttaatatagc

SEQ ID NO: 1106230 - DNA, 22 bp, Artificial Sequence
  chemically synthesized
catccctcacatggctatatta

SEQ ID NO: 1106231 - DNA, 22 bp, Artificial Sequence
  chemically synthesized
ccatccctcacatggctatatt

SEQ ID NO: 1106232 - DNA, 22 bp, Artificial Sequence
  chemically synthesized
gacatttaatatagccatgtga

SEQ ID NO: 1106233 - DNA, 22 bp, Artificial Sequence
  chemically synthesized
tcacttccatccctcacatggc

SEQ ID NO: 1106234 - DNA, 22 bp, Artificial Sequence
  chemically synthesized
atcacttccatccctcacatgg

SEQ ID NO: 1106235 - DNA, 22 bp, Artificial Sequence
  chemically synthesized
tatcacttccatccctcacatg

SEQ ID NO: 1106236 - DNA, 22 bp, Artificial Sequence
  chemically synthesized
aatatagccatgtgagggatgg

SEQ ID NO: 1106237 - DNA, 22 bp, Artificial Sequence
  chemically synthesized
atatagccatgtgagggatgga

SEQ ID NO: 1106238 - DNA, 22 bp, Artificial Sequence
  chemically synthesized
tactttatcacttccatccctc

SEQ ID NO: 1106239 - DNA, 22 bp, Artificial Sequence
  chemically synthesized
cctatactttatcacttccatc

SEQ ID NO: 1106240 - DNA, 22 bp, Artificial Sequence
  chemically synthesized
gcctatactttatcacttccat

SEQ ID NO: 1106241 - DNA, 22 bp, Artificial Sequence
  chemically synthesized
gatgtcagtttgcctatacttt

SEQ ID NO: 1106242 - DNA, 22 bp, Artificial Sequence
  chemically synthesized
agatgtcagtttgcctatactt

SEQ ID NO: 1106243 - DNA, 22 bp, Artificial Sequence
  chemically synthesized
tagatgtcagtttgcctatact

SEQ ID NO: 1106244 - DNA, 22 bp, Artificial Sequence
  chemically synthesized
taattttagatgtcagtttgcc

SEQ ID NO: 1106245 - DNA, 22 bp, Artificial Sequence
  chemically synthesized
ctataattttagatgtcagttt

SEQ ID NO: 1106246 - DNA, 22 bp, Artificial Sequence
  chemically synthesized
actataattttagatgtcagtt

SEQ ID NO: 1106247 - DNA, 22 bp, Artificial Sequence
  chemically synthesized
tactataattttagatgtcagt

SEQ ID NO: 1106248 - DNA, 22 bp, Artificial Sequence
  chemically synthesized
ctttactataattttagatgtc

SEQ ID NO: 1106249 - DNA, 22 bp, Artificial Sequence
  chemically synthesized
tattcctttactataattttag

SEQ ID NO: 1106250 - DNA, 22 bp, Artificial Sequence
  chemically synthesized
gtattcctttactataatttta

SEQ ID NO: 1106251 - DNA, 22 bp, Artificial Sequence
  chemically synthesized
tgtattcctttactataatttt

SEQ ID NO: 1106252 - DNA, 22 bp, Artificial Sequence
  chemically synthesized
ttgtattcctttactataattt

SEQ ID NO: 1106253 - DNA, 22 bp, Artificial Sequence
  chemically synthesized
tttgtattcctttactataatt

SEQ ID NO: 1106254 - DNA, 22 bp, Artificial Sequence
  chemically synthesized
ttttgtattcctttactataat

SEQ ID NO: 1106255 - DNA, 22 bp, Artificial Sequence
  chemically synthesized
ttttttgtattcctttactata

SEQ ID NO: 1106256 - DNA, 22 bp, Artificial Sequence
  chemically synthesized
acatctaaaattatagtaaagg

SEQ ID NO: 1106257 - DNA, 22 bp, Artificial Sequence
  chemically synthesized
cttttttgtattcctttactat

SEQ ID NO: 1106258 - DNA, 22 bp, Artificial Sequence
  chemically synthesized
aaattatagtaaaggaatacaa

SEQ ID NO: 1106259 - DNA, 22 bp, Artificial Sequence
  chemically synthesized
tagtaaaggaatacaaaaaaga

SEQ ID NO: 1106260 - DNA, 22 bp, Artificial Sequence
  chemically synthesized
aacaaaaggtgcagaaaacttc

SEQ ID NO: 1106261 - DNA, 22 bp, Artificial Sequence
  chemically synthesized
aaacaaaaggtgcagaaaactt

SEQ ID NO: 1106262 - DNA, 22 bp, Artificial Sequence
  chemically synthesized
taaacaaaaggtgcagaaaact

SEQ ID NO: 1106263 - DNA, 22 bp, Artificial Sequence
  chemically synthesized
ttaaacaaaaggtgcagaaaac

SEQ ID NO: 1106264 - DNA, 22 bp, Artificial Sequence
  chemically synthesized
aagacaagcagtttttaaacaa

SEQ ID NO: 1106265 - DNA, 22 bp, Artificial Sequence
  chemically synthesized
tctgcaccttttgtttaaaaac

SEQ ID NO: 1106266 - DNA, 22 bp, Artificial Sequence
  chemically synthesized
ctgcaccttttgtttaaaaact

SEQ ID NO: 1106267 - DNA, 22 bp, Artificial Sequence
  chemically synthesized
tgcaccttttgtttaaaaactg

SEQ ID NO: 1106268 - DNA, 22 bp, Artificial Sequence
  chemically synthesized
caccttttgtttaaaaactgct

SEQ ID NO: 1106269 - DNA, 22 bp, Artificial Sequence
  chemically synthesized
agagttaaagacaagcagtttt

SEQ ID NO: 1106270 - DNA, 22 bp, Artificial Sequence
  chemically synthesized
aagagttaaagacaagcagttt

SEQ ID NO: 1106271 - DNA, 22 bp, Artificial Sequence
  chemically synthesized
taagagttaaagacaagcagtt

SEQ ID NO: 1106272 - DNA, 22 bp, Artificial Sequence
  chemically synthesized
ttaagagttaaagacaagcagt

SEQ ID NO: 1106273 - DNA, 22 bp, Artificial Sequence
  chemically synthesized
ttgtttaaaaactgcttgtctt

SEQ ID NO: 1106274 - DNA, 22 bp, Artificial Sequence
  chemically synthesized
ttttaagagttaaagacaagca

SEQ ID NO: 1106275 - DNA, 22 bp, Artificial Sequence
  chemically synthesized
tgtttaaaaactgcttgtcttt

SEQ ID NO: 1106276 - DNA, 22 bp, Artificial Sequence
  chemically synthesized
gtttaaaaactgcttgtcttta

SEQ ID NO: 1106277 - DNA, 22 bp, Artificial Sequence
  chemically synthesized
tttaaaaactgcttgtctttaa

SEQ ID NO: 1106278 - DNA, 22 bp, Artificial Sequence
  chemically synthesized
cctcttttaagagttaaagaca

SEQ ID NO: 1106279 - DNA, 22 bp, Artificial Sequence
  chemically synthesized
aaaaactgcttgtctttaactc

SEQ ID NO: 1106280 - DNA, 22 bp, Artificial Sequence
  chemically synthesized
aaaactgcttgtctttaactct

SEQ ID NO: 1106281 - DNA, 22 bp, Artificial Sequence
  chemically synthesized
gcccctccctcttttaagagtt

SEQ ID NO: 1106282 - DNA, 22 bp, Artificial Sequence
  chemically synthesized
agcccctccctcttttaagagt

SEQ ID NO: 1106283 - DNA, 22 bp, Artificial Sequence
  chemically synthesized
tagcccctccctcttttaagag

SEQ ID NO: 1106284 - DNA, 22 bp, Artificial Sequence
  chemically synthesized
cttgtctttaactcttaaaaga

SEQ ID NO: 1106285 - DNA, 22 bp, Artificial Sequence
  chemically synthesized
gtctttaactcttaaaagaggg

SEQ ID NO: 1106286 - DNA, 22 bp, Artificial Sequence
  chemically synthesized
cctttagcccctccctctttta

SEQ ID NO: 1106287 - DNA, 22 bp, Artificial Sequence
  chemically synthesized
tctttaactcttaaaagaggga

SEQ ID NO: 1106288 - DNA, 22 bp, Artificial Sequence
  chemically synthesized
ccctttagcccctccctctttt

SEQ ID NO: 1106289 - DNA, 22 bp, Artificial Sequence
  chemically synthesized
tccctttagcccctccctcttt

SEQ ID NO: 1106290 - DNA, 22 bp, Artificial Sequence
  chemically synthesized
ttccctttagcccctccctctt

SEQ ID NO: 1106291 - DNA, 22 bp, Artificial Sequence
  chemically synthesized
taactcttaaaagagggagggg

SEQ ID NO: 1106292 - DNA, 22 bp, Artificial Sequence
  chemically synthesized
ttttccctttagcccctccctc

SEQ ID NO: 1106293 - DNA, 22 bp, Artificial Sequence
  chemically synthesized
aactcttaaaagagggaggggc

SEQ ID NO: 1106294 - DNA, 22 bp, Artificial Sequence
  chemically synthesized
cttttccctttagcccctccct

SEQ ID NO: 1106295 - DNA, 22 bp, Artificial Sequence
  chemically synthesized
actcttaaaagagggaggggct

SEQ ID NO: 1106296 - DNA, 22 bp, Artificial Sequence
  chemically synthesized
ttcttttccctttagcccctcc

SEQ ID NO: 1106297 - DNA, 22 bp, Artificial Sequence
  chemically synthesized
tcttcttttccctttagcccct

SEQ ID NO: 1106298 - DNA, 22 bp, Artificial Sequence
  chemically synthesized
ttaaaagagggaggggctaaag

SEQ ID NO: 1106299 - DNA, 22 bp, Artificial Sequence
  chemically synthesized
tctcttcttttccctttagccc

SEQ ID NO: 1106300 - DNA, 22 bp, Artificial Sequence
  chemically synthesized
aaaagagggaggggctaaaggg

SEQ ID NO: 1106301 - DNA, 22 bp, Artificial Sequence
  chemically synthesized
ctctcttcttttccctttagcc

SEQ ID NO: 1106302 - DNA, 22 bp, Artificial Sequence
  chemically synthesized
aaagagggaggggctaaaggga

SEQ ID NO: 1106303 - DNA, 22 bp, Artificial Sequence
  chemically synthesized
tctctcttcttttccctttagc

SEQ ID NO: 1106304 - DNA, 22 bp, Artificial Sequence
  chemically synthesized
ttctctcttcttttccctttag

SEQ ID NO: 1106305 - DNA, 22 bp, Artificial Sequence
  chemically synthesized
tttctctcttcttttcccttta

SEQ ID NO: 1106306 - DNA, 22 bp, Artificial Sequence
  chemically synthesized
ttttctctcttcttttcccttt

SEQ ID NO: 1106307 - DNA, 22 bp, Artificial Sequence
  chemically synthesized
cttttttctctcttcttttccc

SEQ ID NO: 1106308 - DNA, 22 bp, Artificial Sequence
  chemically synthesized
tccttttttctctcttcttttc

SEQ ID NO: 1106309 - DNA, 22 bp, Artificial Sequence
  chemically synthesized
ctctccttttttctctcttctt

SEQ ID NO: 1106310 - DNA, 22 bp, Artificial Sequence
  chemically synthesized
gctctccttttttctctcttct

SEQ ID NO: 1106311 - DNA, 22 bp, Artificial Sequence
  chemically synthesized
tgctctccttttttctctcttc

SEQ ID NO: 1106312 - DNA, 22 bp, Artificial Sequence
  chemically synthesized
aagggaaaagaagagagaaaaa

SEQ ID NO: 1106313 - DNA, 22 bp, Artificial Sequence
  chemically synthesized
tcctttgctctccttttttctc

SEQ ID NO: 1106314 - DNA, 22 bp, Artificial Sequence
  chemically synthesized
gtctgtcctttgctctcctttt

SEQ ID NO: 1106315 - DNA, 22 bp, Artificial Sequence
  chemically synthesized
ggtctgtcctttgctctccttt

SEQ ID NO: 1106316 - DNA, 22 bp, Artificial Sequence
  chemically synthesized
ttggtctgtcctttgctctcct

SEQ ID NO: 1106317 - DNA, 22 bp, Artificial Sequence
  chemically synthesized
tcttggtctgtcctttgctctc

SEQ ID NO: 1106318 - DNA, 22 bp, Artificial Sequence
  chemically synthesized
cctctcttggtctgtcctttgc

SEQ ID NO: 1106319 - DNA, 22 bp, Artificial Sequence
  chemically synthesized
gcctctcttggtctgtcctttg

SEQ ID NO: 1106320 - DNA, 22 bp, Artificial Sequence
  chemically synthesized
tgcctctcttggtctgtccttt

SEQ ID NO: 1106321 - DNA, 22 bp, Artificial Sequence
  chemically synthesized
ctttgcctctcttggtctgtcc

SEQ ID NO: 1106322 - DNA, 22 bp, Artificial Sequence
  chemically synthesized
gctttgcctctcttggtctgtc

SEQ ID NO: 1106323 - DNA, 22 bp, Artificial Sequence
  chemically synthesized
tcacaaaagaatcttgctttgc

SEQ ID NO: 1106324 - DNA, 22 bp, Artificial Sequence
  chemically synthesized
ttatcacaaaagaatcttgctt

SEQ ID NO: 1106325 - DNA, 22 bp, Artificial Sequence
  chemically synthesized
gttatcacaaaagaatcttgct

SEQ ID NO: 1106326 - DNA, 22 bp, Artificial Sequence
  chemically synthesized
tgttatcacaaaagaatcttgc

SEQ ID NO: 1106327 - DNA, 22 bp, Artificial Sequence
  chemically synthesized
ttgttatcacaaaagaatcttg

SEQ ID NO: 1106328 - DNA, 22 bp, Artificial Sequence
  chemically synthesized
ttttgttatcacaaaagaatct

SEQ ID NO: 1106329 - DNA, 22 bp, Artificial Sequence
  chemically synthesized
gctcttttgttatcacaaaaga

SEQ ID NO: 1106330 - DNA, 22 bp, Artificial Sequence
  chemically synthesized
agctcttttgttatcacaaaag

SEQ ID NO: 1106331 - DNA, 22 bp, Artificial Sequence
  chemically synthesized
atacttagctcttttgttatca

SEQ ID NO: 1106332 - DNA, 22 bp, Artificial Sequence
  chemically synthesized
catacttagctcttttgttatc

SEQ ID NO: 1106333 - DNA, 22 bp, Artificial Sequence
  chemically synthesized
atttcatacttagctcttttgt

SEQ ID NO: 1106334 - DNA, 22 bp, Artificial Sequence
  chemically synthesized
ttttgtgataacaaaagagcta

SEQ ID NO: 1106335 - DNA, 22 bp, Artificial Sequence
  chemically synthesized
ttgtgataacaaaagagctaag

SEQ ID NO: 1106336 - DNA, 22 bp, Artificial Sequence
  chemically synthesized
tgtgataacaaaagagctaagt

SEQ ID NO: 1106337 - DNA, 22 bp, Artificial Sequence
  chemically synthesized
gtgataacaaaagagctaagta

SEQ ID NO: 1106338 - DNA, 22 bp, Artificial Sequence
  chemically synthesized
tgataacaaaagagctaagtat

SEQ ID NO: 1106339 - DNA, 22 bp, Artificial Sequence
  chemically synthesized
gaaaatgtagcatctaatttca

SEQ ID NO: 1106340 - DNA, 22 bp, Artificial Sequence
  chemically synthesized
agtatgaaattagatgctacat

SEQ ID NO: 1106341 - DNA, 22 bp, Artificial Sequence
  chemically synthesized
atgtgtattagaaaatgtagca

SEQ ID NO: 1106342 - DNA, 22 bp, Artificial Sequence
  chemically synthesized
gatgctacattttctaatacac

SEQ ID NO: 1106343 - DNA, 22 bp, Artificial Sequence
  chemically synthesized
acatagactcatgtgtattaga

SEQ ID NO: 1106344 - DNA, 22 bp, Artificial Sequence
  chemically synthesized
gacatagactcatgtgtattag

SEQ ID NO: 1106345 - DNA, 22 bp, Artificial Sequence
  chemically synthesized
cccttgacatagactcatgtgt

SEQ ID NO: 1106346 - DNA, 22 bp, Artificial Sequence
  chemically synthesized
cattttctaatacacatgagtc

SEQ ID NO: 1106347 - DNA, 22 bp, Artificial Sequence
  chemically synthesized
gcccttgacatagactcatgtg

SEQ ID NO: 1106348 - DNA, 22 bp, Artificial Sequence
  chemically synthesized
tctaatacacatgagtctatgt

SEQ ID NO: 1106349 - DNA, 22 bp, Artificial Sequence
  chemically synthesized
ctaatacacatgagtctatgtc

SEQ ID NO: 1106350 - DNA, 22 bp, Artificial Sequence
  chemically synthesized
taatacacatgagtctatgtca

SEQ ID NO: 1106351 - DNA, 22 bp, Artificial Sequence
  chemically synthesized
atacacatgagtctatgtcaag

SEQ ID NO: 1106352 - DNA, 22 bp, Artificial Sequence
  chemically synthesized
aagtggtttgcccttgacatag

SEQ ID NO: 1106353 - DNA, 22 bp, Artificial Sequence
  chemically synthesized
cagttaaagtggtttgcccttg

SEQ ID NO: 1106354 - DNA, 22 bp, Artificial Sequence
  chemically synthesized
ccagttaaagtggtttgccctt

SEQ ID NO: 1106355 - DNA, 22 bp, Artificial Sequence
  chemically synthesized
tccagttaaagtggtttgccct

SEQ ID NO: 1106356 - DNA, 22 bp, Artificial Sequence
  chemically synthesized
ctttccagttaaagtggtttgc

SEQ ID NO: 1106357 - DNA, 22 bp, Artificial Sequence
  chemically synthesized
gctttccagttaaagtggtttg

SEQ ID NO: 1106358 - DNA, 22 bp, Artificial Sequence
  chemically synthesized
tgctttccagttaaagtggttt

SEQ ID NO: 1106359 - DNA, 22 bp, Artificial Sequence
  chemically synthesized
tgtcaagggcaaaccactttaa

SEQ ID NO: 1106360 - DNA, 22 bp, Artificial Sequence
  chemically synthesized
ctttgctttccagttaaagtgg

SEQ ID NO: 1106361 - DNA, 22 bp, Artificial Sequence
  chemically synthesized
actttgctttccagttaaagtg

SEQ ID NO: 1106362 - DNA, 22 bp, Artificial Sequence
  chemically synthesized
tttactttgctttccagttaaa

SEQ ID NO: 1106363 - DNA, 22 bp, Artificial Sequence
  chemically synthesized
tgtttactttgctttccagtta

SEQ ID NO: 1106364 - DNA, 22 bp, Artificial Sequence
  chemically synthesized
tctgtttactttgctttccagt

SEQ ID NO: 1106365 - DNA, 22 bp, Artificial Sequence
  chemically synthesized
ctctgtttactttgctttccag

SEQ ID NO: 1106366 - DNA, 22 bp, Artificial Sequence
  chemically synthesized
taactggaaagcaaagtaaaca

SEQ ID NO: 1106367 - DNA, 22 bp, Artificial Sequence
  chemically synthesized
aatatacttctctgtttacttt

SEQ ID NO: 1106368 - DNA, 22 bp, Artificial Sequence
  chemically synthesized
aactggaaagcaaagtaaacag

SEQ ID NO: 1106369 - DNA, 22 bp, Artificial Sequence
  chemically synthesized
caatatacttctctgtttactt

SEQ ID NO: 1106370 - DNA, 22 bp, Artificial Sequence
  chemically synthesized
actggaaagcaaagtaaacaga

SEQ ID NO: 1106371 - DNA, 22 bp, Artificial Sequence
  chemically synthesized
tcaatatacttctctgtttact

SEQ ID NO: 1106372 - DNA, 22 bp, Artificial Sequence
  chemically synthesized
gaaagcaaagtaaacagagaag

SEQ ID NO: 1106373 - DNA, 22 bp, Artificial Sequence
  chemically synthesized
agaattttcaatatacttctct

SEQ ID NO: 1106374 - DNA, 22 bp, Artificial Sequence
  chemically synthesized
tcagaattttcaatatacttct

SEQ ID NO: 1106375 - DNA, 22 bp, Artificial Sequence
  chemically synthesized
tgtctctcagaattttcaatat

SEQ ID NO: 1106376 - DNA, 22 bp, Artificial Sequence
  chemically synthesized
gatagttatgtctctcagaatt

SEQ ID NO: 1106377 - DNA, 22 bp, Artificial Sequence
  chemically synthesized
tctcgatagttatgtctctcag

SEQ ID NO: 1106378 - DNA, 22 bp, Artificial Sequence
  chemically synthesized
atctcgatagttatgtctctca

SEQ ID NO: 1106379 - DNA, 22 bp, Artificial Sequence
  chemically synthesized
tatctcgatagttatgtctctc

SEQ ID NO: 1106380 - DNA, 22 bp, Artificial Sequence
  chemically synthesized
tttatctcgatagttatgtctc

SEQ ID NO: 1106381 - DNA, 22 bp, Artificial Sequence
  chemically synthesized
aaaattctgagagacataacta

SEQ ID NO: 1106382 - DNA, 22 bp, Artificial Sequence
  chemically synthesized
gtatctctttatctcgatagtt

SEQ ID NO: 1106383 - DNA, 22 bp, Artificial Sequence
  chemically synthesized
tgagagacataactatcgagat

SEQ ID NO: 1106384 - DNA, 22 bp, Artificial Sequence
  chemically synthesized
tggtatctctttatctcgatag

SEQ ID NO: 1106385 - DNA, 22 bp, Artificial Sequence
  chemically synthesized
agagacataactatcgagataa

SEQ ID NO: 1106386 - DNA, 22 bp, Artificial Sequence
  chemically synthesized
ctctggtatctctttatctcga

SEQ ID NO: 1106387 - DNA, 22 bp, Artificial Sequence
  chemically synthesized
tcgagataaagagataccagag

SEQ ID NO: 1106388 - DNA, 22 bp, Artificial Sequence
  chemically synthesized
tatataaccgattgctctggta

SEQ ID NO: 1106389 - DNA, 22 bp, Artificial Sequence
  chemically synthesized
agtaaagtgttatatataaccg

SEQ ID NO: 1106390 - DNA, 22 bp, Artificial Sequence
  chemically synthesized
cagtaaagtgttatatataacc

SEQ ID NO: 1106391 - DNA, 22 bp, Artificial Sequence
  chemically synthesized
tcagtaaagtgttatatataac

SEQ ID NO: 1106392 - DNA, 22 bp, Artificial Sequence
  chemically synthesized
ttcagtaaagtgttatatataa

SEQ ID NO: 1106393 - DNA, 22 bp, Artificial Sequence
  chemically synthesized
tttcagtaaagtgttatatata

SEQ ID NO: 1106394 - DNA, 22 bp, Artificial Sequence
  chemically synthesized
ttttcagtaaagtgttatatat

SEQ ID NO: 1106395 - DNA, 22 bp, Artificial Sequence
  chemically synthesized
tttttcagtaaagtgttatata

SEQ ID NO: 1106396 - DNA, 22 bp, Artificial Sequence
  chemically synthesized
ttttttcagtaaagtgttatat

SEQ ID NO: 1106397 - DNA, 22 bp, Artificial Sequence
  chemically synthesized
tttttttcagtaaagtgttata

SEQ ID NO: 1106398 - DNA, 22 bp, Artificial Sequence
  chemically synthesized
tatataacactttactgaaaaa

SEQ ID NO: 1106399 - DNA, 22 bp, Artificial Sequence
  chemically synthesized
aagaggagagattttttttttc

SEQ ID NO: 1106400 - DNA, 22 bp, Artificial Sequence
  chemically synthesized
caagaggagagatttttttttt

SEQ ID NO: 1106401 - DNA, 22 bp, Artificial Sequence
  chemically synthesized
tcaagaggagagattttttttt

SEQ ID NO: 1106402 - DNA, 22 bp, Artificial Sequence
  chemically synthesized
ttcaagaggagagatttttttt

SEQ ID NO: 1106403 - DNA, 22 bp, Artificial Sequence
  chemically synthesized
tttttcaagaggagagattttt

SEQ ID NO: 1106404 - DNA, 22 bp, Artificial Sequence
  chemically synthesized
tactgaaaaaaaaaatctctcc

SEQ ID NO: 1106405 - DNA, 22 bp, Artificial Sequence
  chemically synthesized
tatttttcaagaggagagattt

SEQ ID NO: 1106406 - DNA, 22 bp, Artificial Sequence
  chemically synthesized
actgaaaaaaaaaatctctcct

SEQ ID NO: 1106407 - DNA, 22 bp, Artificial Sequence
  chemically synthesized
ctgaaaaaaaaaatctctcctc

SEQ ID NO: 1106408 - DNA, 22 bp, Artificial Sequence
  chemically synthesized
aaaaaaaaaatctctcctcttg

SEQ ID NO: 1106409 - DNA, 22 bp, Artificial Sequence
  chemically synthesized
agtagttctatttttcaagagg

SEQ ID NO: 1106410 - DNA, 22 bp, Artificial Sequence
  chemically synthesized
tgagtagttctatttttcaaga

SEQ ID NO: 1106411 - DNA, 22 bp, Artificial Sequence
  chemically synthesized
ctgagtagttctatttttcaag

SEQ ID NO: 1106412 - DNA, 22 bp, Artificial Sequence
  chemically synthesized
tctgagtagttctatttttcaa

SEQ ID NO: 1106413 - DNA, 22 bp, Artificial Sequence
  chemically synthesized
ttttctgagtagttctattttt

SEQ ID NO: 1106414 - DNA, 22 bp, Artificial Sequence
  chemically synthesized
tcctcttgaaaaatagaactac

SEQ ID NO: 1106415 - DNA, 22 bp, Artificial Sequence
  chemically synthesized
ctcttgaaaaatagaactactc

SEQ ID NO: 1106416 - DNA, 22 bp, Artificial Sequence
  chemically synthesized
agtgcctattttctgagtagtt

SEQ ID NO: 1106417 - DNA, 22 bp, Artificial Sequence
  chemically synthesized
ttgaaaaatagaactactcaga

SEQ ID NO: 1106418 - DNA, 22 bp, Artificial Sequence
  chemically synthesized
aagtgcctattttctgagtagt

SEQ ID NO: 1106419 - DNA, 22 bp, Artificial Sequence
  chemically synthesized
gaaaaatagaactactcagaaa

SEQ ID NO: 1106420 - DNA, 22 bp, Artificial Sequence
  chemically synthesized
aaaaatagaactactcagaaaa

SEQ ID NO: 1106421 - DNA, 22 bp, Artificial Sequence
  chemically synthesized
atgcttaagtgcctattttctg

SEQ ID NO: 1106422 - DNA, 22 bp, Artificial Sequence
  chemically synthesized
tgatgcttaagtgcctattttc

SEQ ID NO: 1106423 - DNA, 22 bp, Artificial Sequence
  chemically synthesized
tctgatgcttaagtgcctattt

SEQ ID NO: 1106424 - DNA, 22 bp, Artificial Sequence
  chemically synthesized
ctcagaaaataggcacttaagc

SEQ ID NO: 1106425 - DNA, 22 bp, Artificial Sequence
  chemically synthesized
tacattctctgatgcttaagtg

SEQ ID NO: 1106426 - DNA, 22 bp, Artificial Sequence
  chemically synthesized
agaaaataggcacttaagcatc

SEQ ID NO: 1106427 - DNA, 22 bp, Artificial Sequence
  chemically synthesized
ttgtacattctctgatgcttaa

SEQ ID NO: 1106428 - DNA, 22 bp, Artificial Sequence
  chemically synthesized
tattgtacattctctgatgctt

SEQ ID NO: 1106429 - DNA, 22 bp, Artificial Sequence
  chemically synthesized
tctattgtacattctctgatgc

SEQ ID NO: 1106430 - DNA, 22 bp, Artificial Sequence
  chemically synthesized
tctctattgtacattctctgat

SEQ ID NO: 1106431 - DNA, 22 bp, Artificial Sequence
  chemically synthesized
ctctctattgtacattctctga

SEQ ID NO: 1106432 - DNA, 22 bp, Artificial Sequence
  chemically synthesized
cttctctctattgtacattctc

SEQ ID NO: 1106433 - DNA, 22 bp, Artificial Sequence
  chemically synthesized
ccttctctctattgtacattct

SEQ ID NO: 1106434 - DNA, 22 bp, Artificial Sequence
  chemically synthesized
aagcatcagagaatgtacaata

SEQ ID NO: 1106435 - DNA, 22 bp, Artificial Sequence
  chemically synthesized
agcatcagagaatgtacaatag

SEQ ID NO: 1106436 - DNA, 22 bp, Artificial Sequence
  chemically synthesized
cgtcttccttctctctattgta

SEQ ID NO: 1106437 - DNA, 22 bp, Artificial Sequence
  chemically synthesized
gcacagttacgtcttccttctc

SEQ ID NO: 1106438 - DNA, 22 bp, Artificial Sequence
  chemically synthesized
gttggcacagttacgtcttcct

SEQ ID NO: 1106439 - DNA, 22 bp, Artificial Sequence
  chemically synthesized
ttggttggcacagttacgtctt

SEQ ID NO: 1106440 - DNA, 22 bp, Artificial Sequence
  chemically synthesized
attggttggcacagttacgtct

SEQ ID NO: 1106441 - DNA, 22 bp, Artificial Sequence
  chemically synthesized
ccttattggttggcacagttac

SEQ ID NO: 1106442 - DNA, 22 bp, Artificial Sequence
  chemically synthesized
ctaccttattggttggcacagt

SEQ ID NO: 1106443 - DNA, 22 bp, Artificial Sequence
  chemically synthesized
tgccaaccaataaggtagcaac

SEQ ID NO: 1106444 - DNA, 22 bp, Artificial Sequence
  chemically synthesized
acggacgggtagccagttgcta

SEQ ID NO: 1106445 - DNA, 22 bp, Artificial Sequence
  chemically synthesized
aacggacgggtagccagttgct

SEQ ID NO: 1106446 - DNA, 22 bp, Artificial Sequence
  chemically synthesized
aagtgcttaacggacgggtagc

SEQ ID NO: 1106447 - DNA, 22 bp, Artificial Sequence
  chemically synthesized
caagtgcttaacggacgggtag

SEQ ID NO: 1106448 - DNA, 22 bp, Artificial Sequence
  chemically synthesized
gccacgtttcaagtgcttaacg

SEQ ID NO: 1106449 - DNA, 22 bp, Artificial Sequence
  chemically synthesized
gctacccgtccgttaagcactt

SEQ ID NO: 1106450 - DNA, 22 bp, Artificial Sequence
  chemically synthesized
cccgtccgttaagcacttgaaa

SEQ ID NO: 1106451 - DNA, 22 bp, Artificial Sequence
  chemically synthesized
aaactggccacgtttcaagtgc

SEQ ID NO: 1106452 - DNA, 22 bp, Artificial Sequence
  chemically synthesized
aactcaaactggccacgtttca

SEQ ID NO: 1106453 - DNA, 22 bp, Artificial Sequence
  chemically synthesized
agcacttgaaacgtggccagtt

SEQ ID NO: 1106454 - DNA, 22 bp, Artificial Sequence
  chemically synthesized
gaaacgtggccagtttgagttg

SEQ ID NO: 1106455 - DNA, 22 bp, Artificial Sequence
  chemically synthesized
aaacgtggccagtttgagttga

SEQ ID NO: 1106456 - DNA, 22 bp, Artificial Sequence
  chemically synthesized
tatatacaaaacatctcaactc

SEQ ID NO: 1106457 - DNA, 22 bp, Artificial Sequence
  chemically synthesized
atatatacaaaacatctcaact

SEQ ID NO: 1106458 - DNA, 22 bp, Artificial Sequence
  chemically synthesized
tatatatacaaaacatctcaac

SEQ ID NO: 1106459 - DNA, 22 bp, Artificial Sequence
  chemically synthesized
gtgtgtctttatatatacaaaa

SEQ ID NO: 1106460 - DNA, 22 bp, Artificial Sequence
  chemically synthesized
gagttgagatgttttgtatata

SEQ ID NO: 1106461 - DNA, 22 bp, Artificial Sequence
  chemically synthesized
agttgagatgttttgtatatat

SEQ ID NO: 1106462 - DNA, 22 bp, Artificial Sequence
  chemically synthesized
agatgttttgtatatataaaga

SEQ ID NO: 1106463 - DNA, 22 bp, Artificial Sequence
  chemically synthesized
tccaatatctggtgtgtcttta

SEQ ID NO: 1106464 - DNA, 22 bp, Artificial Sequence
  chemically synthesized
tgtatatataaagacacaccag

SEQ ID NO: 1106465 - DNA, 22 bp, Artificial Sequence
  chemically synthesized
gtatatataaagacacaccaga

SEQ ID NO: 1106466 - DNA, 22 bp, Artificial Sequence
  chemically synthesized
tatatataaagacacaccagat

SEQ ID NO: 1106467 - DNA, 22 bp, Artificial Sequence
  chemically synthesized
tatgaactgtccaatatctggt

SEQ ID NO: 1106468 - DNA, 22 bp, Artificial Sequence
  chemically synthesized
gtatgaactgtccaatatctgg

SEQ ID NO: 1106469 - DNA, 22 bp, Artificial Sequence
  chemically synthesized
tgtatgaactgtccaatatctg

SEQ ID NO: 1106470 - DNA, 22 bp, Artificial Sequence
  chemically synthesized
ttgtatgaactgtccaatatct

SEQ ID NO: 1106471 - DNA, 22 bp, Artificial Sequence
  chemically synthesized
tttgtatgaactgtccaatatc

SEQ ID NO: 1106472 - DNA, 22 bp, Artificial Sequence
  chemically synthesized
tttttgtatgaactgtccaata

SEQ ID NO: 1106473 - DNA, 22 bp, Artificial Sequence
  chemically synthesized
cattctttttgtatgaactgtc

SEQ ID NO: 1106474 - DNA, 22 bp, Artificial Sequence
  chemically synthesized
acattctttttgtatgaactgt

SEQ ID NO: 1106475 - DNA, 22 bp, Artificial Sequence
  chemically synthesized
tacattctttttgtatgaactg

SEQ ID NO: 1106476 - DNA, 22 bp, Artificial Sequence
  chemically synthesized
gacagttcatacaaaaagaatg

SEQ ID NO: 1106477 - DNA, 22 bp, Artificial Sequence
  chemically synthesized
aaatgtggaaatagctttacat

SEQ ID NO: 1106478 - DNA, 22 bp, Artificial Sequence
  chemically synthesized
atacaaaaagaatgtaaagcta

SEQ ID NO: 1106479 - DNA, 22 bp, Artificial Sequence
  chemically synthesized
aaaatgtggaaatagctttaca

SEQ ID NO: 1106480 - DNA, 22 bp, Artificial Sequence
  chemically synthesized
taaaatgtggaaatagctttac

SEQ ID NO: 1106481 - DNA, 22 bp, Artificial Sequence
  chemically synthesized
aaattttaaaatgtggaaatag

SEQ ID NO: 1106482 - DNA, 22 bp, Artificial Sequence
  chemically synthesized
gaattaaaattttaaaatgtgg

SEQ ID NO: 1106483 - DNA, 22 bp, Artificial Sequence
  chemically synthesized
agaattaaaattttaaaatgtg

SEQ ID NO: 1106484 - DNA, 22 bp, Artificial Sequence
  chemically synthesized
atcttagaattaaaattttaaa

SEQ ID NO: 1106485 - DNA, 22 bp, Artificial Sequence
  chemically synthesized
catcttagaattaaaattttaa

SEQ ID NO: 1106486 - DNA, 22 bp, Artificial Sequence
  chemically synthesized
tttccacattttaaaattttaa

SEQ ID NO: 1106487 - DNA, 22 bp, Artificial Sequence
  chemically synthesized
tttcatcttagaattaaaattt

SEQ ID NO: 1106488 - DNA, 22 bp, Artificial Sequence
  chemically synthesized
ccacattttaaaattttaattc

SEQ ID NO: 1106489 - DNA, 22 bp, Artificial Sequence
  chemically synthesized
cacattttaaaattttaattct

SEQ ID NO: 1106490 - DNA, 22 bp, Artificial Sequence
  chemically synthesized
aaaatattgtttcatcttagaa

SEQ ID NO: 1106491 - DNA, 22 bp, Artificial Sequence
  chemically synthesized
taaaattttaattctaagatga

SEQ ID NO: 1106492 - DNA, 22 bp, Artificial Sequence
  chemically synthesized
gaaaatattgtttcatcttaga

SEQ ID NO: 1106493 - DNA, 22 bp, Artificial Sequence
  chemically synthesized
aaaattttaattctaagatgaa

SEQ ID NO: 1106494 - DNA, 22 bp, Artificial Sequence
  chemically synthesized
aaattttaattctaagatgaaa

SEQ ID NO: 1106495 - DNA, 22 bp, Artificial Sequence
  chemically synthesized
taattctaagatgaaacaatat

SEQ ID NO: 1106496 - DNA, 22 bp, Artificial Sequence
  chemically synthesized
aattctaagatgaaacaatatt

SEQ ID NO: 1106497 - DNA, 22 bp, Artificial Sequence
  chemically synthesized
attctaagatgaaacaatattt

SEQ ID NO: 1106498 - DNA, 22 bp, Artificial Sequence
  chemically synthesized
taagatgaaacaatattttcaa

SEQ ID NO: 1106499 - DNA, 22 bp, Artificial Sequence
  chemically synthesized
agatgaaacaatattttcaaat

SEQ ID NO: 1106500 - DNA, 22 bp, Artificial Sequence
  chemically synthesized
acagatcaacaggtaaaagtca

SEQ ID NO: 1106501 - DNA, 22 bp, Artificial Sequence
  chemically synthesized
tcaaatgacttttacctgttga

SEQ ID NO: 1106502 - DNA, 22 bp, Artificial Sequence
  chemically synthesized
caaatgacttttacctgttgat

SEQ ID NO: 1106503 - DNA, 22 bp, Artificial Sequence
  chemically synthesized
aaatgacttttacctgttgatc

SEQ ID NO: 1106504 - DNA, 22 bp, Artificial Sequence
  chemically synthesized
gaaaccacattaacagatcaac

SEQ ID NO: 1106505 - DNA, 22 bp, Artificial Sequence
  chemically synthesized
tagaaaccacattaacagatca

SEQ ID NO: 1106506 - DNA, 22 bp, Artificial Sequence
  chemically synthesized
ttacctgttgatctgttaatgt

SEQ ID NO: 1106507 - DNA, 22 bp, Artificial Sequence
  chemically synthesized
tacctgttgatctgttaatgtg

SEQ ID NO: 1106508 - DNA, 22 bp, Artificial Sequence
  chemically synthesized
acctgttgatctgttaatgtgg

SEQ ID NO: 1106509 - DNA, 22 bp, Artificial Sequence
  chemically synthesized
cctgttgatctgttaatgtggt

SEQ ID NO: 1106510 - DNA, 22 bp, Artificial Sequence
  chemically synthesized
aatgttctagaaaccacattaa

SEQ ID NO: 1106511 - DNA, 22 bp, Artificial Sequence
  chemically synthesized
aaatgttctagaaaccacatta

SEQ ID NO: 1106512 - DNA, 22 bp, Artificial Sequence
  chemically synthesized
taaatgttctagaaaccacatt

SEQ ID NO: 1106513 - DNA, 22 bp, Artificial Sequence
  chemically synthesized
ttgatctgttaatgtggtttct

SEQ ID NO: 1106514 - DNA, 22 bp, Artificial Sequence
  chemically synthesized
attttaaatgttctagaaacca

SEQ ID NO: 1106515 - DNA, 22 bp, Artificial Sequence
  chemically synthesized
atctgttaatgtggtttctaga

SEQ ID NO: 1106516 - DNA, 22 bp, Artificial Sequence
  chemically synthesized
aattttaaatgttctagaaacc

SEQ ID NO: 1106517 - DNA, 22 bp, Artificial Sequence
  chemically synthesized
ttaatgtggtttctagaacatt

SEQ ID NO: 1106518 - DNA, 22 bp, Artificial Sequence
  chemically synthesized
atgtggtttctagaacatttaa

SEQ ID NO: 1106519 - DNA, 22 bp, Artificial Sequence
  chemically synthesized
ctagaacatttaaaattaaata

SEQ ID NO: 1106520 - DNA, 22 bp, Artificial Sequence
  chemically synthesized
tagaacatttaaaattaaatat

SEQ ID NO: 1106521 - DNA, 22 bp, Artificial Sequence
  chemically synthesized
gaacatttaaaattaaatatat

SEQ ID NO: 1106522 - DNA, 22 bp, Artificial Sequence
  chemically synthesized
aaaattaaatatatggctcaca

SEQ ID NO: 1106523 - DNA, 22 bp, Artificial Sequence
  chemically synthesized
aaattaaatatatggctcacat

SEQ ID NO: 1106524 - DNA, 22 bp, Artificial Sequence
  chemically synthesized
tccaacagaaaaataatgtgag

SEQ ID NO: 1106525 - DNA, 22 bp, Artificial Sequence
  chemically synthesized
aatatatggctcacattatttt

SEQ ID NO: 1106526 - DNA, 22 bp, Artificial Sequence
  chemically synthesized
agcactatccaacagaaaaata

SEQ ID NO: 1106527 - DNA, 22 bp, Artificial Sequence
  chemically synthesized
tctaagcactatccaacagaaa

SEQ ID NO: 1106528 - DNA, 22 bp, Artificial Sequence
  chemically synthesized
tatctaagcactatccaacaga

SEQ ID NO: 1106529 - DNA, 22 bp, Artificial Sequence
  chemically synthesized
ctatctaagcactatccaacag

SEQ ID NO: 1106530 - DNA, 22 bp, Artificial Sequence
  chemically synthesized
acattatttttctgttggatag

SEQ ID NO: 1106531 - DNA, 22 bp, Artificial Sequence
  chemically synthesized
cagcttctatctaagcactatc

SEQ ID NO: 1106532 - DNA, 22 bp, Artificial Sequence
  chemically synthesized
tttttctgttggatagtgctta

SEQ ID NO: 1106533 - DNA, 22 bp, Artificial Sequence
  chemically synthesized
ccagcttctatctaagcactat

SEQ ID NO: 1106534 - DNA, 22 bp, Artificial Sequence
  chemically synthesized
tccagcttctatctaagcacta

SEQ ID NO: 1106535 - DNA, 22 bp, Artificial Sequence
  chemically synthesized
ttccagcttctatctaagcact

SEQ ID NO: 1106536 - DNA, 22 bp, Artificial Sequence
  chemically synthesized
ttctgttggatagtgcttagat

SEQ ID NO: 1106537 - DNA, 22 bp, Artificial Sequence
  chemically synthesized
tctgttggatagtgcttagata

SEQ ID NO: 1106538 - DNA, 22 bp, Artificial Sequence
  chemically synthesized
ctgttggatagtgcttagatag

SEQ ID NO: 1106539 - DNA, 22 bp, Artificial Sequence
  chemically synthesized
tgttggatagtgcttagataga

SEQ ID NO: 1106540 - DNA, 22 bp, Artificial Sequence
  chemically synthesized
ttggatagtgcttagatagaag

SEQ ID NO: 1106541 - DNA, 22 bp, Artificial Sequence
  chemically synthesized
gatagtgcttagatagaagctg

SEQ ID NO: 1106542 - DNA, 22 bp, Artificial Sequence
  chemically synthesized
catgggtgccttttccagcttc

SEQ ID NO: 1106543 - DNA, 22 bp, Artificial Sequence
  chemically synthesized
agatagaagctggaaaaggcac

SEQ ID NO: 1106544 - DNA, 22 bp, Artificial Sequence
  chemically synthesized
gatagaagctggaaaaggcacc

SEQ ID NO: 1106545 - DNA, 22 bp, Artificial Sequence
  chemically synthesized
aatggattacatgggtgccttt

SEQ ID NO: 1106546 - DNA, 22 bp, Artificial Sequence
  chemically synthesized
cccctaaatggattacatgggt

SEQ ID NO: 1106547 - DNA, 22 bp, Artificial Sequence
  chemically synthesized
tccccctaaatggattacatgg

SEQ ID NO: 1106548 - DNA, 22 bp, Artificial Sequence
  chemically synthesized
ctccccctaaatggattacatg

SEQ ID NO: 1106549 - DNA, 22 bp, Artificial Sequence
  chemically synthesized
gaaaaggcacccatgtaatcca

SEQ ID NO: 1106550 - DNA, 22 bp, Artificial Sequence
  chemically synthesized
tctccccctaaatggattacat

SEQ ID NO: 1106551 - DNA, 22 bp, Artificial Sequence
  chemically synthesized
tttctccccctaaatggattac

SEQ ID NO: 1106552 - DNA, 22 bp, Artificial Sequence
  chemically synthesized
acatatcatctctttctccccc

SEQ ID NO: 1106553 - DNA, 22 bp, Artificial Sequence
  chemically synthesized
ctaacatatcatctctttctcc

SEQ ID NO: 1106554 - DNA, 22 bp, Artificial Sequence
  chemically synthesized
agactactaacatatcatctct

SEQ ID NO: 1106555 - DNA, 22 bp, Artificial Sequence
  chemically synthesized
agggggagaaagagatgatatg

SEQ ID NO: 1106556 - DNA, 22 bp, Artificial Sequence
  chemically synthesized
gggggagaaagagatgatatgt

SEQ ID NO: 1106557 - DNA, 22 bp, Artificial Sequence
  chemically synthesized
tcaatattaagactactaacat

SEQ ID NO: 1106558 - DNA, 22 bp, Artificial Sequence
  chemically synthesized
aatgctgtcaatattaagacta

SEQ ID NO: 1106559 - DNA, 22 bp, Artificial Sequence
  chemically synthesized
aaatgctgtcaatattaagact

SEQ ID NO: 1106560 - DNA, 22 bp, Artificial Sequence
  chemically synthesized
taaatgctgtcaatattaagac

SEQ ID NO: 1106561 - DNA, 22 bp, Artificial Sequence
  chemically synthesized
ttaaatgctgtcaatattaaga

SEQ ID NO: 1106562 - DNA, 22 bp, Artificial Sequence
  chemically synthesized
atgtttttaaatgctgtcaata

SEQ ID NO: 1106563 - DNA, 22 bp, Artificial Sequence
  chemically synthesized
gtagtcttaatattgacagcat

SEQ ID NO: 1106564 - DNA, 22 bp, Artificial Sequence
  chemically synthesized
taatgtttttaaatgctgtcaa

SEQ ID NO: 1106565 - DNA, 22 bp, Artificial Sequence
  chemically synthesized
ctaatgtttttaaatgctgtca

SEQ ID NO: 1106566 - DNA, 22 bp, Artificial Sequence
  chemically synthesized
aatattgacagcatttaaaaac

SEQ ID NO: 1106567 - DNA, 22 bp, Artificial Sequence
  chemically synthesized
atattgacagcatttaaaaaca

SEQ ID NO: 1106568 - DNA, 22 bp, Artificial Sequence
  chemically synthesized
acaacaggacttctaatgtttt

SEQ ID NO: 1106569 - DNA, 22 bp, Artificial Sequence
  chemically synthesized
acagcatttaaaaacattagaa

SEQ ID NO: 1106570 - DNA, 22 bp, Artificial Sequence
  chemically synthesized
atattcacaacaggacttctaa

SEQ ID NO: 1106571 - DNA, 22 bp, Artificial Sequence
  chemically synthesized
catattcacaacaggacttcta

SEQ ID NO: 1106572 - DNA, 22 bp, Artificial Sequence
  chemically synthesized
aaaaacattagaagtcctgttg

SEQ ID NO: 1106573 - DNA, 22 bp, Artificial Sequence
  chemically synthesized
aaaacattagaagtcctgttgt

SEQ ID NO: 1106574 - DNA, 22 bp, Artificial Sequence
  chemically synthesized
gatttcatattcacaacaggac

SEQ ID NO: 1106575 - DNA, 22 bp, Artificial Sequence
  chemically synthesized
gactcgatttcatattcacaac

SEQ ID NO: 1106576 - DNA, 22 bp, Artificial Sequence
  chemically synthesized
gaagtcctgttgtgaatatgaa

SEQ ID NO: 1106577 - DNA, 22 bp, Artificial Sequence
  chemically synthesized
aaattggactcgatttcatatt

SEQ ID NO: 1106578 - DNA, 22 bp, Artificial Sequence
  chemically synthesized
ttgtgaatatgaaatcgagtcc

SEQ ID NO: 1106579 - DNA, 22 bp, Artificial Sequence
  chemically synthesized
tgaatatgaaatcgagtccaat

SEQ ID NO: 1106580 - DNA, 22 bp, Artificial Sequence
  chemically synthesized
cccacaggtaataatggggaat

SEQ ID NO: 1106581 - DNA, 22 bp, Artificial Sequence
  chemically synthesized
ccccacaggtaataatggggaa

SEQ ID NO: 1106582 - DNA, 22 bp, Artificial Sequence
  chemically synthesized
tccccacaggtaataatgggga

SEQ ID NO: 1106583 - DNA, 22 bp, Artificial Sequence
  chemically synthesized
ttccccacaggtaataatgggg

SEQ ID NO: 1106584 - DNA, 22 bp, Artificial Sequence
  chemically synthesized
tttccccacaggtaataatggg

SEQ ID NO: 1106585 - DNA, 22 bp, Artificial Sequence
  chemically synthesized
ttttccccacaggtaataatgg

SEQ ID NO: 1106586 - DNA, 22 bp, Artificial Sequence
  chemically synthesized
gaattccccattattacctgtg

SEQ ID NO: 1106587 - DNA, 22 bp, Artificial Sequence
  chemically synthesized
aattccccattattacctgtgg

SEQ ID NO: 1106588 - DNA, 22 bp, Artificial Sequence
  chemically synthesized
cccattattacctgtggggaaa

SEQ ID NO: 1106589 - DNA, 22 bp, Artificial Sequence
  chemically synthesized
ttacctgtggggaaaaaaatgc

SEQ ID NO: 1106590 - DNA, 22 bp, Artificial Sequence
  chemically synthesized
acacatgtgcagtgcatttttt

SEQ ID NO: 1106591 - DNA, 22 bp, Artificial Sequence
  chemically synthesized
cacacatgtgcagtgcattttt

SEQ ID NO: 1106592 - DNA, 22 bp, Artificial Sequence
  chemically synthesized
cctgtggggaaaaaaatgcact

SEQ ID NO: 1106593 - DNA, 22 bp, Artificial Sequence
  chemically synthesized
ttcacacatgtgcagtgcattt

SEQ ID NO: 1106594 - DNA, 22 bp, Artificial Sequence
  chemically synthesized
cttcacacatgtgcagtgcatt

SEQ ID NO: 1106595 - DNA, 22 bp, Artificial Sequence
  chemically synthesized
tggggaaaaaaatgcactgcac

SEQ ID NO: 1106596 - DNA, 22 bp, Artificial Sequence
  chemically synthesized
agcttcttcacacatgtgcagt

SEQ ID NO: 1106597 - DNA, 22 bp, Artificial Sequence
  chemically synthesized
gttcagcttcttcacacatgtg

SEQ ID NO: 1106598 - DNA, 22 bp, Artificial Sequence
  chemically synthesized
cacatgtgtgaagaagctgaac

SEQ ID NO: 1106599 - DNA, 22 bp, Artificial Sequence
  chemically synthesized
ccgaagtaggtatatgtcatta

SEQ ID NO: 1106600 - DNA, 22 bp, Artificial Sequence
  chemically synthesized
gccgaagtaggtatatgtcatt

SEQ ID NO: 1106601 - DNA, 22 bp, Artificial Sequence
  chemically synthesized
tgccgaagtaggtatatgtcat

SEQ ID NO: 1106602 - DNA, 22 bp, Artificial Sequence
  chemically synthesized
aactaatgacatatacctactt

SEQ ID NO: 1106603 - DNA, 22 bp, Artificial Sequence
  chemically synthesized
agcattttgccgaagtaggtat

SEQ ID NO: 1106604 - DNA, 22 bp, Artificial Sequence
  chemically synthesized
atgacatatacctacttcggca

SEQ ID NO: 1106605 - DNA, 22 bp, Artificial Sequence
  chemically synthesized
aagttgagcattttgccgaagt

SEQ ID NO: 1106606 - DNA, 22 bp, Artificial Sequence
  chemically synthesized
aaggctcaagttgagcattttg

SEQ ID NO: 1106607 - DNA, 22 bp, Artificial Sequence
  chemically synthesized
cttcggcaaaatgctcaacttg

SEQ ID NO: 1106608 - DNA, 22 bp, Artificial Sequence
  chemically synthesized
cggcaaaatgctcaacttgagc

SEQ ID NO: 1106609 - DNA, 22 bp, Artificial Sequence
  chemically synthesized
ggcaaaatgctcaacttgagcc

SEQ ID NO: 1106610 - DNA, 22 bp, Artificial Sequence
  chemically synthesized
gcatggaattaaaggctcaagt

SEQ ID NO: 1106611 - DNA, 22 bp, Artificial Sequence
  chemically synthesized
gttggcatggaattaaaggctc

SEQ ID NO: 1106612 - DNA, 22 bp, Artificial Sequence
  chemically synthesized
aacttgagcctttaattccatg

SEQ ID NO: 1106613 - DNA, 22 bp, Artificial Sequence
  chemically synthesized
gagcctttaattccatgccaac

SEQ ID NO: 1106614 - DNA, 22 bp, Artificial Sequence
  chemically synthesized
agcctttaattccatgccaacc

SEQ ID NO: 1106615 - DNA, 22 bp, Artificial Sequence
  chemically synthesized
taattccatgccaaccagatcc

SEQ ID NO: 1106616 - DNA, 22 bp, Artificial Sequence
  chemically synthesized
aattccatgccaaccagatccc

SEQ ID NO: 1106617 - DNA, 22 bp, Artificial Sequence
  chemically synthesized
attccatgccaaccagatccca

SEQ ID NO: 1106618 - DNA, 22 bp, Artificial Sequence
  chemically synthesized
catgccaaccagatcccacctt

SEQ ID NO: 1106619 - DNA, 22 bp, Artificial Sequence
  chemically synthesized
atcatggggaatgaggaaaaag

SEQ ID NO: 1106620 - DNA, 22 bp, Artificial Sequence
  chemically synthesized
gattgatcatggggaatgagga

SEQ ID NO: 1106621 - DNA, 22 bp, Artificial Sequence
  chemically synthesized
agattgatcatggggaatgagg

SEQ ID NO: 1106622 - DNA, 22 bp, Artificial Sequence
  chemically synthesized
tagattgatcatggggaatgag

SEQ ID NO: 1106623 - DNA, 22 bp, Artificial Sequence
  chemically synthesized
actttagattgatcatggggaa

SEQ ID NO: 1106624 - DNA, 22 bp, Artificial Sequence
  chemically synthesized
gactttagattgatcatgggga

SEQ ID NO: 1106625 - DNA, 22 bp, Artificial Sequence
  chemically synthesized
tttcctcattccccatgatcaa

SEQ ID NO: 1106626 - DNA, 22 bp, Artificial Sequence
  chemically synthesized
cttgactttagattgatcatgg

SEQ ID NO: 1106627 - DNA, 22 bp, Artificial Sequence
  chemically synthesized
ttcctcattccccatgatcaat

SEQ ID NO: 1106628 - DNA, 22 bp, Artificial Sequence
  chemically synthesized
tcctcattccccatgatcaatc

SEQ ID NO: 1106629 - DNA, 22 bp, Artificial Sequence
  chemically synthesized
cctcattccccatgatcaatct

SEQ ID NO: 1106630 - DNA, 22 bp, Artificial Sequence
  chemically synthesized
ctcattccccatgatcaatcta

SEQ ID NO: 1106631 - DNA, 22 bp, Artificial Sequence
  chemically synthesized
tctccttgactttagattgatc

SEQ ID NO: 1106632 - DNA, 22 bp, Artificial Sequence
  chemically synthesized
attccccatgatcaatctaaag

SEQ ID NO: 1106633 - DNA, 22 bp, Artificial Sequence
  chemically synthesized
cattatctccttgactttagat

SEQ ID NO: 1106634 - DNA, 22 bp, Artificial Sequence
  chemically synthesized
cccatgatcaatctaaagtcaa

SEQ ID NO: 1106635 - DNA, 22 bp, Artificial Sequence
  chemically synthesized
attgcattatctccttgacttt

SEQ ID NO: 1106636 - DNA, 22 bp, Artificial Sequence
  chemically synthesized
ctgattgcattatctccttgac

SEQ ID NO: 1106637 - DNA, 22 bp, Artificial Sequence
  chemically synthesized
gctgattgcattatctccttga

SEQ ID NO: 1106638 - DNA, 22 bp, Artificial Sequence
  chemically synthesized
tgctgattgcattatctccttg

SEQ ID NO: 1106639 - DNA, 22 bp, Artificial Sequence
  chemically synthesized
gagcctttgctgattgcattat

SEQ ID NO: 1106640 - DNA, 22 bp, Artificial Sequence
  chemically synthesized
aagtcaaggagataatgcaatc

SEQ ID NO: 1106641 - DNA, 22 bp, Artificial Sequence
  chemically synthesized
ggagcctttgctgattgcatta

SEQ ID NO: 1106642 - DNA, 22 bp, Artificial Sequence
  chemically synthesized
ataaagtttggagcctttgctg

SEQ ID NO: 1106643 - DNA, 22 bp, Artificial Sequence
  chemically synthesized
aataaagtttggagcctttgct

SEQ ID NO: 1106644 - DNA, 22 bp, Artificial Sequence
  chemically synthesized
tttaataaagtttggagccttt

SEQ ID NO: 1106645 - DNA, 22 bp, Artificial Sequence
  chemically synthesized
tgttatttaataaagtttggag

SEQ ID NO: 1106646 - DNA, 22 bp, Artificial Sequence
  chemically synthesized
tcatggtctatgttatttaata

SEQ ID NO: 1106647 - DNA, 22 bp, Artificial Sequence
  chemically synthesized
gtcatggtctatgttatttaat

SEQ ID NO: 1106648 - DNA, 22 bp, Artificial Sequence
  chemically synthesized
tgtcatggtctatgttatttaa

SEQ ID NO: 1106649 - DNA, 22 bp, Artificial Sequence
  chemically synthesized
ttgtcatggtctatgttattta

SEQ ID NO: 1106650 - DNA, 22 bp, Artificial Sequence
  chemically synthesized
caaactttattaaataacatag

SEQ ID NO: 1106651 - DNA, 22 bp, Artificial Sequence
  chemically synthesized
cttttgtcatggtctatgttat

SEQ ID NO: 1106652 - DNA, 22 bp, Artificial Sequence
  chemically synthesized
acttttgtcatggtctatgtta

SEQ ID NO: 1106653 - DNA, 22 bp, Artificial Sequence
  chemically synthesized
tattaaataacatagaccatga

SEQ ID NO: 1106654 - DNA, 22 bp, Artificial Sequence
  chemically synthesized
attaaataacatagaccatgac

SEQ ID NO: 1106655 - DNA, 22 bp, Artificial Sequence
  chemically synthesized
ttaaataacatagaccatgaca

SEQ ID NO: 1106656 - DNA, 22 bp, Artificial Sequence
  chemically synthesized
aataacatagaccatgacaaaa

SEQ ID NO: 1106657 - DNA, 22 bp, Artificial Sequence
  chemically synthesized
gagaaatgcttacttttgtcat

SEQ ID NO: 1106658 - DNA, 22 bp, Artificial Sequence
  chemically synthesized
agagaaatgcttacttttgtca

SEQ ID NO: 1106659 - DNA, 22 bp, Artificial Sequence
  chemically synthesized
tagagaaatgcttacttttgtc

SEQ ID NO: 1106660 - DNA, 22 bp, Artificial Sequence
  chemically synthesized
acattttagagaaatgcttact

SEQ ID NO: 1106661 - DNA, 22 bp, Artificial Sequence
  chemically synthesized
tcagtgttcacattttagagaa

SEQ ID NO: 1106662 - DNA, 22 bp, Artificial Sequence
  chemically synthesized
gtcagtgttcacattttagaga

SEQ ID NO: 1106663 - DNA, 22 bp, Artificial Sequence
  chemically synthesized
tgtcagtgttcacattttagag

SEQ ID NO: 1106664 - DNA, 22 bp, Artificial Sequence
  chemically synthesized
acacctttgtcagtgttcacat

SEQ ID NO: 1106665 - DNA, 22 bp, Artificial Sequence
  chemically synthesized
gacacctttgtcagtgttcaca

SEQ ID NO: 1106666 - DNA, 22 bp, Artificial Sequence
  chemically synthesized
ttgacacctttgtcagtgttca

SEQ ID NO: 1106667 - DNA, 22 bp, Artificial Sequence
  chemically synthesized
cttgacacctttgtcagtgttc

SEQ ID NO: 1106668 - DNA, 22 bp, Artificial Sequence
  chemically synthesized
ctctaaaatgtgaacactgaca

SEQ ID NO: 1106669 - DNA, 22 bp, Artificial Sequence
  chemically synthesized
tctaaaatgtgaacactgacaa

SEQ ID NO: 1106670 - DNA, 22 bp, Artificial Sequence
  chemically synthesized
taaaatgtgaacactgacaaag

SEQ ID NO: 1106671 - DNA, 22 bp, Artificial Sequence
  chemically synthesized
tatttcttgacacctttgtcag

SEQ ID NO: 1106672 - DNA, 22 bp, Artificial Sequence
  chemically synthesized
aaatgtgaacactgacaaaggt

SEQ ID NO: 1106673 - DNA, 22 bp, Artificial Sequence
  chemically synthesized
ttgtatttcttgacacctttgt

SEQ ID NO: 1106674 - DNA, 22 bp, Artificial Sequence
  chemically synthesized
acaaaggtgtcaagaaatacaa

SEQ ID NO: 1106675 - DNA, 22 bp, Artificial Sequence
  chemically synthesized
atcatcatatatcatgcatggg

SEQ ID NO: 1106676 - DNA, 22 bp, Artificial Sequence
  chemically synthesized
gtatgttaatcatcatatatca

SEQ ID NO: 1106677 - DNA, 22 bp, Artificial Sequence
  chemically synthesized
ctagtatgttaatcatcatata

SEQ ID NO: 1106678 - DNA, 22 bp, Artificial Sequence
  chemically synthesized
aaggaccattcctagtatgtta

SEQ ID NO: 1106679 - DNA, 22 bp, Artificial Sequence
  chemically synthesized
tctgaaggaccattcctagtat

SEQ ID NO: 1106680 - DNA, 22 bp, Artificial Sequence
  chemically synthesized
taattatctgaaggaccattcc

SEQ ID NO: 1106681 - DNA, 22 bp, Artificial Sequence
  chemically synthesized
gtaattatctgaaggaccattc

SEQ ID NO: 1106682 - DNA, 22 bp, Artificial Sequence
  chemically synthesized
acatactaggaatggtccttca

SEQ ID NO: 1106683 - DNA, 22 bp, Artificial Sequence
  chemically synthesized
cacttgtaattatctgaaggac

SEQ ID NO: 1106684 - DNA, 22 bp, Artificial Sequence
  chemically synthesized
gcacttgtaattatctgaagga

SEQ ID NO: 1106685 - DNA, 22 bp, Artificial Sequence
  chemically synthesized
cttgcacttgtaattatctgaa

SEQ ID NO: 1106686 - DNA, 22 bp, Artificial Sequence
  chemically synthesized
ccttgcacttgtaattatctga

SEQ ID NO: 1106687 - DNA, 22 bp, Artificial Sequence
  chemically synthesized
ggaatggtccttcagataatta

SEQ ID NO: 1106688 - DNA, 22 bp, Artificial Sequence
  chemically synthesized
agacttccttgcacttgtaatt

SEQ ID NO: 1106689 - DNA, 22 bp, Artificial Sequence
  chemically synthesized
tactcagacttccttgcacttg

SEQ ID NO: 1106690 - DNA, 22 bp, Artificial Sequence
  chemically synthesized
cagataattacaagtgcaagga

SEQ ID NO: 1106691 - DNA, 22 bp, Artificial Sequence
  chemically synthesized
agataattacaagtgcaaggaa

SEQ ID NO: 1106692 - DNA, 22 bp, Artificial Sequence
  chemically synthesized
aagttatactcagacttccttg

SEQ ID NO: 1106693 - DNA, 22 bp, Artificial Sequence
  chemically synthesized
caagtgcaaggaagtctgagta

SEQ ID NO: 1106694 - DNA, 22 bp, Artificial Sequence
  chemically synthesized
gaaattcaagttatactcagac

SEQ ID NO: 1106695 - DNA, 22 bp, Artificial Sequence
  chemically synthesized
acattagaaattcaagttatac

SEQ ID NO: 1106696 - DNA, 22 bp, Artificial Sequence
  chemically synthesized
tatattgacattagaaattcaa

SEQ ID NO: 1106697 - DNA, 22 bp, Artificial Sequence
  chemically synthesized
atatattgacattagaaattca

SEQ ID NO: 1106698 - DNA, 22 bp, Artificial Sequence
  chemically synthesized
agtataacttgaatttctaatg

SEQ ID NO: 1106699 - DNA, 22 bp, Artificial Sequence
  chemically synthesized
aggaaacaacttatatattgac

SEQ ID NO: 1106700 - DNA, 22 bp, Artificial Sequence
  chemically synthesized
gaatttctaatgtcaatatata

SEQ ID NO: 1106701 - DNA, 22 bp, Artificial Sequence
  chemically synthesized
aatttctaatgtcaatatataa

SEQ ID NO: 1106702 - DNA, 22 bp, Artificial Sequence
  chemically synthesized
aaactaaggaaacaacttatat

SEQ ID NO: 1106703 - DNA, 22 bp, Artificial Sequence
  chemically synthesized
ctaatgtcaatatataagttgt

SEQ ID NO: 1106704 - DNA, 22 bp, Artificial Sequence
  chemically synthesized
caaactaaggaaacaacttata

SEQ ID NO: 1106705 - DNA, 22 bp, Artificial Sequence
  chemically synthesized
taatgtcaatatataagttgtt

SEQ ID NO: 1106706 - DNA, 22 bp, Artificial Sequence
  chemically synthesized
atgtcaatatataagttgtttc

SEQ ID NO: 1106707 - DNA, 22 bp, Artificial Sequence
  chemically synthesized
tatttcaaactaaggaaacaac

SEQ ID NO: 1106708 - DNA, 22 bp, Artificial Sequence
  chemically synthesized
gtatttcaaactaaggaaacaa

SEQ ID NO: 1106709 - DNA, 22 bp, Artificial Sequence
  chemically synthesized
tttccttagtttgaaatacaag

SEQ ID NO: 1106710 - DNA, 22 bp, Artificial Sequence
  chemically synthesized
ccttagtttgaaatacaaggat

SEQ ID NO: 1106711 - DNA, 22 bp, Artificial Sequence
  chemically synthesized
ccaatcacaaagatccttgtat

SEQ ID NO: 1106712 - DNA, 22 bp, Artificial Sequence
  chemically synthesized
cttagtttgaaatacaaggatc

SEQ ID NO: 1106713 - DNA, 22 bp, Artificial Sequence
  chemically synthesized
agtttgaaatacaaggatcttt

SEQ ID NO: 1106714 - DNA, 22 bp, Artificial Sequence
  chemically synthesized
gtttgaaatacaaggatctttg

SEQ ID NO: 1106715 - DNA, 22 bp, Artificial Sequence
  chemically synthesized
aattcccaatcacaaagatcct

SEQ ID NO: 1106716 - DNA, 22 bp, Artificial Sequence
  chemically synthesized
gaaatacaaggatctttgtgat

SEQ ID NO: 1106717 - DNA, 22 bp, Artificial Sequence
  chemically synthesized
attgaattcccaatcacaaaga

SEQ ID NO: 1106718 - DNA, 22 bp, Artificial Sequence
  chemically synthesized
aaatacaaggatctttgtgatt

SEQ ID NO: 1106719 - DNA, 22 bp, Artificial Sequence
  chemically synthesized
aaatgttgattgaattcccaat

SEQ ID NO: 1106720 - DNA, 22 bp, Artificial Sequence
  chemically synthesized
ggctaaaatgttgattgaattc

SEQ ID NO: 1106721 - DNA, 22 bp, Artificial Sequence
  chemically synthesized
tgtgattgggaattcaatcaac

SEQ ID NO: 1106722 - DNA, 22 bp, Artificial Sequence
  chemically synthesized
gtgattgggaattcaatcaaca

SEQ ID NO: 1106723 - DNA, 22 bp, Artificial Sequence
  chemically synthesized
tgattgggaattcaatcaacat

SEQ ID NO: 1106724 - DNA, 22 bp, Artificial Sequence
  chemically synthesized
ggaattcaatcaacattttagc

SEQ ID NO: 1106725 - DNA, 22 bp, Artificial Sequence
  chemically synthesized
ataggaaattgggctaaaatgt

SEQ ID NO: 1106726 - DNA, 22 bp, Artificial Sequence
  chemically synthesized
gataggaaattgggctaaaatg

SEQ ID NO: 1106727 - DNA, 22 bp, Artificial Sequence
  chemically synthesized
tgataggaaattgggctaaaat

SEQ ID NO: 1106728 - DNA, 22 bp, Artificial Sequence
  chemically synthesized
attttgataggaaattgggcta

SEQ ID NO: 1106729 - DNA, 22 bp, Artificial Sequence
  chemically synthesized
aatcaacattttagcccaattt

SEQ ID NO: 1106730 - DNA, 22 bp, Artificial Sequence
  chemically synthesized
tagcccaatttcctatcaaaat

SEQ ID NO: 1106731 - DNA, 22 bp, Artificial Sequence
  chemically synthesized
agcccaatttcctatcaaaatc

SEQ ID NO: 1106732 - DNA, 22 bp, Artificial Sequence
  chemically synthesized
gcccaatttcctatcaaaatca

SEQ ID NO: 1106733 - DNA, 22 bp, Artificial Sequence
  chemically synthesized
gaggatagaatattgattttga

SEQ ID NO: 1106734 - DNA, 22 bp, Artificial Sequence
  chemically synthesized
actggaggatagaatattgatt

SEQ ID NO: 1106735 - DNA, 22 bp, Artificial Sequence
  chemically synthesized
gactggaggatagaatattgat

SEQ ID NO: 1106736 - DNA, 22 bp, Artificial Sequence
  chemically synthesized
tgactggaggatagaatattga

SEQ ID NO: 1106737 - DNA, 22 bp, Artificial Sequence
  chemically synthesized
cctatcaaaatcaatattctat

SEQ ID NO: 1106738 - DNA, 22 bp, Artificial Sequence
  chemically synthesized
ctatcaaaatcaatattctatc

SEQ ID NO: 1106739 - DNA, 22 bp, Artificial Sequence
  chemically synthesized
tcaaaatcaatattctatcctc

SEQ ID NO: 1106740 - DNA, 22 bp, Artificial Sequence
  chemically synthesized
aaaggcatattttgactggagg

SEQ ID NO: 1106741 - DNA, 22 bp, Artificial Sequence
  chemically synthesized
tatcctccagtcaaaatatgcc

SEQ ID NO: 1106742 - DNA, 22 bp, Artificial Sequence
  chemically synthesized
tcctccagtcaaaatatgcctt

SEQ ID NO: 1106743 - DNA, 22 bp, Artificial Sequence
  chemically synthesized
cagtcaaaatatgccttttaat

SEQ ID NO: 1106744 - DNA, 22 bp, Artificial Sequence
  chemically synthesized
cataagcaaaaaggcgtgaagt

SEQ ID NO: 1106745 - DNA, 22 bp, Artificial Sequence
  chemically synthesized
ttaattacttcacgcctttttg

SEQ ID NO: 1106746 - DNA, 22 bp, Artificial Sequence
  chemically synthesized
taattacttcacgcctttttgc

SEQ ID NO: 1106747 - DNA, 22 bp, Artificial Sequence
  chemically synthesized
aattacttcacgcctttttgct

SEQ ID NO: 1106748 - DNA, 22 bp, Artificial Sequence
  chemically synthesized
attacttcacgcctttttgctt

SEQ ID NO: 1106749 - DNA, 22 bp, Artificial Sequence
  chemically synthesized
cttcacgcctttttgcttatgc

SEQ ID NO: 1106750 - DNA, 22 bp, Artificial Sequence
  chemically synthesized
agcagagcaagttgcataagca

SEQ ID NO: 1106751 - DNA, 22 bp, Artificial Sequence
  chemically synthesized
cagcagagcaagttgcataagc

SEQ ID NO: 1106752 - DNA, 22 bp, Artificial Sequence
  chemically synthesized
cacgcctttttgcttatgcaac

SEQ ID NO: 1106753 - DNA, 22 bp, Artificial Sequence
  chemically synthesized
tcagcagagcaagttgcataag

SEQ ID NO: 1106754 - DNA, 22 bp, Artificial Sequence
  chemically synthesized
acgcctttttgcttatgcaact

SEQ ID NO: 1106755 - DNA, 22 bp, Artificial Sequence
  chemically synthesized
tttgcttatgcaacttgctctg

SEQ ID NO: 1106756 - DNA, 22 bp, Artificial Sequence
  chemically synthesized
ttgcttatgcaacttgctctgc

SEQ ID NO: 1106757 - DNA, 22 bp, Artificial Sequence
  chemically synthesized
tgcttatgcaacttgctctgct

SEQ ID NO: 1106758 - DNA, 22 bp, Artificial Sequence
  chemically synthesized
gcttatgcaacttgctctgctg

SEQ ID NO: 1106759 - DNA, 22 bp, Artificial Sequence
  chemically synthesized
cttatgcaacttgctctgctga

SEQ ID NO: 1106760 - DNA, 22 bp, Artificial Sequence
  chemically synthesized
agcagcagcgactttcagcaga

SEQ ID NO: 1106761 - DNA, 22 bp, Artificial Sequence
  chemically synthesized
atgcaacttgctctgctgaaag

SEQ ID NO: 1106762 - DNA, 22 bp, Artificial Sequence
  chemically synthesized
tgcaacttgctctgctgaaagt

SEQ ID NO: 1106763 - DNA, 22 bp, Artificial Sequence
  chemically synthesized
gctctgctgaaagtcgctgctg

SEQ ID NO: 1106764 - DNA, 22 bp, Artificial Sequence
  chemically synthesized
ctctgctgaaagtcgctgctgc

SEQ ID NO: 1106765 - DNA, 22 bp, Artificial Sequence
  chemically synthesized
tgctgaaagtcgctgctgctca

SEQ ID NO: 1106766 - DNA, 22 bp, Artificial Sequence
  chemically synthesized
tgagaatggagcctgagcagca

SEQ ID NO: 1106767 - DNA, 22 bp, Artificial Sequence
  chemically synthesized
ctgaaagtcgctgctgctcagg

SEQ ID NO: 1106768 - DNA, 22 bp, Artificial Sequence
  chemically synthesized
gtgagaatggagcctgagcagc

SEQ ID NO: 1106769 - DNA, 22 bp, Artificial Sequence
  chemically synthesized
tgtgagaatggagcctgagcag

SEQ ID NO: 1106770 - DNA, 22 bp, Artificial Sequence
  chemically synthesized
aaagtcgctgctgctcaggctc

SEQ ID NO: 1106771 - DNA, 22 bp, Artificial Sequence
  chemically synthesized
ctgctcaggctccattctcaca

SEQ ID NO: 1106772 - DNA, 22 bp, Artificial Sequence
  chemically synthesized
ctcaggctccattctcacaaag

SEQ ID NO: 1106773 - DNA, 22 bp, Artificial Sequence
  chemically synthesized
aggctccattctcacaaagggc

SEQ ID NO: 1106774 - DNA, 22 bp, Artificial Sequence
  chemically synthesized
cattctcacaaagggcacttgg

SEQ ID NO: 1106775 - DNA, 22 bp, Artificial Sequence
  chemically synthesized
atgtcagaccacaccaagtgcc

SEQ ID NO: 1106776 - DNA, 22 bp, Artificial Sequence
  chemically synthesized
tcacaaagggcacttggtgtgg

SEQ ID NO: 1106777 - DNA, 22 bp, Artificial Sequence
  chemically synthesized
actcatgtcagaccacaccaag

SEQ ID NO: 1106778 - DNA, 22 bp, Artificial Sequence
  chemically synthesized
cactcatgtcagaccacaccaa

SEQ ID NO: 1106779 - DNA, 22 bp, Artificial Sequence
  chemically synthesized
acaaagggcacttggtgtggtc

SEQ ID NO: 1106780 - DNA, 22 bp, Artificial Sequence
  chemically synthesized
tttcactcatgtcagaccacac

SEQ ID NO: 1106781 - DNA, 22 bp, Artificial Sequence
  chemically synthesized
ggtgtggtctgacatgagtgaa

SEQ ID NO: 1106782 - DNA, 22 bp, Artificial Sequence
  chemically synthesized
gtgtggtctgacatgagtgaaa

SEQ ID NO: 1106783 - DNA, 22 bp, Artificial Sequence
  chemically synthesized
taaacccatctatttcactcat

SEQ ID NO: 1106784 - DNA, 22 bp, Artificial Sequence
  chemically synthesized
ctataaacccatctatttcact

SEQ ID NO: 1106785 - DNA, 22 bp, Artificial Sequence
  chemically synthesized
acatgagtgaaatagatgggtt

SEQ ID NO: 1106786 - DNA, 22 bp, Artificial Sequence
  chemically synthesized
gataaaattcctataaacccat

SEQ ID NO: 1106787 - DNA, 22 bp, Artificial Sequence
  chemically synthesized
agataaaattcctataaaccca

SEQ ID NO: 1106788 - DNA, 22 bp, Artificial Sequence
  chemically synthesized
tggtgatcttagataaaattcc

SEQ ID NO: 1106789 - DNA, 22 bp, Artificial Sequence
  chemically synthesized
tatggtgatcttagataaaatt

SEQ ID NO: 1106790 - DNA, 22 bp, Artificial Sequence
  chemically synthesized
ataggaattttatctaagatca

SEQ ID NO: 1106791 - DNA, 22 bp, Artificial Sequence
  chemically synthesized
taggaattttatctaagatcac

SEQ ID NO: 1106792 - DNA, 22 bp, Artificial Sequence
  chemically synthesized
taaaacaaattctatggtgatc

SEQ ID NO: 1106793 - DNA, 22 bp, Artificial Sequence
  chemically synthesized
ataaaacaaattctatggtgat

SEQ ID NO: 1106794 - DNA, 22 bp, Artificial Sequence
  chemically synthesized
tatctaagatcaccatagaatt

SEQ ID NO: 1106795 - DNA, 22 bp, Artificial Sequence
  chemically synthesized
atctaagatcaccatagaattt

SEQ ID NO: 1106796 - DNA, 22 bp, Artificial Sequence
  chemically synthesized
tctaagatcaccatagaatttg

SEQ ID NO: 1106797 - DNA, 22 bp, Artificial Sequence
  chemically synthesized
tgacttataaaacaaattctat

SEQ ID NO: 1106798 - DNA, 22 bp, Artificial Sequence
  chemically synthesized
atgacttataaaacaaattcta

SEQ ID NO: 1106799 - DNA, 22 bp, Artificial Sequence
  chemically synthesized
tatgacttataaaacaaattct

SEQ ID NO: 1106800 - DNA, 22 bp, Artificial Sequence
  chemically synthesized
agatcaccatagaatttgtttt

SEQ ID NO: 1106801 - DNA, 22 bp, Artificial Sequence
  chemically synthesized
gagttttatgacttataaaaca

SEQ ID NO: 1106802 - DNA, 22 bp, Artificial Sequence
  chemically synthesized
attggagttttatgacttataa

SEQ ID NO: 1106803 - DNA, 22 bp, Artificial Sequence
  chemically synthesized
gttcattggagttttatgactt

SEQ ID NO: 1106804 - DNA, 22 bp, Artificial Sequence
  chemically synthesized
gttttataagtcataaaactcc

SEQ ID NO: 1106805 - DNA, 22 bp, Artificial Sequence
  chemically synthesized
agttggttcattggagttttat

SEQ ID NO: 1106806 - DNA, 22 bp, Artificial Sequence
  chemically synthesized
ttttataagtcataaaactcca

SEQ ID NO: 1106807 - DNA, 22 bp, Artificial Sequence
  chemically synthesized
cagttggttcattggagtttta

SEQ ID NO: 1106808 - DNA, 22 bp, Artificial Sequence
  chemically synthesized
tataagtcataaaactccaatg

SEQ ID NO: 1106809 - DNA, 22 bp, Artificial Sequence
  chemically synthesized
ataagtcataaaactccaatga

SEQ ID NO: 1106810 - DNA, 22 bp, Artificial Sequence
  chemically synthesized
taagtcataaaactccaatgaa

SEQ ID NO: 1106811 - DNA, 22 bp, Artificial Sequence
  chemically synthesized
tgaaaatgaccccaatttcagt

SEQ ID NO: 1106812 - DNA, 22 bp, Artificial Sequence
  chemically synthesized
atgaaaatgaccccaatttcag

SEQ ID NO: 1106813 - DNA, 22 bp, Artificial Sequence
  chemically synthesized
caatgaaccaactgaaattggg

SEQ ID NO: 1106814 - DNA, 22 bp, Artificial Sequence
  chemically synthesized
aaattggggtcattttcataaa

SEQ ID NO: 1106815 - DNA, 22 bp, Artificial Sequence
  chemically synthesized
gggtcattttcataaatactgc

SEQ ID NO: 1106816 - DNA, 22 bp, Artificial Sequence
  chemically synthesized
tccaggaggtgaataatagagc

SEQ ID NO: 1106817 - DNA, 22 bp, Artificial Sequence
  chemically synthesized
tcataaatactgctctattatt

SEQ ID NO: 1106818 - DNA, 22 bp, Artificial Sequence
  chemically synthesized
cataaatactgctctattattc

SEQ ID NO: 1106819 - DNA, 22 bp, Artificial Sequence
  chemically synthesized
ataaatactgctctattattca

SEQ ID NO: 1106820 - DNA, 22 bp, Artificial Sequence
  chemically synthesized
ctctattattcacctcctggac

SEQ ID NO: 1106821 - DNA, 22 bp, Artificial Sequence
  chemically synthesized
tattattcacctcctggacaac

SEQ ID NO: 1106822 - DNA, 22 bp, Artificial Sequence
  chemically synthesized
gaaaataaatcagttgtccagg

SEQ ID NO: 1106823 - DNA, 22 bp, Artificial Sequence
  chemically synthesized
ttattcacctcctggacaactg

SEQ ID NO: 1106824 - DNA, 22 bp, Artificial Sequence
  chemically synthesized
cctggaaaataaatcagttgtc

SEQ ID NO: 1106825 - DNA, 22 bp, Artificial Sequence
  chemically synthesized
ttcacctcctggacaactgatt

SEQ ID NO: 1106826 - DNA, 22 bp, Artificial Sequence
  chemically synthesized
acctggaaaataaatcagttgt

SEQ ID NO: 1106827 - DNA, 22 bp, Artificial Sequence
  chemically synthesized
acctcctggacaactgatttat

SEQ ID NO: 1106828 - DNA, 22 bp, Artificial Sequence
  chemically synthesized
ctggacaactgatttattttcc

SEQ ID NO: 1106829 - DNA, 22 bp, Artificial Sequence
  chemically synthesized
gacaactgatttattttccagg

SEQ ID NO: 1106830 - DNA, 22 bp, Artificial Sequence
  chemically synthesized
gtcagaaaaatgagacttacct

SEQ ID NO: 1106831 - DNA, 22 bp, Artificial Sequence
  chemically synthesized
atttattttccaggtaagtctc

SEQ ID NO: 1106832 - DNA, 22 bp, Artificial Sequence
  chemically synthesized
attttccaggtaagtctcattt

SEQ ID NO: 1106833 - DNA, 22 bp, Artificial Sequence
  chemically synthesized
ttttccaggtaagtctcatttt

SEQ ID NO: 1106834 - DNA, 22 bp, Artificial Sequence
  chemically synthesized
tccaggtaagtctcatttttct

SEQ ID NO: 1106835 - DNA, 22 bp, Artificial Sequence
  chemically synthesized
ccaggtaagtctcatttttctg

SEQ ID NO: 1106836 - DNA, 22 bp, Artificial Sequence
  chemically synthesized
cacaaagttggtcagaaaaatg

SEQ ID NO: 1106837 - DNA, 22 bp, Artificial Sequence
  chemically synthesized
caggtaagtctcatttttctga

SEQ ID NO: 1106838 - DNA, 22 bp, Artificial Sequence
  chemically synthesized
acacaaagttggtcagaaaaat

SEQ ID NO: 1106839 - DNA, 22 bp, Artificial Sequence
  chemically synthesized
tacttacacaaagttggtcaga

SEQ ID NO: 1106840 - DNA, 22 bp, Artificial Sequence
  chemically synthesized
atacttacacaaagttggtcag

SEQ ID NO: 1106841 - DNA, 22 bp, Artificial Sequence
  chemically synthesized
atttttctgaccaactttgtgt

SEQ ID NO: 1106842 - DNA, 22 bp, Artificial Sequence
  chemically synthesized
ttctgaccaactttgtgtaagt

SEQ ID NO: 1106843 - DNA, 22 bp, Artificial Sequence
  chemically synthesized
tctgaccaactttgtgtaagta

SEQ ID NO: 1106844 - DNA, 22 bp, Artificial Sequence
  chemically synthesized
ctgaccaactttgtgtaagtat

SEQ ID NO: 1106845 - DNA, 22 bp, Artificial Sequence
  chemically synthesized
tgaccaactttgtgtaagtata

SEQ ID NO: 1106846 - DNA, 22 bp, Artificial Sequence
  chemically synthesized
tagtgtggtagtttatacttac

SEQ ID NO: 1106847 - DNA, 22 bp, Artificial Sequence
  chemically synthesized
accaactttgtgtaagtataaa

SEQ ID NO: 1106848 - DNA, 22 bp, Artificial Sequence
  chemically synthesized
tgtagtgtggtagtttatactt

SEQ ID NO: 1106849 - DNA, 22 bp, Artificial Sequence
  chemically synthesized
ctgtagtgtggtagtttatact

SEQ ID NO: 1106850 - DNA, 22 bp, Artificial Sequence
  chemically synthesized
tgtgtaagtataaactaccaca

SEQ ID NO: 1106851 - DNA, 22 bp, Artificial Sequence
  chemically synthesized
gtgtaagtataaactaccacac

SEQ ID NO: 1106852 - DNA, 22 bp, Artificial Sequence
  chemically synthesized
tgtaagtataaactaccacact

SEQ ID NO: 1106853 - DNA, 22 bp, Artificial Sequence
  chemically synthesized
ataaatatttctgtagtgtggt

SEQ ID NO: 1106854 - DNA, 22 bp, Artificial Sequence
  chemically synthesized
taataaatatttctgtagtgtg

SEQ ID NO: 1106855 - DNA, 22 bp, Artificial Sequence
  chemically synthesized
aattctaataaatatttctgta

SEQ ID NO: 1106856 - DNA, 22 bp, Artificial Sequence
  chemically synthesized
aaattctaataaatatttctgt

SEQ ID NO: 1106857 - DNA, 22 bp, Artificial Sequence
  chemically synthesized
ttaaattctaataaatatttct

SEQ ID NO: 1106858 - DNA, 22 bp, Artificial Sequence
  chemically synthesized
ccacactacagaaatatttatt

SEQ ID NO: 1106859 - DNA, 22 bp, Artificial Sequence
  chemically synthesized
cagaaatatttattagaattta

SEQ ID NO: 1106860 - DNA, 22 bp, Artificial Sequence
  chemically synthesized
agcaaaagaaaaaaactcttaa

SEQ ID NO: 1106861 - DNA, 22 bp, Artificial Sequence
  chemically synthesized
attagaatttaagagttttttt

SEQ ID NO: 1106862 - DNA, 22 bp, Artificial Sequence
  chemically synthesized
ttagaatttaagagtttttttc

SEQ ID NO: 1106863 - DNA, 22 bp, Artificial Sequence
  chemically synthesized
gaatttaagagtttttttcttt

SEQ ID NO: 1106864 - DNA, 22 bp, Artificial Sequence
  chemically synthesized
aagagtttttttcttttgctga

SEQ ID NO: 1106865 - DNA, 22 bp, Artificial Sequence
  chemically synthesized
agagtttttttcttttgctgaa

SEQ ID NO: 1106866 - DNA, 22 bp, Artificial Sequence
  chemically synthesized
gaaaaagggaaaattcagcaaa

SEQ ID NO: 1106867 - DNA, 22 bp, Artificial Sequence
  chemically synthesized
agaaaaagggaaaattcagcaa

SEQ ID NO: 1106868 - DNA, 22 bp, Artificial Sequence
  chemically synthesized
tagaaaaagggaaaattcagca

SEQ ID NO: 1106869 - DNA, 22 bp, Artificial Sequence
  chemically synthesized
ttagaaaaagggaaaattcagc

SEQ ID NO: 1106870 - DNA, 22 bp, Artificial Sequence
  chemically synthesized
ttttcttttgctgaattttccc

SEQ ID NO: 1106871 - DNA, 22 bp, Artificial Sequence
  chemically synthesized
cttttagaaaaagggaaaattc

SEQ ID NO: 1106872 - DNA, 22 bp, Artificial Sequence
  chemically synthesized
tttcttttgctgaattttccct

SEQ ID NO: 1106873 - DNA, 22 bp, Artificial Sequence
  chemically synthesized
ttcttttgctgaattttccctt

SEQ ID NO: 1106874 - DNA, 22 bp, Artificial Sequence
  chemically synthesized
tcttttgctgaattttcccttt

SEQ ID NO: 1106875 - DNA, 22 bp, Artificial Sequence
  chemically synthesized
cttttgctgaattttccctttt

SEQ ID NO: 1106876 - DNA, 22 bp, Artificial Sequence
  chemically synthesized
ttttgctgaattttcccttttt

SEQ ID NO: 1106877 - DNA, 22 bp, Artificial Sequence
  chemically synthesized
ttgctgaattttccctttttct

SEQ ID NO: 1106878 - DNA, 22 bp, Artificial Sequence
  chemically synthesized
tgctgaattttccctttttcta

SEQ ID NO: 1106879 - DNA, 22 bp, Artificial Sequence
  chemically synthesized
gctgaattttccctttttctaa

SEQ ID NO: 1106880 - DNA, 22 bp, Artificial Sequence
  chemically synthesized
ctgaattttccctttttctaaa

SEQ ID NO: 1106881 - DNA, 22 bp, Artificial Sequence
  chemically synthesized
aattttccctttttctaaaagc

SEQ ID NO: 1106882 - DNA, 22 bp, Artificial Sequence
  chemically synthesized
agtggatagagctgcttttaga

SEQ ID NO: 1106883 - DNA, 22 bp, Artificial Sequence
  chemically synthesized
ctaagtggatagagctgctttt

SEQ ID NO: 1106884 - DNA, 22 bp, Artificial Sequence
  chemically synthesized
tccctttttctaaaagcagctc

SEQ ID NO: 1106885 - DNA, 22 bp, Artificial Sequence
  chemically synthesized
ccctttttctaaaagcagctct

SEQ ID NO: 1106886 - DNA, 22 bp, Artificial Sequence
  chemically synthesized
cctttttctaaaagcagctcta

SEQ ID NO: 1106887 - DNA, 22 bp, Artificial Sequence
  chemically synthesized
tttctaaaagcagctctatcca

SEQ ID NO: 1106888 - DNA, 22 bp, Artificial Sequence
  chemically synthesized
ttctaaaagcagctctatccac

SEQ ID NO: 1106889 - DNA, 22 bp, Artificial Sequence
  chemically synthesized
tctaaaagcagctctatccact

SEQ ID NO: 1106890 - DNA, 22 bp, Artificial Sequence
  chemically synthesized
ctaaaagcagctctatccactt

SEQ ID NO: 1106891 - DNA, 22 bp, Artificial Sequence
  chemically synthesized
taaaagcagctctatccactta

SEQ ID NO: 1106892 - DNA, 22 bp, Artificial Sequence
  chemically synthesized
aaaataggattgctaagtggat

SEQ ID NO: 1106893 - DNA, 22 bp, Artificial Sequence
  chemically synthesized
aaagcagctctatccacttagc

SEQ ID NO: 1106894 - DNA, 22 bp, Artificial Sequence
  chemically synthesized
gaaaataggattgctaagtgga

SEQ ID NO: 1106895 - DNA, 22 bp, Artificial Sequence
  chemically synthesized
tgaaaataggattgctaagtgg

SEQ ID NO: 1106896 - DNA, 22 bp, Artificial Sequence
  chemically synthesized
tatccacttagcaatcctattt

SEQ ID NO: 1106897 - DNA, 22 bp, Artificial Sequence
  chemically synthesized
tccacttagcaatcctattttc

SEQ ID NO: 1106898 - DNA, 22 bp, Artificial Sequence
  chemically synthesized
acatgatattttgaaaatagga

SEQ ID NO: 1106899 - DNA, 22 bp, Artificial Sequence
  chemically synthesized
aacatgatattttgaaaatagg

SEQ ID NO: 1106900 - DNA, 22 bp, Artificial Sequence
  chemically synthesized
agcaatcctattttcaaaatat

SEQ ID NO: 1106901 - DNA, 22 bp, Artificial Sequence
  chemically synthesized
gcaatcctattttcaaaatatc

SEQ ID NO: 1106902 - DNA, 22 bp, Artificial Sequence
  chemically synthesized
aatatgaaatagtttaacatga

SEQ ID NO: 1106903 - DNA, 22 bp, Artificial Sequence
  chemically synthesized
ttttcaaaatatcatgttaaac

SEQ ID NO: 1106904 - DNA, 22 bp, Artificial Sequence
  chemically synthesized
tcaaaatatcatgttaaactat

SEQ ID NO: 1106905 - DNA, 22 bp, Artificial Sequence
  chemically synthesized
gttaaatatgaaatagtttaac

SEQ ID NO: 1106906 - DNA, 22 bp, Artificial Sequence
  chemically synthesized
caaaatatcatgttaaactatt

SEQ ID NO: 1106907 - DNA, 22 bp, Artificial Sequence
  chemically synthesized
aaaatatcatgttaaactattt

SEQ ID NO: 1106908 - DNA, 22 bp, Artificial Sequence
  chemically synthesized
ttagttaaatatgaaatagttt

SEQ ID NO: 1106909 - DNA, 22 bp, Artificial Sequence
  chemically synthesized
gttagttaaatatgaaatagtt

SEQ ID NO: 1106910 - DNA, 22 bp, Artificial Sequence
  chemically synthesized
tttgttagttaaatatgaaata

SEQ ID NO: 1106911 - DNA, 22 bp, Artificial Sequence
  chemically synthesized
ttatttgttagttaaatatgaa

SEQ ID NO: 1106912 - DNA, 22 bp, Artificial Sequence
  chemically synthesized
aactatttcatatttaactaac

SEQ ID NO: 1106913 - DNA, 22 bp, Artificial Sequence
  chemically synthesized
tttcatatttaactaacaaata

SEQ ID NO: 1106914 - DNA, 22 bp, Artificial Sequence
  chemically synthesized
catatttaactaacaaataata

SEQ ID NO: 1106915 - DNA, 22 bp, Artificial Sequence
  chemically synthesized
atatttaactaacaaataataa

SEQ ID NO: 1106916 - DNA, 22 bp, Artificial Sequence
  chemically synthesized
aactaacaaataataattatgt

SEQ ID NO: 1106917 - DNA, 22 bp, Artificial Sequence
  chemically synthesized
actaacaaataataattatgtg

SEQ ID NO: 1106918 - DNA, 22 bp, Artificial Sequence
  chemically synthesized
acaaataataattatgtgtatt

SEQ ID NO: 1106919 - DNA, 22 bp, Artificial Sequence
  chemically synthesized
tgtgtatttatggggtatcatg

SEQ ID NO: 1106920 - DNA, 22 bp, Artificial Sequence
  chemically synthesized
atggggtatcatgtgatgtttt

SEQ ID NO: 1106921 - DNA, 22 bp, Artificial Sequence
  chemically synthesized
tggggtatcatgtgatgttttg

SEQ ID NO: 1106922 - DNA, 22 bp, Artificial Sequence
  chemically synthesized
caatgcatacatagatcaaaac

SEQ ID NO: 1106923 - DNA, 22 bp, Artificial Sequence
  chemically synthesized
acaatgcatacatagatcaaaa

SEQ ID NO: 1106924 - DNA, 22 bp, Artificial Sequence
  chemically synthesized
tacaatgcatacatagatcaaa

SEQ ID NO: 1106925 - DNA, 22 bp, Artificial Sequence
  chemically synthesized
agtgaatattttacaatgcata

SEQ ID NO: 1106926 - DNA, 22 bp, Artificial Sequence
  chemically synthesized
tgatctatgtatgcattgtaaa

SEQ ID NO: 1106927 - DNA, 22 bp, Artificial Sequence
  chemically synthesized
gatctatgtatgcattgtaaaa

SEQ ID NO: 1106928 - DNA, 22 bp, Artificial Sequence
  chemically synthesized
atctatgtatgcattgtaaaat

SEQ ID NO: 1106929 - DNA, 22 bp, Artificial Sequence
  chemically synthesized
acctgagtgaatattttacaat

SEQ ID NO: 1106930 - DNA, 22 bp, Artificial Sequence
  chemically synthesized
attaacctgagtgaatatttta

SEQ ID NO: 1106931 - DNA, 22 bp, Artificial Sequence
  chemically synthesized
tgtatgcattgtaaaatattca

SEQ ID NO: 1106932 - DNA, 22 bp, Artificial Sequence
  chemically synthesized
atatgttaattaacctgagtga

SEQ ID NO: 1106933 - DNA, 22 bp, Artificial Sequence
  chemically synthesized
taaaatattcactcaggttaat

SEQ ID NO: 1106934 - DNA, 22 bp, Artificial Sequence
  chemically synthesized
gtgaggtgattaatatgttaat

SEQ ID NO: 1106935 - DNA, 22 bp, Artificial Sequence
  chemically synthesized
actcaggttaattaacatatta

SEQ ID NO: 1106936 - DNA, 22 bp, Artificial Sequence
  chemically synthesized
aggttaattaacatattaatca

SEQ ID NO: 1106937 - DNA, 22 bp, Artificial Sequence
  chemically synthesized
attaacatattaatcacctcac

SEQ ID NO: 1106938 - DNA, 22 bp, Artificial Sequence
  chemically synthesized
acatattaatcacctcaccaac

SEQ ID NO: 1106939 - DNA, 22 bp, Artificial Sequence
  chemically synthesized
atcacctcaccaacttatcttt

SEQ ID NO: 1106940 - DNA, 22 bp, Artificial Sequence
  chemically synthesized
atatccgcatcacaaaaaaaga

SEQ ID NO: 1106941 - DNA, 22 bp, Artificial Sequence
  chemically synthesized
aatatccgcatcacaaaaaaag

SEQ ID NO: 1106942 - DNA, 22 bp, Artificial Sequence
  chemically synthesized
taatatccgcatcacaaaaaaa

SEQ ID NO: 1106943 - DNA, 22 bp, Artificial Sequence
  chemically synthesized
accaacttatctttttttgtga

SEQ ID NO: 1106944 - DNA, 22 bp, Artificial Sequence
  chemically synthesized
atctttttttgtgatgcggata

SEQ ID NO: 1106945 - DNA, 22 bp, Artificial Sequence
  chemically synthesized
tctttttttgtgatgcggatat

SEQ ID NO: 1106946 - DNA, 22 bp, Artificial Sequence
  chemically synthesized
tttttgtgatgcggatattaaa

SEQ ID NO: 1106947 - DNA, 22 bp, Artificial Sequence
  chemically synthesized
ttttgtgatgcggatattaaaa

SEQ ID NO: 1106948 - DNA, 22 bp, Artificial Sequence
  chemically synthesized
tttgtgatgcggatattaaaat

SEQ ID NO: 1106949 - DNA, 22 bp, Artificial Sequence
  chemically synthesized
gtaaaagaatagattttaatat

SEQ ID NO: 1106950 - DNA, 22 bp, Artificial Sequence
  chemically synthesized
ttgtgatgcggatattaaaatc

SEQ ID NO: 1106951 - DNA, 22 bp, Artificial Sequence
  chemically synthesized
tgtgatgcggatattaaaatct

SEQ ID NO: 1106952 - DNA, 22 bp, Artificial Sequence
  chemically synthesized
gtgatgcggatattaaaatcta

SEQ ID NO: 1106953 - DNA, 22 bp, Artificial Sequence
  chemically synthesized
tgatgcggatattaaaatctat

SEQ ID NO: 1106954 - DNA, 22 bp, Artificial Sequence
  chemically synthesized
aaaattggtaaaagaatagatt

SEQ ID NO: 1106955 - DNA, 22 bp, Artificial Sequence
  chemically synthesized
caaaattggtaaaagaatagat

SEQ ID NO: 1106956 - DNA, 22 bp, Artificial Sequence
  chemically synthesized
tgtttcaaaattggtaaaagaa

SEQ ID NO: 1106957 - DNA, 22 bp, Artificial Sequence
  chemically synthesized
aaatctattcttttaccaattt

SEQ ID NO: 1106958 - DNA, 22 bp, Artificial Sequence
  chemically synthesized
ataaaaatctatgtttcaaaat

SEQ ID NO: 1106959 - DNA, 22 bp, Artificial Sequence
  chemically synthesized
ttcttttaccaattttgaaaca

SEQ ID NO: 1106960 - DNA, 22 bp, Artificial Sequence
  chemically synthesized
ttttaccaattttgaaacatag

SEQ ID NO: 1106961 - DNA, 22 bp, Artificial Sequence
  chemically synthesized
ttaccaattttgaaacatagat

SEQ ID NO: 1106962 - DNA, 22 bp, Artificial Sequence
  chemically synthesized
taccaattttgaaacatagatt

SEQ ID NO: 1106963 - DNA, 22 bp, Artificial Sequence
  chemically synthesized
accaattttgaaacatagattt

SEQ ID NO: 1106964 - DNA, 22 bp, Artificial Sequence
  chemically synthesized
ccaattttgaaacatagatttt

SEQ ID NO: 1106965 - DNA, 22 bp, Artificial Sequence
  chemically synthesized
tgaaacatagatttttattaac

SEQ ID NO: 1106966 - DNA, 22 bp, Artificial Sequence
  chemically synthesized
gaaacatagatttttattaact

SEQ ID NO: 1106967 - DNA, 22 bp, Artificial Sequence
  chemically synthesized
cgtggtggacacagttaataaa

SEQ ID NO: 1106968 - DNA, 22 bp, Artificial Sequence
  chemically synthesized
aaacatagatttttattaactg

SEQ ID NO: 1106969 - DNA, 22 bp, Artificial Sequence
  chemically synthesized
gtactgcgtggtggacacagtt

SEQ ID NO: 1106970 - DNA, 22 bp, Artificial Sequence
  chemically synthesized
tagtactgcgtggtggacacag

SEQ ID NO: 1106971 - DNA, 22 bp, Artificial Sequence
  chemically synthesized
ttattaactgtgtccaccacgc

SEQ ID NO: 1106972 - DNA, 22 bp, Artificial Sequence
  chemically synthesized
tattaactgtgtccaccacgca

SEQ ID NO: 1106973 - DNA, 22 bp, Artificial Sequence
  chemically synthesized
attaactgtgtccaccacgcag

SEQ ID NO: 1106974 - DNA, 22 bp, Artificial Sequence
  chemically synthesized
ttaactgtgtccaccacgcagt

SEQ ID NO: 1106975 - DNA, 22 bp, Artificial Sequence
  chemically synthesized
tagcgatctctagtactgcgtg

SEQ ID NO: 1106976 - DNA, 22 bp, Artificial Sequence
  chemically synthesized
actgtgtccaccacgcagtact

SEQ ID NO: 1106977 - DNA, 22 bp, Artificial Sequence
  chemically synthesized
tgtccaccacgcagtactagag

SEQ ID NO: 1106978 - DNA, 22 bp, Artificial Sequence
  chemically synthesized
gaggaataaattgtagcgatct

SEQ ID NO: 1106979 - DNA, 22 bp, Artificial Sequence
  chemically synthesized
gactggaggaataaattgtagc

SEQ ID NO: 1106980 - DNA, 22 bp, Artificial Sequence
  chemically synthesized
agttagactggaggaataaatt

SEQ ID NO: 1106981 - DNA, 22 bp, Artificial Sequence
  chemically synthesized
gagatcgctacaatttattcct

SEQ ID NO: 1106982 - DNA, 22 bp, Artificial Sequence
  chemically synthesized
cagttagactggaggaataaat

SEQ ID NO: 1106983 - DNA, 22 bp, Artificial Sequence
  chemically synthesized
caatttattcctccagtctaac

SEQ ID NO: 1106984 - DNA, 22 bp, Artificial Sequence
  chemically synthesized
attcctccagtctaactgaaac

SEQ ID NO: 1106985 - DNA, 22 bp, Artificial Sequence
  chemically synthesized
ttcctccagtctaactgaaact

SEQ ID NO: 1106986 - DNA, 22 bp, Artificial Sequence
  chemically synthesized
atcaaatgatagaaagtttcag

SEQ ID NO: 1106987 - DNA, 22 bp, Artificial Sequence
  chemically synthesized
ctccagtctaactgaaactttc

SEQ ID NO: 1106988 - DNA, 22 bp, Artificial Sequence
  chemically synthesized
cagtctaactgaaactttctat

SEQ ID NO: 1106989 - DNA, 22 bp, Artificial Sequence
  chemically synthesized
actgaaactttctatcatttga

SEQ ID NO: 1106990 - DNA, 22 bp, Artificial Sequence
  chemically synthesized
aaactttctatcatttgatcaa

SEQ ID NO: 1106991 - DNA, 22 bp, Artificial Sequence
  chemically synthesized
ggaaagggaaggtgttgatcaa

SEQ ID NO: 1106992 - DNA, 22 bp, Artificial Sequence
  chemically synthesized
tctatcatttgatcaacacctt

SEQ ID NO: 1106993 - DNA, 22 bp, Artificial Sequence
  chemically synthesized
ctatcatttgatcaacaccttc

SEQ ID NO: 1106994 - DNA, 22 bp, Artificial Sequence
  chemically synthesized
tatcatttgatcaacaccttcc

SEQ ID NO: 1106995 - DNA, 22 bp, Artificial Sequence
  chemically synthesized
tcatttgatcaacaccttccct

SEQ ID NO: 1106996 - DNA, 22 bp, Artificial Sequence
  chemically synthesized
gatcaacaccttccctttccca

SEQ ID NO: 1106997 - DNA, 22 bp, Artificial Sequence
  chemically synthesized
atcaacaccttccctttcccaa

SEQ ID NO: 1106998 - DNA, 22 bp, Artificial Sequence
  chemically synthesized
gggggaagaggaaggttgggaa

SEQ ID NO: 1106999 - DNA, 22 bp, Artificial Sequence
  chemically synthesized
ccctttcccaaccttcctcttc

SEQ ID NO: 1107000 - DNA, 22 bp, Artificial Sequence
  chemically synthesized
cctttcccaaccttcctcttcc

SEQ ID NO: 1107001 - DNA, 22 bp, Artificial Sequence
  chemically synthesized
ccagagactggggggaagagga

SEQ ID NO: 1107002 - DNA, 22 bp, Artificial Sequence
  chemically synthesized
tcccaaccttcctcttcccccc

SEQ ID NO: 1107003 - DNA, 22 bp, Artificial Sequence
  chemically synthesized
cccaaccttcctcttcccccca

SEQ ID NO: 1107004 - DNA, 22 bp, Artificial Sequence
  chemically synthesized
ccaaccttcctcttccccccag

SEQ ID NO: 1107005 - DNA, 22 bp, Artificial Sequence
  chemically synthesized
cctcttccccccagtctctggt

SEQ ID NO: 1107006 - DNA, 22 bp, Artificial Sequence
  chemically synthesized
ctcttccccccagtctctggta

SEQ ID NO: 1107007 - DNA, 22 bp, Artificial Sequence
  chemically synthesized
ttccccccagtctctggtaact

SEQ ID NO: 1107008 - DNA, 22 bp, Artificial Sequence
  chemically synthesized
ccccccagtctctggtaactac

SEQ ID NO: 1107009 - DNA, 22 bp, Artificial Sequence
  chemically synthesized
cccccagtctctggtaactacc

SEQ ID NO: 1107010 - DNA, 22 bp, Artificial Sequence
  chemically synthesized
tagaaacagaaaatagaaaggt

SEQ ID NO: 1107011 - DNA, 22 bp, Artificial Sequence
  chemically synthesized
tggtaactacctttctattttc

SEQ ID NO: 1107012 - DNA, 22 bp, Artificial Sequence
  chemically synthesized
gtaactacctttctattttctg

SEQ ID NO: 1107013 - DNA, 22 bp, Artificial Sequence
  chemically synthesized
cctttctattttctgtttctat

SEQ ID NO: 1107014 - DNA, 22 bp, Artificial Sequence
  chemically synthesized
tctattttctgtttctataatt

SEQ ID NO: 1107015 - DNA, 22 bp, Artificial Sequence
  chemically synthesized
ctattttctgtttctataattt

SEQ ID NO: 1107016 - DNA, 22 bp, Artificial Sequence
  chemically synthesized
tattttctgtttctataatttg

SEQ ID NO: 1107017 - DNA, 22 bp, Artificial Sequence
  chemically synthesized
ttttctgtttctataatttgac

SEQ ID NO: 1107018 - DNA, 22 bp, Artificial Sequence
  chemically synthesized
tctgtttctataatttgacttt

SEQ ID NO: 1107019 - DNA, 22 bp, Artificial Sequence
  chemically synthesized
ctgtttctataatttgactttt

SEQ ID NO: 1107020 - DNA, 22 bp, Artificial Sequence
  chemically synthesized
tgtttctataatttgacttttt

SEQ ID NO: 1107021 - DNA, 22 bp, Artificial Sequence
  chemically synthesized
tttctataatttgacttttttt

SEQ ID NO: 1107022 - DNA, 22 bp, Artificial Sequence
  chemically synthesized
tatgagaaatccaaaaaaaagt

SEQ ID NO: 1107023 - DNA, 22 bp, Artificial Sequence
  chemically synthesized
atatgagaaatccaaaaaaaag

SEQ ID NO: 1107024 - DNA, 22 bp, Artificial Sequence
  chemically synthesized
ctataatttgacttttttttgg

SEQ ID NO: 1107025 - DNA, 22 bp, Artificial Sequence
  chemically synthesized
tataatttgacttttttttgga

SEQ ID NO: 1107026 - DNA, 22 bp, Artificial Sequence
  chemically synthesized
taatttgacttttttttggatt

SEQ ID NO: 1107027 - DNA, 22 bp, Artificial Sequence
  chemically synthesized
acttatatgagaaatccaaaaa

SEQ ID NO: 1107028 - DNA, 22 bp, Artificial Sequence
  chemically synthesized
gacttttttttggatttctcat

SEQ ID NO: 1107029 - DNA, 22 bp, Artificial Sequence
  chemically synthesized
acttttttttggatttctcata

SEQ ID NO: 1107030 - DNA, 22 bp, Artificial Sequence
  chemically synthesized
tatgatctcacttatatgagaa

SEQ ID NO: 1107031 - DNA, 22 bp, Artificial Sequence
  chemically synthesized
ttttttggatttctcatataag

SEQ ID NO: 1107032 - DNA, 22 bp, Artificial Sequence
  chemically synthesized
tttttggatttctcatataagt

SEQ ID NO: 1107033 - DNA, 22 bp, Artificial Sequence
  chemically synthesized
ttttggatttctcatataagtg

SEQ ID NO: 1107034 - DNA, 22 bp, Artificial Sequence
  chemically synthesized
tttggatttctcatataagtga

SEQ ID NO: 1107035 - DNA, 22 bp, Artificial Sequence
  chemically synthesized
ttggatttctcatataagtgag

SEQ ID NO: 1107036 - DNA, 22 bp, Artificial Sequence
  chemically synthesized
tggatttctcatataagtgaga

SEQ ID NO: 1107037 - DNA, 22 bp, Artificial Sequence
  chemically synthesized
ggatttctcatataagtgagat

SEQ ID NO: 1107038 - DNA, 22 bp, Artificial Sequence
  chemically synthesized
gatttctcatataagtgagatc

SEQ ID NO: 1107039 - DNA, 22 bp, Artificial Sequence
  chemically synthesized
ctcatataagtgagatcataca

SEQ ID NO: 1107040 - DNA, 22 bp, Artificial Sequence
  chemically synthesized
tcatataagtgagatcatacag

SEQ ID NO: 1107041 - DNA, 22 bp, Artificial Sequence
  chemically synthesized
atataagtgagatcatacagta

SEQ ID NO: 1107042 - DNA, 22 bp, Artificial Sequence
  chemically synthesized
aaatgagccaggcaaagaaaga

SEQ ID NO: 1107043 - DNA, 22 bp, Artificial Sequence
  chemically synthesized
gctgaaatgagccaggcaaaga

SEQ ID NO: 1107044 - DNA, 22 bp, Artificial Sequence
  chemically synthesized
ggctagctgaaatgagccaggc

SEQ ID NO: 1107045 - DNA, 22 bp, Artificial Sequence
  chemically synthesized
gtctttctttgcctggctcatt

SEQ ID NO: 1107046 - DNA, 22 bp, Artificial Sequence
  chemically synthesized
tctttctttgcctggctcattt

SEQ ID NO: 1107047 - DNA, 22 bp, Artificial Sequence
  chemically synthesized
tctttgcctggctcatttcagc

SEQ ID NO: 1107048 - DNA, 22 bp, Artificial Sequence
  chemically synthesized
ctttgcctggctcatttcagct

SEQ ID NO: 1107049 - DNA, 22 bp, Artificial Sequence
  chemically synthesized
tttgcctggctcatttcagcta

SEQ ID NO: 1107050 - DNA, 22 bp, Artificial Sequence
  chemically synthesized
gcggacattaggctagctgaaa

SEQ ID NO: 1107051 - DNA, 22 bp, Artificial Sequence
  chemically synthesized
tgcctggctcatttcagctagc

SEQ ID NO: 1107052 - DNA, 22 bp, Artificial Sequence
  chemically synthesized
gcctggctcatttcagctagcc

SEQ ID NO: 1107053 - DNA, 22 bp, Artificial Sequence
  chemically synthesized
cctggctcatttcagctagcct

SEQ ID NO: 1107054 - DNA, 22 bp, Artificial Sequence
  chemically synthesized
gctcatttcagctagcctaatg

SEQ ID NO: 1107055 - DNA, 22 bp, Artificial Sequence
  chemically synthesized
atttcagctagcctaatgtccg

SEQ ID NO: 1107056 - DNA, 22 bp, Artificial Sequence
  chemically synthesized
cagctagcctaatgtccgccag

SEQ ID NO: 1107057 - DNA, 22 bp, Artificial Sequence
  chemically synthesized
agctagcctaatgtccgccagt

SEQ ID NO: 1107058 - DNA, 22 bp, Artificial Sequence
  chemically synthesized
ccaccatgtagatagaactggc

SEQ ID NO: 1107059 - DNA, 22 bp, Artificial Sequence
  chemically synthesized
gcctaatgtccgccagttctat

SEQ ID NO: 1107060 - DNA, 22 bp, Artificial Sequence
  chemically synthesized
gccaccatgtagatagaactgg

SEQ ID NO: 1107061 - DNA, 22 bp, Artificial Sequence
  chemically synthesized
atgtccgccagttctatctaca

SEQ ID NO: 1107062 - DNA, 22 bp, Artificial Sequence
  chemically synthesized
tcatttgccaccatgtagatag

SEQ ID NO: 1107063 - DNA, 22 bp, Artificial Sequence
  chemically synthesized
tgtcatttgccaccatgtagat

SEQ ID NO: 1107064 - DNA, 22 bp, Artificial Sequence
  chemically synthesized
ctgtcatttgccaccatgtaga

SEQ ID NO: 1107065 - DNA, 22 bp, Artificial Sequence
  chemically synthesized
tatctacatggtggcaaatgac

SEQ ID NO: 1107066 - DNA, 22 bp, Artificial Sequence
  chemically synthesized
tctacatggtggcaaatgacag

SEQ ID NO: 1107067 - DNA, 22 bp, Artificial Sequence
  chemically synthesized
aaaggaaggaatttctgtcatt

SEQ ID NO: 1107068 - DNA, 22 bp, Artificial Sequence
  chemically synthesized
aaaaggaaggaatttctgtcat

SEQ ID NO: 1107069 - DNA, 22 bp, Artificial Sequence
  chemically synthesized
catggtggcaaatgacagaaat

SEQ ID NO: 1107070 - DNA, 22 bp, Artificial Sequence
  chemically synthesized
taaaaggaaggaatttctgtca

SEQ ID NO: 1107071 - DNA, 22 bp, Artificial Sequence
  chemically synthesized
tacagtctttaaaaggaaggaa

SEQ ID NO: 1107072 - DNA, 22 bp, Artificial Sequence
  chemically synthesized
cttccttttaaagactgtatag

SEQ ID NO: 1107073 - DNA, 22 bp, Artificial Sequence
  chemically synthesized
ccttttaaagactgtatagtat

SEQ ID NO: 1107074 - DNA, 22 bp, Artificial Sequence
  chemically synthesized
cttttaaagactgtatagtatt

SEQ ID NO: 1107075 - DNA, 22 bp, Artificial Sequence
  chemically synthesized
ttaaagactgtatagtattcca

SEQ ID NO: 1107076 - DNA, 22 bp, Artificial Sequence
  chemically synthesized
taaagactgtatagtattccat

SEQ ID NO: 1107077 - DNA, 22 bp, Artificial Sequence
  chemically synthesized
aaagactgtatagtattccatt

SEQ ID NO: 1107078 - DNA, 22 bp, Artificial Sequence
  chemically synthesized
aagactgtatagtattccattg

SEQ ID NO: 1107079 - DNA, 22 bp, Artificial Sequence
  chemically synthesized
tatatgatatatatatgcaatg

SEQ ID NO: 1107080 - DNA, 22 bp, Artificial Sequence
  chemically synthesized
tatagtattccattgcatatat

SEQ ID NO: 1107081 - DNA, 22 bp, Artificial Sequence
  chemically synthesized
cagtgtctatatatgatatata

SEQ ID NO: 1107082 - DNA, 22 bp, Artificial Sequence
  chemically synthesized
cattgcatatatatatcatata

SEQ ID NO: 1107083 - DNA, 22 bp, Artificial Sequence
  chemically synthesized
catatatatatcatatatagac

SEQ ID NO: 1107084 - DNA, 22 bp, Artificial Sequence
  chemically synthesized
gaatatatttatcactatatat

SEQ ID NO: 1107085 - DNA, 22 bp, Artificial Sequence
  chemically synthesized
atatatatagtgacatatatat

SEQ ID NO: 1107086 - DNA, 22 bp, Artificial Sequence
  chemically synthesized
atcactatatatatatgtcact

SEQ ID NO: 1107087 - DNA, 22 bp, Artificial Sequence
  chemically synthesized
tcactatatatatatgtcacta

SEQ ID NO: 1107088 - DNA, 22 bp, Artificial Sequence
  chemically synthesized
tatatatatgtcactatatata

SEQ ID NO: 1107089 - DNA, 22 bp, Artificial Sequence
  chemically synthesized
atatatagagatatatatactg

SEQ ID NO: 1107090 - DNA, 22 bp, Artificial Sequence
  chemically synthesized
tatatatcagtatatatatctc

SEQ ID NO: 1107091 - DNA, 22 bp, Artificial Sequence
  chemically synthesized
tatatactgatatatagagata

SEQ ID NO: 1107092 - DNA, 22 bp, Artificial Sequence
  chemically synthesized
atatatactgatatatagagat

SEQ ID NO: 1107093 - DNA, 22 bp, Artificial Sequence
  chemically synthesized
tatatatcagtatatataaatc

SEQ ID NO: 1107094 - DNA, 22 bp, Artificial Sequence
  chemically synthesized
tatatcagtatatataaatcac

SEQ ID NO: 1107095 - DNA, 22 bp, Artificial Sequence
  chemically synthesized
tatatatctaccactatgcata

SEQ ID NO: 1107096 - DNA, 22 bp, Artificial Sequence
  chemically synthesized
ccactatgcatatatcactata

SEQ ID NO: 1107097 - DNA, 22 bp, Artificial Sequence
  chemically synthesized
tgcatatatcactatatatatc

SEQ ID NO: 1107098 - DNA, 22 bp, Artificial Sequence
  chemically synthesized
caggacgaatggataaagaaaa

SEQ ID NO: 1107099 - DNA, 22 bp, Artificial Sequence
  chemically synthesized
tatatatcacattttctttatc

SEQ ID NO: 1107100 - DNA, 22 bp, Artificial Sequence
  chemically synthesized
ttacaggacgaatggataaaga

SEQ ID NO: 1107101 - DNA, 22 bp, Artificial Sequence
  chemically synthesized
aatgtctattacaggacgaatg

SEQ ID NO: 1107102 - DNA, 22 bp, Artificial Sequence
  chemically synthesized
tctttatccattcgtcctgtaa

SEQ ID NO: 1107103 - DNA, 22 bp, Artificial Sequence
  chemically synthesized
ctttatccattcgtcctgtaat

SEQ ID NO: 1107104 - DNA, 22 bp, Artificial Sequence
  chemically synthesized
tttatccattcgtcctgtaata

SEQ ID NO: 1107105 - DNA, 22 bp, Artificial Sequence
  chemically synthesized
tatccattcgtcctgtaataga

SEQ ID NO: 1107106 - DNA, 22 bp, Artificial Sequence
  chemically synthesized
atccattcgtcctgtaatagac

SEQ ID NO: 1107107 - DNA, 22 bp, Artificial Sequence
  chemically synthesized
tccattcgtcctgtaatagaca

SEQ ID NO: 1107108 - DNA, 22 bp, Artificial Sequence
  chemically synthesized
gtcctgtaatagacatttaggt

SEQ ID NO: 1107109 - DNA, 22 bp, Artificial Sequence
  chemically synthesized
taatagacatttaggttgtttc

SEQ ID NO: 1107110 - DNA, 22 bp, Artificial Sequence
  chemically synthesized
ataacagccaagatacggaaac

SEQ ID NO: 1107111 - DNA, 22 bp, Artificial Sequence
  chemically synthesized
ttcataacagccaagatacgga

SEQ ID NO: 1107112 - DNA, 22 bp, Artificial Sequence
  chemically synthesized
aggttgtttccgtatcttggct

SEQ ID NO: 1107113 - DNA, 22 bp, Artificial Sequence
  chemically synthesized
ggttgtttccgtatcttggctg

SEQ ID NO: 1107114 - DNA, 22 bp, Artificial Sequence
  chemically synthesized
agcattattcataacagccaag

SEQ ID NO: 1107115 - DNA, 22 bp, Artificial Sequence
  chemically synthesized
gagcattattcataacagccaa

SEQ ID NO: 1107116 - DNA, 22 bp, Artificial Sequence
  chemically synthesized
tttccgtatcttggctgttatg

SEQ ID NO: 1107117 - DNA, 22 bp, Artificial Sequence
  chemically synthesized
ccgtatcttggctgttatgaat

SEQ ID NO: 1107118 - DNA, 22 bp, Artificial Sequence
  chemically synthesized
cgtatcttggctgttatgaata

SEQ ID NO: 1107119 - DNA, 22 bp, Artificial Sequence
  chemically synthesized
ggctgttatgaataatgctcaa

SEQ ID NO: 1107120 - DNA, 22 bp, Artificial Sequence
  chemically synthesized
gctgttatgaataatgctcaaa

SEQ ID NO: 1107121 - DNA, 22 bp, Artificial Sequence
  chemically synthesized
cccatgccatatccatttgagc

SEQ ID NO: 1107122 - DNA, 22 bp, Artificial Sequence
  chemically synthesized
ttatgaataatgctcaaatgga

SEQ ID NO: 1107123 - DNA, 22 bp, Artificial Sequence
  chemically synthesized
ttgcccatgccatatccatttg

SEQ ID NO: 1107124 - DNA, 22 bp, Artificial Sequence
  chemically synthesized
tgaataatgctcaaatggatat

SEQ ID NO: 1107125 - DNA, 22 bp, Artificial Sequence
  chemically synthesized
gttgcccatgccatatccattt

SEQ ID NO: 1107126 - DNA, 22 bp, Artificial Sequence
  chemically synthesized
tgttgcccatgccatatccatt

SEQ ID NO: 1107127 - DNA, 22 bp, Artificial Sequence
  chemically synthesized
ttgttgcccatgccatatccat

SEQ ID NO: 1107128 - DNA, 22 bp, Artificial Sequence
  chemically synthesized
cttttgttgcccatgccatatc

SEQ ID NO: 1107129 - DNA, 22 bp, Artificial Sequence
  chemically synthesized
gcttttgttgcccatgccatat

SEQ ID NO: 1107130 - DNA, 22 bp, Artificial Sequence
  chemically synthesized
tgcttttgttgcccatgccata

SEQ ID NO: 1107131 - DNA, 22 bp, Artificial Sequence
  chemically synthesized
ttgcttttgttgcccatgccat

SEQ ID NO: 1107132 - DNA, 22 bp, Artificial Sequence
  chemically synthesized
tttttgcttttgttgcccatgc

SEQ ID NO: 1107133 - DNA, 22 bp, Artificial Sequence
  chemically synthesized
aaatggatatggcatgggcaac

SEQ ID NO: 1107134 - DNA, 22 bp, Artificial Sequence
  chemically synthesized
tctatttttgcttttgttgccc

SEQ ID NO: 1107135 - DNA, 22 bp, Artificial Sequence
  chemically synthesized
gtctatttttgcttttgttgcc

SEQ ID NO: 1107136 - DNA, 22 bp, Artificial Sequence
  chemically synthesized
atttgtctatttttgcttttgt

SEQ ID NO: 1107137 - DNA, 22 bp, Artificial Sequence
  chemically synthesized
atgcaatctaatttgtctattt

SEQ ID NO: 1107138 - DNA, 22 bp, Artificial Sequence
  chemically synthesized
gatgcaatctaatttgtctatt

SEQ ID NO: 1107139 - DNA, 22 bp, Artificial Sequence
  chemically synthesized
gtttgatgcaatctaatttgtc

SEQ ID NO: 1107140 - DNA, 22 bp, Artificial Sequence
  chemically synthesized
agtttgatgcaatctaatttgt

SEQ ID NO: 1107141 - DNA, 22 bp, Artificial Sequence
  chemically synthesized
tagtttgatgcaatctaatttg

SEQ ID NO: 1107142 - DNA, 22 bp, Artificial Sequence
  chemically synthesized
ttagtttgatgcaatctaattt

SEQ ID NO: 1107143 - DNA, 22 bp, Artificial Sequence
  chemically synthesized
tttagtttgatgcaatctaatt

SEQ ID NO: 1107144 - DNA, 22 bp, Artificial Sequence
  chemically synthesized
tgcaggagctttttagtttgat

SEQ ID NO: 1107145 - DNA, 22 bp, Artificial Sequence
  chemically synthesized
ctgtgcaggagctttttagttt

SEQ ID NO: 1107146 - DNA, 22 bp, Artificial Sequence
  chemically synthesized
cctgtgcaggagctttttagtt

SEQ ID NO: 1107147 - DNA, 22 bp, Artificial Sequence
  chemically synthesized
tcctgtgcaggagctttttagt

SEQ ID NO: 1107148 - DNA, 22 bp, Artificial Sequence
  chemically synthesized
gattgcatcaaactaaaaagct

SEQ ID NO: 1107149 - DNA, 22 bp, Artificial Sequence
  chemically synthesized
ctttcctgtgcaggagcttttt

SEQ ID NO: 1107150 - DNA, 22 bp, Artificial Sequence
  chemically synthesized
cctttcctgtgcaggagctttt

SEQ ID NO: 1107151 - DNA, 22 bp, Artificial Sequence
  chemically synthesized
catcaaactaaaaagctcctgc

SEQ ID NO: 1107152 - DNA, 22 bp, Artificial Sequence
  chemically synthesized
atagtttcctttcctgtgcagg

SEQ ID NO: 1107153 - DNA, 22 bp, Artificial Sequence
  chemically synthesized
ttaatagtttcctttcctgtgc

SEQ ID NO: 1107154 - DNA, 22 bp, Artificial Sequence
  chemically synthesized
aaaagctcctgcacaggaaagg

SEQ ID NO: 1107155 - DNA, 22 bp, Artificial Sequence
  chemically synthesized
tgttaatagtttcctttcctgt

SEQ ID NO: 1107156 - DNA, 22 bp, Artificial Sequence
  chemically synthesized
actctgttaatagtttcctttc

SEQ ID NO: 1107157 - DNA, 22 bp, Artificial Sequence
  chemically synthesized
cactctgttaatagtttccttt

SEQ ID NO: 1107158 - DNA, 22 bp, Artificial Sequence
  chemically synthesized
ttcactctgttaatagtttcct

SEQ ID NO: 1107159 - DNA, 22 bp, Artificial Sequence
  chemically synthesized
ctgcacaggaaaggaaactatt

SEQ ID NO: 1107160 - DNA, 22 bp, Artificial Sequence
  chemically synthesized
cacaggaaaggaaactattaac

SEQ ID NO: 1107161 - DNA, 22 bp, Artificial Sequence
  chemically synthesized
cctcttcactctgttaatagtt

SEQ ID NO: 1107162 - DNA, 22 bp, Artificial Sequence
  chemically synthesized
tgagctgcctcttcactctgtt

SEQ ID NO: 1107163 - DNA, 22 bp, Artificial Sequence
  chemically synthesized
atctgtgagctgcctcttcact

SEQ ID NO: 1107164 - DNA, 22 bp, Artificial Sequence
  chemically synthesized
gatctgtgagctgcctcttcac

SEQ ID NO: 1107165 - DNA, 22 bp, Artificial Sequence
  chemically synthesized
ttgatctgtgagctgcctcttc

SEQ ID NO: 1107166 - DNA, 22 bp, Artificial Sequence
  chemically synthesized
ttaacagagtgaagaggcagct

SEQ ID NO: 1107167 - DNA, 22 bp, Artificial Sequence
  chemically synthesized
tcttgatctgtgagctgcctct

SEQ ID NO: 1107168 - DNA, 22 bp, Artificial Sequence
  chemically synthesized
ctcttgatctgtgagctgcctc

SEQ ID NO: 1107169 - DNA, 22 bp, Artificial Sequence
  chemically synthesized
tctcttgatctgtgagctgcct

SEQ ID NO: 1107170 - DNA, 22 bp, Artificial Sequence
  chemically synthesized
acagagtgaagaggcagctcac

SEQ ID NO: 1107171 - DNA, 22 bp, Artificial Sequence
  chemically synthesized
caaatattttctcttgatctgt

SEQ ID NO: 1107172 - DNA, 22 bp, Artificial Sequence
  chemically synthesized
gcaaatattttctcttgatctg

SEQ ID NO: 1107173 - DNA, 22 bp, Artificial Sequence
  chemically synthesized
gtttgcaaatattttctcttga

SEQ ID NO: 1107174 - DNA, 22 bp, Artificial Sequence
  chemically synthesized
ggtttgcaaatattttctcttg

SEQ ID NO: 1107175 - DNA, 22 bp, Artificial Sequence
  chemically synthesized
acagatcaagagaaaatatttg

SEQ ID NO: 1107176 - DNA, 22 bp, Artificial Sequence
  chemically synthesized
ccagatatttggtttgcaaata

SEQ ID NO: 1107177 - DNA, 22 bp, Artificial Sequence
  chemically synthesized
accagatatttggtttgcaaat

SEQ ID NO: 1107178 - DNA, 22 bp, Artificial Sequence
  chemically synthesized
cttaccagatatttggtttgca

SEQ ID NO: 1107179 - DNA, 22 bp, Artificial Sequence
  chemically synthesized
actccttaccagatatttggtt

SEQ ID NO: 1107180 - DNA, 22 bp, Artificial Sequence
  chemically synthesized
gatattaactccttaccagata

SEQ ID NO: 1107181 - DNA, 22 bp, Artificial Sequence
  chemically synthesized
ggatattaactccttaccagat

SEQ ID NO: 1107182 - DNA, 22 bp, Artificial Sequence
  chemically synthesized
gcaaaccaaatatctggtaagg

SEQ ID NO: 1107183 - DNA, 22 bp, Artificial Sequence
  chemically synthesized
tggatattaactccttaccaga

SEQ ID NO: 1107184 - DNA, 22 bp, Artificial Sequence
  chemically synthesized
caaaccaaatatctggtaagga

SEQ ID NO: 1107185 - DNA, 22 bp, Artificial Sequence
  chemically synthesized
tatattttggatattaactcct

SEQ ID NO: 1107186 - DNA, 22 bp, Artificial Sequence
  chemically synthesized
tatatattttggatattaactc

SEQ ID NO: 1107187 - DNA, 22 bp, Artificial Sequence
  chemically synthesized
ctatatattttggatattaact

SEQ ID NO: 1107188 - DNA, 22 bp, Artificial Sequence
  chemically synthesized
gtaaggagttaatatccaaaat

SEQ ID NO: 1107189 - DNA, 22 bp, Artificial Sequence
  chemically synthesized
aggtttctatatattttggata

SEQ ID NO: 1107190 - DNA, 22 bp, Artificial Sequence
  chemically synthesized
gaggtttctatatattttggat

SEQ ID NO: 1107191 - DNA, 22 bp, Artificial Sequence
  chemically synthesized
tgaggtttctatatattttgga

SEQ ID NO: 1107192 - DNA, 22 bp, Artificial Sequence
  chemically synthesized
ttgaggtttctatatattttgg

SEQ ID NO: 1107193 - DNA, 22 bp, Artificial Sequence
  chemically synthesized
tttgaggtttctatatattttg

SEQ ID NO: 1107194 - DNA, 22 bp, Artificial Sequence
  chemically synthesized
agttttttgaggtttctatata

SEQ ID NO: 1107195 - DNA, 22 bp, Artificial Sequence
  chemically synthesized
atatccaaaatatatagaaacc

SEQ ID NO: 1107196 - DNA, 22 bp, Artificial Sequence
  chemically synthesized
ttgagttttttgaggtttctat

SEQ ID NO: 1107197 - DNA, 22 bp, Artificial Sequence
  chemically synthesized
ctgttgagttttttgaggtttc

SEQ ID NO: 1107198 - DNA, 22 bp, Artificial Sequence
  chemically synthesized
gctgttgagttttttgaggttt

SEQ ID NO: 1107199 - DNA, 22 bp, Artificial Sequence
  chemically synthesized
ttgctgttgagttttttgaggt

SEQ ID NO: 1107200 - DNA, 22 bp, Artificial Sequence
  chemically synthesized
cttgctgttgagttttttgagg

SEQ ID NO: 1107201 - DNA, 22 bp, Artificial Sequence
  chemically synthesized
tcttgctgttgagttttttgag

SEQ ID NO: 1107202 - DNA, 22 bp, Artificial Sequence
  chemically synthesized
ttttcttgctgttgagtttttt

SEQ ID NO: 1107203 - DNA, 22 bp, Artificial Sequence
  chemically synthesized
gttttcttgctgttgagttttt

SEQ ID NO: 1107204 - DNA, 22 bp, Artificial Sequence
  chemically synthesized
tttgttttcttgctgttgagtt

SEQ ID NO: 1107205 - DNA, 22 bp, Artificial Sequence
  chemically synthesized
aaaaaactcaacagcaagaaaa

SEQ ID NO: 1107206 - DNA, 22 bp, Artificial Sequence
  chemically synthesized
aatcaggttatttgttttcttg

SEQ ID NO: 1107207 - DNA, 22 bp, Artificial Sequence
  chemically synthesized
aaatcaggttatttgttttctt

SEQ ID NO: 1107208 - DNA, 22 bp, Artificial Sequence
  chemically synthesized
taaatcaggttatttgttttct

SEQ ID NO: 1107209 - DNA, 22 bp, Artificial Sequence
  chemically synthesized
ttaaatcaggttatttgttttc

SEQ ID NO: 1107210 - DNA, 22 bp, Artificial Sequence
  chemically synthesized
aacagcaagaaaacaaataacc

SEQ ID NO: 1107211 - DNA, 22 bp, Artificial Sequence
  chemically synthesized
cccatttttaaatcaggttatt

SEQ ID NO: 1107212 - DNA, 22 bp, Artificial Sequence
  chemically synthesized
gcccatttttaaatcaggttat

SEQ ID NO: 1107213 - DNA, 22 bp, Artificial Sequence
  chemically synthesized
atatcccttgcccatttttaaa

SEQ ID NO: 1107214 - DNA, 22 bp, Artificial Sequence
  chemically synthesized
ttcatatcccttgcccattttt

SEQ ID NO: 1107215 - DNA, 22 bp, Artificial Sequence
  chemically synthesized
atttaaaaatgggcaagggata

SEQ ID NO: 1107216 - DNA, 22 bp, Artificial Sequence
  chemically synthesized
aaaaatgggcaagggatatgaa

SEQ ID NO: 1107217 - DNA, 22 bp, Artificial Sequence
  chemically synthesized
aaaatgggcaagggatatgaac

SEQ ID NO: 1107218 - DNA, 22 bp, Artificial Sequence
  chemically synthesized
cgagaaatgtctgttcatatcc

SEQ ID NO: 1107219 - DNA, 22 bp, Artificial Sequence
  chemically synthesized
ttgcgagaaatgtctgttcata

SEQ ID NO: 1107220 - DNA, 22 bp, Artificial Sequence
  chemically synthesized
attgcgagaaatgtctgttcat

SEQ ID NO: 1107221 - DNA, 22 bp, Artificial Sequence
  chemically synthesized
ttattgcgagaaatgtctgttc

SEQ ID NO: 1107222 - DNA, 22 bp, Artificial Sequence
  chemically synthesized
gtgcctcttattgcgagaaatg

SEQ ID NO: 1107223 - DNA, 22 bp, Artificial Sequence
  chemically synthesized
gccattggtgcctcttattgcg

SEQ ID NO: 1107224 - DNA, 22 bp, Artificial Sequence
  chemically synthesized
ttggccattggtgcctcttatt

SEQ ID NO: 1107225 - DNA, 22 bp, Artificial Sequence
  chemically synthesized
ctcgcaataagaggcaccaatg

SEQ ID NO: 1107226 - DNA, 22 bp, Artificial Sequence
  chemically synthesized
tcgcaataagaggcaccaatgg

SEQ ID NO: 1107227 - DNA, 22 bp, Artificial Sequence
  chemically synthesized
acatatctgttggccattggtg

SEQ ID NO: 1107228 - DNA, 22 bp, Artificial Sequence
  chemically synthesized
gcaataagaggcaccaatggcc

SEQ ID NO: 1107229 - DNA, 22 bp, Artificial Sequence
  chemically synthesized
cacatatctgttggccattggt

SEQ ID NO: 1107230 - DNA, 22 bp, Artificial Sequence
  chemically synthesized
tcacatatctgttggccattgg

SEQ ID NO: 1107231 - DNA, 22 bp, Artificial Sequence
  chemically synthesized
ttcacatatctgttggccattg

SEQ ID NO: 1107232 - DNA, 22 bp, Artificial Sequence
  chemically synthesized
tttcacatatctgttggccatt

SEQ ID NO: 1107233 - DNA, 22 bp, Artificial Sequence
  chemically synthesized
agcattttttcacatatctgtt

SEQ ID NO: 1107234 - DNA, 22 bp, Artificial Sequence
  chemically synthesized
gagatgttgagcattttttcac

SEQ ID NO: 1107235 - DNA, 22 bp, Artificial Sequence
  chemically synthesized
agagatgttgagcattttttca

SEQ ID NO: 1107236 - DNA, 22 bp, Artificial Sequence
  chemically synthesized
atgtttagagatgttgagcatt

SEQ ID NO: 1107237 - DNA, 22 bp, Artificial Sequence
  chemically synthesized
tgatgtttagagatgttgagca

SEQ ID NO: 1107238 - DNA, 22 bp, Artificial Sequence
  chemically synthesized
ctgatgtttagagatgttgagc

SEQ ID NO: 1107239 - DNA, 22 bp, Artificial Sequence
  chemically synthesized
tctgatgtttagagatgttgag

SEQ ID NO: 1107240 - DNA, 22 bp, Artificial Sequence
  chemically synthesized
ttctgatgtttagagatgttga

SEQ ID NO: 1107241 - DNA, 22 bp, Artificial Sequence
  chemically synthesized
acatttttctgatgtttagaga

SEQ ID NO: 1107242 - DNA, 22 bp, Artificial Sequence
  chemically synthesized
cacatttttctgatgtttagag

SEQ ID NO: 1107243 - DNA, 22 bp, Artificial Sequence
  chemically synthesized
tcacatttttctgatgtttaga

SEQ ID NO: 1107244 - DNA, 22 bp, Artificial Sequence
  chemically synthesized
aacatctctaaacatcagaaaa

SEQ ID NO: 1107245 - DNA, 22 bp, Artificial Sequence
  chemically synthesized
tggttttcacatttttctgatg

SEQ ID NO: 1107246 - DNA, 22 bp, Artificial Sequence
  chemically synthesized
taaacatcagaaaaatgtgaaa

SEQ ID NO: 1107247 - DNA, 22 bp, Artificial Sequence
  chemically synthesized
aacatcagaaaaatgtgaaaac

SEQ ID NO: 1107248 - DNA, 22 bp, Artificial Sequence
  chemically synthesized
acatgtgtaaggtgacacatca

SEQ ID NO: 1107249 - DNA, 22 bp, Artificial Sequence
  chemically synthesized
aacatgtgtaaggtgacacatc

SEQ ID NO: 1107250 - DNA, 22 bp, Artificial Sequence
  chemically synthesized
taacatgtgtaaggtgacacat

SEQ ID NO: 1107251 - DNA, 22 bp, Artificial Sequence
  chemically synthesized
attttaacatgtgtaaggtgac

SEQ ID NO: 1107252 - DNA, 22 bp, Artificial Sequence
  chemically synthesized
taattttaacatgtgtaaggtg

SEQ ID NO: 1107253 - DNA, 22 bp, Artificial Sequence
  chemically synthesized
aaagtagccgttctaattttaa

SEQ ID NO: 1107254 - DNA, 22 bp, Artificial Sequence
  chemically synthesized
gaaagtagccgttctaatttta

SEQ ID NO: 1107255 - DNA, 22 bp, Artificial Sequence
  chemically synthesized
tgaaagtagccgttctaatttt

SEQ ID NO: 1107256 - DNA, 22 bp, Artificial Sequence
  chemically synthesized
acacatgttaaaattagaacgg

SEQ ID NO: 1107257 - DNA, 22 bp, Artificial Sequence
  chemically synthesized
cacatgttaaaattagaacggc

SEQ ID NO: 1107258 - DNA, 22 bp, Artificial Sequence
  chemically synthesized
atcattttgaaagtagccgttc

SEQ ID NO: 1107259 - DNA, 22 bp, Artificial Sequence
  chemically synthesized
catcattttgaaagtagccgtt

SEQ ID NO: 1107260 - DNA, 22 bp, Artificial Sequence
  chemically synthesized
tcatcattttgaaagtagccgt

SEQ ID NO: 1107261 - DNA, 22 bp, Artificial Sequence
  chemically synthesized
aaattagaacggctactttcaa

SEQ ID NO: 1107262 - DNA, 22 bp, Artificial Sequence
  chemically synthesized
tctttcatcattttgaaagtag

SEQ ID NO: 1107263 - DNA, 22 bp, Artificial Sequence
  chemically synthesized
atctttcatcattttgaaagta

SEQ ID NO: 1107264 - DNA, 22 bp, Artificial Sequence
  chemically synthesized
gaacggctactttcaaaatgat

SEQ ID NO: 1107265 - DNA, 22 bp, Artificial Sequence
  chemically synthesized
caacatttatctttcatcattt

SEQ ID NO: 1107266 - DNA, 22 bp, Artificial Sequence
  chemically synthesized
tccaacatttatctttcatcat

SEQ ID NO: 1107267 - DNA, 22 bp, Artificial Sequence
  chemically synthesized
ctttcaaaatgatgaaagataa

SEQ ID NO: 1107268 - DNA, 22 bp, Artificial Sequence
  chemically synthesized
tcaaaatgatgaaagataaatg

SEQ ID NO: 1107269 - DNA, 22 bp, Artificial Sequence
  chemically synthesized
caaaatgatgaaagataaatgt

SEQ ID NO: 1107270 - DNA, 22 bp, Artificial Sequence
  chemically synthesized
aaaatgatgaaagataaatgtt

SEQ ID NO: 1107271 - DNA, 22 bp, Artificial Sequence
  chemically synthesized
cacagcctctccaacatttatc

SEQ ID NO: 1107272 - DNA, 22 bp, Artificial Sequence
  chemically synthesized
tccacagcctctccaacattta

SEQ ID NO: 1107273 - DNA, 22 bp, Artificial Sequence
  chemically synthesized
ctccacagcctctccaacattt

SEQ ID NO: 1107274 - DNA, 22 bp, Artificial Sequence
  chemically synthesized
tctccacagcctctccaacatt

SEQ ID NO: 1107275 - DNA, 22 bp, Artificial Sequence
  chemically synthesized
ttctccacagcctctccaacat

SEQ ID NO: 1107276 - DNA, 22 bp, Artificial Sequence
  chemically synthesized
gagaggctgtggagaaaagtac

SEQ ID NO: 1107277 - DNA, 22 bp, Artificial Sequence
  chemically synthesized
ccaccaacaatgtgtaagtgta

SEQ ID NO: 1107278 - DNA, 22 bp, Artificial Sequence
  chemically synthesized
tggagaaaagtacacttacaca

SEQ ID NO: 1107279 - DNA, 22 bp, Artificial Sequence
  chemically synthesized
cattcccaccaacaatgtgtaa

SEQ ID NO: 1107280 - DNA, 22 bp, Artificial Sequence
  chemically synthesized
acattcccaccaacaatgtgta

SEQ ID NO: 1107281 - DNA, 22 bp, Artificial Sequence
  chemically synthesized
atttacattcccaccaacaatg

SEQ ID NO: 1107282 - DNA, 22 bp, Artificial Sequence
  chemically synthesized
tactaatttacattcccaccaa

SEQ ID NO: 1107283 - DNA, 22 bp, Artificial Sequence
  chemically synthesized
acacattgttggtgggaatgta

SEQ ID NO: 1107284 - DNA, 22 bp, Artificial Sequence
  chemically synthesized
cacattgttggtgggaatgtaa

SEQ ID NO: 1107285 - DNA, 22 bp, Artificial Sequence
  chemically synthesized
caaaatggctgtactaatttac

SEQ ID NO: 1107286 - DNA, 22 bp, Artificial Sequence
  chemically synthesized
ttggtgggaatgtaaattagta

SEQ ID NO: 1107287 - DNA, 22 bp, Artificial Sequence
  chemically synthesized
ccaaaatggctgtactaattta

SEQ ID NO: 1107288 - DNA, 22 bp, Artificial Sequence
  chemically synthesized
tccaaaatggctgtactaattt

SEQ ID NO: 1107289 - DNA, 22 bp, Artificial Sequence
  chemically synthesized
gtgggaatgtaaattagtacag

SEQ ID NO: 1107290 - DNA, 22 bp, Artificial Sequence
  chemically synthesized
ttttccaaaatggctgtactaa

SEQ ID NO: 1107291 - DNA, 22 bp, Artificial Sequence
  chemically synthesized
atactattttccaaaatggctg

SEQ ID NO: 1107292 - DNA, 22 bp, Artificial Sequence
  chemically synthesized
gtacagccattttggaaaatag

SEQ ID NO: 1107293 - DNA, 22 bp, Artificial Sequence
  chemically synthesized
tgtgacaggaacctcatactat

SEQ ID NO: 1107294 - DNA, 22 bp, Artificial Sequence
  chemically synthesized
atgtgacaggaacctcatacta

SEQ ID NO: 1107295 - DNA, 22 bp, Artificial Sequence
  chemically synthesized
tggaaaatagtatgaggttcct

SEQ ID NO: 1107296 - DNA, 22 bp, Artificial Sequence
  chemically synthesized
ggaaaatagtatgaggttcctg

SEQ ID NO: 1107297 - DNA, 22 bp, Artificial Sequence
  chemically synthesized
gaaaatagtatgaggttcctgt

SEQ ID NO: 1107298 - DNA, 22 bp, Artificial Sequence
  chemically synthesized
taaaatttatgtgacaggaacc

SEQ ID NO: 1107299 - DNA, 22 bp, Artificial Sequence
  chemically synthesized
ataaaatttatgtgacaggaac

SEQ ID NO: 1107300 - DNA, 22 bp, Artificial Sequence
  chemically synthesized
ctgtcacataaattttataaat

SEQ ID NO: 1107301 - DNA, 22 bp, Artificial Sequence
  chemically synthesized
tcacataaattttataaatgtg

SEQ ID NO: 1107302 - DNA, 22 bp, Artificial Sequence
  chemically synthesized
tataaatgtgtgtgtgtgtgtg

SEQ ID NO: 1107303 - DNA, 22 bp, Artificial Sequence
  chemically synthesized
ataaatgtgtgtgtgtgtgtgt

SEQ ID NO: 1107304 - DNA, 22 bp, Artificial Sequence
  chemically synthesized
taaatgtgtgtgtgtgtgtgtg

SEQ ID NO: 1107305 - DNA, 22 bp, Artificial Sequence
  chemically synthesized
tgtatatacacatgtagacata

SEQ ID NO: 1107306 - DNA, 22 bp, Artificial Sequence
  chemically synthesized
catgtgtatatacacagtatgt

SEQ ID NO: 1107307 - DNA, 22 bp, Artificial Sequence
  chemically synthesized
tgtatgtacacacatagacaca

SEQ ID NO: 1107308 - DNA, 22 bp, Artificial Sequence
  chemically synthesized
tgtgtgtacatacacagtatgt

SEQ ID NO: 1107309 - DNA, 22 bp, Artificial Sequence
  chemically synthesized
tgtatgtacacacgtagacaca

SEQ ID NO: 1107310 - DNA, 22 bp, Artificial Sequence
  chemically synthesized
cgtgtgtacatacacagtatgt

SEQ ID NO: 1107311 - DNA, 22 bp, Artificial Sequence
  chemically synthesized
tgtatataaacacgtagacaca

SEQ ID NO: 1107312 - DNA, 22 bp, Artificial Sequence
  chemically synthesized
tgtgtatataaacacgtagaca

SEQ ID NO: 1107313 - DNA, 22 bp, Artificial Sequence
  chemically synthesized
cgtgtttatatacacagaatgt

SEQ ID NO: 1107314 - DNA, 22 bp, Artificial Sequence
  chemically synthesized
atatacacagaatgtgtctacg

SEQ ID NO: 1107315 - DNA, 22 bp, Artificial Sequence
  chemically synthesized
tgtatatacacacgtagacaca

SEQ ID NO: 1107316 - DNA, 22 bp, Artificial Sequence
  chemically synthesized
tatacacagaatgtgtctacgt

SEQ ID NO: 1107317 - DNA, 22 bp, Artificial Sequence
  chemically synthesized
cgtgtgtatatacacagtatgt

SEQ ID NO: 1107318 - DNA, 22 bp, Artificial Sequence
  chemically synthesized
tgtatatacacacgtagacaca

SEQ ID NO: 1107319 - DNA, 22 bp, Artificial Sequence
  chemically synthesized
acgtaggcaaatattgtgtata

SEQ ID NO: 1107320 - DNA, 22 bp, Artificial Sequence
  chemically synthesized
cgtgtgtatatacacaatattt

SEQ ID NO: 1107321 - DNA, 22 bp, Artificial Sequence
  chemically synthesized
tgtaaatactcacgtaggcaaa

SEQ ID NO: 1107322 - DNA, 22 bp, Artificial Sequence
  chemically synthesized
gcctacgtgagtatttacacag

SEQ ID NO: 1107323 - DNA, 22 bp, Artificial Sequence
  chemically synthesized
cctacgtgagtatttacacagt

SEQ ID NO: 1107324 - DNA, 22 bp, Artificial Sequence
  chemically synthesized
cgtgagtatttacacagtatgt

SEQ ID NO: 1107325 - DNA, 22 bp, Artificial Sequence
  chemically synthesized
tgtatgtacacacacagacaca

SEQ ID NO: 1107326 - DNA, 22 bp, Artificial Sequence
  chemically synthesized
acacagtatgtgtctgtgtgtg

SEQ ID NO: 1107327 - DNA, 22 bp, Artificial Sequence
  chemically synthesized
cacagtatgtgtctgtgtgtgt

SEQ ID NO: 1107328 - DNA, 22 bp, Artificial Sequence
  chemically synthesized
tgtgtgtacatacacagtatgt

SEQ ID NO: 1107329 - DNA, 22 bp, Artificial Sequence
  chemically synthesized
tgtgtgcatatacgtatgtaca

SEQ ID NO: 1107330 - DNA, 22 bp, Artificial Sequence
  chemically synthesized
tgtgtacatatacgtatatgta

SEQ ID NO: 1107331 - DNA, 22 bp, Artificial Sequence
  chemically synthesized
gtgtacatatacgtatatgtac

SEQ ID NO: 1107332 - DNA, 22 bp, Artificial Sequence
  chemically synthesized
tgtacatatacgtatatgtaca

SEQ ID NO: 1107333 - DNA, 22 bp, Artificial Sequence
  chemically synthesized
tacatatatatatacacacgct

SEQ ID NO: 1107334 - DNA, 22 bp, Artificial Sequence
  chemically synthesized
aagctatacatatatatataca

SEQ ID NO: 1107335 - DNA, 22 bp, Artificial Sequence
  chemically synthesized
aatgccaagttaaagctataca

SEQ ID NO: 1107336 - DNA, 22 bp, Artificial Sequence
  chemically synthesized
gctaaatgccaagttaaagcta

SEQ ID NO: 1107337 - DNA, 22 bp, Artificial Sequence
  chemically synthesized
taacttggcatttagcgagttt

SEQ ID NO: 1107338 - DNA, 22 bp, Artificial Sequence
  chemically synthesized
aacttggcatttagcgagtttt

SEQ ID NO: 1107339 - DNA, 22 bp, Artificial Sequence
  chemically synthesized
aagaatcatgggaaaactcgct

SEQ ID NO: 1107340 - DNA, 22 bp, Artificial Sequence
  chemically synthesized
acttggcatttagcgagttttc

SEQ ID NO: 1107341 - DNA, 22 bp, Artificial Sequence
  chemically synthesized
ggcatttagcgagttttcccat

SEQ ID NO: 1107342 - DNA, 22 bp, Artificial Sequence
  chemically synthesized
acctcaagaatcatgggaaaac

SEQ ID NO: 1107343 - DNA, 22 bp, Artificial Sequence
  chemically synthesized
gcatttagcgagttttcccatg

SEQ ID NO: 1107344 - DNA, 22 bp, Artificial Sequence
  chemically synthesized
cctgacctcaagaatcatggga

SEQ ID NO: 1107345 - DNA, 22 bp, Artificial Sequence
  chemically synthesized
agcgagttttcccatgattctt

SEQ ID NO: 1107346 - DNA, 22 bp, Artificial Sequence
  chemically synthesized
ttccctgacctcaagaatcatg

SEQ ID NO: 1107347 - DNA, 22 bp, Artificial Sequence
  chemically synthesized
gcgagttttcccatgattcttg

SEQ ID NO: 1107348 - DNA, 22 bp, Artificial Sequence
  chemically synthesized
tcccatgattcttgaggtcagg

SEQ ID NO: 1107349 - DNA, 22 bp, Artificial Sequence
  chemically synthesized
cccatgattcttgaggtcaggg

SEQ ID NO: 1107350 - DNA, 22 bp, Artificial Sequence
  chemically synthesized
ccatgattcttgaggtcaggga

SEQ ID NO: 1107351 - DNA, 22 bp, Artificial Sequence
  chemically synthesized
tgagataaaagaattgttccct

SEQ ID NO: 1107352 - DNA, 22 bp, Artificial Sequence
  chemically synthesized
ttgtgagataaaagaattgttc

SEQ ID NO: 1107353 - DNA, 22 bp, Artificial Sequence
  chemically synthesized
ttgaggtcagggaacaattctt

SEQ ID NO: 1107354 - DNA, 22 bp, Artificial Sequence
  chemically synthesized
attgtgagataaaagaattgtt

SEQ ID NO: 1107355 - DNA, 22 bp, Artificial Sequence
  chemically synthesized
gaggtcagggaacaattctttt

SEQ ID NO: 1107356 - DNA, 22 bp, Artificial Sequence
  chemically synthesized
aggtcagggaacaattctttta

SEQ ID NO: 1107357 - DNA, 22 bp, Artificial Sequence
  chemically synthesized
tgtgcttattgtgagataaaag

SEQ ID NO: 1107358 - DNA, 22 bp, Artificial Sequence
  chemically synthesized
agcaagctatgtgcttattgtg

SEQ ID NO: 1107359 - DNA, 22 bp, Artificial Sequence
  chemically synthesized
aagcaagctatgtgcttattgt

SEQ ID NO: 1107360 - DNA, 22 bp, Artificial Sequence
  chemically synthesized
ttttatctcacaataagcacat

SEQ ID NO: 1107361 - DNA, 22 bp, Artificial Sequence
  chemically synthesized
tttaagcaagctatgtgcttat

SEQ ID NO: 1107362 - DNA, 22 bp, Artificial Sequence
  chemically synthesized
atttaagcaagctatgtgctta

SEQ ID NO: 1107363 - DNA, 22 bp, Artificial Sequence
  chemically synthesized
ttatctcacaataagcacatag

SEQ ID NO: 1107364 - DNA, 22 bp, Artificial Sequence
  chemically synthesized
tatctcacaataagcacatagc

SEQ ID NO: 1107365 - DNA, 22 bp, Artificial Sequence
  chemically synthesized
atctcacaataagcacatagct

SEQ ID NO: 1107366 - DNA, 22 bp, Artificial Sequence
  chemically synthesized
tctcacaataagcacatagctt

SEQ ID NO: 1107367 - DNA, 22 bp, Artificial Sequence
  chemically synthesized
acaataagcacatagcttgctt

SEQ ID NO: 1107368 - DNA, 22 bp, Artificial Sequence
  chemically synthesized
gcttaaataaacatgtctgcta

SEQ ID NO: 1107369 - DNA, 22 bp, Artificial Sequence
  chemically synthesized
cttaaataaacatgtctgctat

SEQ ID NO: 1107370 - DNA, 22 bp, Artificial Sequence
  chemically synthesized
aaataaacatgtctgctatgct

SEQ ID NO: 1107371 - DNA, 22 bp, Artificial Sequence
  chemically synthesized
aataaacatgtctgctatgctt

SEQ ID NO: 1107372 - DNA, 22 bp, Artificial Sequence
  chemically synthesized
tcaataccatcaagagcaagca

SEQ ID NO: 1107373 - DNA, 22 bp, Artificial Sequence
  chemically synthesized
atcaataccatcaagagcaagc

SEQ ID NO: 1107374 - DNA, 22 bp, Artificial Sequence
  chemically synthesized
tatcaataccatcaagagcaag

SEQ ID NO: 1107375 - DNA, 22 bp, Artificial Sequence
  chemically synthesized
ttatcaataccatcaagagcaa

SEQ ID NO: 1107376 - DNA, 22 bp, Artificial Sequence
  chemically synthesized
tttttatcaataccatcaagag

SEQ ID NO: 1107377 - DNA, 22 bp, Artificial Sequence
  chemically synthesized
ctatgcttgctcttgatggtat

SEQ ID NO: 1107378 - DNA, 22 bp, Artificial Sequence
  chemically synthesized
tgttatttttatcaataccatc

SEQ ID NO: 1107379 - DNA, 22 bp, Artificial Sequence
  chemically synthesized
tgcttgctcttgatggtattga

SEQ ID NO: 1107380 - DNA, 22 bp, Artificial Sequence
  chemically synthesized
gctcttgatggtattgataaaa

SEQ ID NO: 1107381 - DNA, 22 bp, Artificial Sequence
  chemically synthesized
ctcttgatggtattgataaaaa

SEQ ID NO: 1107382 - DNA, 22 bp, Artificial Sequence
  chemically synthesized
aaaattgtgttatttttatcaa

SEQ ID NO: 1107383 - DNA, 22 bp, Artificial Sequence
  chemically synthesized
aaaaattgtgttatttttatca

SEQ ID NO: 1107384 - DNA, 22 bp, Artificial Sequence
  chemically synthesized
taaaaattgtgttatttttatc

SEQ ID NO: 1107385 - DNA, 22 bp, Artificial Sequence
  chemically synthesized
ttgatggtattgataaaaataa

SEQ ID NO: 1107386 - DNA, 22 bp, Artificial Sequence
  chemically synthesized
ttaaaaattgtgttatttttat

SEQ ID NO: 1107387 - DNA, 22 bp, Artificial Sequence
  chemically synthesized
gatggtattgataaaaataaca

SEQ ID NO: 1107388 - DNA, 22 bp, Artificial Sequence
  chemically synthesized
atggtattgataaaaataacac

SEQ ID NO: 1107389 - DNA, 22 bp, Artificial Sequence
  chemically synthesized
cttttaaaaattgtgttatttt

SEQ ID NO: 1107390 - DNA, 22 bp, Artificial Sequence
  chemically synthesized
ataaaaataacacaatttttaa

SEQ ID NO: 1107391 - DNA, 22 bp, Artificial Sequence
  chemically synthesized
taaatgttccttttaaaaattg

SEQ ID NO: 1107392 - DNA, 22 bp, Artificial Sequence
  chemically synthesized
gtaaatgttccttttaaaaatt

SEQ ID NO: 1107393 - DNA, 22 bp, Artificial Sequence
  chemically synthesized
tttgtaaatgttccttttaaaa

SEQ ID NO: 1107394 - DNA, 22 bp, Artificial Sequence
  chemically synthesized
ggtaaactgtttgtaaatgttc

SEQ ID NO: 1107395 - DNA, 22 bp, Artificial Sequence
  chemically synthesized
ttaaaaggaacatttacaaaca

SEQ ID NO: 1107396 - DNA, 22 bp, Artificial Sequence
  chemically synthesized
taaaaggaacatttacaaacag

SEQ ID NO: 1107397 - DNA, 22 bp, Artificial Sequence
  chemically synthesized
aaaaggaacatttacaaacagt

SEQ ID NO: 1107398 - DNA, 22 bp, Artificial Sequence
  chemically synthesized
aaaggaacatttacaaacagtt

SEQ ID NO: 1107399 - DNA, 22 bp, Artificial Sequence
  chemically synthesized
cagaaactaggtaaactgtttg

SEQ ID NO: 1107400 - DNA, 22 bp, Artificial Sequence
  chemically synthesized
actccagaaactaggtaaactg

SEQ ID NO: 1107401 - DNA, 22 bp, Artificial Sequence
  chemically synthesized
cactccagaaactaggtaaact

SEQ ID NO: 1107402 - DNA, 22 bp, Artificial Sequence
  chemically synthesized
cttcactccagaaactaggtaa

SEQ ID NO: 1107403 - DNA, 22 bp, Artificial Sequence
  chemically synthesized
acaaacagtttacctagtttct

SEQ ID NO: 1107404 - DNA, 22 bp, Artificial Sequence
  chemically synthesized
ctccttcactccagaaactagg

SEQ ID NO: 1107405 - DNA, 22 bp, Artificial Sequence
  chemically synthesized
caaacagtttacctagtttctg

SEQ ID NO: 1107406 - DNA, 22 bp, Artificial Sequence
  chemically synthesized
cattgctccttcactccagaaa

SEQ ID NO: 1107407 - DNA, 22 bp, Artificial Sequence
  chemically synthesized
ttgcattgctccttcactccag

SEQ ID NO: 1107408 - DNA, 22 bp, Artificial Sequence
  chemically synthesized
acctagtttctggagtgaagga

SEQ ID NO: 1107409 - DNA, 22 bp, Artificial Sequence
  chemically synthesized
cctagtttctggagtgaaggag

SEQ ID NO: 1107410 - DNA, 22 bp, Artificial Sequence
  chemically synthesized
gtttctggagtgaaggagcaat

SEQ ID NO: 1107411 - DNA, 22 bp, Artificial Sequence
  chemically synthesized
ctggagtgaaggagcaatgcaa

SEQ ID NO: 1107412 - DNA, 22 bp, Artificial Sequence
  chemically synthesized
tggagtgaaggagcaatgcaac

SEQ ID NO: 1107413 - DNA, 22 bp, Artificial Sequence
  chemically synthesized
gagtgaaggagcaatgcaacag

SEQ ID NO: 1107414 - DNA, 22 bp, Artificial Sequence
  chemically synthesized
cagtagacacataatctgttgc

SEQ ID NO: 1107415 - DNA, 22 bp, Artificial Sequence
  chemically synthesized
ttccagtagacacataatctgt

SEQ ID NO: 1107416 - DNA, 22 bp, Artificial Sequence
  chemically synthesized
gttccagtagacacataatctg

SEQ ID NO: 1107417 - DNA, 22 bp, Artificial Sequence
  chemically synthesized
tgttccagtagacacataatct

SEQ ID NO: 1107418 - DNA, 22 bp, Artificial Sequence
  chemically synthesized
ggcaaaggaatgttttgttcca

SEQ ID NO: 1107419 - DNA, 22 bp, Artificial Sequence
  chemically synthesized
tgtgtctactggaacaaaacat

SEQ ID NO: 1107420 - DNA, 22 bp, Artificial Sequence
  chemically synthesized
atacatctaggcaaaggaatgt

SEQ ID NO: 1107421 - DNA, 22 bp, Artificial Sequence
  chemically synthesized
aatacatctaggcaaaggaatg

SEQ ID NO: 1107422 - DNA, 22 bp, Artificial Sequence
  chemically synthesized
ctggaacaaaacattcctttgc

SEQ ID NO: 1107423 - DNA, 22 bp, Artificial Sequence
  chemically synthesized
taatacatctaggcaaaggaat

SEQ ID NO: 1107424 - DNA, 22 bp, Artificial Sequence
  chemically synthesized
ttaatacatctaggcaaaggaa

SEQ ID NO: 1107425 - DNA, 22 bp, Artificial Sequence
  chemically synthesized
gaacaaaacattcctttgccta

SEQ ID NO: 1107426 - DNA, 22 bp, Artificial Sequence
  chemically synthesized
tttttaatacatctaggcaaag

SEQ ID NO: 1107427 - DNA, 22 bp, Artificial Sequence
  chemically synthesized
atttttaatacatctaggcaaa

SEQ ID NO: 1107428 - DNA, 22 bp, Artificial Sequence
  chemically synthesized
tatttttaatacatctaggcaa

SEQ ID NO: 1107429 - DNA, 22 bp, Artificial Sequence
  chemically synthesized
aaattttatttttaatacatct

SEQ ID NO: 1107430 - DNA, 22 bp, Artificial Sequence
  chemically synthesized
aaaattttatttttaatacatc

SEQ ID NO: 1107431 - DNA, 22 bp, Artificial Sequence
  chemically synthesized
taaaattttatttttaatacat

SEQ ID NO: 1107432 - DNA, 22 bp, Artificial Sequence
  chemically synthesized
ctttgcctagatgtattaaaaa

SEQ ID NO: 1107433 - DNA, 22 bp, Artificial Sequence
  chemically synthesized
ttttaaaattttatttttaata

SEQ ID NO: 1107434 - DNA, 22 bp, Artificial Sequence
  chemically synthesized
attttaaaattttatttttaat

SEQ ID NO: 1107435 - DNA, 22 bp, Artificial Sequence
  chemically synthesized
tgcctagatgtattaaaaataa

SEQ ID NO: 1107436 - DNA, 22 bp, Artificial Sequence
  chemically synthesized
tattttaaaattttatttttaa

SEQ ID NO: 1107437 - DNA, 22 bp, Artificial Sequence
  chemically synthesized
gcctagatgtattaaaaataaa

SEQ ID NO: 1107438 - DNA, 22 bp, Artificial Sequence
  chemically synthesized
ttattttaaaattttattttta

SEQ ID NO: 1107439 - DNA, 22 bp, Artificial Sequence
  chemically synthesized
cctagatgtattaaaaataaaa

SEQ ID NO: 1107440 - DNA, 22 bp, Artificial Sequence
  chemically synthesized
tttattttaaaattttattttt

SEQ ID NO: 1107441 - DNA, 22 bp, Artificial Sequence
  chemically synthesized
gatgtattaaaaataaaatttt

SEQ ID NO: 1107442 - DNA, 22 bp, Artificial Sequence
  chemically synthesized
aattttttattttaaaatttta

SEQ ID NO: 1107443 - DNA, 22 bp, Artificial Sequence
  chemically synthesized
aaattttttattttaaaatttt

SEQ ID NO: 1107444 - DNA, 22 bp, Artificial Sequence
  chemically synthesized
taaattttttattttaaaattt

SEQ ID NO: 1107445 - DNA, 22 bp, Artificial Sequence
  chemically synthesized
aaaataaaattttaaaataaaa

SEQ ID NO: 1107446 - DNA, 22 bp, Artificial Sequence
  chemically synthesized
aaattttaaattttttatttta

SEQ ID NO: 1107447 - DNA, 22 bp, Artificial Sequence
  chemically synthesized
ttaaaattttaaattttttatt

SEQ ID NO: 1107448 - DNA, 22 bp, Artificial Sequence
  chemically synthesized
attaaaattttaaattttttat

SEQ ID NO: 1107449 - DNA, 22 bp, Artificial Sequence
  chemically synthesized
tattaaaattttaaatttttta

SEQ ID NO: 1107450 - DNA, 22 bp, Artificial Sequence
  chemically synthesized
ctttattaaaattttaaatttt

SEQ ID NO: 1107451 - DNA, 22 bp, Artificial Sequence
  chemically synthesized
actttattaaaattttaaattt

SEQ ID NO: 1107452 - DNA, 22 bp, Artificial Sequence
  chemically synthesized
taaaataaaaaatttaaaattt

SEQ ID NO: 1107453 - DNA, 22 bp, Artificial Sequence
  chemically synthesized
aaaataaaaaatttaaaatttt

SEQ ID NO: 1107454 - DNA, 22 bp, Artificial Sequence
  chemically synthesized
atttactttattaaaattttaa

SEQ ID NO: 1107455 - DNA, 22 bp, Artificial Sequence
  chemically synthesized
aaataaaaaatttaaaatttta

SEQ ID NO: 1107456 - DNA, 22 bp, Artificial Sequence
  chemically synthesized
acctaatttactttattaaaat

SEQ ID NO: 1107457 - DNA, 22 bp, Artificial Sequence
  chemically synthesized
aaaattttaataaagtaaatta

SEQ ID NO: 1107458 - DNA, 22 bp, Artificial Sequence
  chemically synthesized
aggaaattgacctaatttactt

SEQ ID NO: 1107459 - DNA, 22 bp, Artificial Sequence
  chemically synthesized
aaattttaataaagtaaattag

SEQ ID NO: 1107460 - DNA, 22 bp, Artificial Sequence
  chemically synthesized
cagttcaggaaattgacctaat

SEQ ID NO: 1107461 - DNA, 22 bp, Artificial Sequence
  chemically synthesized
taataaagtaaattaggtcaat

SEQ ID NO: 1107462 - DNA, 22 bp, Artificial Sequence
  chemically synthesized
aataaagtaaattaggtcaatt

SEQ ID NO: 1107463 - DNA, 22 bp, Artificial Sequence
  chemically synthesized
ataaagtaaattaggtcaattt

SEQ ID NO: 1107464 - DNA, 22 bp, Artificial Sequence
  chemically synthesized
gctgcagttcaggaaattgacc

SEQ ID NO: 1107465 - DNA, 22 bp, Artificial Sequence
  chemically synthesized
tagctgcagttcaggaaattga

SEQ ID NO: 1107466 - DNA, 22 bp, Artificial Sequence
  chemically synthesized
ctagctgcagttcaggaaattg

SEQ ID NO: 1107467 - DNA, 22 bp, Artificial Sequence
  chemically synthesized
ttctagctgcagttcaggaaat

SEQ ID NO: 1107468 - DNA, 22 bp, Artificial Sequence
  chemically synthesized
ggtcaatttcctgaactgcagc

SEQ ID NO: 1107469 - DNA, 22 bp, Artificial Sequence
  chemically synthesized
atgtgaggtaactcttctagct

SEQ ID NO: 1107470 - DNA, 22 bp, Artificial Sequence
  chemically synthesized
gatgtgaggtaactcttctagc

SEQ ID NO: 1107471 - DNA, 22 bp, Artificial Sequence
  chemically synthesized
cctgaactgcagctagaagagt

SEQ ID NO: 1107472 - DNA, 22 bp, Artificial Sequence
  chemically synthesized
ctgaactgcagctagaagagtt

SEQ ID NO: 1107473 - DNA, 22 bp, Artificial Sequence
  chemically synthesized
aactgcagctagaagagttacc

SEQ ID NO: 1107474 - DNA, 22 bp, Artificial Sequence
  chemically synthesized
cagctagaagagttacctcaca

SEQ ID NO: 1107475 - DNA, 22 bp, Artificial Sequence
  chemically synthesized
aaacaaagtttgatgtgaggta

SEQ ID NO: 1107476 - DNA, 22 bp, Artificial Sequence
  chemically synthesized
gaagagttacctcacatcaaac

SEQ ID NO: 1107477 - DNA, 22 bp, Artificial Sequence
  chemically synthesized
ggaattaaaacaaagtttgatg

SEQ ID NO: 1107478 - DNA, 22 bp, Artificial Sequence
  chemically synthesized
agactgggaattaaaacaaagt

SEQ ID NO: 1107479 - DNA, 22 bp, Artificial Sequence
  chemically synthesized
cctcacatcaaactttgtttta

SEQ ID NO: 1107480 - DNA, 22 bp, Artificial Sequence
  chemically synthesized
acatcaaactttgttttaattc

SEQ ID NO: 1107481 - DNA, 22 bp, Artificial Sequence
  chemically synthesized
ggatgctgagactgggaattaa

SEQ ID NO: 1107482 - DNA, 22 bp, Artificial Sequence
  chemically synthesized
ttaggatgctgagactgggaat

SEQ ID NO: 1107483 - DNA, 22 bp, Artificial Sequence
  chemically synthesized
cctgttaggatgctgagactgg

SEQ ID NO: 1107484 - DNA, 22 bp, Artificial Sequence
  chemically synthesized
tgttttaattcccagtctcagc

SEQ ID NO: 1107485 - DNA, 22 bp, Artificial Sequence
  chemically synthesized
gttttaattcccagtctcagca

SEQ ID NO: 1107486 - DNA, 22 bp, Artificial Sequence
  chemically synthesized
ttttaattcccagtctcagcat

SEQ ID NO: 1107487 - DNA, 22 bp, Artificial Sequence
  chemically synthesized
taattcccagtctcagcatcct

SEQ ID NO: 1107488 - DNA, 22 bp, Artificial Sequence
  chemically synthesized
cccctccctgttaggatgctga

SEQ ID NO: 1107489 - DNA, 22 bp, Artificial Sequence
  chemically synthesized
aattcccagtctcagcatccta

SEQ ID NO: 1107490 - DNA, 22 bp, Artificial Sequence
  chemically synthesized
attcccagtctcagcatcctaa

SEQ ID NO: 1107491 - DNA, 22 bp, Artificial Sequence
  chemically synthesized
tacccctccctgttaggatgct

SEQ ID NO: 1107492 - DNA, 22 bp, Artificial Sequence
  chemically synthesized
ccagtctcagcatcctaacagg

SEQ ID NO: 1107493 - DNA, 22 bp, Artificial Sequence
  chemically synthesized
gtctctacccctccctgttagg

SEQ ID NO: 1107494 - DNA, 22 bp, Artificial Sequence
  chemically synthesized
tggttagtctctacccctccct

SEQ ID NO: 1107495 - DNA, 22 bp, Artificial Sequence
  chemically synthesized
agcatcctaacagggaggggta

SEQ ID NO: 1107496 - DNA, 22 bp, Artificial Sequence
  chemically synthesized
tatggttagtctctacccctcc

SEQ ID NO: 1107497 - DNA, 22 bp, Artificial Sequence
  chemically synthesized
aagctctatggttagtctctac

SEQ ID NO: 1107498 - DNA, 22 bp, Artificial Sequence
  chemically synthesized
caagctctatggttagtctcta

SEQ ID NO: 1107499 - DNA, 22 bp, Artificial Sequence
  chemically synthesized
acagggaggggtagagactaac

SEQ ID NO: 1107500 - DNA, 22 bp, Artificial Sequence
  chemically synthesized
catggccacaatttcaagctct

SEQ ID NO: 1107501 - DNA, 22 bp, Artificial Sequence
  chemically synthesized
tccatggccacaatttcaagct

SEQ ID NO: 1107502 - DNA, 22 bp, Artificial Sequence
  chemically synthesized
accatagagcttgaaattgtgg

SEQ ID NO: 1107503 - DNA, 22 bp, Artificial Sequence
  chemically synthesized
gaaattgtggccatggagagca

SEQ ID NO: 1107504 - DNA, 22 bp, Artificial Sequence
  chemically synthesized
aaattgtggccatggagagcat

SEQ ID NO: 1107505 - DNA, 22 bp, Artificial Sequence
  chemically synthesized
agggtagccagcaaggatgctc

SEQ ID NO: 1107506 - DNA, 22 bp, Artificial Sequence
  chemically synthesized
aagggtagccagcaaggatgct

SEQ ID NO: 1107507 - DNA, 22 bp, Artificial Sequence
  chemically synthesized
tggccatggagagcatccttgc

SEQ ID NO: 1107508 - DNA, 22 bp, Artificial Sequence
  chemically synthesized
taagggtagccagcaaggatgc

SEQ ID NO: 1107509 - DNA, 22 bp, Artificial Sequence
  chemically synthesized
gctggctacccttaaaattttc

SEQ ID NO: 1107510 - DNA, 22 bp, Artificial Sequence
  chemically synthesized
ctggctacccttaaaattttct

SEQ ID NO: 1107511 - DNA, 22 bp, Artificial Sequence
  chemically synthesized
cagagacagtagaagaaaattt

SEQ ID NO: 1107512 - DNA, 22 bp, Artificial Sequence
  chemically synthesized
acagagacagtagaagaaaatt

SEQ ID NO: 1107513 - DNA, 22 bp, Artificial Sequence
  chemically synthesized
gctacccttaaaattttcttct

SEQ ID NO: 1107514 - DNA, 22 bp, Artificial Sequence
  chemically synthesized
ttacagagacagtagaagaaaa

SEQ ID NO: 1107515 - DNA, 22 bp, Artificial Sequence
  chemically synthesized
cccttaaaattttcttctactg

SEQ ID NO: 1107516 - DNA, 22 bp, Artificial Sequence
  chemically synthesized
cctcttacagagacagtagaag

SEQ ID NO: 1107517 - DNA, 22 bp, Artificial Sequence
  chemically synthesized
acctcttacagagacagtagaa

SEQ ID NO: 1107518 - DNA, 22 bp, Artificial Sequence
  chemically synthesized
tacctcttacagagacagtaga

SEQ ID NO: 1107519 - DNA, 22 bp, Artificial Sequence
  chemically synthesized
ttacctcttacagagacagtag

SEQ ID NO: 1107520 - DNA, 22 bp, Artificial Sequence
  chemically synthesized
aaaattttcttctactgtctct

SEQ ID NO: 1107521 - DNA, 22 bp, Artificial Sequence
  chemically synthesized
aaattttcttctactgtctctg

SEQ ID NO: 1107522 - DNA, 22 bp, Artificial Sequence
  chemically synthesized
tcttctactgtctctgtaagag

SEQ ID NO: 1107523 - DNA, 22 bp, Artificial Sequence
  chemically synthesized
cttctactgtctctgtaagagg

SEQ ID NO: 1107524 - DNA, 22 bp, Artificial Sequence
  chemically synthesized
ttctactgtctctgtaagaggt

SEQ ID NO: 1107525 - DNA, 22 bp, Artificial Sequence
  chemically synthesized
ctactgtctctgtaagaggtaa

SEQ ID NO: 1107526 - DNA, 22 bp, Artificial Sequence
  chemically synthesized
tactgtctctgtaagaggtaaa

SEQ ID NO: 1107527 - DNA, 22 bp, Artificial Sequence
  chemically synthesized
aaagaaaataacttttacctct

SEQ ID NO: 1107528 - DNA, 22 bp, Artificial Sequence
  chemically synthesized
ctgtctctgtaagaggtaaaag

SEQ ID NO: 1107529 - DNA, 22 bp, Artificial Sequence
  chemically synthesized
tctctgtaagaggtaaaagtta

SEQ ID NO: 1107530 - DNA, 22 bp, Artificial Sequence
  chemically synthesized
tgtaagaggtaaaagttatttt

SEQ ID NO: 1107531 - DNA, 22 bp, Artificial Sequence
  chemically synthesized
ccagaattgaaagaaaataact

SEQ ID NO: 1107532 - DNA, 22 bp, Artificial Sequence
  chemically synthesized
taagaggtaaaagttattttct

SEQ ID NO: 1107533 - DNA, 22 bp, Artificial Sequence
  chemically synthesized
gccagaattgaaagaaaataac

SEQ ID NO: 1107534 - DNA, 22 bp, Artificial Sequence
  chemically synthesized
ttgccagaattgaaagaaaata

SEQ ID NO: 1107535 - DNA, 22 bp, Artificial Sequence
  chemically synthesized
ttttctttcaattctggcaaga

SEQ ID NO: 1107536 - DNA, 22 bp, Artificial Sequence
  chemically synthesized
tctttcaattctggcaagaata

SEQ ID NO: 1107537 - DNA, 22 bp, Artificial Sequence
  chemically synthesized
ctttcaattctggcaagaatat

SEQ ID NO: 1107538 - DNA, 22 bp, Artificial Sequence
  chemically synthesized
tttcaattctggcaagaatatc

SEQ ID NO: 1107539 - DNA, 22 bp, Artificial Sequence
  chemically synthesized
tcaattctggcaagaatatctt

SEQ ID NO: 1107540 - DNA, 22 bp, Artificial Sequence
  chemically synthesized
caattctggcaagaatatcttc

SEQ ID NO: 1107541 - DNA, 22 bp, Artificial Sequence
  chemically synthesized
aattctggcaagaatatcttct

SEQ ID NO: 1107542 - DNA, 22 bp, Artificial Sequence
  chemically synthesized
gggaggtgtagcacagaagata

SEQ ID NO: 1107543 - DNA, 22 bp, Artificial Sequence
  chemically synthesized
tggcaagaatatcttctgtgct

SEQ ID NO: 1107544 - DNA, 22 bp, Artificial Sequence
  chemically synthesized
gcaagaatatcttctgtgctac

SEQ ID NO: 1107545 - DNA, 22 bp, Artificial Sequence
  chemically synthesized
aagaggtgatgatctggggagg

SEQ ID NO: 1107546 - DNA, 22 bp, Artificial Sequence
  chemically synthesized
gaagaggtgatgatctggggag

SEQ ID NO: 1107547 - DNA, 22 bp, Artificial Sequence
  chemically synthesized
ctgtgctacacctccccagatc

SEQ ID NO: 1107548 - DNA, 22 bp, Artificial Sequence
  chemically synthesized
tgtgctacacctccccagatca

SEQ ID NO: 1107549 - DNA, 22 bp, Artificial Sequence
  chemically synthesized
tgctacacctccccagatcatc

SEQ ID NO: 1107550 - DNA, 22 bp, Artificial Sequence
  chemically synthesized
aacccttgaagaggtgatgatc

SEQ ID NO: 1107551 - DNA, 22 bp, Artificial Sequence
  chemically synthesized
caacccttgaagaggtgatgat

SEQ ID NO: 1107552 - DNA, 22 bp, Artificial Sequence
  chemically synthesized
cacctccccagatcatcacctc

SEQ ID NO: 1107553 - DNA, 22 bp, Artificial Sequence
  chemically synthesized
cccagatcatcacctcttcaag

SEQ ID NO: 1107554 - DNA, 22 bp, Artificial Sequence
  chemically synthesized
ttcaagggttgaaatgattttt

SEQ ID NO: 1107555 - DNA, 22 bp, Artificial Sequence
  chemically synthesized
tgataagataaagaaaaatcat

SEQ ID NO: 1107556 - DNA, 22 bp, Artificial Sequence
  chemically synthesized
caagggttgaaatgatttttct

SEQ ID NO: 1107557 - DNA, 22 bp, Artificial Sequence
  chemically synthesized
aagggttgaaatgatttttctt

SEQ ID NO: 1107558 - DNA, 22 bp, Artificial Sequence
  chemically synthesized
cagttgtgataagataaagaaa

SEQ ID NO: 1107559 - DNA, 22 bp, Artificial Sequence
  chemically synthesized
aaatgatttttctttatcttat

SEQ ID NO: 1107560 - DNA, 22 bp, Artificial Sequence
  chemically synthesized
aactacagttgtgataagataa

SEQ ID NO: 1107561 - DNA, 22 bp, Artificial Sequence
  chemically synthesized
aaactacagttgtgataagata

SEQ ID NO: 1107562 - DNA, 22 bp, Artificial Sequence
  chemically synthesized
aaccttaaactacagttgtgat

SEQ ID NO: 1107563 - DNA, 22 bp, Artificial Sequence
  chemically synthesized
ttctttatcttatcacaactgt

SEQ ID NO: 1107564 - DNA, 22 bp, Artificial Sequence
  chemically synthesized
tctttatcttatcacaactgta

SEQ ID NO: 1107565 - DNA, 22 bp, Artificial Sequence
  chemically synthesized
ctttatcttatcacaactgtag

SEQ ID NO: 1107566 - DNA, 22 bp, Artificial Sequence
  chemically synthesized
tttatcttatcacaactgtagt

SEQ ID NO: 1107567 - DNA, 22 bp, Artificial Sequence
  chemically synthesized
tatcttatcacaactgtagttt

SEQ ID NO: 1107568 - DNA, 22 bp, Artificial Sequence
  chemically synthesized
atcttatcacaactgtagttta

SEQ ID NO: 1107569 - DNA, 22 bp, Artificial Sequence
  chemically synthesized
tcttatcacaactgtagtttaa

SEQ ID NO: 1107570 - DNA, 22 bp, Artificial Sequence
  chemically synthesized
atcacaactgtagtttaaggtt

SEQ ID NO: 1107571 - DNA, 22 bp, Artificial Sequence
  chemically synthesized
tcacaactgtagtttaaggttc

SEQ ID NO: 1107572 - DNA, 22 bp, Artificial Sequence
  chemically synthesized
tagtttaaggttcaatggactc

SEQ ID NO: 1107573 - DNA, 22 bp, Artificial Sequence
  chemically synthesized
aaggttcaatggactctcctct

SEQ ID NO: 1107574 - DNA, 22 bp, Artificial Sequence
  chemically synthesized
aggttcaatggactctcctctg

SEQ ID NO: 1107575 - DNA, 22 bp, Artificial Sequence
  chemically synthesized
tggaaagaatagccacacagag

SEQ ID NO: 1107576 - DNA, 22 bp, Artificial Sequence
  chemically synthesized
aatggactctcctctgtgtggc

SEQ ID NO: 1107577 - DNA, 22 bp, Artificial Sequence
  chemically synthesized
gtggaaagaatagccacacaga

SEQ ID NO: 1107578 - DNA, 22 bp, Artificial Sequence
  chemically synthesized
tcctctgtgtggctattctttc

SEQ ID NO: 1107579 - DNA, 22 bp, Artificial Sequence
  chemically synthesized
ctctgtgtggctattctttcca

SEQ ID NO: 1107580 - DNA, 22 bp, Artificial Sequence
  chemically synthesized
tgtgtggctattctttccacaa

SEQ ID NO: 1107581 - DNA, 22 bp, Artificial Sequence
  chemically synthesized
tgtggctattctttccacaagt

SEQ ID NO: 1107582 - DNA, 22 bp, Artificial Sequence
  chemically synthesized
aggagaagcaggaagacttgtg

SEQ ID NO: 1107583 - DNA, 22 bp, Artificial Sequence
  chemically synthesized
ttctttccacaagtcttcctgc

SEQ ID NO: 1107584 - DNA, 22 bp, Artificial Sequence
  chemically synthesized
tttccacaagtcttcctgcttc

SEQ ID NO: 1107585 - DNA, 22 bp, Artificial Sequence
  chemically synthesized
tccacaagtcttcctgcttctc

SEQ ID NO: 1107586 - DNA, 22 bp, Artificial Sequence
  chemically synthesized
ccacaagtcttcctgcttctcc

SEQ ID NO: 1107587 - DNA, 22 bp, Artificial Sequence
  chemically synthesized
cacaagtcttcctgcttctcct

SEQ ID NO: 1107588 - DNA, 22 bp, Artificial Sequence
  chemically synthesized
cctgcttctcctcagacttgta

SEQ ID NO: 1107589 - DNA, 22 bp, Artificial Sequence
  chemically synthesized
ctgcttctcctcagacttgtat

SEQ ID NO: 1107590 - DNA, 22 bp, Artificial Sequence
  chemically synthesized
cttctcctcagacttgtattgc

SEQ ID NO: 1107591 - DNA, 22 bp, Artificial Sequence
  chemically synthesized
ctcctcagacttgtattgcatt

SEQ ID NO: 1107592 - DNA, 22 bp, Artificial Sequence
  chemically synthesized
tcctcagacttgtattgcattt

SEQ ID NO: 1107593 - DNA, 22 bp, Artificial Sequence
  chemically synthesized
gtatgtgaagaagaaatgcaat

SEQ ID NO: 1107594 - DNA, 22 bp, Artificial Sequence
  chemically synthesized
ctcagacttgtattgcatttct

SEQ ID NO: 1107595 - DNA, 22 bp, Artificial Sequence
  chemically synthesized
agacttgtattgcatttcttct

SEQ ID NO: 1107596 - DNA, 22 bp, Artificial Sequence
  chemically synthesized
gctggtatgtgaagaagaaatg

SEQ ID NO: 1107597 - DNA, 22 bp, Artificial Sequence
  chemically synthesized
tagctggtatgtgaagaagaaa

SEQ ID NO: 1107598 - DNA, 22 bp, Artificial Sequence
  chemically synthesized
gtattgcatttcttcttcacat

SEQ ID NO: 1107599 - DNA, 22 bp, Artificial Sequence
  chemically synthesized
tattgcatttcttcttcacata

SEQ ID NO: 1107600 - DNA, 22 bp, Artificial Sequence
  chemically synthesized
accctctagctggtatgtgaag

SEQ ID NO: 1107601 - DNA, 22 bp, Artificial Sequence
  chemically synthesized
catttcttcttcacataccagc

SEQ ID NO: 1107602 - DNA, 22 bp, Artificial Sequence
  chemically synthesized
aaaactcaccctctagctggta

SEQ ID NO: 1107603 - DNA, 22 bp, Artificial Sequence
  chemically synthesized
caaaactcaccctctagctggt

SEQ ID NO: 1107604 - DNA, 22 bp, Artificial Sequence
  chemically synthesized
cttcttcacataccagctagag

SEQ ID NO: 1107605 - DNA, 22 bp, Artificial Sequence
  chemically synthesized
tcaaaactcaccctctagctgg

SEQ ID NO: 1107606 - DNA, 22 bp, Artificial Sequence
  chemically synthesized
ttcttcacataccagctagagg

SEQ ID NO: 1107607 - DNA, 22 bp, Artificial Sequence
  chemically synthesized
ttcaaaactcaccctctagctg

SEQ ID NO: 1107608 - DNA, 22 bp, Artificial Sequence
  chemically synthesized
tttcaaaactcaccctctagct

SEQ ID NO: 1107609 - DNA, 22 bp, Artificial Sequence
  chemically synthesized
cttcacataccagctagagggt

SEQ ID NO: 1107610 - DNA, 22 bp, Artificial Sequence
  chemically synthesized
ttcacataccagctagagggtg

SEQ ID NO: 1107611 - DNA, 22 bp, Artificial Sequence
  chemically synthesized
cacataccagctagagggtgag

SEQ ID NO: 1107612 - DNA, 22 bp, Artificial Sequence
  chemically synthesized
acataccagctagagggtgagt

SEQ ID NO: 1107613 - DNA, 22 bp, Artificial Sequence
  chemically synthesized
tattttttcaaaactcaccctc

SEQ ID NO: 1107614 - DNA, 22 bp, Artificial Sequence
  chemically synthesized
gttgtattttttcaaaactcac

SEQ ID NO: 1107615 - DNA, 22 bp, Artificial Sequence
  chemically synthesized
agttgtattttttcaaaactca

SEQ ID NO: 1107616 - DNA, 22 bp, Artificial Sequence
  chemically synthesized
gagggtgagttttgaaaaaata

SEQ ID NO: 1107617 - DNA, 22 bp, Artificial Sequence
  chemically synthesized
agtacccttagttgtatttttt

SEQ ID NO: 1107618 - DNA, 22 bp, Artificial Sequence
  chemically synthesized
aggaaattaagtacccttagtt

SEQ ID NO: 1107619 - DNA, 22 bp, Artificial Sequence
  chemically synthesized
tgaaaaaatacaactaagggta

SEQ ID NO: 1107620 - DNA, 22 bp, Artificial Sequence
  chemically synthesized
gaaaaaatacaactaagggtac

SEQ ID NO: 1107621 - DNA, 22 bp, Artificial Sequence
  chemically synthesized
aaaaaatacaactaagggtact

SEQ ID NO: 1107622 - DNA, 22 bp, Artificial Sequence
  chemically synthesized
aattgaggaaattaagtaccct

SEQ ID NO: 1107623 - DNA, 22 bp, Artificial Sequence
  chemically synthesized
caattgaggaaattaagtaccc

SEQ ID NO: 1107624 - DNA, 22 bp, Artificial Sequence
  chemically synthesized
agggtacttaatttcctcaatt

SEQ ID NO: 1107625 - DNA, 22 bp, Artificial Sequence
  chemically synthesized
cgaaagaatttcaattgaggaa

SEQ ID NO: 1107626 - DNA, 22 bp, Artificial Sequence
  chemically synthesized
ccgaaagaatttcaattgagga

SEQ ID NO: 1107627 - DNA, 22 bp, Artificial Sequence
  chemically synthesized
aatttcctcaattgaaattctt

SEQ ID NO: 1107628 - DNA, 22 bp, Artificial Sequence
  chemically synthesized
atttcctcaattgaaattcttt

SEQ ID NO: 1107629 - DNA, 22 bp, Artificial Sequence
  chemically synthesized
cctcaattgaaattctttcgga

SEQ ID NO: 1107630 - DNA, 22 bp, Artificial Sequence
  chemically synthesized
ctcaattgaaattctttcggaa

SEQ ID NO: 1107631 - DNA, 22 bp, Artificial Sequence
  chemically synthesized
agagcagtagacatttccgaaa

SEQ ID NO: 1107632 - DNA, 22 bp, Artificial Sequence
  chemically synthesized
aattgaaattctttcggaaatg

SEQ ID NO: 1107633 - DNA, 22 bp, Artificial Sequence
  chemically synthesized
aagagcagtagacatttccgaa

SEQ ID NO: 1107634 - DNA, 22 bp, Artificial Sequence
  chemically synthesized
taagagcagtagacatttccga

SEQ ID NO: 1107635 - DNA, 22 bp, Artificial Sequence
  chemically synthesized
aaattctttcggaaatgtctac

SEQ ID NO: 1107636 - DNA, 22 bp, Artificial Sequence
  chemically synthesized
gattttaagagcagtagacatt

SEQ ID NO: 1107637 - DNA, 22 bp, Artificial Sequence
  chemically synthesized
ggattttaagagcagtagacat

SEQ ID NO: 1107638 - DNA, 22 bp, Artificial Sequence
  chemically synthesized
tttcggaaatgtctactgctct

SEQ ID NO: 1107639 - DNA, 22 bp, Artificial Sequence
  chemically synthesized
tcggaaatgtctactgctctta

SEQ ID NO: 1107640 - DNA, 22 bp, Artificial Sequence
  chemically synthesized
cggaaatgtctactgctcttaa

SEQ ID NO: 1107641 - DNA, 22 bp, Artificial Sequence
  chemically synthesized
ggaaatgtctactgctcttaaa

SEQ ID NO: 1107642 - DNA, 22 bp, Artificial Sequence
  chemically synthesized
taacaggtttggattttaagag

SEQ ID NO: 1107643 - DNA, 22 bp, Artificial Sequence
  chemically synthesized
tataacaggtttggattttaag

SEQ ID NO: 1107644 - DNA, 22 bp, Artificial Sequence
  chemically synthesized
ctataacaggtttggattttaa

SEQ ID NO: 1107645 - DNA, 22 bp, Artificial Sequence
  chemically synthesized
ctgctcttaaaatccaaacctg

SEQ ID NO: 1107646 - DNA, 22 bp, Artificial Sequence
  chemically synthesized
tagaacttctataacaggtttg

SEQ ID NO: 1107647 - DNA, 22 bp, Artificial Sequence
  chemically synthesized
ctcttaaaatccaaacctgtta

SEQ ID NO: 1107648 - DNA, 22 bp, Artificial Sequence
  chemically synthesized
atagaacttctataacaggttt

SEQ ID NO: 1107649 - DNA, 22 bp, Artificial Sequence
  chemically synthesized
ttatagaacttctataacaggt

SEQ ID NO: 1107650 - DNA, 22 bp, Artificial Sequence
  chemically synthesized
ttaaaatccaaacctgttatag

SEQ ID NO: 1107651 - DNA, 22 bp, Artificial Sequence
  chemically synthesized
aaaatccaaacctgttatagaa

SEQ ID NO: 1107652 - DNA, 22 bp, Artificial Sequence
  chemically synthesized
ctcttatagaacttctataaca

SEQ ID NO: 1107653 - DNA, 22 bp, Artificial Sequence
  chemically synthesized
aaatccaaacctgttatagaag

SEQ ID NO: 1107654 - DNA, 22 bp, Artificial Sequence
  chemically synthesized
ttatagaagttctataagagca

SEQ ID NO: 1107655 - DNA, 22 bp, Artificial Sequence
  chemically synthesized
tagaagttctataagagcaatt

SEQ ID NO: 1107656 - DNA, 22 bp, Artificial Sequence
  chemically synthesized
ggacaagatgagggtagaattg

SEQ ID NO: 1107657 - DNA, 22 bp, Artificial Sequence
  chemically synthesized
tataagagcaattctaccctca

SEQ ID NO: 1107658 - DNA, 22 bp, Artificial Sequence
  chemically synthesized
taagagcaattctaccctcatc

SEQ ID NO: 1107659 - DNA, 22 bp, Artificial Sequence
  chemically synthesized
taccctcatcttgtcctaatct

SEQ ID NO: 1107660 - DNA, 22 bp, Artificial Sequence
  chemically synthesized
ccctcatcttgtcctaatcttt

SEQ ID NO: 1107661 - DNA, 22 bp, Artificial Sequence
  chemically synthesized
atcttgtcctaatctttcattg

SEQ ID NO: 1107662 - DNA, 22 bp, Artificial Sequence
  chemically synthesized
gaatgtaacaaatcaatgaaag

SEQ ID NO: 1107663 - DNA, 22 bp, Artificial Sequence
  chemically synthesized
gtcctaatctttcattgatttg

SEQ ID NO: 1107664 - DNA, 22 bp, Artificial Sequence
  chemically synthesized
tcctaatctttcattgatttgt

SEQ ID NO: 1107665 - DNA, 22 bp, Artificial Sequence
  chemically synthesized
atctttcattgatttgttacat

SEQ ID NO: 1107666 - DNA, 22 bp, Artificial Sequence
  chemically synthesized
tcattgatttgttacattccag

SEQ ID NO: 1107667 - DNA, 22 bp, Artificial Sequence
  chemically synthesized
cattgatttgttacattccagc

SEQ ID NO: 1107668 - DNA, 22 bp, Artificial Sequence
  chemically synthesized
attgatttgttacattccagcc

SEQ ID NO: 1107669 - DNA, 22 bp, Artificial Sequence
  chemically synthesized
atttgttacattccagcctttc

SEQ ID NO: 1107670 - DNA, 22 bp, Artificial Sequence
  chemically synthesized
gttacattccagcctttctggc

SEQ ID NO: 1107671 - DNA, 22 bp, Artificial Sequence
  chemically synthesized
ttacattccagcctttctggcc

SEQ ID NO: 1107672 - DNA, 22 bp, Artificial Sequence
  chemically synthesized
cattccagcctttctggcctcc

SEQ ID NO: 1107673 - DNA, 22 bp, Artificial Sequence
  chemically synthesized
cagcctttctggcctcccttat

SEQ ID NO: 1107674 - DNA, 22 bp, Artificial Sequence
  chemically synthesized
gcatgtccagaagacataaggg

SEQ ID NO: 1107675 - DNA, 22 bp, Artificial Sequence
  chemically synthesized
ggcatgtccagaagacataagg

SEQ ID NO: 1107676 - DNA, 22 bp, Artificial Sequence
  chemically synthesized
tctggcctcccttatgtcttct

SEQ ID NO: 1107677 - DNA, 22 bp, Artificial Sequence
  chemically synthesized
ctggcctcccttatgtcttctg

SEQ ID NO: 1107678 - DNA, 22 bp, Artificial Sequence
  chemically synthesized
tggcctcccttatgtcttctgg

SEQ ID NO: 1107679 - DNA, 22 bp, Artificial Sequence
  chemically synthesized
gcctcccttatgtcttctggac

SEQ ID NO: 1107680 - DNA, 22 bp, Artificial Sequence
  chemically synthesized
ccttatgtcttctggacatgcc

SEQ ID NO: 1107681 - DNA, 22 bp, Artificial Sequence
  chemically synthesized
atgtcttctggacatgccaagc

SEQ ID NO: 1107682 - DNA, 22 bp, Artificial Sequence
  chemically synthesized
tgtcttctggacatgccaagcc

SEQ ID NO: 1107683 - DNA, 22 bp, Artificial Sequence
  chemically synthesized
ctggacatgccaagccctcatt

SEQ ID NO: 1107684 - DNA, 22 bp, Artificial Sequence
  chemically synthesized
ccaaaggtgaagaatgagggct

SEQ ID NO: 1107685 - DNA, 22 bp, Artificial Sequence
  chemically synthesized
tggacatgccaagccctcattc

SEQ ID NO: 1107686 - DNA, 22 bp, Artificial Sequence
  chemically synthesized
gacatgccaagccctcattctt

SEQ ID NO: 1107687 - DNA, 22 bp, Artificial Sequence
  chemically synthesized
attcttcacctttggcaatttg

SEQ ID NO: 1107688 - DNA, 22 bp, Artificial Sequence
  chemically synthesized
ttcacctttggcaatttgtgtt

SEQ ID NO: 1107689 - DNA, 22 bp, Artificial Sequence
  chemically synthesized
cacctttggcaatttgtgtttc

SEQ ID NO: 1107690 - DNA, 22 bp, Artificial Sequence
  chemically synthesized
acctttggcaatttgtgtttct

SEQ ID NO: 1107691 - DNA, 22 bp, Artificial Sequence
  chemically synthesized
ggagaaatgaaaagaaacacaa

SEQ ID NO: 1107692 - DNA, 22 bp, Artificial Sequence
  chemically synthesized
tggcaatttgtgtttcttttca

SEQ ID NO: 1107693 - DNA, 22 bp, Artificial Sequence
  chemically synthesized
ggcaatttgtgtttcttttcat

SEQ ID NO: 1107694 - DNA, 22 bp, Artificial Sequence
  chemically synthesized
gcaatttgtgtttcttttcatt

SEQ ID NO: 1107695 - DNA, 22 bp, Artificial Sequence
  chemically synthesized
gtgtttcttttcatttctccta

SEQ ID NO: 1107696 - DNA, 22 bp, Artificial Sequence
  chemically synthesized
gagaaaggacattaggagaaat

SEQ ID NO: 1107697 - DNA, 22 bp, Artificial Sequence
  chemically synthesized
tgtttcttttcatttctcctaa

SEQ ID NO: 1107698 - DNA, 22 bp, Artificial Sequence
  chemically synthesized
cttttcatttctcctaatgtcc

SEQ ID NO: 1107699 - DNA, 22 bp, Artificial Sequence
  chemically synthesized
ttttcatttctcctaatgtcct

SEQ ID NO: 1107700 - DNA, 22 bp, Artificial Sequence
  chemically synthesized
ttcatttctcctaatgtccttt

SEQ ID NO: 1107701 - DNA, 22 bp, Artificial Sequence
  chemically synthesized
tcatttctcctaatgtcctttc

SEQ ID NO: 1107702 - DNA, 22 bp, Artificial Sequence
  chemically synthesized
catttctcctaatgtcctttct

SEQ ID NO: 1107703 - DNA, 22 bp, Artificial Sequence
  chemically synthesized
atttctcctaatgtcctttctc

SEQ ID NO: 1107704 - DNA, 22 bp, Artificial Sequence
  chemically synthesized
tatgataagttggagaaaggac

SEQ ID NO: 1107705 - DNA, 22 bp, Artificial Sequence
  chemically synthesized
ctcctaatgtcctttctccaac

SEQ ID NO: 1107706 - DNA, 22 bp, Artificial Sequence
  chemically synthesized
tcctaatgtcctttctccaact

SEQ ID NO: 1107707 - DNA, 22 bp, Artificial Sequence
  chemically synthesized
ctaatgtcctttctccaactta

SEQ ID NO: 1107708 - DNA, 22 bp, Artificial Sequence
  chemically synthesized
atgtcctttctccaacttatca

SEQ ID NO: 1107709 - DNA, 22 bp, Artificial Sequence
  chemically synthesized
tctccaacttatcatatagctg

SEQ ID NO: 1107710 - DNA, 22 bp, Artificial Sequence
  chemically synthesized
ctccaacttatcatatagctgg

SEQ ID NO: 1107711 - DNA, 22 bp, Artificial Sequence
  chemically synthesized
tccaacttatcatatagctggc

SEQ ID NO: 1107712 - DNA, 22 bp, Artificial Sequence
  chemically synthesized
caacttatcatatagctggcac

SEQ ID NO: 1107713 - DNA, 22 bp, Artificial Sequence
  chemically synthesized
gagaatgtgcaggtgccagcta

SEQ ID NO: 1107714 - DNA, 22 bp, Artificial Sequence
  chemically synthesized
atcatatagctggcacctgcac

SEQ ID NO: 1107715 - DNA, 22 bp, Artificial Sequence
  chemically synthesized
tcatatagctggcacctgcaca

SEQ ID NO: 1107716 - DNA, 22 bp, Artificial Sequence
  chemically synthesized
gaaccaaacctggagaatgtgc

SEQ ID NO: 1107717 - DNA, 22 bp, Artificial Sequence
  chemically synthesized
gcacctgcacattctccaggtt

SEQ ID NO: 1107718 - DNA, 22 bp, Artificial Sequence
  chemically synthesized
cacattctccaggtttggttct

SEQ ID NO: 1107719 - DNA, 22 bp, Artificial Sequence
  chemically synthesized
gggagatgatgttagaaccaaa

SEQ ID NO: 1107720 - DNA, 22 bp, Artificial Sequence
  chemically synthesized
tggggagatgatgttagaacca

SEQ ID NO: 1107721 - DNA, 22 bp, Artificial Sequence
  chemically synthesized
tccaggtttggttctaacatca

SEQ ID NO: 1107722 - DNA, 22 bp, Artificial Sequence
  chemically synthesized
caggtttggttctaacatcatc

SEQ ID NO: 1107723 - DNA, 22 bp, Artificial Sequence
  chemically synthesized
aaaccgtgattctggggagatg

SEQ ID NO: 1107724 - DNA, 22 bp, Artificial Sequence
  chemically synthesized
ggttctaacatcatctccccag

SEQ ID NO: 1107725 - DNA, 22 bp, Artificial Sequence
  chemically synthesized
gttctaacatcatctccccaga

SEQ ID NO: 1107726 - DNA, 22 bp, Artificial Sequence
  chemically synthesized
taacatcatctccccagaatca

SEQ ID NO: 1107727 - DNA, 22 bp, Artificial Sequence
  chemically synthesized
gcgtctgaaaccgtgattctgg

SEQ ID NO: 1107728 - DNA, 22 bp, Artificial Sequence
  chemically synthesized
acatcatctccccagaatcacg

SEQ ID NO: 1107729 - DNA, 22 bp, Artificial Sequence
  chemically synthesized
ggcgtctgaaaccgtgattctg

SEQ ID NO: 1107730 - DNA, 22 bp, Artificial Sequence
  chemically synthesized
tggcgtctgaaaccgtgattct

SEQ ID NO: 1107731 - DNA, 22 bp, Artificial Sequence
  chemically synthesized
ctttggcgtctgaaaccgtgat

SEQ ID NO: 1107732 - DNA, 22 bp, Artificial Sequence
  chemically synthesized
cccagaatcacggtttcagacg

SEQ ID NO: 1107733 - DNA, 22 bp, Artificial Sequence
  chemically synthesized
taattactttggcgtctgaaac

SEQ ID NO: 1107734 - DNA, 22 bp, Artificial Sequence
  chemically synthesized
cagattataattactttggcgt

SEQ ID NO: 1107735 - DNA, 22 bp, Artificial Sequence
  chemically synthesized
ttgcagattataattactttgg

SEQ ID NO: 1107736 - DNA, 22 bp, Artificial Sequence
  chemically synthesized
cagacgccaaagtaattataat

SEQ ID NO: 1107737 - DNA, 22 bp, Artificial Sequence
  chemically synthesized
agacgccaaagtaattataatc

SEQ ID NO: 1107738 - DNA, 22 bp, Artificial Sequence
  chemically synthesized
aatattattgcagattataatt

SEQ ID NO: 1107739 - DNA, 22 bp, Artificial Sequence
  chemically synthesized
aatatctgaatattattgcaga

SEQ ID NO: 1107740 - DNA, 22 bp, Artificial Sequence
  chemically synthesized
taatctgcaataatattcagat

SEQ ID NO: 1107741 - DNA, 22 bp, Artificial Sequence
  chemically synthesized
caataatattcagatattcaat

SEQ ID NO: 1107742 - DNA, 22 bp, Artificial Sequence
  chemically synthesized
aaagaaagataataaaattgaa

SEQ ID NO: 1107743 - DNA, 22 bp, Artificial Sequence
  chemically synthesized
ttgaaagaaagataataaaatt

SEQ ID NO: 1107744 - DNA, 22 bp, Artificial Sequence
  chemically synthesized
attgaaagaaagataataaaat

SEQ ID NO: 1107745 - DNA, 22 bp, Artificial Sequence
  chemically synthesized
agatattcaattttattatctt

SEQ ID NO: 1107746 - DNA, 22 bp, Artificial Sequence
  chemically synthesized
atggagcttattgaaagaaaga

SEQ ID NO: 1107747 - DNA, 22 bp, Artificial Sequence
  chemically synthesized
catggagcttattgaaagaaag

SEQ ID NO: 1107748 - DNA, 22 bp, Artificial Sequence
  chemically synthesized
aattttattatctttctttcaa

SEQ ID NO: 1107749 - DNA, 22 bp, Artificial Sequence
  chemically synthesized
tattatctttctttcaataagc

SEQ ID NO: 1107750 - DNA, 22 bp, Artificial Sequence
  chemically synthesized
attatctttctttcaataagct

SEQ ID NO: 1107751 - DNA, 22 bp, Artificial Sequence
  chemically synthesized
ttatctttctttcaataagctc

SEQ ID NO: 1107752 - DNA, 22 bp, Artificial Sequence
  chemically synthesized
tctttctttcaataagctccat

SEQ ID NO: 1107753 - DNA, 22 bp, Artificial Sequence
  chemically synthesized
tctttcaataagctccatgaag

SEQ ID NO: 1107754 - DNA, 22 bp, Artificial Sequence
  chemically synthesized
ctttcaataagctccatgaaga

SEQ ID NO: 1107755 - DNA, 22 bp, Artificial Sequence
  chemically synthesized
tttcaataagctccatgaagac

SEQ ID NO: 1107756 - DNA, 22 bp, Artificial Sequence
  chemically synthesized
tcaataagctccatgaagacat

SEQ ID NO: 1107757 - DNA, 22 bp, Artificial Sequence
  chemically synthesized
caataagctccatgaagacata

SEQ ID NO: 1107758 - DNA, 22 bp, Artificial Sequence
  chemically synthesized
aataagctccatgaagacatat

SEQ ID NO: 1107759 - DNA, 22 bp, Artificial Sequence
  chemically synthesized
catgaagacatattgctcttga

SEQ ID NO: 1107760 - DNA, 22 bp, Artificial Sequence
  chemically synthesized
ggtaatatacatggtggagaaa

SEQ ID NO: 1107761 - DNA, 22 bp, Artificial Sequence
  chemically synthesized
ctcttgattttctccaccatgt

SEQ ID NO: 1107762 - DNA, 22 bp, Artificial Sequence
  chemically synthesized
ttgattttctccaccatgtata

SEQ ID NO: 1107763 - DNA, 22 bp, Artificial Sequence
  chemically synthesized
ggcactaggtaatatacatggt

SEQ ID NO: 1107764 - DNA, 22 bp, Artificial Sequence
  chemically synthesized
gattttctccaccatgtatatt

SEQ ID NO: 1107765 - DNA, 22 bp, Artificial Sequence
  chemically synthesized
attttctccaccatgtatatta

SEQ ID NO: 1107766 - DNA, 22 bp, Artificial Sequence
  chemically synthesized
tctccaccatgtatattaccta

SEQ ID NO: 1107767 - DNA, 22 bp, Artificial Sequence
  chemically synthesized
ctccaccatgtatattacctag

SEQ ID NO: 1107768 - DNA, 22 bp, Artificial Sequence
  chemically synthesized
tccaccatgtatattacctagt

SEQ ID NO: 1107769 - DNA, 22 bp, Artificial Sequence
  chemically synthesized
caccatgtatattacctagtgc

SEQ ID NO: 1107770 - DNA, 22 bp, Artificial Sequence
  chemically synthesized
gtatatgccgtaaaagtgctgg

SEQ ID NO: 1107771 - DNA, 22 bp, Artificial Sequence
  chemically synthesized
cctagtgcccagcacttttacg

SEQ ID NO: 1107772 - DNA, 22 bp, Artificial Sequence
  chemically synthesized
gtgcccagcacttttacggcat

SEQ ID NO: 1107773 - DNA, 22 bp, Artificial Sequence
  chemically synthesized
aacacctggtatatgccgtaaa

SEQ ID NO: 1107774 - DNA, 22 bp, Artificial Sequence
  chemically synthesized
gaacacctggtatatgccgtaa

SEQ ID NO: 1107775 - DNA, 22 bp, Artificial Sequence
  chemically synthesized
tgaacacctggtatatgccgta

SEQ ID NO: 1107776 - DNA, 22 bp, Artificial Sequence
  chemically synthesized
ttgaacacctggtatatgccgt

SEQ ID NO: 1107777 - DNA, 22 bp, Artificial Sequence
  chemically synthesized
ttacggcatataccaggtgttc

SEQ ID NO: 1107778 - DNA, 22 bp, Artificial Sequence
  chemically synthesized
tacggcatataccaggtgttca

SEQ ID NO: 1107779 - DNA, 22 bp, Artificial Sequence
  chemically synthesized
aagaaatatttttgaacacctg

SEQ ID NO: 1107780 - DNA, 22 bp, Artificial Sequence
  chemically synthesized
acggcatataccaggtgttcaa

SEQ ID NO: 1107781 - DNA, 22 bp, Artificial Sequence
  chemically synthesized
cggcatataccaggtgttcaaa

SEQ ID NO: 1107782 - DNA, 22 bp, Artificial Sequence
  chemically synthesized
ataaattcaagaaatatttttg

SEQ ID NO: 1107783 - DNA, 22 bp, Artificial Sequence
  chemically synthesized
actaataaattcaagaaatatt

SEQ ID NO: 1107784 - DNA, 22 bp, Artificial Sequence
  chemically synthesized
cactaataaattcaagaaatat

SEQ ID NO: 1107785 - DNA, 22 bp, Artificial Sequence
  chemically synthesized
tcactaataaattcaagaaata

SEQ ID NO: 1107786 - DNA, 22 bp, Artificial Sequence
  chemically synthesized
ttcactaataaattcaagaaat

SEQ ID NO: 1107787 - DNA, 22 bp, Artificial Sequence
  chemically synthesized
tttcactaataaattcaagaaa

SEQ ID NO: 1107788 - DNA, 22 bp, Artificial Sequence
  chemically synthesized
actttttcactaataaattcaa

SEQ ID NO: 1107789 - DNA, 22 bp, Artificial Sequence
  chemically synthesized
aaaaatatttcttgaatttatt

SEQ ID NO: 1107790 - DNA, 22 bp, Artificial Sequence
  chemically synthesized
ctcactttttcactaataaatt

SEQ ID NO: 1107791 - DNA, 22 bp, Artificial Sequence
  chemically synthesized
gctcactttttcactaataaat

SEQ ID NO: 1107792 - DNA, 22 bp, Artificial Sequence
  chemically synthesized
cttgaatttattagtgaaaaag

SEQ ID NO: 1107793 - DNA, 22 bp, Artificial Sequence
  chemically synthesized
ttgaatttattagtgaaaaagt

SEQ ID NO: 1107794 - DNA, 22 bp, Artificial Sequence
  chemically synthesized
gaatttattagtgaaaaagtga

SEQ ID NO: 1107795 - DNA, 22 bp, Artificial Sequence
  chemically synthesized
aatttattagtgaaaaagtgag

SEQ ID NO: 1107796 - DNA, 22 bp, Artificial Sequence
  chemically synthesized
agaacagagtcttgctcacttt

SEQ ID NO: 1107797 - DNA, 22 bp, Artificial Sequence
  chemically synthesized
cagaacagagtcttgctcactt

SEQ ID NO: 1107798 - DNA, 22 bp, Artificial Sequence
  chemically synthesized
tcagaacagagtcttgctcact

SEQ ID NO: 1107799 - DNA, 22 bp, Artificial Sequence
  chemically synthesized
attagtgaaaaagtgagcaaga

SEQ ID NO: 1107800 - DNA, 22 bp, Artificial Sequence
  chemically synthesized
ttagtgaaaaagtgagcaagac

SEQ ID NO: 1107801 - DNA, 22 bp, Artificial Sequence
  chemically synthesized
ctttcagaacagagtcttgctc

SEQ ID NO: 1107802 - DNA, 22 bp, Artificial Sequence
  chemically synthesized
gtgaaaaagtgagcaagactct

SEQ ID NO: 1107803 - DNA, 22 bp, Artificial Sequence
  chemically synthesized
gattgctttcagaacagagtct

SEQ ID NO: 1107804 - DNA, 22 bp, Artificial Sequence
  chemically synthesized
caccattagattgctttcagaa

SEQ ID NO: 1107805 - DNA, 22 bp, Artificial Sequence
  chemically synthesized
tacaccattagattgctttcag

SEQ ID NO: 1107806 - DNA, 22 bp, Artificial Sequence
  chemically synthesized
ttctacaccattagattgcttt

SEQ ID NO: 1107807 - DNA, 22 bp, Artificial Sequence
  chemically synthesized
tgttctacaccattagattgct

SEQ ID NO: 1107808 - DNA, 22 bp, Artificial Sequence
  chemically synthesized
ctgttctacaccattagattgc

SEQ ID NO: 1107809 - DNA, 22 bp, Artificial Sequence
  chemically synthesized
tgttctgaaagcaatctaatgg

SEQ ID NO: 1107810 - DNA, 22 bp, Artificial Sequence
  chemically synthesized
ttctgttctacaccattagatt

SEQ ID NO: 1107811 - DNA, 22 bp, Artificial Sequence
  chemically synthesized
ttctgaaagcaatctaatggtg

SEQ ID NO: 1107812 - DNA, 22 bp, Artificial Sequence
  chemically synthesized
tcttctgttctacaccattaga

SEQ ID NO: 1107813 - DNA, 22 bp, Artificial Sequence
  chemically synthesized
tgaaagcaatctaatggtgtag

SEQ ID NO: 1107814 - DNA, 22 bp, Artificial Sequence
  chemically synthesized
aaagcaatctaatggtgtagaa

SEQ ID NO: 1107815 - DNA, 22 bp, Artificial Sequence
  chemically synthesized
aaaatgattctcttctgttcta

SEQ ID NO: 1107816 - DNA, 22 bp, Artificial Sequence
  chemically synthesized
caaaatgattctcttctgttct

SEQ ID NO: 1107817 - DNA, 22 bp, Artificial Sequence
  chemically synthesized
atggtgtagaacagaagagaat

SEQ ID NO: 1107818 - DNA, 22 bp, Artificial Sequence
  chemically synthesized
aagtttcaaaatgattctcttc

SEQ ID NO: 1107819 - DNA, 22 bp, Artificial Sequence
  chemically synthesized
taaagtttcaaaatgattctct

SEQ ID NO: 1107820 - DNA, 22 bp, Artificial Sequence
  chemically synthesized
ttctaaagtttcaaaatgattc

SEQ ID NO: 1107821 - DNA, 22 bp, Artificial Sequence
  chemically synthesized
actgttctaaagtttcaaaatg

SEQ ID NO: 1107822 - DNA, 22 bp, Artificial Sequence
  chemically synthesized
gactgttctaaagtttcaaaat

SEQ ID NO: 1107823 - DNA, 22 bp, Artificial Sequence
  chemically synthesized
tgactgttctaaagtttcaaaa

SEQ ID NO: 1107824 - DNA, 22 bp, Artificial Sequence
  chemically synthesized
tgaaactttagaacagtcaaaa

SEQ ID NO: 1107825 - DNA, 22 bp, Artificial Sequence
  chemically synthesized
gaaactttagaacagtcaaaac

SEQ ID NO: 1107826 - DNA, 22 bp, Artificial Sequence
  chemically synthesized
aaactttagaacagtcaaaaca

SEQ ID NO: 1107827 - DNA, 22 bp, Artificial Sequence
  chemically synthesized
tgacaaagccagtgttttgact

SEQ ID NO: 1107828 - DNA, 22 bp, Artificial Sequence
  chemically synthesized
gttatgacaaagccagtgtttt

SEQ ID NO: 1107829 - DNA, 22 bp, Artificial Sequence
  chemically synthesized
tagaacagtcaaaacactggct

SEQ ID NO: 1107830 - DNA, 22 bp, Artificial Sequence
  chemically synthesized
agaacagtcaaaacactggctt

SEQ ID NO: 1107831 - DNA, 22 bp, Artificial Sequence
  chemically synthesized
ttagttatgacaaagccagtgt

SEQ ID NO: 1107832 - DNA, 22 bp, Artificial Sequence
  chemically synthesized
gaacagtcaaaacactggcttt

SEQ ID NO: 1107833 - DNA, 22 bp, Artificial Sequence
  chemically synthesized
gctttgtcataactaataatgt

SEQ ID NO: 1107834 - DNA, 22 bp, Artificial Sequence
  chemically synthesized
tgtcataactaataatgtcact

SEQ ID NO: 1107835 - DNA, 22 bp, Artificial Sequence
  chemically synthesized
gtcataactaataatgtcactt

SEQ ID NO: 1107836 - DNA, 22 bp, Artificial Sequence
  chemically synthesized
caaaaatggagaaagtgacatt

SEQ ID NO: 1107837 - DNA, 22 bp, Artificial Sequence
  chemically synthesized
tcataactaataatgtcacttt

SEQ ID NO: 1107838 - DNA, 22 bp, Artificial Sequence
  chemically synthesized
gcaaaaatggagaaagtgacat

SEQ ID NO: 1107839 - DNA, 22 bp, Artificial Sequence
  chemically synthesized
tgcaaaaatggagaaagtgaca

SEQ ID NO: 1107840 - DNA, 22 bp, Artificial Sequence
  chemically synthesized
gttttgcaaaaatggagaaagt

SEQ ID NO: 1107841 - DNA, 22 bp, Artificial Sequence
  chemically synthesized
agttttgcaaaaatggagaaag

SEQ ID NO: 1107842 - DNA, 22 bp, Artificial Sequence
  chemically synthesized
ataatgtcactttctccatttt

SEQ ID NO: 1107843 - DNA, 22 bp, Artificial Sequence
  chemically synthesized
gtttagttttgcaaaaatggag

SEQ ID NO: 1107844 - DNA, 22 bp, Artificial Sequence
  chemically synthesized
ggtttagttttgcaaaaatgga

SEQ ID NO: 1107845 - DNA, 22 bp, Artificial Sequence
  chemically synthesized
gtttggtttagttttgcaaaaa

SEQ ID NO: 1107846 - DNA, 22 bp, Artificial Sequence
  chemically synthesized
ttggtttggtttagttttgcaa

SEQ ID NO: 1107847 - DNA, 22 bp, Artificial Sequence
  chemically synthesized
attggtttggtttagttttgca

SEQ ID NO: 1107848 - DNA, 22 bp, Artificial Sequence
  chemically synthesized
tattggtttggtttagttttgc

SEQ ID NO: 1107849 - DNA, 22 bp, Artificial Sequence
  chemically synthesized
tctccatttttgcaaaactaaa

SEQ ID NO: 1107850 - DNA, 22 bp, Artificial Sequence
  chemically synthesized
ctccatttttgcaaaactaaac

SEQ ID NO: 1107851 - DNA, 22 bp, Artificial Sequence
  chemically synthesized
tccatttttgcaaaactaaacc

SEQ ID NO: 1107852 - DNA, 22 bp, Artificial Sequence
  chemically synthesized
catttttgcaaaactaaaccaa

SEQ ID NO: 1107853 - DNA, 22 bp, Artificial Sequence
  chemically synthesized
gggattttattggtttggttta

SEQ ID NO: 1107854 - DNA, 22 bp, Artificial Sequence
  chemically synthesized
ttgcaaaactaaaccaaaccaa

SEQ ID NO: 1107855 - DNA, 22 bp, Artificial Sequence
  chemically synthesized
ttagggattttattggtttggt

SEQ ID NO: 1107856 - DNA, 22 bp, Artificial Sequence
  chemically synthesized
tgcaaaactaaaccaaaccaat

SEQ ID NO: 1107857 - DNA, 22 bp, Artificial Sequence
  chemically synthesized
gcaaaactaaaccaaaccaata

SEQ ID NO: 1107858 - DNA, 22 bp, Artificial Sequence
  chemically synthesized
caaaactaaaccaaaccaataa

SEQ ID NO: 1107859 - DNA, 22 bp, Artificial Sequence
  chemically synthesized
aaataattattagggattttat

SEQ ID NO: 1107860 - DNA, 22 bp, Artificial Sequence
  chemically synthesized
aaccaaaccaataaaatcccta

SEQ ID NO: 1107861 - DNA, 22 bp, Artificial Sequence
  chemically synthesized
gaaatcatgttaaaataattat

SEQ ID NO: 1107862 - DNA, 22 bp, Artificial Sequence
  chemically synthesized
ggaaatcatgttaaaataatta

SEQ ID NO: 1107863 - DNA, 22 bp, Artificial Sequence
  chemically synthesized
acaatttggaaatcatgttaaa

SEQ ID NO: 1107864 - DNA, 22 bp, Artificial Sequence
  chemically synthesized
ataattattttaacatgatttc

SEQ ID NO: 1107865 - DNA, 22 bp, Artificial Sequence
  chemically synthesized
attaacaatttggaaatcatgt

SEQ ID NO: 1107866 - DNA, 22 bp, Artificial Sequence
  chemically synthesized
cattaacaatttggaaatcatg

SEQ ID NO: 1107867 - DNA, 22 bp, Artificial Sequence
  chemically synthesized
tttcattaacaatttggaaatc

SEQ ID NO: 1107868 - DNA, 22 bp, Artificial Sequence
  chemically synthesized
atttcattaacaatttggaaat

SEQ ID NO: 1107869 - DNA, 22 bp, Artificial Sequence
  chemically synthesized
ttttaacatgatttccaaattg

SEQ ID NO: 1107870 - DNA, 22 bp, Artificial Sequence
  chemically synthesized
taacatgatttccaaattgtta

SEQ ID NO: 1107871 - DNA, 22 bp, Artificial Sequence
  chemically synthesized
agtttatttcattaacaatttg

SEQ ID NO: 1107872 - DNA, 22 bp, Artificial Sequence
  chemically synthesized
aacatgatttccaaattgttaa

SEQ ID NO: 1107873 - DNA, 22 bp, Artificial Sequence
  chemically synthesized
gagtttatttcattaacaattt

SEQ ID NO: 1107874 - DNA, 22 bp, Artificial Sequence
  chemically synthesized
acatgatttccaaattgttaat

SEQ ID NO: 1107875 - DNA, 22 bp, Artificial Sequence
  chemically synthesized
ccaaattgttaatgaaataaac

SEQ ID NO: 1107876 - DNA, 22 bp, Artificial Sequence
  chemically synthesized
caaattgttaatgaaataaact

SEQ ID NO: 1107877 - DNA, 22 bp, Artificial Sequence
  chemically synthesized
gtcatataatttgagtttattt

SEQ ID NO: 1107878 - DNA, 22 bp, Artificial Sequence
  chemically synthesized
ttaatgaaataaactcaaatta

SEQ ID NO: 1107879 - DNA, 22 bp, Artificial Sequence
  chemically synthesized
atgaaataaactcaaattatat

SEQ ID NO: 1107880 - DNA, 22 bp, Artificial Sequence
  chemically synthesized
aaattatatgaccaatcttttt

SEQ ID NO: 1107881 - DNA, 22 bp, Artificial Sequence
  chemically synthesized
atgtaaagaaggaaaaagattg

SEQ ID NO: 1107882 - DNA, 22 bp, Artificial Sequence
  chemically synthesized
aatgtaaagaaggaaaaagatt

SEQ ID NO: 1107883 - DNA, 22 bp, Artificial Sequence
  chemically synthesized
ttaatgtaaagaaggaaaaaga

SEQ ID NO: 1107884 - DNA, 22 bp, Artificial Sequence
  chemically synthesized
cttaatgtaaagaaggaaaaag

SEQ ID NO: 1107885 - DNA, 22 bp, Artificial Sequence
  chemically synthesized
tatgaccaatctttttccttct

SEQ ID NO: 1107886 - DNA, 22 bp, Artificial Sequence
  chemically synthesized
tttcttaatgtaaagaaggaaa

SEQ ID NO: 1107887 - DNA, 22 bp, Artificial Sequence
  chemically synthesized
atttcttaatgtaaagaaggaa

SEQ ID NO: 1107888 - DNA, 22 bp, Artificial Sequence
  chemically synthesized
tttccttctttacattaagaaa

SEQ ID NO: 1107889 - DNA, 22 bp, Artificial Sequence
  chemically synthesized
ttccttctttacattaagaaat

SEQ ID NO: 1107890 - DNA, 22 bp, Artificial Sequence
  chemically synthesized
tccttctttacattaagaaata

SEQ ID NO: 1107891 - DNA, 22 bp, Artificial Sequence
  chemically synthesized
ccttctttacattaagaaataa

SEQ ID NO: 1107892 - DNA, 22 bp, Artificial Sequence
  chemically synthesized
cttctttacattaagaaataag

SEQ ID NO: 1107893 - DNA, 22 bp, Artificial Sequence
  chemically synthesized
ctttacattaagaaataaggtt

SEQ ID NO: 1107894 - DNA, 22 bp, Artificial Sequence
  chemically synthesized
tttacattaagaaataaggttt

SEQ ID NO: 1107895 - DNA, 22 bp, Artificial Sequence
  chemically synthesized
tacattaagaaataaggtttca

SEQ ID NO: 1107896 - DNA, 22 bp, Artificial Sequence
  chemically synthesized
acattaagaaataaggtttcat

SEQ ID NO: 1107897 - DNA, 22 bp, Artificial Sequence
  chemically synthesized
cattaagaaataaggtttcatt

SEQ ID NO: 1107898 - DNA, 22 bp, Artificial Sequence
  chemically synthesized
aacaaagaaaaaaatgaaacct

SEQ ID NO: 1107899 - DNA, 22 bp, Artificial Sequence
  chemically synthesized
caacaaagaaaaaaatgaaacc

SEQ ID NO: 1107900 - DNA, 22 bp, Artificial Sequence
  chemically synthesized
tttcaacaaagaaaaaaatgaa

SEQ ID NO: 1107901 - DNA, 22 bp, Artificial Sequence
  chemically synthesized
agaaataaggtttcattttttt

SEQ ID NO: 1107902 - DNA, 22 bp, Artificial Sequence
  chemically synthesized
tagataattgtttcaacaaaga

SEQ ID NO: 1107903 - DNA, 22 bp, Artificial Sequence
  chemically synthesized
ttgtagataattgtttcaacaa

SEQ ID NO: 1107904 - DNA, 22 bp, Artificial Sequence
  chemically synthesized
catttttttctttgttgaaaca

SEQ ID NO: 1107905 - DNA, 22 bp, Artificial Sequence
  chemically synthesized
atttttttctttgttgaaacaa

SEQ ID NO: 1107906 - DNA, 22 bp, Artificial Sequence
  chemically synthesized
gtctgttgtagataattgtttc

SEQ ID NO: 1107907 - DNA, 22 bp, Artificial Sequence
  chemically synthesized
ttttctttgttgaaacaattat

SEQ ID NO: 1107908 - DNA, 22 bp, Artificial Sequence
  chemically synthesized
tttctttgttgaaacaattatc

SEQ ID NO: 1107909 - DNA, 22 bp, Artificial Sequence
  chemically synthesized
ttctttgttgaaacaattatct

SEQ ID NO: 1107910 - DNA, 22 bp, Artificial Sequence
  chemically synthesized
tctttgttgaaacaattatcta

SEQ ID NO: 1107911 - DNA, 22 bp, Artificial Sequence
  chemically synthesized
ctttgttgaaacaattatctac

SEQ ID NO: 1107912 - DNA, 22 bp, Artificial Sequence
  chemically synthesized
tttgttgaaacaattatctaca

SEQ ID NO: 1107913 - DNA, 22 bp, Artificial Sequence
  chemically synthesized
tgttgaaacaattatctacaac

SEQ ID NO: 1107914 - DNA, 22 bp, Artificial Sequence
  chemically synthesized
gttgaaacaattatctacaaca

SEQ ID NO: 1107915 - DNA, 22 bp, Artificial Sequence
  chemically synthesized
ttgaaacaattatctacaacag

SEQ ID NO: 1107916 - DNA, 22 bp, Artificial Sequence
  chemically synthesized
aaacaattatctacaacagact

SEQ ID NO: 1107917 - DNA, 22 bp, Artificial Sequence
  chemically synthesized
tctacaacagactagatgctgt

SEQ ID NO: 1107918 - DNA, 22 bp, Artificial Sequence
  chemically synthesized
gatgaatatagaaacacagcat

SEQ ID NO: 1107919 - DNA, 22 bp, Artificial Sequence
  chemically synthesized
caacagactagatgctgtgttt

SEQ ID NO: 1107920 - DNA, 22 bp, Artificial Sequence
  chemically synthesized
tatgctagatgaatatagaaac

SEQ ID NO: 1107921 - DNA, 22 bp, Artificial Sequence
  chemically synthesized
gatgctgtgtttctatattcat

SEQ ID NO: 1107922 - DNA, 22 bp, Artificial Sequence
  chemically synthesized
atgttatatgctagatgaatat

SEQ ID NO: 1107923 - DNA, 22 bp, Artificial Sequence
  chemically synthesized
tgtttctatattcatctagcat

SEQ ID NO: 1107924 - DNA, 22 bp, Artificial Sequence
  chemically synthesized
ctatattcatctagcatataac

SEQ ID NO: 1107925 - DNA, 22 bp, Artificial Sequence
  chemically synthesized
tatattcatctagcatataaca

SEQ ID NO: 1107926 - DNA, 22 bp, Artificial Sequence
  chemically synthesized
tattcatctagcatataacatg

SEQ ID NO: 1107927 - DNA, 22 bp, Artificial Sequence
  chemically synthesized
aaaaccagtaaactcatgttat

SEQ ID NO: 1107928 - DNA, 22 bp, Artificial Sequence
  chemically synthesized
atctagcatataacatgagttt

SEQ ID NO: 1107929 - DNA, 22 bp, Artificial Sequence
  chemically synthesized
gagactgaaaaccagtaaactc

SEQ ID NO: 1107930 - DNA, 22 bp, Artificial Sequence
  chemically synthesized
gcatataacatgagtttactgg

SEQ ID NO: 1107931 - DNA, 22 bp, Artificial Sequence
  chemically synthesized
tagagactgaaaaccagtaaac

SEQ ID NO: 1107932 - DNA, 22 bp, Artificial Sequence
  chemically synthesized
ctagagactgaaaaccagtaaa

SEQ ID NO: 1107933 - DNA, 22 bp, Artificial Sequence
  chemically synthesized
tctagagactgaaaaccagtaa

SEQ ID NO: 1107934 - DNA, 22 bp, Artificial Sequence
  chemically synthesized
ttctagagactgaaaaccagta

SEQ ID NO: 1107935 - DNA, 22 bp, Artificial Sequence
  chemically synthesized
ataaaatacttttctagagact

SEQ ID NO: 1107936 - DNA, 22 bp, Artificial Sequence
  chemically synthesized
actggttttcagtctctagaaa

SEQ ID NO: 1107937 - DNA, 22 bp, Artificial Sequence
  chemically synthesized
ctggttttcagtctctagaaaa

SEQ ID NO: 1107938 - DNA, 22 bp, Artificial Sequence
  chemically synthesized
gttttcagtctctagaaaagta

SEQ ID NO: 1107939 - DNA, 22 bp, Artificial Sequence
  chemically synthesized
tcagtctctagaaaagtatttt

SEQ ID NO: 1107940 - DNA, 22 bp, Artificial Sequence
  chemically synthesized
cagtctctagaaaagtatttta

SEQ ID NO: 1107941 - DNA, 22 bp, Artificial Sequence
  chemically synthesized
agtctctagaaaagtattttat

SEQ ID NO: 1107942 - DNA, 22 bp, Artificial Sequence
  chemically synthesized
ccatgacagttgataaaatact

SEQ ID NO: 1107943 - DNA, 22 bp, Artificial Sequence
  chemically synthesized
cccatgacagttgataaaatac

SEQ ID NO: 1107944 - DNA, 22 bp, Artificial Sequence
  chemically synthesized
tttcccatgacagttgataaaa

SEQ ID NO: 1107945 - DNA, 22 bp, Artificial Sequence
  chemically synthesized
tagaaaagtattttatcaactg

SEQ ID NO: 1107946 - DNA, 22 bp, Artificial Sequence
  chemically synthesized
gaaaagtattttatcaactgtc

SEQ ID NO: 1107947 - DNA, 22 bp, Artificial Sequence
  chemically synthesized
tatcaactgtcatgggaaacaa

SEQ ID NO: 1107948 - DNA, 22 bp, Artificial Sequence
  chemically synthesized
atcaactgtcatgggaaacaat

SEQ ID NO: 1107949 - DNA, 22 bp, Artificial Sequence
  chemically synthesized
tcaactgtcatgggaaacaatt

SEQ ID NO: 1107950 - DNA, 22 bp, Artificial Sequence
  chemically synthesized
ggaggatgagggggtggaattg

SEQ ID NO: 1107951 - DNA, 22 bp, Artificial Sequence
  chemically synthesized
tcatgggaaacaattccacccc

SEQ ID NO: 1107952 - DNA, 22 bp, Artificial Sequence
  chemically synthesized
ggtctgggaggatgagggggtg

SEQ ID NO: 1107953 - DNA, 22 bp, Artificial Sequence
  chemically synthesized
cctaggtctgggaggatgaggg

SEQ ID NO: 1107954 - DNA, 22 bp, Artificial Sequence
  chemically synthesized
gtggttgcctaggtctgggagg

SEQ ID NO: 1107955 - DNA, 22 bp, Artificial Sequence
  chemically synthesized
caccccctcatcctcccagacc

SEQ ID NO: 1107956 - DNA, 22 bp, Artificial Sequence
  chemically synthesized
atcctcccagacctaggcaacc

SEQ ID NO: 1107957 - DNA, 22 bp, Artificial Sequence
  chemically synthesized
ccagacctaggcaaccactaat

SEQ ID NO: 1107958 - DNA, 22 bp, Artificial Sequence
  chemically synthesized
tacaggcagaaataagattagt

SEQ ID NO: 1107959 - DNA, 22 bp, Artificial Sequence
  chemically synthesized
ggcaaccactaatcttatttct

SEQ ID NO: 1107960 - DNA, 22 bp, Artificial Sequence
  chemically synthesized
atcttatttctgcctgtacaga

SEQ ID NO: 1107961 - DNA, 22 bp, Artificial Sequence
  chemically synthesized
atttctgcctgtacagatttgc

SEQ ID NO: 1107962 - DNA, 22 bp, Artificial Sequence
  chemically synthesized
tttctgcctgtacagatttgcc

SEQ ID NO: 1107963 - DNA, 22 bp, Artificial Sequence
  chemically synthesized
ctgcctgtacagatttgcctat

SEQ ID NO: 1107964 - DNA, 22 bp, Artificial Sequence
  chemically synthesized
tgcctgtacagatttgcctatt

SEQ ID NO: 1107965 - DNA, 22 bp, Artificial Sequence
  chemically synthesized
cctgtacagatttgcctattgt

SEQ ID NO: 1107966 - DNA, 22 bp, Artificial Sequence
  chemically synthesized
atataaaatggccacaataggc

SEQ ID NO: 1107967 - DNA, 22 bp, Artificial Sequence
  chemically synthesized
gatataaaatggccacaatagg

SEQ ID NO: 1107968 - DNA, 22 bp, Artificial Sequence
  chemically synthesized
tacagatttgcctattgtggcc

SEQ ID NO: 1107969 - DNA, 22 bp, Artificial Sequence
  chemically synthesized
ttgatataaaatggccacaata

SEQ ID NO: 1107970 - DNA, 22 bp, Artificial Sequence
  chemically synthesized
gcctattgtggccattttatat

SEQ ID NO: 1107971 - DNA, 22 bp, Artificial Sequence
  chemically synthesized
cctattgtggccattttatatc

SEQ ID NO: 1107972 - DNA, 22 bp, Artificial Sequence
  chemically synthesized
tatgagtctcttgatataaaat

SEQ ID NO: 1107973 - DNA, 22 bp, Artificial Sequence
  chemically synthesized
ttgtggccattttatatcaaga

SEQ ID NO: 1107974 - DNA, 22 bp, Artificial Sequence
  chemically synthesized
tggccattttatatcaagagac

SEQ ID NO: 1107975 - DNA, 22 bp, Artificial Sequence
  chemically synthesized
tatatcaagagactcatataac

SEQ ID NO: 1107976 - DNA, 22 bp, Artificial Sequence
  chemically synthesized
atatcaagagactcatataaca

SEQ ID NO: 1107977 - DNA, 22 bp, Artificial Sequence
  chemically synthesized
tatcaagagactcatataacat

SEQ ID NO: 1107978 - DNA, 22 bp, Artificial Sequence
  chemically synthesized
atataacatatgatcttttgtg

SEQ ID NO: 1107979 - DNA, 22 bp, Artificial Sequence
  chemically synthesized
agtgaaagaagccagtcacaaa

SEQ ID NO: 1107980 - DNA, 22 bp, Artificial Sequence
  chemically synthesized
tgctgagtgaaagaagccagtc

SEQ ID NO: 1107981 - DNA, 22 bp, Artificial Sequence
  chemically synthesized
ttgtgactggcttctttcactc

SEQ ID NO: 1107982 - DNA, 22 bp, Artificial Sequence
  chemically synthesized
tgtgactggcttctttcactca

SEQ ID NO: 1107983 - DNA, 22 bp, Artificial Sequence
  chemically synthesized
aagacattatgctgagtgaaag

SEQ ID NO: 1107984 - DNA, 22 bp, Artificial Sequence
  chemically synthesized
gtgactggcttctttcactcag

SEQ ID NO: 1107985 - DNA, 22 bp, Artificial Sequence
  chemically synthesized
gaagacattatgctgagtgaaa

SEQ ID NO: 1107986 - DNA, 22 bp, Artificial Sequence
  chemically synthesized
tgactggcttctttcactcagc

SEQ ID NO: 1107987 - DNA, 22 bp, Artificial Sequence
  chemically synthesized
gcttctttcactcagcataatg

SEQ ID NO: 1107988 - DNA, 22 bp, Artificial Sequence
  chemically synthesized
ctttcactcagcataatgtctt

SEQ ID NO: 1107989 - DNA, 22 bp, Artificial Sequence
  chemically synthesized
tttcactcagcataatgtcttc

SEQ ID NO: 1107990 - DNA, 22 bp, Artificial Sequence
  chemically synthesized
tcactcagcataatgtcttcaa

SEQ ID NO: 1107991 - DNA, 22 bp, Artificial Sequence
  chemically synthesized
cactcagcataatgtcttcaag

SEQ ID NO: 1107992 - DNA, 22 bp, Artificial Sequence
  chemically synthesized
actcagcataatgtcttcaagg

SEQ ID NO: 1107993 - DNA, 22 bp, Artificial Sequence
  chemically synthesized
cagcatggagtacccttgaaga

SEQ ID NO: 1107994 - DNA, 22 bp, Artificial Sequence
  chemically synthesized
agcataatgtcttcaagggtac

SEQ ID NO: 1107995 - DNA, 22 bp, Artificial Sequence
  chemically synthesized
atacatgctacagcatggagta

SEQ ID NO: 1107996 - DNA, 22 bp, Artificial Sequence
  chemically synthesized
caagggtactccatgctgtagc

SEQ ID NO: 1107997 - DNA, 22 bp, Artificial Sequence
  chemically synthesized
aagggtactccatgctgtagca

SEQ ID NO: 1107998 - DNA, 22 bp, Artificial Sequence
  chemically synthesized
catgctgtagcatgtatcagta

SEQ ID NO: 1107999 - DNA, 22 bp, Artificial Sequence
  chemically synthesized
tagcatgtatcagtactttctc

SEQ ID NO: 1108000 - DNA, 22 bp, Artificial Sequence
  chemically synthesized
agcaataaaaagggagaaagta

SEQ ID NO: 1108001 - DNA, 22 bp, Artificial Sequence
  chemically synthesized
ctgagcaataaaaagggagaaa

SEQ ID NO: 1108002 - DNA, 22 bp, Artificial Sequence
  chemically synthesized
tctccctttttattgctcagta

SEQ ID NO: 1108003 - DNA, 22 bp, Artificial Sequence
  chemically synthesized
ctccctttttattgctcagtaa

SEQ ID NO: 1108004 - DNA, 22 bp, Artificial Sequence
  chemically synthesized
tccctttttattgctcagtaac

SEQ ID NO: 1108005 - DNA, 22 bp, Artificial Sequence
  chemically synthesized
cctttttattgctcagtaacac

SEQ ID NO: 1108006 - DNA, 22 bp, Artificial Sequence
  chemically synthesized
tttattgctcagtaacactgcc

SEQ ID NO: 1108007 - DNA, 22 bp, Artificial Sequence
  chemically synthesized
ttattgctcagtaacactgcct

SEQ ID NO: 1108008 - DNA, 22 bp, Artificial Sequence
  chemically synthesized
tattgctcagtaacactgcctt

SEQ ID NO: 1108009 - DNA, 22 bp, Artificial Sequence
  chemically synthesized
attgctcagtaacactgccttg

SEQ ID NO: 1108010 - DNA, 22 bp, Artificial Sequence
  chemically synthesized
ttgctcagtaacactgccttgt

SEQ ID NO: 1108011 - DNA, 22 bp, Artificial Sequence
  chemically synthesized
ctcagtaacactgccttgtatg

SEQ ID NO: 1108012 - DNA, 22 bp, Artificial Sequence
  chemically synthesized
agtaacactgccttgtatggat

SEQ ID NO: 1108013 - DNA, 22 bp, Artificial Sequence
  chemically synthesized
tatgaagaaaatgggcacatcc

SEQ ID NO: 1108014 - DNA, 22 bp, Artificial Sequence
  chemically synthesized
ccttgtatggatgtgcccattt

SEQ ID NO: 1108015 - DNA, 22 bp, Artificial Sequence
  chemically synthesized
gtatggatgtgcccattttctt

SEQ ID NO: 1108016 - DNA, 22 bp, Artificial Sequence
  chemically synthesized
tatggatgtgcccattttcttc

SEQ ID NO: 1108017 - DNA, 22 bp, Artificial Sequence
  chemically synthesized
tcttcatatagtcatcactgga

SEQ ID NO: 1108018 - DNA, 22 bp, Artificial Sequence
  chemically synthesized
cttcatatagtcatcactggat

SEQ ID NO: 1108019 - DNA, 22 bp, Artificial Sequence
  chemically synthesized
ttcatatagtcatcactggatg

SEQ ID NO: 1108020 - DNA, 22 bp, Artificial Sequence
  chemically synthesized
catatagtcatcactggatgga

SEQ ID NO: 1108021 - DNA, 22 bp, Artificial Sequence
  chemically synthesized
atatagtcatcactggatggac

SEQ ID NO: 1108022 - DNA, 22 bp, Artificial Sequence
  chemically synthesized
gatggacatgtgggtttcttct

SEQ ID NO: 1108023 - DNA, 22 bp, Artificial Sequence
  chemically synthesized
ataatagccaaaacgtagaaga

SEQ ID NO: 1108024 - DNA, 22 bp, Artificial Sequence
  chemically synthesized
ttcataatagccaaaacgtaga

SEQ ID NO: 1108025 - DNA, 22 bp, Artificial Sequence
  chemically synthesized
cttctacgttttggctattatg

SEQ ID NO: 1108026 - DNA, 22 bp, Artificial Sequence
  chemically synthesized
ttctacgttttggctattatga

SEQ ID NO: 1108027 - DNA, 22 bp, Artificial Sequence
  chemically synthesized
ctacgttttggctattatgaat

SEQ ID NO: 1108028 - DNA, 22 bp, Artificial Sequence
  chemically synthesized
tacgttttggctattatgaata

SEQ ID NO: 1108029 - DNA, 22 bp, Artificial Sequence
  chemically synthesized
cgttttggctattatgaataat

SEQ ID NO: 1108030 - DNA, 22 bp, Artificial Sequence
  chemically synthesized
tggctattatgaataatgttgt

SEQ ID NO: 1108031 - DNA, 22 bp, Artificial Sequence
  chemically synthesized
ggctattatgaataatgttgtt

SEQ ID NO: 1108032 - DNA, 22 bp, Artificial Sequence
  chemically synthesized
gctattatgaataatgttgtta

SEQ ID NO: 1108033 - DNA, 22 bp, Artificial Sequence
  chemically synthesized
ttatgaataatgttgttatgga

SEQ ID NO: 1108034 - DNA, 22 bp, Artificial Sequence
  chemically synthesized
tgaataatgttgttatggacat

SEQ ID NO: 1108035 - DNA, 22 bp, Artificial Sequence
  chemically synthesized
gatcgtatacacgaatgtccat

SEQ ID NO: 1108036 - DNA, 22 bp, Artificial Sequence
  chemically synthesized
taagaactagatcgtatacacg

SEQ ID NO: 1108037 - DNA, 22 bp, Artificial Sequence
  chemically synthesized
ttatggacattcgtgtatacga

SEQ ID NO: 1108038 - DNA, 22 bp, Artificial Sequence
  chemically synthesized
tggacattcgtgtatacgatct

SEQ ID NO: 1108039 - DNA, 22 bp, Artificial Sequence
  chemically synthesized
gtgtatacgatctagttcttac

SEQ ID NO: 1108040 - DNA, 22 bp, Artificial Sequence
  chemically synthesized
aaagcatggatatgggatgctg

SEQ ID NO: 1108041 - DNA, 22 bp, Artificial Sequence
  chemically synthesized
gttcttacagcatcccatatcc

SEQ ID NO: 1108042 - DNA, 22 bp, Artificial Sequence
  chemically synthesized
aataactaaaagcatggatatg

SEQ ID NO: 1108043 - DNA, 22 bp, Artificial Sequence
  chemically synthesized
ttacagcatcccatatccatgc

SEQ ID NO: 1108044 - DNA, 22 bp, Artificial Sequence
  chemically synthesized
gaataactaaaagcatggatat

SEQ ID NO: 1108045 - DNA, 22 bp, Artificial Sequence
  chemically synthesized
acagcatcccatatccatgctt

SEQ ID NO: 1108046 - DNA, 22 bp, Artificial Sequence
  chemically synthesized
cagcatcccatatccatgcttt

SEQ ID NO: 1108047 - DNA, 22 bp, Artificial Sequence
  chemically synthesized
atggggtttgaataactaaaag

SEQ ID NO: 1108048 - DNA, 22 bp, Artificial Sequence
  chemically synthesized
ttagttattcaaaccccattag

SEQ ID NO: 1108049 - DNA, 22 bp, Artificial Sequence
  chemically synthesized
tagttattcaaaccccattagc

SEQ ID NO: 1108050 - DNA, 22 bp, Artificial Sequence
  chemically synthesized
tatcacaagtaagctaatgggg

SEQ ID NO: 1108051 - DNA, 22 bp, Artificial Sequence
  chemically synthesized
agttattcaaaccccattagct

SEQ ID NO: 1108052 - DNA, 22 bp, Artificial Sequence
  chemically synthesized
gttattcaaaccccattagctt

SEQ ID NO: 1108053 - DNA, 22 bp, Artificial Sequence
  chemically synthesized
ttcaaaccccattagcttactt

SEQ ID NO: 1108054 - DNA, 22 bp, Artificial Sequence
  chemically synthesized
caactatatcacaagtaagcta

SEQ ID NO: 1108055 - DNA, 22 bp, Artificial Sequence
  chemically synthesized
aaaccccattagcttacttgtg

SEQ ID NO: 1108056 - DNA, 22 bp, Artificial Sequence
  chemically synthesized
ttacaactatatcacaagtaag

SEQ ID NO: 1108057 - DNA, 22 bp, Artificial Sequence
  chemically synthesized
ttattacaactatatcacaagt

SEQ ID NO: 1108058 - DNA, 22 bp, Artificial Sequence
  chemically synthesized
gttattacaactatatcacaag

SEQ ID NO: 1108059 - DNA, 22 bp, Artificial Sequence
  chemically synthesized
gcttacttgtgatatagttgta

SEQ ID NO: 1108060 - DNA, 22 bp, Artificial Sequence
  chemically synthesized
agtatttgttattacaactata

SEQ ID NO: 1108061 - DNA, 22 bp, Artificial Sequence
  chemically synthesized
acttgtgatatagttgtaataa

SEQ ID NO: 1108062 - DNA, 22 bp, Artificial Sequence
  chemically synthesized
cttgtgatatagttgtaataac

SEQ ID NO: 1108063 - DNA, 22 bp, Artificial Sequence
  chemically synthesized
gtgatatagttgtaataacaaa

SEQ ID NO: 1108064 - DNA, 22 bp, Artificial Sequence
  chemically synthesized
tgatatagttgtaataacaaat

SEQ ID NO: 1108065 - DNA, 22 bp, Artificial Sequence
  chemically synthesized
agagagaaacacattgagtatt

SEQ ID NO: 1108066 - DNA, 22 bp, Artificial Sequence
  chemically synthesized
taataacaaatactcaatgtgt

SEQ ID NO: 1108067 - DNA, 22 bp, Artificial Sequence
  chemically synthesized
accctcagagagaaacacattg

SEQ ID NO: 1108068 - DNA, 22 bp, Artificial Sequence
  chemically synthesized
cctaaccctcagagagaaacac

SEQ ID NO: 1108069 - DNA, 22 bp, Artificial Sequence
  chemically synthesized
acctaaccctcagagagaaaca

SEQ ID NO: 1108070 - DNA, 22 bp, Artificial Sequence
  chemically synthesized
tacctaaccctcagagagaaac

SEQ ID NO: 1108071 - DNA, 22 bp, Artificial Sequence
  chemically synthesized
aatgtgtttctctctgagggtt

SEQ ID NO: 1108072 - DNA, 22 bp, Artificial Sequence
  chemically synthesized
tacatcattttacctaaccctc

SEQ ID NO: 1108073 - DNA, 22 bp, Artificial Sequence
  chemically synthesized
atacatcattttacctaaccct

SEQ ID NO: 1108074 - DNA, 22 bp, Artificial Sequence
  chemically synthesized
atttatacatcattttacctaa

SEQ ID NO: 1108075 - DNA, 22 bp, Artificial Sequence
  chemically synthesized
ctctctgagggttaggtaaaat

SEQ ID NO: 1108076 - DNA, 22 bp, Artificial Sequence
  chemically synthesized
tctctgagggttaggtaaaatg

SEQ ID NO: 1108077 - DNA, 22 bp, Artificial Sequence
  chemically synthesized
tctgagggttaggtaaaatgat

SEQ ID NO: 1108078 - DNA, 22 bp, Artificial Sequence
  chemically synthesized
tgagggttaggtaaaatgatgt

SEQ ID NO: 1108079 - DNA, 22 bp, Artificial Sequence
  chemically synthesized
agggttaggtaaaatgatgtat

SEQ ID NO: 1108080 - DNA, 22 bp, Artificial Sequence
  chemically synthesized
tgcataactaatttatacatca

SEQ ID NO: 1108081 - DNA, 22 bp, Artificial Sequence
  chemically synthesized
tatgcataactaatttatacat

SEQ ID NO: 1108082 - DNA, 22 bp, Artificial Sequence
  chemically synthesized
ggtaaaatgatgtataaattag

SEQ ID NO: 1108083 - DNA, 22 bp, Artificial Sequence
  chemically synthesized
ctctatgcataactaatttata

SEQ ID NO: 1108084 - DNA, 22 bp, Artificial Sequence
  chemically synthesized
actctatgcataactaatttat

SEQ ID NO: 1108085 - DNA, 22 bp, Artificial Sequence
  chemically synthesized
tactctatgcataactaattta

SEQ ID NO: 1108086 - DNA, 22 bp, Artificial Sequence
  chemically synthesized
ttactctatgcataactaattt

SEQ ID NO: 1108087 - DNA, 22 bp, Artificial Sequence
  chemically synthesized
tttactctatgcataactaatt

SEQ ID NO: 1108088 - DNA, 22 bp, Artificial Sequence
  chemically synthesized
aaagcactttttactctatgca

SEQ ID NO: 1108089 - DNA, 22 bp, Artificial Sequence
  chemically synthesized
caaagcactttttactctatgc

SEQ ID NO: 1108090 - DNA, 22 bp, Artificial Sequence
  chemically synthesized
tcaaagcactttttactctatg

SEQ ID NO: 1108091 - DNA, 22 bp, Artificial Sequence
  chemically synthesized
ttttcaaagcactttttactct

SEQ ID NO: 1108092 - DNA, 22 bp, Artificial Sequence
  chemically synthesized
tattttcaaagcactttttact

SEQ ID NO: 1108093 - DNA, 22 bp, Artificial Sequence
  chemically synthesized
gttatgcatagagtaaaaagtg

SEQ ID NO: 1108094 - DNA, 22 bp, Artificial Sequence
  chemically synthesized
tgcatagagtaaaaagtgcttt

SEQ ID NO: 1108095 - DNA, 22 bp, Artificial Sequence
  chemically synthesized
tgaaaatagaattttatctttt

SEQ ID NO: 1108096 - DNA, 22 bp, Artificial Sequence
  chemically synthesized
gaaaatagaattttatcttttt

SEQ ID NO: 1108097 - DNA, 22 bp, Artificial Sequence
  chemically synthesized
aaaatagaattttatcttttta

SEQ ID NO: 1108098 - DNA, 22 bp, Artificial Sequence
  chemically synthesized
tatctttttatattattttctt

SEQ ID NO: 1108099 - DNA, 22 bp, Artificial Sequence
  chemically synthesized
atctttttatattattttcttc

SEQ ID NO: 1108100 - DNA, 22 bp, Artificial Sequence
  chemically synthesized
acataagtgatagaagaaaata

SEQ ID NO: 1108101 - DNA, 22 bp, Artificial Sequence
  chemically synthesized
tctttttatattattttcttct

SEQ ID NO: 1108102 - DNA, 22 bp, Artificial Sequence
  chemically synthesized
cctgacataagtgatagaagaa

SEQ ID NO: 1108103 - DNA, 22 bp, Artificial Sequence
  chemically synthesized
tttatattattttcttctatca

SEQ ID NO: 1108104 - DNA, 22 bp, Artificial Sequence
  chemically synthesized
ttatattattttcttctatcac

SEQ ID NO: 1108105 - DNA, 22 bp, Artificial Sequence
  chemically synthesized
tatattattttcttctatcact

SEQ ID NO: 1108106 - DNA, 22 bp, Artificial Sequence
  chemically synthesized
ttacctgacataagtgatagaa

SEQ ID NO: 1108107 - DNA, 22 bp, Artificial Sequence
  chemically synthesized
atattattttcttctatcactt

SEQ ID NO: 1108108 - DNA, 22 bp, Artificial Sequence
  chemically synthesized
tattattttcttctatcactta

SEQ ID NO: 1108109 - DNA, 22 bp, Artificial Sequence
  chemically synthesized
ttttcttctatcacttatgtca

SEQ ID NO: 1108110 - DNA, 22 bp, Artificial Sequence
  chemically synthesized
gtagttgttacctgacataagt

SEQ ID NO: 1108111 - DNA, 22 bp, Artificial Sequence
  chemically synthesized
tcttctatcacttatgtcaggt

SEQ ID NO: 1108112 - DNA, 22 bp, Artificial Sequence
  chemically synthesized
cttctatcacttatgtcaggta

SEQ ID NO: 1108113 - DNA, 22 bp, Artificial Sequence
  chemically synthesized
ttctatcacttatgtcaggtaa

SEQ ID NO: 1108114 - DNA, 22 bp, Artificial Sequence
  chemically synthesized
ctatcacttatgtcaggtaaca

SEQ ID NO: 1108115 - DNA, 22 bp, Artificial Sequence
  chemically synthesized
tatcacttatgtcaggtaacaa

SEQ ID NO: 1108116 - DNA, 22 bp, Artificial Sequence
  chemically synthesized
tcacttatgtcaggtaacaact

SEQ ID NO: 1108117 - DNA, 22 bp, Artificial Sequence
  chemically synthesized
atgtcaggtaacaactaccaat

SEQ ID NO: 1108118 - DNA, 22 bp, Artificial Sequence
  chemically synthesized
tgtcaggtaacaactaccaatt

SEQ ID NO: 1108119 - DNA, 22 bp, Artificial Sequence
  chemically synthesized
gaaaatggcataaggaattggt

SEQ ID NO: 1108120 - DNA, 22 bp, Artificial Sequence
  chemically synthesized
tcagtgttggaaaatggcataa

SEQ ID NO: 1108121 - DNA, 22 bp, Artificial Sequence
  chemically synthesized
ccaattccttatgccattttcc

SEQ ID NO: 1108122 - DNA, 22 bp, Artificial Sequence
  chemically synthesized
aaatatactatcagtgttggaa

SEQ ID NO: 1108123 - DNA, 22 bp, Artificial Sequence
  chemically synthesized
cttatgccattttccaacactg

SEQ ID NO: 1108124 - DNA, 22 bp, Artificial Sequence
  chemically synthesized
aaaatatactatcagtgttgga

SEQ ID NO: 1108125 - DNA, 22 bp, Artificial Sequence
  chemically synthesized
taaaatatactatcagtgttgg

SEQ ID NO: 1108126 - DNA, 22 bp, Artificial Sequence
  chemically synthesized
ttaaaatatactatcagtgttg

SEQ ID NO: 1108127 - DNA, 22 bp, Artificial Sequence
  chemically synthesized
atgccattttccaacactgata

SEQ ID NO: 1108128 - DNA, 22 bp, Artificial Sequence
  chemically synthesized
tgccattttccaacactgatag

SEQ ID NO: 1108129 - DNA, 22 bp, Artificial Sequence
  chemically synthesized
gcttttaaaatatactatcagt

SEQ ID NO: 1108130 - DNA, 22 bp, Artificial Sequence
  chemically synthesized
tccaacactgatagtatatttt

SEQ ID NO: 1108131 - DNA, 22 bp, Artificial Sequence
  chemically synthesized
ccaacactgatagtatatttta

SEQ ID NO: 1108132 - DNA, 22 bp, Artificial Sequence
  chemically synthesized
caacactgatagtatattttaa

SEQ ID NO: 1108133 - DNA, 22 bp, Artificial Sequence
  chemically synthesized
acacaaaaacctggcttttaaa

SEQ ID NO: 1108134 - DNA, 22 bp, Artificial Sequence
  chemically synthesized
cacacaaaaacctggcttttaa

SEQ ID NO: 1108135 - DNA, 22 bp, Artificial Sequence
  chemically synthesized
tcacacaaaaacctggctttta

SEQ ID NO: 1108136 - DNA, 22 bp, Artificial Sequence
  chemically synthesized
atagtatattttaaaagccagg

SEQ ID NO: 1108137 - DNA, 22 bp, Artificial Sequence
  chemically synthesized
ttcacacaaaaacctggctttt

SEQ ID NO: 1108138 - DNA, 22 bp, Artificial Sequence
  chemically synthesized
tttcacacaaaaacctggcttt

SEQ ID NO: 1108139 - DNA, 22 bp, Artificial Sequence
  chemically synthesized
ctttttcacacaaaaacctggc

SEQ ID NO: 1108140 - DNA, 22 bp, Artificial Sequence
  chemically synthesized
gctttttcacacaaaaacctgg

SEQ ID NO: 1108141 - DNA, 22 bp, Artificial Sequence
  chemically synthesized
aacttgctttttcacacaaaaa

SEQ ID NO: 1108142 - DNA, 22 bp, Artificial Sequence
  chemically synthesized
taaaagccaggtttttgtgtga

SEQ ID NO: 1108143 - DNA, 22 bp, Artificial Sequence
  chemically synthesized
aaacttgctttttcacacaaaa

SEQ ID NO: 1108144 - DNA, 22 bp, Artificial Sequence
  chemically synthesized
aaaagccaggtttttgtgtgaa

SEQ ID NO: 1108145 - DNA, 22 bp, Artificial Sequence
  chemically synthesized
taaacttgctttttcacacaaa

SEQ ID NO: 1108146 - DNA, 22 bp, Artificial Sequence
  chemically synthesized
aaagccaggtttttgtgtgaaa

SEQ ID NO: 1108147 - DNA, 22 bp, Artificial Sequence
  chemically synthesized
ttaaacttgctttttcacacaa

SEQ ID NO: 1108148 - DNA, 22 bp, Artificial Sequence
  chemically synthesized
tttaaacttgctttttcacaca

SEQ ID NO: 1108149 - DNA, 22 bp, Artificial Sequence
  chemically synthesized
ttttaaacttgctttttcacac

SEQ ID NO: 1108150 - DNA, 22 bp, Artificial Sequence
  chemically synthesized
cttttttaaacttgctttttca

SEQ ID NO: 1108151 - DNA, 22 bp, Artificial Sequence
  chemically synthesized
acttttttaaacttgctttttc

SEQ ID NO: 1108152 - DNA, 22 bp, Artificial Sequence
  chemically synthesized
tacttttttaaacttgcttttt

SEQ ID NO: 1108153 - DNA, 22 bp, Artificial Sequence
  chemically synthesized
tttacttttttaaacttgcttt

SEQ ID NO: 1108154 - DNA, 22 bp, Artificial Sequence
  chemically synthesized
ttgtgtgaaaaagcaagtttaa

SEQ ID NO: 1108155 - DNA, 22 bp, Artificial Sequence
  chemically synthesized
ctctttacttttttaaacttgc

SEQ ID NO: 1108156 - DNA, 22 bp, Artificial Sequence
  chemically synthesized
tgtgtgaaaaagcaagtttaaa

SEQ ID NO: 1108157 - DNA, 22 bp, Artificial Sequence
  chemically synthesized
cctctttacttttttaaacttg

SEQ ID NO: 1108158 - DNA, 22 bp, Artificial Sequence
  chemically synthesized
gtgtgaaaaagcaagtttaaaa

SEQ ID NO: 1108159 - DNA, 22 bp, Artificial Sequence
  chemically synthesized
tgtgaaaaagcaagtttaaaaa

SEQ ID NO: 1108160 - DNA, 22 bp, Artificial Sequence
  chemically synthesized
tttcctctttacttttttaaac

SEQ ID NO: 1108161 - DNA, 22 bp, Artificial Sequence
  chemically synthesized
atttcctctttacttttttaaa

SEQ ID NO: 1108162 - DNA, 22 bp, Artificial Sequence
  chemically synthesized
tatttcctctttacttttttaa

SEQ ID NO: 1108163 - DNA, 22 bp, Artificial Sequence
  chemically synthesized
ttatttcctctttactttttta

SEQ ID NO: 1108164 - DNA, 22 bp, Artificial Sequence
  chemically synthesized
acttttatttcctctttacttt

SEQ ID NO: 1108165 - DNA, 22 bp, Artificial Sequence
  chemically synthesized
aaaaaagtaaagaggaaataaa

SEQ ID NO: 1108166 - DNA, 22 bp, Artificial Sequence
  chemically synthesized
aaaaagtaaagaggaaataaaa

SEQ ID NO: 1108167 - DNA, 22 bp, Artificial Sequence
  chemically synthesized
ggcatccatactgacttttatt

SEQ ID NO: 1108168 - DNA, 22 bp, Artificial Sequence
  chemically synthesized
acagaagtgcctaggcatccat

SEQ ID NO: 1108169 - DNA, 22 bp, Artificial Sequence
  chemically synthesized
agtatgcaggaaataagagcta

SEQ ID NO: 1108170 - DNA, 22 bp, Artificial Sequence
  chemically synthesized
ggcacttctgttagctcttatt

SEQ ID NO: 1108171 - DNA, 22 bp, Artificial Sequence
  chemically synthesized
ctgttagctcttatttcctgca

SEQ ID NO: 1108172 - DNA, 22 bp, Artificial Sequence
  chemically synthesized
tgttagctcttatttcctgcat

SEQ ID NO: 1108173 - DNA, 22 bp, Artificial Sequence
  chemically synthesized
gacgtattaagtatgcaggaaa

SEQ ID NO: 1108174 - DNA, 22 bp, Artificial Sequence
  chemically synthesized
ggacgtattaagtatgcaggaa

SEQ ID NO: 1108175 - DNA, 22 bp, Artificial Sequence
  chemically synthesized
ttagctcttatttcctgcatac

SEQ ID NO: 1108176 - DNA, 22 bp, Artificial Sequence
  chemically synthesized
tggacgtattaagtatgcagga

SEQ ID NO: 1108177 - DNA, 22 bp, Artificial Sequence
  chemically synthesized
gctcttatttcctgcatactta

SEQ ID NO: 1108178 - DNA, 22 bp, Artificial Sequence
  chemically synthesized
ttatttcctgcatacttaatac

SEQ ID NO: 1108179 - DNA, 22 bp, Artificial Sequence
  chemically synthesized
atttcctgcatacttaatacgt

SEQ ID NO: 1108180 - DNA, 22 bp, Artificial Sequence
  chemically synthesized
tttcctgcatacttaatacgtc

SEQ ID NO: 1108181 - DNA, 22 bp, Artificial Sequence
  chemically synthesized
cacagtactttggacgtattaa

SEQ ID NO: 1108182 - DNA, 22 bp, Artificial Sequence
  chemically synthesized
cctgcatacttaatacgtccaa

SEQ ID NO: 1108183 - DNA, 22 bp, Artificial Sequence
  chemically synthesized
ctccacagtactttggacgtat

SEQ ID NO: 1108184 - DNA, 22 bp, Artificial Sequence
  chemically synthesized
ctgcatacttaatacgtccaaa

SEQ ID NO: 1108185 - DNA, 22 bp, Artificial Sequence
  chemically synthesized
catacttaatacgtccaaagta

SEQ ID NO: 1108186 - DNA, 22 bp, Artificial Sequence
  chemically synthesized
tattcctccacagtactttgga

SEQ ID NO: 1108187 - DNA, 22 bp, Artificial Sequence
  chemically synthesized
gtattcctccacagtactttgg

SEQ ID NO: 1108188 - DNA, 22 bp, Artificial Sequence
  chemically synthesized
ttgtattcctccacagtacttt

SEQ ID NO: 1108189 - DNA, 22 bp, Artificial Sequence
  chemically synthesized
cttgtattcctccacagtactt

SEQ ID NO: 1108190 - DNA, 22 bp, Artificial Sequence
  chemically synthesized
aatacgtccaaagtactgtgga

SEQ ID NO: 1108191 - DNA, 22 bp, Artificial Sequence
  chemically synthesized
atacgtccaaagtactgtggag

SEQ ID NO: 1108192 - DNA, 22 bp, Artificial Sequence
  chemically synthesized
atttcttgtattcctccacagt

SEQ ID NO: 1108193 - DNA, 22 bp, Artificial Sequence
  chemically synthesized
tggaggaatacaagaaatgaga

SEQ ID NO: 1108194 - DNA, 22 bp, Artificial Sequence
  chemically synthesized
gcaccagggagtaaatctcatt

SEQ ID NO: 1108195 - DNA, 22 bp, Artificial Sequence
  chemically synthesized
tatccgaactggcaccagggag

SEQ ID NO: 1108196 - DNA, 22 bp, Artificial Sequence
  chemically synthesized
actccctggtgccagttcggat

SEQ ID NO: 1108197 - DNA, 22 bp, Artificial Sequence
  chemically synthesized
ctccctggtgccagttcggata

SEQ ID NO: 1108198 - DNA, 22 bp, Artificial Sequence
  chemically synthesized
cctggtgccagttcggatataa

SEQ ID NO: 1108199 - DNA, 22 bp, Artificial Sequence
  chemically synthesized
cacatgtgtatgcattatatcc

SEQ ID NO: 1108200 - DNA, 22 bp, Artificial Sequence
  chemically synthesized
gtgccagttcggatataatgca

SEQ ID NO: 1108201 - DNA, 22 bp, Artificial Sequence
  chemically synthesized
aaataattgcacatgtgtatgc

SEQ ID NO: 1108202 - DNA, 22 bp, Artificial Sequence
  chemically synthesized
ggatataatgcatacacatgtg

SEQ ID NO: 1108203 - DNA, 22 bp, Artificial Sequence
  chemically synthesized
attcaaataattgcacatgtgt

SEQ ID NO: 1108204 - DNA, 22 bp, Artificial Sequence
  chemically synthesized
aaattaattcaaataattgcac

SEQ ID NO: 1108205 - DNA, 22 bp, Artificial Sequence
  chemically synthesized
gaaattaattcaaataattgca

SEQ ID NO: 1108206 - DNA, 22 bp, Artificial Sequence
  chemically synthesized
atttgaaattaattcaaataat

SEQ ID NO: 1108207 - DNA, 22 bp, Artificial Sequence
  chemically synthesized
ttaatttgaaattaattcaaat

SEQ ID NO: 1108208 - DNA, 22 bp, Artificial Sequence
  chemically synthesized
gttaatttgaaattaattcaaa

SEQ ID NO: 1108209 - DNA, 22 bp, Artificial Sequence
  chemically synthesized
tgttaatttgaaattaattcaa

SEQ ID NO: 1108210 - DNA, 22 bp, Artificial Sequence
  chemically synthesized
attttgttaatttgaaattaat

SEQ ID NO: 1108211 - DNA, 22 bp, Artificial Sequence
  chemically synthesized
tttgaattaatttcaaattaac

SEQ ID NO: 1108212 - DNA, 22 bp, Artificial Sequence
  chemically synthesized
gaattaatttcaaattaacaaa

SEQ ID NO: 1108213 - DNA, 22 bp, Artificial Sequence
  chemically synthesized
aattaatttcaaattaacaaaa

SEQ ID NO: 1108214 - DNA, 22 bp, Artificial Sequence
  chemically synthesized
catagcagttgattttgttaat

SEQ ID NO: 1108215 - DNA, 22 bp, Artificial Sequence
  chemically synthesized
atttcaaattaacaaaatcaac

SEQ ID NO: 1108216 - DNA, 22 bp, Artificial Sequence
  chemically synthesized
caaattaacaaaatcaactgct

SEQ ID NO: 1108217 - DNA, 22 bp, Artificial Sequence
  chemically synthesized
aaattaacaaaatcaactgcta

SEQ ID NO: 1108218 - DNA, 22 bp, Artificial Sequence
  chemically synthesized
acaaaatcaactgctatgtaat

SEQ ID NO: 1108219 - DNA, 22 bp, Artificial Sequence
  chemically synthesized
ctatgtaatttcatatgctaca

SEQ ID NO: 1108220 - DNA, 22 bp, Artificial Sequence
  chemically synthesized
tgtaatttcatatgctacattt

SEQ ID NO: 1108221 - DNA, 22 bp, Artificial Sequence
  chemically synthesized
catatgctacatttttcattcc

SEQ ID NO: 1108222 - DNA, 22 bp, Artificial Sequence
  chemically synthesized
atatgctacatttttcattcca

SEQ ID NO: 1108223 - DNA, 22 bp, Artificial Sequence
  chemically synthesized
catttttcattccatatatata

SEQ ID NO: 1108224 - DNA, 22 bp, Artificial Sequence
  chemically synthesized
ttcattccatatatatatatat

SEQ ID NO: 1108225 - DNA, 22 bp, Artificial Sequence
  chemically synthesized
tcattccatatatatatatata

SEQ ID NO: 1108226 - DNA, 22 bp, Artificial Sequence
  chemically synthesized
cattccatatatatatatatat

SEQ ID NO: 1108227 - DNA, 22 bp, Artificial Sequence
  chemically synthesized
aatatggtgtatatatatatat

SEQ ID NO: 1108228 - DNA, 22 bp, Artificial Sequence
  chemically synthesized
attccatatatatatatatata

SEQ ID NO: 1108229 - DNA, 22 bp, Artificial Sequence
  chemically synthesized
attaaatatggtgtatatatat

SEQ ID NO: 1108230 - DNA, 22 bp, Artificial Sequence
  chemically synthesized
catatatatatatatatataca

SEQ ID NO: 1108231 - DNA, 22 bp, Artificial Sequence
  chemically synthesized
aattaaatatggtgtatatata

SEQ ID NO: 1108232 - DNA, 22 bp, Artificial Sequence
  chemically synthesized
taattaaatatggtgtatatat

SEQ ID NO: 1108233 - DNA, 22 bp, Artificial Sequence
  chemically synthesized
ataaataaccctttaattaaat

SEQ ID NO: 1108234 - DNA, 22 bp, Artificial Sequence
  chemically synthesized
gattaataaataaccctttaat

SEQ ID NO: 1108235 - DNA, 22 bp, Artificial Sequence
  chemically synthesized
tctagattaataaataaccctt

SEQ ID NO: 1108236 - DNA, 22 bp, Artificial Sequence
  chemically synthesized
gtctagattaataaataaccct

SEQ ID NO: 1108237 - DNA, 22 bp, Artificial Sequence
  chemically synthesized
aattaaagggttatttattaat

SEQ ID NO: 1108238 - DNA, 22 bp, Artificial Sequence
  chemically synthesized
attaaagggttatttattaatc

SEQ ID NO: 1108239 - DNA, 22 bp, Artificial Sequence
  chemically synthesized
gaatgcttgtctagattaataa

SEQ ID NO: 1108240 - DNA, 22 bp, Artificial Sequence
  chemically synthesized
ggaatgcttgtctagattaata

SEQ ID NO: 1108241 - DNA, 22 bp, Artificial Sequence
  chemically synthesized
tggaatgcttgtctagattaat

SEQ ID NO: 1108242 - DNA, 22 bp, Artificial Sequence
  chemically synthesized
aagggttatttattaatctaga

SEQ ID NO: 1108243 - DNA, 22 bp, Artificial Sequence
  chemically synthesized
ttggaatgcttgtctagattaa

SEQ ID NO: 1108244 - DNA, 22 bp, Artificial Sequence
  chemically synthesized
acccttttggaatgcttgtcta

SEQ ID NO: 1108245 - DNA, 22 bp, Artificial Sequence
  chemically synthesized
tttattaatctagacaagcatt

SEQ ID NO: 1108246 - DNA, 22 bp, Artificial Sequence
  chemically synthesized
ttcacccttttggaatgcttgt

SEQ ID NO: 1108247 - DNA, 22 bp, Artificial Sequence
  chemically synthesized
attaatctagacaagcattcca

SEQ ID NO: 1108248 - DNA, 22 bp, Artificial Sequence
  chemically synthesized
ttaatctagacaagcattccaa

SEQ ID NO: 1108249 - DNA, 22 bp, Artificial Sequence
  chemically synthesized
ctattcacccttttggaatgct

SEQ ID NO: 1108250 - DNA, 22 bp, Artificial Sequence
  chemically synthesized
actattcacccttttggaatgc

SEQ ID NO: 1108251 - DNA, 22 bp, Artificial Sequence
  chemically synthesized
tactattcacccttttggaatg

SEQ ID NO: 1108252 - DNA, 22 bp, Artificial Sequence
  chemically synthesized
atctagacaagcattccaaaag

SEQ ID NO: 1108253 - DNA, 22 bp, Artificial Sequence
  chemically synthesized
attttactattcacccttttgg

SEQ ID NO: 1108254 - DNA, 22 bp, Artificial Sequence
  chemically synthesized
aattttactattcacccttttg

SEQ ID NO: 1108255 - DNA, 22 bp, Artificial Sequence
  chemically synthesized
gacaagcattccaaaagggtga

SEQ ID NO: 1108256 - DNA, 22 bp, Artificial Sequence
  chemically synthesized
taattttactattcaccctttt

SEQ ID NO: 1108257 - DNA, 22 bp, Artificial Sequence
  chemically synthesized
cacatctttaattttactattc

SEQ ID NO: 1108258 - DNA, 22 bp, Artificial Sequence
  chemically synthesized
caaaagggtgaatagtaaaatt

SEQ ID NO: 1108259 - DNA, 22 bp, Artificial Sequence
  chemically synthesized
tagctacacatctttaatttta

SEQ ID NO: 1108260 - DNA, 22 bp, Artificial Sequence
  chemically synthesized
cactgtagctacacatctttaa

SEQ ID NO: 1108261 - DNA, 22 bp, Artificial Sequence
  chemically synthesized
ccactgtagctacacatcttta

SEQ ID NO: 1108262 - DNA, 22 bp, Artificial Sequence
  chemically synthesized
tccccacttccactgtagctac

SEQ ID NO: 1108263 - DNA, 22 bp, Artificial Sequence
  chemically synthesized
aagatgtgtagctacagtggaa

SEQ ID NO: 1108264 - DNA, 22 bp, Artificial Sequence
  chemically synthesized
tatgtaaacaaattgtccccac

SEQ ID NO: 1108265 - DNA, 22 bp, Artificial Sequence
  chemically synthesized
ttatatgtaaacaaattgtccc

SEQ ID NO: 1108266 - DNA, 22 bp, Artificial Sequence
  chemically synthesized
cagtggaagtggggacaatttg

SEQ ID NO: 1108267 - DNA, 22 bp, Artificial Sequence
  chemically synthesized
ctattatatgtaaacaaattgt

SEQ ID NO: 1108268 - DNA, 22 bp, Artificial Sequence
  chemically synthesized
actgctattatatgtaaacaaa

SEQ ID NO: 1108269 - DNA, 22 bp, Artificial Sequence
  chemically synthesized
cactgctattatatgtaaacaa

SEQ ID NO: 1108270 - DNA, 22 bp, Artificial Sequence
  chemically synthesized
tcactgctattatatgtaaaca

SEQ ID NO: 1108271 - DNA, 22 bp, Artificial Sequence
  chemically synthesized
ttcactgctattatatgtaaac

SEQ ID NO: 1108272 - DNA, 22 bp, Artificial Sequence
  chemically synthesized
tttcactgctattatatgtaaa

SEQ ID NO: 1108273 - DNA, 22 bp, Artificial Sequence
  chemically synthesized
actttttcactgctattatatg

SEQ ID NO: 1108274 - DNA, 22 bp, Artificial Sequence
  chemically synthesized
ctaactttttcactgctattat

SEQ ID NO: 1108275 - DNA, 22 bp, Artificial Sequence
  chemically synthesized
cctaactttttcactgctatta

SEQ ID NO: 1108276 - DNA, 22 bp, Artificial Sequence
  chemically synthesized
gtttacatataatagcagtgaa

SEQ ID NO: 1108277 - DNA, 22 bp, Artificial Sequence
  chemically synthesized
tttacatataatagcagtgaaa

SEQ ID NO: 1108278 - DNA, 22 bp, Artificial Sequence
  chemically synthesized
acatataatagcagtgaaaaag

SEQ ID NO: 1108279 - DNA, 22 bp, Artificial Sequence
  chemically synthesized
catataatagcagtgaaaaagt

SEQ ID NO: 1108280 - DNA, 22 bp, Artificial Sequence
  chemically synthesized
taaaacttcctaactttttcac

SEQ ID NO: 1108281 - DNA, 22 bp, Artificial Sequence
  chemically synthesized
ataaaacttcctaactttttca

SEQ ID NO: 1108282 - DNA, 22 bp, Artificial Sequence
  chemically synthesized
tttataaaacttcctaactttt

SEQ ID NO: 1108283 - DNA, 22 bp, Artificial Sequence
  chemically synthesized
caaacgatgattgtttataaaa

SEQ ID NO: 1108284 - DNA, 22 bp, Artificial Sequence
  chemically synthesized
ggaagttttataaacaatcatc

SEQ ID NO: 1108285 - DNA, 22 bp, Artificial Sequence
  chemically synthesized
atacctacaaacgatgattgtt

SEQ ID NO: 1108286 - DNA, 22 bp, Artificial Sequence
  chemically synthesized
catacctacaaacgatgattgt

SEQ ID NO: 1108287 - DNA, 22 bp, Artificial Sequence
  chemically synthesized
aatttcatacctacaaacgatg

SEQ ID NO: 1108288 - DNA, 22 bp, Artificial Sequence
  chemically synthesized
aaatttcatacctacaaacgat

SEQ ID NO: 1108289 - DNA, 22 bp, Artificial Sequence
  chemically synthesized
tataaacaatcatcgtttgtag

SEQ ID NO: 1108290 - DNA, 22 bp, Artificial Sequence
  chemically synthesized
taaatttcatacctacaaacga

SEQ ID NO: 1108291 - DNA, 22 bp, Artificial Sequence
  chemically synthesized
ataaacaatcatcgtttgtagg

SEQ ID NO: 1108292 - DNA, 22 bp, Artificial Sequence
  chemically synthesized
ttaaatttcatacctacaaacg

SEQ ID NO: 1108293 - DNA, 22 bp, Artificial Sequence
  chemically synthesized
taaacaatcatcgtttgtaggt

SEQ ID NO: 1108294 - DNA, 22 bp, Artificial Sequence
  chemically synthesized
tttaaatttcatacctacaaac

SEQ ID NO: 1108295 - DNA, 22 bp, Artificial Sequence
  chemically synthesized
ttttaaatttcatacctacaaa

SEQ ID NO: 1108296 - DNA, 22 bp, Artificial Sequence
  chemically synthesized
ttttttaaatttcatacctaca

SEQ ID NO: 1108297 - DNA, 22 bp, Artificial Sequence
  chemically synthesized
tcttttttaaatttcataccta

SEQ ID NO: 1108298 - DNA, 22 bp, Artificial Sequence
  chemically synthesized
ctcttttttaaatttcatacct

SEQ ID NO: 1108299 - DNA, 22 bp, Artificial Sequence
  chemically synthesized
ttctcttttttaaatttcatac

SEQ ID NO: 1108300 - DNA, 22 bp, Artificial Sequence
  chemically synthesized
cttctcttttttaaatttcata

SEQ ID NO: 1108301 - DNA, 22 bp, Artificial Sequence
  chemically synthesized
tcttctcttttttaaatttcat

SEQ ID NO: 1108302 - DNA, 22 bp, Artificial Sequence
  chemically synthesized
gtaggtatgaaatttaaaaaag

SEQ ID NO: 1108303 - DNA, 22 bp, Artificial Sequence
  chemically synthesized
taggtatgaaatttaaaaaaga

SEQ ID NO: 1108304 - DNA, 22 bp, Artificial Sequence
  chemically synthesized
tcatctttcttctcttttttaa

SEQ ID NO: 1108305 - DNA, 22 bp, Artificial Sequence
  chemically synthesized
aaaaaagagaagaaagatgata

SEQ ID NO: 1108306 - DNA, 22 bp, Artificial Sequence
  chemically synthesized
aaaaagagaagaaagatgatag

SEQ ID NO: 1108307 - DNA, 22 bp, Artificial Sequence
  chemically synthesized
catccatccatccatccctatc

SEQ ID NO: 1108308 - DNA, 22 bp, Artificial Sequence
  chemically synthesized
tccatccatccatccatcccta

SEQ ID NO: 1108309 - DNA, 22 bp, Artificial Sequence
  chemically synthesized
atacagctctccatccatccat

SEQ ID NO: 1108310 - DNA, 22 bp, Artificial Sequence
  chemically synthesized
ttcatacagctctccatccatc

SEQ ID NO: 1108311 - DNA, 22 bp, Artificial Sequence
  chemically synthesized
tattcatacagctctccatcca

SEQ ID NO: 1108312 - DNA, 22 bp, Artificial Sequence
  chemically synthesized
tatgaatagagactatatatta

SEQ ID NO: 1108313 - DNA, 22 bp, Artificial Sequence
  chemically synthesized
caatataaatacgtaataatat

SEQ ID NO: 1108314 - DNA, 22 bp, Artificial Sequence
  chemically synthesized
tgatgttacaatataaatacgt

SEQ ID NO: 1108315 - DNA, 22 bp, Artificial Sequence
  chemically synthesized
tatattattacgtatttatatt

SEQ ID NO: 1108316 - DNA, 22 bp, Artificial Sequence
  chemically synthesized
tctatgatgttacaatataaat

SEQ ID NO: 1108317 - DNA, 22 bp, Artificial Sequence
  chemically synthesized
gtctatgatgttacaatataaa

SEQ ID NO: 1108318 - DNA, 22 bp, Artificial Sequence
  chemically synthesized
ttacgtatttatattgtaacat

SEQ ID NO: 1108319 - DNA, 22 bp, Artificial Sequence
  chemically synthesized
agatttgtctatgatgttacaa

SEQ ID NO: 1108320 - DNA, 22 bp, Artificial Sequence
  chemically synthesized
cgtatttatattgtaacatcat

SEQ ID NO: 1108321 - DNA, 22 bp, Artificial Sequence
  chemically synthesized
ataactgagatttgtctatgat

SEQ ID NO: 1108322 - DNA, 22 bp, Artificial Sequence
  chemically synthesized
gataactgagatttgtctatga

SEQ ID NO: 1108323 - DNA, 22 bp, Artificial Sequence
  chemically synthesized
atattgtaacatcatagacaaa

SEQ ID NO: 1108324 - DNA, 22 bp, Artificial Sequence
  chemically synthesized
tattgtaacatcatagacaaat

SEQ ID NO: 1108325 - DNA, 22 bp, Artificial Sequence
  chemically synthesized
taacatcatagacaaatctcag

SEQ ID NO: 1108326 - DNA, 22 bp, Artificial Sequence
  chemically synthesized
agaatagcaatgtttgataact

SEQ ID NO: 1108327 - DNA, 22 bp, Artificial Sequence
  chemically synthesized
aagatgttcagaatagcaatgt

SEQ ID NO: 1108328 - DNA, 22 bp, Artificial Sequence
  chemically synthesized
aaagatgttcagaatagcaatg

SEQ ID NO: 1108329 - DNA, 22 bp, Artificial Sequence
  chemically synthesized
taaagatgttcagaatagcaat

SEQ ID NO: 1108330 - DNA, 22 bp, Artificial Sequence
  chemically synthesized
agttatcaaacattgctattct

SEQ ID NO: 1108331 - DNA, 22 bp, Artificial Sequence
  chemically synthesized
ctttaaagatgttcagaatagc

SEQ ID NO: 1108332 - DNA, 22 bp, Artificial Sequence
  chemically synthesized
actttaaagatgttcagaatag

SEQ ID NO: 1108333 - DNA, 22 bp, Artificial Sequence
  chemically synthesized
tcaaacattgctattctgaaca

SEQ ID NO: 1108334 - DNA, 22 bp, Artificial Sequence
  chemically synthesized
tcatttactttaaagatgttca

SEQ ID NO: 1108335 - DNA, 22 bp, Artificial Sequence
  chemically synthesized
atcatttactttaaagatgttc

SEQ ID NO: 1108336 - DNA, 22 bp, Artificial Sequence
  chemically synthesized
tatcatttactttaaagatgtt

SEQ ID NO: 1108337 - DNA, 22 bp, Artificial Sequence
  chemically synthesized
ttatcatttactttaaagatgt

SEQ ID NO: 1108338 - DNA, 22 bp, Artificial Sequence
  chemically synthesized
tttatcatttactttaaagatg

SEQ ID NO: 1108339 - DNA, 22 bp, Artificial Sequence
  chemically synthesized
ctattctgaacatctttaaagt

SEQ ID NO: 1108340 - DNA, 22 bp, Artificial Sequence
  chemically synthesized
ttctgaacatctttaaagtaaa

SEQ ID NO: 1108341 - DNA, 22 bp, Artificial Sequence
  chemically synthesized
aactttttatcatttactttaa

SEQ ID NO: 1108342 - DNA, 22 bp, Artificial Sequence
  chemically synthesized
tgaacatctttaaagtaaatga

SEQ ID NO: 1108343 - DNA, 22 bp, Artificial Sequence
  chemically synthesized
aacatctttaaagtaaatgata

SEQ ID NO: 1108344 - DNA, 22 bp, Artificial Sequence
  chemically synthesized
aagttcaactttttatcattta

SEQ ID NO: 1108345 - DNA, 22 bp, Artificial Sequence
  chemically synthesized
taaagtaaatgataaaaagttg

SEQ ID NO: 1108346 - DNA, 22 bp, Artificial Sequence
  chemically synthesized
aaagtaaatgataaaaagttga

SEQ ID NO: 1108347 - DNA, 22 bp, Artificial Sequence
  chemically synthesized
aagtaaatgataaaaagttgaa

SEQ ID NO: 1108348 - DNA, 22 bp, Artificial Sequence
  chemically synthesized
atcatattaaagttcaactttt

SEQ ID NO: 1108349 - DNA, 22 bp, Artificial Sequence
  chemically synthesized
aatcatattaaagttcaacttt

SEQ ID NO: 1108350 - DNA, 22 bp, Artificial Sequence
  chemically synthesized
ttaatcatattaaagttcaact

SEQ ID NO: 1108351 - DNA, 22 bp, Artificial Sequence
  chemically synthesized
tatatacctcttaatcatatta

SEQ ID NO: 1108352 - DNA, 22 bp, Artificial Sequence
  chemically synthesized
atctgtatatacctcttaatca

SEQ ID NO: 1108353 - DNA, 22 bp, Artificial Sequence
  chemically synthesized
aatctgtatatacctcttaatc

SEQ ID NO: 1108354 - DNA, 22 bp, Artificial Sequence
  chemically synthesized
aactttaatatgattaagaggt

SEQ ID NO: 1108355 - DNA, 22 bp, Artificial Sequence
  chemically synthesized
taatctgtatatacctcttaat

SEQ ID NO: 1108356 - DNA, 22 bp, Artificial Sequence
  chemically synthesized
ctttaatctgtatatacctctt

SEQ ID NO: 1108357 - DNA, 22 bp, Artificial Sequence
  chemically synthesized
actttaatctgtatatacctct

SEQ ID NO: 1108358 - DNA, 22 bp, Artificial Sequence
  chemically synthesized
taatatgattaagaggtatata

SEQ ID NO: 1108359 - DNA, 22 bp, Artificial Sequence
  chemically synthesized
aatatgattaagaggtatatac

SEQ ID NO: 1108360 - DNA, 22 bp, Artificial Sequence
  chemically synthesized
atatgattaagaggtatataca

SEQ ID NO: 1108361 - DNA, 22 bp, Artificial Sequence
  chemically synthesized
gaaatttactttaatctgtata

SEQ ID NO: 1108362 - DNA, 22 bp, Artificial Sequence
  chemically synthesized
actggaaatttactttaatctg

SEQ ID NO: 1108363 - DNA, 22 bp, Artificial Sequence
  chemically synthesized
agaggtatatacagattaaagt

SEQ ID NO: 1108364 - DNA, 22 bp, Artificial Sequence
  chemically synthesized
cactggaaatttactttaatct

SEQ ID NO: 1108365 - DNA, 22 bp, Artificial Sequence
  chemically synthesized
tgcaaaggagccatttcactgg

SEQ ID NO: 1108366 - DNA, 22 bp, Artificial Sequence
  chemically synthesized
aagtaaatttccagtgaaatgg

SEQ ID NO: 1108367 - DNA, 22 bp, Artificial Sequence
  chemically synthesized
ttgtgcaaaggagccatttcac

SEQ ID NO: 1108368 - DNA, 22 bp, Artificial Sequence
  chemically synthesized
ccagtgaaatggctcctttgca

SEQ ID NO: 1108369 - DNA, 22 bp, Artificial Sequence
  chemically synthesized
cagtgaaatggctcctttgcac

SEQ ID NO: 1108370 - DNA, 22 bp, Artificial Sequence
  chemically synthesized
tgcagcaattgttgtgcaaagg

SEQ ID NO: 1108371 - DNA, 22 bp, Artificial Sequence
  chemically synthesized
gtggctatgcagcaattgttgt

SEQ ID NO: 1108372 - DNA, 22 bp, Artificial Sequence
  chemically synthesized
agtggctatgcagcaattgttg

SEQ ID NO: 1108373 - DNA, 22 bp, Artificial Sequence
  chemically synthesized
ctttgcacaacaattgctgcat

SEQ ID NO: 1108374 - DNA, 22 bp, Artificial Sequence
  chemically synthesized
tgcacaacaattgctgcatagc

SEQ ID NO: 1108375 - DNA, 22 bp, Artificial Sequence
  chemically synthesized
gcacaacaattgctgcatagcc

SEQ ID NO: 1108376 - DNA, 22 bp, Artificial Sequence
  chemically synthesized
aatacatttagtggctatgcag

SEQ ID NO: 1108377 - DNA, 22 bp, Artificial Sequence
  chemically synthesized
cacaacaattgctgcatagcca

SEQ ID NO: 1108378 - DNA, 22 bp, Artificial Sequence
  chemically synthesized
aagttaaatacatttagtggct

SEQ ID NO: 1108379 - DNA, 22 bp, Artificial Sequence
  chemically synthesized
aaagttaaatacatttagtggc

SEQ ID NO: 1108380 - DNA, 22 bp, Artificial Sequence
  chemically synthesized
ctgcatagccactaaatgtatt

SEQ ID NO: 1108381 - DNA, 22 bp, Artificial Sequence
  chemically synthesized
ccccttaaagttaaatacattt

SEQ ID NO: 1108382 - DNA, 22 bp, Artificial Sequence
  chemically synthesized
catagccactaaatgtatttaa

SEQ ID NO: 1108383 - DNA, 22 bp, Artificial Sequence
  chemically synthesized
catacataactcccccttaaag

SEQ ID NO: 1108384 - DNA, 22 bp, Artificial Sequence
  chemically synthesized
aatgtatttaactttaaggggg

SEQ ID NO: 1108385 - DNA, 22 bp, Artificial Sequence
  chemically synthesized
tcattacatacataactccccc

SEQ ID NO: 1108386 - DNA, 22 bp, Artificial Sequence
  chemically synthesized
gtcattacatacataactcccc

SEQ ID NO: 1108387 - DNA, 22 bp, Artificial Sequence
  chemically synthesized
aactttaagggggagttatgta

SEQ ID NO: 1108388 - DNA, 22 bp, Artificial Sequence
  chemically synthesized
actttaagggggagttatgtat

SEQ ID NO: 1108389 - DNA, 22 bp, Artificial Sequence
  chemically synthesized
acttgtcattacatacataact

SEQ ID NO: 1108390 - DNA, 22 bp, Artificial Sequence
  chemically synthesized
cacttgtcattacatacataac

SEQ ID NO: 1108391 - DNA, 22 bp, Artificial Sequence
  chemically synthesized
tcacttgtcattacatacataa

SEQ ID NO: 1108392 - DNA, 22 bp, Artificial Sequence
  chemically synthesized
taagggggagttatgtatgtaa

SEQ ID NO: 1108393 - DNA, 22 bp, Artificial Sequence
  chemically synthesized
aagggggagttatgtatgtaat

SEQ ID NO: 1108394 - DNA, 22 bp, Artificial Sequence
  chemically synthesized
agggggagttatgtatgtaatg

SEQ ID NO: 1108395 - DNA, 22 bp, Artificial Sequence
  chemically synthesized
acaataatgtattttcacttgt

SEQ ID NO: 1108396 - DNA, 22 bp, Artificial Sequence
  chemically synthesized
tgtatgtaatgacaagtgaaaa

SEQ ID NO: 1108397 - DNA, 22 bp, Artificial Sequence
  chemically synthesized
aacaataatgtattttcacttg

SEQ ID NO: 1108398 - DNA, 22 bp, Artificial Sequence
  chemically synthesized
acatatttaacaataatgtatt

SEQ ID NO: 1108399 - DNA, 22 bp, Artificial Sequence
  chemically synthesized
aaatattgacatatttaacaat

SEQ ID NO: 1108400 - DNA, 22 bp, Artificial Sequence
  chemically synthesized
caaatattgacatatttaacaa

SEQ ID NO: 1108401 - DNA, 22 bp, Artificial Sequence
  chemically synthesized
tcaaatattgacatatttaaca

SEQ ID NO: 1108402 - DNA, 22 bp, Artificial Sequence
  chemically synthesized
gattttcaaatattgacatatt

SEQ ID NO: 1108403 - DNA, 22 bp, Artificial Sequence
  chemically synthesized
ttgttaaatatgtcaatatttg

SEQ ID NO: 1108404 - DNA, 22 bp, Artificial Sequence
  chemically synthesized
ttaaatatgtcaatatttgaaa

SEQ ID NO: 1108405 - DNA, 22 bp, Artificial Sequence
  chemically synthesized
aatgtcctagattttcaaatat

SEQ ID NO: 1108406 - DNA, 22 bp, Artificial Sequence
  chemically synthesized
aaatgtcctagattttcaaata

SEQ ID NO: 1108407 - DNA, 22 bp, Artificial Sequence
  chemically synthesized
taaatgtcctagattttcaaat

SEQ ID NO: 1108408 - DNA, 22 bp, Artificial Sequence
  chemically synthesized
aatatgtcaatatttgaaaatc

SEQ ID NO: 1108409 - DNA, 22 bp, Artificial Sequence
  chemically synthesized
ggaaaatattttaaatgtccta

SEQ ID NO: 1108410 - DNA, 22 bp, Artificial Sequence
  chemically synthesized
gggaaaatattttaaatgtcct

SEQ ID NO: 1108411 - DNA, 22 bp, Artificial Sequence
  chemically synthesized
gaaaatctaggacatttaaaat

SEQ ID NO: 1108412 - DNA, 22 bp, Artificial Sequence
  chemically synthesized
aaaatctaggacatttaaaata

SEQ ID NO: 1108413 - DNA, 22 bp, Artificial Sequence
  chemically synthesized
caaaatcaatttgggaaaatat

SEQ ID NO: 1108414 - DNA, 22 bp, Artificial Sequence
  chemically synthesized
ggacatttaaaatattttccca

SEQ ID NO: 1108415 - DNA, 22 bp, Artificial Sequence
  chemically synthesized
tgcaaaatcaatttgggaaaat

SEQ ID NO: 1108416 - DNA, 22 bp, Artificial Sequence
  chemically synthesized
tgcctctgcaaaatcaatttgg

SEQ ID NO: 1108417 - DNA, 22 bp, Artificial Sequence
  chemically synthesized
aaaatattttcccaaattgatt

SEQ ID NO: 1108418 - DNA, 22 bp, Artificial Sequence
  chemically synthesized
aaatattttcccaaattgattt

SEQ ID NO: 1108419 - DNA, 22 bp, Artificial Sequence
  chemically synthesized
ctgtgcctctgcaaaatcaatt

SEQ ID NO: 1108420 - DNA, 22 bp, Artificial Sequence
  chemically synthesized
ttactgtgcctctgcaaaatca

SEQ ID NO: 1108421 - DNA, 22 bp, Artificial Sequence
  chemically synthesized
gttactgtgcctctgcaaaatc

SEQ ID NO: 1108422 - DNA, 22 bp, Artificial Sequence
  chemically synthesized
tcccaaattgattttgcagagg

SEQ ID NO: 1108423 - DNA, 22 bp, Artificial Sequence
  chemically synthesized
cccaaattgattttgcagaggc

SEQ ID NO: 1108424 - DNA, 22 bp, Artificial Sequence
  chemically synthesized
ccaaattgattttgcagaggca

SEQ ID NO: 1108425 - DNA, 22 bp, Artificial Sequence
  chemically synthesized
agtatacttgttactgtgcctc

SEQ ID NO: 1108426 - DNA, 22 bp, Artificial Sequence
  chemically synthesized
cagtatacttgttactgtgcct

SEQ ID NO: 1108427 - DNA, 22 bp, Artificial Sequence
  chemically synthesized
attttgcagaggcacagtaaca

SEQ ID NO: 1108428 - DNA, 22 bp, Artificial Sequence
  chemically synthesized
tgcagaggcacagtaacaagta

SEQ ID NO: 1108429 - DNA, 22 bp, Artificial Sequence
  chemically synthesized
gcagaggcacagtaacaagtat

SEQ ID NO: 1108430 - DNA, 22 bp, Artificial Sequence
  chemically synthesized
gtggatttcagtatacttgtta

SEQ ID NO: 1108431 - DNA, 22 bp, Artificial Sequence
  chemically synthesized
cagaggcacagtaacaagtata

SEQ ID NO: 1108432 - DNA, 22 bp, Artificial Sequence
  chemically synthesized
tagtggatttcagtatacttgt

SEQ ID NO: 1108433 - DNA, 22 bp, Artificial Sequence
  chemically synthesized
cctctagtggatttcagtatac

SEQ ID NO: 1108434 - DNA, 22 bp, Artificial Sequence
  chemically synthesized
taaatagtatcagctccctcta

SEQ ID NO: 1108435 - DNA, 22 bp, Artificial Sequence
  chemically synthesized
ataaatagtatcagctccctct

SEQ ID NO: 1108436 - DNA, 22 bp, Artificial Sequence
  chemically synthesized
tataaatagtatcagctccctc

SEQ ID NO: 1108437 - DNA, 22 bp, Artificial Sequence
  chemically synthesized
aaatccactagagggagctgat

SEQ ID NO: 1108438 - DNA, 22 bp, Artificial Sequence
  chemically synthesized
gagggagctgatactatttata

SEQ ID NO: 1108439 - DNA, 22 bp, Artificial Sequence
  chemically synthesized
tacaggtagtaaaactttataa

SEQ ID NO: 1108440 - DNA, 22 bp, Artificial Sequence
  chemically synthesized
ctgtacaggtagtaaaacttta

SEQ ID NO: 1108441 - DNA, 22 bp, Artificial Sequence
  chemically synthesized
cctgtacaggtagtaaaacttt

SEQ ID NO: 1108442 - DNA, 22 bp, Artificial Sequence
  chemically synthesized
atactatttataaagttttact

SEQ ID NO: 1108443 - DNA, 22 bp, Artificial Sequence
  chemically synthesized
tcctgtacaggtagtaaaactt

SEQ ID NO: 1108444 - DNA, 22 bp, Artificial Sequence
  chemically synthesized
ttttcctgtacaggtagtaaaa

SEQ ID NO: 1108445 - DNA, 22 bp, Artificial Sequence
  chemically synthesized
attttcctgtacaggtagtaaa

SEQ ID NO: 1108446 - DNA, 22 bp, Artificial Sequence
  chemically synthesized
tttataaagttttactacctgt

SEQ ID NO: 1108447 - DNA, 22 bp, Artificial Sequence
  chemically synthesized
ataaagttttactacctgtaca

SEQ ID NO: 1108448 - DNA, 22 bp, Artificial Sequence
  chemically synthesized
taaagttttactacctgtacag

SEQ ID NO: 1108449 - DNA, 22 bp, Artificial Sequence
  chemically synthesized
aggggtttattttcctgtacag

SEQ ID NO: 1108450 - DNA, 22 bp, Artificial Sequence
  chemically synthesized
ctaaggggtttattttcctgta

SEQ ID NO: 1108451 - DNA, 22 bp, Artificial Sequence
  chemically synthesized
gctaaggggtttattttcctgt

SEQ ID NO: 1108452 - DNA, 22 bp, Artificial Sequence
  chemically synthesized
tgctaaggggtttattttcctg

SEQ ID NO: 1108453 - DNA, 22 bp, Artificial Sequence
  chemically synthesized
tactacctgtacaggaaaataa

SEQ ID NO: 1108454 - DNA, 22 bp, Artificial Sequence
  chemically synthesized
ttgctaaggggtttattttcct

SEQ ID NO: 1108455 - DNA, 22 bp, Artificial Sequence
  chemically synthesized
actacctgtacaggaaaataaa

SEQ ID NO: 1108456 - DNA, 22 bp, Artificial Sequence
  chemically synthesized
ctacctgtacaggaaaataaac

SEQ ID NO: 1108457 - DNA, 22 bp, Artificial Sequence
  chemically synthesized
cctgtacaggaaaataaacccc

SEQ ID NO: 1108458 - DNA, 22 bp, Artificial Sequence
  chemically synthesized
tacaggaaaataaaccccttag

SEQ ID NO: 1108459 - DNA, 22 bp, Artificial Sequence
  chemically synthesized
agagtcgtttttgctaaggggt

SEQ ID NO: 1108460 - DNA, 22 bp, Artificial Sequence
  chemically synthesized
cagagtcgtttttgctaagggg

SEQ ID NO: 1108461 - DNA, 22 bp, Artificial Sequence
  chemically synthesized
tacttcagagtcgtttttgcta

SEQ ID NO: 1108462 - DNA, 22 bp, Artificial Sequence
  chemically synthesized
gtacttcagagtcgtttttgct

SEQ ID NO: 1108463 - DNA, 22 bp, Artificial Sequence
  chemically synthesized
tgtacttcagagtcgtttttgc

SEQ ID NO: 1108464 - DNA, 22 bp, Artificial Sequence
  chemically synthesized
ttgtacttcagagtcgtttttg

SEQ ID NO: 1108465 - DNA, 22 bp, Artificial Sequence
  chemically synthesized
tttgtacttcagagtcgttttt

SEQ ID NO: 1108466 - DNA, 22 bp, Artificial Sequence
  chemically synthesized
ttttgtacttcagagtcgtttt

SEQ ID NO: 1108467 - DNA, 22 bp, Artificial Sequence
  chemically synthesized
tttttgtacttcagagtcgttt

SEQ ID NO: 1108468 - DNA, 22 bp, Artificial Sequence
  chemically synthesized
ttttttgtacttcagagtcgtt

SEQ ID NO: 1108469 - DNA, 22 bp, Artificial Sequence
  chemically synthesized
tttttttgtacttcagagtcgt

SEQ ID NO: 1108470 - DNA, 22 bp, Artificial Sequence
  chemically synthesized
ttttttttgtacttcagagtcg

SEQ ID NO: 1108471 - DNA, 22 bp, Artificial Sequence
  chemically synthesized
tttttttttgtacttcagagtc

SEQ ID NO: 1108472 - DNA, 22 bp, Artificial Sequence
  chemically synthesized
ttttttttttgtacttcagagt

SEQ ID NO: 1108473 - DNA, 22 bp, Artificial Sequence
  chemically synthesized
tttttttttttgtacttcagag

SEQ ID NO: 1108474 - DNA, 22 bp, Artificial Sequence
  chemically synthesized
agcaaaaacgactctgaagtac

SEQ ID NO: 1108475 - DNA, 22 bp, Artificial Sequence
  chemically synthesized
ttttttttttttgtacttcaga

SEQ ID NO: 1108476 - DNA, 22 bp, Artificial Sequence
  chemically synthesized
gcaaaaacgactctgaagtaca

SEQ ID NO: 1108477 - DNA, 22 bp, Artificial Sequence
  chemically synthesized
tttttttttttttgtacttcag

SEQ ID NO: 1108478 - DNA, 22 bp, Artificial Sequence
  chemically synthesized
ttttttttttttttgtacttca

SEQ ID NO: 1108479 - DNA, 22 bp, Artificial Sequence
  chemically synthesized
tttttttttttttttgtacttc

SEQ ID NO: 1108480 - DNA, 22 bp, Artificial Sequence
  chemically synthesized
ttttttttttttttttgtactt

SEQ ID NO: 1108481 - DNA, 22 bp, Artificial Sequence
  chemically synthesized
tttttttttttttttttgtact

SEQ ID NO: 1108482 - DNA, 22 bp, Artificial Sequence
  chemically synthesized
ttttttttttttttttttgtac

SEQ ID NO: 1108483 - DNA, 22 bp, Artificial Sequence
  chemically synthesized
tttttttttttttttttttgta

SEQ ID NO: 1108484 - DNA, 22 bp, Artificial Sequence
  chemically synthesized
ttttttttttttttttttttgt

SEQ ID NO: 1108485 - DNA, 22 bp, Artificial Sequence
  chemically synthesized
tttttttttttttttttttttg

SEQ ID NO: 1108486 - DNA, 22 bp, Artificial Sequence
  chemically synthesized
tgaagtacaaaaaaaaaaaaaa

SEQ ID NO: 1108487 - DNA, 22 bp, Artificial Sequence
  chemically synthesized
aagtacaaaaaaaaaaaaaaaa

SEQ ID NO: 1108488 - DNA, 22 bp, Artificial Sequence
  chemically synthesized
aataaagcaaaggataaatact

SEQ ID NO: 1108489 - DNA, 22 bp, Artificial Sequence
  chemically synthesized
caaaaatgaaatgagctaaata

SEQ ID NO: 1108490 - DNA, 22 bp, Artificial Sequence
  chemically synthesized
atcctttgctttatttagctca

SEQ ID NO: 1108491 - DNA, 22 bp, Artificial Sequence
  chemically synthesized
acaaaaatgaaatgagctaaat

SEQ ID NO: 1108492 - DNA, 22 bp, Artificial Sequence
  chemically synthesized
tcctttgctttatttagctcat

SEQ ID NO: 1108493 - DNA, 22 bp, Artificial Sequence
  chemically synthesized
tacaaaaatgaaatgagctaaa

SEQ ID NO: 1108494 - DNA, 22 bp, Artificial Sequence
  chemically synthesized
ttacaaaaatgaaatgagctaa

SEQ ID NO: 1108495 - DNA, 22 bp, Artificial Sequence
  chemically synthesized
tttacaaaaatgaaatgagcta

SEQ ID NO: 1108496 - DNA, 22 bp, Artificial Sequence
  chemically synthesized
tgctttatttagctcatttcat

SEQ ID NO: 1108497 - DNA, 22 bp, Artificial Sequence
  chemically synthesized
gctttatttagctcatttcatt

SEQ ID NO: 1108498 - DNA, 22 bp, Artificial Sequence
  chemically synthesized
attttttacaaaaatgaaatga

SEQ ID NO: 1108499 - DNA, 22 bp, Artificial Sequence
  chemically synthesized
ctttatttagctcatttcattt

SEQ ID NO: 1108500 - DNA, 22 bp, Artificial Sequence
  chemically synthesized
cattttttacaaaaatgaaatg

SEQ ID NO: 1108501 - DNA, 22 bp, Artificial Sequence
  chemically synthesized
tcattttttacaaaaatgaaat

SEQ ID NO: 1108502 - DNA, 22 bp, Artificial Sequence
  chemically synthesized
ttcattttttacaaaaatgaaa

SEQ ID NO: 1108503 - DNA, 22 bp, Artificial Sequence
  chemically synthesized
tatttagctcatttcatttttg

SEQ ID NO: 1108504 - DNA, 22 bp, Artificial Sequence
  chemically synthesized
atttagctcatttcatttttgt

SEQ ID NO: 1108505 - DNA, 22 bp, Artificial Sequence
  chemically synthesized
tttagctcatttcatttttgta

SEQ ID NO: 1108506 - DNA, 22 bp, Artificial Sequence
  chemically synthesized
agctcatttcatttttgtaaaa

SEQ ID NO: 1108507 - DNA, 22 bp, Artificial Sequence
  chemically synthesized
gctcatttcatttttgtaaaaa

SEQ ID NO: 1108508 - DNA, 22 bp, Artificial Sequence
  chemically synthesized
ccagcttttcattttttacaaa

SEQ ID NO: 1108509 - DNA, 22 bp, Artificial Sequence
  chemically synthesized
cccagcttttcattttttacaa

SEQ ID NO: 1108510 - DNA, 22 bp, Artificial Sequence
  chemically synthesized
atttcatttttgtaaaaaatga

SEQ ID NO: 1108511 - DNA, 22 bp, Artificial Sequence
  chemically synthesized
atttcccagcttttcatttttt

SEQ ID NO: 1108512 - DNA, 22 bp, Artificial Sequence
  chemically synthesized
tcatttcccagcttttcatttt

SEQ ID NO: 1108513 - DNA, 22 bp, Artificial Sequence
  chemically synthesized
catttttgtaaaaaatgaaaag

SEQ ID NO: 1108514 - DNA, 22 bp, Artificial Sequence
  chemically synthesized
ctcatttcccagcttttcattt

SEQ ID NO: 1108515 - DNA, 22 bp, Artificial Sequence
  chemically synthesized
atttttgtaaaaaatgaaaagc

SEQ ID NO: 1108516 - DNA, 22 bp, Artificial Sequence
  chemically synthesized
tctcatttcccagcttttcatt

SEQ ID NO: 1108517 - DNA, 22 bp, Artificial Sequence
  chemically synthesized
ttctcatttcccagcttttcat

SEQ ID NO: 1108518 - DNA, 22 bp, Artificial Sequence
  chemically synthesized
ttgtaaaaaatgaaaagctggg

SEQ ID NO: 1108519 - DNA, 22 bp, Artificial Sequence
  chemically synthesized
tgtaaaaaatgaaaagctggga

SEQ ID NO: 1108520 - DNA, 22 bp, Artificial Sequence
  chemically synthesized
gtaaaaaatgaaaagctgggaa

SEQ ID NO: 1108521 - DNA, 22 bp, Artificial Sequence
  chemically synthesized
taaaaaatgaaaagctgggaaa

SEQ ID NO: 1108522 - DNA, 22 bp, Artificial Sequence
  chemically synthesized
atgtagtgatacacaacgcttt

SEQ ID NO: 1108523 - DNA, 22 bp, Artificial Sequence
  chemically synthesized
ggaaatgagaaaagcgttgtgt

SEQ ID NO: 1108524 - DNA, 22 bp, Artificial Sequence
  chemically synthesized
cagaattaatgtagtgatacac

SEQ ID NO: 1108525 - DNA, 22 bp, Artificial Sequence
  chemically synthesized
ccagaattaatgtagtgataca

SEQ ID NO: 1108526 - DNA, 22 bp, Artificial Sequence
  chemically synthesized
tgtatcactacattaattctgg

SEQ ID NO: 1108527 - DNA, 22 bp, Artificial Sequence
  chemically synthesized
accatataatatcatttccaga

SEQ ID NO: 1108528 - DNA, 22 bp, Artificial Sequence
  chemically synthesized
cattaattctggaaatgatatt

SEQ ID NO: 1108529 - DNA, 22 bp, Artificial Sequence
  chemically synthesized
aagaattcaccatataatatca

SEQ ID NO: 1108530 - DNA, 22 bp, Artificial Sequence
  chemically synthesized
aaagaattcaccatataatatc

SEQ ID NO: 1108531 - DNA, 22 bp, Artificial Sequence
  chemically synthesized
attctggaaatgatattatatg

SEQ ID NO: 1108532 - DNA, 22 bp, Artificial Sequence
  chemically synthesized
tggaaatgatattatatggtga

SEQ ID NO: 1108533 - DNA, 22 bp, Artificial Sequence
  chemically synthesized
gaaatgatattatatggtgaat

SEQ ID NO: 1108534 - DNA, 22 bp, Artificial Sequence
  chemically synthesized
taaatatttaaagaattcacca

SEQ ID NO: 1108535 - DNA, 22 bp, Artificial Sequence
  chemically synthesized
gtaaatatttaaagaattcacc

SEQ ID NO: 1108536 - DNA, 22 bp, Artificial Sequence
  chemically synthesized
tgtaaatatttaaagaattcac

SEQ ID NO: 1108537 - DNA, 22 bp, Artificial Sequence
  chemically synthesized
tttgtaaatatttaaagaattc

SEQ ID NO: 1108538 - DNA, 22 bp, Artificial Sequence
  chemically synthesized
ctttgtaaatatttaaagaatt

SEQ ID NO: 1108539 - DNA, 22 bp, Artificial Sequence
  chemically synthesized
tctttgtaaatatttaaagaat

SEQ ID NO: 1108540 - DNA, 22 bp, Artificial Sequence
  chemically synthesized
ttctttgtaaatatttaaagaa

SEQ ID NO: 1108541 - DNA, 22 bp, Artificial Sequence
  chemically synthesized
tatggtgaattctttaaatatt

SEQ ID NO: 1108542 - DNA, 22 bp, Artificial Sequence
  chemically synthesized
cttttctttgtaaatatttaaa

SEQ ID NO: 1108543 - DNA, 22 bp, Artificial Sequence
  chemically synthesized
ttgcttttctttgtaaatattt

SEQ ID NO: 1108544 - DNA, 22 bp, Artificial Sequence
  chemically synthesized
tcctattgcttttctttgtaaa

SEQ ID NO: 1108545 - DNA, 22 bp, Artificial Sequence
  chemically synthesized
tttaaatatttacaaagaaaag

SEQ ID NO: 1108546 - DNA, 22 bp, Artificial Sequence
  chemically synthesized
taaatatttacaaagaaaagca

SEQ ID NO: 1108547 - DNA, 22 bp, Artificial Sequence
  chemically synthesized
aaatatttacaaagaaaagcaa

SEQ ID NO: 1108548 - DNA, 22 bp, Artificial Sequence
  chemically synthesized
aatatttacaaagaaaagcaat

SEQ ID NO: 1108549 - DNA, 22 bp, Artificial Sequence
  chemically synthesized
gaaaatatattatcctattgct

SEQ ID NO: 1108550 - DNA, 22 bp, Artificial Sequence
  chemically synthesized
acaaagaaaagcaataggataa

SEQ ID NO: 1108551 - DNA, 22 bp, Artificial Sequence
  chemically synthesized
caaagaaaagcaataggataat

SEQ ID NO: 1108552 - DNA, 22 bp, Artificial Sequence
  chemically synthesized
gttggaaaatatattatcctat

SEQ ID NO: 1108553 - DNA, 22 bp, Artificial Sequence
  chemically synthesized
aattagttggaaaatatattat

SEQ ID NO: 1108554 - DNA, 22 bp, Artificial Sequence
  chemically synthesized
aaattagttggaaaatatatta

SEQ ID NO: 1108555 - DNA, 22 bp, Artificial Sequence
  chemically synthesized
aaacttaaattagttggaaaat

SEQ ID NO: 1108556 - DNA, 22 bp, Artificial Sequence
  chemically synthesized
ctaaaacttaaattagttggaa

SEQ ID NO: 1108557 - DNA, 22 bp, Artificial Sequence
  chemically synthesized
ctactaaaacttaaattagttg

SEQ ID NO: 1108558 - DNA, 22 bp, Artificial Sequence
  chemically synthesized
actactaaaacttaaattagtt

SEQ ID NO: 1108559 - DNA, 22 bp, Artificial Sequence
  chemically synthesized
tttactactaaaacttaaatta

SEQ ID NO: 1108560 - DNA, 22 bp, Artificial Sequence
  chemically synthesized
gtttactactaaaacttaaatt

SEQ ID NO: 1108561 - DNA, 22 bp, Artificial Sequence
  chemically synthesized
tccaactaatttaagttttagt

SEQ ID NO: 1108562 - DNA, 22 bp, Artificial Sequence
  chemically synthesized
ccaactaatttaagttttagta

SEQ ID NO: 1108563 - DNA, 22 bp, Artificial Sequence
  chemically synthesized
caactaatttaagttttagtag

SEQ ID NO: 1108564 - DNA, 22 bp, Artificial Sequence
  chemically synthesized
atttaagttttagtagtaaaca

SEQ ID NO: 1108565 - DNA, 22 bp, Artificial Sequence
  chemically synthesized
aagttttagtagtaaacaaaca

SEQ ID NO: 1108566 - DNA, 22 bp, Artificial Sequence
  chemically synthesized
agttttagtagtaaacaaacac

SEQ ID NO: 1108567 - DNA, 22 bp, Artificial Sequence
  chemically synthesized
tagtagtaaacaaacacatgtt

SEQ ID NO: 1108568 - DNA, 22 bp, Artificial Sequence
  chemically synthesized
agtagtaaacaaacacatgttc

SEQ ID NO: 1108569 - DNA, 22 bp, Artificial Sequence
  chemically synthesized
gtagtaaacaaacacatgttcc

SEQ ID NO: 1108570 - DNA, 22 bp, Artificial Sequence
  chemically synthesized
tcatgagaagcacaggaacatg

SEQ ID NO: 1108571 - DNA, 22 bp, Artificial Sequence
  chemically synthesized
gtcatgagaagcacaggaacat

SEQ ID NO: 1108572 - DNA, 22 bp, Artificial Sequence
  chemically synthesized
tcccaaatttgtcatgagaagc

SEQ ID NO: 1108573 - DNA, 22 bp, Artificial Sequence
  chemically synthesized
tgtcccaaatttgtcatgagaa

SEQ ID NO: 1108574 - DNA, 22 bp, Artificial Sequence
  chemically synthesized
ctgtgcttctcatgacaaattt

SEQ ID NO: 1108575 - DNA, 22 bp, Artificial Sequence
  chemically synthesized
tgcttctcatgacaaatttggg

SEQ ID NO: 1108576 - DNA, 22 bp, Artificial Sequence
  chemically synthesized
aaaaaatctctgtcccaaattt

SEQ ID NO: 1108577 - DNA, 22 bp, Artificial Sequence
  chemically synthesized
tgaaaaaatctctgtcccaaat

SEQ ID NO: 1108578 - DNA, 22 bp, Artificial Sequence
  chemically synthesized
ctgaaaaaatctctgtcccaaa

SEQ ID NO: 1108579 - DNA, 22 bp, Artificial Sequence
  chemically synthesized
ctcatgacaaatttgggacaga

SEQ ID NO: 1108580 - DNA, 22 bp, Artificial Sequence
  chemically synthesized
tctgaaaaaatctctgtcccaa

SEQ ID NO: 1108581 - DNA, 22 bp, Artificial Sequence
  chemically synthesized
tcatgacaaatttgggacagag

SEQ ID NO: 1108582 - DNA, 22 bp, Artificial Sequence
  chemically synthesized
ttctgaaaaaatctctgtccca

SEQ ID NO: 1108583 - DNA, 22 bp, Artificial Sequence
  chemically synthesized
atgacaaatttgggacagagat

SEQ ID NO: 1108584 - DNA, 22 bp, Artificial Sequence
  chemically synthesized
gggacagagattttttcagaaa

SEQ ID NO: 1108585 - DNA, 22 bp, Artificial Sequence
  chemically synthesized
ggacagagattttttcagaaaa

SEQ ID NO: 1108586 - DNA, 22 bp, Artificial Sequence
  chemically synthesized
agataaaagtatttttctgaaa

SEQ ID NO: 1108587 - DNA, 22 bp, Artificial Sequence
  chemically synthesized
aaggcattaagataaaagtatt

SEQ ID NO: 1108588 - DNA, 22 bp, Artificial Sequence
  chemically synthesized
gaaggcattaagataaaagtat

SEQ ID NO: 1108589 - DNA, 22 bp, Artificial Sequence
  chemically synthesized
tttcagaaaaatacttttatct

SEQ ID NO: 1108590 - DNA, 22 bp, Artificial Sequence
  chemically synthesized
ttcagaaaaatacttttatctt

SEQ ID NO: 1108591 - DNA, 22 bp, Artificial Sequence
  chemically synthesized
tcagaaaaatacttttatctta

SEQ ID NO: 1108592 - DNA, 22 bp, Artificial Sequence
  chemically synthesized
cagaaaaatacttttatcttaa

SEQ ID NO: 1108593 - DNA, 22 bp, Artificial Sequence
  chemically synthesized
agaaaaatacttttatcttaat

SEQ ID NO: 1108594 - DNA, 22 bp, Artificial Sequence
  chemically synthesized
agtaaaatcgggtttgaaggca

SEQ ID NO: 1108595 - DNA, 22 bp, Artificial Sequence
  chemically synthesized
ttatcttaatgccttcaaaccc

SEQ ID NO: 1108596 - DNA, 22 bp, Artificial Sequence
  chemically synthesized
ttgagtaaaatcgggtttgaag

SEQ ID NO: 1108597 - DNA, 22 bp, Artificial Sequence
  chemically synthesized
tatcttaatgccttcaaacccg

SEQ ID NO: 1108598 - DNA, 22 bp, Artificial Sequence
  chemically synthesized
atcttaatgccttcaaacccga

SEQ ID NO: 1108599 - DNA, 22 bp, Artificial Sequence
  chemically synthesized
tcttaatgccttcaaacccgat

SEQ ID NO: 1108600 - DNA, 22 bp, Artificial Sequence
  chemically synthesized
aatgccttcaaacccgatttta

SEQ ID NO: 1108601 - DNA, 22 bp, Artificial Sequence
  chemically synthesized
atgccttcaaacccgattttac

SEQ ID NO: 1108602 - DNA, 22 bp, Artificial Sequence
  chemically synthesized
caaacccgattttactcaataa

SEQ ID NO: 1108603 - DNA, 22 bp, Artificial Sequence
  chemically synthesized
aaacccgattttactcaataat

SEQ ID NO: 1108604 - DNA, 22 bp, Artificial Sequence
  chemically synthesized
atgtgcacacaaaaggaattat

SEQ ID NO: 1108605 - DNA, 22 bp, Artificial Sequence
  chemically synthesized
tactcaataattccttttgtgt

SEQ ID NO: 1108606 - DNA, 22 bp, Artificial Sequence
  chemically synthesized
actcaataattccttttgtgtg

SEQ ID NO: 1108607 - DNA, 22 bp, Artificial Sequence
  chemically synthesized
ctcaataattccttttgtgtgc

SEQ ID NO: 1108608 - DNA, 22 bp, Artificial Sequence
  chemically synthesized
aataattccttttgtgtgcaca

SEQ ID NO: 1108609 - DNA, 22 bp, Artificial Sequence
  chemically synthesized
cttttgtgtgcacatgaacaca

SEQ ID NO: 1108610 - DNA, 22 bp, Artificial Sequence
  chemically synthesized
tatacatgcatatatgtgttca

SEQ ID NO: 1108611 - DNA, 22 bp, Artificial Sequence
  chemically synthesized
ttgtgtgcacatgaacacatat

SEQ ID NO: 1108612 - DNA, 22 bp, Artificial Sequence
  chemically synthesized
tgtgtgcacatgaacacatata

SEQ ID NO: 1108613 - DNA, 22 bp, Artificial Sequence
  chemically synthesized
gtgtgcacatgaacacatatat

SEQ ID NO: 1108614 - DNA, 22 bp, Artificial Sequence
  chemically synthesized
tgtgcacatgaacacatatatg

SEQ ID NO: 1108615 - DNA, 22 bp, Artificial Sequence
  chemically synthesized
actatatacatgcatatatgtg

SEQ ID NO: 1108616 - DNA, 22 bp, Artificial Sequence
  chemically synthesized
attcactatatacatgcatata

SEQ ID NO: 1108617 - DNA, 22 bp, Artificial Sequence
  chemically synthesized
gattcactatatacatgcatat

SEQ ID NO: 1108618 - DNA, 22 bp, Artificial Sequence
  chemically synthesized
tgattcactatatacatgcata

SEQ ID NO: 1108619 - DNA, 22 bp, Artificial Sequence
  chemically synthesized
agaaatagtaaatggggttttg

SEQ ID NO: 1108620 - DNA, 22 bp, Artificial Sequence
  chemically synthesized
aagaaatagtaaatggggtttt

SEQ ID NO: 1108621 - DNA, 22 bp, Artificial Sequence
  chemically synthesized
taagaaatagtaaatggggttt

SEQ ID NO: 1108622 - DNA, 22 bp, Artificial Sequence
  chemically synthesized
actatttcttaaaggtggtcat

SEQ ID NO: 1108623 - DNA, 22 bp, Artificial Sequence
  chemically synthesized
agagacagatgaatgaccacct

SEQ ID NO: 1108624 - DNA, 22 bp, Artificial Sequence
  chemically synthesized
ctatttcttaaaggtggtcatt

SEQ ID NO: 1108625 - DNA, 22 bp, Artificial Sequence
  chemically synthesized
cagagacagatgaatgaccacc

SEQ ID NO: 1108626 - DNA, 22 bp, Artificial Sequence
  chemically synthesized
tcagagacagatgaatgaccac

SEQ ID NO: 1108627 - DNA, 22 bp, Artificial Sequence
  chemically synthesized
ttcagagacagatgaatgacca

SEQ ID NO: 1108628 - DNA, 22 bp, Artificial Sequence
  chemically synthesized
tttcttaaaggtggtcattcat

SEQ ID NO: 1108629 - DNA, 22 bp, Artificial Sequence
  chemically synthesized
ttttcagagacagatgaatgac

SEQ ID NO: 1108630 - DNA, 22 bp, Artificial Sequence
  chemically synthesized
cttaaaggtggtcattcatctg

SEQ ID NO: 1108631 - DNA, 22 bp, Artificial Sequence
  chemically synthesized
ttaaaggtggtcattcatctgt

SEQ ID NO: 1108632 - DNA, 22 bp, Artificial Sequence
  chemically synthesized
aaaggtggtcattcatctgtct

SEQ ID NO: 1108633 - DNA, 22 bp, Artificial Sequence
  chemically synthesized
aaggtggtcattcatctgtctc

SEQ ID NO: 1108634 - DNA, 22 bp, Artificial Sequence
  chemically synthesized
agacaaaaattcttttcagaga

SEQ ID NO: 1108635 - DNA, 22 bp, Artificial Sequence
  chemically synthesized
aagacaaaaattcttttcagag

SEQ ID NO: 1108636 - DNA, 22 bp, Artificial Sequence
  chemically synthesized
taagacaaaaattcttttcaga

SEQ ID NO: 1108637 - DNA, 22 bp, Artificial Sequence
  chemically synthesized
gttttaagacaaaaattctttt

SEQ ID NO: 1108638 - DNA, 22 bp, Artificial Sequence
  chemically synthesized
atctgtctctgaaaagaatttt

SEQ ID NO: 1108639 - DNA, 22 bp, Artificial Sequence
  chemically synthesized
agttttaagacaaaaattcttt

SEQ ID NO: 1108640 - DNA, 22 bp, Artificial Sequence
  chemically synthesized
tctctgaaaagaatttttgtct

SEQ ID NO: 1108641 - DNA, 22 bp, Artificial Sequence
  chemically synthesized
atcaacttagttttaagacaaa

SEQ ID NO: 1108642 - DNA, 22 bp, Artificial Sequence
  chemically synthesized
tgaaaagaatttttgtcttaaa

SEQ ID NO: 1108643 - DNA, 22 bp, Artificial Sequence
  chemically synthesized
aaaagaatttttgtcttaaaac

SEQ ID NO: 1108644 - DNA, 22 bp, Artificial Sequence
  chemically synthesized
ctcatcaacttagttttaagac

SEQ ID NO: 1108645 - DNA, 22 bp, Artificial Sequence
  chemically synthesized
tactcatcaacttagttttaag

SEQ ID NO: 1108646 - DNA, 22 bp, Artificial Sequence
  chemically synthesized
ttgtcttaaaactaagttgatg

SEQ ID NO: 1108647 - DNA, 22 bp, Artificial Sequence
  chemically synthesized
tgtcttaaaactaagttgatga

SEQ ID NO: 1108648 - DNA, 22 bp, Artificial Sequence
  chemically synthesized
gtcttaaaactaagttgatgag

SEQ ID NO: 1108649 - DNA, 22 bp, Artificial Sequence
  chemically synthesized
tcttaaaactaagttgatgagt

SEQ ID NO: 1108650 - DNA, 22 bp, Artificial Sequence
  chemically synthesized
caaaatatctctactcatcaac

SEQ ID NO: 1108651 - DNA, 22 bp, Artificial Sequence
  chemically synthesized
ctccaaaatatctctactcatc

SEQ ID NO: 1108652 - DNA, 22 bp, Artificial Sequence
  chemically synthesized
aaaactaagttgatgagtagag

SEQ ID NO: 1108653 - DNA, 22 bp, Artificial Sequence
  chemically synthesized
aaactaagttgatgagtagaga

SEQ ID NO: 1108654 - DNA, 22 bp, Artificial Sequence
  chemically synthesized
agttgatgagtagagatatttt

SEQ ID NO: 1108655 - DNA, 22 bp, Artificial Sequence
  chemically synthesized
atgagtagagatattttggagc

SEQ ID NO: 1108656 - DNA, 22 bp, Artificial Sequence
  chemically synthesized
atacatagtatctgctccaaaa

SEQ ID NO: 1108657 - DNA, 22 bp, Artificial Sequence
  chemically synthesized
ataagatgatgttaatacatag

SEQ ID NO: 1108658 - DNA, 22 bp, Artificial Sequence
  chemically synthesized
tggagcagatactatgtattaa

SEQ ID NO: 1108659 - DNA, 22 bp, Artificial Sequence
  chemically synthesized
aataagatgatgttaatacata

SEQ ID NO: 1108660 - DNA, 22 bp, Artificial Sequence
  chemically synthesized
ggagcagatactatgtattaac

SEQ ID NO: 1108661 - DNA, 22 bp, Artificial Sequence
  chemically synthesized
taataagatgatgttaatacat

SEQ ID NO: 1108662 - DNA, 22 bp, Artificial Sequence
  chemically synthesized
gagcagatactatgtattaaca

SEQ ID NO: 1108663 - DNA, 22 bp, Artificial Sequence
  chemically synthesized
ctttaataagatgatgttaata

SEQ ID NO: 1108664 - DNA, 22 bp, Artificial Sequence
  chemically synthesized
aattgctttaataagatgatgt

SEQ ID NO: 1108665 - DNA, 22 bp, Artificial Sequence
  chemically synthesized
ctgaattgctttaataagatga

SEQ ID NO: 1108666 - DNA, 22 bp, Artificial Sequence
  chemically synthesized
cctgaattgctttaataagatg

SEQ ID NO: 1108667 - DNA, 22 bp, Artificial Sequence
  chemically synthesized
tgtattaacatcatcttattaa

SEQ ID NO: 1108668 - DNA, 22 bp, Artificial Sequence
  chemically synthesized
ttcctgaattgctttaataaga

SEQ ID NO: 1108669 - DNA, 22 bp, Artificial Sequence
  chemically synthesized
tctcttcctgaattgctttaat

SEQ ID NO: 1108670 - DNA, 22 bp, Artificial Sequence
  chemically synthesized
gtctcttcctgaattgctttaa

SEQ ID NO: 1108671 - DNA, 22 bp, Artificial Sequence
  chemically synthesized
acatcatcttattaaagcaatt

SEQ ID NO: 1108672 - DNA, 22 bp, Artificial Sequence
  chemically synthesized
tgtctcttcctgaattgcttta

SEQ ID NO: 1108673 - DNA, 22 bp, Artificial Sequence
  chemically synthesized
ttgtctcttcctgaattgcttt

SEQ ID NO: 1108674 - DNA, 22 bp, Artificial Sequence
  chemically synthesized
ttttgtctcttcctgaattgct

SEQ ID NO: 1108675 - DNA, 22 bp, Artificial Sequence
  chemically synthesized
cttttgtctcttcctgaattgc

SEQ ID NO: 1108676 - DNA, 22 bp, Artificial Sequence
  chemically synthesized
attaaagcaattcaggaagaga

SEQ ID NO: 1108677 - DNA, 22 bp, Artificial Sequence
  chemically synthesized
ttaaagcaattcaggaagagac

SEQ ID NO: 1108678 - DNA, 22 bp, Artificial Sequence
  chemically synthesized
aagatgtttcttttgtctcttc

SEQ ID NO: 1108679 - DNA, 22 bp, Artificial Sequence
  chemically synthesized
aagcaattcaggaagagacaaa

SEQ ID NO: 1108680 - DNA, 22 bp, Artificial Sequence
  chemically synthesized
caagatgtttcttttgtctctt

SEQ ID NO: 1108681 - DNA, 22 bp, Artificial Sequence
  chemically synthesized
tcaagatgtttcttttgtctct

SEQ ID NO: 1108682 - DNA, 22 bp, Artificial Sequence
  chemically synthesized
ttcaagatgtttcttttgtctc

SEQ ID NO: 1108683 - DNA, 22 bp, Artificial Sequence
  chemically synthesized
aggaagagacaaaagaaacatc

SEQ ID NO: 1108684 - DNA, 22 bp, Artificial Sequence
  chemically synthesized
gcaaatttttcaagatgtttct

SEQ ID NO: 1108685 - DNA, 22 bp, Artificial Sequence
  chemically synthesized
atgccatgcgactagcaaattt

SEQ ID NO: 1108686 - DNA, 22 bp, Artificial Sequence
  chemically synthesized
gaaaaatttgctagtcgcatgg

SEQ ID NO: 1108687 - DNA, 22 bp, Artificial Sequence
  chemically synthesized
tgcaaattcatgccatgcgact

SEQ ID NO: 1108688 - DNA, 22 bp, Artificial Sequence
  chemically synthesized
aaaaatttgctagtcgcatggc

SEQ ID NO: 1108689 - DNA, 22 bp, Artificial Sequence
  chemically synthesized
gctagtcgcatggcatgaattt

SEQ ID NO: 1108690 - DNA, 22 bp, Artificial Sequence
  chemically synthesized
ctagtcgcatggcatgaatttg

SEQ ID NO: 1108691 - DNA, 22 bp, Artificial Sequence
  chemically synthesized
gtcgcatggcatgaatttgcat

SEQ ID NO: 1108692 - DNA, 22 bp, Artificial Sequence
  chemically synthesized
atgataaaagataaaagtggag

SEQ ID NO: 1108693 - DNA, 22 bp, Artificial Sequence
  chemically synthesized
gatgataaaagataaaagtgga

SEQ ID NO: 1108694 - DNA, 22 bp, Artificial Sequence
  chemically synthesized
tgatgataaaagataaaagtgg

SEQ ID NO: 1108695 - DNA, 22 bp, Artificial Sequence
  chemically synthesized
gcataattgctccacttttatc

SEQ ID NO: 1108696 - DNA, 22 bp, Artificial Sequence
  chemically synthesized
cataattgctccacttttatct

SEQ ID NO: 1108697 - DNA, 22 bp, Artificial Sequence
  chemically synthesized
ctttgatgataaaagataaaag

SEQ ID NO: 1108698 - DNA, 22 bp, Artificial Sequence
  chemically synthesized
cctttgatgataaaagataaaa

SEQ ID NO: 1108699 - DNA, 22 bp, Artificial Sequence
  chemically synthesized
tcctttgatgataaaagataaa

SEQ ID NO: 1108700 - DNA, 22 bp, Artificial Sequence
  chemically synthesized
ttcctttgatgataaaagataa

SEQ ID NO: 1108701 - DNA, 22 bp, Artificial Sequence
  chemically synthesized
tttcctttgatgataaaagata

SEQ ID NO: 1108702 - DNA, 22 bp, Artificial Sequence
  chemically synthesized
ctccacttttatcttttatcat

SEQ ID NO: 1108703 - DNA, 22 bp, Artificial Sequence
  chemically synthesized
ttttttcctttgatgataaaag

SEQ ID NO: 1108704 - DNA, 22 bp, Artificial Sequence
  chemically synthesized
cacttttatcttttatcatcaa

SEQ ID NO: 1108705 - DNA, 22 bp, Artificial Sequence
  chemically synthesized
ttatcttttatcatcaaaggaa

SEQ ID NO: 1108706 - DNA, 22 bp, Artificial Sequence
  chemically synthesized
tatcttttatcatcaaaggaaa

SEQ ID NO: 1108707 - DNA, 22 bp, Artificial Sequence
  chemically synthesized
atcttttatcatcaaaggaaaa

SEQ ID NO: 1108708 - DNA, 22 bp, Artificial Sequence
  chemically synthesized
tcttttatcatcaaaggaaaaa

SEQ ID NO: 1108709 - DNA, 22 bp, Artificial Sequence
  chemically synthesized
cataaatcctattttttccttt

SEQ ID NO: 1108710 - DNA, 22 bp, Artificial Sequence
  chemically synthesized
ttatcatcaaaggaaaaaatag

SEQ ID NO: 1108711 - DNA, 22 bp, Artificial Sequence
  chemically synthesized
tatcatcaaaggaaaaaatagg

SEQ ID NO: 1108712 - DNA, 22 bp, Artificial Sequence
  chemically synthesized
atcatcaaaggaaaaaatagga

SEQ ID NO: 1108713 - DNA, 22 bp, Artificial Sequence
  chemically synthesized
taattacataaatcctattttt

SEQ ID NO: 1108714 - DNA, 22 bp, Artificial Sequence
  chemically synthesized
tcatcaaaggaaaaaataggat

SEQ ID NO: 1108715 - DNA, 22 bp, Artificial Sequence
  chemically synthesized
gatcactataattacataaatc

SEQ ID NO: 1108716 - DNA, 22 bp, Artificial Sequence
  chemically synthesized
ctggatcactataattacataa

SEQ ID NO: 1108717 - DNA, 22 bp, Artificial Sequence
  chemically synthesized
ctactggatcactataattaca

SEQ ID NO: 1108718 - DNA, 22 bp, Artificial Sequence
  chemically synthesized
actactggatcactataattac

SEQ ID NO: 1108719 - DNA, 22 bp, Artificial Sequence
  chemically synthesized
tactactggatcactataatta

SEQ ID NO: 1108720 - DNA, 22 bp, Artificial Sequence
  chemically synthesized
cattttactactggatcactat

SEQ ID NO: 1108721 - DNA, 22 bp, Artificial Sequence
  chemically synthesized
atgtaattatagtgatccagta

SEQ ID NO: 1108722 - DNA, 22 bp, Artificial Sequence
  chemically synthesized
tgtaattatagtgatccagtag

SEQ ID NO: 1108723 - DNA, 22 bp, Artificial Sequence
  chemically synthesized
ggctacattttactactggatc

SEQ ID NO: 1108724 - DNA, 22 bp, Artificial Sequence
  chemically synthesized
gggctacattttactactggat

SEQ ID NO: 1108725 - DNA, 22 bp, Artificial Sequence
  chemically synthesized
tgggctacattttactactgga

SEQ ID NO: 1108726 - DNA, 22 bp, Artificial Sequence
  chemically synthesized
tttgggctacattttactactg

SEQ ID NO: 1108727 - DNA, 22 bp, Artificial Sequence
  chemically synthesized
ttctttgggctacattttacta

SEQ ID NO: 1108728 - DNA, 22 bp, Artificial Sequence
  chemically synthesized
tagtgatccagtagtaaaatgt

SEQ ID NO: 1108729 - DNA, 22 bp, Artificial Sequence
  chemically synthesized
agcaaaggacaaattattcttt

SEQ ID NO: 1108730 - DNA, 22 bp, Artificial Sequence
  chemically synthesized
aaactcagcaaaggacaaatta

SEQ ID NO: 1108731 - DNA, 22 bp, Artificial Sequence
  chemically synthesized
gtcctttgctgagtttcagttg

SEQ ID NO: 1108732 - DNA, 22 bp, Artificial Sequence
  chemically synthesized
gcatacatgtggcaactgaaac

SEQ ID NO: 1108733 - DNA, 22 bp, Artificial Sequence
  chemically synthesized
tcctttgctgagtttcagttgc

SEQ ID NO: 1108734 - DNA, 22 bp, Artificial Sequence
  chemically synthesized
agcatacatgtggcaactgaaa

SEQ ID NO: 1108735 - DNA, 22 bp, Artificial Sequence
  chemically synthesized
tagcatacatgtggcaactgaa

SEQ ID NO: 1108736 - DNA, 22 bp, Artificial Sequence
  chemically synthesized
tgctgagtttcagttgccacat

SEQ ID NO: 1108737 - DNA, 22 bp, Artificial Sequence
  chemically synthesized
gctgagtttcagttgccacatg

SEQ ID NO: 1108738 - DNA, 22 bp, Artificial Sequence
  chemically synthesized
ctgagtttcagttgccacatgt

SEQ ID NO: 1108739 - DNA, 22 bp, Artificial Sequence
  chemically synthesized
tagctttagcatacatgtggca

SEQ ID NO: 1108740 - DNA, 22 bp, Artificial Sequence
  chemically synthesized
agtttcagttgccacatgtatg

SEQ ID NO: 1108741 - DNA, 22 bp, Artificial Sequence
  chemically synthesized
cagttgccacatgtatgctaaa

SEQ ID NO: 1108742 - DNA, 22 bp, Artificial Sequence
  chemically synthesized
agttgccacatgtatgctaaag

SEQ ID NO: 1108743 - DNA, 22 bp, Artificial Sequence
  chemically synthesized
aagagtattatagctttagcat

SEQ ID NO: 1108744 - DNA, 22 bp, Artificial Sequence
  chemically synthesized
ccacatgtatgctaaagctata

SEQ ID NO: 1108745 - DNA, 22 bp, Artificial Sequence
  chemically synthesized
tctgaagagtattatagcttta

SEQ ID NO: 1108746 - DNA, 22 bp, Artificial Sequence
  chemically synthesized
atctgaagagtattatagcttt

SEQ ID NO: 1108747 - DNA, 22 bp, Artificial Sequence
  chemically synthesized
tcaatttatctgaagagtatta

SEQ ID NO: 1108748 - DNA, 22 bp, Artificial Sequence
  chemically synthesized
tgtcaatttatctgaagagtat

SEQ ID NO: 1108749 - DNA, 22 bp, Artificial Sequence
  chemically synthesized
ctgtcaatttatctgaagagta

SEQ ID NO: 1108750 - DNA, 22 bp, Artificial Sequence
  chemically synthesized
aagctataatactcttcagata

SEQ ID NO: 1108751 - DNA, 22 bp, Artificial Sequence
  chemically synthesized
atatttctgtcaatttatctga

SEQ ID NO: 1108752 - DNA, 22 bp, Artificial Sequence
  chemically synthesized
taatatttctgtcaatttatct

SEQ ID NO: 1108753 - DNA, 22 bp, Artificial Sequence
  chemically synthesized
taatactcttcagataaattga

SEQ ID NO: 1108754 - DNA, 22 bp, Artificial Sequence
  chemically synthesized
ctaatatttctgtcaatttatc

SEQ ID NO: 1108755 - DNA, 22 bp, Artificial Sequence
  chemically synthesized
ttcagataaattgacagaaata

SEQ ID NO: 1108756 - DNA, 22 bp, Artificial Sequence
  chemically synthesized
ggcatcttctaatatttctgtc

SEQ ID NO: 1108757 - DNA, 22 bp, Artificial Sequence
  chemically synthesized
cagataaattgacagaaatatt

SEQ ID NO: 1108758 - DNA, 22 bp, Artificial Sequence
  chemically synthesized
agataaattgacagaaatatta

SEQ ID NO: 1108759 - DNA, 22 bp, Artificial Sequence
  chemically synthesized
ctaggcatcttctaatatttct

SEQ ID NO: 1108760 - DNA, 22 bp, Artificial Sequence
  chemically synthesized
gctaggcatcttctaatatttc

SEQ ID NO: 1108761 - DNA, 22 bp, Artificial Sequence
  chemically synthesized
acagaaatattagaagatgcct

SEQ ID NO: 1108762 - DNA, 22 bp, Artificial Sequence
  chemically synthesized
tatatacaaggatatttgctag

SEQ ID NO: 1108763 - DNA, 22 bp, Artificial Sequence
  chemically synthesized
gaagatgcctagcaaatatcct

SEQ ID NO: 1108764 - DNA, 22 bp, Artificial Sequence
  chemically synthesized
gctgtatatacaaggatatttg

SEQ ID NO: 1108765 - DNA, 22 bp, Artificial Sequence
  chemically synthesized
gctcgctgtatatacaaggata

SEQ ID NO: 1108766 - DNA, 22 bp, Artificial Sequence
  chemically synthesized
agtctggctcgctgtatataca

SEQ ID NO: 1108767 - DNA, 22 bp, Artificial Sequence
  chemically synthesized
gcaaatatccttgtatatacag

SEQ ID NO: 1108768 - DNA, 22 bp, Artificial Sequence
  chemically synthesized
aattaagtctggctcgctgtat

SEQ ID NO: 1108769 - DNA, 22 bp, Artificial Sequence
  chemically synthesized
caattaagtctggctcgctgta

SEQ ID NO: 1108770 - DNA, 22 bp, Artificial Sequence
  chemically synthesized
gtatatacagcgagccagactt

SEQ ID NO: 1108771 - DNA, 22 bp, Artificial Sequence
  chemically synthesized
tatatacagcgagccagactta

SEQ ID NO: 1108772 - DNA, 22 bp, Artificial Sequence
  chemically synthesized
aggtcatatgaatacacttcaa

SEQ ID NO: 1108773 - DNA, 22 bp, Artificial Sequence
  chemically synthesized
aattgaagtgtattcatatgac

SEQ ID NO: 1108774 - DNA, 22 bp, Artificial Sequence
  chemically synthesized
attgaagtgtattcatatgacc

SEQ ID NO: 1108775 - DNA, 22 bp, Artificial Sequence
  chemically synthesized
aagtgtattcatatgacctcaa

SEQ ID NO: 1108776 - DNA, 22 bp, Artificial Sequence
  chemically synthesized
atatgacctcaactgctctttt

SEQ ID NO: 1108777 - DNA, 22 bp, Artificial Sequence
  chemically synthesized
aatatagaagaaaataaaagag

SEQ ID NO: 1108778 - DNA, 22 bp, Artificial Sequence
  chemically synthesized
gaatatagaagaaaataaaaga

SEQ ID NO: 1108779 - DNA, 22 bp, Artificial Sequence
  chemically synthesized
tgaatatagaagaaaataaaag

SEQ ID NO: 1108780 - DNA, 22 bp, Artificial Sequence
  chemically synthesized
aactgctcttttattttcttct

SEQ ID NO: 1108781 - DNA, 22 bp, Artificial Sequence
  chemically synthesized
ctcttttattttcttctatatt

SEQ ID NO: 1108782 - DNA, 22 bp, Artificial Sequence
  chemically synthesized
ttttattttcttctatattcaa

SEQ ID NO: 1108783 - DNA, 22 bp, Artificial Sequence
  chemically synthesized
aaaatcagatgttttgaatata

SEQ ID NO: 1108784 - DNA, 22 bp, Artificial Sequence
  chemically synthesized
ttattttcttctatattcaaaa

SEQ ID NO: 1108785 - DNA, 22 bp, Artificial Sequence
  chemically synthesized
caaaatcagatgttttgaatat

SEQ ID NO: 1108786 - DNA, 22 bp, Artificial Sequence
  chemically synthesized
tattttcttctatattcaaaac

SEQ ID NO: 1108787 - DNA, 22 bp, Artificial Sequence
  chemically synthesized
attttcttctatattcaaaaca

SEQ ID NO: 1108788 - DNA, 22 bp, Artificial Sequence
  chemically synthesized
ttttcttctatattcaaaacat

SEQ ID NO: 1108789 - DNA, 22 bp, Artificial Sequence
  chemically synthesized
tcttctatattcaaaacatctg

SEQ ID NO: 1108790 - DNA, 22 bp, Artificial Sequence
  chemically synthesized
cttctatattcaaaacatctga

SEQ ID NO: 1108791 - DNA, 22 bp, Artificial Sequence
  chemically synthesized
tagatttcaaaatcagatgttt

SEQ ID NO: 1108792 - DNA, 22 bp, Artificial Sequence
  chemically synthesized
ttctatattcaaaacatctgat

SEQ ID NO: 1108793 - DNA, 22 bp, Artificial Sequence
  chemically synthesized
ctatattcaaaacatctgattt

SEQ ID NO: 1108794 - DNA, 22 bp, Artificial Sequence
  chemically synthesized
tatattcaaaacatctgatttt

SEQ ID NO: 1108795 - DNA, 22 bp, Artificial Sequence
  chemically synthesized
tattcaaaacatctgattttga

SEQ ID NO: 1108796 - DNA, 22 bp, Artificial Sequence
  chemically synthesized
ggggattgtagatttcaaaatc

SEQ ID NO: 1108797 - DNA, 22 bp, Artificial Sequence
  chemically synthesized
gggggattgtagatttcaaaat

SEQ ID NO: 1108798 - DNA, 22 bp, Artificial Sequence
  chemically synthesized
aaaacatctgattttgaaatct

SEQ ID NO: 1108799 - DNA, 22 bp, Artificial Sequence
  chemically synthesized
cttgggggattgtagatttcaa

SEQ ID NO: 1108800 - DNA, 22 bp, Artificial Sequence
  chemically synthesized
tccttgggggattgtagatttc

SEQ ID NO: 1108801 - DNA, 22 bp, Artificial Sequence
  chemically synthesized
ctccttgggggattgtagattt

SEQ ID NO: 1108802 - DNA, 22 bp, Artificial Sequence
  chemically synthesized
attttgaaatctacaatccccc

SEQ ID NO: 1108803 - DNA, 22 bp, Artificial Sequence
  chemically synthesized
tgaaatctacaatcccccaagg

SEQ ID NO: 1108804 - DNA, 22 bp, Artificial Sequence
  chemically synthesized
gaaatctacaatcccccaagga

SEQ ID NO: 1108805 - DNA, 22 bp, Artificial Sequence
  chemically synthesized
aaatctacaatcccccaaggag

SEQ ID NO: 1108806 - DNA, 22 bp, Artificial Sequence
  chemically synthesized
tatgggaatagcttctccttgg

SEQ ID NO: 1108807 - DNA, 22 bp, Artificial Sequence
  chemically synthesized
gtatgggaatagcttctccttg

SEQ ID NO: 1108808 - DNA, 22 bp, Artificial Sequence
  chemically synthesized
tgtatgggaatagcttctcctt

SEQ ID NO: 1108809 - DNA, 22 bp, Artificial Sequence
  chemically synthesized
caatcccccaaggagaagctat

SEQ ID NO: 1108810 - DNA, 22 bp, Artificial Sequence
  chemically synthesized
agaaacaaaacatgttttgtat

SEQ ID NO: 1108811 - DNA, 22 bp, Artificial Sequence
  chemically synthesized
gagaaacaaaacatgttttgta

SEQ ID NO: 1108812 - DNA, 22 bp, Artificial Sequence
  chemically synthesized
tgagaaacaaaacatgttttgt

SEQ ID NO: 1108813 - DNA, 22 bp, Artificial Sequence
  chemically synthesized
ttcccatacaaaacatgttttg

SEQ ID NO: 1108814 - DNA, 22 bp, Artificial Sequence
  chemically synthesized
tgactttgagaaacaaaacatg

SEQ ID NO: 1108815 - DNA, 22 bp, Artificial Sequence
  chemically synthesized
gtgactttgagaaacaaaacat

SEQ ID NO: 1108816 - DNA, 22 bp, Artificial Sequence
  chemically synthesized
ccatacaaaacatgttttgttt

SEQ ID NO: 1108817 - DNA, 22 bp, Artificial Sequence
  chemically synthesized
tgtgactttgagaaacaaaaca

SEQ ID NO: 1108818 - DNA, 22 bp, Artificial Sequence
  chemically synthesized
ataataattttgtgactttgag

SEQ ID NO: 1108819 - DNA, 22 bp, Artificial Sequence
  chemically synthesized
tcctcataataattttgtgact

SEQ ID NO: 1108820 - DNA, 22 bp, Artificial Sequence
  chemically synthesized
gtcctcataataattttgtgac

SEQ ID NO: 1108821 - DNA, 22 bp, Artificial Sequence
  chemically synthesized
tgtttctcaaagtcacaaaatt

SEQ ID NO: 1108822 - DNA, 22 bp, Artificial Sequence
  chemically synthesized
tgtcctcataataattttgtga

SEQ ID NO: 1108823 - DNA, 22 bp, Artificial Sequence
  chemically synthesized
gtttctcaaagtcacaaaatta

SEQ ID NO: 1108824 - DNA, 22 bp, Artificial Sequence
  chemically synthesized
ttgtcctcataataattttgtg

SEQ ID NO: 1108825 - DNA, 22 bp, Artificial Sequence
  chemically synthesized
tttctcaaagtcacaaaattat

SEQ ID NO: 1108826 - DNA, 22 bp, Artificial Sequence
  chemically synthesized
tttgtcctcataataattttgt

SEQ ID NO: 1108827 - DNA, 22 bp, Artificial Sequence
  chemically synthesized
ttttgtcctcataataattttg

SEQ ID NO: 1108828 - DNA, 22 bp, Artificial Sequence
  chemically synthesized
ctcaaagtcacaaaattattat

SEQ ID NO: 1108829 - DNA, 22 bp, Artificial Sequence
  chemically synthesized
tcaaagtcacaaaattattatg

SEQ ID NO: 1108830 - DNA, 22 bp, Artificial Sequence
  chemically synthesized
aaagtcacaaaattattatgag

SEQ ID NO: 1108831 - DNA, 22 bp, Artificial Sequence
  chemically synthesized
tagatttttttgtcctcataat

SEQ ID NO: 1108832 - DNA, 22 bp, Artificial Sequence
  chemically synthesized
tctgtagatttttttgtcctca

SEQ ID NO: 1108833 - DNA, 22 bp, Artificial Sequence
  chemically synthesized
ttatgaggacaaaaaaatctac

SEQ ID NO: 1108834 - DNA, 22 bp, Artificial Sequence
  chemically synthesized
tgaggacaaaaaaatctacaga

SEQ ID NO: 1108835 - DNA, 22 bp, Artificial Sequence
  chemically synthesized
gtgtaacagataagctgtctgt

SEQ ID NO: 1108836 - DNA, 22 bp, Artificial Sequence
  chemically synthesized
cagacagcttatctgttacacc

SEQ ID NO: 1108837 - DNA, 22 bp, Artificial Sequence
  chemically synthesized
acaaggaacgaaatactggtgt

SEQ ID NO: 1108838 - DNA, 22 bp, Artificial Sequence
  chemically synthesized
atctgttacaccagtatttcgt

SEQ ID NO: 1108839 - DNA, 22 bp, Artificial Sequence
  chemically synthesized
tattaacaaggaacgaaatact

SEQ ID NO: 1108840 - DNA, 22 bp, Artificial Sequence
  chemically synthesized
tctgttacaccagtatttcgtt

SEQ ID NO: 1108841 - DNA, 22 bp, Artificial Sequence
  chemically synthesized
ttacaccagtatttcgttcctt

SEQ ID NO: 1108842 - DNA, 22 bp, Artificial Sequence
  chemically synthesized
caacctgtattaacaaggaacg

SEQ ID NO: 1108843 - DNA, 22 bp, Artificial Sequence
  chemically synthesized
caccagtatttcgttccttgtt

SEQ ID NO: 1108844 - DNA, 22 bp, Artificial Sequence
  chemically synthesized
cctacaacctgtattaacaagg

SEQ ID NO: 1108845 - DNA, 22 bp, Artificial Sequence
  chemically synthesized
tccctacaacctgtattaacaa

SEQ ID NO: 1108846 - DNA, 22 bp, Artificial Sequence
  chemically synthesized
cgttccttgttaatacaggttg

SEQ ID NO: 1108847 - DNA, 22 bp, Artificial Sequence
  chemically synthesized
gttccttgttaatacaggttgt

SEQ ID NO: 1108848 - DNA, 22 bp, Artificial Sequence
  chemically synthesized
cttgttaatacaggttgtaggg

SEQ ID NO: 1108849 - DNA, 22 bp, Artificial Sequence
  chemically synthesized
gttaatacaggttgtagggaga

SEQ ID NO: 1108850 - DNA, 22 bp, Artificial Sequence
  chemically synthesized
ttaatacaggttgtagggagaa

SEQ ID NO: 1108851 - DNA, 22 bp, Artificial Sequence
  chemically synthesized
taaatggaaccattctccctac

SEQ ID NO: 1108852 - DNA, 22 bp, Artificial Sequence
  chemically synthesized
tgtaaatggaaccattctccct

SEQ ID NO: 1108853 - DNA, 22 bp, Artificial Sequence
  chemically synthesized
atacaggttgtagggagaatgg

SEQ ID NO: 1108854 - DNA, 22 bp, Artificial Sequence
  chemically synthesized
ctgtaaatggaaccattctccc

SEQ ID NO: 1108855 - DNA, 22 bp, Artificial Sequence
  chemically synthesized
tagggagaatggttccatttac

SEQ ID NO: 1108856 - DNA, 22 bp, Artificial Sequence
  chemically synthesized
acatgaaacaataatttctgta

SEQ ID NO: 1108857 - DNA, 22 bp, Artificial Sequence
  chemically synthesized
catttacagaaattattgtttc

SEQ ID NO: 1108858 - DNA, 22 bp, Artificial Sequence
  chemically synthesized
acagaaattattgtttcatgtt

SEQ ID NO: 1108859 - DNA, 22 bp, Artificial Sequence
  chemically synthesized
cagaaattattgtttcatgtta

SEQ ID NO: 1108860 - DNA, 22 bp, Artificial Sequence
  chemically synthesized
tggggaaatccagaaggtacta

SEQ ID NO: 1108861 - DNA, 22 bp, Artificial Sequence
  chemically synthesized
ttgtttcatgttagtaccttct

SEQ ID NO: 1108862 - DNA, 22 bp, Artificial Sequence
  chemically synthesized
gtggggaaatccagaaggtact

SEQ ID NO: 1108863 - DNA, 22 bp, Artificial Sequence
  chemically synthesized
tttcatgttagtaccttctgga

SEQ ID NO: 1108864 - DNA, 22 bp, Artificial Sequence
  chemically synthesized
tttgtggggaaatccagaaggt

SEQ ID NO: 1108865 - DNA, 22 bp, Artificial Sequence
  chemically synthesized
catgttagtaccttctggattt

SEQ ID NO: 1108866 - DNA, 22 bp, Artificial Sequence
  chemically synthesized
atgttagtaccttctggatttc

SEQ ID NO: 1108867 - DNA, 22 bp, Artificial Sequence
  chemically synthesized
gtaccttctggatttccccaca

SEQ ID NO: 1108868 - DNA, 22 bp, Artificial Sequence
  chemically synthesized
caaaatggttatttgtggggaa

SEQ ID NO: 1108869 - DNA, 22 bp, Artificial Sequence
  chemically synthesized
ccaaaatggttatttgtgggga

SEQ ID NO: 1108870 - DNA, 22 bp, Artificial Sequence
  chemically synthesized
tccaaaatggttatttgtgggg

SEQ ID NO: 1108871 - DNA, 22 bp, Artificial Sequence
  chemically synthesized
ctggatttccccacaaataacc

SEQ ID NO: 1108872 - DNA, 22 bp, Artificial Sequence
  chemically synthesized
tggatttccccacaaataacca

SEQ ID NO: 1108873 - DNA, 22 bp, Artificial Sequence
  chemically synthesized
acattttccaaaatggttattt

SEQ ID NO: 1108874 - DNA, 22 bp, Artificial Sequence
  chemically synthesized
gatttccccacaaataaccatt

SEQ ID NO: 1108875 - DNA, 22 bp, Artificial Sequence
  chemically synthesized
gacattttccaaaatggttatt

SEQ ID NO: 1108876 - DNA, 22 bp, Artificial Sequence
  chemically synthesized
acttgacattttccaaaatggt

SEQ ID NO: 1108877 - DNA, 22 bp, Artificial Sequence
  chemically synthesized
ccccacaaataaccattttgga

SEQ ID NO: 1108878 - DNA, 22 bp, Artificial Sequence
  chemically synthesized
cccacaaataaccattttggaa

SEQ ID NO: 1108879 - DNA, 22 bp, Artificial Sequence
  chemically synthesized
aaatggctaacttgacattttc

SEQ ID NO: 1108880 - DNA, 22 bp, Artificial Sequence
  chemically synthesized
tggaaaatgtcaagttagccat

SEQ ID NO: 1108881 - DNA, 22 bp, Artificial Sequence
  chemically synthesized
ggaaaatgtcaagttagccatt

SEQ ID NO: 1108882 - DNA, 22 bp, Artificial Sequence
  chemically synthesized
gaaaatgtcaagttagccattt

SEQ ID NO: 1108883 - DNA, 22 bp, Artificial Sequence
  chemically synthesized
cagacaagtaagtaaaaagcct

SEQ ID NO: 1108884 - DNA, 22 bp, Artificial Sequence
  chemically synthesized
gccattttaggctttttactta

SEQ ID NO: 1108885 - DNA, 22 bp, Artificial Sequence
  chemically synthesized
taggctttttacttacttgtct

SEQ ID NO: 1108886 - DNA, 22 bp, Artificial Sequence
  chemically synthesized
aggctttttacttacttgtctg

SEQ ID NO: 1108887 - DNA, 22 bp, Artificial Sequence
  chemically synthesized
ggctttttacttacttgtctgt

SEQ ID NO: 1108888 - DNA, 22 bp, Artificial Sequence
  chemically synthesized
tttacttacttgtctgtagctc

SEQ ID NO: 1108889 - DNA, 22 bp, Artificial Sequence
  chemically synthesized
ttacttacttgtctgtagctct

SEQ ID NO: 1108890 - DNA, 22 bp, Artificial Sequence
  chemically synthesized
tacttacttgtctgtagctctt

SEQ ID NO: 1108891 - DNA, 22 bp, Artificial Sequence
  chemically synthesized
acttacttgtctgtagctcttt

SEQ ID NO: 1108892 - DNA, 22 bp, Artificial Sequence
  chemically synthesized
cttacttgtctgtagctctttc

SEQ ID NO: 1108893 - DNA, 22 bp, Artificial Sequence
  chemically synthesized
acttgtctgtagctctttctct

SEQ ID NO: 1108894 - DNA, 22 bp, Artificial Sequence
  chemically synthesized
cttgtctgtagctctttctctc

SEQ ID NO: 1108895 - DNA, 22 bp, Artificial Sequence
  chemically synthesized
atgtgcaggccagagagaaaga

SEQ ID NO: 1108896 - DNA, 22 bp, Artificial Sequence
  chemically synthesized
tgatgtgcaggccagagagaaa

SEQ ID NO: 1108897 - DNA, 22 bp, Artificial Sequence
  chemically synthesized
gtctgtagctctttctctctgg

SEQ ID NO: 1108898 - DNA, 22 bp, Artificial Sequence
  chemically synthesized
ctgatgtgcaggccagagagaa

SEQ ID NO: 1108899 - DNA, 22 bp, Artificial Sequence
  chemically synthesized
tctgtagctctttctctctggc

SEQ ID NO: 1108900 - DNA, 22 bp, Artificial Sequence
  chemically synthesized
tctgatgtgcaggccagagaga

SEQ ID NO: 1108901 - DNA, 22 bp, Artificial Sequence
  chemically synthesized
ttctgatgtgcaggccagagag

SEQ ID NO: 1108902 - DNA, 22 bp, Artificial Sequence
  chemically synthesized
tagctctttctctctggcctgc

SEQ ID NO: 1108903 - DNA, 22 bp, Artificial Sequence
  chemically synthesized
tttctctctggcctgcacatca

SEQ ID NO: 1108904 - DNA, 22 bp, Artificial Sequence
  chemically synthesized
agcaagtcttttctgatgtgca

SEQ ID NO: 1108905 - DNA, 22 bp, Artificial Sequence
  chemically synthesized
tctctctggcctgcacatcaga

SEQ ID NO: 1108906 - DNA, 22 bp, Artificial Sequence
  chemically synthesized
aagcaagtcttttctgatgtgc

SEQ ID NO: 1108907 - DNA, 22 bp, Artificial Sequence
  chemically synthesized
ctctctggcctgcacatcagaa

SEQ ID NO: 1108908 - DNA, 22 bp, Artificial Sequence
  chemically synthesized
taagcaagtcttttctgatgtg

SEQ ID NO: 1108909 - DNA, 22 bp, Artificial Sequence
  chemically synthesized
tctctggcctgcacatcagaaa

SEQ ID NO: 1108910 - DNA, 22 bp, Artificial Sequence
  chemically synthesized
tctggcctgcacatcagaaaag

SEQ ID NO: 1108911 - DNA, 22 bp, Artificial Sequence
  chemically synthesized
tggcctgcacatcagaaaagac

SEQ ID NO: 1108912 - DNA, 22 bp, Artificial Sequence
  chemically synthesized
gcctgcacatcagaaaagactt

SEQ ID NO: 1108913 - DNA, 22 bp, Artificial Sequence
  chemically synthesized
caaatcattttaagcaagtctt

SEQ ID NO: 1108914 - DNA, 22 bp, Artificial Sequence
  chemically synthesized
acaaatcattttaagcaagtct

SEQ ID NO: 1108915 - DNA, 22 bp, Artificial Sequence
  chemically synthesized
cacatcagaaaagacttgctta

SEQ ID NO: 1108916 - DNA, 22 bp, Artificial Sequence
  chemically synthesized
tacaaatcattttaagcaagtc

SEQ ID NO: 1108917 - DNA, 22 bp, Artificial Sequence
  chemically synthesized
tggcctttacaaatcattttaa

SEQ ID NO: 1108918 - DNA, 22 bp, Artificial Sequence
  chemically synthesized
gtggcctttacaaatcatttta

SEQ ID NO: 1108919 - DNA, 22 bp, Artificial Sequence
  chemically synthesized
tgtggcctttacaaatcatttt

SEQ ID NO: 1108920 - DNA, 22 bp, Artificial Sequence
  chemically synthesized
gcttaaaatgatttgtaaaggc

SEQ ID NO: 1108921 - DNA, 22 bp, Artificial Sequence
  chemically synthesized
cttaaaatgatttgtaaaggcc

SEQ ID NO: 1108922 - DNA, 22 bp, Artificial Sequence
  chemically synthesized
gatgcagactttgtggccttta

SEQ ID NO: 1108923 - DNA, 22 bp, Artificial Sequence
  chemically synthesized
aaaatgatttgtaaaggccaca

SEQ ID NO: 1108924 - DNA, 22 bp, Artificial Sequence
  chemically synthesized
aaatgatttgtaaaggccacaa

SEQ ID NO: 1108925 - DNA, 22 bp, Artificial Sequence
  chemically synthesized
ctggatgcagactttgtggcct

SEQ ID NO: 1108926 - DNA, 22 bp, Artificial Sequence
  chemically synthesized
gtaaaggccacaaagtctgcat

SEQ ID NO: 1108927 - DNA, 22 bp, Artificial Sequence
  chemically synthesized
taaaggccacaaagtctgcatc

SEQ ID NO: 1108928 - DNA, 22 bp, Artificial Sequence
  chemically synthesized
catccaggaacatgggtccttg

SEQ ID NO: 1108929 - DNA, 22 bp, Artificial Sequence
  chemically synthesized
aaagagaaaggacaaggaccca

SEQ ID NO: 1108930 - DNA, 22 bp, Artificial Sequence
  chemically synthesized
aaagcatagccctgaaagagaa

SEQ ID NO: 1108931 - DNA, 22 bp, Artificial Sequence
  chemically synthesized
gtcctttctctttcagggctat

SEQ ID NO: 1108932 - DNA, 22 bp, Artificial Sequence
  chemically synthesized
aaaattcaaagcatagccctga

SEQ ID NO: 1108933 - DNA, 22 bp, Artificial Sequence
  chemically synthesized
tcctttctctttcagggctatg

SEQ ID NO: 1108934 - DNA, 22 bp, Artificial Sequence
  chemically synthesized
tctctttcagggctatgctttg

SEQ ID NO: 1108935 - DNA, 22 bp, Artificial Sequence
  chemically synthesized
ctctttcagggctatgctttga

SEQ ID NO: 1108936 - DNA, 22 bp, Artificial Sequence
  chemically synthesized
tctttcagggctatgctttgaa

SEQ ID NO: 1108937 - DNA, 22 bp, Artificial Sequence
  chemically synthesized
aacgattaaaaattcaaagcat

SEQ ID NO: 1108938 - DNA, 22 bp, Artificial Sequence
  chemically synthesized
tttcagggctatgctttgaatt

SEQ ID NO: 1108939 - DNA, 22 bp, Artificial Sequence
  chemically synthesized
tcagggctatgctttgaatttt

SEQ ID NO: 1108940 - DNA, 22 bp, Artificial Sequence
  chemically synthesized
cagggctatgctttgaattttt

SEQ ID NO: 1108941 - DNA, 22 bp, Artificial Sequence
  chemically synthesized
agggctatgctttgaattttta

SEQ ID NO: 1108942 - DNA, 22 bp, Artificial Sequence
  chemically synthesized
aaattgaacgattaaaaattca

SEQ ID NO: 1108943 - DNA, 22 bp, Artificial Sequence
  chemically synthesized
aacctcaaattgaacgattaaa

SEQ ID NO: 1108944 - DNA, 22 bp, Artificial Sequence
  chemically synthesized
tgctttgaatttttaatcgttc

SEQ ID NO: 1108945 - DNA, 22 bp, Artificial Sequence
  chemically synthesized
caacctcaaattgaacgattaa

SEQ ID NO: 1108946 - DNA, 22 bp, Artificial Sequence
  chemically synthesized
tgaatttttaatcgttcaattt

SEQ ID NO: 1108947 - DNA, 22 bp, Artificial Sequence
  chemically synthesized
gaatttttaatcgttcaatttg

SEQ ID NO: 1108948 - DNA, 22 bp, Artificial Sequence
  chemically synthesized
aatttttaatcgttcaatttga

SEQ ID NO: 1108949 - DNA, 22 bp, Artificial Sequence
  chemically synthesized
tcaggtcttcaacctcaaattg

SEQ ID NO: 1108950 - DNA, 22 bp, Artificial Sequence
  chemically synthesized
ttaatcgttcaatttgaggttg

SEQ ID NO: 1108951 - DNA, 22 bp, Artificial Sequence
  chemically synthesized
taatcgttcaatttgaggttga

SEQ ID NO: 1108952 - DNA, 22 bp, Artificial Sequence
  chemically synthesized
aatcgttcaatttgaggttgaa

SEQ ID NO: 1108953 - DNA, 22 bp, Artificial Sequence
  chemically synthesized
atcgttcaatttgaggttgaag

SEQ ID NO: 1108954 - DNA, 22 bp, Artificial Sequence
  chemically synthesized
aatttgaggttgaagacctgat

SEQ ID NO: 1108955 - DNA, 22 bp, Artificial Sequence
  chemically synthesized
gaggttgaagacctgatagccg

SEQ ID NO: 1108956 - DNA, 22 bp, Artificial Sequence
  chemically synthesized
aggttgaagacctgatagccgg

SEQ ID NO: 1108957 - DNA, 22 bp, Artificial Sequence
  chemically synthesized
aagacctgatagccggttgact

SEQ ID NO: 1108958 - DNA, 22 bp, Artificial Sequence
  chemically synthesized
tggcacaggatgaagtcaaccg

SEQ ID NO: 1108959 - DNA, 22 bp, Artificial Sequence
  chemically synthesized
tatggcacaggatgaagtcaac

SEQ ID NO: 1108960 - DNA, 22 bp, Artificial Sequence
  chemically synthesized
atagccggttgacttcatcctg

SEQ ID NO: 1108961 - DNA, 22 bp, Artificial Sequence
  chemically synthesized
catactctatggcacaggatga

SEQ ID NO: 1108962 - DNA, 22 bp, Artificial Sequence
  chemically synthesized
ccatactctatggcacaggatg

SEQ ID NO: 1108963 - DNA, 22 bp, Artificial Sequence
  chemically synthesized
tccatactctatggcacaggat

SEQ ID NO: 1108964 - DNA, 22 bp, Artificial Sequence
  chemically synthesized
ctttccatactctatggcacag

SEQ ID NO: 1108965 - DNA, 22 bp, Artificial Sequence
  chemically synthesized
actttccatactctatggcaca

SEQ ID NO: 1108966 - DNA, 22 bp, Artificial Sequence
  chemically synthesized
acttcatcctgtgccatagagt

SEQ ID NO: 1108967 - DNA, 22 bp, Artificial Sequence
  chemically synthesized
cttactttccatactctatggc

SEQ ID NO: 1108968 - DNA, 22 bp, Artificial Sequence
  chemically synthesized
catcctgtgccatagagtatgg

SEQ ID NO: 1108969 - DNA, 22 bp, Artificial Sequence
  chemically synthesized
atcctgtgccatagagtatgga

SEQ ID NO: 1108970 - DNA, 22 bp, Artificial Sequence
  chemically synthesized
tgccatagagtatggaaagtaa

SEQ ID NO: 1108971 - DNA, 22 bp, Artificial Sequence
  chemically synthesized
caaaatgtaatgtatgcaaagt

SEQ ID NO: 1108972 - DNA, 22 bp, Artificial Sequence
  chemically synthesized
gcaaaatgtaatgtatgcaaag

SEQ ID NO: 1108973 - DNA, 22 bp, Artificial Sequence
  chemically synthesized
tgcaaaatgtaatgtatgcaaa

SEQ ID NO: 1108974 - DNA, 22 bp, Artificial Sequence
  chemically synthesized
ttgcaaaatgtaatgtatgcaa

SEQ ID NO: 1108975 - DNA, 22 bp, Artificial Sequence
  chemically synthesized
ttttgcaaaatgtaatgtatgc

SEQ ID NO: 1108976 - DNA, 22 bp, Artificial Sequence
  chemically synthesized
cttttgcaaaatgtaatgtatg

SEQ ID NO: 1108977 - DNA, 22 bp, Artificial Sequence
  chemically synthesized
actttgcatacattacattttg

SEQ ID NO: 1108978 - DNA, 22 bp, Artificial Sequence
  chemically synthesized
ctttgcatacattacattttgc

SEQ ID NO: 1108979 - DNA, 22 bp, Artificial Sequence
  chemically synthesized
ataccttcttttgcaaaatgta

SEQ ID NO: 1108980 - DNA, 22 bp, Artificial Sequence
  chemically synthesized
aataccttcttttgcaaaatgt

SEQ ID NO: 1108981 - DNA, 22 bp, Artificial Sequence
  chemically synthesized
taataccttcttttgcaaaatg

SEQ ID NO: 1108982 - DNA, 22 bp, Artificial Sequence
  chemically synthesized
tgcatacattacattttgcaaa

SEQ ID NO: 1108983 - DNA, 22 bp, Artificial Sequence
  chemically synthesized
ttaataccttcttttgcaaaat

SEQ ID NO: 1108984 - DNA, 22 bp, Artificial Sequence
  chemically synthesized
gcatacattacattttgcaaaa

SEQ ID NO: 1108985 - DNA, 22 bp, Artificial Sequence
  chemically synthesized
tttaataccttcttttgcaaaa

SEQ ID NO: 1108986 - DNA, 22 bp, Artificial Sequence
  chemically synthesized
catacattacattttgcaaaag

SEQ ID NO: 1108987 - DNA, 22 bp, Artificial Sequence
  chemically synthesized
ctttttaataccttcttttgca

SEQ ID NO: 1108988 - DNA, 22 bp, Artificial Sequence
  chemically synthesized
ctgctttttaataccttctttt

SEQ ID NO: 1108989 - DNA, 22 bp, Artificial Sequence
  chemically synthesized
actgctttttaataccttcttt

SEQ ID NO: 1108990 - DNA, 22 bp, Artificial Sequence
  chemically synthesized
cattttgcaaaagaaggtatta

SEQ ID NO: 1108991 - DNA, 22 bp, Artificial Sequence
  chemically synthesized
ccttactgctttttaatacctt

SEQ ID NO: 1108992 - DNA, 22 bp, Artificial Sequence
  chemically synthesized
gccttactgctttttaatacct

SEQ ID NO: 1108993 - DNA, 22 bp, Artificial Sequence
  chemically synthesized
tgcaaaagaaggtattaaaaag

SEQ ID NO: 1108994 - DNA, 22 bp, Artificial Sequence
  chemically synthesized
gcaaaagaaggtattaaaaagc

SEQ ID NO: 1108995 - DNA, 22 bp, Artificial Sequence
  chemically synthesized
caaaagaaggtattaaaaagca

SEQ ID NO: 1108996 - DNA, 22 bp, Artificial Sequence
  chemically synthesized
aacttgccttactgctttttaa

SEQ ID NO: 1108997 - DNA, 22 bp, Artificial Sequence
  chemically synthesized
agctaaacttgccttactgctt

SEQ ID NO: 1108998 - DNA, 22 bp, Artificial Sequence
  chemically synthesized
aaaagcagtaaggcaagtttag

SEQ ID NO: 1108999 - DNA, 22 bp, Artificial Sequence
  chemically synthesized
tgaagggtattaagctaaactt

SEQ ID NO: 1109000 - DNA, 22 bp, Artificial Sequence
  chemically synthesized
gtgaagggtattaagctaaact

SEQ ID NO: 1109001 - DNA, 22 bp, Artificial Sequence
  chemically synthesized
tcagatatttgtgaagggtatt

SEQ ID NO: 1109002 - DNA, 22 bp, Artificial Sequence
  chemically synthesized
atcagatatttgtgaagggtat

SEQ ID NO: 1109003 - DNA, 22 bp, Artificial Sequence
  chemically synthesized
ttatcagatatttgtgaagggt

SEQ ID NO: 1109004 - DNA, 22 bp, Artificial Sequence
  chemically synthesized
cttatcagatatttgtgaaggg

SEQ ID NO: 1109005 - DNA, 22 bp, Artificial Sequence
  chemically synthesized
agcttaatacccttcacaaata

SEQ ID NO: 1109006 - DNA, 22 bp, Artificial Sequence
  chemically synthesized
gcttaatacccttcacaaatat

SEQ ID NO: 1109007 - DNA, 22 bp, Artificial Sequence
  chemically synthesized
aatacccttcacaaatatctga

SEQ ID NO: 1109008 - DNA, 22 bp, Artificial Sequence
  chemically synthesized
atacccttcacaaatatctgat

SEQ ID NO: 1109009 - DNA, 22 bp, Artificial Sequence
  chemically synthesized
tcatggatgtttcttatcagat

SEQ ID NO: 1109010 - DNA, 22 bp, Artificial Sequence
  chemically synthesized
cacaaatatctgataagaaaca

SEQ ID NO: 1109011 - DNA, 22 bp, Artificial Sequence
  chemically synthesized
tactgtcatggatgtttcttat

SEQ ID NO: 1109012 - DNA, 22 bp, Artificial Sequence
  chemically synthesized
acaaatatctgataagaaacat

SEQ ID NO: 1109013 - DNA, 22 bp, Artificial Sequence
  chemically synthesized
tctatactgtcatggatgtttc

SEQ ID NO: 1109014 - DNA, 22 bp, Artificial Sequence
  chemically synthesized
gtctatactgtcatggatgttt

SEQ ID NO: 1109015 - DNA, 22 bp, Artificial Sequence
  chemically synthesized
ataagaaacatccatgacagta

SEQ ID NO: 1109016 - DNA, 22 bp, Artificial Sequence
  chemically synthesized
gtgatagaggcttgtctatact

SEQ ID NO: 1109017 - DNA, 22 bp, Artificial Sequence
  chemically synthesized
aatgtatggctggtgatagagg

SEQ ID NO: 1109018 - DNA, 22 bp, Artificial Sequence
  chemically synthesized
aaatgtatggctggtgatagag

SEQ ID NO: 1109019 - DNA, 22 bp, Artificial Sequence
  chemically synthesized
tatcaccagccatacatttaag

SEQ ID NO: 1109020 - DNA, 22 bp, Artificial Sequence
  chemically synthesized
tcaccagccatacatttaagga

SEQ ID NO: 1109021 - DNA, 22 bp, Artificial Sequence
  chemically synthesized
aacaaagagccaaggtatcctt

SEQ ID NO: 1109022 - DNA, 22 bp, Artificial Sequence
  chemically synthesized
aaggataccttggctctttgtt

SEQ ID NO: 1109023 - DNA, 22 bp, Artificial Sequence
  chemically synthesized
aggataccttggctctttgttc

SEQ ID NO: 1109024 - DNA, 22 bp, Artificial Sequence
  chemically synthesized
tataggatgatacatattgaac

SEQ ID NO: 1109025 - DNA, 22 bp, Artificial Sequence
  chemically synthesized
ggctctttgttcaatatgtatc

SEQ ID NO: 1109026 - DNA, 22 bp, Artificial Sequence
  chemically synthesized
gctctttgttcaatatgtatca

SEQ ID NO: 1109027 - DNA, 22 bp, Artificial Sequence
  chemically synthesized
tttgttcaatatgtatcatcct

SEQ ID NO: 1109028 - DNA, 22 bp, Artificial Sequence
  chemically synthesized
aatatcattatataggatgata

SEQ ID NO: 1109029 - DNA, 22 bp, Artificial Sequence
  chemically synthesized
tgttcaatatgtatcatcctat

SEQ ID NO: 1109030 - DNA, 22 bp, Artificial Sequence
  chemically synthesized
aaatatcattatataggatgat

SEQ ID NO: 1109031 - DNA, 22 bp, Artificial Sequence
  chemically synthesized
gttcaatatgtatcatcctata

SEQ ID NO: 1109032 - DNA, 22 bp, Artificial Sequence
  chemically synthesized
ttcaatatgtatcatcctatat

SEQ ID NO: 1109033 - DNA, 22 bp, Artificial Sequence
  chemically synthesized
aatatgtatcatcctatataat

SEQ ID NO: 1109034 - DNA, 22 bp, Artificial Sequence
  chemically synthesized
aaatttaaatatcattatatag

SEQ ID NO: 1109035 - DNA, 22 bp, Artificial Sequence
  chemically synthesized
gaaatttaaatatcattatata

SEQ ID NO: 1109036 - DNA, 22 bp, Artificial Sequence
  chemically synthesized
tgtcatcttgaaatttaaatat

SEQ ID NO: 1109037 - DNA, 22 bp, Artificial Sequence
  chemically synthesized
tataatgatatttaaatttcaa

SEQ ID NO: 1109038 - DNA, 22 bp, Artificial Sequence
  chemically synthesized
aattatgtcatcttgaaattta

SEQ ID NO: 1109039 - DNA, 22 bp, Artificial Sequence
  chemically synthesized
taaattatgtcatcttgaaatt

SEQ ID NO: 1109040 - DNA, 22 bp, Artificial Sequence
  chemically synthesized
atgctctaaattatgtcatctt

SEQ ID NO: 1109041 - DNA, 22 bp, Artificial Sequence
  chemically synthesized
aaatttcaagatgacataattt

SEQ ID NO: 1109042 - DNA, 22 bp, Artificial Sequence
  chemically synthesized
aatttcaagatgacataattta

SEQ ID NO: 1109043 - DNA, 22 bp, Artificial Sequence
  chemically synthesized
atacccattaatgctctaaatt

SEQ ID NO: 1109044 - DNA, 22 bp, Artificial Sequence
  chemically synthesized
caagatgacataatttagagca

SEQ ID NO: 1109045 - DNA, 22 bp, Artificial Sequence
  chemically synthesized
aagatgacataatttagagcat

SEQ ID NO: 1109046 - DNA, 22 bp, Artificial Sequence
  chemically synthesized
tacgcattcatacccattaatg

SEQ ID NO: 1109047 - DNA, 22 bp, Artificial Sequence
  chemically synthesized
cactgtacgcattcatacccat

SEQ ID NO: 1109048 - DNA, 22 bp, Artificial Sequence
  chemically synthesized
ccactgtacgcattcataccca

SEQ ID NO: 1109049 - DNA, 22 bp, Artificial Sequence
  chemically synthesized
tccactgtacgcattcataccc

SEQ ID NO: 1109050 - DNA, 22 bp, Artificial Sequence
  chemically synthesized
agagcattaatgggtatgaatg

SEQ ID NO: 1109051 - DNA, 22 bp, Artificial Sequence
  chemically synthesized
ttccactgtacgcattcatacc

SEQ ID NO: 1109052 - DNA, 22 bp, Artificial Sequence
  chemically synthesized
gagcattaatgggtatgaatgc

SEQ ID NO: 1109053 - DNA, 22 bp, Artificial Sequence
  chemically synthesized
atgggtatgaatgcgtacagtg

SEQ ID NO: 1109054 - DNA, 22 bp, Artificial Sequence
  chemically synthesized
aggtcatgcatagtatttttcc

SEQ ID NO: 1109055 - DNA, 22 bp, Artificial Sequence
  chemically synthesized
aaggtcatgcatagtatttttc

SEQ ID NO: 1109056 - DNA, 22 bp, Artificial Sequence
  chemically synthesized
tggaaaggatttaaggtcatgc

SEQ ID NO: 1109057 - DNA, 22 bp, Artificial Sequence
  chemically synthesized
atggaaaggatttaaggtcatg

SEQ ID NO: 1109058 - DNA, 22 bp, Artificial Sequence
  chemically synthesized
atttatggaaaggatttaaggt

SEQ ID NO: 1109059 - DNA, 22 bp, Artificial Sequence
  chemically synthesized
gatttatggaaaggatttaagg

SEQ ID NO: 1109060 - DNA, 22 bp, Artificial Sequence
  chemically synthesized
tgcatgaccttaaatcctttcc

SEQ ID NO: 1109061 - DNA, 22 bp, Artificial Sequence
  chemically synthesized
tatttgatttatggaaaggatt

SEQ ID NO: 1109062 - DNA, 22 bp, Artificial Sequence
  chemically synthesized
aaatcctttccataaatcaaat

SEQ ID NO: 1109063 - DNA, 22 bp, Artificial Sequence
  chemically synthesized
aatcctttccataaatcaaata

SEQ ID NO: 1109064 - DNA, 22 bp, Artificial Sequence
  chemically synthesized
tccataaatcaaatataggtgt

SEQ ID NO: 1109065 - DNA, 22 bp, Artificial Sequence
  chemically synthesized
ccataaatcaaatataggtgtt

SEQ ID NO: 1109066 - DNA, 22 bp, Artificial Sequence
  chemically synthesized
cataaatcaaatataggtgttt

SEQ ID NO: 1109067 - DNA, 22 bp, Artificial Sequence
  chemically synthesized
atataagaggggtgcagccaaa

SEQ ID NO: 1109068 - DNA, 22 bp, Artificial Sequence
  chemically synthesized
gatataagaggggtgcagccaa

SEQ ID NO: 1109069 - DNA, 22 bp, Artificial Sequence
  chemically synthesized
tgatataagaggggtgcagcca

SEQ ID NO: 1109070 - DNA, 22 bp, Artificial Sequence
  chemically synthesized
ggctgcacccctcttatatcaa

SEQ ID NO: 1109071 - DNA, 22 bp, Artificial Sequence
  chemically synthesized
gctgcacccctcttatatcaaa

SEQ ID NO: 1109072 - DNA, 22 bp, Artificial Sequence
  chemically synthesized
cacccctcttatatcaaaatga

SEQ ID NO: 1109073 - DNA, 22 bp, Artificial Sequence
  chemically synthesized
aagcaagcgcacatcattttga

SEQ ID NO: 1109074 - DNA, 22 bp, Artificial Sequence
  chemically synthesized
gaagcaagcgcacatcattttg

SEQ ID NO: 1109075 - DNA, 22 bp, Artificial Sequence
  chemically synthesized
ttatatcaaaatgatgtgcgct

SEQ ID NO: 1109076 - DNA, 22 bp, Artificial Sequence
  chemically synthesized
aaatttgaagcaagcgcacatc

SEQ ID NO: 1109077 - DNA, 22 bp, Artificial Sequence
  chemically synthesized
aaaatttgaagcaagcgcacat

SEQ ID NO: 1109078 - DNA, 22 bp, Artificial Sequence
  chemically synthesized
atatcaaaatgatgtgcgcttg

SEQ ID NO: 1109079 - DNA, 22 bp, Artificial Sequence
  chemically synthesized
tatcaaaatgatgtgcgcttgc

SEQ ID NO: 1109080 - DNA, 22 bp, Artificial Sequence
  chemically synthesized
agtgagcttaaaatttgaagca

SEQ ID NO: 1109081 - DNA, 22 bp, Artificial Sequence
  chemically synthesized
attgagtgagcttaaaatttga

SEQ ID NO: 1109082 - DNA, 22 bp, Artificial Sequence
  chemically synthesized
ttcattgagtgagcttaaaatt

SEQ ID NO: 1109083 - DNA, 22 bp, Artificial Sequence
  chemically synthesized
gcttcaaattttaagctcactc

SEQ ID NO: 1109084 - DNA, 22 bp, Artificial Sequence
  chemically synthesized
cttcaaattttaagctcactca

SEQ ID NO: 1109085 - DNA, 22 bp, Artificial Sequence
  chemically synthesized
caaattttaagctcactcaatg

SEQ ID NO: 1109086 - DNA, 22 bp, Artificial Sequence
  chemically synthesized
aaattttaagctcactcaatga

SEQ ID NO: 1109087 - DNA, 22 bp, Artificial Sequence
  chemically synthesized
taagctcactcaatgaacaata

SEQ ID NO: 1109088 - DNA, 22 bp, Artificial Sequence
  chemically synthesized
aagctcactcaatgaacaatat

SEQ ID NO: 1109089 - DNA, 22 bp, Artificial Sequence
  chemically synthesized
agctcactcaatgaacaatatt

SEQ ID NO: 1109090 - DNA, 22 bp, Artificial Sequence
  chemically synthesized
cagaaatgaaagagaaaatatt

SEQ ID NO: 1109091 - DNA, 22 bp, Artificial Sequence
  chemically synthesized
actcaatgaacaatattttctc

SEQ ID NO: 1109092 - DNA, 22 bp, Artificial Sequence
  chemically synthesized
gcagaaatgaaagagaaaatat

SEQ ID NO: 1109093 - DNA, 22 bp, Artificial Sequence
  chemically synthesized
tgcagaaatgaaagagaaaata

SEQ ID NO: 1109094 - DNA, 22 bp, Artificial Sequence
  chemically synthesized
aatgaacaatattttctctttc

SEQ ID NO: 1109095 - DNA, 22 bp, Artificial Sequence
  chemically synthesized
tattttgcagaaatgaaagaga

SEQ ID NO: 1109096 - DNA, 22 bp, Artificial Sequence
  chemically synthesized
atattttgcagaaatgaaagag

SEQ ID NO: 1109097 - DNA, 22 bp, Artificial Sequence
  chemically synthesized
tctctttcatttctgcaaaata

SEQ ID NO: 1109098 - DNA, 22 bp, Artificial Sequence
  chemically synthesized
ctctttcatttctgcaaaatat

SEQ ID NO: 1109099 - DNA, 22 bp, Artificial Sequence
  chemically synthesized
tctttcatttctgcaaaatata

SEQ ID NO: 1109100 - DNA, 22 bp, Artificial Sequence
  chemically synthesized
tttcatttctgcaaaatataaa

SEQ ID NO: 1109101 - DNA, 22 bp, Artificial Sequence
  chemically synthesized
tcatttctgcaaaatataaatt

SEQ ID NO: 1109102 - DNA, 22 bp, Artificial Sequence
  chemically synthesized
catttctgcaaaatataaatta

SEQ ID NO: 1109103 - DNA, 22 bp, Artificial Sequence
  chemically synthesized
atttctgcaaaatataaattac

SEQ ID NO: 1109104 - DNA, 22 bp, Artificial Sequence
  chemically synthesized
ctgcaaaatataaattacatat

SEQ ID NO: 1109105 - DNA, 22 bp, Artificial Sequence
  chemically synthesized
tgcaaaatataaattacatata

SEQ ID NO: 1109106 - DNA, 22 bp, Artificial Sequence
  chemically synthesized
caaaatataaattacatatata

SEQ ID NO: 1109107 - DNA, 22 bp, Artificial Sequence
  chemically synthesized
catatatacctacatatatgta

SEQ ID NO: 1109108 - DNA, 22 bp, Artificial Sequence
  chemically synthesized
tagtatacacatatacatatat

SEQ ID NO: 1109109 - DNA, 22 bp, Artificial Sequence
  chemically synthesized
taattatagtatacacatatac

SEQ ID NO: 1109110 - DNA, 22 bp, Artificial Sequence
  chemically synthesized
ataattatagtatacacatata

SEQ ID NO: 1109111 - DNA, 22 bp, Artificial Sequence
  chemically synthesized
catatatgtatatgtgtatact

SEQ ID NO: 1109112 - DNA, 22 bp, Artificial Sequence
  chemically synthesized
tatcaaaatatatttataatta

SEQ ID NO: 1109113 - DNA, 22 bp, Artificial Sequence
  chemically synthesized
tataattgtatcaaaatatatt

SEQ ID NO: 1109114 - DNA, 22 bp, Artificial Sequence
  chemically synthesized
taattataaatatattttgata

SEQ ID NO: 1109115 - DNA, 22 bp, Artificial Sequence
  chemically synthesized
taaatatattttgatacaatta

SEQ ID NO: 1109116 - DNA, 22 bp, Artificial Sequence
  chemically synthesized
tatgtgtgtatataatctatat

SEQ ID NO: 1109117 - DNA, 22 bp, Artificial Sequence
  chemically synthesized
atatgtgtgtatataatctata

SEQ ID NO: 1109118 - DNA, 22 bp, Artificial Sequence
  chemically synthesized
tgatacaattatatagattata

SEQ ID NO: 1109119 - DNA, 22 bp, Artificial Sequence
  chemically synthesized
tatatgtgtgtatataatctat

SEQ ID NO: 1109120 - DNA, 22 bp, Artificial Sequence
  chemically synthesized
gatacaattatatagattatat

SEQ ID NO: 1109121 - DNA, 22 bp, Artificial Sequence
  chemically synthesized
atacaattatatagattatata

SEQ ID NO: 1109122 - DNA, 22 bp, Artificial Sequence
  chemically synthesized
tatagattttatatgtgtgtat

SEQ ID NO: 1109123 - DNA, 22 bp, Artificial Sequence
  chemically synthesized
tatagattatatacacacatat

SEQ ID NO: 1109124 - DNA, 22 bp, Artificial Sequence
  chemically synthesized
tatacacacatataaaatctat

SEQ ID NO: 1109125 - DNA, 22 bp, Artificial Sequence
  chemically synthesized
ggtgtgtacatacatatgtata

SEQ ID NO: 1109126 - DNA, 22 bp, Artificial Sequence
  chemically synthesized
gggtgtgtacatacatatgtat

SEQ ID NO: 1109127 - DNA, 22 bp, Artificial Sequence
  chemically synthesized
tataatacttatacatatgtat

SEQ ID NO: 1109128 - DNA, 22 bp, Artificial Sequence
  chemically synthesized
tatttgggtgtgtacatacata

SEQ ID NO: 1109129 - DNA, 22 bp, Artificial Sequence
  chemically synthesized
atatttgggtgtgtacatacat

SEQ ID NO: 1109130 - DNA, 22 bp, Artificial Sequence
  chemically synthesized
tatatttgggtgtgtacataca

SEQ ID NO: 1109131 - DNA, 22 bp, Artificial Sequence
  chemically synthesized
ttatatttgggtgtgtacatac

SEQ ID NO: 1109132 - DNA, 22 bp, Artificial Sequence
  chemically synthesized
atacatatgtatgtacacaccc

SEQ ID NO: 1109133 - DNA, 22 bp, Artificial Sequence
  chemically synthesized
tacatatgtatgtacacaccca

SEQ ID NO: 1109134 - DNA, 22 bp, Artificial Sequence
  chemically synthesized
tagatatatttttatatttggg

SEQ ID NO: 1109135 - DNA, 22 bp, Artificial Sequence
  chemically synthesized
taatcttctatgttttgtatgg

SEQ ID NO: 1109136 - DNA, 22 bp, Artificial Sequence
  chemically synthesized
ctatgttttgtatggtctcatt

SEQ ID NO: 1109137 - DNA, 22 bp, Artificial Sequence
  chemically synthesized
gtcaggagaagtaatgagacca

SEQ ID NO: 1109138 - DNA, 22 bp, Artificial Sequence
  chemically synthesized
tatgttttgtatggtctcatta

SEQ ID NO: 1109139 - DNA, 22 bp, Artificial Sequence
  chemically synthesized
ggtcaggagaagtaatgagacc

SEQ ID NO: 1109140 - DNA, 22 bp, Artificial Sequence
  chemically synthesized
tgttttgtatggtctcattact

SEQ ID NO: 1109141 - DNA, 22 bp, Artificial Sequence
  chemically synthesized
tttggtcaggagaagtaatgag

SEQ ID NO: 1109142 - DNA, 22 bp, Artificial Sequence
  chemically synthesized
tgtatggtctcattacttctcc

SEQ ID NO: 1109143 - DNA, 22 bp, Artificial Sequence
  chemically synthesized
cctgtttggtcaggagaagtaa

SEQ ID NO: 1109144 - DNA, 22 bp, Artificial Sequence
  chemically synthesized
gtatggtctcattacttctcct

SEQ ID NO: 1109145 - DNA, 22 bp, Artificial Sequence
  chemically synthesized
tatggtctcattacttctcctg

SEQ ID NO: 1109146 - DNA, 22 bp, Artificial Sequence
  chemically synthesized
attacttctcctgaccaaacag

SEQ ID NO: 1109147 - DNA, 22 bp, Artificial Sequence
  chemically synthesized
cttctcctgaccaaacaggcaa

SEQ ID NO: 1109148 - DNA, 22 bp, Artificial Sequence
  chemically synthesized
ctcctgaccaaacaggcaacca

SEQ ID NO: 1109149 - DNA, 22 bp, Artificial Sequence
  chemically synthesized
tcctgaccaaacaggcaaccac

SEQ ID NO: 1109150 - DNA, 22 bp, Artificial Sequence
  chemically synthesized
ctgaccaaacaggcaaccactg

SEQ ID NO: 1109151 - DNA, 22 bp, Artificial Sequence
  chemically synthesized
accaaacaggcaaccactgctt

SEQ ID NO: 1109152 - DNA, 22 bp, Artificial Sequence
  chemically synthesized
tcccaaaaaaaaaaaaaaaaaa

SEQ ID NO: 1109153 - DNA, 22 bp, Artificial Sequence
  chemically synthesized
tgtcccaaaaaaaaaaaaaaaa

SEQ ID NO: 1109154 - DNA, 22 bp, Artificial Sequence
  chemically synthesized
cttttttttttttttttttttt

SEQ ID NO: 1109155 - DNA, 22 bp, Artificial Sequence
  chemically synthesized
tttttttttttttttttttttt

SEQ ID NO: 1109156 - DNA, 22 bp, Artificial Sequence
  chemically synthesized
tttttttttttttttttttttt

SEQ ID NO: 1109157 - DNA, 22 bp, Artificial Sequence
  chemically synthesized
tttttttttttttttttttttt

SEQ ID NO: 1109158 - DNA, 22 bp, Artificial Sequence
  chemically synthesized
tttttttttttttttttttttg

SEQ ID NO: 1109159 - DNA, 22 bp, Artificial Sequence
  chemically synthesized
ttttttttttttttttttttgg

SEQ ID NO: 1109160 - DNA, 22 bp, Artificial Sequence
  chemically synthesized
tttttttttttttttttttggg

SEQ ID NO: 1109161 - DNA, 22 bp, Artificial Sequence
  chemically synthesized
ttttttttttttttttttggga

SEQ ID NO: 1109162 - DNA, 22 bp, Artificial Sequence
  chemically synthesized
tttttttttttttttttgggac

SEQ ID NO: 1109163 - DNA, 22 bp, Artificial Sequence
  chemically synthesized
ttttttttttttttttgggaca

SEQ ID NO: 1109164 - DNA, 22 bp, Artificial Sequence
  chemically synthesized
tttttttttttttttgggacag

SEQ ID NO: 1109165 - DNA, 22 bp, Artificial Sequence
  chemically synthesized
ttttttttttttttgggacaga

SEQ ID NO: 1109166 - DNA, 22 bp, Artificial Sequence
  chemically synthesized
tttttttttttttgggacagag

SEQ ID NO: 1109167 - DNA, 22 bp, Artificial Sequence
  chemically synthesized
ttttttttttttgggacagagt

SEQ ID NO: 1109168 - DNA, 22 bp, Artificial Sequence
  chemically synthesized
tttttttttttgggacagagtc

SEQ ID NO: 1109169 - DNA, 22 bp, Artificial Sequence
  chemically synthesized
ttttttttttgggacagagtct

SEQ ID NO: 1109170 - DNA, 22 bp, Artificial Sequence
  chemically synthesized
tttttttttgggacagagtctc

SEQ ID NO: 1109171 - DNA, 22 bp, Artificial Sequence
  chemically synthesized
ggcaacaagagcgagactctgt

SEQ ID NO: 1109172 - DNA, 22 bp, Artificial Sequence
  chemically synthesized
ttttttttgggacagagtctcg

SEQ ID NO: 1109173 - DNA, 22 bp, Artificial Sequence
  chemically synthesized
tttttttgggacagagtctcgc

SEQ ID NO: 1109174 - DNA, 22 bp, Artificial Sequence
  chemically synthesized
ttttttgggacagagtctcgct

SEQ ID NO: 1109175 - DNA, 22 bp, Artificial Sequence
  chemically synthesized
tttttgggacagagtctcgctc

SEQ ID NO: 1109176 - DNA, 22 bp, Artificial Sequence
  chemically synthesized
ttttgggacagagtctcgctct

SEQ ID NO: 1109177 - DNA, 22 bp, Artificial Sequence
  chemically synthesized
tttgggacagagtctcgctctt

SEQ ID NO: 1109178 - DNA, 22 bp, Artificial Sequence
  chemically synthesized
ttgggacagagtctcgctcttg

SEQ ID NO: 1109179 - DNA, 22 bp, Artificial Sequence
  chemically synthesized
cagcctgggcaacaagagcgag

SEQ ID NO: 1109180 - DNA, 22 bp, Artificial Sequence
  chemically synthesized
tgggacagagtctcgctcttgt

SEQ ID NO: 1109181 - DNA, 22 bp, Artificial Sequence
  chemically synthesized
gggacagagtctcgctcttgtt

SEQ ID NO: 1109182 - DNA, 22 bp, Artificial Sequence
  chemically synthesized
ggacagagtctcgctcttgttg

SEQ ID NO: 1109183 - DNA, 22 bp, Artificial Sequence
  chemically synthesized
cactccagcctgggcaacaaga

SEQ ID NO: 1109184 - DNA, 22 bp, Artificial Sequence
  chemically synthesized
gctcttgttgcccaggctggag

SEQ ID NO: 1109185 - DNA, 22 bp, Artificial Sequence
  chemically synthesized
ttgttgcccaggctggagtgca

SEQ ID NO: 1109186 - DNA, 22 bp, Artificial Sequence
  chemically synthesized
gttgcccaggctggagtgcaat

SEQ ID NO: 1109187 - DNA, 22 bp, Artificial Sequence
  chemically synthesized
ttgcccaggctggagtgcaatg

SEQ ID NO: 1109188 - DNA, 22 bp, Artificial Sequence
  chemically synthesized
gccaagatcgcgtcattgcact

SEQ ID NO: 1109189 - DNA, 22 bp, Artificial Sequence
  chemically synthesized
ggccaagatcgcgtcattgcac

SEQ ID NO: 1109190 - DNA, 22 bp, Artificial Sequence
  chemically synthesized
cccaggctggagtgcaatgacg

SEQ ID NO: 1109191 - DNA, 22 bp, Artificial Sequence
  chemically synthesized
catttggccaagatcgcgtcat

SEQ ID NO: 1109192 - DNA, 22 bp, Artificial Sequence
  chemically synthesized
gagtgcaatgacgcgatcttgg

SEQ ID NO: 1109193 - DNA, 22 bp, Artificial Sequence
  chemically synthesized
gaatgtgaaggttgcatttggc

SEQ ID NO: 1109194 - DNA, 22 bp, Artificial Sequence
  chemically synthesized
aacctggaatgtgaaggttgca

SEQ ID NO: 1109195 - DNA, 22 bp, Artificial Sequence
  chemically synthesized
gaacctggaatgtgaaggttgc

SEQ ID NO: 1109196 - DNA, 22 bp, Artificial Sequence
  chemically synthesized
ggccaaatgcaaccttcacatt

SEQ ID NO: 1109197 - DNA, 22 bp, Artificial Sequence
  chemically synthesized
gccaaatgcaaccttcacattc

SEQ ID NO: 1109198 - DNA, 22 bp, Artificial Sequence
  chemically synthesized
aggcagaagaatcgcttgaacc

SEQ ID NO: 1109199 - DNA, 22 bp, Artificial Sequence
  chemically synthesized
cacattccaggttcaagcgatt

SEQ ID NO: 1109200 - DNA, 22 bp, Artificial Sequence
  chemically synthesized
acattccaggttcaagcgattc

SEQ ID NO: 1109201 - DNA, 22 bp, Artificial Sequence
  chemically synthesized
aggaggctgaggcagaagaatc

SEQ ID NO: 1109202 - DNA, 22 bp, Artificial Sequence
  chemically synthesized
caggttcaagcgattcttctgc

SEQ ID NO: 1109203 - DNA, 22 bp, Artificial Sequence
  chemically synthesized
ctcaggaggctgaggcagaaga

SEQ ID NO: 1109204 - DNA, 22 bp, Artificial Sequence
  chemically synthesized
aagcgattcttctgcctcagcc

SEQ ID NO: 1109205 - DNA, 22 bp, Artificial Sequence
  chemically synthesized
taatcccagctactcaggaggc

SEQ ID NO: 1109206 - DNA, 22 bp, Artificial Sequence
  chemically synthesized
ttctgcctcagcctcctgagta

SEQ ID NO: 1109207 - DNA, 22 bp, Artificial Sequence
  chemically synthesized
ctgcctcagcctcctgagtagc

SEQ ID NO: 1109208 - DNA, 22 bp, Artificial Sequence
  chemically synthesized
tgcctcagcctcctgagtagct

SEQ ID NO: 1109209 - DNA, 22 bp, Artificial Sequence
  chemically synthesized
cctcagcctcctgagtagctgg

SEQ ID NO: 1109210 - DNA, 22 bp, Artificial Sequence
  chemically synthesized
agcctcctgagtagctgggatt

SEQ ID NO: 1109211 - DNA, 22 bp, Artificial Sequence
  chemically synthesized
ctgagtagctgggattacaggt

SEQ ID NO: 1109212 - DNA, 22 bp, Artificial Sequence
  chemically synthesized
agtagctgggattacaggtgcc

SEQ ID NO: 1109213 - DNA, 22 bp, Artificial Sequence
  chemically synthesized
gacacggtagcgggcacctgta

SEQ ID NO: 1109214 - DNA, 22 bp, Artificial Sequence
  chemically synthesized
ctggacacggtagcgggcacct

SEQ ID NO: 1109215 - DNA, 22 bp, Artificial Sequence
  chemically synthesized
gctggacacggtagcgggcacc

SEQ ID NO: 1109216 - DNA, 22 bp, Artificial Sequence
  chemically synthesized
ggattacaggtgcccgctaccg

SEQ ID NO: 1109217 - DNA, 22 bp, Artificial Sequence
  chemically synthesized
caggtgcccgctaccgtgtcca

SEQ ID NO: 1109218 - DNA, 22 bp, Artificial Sequence
  chemically synthesized
aaaataaaaaaaatttgctgga

SEQ ID NO: 1109219 - DNA, 22 bp, Artificial Sequence
  chemically synthesized
ctaaaaataaaaaaaatttgct

SEQ ID NO: 1109220 - DNA, 22 bp, Artificial Sequence
  chemically synthesized
tactaaaaataaaaaaaatttg

SEQ ID NO: 1109221 - DNA, 22 bp, Artificial Sequence
  chemically synthesized
ccgtgtccagcaaatttttttt

SEQ ID NO: 1109222 - DNA, 22 bp, Artificial Sequence
  chemically synthesized
catctctactaaaaataaaaaa

SEQ ID NO: 1109223 - DNA, 22 bp, Artificial Sequence
  chemically synthesized
tttttatttttagtagagatgg

SEQ ID NO: 1109224 - DNA, 22 bp, Artificial Sequence
  chemically synthesized
ttttatttttagtagagatgga

SEQ ID NO: 1109225 - DNA, 22 bp, Artificial Sequence
  chemically synthesized
tttatttttagtagagatggag

SEQ ID NO: 1109226 - DNA, 22 bp, Artificial Sequence
  chemically synthesized
ttatttttagtagagatggagt

SEQ ID NO: 1109227 - DNA, 22 bp, Artificial Sequence
  chemically synthesized
gccaacagtgaaactccatctc

SEQ ID NO: 1109228 - DNA, 22 bp, Artificial Sequence
  chemically synthesized
tatttttagtagagatggagtt

SEQ ID NO: 1109229 - DNA, 22 bp, Artificial Sequence
  chemically synthesized
atttttagtagagatggagttt

SEQ ID NO: 1109230 - DNA, 22 bp, Artificial Sequence
  chemically synthesized
tttttagtagagatggagtttc

SEQ ID NO: 1109231 - DNA, 22 bp, Artificial Sequence
  chemically synthesized
ttagtagagatggagtttcact

SEQ ID NO: 1109232 - DNA, 22 bp, Artificial Sequence
  chemically synthesized
tagtagagatggagtttcactg

SEQ ID NO: 1109233 - DNA, 22 bp, Artificial Sequence
  chemically synthesized
agtagagatggagtttcactgt

SEQ ID NO: 1109234 - DNA, 22 bp, Artificial Sequence
  chemically synthesized
gtagagatggagtttcactgtt

SEQ ID NO: 1109235 - DNA, 22 bp, Artificial Sequence
  chemically synthesized
agaccagcctggccaacagtga

SEQ ID NO: 1109236 - DNA, 22 bp, Artificial Sequence
  chemically synthesized
gagaccagcctggccaacagtg

SEQ ID NO: 1109237 - DNA, 22 bp, Artificial Sequence
  chemically synthesized
cactgttggccaggctggtctc

SEQ ID NO: 1109238 - DNA, 22 bp, Artificial Sequence
  chemically synthesized
actgttggccaggctggtctca

SEQ ID NO: 1109239 - DNA, 22 bp, Artificial Sequence
  chemically synthesized
ttggccaggctggtctcaaact

SEQ ID NO: 1109240 - DNA, 22 bp, Artificial Sequence
  chemically synthesized
gccaggctggtctcaaactgct

SEQ ID NO: 1109241 - DNA, 22 bp, Artificial Sequence
  chemically synthesized
gtctcaaactgctgacctcatg

SEQ ID NO: 1109242 - DNA, 22 bp, Artificial Sequence
  chemically synthesized
aaactgctgacctcatgatcca

SEQ ID NO: 1109243 - DNA, 22 bp, Artificial Sequence
  chemically synthesized
ggaggccaaggtgggtggatca

SEQ ID NO: 1109244 - DNA, 22 bp, Artificial Sequence
  chemically synthesized
gggaggccaaggtgggtggatc

SEQ ID NO: 1109245 - DNA, 22 bp, Artificial Sequence
  chemically synthesized
tgggaggccaaggtgggtggat

SEQ ID NO: 1109246 - DNA, 22 bp, Artificial Sequence
  chemically synthesized
ctgacctcatgatccacccacc

SEQ ID NO: 1109247 - DNA, 22 bp, Artificial Sequence
  chemically synthesized
acctcatgatccacccaccttg

SEQ ID NO: 1109248 - DNA, 22 bp, Artificial Sequence
  chemically synthesized
atgatccacccaccttggcctc

SEQ ID NO: 1109249 - DNA, 22 bp, Artificial Sequence
  chemically synthesized
taatcccagcactttgggaggc

SEQ ID NO: 1109250 - DNA, 22 bp, Artificial Sequence
  chemically synthesized
acacctgtaatcccagcacttt

SEQ ID NO: 1109251 - DNA, 22 bp, Artificial Sequence
  chemically synthesized
ggcctcccaaagtgctgggatt

SEQ ID NO: 1109252 - DNA, 22 bp, Artificial Sequence
  chemically synthesized
gcctcccaaagtgctgggatta

SEQ ID NO: 1109253 - DNA, 22 bp, Artificial Sequence
  chemically synthesized
ccaaagtgctgggattacaggt

SEQ ID NO: 1109254 - DNA, 22 bp, Artificial Sequence
  chemically synthesized
ggcgcggtggctcacacctgta

SEQ ID NO: 1109255 - DNA, 22 bp, Artificial Sequence
  chemically synthesized
gctgggcgcggtggctcacacc

SEQ ID NO: 1109256 - DNA, 22 bp, Artificial Sequence
  chemically synthesized
ggattacaggtgtgagccaccg

SEQ ID NO: 1109257 - DNA, 22 bp, Artificial Sequence
  chemically synthesized
caggtgtgagccaccgcgccca

SEQ ID NO: 1109258 - DNA, 22 bp, Artificial Sequence
  chemically synthesized
aaaagtggcaattggctgggcg

SEQ ID NO: 1109259 - DNA, 22 bp, Artificial Sequence
  chemically synthesized
aaaaagtggcaattggctgggc

SEQ ID NO: 1109260 - DNA, 22 bp, Artificial Sequence
  chemically synthesized
gacagccaccgtaatttaaaaa

SEQ ID NO: 1109261 - DNA, 22 bp, Artificial Sequence
  chemically synthesized
ccactttttaaattacggtggc

SEQ ID NO: 1109262 - DNA, 22 bp, Artificial Sequence
  chemically synthesized
tttaaattacggtggctgtcca

SEQ ID NO: 1109263 - DNA, 22 bp, Artificial Sequence
  chemically synthesized
ttaaattacggtggctgtccag

SEQ ID NO: 1109264 - DNA, 22 bp, Artificial Sequence
  chemically synthesized
taaattacggtggctgtccagg

SEQ ID NO: 1109265 - DNA, 22 bp, Artificial Sequence
  chemically synthesized
aaattacggtggctgtccaggt

SEQ ID NO: 1109266 - DNA, 22 bp, Artificial Sequence
  chemically synthesized
aattacggtggctgtccaggtt

SEQ ID NO: 1109267 - DNA, 22 bp, Artificial Sequence
  chemically synthesized
cggtggctgtccaggtttcctc

SEQ ID NO: 1109268 - DNA, 22 bp, Artificial Sequence
  chemically synthesized
tgccaggacaacaagaggaaac

SEQ ID NO: 1109269 - DNA, 22 bp, Artificial Sequence
  chemically synthesized
tccaggtttcctcttgttgtcc

SEQ ID NO: 1109270 - DNA, 22 bp, Artificial Sequence
  chemically synthesized
ataattatgccaggacaacaag

SEQ ID NO: 1109271 - DNA, 22 bp, Artificial Sequence
  chemically synthesized
ctaataattatgccaggacaac

SEQ ID NO: 1109272 - DNA, 22 bp, Artificial Sequence
  chemically synthesized
cctcttgttgtcctggcataat

SEQ ID NO: 1109273 - DNA, 22 bp, Artificial Sequence
  chemically synthesized
ctcttgttgtcctggcataatt

SEQ ID NO: 1109274 - DNA, 22 bp, Artificial Sequence
  chemically synthesized
ttgttgtcctggcataattatt

SEQ ID NO: 1109275 - DNA, 22 bp, Artificial Sequence
  chemically synthesized
gttgtcctggcataattattag

SEQ ID NO: 1109276 - DNA, 22 bp, Artificial Sequence
  chemically synthesized
ttgtcctggcataattattagt

SEQ ID NO: 1109277 - DNA, 22 bp, Artificial Sequence
  chemically synthesized
tcctggcataattattagtagc

SEQ ID NO: 1109278 - DNA, 22 bp, Artificial Sequence
  chemically synthesized
agagtgaaacagggtgctacta

SEQ ID NO: 1109279 - DNA, 22 bp, Artificial Sequence
  chemically synthesized
gcataattattagtagcaccct

SEQ ID NO: 1109280 - DNA, 22 bp, Artificial Sequence
  chemically synthesized
ctgagagtgaaacagggtgcta

SEQ ID NO: 1109281 - DNA, 22 bp, Artificial Sequence
  chemically synthesized
ttagtagcaccctgtttcactc

SEQ ID NO: 1109282 - DNA, 22 bp, Artificial Sequence
  chemically synthesized
gtagcaccctgtttcactctca

SEQ ID NO: 1109283 - DNA, 22 bp, Artificial Sequence
  chemically synthesized
tcatacaaaccagggtactact

SEQ ID NO: 1109284 - DNA, 22 bp, Artificial Sequence
  chemically synthesized
atcatacaaaccagggtactac

SEQ ID NO: 1109285 - DNA, 22 bp, Artificial Sequence
  chemically synthesized
tttcactctcagtagtaccctg

SEQ ID NO: 1109286 - DNA, 22 bp, Artificial Sequence
  chemically synthesized
tatcatacaaaccagggtacta

SEQ ID NO: 1109287 - DNA, 22 bp, Artificial Sequence
  chemically synthesized
cactctcagtagtaccctggtt

SEQ ID NO: 1109288 - DNA, 22 bp, Artificial Sequence
  chemically synthesized
actctcagtagtaccctggttt

SEQ ID NO: 1109289 - DNA, 22 bp, Artificial Sequence
  chemically synthesized
tcagtagtaccctggtttgtat

SEQ ID NO: 1109290 - DNA, 22 bp, Artificial Sequence
  chemically synthesized
atgtgattttatcatacaaacc

SEQ ID NO: 1109291 - DNA, 22 bp, Artificial Sequence
  chemically synthesized
agtagtaccctggtttgtatga

SEQ ID NO: 1109292 - DNA, 22 bp, Artificial Sequence
  chemically synthesized
gtttgtatgataaaatcacatg

SEQ ID NO: 1109293 - DNA, 22 bp, Artificial Sequence
  chemically synthesized
gtatgataaaatcacatgaaca

SEQ ID NO: 1109294 - DNA, 22 bp, Artificial Sequence
  chemically synthesized
tatgataaaatcacatgaacac

SEQ ID NO: 1109295 - DNA, 22 bp, Artificial Sequence
  chemically synthesized
gtgacagtacagcagtgttcat

SEQ ID NO: 1109296 - DNA, 22 bp, Artificial Sequence
  chemically synthesized
ccacatgagctagtgacagtac

SEQ ID NO: 1109297 - DNA, 22 bp, Artificial Sequence
  chemically synthesized
ctgtactgtcactagctcatgt

SEQ ID NO: 1109298 - DNA, 22 bp, Artificial Sequence
  chemically synthesized
tactgtcactagctcatgtggc

SEQ ID NO: 1109299 - DNA, 22 bp, Artificial Sequence
  chemically synthesized
aggtgcccagttgccacatgag

SEQ ID NO: 1109300 - DNA, 22 bp, Artificial Sequence
  chemically synthesized
caggtgcccagttgccacatga

SEQ ID NO: 1109301 - DNA, 22 bp, Artificial Sequence
  chemically synthesized
tcactagctcatgtggcaactg

SEQ ID NO: 1109302 - DNA, 22 bp, Artificial Sequence
  chemically synthesized
gctcatgtggcaactgggcacc

SEQ ID NO: 1109303 - DNA, 22 bp, Artificial Sequence
  chemically synthesized
atgtggcaactgggcacctgaa

SEQ ID NO: 1109304 - DNA, 22 bp, Artificial Sequence
  chemically synthesized
gaccagccacatttcaggtgcc

SEQ ID NO: 1109305 - DNA, 22 bp, Artificial Sequence
  chemically synthesized
ggaccagccacatttcaggtgc

SEQ ID NO: 1109306 - DNA, 22 bp, Artificial Sequence
  chemically synthesized
aatttggaccagccacatttca

SEQ ID NO: 1109307 - DNA, 22 bp, Artificial Sequence
  chemically synthesized
ggcacctgaaatgtggctggtc

SEQ ID NO: 1109308 - DNA, 22 bp, Artificial Sequence
  chemically synthesized
atgcatctaaatttggaccagc

SEQ ID NO: 1109309 - DNA, 22 bp, Artificial Sequence
  chemically synthesized
catgcatctaaatttggaccag

SEQ ID NO: 1109310 - DNA, 22 bp, Artificial Sequence
  chemically synthesized
aaatgtggctggtccaaattta

SEQ ID NO: 1109311 - DNA, 22 bp, Artificial Sequence
  chemically synthesized
gtaatttcatgcatctaaattt

SEQ ID NO: 1109312 - DNA, 22 bp, Artificial Sequence
  chemically synthesized
ggtaatttcatgcatctaaatt

SEQ ID NO: 1109313 - DNA, 22 bp, Artificial Sequence
  chemically synthesized
tggtaatttcatgcatctaaat

SEQ ID NO: 1109314 - DNA, 22 bp, Artificial Sequence
  chemically synthesized
gtccaaatttagatgcatgaaa

SEQ ID NO: 1109315 - DNA, 22 bp, Artificial Sequence
  chemically synthesized
aacatattttggtaatttcatg

SEQ ID NO: 1109316 - DNA, 22 bp, Artificial Sequence
  chemically synthesized
agatgcatgaaattaccaaaat

SEQ ID NO: 1109317 - DNA, 22 bp, Artificial Sequence
  chemically synthesized
agaattaaacatattttggtaa

SEQ ID NO: 1109318 - DNA, 22 bp, Artificial Sequence
  chemically synthesized
gatgcatgaaattaccaaaata

SEQ ID NO: 1109319 - DNA, 22 bp, Artificial Sequence
  chemically synthesized
cagaattaaacatattttggta

SEQ ID NO: 1109320 - DNA, 22 bp, Artificial Sequence
  chemically synthesized
atcttcagaattaaacatattt

SEQ ID NO: 1109321 - DNA, 22 bp, Artificial Sequence
  chemically synthesized
aatcttcagaattaaacatatt

SEQ ID NO: 1109322 - DNA, 22 bp, Artificial Sequence
  chemically synthesized
ttaatcttcagaattaaacata

SEQ ID NO: 1109323 - DNA, 22 bp, Artificial Sequence
  chemically synthesized
cttaatcttcagaattaaacat

SEQ ID NO: 1109324 - DNA, 22 bp, Artificial Sequence
  chemically synthesized
tcttaatcttcagaattaaaca

SEQ ID NO: 1109325 - DNA, 22 bp, Artificial Sequence
  chemically synthesized
ttcttaatcttcagaattaaac

SEQ ID NO: 1109326 - DNA, 22 bp, Artificial Sequence
  chemically synthesized
ccaaaatatgtttaattctgaa

SEQ ID NO: 1109327 - DNA, 22 bp, Artificial Sequence
  chemically synthesized
gcttttcttaatcttcagaatt

SEQ ID NO: 1109328 - DNA, 22 bp, Artificial Sequence
  chemically synthesized
agcttttcttaatcttcagaat

SEQ ID NO: 1109329 - DNA, 22 bp, Artificial Sequence
  chemically synthesized
ttagcttttcttaatcttcaga

SEQ ID NO: 1109330 - DNA, 22 bp, Artificial Sequence
  chemically synthesized
tgttcttagcttttcttaatct

SEQ ID NO: 1109331 - DNA, 22 bp, Artificial Sequence
  chemically synthesized
aattctgaagattaagaaaagc

SEQ ID NO: 1109332 - DNA, 22 bp, Artificial Sequence
  chemically synthesized
attctgaagattaagaaaagct

SEQ ID NO: 1109333 - DNA, 22 bp, Artificial Sequence
  chemically synthesized
agattatgttcttagcttttct

SEQ ID NO: 1109334 - DNA, 22 bp, Artificial Sequence
  chemically synthesized
gagattatgttcttagcttttc

SEQ ID NO: 1109335 - DNA, 22 bp, Artificial Sequence
  chemically synthesized
tgagattatgttcttagctttt

SEQ ID NO: 1109336 - DNA, 22 bp, Artificial Sequence
  chemically synthesized
tgaagattaagaaaagctaaga

SEQ ID NO: 1109337 - DNA, 22 bp, Artificial Sequence
  chemically synthesized
aagattaagaaaagctaagaac

SEQ ID NO: 1109338 - DNA, 22 bp, Artificial Sequence
  chemically synthesized
aaaactttgagattatgttctt

SEQ ID NO: 1109339 - DNA, 22 bp, Artificial Sequence
  chemically synthesized
aaaaactttgagattatgttct

SEQ ID NO: 1109340 - DNA, 22 bp, Artificial Sequence
  chemically synthesized
agaaaagctaagaacataatct

SEQ ID NO: 1109341 - DNA, 22 bp, Artificial Sequence
  chemically synthesized
agaacataatctcaaagttttt

SEQ ID NO: 1109342 - DNA, 22 bp, Artificial Sequence
  chemically synthesized
aaagtgtaatcagtatttaaaa

SEQ ID NO: 1109343 - DNA, 22 bp, Artificial Sequence
  chemically synthesized
gaaagtgtaatcagtatttaaa

SEQ ID NO: 1109344 - DNA, 22 bp, Artificial Sequence
  chemically synthesized
tttgaaagtgtaatcagtattt

SEQ ID NO: 1109345 - DNA, 22 bp, Artificial Sequence
  chemically synthesized
aaagtttttaaatactgattac

SEQ ID NO: 1109346 - DNA, 22 bp, Artificial Sequence
  chemically synthesized
ttaaatactgattacactttca

SEQ ID NO: 1109347 - DNA, 22 bp, Artificial Sequence
  chemically synthesized
taaatactgattacactttcaa

SEQ ID NO: 1109348 - DNA, 22 bp, Artificial Sequence
  chemically synthesized
aaatactgattacactttcaaa

SEQ ID NO: 1109349 - DNA, 22 bp, Artificial Sequence
  chemically synthesized
aatactgattacactttcaaat

SEQ ID NO: 1109350 - DNA, 22 bp, Artificial Sequence
  chemically synthesized
atcaaaaatattatttgaaagt

SEQ ID NO: 1109351 - DNA, 22 bp, Artificial Sequence
  chemically synthesized
attcatcaaaaatattatttga

SEQ ID NO: 1109352 - DNA, 22 bp, Artificial Sequence
  chemically synthesized
attacactttcaaataatattt

SEQ ID NO: 1109353 - DNA, 22 bp, Artificial Sequence
  chemically synthesized
acctgattcatcaaaaatatta

SEQ ID NO: 1109354 - DNA, 22 bp, Artificial Sequence
  chemically synthesized
aacctgattcatcaaaaatatt

SEQ ID NO: 1109355 - DNA, 22 bp, Artificial Sequence
  chemically synthesized
cactttcaaataatatttttga

SEQ ID NO: 1109356 - DNA, 22 bp, Artificial Sequence
  chemically synthesized
tttaacctgattcatcaaaaat

SEQ ID NO: 1109357 - DNA, 22 bp, Artificial Sequence
  chemically synthesized
atttaacctgattcatcaaaaa

SEQ ID NO: 1109358 - DNA, 22 bp, Artificial Sequence
  chemically synthesized
tatttaacctgattcatcaaaa

SEQ ID NO: 1109359 - DNA, 22 bp, Artificial Sequence
  chemically synthesized
tcaaataatatttttgatgaat

SEQ ID NO: 1109360 - DNA, 22 bp, Artificial Sequence
  chemically synthesized
caaataatatttttgatgaatc

SEQ ID NO: 1109361 - DNA, 22 bp, Artificial Sequence
  chemically synthesized
aaataatatttttgatgaatca

SEQ ID NO: 1109362 - DNA, 22 bp, Artificial Sequence
  chemically synthesized
aatagtacattttatttaacct

SEQ ID NO: 1109363 - DNA, 22 bp, Artificial Sequence
  chemically synthesized
caatagtacattttatttaacc

SEQ ID NO: 1109364 - DNA, 22 bp, Artificial Sequence
  chemically synthesized
ttgatgaatcaggttaaataaa

SEQ ID NO: 1109365 - DNA, 22 bp, Artificial Sequence
  chemically synthesized
tgatgaatcaggttaaataaaa

SEQ ID NO: 1109366 - DNA, 22 bp, Artificial Sequence
  chemically synthesized
gatgaatcaggttaaataaaat

SEQ ID NO: 1109367 - DNA, 22 bp, Artificial Sequence
  chemically synthesized
atgaatcaggttaaataaaatg

SEQ ID NO: 1109368 - DNA, 22 bp, Artificial Sequence
  chemically synthesized
aatttcaatagtacattttatt

SEQ ID NO: 1109369 - DNA, 22 bp, Artificial Sequence
  chemically synthesized
aataaaatgtactattgaaatt

SEQ ID NO: 1109370 - DNA, 22 bp, Artificial Sequence
  chemically synthesized
ggaaaggaaaaagaaacggtaa

SEQ ID NO: 1109371 - DNA, 22 bp, Artificial Sequence
  chemically synthesized
ttgaaattcaattaccgtttct

SEQ ID NO: 1109372 - DNA, 22 bp, Artificial Sequence
  chemically synthesized
aaattcaattaccgtttctttt

SEQ ID NO: 1109373 - DNA, 22 bp, Artificial Sequence
  chemically synthesized
tattaggaaaggaaaaagaaac

SEQ ID NO: 1109374 - DNA, 22 bp, Artificial Sequence
  chemically synthesized
aattaccgtttctttttccttt

SEQ ID NO: 1109375 - DNA, 22 bp, Artificial Sequence
  chemically synthesized
gaaactatattaggaaaggaaa

SEQ ID NO: 1109376 - DNA, 22 bp, Artificial Sequence
  chemically synthesized
ccgtttctttttcctttcctaa

SEQ ID NO: 1109377 - DNA, 22 bp, Artificial Sequence
  chemically synthesized
ctttttcctttcctaatatagt

SEQ ID NO: 1109378 - DNA, 22 bp, Artificial Sequence
  chemically synthesized
tttttcctttcctaatatagtt

SEQ ID NO: 1109379 - DNA, 22 bp, Artificial Sequence
  chemically synthesized
aaatggtctagaaactatatta

SEQ ID NO: 1109380 - DNA, 22 bp, Artificial Sequence
  chemically synthesized
aaaatggtctagaaactatatt

SEQ ID NO: 1109381 - DNA, 22 bp, Artificial Sequence
  chemically synthesized
tttcctttcctaatatagtttc

SEQ ID NO: 1109382 - DNA, 22 bp, Artificial Sequence
  chemically synthesized
ttcctttcctaatatagtttct

SEQ ID NO: 1109383 - DNA, 22 bp, Artificial Sequence
  chemically synthesized
tcctttcctaatatagtttcta

SEQ ID NO: 1109384 - DNA, 22 bp, Artificial Sequence
  chemically synthesized
cctttcctaatatagtttctag

SEQ ID NO: 1109385 - DNA, 22 bp, Artificial Sequence
  chemically synthesized
ctttcctaatatagtttctaga

SEQ ID NO: 1109386 - DNA, 22 bp, Artificial Sequence
  chemically synthesized
tcctaatatagtttctagacca

SEQ ID NO: 1109387 - DNA, 22 bp, Artificial Sequence
  chemically synthesized
cctaatatagtttctagaccat

SEQ ID NO: 1109388 - DNA, 22 bp, Artificial Sequence
  chemically synthesized
ctaatatagtttctagaccatt

SEQ ID NO: 1109389 - DNA, 22 bp, Artificial Sequence
  chemically synthesized
atatagtttctagaccatttta

SEQ ID NO: 1109390 - DNA, 22 bp, Artificial Sequence
  chemically synthesized
aagccacatatgtaatttaaaa

SEQ ID NO: 1109391 - DNA, 22 bp, Artificial Sequence
  chemically synthesized
ctagaccattttaaattacata

SEQ ID NO: 1109392 - DNA, 22 bp, Artificial Sequence
  chemically synthesized
tagaccattttaaattacatat

SEQ ID NO: 1109393 - DNA, 22 bp, Artificial Sequence
  chemically synthesized
gaccattttaaattacatatgt

SEQ ID NO: 1109394 - DNA, 22 bp, Artificial Sequence
  chemically synthesized
gccacaaattcaagccacatat

SEQ ID NO: 1109395 - DNA, 22 bp, Artificial Sequence
  chemically synthesized
taaattacatatgtggcttgaa

SEQ ID NO: 1109396 - DNA, 22 bp, Artificial Sequence
  chemically synthesized
aaattacatatgtggcttgaat

SEQ ID NO: 1109397 - DNA, 22 bp, Artificial Sequence
  chemically synthesized
aattacatatgtggcttgaatt

SEQ ID NO: 1109398 - DNA, 22 bp, Artificial Sequence
  chemically synthesized
catatgtggcttgaatttgtgg

SEQ ID NO: 1109399 - DNA, 22 bp, Artificial Sequence
  chemically synthesized
tccaaaagaaatacagtgctag

SEQ ID NO: 1109400 - DNA, 22 bp, Artificial Sequence
  chemically synthesized
gaatttgtggctagcactgtat

SEQ ID NO: 1109401 - DNA, 22 bp, Artificial Sequence
  chemically synthesized
aatttgtggctagcactgtatt

SEQ ID NO: 1109402 - DNA, 22 bp, Artificial Sequence
  chemically synthesized
gtggctagcactgtatttcttt

SEQ ID NO: 1109403 - DNA, 22 bp, Artificial Sequence
  chemically synthesized
tggctagcactgtatttctttt

SEQ ID NO: 1109404 - DNA, 22 bp, Artificial Sequence
  chemically synthesized
gcactgtatttcttttggacaa

SEQ ID NO: 1109405 - DNA, 22 bp, Artificial Sequence
  chemically synthesized
tgaagaaagtcattgtccaaaa

SEQ ID NO: 1109406 - DNA, 22 bp, Artificial Sequence
  chemically synthesized
tgtgaagaaagtcattgtccaa

SEQ ID NO: 1109407 - DNA, 22 bp, Artificial Sequence
  chemically synthesized
tatttcttttggacaatgactt

SEQ ID NO: 1109408 - DNA, 22 bp, Artificial Sequence
  chemically synthesized
caattctgtgaagaaagtcatt

SEQ ID NO: 1109409 - DNA, 22 bp, Artificial Sequence
  chemically synthesized
ccaattctgtgaagaaagtcat

SEQ ID NO: 1109410 - DNA, 22 bp, Artificial Sequence
  chemically synthesized
tccaattctgtgaagaaagtca

SEQ ID NO: 1109411 - DNA, 22 bp, Artificial Sequence
  chemically synthesized
cttttggacaatgactttcttc

SEQ ID NO: 1109412 - DNA, 22 bp, Artificial Sequence
  chemically synthesized
ttccaattctgtgaagaaagtc

SEQ ID NO: 1109413 - DNA, 22 bp, Artificial Sequence
  chemically synthesized
ttttggacaatgactttcttca

SEQ ID NO: 1109414 - DNA, 22 bp, Artificial Sequence
  chemically synthesized
tttccaattctgtgaagaaagt

SEQ ID NO: 1109415 - DNA, 22 bp, Artificial Sequence
  chemically synthesized
ttggacaatgactttcttcaca

SEQ ID NO: 1109416 - DNA, 22 bp, Artificial Sequence
  chemically synthesized
tggacaatgactttcttcacag

SEQ ID NO: 1109417 - DNA, 22 bp, Artificial Sequence
  chemically synthesized
ggacaatgactttcttcacaga

SEQ ID NO: 1109418 - DNA, 22 bp, Artificial Sequence
  chemically synthesized
gacaatgactttcttcacagaa

SEQ ID NO: 1109419 - DNA, 22 bp, Artificial Sequence
  chemically synthesized
aagtagttttttccaattctgt

SEQ ID NO: 1109420 - DNA, 22 bp, Artificial Sequence
  chemically synthesized
aaagtagttttttccaattctg

SEQ ID NO: 1109421 - DNA, 22 bp, Artificial Sequence
  chemically synthesized
taaagtagttttttccaattct

SEQ ID NO: 1109422 - DNA, 22 bp, Artificial Sequence
  chemically synthesized
tcttcacagaattggaaaaaac

SEQ ID NO: 1109423 - DNA, 22 bp, Artificial Sequence
  chemically synthesized
cttcacagaattggaaaaaact

SEQ ID NO: 1109424 - DNA, 22 bp, Artificial Sequence
  chemically synthesized
ttcacagaattggaaaaaacta

SEQ ID NO: 1109425 - DNA, 22 bp, Artificial Sequence
  chemically synthesized
cacagaattggaaaaaactact

SEQ ID NO: 1109426 - DNA, 22 bp, Artificial Sequence
  chemically synthesized
acagaattggaaaaaactactt

SEQ ID NO: 1109427 - DNA, 22 bp, Artificial Sequence
  chemically synthesized
catatgaactttaaagtagttt

SEQ ID NO: 1109428 - DNA, 22 bp, Artificial Sequence
  chemically synthesized
gttccatatgaactttaaagta

SEQ ID NO: 1109429 - DNA, 22 bp, Artificial Sequence
  chemically synthesized
ggttccatatgaactttaaagt

SEQ ID NO: 1109430 - DNA, 22 bp, Artificial Sequence
  chemically synthesized
tggttccatatgaactttaaag

SEQ ID NO: 1109431 - DNA, 22 bp, Artificial Sequence
  chemically synthesized
ttggttccatatgaactttaaa

SEQ ID NO: 1109432 - DNA, 22 bp, Artificial Sequence
  chemically synthesized
gaaaaaactactttaaagttca

SEQ ID NO: 1109433 - DNA, 22 bp, Artificial Sequence
  chemically synthesized
tttggttccatatgaactttaa

SEQ ID NO: 1109434 - DNA, 22 bp, Artificial Sequence
  chemically synthesized
ttttggttccatatgaacttta

SEQ ID NO: 1109435 - DNA, 22 bp, Artificial Sequence
  chemically synthesized
ttttttggttccatatgaactt

SEQ ID NO: 1109436 - DNA, 22 bp, Artificial Sequence
  chemically synthesized
ctttaaagttcatatggaacca

SEQ ID NO: 1109437 - DNA, 22 bp, Artificial Sequence
  chemically synthesized
taaagttcatatggaaccaaaa

SEQ ID NO: 1109438 - DNA, 22 bp, Artificial Sequence
  chemically synthesized
aaagttcatatggaaccaaaaa

SEQ ID NO: 1109439 - DNA, 22 bp, Artificial Sequence
  chemically synthesized
aagttcatatggaaccaaaaaa

SEQ ID NO: 1109440 - DNA, 22 bp, Artificial Sequence
  chemically synthesized
gcgatgcgggctcttttttggt

SEQ ID NO: 1109441 - DNA, 22 bp, Artificial Sequence
  chemically synthesized
ggcgatgcgggctcttttttgg

SEQ ID NO: 1109442 - DNA, 22 bp, Artificial Sequence
  chemically synthesized
atatggaaccaaaaaagagccc

SEQ ID NO: 1109443 - DNA, 22 bp, Artificial Sequence
  chemically synthesized
acttggcgatgcgggctctttt

SEQ ID NO: 1109444 - DNA, 22 bp, Artificial Sequence
  chemically synthesized
ggattgacttggcgatgcgggc

SEQ ID NO: 1109445 - DNA, 22 bp, Artificial Sequence
  chemically synthesized
aggattgacttggcgatgcggg

SEQ ID NO: 1109446 - DNA, 22 bp, Artificial Sequence
  chemically synthesized
gcttaggattgacttggcgatg

SEQ ID NO: 1109447 - DNA, 22 bp, Artificial Sequence
  chemically synthesized
ttggcttaggattgacttggcg

SEQ ID NO: 1109448 - DNA, 22 bp, Artificial Sequence
  chemically synthesized
tcctgttggcttaggattgact

SEQ ID NO: 1109449 - DNA, 22 bp, Artificial Sequence
  chemically synthesized
gtcctgttggcttaggattgac

SEQ ID NO: 1109450 - DNA, 22 bp, Artificial Sequence
  chemically synthesized
tgtcctgttggcttaggattga

SEQ ID NO: 1109451 - DNA, 22 bp, Artificial Sequence
  chemically synthesized
cagctttgtcctgttggcttag

SEQ ID NO: 1109452 - DNA, 22 bp, Artificial Sequence
  chemically synthesized
agccaacaggacaaagctggag

SEQ ID NO: 1109453 - DNA, 22 bp, Artificial Sequence
  chemically synthesized
aagtcaggtagtgtgatgcctc

SEQ ID NO: 1109454 - DNA, 22 bp, Artificial Sequence
  chemically synthesized
gaagtcaggtagtgtgatgcct

SEQ ID NO: 1109455 - DNA, 22 bp, Artificial Sequence
  chemically synthesized
gaggcatcacactacctgactt

SEQ ID NO: 1109456 - DNA, 22 bp, Artificial Sequence
  chemically synthesized
tagtatagtttgaagtcaggta

SEQ ID NO: 1109457 - DNA, 22 bp, Artificial Sequence
  chemically synthesized
gtagtatagtttgaagtcaggt

SEQ ID NO: 1109458 - DNA, 22 bp, Artificial Sequence
  chemically synthesized
tagccttgtagtatagtttgaa

SEQ ID NO: 1109459 - DNA, 22 bp, Artificial Sequence
  chemically synthesized
ctgtagccttgtagtatagttt

SEQ ID NO: 1109460 - DNA, 22 bp, Artificial Sequence
  chemically synthesized
cctgacttcaaactatactaca

SEQ ID NO: 1109461 - DNA, 22 bp, Artificial Sequence
  chemically synthesized
gttactgtagccttgtagtata

SEQ ID NO: 1109462 - DNA, 22 bp, Artificial Sequence
  chemically synthesized
ggttactgtagccttgtagtat

SEQ ID NO: 1109463 - DNA, 22 bp, Artificial Sequence
  chemically synthesized
tggttactgtagccttgtagta

SEQ ID NO: 1109464 - DNA, 22 bp, Artificial Sequence
  chemically synthesized
acttcaaactatactacaaggc

SEQ ID NO: 1109465 - DNA, 22 bp, Artificial Sequence
  chemically synthesized
ttttggttactgtagccttgta

SEQ ID NO: 1109466 - DNA, 22 bp, Artificial Sequence
  chemically synthesized
caaactatactacaaggctaca

SEQ ID NO: 1109467 - DNA, 22 bp, Artificial Sequence
  chemically synthesized
aaactatactacaaggctacag

SEQ ID NO: 1109468 - DNA, 22 bp, Artificial Sequence
  chemically synthesized
tactacaaggctacagtaacca

SEQ ID NO: 1109469 - DNA, 22 bp, Artificial Sequence
  chemically synthesized
caaggctacagtaaccaaaaca

SEQ ID NO: 1109470 - DNA, 22 bp, Artificial Sequence
  chemically synthesized
gtaccagtaccatgctgttttg

SEQ ID NO: 1109471 - DNA, 22 bp, Artificial Sequence
  chemically synthesized
ggtaccagtaccatgctgtttt

SEQ ID NO: 1109472 - DNA, 22 bp, Artificial Sequence
  chemically synthesized
tggtaccagtaccatgctgttt

SEQ ID NO: 1109473 - DNA, 22 bp, Artificial Sequence
  chemically synthesized
cagtaaccaaaacagcatggta

SEQ ID NO: 1109474 - DNA, 22 bp, Artificial Sequence
  chemically synthesized
ttttggtaccagtaccatgctg

SEQ ID NO: 1109475 - DNA, 22 bp, Artificial Sequence
  chemically synthesized
tgttttggtaccagtaccatgc

SEQ ID NO: 1109476 - DNA, 22 bp, Artificial Sequence
  chemically synthesized
tatctctgttttggtaccagta

SEQ ID NO: 1109477 - DNA, 22 bp, Artificial Sequence
  chemically synthesized
atctatatctctgttttggtac

SEQ ID NO: 1109478 - DNA, 22 bp, Artificial Sequence
  chemically synthesized
cattgatctatatctctgtttt

SEQ ID NO: 1109479 - DNA, 22 bp, Artificial Sequence
  chemically synthesized
ttccattgatctatatctctgt

SEQ ID NO: 1109480 - DNA, 22 bp, Artificial Sequence
  chemically synthesized
tgttccattgatctatatctct

SEQ ID NO: 1109481 - DNA, 22 bp, Artificial Sequence
  chemically synthesized
gtaccaaaacagagatatagat

SEQ ID NO: 1109482 - DNA, 22 bp, Artificial Sequence
  chemically synthesized
ttctgttccattgatctatatc

SEQ ID NO: 1109483 - DNA, 22 bp, Artificial Sequence
  chemically synthesized
tgttctgttccattgatctata

SEQ ID NO: 1109484 - DNA, 22 bp, Artificial Sequence
  chemically synthesized
agggctctgttctgttccattg

SEQ ID NO: 1109485 - DNA, 22 bp, Artificial Sequence
  chemically synthesized
tgagggctctgttctgttccat

SEQ ID NO: 1109486 - DNA, 22 bp, Artificial Sequence
  chemically synthesized
ctgagggctctgttctgttcca

SEQ ID NO: 1109487 - DNA, 22 bp, Artificial Sequence
  chemically synthesized
tttctgagggctctgttctgtt

SEQ ID NO: 1109488 - DNA, 22 bp, Artificial Sequence
  chemically synthesized
taggtatgcggcgttatttctg

SEQ ID NO: 1109489 - DNA, 22 bp, Artificial Sequence
  chemically synthesized
agaaataacgccgcatacctac

SEQ ID NO: 1109490 - DNA, 22 bp, Artificial Sequence
  chemically synthesized
tcaaagatcagatagttgtagg

SEQ ID NO: 1109491 - DNA, 22 bp, Artificial Sequence
  chemically synthesized
gtcaaagatcagatagttgtag

SEQ ID NO: 1109492 - DNA, 22 bp, Artificial Sequence
  chemically synthesized
tcaggtttgtcaaagatcagat

SEQ ID NO: 1109493 - DNA, 22 bp, Artificial Sequence
  chemically synthesized
gtcaggtttgtcaaagatcaga

SEQ ID NO: 1109494 - DNA, 22 bp, Artificial Sequence
  chemically synthesized
tgtcaggtttgtcaaagatcag

SEQ ID NO: 1109495 - DNA, 22 bp, Artificial Sequence
  chemically synthesized
ttgtcaggtttgtcaaagatca

SEQ ID NO: 1109496 - DNA, 22 bp, Artificial Sequence
  chemically synthesized
tttttgtcaggtttgtcaaaga

SEQ ID NO: 1109497 - DNA, 22 bp, Artificial Sequence
  chemically synthesized
caactatctgatctttgacaaa

SEQ ID NO: 1109498 - DNA, 22 bp, Artificial Sequence
  chemically synthesized
gtttttgtcaggtttgtcaaag

SEQ ID NO: 1109499 - DNA, 22 bp, Artificial Sequence
  chemically synthesized
cttgtttttgtcaggtttgtca

SEQ ID NO: 1109500 - DNA, 22 bp, Artificial Sequence
  chemically synthesized
tctgatctttgacaaacctgac

SEQ ID NO: 1109501 - DNA, 22 bp, Artificial Sequence
  chemically synthesized
atctttgacaaacctgacaaaa

SEQ ID NO: 1109502 - DNA, 22 bp, Artificial Sequence
  chemically synthesized
cccattgcttgtttttgtcagg

SEQ ID NO: 1109503 - DNA, 22 bp, Artificial Sequence
  chemically synthesized
ccccattgcttgtttttgtcag

SEQ ID NO: 1109504 - DNA, 22 bp, Artificial Sequence
  chemically synthesized
tccccattgcttgtttttgtca

SEQ ID NO: 1109505 - DNA, 22 bp, Artificial Sequence
  chemically synthesized
tgacaaacctgacaaaaacaag

SEQ ID NO: 1109506 - DNA, 22 bp, Artificial Sequence
  chemically synthesized
gacaaacctgacaaaaacaagc

SEQ ID NO: 1109507 - DNA, 22 bp, Artificial Sequence
  chemically synthesized
acaaacctgacaaaaacaagca

SEQ ID NO: 1109508 - DNA, 22 bp, Artificial Sequence
  chemically synthesized
acaaaaacaagcaatggggaaa

SEQ ID NO: 1109509 - DNA, 22 bp, Artificial Sequence
  chemically synthesized
aatagggaatcctttccccatt

SEQ ID NO: 1109510 - DNA, 22 bp, Artificial Sequence
  chemically synthesized
ttaaatagggaatcctttcccc

SEQ ID NO: 1109511 - DNA, 22 bp, Artificial Sequence
  chemically synthesized
attaaatagggaatcctttccc

SEQ ID NO: 1109512 - DNA, 22 bp, Artificial Sequence
  chemically synthesized
ccagcaccatttattaaatagg

SEQ ID NO: 1109513 - DNA, 22 bp, Artificial Sequence
  chemically synthesized
cccagcaccatttattaaatag

SEQ ID NO: 1109514 - DNA, 22 bp, Artificial Sequence
  chemically synthesized
tcccagcaccatttattaaata

SEQ ID NO: 1109515 - DNA, 22 bp, Artificial Sequence
  chemically synthesized
gccagttttcccagcaccattt

SEQ ID NO: 1109516 - DNA, 22 bp, Artificial Sequence
  chemically synthesized
cctatttaataaatggtgctgg

SEQ ID NO: 1109517 - DNA, 22 bp, Artificial Sequence
  chemically synthesized
tttaataaatggtgctgggaaa

SEQ ID NO: 1109518 - DNA, 22 bp, Artificial Sequence
  chemically synthesized
aataaatggtgctgggaaaact

SEQ ID NO: 1109519 - DNA, 22 bp, Artificial Sequence
  chemically synthesized
ataaatggtgctgggaaaactg

SEQ ID NO: 1109520 - DNA, 22 bp, Artificial Sequence
  chemically synthesized
catatggctagccagttttccc

SEQ ID NO: 1109521 - DNA, 22 bp, Artificial Sequence
  chemically synthesized
tacatatggctagccagttttc

SEQ ID NO: 1109522 - DNA, 22 bp, Artificial Sequence
  chemically synthesized
ctacatatggctagccagtttt

SEQ ID NO: 1109523 - DNA, 22 bp, Artificial Sequence
  chemically synthesized
tctacatatggctagccagttt

SEQ ID NO: 1109524 - DNA, 22 bp, Artificial Sequence
  chemically synthesized
agctttctacatatggctagcc

SEQ ID NO: 1109525 - DNA, 22 bp, Artificial Sequence
  chemically synthesized
cagctttctacatatggctagc

SEQ ID NO: 1109526 - DNA, 22 bp, Artificial Sequence
  chemically synthesized
ggaaaactggctagccatatgt

SEQ ID NO: 1109527 - DNA, 22 bp, Artificial Sequence
  chemically synthesized
gctagccatatgtagaaagctg

SEQ ID NO: 1109528 - DNA, 22 bp, Artificial Sequence
  chemically synthesized
gccatatgtagaaagctgaaac

SEQ ID NO: 1109529 - DNA, 22 bp, Artificial Sequence
  chemically synthesized
taaggaagggatccagtttcag

SEQ ID NO: 1109530 - DNA, 22 bp, Artificial Sequence
  chemically synthesized
tataagttgtaaggaagggatc

SEQ ID NO: 1109531 - DNA, 22 bp, Artificial Sequence
  chemically synthesized
gtataagttgtaaggaagggat

SEQ ID NO: 1109532 - DNA, 22 bp, Artificial Sequence
  chemically synthesized
tgtataagttgtaaggaaggga

SEQ ID NO: 1109533 - DNA, 22 bp, Artificial Sequence
  chemically synthesized
ttgtataagttgtaaggaaggg

SEQ ID NO: 1109534 - DNA, 22 bp, Artificial Sequence
  chemically synthesized
aaactggatcccttccttacaa

SEQ ID NO: 1109535 - DNA, 22 bp, Artificial Sequence
  chemically synthesized
atttttgtataagttgtaagga

SEQ ID NO: 1109536 - DNA, 22 bp, Artificial Sequence
  chemically synthesized
gatcccttccttacaacttata

SEQ ID NO: 1109537 - DNA, 22 bp, Artificial Sequence
  chemically synthesized
aattgatttttgtataagttgt

SEQ ID NO: 1109538 - DNA, 22 bp, Artificial Sequence
  chemically synthesized
gaattgatttttgtataagttg

SEQ ID NO: 1109539 - DNA, 22 bp, Artificial Sequence
  chemically synthesized
ccttacaacttatacaaaaatc

SEQ ID NO: 1109540 - DNA, 22 bp, Artificial Sequence
  chemically synthesized
cttacaacttatacaaaaatca

SEQ ID NO: 1109541 - DNA, 22 bp, Artificial Sequence
  chemically synthesized
atccatcttgaattgatttttg

SEQ ID NO: 1109542 - DNA, 22 bp, Artificial Sequence
  chemically synthesized
aatccatcttgaattgattttt

SEQ ID NO: 1109543 - DNA, 22 bp, Artificial Sequence
  chemically synthesized
acaacttatacaaaaatcaatt

SEQ ID NO: 1109544 - DNA, 22 bp, Artificial Sequence
  chemically synthesized
taatccatcttgaattgatttt

SEQ ID NO: 1109545 - DNA, 22 bp, Artificial Sequence
  chemically synthesized
caacttatacaaaaatcaattc

SEQ ID NO: 1109546 - DNA, 22 bp, Artificial Sequence
  chemically synthesized
aatctttaatccatcttgaatt

SEQ ID NO: 1109547 - DNA, 22 bp, Artificial Sequence
  chemically synthesized
atacaaaaatcaattcaagatg

SEQ ID NO: 1109548 - DNA, 22 bp, Artificial Sequence
  chemically synthesized
aaatctttaatccatcttgaat

SEQ ID NO: 1109549 - DNA, 22 bp, Artificial Sequence
  chemically synthesized
tacaaaaatcaattcaagatgg

SEQ ID NO: 1109550 - DNA, 22 bp, Artificial Sequence
  chemically synthesized
acgtttaaatctttaatccatc

SEQ ID NO: 1109551 - DNA, 22 bp, Artificial Sequence
  chemically synthesized
ggtctaacgtttaaatctttaa

SEQ ID NO: 1109552 - DNA, 22 bp, Artificial Sequence
  chemically synthesized
aggtctaacgtttaaatcttta

SEQ ID NO: 1109553 - DNA, 22 bp, Artificial Sequence
  chemically synthesized
taggtctaacgtttaaatcttt

SEQ ID NO: 1109554 - DNA, 22 bp, Artificial Sequence
  chemically synthesized
aagatggattaaagatttaaac

SEQ ID NO: 1109555 - DNA, 22 bp, Artificial Sequence
  chemically synthesized
tggttttaggtctaacgtttaa

SEQ ID NO: 1109556 - DNA, 22 bp, Artificial Sequence
  chemically synthesized
atggttttaggtctaacgttta

SEQ ID NO: 1109557 - DNA, 22 bp, Artificial Sequence
  chemically synthesized
tatggttttaggtctaacgttt

SEQ ID NO: 1109558 - DNA, 22 bp, Artificial Sequence
  chemically synthesized
ttatggttttaggtctaacgtt

SEQ ID NO: 1109559 - DNA, 22 bp, Artificial Sequence
  chemically synthesized
aagatttaaacgttagacctaa

SEQ ID NO: 1109560 - DNA, 22 bp, Artificial Sequence
  chemically synthesized
gggtttttatggttttaggtct

SEQ ID NO: 1109561 - DNA, 22 bp, Artificial Sequence
  chemically synthesized
tagggtttttatggttttaggt

SEQ ID NO: 1109562 - DNA, 22 bp, Artificial Sequence
  chemically synthesized
ctagggtttttatggttttagg

SEQ ID NO: 1109563 - DNA, 22 bp, Artificial Sequence
  chemically synthesized
aaacgttagacctaaaaccata

SEQ ID NO: 1109564 - DNA, 22 bp, Artificial Sequence
  chemically synthesized
ttctagggtttttatggtttta

SEQ ID NO: 1109565 - DNA, 22 bp, Artificial Sequence
  chemically synthesized
aacgttagacctaaaaccataa

SEQ ID NO: 1109566 - DNA, 22 bp, Artificial Sequence
  chemically synthesized
cttctagggtttttatggtttt

SEQ ID NO: 1109567 - DNA, 22 bp, Artificial Sequence
  chemically synthesized
tcttctagggtttttatggttt

SEQ ID NO: 1109568 - DNA, 22 bp, Artificial Sequence
  chemically synthesized
ggttttcttctagggtttttat

SEQ ID NO: 1109569 - DNA, 22 bp, Artificial Sequence
  chemically synthesized
gacctaaaaccataaaaaccct

SEQ ID NO: 1109570 - DNA, 22 bp, Artificial Sequence
  chemically synthesized
cctaggttttcttctagggttt

SEQ ID NO: 1109571 - DNA, 22 bp, Artificial Sequence
  chemically synthesized
aaaccataaaaaccctagaaga

SEQ ID NO: 1109572 - DNA, 22 bp, Artificial Sequence
  chemically synthesized
aatggtattgcctaggttttct

SEQ ID NO: 1109573 - DNA, 22 bp, Artificial Sequence
  chemically synthesized
tgccctgaatggtattgcctag

SEQ ID NO: 1109574 - DNA, 22 bp, Artificial Sequence
  chemically synthesized
gaagaaaacctaggcaatacca

SEQ ID NO: 1109575 - DNA, 22 bp, Artificial Sequence
  chemically synthesized
cccatgcctatgccctgaatgg

SEQ ID NO: 1109576 - DNA, 22 bp, Artificial Sequence
  chemically synthesized
gcccatgcctatgccctgaatg

SEQ ID NO: 1109577 - DNA, 22 bp, Artificial Sequence
  chemically synthesized
ggcaataccattcagggcatag

SEQ ID NO: 1109578 - DNA, 22 bp, Artificial Sequence
  chemically synthesized
gacatgaagtccttgcccatgc

SEQ ID NO: 1109579 - DNA, 22 bp, Artificial Sequence
  chemically synthesized
ggacatgaagtccttgcccatg

SEQ ID NO: 1109580 - DNA, 22 bp, Artificial Sequence
  chemically synthesized
tggacatgaagtccttgcccat

SEQ ID NO: 1109581 - DNA, 22 bp, Artificial Sequence
  chemically synthesized
agggcataggcatgggcaagga

SEQ ID NO: 1109582 - DNA, 22 bp, Artificial Sequence
  chemically synthesized
gtgttttggacatgaagtcctt

SEQ ID NO: 1109583 - DNA, 22 bp, Artificial Sequence
  chemically synthesized
ggtgttttggacatgaagtcct

SEQ ID NO: 1109584 - DNA, 22 bp, Artificial Sequence
  chemically synthesized
tggtgttttggacatgaagtcc

SEQ ID NO: 1109585 - DNA, 22 bp, Artificial Sequence
  chemically synthesized
ttggtgttttggacatgaagtc

SEQ ID NO: 1109586 - DNA, 22 bp, Artificial Sequence
  chemically synthesized
cttttggtgttttggacatgaa

SEQ ID NO: 1109587 - DNA, 22 bp, Artificial Sequence
  chemically synthesized
ccattgcttttggtgttttgga

SEQ ID NO: 1109588 - DNA, 22 bp, Artificial Sequence
  chemically synthesized
ttgccattgcttttggtgtttt

SEQ ID NO: 1109589 - DNA, 22 bp, Artificial Sequence
  chemically synthesized
gttgccattgcttttggtgttt

SEQ ID NO: 1109590 - DNA, 22 bp, Artificial Sequence
  chemically synthesized
tgttgccattgcttttggtgtt

SEQ ID NO: 1109591 - DNA, 22 bp, Artificial Sequence
  chemically synthesized
ttgttgccattgcttttggtgt

SEQ ID NO: 1109592 - DNA, 22 bp, Artificial Sequence
  chemically synthesized
catgtccaaaacaccaaaagca

SEQ ID NO: 1109593 - DNA, 22 bp, Artificial Sequence
  chemically synthesized
atgtccaaaacaccaaaagcaa

SEQ ID NO: 1109594 - DNA, 22 bp, Artificial Sequence
  chemically synthesized
tcttttgttgccattgcttttg

SEQ ID NO: 1109595 - DNA, 22 bp, Artificial Sequence
  chemically synthesized
gtcttttgttgccattgctttt

SEQ ID NO: 1109596 - DNA, 22 bp, Artificial Sequence
  chemically synthesized
tcaatttgtcttttgttgccat

SEQ ID NO: 1109597 - DNA, 22 bp, Artificial Sequence
  chemically synthesized
gtcaatttgtcttttgttgcca

SEQ ID NO: 1109598 - DNA, 22 bp, Artificial Sequence
  chemically synthesized
gatcccatttgtcaatttgtct

SEQ ID NO: 1109599 - DNA, 22 bp, Artificial Sequence
  chemically synthesized
attagatcccatttgtcaattt

SEQ ID NO: 1109600 - DNA, 22 bp, Artificial Sequence
  chemically synthesized
aattagatcccatttgtcaatt

SEQ ID NO: 1109601 - DNA, 22 bp, Artificial Sequence
  chemically synthesized
gtttaattagatcccatttgtc

SEQ ID NO: 1109602 - DNA, 22 bp, Artificial Sequence
  chemically synthesized
agtttaattagatcccatttgt

SEQ ID NO: 1109603 - DNA, 22 bp, Artificial Sequence
  chemically synthesized
tagtttaattagatcccatttg

SEQ ID NO: 1109604 - DNA, 22 bp, Artificial Sequence
  chemically synthesized
tttagtttaattagatcccatt

SEQ ID NO: 1109605 - DNA, 22 bp, Artificial Sequence
  chemically synthesized
acaaatgggatctaattaaact

SEQ ID NO: 1109606 - DNA, 22 bp, Artificial Sequence
  chemically synthesized
tgcagaagctctttagtttaat

SEQ ID NO: 1109607 - DNA, 22 bp, Artificial Sequence
  chemically synthesized
ctgtgcagaagctctttagttt

SEQ ID NO: 1109608 - DNA, 22 bp, Artificial Sequence
  chemically synthesized
gctgtgcagaagctctttagtt

SEQ ID NO: 1109609 - DNA, 22 bp, Artificial Sequence
  chemically synthesized
tgctgtgcagaagctctttagt

SEQ ID NO: 1109610 - DNA, 22 bp, Artificial Sequence
  chemically synthesized
ttgctgtgcagaagctctttag

SEQ ID NO: 1109611 - DNA, 22 bp, Artificial Sequence
  chemically synthesized
ttttgctgtgcagaagctcttt

SEQ ID NO: 1109612 - DNA, 22 bp, Artificial Sequence
  chemically synthesized
cttttgctgtgcagaagctctt

SEQ ID NO: 1109613 - DNA, 22 bp, Artificial Sequence
  chemically synthesized
attaaactaaagagcttctgca

SEQ ID NO: 1109614 - DNA, 22 bp, Artificial Sequence
  chemically synthesized
aactaaagagcttctgcacagc

SEQ ID NO: 1109615 - DNA, 22 bp, Artificial Sequence
  chemically synthesized
atggtagtttcttttgctgtgc

SEQ ID NO: 1109616 - DNA, 22 bp, Artificial Sequence
  chemically synthesized
aagagcttctgcacagcaaaag

SEQ ID NO: 1109617 - DNA, 22 bp, Artificial Sequence
  chemically synthesized
tgatggtagtttcttttgctgt

SEQ ID NO: 1109618 - DNA, 22 bp, Artificial Sequence
  chemically synthesized
actctgatggtagtttcttttg

SEQ ID NO: 1109619 - DNA, 22 bp, Artificial Sequence
  chemically synthesized
ttcactctgatggtagtttctt

SEQ ID NO: 1109620 - DNA, 22 bp, Artificial Sequence
  chemically synthesized
ctgcacagcaaaagaaactacc

SEQ ID NO: 1109621 - DNA, 22 bp, Artificial Sequence
  chemically synthesized
tgcacagcaaaagaaactacca

SEQ ID NO: 1109622 - DNA, 22 bp, Artificial Sequence
  chemically synthesized
cacagcaaaagaaactaccatc

SEQ ID NO: 1109623 - DNA, 22 bp, Artificial Sequence
  chemically synthesized
cctgttcactctgatggtagtt

SEQ ID NO: 1109624 - DNA, 22 bp, Artificial Sequence
  chemically synthesized
taggttgcctgttcactctgat

SEQ ID NO: 1109625 - DNA, 22 bp, Artificial Sequence
  chemically synthesized
gtaggttgcctgttcactctga

SEQ ID NO: 1109626 - DNA, 22 bp, Artificial Sequence
  chemically synthesized
tgtaggttgcctgttcactctg

SEQ ID NO: 1109627 - DNA, 22 bp, Artificial Sequence
  chemically synthesized
ccattttgtaggttgcctgttc

SEQ ID NO: 1109628 - DNA, 22 bp, Artificial Sequence
  chemically synthesized
ccatcagagtgaacaggcaacc

SEQ ID NO: 1109629 - DNA, 22 bp, Artificial Sequence
  chemically synthesized
tcccattttgtaggttgcctgt

SEQ ID NO: 1109630 - DNA, 22 bp, Artificial Sequence
  chemically synthesized
ctcccattttgtaggttgcctg

SEQ ID NO: 1109631 - DNA, 22 bp, Artificial Sequence
  chemically synthesized
tctcccattttgtaggttgcct

SEQ ID NO: 1109632 - DNA, 22 bp, Artificial Sequence
  chemically synthesized
caaaaattttctcccattttgt

SEQ ID NO: 1109633 - DNA, 22 bp, Artificial Sequence
  chemically synthesized
caaaatgggagaaaatttttgc

SEQ ID NO: 1109634 - DNA, 22 bp, Artificial Sequence
  chemically synthesized
tcagatgagtaggttgcaaaaa

SEQ ID NO: 1109635 - DNA, 22 bp, Artificial Sequence
  chemically synthesized
gtcagatgagtaggttgcaaaa

SEQ ID NO: 1109636 - DNA, 22 bp, Artificial Sequence
  chemically synthesized
tgtcagatgagtaggttgcaaa

SEQ ID NO: 1109637 - DNA, 22 bp, Artificial Sequence
  chemically synthesized
gccctttgtcagatgagtaggt

SEQ ID NO: 1109638 - DNA, 22 bp, Artificial Sequence
  chemically synthesized
ttgcaacctactcatctgacaa

SEQ ID NO: 1109639 - DNA, 22 bp, Artificial Sequence
  chemically synthesized
gatattagccctttgtcagatg

SEQ ID NO: 1109640 - DNA, 22 bp, Artificial Sequence
  chemically synthesized
tgcaacctactcatctgacaaa

SEQ ID NO: 1109641 - DNA, 22 bp, Artificial Sequence
  chemically synthesized
gcaacctactcatctgacaaag

SEQ ID NO: 1109642 - DNA, 22 bp, Artificial Sequence
  chemically synthesized
tggatattagccctttgtcaga

SEQ ID NO: 1109643 - DNA, 22 bp, Artificial Sequence
  chemically synthesized
caacctactcatctgacaaagg

SEQ ID NO: 1109644 - DNA, 22 bp, Artificial Sequence
  chemically synthesized
tagattctggatattagccctt

SEQ ID NO: 1109645 - DNA, 22 bp, Artificial Sequence
  chemically synthesized
ctcatctgacaaagggctaata

SEQ ID NO: 1109646 - DNA, 22 bp, Artificial Sequence
  chemically synthesized
atctgacaaagggctaatatcc

SEQ ID NO: 1109647 - DNA, 22 bp, Artificial Sequence
  chemically synthesized
gttgtagattctggatattagc

SEQ ID NO: 1109648 - DNA, 22 bp, Artificial Sequence
  chemically synthesized
acaaagggctaatatccagaat

SEQ ID NO: 1109649 - DNA, 22 bp, Artificial Sequence
  chemically synthesized
agttcgttgtagattctggata

SEQ ID NO: 1109650 - DNA, 22 bp, Artificial Sequence
  chemically synthesized
gagttcgttgtagattctggat

SEQ ID NO: 1109651 - DNA, 22 bp, Artificial Sequence
  chemically synthesized
tgagttcgttgtagattctgga

SEQ ID NO: 1109652 - DNA, 22 bp, Artificial Sequence
  chemically synthesized
ttgagttcgttgtagattctgg

SEQ ID NO: 1109653 - DNA, 22 bp, Artificial Sequence
  chemically synthesized
tttgagttcgttgtagattctg

SEQ ID NO: 1109654 - DNA, 22 bp, Artificial Sequence
  chemically synthesized
ttttgagttcgttgtagattct

SEQ ID NO: 1109655 - DNA, 22 bp, Artificial Sequence
  chemically synthesized
atatccagaatctacaacgaac

SEQ ID NO: 1109656 - DNA, 22 bp, Artificial Sequence
  chemically synthesized
taaatttttttgagttcgttgt

SEQ ID NO: 1109657 - DNA, 22 bp, Artificial Sequence
  chemically synthesized
gtaaatttttttgagttcgttg

SEQ ID NO: 1109658 - DNA, 22 bp, Artificial Sequence
  chemically synthesized
ttgtaaatttttttgagttcgt

SEQ ID NO: 1109659 - DNA, 22 bp, Artificial Sequence
  chemically synthesized
cttgtaaatttttttgagttcg

SEQ ID NO: 1109660 - DNA, 22 bp, Artificial Sequence
  chemically synthesized
tcttgtaaatttttttgagttc

SEQ ID NO: 1109661 - DNA, 22 bp, Artificial Sequence
  chemically synthesized
ttcttgtaaatttttttgagtt

SEQ ID NO: 1109662 - DNA, 22 bp, Artificial Sequence
  chemically synthesized
tttcttgtaaatttttttgagt

SEQ ID NO: 1109663 - DNA, 22 bp, Artificial Sequence
  chemically synthesized
ttttcttgtaaatttttttgag

SEQ ID NO: 1109664 - DNA, 22 bp, Artificial Sequence
  chemically synthesized
tttttttcttgtaaattttttt

SEQ ID NO: 1109665 - DNA, 22 bp, Artificial Sequence
  chemically synthesized
gtttttttcttgtaaatttttt

SEQ ID NO: 1109666 - DNA, 22 bp, Artificial Sequence
  chemically synthesized
caacgaactcaaaaaaatttac

SEQ ID NO: 1109667 - DNA, 22 bp, Artificial Sequence
  chemically synthesized
tttgtttttttcttgtaaattt

SEQ ID NO: 1109668 - DNA, 22 bp, Artificial Sequence
  chemically synthesized
aaaaaaatttacaagaaaaaaa

SEQ ID NO: 1109669 - DNA, 22 bp, Artificial Sequence
  chemically synthesized
atggggttgtttgtttttttct

SEQ ID NO: 1109670 - DNA, 22 bp, Artificial Sequence
  chemically synthesized
gatggggttgtttgtttttttc

SEQ ID NO: 1109671 - DNA, 22 bp, Artificial Sequence
  chemically synthesized
tgatggggttgtttgttttttt

SEQ ID NO: 1109672 - DNA, 22 bp, Artificial Sequence
  chemically synthesized
ttgatggggttgtttgtttttt

SEQ ID NO: 1109673 - DNA, 22 bp, Artificial Sequence
  chemically synthesized
tttgatggggttgtttgttttt

SEQ ID NO: 1109674 - DNA, 22 bp, Artificial Sequence
  chemically synthesized
acaagaaaaaaacaaacaaccc

SEQ ID NO: 1109675 - DNA, 22 bp, Artificial Sequence
  chemically synthesized
caagaaaaaaacaaacaacccc

SEQ ID NO: 1109676 - DNA, 22 bp, Artificial Sequence
  chemically synthesized
gcccactttttgatggggttgt

SEQ ID NO: 1109677 - DNA, 22 bp, Artificial Sequence
  chemically synthesized
cgcccactttttgatggggttg

SEQ ID NO: 1109678 - DNA, 22 bp, Artificial Sequence
  chemically synthesized
tgtagagaatagcatgcccttc

SEQ ID NO: 1109679 - DNA, 22 bp, Artificial Sequence
  chemically synthesized
atgtagagaatagcatgccctt

SEQ ID NO: 1109680 - DNA, 22 bp, Artificial Sequence
  chemically synthesized
gaaacaagaacatgaaaacatt

SEQ ID NO: 1109681 - DNA, 22 bp, Artificial Sequence
  chemically synthesized
ttctctacataaatgttttcat

SEQ ID NO: 1109682 - DNA, 22 bp, Artificial Sequence
  chemically synthesized
tctacataaatgttttcatgtt

SEQ ID NO: 1109683 - DNA, 22 bp, Artificial Sequence
  chemically synthesized
actggaaacaagaacatgaaaa

SEQ ID NO: 1109684 - DNA, 22 bp, Artificial Sequence
  chemically synthesized
cactggaaacaagaacatgaaa

SEQ ID NO: 1109685 - DNA, 22 bp, Artificial Sequence
  chemically synthesized
tacataaatgttttcatgttct

SEQ ID NO: 1109686 - DNA, 22 bp, Artificial Sequence
  chemically synthesized
cataaatgttttcatgttcttg

SEQ ID NO: 1109687 - DNA, 22 bp, Artificial Sequence
  chemically synthesized
caacttcactggaaacaagaac

SEQ ID NO: 1109688 - DNA, 22 bp, Artificial Sequence
  chemically synthesized
tcatgttcttgtttccagtgaa

SEQ ID NO: 1109689 - DNA, 22 bp, Artificial Sequence
  chemically synthesized
catgttcttgtttccagtgaag

SEQ ID NO: 1109690 - DNA, 22 bp, Artificial Sequence
  chemically synthesized
atgttcttgtttccagtgaagt

SEQ ID NO: 1109691 - DNA, 22 bp, Artificial Sequence
  chemically synthesized
aatacgaaacaattccaacttc

SEQ ID NO: 1109692 - DNA, 22 bp, Artificial Sequence
  chemically synthesized
ttgtttccagtgaagttggaat

SEQ ID NO: 1109693 - DNA, 22 bp, Artificial Sequence
  chemically synthesized
gtttccagtgaagttggaattg

SEQ ID NO: 1109694 - DNA, 22 bp, Artificial Sequence
  chemically synthesized
tttccagtgaagttggaattgt

SEQ ID NO: 1109695 - DNA, 22 bp, Artificial Sequence
  chemically synthesized
ccagtgaagttggaattgtttc

SEQ ID NO: 1109696 - DNA, 22 bp, Artificial Sequence
  chemically synthesized
cagtgaagttggaattgtttcg

SEQ ID NO: 1109697 - DNA, 22 bp, Artificial Sequence
  chemically synthesized
tatatgtattaaatacgaaaca

SEQ ID NO: 1109698 - DNA, 22 bp, Artificial Sequence
  chemically synthesized
aaattatatatgtattaaatac

SEQ ID NO: 1109699 - DNA, 22 bp, Artificial Sequence
  chemically synthesized
gaattgtttcgtatttaataca

SEQ ID NO: 1109700 - DNA, 22 bp, Artificial Sequence
  chemically synthesized
agttcaaattatatatgtatta

SEQ ID NO: 1109701 - DNA, 22 bp, Artificial Sequence
  chemically synthesized
gagttcaaattatatatgtatt

SEQ ID NO: 1109702 - DNA, 22 bp, Artificial Sequence
  chemically synthesized
tgagttcaaattatatatgtat

SEQ ID NO: 1109703 - DNA, 22 bp, Artificial Sequence
  chemically synthesized
tttcgtatttaatacatatata

SEQ ID NO: 1109704 - DNA, 22 bp, Artificial Sequence
  chemically synthesized
cgtatttaatacatatataatt

SEQ ID NO: 1109705 - DNA, 22 bp, Artificial Sequence
  chemically synthesized
gtatttaatacatatataattt

SEQ ID NO: 1109706 - DNA, 22 bp, Artificial Sequence
  chemically synthesized
aatacatatataatttgaactc

SEQ ID NO: 1109707 - DNA, 22 bp, Artificial Sequence
  chemically synthesized
atacatatataatttgaactca

SEQ ID NO: 1109708 - DNA, 22 bp, Artificial Sequence
  chemically synthesized
aaaagggcagtgaaaactttga

SEQ ID NO: 1109709 - DNA, 22 bp, Artificial Sequence
  chemically synthesized
aaaaagggcagtgaaaactttg

SEQ ID NO: 1109710 - DNA, 22 bp, Artificial Sequence
  chemically synthesized
taaaaagggcagtgaaaacttt

SEQ ID NO: 1109711 - DNA, 22 bp, Artificial Sequence
  chemically synthesized
ttaaaaagggcagtgaaaactt

SEQ ID NO: 1109712 - DNA, 22 bp, Artificial Sequence
  chemically synthesized
gaactcaaagttttcactgccc

SEQ ID NO: 1109713 - DNA, 22 bp, Artificial Sequence
  chemically synthesized
aactcaaagttttcactgccct

SEQ ID NO: 1109714 - DNA, 22 bp, Artificial Sequence
  chemically synthesized
aaagttttcactgcccttttta

SEQ ID NO: 1109715 - DNA, 22 bp, Artificial Sequence
  chemically synthesized
tcactgccctttttaaaagtgt

SEQ ID NO: 1109716 - DNA, 22 bp, Artificial Sequence
  chemically synthesized
cactgccctttttaaaagtgtt

SEQ ID NO: 1109717 - DNA, 22 bp, Artificial Sequence
  chemically synthesized
actgccctttttaaaagtgtta

SEQ ID NO: 1109718 - DNA, 22 bp, Artificial Sequence
  chemically synthesized
ccctttttaaaagtgttattat

SEQ ID NO: 1109719 - DNA, 22 bp, Artificial Sequence
  chemically synthesized
taagtaagcagccatgataata

SEQ ID NO: 1109720 - DNA, 22 bp, Artificial Sequence
  chemically synthesized
tttaaaagtgttattatcatgg

SEQ ID NO: 1109721 - DNA, 22 bp, Artificial Sequence
  chemically synthesized
ttaaaagtgttattatcatggc

SEQ ID NO: 1109722 - DNA, 22 bp, Artificial Sequence
  chemically synthesized
taaaagtgttattatcatggct

SEQ ID NO: 1109723 - DNA, 22 bp, Artificial Sequence
  chemically synthesized
aaaagtgttattatcatggctg

SEQ ID NO: 1109724 - DNA, 22 bp, Artificial Sequence
  chemically synthesized
aaagtgttattatcatggctgc

SEQ ID NO: 1109725 - DNA, 22 bp, Artificial Sequence
  chemically synthesized
ttatcatggctgcttacttaca

SEQ ID NO: 1109726 - DNA, 22 bp, Artificial Sequence
  chemically synthesized
tcatggctgcttacttacaatt

SEQ ID NO: 1109727 - DNA, 22 bp, Artificial Sequence
  chemically synthesized
aagacagcatatatatgaattg

SEQ ID NO: 1109728 - DNA, 22 bp, Artificial Sequence
  chemically synthesized
taaagacagcatatatatgaat

SEQ ID NO: 1109729 - DNA, 22 bp, Artificial Sequence
  chemically synthesized
ctaaagacagcatatatatgaa

SEQ ID NO: 1109730 - DNA, 22 bp, Artificial Sequence
  chemically synthesized
cttacttacaattcatatatat

SEQ ID NO: 1109731 - DNA, 22 bp, Artificial Sequence
  chemically synthesized
tctaaagacagcatatatatga

SEQ ID NO: 1109732 - DNA, 22 bp, Artificial Sequence
  chemically synthesized
ttctaaagacagcatatatatg

SEQ ID NO: 1109733 - DNA, 22 bp, Artificial Sequence
  chemically synthesized
tttctaaagacagcatatatat

SEQ ID NO: 1109734 - DNA, 22 bp, Artificial Sequence
  chemically synthesized
acttacaattcatatatatgct

SEQ ID NO: 1109735 - DNA, 22 bp, Artificial Sequence
  chemically synthesized
ttttctaaagacagcatatata

SEQ ID NO: 1109736 - DNA, 22 bp, Artificial Sequence
  chemically synthesized
cttacaattcatatatatgctg

SEQ ID NO: 1109737 - DNA, 22 bp, Artificial Sequence
  chemically synthesized
acaattcatatatatgctgtct

SEQ ID NO: 1109738 - DNA, 22 bp, Artificial Sequence
  chemically synthesized
caattcatatatatgctgtctt

SEQ ID NO: 1109739 - DNA, 22 bp, Artificial Sequence
  chemically synthesized
aagtatttttttctaaagacag

SEQ ID NO: 1109740 - DNA, 22 bp, Artificial Sequence
  chemically synthesized
atatatatgctgtctttagaaa

SEQ ID NO: 1109741 - DNA, 22 bp, Artificial Sequence
  chemically synthesized
accctcaagtatttttttctaa

SEQ ID NO: 1109742 - DNA, 22 bp, Artificial Sequence
  chemically synthesized
tctttagaaaaaaatacttgag

SEQ ID NO: 1109743 - DNA, 22 bp, Artificial Sequence
  chemically synthesized
aatagtaactaaccctcaagta

SEQ ID NO: 1109744 - DNA, 22 bp, Artificial Sequence
  chemically synthesized
tagaaaaaaatacttgagggtt

SEQ ID NO: 1109745 - DNA, 22 bp, Artificial Sequence
  chemically synthesized
agaaaaaaatacttgagggtta

SEQ ID NO: 1109746 - DNA, 22 bp, Artificial Sequence
  chemically synthesized
gaaaaaaatacttgagggttag

SEQ ID NO: 1109747 - DNA, 22 bp, Artificial Sequence
  chemically synthesized
catattaaatagtaactaaccc

SEQ ID NO: 1109748 - DNA, 22 bp, Artificial Sequence
  chemically synthesized
ttacatattaaatagtaactaa

SEQ ID NO: 1109749 - DNA, 22 bp, Artificial Sequence
  chemically synthesized
ttgttacatattaaatagtaac

SEQ ID NO: 1109750 - DNA, 22 bp, Artificial Sequence
  chemically synthesized
ctgttgttacatattaaatagt

SEQ ID NO: 1109751 - DNA, 22 bp, Artificial Sequence
  chemically synthesized
gagggttagttactatttaata

SEQ ID NO: 1109752 - DNA, 22 bp, Artificial Sequence
  chemically synthesized
cctgttgttacatattaaatag

SEQ ID NO: 1109753 - DNA, 22 bp, Artificial Sequence
  chemically synthesized
agggttagttactatttaatat

SEQ ID NO: 1109754 - DNA, 22 bp, Artificial Sequence
  chemically synthesized
tcctgttgttacatattaaata

SEQ ID NO: 1109755 - DNA, 22 bp, Artificial Sequence
  chemically synthesized
aattttcctgttgttacatatt

SEQ ID NO: 1109756 - DNA, 22 bp, Artificial Sequence
  chemically synthesized
caattttcctgttgttacatat

SEQ ID NO: 1109757 - DNA, 22 bp, Artificial Sequence
  chemically synthesized
gttactatttaatatgtaacaa

SEQ ID NO: 1109758 - DNA, 22 bp, Artificial Sequence
  chemically synthesized
ctatttaatatgtaacaacagg

SEQ ID NO: 1109759 - DNA, 22 bp, Artificial Sequence
  chemically synthesized
aatttcaattttcctgttgtta

SEQ ID NO: 1109760 - DNA, 22 bp, Artificial Sequence
  chemically synthesized
aaatttcaattttcctgttgtt

SEQ ID NO: 1109761 - DNA, 22 bp, Artificial Sequence
  chemically synthesized
taaatttcaattttcctgttgt

SEQ ID NO: 1109762 - DNA, 22 bp, Artificial Sequence
  chemically synthesized
tttaatatgtaacaacaggaaa

SEQ ID NO: 1109763 - DNA, 22 bp, Artificial Sequence
  chemically synthesized
ttaaatttcaattttcctgttg

SEQ ID NO: 1109764 - DNA, 22 bp, Artificial Sequence
  chemically synthesized
aatatgtaacaacaggaaaatt

SEQ ID NO: 1109765 - DNA, 22 bp, Artificial Sequence
  chemically synthesized
atatgtaacaacaggaaaattg

SEQ ID NO: 1109766 - DNA, 22 bp, Artificial Sequence
  chemically synthesized
caatttttaaatttcaattttc

SEQ ID NO: 1109767 - DNA, 22 bp, Artificial Sequence
  chemically synthesized
atgttccaatttttaaatttca

SEQ ID NO: 1109768 - DNA, 22 bp, Artificial Sequence
  chemically synthesized
atgggctcatgttccaattttt

SEQ ID NO: 1109769 - DNA, 22 bp, Artificial Sequence
  chemically synthesized
taatgggctcatgttccaattt

SEQ ID NO: 1109770 - DNA, 22 bp, Artificial Sequence
  chemically synthesized
ctaatgggctcatgttccaatt

SEQ ID NO: 1109771 - DNA, 22 bp, Artificial Sequence
  chemically synthesized
ttctaatgggctcatgttccaa

SEQ ID NO: 1109772 - DNA, 22 bp, Artificial Sequence
  chemically synthesized
aaatttaaaaattggaacatga

SEQ ID NO: 1109773 - DNA, 22 bp, Artificial Sequence
  chemically synthesized
cttctaatgggctcatgttcca

SEQ ID NO: 1109774 - DNA, 22 bp, Artificial Sequence
  chemically synthesized
tcttctaatgggctcatgttcc

SEQ ID NO: 1109775 - DNA, 22 bp, Artificial Sequence
  chemically synthesized
tttcttctaatgggctcatgtt

SEQ ID NO: 1109776 - DNA, 22 bp, Artificial Sequence
  chemically synthesized
tctttcttctaatgggctcatg

SEQ ID NO: 1109777 - DNA, 22 bp, Artificial Sequence
  chemically synthesized
aaaaattggaacatgagcccat

SEQ ID NO: 1109778 - DNA, 22 bp, Artificial Sequence
  chemically synthesized
ctctttcttctaatgggctcat

SEQ ID NO: 1109779 - DNA, 22 bp, Artificial Sequence
  chemically synthesized
aaaattggaacatgagcccatt

SEQ ID NO: 1109780 - DNA, 22 bp, Artificial Sequence
  chemically synthesized
tctctttcttctaatgggctca

SEQ ID NO: 1109781 - DNA, 22 bp, Artificial Sequence
  chemically synthesized
cattttctctttcttctaatgg

SEQ ID NO: 1109782 - DNA, 22 bp, Artificial Sequence
  chemically synthesized
ccattttctctttcttctaatg

SEQ ID NO: 1109783 - DNA, 22 bp, Artificial Sequence
  chemically synthesized
gaacatgagcccattagaagaa

SEQ ID NO: 1109784 - DNA, 22 bp, Artificial Sequence
  chemically synthesized
tccattttctctttcttctaat

SEQ ID NO: 1109785 - DNA, 22 bp, Artificial Sequence
  chemically synthesized
tttccattttctctttcttcta

SEQ ID NO: 1109786 - DNA, 22 bp, Artificial Sequence
  chemically synthesized
gtataattctttccattttctc

SEQ ID NO: 1109787 - DNA, 22 bp, Artificial Sequence
  chemically synthesized
gaagaaagagaaaatggaaaga

SEQ ID NO: 1109788 - DNA, 22 bp, Artificial Sequence
  chemically synthesized
agaattggtataattctttcca

SEQ ID NO: 1109789 - DNA, 22 bp, Artificial Sequence
  chemically synthesized
gttcagaattggtataattctt

SEQ ID NO: 1109790 - DNA, 22 bp, Artificial Sequence
  chemically synthesized
aattcgttcagaattggtataa

SEQ ID NO: 1109791 - DNA, 22 bp, Artificial Sequence
  chemically synthesized
caattcgttcagaattggtata

SEQ ID NO: 1109792 - DNA, 22 bp, Artificial Sequence
  chemically synthesized
agatttcaattcgttcagaatt

SEQ ID NO: 1109793 - DNA, 22 bp, Artificial Sequence
  chemically synthesized
taccaattctgaacgaattgaa

SEQ ID NO: 1109794 - DNA, 22 bp, Artificial Sequence
  chemically synthesized
aggaagctcagatttcaattcg

SEQ ID NO: 1109795 - DNA, 22 bp, Artificial Sequence
  chemically synthesized
caggaagctcagatttcaattc

SEQ ID NO: 1109796 - DNA, 22 bp, Artificial Sequence
  chemically synthesized
tcaggaagctcagatttcaatt

SEQ ID NO: 1109797 - DNA, 22 bp, Artificial Sequence
  chemically synthesized
attttcaggaagctcagatttc

SEQ ID NO: 1109798 - DNA, 22 bp, Artificial Sequence
  chemically synthesized
gattttcaggaagctcagattt

SEQ ID NO: 1109799 - DNA, 22 bp, Artificial Sequence
  chemically synthesized
tgaacgaattgaaatctgagct

SEQ ID NO: 1109800 - DNA, 22 bp, Artificial Sequence
  chemically synthesized
tgattttcaggaagctcagatt

SEQ ID NO: 1109801 - DNA, 22 bp, Artificial Sequence
  chemically synthesized
aacgaattgaaatctgagcttc

SEQ ID NO: 1109802 - DNA, 22 bp, Artificial Sequence
  chemically synthesized
actttgattttcaggaagctca

SEQ ID NO: 1109803 - DNA, 22 bp, Artificial Sequence
  chemically synthesized
cactttgattttcaggaagctc

SEQ ID NO: 1109804 - DNA, 22 bp, Artificial Sequence
  chemically synthesized
tcactttgattttcaggaagct

SEQ ID NO: 1109805 - DNA, 22 bp, Artificial Sequence
  chemically synthesized
ttcactttgattttcaggaagc

SEQ ID NO: 1109806 - DNA, 22 bp, Artificial Sequence
  chemically synthesized
aaatctgagcttcctgaaaatc

SEQ ID NO: 1109807 - DNA, 22 bp, Artificial Sequence
  chemically synthesized
ccttttcactttgattttcagg

SEQ ID NO: 1109808 - DNA, 22 bp, Artificial Sequence
  chemically synthesized
gccttttcactttgattttcag

SEQ ID NO: 1109809 - DNA, 22 bp, Artificial Sequence
  chemically synthesized
tgccttttcactttgattttca

SEQ ID NO: 1109810 - DNA, 22 bp, Artificial Sequence
  chemically synthesized
ttgccttttcactttgattttc

SEQ ID NO: 1109811 - DNA, 22 bp, Artificial Sequence
  chemically synthesized
tttgccttttcactttgatttt

SEQ ID NO: 1109812 - DNA, 22 bp, Artificial Sequence
  chemically synthesized
ttttgccttttcactttgattt

SEQ ID NO: 1109813 - DNA, 22 bp, Artificial Sequence
  chemically synthesized
tttttgccttttcactttgatt

SEQ ID NO: 1109814 - DNA, 22 bp, Artificial Sequence
  chemically synthesized
agcttcctgaaaatcaaagtga

SEQ ID NO: 1109815 - DNA, 22 bp, Artificial Sequence
  chemically synthesized
ttttttgccttttcactttgat

SEQ ID NO: 1109816 - DNA, 22 bp, Artificial Sequence
  chemically synthesized
tttttttgccttttcactttga

SEQ ID NO: 1109817 - DNA, 22 bp, Artificial Sequence
  chemically synthesized
cctgaaaatcaaagtgaaaagg

SEQ ID NO: 1109818 - DNA, 22 bp, Artificial Sequence
  chemically synthesized
actttttttttgccttttcact

SEQ ID NO: 1109819 - DNA, 22 bp, Artificial Sequence
  chemically synthesized
ctgaaaatcaaagtgaaaaggc

SEQ ID NO: 1109820 - DNA, 22 bp, Artificial Sequence
  chemically synthesized
aaaatcaaagtgaaaaggcaaa

SEQ ID NO: 1109821 - DNA, 22 bp, Artificial Sequence
  chemically synthesized
cataaatattaacttttttttt

SEQ ID NO: 1109822 - DNA, 22 bp, Artificial Sequence
  chemically synthesized
ccaaagagtatgaatgcctcca

SEQ ID NO: 1109823 - DNA, 22 bp, Artificial Sequence
  chemically synthesized
tcccaaagagtatgaatgcctc

SEQ ID NO: 1109824 - DNA, 22 bp, Artificial Sequence
  chemically synthesized
tctcccaaagagtatgaatgcc

SEQ ID NO: 1109825 - DNA, 22 bp, Artificial Sequence
  chemically synthesized
atatttatggaggcattcatac

SEQ ID NO: 1109826 - DNA, 22 bp, Artificial Sequence
  chemically synthesized
ctctctcccaaagagtatgaat

SEQ ID NO: 1109827 - DNA, 22 bp, Artificial Sequence
  chemically synthesized
atggaggcattcatactctttg

SEQ ID NO: 1109828 - DNA, 22 bp, Artificial Sequence
  chemically synthesized
tggaggcattcatactctttgg

SEQ ID NO: 1109829 - DNA, 22 bp, Artificial Sequence
  chemically synthesized
atacaaaagttactctctccca

SEQ ID NO: 1109830 - DNA, 22 bp, Artificial Sequence
  chemically synthesized
ctaatacaaaagttactctctc

SEQ ID NO: 1109831 - DNA, 22 bp, Artificial Sequence
  chemically synthesized
atactctttgggagagagtaac

SEQ ID NO: 1109832 - DNA, 22 bp, Artificial Sequence
  chemically synthesized
tcctaatacaaaagttactctc

SEQ ID NO: 1109833 - DNA, 22 bp, Artificial Sequence
  chemically synthesized
tttgggagagagtaacttttgt

SEQ ID NO: 1109834 - DNA, 22 bp, Artificial Sequence
  chemically synthesized
agcctctcctaatacaaaagtt

SEQ ID NO: 1109835 - DNA, 22 bp, Artificial Sequence
  chemically synthesized
tgggagagagtaacttttgtat

SEQ ID NO: 1109836 - DNA, 22 bp, Artificial Sequence
  chemically synthesized
gggagagagtaacttttgtatt

SEQ ID NO: 1109837 - DNA, 22 bp, Artificial Sequence
  chemically synthesized
tcagcctctcctaatacaaaag

SEQ ID NO: 1109838 - DNA, 22 bp, Artificial Sequence
  chemically synthesized
ggagagagtaacttttgtatta

SEQ ID NO: 1109839 - DNA, 22 bp, Artificial Sequence
  chemically synthesized
ctcagcctctcctaatacaaaa

SEQ ID NO: 1109840 - DNA, 22 bp, Artificial Sequence
  chemically synthesized
tgtgataaatttctcagcctct

SEQ ID NO: 1109841 - DNA, 22 bp, Artificial Sequence
  chemically synthesized
atgtgataaatttctcagcctc

SEQ ID NO: 1109842 - DNA, 22 bp, Artificial Sequence
  chemically synthesized
ttgtattaggagaggctgagaa

SEQ ID NO: 1109843 - DNA, 22 bp, Artificial Sequence
  chemically synthesized
tgtattaggagaggctgagaaa

SEQ ID NO: 1109844 - DNA, 22 bp, Artificial Sequence
  chemically synthesized
gtattaggagaggctgagaaat

SEQ ID NO: 1109845 - DNA, 22 bp, Artificial Sequence
  chemically synthesized
tattaggagaggctgagaaatt

SEQ ID NO: 1109846 - DNA, 22 bp, Artificial Sequence
  chemically synthesized
ggagaggctgagaaatttatca

SEQ ID NO: 1109847 - DNA, 22 bp, Artificial Sequence
  chemically synthesized
caaccatgacagaatttatgtg

SEQ ID NO: 1109848 - DNA, 22 bp, Artificial Sequence
  chemically synthesized
gcaaccatgacagaatttatgt

SEQ ID NO: 1109849 - DNA, 22 bp, Artificial Sequence
  chemically synthesized
agaaatttatcacataaattct

SEQ ID NO: 1109850 - DNA, 22 bp, Artificial Sequence
  chemically synthesized
gtcttgcaaccatgacagaatt

SEQ ID NO: 1109851 - DNA, 22 bp, Artificial Sequence
  chemically synthesized
atcacataaattctgtcatggt

SEQ ID NO: 1109852 - DNA, 22 bp, Artificial Sequence
  chemically synthesized
tcacataaattctgtcatggtt

SEQ ID NO: 1109853 - DNA, 22 bp, Artificial Sequence
  chemically synthesized
tacattagtcttgcaaccatga

SEQ ID NO: 1109854 - DNA, 22 bp, Artificial Sequence
  chemically synthesized
tgtcatggttgcaagactaatg

SEQ ID NO: 1109855 - DNA, 22 bp, Artificial Sequence
  chemically synthesized
tcatggttgcaagactaatgta

SEQ ID NO: 1109856 - DNA, 22 bp, Artificial Sequence
  chemically synthesized
atgagaataagtggcattgtac

SEQ ID NO: 1109857 - DNA, 22 bp, Artificial Sequence
  chemically synthesized
aatgagaataagtggcattgta

SEQ ID NO: 1109858 - DNA, 22 bp, Artificial Sequence
  chemically synthesized
caagactaatgtacaatgccac

SEQ ID NO: 1109859 - DNA, 22 bp, Artificial Sequence
  chemically synthesized
taatgagaataagtggcattgt

SEQ ID NO: 1109860 - DNA, 22 bp, Artificial Sequence
  chemically synthesized
ttaatgagaataagtggcattg

SEQ ID NO: 1109861 - DNA, 22 bp, Artificial Sequence
  chemically synthesized
tttaatgagaataagtggcatt

SEQ ID NO: 1109862 - DNA, 22 bp, Artificial Sequence
  chemically synthesized
ttttaatgagaataagtggcat

SEQ ID NO: 1109863 - DNA, 22 bp, Artificial Sequence
  chemically synthesized
atgtacaatgccacttattctc

SEQ ID NO: 1109864 - DNA, 22 bp, Artificial Sequence
  chemically synthesized
tgtttttttaatgagaataagt

SEQ ID NO: 1109865 - DNA, 22 bp, Artificial Sequence
  chemically synthesized
atgtttttttaatgagaataag

SEQ ID NO: 1109866 - DNA, 22 bp, Artificial Sequence
  chemically synthesized
tatttatgtttttttaatgaga

SEQ ID NO: 1109867 - DNA, 22 bp, Artificial Sequence
  chemically synthesized
aaagctgtatttatgttttttt

SEQ ID NO: 1109868 - DNA, 22 bp, Artificial Sequence
  chemically synthesized
tgaaagctgtatttatgttttt

SEQ ID NO: 1109869 - DNA, 22 bp, Artificial Sequence
  chemically synthesized
attctcattaaaaaaacataaa

SEQ ID NO: 1109870 - DNA, 22 bp, Artificial Sequence
  chemically synthesized
ttctcattaaaaaaacataaat

SEQ ID NO: 1109871 - DNA, 22 bp, Artificial Sequence
  chemically synthesized
ctctgaaagctgtatttatgtt

SEQ ID NO: 1109872 - DNA, 22 bp, Artificial Sequence
  chemically synthesized
tcattaaaaaaacataaataca

SEQ ID NO: 1109873 - DNA, 22 bp, Artificial Sequence
  chemically synthesized
attaaaaaaacataaatacagc

SEQ ID NO: 1109874 - DNA, 22 bp, Artificial Sequence
  chemically synthesized
aaaaaacataaatacagctttc

SEQ ID NO: 1109875 - DNA, 22 bp, Artificial Sequence
  chemically synthesized
taaccacataaacacattcctc

SEQ ID NO: 1109876 - DNA, 22 bp, Artificial Sequence
  chemically synthesized
tcagaggaatgtgtttatgtgg

SEQ ID NO: 1109877 - DNA, 22 bp, Artificial Sequence
  chemically synthesized
ataccattataaccacataaac

SEQ ID NO: 1109878 - DNA, 22 bp, Artificial Sequence
  chemically synthesized
cagaggaatgtgtttatgtggt

SEQ ID NO: 1109879 - DNA, 22 bp, Artificial Sequence
  chemically synthesized
agaggaatgtgtttatgtggtt

SEQ ID NO: 1109880 - DNA, 22 bp, Artificial Sequence
  chemically synthesized
aatcagctcataccattataac

SEQ ID NO: 1109881 - DNA, 22 bp, Artificial Sequence
  chemically synthesized
cctgaatcagctcataccatta

SEQ ID NO: 1109882 - DNA, 22 bp, Artificial Sequence
  chemically synthesized
acctgaatcagctcataccatt

SEQ ID NO: 1109883 - DNA, 22 bp, Artificial Sequence
  chemically synthesized
tacctgaatcagctcataccat

SEQ ID NO: 1109884 - DNA, 22 bp, Artificial Sequence
  chemically synthesized
atgtggttataatggtatgagc

SEQ ID NO: 1109885 - DNA, 22 bp, Artificial Sequence
  chemically synthesized
tgtggttataatggtatgagct

SEQ ID NO: 1109886 - DNA, 22 bp, Artificial Sequence
  chemically synthesized
ttttacctgaatcagctcatac

SEQ ID NO: 1109887 - DNA, 22 bp, Artificial Sequence
  chemically synthesized
taatggtatgagctgattcagg

SEQ ID NO: 1109888 - DNA, 22 bp, Artificial Sequence
  chemically synthesized
aatcgtcagagattattttacc

SEQ ID NO: 1109889 - DNA, 22 bp, Artificial Sequence
  chemically synthesized
attcaggtaaaataatctctga

SEQ ID NO: 1109890 - DNA, 22 bp, Artificial Sequence
  chemically synthesized
aggtaaaataatctctgacgat

SEQ ID NO: 1109891 - DNA, 22 bp, Artificial Sequence
  chemically synthesized
acccaccaaaacgattgaatcg

SEQ ID NO: 1109892 - DNA, 22 bp, Artificial Sequence
  chemically synthesized
cacccaccaaaacgattgaatc

SEQ ID NO: 1109893 - DNA, 22 bp, Artificial Sequence
  chemically synthesized
atcttcacccaccaaaacgatt

SEQ ID NO: 1109894 - DNA, 22 bp, Artificial Sequence
  chemically synthesized
aatcttcacccaccaaaacgat

SEQ ID NO: 1109895 - DNA, 22 bp, Artificial Sequence
  chemically synthesized
taatcttcacccaccaaaacga

SEQ ID NO: 1109896 - DNA, 22 bp, Artificial Sequence
  chemically synthesized
tgacgattcaatcgttttggtg

SEQ ID NO: 1109897 - DNA, 22 bp, Artificial Sequence
  chemically synthesized
acgattcaatcgttttggtggg

SEQ ID NO: 1109898 - DNA, 22 bp, Artificial Sequence
  chemically synthesized
aacgtctttaatcttcacccac

SEQ ID NO: 1109899 - DNA, 22 bp, Artificial Sequence
  chemically synthesized
aatcgttttggtgggtgaagat

SEQ ID NO: 1109900 - DNA, 22 bp, Artificial Sequence
  chemically synthesized
ctaaacgtctttaatcttcacc

SEQ ID NO: 1109901 - DNA, 22 bp, Artificial Sequence
  chemically synthesized
gctaaacgtctttaatcttcac

SEQ ID NO: 1109902 - DNA, 22 bp, Artificial Sequence
  chemically synthesized
tgctaaacgtctttaatcttca

SEQ ID NO: 1109903 - DNA, 22 bp, Artificial Sequence
  chemically synthesized
tggtgggtgaagattaaagacg

SEQ ID NO: 1109904 - DNA, 22 bp, Artificial Sequence
  chemically synthesized
cattttgctaaacgtctttaat

SEQ ID NO: 1109905 - DNA, 22 bp, Artificial Sequence
  chemically synthesized
ggtgggtgaagattaaagacgt

SEQ ID NO: 1109906 - DNA, 22 bp, Artificial Sequence
  chemically synthesized
ccattttgctaaacgtctttaa

SEQ ID NO: 1109907 - DNA, 22 bp, Artificial Sequence
  chemically synthesized
gtgggtgaagattaaagacgtt

SEQ ID NO: 1109908 - DNA, 22 bp, Artificial Sequence
  chemically synthesized
aagacgtttagcaaaatggaag

SEQ ID NO: 1109909 - DNA, 22 bp, Artificial Sequence
  chemically synthesized
aaagagaaatataggtcacctt

SEQ ID NO: 1109910 - DNA, 22 bp, Artificial Sequence
  chemically synthesized
gaaagagaaatataggtcacct

SEQ ID NO: 1109911 - DNA, 22 bp, Artificial Sequence
  chemically synthesized
agcaaaatggaaggtgacctat

SEQ ID NO: 1109912 - DNA, 22 bp, Artificial Sequence
  chemically synthesized
gcaaaatggaaggtgacctata

SEQ ID NO: 1109913 - DNA, 22 bp, Artificial Sequence
  chemically synthesized
tatttgaaagagaaatataggt

SEQ ID NO: 1109914 - DNA, 22 bp, Artificial Sequence
  chemically synthesized
atatttgaaagagaaatatagg

SEQ ID NO: 1109915 - DNA, 22 bp, Artificial Sequence
  chemically synthesized
agaggatttatatttgaaagag

SEQ ID NO: 1109916 - DNA, 22 bp, Artificial Sequence
  chemically synthesized
gagaggatttatatttgaaaga

SEQ ID NO: 1109917 - DNA, 22 bp, Artificial Sequence
  chemically synthesized
gtttgagaggatttatatttga

SEQ ID NO: 1109918 - DNA, 22 bp, Artificial Sequence
  chemically synthesized
tatttctctttcaaatataaat

SEQ ID NO: 1109919 - DNA, 22 bp, Artificial Sequence
  chemically synthesized
gcactggtttgagaggatttat

SEQ ID NO: 1109920 - DNA, 22 bp, Artificial Sequence
  chemically synthesized
ctctttcaaatataaatcctct

SEQ ID NO: 1109921 - DNA, 22 bp, Artificial Sequence
  chemically synthesized
tctttcaaatataaatcctctc

SEQ ID NO: 1109922 - DNA, 22 bp, Artificial Sequence
  chemically synthesized
tagcactggtttgagaggattt

SEQ ID NO: 1109923 - DNA, 22 bp, Artificial Sequence
  chemically synthesized
ctagcactggtttgagaggatt

SEQ ID NO: 1109924 - DNA, 22 bp, Artificial Sequence
  chemically synthesized
tttcaaatataaatcctctcaa

SEQ ID NO: 1109925 - DNA, 22 bp, Artificial Sequence
  chemically synthesized
tctagcactggtttgagaggat

SEQ ID NO: 1109926 - DNA, 22 bp, Artificial Sequence
  chemically synthesized
tcaaatataaatcctctcaaac

SEQ ID NO: 1109927 - DNA, 22 bp, Artificial Sequence
  chemically synthesized
caaatataaatcctctcaaacc

SEQ ID NO: 1109928 - DNA, 22 bp, Artificial Sequence
  chemically synthesized
aaatataaatcctctcaaacca

SEQ ID NO: 1109929 - DNA, 22 bp, Artificial Sequence
  chemically synthesized
tcaaaccagtgctagaaagttg

SEQ ID NO: 1109930 - DNA, 22 bp, Artificial Sequence
  chemically synthesized
aaaccagtgctagaaagttggt

SEQ ID NO: 1109931 - DNA, 22 bp, Artificial Sequence
  chemically synthesized
tccatggatatataccaacttt

SEQ ID NO: 1109932 - DNA, 22 bp, Artificial Sequence
  chemically synthesized
atccatggatatataccaactt

SEQ ID NO: 1109933 - DNA, 22 bp, Artificial Sequence
  chemically synthesized
ttatccatggatatataccaac

SEQ ID NO: 1109934 - DNA, 22 bp, Artificial Sequence
  chemically synthesized
cttatccatggatatataccaa

SEQ ID NO: 1109935 - DNA, 22 bp, Artificial Sequence
  chemically synthesized
tttcttatccatggatatatac

SEQ ID NO: 1109936 - DNA, 22 bp, Artificial Sequence
  chemically synthesized
atttcttatccatggatatata

SEQ ID NO: 1109937 - DNA, 22 bp, Artificial Sequence
  chemically synthesized
gaaagttggtatatatccatgg

SEQ ID NO: 1109938 - DNA, 22 bp, Artificial Sequence
  chemically synthesized
tcttatttcttatccatggata

SEQ ID NO: 1109939 - DNA, 22 bp, Artificial Sequence
  chemically synthesized
gtcttatttcttatccatggat

SEQ ID NO: 1109940 - DNA, 22 bp, Artificial Sequence
  chemically synthesized
ttgtcttatttcttatccatgg

SEQ ID NO: 1109941 - DNA, 22 bp, Artificial Sequence
  chemically synthesized
gtatatatccatggataagaaa

SEQ ID NO: 1109942 - DNA, 22 bp, Artificial Sequence
  chemically synthesized
cctcttgtcttatttcttatcc

SEQ ID NO: 1109943 - DNA, 22 bp, Artificial Sequence
  chemically synthesized
acctcttgtcttatttcttatc

SEQ ID NO: 1109944 - DNA, 22 bp, Artificial Sequence
  chemically synthesized
tacctcttgtcttatttcttat

SEQ ID NO: 1109945 - DNA, 22 bp, Artificial Sequence
  chemically synthesized
ccctttacctcttgtcttattt

SEQ ID NO: 1109946 - DNA, 22 bp, Artificial Sequence
  chemically synthesized
taaatacagaatattacccttt

SEQ ID NO: 1109947 - DNA, 22 bp, Artificial Sequence
  chemically synthesized
tactataaatacagaatattac

SEQ ID NO: 1109948 - DNA, 22 bp, Artificial Sequence
  chemically synthesized
tgtactataaatacagaatatt

SEQ ID NO: 1109949 - DNA, 22 bp, Artificial Sequence
  chemically synthesized
ctgtactataaatacagaatat

SEQ ID NO: 1109950 - DNA, 22 bp, Artificial Sequence
  chemically synthesized
tatatatttctgtactataaat

SEQ ID NO: 1109951 - DNA, 22 bp, Artificial Sequence
  chemically synthesized
gtatatatttctgtactataaa

SEQ ID NO: 1109952 - DNA, 22 bp, Artificial Sequence
  chemically synthesized
tttgtatatatttctgtactat

SEQ ID NO: 1109953 - DNA, 22 bp, Artificial Sequence
  chemically synthesized
tgtatttatagtacagaaatat

SEQ ID NO: 1109954 - DNA, 22 bp, Artificial Sequence
  chemically synthesized
tatttatagtacagaaatatat

SEQ ID NO: 1109955 - DNA, 22 bp, Artificial Sequence
  chemically synthesized
atagtacagaaatatatacaaa

SEQ ID NO: 1109956 - DNA, 22 bp, Artificial Sequence
  chemically synthesized
gcatacaaattatttgtatata

SEQ ID NO: 1109957 - DNA, 22 bp, Artificial Sequence
  chemically synthesized
tagtacagaaatatatacaaat

SEQ ID NO: 1109958 - DNA, 22 bp, Artificial Sequence
  chemically synthesized
taaatctagcatacaaattatt

SEQ ID NO: 1109959 - DNA, 22 bp, Artificial Sequence
  chemically synthesized
gtaaatctagcatacaaattat

SEQ ID NO: 1109960 - DNA, 22 bp, Artificial Sequence
  chemically synthesized
ccatttgtaaatctagcataca

SEQ ID NO: 1109961 - DNA, 22 bp, Artificial Sequence
  chemically synthesized
gtatgctagatttacaaatggc

SEQ ID NO: 1109962 - DNA, 22 bp, Artificial Sequence
  chemically synthesized
tatgctagatttacaaatggca

SEQ ID NO: 1109963 - DNA, 22 bp, Artificial Sequence
  chemically synthesized
acagtagatgccaatgctgcca

SEQ ID NO: 1109964 - DNA, 22 bp, Artificial Sequence
  chemically synthesized
gatttacaaatggcagcattgg

SEQ ID NO: 1109965 - DNA, 22 bp, Artificial Sequence
  chemically synthesized
acaaatggcagcattggcatct

SEQ ID NO: 1109966 - DNA, 22 bp, Artificial Sequence
  chemically synthesized
atggttcacagtagatgccaat

SEQ ID NO: 1109967 - DNA, 22 bp, Artificial Sequence
  chemically synthesized
caaatggcagcattggcatcta

SEQ ID NO: 1109968 - DNA, 22 bp, Artificial Sequence
  chemically synthesized
aatggttcacagtagatgccaa

SEQ ID NO: 1109969 - DNA, 22 bp, Artificial Sequence
  chemically synthesized
ttaatggttcacagtagatgcc

SEQ ID NO: 1109970 - DNA, 22 bp, Artificial Sequence
  chemically synthesized
gcatctactgtgaaccattaag

SEQ ID NO: 1109971 - DNA, 22 bp, Artificial Sequence
  chemically synthesized
ctgtgaaccattaagaacctga

SEQ ID NO: 1109972 - DNA, 22 bp, Artificial Sequence
  chemically synthesized
gccaaatataaatcaggttctt

SEQ ID NO: 1109973 - DNA, 22 bp, Artificial Sequence
  chemically synthesized
tgaaccattaagaacctgattt

SEQ ID NO: 1109974 - DNA, 22 bp, Artificial Sequence
  chemically synthesized
catctggccaaatataaatcag

SEQ ID NO: 1109975 - DNA, 22 bp, Artificial Sequence
  chemically synthesized
agaacctgatttatatttggcc

SEQ ID NO: 1109976 - DNA, 22 bp, Artificial Sequence
  chemically synthesized
atttatatttggccagatggag

SEQ ID NO: 1109977 - DNA, 22 bp, Artificial Sequence
  chemically synthesized
atatttggccagatggagggct

SEQ ID NO: 1109978 - DNA, 22 bp, Artificial Sequence
  chemically synthesized
tatttggccagatggagggctg

SEQ ID NO: 1109979 - DNA, 22 bp, Artificial Sequence
  chemically synthesized
aacgggaaaaatggcagccctc

SEQ ID NO: 1109980 - DNA, 22 bp, Artificial Sequence
  chemically synthesized
ggccagatggagggctgccatt

SEQ ID NO: 1109981 - DNA, 22 bp, Artificial Sequence
  chemically synthesized
gccagatggagggctgccattt

SEQ ID NO: 1109982 - DNA, 22 bp, Artificial Sequence
  chemically synthesized
tagccccctgaacgggaaaaat

SEQ ID NO: 1109983 - DNA, 22 bp, Artificial Sequence
  chemically synthesized
tatagccccctgaacgggaaaa

SEQ ID NO: 1109984 - DNA, 22 bp, Artificial Sequence
  chemically synthesized
ctatagccccctgaacgggaaa

SEQ ID NO: 1109985 - DNA, 22 bp, Artificial Sequence
  chemically synthesized
tctatagccccctgaacgggaa

SEQ ID NO: 1109986 - DNA, 22 bp, Artificial Sequence
  chemically synthesized
tttctatagccccctgaacggg

SEQ ID NO: 1109987 - DNA, 22 bp, Artificial Sequence
  chemically synthesized
ccatttttcccgttcagggggc

SEQ ID NO: 1109988 - DNA, 22 bp, Artificial Sequence
  chemically synthesized
gctctttctatagccccctgaa

SEQ ID NO: 1109989 - DNA, 22 bp, Artificial Sequence
  chemically synthesized
ttcccgttcagggggctataga

SEQ ID NO: 1109990 - DNA, 22 bp, Artificial Sequence
  chemically synthesized
tcccgttcagggggctatagaa

SEQ ID NO: 1109991 - DNA, 22 bp, Artificial Sequence
  chemically synthesized
cccgttcagggggctatagaaa

SEQ ID NO: 1109992 - DNA, 22 bp, Artificial Sequence
  chemically synthesized
taatgttggctctttctatagc

SEQ ID NO: 1109993 - DNA, 22 bp, Artificial Sequence
  chemically synthesized
ccgttcagggggctatagaaag

SEQ ID NO: 1109994 - DNA, 22 bp, Artificial Sequence
  chemically synthesized
gctataatgttggctctttcta

SEQ ID NO: 1109995 - DNA, 22 bp, Artificial Sequence
  chemically synthesized
ggctataatgttggctctttct

SEQ ID NO: 1109996 - DNA, 22 bp, Artificial Sequence
  chemically synthesized
agggggctatagaaagagccaa

SEQ ID NO: 1109997 - DNA, 22 bp, Artificial Sequence
  chemically synthesized
tagaaagagccaacattatagc

SEQ ID NO: 1109998 - DNA, 22 bp, Artificial Sequence
  chemically synthesized
agagcacacttggctataatgt

SEQ ID NO: 1109999 - DNA, 22 bp, Artificial Sequence
  chemically synthesized
cagagcacacttggctataatg

SEQ ID NO: 1110000 - DNA, 22 bp, Artificial Sequence
  chemically synthesized
tcagagcacacttggctataat

SEQ ID NO: 1110001 - DNA, 22 bp, Artificial Sequence
  chemically synthesized
ttcagagcacacttggctataa

SEQ ID NO: 1110002 - DNA, 22 bp, Artificial Sequence
  chemically synthesized
tttttcagagcacacttggcta

SEQ ID NO: 1110003 - DNA, 22 bp, Artificial Sequence
  chemically synthesized
gtttttcagagcacacttggct

SEQ ID NO: 1110004 - DNA, 22 bp, Artificial Sequence
  chemically synthesized
tgtttttcagagcacacttggc

SEQ ID NO: 1110005 - DNA, 22 bp, Artificial Sequence
  chemically synthesized
tagccaagtgtgctctgaaaaa

SEQ ID NO: 1110006 - DNA, 22 bp, Artificial Sequence
  chemically synthesized
aaagtcccctttgtttttcaga

SEQ ID NO: 1110007 - DNA, 22 bp, Artificial Sequence
  chemically synthesized
caaagtcccctttgtttttcag

SEQ ID NO: 1110008 - DNA, 22 bp, Artificial Sequence
  chemically synthesized
gtttcaaagtcccctttgtttt

SEQ ID NO: 1110009 - DNA, 22 bp, Artificial Sequence
  chemically synthesized
ttagtttcaaagtcccctttgt

SEQ ID NO: 1110010 - DNA, 22 bp, Artificial Sequence
  chemically synthesized
attagtttcaaagtcccctttg

SEQ ID NO: 1110011 - DNA, 22 bp, Artificial Sequence
  chemically synthesized
tattagtttcaaagtccccttt

SEQ ID NO: 1110012 - DNA, 22 bp, Artificial Sequence
  chemically synthesized
tgaaaaacaaaggggactttga

SEQ ID NO: 1110013 - DNA, 22 bp, Artificial Sequence
  chemically synthesized
aaaaacaaaggggactttgaaa

SEQ ID NO: 1110014 - DNA, 22 bp, Artificial Sequence
  chemically synthesized
cccaaatgttttattagtttca

SEQ ID NO: 1110015 - DNA, 22 bp, Artificial Sequence
  chemically synthesized
gcccaaatgttttattagtttc

SEQ ID NO: 1110016 - DNA, 22 bp, Artificial Sequence
  chemically synthesized
aacatttgcccaaatgttttat

SEQ ID NO: 1110017 - DNA, 22 bp, Artificial Sequence
  chemically synthesized
tgaaactaataaaacatttggg

SEQ ID NO: 1110018 - DNA, 22 bp, Artificial Sequence
  chemically synthesized
gaaactaataaaacatttgggc

SEQ ID NO: 1110019 - DNA, 22 bp, Artificial Sequence
  chemically synthesized
aactgaacatttgcccaaatgt

SEQ ID NO: 1110020 - DNA, 22 bp, Artificial Sequence
  chemically synthesized
aaactaataaaacatttgggca

SEQ ID NO: 1110021 - DNA, 22 bp, Artificial Sequence
  chemically synthesized
ataaaacatttgggcaaatgtt

SEQ ID NO: 1110022 - DNA, 22 bp, Artificial Sequence
  chemically synthesized
aggtctcaactgaacatttgcc

SEQ ID NO: 1110023 - DNA, 22 bp, Artificial Sequence
  chemically synthesized
agaacattaaggtctcaactga

SEQ ID NO: 1110024 - DNA, 22 bp, Artificial Sequence
  chemically synthesized
gggcaaatgttcagttgagacc

SEQ ID NO: 1110025 - DNA, 22 bp, Artificial Sequence
  chemically synthesized
tcagaacattaaggtctcaact

SEQ ID NO: 1110026 - DNA, 22 bp, Artificial Sequence
  chemically synthesized
ggcaaatgttcagttgagacct

SEQ ID NO: 1110027 - DNA, 22 bp, Artificial Sequence
  chemically synthesized
ttctcagaacattaaggtctca

SEQ ID NO: 1110028 - DNA, 22 bp, Artificial Sequence
  chemically synthesized
attctcagaacattaaggtctc

SEQ ID NO: 1110029 - DNA, 22 bp, Artificial Sequence
  chemically synthesized
tgatttattctcagaacattaa

SEQ ID NO: 1110030 - DNA, 22 bp, Artificial Sequence
  chemically synthesized
agttgagaccttaatgttctga

SEQ ID NO: 1110031 - DNA, 22 bp, Artificial Sequence
  chemically synthesized
tatgatttattctcagaacatt

SEQ ID NO: 1110032 - DNA, 22 bp, Artificial Sequence
  chemically synthesized
ctatgatttattctcagaacat

SEQ ID NO: 1110033 - DNA, 22 bp, Artificial Sequence
  chemically synthesized
ttctatgatttattctcagaac

SEQ ID NO: 1110034 - DNA, 22 bp, Artificial Sequence
  chemically synthesized
agaccttaatgttctgagaata

SEQ ID NO: 1110035 - DNA, 22 bp, Artificial Sequence
  chemically synthesized
aatgttctgagaataaatcata

SEQ ID NO: 1110036 - DNA, 22 bp, Artificial Sequence
  chemically synthesized
atgttctgagaataaatcatag

SEQ ID NO: 1110037 - DNA, 22 bp, Artificial Sequence
  chemically synthesized
aaaagtatctcttctatgattt

SEQ ID NO: 1110038 - DNA, 22 bp, Artificial Sequence
  chemically synthesized
tgagaataaatcatagaagaga

SEQ ID NO: 1110039 - DNA, 22 bp, Artificial Sequence
  chemically synthesized
agttgaaaagtatctcttctat

SEQ ID NO: 1110040 - DNA, 22 bp, Artificial Sequence
  chemically synthesized
cagttgaaaagtatctcttcta

SEQ ID NO: 1110041 - DNA, 22 bp, Artificial Sequence
  chemically synthesized
agaataaatcatagaagagata

SEQ ID NO: 1110042 - DNA, 22 bp, Artificial Sequence
  chemically synthesized
aacacagaatacttcagttgaa

SEQ ID NO: 1110043 - DNA, 22 bp, Artificial Sequence
  chemically synthesized
aaacacagaatacttcagttga

SEQ ID NO: 1110044 - DNA, 22 bp, Artificial Sequence
  chemically synthesized
taaacacagaatacttcagttg

SEQ ID NO: 1110045 - DNA, 22 bp, Artificial Sequence
  chemically synthesized
ttaaacacagaatacttcagtt

SEQ ID NO: 1110046 - DNA, 22 bp, Artificial Sequence
  chemically synthesized
tttaaacacagaatacttcagt

SEQ ID NO: 1110047 - DNA, 22 bp, Artificial Sequence
  chemically synthesized
acatctttttaaacacagaata

SEQ ID NO: 1110048 - DNA, 22 bp, Artificial Sequence
  chemically synthesized
ttcaactgaagtattctgtgtt

SEQ ID NO: 1110049 - DNA, 22 bp, Artificial Sequence
  chemically synthesized
tcaactgaagtattctgtgttt

SEQ ID NO: 1110050 - DNA, 22 bp, Artificial Sequence
  chemically synthesized
caactgaagtattctgtgttta

SEQ ID NO: 1110051 - DNA, 22 bp, Artificial Sequence
  chemically synthesized
ttcacatctttttaaacacaga

SEQ ID NO: 1110052 - DNA, 22 bp, Artificial Sequence
  chemically synthesized
aactgaagtattctgtgtttaa

SEQ ID NO: 1110053 - DNA, 22 bp, Artificial Sequence
  chemically synthesized
attgttcacatctttttaaaca

SEQ ID NO: 1110054 - DNA, 22 bp, Artificial Sequence
  chemically synthesized
aagtattctgtgtttaaaaaga

SEQ ID NO: 1110055 - DNA, 22 bp, Artificial Sequence
  chemically synthesized
tgtgtttaaaaagatgtgaaca

SEQ ID NO: 1110056 - DNA, 22 bp, Artificial Sequence
  chemically synthesized
tgtttaaaaagatgtgaacaat

SEQ ID NO: 1110057 - DNA, 22 bp, Artificial Sequence
  chemically synthesized
tggaaataatggctaattgttc

SEQ ID NO: 1110058 - DNA, 22 bp, Artificial Sequence
  chemically synthesized
atggaaataatggctaattgtt

SEQ ID NO: 1110059 - DNA, 22 bp, Artificial Sequence
  chemically synthesized
aaaaagatgtgaacaattagcc

SEQ ID NO: 1110060 - DNA, 22 bp, Artificial Sequence
  chemically synthesized
tatggaaataatggctaattgt

SEQ ID NO: 1110061 - DNA, 22 bp, Artificial Sequence
  chemically synthesized
aaaagatgtgaacaattagcca

SEQ ID NO: 1110062 - DNA, 22 bp, Artificial Sequence
  chemically synthesized
ttatggaaataatggctaattg

SEQ ID NO: 1110063 - DNA, 22 bp, Artificial Sequence
  chemically synthesized
aaccaaatccttttatggaaat

SEQ ID NO: 1110064 - DNA, 22 bp, Artificial Sequence
  chemically synthesized
gccattatttccataaaaggat

SEQ ID NO: 1110065 - DNA, 22 bp, Artificial Sequence
  chemically synthesized
gaggaccaactaaaccaaatcc

SEQ ID NO: 1110066 - DNA, 22 bp, Artificial Sequence
  chemically synthesized
tttccataaaaggatttggttt

SEQ ID NO: 1110067 - DNA, 22 bp, Artificial Sequence
  chemically synthesized
tggaggaccaactaaaccaaat

SEQ ID NO: 1110068 - DNA, 22 bp, Artificial Sequence
  chemically synthesized
ccataaaaggatttggtttagt

SEQ ID NO: 1110069 - DNA, 22 bp, Artificial Sequence
  chemically synthesized
cataaaaggatttggtttagtt

SEQ ID NO: 1110070 - DNA, 22 bp, Artificial Sequence
  chemically synthesized
ggtttagttggtcctccagagt

SEQ ID NO: 1110071 - DNA, 22 bp, Artificial Sequence
  chemically synthesized
gtttagttggtcctccagagta

SEQ ID NO: 1110072 - DNA, 22 bp, Artificial Sequence
  chemically synthesized
aaaggagataccatactctgga

SEQ ID NO: 1110073 - DNA, 22 bp, Artificial Sequence
  chemically synthesized
agttggtcctccagagtatggt

SEQ ID NO: 1110074 - DNA, 22 bp, Artificial Sequence
  chemically synthesized
gttggtcctccagagtatggta

SEQ ID NO: 1110075 - DNA, 22 bp, Artificial Sequence
  chemically synthesized
gtcctccagagtatggtatctc

SEQ ID NO: 1110076 - DNA, 22 bp, Artificial Sequence
  chemically synthesized
cagagtatggtatctcctttga

SEQ ID NO: 1110077 - DNA, 22 bp, Artificial Sequence
  chemically synthesized
aagaataaacagactcaaagga

SEQ ID NO: 1110078 - DNA, 22 bp, Artificial Sequence
  chemically synthesized
aaagaataaacagactcaaagg

SEQ ID NO: 1110079 - DNA, 22 bp, Artificial Sequence
  chemically synthesized
taaagaataaacagactcaaag

SEQ ID NO: 1110080 - DNA, 22 bp, Artificial Sequence
  chemically synthesized
ctttgagtctgtttattcttta

SEQ ID NO: 1110081 - DNA, 22 bp, Artificial Sequence
  chemically synthesized
tgagtctgtttattctttaaaa

SEQ ID NO: 1110082 - DNA, 22 bp, Artificial Sequence
  chemically synthesized
gagtctgtttattctttaaaat

SEQ ID NO: 1110083 - DNA, 22 bp, Artificial Sequence
  chemically synthesized
agtctgtttattctttaaaatt

SEQ ID NO: 1110084 - DNA, 22 bp, Artificial Sequence
  chemically synthesized
catgagataagcatataatttt

SEQ ID NO: 1110085 - DNA, 22 bp, Artificial Sequence
  chemically synthesized
ccatgagataagcatataattt

SEQ ID NO: 1110086 - DNA, 22 bp, Artificial Sequence
  chemically synthesized
tttattctttaaaattatatgc

SEQ ID NO: 1110087 - DNA, 22 bp, Artificial Sequence
  chemically synthesized
attctttaaaattatatgctta

SEQ ID NO: 1110088 - DNA, 22 bp, Artificial Sequence
  chemically synthesized
ttctttaaaattatatgcttat

SEQ ID NO: 1110089 - DNA, 22 bp, Artificial Sequence
  chemically synthesized
tttaaaattatatgcttatctc

SEQ ID NO: 1110090 - DNA, 22 bp, Artificial Sequence
  chemically synthesized
taaaattatatgcttatctcat

SEQ ID NO: 1110091 - DNA, 22 bp, Artificial Sequence
  chemically synthesized
aaaattatatgcttatctcatg

SEQ ID NO: 1110092 - DNA, 22 bp, Artificial Sequence
  chemically synthesized
aaattatatgcttatctcatgg

SEQ ID NO: 1110093 - DNA, 22 bp, Artificial Sequence
  chemically synthesized
tatgcttatctcatggaagctt

SEQ ID NO: 1110094 - DNA, 22 bp, Artificial Sequence
  chemically synthesized
tgaaaaatacaaaagcttccat

SEQ ID NO: 1110095 - DNA, 22 bp, Artificial Sequence
  chemically synthesized
ctgtgaaaaatacaaaagcttc

SEQ ID NO: 1110096 - DNA, 22 bp, Artificial Sequence
  chemically synthesized
cctgtgaaaaatacaaaagctt

SEQ ID NO: 1110097 - DNA, 22 bp, Artificial Sequence
  chemically synthesized
tcctgtgaaaaatacaaaagct

SEQ ID NO: 1110098 - DNA, 22 bp, Artificial Sequence
  chemically synthesized
atctcatggaagcttttgtatt

SEQ ID NO: 1110099 - DNA, 22 bp, Artificial Sequence
  chemically synthesized
tctcatggaagcttttgtattt

SEQ ID NO: 1110100 - DNA, 22 bp, Artificial Sequence
  chemically synthesized
atggaagcttttgtatttttca

SEQ ID NO: 1110101 - DNA, 22 bp, Artificial Sequence
  chemically synthesized
atgaaccctttcctgtgaaaaa

SEQ ID NO: 1110102 - DNA, 22 bp, Artificial Sequence
  chemically synthesized
ttgtatttttcacaggaaaggg

SEQ ID NO: 1110103 - DNA, 22 bp, Artificial Sequence
  chemically synthesized
tgtatttttcacaggaaagggt

SEQ ID NO: 1110104 - DNA, 22 bp, Artificial Sequence
  chemically synthesized
gtatttttcacaggaaagggtt

SEQ ID NO: 1110105 - DNA, 22 bp, Artificial Sequence
  chemically synthesized
tatttttcacaggaaagggttc

SEQ ID NO: 1110106 - DNA, 22 bp, Artificial Sequence
  chemically synthesized
gaaaaaattcatgaaccctttc

SEQ ID NO: 1110107 - DNA, 22 bp, Artificial Sequence
  chemically synthesized
ttcacaggaaagggttcatgaa

SEQ ID NO: 1110108 - DNA, 22 bp, Artificial Sequence
  chemically synthesized
tcacaggaaagggttcatgaat

SEQ ID NO: 1110109 - DNA, 22 bp, Artificial Sequence
  chemically synthesized
cacaggaaagggttcatgaatt

SEQ ID NO: 1110110 - DNA, 22 bp, Artificial Sequence
  chemically synthesized
acaggaaagggttcatgaattt

SEQ ID NO: 1110111 - DNA, 22 bp, Artificial Sequence
  chemically synthesized
tcagaattggaaaaaattcatg

SEQ ID NO: 1110112 - DNA, 22 bp, Artificial Sequence
  chemically synthesized
atcagaattggaaaaaattcat

SEQ ID NO: 1110113 - DNA, 22 bp, Artificial Sequence
  chemically synthesized
gagagccttatcagaattggaa

SEQ ID NO: 1110114 - DNA, 22 bp, Artificial Sequence
  chemically synthesized
atgaattttttccaattctgat

SEQ ID NO: 1110115 - DNA, 22 bp, Artificial Sequence
  chemically synthesized
tgggggttagagagccttatca

SEQ ID NO: 1110116 - DNA, 22 bp, Artificial Sequence
  chemically synthesized
tttccaattctgataaggctct

SEQ ID NO: 1110117 - DNA, 22 bp, Artificial Sequence
  chemically synthesized
ttccaattctgataaggctctc

SEQ ID NO: 1110118 - DNA, 22 bp, Artificial Sequence
  chemically synthesized
tccaattctgataaggctctct

SEQ ID NO: 1110119 - DNA, 22 bp, Artificial Sequence
  chemically synthesized
ccaattctgataaggctctcta

SEQ ID NO: 1110120 - DNA, 22 bp, Artificial Sequence
  chemically synthesized
caattctgataaggctctctaa

SEQ ID NO: 1110121 - DNA, 22 bp, Artificial Sequence
  chemically synthesized
atattgtgggggttagagagcc

SEQ ID NO: 1110122 - DNA, 22 bp, Artificial Sequence
  chemically synthesized
aatattgtgggggttagagagc

SEQ ID NO: 1110123 - DNA, 22 bp, Artificial Sequence
  chemically synthesized
taatattgtgggggttagagag

SEQ ID NO: 1110124 - DNA, 22 bp, Artificial Sequence
  chemically synthesized
ttaatattgtgggggttagaga

SEQ ID NO: 1110125 - DNA, 22 bp, Artificial Sequence
  chemically synthesized
tgataaggctctctaaccccca

SEQ ID NO: 1110126 - DNA, 22 bp, Artificial Sequence
  chemically synthesized
gtttttaatattgtgggggtta

SEQ ID NO: 1110127 - DNA, 22 bp, Artificial Sequence
  chemically synthesized
ataaggctctctaacccccaca

SEQ ID NO: 1110128 - DNA, 22 bp, Artificial Sequence
  chemically synthesized
tctaacccccacaatattaaaa

SEQ ID NO: 1110129 - DNA, 22 bp, Artificial Sequence
  chemically synthesized
taacccccacaatattaaaaac

SEQ ID NO: 1110130 - DNA, 22 bp, Artificial Sequence
  chemically synthesized
acccccacaatattaaaaacca

SEQ ID NO: 1110131 - DNA, 22 bp, Artificial Sequence
  chemically synthesized
atgatcggcagaactggttttt

SEQ ID NO: 1110132 - DNA, 22 bp, Artificial Sequence
  chemically synthesized
taatgatcggcagaactggttt

SEQ ID NO: 1110133 - DNA, 22 bp, Artificial Sequence
  chemically synthesized
atattctaatgatcggcagaac

SEQ ID NO: 1110134 - DNA, 22 bp, Artificial Sequence
  chemically synthesized
gctcatattctaatgatcggca

SEQ ID NO: 1110135 - DNA, 22 bp, Artificial Sequence
  chemically synthesized
aaaaccagttctgccgatcatt

SEQ ID NO: 1110136 - DNA, 22 bp, Artificial Sequence
  chemically synthesized
agctcatattctaatgatcggc

SEQ ID NO: 1110137 - DNA, 22 bp, Artificial Sequence
  chemically synthesized
tgccgatcattagaatatgagc

SEQ ID NO: 1110138 - DNA, 22 bp, Artificial Sequence
  chemically synthesized
gagcgcatatttagctcatatt

SEQ ID NO: 1110139 - DNA, 22 bp, Artificial Sequence
  chemically synthesized
ccgatcattagaatatgagcta

SEQ ID NO: 1110140 - DNA, 22 bp, Artificial Sequence
  chemically synthesized
taacattagagcgcatatttag

SEQ ID NO: 1110141 - DNA, 22 bp, Artificial Sequence
  chemically synthesized
ataacattagagcgcatattta

SEQ ID NO: 1110142 - DNA, 22 bp, Artificial Sequence
  chemically synthesized
tataacattagagcgcatattt

SEQ ID NO: 1110143 - DNA, 22 bp, Artificial Sequence
  chemically synthesized
gaatatgagctaaatatgcgct

SEQ ID NO: 1110144 - DNA, 22 bp, Artificial Sequence
  chemically synthesized
gagaagttttataacattagag

SEQ ID NO: 1110145 - DNA, 22 bp, Artificial Sequence
  chemically synthesized
ggagaagttttataacattaga

SEQ ID NO: 1110146 - DNA, 22 bp, Artificial Sequence
  chemically synthesized
aatatgcgctctaatgttataa

SEQ ID NO: 1110147 - DNA, 22 bp, Artificial Sequence
  chemically synthesized
tttggagaagttttataacatt

SEQ ID NO: 1110148 - DNA, 22 bp, Artificial Sequence
  chemically synthesized
atttggagaagttttataacat

SEQ ID NO: 1110149 - DNA, 22 bp, Artificial Sequence
  chemically synthesized
tatttggagaagttttataaca

SEQ ID NO: 1110150 - DNA, 22 bp, Artificial Sequence
  chemically synthesized
ttttatttggagaagttttata

SEQ ID NO: 1110151 - DNA, 22 bp, Artificial Sequence
  chemically synthesized
attttatttggagaagttttat

SEQ ID NO: 1110152 - DNA, 22 bp, Artificial Sequence
  chemically synthesized
tattttatttggagaagtttta

SEQ ID NO: 1110153 - DNA, 22 bp, Artificial Sequence
  chemically synthesized
taatgttataaaacttctccaa

SEQ ID NO: 1110154 - DNA, 22 bp, Artificial Sequence
  chemically synthesized
atgttataaaacttctccaaat

SEQ ID NO: 1110155 - DNA, 22 bp, Artificial Sequence
  chemically synthesized
agcgttttattttatttggaga

SEQ ID NO: 1110156 - DNA, 22 bp, Artificial Sequence
  chemically synthesized
tcagcgttttattttatttgga

SEQ ID NO: 1110157 - DNA, 22 bp, Artificial Sequence
  chemically synthesized
ctcagcgttttattttatttgg

SEQ ID NO: 1110158 - DNA, 22 bp, Artificial Sequence
  chemically synthesized
taaaacttctccaaataaaata

SEQ ID NO: 1110159 - DNA, 22 bp, Artificial Sequence
  chemically synthesized
ctccaaataaaataaaacgctg

SEQ ID NO: 1110160 - DNA, 22 bp, Artificial Sequence
  chemically synthesized
taacatgtttctcagcgtttta

SEQ ID NO: 1110161 - DNA, 22 bp, Artificial Sequence
  chemically synthesized
tccaaataaaataaaacgctga

SEQ ID NO: 1110162 - DNA, 22 bp, Artificial Sequence
  chemically synthesized
caaataaaataaaacgctgaga

SEQ ID NO: 1110163 - DNA, 22 bp, Artificial Sequence
  chemically synthesized
gtgataggtaaataaattataa

SEQ ID NO: 1110164 - DNA, 22 bp, Artificial Sequence
  chemically synthesized
agaaacatgttataatttattt

SEQ ID NO: 1110165 - DNA, 22 bp, Artificial Sequence
  chemically synthesized
agattagtgataggtaaataaa

SEQ ID NO: 1110166 - DNA, 22 bp, Artificial Sequence
  chemically synthesized
ctgagattagtgataggtaaat

SEQ ID NO: 1110167 - DNA, 22 bp, Artificial Sequence
  chemically synthesized
tgctgagattagtgataggtaa

SEQ ID NO: 1110168 - DNA, 22 bp, Artificial Sequence
  chemically synthesized
ttctgctgagattagtgatagg

SEQ ID NO: 1110169 - DNA, 22 bp, Artificial Sequence
  chemically synthesized
taatttatttacctatcactaa

SEQ ID NO: 1110170 - DNA, 22 bp, Artificial Sequence
  chemically synthesized
atttacctatcactaatctcag

SEQ ID NO: 1110171 - DNA, 22 bp, Artificial Sequence
  chemically synthesized
tttacctatcactaatctcagc

SEQ ID NO: 1110172 - DNA, 22 bp, Artificial Sequence
  chemically synthesized
acctatcactaatctcagcaga

SEQ ID NO: 1110173 - DNA, 22 bp, Artificial Sequence
  chemically synthesized
cctatcactaatctcagcagaa

SEQ ID NO: 1110174 - DNA, 22 bp, Artificial Sequence
  chemically synthesized
tcactaatctcagcagaacagt

SEQ ID NO: 1110175 - DNA, 22 bp, Artificial Sequence
  chemically synthesized
atctcagcagaacagtatatat

SEQ ID NO: 1110176 - DNA, 22 bp, Artificial Sequence
  chemically synthesized
atacaagggcaaatatatatac

SEQ ID NO: 1110177 - DNA, 22 bp, Artificial Sequence
  chemically synthesized
agcagaacagtatatatatttg

SEQ ID NO: 1110178 - DNA, 22 bp, Artificial Sequence
  chemically synthesized
ttcatacaagggcaaatatata

SEQ ID NO: 1110179 - DNA, 22 bp, Artificial Sequence
  chemically synthesized
atattattcatacaagggcaaa

SEQ ID NO: 1110180 - DNA, 22 bp, Artificial Sequence
  chemically synthesized
aatattattcatacaagggcaa

SEQ ID NO: 1110181 - DNA, 22 bp, Artificial Sequence
  chemically synthesized
gcaagataagcttaatattatt

SEQ ID NO: 1110182 - DNA, 22 bp, Artificial Sequence
  chemically synthesized
gcccttgtatgaataatattaa

SEQ ID NO: 1110183 - DNA, 22 bp, Artificial Sequence
  chemically synthesized
agcaagataagcttaatattat

SEQ ID NO: 1110184 - DNA, 22 bp, Artificial Sequence
  chemically synthesized
cccttgtatgaataatattaag

SEQ ID NO: 1110185 - DNA, 22 bp, Artificial Sequence
  chemically synthesized
gtatgaataatattaagcttat

SEQ ID NO: 1110186 - DNA, 22 bp, Artificial Sequence
  chemically synthesized
tatgaataatattaagcttatc

SEQ ID NO: 1110187 - DNA, 22 bp, Artificial Sequence
  chemically synthesized
ggtaaaatatttagcaagataa

SEQ ID NO: 1110188 - DNA, 22 bp, Artificial Sequence
  chemically synthesized
aggtaaaatatttagcaagata

SEQ ID NO: 1110189 - DNA, 22 bp, Artificial Sequence
  chemically synthesized
taggtaaaatatttagcaagat

SEQ ID NO: 1110190 - DNA, 22 bp, Artificial Sequence
  chemically synthesized
agcttatcttgctaaatatttt

SEQ ID NO: 1110191 - DNA, 22 bp, Artificial Sequence
  chemically synthesized
aagaatcactttaggtaaaata

SEQ ID NO: 1110192 - DNA, 22 bp, Artificial Sequence
  chemically synthesized
atcttgctaaatattttaccta

SEQ ID NO: 1110193 - DNA, 22 bp, Artificial Sequence
  chemically synthesized
gaagaatcactttaggtaaaat

SEQ ID NO: 1110194 - DNA, 22 bp, Artificial Sequence
  chemically synthesized
tcttgctaaatattttacctaa

SEQ ID NO: 1110195 - DNA, 22 bp, Artificial Sequence
  chemically synthesized
atttgaagaatcactttaggta

SEQ ID NO: 1110196 - DNA, 22 bp, Artificial Sequence
  chemically synthesized
gctaaatattttacctaaagtg

SEQ ID NO: 1110197 - DNA, 22 bp, Artificial Sequence
  chemically synthesized
ctaaatattttacctaaagtga

SEQ ID NO: 1110198 - DNA, 22 bp, Artificial Sequence
  chemically synthesized
ttaatttgaagaatcactttag

SEQ ID NO: 1110199 - DNA, 22 bp, Artificial Sequence
  chemically synthesized
aatattttacctaaagtgattc

SEQ ID NO: 1110200 - DNA, 22 bp, Artificial Sequence
  chemically synthesized
gtgtctattaatttgaagaatc

SEQ ID NO: 1110201 - DNA, 22 bp, Artificial Sequence
  chemically synthesized
tacctaaagtgattcttcaaat

SEQ ID NO: 1110202 - DNA, 22 bp, Artificial Sequence
  chemically synthesized
acctaaagtgattcttcaaatt

SEQ ID NO: 1110203 - DNA, 22 bp, Artificial Sequence
  chemically synthesized
cctaaagtgattcttcaaatta

SEQ ID NO: 1110204 - DNA, 22 bp, Artificial Sequence
  chemically synthesized
aagtgattcttcaaattaatag

SEQ ID NO: 1110205 - DNA, 22 bp, Artificial Sequence
  chemically synthesized
agacccattggtgtctattaat

SEQ ID NO: 1110206 - DNA, 22 bp, Artificial Sequence
  chemically synthesized
tcagacccattggtgtctatta

SEQ ID NO: 1110207 - DNA, 22 bp, Artificial Sequence
  chemically synthesized
tctcagacccattggtgtctat

SEQ ID NO: 1110208 - DNA, 22 bp, Artificial Sequence
  chemically synthesized
ctctcagacccattggtgtcta

SEQ ID NO: 1110209 - DNA, 22 bp, Artificial Sequence
  chemically synthesized
tctctcagacccattggtgtct

SEQ ID NO: 1110210 - DNA, 22 bp, Artificial Sequence
  chemically synthesized
ttcaaattaatagacaccaatg

SEQ ID NO: 1110211 - DNA, 22 bp, Artificial Sequence
  chemically synthesized
tttctctcagacccattggtgt

SEQ ID NO: 1110212 - DNA, 22 bp, Artificial Sequence
  chemically synthesized
caaattaatagacaccaatggg

SEQ ID NO: 1110213 - DNA, 22 bp, Artificial Sequence
  chemically synthesized
aaattaatagacaccaatgggt

SEQ ID NO: 1110214 - DNA, 22 bp, Artificial Sequence
  chemically synthesized
ctctttctctcagacccattgg

SEQ ID NO: 1110215 - DNA, 22 bp, Artificial Sequence
  chemically synthesized
actctttctctcagacccattg

SEQ ID NO: 1110216 - DNA, 22 bp, Artificial Sequence
  chemically synthesized
atagacaccaatgggtctgaga

SEQ ID NO: 1110217 - DNA, 22 bp, Artificial Sequence
  chemically synthesized
tcaccccttactctttctctca

SEQ ID NO: 1110218 - DNA, 22 bp, Artificial Sequence
  chemically synthesized
atcaccccttactctttctctc

SEQ ID NO: 1110219 - DNA, 22 bp, Artificial Sequence
  chemically synthesized
cttatcaccccttactctttct

SEQ ID NO: 1110220 - DNA, 22 bp, Artificial Sequence
  chemically synthesized
tcacctccttatcaccccttac

SEQ ID NO: 1110221 - DNA, 22 bp, Artificial Sequence
  chemically synthesized
agagaaagagtaaggggtgata

SEQ ID NO: 1110222 - DNA, 22 bp, Artificial Sequence
  chemically synthesized
cgttgtcacctccttatcaccc

SEQ ID NO: 1110223 - DNA, 22 bp, Artificial Sequence
  chemically synthesized
catccaaattccgttgtcacct

SEQ ID NO: 1110224 - DNA, 22 bp, Artificial Sequence
  chemically synthesized
ctgcatccaaattccgttgtca

SEQ ID NO: 1110225 - DNA, 22 bp, Artificial Sequence
  chemically synthesized
actgcatccaaattccgttgtc

SEQ ID NO: 1110226 - DNA, 22 bp, Artificial Sequence
  chemically synthesized
ttactgcatccaaattccgttg

SEQ ID NO: 1110227 - DNA, 22 bp, Artificial Sequence
  chemically synthesized
tcttactgcatccaaattccgt

SEQ ID NO: 1110228 - DNA, 22 bp, Artificial Sequence
  chemically synthesized
ctcttactgcatccaaattccg

SEQ ID NO: 1110229 - DNA, 22 bp, Artificial Sequence
  chemically synthesized
agggaaaatacttctcttactg

SEQ ID NO: 1110230 - DNA, 22 bp, Artificial Sequence
  chemically synthesized
ggatgcagtaagagaagtattt

SEQ ID NO: 1110231 - DNA, 22 bp, Artificial Sequence
  chemically synthesized
gatgcagtaagagaagtatttt

SEQ ID NO: 1110232 - DNA, 22 bp, Artificial Sequence
  chemically synthesized
aggaagtcatcctaagggaaaa

SEQ ID NO: 1110233 - DNA, 22 bp, Artificial Sequence
  chemically synthesized
gaggttgaggaagtcatcctaa

SEQ ID NO: 1110234 - DNA, 22 bp, Artificial Sequence
  chemically synthesized
tctggaggttgaggaagtcatc

SEQ ID NO: 1110235 - DNA, 22 bp, Artificial Sequence
  chemically synthesized
tcccttaggatgacttcctcaa

SEQ ID NO: 1110236 - DNA, 22 bp, Artificial Sequence
  chemically synthesized
cccttaggatgacttcctcaac

SEQ ID NO: 1110237 - DNA, 22 bp, Artificial Sequence
  chemically synthesized
ccttaggatgacttcctcaacc

SEQ ID NO: 1110238 - DNA, 22 bp, Artificial Sequence
  chemically synthesized
aatattgtctggaggttgagga

SEQ ID NO: 1110239 - DNA, 22 bp, Artificial Sequence
  chemically synthesized
aggatgacttcctcaacctcca

SEQ ID NO: 1110240 - DNA, 22 bp, Artificial Sequence
  chemically synthesized
ggatgacttcctcaacctccag

SEQ ID NO: 1110241 - DNA, 22 bp, Artificial Sequence
  chemically synthesized
tatattaaatattgtctggagg

SEQ ID NO: 1110242 - DNA, 22 bp, Artificial Sequence
  chemically synthesized
atatattaaatattgtctggag

SEQ ID NO: 1110243 - DNA, 22 bp, Artificial Sequence
  chemically synthesized
tatatattaaatattgtctgga

SEQ ID NO: 1110244 - DNA, 22 bp, Artificial Sequence
  chemically synthesized
cctcaacctccagacaatattt

SEQ ID NO: 1110245 - DNA, 22 bp, Artificial Sequence
  chemically synthesized
ctcaacctccagacaatattta

SEQ ID NO: 1110246 - DNA, 22 bp, Artificial Sequence
  chemically synthesized
aacctccagacaatatttaata

SEQ ID NO: 1110247 - DNA, 22 bp, Artificial Sequence
  chemically synthesized
cagacaatatttaatatataaa

SEQ ID NO: 1110248 - DNA, 22 bp, Artificial Sequence
  chemically synthesized
aatatataaaacctctggtgat

SEQ ID NO: 1110249 - DNA, 22 bp, Artificial Sequence
  chemically synthesized
atatataaaacctctggtgatc

SEQ ID NO: 1110250 - DNA, 22 bp, Artificial Sequence
  chemically synthesized
aggaacaaatggagatcaccag

SEQ ID NO: 1110251 - DNA, 22 bp, Artificial Sequence
  chemically synthesized
gaggaacaaatggagatcacca

SEQ ID NO: 1110252 - DNA, 22 bp, Artificial Sequence
  chemically synthesized
atttgaggaacaaatggagatc

SEQ ID NO: 1110253 - DNA, 22 bp, Artificial Sequence
  chemically synthesized
gatttgaggaacaaatggagat

SEQ ID NO: 1110254 - DNA, 22 bp, Artificial Sequence
  chemically synthesized
gtcttgatttgaggaacaaatg

SEQ ID NO: 1110255 - DNA, 22 bp, Artificial Sequence
  chemically synthesized
ggtcttgatttgaggaacaaat

SEQ ID NO: 1110256 - DNA, 22 bp, Artificial Sequence
  chemically synthesized
tggtgatctccatttgttcctc

SEQ ID NO: 1110257 - DNA, 22 bp, Artificial Sequence
  chemically synthesized
gtgatctccatttgttcctcaa

SEQ ID NO: 1110258 - DNA, 22 bp, Artificial Sequence
  chemically synthesized
gtatcttggtcttgatttgagg

SEQ ID NO: 1110259 - DNA, 22 bp, Artificial Sequence
  chemically synthesized
ctagtatcttggtcttgatttg

SEQ ID NO: 1110260 - DNA, 22 bp, Artificial Sequence
  chemically synthesized
catttgttcctcaaatcaagac

SEQ ID NO: 1110261 - DNA, 22 bp, Artificial Sequence
  chemically synthesized
gttcctcaaatcaagaccaaga

SEQ ID NO: 1110262 - DNA, 22 bp, Artificial Sequence
  chemically synthesized
ttcctcaaatcaagaccaagat

SEQ ID NO: 1110263 - DNA, 22 bp, Artificial Sequence
  chemically synthesized
ggacctgctagtatcttggtct

SEQ ID NO: 1110264 - DNA, 22 bp, Artificial Sequence
  chemically synthesized
tgggacctgctagtatcttggt

SEQ ID NO: 1110265 - DNA, 22 bp, Artificial Sequence
  chemically synthesized
ctcaaatcaagaccaagatact

SEQ ID NO: 1110266 - DNA, 22 bp, Artificial Sequence
  chemically synthesized
ctgggacctgctagtatcttgg

SEQ ID NO: 1110267 - DNA, 22 bp, Artificial Sequence
  chemically synthesized
aaatcaagaccaagatactagc

SEQ ID NO: 1110268 - DNA, 22 bp, Artificial Sequence
  chemically synthesized
gcaggtcccagaagtcattggt

SEQ ID NO: 1110269 - DNA, 22 bp, Artificial Sequence
  chemically synthesized
gtttgtctcctatatacctgac

SEQ ID NO: 1110270 - DNA, 22 bp, Artificial Sequence
  chemically synthesized
gtctcctatatacctgactgat

SEQ ID NO: 1110271 - DNA, 22 bp, Artificial Sequence
  chemically synthesized
tctcctatatacctgactgatt

SEQ ID NO: 1110272 - DNA, 22 bp, Artificial Sequence
  chemically synthesized
ctatatacctgactgattcctg

SEQ ID NO: 1110273 - DNA, 22 bp, Artificial Sequence
  chemically synthesized
tatacctgactgattcctgttt

SEQ ID NO: 1110274 - DNA, 22 bp, Artificial Sequence
  chemically synthesized
actgattcctgtttgtctctcc

SEQ ID NO: 1110275 - DNA, 22 bp, Artificial Sequence
  chemically synthesized
attcctgtttgtctctcctctc

SEQ ID NO: 1110276 - DNA, 22 bp, Artificial Sequence
  chemically synthesized
ctgtttgtctctcctctcattc

SEQ ID NO: 1110277 - DNA, 22 bp, Artificial Sequence
  chemically synthesized
tttgtctctcctctcattcatc

SEQ ID NO: 1110278 - DNA, 22 bp, Artificial Sequence
  chemically synthesized
aacatagaggggcagatgaatg

SEQ ID NO: 1110279 - DNA, 22 bp, Artificial Sequence
  chemically synthesized
gtctctcctctcattcatctgc

SEQ ID NO: 1110280 - DNA, 22 bp, Artificial Sequence
  chemically synthesized
tctctcctctcattcatctgcc

SEQ ID NO: 1110281 - DNA, 22 bp, Artificial Sequence
  chemically synthesized
tcctctcattcatctgcccctc

SEQ ID NO: 1110282 - DNA, 22 bp, Artificial Sequence
  chemically synthesized
ctctcattcatctgcccctcta

SEQ ID NO: 1110283 - DNA, 22 bp, Artificial Sequence
  chemically synthesized
taaatgctgaacatagaggggc

SEQ ID NO: 1110284 - DNA, 22 bp, Artificial Sequence
  chemically synthesized
tcattcatctgcccctctatgt

SEQ ID NO: 1110285 - DNA, 22 bp, Artificial Sequence
  chemically synthesized
attcatctgcccctctatgttc

SEQ ID NO: 1110286 - DNA, 22 bp, Artificial Sequence
  chemically synthesized
atctgcccctctatgttcagca

SEQ ID NO: 1110287 - DNA, 22 bp, Artificial Sequence
  chemically synthesized
cccctctatgttcagcatttac

SEQ ID NO: 1110288 - DNA, 22 bp, Artificial Sequence
  chemically synthesized
aatgaagaccattgtaaatgct

SEQ ID NO: 1110289 - DNA, 22 bp, Artificial Sequence
  chemically synthesized
tatgttcagcatttacaatggt

SEQ ID NO: 1110290 - DNA, 22 bp, Artificial Sequence
  chemically synthesized
tgttcagcatttacaatggtct

SEQ ID NO: 1110291 - DNA, 22 bp, Artificial Sequence
  chemically synthesized
agcatttacaatggtcttcatt

SEQ ID NO: 1110292 - DNA, 22 bp, Artificial Sequence
  chemically synthesized
acaatggtcttcattcaggtgc

SEQ ID NO: 1110293 - DNA, 22 bp, Artificial Sequence
  chemically synthesized
caatggtcttcattcaggtgct

SEQ ID NO: 1110294 - DNA, 22 bp, Artificial Sequence
  chemically synthesized
cattcaggtgcttggcctttat

SEQ ID NO: 1110295 - DNA, 22 bp, Artificial Sequence
  chemically synthesized
attcaggtgcttggcctttatt

SEQ ID NO: 1110296 - DNA, 22 bp, Artificial Sequence
  chemically synthesized
aggtgcttggcctttattgctc

SEQ ID NO: 1110297 - DNA, 22 bp, Artificial Sequence
  chemically synthesized
ggcctttattgctccctcttgc

SEQ ID NO: 1110298 - DNA, 22 bp, Artificial Sequence
  chemically synthesized
gcctttattgctccctcttgcc

SEQ ID NO: 1110299 - DNA, 22 bp, Artificial Sequence
  chemically synthesized
caggcagaaggaacatggcaag

SEQ ID NO: 1110300 - DNA, 22 bp, Artificial Sequence
  chemically synthesized
tattgctccctcttgccatgtt

SEQ ID NO: 1110301 - DNA, 22 bp, Artificial Sequence
  chemically synthesized
attgctccctcttgccatgttc

SEQ ID NO: 1110302 - DNA, 22 bp, Artificial Sequence
  chemically synthesized
ttgctccctcttgccatgttcc

SEQ ID NO: 1110303 - DNA, 22 bp, Artificial Sequence
  chemically synthesized
ctccctcttgccatgttccttc

SEQ ID NO: 1110304 - DNA, 22 bp, Artificial Sequence
  chemically synthesized
cctcttgccatgttccttctgc

SEQ ID NO: 1110305 - DNA, 22 bp, Artificial Sequence
  chemically synthesized
agcaagattccaggcagaagga

SEQ ID NO: 1110306 - DNA, 22 bp, Artificial Sequence
  chemically synthesized
ttgccatgttccttctgcctgg

SEQ ID NO: 1110307 - DNA, 22 bp, Artificial Sequence
  chemically synthesized
gccatgttccttctgcctggaa

SEQ ID NO: 1110308 - DNA, 22 bp, Artificial Sequence
  chemically synthesized
ccatgttccttctgcctggaat

SEQ ID NO: 1110309 - DNA, 22 bp, Artificial Sequence
  chemically synthesized
cttctgcctggaatcttgctta

SEQ ID NO: 1110310 - DNA, 22 bp, Artificial Sequence
  chemically synthesized
ggtaagagaacagttaagcaag

SEQ ID NO: 1110311 - DNA, 22 bp, Artificial Sequence
  chemically synthesized
ctgcctggaatcttgcttaact

SEQ ID NO: 1110312 - DNA, 22 bp, Artificial Sequence
  chemically synthesized
tgcctggaatcttgcttaactg

SEQ ID NO: 1110313 - DNA, 22 bp, Artificial Sequence
  chemically synthesized
cctggaatcttgcttaactgtt

SEQ ID NO: 1110314 - DNA, 22 bp, Artificial Sequence
  chemically synthesized
gaattaggtaagagaacagtta

SEQ ID NO: 1110315 - DNA, 22 bp, Artificial Sequence
  chemically synthesized
gaatcttgcttaactgttctct

SEQ ID NO: 1110316 - DNA, 22 bp, Artificial Sequence
  chemically synthesized
gcttaactgttctcttacctaa

SEQ ID NO: 1110317 - DNA, 22 bp, Artificial Sequence
  chemically synthesized
cttaactgttctcttacctaat

SEQ ID NO: 1110318 - DNA, 22 bp, Artificial Sequence
  chemically synthesized
tgataagttagaattaggtaag

SEQ ID NO: 1110319 - DNA, 22 bp, Artificial Sequence
  chemically synthesized
gtgataagttagaattaggtaa

SEQ ID NO: 1110320 - DNA, 22 bp, Artificial Sequence
  chemically synthesized
tgtgataagttagaattaggta

SEQ ID NO: 1110321 - DNA, 22 bp, Artificial Sequence
  chemically synthesized
aactgttctcttacctaattct

SEQ ID NO: 1110322 - DNA, 22 bp, Artificial Sequence
  chemically synthesized
ttgtgataagttagaattaggt

SEQ ID NO: 1110323 - DNA, 22 bp, Artificial Sequence
  chemically synthesized
actgttctcttacctaattcta

SEQ ID NO: 1110324 - DNA, 22 bp, Artificial Sequence
  chemically synthesized
ttctcttacctaattctaactt

SEQ ID NO: 1110325 - DNA, 22 bp, Artificial Sequence
  chemically synthesized
agacttttgtgataagttagaa

SEQ ID NO: 1110326 - DNA, 22 bp, Artificial Sequence
  chemically synthesized
tcttacctaattctaacttatc

SEQ ID NO: 1110327 - DNA, 22 bp, Artificial Sequence
  chemically synthesized
ttacctaattctaacttatcac

SEQ ID NO: 1110328 - DNA, 22 bp, Artificial Sequence
  chemically synthesized
agttgagacttttgtgataagt

SEQ ID NO: 1110329 - DNA, 22 bp, Artificial Sequence
  chemically synthesized
acctaattctaacttatcacaa

SEQ ID NO: 1110330 - DNA, 22 bp, Artificial Sequence
  chemically synthesized
gagttgagacttttgtgataag

SEQ ID NO: 1110331 - DNA, 22 bp, Artificial Sequence
  chemically synthesized
cctaattctaacttatcacaaa

SEQ ID NO: 1110332 - DNA, 22 bp, Artificial Sequence
  chemically synthesized
attctaacttatcacaaaagtc

SEQ ID NO: 1110333 - DNA, 22 bp, Artificial Sequence
  chemically synthesized
taacttatcacaaaagtctcaa

SEQ ID NO: 1110334 - DNA, 22 bp, Artificial Sequence
  chemically synthesized
acttatcacaaaagtctcaact

SEQ ID NO: 1110335 - DNA, 22 bp, Artificial Sequence
  chemically synthesized
agggaggaacatttgagttgag

SEQ ID NO: 1110336 - DNA, 22 bp, Artificial Sequence
  chemically synthesized
atcacaaaagtctcaactcaaa

SEQ ID NO: 1110337 - DNA, 22 bp, Artificial Sequence
  chemically synthesized
gagggaggaacatttgagttga

SEQ ID NO: 1110338 - DNA, 22 bp, Artificial Sequence
  chemically synthesized
tcacaaaagtctcaactcaaat

SEQ ID NO: 1110339 - DNA, 22 bp, Artificial Sequence
  chemically synthesized
cttgagggaggaacatttgagt

SEQ ID NO: 1110340 - DNA, 22 bp, Artificial Sequence
  chemically synthesized
ccttgagggaggaacatttgag

SEQ ID NO: 1110341 - DNA, 22 bp, Artificial Sequence
  chemically synthesized
aactcaaatgttcctccctcaa

SEQ ID NO: 1110342 - DNA, 22 bp, Artificial Sequence
  chemically synthesized
aaatgttcctccctcaaggaag

SEQ ID NO: 1110343 - DNA, 22 bp, Artificial Sequence
  chemically synthesized
atacagccaccaagggcatctt

SEQ ID NO: 1110344 - DNA, 22 bp, Artificial Sequence
  chemically synthesized
ctccctcaaggaagatgccctt

SEQ ID NO: 1110345 - DNA, 22 bp, Artificial Sequence
  chemically synthesized
cctcaaggaagatgcccttggt

SEQ ID NO: 1110346 - DNA, 22 bp, Artificial Sequence
  chemically synthesized
aaggaagatgcccttggtggct

SEQ ID NO: 1110347 - DNA, 22 bp, Artificial Sequence
  chemically synthesized
ggtggctgtatcaggttcgttt

SEQ ID NO: 1110348 - DNA, 22 bp, Artificial Sequence
  chemically synthesized
gtggctgtatcaggttcgtttt

SEQ ID NO: 1110349 - DNA, 22 bp, Artificial Sequence
  chemically synthesized
tatcaggttcgtttttccctgt

SEQ ID NO: 1110350 - DNA, 22 bp, Artificial Sequence
  chemically synthesized
ggagaatgagtaacagggaaaa

SEQ ID NO: 1110351 - DNA, 22 bp, Artificial Sequence
  chemically synthesized
gggagaatgagtaacagggaaa

SEQ ID NO: 1110352 - DNA, 22 bp, Artificial Sequence
  chemically synthesized
tgggagaatgagtaacagggaa

SEQ ID NO: 1110353 - DNA, 22 bp, Artificial Sequence
  chemically synthesized
gtttttccctgttactcattct

SEQ ID NO: 1110354 - DNA, 22 bp, Artificial Sequence
  chemically synthesized
ttccctgttactcattctccca

SEQ ID NO: 1110355 - DNA, 22 bp, Artificial Sequence
  chemically synthesized
tccctgttactcattctcccaa

SEQ ID NO: 1110356 - DNA, 22 bp, Artificial Sequence
  chemically synthesized
agatgcaaagctttgggagaat

SEQ ID NO: 1110357 - DNA, 22 bp, Artificial Sequence
  chemically synthesized
ccctgttactcattctcccaaa

SEQ ID NO: 1110358 - DNA, 22 bp, Artificial Sequence
  chemically synthesized
cctgttactcattctcccaaag

SEQ ID NO: 1110359 - DNA, 22 bp, Artificial Sequence
  chemically synthesized
aactaagatgcaaagctttggg

SEQ ID NO: 1110360 - DNA, 22 bp, Artificial Sequence
  chemically synthesized
ttactcattctcccaaagcttt

SEQ ID NO: 1110361 - DNA, 22 bp, Artificial Sequence
  chemically synthesized
aaactaagatgcaaagctttgg

SEQ ID NO: 1110362 - DNA, 22 bp, Artificial Sequence
  chemically synthesized
ctcattctcccaaagctttgca

SEQ ID NO: 1110363 - DNA, 22 bp, Artificial Sequence
  chemically synthesized
attctcccaaagctttgcatct

SEQ ID NO: 1110364 - DNA, 22 bp, Artificial Sequence
  chemically synthesized
tcccaaagctttgcatcttagt

SEQ ID NO: 1110365 - DNA, 22 bp, Artificial Sequence
  chemically synthesized
ccaaagctttgcatcttagttt

SEQ ID NO: 1110366 - DNA, 22 bp, Artificial Sequence
  chemically synthesized
ggaacagtggtttaaactaaga

SEQ ID NO: 1110367 - DNA, 22 bp, Artificial Sequence
  chemically synthesized
ctaggaacagtggtttaaacta

SEQ ID NO: 1110368 - DNA, 22 bp, Artificial Sequence
  chemically synthesized
ctgctaggaacagtggtttaaa

SEQ ID NO: 1110369 - DNA, 22 bp, Artificial Sequence
  chemically synthesized
cctgctaggaacagtggtttaa

SEQ ID NO: 1110370 - DNA, 22 bp, Artificial Sequence
  chemically synthesized
tgcatcttagtttaaaccactg

SEQ ID NO: 1110371 - DNA, 22 bp, Artificial Sequence
  chemically synthesized
gcatcttagtttaaaccactgt

SEQ ID NO: 1110372 - DNA, 22 bp, Artificial Sequence
  chemically synthesized
catcttagtttaaaccactgtt

SEQ ID NO: 1110373 - DNA, 22 bp, Artificial Sequence
  chemically synthesized
aatttcctgctaggaacagtgg

SEQ ID NO: 1110374 - DNA, 22 bp, Artificial Sequence
  chemically synthesized
aaatttcctgctaggaacagtg

SEQ ID NO: 1110375 - DNA, 22 bp, Artificial Sequence
  chemically synthesized
taaatttcctgctaggaacagt

SEQ ID NO: 1110376 - DNA, 22 bp, Artificial Sequence
  chemically synthesized
ttaaatttcctgctaggaacag

SEQ ID NO: 1110377 - DNA, 22 bp, Artificial Sequence
  chemically synthesized
agtttaaaccactgttcctagc

SEQ ID NO: 1110378 - DNA, 22 bp, Artificial Sequence
  chemically synthesized
gtttaaaccactgttcctagca

SEQ ID NO: 1110379 - DNA, 22 bp, Artificial Sequence
  chemically synthesized
aaaccactgttcctagcaggaa

SEQ ID NO: 1110380 - DNA, 22 bp, Artificial Sequence
  chemically synthesized
aaccactgttcctagcaggaaa

SEQ ID NO: 1110381 - DNA, 22 bp, Artificial Sequence
  chemically synthesized
ttcctagcaggaaatttaaaaa

SEQ ID NO: 1110382 - DNA, 22 bp, Artificial Sequence
  chemically synthesized
ctagcaggaaatttaaaaatat

SEQ ID NO: 1110383 - DNA, 22 bp, Artificial Sequence
  chemically synthesized
gcaggaaatttaaaaatattga

SEQ ID NO: 1110384 - DNA, 22 bp, Artificial Sequence
  chemically synthesized
aaaaatattgattccattgttt

SEQ ID NO: 1110385 - DNA, 22 bp, Artificial Sequence
  chemically synthesized
aaaatattgattccattgtttc

SEQ ID NO: 1110386 - DNA, 22 bp, Artificial Sequence
  chemically synthesized
attccattgtttcatatctctc

SEQ ID NO: 1110387 - DNA, 22 bp, Artificial Sequence
  chemically synthesized
cggaaagcagagaagagagata

SEQ ID NO: 1110388 - DNA, 22 bp, Artificial Sequence
  chemically synthesized
acggaaagcagagaagagagat

SEQ ID NO: 1110389 - DNA, 22 bp, Artificial Sequence
  chemically synthesized
cattgtttcatatctctcttct

SEQ ID NO: 1110390 - DNA, 22 bp, Artificial Sequence
  chemically synthesized
tatttacggaaagcagagaaga

SEQ ID NO: 1110391 - DNA, 22 bp, Artificial Sequence
  chemically synthesized
tttcatatctctcttctctgct

SEQ ID NO: 1110392 - DNA, 22 bp, Artificial Sequence
  chemically synthesized
ttgtatttacggaaagcagaga

SEQ ID NO: 1110393 - DNA, 22 bp, Artificial Sequence
  chemically synthesized
catatctctcttctctgctttc

SEQ ID NO: 1110394 - DNA, 22 bp, Artificial Sequence
  chemically synthesized
attgtatttacggaaagcagag

SEQ ID NO: 1110395 - DNA, 22 bp, Artificial Sequence
  chemically synthesized
atatctctcttctctgctttcc

SEQ ID NO: 1110396 - DNA, 22 bp, Artificial Sequence
  chemically synthesized
tattgtatttacggaaagcaga

SEQ ID NO: 1110397 - DNA, 22 bp, Artificial Sequence
  chemically synthesized
ttattgtatttacggaaagcag

SEQ ID NO: 1110398 - DNA, 22 bp, Artificial Sequence
  chemically synthesized
cttttattgtatttacggaaag

SEQ ID NO: 1110399 - DNA, 22 bp, Artificial Sequence
  chemically synthesized
tgcttttattgtatttacggaa

SEQ ID NO: 1110400 - DNA, 22 bp, Artificial Sequence
  chemically synthesized
tcttctctgctttccgtaaata

SEQ ID NO: 1110401 - DNA, 22 bp, Artificial Sequence
  chemically synthesized
ttctctgctttccgtaaataca

SEQ ID NO: 1110402 - DNA, 22 bp, Artificial Sequence
  chemically synthesized
ctctgctttccgtaaatacaat

SEQ ID NO: 1110403 - DNA, 22 bp, Artificial Sequence
  chemically synthesized
tctgctttccgtaaatacaata

SEQ ID NO: 1110404 - DNA, 22 bp, Artificial Sequence
  chemically synthesized
tgctttccgtaaatacaataaa

SEQ ID NO: 1110405 - DNA, 22 bp, Artificial Sequence
  chemically synthesized
atggactctgcttttattgtat

SEQ ID NO: 1110406 - DNA, 22 bp, Artificial Sequence
  chemically synthesized
ctttccgtaaatacaataaaag

SEQ ID NO: 1110407 - DNA, 22 bp, Artificial Sequence
  chemically synthesized
tccgtaaatacaataaaagcag

SEQ ID NO: 1110408 - DNA, 22 bp, Artificial Sequence
  chemically synthesized
ccgtaaatacaataaaagcaga

SEQ ID NO: 1110409 - DNA, 22 bp, Artificial Sequence
  chemically synthesized
cgtaaatacaataaaagcagag

SEQ ID NO: 1110410 - DNA, 22 bp, Artificial Sequence
  chemically synthesized
gagtgggcattcatggactctg

SEQ ID NO: 1110411 - DNA, 22 bp, Artificial Sequence
  chemically synthesized
ggaatattagagtgggcattca

SEQ ID NO: 1110412 - DNA, 22 bp, Artificial Sequence
  chemically synthesized
gggaatattagagtgggcattc

SEQ ID NO: 1110413 - DNA, 22 bp, Artificial Sequence
  chemically synthesized
tgggaatattagagtgggcatt

SEQ ID NO: 1110414 - DNA, 22 bp, Artificial Sequence
  chemically synthesized
agttttgggaatattagagtgg

SEQ ID NO: 1110415 - DNA, 22 bp, Artificial Sequence
  chemically synthesized
agcccatagcactaagttttgg

SEQ ID NO: 1110416 - DNA, 22 bp, Artificial Sequence
  chemically synthesized
taatattcccaaaacttagtgc

SEQ ID NO: 1110417 - DNA, 22 bp, Artificial Sequence
  chemically synthesized
atattcccaaaacttagtgcta

SEQ ID NO: 1110418 - DNA, 22 bp, Artificial Sequence
  chemically synthesized
ccaaaacttagtgctatgggct

SEQ ID NO: 1110419 - DNA, 22 bp, Artificial Sequence
  chemically synthesized
gaagacacaattcagcccatag

SEQ ID NO: 1110420 - DNA, 22 bp, Artificial Sequence
  chemically synthesized
ggaagacacaattcagcccata

SEQ ID NO: 1110421 - DNA, 22 bp, Artificial Sequence
  chemically synthesized
tggaagacacaattcagcccat

SEQ ID NO: 1110422 - DNA, 22 bp, Artificial Sequence
  chemically synthesized
agtgctatgggctgaattgtgt

SEQ ID NO: 1110423 - DNA, 22 bp, Artificial Sequence
  chemically synthesized
gtgctatgggctgaattgtgtc

SEQ ID NO: 1110424 - DNA, 22 bp, Artificial Sequence
  chemically synthesized
tgggctgaattgtgtcttccaa

SEQ ID NO: 1110425 - DNA, 22 bp, Artificial Sequence
  chemically synthesized
aacatgtgaattttggaagaca

SEQ ID NO: 1110426 - DNA, 22 bp, Artificial Sequence
  chemically synthesized
caacatgtgaattttggaagac

SEQ ID NO: 1110427 - DNA, 22 bp, Artificial Sequence
  chemically synthesized
aattgtgtcttccaaaattcac

SEQ ID NO: 1110428 - DNA, 22 bp, Artificial Sequence
  chemically synthesized
ggacttcaacatgtgaattttg

SEQ ID NO: 1110429 - DNA, 22 bp, Artificial Sequence
  chemically synthesized
tgtcttccaaaattcacatgtt

SEQ ID NO: 1110430 - DNA, 22 bp, Artificial Sequence
  chemically synthesized
ccaaaattcacatgttgaagtc

SEQ ID NO: 1110431 - DNA, 22 bp, Artificial Sequence
  chemically synthesized
accaatggttaggacttcaaca

SEQ ID NO: 1110432 - DNA, 22 bp, Artificial Sequence
  chemically synthesized
caaaattcacatgttgaagtcc

SEQ ID NO: 1110433 - DNA, 22 bp, Artificial Sequence
  chemically synthesized
acatgttgaagtcctaaccatt

SEQ ID NO: 1110434 - DNA, 22 bp, Artificial Sequence
  chemically synthesized
tcaccaaatagtctcaccaatg

SEQ ID NO: 1110435 - DNA, 22 bp, Artificial Sequence
  chemically synthesized
aagtcctaaccattggtgagac

SEQ ID NO: 1110436 - DNA, 22 bp, Artificial Sequence
  chemically synthesized
aaagtcctatcaccaaatagtc

SEQ ID NO: 1110437 - DNA, 22 bp, Artificial Sequence
  chemically synthesized
accattggtgagactatttggt

SEQ ID NO: 1110438 - DNA, 22 bp, Artificial Sequence
  chemically synthesized
aaaagtcctatcaccaaatagt

SEQ ID NO: 1110439 - DNA, 22 bp, Artificial Sequence
  chemically synthesized
ttaaaagtcctatcaccaaata

SEQ ID NO: 1110440 - DNA, 22 bp, Artificial Sequence
  chemically synthesized
cctcttaaaagtcctatcacca

SEQ ID NO: 1110441 - DNA, 22 bp, Artificial Sequence
  chemically synthesized
gtgagactatttggtgatagga

SEQ ID NO: 1110442 - DNA, 22 bp, Artificial Sequence
  chemically synthesized
tttggtgataggacttttaaga

SEQ ID NO: 1110443 - DNA, 22 bp, Artificial Sequence
  chemically synthesized
ggtgataggacttttaagaggt

SEQ ID NO: 1110444 - DNA, 22 bp, Artificial Sequence
  chemically synthesized
gtgataggacttttaagaggta

SEQ ID NO: 1110445 - DNA, 22 bp, Artificial Sequence
  chemically synthesized
atgacgtcatataaacatcatt

SEQ ID NO: 1110446 - DNA, 22 bp, Artificial Sequence
  chemically synthesized
ttaagaggtaatgatgtttata

SEQ ID NO: 1110447 - DNA, 22 bp, Artificial Sequence
  chemically synthesized
taagaggtaatgatgtttatat

SEQ ID NO: 1110448 - DNA, 22 bp, Artificial Sequence
  chemically synthesized
aagaggtaatgatgtttatatg

SEQ ID NO: 1110449 - DNA, 22 bp, Artificial Sequence
  chemically synthesized
agaggtaatgatgtttatatga

SEQ ID NO: 1110450 - DNA, 22 bp, Artificial Sequence
  chemically synthesized
cccaaccctgatgacgtcatat

SEQ ID NO: 1110451 - DNA, 22 bp, Artificial Sequence
  chemically synthesized
acccaaccctgatgacgtcata

SEQ ID NO: 1110452 - DNA, 22 bp, Artificial Sequence
  chemically synthesized
atatgacgtcatcagggttggg

SEQ ID NO: 1110453 - DNA, 22 bp, Artificial Sequence
  chemically synthesized
tatgacgtcatcagggttgggt

SEQ ID NO: 1110454 - DNA, 22 bp, Artificial Sequence
  chemically synthesized
gccccccaccccgccaccctta

SEQ ID NO: 1110455 - DNA, 22 bp, Artificial Sequence
  chemically synthesized
agggattagccccccaccccgc

SEQ ID NO: 1110456 - DNA, 22 bp, Artificial Sequence
  chemically synthesized
ggtaagggtggcggggtggggg

SEQ ID NO: 1110457 - DNA, 22 bp, Artificial Sequence
  chemically synthesized
taaagccaccaatccctaaggg

SEQ ID NO: 1110458 - DNA, 22 bp, Artificial Sequence
  chemically synthesized
ataaagccaccaatccctaagg

SEQ ID NO: 1110459 - DNA, 22 bp, Artificial Sequence
  chemically synthesized
tataaagccaccaatccctaag

SEQ ID NO: 1110460 - DNA, 22 bp, Artificial Sequence
  chemically synthesized
ttataaagccaccaatccctaa

SEQ ID NO: 1110461 - DNA, 22 bp, Artificial Sequence
  chemically synthesized
cttttataaagccaccaatccc

SEQ ID NO: 1110462 - DNA, 22 bp, Artificial Sequence
  chemically synthesized
atcccttagggattggtggctt

SEQ ID NO: 1110463 - DNA, 22 bp, Artificial Sequence
  chemically synthesized
cctccttttataaagccaccaa

SEQ ID NO: 1110464 - DNA, 22 bp, Artificial Sequence
  chemically synthesized
tgcctccttttataaagccacc

SEQ ID NO: 1110465 - DNA, 22 bp, Artificial Sequence
  chemically synthesized
tctctgcctccttttataaagc

SEQ ID NO: 1110466 - DNA, 22 bp, Artificial Sequence
  chemically synthesized
agggattggtggctttataaaa

SEQ ID NO: 1110467 - DNA, 22 bp, Artificial Sequence
  chemically synthesized
atctctgcctccttttataaag

SEQ ID NO: 1110468 - DNA, 22 bp, Artificial Sequence
  chemically synthesized
gggattggtggctttataaaag

SEQ ID NO: 1110469 - DNA, 22 bp, Artificial Sequence
  chemically synthesized
tatctctgcctccttttataaa

SEQ ID NO: 1110470 - DNA, 22 bp, Artificial Sequence
  chemically synthesized
tttatctctgcctccttttata

SEQ ID NO: 1110471 - DNA, 22 bp, Artificial Sequence
  chemically synthesized
tctttatctctgcctcctttta

SEQ ID NO: 1110472 - DNA, 22 bp, Artificial Sequence
  chemically synthesized
tctctttatctctgcctccttt

SEQ ID NO: 1110473 - DNA, 22 bp, Artificial Sequence
  chemically synthesized
gtggctttataaaaggaggcag

SEQ ID NO: 1110474 - DNA, 22 bp, Artificial Sequence
  chemically synthesized
tctctctttatctctgcctcct

SEQ ID NO: 1110475 - DNA, 22 bp, Artificial Sequence
  chemically synthesized
tctctctctttatctctgcctc

SEQ ID NO: 1110476 - DNA, 22 bp, Artificial Sequence
  chemically synthesized
ctctctctctttatctctgcct

SEQ ID NO: 1110477 - DNA, 22 bp, Artificial Sequence
  chemically synthesized
tctctctctctttatctctgcc

SEQ ID NO: 1110478 - DNA, 22 bp, Artificial Sequence
  chemically synthesized
tataaaaggaggcagagataaa

SEQ ID NO: 1110479 - DNA, 22 bp, Artificial Sequence
  chemically synthesized
tttctctctctctttatctctg

SEQ ID NO: 1110480 - DNA, 22 bp, Artificial Sequence
  chemically synthesized
ataaaaggaggcagagataaag

SEQ ID NO: 1110481 - DNA, 22 bp, Artificial Sequence
  chemically synthesized
ctttctctctctctttatctct

SEQ ID NO: 1110482 - DNA, 22 bp, Artificial Sequence
  chemically synthesized
taaaaggaggcagagataaaga

SEQ ID NO: 1110483 - DNA, 22 bp, Artificial Sequence
  chemically synthesized
tctttctctctctctttatctc

SEQ ID NO: 1110484 - DNA, 22 bp, Artificial Sequence
  chemically synthesized
ttctttctctctctctttatct

SEQ ID NO: 1110485 - DNA, 22 bp, Artificial Sequence
  chemically synthesized
tttttctttctctctctcttta

SEQ ID NO: 1110486 - DNA, 22 bp, Artificial Sequence
  chemically synthesized
tgtgtatacatgcagagagaga

SEQ ID NO: 1110487 - DNA, 22 bp, Artificial Sequence
  chemically synthesized
tgtgtgtatacatgcagagaga

SEQ ID NO: 1110488 - DNA, 22 bp, Artificial Sequence
  chemically synthesized
ctctgtgtgtatacatgcagag

SEQ ID NO: 1110489 - DNA, 22 bp, Artificial Sequence
  chemically synthesized
cctctgtgtgtatacatgcaga

SEQ ID NO: 1110490 - DNA, 22 bp, Artificial Sequence
  chemically synthesized
tcctctgtgtgtatacatgcag

SEQ ID NO: 1110491 - DNA, 22 bp, Artificial Sequence
  chemically synthesized
attctctctctctgcatgtata

SEQ ID NO: 1110492 - DNA, 22 bp, Artificial Sequence
  chemically synthesized
tctctctctgcatgtatacaca

SEQ ID NO: 1110493 - DNA, 22 bp, Artificial Sequence
  chemically synthesized
tctctctgcatgtatacacaca

SEQ ID NO: 1110494 - DNA, 22 bp, Artificial Sequence
  chemically synthesized
tctctgcatgtatacacacaga

SEQ ID NO: 1110495 - DNA, 22 bp, Artificial Sequence
  chemically synthesized
acatggctttcctctgtgtgta

SEQ ID NO: 1110496 - DNA, 22 bp, Artificial Sequence
  chemically synthesized
tctgcatgtatacacacagagg

SEQ ID NO: 1110497 - DNA, 22 bp, Artificial Sequence
  chemically synthesized
tgcatgtatacacacagaggaa

SEQ ID NO: 1110498 - DNA, 22 bp, Artificial Sequence
  chemically synthesized
tcctcacatggctttcctctgt

SEQ ID NO: 1110499 - DNA, 22 bp, Artificial Sequence
  chemically synthesized
catgtatacacacagaggaaag

SEQ ID NO: 1110500 - DNA, 22 bp, Artificial Sequence
  chemically synthesized
tgtcctcacatggctttcctct

SEQ ID NO: 1110501 - DNA, 22 bp, Artificial Sequence
  chemically synthesized
actctgtcctcacatggctttc

SEQ ID NO: 1110502 - DNA, 22 bp, Artificial Sequence
  chemically synthesized
tcactctgtcctcacatggctt

SEQ ID NO: 1110503 - DNA, 22 bp, Artificial Sequence
  chemically synthesized
ctcactctgtcctcacatggct

SEQ ID NO: 1110504 - DNA, 22 bp, Artificial Sequence
  chemically synthesized
cagataaccaacttctcactct

SEQ ID NO: 1110505 - DNA, 22 bp, Artificial Sequence
  chemically synthesized
gcagataaccaacttctcactc

SEQ ID NO: 1110506 - DNA, 22 bp, Artificial Sequence
  chemically synthesized
gcttgcagataaccaacttctc

SEQ ID NO: 1110507 - DNA, 22 bp, Artificial Sequence
  chemically synthesized
ctggcttgcagataaccaactt

SEQ ID NO: 1110508 - DNA, 22 bp, Artificial Sequence
  chemically synthesized
cctggcttgcagataaccaact

SEQ ID NO: 1110509 - DNA, 22 bp, Artificial Sequence
  chemically synthesized
tcttcctggcttgcagataacc

SEQ ID NO: 1110510 - DNA, 22 bp, Artificial Sequence
  chemically synthesized
gtgaaggctgtcttcctggctt

SEQ ID NO: 1110511 - DNA, 22 bp, Artificial Sequence
  chemically synthesized
tggtgaaggctgtcttcctggc

SEQ ID NO: 1110512 - DNA, 22 bp, Artificial Sequence
  chemically synthesized
gttatctgcaagccaggaagac

SEQ ID NO: 1110513 - DNA, 22 bp, Artificial Sequence
  chemically synthesized
ctggtgaaggctgtcttcctgg

SEQ ID NO: 1110514 - DNA, 22 bp, Artificial Sequence
  chemically synthesized
tctgcaagccaggaagacagcc

SEQ ID NO: 1110515 - DNA, 22 bp, Artificial Sequence
  chemically synthesized
atcttctggtgaaggctgtctt

SEQ ID NO: 1110516 - DNA, 22 bp, Artificial Sequence
  chemically synthesized
catcttctggtgaaggctgtct

SEQ ID NO: 1110517 - DNA, 22 bp, Artificial Sequence
  chemically synthesized
caagccaggaagacagccttca

SEQ ID NO: 1110518 - DNA, 22 bp, Artificial Sequence
  chemically synthesized
agcttcatcttctggtgaaggc

SEQ ID NO: 1110519 - DNA, 22 bp, Artificial Sequence
  chemically synthesized
gtagggttcagcttcatcttct

SEQ ID NO: 1110520 - DNA, 22 bp, Artificial Sequence
  chemically synthesized
ggtagggttcagcttcatcttc

SEQ ID NO: 1110521 - DNA, 22 bp, Artificial Sequence
  chemically synthesized
caccagaagatgaagctgaacc

SEQ ID NO: 1110522 - DNA, 22 bp, Artificial Sequence
  chemically synthesized
accagaagatgaagctgaaccc

SEQ ID NO: 1110523 - DNA, 22 bp, Artificial Sequence
  chemically synthesized
aaccctaccaaaccttgatcct

SEQ ID NO: 1110524 - DNA, 22 bp, Artificial Sequence
  chemically synthesized
gaagtgagagaaagtccaggat

SEQ ID NO: 1110525 - DNA, 22 bp, Artificial Sequence
  chemically synthesized
ccaaaccttgatcctggacttt

SEQ ID NO: 1110526 - DNA, 22 bp, Artificial Sequence
  chemically synthesized
tagaagtgagagaaagtccagg

SEQ ID NO: 1110527 - DNA, 22 bp, Artificial Sequence
  chemically synthesized
agagttctagaagtgagagaaa

SEQ ID NO: 1110528 - DNA, 22 bp, Artificial Sequence
  chemically synthesized
gatcctggactttctctcactt

SEQ ID NO: 1110529 - DNA, 22 bp, Artificial Sequence
  chemically synthesized
tgagagttctagaagtgagaga

SEQ ID NO: 1110530 - DNA, 22 bp, Artificial Sequence
  chemically synthesized
atcctggactttctctcacttc

SEQ ID NO: 1110531 - DNA, 22 bp, Artificial Sequence
  chemically synthesized
ctgagagttctagaagtgagag

SEQ ID NO: 1110532 - DNA, 22 bp, Artificial Sequence
  chemically synthesized
tctgagagttctagaagtgaga

SEQ ID NO: 1110533 - DNA, 22 bp, Artificial Sequence
  chemically synthesized
ttttctgagagttctagaagtg

SEQ ID NO: 1110534 - DNA, 22 bp, Artificial Sequence
  chemically synthesized
attttctgagagttctagaagt

SEQ ID NO: 1110535 - DNA, 22 bp, Artificial Sequence
  chemically synthesized
gactttctctcacttctagaac

SEQ ID NO: 1110536 - DNA, 22 bp, Artificial Sequence
  chemically synthesized
tctctcacttctagaactctca

SEQ ID NO: 1110537 - DNA, 22 bp, Artificial Sequence
  chemically synthesized
ctctcacttctagaactctcag

SEQ ID NO: 1110538 - DNA, 22 bp, Artificial Sequence
  chemically synthesized
tctcacttctagaactctcaga

SEQ ID NO: 1110539 - DNA, 22 bp, Artificial Sequence
  chemically synthesized
tcacttctagaactctcagaaa

SEQ ID NO: 1110540 - DNA, 22 bp, Artificial Sequence
  chemically synthesized
acttctagaactctcagaaaat

SEQ ID NO: 1110541 - DNA, 22 bp, Artificial Sequence
  chemically synthesized
aacaacacaggtttattttctg

SEQ ID NO: 1110542 - DNA, 22 bp, Artificial Sequence
  chemically synthesized
aaacaacacaggtttattttct

SEQ ID NO: 1110543 - DNA, 22 bp, Artificial Sequence
  chemically synthesized
ctagaactctcagaaaataaac

SEQ ID NO: 1110544 - DNA, 22 bp, Artificial Sequence
  chemically synthesized
tagaactctcagaaaataaacc

SEQ ID NO: 1110545 - DNA, 22 bp, Artificial Sequence
  chemically synthesized
gaactctcagaaaataaacctg

SEQ ID NO: 1110546 - DNA, 22 bp, Artificial Sequence
  chemically synthesized
ggtggcttaaacaacacaggtt

SEQ ID NO: 1110547 - DNA, 22 bp, Artificial Sequence
  chemically synthesized
tcagaaaataaacctgtgttgt

SEQ ID NO: 1110548 - DNA, 22 bp, Artificial Sequence
  chemically synthesized
agaaaataaacctgtgttgttt

SEQ ID NO: 1110549 - DNA, 22 bp, Artificial Sequence
  chemically synthesized
tgttgtttaagccaccgagtct

SEQ ID NO: 1110550 - DNA, 22 bp, Artificial Sequence
  chemically synthesized
ccacaataaataccacagactc

SEQ ID NO: 1110551 - DNA, 22 bp, Artificial Sequence
  chemically synthesized
tttaagccaccgagtctgtggt

SEQ ID NO: 1110552 - DNA, 22 bp, Artificial Sequence
  chemically synthesized
aagccaccgagtctgtggtatt

SEQ ID NO: 1110553 - DNA, 22 bp, Artificial Sequence
  chemically synthesized
agccaccgagtctgtggtattt

SEQ ID NO: 1110554 - DNA, 22 bp, Artificial Sequence
  chemically synthesized
agtctgccacaataaataccac

SEQ ID NO: 1110555 - DNA, 22 bp, Artificial Sequence
  chemically synthesized
atcagctgagtctgccacaata

SEQ ID NO: 1110556 - DNA, 22 bp, Artificial Sequence
  chemically synthesized
tggtatttattgtggcagactc

SEQ ID NO: 1110557 - DNA, 22 bp, Artificial Sequence
  chemically synthesized
agtgtattaatcagctgagtct

SEQ ID NO: 1110558 - DNA, 22 bp, Artificial Sequence
  chemically synthesized
ctgagtgtattaatcagctgag

SEQ ID NO: 1110559 - DNA, 22 bp, Artificial Sequence
  chemically synthesized
attgtggcagactcagctgatt

SEQ ID NO: 1110560 - DNA, 22 bp, Artificial Sequence
  chemically synthesized
ttgtggcagactcagctgatta

SEQ ID NO: 1110561 - DNA, 22 bp, Artificial Sequence
  chemically synthesized
tggcagactcagctgattaata

SEQ ID NO: 1110562 - DNA, 22 bp, Artificial Sequence
  chemically synthesized
agaatgctactgagtgtattaa

SEQ ID NO: 1110563 - DNA, 22 bp, Artificial Sequence
  chemically synthesized
aagaatgctactgagtgtatta

SEQ ID NO: 1110564 - DNA, 22 bp, Artificial Sequence
  chemically synthesized
agctgattaatacactcagtag

SEQ ID NO: 1110565 - DNA, 22 bp, Artificial Sequence
  chemically synthesized
atgtgtttaagaatgctactga

SEQ ID NO: 1110566 - DNA, 22 bp, Artificial Sequence
  chemically synthesized
attaatacactcagtagcattc

SEQ ID NO: 1110567 - DNA, 22 bp, Artificial Sequence
  chemically synthesized
taatgtgtttaagaatgctact

SEQ ID NO: 1110568 - DNA, 22 bp, Artificial Sequence
  chemically synthesized
atacactcagtagcattcttaa

SEQ ID NO: 1110569 - DNA, 22 bp, Artificial Sequence
  chemically synthesized
agtgtctctaatgtgtttaaga

SEQ ID NO: 1110570 - DNA, 22 bp, Artificial Sequence
  chemically synthesized
agtagcattcttaaacacatta

SEQ ID NO: 1110571 - DNA, 22 bp, Artificial Sequence
  chemically synthesized
ttaaacacattagagacactta

SEQ ID NO: 1110572 - DNA, 22 bp, Artificial Sequence
  chemically synthesized
aaacacattagagacacttaat

SEQ ID NO: 1110573 - DNA, 22 bp, Artificial Sequence
  chemically synthesized
aacacattagagacacttaatg

SEQ ID NO: 1110574 - DNA, 22 bp, Artificial Sequence
  chemically synthesized
atgcataaaatatatacattaa

SEQ ID NO: 1110575 - DNA, 22 bp, Artificial Sequence
  chemically synthesized
gagacacttaatgtatatattt

SEQ ID NO: 1110576 - DNA, 22 bp, Artificial Sequence
  chemically synthesized
cacagtacattcatgcataaaa

SEQ ID NO: 1110577 - DNA, 22 bp, Artificial Sequence
  chemically synthesized
aatgtatatattttatgcatga

SEQ ID NO: 1110578 - DNA, 22 bp, Artificial Sequence
  chemically synthesized
atgtatatattttatgcatgaa

SEQ ID NO: 1110579 - DNA, 22 bp, Artificial Sequence
  chemically synthesized
gtaatagtacctacacagtaca

SEQ ID NO: 1110580 - DNA, 22 bp, Artificial Sequence
  chemically synthesized
tatgcatgaatgtactgtgtag

SEQ ID NO: 1110581 - DNA, 22 bp, Artificial Sequence
  chemically synthesized
atgcatgaatgtactgtgtagg

SEQ ID NO: 1110582 - DNA, 22 bp, Artificial Sequence
  chemically synthesized
tgcatgaatgtactgtgtaggt

SEQ ID NO: 1110583 - DNA, 22 bp, Artificial Sequence
  chemically synthesized
agatatagtagttagtaatagt

SEQ ID NO: 1110584 - DNA, 22 bp, Artificial Sequence
  chemically synthesized
tgtaggtactattactaactac

SEQ ID NO: 1110585 - DNA, 22 bp, Artificial Sequence
  chemically synthesized
agattcagatatagtagttagt

SEQ ID NO: 1110586 - DNA, 22 bp, Artificial Sequence
  chemically synthesized
gagattcagatatagtagttag

SEQ ID NO: 1110587 - DNA, 22 bp, Artificial Sequence
  chemically synthesized
ttgagattcagatatagtagtt

SEQ ID NO: 1110588 - DNA, 22 bp, Artificial Sequence
  chemically synthesized
ttactaactactatatctgaat

SEQ ID NO: 1110589 - DNA, 22 bp, Artificial Sequence
  chemically synthesized
tccgattcttgagattcagata

SEQ ID NO: 1110590 - DNA, 22 bp, Artificial Sequence
  chemically synthesized
atccgattcttgagattcagat

SEQ ID NO: 1110591 - DNA, 22 bp, Artificial Sequence
  chemically synthesized
ctaactactatatctgaatctc

SEQ ID NO: 1110592 - DNA, 22 bp, Artificial Sequence
  chemically synthesized
actactatatctgaatctcaag

SEQ ID NO: 1110593 - DNA, 22 bp, Artificial Sequence
  chemically synthesized
ccttatccgattcttgagattc

SEQ ID NO: 1110594 - DNA, 22 bp, Artificial Sequence
  chemically synthesized
ctatatctgaatctcaagaatc

SEQ ID NO: 1110595 - DNA, 22 bp, Artificial Sequence
  chemically synthesized
atgttaccttatccgattcttg

SEQ ID NO: 1110596 - DNA, 22 bp, Artificial Sequence
  chemically synthesized
tatctgaatctcaagaatcgga

SEQ ID NO: 1110597 - DNA, 22 bp, Artificial Sequence
  chemically synthesized
aatctcaagaatcggataaggt

SEQ ID NO: 1110598 - DNA, 22 bp, Artificial Sequence
  chemically synthesized
aagaatcggataaggtaacatc

SEQ ID NO: 1110599 - DNA, 22 bp, Artificial Sequence
  chemically synthesized
ccacaaaaatctgatgttacct

SEQ ID NO: 1110600 - DNA, 22 bp, Artificial Sequence
  chemically synthesized
gccacaaaaatctgatgttacc

SEQ ID NO: 1110601 - DNA, 22 bp, Artificial Sequence
  chemically synthesized
ttgccacaaaaatctgatgtta

SEQ ID NO: 1110602 - DNA, 22 bp, Artificial Sequence
  chemically synthesized
cttgccacaaaaatctgatgtt

SEQ ID NO: 1110603 - DNA, 22 bp, Artificial Sequence
  chemically synthesized
tttcttgccacaaaaatctgat

SEQ ID NO: 1110604 - DNA, 22 bp, Artificial Sequence
  chemically synthesized
ttgtggcaagaaataatgtatt

SEQ ID NO: 1110605 - DNA, 22 bp, Artificial Sequence
  chemically synthesized
tgtggcaagaaataatgtattt

SEQ ID NO: 1110606 - DNA, 22 bp, Artificial Sequence
  chemically synthesized
gtggcaagaaataatgtatttg

SEQ ID NO: 1110607 - DNA, 22 bp, Artificial Sequence
  chemically synthesized
tggcaagaaataatgtatttgg

SEQ ID NO: 1110608 - DNA, 22 bp, Artificial Sequence
  chemically synthesized
tgaatcagaggaataatccaaa

SEQ ID NO: 1110609 - DNA, 22 bp, Artificial Sequence
  chemically synthesized
ctgtgaatcagaggaataatcc

SEQ ID NO: 1110610 - DNA, 22 bp, Artificial Sequence
  chemically synthesized
cctgtgaatcagaggaataatc

SEQ ID NO: 1110611 - DNA, 22 bp, Artificial Sequence
  chemically synthesized
tcctgtgaatcagaggaataat

SEQ ID NO: 1110612 - DNA, 22 bp, Artificial Sequence
  chemically synthesized
ttcctgtgaatcagaggaataa

SEQ ID NO: 1110613 - DNA, 22 bp, Artificial Sequence
  chemically synthesized
ggattattcctctgattcacag

SEQ ID NO: 1110614 - DNA, 22 bp, Artificial Sequence
  chemically synthesized
gattattcctctgattcacagg

SEQ ID NO: 1110615 - DNA, 22 bp, Artificial Sequence
  chemically synthesized
ttcctctgattcacaggaaaag

SEQ ID NO: 1110616 - DNA, 22 bp, Artificial Sequence
  chemically synthesized
ctctgattcacaggaaaagcgg

SEQ ID NO: 1110617 - DNA, 22 bp, Artificial Sequence
  chemically synthesized
tgattcacaggaaaagcggcat

SEQ ID NO: 1110618 - DNA, 22 bp, Artificial Sequence
  chemically synthesized
agaatagaaccaatgccgcttt

SEQ ID NO: 1110619 - DNA, 22 bp, Artificial Sequence
  chemically synthesized
aagaatagaaccaatgccgctt

SEQ ID NO: 1110620 - DNA, 22 bp, Artificial Sequence
  chemically synthesized
attcacaggaaaagcggcattg

SEQ ID NO: 1110621 - DNA, 22 bp, Artificial Sequence
  chemically synthesized
acaggaaaagcggcattggttc

SEQ ID NO: 1110622 - DNA, 22 bp, Artificial Sequence
  chemically synthesized
taatttaagaatagaaccaatg

SEQ ID NO: 1110623 - DNA, 22 bp, Artificial Sequence
  chemically synthesized
gtaatttaagaatagaaccaat

SEQ ID NO: 1110624 - DNA, 22 bp, Artificial Sequence
  chemically synthesized
tgtaatttaagaatagaaccaa

SEQ ID NO: 1110625 - DNA, 22 bp, Artificial Sequence
  chemically synthesized
agatgcattttgtaatttaaga

SEQ ID NO: 1110626 - DNA, 22 bp, Artificial Sequence
  chemically synthesized
gttctattcttaaattacaaaa

SEQ ID NO: 1110627 - DNA, 22 bp, Artificial Sequence
  chemically synthesized
cattgagatgcattttgtaatt

SEQ ID NO: 1110628 - DNA, 22 bp, Artificial Sequence
  chemically synthesized
tacattgagatgcattttgtaa

SEQ ID NO: 1110629 - DNA, 22 bp, Artificial Sequence
  chemically synthesized
ctacattgagatgcattttgta

SEQ ID NO: 1110630 - DNA, 22 bp, Artificial Sequence
  chemically synthesized
tattcttaaattacaaaatgca

SEQ ID NO: 1110631 - DNA, 22 bp, Artificial Sequence
  chemically synthesized
ttcttaaattacaaaatgcatc

SEQ ID NO: 1110632 - DNA, 22 bp, Artificial Sequence
  chemically synthesized
ttaaattacaaaatgcatctca

SEQ ID NO: 1110633 - DNA, 22 bp, Artificial Sequence
  chemically synthesized
aaattacaaaatgcatctcaat

SEQ ID NO: 1110634 - DNA, 22 bp, Artificial Sequence
  chemically synthesized
aggaatttctacattgagatgc

SEQ ID NO: 1110635 - DNA, 22 bp, Artificial Sequence
  chemically synthesized
aattacaaaatgcatctcaatg

SEQ ID NO: 1110636 - DNA, 22 bp, Artificial Sequence
  chemically synthesized
caaaatgcatctcaatgtagaa

SEQ ID NO: 1110637 - DNA, 22 bp, Artificial Sequence
  chemically synthesized
ggcaaatacacacatctaagga

SEQ ID NO: 1110638 - DNA, 22 bp, Artificial Sequence
  chemically synthesized
aatgtagaaattccttagatgt

SEQ ID NO: 1110639 - DNA, 22 bp, Artificial Sequence
  chemically synthesized
ttaggcaaatacacacatctaa

SEQ ID NO: 1110640 - DNA, 22 bp, Artificial Sequence
  chemically synthesized
gttaggcaaatacacacatcta

SEQ ID NO: 1110641 - DNA, 22 bp, Artificial Sequence
  chemically synthesized
acttgttaggcaaatacacaca

SEQ ID NO: 1110642 - DNA, 22 bp, Artificial Sequence
  chemically synthesized
gacttgttaggcaaatacacac

SEQ ID NO: 1110643 - DNA, 22 bp, Artificial Sequence
  chemically synthesized
cttagatgtgtgtatttgccta

SEQ ID NO: 1110644 - DNA, 22 bp, Artificial Sequence
  chemically synthesized
agatgtgtgtatttgcctaaca

SEQ ID NO: 1110645 - DNA, 22 bp, Artificial Sequence
  chemically synthesized
gatgtgtgtatttgcctaacaa

SEQ ID NO: 1110646 - DNA, 22 bp, Artificial Sequence
  chemically synthesized
gataaggcacttgacttgttag

SEQ ID NO: 1110647 - DNA, 22 bp, Artificial Sequence
  chemically synthesized
ggataaggcacttgacttgtta

SEQ ID NO: 1110648 - DNA, 22 bp, Artificial Sequence
  chemically synthesized
gcctaacaagtcaagtgcctta

SEQ ID NO: 1110649 - DNA, 22 bp, Artificial Sequence
  chemically synthesized
cctaacaagtcaagtgccttat

SEQ ID NO: 1110650 - DNA, 22 bp, Artificial Sequence
  chemically synthesized
acaagtcaagtgccttatccaa

SEQ ID NO: 1110651 - DNA, 22 bp, Artificial Sequence
  chemically synthesized
gataaagaataccttggataag

SEQ ID NO: 1110652 - DNA, 22 bp, Artificial Sequence
  chemically synthesized
ggataaagaataccttggataa

SEQ ID NO: 1110653 - DNA, 22 bp, Artificial Sequence
  chemically synthesized
tggataaagaataccttggata

SEQ ID NO: 1110654 - DNA, 22 bp, Artificial Sequence
  chemically synthesized
ttggataaagaataccttggat

SEQ ID NO: 1110655 - DNA, 22 bp, Artificial Sequence
  chemically synthesized
atccaaggtattctttatccaa

SEQ ID NO: 1110656 - DNA, 22 bp, Artificial Sequence
  chemically synthesized
tccaaggtattctttatccaaa

SEQ ID NO: 1110657 - DNA, 22 bp, Artificial Sequence
  chemically synthesized
agaaagtatacttttggataaa

SEQ ID NO: 1110658 - DNA, 22 bp, Artificial Sequence
  chemically synthesized
tttatccaaaagtatactttct

SEQ ID NO: 1110659 - DNA, 22 bp, Artificial Sequence
  chemically synthesized
aggaaataaactcagaaagtat

SEQ ID NO: 1110660 - DNA, 22 bp, Artificial Sequence
  chemically synthesized
tatccaaaagtatactttctga

SEQ ID NO: 1110661 - DNA, 22 bp, Artificial Sequence
  chemically synthesized
atccaaaagtatactttctgag

SEQ ID NO: 1110662 - DNA, 22 bp, Artificial Sequence
  chemically synthesized
tccaaaagtatactttctgagt

SEQ ID NO: 1110663 - DNA, 22 bp, Artificial Sequence
  chemically synthesized
ctgaggaaataaactcagaaag

SEQ ID NO: 1110664 - DNA, 22 bp, Artificial Sequence
  chemically synthesized
gctgaggaaataaactcagaaa

SEQ ID NO: 1110665 - DNA, 22 bp, Artificial Sequence
  chemically synthesized
gtttgctgaggaaataaactca

SEQ ID NO: 1110666 - DNA, 22 bp, Artificial Sequence
  chemically synthesized
tgttagtttgctgaggaaataa

SEQ ID NO: 1110667 - DNA, 22 bp, Artificial Sequence
  chemically synthesized
gtgttagtttgctgaggaaata

SEQ ID NO: 1110668 - DNA, 22 bp, Artificial Sequence
  chemically synthesized
ttgtgttagtttgctgaggaaa

SEQ ID NO: 1110669 - DNA, 22 bp, Artificial Sequence
  chemically synthesized
tctgagtttatttcctcagcaa

SEQ ID NO: 1110670 - DNA, 22 bp, Artificial Sequence
  chemically synthesized
ctgagtttatttcctcagcaaa

SEQ ID NO: 1110671 - DNA, 22 bp, Artificial Sequence
  chemically synthesized
ttcttgtgttagtttgctgagg

SEQ ID NO: 1110672 - DNA, 22 bp, Artificial Sequence
  chemically synthesized
tgagtttatttcctcagcaaac

SEQ ID NO: 1110673 - DNA, 22 bp, Artificial Sequence
  chemically synthesized
tgttcttgtgttagtttgctga

SEQ ID NO: 1110674 - DNA, 22 bp, Artificial Sequence
  chemically synthesized
agtttatttcctcagcaaacta

SEQ ID NO: 1110675 - DNA, 22 bp, Artificial Sequence
  chemically synthesized
ctgttcttgtgttagtttgctg

SEQ ID NO: 1110676 - DNA, 22 bp, Artificial Sequence
  chemically synthesized
tctgttcttgtgttagtttgct

SEQ ID NO: 1110677 - DNA, 22 bp, Artificial Sequence
  chemically synthesized
atttcctcagcaaactaacaca

SEQ ID NO: 1110678 - DNA, 22 bp, Artificial Sequence
  chemically synthesized
tttcctcagcaaactaacacaa

SEQ ID NO: 1110679 - DNA, 22 bp, Artificial Sequence
  chemically synthesized
ggttttctgttcttgtgttagt

SEQ ID NO: 1110680 - DNA, 22 bp, Artificial Sequence
  chemically synthesized
cctcagcaaactaacacaagaa

SEQ ID NO: 1110681 - DNA, 22 bp, Artificial Sequence
  chemically synthesized
ttaggttttctgttcttgtgtt

SEQ ID NO: 1110682 - DNA, 22 bp, Artificial Sequence
  chemically synthesized
ctcagcaaactaacacaagaac

SEQ ID NO: 1110683 - DNA, 22 bp, Artificial Sequence
  chemically synthesized
agcaaactaacacaagaacaga

SEQ ID NO: 1110684 - DNA, 22 bp, Artificial Sequence
  chemically synthesized
tagcattattaggttttctgtt

SEQ ID NO: 1110685 - DNA, 22 bp, Artificial Sequence
  chemically synthesized
acacaagaacagaaaacctaat

SEQ ID NO: 1110686 - DNA, 22 bp, Artificial Sequence
  chemically synthesized
aaatatcggacctgtagcatta

SEQ ID NO: 1110687 - DNA, 22 bp, Artificial Sequence
  chemically synthesized
caaatatcggacctgtagcatt

SEQ ID NO: 1110688 - DNA, 22 bp, Artificial Sequence
  chemically synthesized
ttcaaatatcggacctgtagca

SEQ ID NO: 1110689 - DNA, 22 bp, Artificial Sequence
  chemically synthesized
atggttcttcaaatatcggacc

SEQ ID NO: 1110690 - DNA, 22 bp, Artificial Sequence
  chemically synthesized
ataatgctacaggtccgatatt

SEQ ID NO: 1110691 - DNA, 22 bp, Artificial Sequence
  chemically synthesized
aatggttcttcaaatatcggac

SEQ ID NO: 1110692 - DNA, 22 bp, Artificial Sequence
  chemically synthesized
aaggacttaatggttcttcaaa

SEQ ID NO: 1110693 - DNA, 22 bp, Artificial Sequence
  chemically synthesized
caggtccgatatttgaagaacc

SEQ ID NO: 1110694 - DNA, 22 bp, Artificial Sequence
  chemically synthesized
gaagaaccattaagtccttcaa

SEQ ID NO: 1110695 - DNA, 22 bp, Artificial Sequence
  chemically synthesized
aagaaccattaagtccttcaat

SEQ ID NO: 1110696 - DNA, 22 bp, Artificial Sequence
  chemically synthesized
aagagaaaaacaattgaaggac

SEQ ID NO: 1110697 - DNA, 22 bp, Artificial Sequence
  chemically synthesized
gaagagaaaaacaattgaagga

SEQ ID NO: 1110698 - DNA, 22 bp, Artificial Sequence
  chemically synthesized
tgaagagaaaaacaattgaagg

SEQ ID NO: 1110699 - DNA, 22 bp, Artificial Sequence
  chemically synthesized
ttttgaagagaaaaacaattga

SEQ ID NO: 1110700 - DNA, 22 bp, Artificial Sequence
  chemically synthesized
agtccttcaattgtttttctct

SEQ ID NO: 1110701 - DNA, 22 bp, Artificial Sequence
  chemically synthesized
aaagctattttgaagagaaaaa

SEQ ID NO: 1110702 - DNA, 22 bp, Artificial Sequence
  chemically synthesized
caattgtttttctcttcaaaat

SEQ ID NO: 1110703 - DNA, 22 bp, Artificial Sequence
  chemically synthesized
aattgtttttctcttcaaaata

SEQ ID NO: 1110704 - DNA, 22 bp, Artificial Sequence
  chemically synthesized
tttttctcttcaaaatagcttt

SEQ ID NO: 1110705 - DNA, 22 bp, Artificial Sequence
  chemically synthesized
ttctcttcaaaatagctttgaa

SEQ ID NO: 1110706 - DNA, 22 bp, Artificial Sequence
  chemically synthesized
tctcttcaaaatagctttgaat

SEQ ID NO: 1110707 - DNA, 22 bp, Artificial Sequence
  chemically synthesized
ctcttcaaaatagctttgaatt

SEQ ID NO: 1110708 - DNA, 22 bp, Artificial Sequence
  chemically synthesized
tcttcaaaatagctttgaattt

SEQ ID NO: 1110709 - DNA, 22 bp, Artificial Sequence
  chemically synthesized
ttcaaaatagctttgaatttct

SEQ ID NO: 1110710 - DNA, 22 bp, Artificial Sequence
  chemically synthesized
caaaatagctttgaatttctca

SEQ ID NO: 1110711 - DNA, 22 bp, Artificial Sequence
  chemically synthesized
aaaatagctttgaatttctcat

SEQ ID NO: 1110712 - DNA, 22 bp, Artificial Sequence
  chemically synthesized
gacccaaaaagtgatgagaaat

SEQ ID NO: 1110713 - DNA, 22 bp, Artificial Sequence
  chemically synthesized
tgaatttctcatcactttttgg

SEQ ID NO: 1110714 - DNA, 22 bp, Artificial Sequence
  chemically synthesized
gaatttctcatcactttttggg

SEQ ID NO: 1110715 - DNA, 22 bp, Artificial Sequence
  chemically synthesized
aatttctcatcactttttgggt

SEQ ID NO: 1110716 - DNA, 22 bp, Artificial Sequence
  chemically synthesized
gaaaaggtattggacccaaaaa

SEQ ID NO: 1110717 - DNA, 22 bp, Artificial Sequence
  chemically synthesized
agaaaaggtattggacccaaaa

SEQ ID NO: 1110718 - DNA, 22 bp, Artificial Sequence
  chemically synthesized
ctcatcactttttgggtccaat

SEQ ID NO: 1110719 - DNA, 22 bp, Artificial Sequence
  chemically synthesized
tcatcactttttgggtccaata

SEQ ID NO: 1110720 - DNA, 22 bp, Artificial Sequence
  chemically synthesized
atttagaaaaggtattggaccc

SEQ ID NO: 1110721 - DNA, 22 bp, Artificial Sequence
  chemically synthesized
atcactttttgggtccaatacc

SEQ ID NO: 1110722 - DNA, 22 bp, Artificial Sequence
  chemically synthesized
tttgggtccaataccttttcta

SEQ ID NO: 1110723 - DNA, 22 bp, Artificial Sequence
  chemically synthesized
ttgggtccaataccttttctaa

SEQ ID NO: 1110724 - DNA, 22 bp, Artificial Sequence
  chemically synthesized
tgggtccaataccttttctaaa

SEQ ID NO: 1110725 - DNA, 22 bp, Artificial Sequence
  chemically synthesized
gggtccaataccttttctaaat

SEQ ID NO: 1110726 - DNA, 22 bp, Artificial Sequence
  chemically synthesized
ggtccaataccttttctaaatc

SEQ ID NO: 1110727 - DNA, 22 bp, Artificial Sequence
  chemically synthesized
ttctaaatcaaccttgtcacct

SEQ ID NO: 1110728 - DNA, 22 bp, Artificial Sequence
  chemically synthesized
tctaaatcaaccttgtcacctt

SEQ ID NO: 1110729 - DNA, 22 bp, Artificial Sequence
  chemically synthesized
ctaaatcaaccttgtcaccttt

SEQ ID NO: 1110730 - DNA, 22 bp, Artificial Sequence
  chemically synthesized
taaatcaaccttgtcacctttc

SEQ ID NO: 1110731 - DNA, 22 bp, Artificial Sequence
  chemically synthesized
aatcaaccttgtcacctttcca

SEQ ID NO: 1110732 - DNA, 22 bp, Artificial Sequence
  chemically synthesized
aataaaggtagaatagacatgg

SEQ ID NO: 1110733 - DNA, 22 bp, Artificial Sequence
  chemically synthesized
aaataaaggtagaatagacatg

SEQ ID NO: 1110734 - DNA, 22 bp, Artificial Sequence
  chemically synthesized
gtcacctttccatgtctattct

SEQ ID NO: 1110735 - DNA, 22 bp, Artificial Sequence
  chemically synthesized
tcacctttccatgtctattcta

SEQ ID NO: 1110736 - DNA, 22 bp, Artificial Sequence
  chemically synthesized
tccatgtctattctacctttat

SEQ ID NO: 1110737 - DNA, 22 bp, Artificial Sequence
  chemically synthesized
ccatgtctattctacctttatt

SEQ ID NO: 1110738 - DNA, 22 bp, Artificial Sequence
  chemically synthesized
catgtctattctacctttattt

SEQ ID NO: 1110739 - DNA, 22 bp, Artificial Sequence
  chemically synthesized
taaaaaagaatggcttaaataa

SEQ ID NO: 1110740 - DNA, 22 bp, Artificial Sequence
  chemically synthesized
ttctacctttatttaagccatt

SEQ ID NO: 1110741 - DNA, 22 bp, Artificial Sequence
  chemically synthesized
tacctttatttaagccattctt

SEQ ID NO: 1110742 - DNA, 22 bp, Artificial Sequence
  chemically synthesized
catactgtaaaaaagaatggct

SEQ ID NO: 1110743 - DNA, 22 bp, Artificial Sequence
  chemically synthesized
gcatactgtaaaaaagaatggc

SEQ ID NO: 1110744 - DNA, 22 bp, Artificial Sequence
  chemically synthesized
cctttatttaagccattctttt

SEQ ID NO: 1110745 - DNA, 22 bp, Artificial Sequence
  chemically synthesized
atttgcatactgtaaaaaagaa

SEQ ID NO: 1110746 - DNA, 22 bp, Artificial Sequence
  chemically synthesized
tatttaagccattcttttttac

SEQ ID NO: 1110747 - DNA, 22 bp, Artificial Sequence
  chemically synthesized
atttaagccattcttttttaca

SEQ ID NO: 1110748 - DNA, 22 bp, Artificial Sequence
  chemically synthesized
tttaagccattcttttttacag

SEQ ID NO: 1110749 - DNA, 22 bp, Artificial Sequence
  chemically synthesized
aagccattcttttttacagtat

SEQ ID NO: 1110750 - DNA, 22 bp, Artificial Sequence
  chemically synthesized
agccattcttttttacagtatg

SEQ ID NO: 1110751 - DNA, 22 bp, Artificial Sequence
  chemically synthesized
ttttttacagtatgcaaatgaa

SEQ ID NO: 1110752 - DNA, 22 bp, Artificial Sequence
  chemically synthesized
ttttacagtatgcaaatgaatc

SEQ ID NO: 1110753 - DNA, 22 bp, Artificial Sequence
  chemically synthesized
tttacagtatgcaaatgaatct

SEQ ID NO: 1110754 - DNA, 22 bp, Artificial Sequence
  chemically synthesized
ttacagtatgcaaatgaatctc

SEQ ID NO: 1110755 - DNA, 22 bp, Artificial Sequence
  chemically synthesized
tacagtatgcaaatgaatctcc

SEQ ID NO: 1110756 - DNA, 22 bp, Artificial Sequence
  chemically synthesized
acagtatgcaaatgaatctcca

SEQ ID NO: 1110757 - DNA, 22 bp, Artificial Sequence
  chemically synthesized
cagtatgcaaatgaatctccac

SEQ ID NO: 1110758 - DNA, 22 bp, Artificial Sequence
  chemically synthesized
atacaaaaggcaaggagtggag

SEQ ID NO: 1110759 - DNA, 22 bp, Artificial Sequence
  chemically synthesized
aatacaaaaggcaaggagtgga

SEQ ID NO: 1110760 - DNA, 22 bp, Artificial Sequence
  chemically synthesized
catttaatacaaaaggcaagga

SEQ ID NO: 1110761 - DNA, 22 bp, Artificial Sequence
  chemically synthesized
cactccttgccttttgtattaa

SEQ ID NO: 1110762 - DNA, 22 bp, Artificial Sequence
  chemically synthesized
cttgccttttgtattaaatgta

SEQ ID NO: 1110763 - DNA, 22 bp, Artificial Sequence
  chemically synthesized
gccttttgtattaaatgtaatc

SEQ ID NO: 1110764 - DNA, 22 bp, Artificial Sequence
  chemically synthesized
ccttttgtattaaatgtaatca

SEQ ID NO: 1110765 - DNA, 22 bp, Artificial Sequence
  chemically synthesized
gtgatagatcgagatgattaca

SEQ ID NO: 1110766 - DNA, 22 bp, Artificial Sequence
  chemically synthesized
agtgatagatcgagatgattac

SEQ ID NO: 1110767 - DNA, 22 bp, Artificial Sequence
  chemically synthesized
ttgtattaaatgtaatcatctc

SEQ ID NO: 1110768 - DNA, 22 bp, Artificial Sequence
  chemically synthesized
tgtattaaatgtaatcatctcg

SEQ ID NO: 1110769 - DNA, 22 bp, Artificial Sequence
  chemically synthesized
gtattaaatgtaatcatctcga

SEQ ID NO: 1110770 - DNA, 22 bp, Artificial Sequence
  chemically synthesized
tattaaatgtaatcatctcgat

SEQ ID NO: 1110771 - DNA, 22 bp, Artificial Sequence
  chemically synthesized
aatgtaatcatctcgatctatc

SEQ ID NO: 1110772 - DNA, 22 bp, Artificial Sequence
  chemically synthesized
caggatgaacgtttagtgatag

SEQ ID NO: 1110773 - DNA, 22 bp, Artificial Sequence
  chemically synthesized
ccaggatgaacgtttagtgata

SEQ ID NO: 1110774 - DNA, 22 bp, Artificial Sequence
  chemically synthesized
gatctatcactaaacgttcatc

SEQ ID NO: 1110775 - DNA, 22 bp, Artificial Sequence
  chemically synthesized
aaacgtttccaggatgaacgtt

SEQ ID NO: 1110776 - DNA, 22 bp, Artificial Sequence
  chemically synthesized
tcactaaacgttcatcctggaa

SEQ ID NO: 1110777 - DNA, 22 bp, Artificial Sequence
  chemically synthesized
aacgttcatcctggaaacgttt

SEQ ID NO: 1110778 - DNA, 22 bp, Artificial Sequence
  chemically synthesized
gaggatggactaaaacgtttcc

SEQ ID NO: 1110779 - DNA, 22 bp, Artificial Sequence
  chemically synthesized
attagaggatggactaaaacgt

SEQ ID NO: 1110780 - DNA, 22 bp, Artificial Sequence
  chemically synthesized
atcctggaaacgttttagtcca

SEQ ID NO: 1110781 - DNA, 22 bp, Artificial Sequence
  chemically synthesized
gaaacgttttagtccatcctct

SEQ ID NO: 1110782 - DNA, 22 bp, Artificial Sequence
  chemically synthesized
tagtccatcctctaatcagttt

SEQ ID NO: 1110783 - DNA, 22 bp, Artificial Sequence
  chemically synthesized
gcggggaatgagaaactgatta

SEQ ID NO: 1110784 - DNA, 22 bp, Artificial Sequence
  chemically synthesized
agtccatcctctaatcagtttc

SEQ ID NO: 1110785 - DNA, 22 bp, Artificial Sequence
  chemically synthesized
cgcggggaatgagaaactgatt

SEQ ID NO: 1110786 - DNA, 22 bp, Artificial Sequence
  chemically synthesized
gtccatcctctaatcagtttct

SEQ ID NO: 1110787 - DNA, 22 bp, Artificial Sequence
  chemically synthesized
tcgcggggaatgagaaactgat

SEQ ID NO: 1110788 - DNA, 22 bp, Artificial Sequence
  chemically synthesized
ttcgcggggaatgagaaactga

SEQ ID NO: 1110789 - DNA, 22 bp, Artificial Sequence
  chemically synthesized
tgtgcttttcgcggggaatgag

SEQ ID NO: 1110790 - DNA, 22 bp, Artificial Sequence
  chemically synthesized
taatcagtttctcattccccgc

SEQ ID NO: 1110791 - DNA, 22 bp, Artificial Sequence
  chemically synthesized
atcagtttctcattccccgcga

SEQ ID NO: 1110792 - DNA, 22 bp, Artificial Sequence
  chemically synthesized
tgagctatgtgcttttcgcggg

SEQ ID NO: 1110793 - DNA, 22 bp, Artificial Sequence
  chemically synthesized
ctatgagctatgtgcttttcgc

SEQ ID NO: 1110794 - DNA, 22 bp, Artificial Sequence
  chemically synthesized
ctcattccccgcgaaaagcaca

SEQ ID NO: 1110795 - DNA, 22 bp, Artificial Sequence
  chemically synthesized
tcattccccgcgaaaagcacat

SEQ ID NO: 1110796 - DNA, 22 bp, Artificial Sequence
  chemically synthesized
ttactatgagctatgtgctttt

SEQ ID NO: 1110797 - DNA, 22 bp, Artificial Sequence
  chemically synthesized
attccccgcgaaaagcacatag

SEQ ID NO: 1110798 - DNA, 22 bp, Artificial Sequence
  chemically synthesized
attgttactatgagctatgtgc

SEQ ID NO: 1110799 - DNA, 22 bp, Artificial Sequence
  chemically synthesized
cattgttactatgagctatgtg

SEQ ID NO: 1110800 - DNA, 22 bp, Artificial Sequence
  chemically synthesized
cccgcgaaaagcacatagctca

SEQ ID NO: 1110801 - DNA, 22 bp, Artificial Sequence
  chemically synthesized
tcattgttactatgagctatgt

SEQ ID NO: 1110802 - DNA, 22 bp, Artificial Sequence
  chemically synthesized
ttttcattgttactatgagcta

SEQ ID NO: 1110803 - DNA, 22 bp, Artificial Sequence
  chemically synthesized
aactgttttcattgttactatg

SEQ ID NO: 1110804 - DNA, 22 bp, Artificial Sequence
  chemically synthesized
atagtaacaatgaaaacagttt

SEQ ID NO: 1110805 - DNA, 22 bp, Artificial Sequence
  chemically synthesized
tataataatgaaaatagcctaa

SEQ ID NO: 1110806 - DNA, 22 bp, Artificial Sequence
  chemically synthesized
aggctattttcattattataca

SEQ ID NO: 1110807 - DNA, 22 bp, Artificial Sequence
  chemically synthesized
ggctattttcattattatacag

SEQ ID NO: 1110808 - DNA, 22 bp, Artificial Sequence
  chemically synthesized
ttttcattattatacagctctt

SEQ ID NO: 1110809 - DNA, 22 bp, Artificial Sequence
  chemically synthesized
aagtgtaagaaaacaagagctg

SEQ ID NO: 1110810 - DNA, 22 bp, Artificial Sequence
  chemically synthesized
tcattattatacagctcttgtt

SEQ ID NO: 1110811 - DNA, 22 bp, Artificial Sequence
  chemically synthesized
caagtgtaagaaaacaagagct

SEQ ID NO: 1110812 - DNA, 22 bp, Artificial Sequence
  chemically synthesized
cattattatacagctcttgttt

SEQ ID NO: 1110813 - DNA, 22 bp, Artificial Sequence
  chemically synthesized
attattatacagctcttgtttt

SEQ ID NO: 1110814 - DNA, 22 bp, Artificial Sequence
  chemically synthesized
ttatacagctcttgttttctta

SEQ ID NO: 1110815 - DNA, 22 bp, Artificial Sequence
  chemically synthesized
tgccttcaagtgtaagaaaaca

SEQ ID NO: 1110816 - DNA, 22 bp, Artificial Sequence
  chemically synthesized
tacagctcttgttttcttacac

SEQ ID NO: 1110817 - DNA, 22 bp, Artificial Sequence
  chemically synthesized
ttgttttcttacacttgaaggc

SEQ ID NO: 1110818 - DNA, 22 bp, Artificial Sequence
  chemically synthesized
gttttcttacacttgaaggcat

SEQ ID NO: 1110819 - DNA, 22 bp, Artificial Sequence
  chemically synthesized
ttttcttacacttgaaggcata

SEQ ID NO: 1110820 - DNA, 22 bp, Artificial Sequence
  chemically synthesized
tcttacacttgaaggcataatc

SEQ ID NO: 1110821 - DNA, 22 bp, Artificial Sequence
  chemically synthesized
cttacacttgaaggcataatcc

SEQ ID NO: 1110822 - DNA, 22 bp, Artificial Sequence
  chemically synthesized
ttacacttgaaggcataatcct

SEQ ID NO: 1110823 - DNA, 22 bp, Artificial Sequence
  chemically synthesized
agaaagagatgaaaggattatg

SEQ ID NO: 1110824 - DNA, 22 bp, Artificial Sequence
  chemically synthesized
acacttgaaggcataatccttt

SEQ ID NO: 1110825 - DNA, 22 bp, Artificial Sequence
  chemically synthesized
cacttgaaggcataatcctttc

SEQ ID NO: 1110826 - DNA, 22 bp, Artificial Sequence
  chemically synthesized
gaaggcataatcctttcatctc

SEQ ID NO: 1110827 - DNA, 22 bp, Artificial Sequence
  chemically synthesized
aaggcataatcctttcatctct

SEQ ID NO: 1110828 - DNA, 22 bp, Artificial Sequence
  chemically synthesized
tcatctctttctcaggcccttt

SEQ ID NO: 1110829 - DNA, 22 bp, Artificial Sequence
  chemically synthesized
catctctttctcaggccctttt

SEQ ID NO: 1110830 - DNA, 22 bp, Artificial Sequence
  chemically synthesized
atctctttctcaggcccttttg

SEQ ID NO: 1110831 - DNA, 22 bp, Artificial Sequence
  chemically synthesized
tttctcaggcccttttgtccac

SEQ ID NO: 1110832 - DNA, 22 bp, Artificial Sequence
  chemically synthesized
tctcaggcccttttgtccactt

SEQ ID NO: 1110833 - DNA, 22 bp, Artificial Sequence
  chemically synthesized
ctcaggcccttttgtccactta

SEQ ID NO: 1110834 - DNA, 22 bp, Artificial Sequence
  chemically synthesized
tcaggcccttttgtccacttac

SEQ ID NO: 1110835 - DNA, 22 bp, Artificial Sequence
  chemically synthesized
aggcccttttgtccacttacat

SEQ ID NO: 1110836 - DNA, 22 bp, Artificial Sequence
  chemically synthesized
gaggggcaaacaagatgtaagt

SEQ ID NO: 1110837 - DNA, 22 bp, Artificial Sequence
  chemically synthesized
ttgtccacttacatcttgtttg

SEQ ID NO: 1110838 - DNA, 22 bp, Artificial Sequence
  chemically synthesized
tgtccacttacatcttgtttgc

SEQ ID NO: 1110839 - DNA, 22 bp, Artificial Sequence
  chemically synthesized
gtccacttacatcttgtttgcc

SEQ ID NO: 1110840 - DNA, 22 bp, Artificial Sequence
  chemically synthesized
tccacttacatcttgtttgccc

SEQ ID NO: 1110841 - DNA, 22 bp, Artificial Sequence
  chemically synthesized
acatcttgtttgcccctccaga

SEQ ID NO: 1110842 - DNA, 22 bp, Artificial Sequence
  chemically synthesized
catcttgtttgcccctccagat

SEQ ID NO: 1110843 - DNA, 22 bp, Artificial Sequence
  chemically synthesized
gtttgcccctccagatccactg

SEQ ID NO: 1110844 - DNA, 22 bp, Artificial Sequence
  chemically synthesized
tttgcccctccagatccactgt

SEQ ID NO: 1110845 - DNA, 22 bp, Artificial Sequence
  chemically synthesized
gcccctccagatccactgtccg

SEQ ID NO: 1110846 - DNA, 22 bp, Artificial Sequence
  chemically synthesized
cccctccagatccactgtccgc

SEQ ID NO: 1110847 - DNA, 22 bp, Artificial Sequence
  chemically synthesized
ggtaacaggagaagagcggaca

SEQ ID NO: 1110848 - DNA, 22 bp, Artificial Sequence
  chemically synthesized
cagatccactgtccgctcttct

SEQ ID NO: 1110849 - DNA, 22 bp, Artificial Sequence
  chemically synthesized
ctgggtaacaggagaagagcgg

SEQ ID NO: 1110850 - DNA, 22 bp, Artificial Sequence
  chemically synthesized
tccgctcttctcctgttaccca

SEQ ID NO: 1110851 - DNA, 22 bp, Artificial Sequence
  chemically synthesized
taaatatcagtctcctgggtaa

SEQ ID NO: 1110852 - DNA, 22 bp, Artificial Sequence
  chemically synthesized
ttctcctgttacccaggagact

SEQ ID NO: 1110853 - DNA, 22 bp, Artificial Sequence
  chemically synthesized
ctcctgttacccaggagactga

SEQ ID NO: 1110854 - DNA, 22 bp, Artificial Sequence
  chemically synthesized
tcctgttacccaggagactgat

SEQ ID NO: 1110855 - DNA, 22 bp, Artificial Sequence
  chemically synthesized
ctgttacccaggagactgatat

SEQ ID NO: 1110856 - DNA, 22 bp, Artificial Sequence
  chemically synthesized
ttacccaggagactgatattta

SEQ ID NO: 1110857 - DNA, 22 bp, Artificial Sequence
  chemically synthesized
cccaggagactgatatttacag

SEQ ID NO: 1110858 - DNA, 22 bp, Artificial Sequence
  chemically synthesized
atatttacagatgacggttcct

SEQ ID NO: 1110859 - DNA, 22 bp, Artificial Sequence
  chemically synthesized
acagatgacggttccttgtcct

SEQ ID NO: 1110860 - DNA, 22 bp, Artificial Sequence
  chemically synthesized
atcgtaagacaaaggacaagga

SEQ ID NO: 1110861 - DNA, 22 bp, Artificial Sequence
  chemically synthesized
cagatgacggttccttgtcctt

SEQ ID NO: 1110862 - DNA, 22 bp, Artificial Sequence
  chemically synthesized
aatcgtaagacaaaggacaagg

SEQ ID NO: 1110863 - DNA, 22 bp, Artificial Sequence
  chemically synthesized
aacttaatcgtaagacaaagga

SEQ ID NO: 1110864 - DNA, 22 bp, Artificial Sequence
  chemically synthesized
actaaacttaatcgtaagacaa

SEQ ID NO: 1110865 - DNA, 22 bp, Artificial Sequence
  chemically synthesized
cttgtcctttgtcttacgatta

SEQ ID NO: 1110866 - DNA, 22 bp, Artificial Sequence
  chemically synthesized
actgactaaacttaatcgtaag

SEQ ID NO: 1110867 - DNA, 22 bp, Artificial Sequence
  chemically synthesized
gtcctttgtcttacgattaagt

SEQ ID NO: 1110868 - DNA, 22 bp, Artificial Sequence
  chemically synthesized
ctcactgactaaacttaatcgt

SEQ ID NO: 1110869 - DNA, 22 bp, Artificial Sequence
  chemically synthesized
tcctttgtcttacgattaagtt

SEQ ID NO: 1110870 - DNA, 22 bp, Artificial Sequence
  chemically synthesized
tgtcttacgattaagtttagtc

SEQ ID NO: 1110871 - DNA, 22 bp, Artificial Sequence
  chemically synthesized
gtcttacgattaagtttagtca

SEQ ID NO: 1110872 - DNA, 22 bp, Artificial Sequence
  chemically synthesized
tcttacgattaagtttagtcag

SEQ ID NO: 1110873 - DNA, 22 bp, Artificial Sequence
  chemically synthesized
tcagggctcctcactgactaaa

SEQ ID NO: 1110874 - DNA, 22 bp, Artificial Sequence
  chemically synthesized
gtcagggctcctcactgactaa

SEQ ID NO: 1110875 - DNA, 22 bp, Artificial Sequence
  chemically synthesized
acgattaagtttagtcagtgag

SEQ ID NO: 1110876 - DNA, 22 bp, Artificial Sequence
  chemically synthesized
cgattaagtttagtcagtgagg

SEQ ID NO: 1110877 - DNA, 22 bp, Artificial Sequence
  chemically synthesized
agtttagtcagtgaggagccct

SEQ ID NO: 1110878 - DNA, 22 bp, Artificial Sequence
  chemically synthesized
cagaatcttgtcagggctcctc

SEQ ID NO: 1110879 - DNA, 22 bp, Artificial Sequence
  chemically synthesized
cctccagaatcttgtcagggct

SEQ ID NO: 1110880 - DNA, 22 bp, Artificial Sequence
  chemically synthesized
agtcagtgaggagccctgacaa

SEQ ID NO: 1110881 - DNA, 22 bp, Artificial Sequence
  chemically synthesized
gtcagtgaggagccctgacaag

SEQ ID NO: 1110882 - DNA, 22 bp, Artificial Sequence
  chemically synthesized
cctgcctccagaatcttgtcag

SEQ ID NO: 1110883 - DNA, 22 bp, Artificial Sequence
  chemically synthesized
ccctgcctccagaatcttgtca

SEQ ID NO: 1110884 - DNA, 22 bp, Artificial Sequence
  chemically synthesized
tccctgcctccagaatcttgtc

SEQ ID NO: 1110885 - DNA, 22 bp, Artificial Sequence
  chemically synthesized
ttccctgcctccagaatcttgt

SEQ ID NO: 1110886 - DNA, 22 bp, Artificial Sequence
  chemically synthesized
tttccctgcctccagaatcttg

SEQ ID NO: 1110887 - DNA, 22 bp, Artificial Sequence
  chemically synthesized
ttttccctgcctccagaatctt

SEQ ID NO: 1110888 - DNA, 22 bp, Artificial Sequence
  chemically synthesized
acttttttccctgcctccagaa

SEQ ID NO: 1110889 - DNA, 22 bp, Artificial Sequence
  chemically synthesized
cacttttttccctgcctccaga

SEQ ID NO: 1110890 - DNA, 22 bp, Artificial Sequence
  chemically synthesized
acaagattctggaggcagggaa

SEQ ID NO: 1110891 - DNA, 22 bp, Artificial Sequence
  chemically synthesized
tggaggcagggaaaaaagtgaa

SEQ ID NO: 1110892 - DNA, 22 bp, Artificial Sequence
  chemically synthesized
gaggcagggaaaaaagtgaagt

SEQ ID NO: 1110893 - DNA, 22 bp, Artificial Sequence
  chemically synthesized
atagaaatggagtcagacaaat

SEQ ID NO: 1110894 - DNA, 22 bp, Artificial Sequence
  chemically synthesized
aggaatcctcatagaaatggag

SEQ ID NO: 1110895 - DNA, 22 bp, Artificial Sequence
  chemically synthesized
aaggaatcctcatagaaatgga

SEQ ID NO: 1110896 - DNA, 22 bp, Artificial Sequence
  chemically synthesized
atttgtctgactccatttctat

SEQ ID NO: 1110897 - DNA, 22 bp, Artificial Sequence
  chemically synthesized
tttgtctgactccatttctatg

SEQ ID NO: 1110898 - DNA, 22 bp, Artificial Sequence
  chemically synthesized
gtctgactccatttctatgagg

SEQ ID NO: 1110899 - DNA, 22 bp, Artificial Sequence
  chemically synthesized
tctgactccatttctatgagga

SEQ ID NO: 1110900 - DNA, 22 bp, Artificial Sequence
  chemically synthesized
actccatttctatgaggattcc

SEQ ID NO: 1110901 - DNA, 22 bp, Artificial Sequence
  chemically synthesized
catttctatgaggattccttaa

SEQ ID NO: 1110902 - DNA, 22 bp, Artificial Sequence
  chemically synthesized
ctatgaggattccttaagccgg

SEQ ID NO: 1110903 - DNA, 22 bp, Artificial Sequence
  chemically synthesized
tatgaggattccttaagccggc

SEQ ID NO: 1110904 - DNA, 22 bp, Artificial Sequence
  chemically synthesized
tgaggattccttaagccggcca

SEQ ID NO: 1110905 - DNA, 22 bp, Artificial Sequence
  chemically synthesized
atggtaaaagcagcatggccgg

SEQ ID NO: 1110906 - DNA, 22 bp, Artificial Sequence
  chemically synthesized
cttaagccggccatgctgcttt

SEQ ID NO: 1110907 - DNA, 22 bp, Artificial Sequence
  chemically synthesized
aagccggccatgctgcttttac

SEQ ID NO: 1110908 - DNA, 22 bp, Artificial Sequence
  chemically synthesized
agccggccatgctgcttttacc

SEQ ID NO: 1110909 - DNA, 22 bp, Artificial Sequence
  chemically synthesized
agaaggagacagtcagatcctc

SEQ ID NO: 1110910 - DNA, 22 bp, Artificial Sequence
  chemically synthesized
cttttaccatgaggatctgact

SEQ ID NO: 1110911 - DNA, 22 bp, Artificial Sequence
  chemically synthesized
ttaccatgaggatctgactgtc

SEQ ID NO: 1110912 - DNA, 22 bp, Artificial Sequence
  chemically synthesized
taccatgaggatctgactgtct

SEQ ID NO: 1110913 - DNA, 22 bp, Artificial Sequence
  chemically synthesized
accatgaggatctgactgtctc

SEQ ID NO: 1110914 - DNA, 22 bp, Artificial Sequence
  chemically synthesized
ccatgaggatctgactgtctcc

SEQ ID NO: 1110915 - DNA, 22 bp, Artificial Sequence
  chemically synthesized
tagaaactcagaaggagacagt

SEQ ID NO: 1110916 - DNA, 22 bp, Artificial Sequence
  chemically synthesized
actgtctccttctgagtttcta

SEQ ID NO: 1110917 - DNA, 22 bp, Artificial Sequence
  chemically synthesized
tctccttctgagtttctataac

SEQ ID NO: 1110918 - DNA, 22 bp, Artificial Sequence
  chemically synthesized
cttctgagtttctataactgct

SEQ ID NO: 1110919 - DNA, 22 bp, Artificial Sequence
  chemically synthesized
ctgagtttctataactgctctc

SEQ ID NO: 1110920 - DNA, 22 bp, Artificial Sequence
  chemically synthesized
tgagtttctataactgctctct

SEQ ID NO: 1110921 - DNA, 22 bp, Artificial Sequence
  chemically synthesized
agtttctataactgctctctca

SEQ ID NO: 1110922 - DNA, 22 bp, Artificial Sequence
  chemically synthesized
gtccagaaaggatcagtgagag

SEQ ID NO: 1110923 - DNA, 22 bp, Artificial Sequence
  chemically synthesized
ctataactgctctctcactgat

SEQ ID NO: 1110924 - DNA, 22 bp, Artificial Sequence
  chemically synthesized
agtccagaaaggatcagtgaga

SEQ ID NO: 1110925 - DNA, 22 bp, Artificial Sequence
  chemically synthesized
tataactgctctctcactgatc

SEQ ID NO: 1110926 - DNA, 22 bp, Artificial Sequence
  chemically synthesized
tagtccagaaaggatcagtgag

SEQ ID NO: 1110927 - DNA, 22 bp, Artificial Sequence
  chemically synthesized
ttagtccagaaaggatcagtga

SEQ ID NO: 1110928 - DNA, 22 bp, Artificial Sequence
  chemically synthesized
taactgctctctcactgatcct

SEQ ID NO: 1110929 - DNA, 22 bp, Artificial Sequence
  chemically synthesized
ccccttttagtccagaaaggat

SEQ ID NO: 1110930 - DNA, 22 bp, Artificial Sequence
  chemically synthesized
ctctctcactgatcctttctgg

SEQ ID NO: 1110931 - DNA, 22 bp, Artificial Sequence
  chemically synthesized
accccttttagtccagaaagga

SEQ ID NO: 1110932 - DNA, 22 bp, Artificial Sequence
  chemically synthesized
ttaccccttttagtccagaaag

SEQ ID NO: 1110933 - DNA, 22 bp, Artificial Sequence
  chemically synthesized
tctcactgatcctttctggact

SEQ ID NO: 1110934 - DNA, 22 bp, Artificial Sequence
  chemically synthesized
tcactgatcctttctggactaa

SEQ ID NO: 1110935 - DNA, 22 bp, Artificial Sequence
  chemically synthesized
actgatcctttctggactaaaa

SEQ ID NO: 1110936 - DNA, 22 bp, Artificial Sequence
  chemically synthesized
atcctttctggactaaaagggg

SEQ ID NO: 1110937 - DNA, 22 bp, Artificial Sequence
  chemically synthesized
tctggactaaaaggggtaagaa

SEQ ID NO: 1110938 - DNA, 22 bp, Artificial Sequence
  chemically synthesized
ctggactaaaaggggtaagaac

SEQ ID NO: 1110939 - DNA, 22 bp, Artificial Sequence
  chemically synthesized
tggactaaaaggggtaagaact

SEQ ID NO: 1110940 - DNA, 22 bp, Artificial Sequence
  chemically synthesized
gactaaaaggggtaagaactct

SEQ ID NO: 1110941 - DNA, 22 bp, Artificial Sequence
  chemically synthesized
aaaggggtaagaactctgatgc

SEQ ID NO: 1110942 - DNA, 22 bp, Artificial Sequence
  chemically synthesized
tgatgctgggttactacactat

SEQ ID NO: 1110943 - DNA, 22 bp, Artificial Sequence
  chemically synthesized
atgctgggttactacactatcc

SEQ ID NO: 1110944 - DNA, 22 bp, Artificial Sequence
  chemically synthesized
ggttactacactatccggtgtg

SEQ ID NO: 1110945 - DNA, 22 bp, Artificial Sequence
  chemically synthesized
gagtacagaggaaccacaccgg

SEQ ID NO: 1110946 - DNA, 22 bp, Artificial Sequence
  chemically synthesized
ctacactatccggtgtggttcc

SEQ ID NO: 1110947 - DNA, 22 bp, Artificial Sequence
  chemically synthesized
cactatccggtgtggttcctct

SEQ ID NO: 1110948 - DNA, 22 bp, Artificial Sequence
  chemically synthesized
tccggtgtggttcctctgtact

SEQ ID NO: 1110949 - DNA, 22 bp, Artificial Sequence
  chemically synthesized
aaatgtagctggagtacagagg

SEQ ID NO: 1110950 - DNA, 22 bp, Artificial Sequence
  chemically synthesized
aaaatgtagctggagtacagag

SEQ ID NO: 1110951 - DNA, 22 bp, Artificial Sequence
  chemically synthesized
taaaatgtagctggagtacaga

SEQ ID NO: 1110952 - DNA, 22 bp, Artificial Sequence
  chemically synthesized
ttaaaatgtagctggagtacag

SEQ ID NO: 1110953 - DNA, 22 bp, Artificial Sequence
  chemically synthesized
ctctgtactccagctacatttt

SEQ ID NO: 1110954 - DNA, 22 bp, Artificial Sequence
  chemically synthesized
tgtactccagctacattttaaa

SEQ ID NO: 1110955 - DNA, 22 bp, Artificial Sequence
  chemically synthesized
caaaaagatatttttaaaatgt

SEQ ID NO: 1110956 - DNA, 22 bp, Artificial Sequence
  chemically synthesized
acaaaaagatatttttaaaatg

SEQ ID NO: 1110957 - DNA, 22 bp, Artificial Sequence
  chemically synthesized
tactccagctacattttaaaaa

SEQ ID NO: 1110958 - DNA, 22 bp, Artificial Sequence
  chemically synthesized
tacaaaaagatatttttaaaat

SEQ ID NO: 1110959 - DNA, 22 bp, Artificial Sequence
  chemically synthesized
tttacaaaaagatatttttaaa

SEQ ID NO: 1110960 - DNA, 22 bp, Artificial Sequence
  chemically synthesized
ctttacaaaaagatatttttaa

SEQ ID NO: 1110961 - DNA, 22 bp, Artificial Sequence
  chemically synthesized
cagctacattttaaaaatatct

SEQ ID NO: 1110962 - DNA, 22 bp, Artificial Sequence
  chemically synthesized
cattttaaaaatatctttttgt

SEQ ID NO: 1110963 - DNA, 22 bp, Artificial Sequence
  chemically synthesized
aggaaggtttctttacaaaaag

SEQ ID NO: 1110964 - DNA, 22 bp, Artificial Sequence
  chemically synthesized
gaggaaggtttctttacaaaaa

SEQ ID NO: 1110965 - DNA, 22 bp, Artificial Sequence
  chemically synthesized
taaaaatatctttttgtaaaga

SEQ ID NO: 1110966 - DNA, 22 bp, Artificial Sequence
  chemically synthesized
aaaaatatctttttgtaaagaa

SEQ ID NO: 1110967 - DNA, 22 bp, Artificial Sequence
  chemically synthesized
aaaatatctttttgtaaagaaa

SEQ ID NO: 1110968 - DNA, 22 bp, Artificial Sequence
  chemically synthesized
cgataatttgaggaaggtttct

SEQ ID NO: 1110969 - DNA, 22 bp, Artificial Sequence
  chemically synthesized
tttgtaaagaaaccttcctcaa

SEQ ID NO: 1110970 - DNA, 22 bp, Artificial Sequence
  chemically synthesized
ttgtaaagaaaccttcctcaaa

SEQ ID NO: 1110971 - DNA, 22 bp, Artificial Sequence
  chemically synthesized
aaattacgataatttgaggaag

SEQ ID NO: 1110972 - DNA, 22 bp, Artificial Sequence
  chemically synthesized
tgtaaagaaaccttcctcaaat

SEQ ID NO: 1110973 - DNA, 22 bp, Artificial Sequence
  chemically synthesized
gtaaagaaaccttcctcaaatt

SEQ ID NO: 1110974 - DNA, 22 bp, Artificial Sequence
  chemically synthesized
tcaaattacgataatttgagga

SEQ ID NO: 1110975 - DNA, 22 bp, Artificial Sequence
  chemically synthesized
taaagaaaccttcctcaaatta

SEQ ID NO: 1110976 - DNA, 22 bp, Artificial Sequence
  chemically synthesized
atggacctctcaaattacgata

SEQ ID NO: 1110977 - DNA, 22 bp, Artificial Sequence
  chemically synthesized
cctcaaattatcgtaatttgag

SEQ ID NO: 1110978 - DNA, 22 bp, Artificial Sequence
  chemically synthesized
ctcaaattatcgtaatttgaga

SEQ ID NO: 1110979 - DNA, 22 bp, Artificial Sequence
  chemically synthesized
aaactgatggacctctcaaatt

SEQ ID NO: 1110980 - DNA, 22 bp, Artificial Sequence
  chemically synthesized
aaaactgatggacctctcaaat

SEQ ID NO: 1110981 - DNA, 22 bp, Artificial Sequence
  chemically synthesized
aaattatcgtaatttgagaggt

SEQ ID NO: 1110982 - DNA, 22 bp, Artificial Sequence
  chemically synthesized
tcgtaatttgagaggtccatca

SEQ ID NO: 1110983 - DNA, 22 bp, Artificial Sequence
  chemically synthesized
gagaggtccatcagttttaaat

SEQ ID NO: 1110984 - DNA, 22 bp, Artificial Sequence
  chemically synthesized
agaggtccatcagttttaaata

SEQ ID NO: 1110985 - DNA, 22 bp, Artificial Sequence
  chemically synthesized
gatacataaggaaaatatttaa

SEQ ID NO: 1110986 - DNA, 22 bp, Artificial Sequence
  chemically synthesized
taaatattttccttatgtatct

SEQ ID NO: 1110987 - DNA, 22 bp, Artificial Sequence
  chemically synthesized
aaatattttccttatgtatcta

SEQ ID NO: 1110988 - DNA, 22 bp, Artificial Sequence
  chemically synthesized
aatattttccttatgtatctag

SEQ ID NO: 1110989 - DNA, 22 bp, Artificial Sequence
  chemically synthesized
gatgcagtataactagatacat

SEQ ID NO: 1110990 - DNA, 22 bp, Artificial Sequence
  chemically synthesized
ggatgcagtataactagataca

SEQ ID NO: 1110991 - DNA, 22 bp, Artificial Sequence
  chemically synthesized
tccttatgtatctagttatact

SEQ ID NO: 1110992 - DNA, 22 bp, Artificial Sequence
  chemically synthesized
ccttatgtatctagttatactg

SEQ ID NO: 1110993 - DNA, 22 bp, Artificial Sequence
  chemically synthesized
cttatgtatctagttatactgc

SEQ ID NO: 1110994 - DNA, 22 bp, Artificial Sequence
  chemically synthesized
atgtatctagttatactgcatc

SEQ ID NO: 1110995 - DNA, 22 bp, Artificial Sequence
  chemically synthesized
tgtatctagttatactgcatcc

SEQ ID NO: 1110996 - DNA, 22 bp, Artificial Sequence
  chemically synthesized
gttatactgcatccaagcttgt

SEQ ID NO: 1110997 - DNA, 22 bp, Artificial Sequence
  chemically synthesized
tactgcatccaagcttgttgtt

SEQ ID NO: 1110998 - DNA, 22 bp, Artificial Sequence
  chemically synthesized
gaaacacgggtcaacaacaagc

SEQ ID NO: 1110999 - DNA, 22 bp, Artificial Sequence
  chemically synthesized
catccaagcttgttgttgaccc

SEQ ID NO: 1111000 - DNA, 22 bp, Artificial Sequence
  chemically synthesized
gttgttgacccgtgtttctaac

SEQ ID NO: 1111001 - DNA, 22 bp, Artificial Sequence
  chemically synthesized
ttgttgacccgtgtttctaact

SEQ ID NO: 1111002 - DNA, 22 bp, Artificial Sequence
  chemically synthesized
ttgacccgtgtttctaactatt

SEQ ID NO: 1111003 - DNA, 22 bp, Artificial Sequence
  chemically synthesized
acccgtgtttctaactatttcc

SEQ ID NO: 1111004 - DNA, 22 bp, Artificial Sequence
  chemically synthesized
aaaaagtggaatccatggaaat

SEQ ID NO: 1111005 - DNA, 22 bp, Artificial Sequence
  chemically synthesized
gaaaaagtggaatccatggaaa

SEQ ID NO: 1111006 - DNA, 22 bp, Artificial Sequence
  chemically synthesized
tgaaaaagtggaatccatggaa

SEQ ID NO: 1111007 - DNA, 22 bp, Artificial Sequence
  chemically synthesized
ctaactatttccatggattcca

SEQ ID NO: 1111008 - DNA, 22 bp, Artificial Sequence
  chemically synthesized
taactatttccatggattccac

SEQ ID NO: 1111009 - DNA, 22 bp, Artificial Sequence
  chemically synthesized
actatttccatggattccactt

SEQ ID NO: 1111010 - DNA, 22 bp, Artificial Sequence
  chemically synthesized
tttccatggattccactttttc

SEQ ID NO: 1111011 - DNA, 22 bp, Artificial Sequence
  chemically synthesized
ccatggattccactttttcaaa

SEQ ID NO: 1111012 - DNA, 22 bp, Artificial Sequence
  chemically synthesized
catggattccactttttcaaaa

SEQ ID NO: 1111013 - DNA, 22 bp, Artificial Sequence
  chemically synthesized
tgacgagtgaaacatagtcatt

SEQ ID NO: 1111014 - DNA, 22 bp, Artificial Sequence
  chemically synthesized
cactttttcaaaatgactatgt

SEQ ID NO: 1111015 - DNA, 22 bp, Artificial Sequence
  chemically synthesized
gtgacgagtgaaacatagtcat

SEQ ID NO: 1111016 - DNA, 22 bp, Artificial Sequence
  chemically synthesized
tgtgacgagtgaaacatagtca

SEQ ID NO: 1111017 - DNA, 22 bp, Artificial Sequence
  chemically synthesized
tttgtgacgagtgaaacatagt

SEQ ID NO: 1111018 - DNA, 22 bp, Artificial Sequence
  chemically synthesized
ctttgtgacgagtgaaacatag

SEQ ID NO: 1111019 - DNA, 22 bp, Artificial Sequence
  chemically synthesized
tttcaaaatgactatgtttcac

SEQ ID NO: 1111020 - DNA, 22 bp, Artificial Sequence
  chemically synthesized
tctttgtgacgagtgaaacata

SEQ ID NO: 1111021 - DNA, 22 bp, Artificial Sequence
  chemically synthesized
ttcaaaatgactatgtttcact

SEQ ID NO: 1111022 - DNA, 22 bp, Artificial Sequence
  chemically synthesized
tcaaaatgactatgtttcactc

SEQ ID NO: 1111023 - DNA, 22 bp, Artificial Sequence
  chemically synthesized
tttctttgtgacgagtgaaaca

SEQ ID NO: 1111024 - DNA, 22 bp, Artificial Sequence
  chemically synthesized
caaaatgactatgtttcactcg

SEQ ID NO: 1111025 - DNA, 22 bp, Artificial Sequence
  chemically synthesized
aaaatgactatgtttcactcgt

SEQ ID NO: 1111026 - DNA, 22 bp, Artificial Sequence
  chemically synthesized
gaactctttctttgtgacgagt

SEQ ID NO: 1111027 - DNA, 22 bp, Artificial Sequence
  chemically synthesized
ggaactctttctttgtgacgag

SEQ ID NO: 1111028 - DNA, 22 bp, Artificial Sequence
  chemically synthesized
tggaactctttctttgtgacga

SEQ ID NO: 1111029 - DNA, 22 bp, Artificial Sequence
  chemically synthesized
tgtttcactcgtcacaaagaaa

SEQ ID NO: 1111030 - DNA, 22 bp, Artificial Sequence
  chemically synthesized
actttggaactctttctttgtg

SEQ ID NO: 1111031 - DNA, 22 bp, Artificial Sequence
  chemically synthesized
tcactttggaactctttctttg

SEQ ID NO: 1111032 - DNA, 22 bp, Artificial Sequence
  chemically synthesized
cactcgtcacaaagaaagagtt

SEQ ID NO: 1111033 - DNA, 22 bp, Artificial Sequence
  chemically synthesized
actcgtcacaaagaaagagttc

SEQ ID NO: 1111034 - DNA, 22 bp, Artificial Sequence
  chemically synthesized
gtcacaaagaaagagttccaaa

SEQ ID NO: 1111035 - DNA, 22 bp, Artificial Sequence
  chemically synthesized
taaaaaatggcctctcactttg

SEQ ID NO: 1111036 - DNA, 22 bp, Artificial Sequence
  chemically synthesized
caaagtgagaggccatttttta

SEQ ID NO: 1111037 - DNA, 22 bp, Artificial Sequence
  chemically synthesized
ggagtgtggaaaccacatgtat

SEQ ID NO: 1111038 - DNA, 22 bp, Artificial Sequence
  chemically synthesized
aggagtgtggaaaccacatgta

SEQ ID NO: 1111039 - DNA, 22 bp, Artificial Sequence
  chemically synthesized
tttacaggatacatgtggtttc

SEQ ID NO: 1111040 - DNA, 22 bp, Artificial Sequence
  chemically synthesized
ttacaggatacatgtggtttcc

SEQ ID NO: 1111041 - DNA, 22 bp, Artificial Sequence
  chemically synthesized
tacaggatacatgtggtttcca

SEQ ID NO: 1111042 - DNA, 22 bp, Artificial Sequence
  chemically synthesized
acaggatacatgtggtttccac

SEQ ID NO: 1111043 - DNA, 22 bp, Artificial Sequence
  chemically synthesized
caggatacatgtggtttccaca

SEQ ID NO: 1111044 - DNA, 22 bp, Artificial Sequence
  chemically synthesized
cgtaagcatgaggcagtttagg

SEQ ID NO: 1111045 - DNA, 22 bp, Artificial Sequence
  chemically synthesized
gcgtaagcatgaggcagtttag

SEQ ID NO: 1111046 - DNA, 22 bp, Artificial Sequence
  chemically synthesized
ccacactcctaaactgcctcat

SEQ ID NO: 1111047 - DNA, 22 bp, Artificial Sequence
  chemically synthesized
cacactcctaaactgcctcatg

SEQ ID NO: 1111048 - DNA, 22 bp, Artificial Sequence
  chemically synthesized
tgtcggtttgcgtaagcatgag

SEQ ID NO: 1111049 - DNA, 22 bp, Artificial Sequence
  chemically synthesized
ctaaactgcctcatgcttacgc

SEQ ID NO: 1111050 - DNA, 22 bp, Artificial Sequence
  chemically synthesized
attgtgtcggtttgcgtaagca

SEQ ID NO: 1111051 - DNA, 22 bp, Artificial Sequence
  chemically synthesized
aactgcctcatgcttacgcaaa

SEQ ID NO: 1111052 - DNA, 22 bp, Artificial Sequence
  chemically synthesized
attgattgtgtcggtttgcgta

SEQ ID NO: 1111053 - DNA, 22 bp, Artificial Sequence
  chemically synthesized
cctcatgcttacgcaaaccgac

SEQ ID NO: 1111054 - DNA, 22 bp, Artificial Sequence
  chemically synthesized
atgcttacgcaaaccgacacaa

SEQ ID NO: 1111055 - DNA, 22 bp, Artificial Sequence
  chemically synthesized
cacagcgctaattgattgtgtc

SEQ ID NO: 1111056 - DNA, 22 bp, Artificial Sequence
  chemically synthesized
acgcaaaccgacacaatcaatt

SEQ ID NO: 1111057 - DNA, 22 bp, Artificial Sequence
  chemically synthesized
cgcaaaccgacacaatcaatta

SEQ ID NO: 1111058 - DNA, 22 bp, Artificial Sequence
  chemically synthesized
gcgtagttacacagcgctaatt

SEQ ID NO: 1111059 - DNA, 22 bp, Artificial Sequence
  chemically synthesized
ggcgtagttacacagcgctaat

SEQ ID NO: 1111060 - DNA, 22 bp, Artificial Sequence
  chemically synthesized
tatttggcgtagttacacagcg

SEQ ID NO: 1111061 - DNA, 22 bp, Artificial Sequence
  chemically synthesized
aaattgtatttggcgtagttac

SEQ ID NO: 1111062 - DNA, 22 bp, Artificial Sequence
  chemically synthesized
taaaattgtatttggcgtagtt

SEQ ID NO: 1111063 - DNA, 22 bp, Artificial Sequence
  chemically synthesized
gcgctgtgtaactacgccaaat

SEQ ID NO: 1111064 - DNA, 22 bp, Artificial Sequence
  chemically synthesized
tgtaactacgccaaatacaatt

SEQ ID NO: 1111065 - DNA, 22 bp, Artificial Sequence
  chemically synthesized
cgccaaatacaattttagaatc

SEQ ID NO: 1111066 - DNA, 22 bp, Artificial Sequence
  chemically synthesized
aatatgtaagacgtagataccc

SEQ ID NO: 1111067 - DNA, 22 bp, Artificial Sequence
  chemically synthesized
aaatatgtaagacgtagatacc

SEQ ID NO: 1111068 - DNA, 22 bp, Artificial Sequence
  chemically synthesized
tagaatccgggtatctacgtct

SEQ ID NO: 1111069 - DNA, 22 bp, Artificial Sequence
  chemically synthesized
tttaaatatgtaagacgtagat

SEQ ID NO: 1111070 - DNA, 22 bp, Artificial Sequence
  chemically synthesized
agaatccgggtatctacgtctt

SEQ ID NO: 1111071 - DNA, 22 bp, Artificial Sequence
  chemically synthesized
gaatccgggtatctacgtctta

SEQ ID NO: 1111072 - DNA, 22 bp, Artificial Sequence
  chemically synthesized
cgtcttacatatttaaacagat

SEQ ID NO: 1111073 - DNA, 22 bp, Artificial Sequence
  chemically synthesized
acatatttaaacagatttctgt

SEQ ID NO: 1111074 - DNA, 22 bp, Artificial Sequence
  chemically synthesized
aaaatgtaagcaacagaaatct

SEQ ID NO: 1111075 - DNA, 22 bp, Artificial Sequence
  chemically synthesized
catatttaaacagatttctgtt

SEQ ID NO: 1111076 - DNA, 22 bp, Artificial Sequence
  chemically synthesized
aaacagatttctgttgcttaca

SEQ ID NO: 1111077 - DNA, 22 bp, Artificial Sequence
  chemically synthesized
aacagatttctgttgcttacat

SEQ ID NO: 1111078 - DNA, 22 bp, Artificial Sequence
  chemically synthesized
agcgcaataaagttcaaaatgt

SEQ ID NO: 1111079 - DNA, 22 bp, Artificial Sequence
  chemically synthesized
ctgttgcttacattttgaactt

SEQ ID NO: 1111080 - DNA, 22 bp, Artificial Sequence
  chemically synthesized
tgttgcttacattttgaacttt

SEQ ID NO: 1111081 - DNA, 22 bp, Artificial Sequence
  chemically synthesized
gctaagcgcaataaagttcaaa

SEQ ID NO: 1111082 - DNA, 22 bp, Artificial Sequence
  chemically synthesized
agctaagcgcaataaagttcaa

SEQ ID NO: 1111083 - DNA, 22 bp, Artificial Sequence
  chemically synthesized
ttgcttacattttgaactttat

SEQ ID NO: 1111084 - DNA, 22 bp, Artificial Sequence
  chemically synthesized
cttacattttgaactttattgc

SEQ ID NO: 1111085 - DNA, 22 bp, Artificial Sequence
  chemically synthesized
acattttgaactttattgcgct

SEQ ID NO: 1111086 - DNA, 22 bp, Artificial Sequence
  chemically synthesized
aggatttagctaagcgcaataa

SEQ ID NO: 1111087 - DNA, 22 bp, Artificial Sequence
  chemically synthesized
cattttgaactttattgcgctt

SEQ ID NO: 1111088 - DNA, 22 bp, Artificial Sequence
  chemically synthesized
taaggatttagctaagcgcaat

SEQ ID NO: 1111089 - DNA, 22 bp, Artificial Sequence
  chemically synthesized
ctaaggatttagctaagcgcaa

SEQ ID NO: 1111090 - DNA, 22 bp, Artificial Sequence
  chemically synthesized
tgaactttattgcgcttagcta

SEQ ID NO: 1111091 - DNA, 22 bp, Artificial Sequence
  chemically synthesized
gaactttattgcgcttagctaa

SEQ ID NO: 1111092 - DNA, 22 bp, Artificial Sequence
  chemically synthesized
aactttattgcgcttagctaaa

SEQ ID NO: 1111093 - DNA, 22 bp, Artificial Sequence
  chemically synthesized
accttctaaggatttagctaag

SEQ ID NO: 1111094 - DNA, 22 bp, Artificial Sequence
  chemically synthesized
tattgcgcttagctaaatcctt

SEQ ID NO: 1111095 - DNA, 22 bp, Artificial Sequence
  chemically synthesized
attgcgcttagctaaatcctta

SEQ ID NO: 1111096 - DNA, 22 bp, Artificial Sequence
  chemically synthesized
ttgcgcttagctaaatccttag

SEQ ID NO: 1111097 - DNA, 22 bp, Artificial Sequence
  chemically synthesized
cgcttagctaaatccttagaag

SEQ ID NO: 1111098 - DNA, 22 bp, Artificial Sequence
  chemically synthesized
gtaatgaaacgttcaccttcta

SEQ ID NO: 1111099 - DNA, 22 bp, Artificial Sequence
  chemically synthesized
agctaaatccttagaaggtgaa

SEQ ID NO: 1111100 - DNA, 22 bp, Artificial Sequence
  chemically synthesized
agtaatgaaacgttcaccttct

SEQ ID NO: 1111101 - DNA, 22 bp, Artificial Sequence
  chemically synthesized
gctaaatccttagaaggtgaac

SEQ ID NO: 1111102 - DNA, 22 bp, Artificial Sequence
  chemically synthesized
tttagtaatgaaacgttcacct

SEQ ID NO: 1111103 - DNA, 22 bp, Artificial Sequence
  chemically synthesized
aatccttagaaggtgaacgttt

SEQ ID NO: 1111104 - DNA, 22 bp, Artificial Sequence
  chemically synthesized
agaaggtgaacgtttcattact

SEQ ID NO: 1111105 - DNA, 22 bp, Artificial Sequence
  chemically synthesized
gaaggtgaacgtttcattacta

SEQ ID NO: 1111106 - DNA, 22 bp, Artificial Sequence
  chemically synthesized
caagaagacagtaacaaattat

SEQ ID NO: 1111107 - DNA, 22 bp, Artificial Sequence
  chemically synthesized
ccaagaagacagtaacaaatta

SEQ ID NO: 1111108 - DNA, 22 bp, Artificial Sequence
  chemically synthesized
cattactaaataatttgttact

SEQ ID NO: 1111109 - DNA, 22 bp, Artificial Sequence
  chemically synthesized
attactaaataatttgttactg

SEQ ID NO: 1111110 - DNA, 22 bp, Artificial Sequence
  chemically synthesized
ctaaataatttgttactgtctt

SEQ ID NO: 1111111 - DNA, 22 bp, Artificial Sequence
  chemically synthesized
gcaatttccaagaagacagtaa

SEQ ID NO: 1111112 - DNA, 22 bp, Artificial Sequence
  chemically synthesized
ggcaatttccaagaagacagta

SEQ ID NO: 1111113 - DNA, 22 bp, Artificial Sequence
  chemically synthesized
aataatttgttactgtcttctt

SEQ ID NO: 1111114 - DNA, 22 bp, Artificial Sequence
  chemically synthesized
ttggcaatttccaagaagacag

SEQ ID NO: 1111115 - DNA, 22 bp, Artificial Sequence
  chemically synthesized
cttggcaatttccaagaagaca

SEQ ID NO: 1111116 - DNA, 22 bp, Artificial Sequence
  chemically synthesized
gttactgtcttcttggaaattg

SEQ ID NO: 1111117 - DNA, 22 bp, Artificial Sequence
  chemically synthesized
ttactgtcttcttggaaattgc

SEQ ID NO: 1111118 - DNA, 22 bp, Artificial Sequence
  chemically synthesized
ctgtcttcttggaaattgccaa

SEQ ID NO: 1111119 - DNA, 22 bp, Artificial Sequence
  chemically synthesized
tcttcttggaaattgccaagaa

SEQ ID NO: 1111120 - DNA, 22 bp, Artificial Sequence
  chemically synthesized
cttggaaattgccaagaaatac

SEQ ID NO: 1111121 - DNA, 22 bp, Artificial Sequence
  chemically synthesized
ttggaaattgccaagaaatacc

SEQ ID NO: 1111122 - DNA, 22 bp, Artificial Sequence
  chemically synthesized
ggaaattgccaagaaataccta

SEQ ID NO: 1111123 - DNA, 22 bp, Artificial Sequence
  chemically synthesized
gagcataatcaataggtatttc

SEQ ID NO: 1111124 - DNA, 22 bp, Artificial Sequence
  chemically synthesized
gaaattgccaagaaatacctat

SEQ ID NO: 1111125 - DNA, 22 bp, Artificial Sequence
  chemically synthesized
ggagcataatcaataggtattt

SEQ ID NO: 1111126 - DNA, 22 bp, Artificial Sequence
  chemically synthesized
catttggagcataatcaatagg

SEQ ID NO: 1111127 - DNA, 22 bp, Artificial Sequence
  chemically synthesized
ccatttggagcataatcaatag

SEQ ID NO: 1111128 - DNA, 22 bp, Artificial Sequence
  chemically synthesized
ccaagaaatacctattgattat

SEQ ID NO: 1111129 - DNA, 22 bp, Artificial Sequence
  chemically synthesized
cttccatttggagcataatcaa

SEQ ID NO: 1111130 - DNA, 22 bp, Artificial Sequence
  chemically synthesized
tccttccatttggagcataatc

SEQ ID NO: 1111131 - DNA, 22 bp, Artificial Sequence
  chemically synthesized
ctccttccatttggagcataat

SEQ ID NO: 1111132 - DNA, 22 bp, Artificial Sequence
  chemically synthesized
ttctccttccatttggagcata

SEQ ID NO: 1111133 - DNA, 22 bp, Artificial Sequence
  chemically synthesized
ttgattatgctccaaatggaag

SEQ ID NO: 1111134 - DNA, 22 bp, Artificial Sequence
  chemically synthesized
attatgctccaaatggaaggag

SEQ ID NO: 1111135 - DNA, 22 bp, Artificial Sequence
  chemically synthesized
tgctccaaatggaaggagaaga

SEQ ID NO: 1111136 - DNA, 22 bp, Artificial Sequence
  chemically synthesized
taaggtaagaatctcttctcct

SEQ ID NO: 1111137 - DNA, 22 bp, Artificial Sequence
  chemically synthesized
gtaaggtaagaatctcttctcc

SEQ ID NO: 1111138 - DNA, 22 bp, Artificial Sequence
  chemically synthesized
caaatggaaggagaagagattc

SEQ ID NO: 1111139 - DNA, 22 bp, Artificial Sequence
  chemically synthesized
aaaatttgtaaggtaagaatct

SEQ ID NO: 1111140 - DNA, 22 bp, Artificial Sequence
  chemically synthesized
aaagtcagttaaaaatttgtaa

SEQ ID NO: 1111141 - DNA, 22 bp, Artificial Sequence
  chemically synthesized
ttaccttacaaatttttaactg

SEQ ID NO: 1111142 - DNA, 22 bp, Artificial Sequence
  chemically synthesized
accttacaaatttttaactgac

SEQ ID NO: 1111143 - DNA, 22 bp, Artificial Sequence
  chemically synthesized
ccttacaaatttttaactgact

SEQ ID NO: 1111144 - DNA, 22 bp, Artificial Sequence
  chemically synthesized
acaaatttttaactgactttta

SEQ ID NO: 1111145 - DNA, 22 bp, Artificial Sequence
  chemically synthesized
caaatttttaactgacttttaa

SEQ ID NO: 1111146 - DNA, 22 bp, Artificial Sequence
  chemically synthesized
ttaactgacttttaattgctgt

SEQ ID NO: 1111147 - DNA, 22 bp, Artificial Sequence
  chemically synthesized
taactgacttttaattgctgtt

SEQ ID NO: 1111148 - DNA, 22 bp, Artificial Sequence
  chemically synthesized
aactgacttttaattgctgttg

SEQ ID NO: 1111149 - DNA, 22 bp, Artificial Sequence
  chemically synthesized
actgacttttaattgctgttgg

SEQ ID NO: 1111150 - DNA, 22 bp, Artificial Sequence
  chemically synthesized
acttttaattgctgttggctct

SEQ ID NO: 1111151 - DNA, 22 bp, Artificial Sequence
  chemically synthesized
ttaattgctgttggctctgatg

SEQ ID NO: 1111152 - DNA, 22 bp, Artificial Sequence
  chemically synthesized
taattgctgttggctctgatgg

SEQ ID NO: 1111153 - DNA, 22 bp, Artificial Sequence
  chemically synthesized
aattgctgttggctctgatggg

SEQ ID NO: 1111154 - DNA, 22 bp, Artificial Sequence
  chemically synthesized
attgctgttggctctgatgggg

SEQ ID NO: 1111155 - DNA, 22 bp, Artificial Sequence
  chemically synthesized
ctgttggctctgatggggtggt

SEQ ID NO: 1111156 - DNA, 22 bp, Artificial Sequence
  chemically synthesized
aaaatccaacccaccaccccat

SEQ ID NO: 1111157 - DNA, 22 bp, Artificial Sequence
  chemically synthesized
ttggctctgatggggtggtggg

SEQ ID NO: 1111158 - DNA, 22 bp, Artificial Sequence
  chemically synthesized
gttgaaaatccaacccaccacc

SEQ ID NO: 1111159 - DNA, 22 bp, Artificial Sequence
  chemically synthesized
gctctgatggggtggtgggttg

SEQ ID NO: 1111160 - DNA, 22 bp, Artificial Sequence
  chemically synthesized
tgatggggtggtgggttggatt

SEQ ID NO: 1111161 - DNA, 22 bp, Artificial Sequence
  chemically synthesized
aaaactggttgaaaatccaacc

SEQ ID NO: 1111162 - DNA, 22 bp, Artificial Sequence
  chemically synthesized
atggggtggtgggttggatttt

SEQ ID NO: 1111163 - DNA, 22 bp, Artificial Sequence
  chemically synthesized
ctgaaaactggttgaaaatcca

SEQ ID NO: 1111164 - DNA, 22 bp, Artificial Sequence
  chemically synthesized
ctgctgaaaactggttgaaaat

SEQ ID NO: 1111165 - DNA, 22 bp, Artificial Sequence
  chemically synthesized
gattttcaaccagttttcagca

SEQ ID NO: 1111166 - DNA, 22 bp, Artificial Sequence
  chemically synthesized
tcaaccagttttcagcagtagt

SEQ ID NO: 1111167 - DNA, 22 bp, Artificial Sequence
  chemically synthesized
gagcagatgacaactactgctg

SEQ ID NO: 1111168 - DNA, 22 bp, Artificial Sequence
  chemically synthesized
caaccagttttcagcagtagtt

SEQ ID NO: 1111169 - DNA, 22 bp, Artificial Sequence
  chemically synthesized
aaccagttttcagcagtagttg

SEQ ID NO: 1111170 - DNA, 22 bp, Artificial Sequence
  chemically synthesized
caacaattggagcagatgacaa

SEQ ID NO: 1111171 - DNA, 22 bp, Artificial Sequence
  chemically synthesized
tcagcagtagttgtcatctgct

SEQ ID NO: 1111172 - DNA, 22 bp, Artificial Sequence
  chemically synthesized
cagcagtagttgtcatctgctc

SEQ ID NO: 1111173 - DNA, 22 bp, Artificial Sequence
  chemically synthesized
agcagtagttgtcatctgctcc

SEQ ID NO: 1111174 - DNA, 22 bp, Artificial Sequence
  chemically synthesized
taatcagctacaacaattggag

SEQ ID NO: 1111175 - DNA, 22 bp, Artificial Sequence
  chemically synthesized
tataatcagctacaacaattgg

SEQ ID NO: 1111176 - DNA, 22 bp, Artificial Sequence
  chemically synthesized
ctataatcagctacaacaattg

SEQ ID NO: 1111177 - DNA, 22 bp, Artificial Sequence
  chemically synthesized
tctataatcagctacaacaatt

SEQ ID NO: 1111178 - DNA, 22 bp, Artificial Sequence
  chemically synthesized
tcatctgctccaattgttgtag

SEQ ID NO: 1111179 - DNA, 22 bp, Artificial Sequence
  chemically synthesized
ctccaattgttgtagctgatta

SEQ ID NO: 1111180 - DNA, 22 bp, Artificial Sequence
  chemically synthesized
caattgttgtagctgattatag

SEQ ID NO: 1111181 - DNA, 22 bp, Artificial Sequence
  chemically synthesized
ttgtagctgattatagaaagcg

SEQ ID NO: 1111182 - DNA, 22 bp, Artificial Sequence
  chemically synthesized
tagctgattatagaaagcgatg

SEQ ID NO: 1111183 - DNA, 22 bp, Artificial Sequence
  chemically synthesized
gagtatcagaacaacatcatcg

SEQ ID NO: 1111184 - DNA, 22 bp, Artificial Sequence
  chemically synthesized
attatagaaagcgatgatgttg

SEQ ID NO: 1111185 - DNA, 22 bp, Artificial Sequence
  chemically synthesized
gctggagtatcagaacaacatc

SEQ ID NO: 1111186 - DNA, 22 bp, Artificial Sequence
  chemically synthesized
tagaaagcgatgatgttgttct

SEQ ID NO: 1111187 - DNA, 22 bp, Artificial Sequence
  chemically synthesized
actggctggagtatcagaacaa

SEQ ID NO: 1111188 - DNA, 22 bp, Artificial Sequence
  chemically synthesized
aactggctggagtatcagaaca

SEQ ID NO: 1111189 - DNA, 22 bp, Artificial Sequence
  chemically synthesized
agtgagagacttaactggctgg

SEQ ID NO: 1111190 - DNA, 22 bp, Artificial Sequence
  chemically synthesized
ttctgatactccagccagttaa

SEQ ID NO: 1111191 - DNA, 22 bp, Artificial Sequence
  chemically synthesized
ctaagtgagagacttaactggc

SEQ ID NO: 1111192 - DNA, 22 bp, Artificial Sequence
  chemically synthesized
tgatactccagccagttaagtc

SEQ ID NO: 1111193 - DNA, 22 bp, Artificial Sequence
  chemically synthesized
atactccagccagttaagtctc

SEQ ID NO: 1111194 - DNA, 22 bp, Artificial Sequence
  chemically synthesized
ccagttgctaagtgagagactt

SEQ ID NO: 1111195 - DNA, 22 bp, Artificial Sequence
  chemically synthesized
tgccagttgctaagtgagagac

SEQ ID NO: 1111196 - DNA, 22 bp, Artificial Sequence
  chemically synthesized
cagccagttaagtctctcactt

SEQ ID NO: 1111197 - DNA, 22 bp, Artificial Sequence
  chemically synthesized
agtctctcacttagcaactggc

SEQ ID NO: 1111198 - DNA, 22 bp, Artificial Sequence
  chemically synthesized
tcacttagcaactggcagaatt

SEQ ID NO: 1111199 - DNA, 22 bp, Artificial Sequence
  chemically synthesized
acttagcaactggcagaattcg

SEQ ID NO: 1111200 - DNA, 22 bp, Artificial Sequence
  chemically synthesized
aacagccggtggatcgaattct

SEQ ID NO: 1111201 - DNA, 22 bp, Artificial Sequence
  chemically synthesized
agcaactggcagaattcgatcc

SEQ ID NO: 1111202 - DNA, 22 bp, Artificial Sequence
  chemically synthesized
gcaactggcagaattcgatcca

SEQ ID NO: 1111203 - DNA, 22 bp, Artificial Sequence
  chemically synthesized
gcagaattcgatccaccggctg

SEQ ID NO: 1111204 - DNA, 22 bp, Artificial Sequence
  chemically synthesized
agaacaactgaacagccggtgg

SEQ ID NO: 1111205 - DNA, 22 bp, Artificial Sequence
  chemically synthesized
gatccaccggctgttcagttgt

SEQ ID NO: 1111206 - DNA, 22 bp, Artificial Sequence
  chemically synthesized
ttcagttgttctgaggcttgtt

SEQ ID NO: 1111207 - DNA, 22 bp, Artificial Sequence
  chemically synthesized
agttgttctgaggcttgtttga

SEQ ID NO: 1111208 - DNA, 22 bp, Artificial Sequence
  chemically synthesized
atgcagatagcatcaaacaagc

SEQ ID NO: 1111209 - DNA, 22 bp, Artificial Sequence
  chemically synthesized
ttctgaggcttgtttgatgcta

SEQ ID NO: 1111210 - DNA, 22 bp, Artificial Sequence
  chemically synthesized
tgaggcttgtttgatgctatct

SEQ ID NO: 1111211 - DNA, 22 bp, Artificial Sequence
  chemically synthesized
aggcttgtttgatgctatctgc

SEQ ID NO: 1111212 - DNA, 22 bp, Artificial Sequence
  chemically synthesized
gagggtgttaatgcagatagca

SEQ ID NO: 1111213 - DNA, 22 bp, Artificial Sequence
  chemically synthesized
tagagggtgttaatgcagatag

SEQ ID NO: 1111214 - DNA, 22 bp, Artificial Sequence
  chemically synthesized
ctagagggtgttaatgcagata

SEQ ID NO: 1111215 - DNA, 22 bp, Artificial Sequence
  chemically synthesized
tctagagggtgttaatgcagat

SEQ ID NO: 1111216 - DNA, 22 bp, Artificial Sequence
  chemically synthesized
gtttgatgctatctgcattaac

SEQ ID NO: 1111217 - DNA, 22 bp, Artificial Sequence
  chemically synthesized
tttctagagggtgttaatgcag

SEQ ID NO: 1111218 - DNA, 22 bp, Artificial Sequence
  chemically synthesized
tttgatgctatctgcattaaca

SEQ ID NO: 1111219 - DNA, 22 bp, Artificial Sequence
  chemically synthesized
ctttctagagggtgttaatgca

SEQ ID NO: 1111220 - DNA, 22 bp, Artificial Sequence
  chemically synthesized
tctttctagagggtgttaatgc

SEQ ID NO: 1111221 - DNA, 22 bp, Artificial Sequence
  chemically synthesized
ttctttctagagggtgttaatg

SEQ ID NO: 1111222 - DNA, 22 bp, Artificial Sequence
  chemically synthesized
gatgctatctgcattaacaccc

SEQ ID NO: 1111223 - DNA, 22 bp, Artificial Sequence
  chemically synthesized
tttctttctagagggtgttaat

SEQ ID NO: 1111224 - DNA, 22 bp, Artificial Sequence
  chemically synthesized
atgctatctgcattaacaccct

SEQ ID NO: 1111225 - DNA, 22 bp, Artificial Sequence
  chemically synthesized
ttttctttctagagggtgttaa

SEQ ID NO: 1111226 - DNA, 22 bp, Artificial Sequence
  chemically synthesized
tttttttctttctagagggtgt

SEQ ID NO: 1111227 - DNA, 22 bp, Artificial Sequence
  chemically synthesized
tctgcattaacaccctctagaa

SEQ ID NO: 1111228 - DNA, 22 bp, Artificial Sequence
  chemically synthesized
attatttttttctttctagagg

SEQ ID NO: 1111229 - DNA, 22 bp, Artificial Sequence
  chemically synthesized
aattatttttttctttctagag

SEQ ID NO: 1111230 - DNA, 22 bp, Artificial Sequence
  chemically synthesized
cattaacaccctctagaaagaa

SEQ ID NO: 1111231 - DNA, 22 bp, Artificial Sequence
  chemically synthesized
acaccctctagaaagaaaaaaa

SEQ ID NO: 1111232 - DNA, 22 bp, Artificial Sequence
  chemically synthesized
aggggatatatttaattatttt

SEQ ID NO: 1111233 - DNA, 22 bp, Artificial Sequence
  chemically synthesized
tagaaagaaaaaaataattaaa

SEQ ID NO: 1111234 - DNA, 22 bp, Artificial Sequence
  chemically synthesized
gaaagaaaaaaataattaaata

SEQ ID NO: 1111235 - DNA, 22 bp, Artificial Sequence
  chemically synthesized
tgggttcaggggatatatttaa

SEQ ID NO: 1111236 - DNA, 22 bp, Artificial Sequence
  chemically synthesized
agtctgtgggttcaggggatat

SEQ ID NO: 1111237 - DNA, 22 bp, Artificial Sequence
  chemically synthesized
cagtctgtgggttcaggggata

SEQ ID NO: 1111238 - DNA, 22 bp, Artificial Sequence
  chemically synthesized
tcagtctgtgggttcaggggat

SEQ ID NO: 1111239 - DNA, 22 bp, Artificial Sequence
  chemically synthesized
tttcagtctgtgggttcagggg

SEQ ID NO: 1111240 - DNA, 22 bp, Artificial Sequence
  chemically synthesized
ctttcagtctgtgggttcaggg

SEQ ID NO: 1111241 - DNA, 22 bp, Artificial Sequence
  chemically synthesized
aatatatcccctgaacccacag

SEQ ID NO: 1111242 - DNA, 22 bp, Artificial Sequence
  chemically synthesized
agatcatttctttcagtctgtg

SEQ ID NO: 1111243 - DNA, 22 bp, Artificial Sequence
  chemically synthesized
cagatcatttctttcagtctgt

SEQ ID NO: 1111244 - DNA, 22 bp, Artificial Sequence
  chemically synthesized
tcagatcatttctttcagtctg

SEQ ID NO: 1111245 - DNA, 22 bp, Artificial Sequence
  chemically synthesized
gctttcagatcatttctttcag

SEQ ID NO: 1111246 - DNA, 22 bp, Artificial Sequence
  chemically synthesized
aacccacagactgaaagaaatg

SEQ ID NO: 1111247 - DNA, 22 bp, Artificial Sequence
  chemically synthesized
ggatgtgttggctttcagatca

SEQ ID NO: 1111248 - DNA, 22 bp, Artificial Sequence
  chemically synthesized
aaagaaatgatctgaaagccaa

SEQ ID NO: 1111249 - DNA, 22 bp, Artificial Sequence
  chemically synthesized
taattaggatgtgttggctttc

SEQ ID NO: 1111250 - DNA, 22 bp, Artificial Sequence
  chemically synthesized
ataattaggatgtgttggcttt

SEQ ID NO: 1111251 - DNA, 22 bp, Artificial Sequence
  chemically synthesized
tataattaggatgtgttggctt

SEQ ID NO: 1111252 - DNA, 22 bp, Artificial Sequence
  chemically synthesized
ttataattaggatgtgttggct

SEQ ID NO: 1111253 - DNA, 22 bp, Artificial Sequence
  chemically synthesized
aaagccaacacatcctaattat

SEQ ID NO: 1111254 - DNA, 22 bp, Artificial Sequence
  chemically synthesized
atgtggtgaatacttttataat

SEQ ID NO: 1111255 - DNA, 22 bp, Artificial Sequence
  chemically synthesized
aaatcattcatgtggtgaatac

SEQ ID NO: 1111256 - DNA, 22 bp, Artificial Sequence
  chemically synthesized
gaaatcattcatgtggtgaata

SEQ ID NO: 1111257 - DNA, 22 bp, Artificial Sequence
  chemically synthesized
attataaaagtattcaccacat

SEQ ID NO: 1111258 - DNA, 22 bp, Artificial Sequence
  chemically synthesized
gtttgaaatcattcatgtggtg

SEQ ID NO: 1111259 - DNA, 22 bp, Artificial Sequence
  chemically synthesized
taaaagtattcaccacatgaat

SEQ ID NO: 1111260 - DNA, 22 bp, Artificial Sequence
  chemically synthesized
atctggtttgaaatcattcatg

SEQ ID NO: 1111261 - DNA, 22 bp, Artificial Sequence
  chemically synthesized
accacatgaatgatttcaaacc

SEQ ID NO: 1111262 - DNA, 22 bp, Artificial Sequence
  chemically synthesized
gaaaataattgatctggtttga

SEQ ID NO: 1111263 - DNA, 22 bp, Artificial Sequence
  chemically synthesized
agaaaataattgatctggtttg

SEQ ID NO: 1111264 - DNA, 22 bp, Artificial Sequence
  chemically synthesized
tatcttagaaaataattgatct

SEQ ID NO: 1111265 - DNA, 22 bp, Artificial Sequence
  chemically synthesized
atatcttagaaaataattgatc

SEQ ID NO: 1111266 - DNA, 22 bp, Artificial Sequence
  chemically synthesized
caaaccagatcaattattttct

SEQ ID NO: 1111267 - DNA, 22 bp, Artificial Sequence
  chemically synthesized
aaaccagatcaattattttcta

SEQ ID NO: 1111268 - DNA, 22 bp, Artificial Sequence
  chemically synthesized
cacatttatatcttagaaaata

SEQ ID NO: 1111269 - DNA, 22 bp, Artificial Sequence
  chemically synthesized
acacatttatatcttagaaaat

SEQ ID NO: 1111270 - DNA, 22 bp, Artificial Sequence
  chemically synthesized
aaatcatatttacacatttata

SEQ ID NO: 1111271 - DNA, 22 bp, Artificial Sequence
  chemically synthesized
ttttctaagatataaatgtgta

SEQ ID NO: 1111272 - DNA, 22 bp, Artificial Sequence
  chemically synthesized
tctaagatataaatgtgtaaat

SEQ ID NO: 1111273 - DNA, 22 bp, Artificial Sequence
  chemically synthesized
ctaagatataaatgtgtaaata

SEQ ID NO: 1111274 - DNA, 22 bp, Artificial Sequence
  chemically synthesized
taagatataaatgtgtaaatat

SEQ ID NO: 1111275 - DNA, 22 bp, Artificial Sequence
  chemically synthesized
agatataaatgtgtaaatatga

SEQ ID NO: 1111276 - DNA, 22 bp, Artificial Sequence
  chemically synthesized
aataatctgaaatcatatttac

SEQ ID NO: 1111277 - DNA, 22 bp, Artificial Sequence
  chemically synthesized
acattgaataatctgaaatcat

SEQ ID NO: 1111278 - DNA, 22 bp, Artificial Sequence
  chemically synthesized
ataattcacattgaataatctg

SEQ ID NO: 1111279 - DNA, 22 bp, Artificial Sequence
  chemically synthesized
cagattattcaatgtgaattat

SEQ ID NO: 1111280 - DNA, 22 bp, Artificial Sequence
  chemically synthesized
agattattcaatgtgaattatc

SEQ ID NO: 1111281 - DNA, 22 bp, Artificial Sequence
  chemically synthesized
tgacgcaagtctgataattcac

SEQ ID NO: 1111282 - DNA, 22 bp, Artificial Sequence
  chemically synthesized
ttgtgacgcaagtctgataatt

SEQ ID NO: 1111283 - DNA, 22 bp, Artificial Sequence
  chemically synthesized
ttcaatgtgaattatcagactt

SEQ ID NO: 1111284 - DNA, 22 bp, Artificial Sequence
  chemically synthesized
attgttgtgacgcaagtctgat

SEQ ID NO: 1111285 - DNA, 22 bp, Artificial Sequence
  chemically synthesized
aatgtgaattatcagacttgcg

SEQ ID NO: 1111286 - DNA, 22 bp, Artificial Sequence
  chemically synthesized
atattcattgttgtgacgcaag

SEQ ID NO: 1111287 - DNA, 22 bp, Artificial Sequence
  chemically synthesized
tcagacttgcgtcacaacaatg

SEQ ID NO: 1111288 - DNA, 22 bp, Artificial Sequence
  chemically synthesized
atggcattgatattcattgttg

SEQ ID NO: 1111289 - DNA, 22 bp, Artificial Sequence
  chemically synthesized
gatggcattgatattcattgtt

SEQ ID NO: 1111290 - DNA, 22 bp, Artificial Sequence
  chemically synthesized
cttgatggcattgatattcatt

SEQ ID NO: 1111291 - DNA, 22 bp, Artificial Sequence
  chemically synthesized
gcgtcacaacaatgaatatcaa

SEQ ID NO: 1111292 - DNA, 22 bp, Artificial Sequence
  chemically synthesized
cgtcacaacaatgaatatcaat

SEQ ID NO: 1111293 - DNA, 22 bp, Artificial Sequence
  chemically synthesized
ttacttgatggcattgatattc

SEQ ID NO: 1111294 - DNA, 22 bp, Artificial Sequence
  chemically synthesized
attacttgatggcattgatatt

SEQ ID NO: 1111295 - DNA, 22 bp, Artificial Sequence
  chemically synthesized
tgtcttattacttgatggcatt

SEQ ID NO: 1111296 - DNA, 22 bp, Artificial Sequence
  chemically synthesized
atgtcttattacttgatggcat

SEQ ID NO: 1111297 - DNA, 22 bp, Artificial Sequence
  chemically synthesized
catcttatgtcttattacttga

SEQ ID NO: 1111298 - DNA, 22 bp, Artificial Sequence
  chemically synthesized
tacatcttatgtcttattactt

SEQ ID NO: 1111299 - DNA, 22 bp, Artificial Sequence
  chemically synthesized
ctacatcttatgtcttattact

SEQ ID NO: 1111300 - DNA, 22 bp, Artificial Sequence
  chemically synthesized
tctacatcttatgtcttattac

SEQ ID NO: 1111301 - DNA, 22 bp, Artificial Sequence
  chemically synthesized
attttctacatcttatgtctta

SEQ ID NO: 1111302 - DNA, 22 bp, Artificial Sequence
  chemically synthesized
taattttctacatcttatgtct

SEQ ID NO: 1111303 - DNA, 22 bp, Artificial Sequence
  chemically synthesized
catatattctaattttctacat

SEQ ID NO: 1111304 - DNA, 22 bp, Artificial Sequence
  chemically synthesized
acatatattctaattttctaca

SEQ ID NO: 1111305 - DNA, 22 bp, Artificial Sequence
  chemically synthesized
tttacatatattctaattttct

SEQ ID NO: 1111306 - DNA, 22 bp, Artificial Sequence
  chemically synthesized
atttacatatattctaattttc

SEQ ID NO: 1111307 - DNA, 22 bp, Artificial Sequence
  chemically synthesized
tatttacatatattctaatttt

SEQ ID NO: 1111308 - DNA, 22 bp, Artificial Sequence
  chemically synthesized
atattttatttacatatattct

SEQ ID NO: 1111309 - DNA, 22 bp, Artificial Sequence
  chemically synthesized
aatattttatttacatatattc

SEQ ID NO: 1111310 - DNA, 22 bp, Artificial Sequence
  chemically synthesized
tttaatattttatttacatata

SEQ ID NO: 1111311 - DNA, 22 bp, Artificial Sequence
  chemically synthesized
atttaatattttatttacatat

SEQ ID NO: 1111312 - DNA, 22 bp, Artificial Sequence
  chemically synthesized
tatttaatattttatttacata

SEQ ID NO: 1111313 - DNA, 22 bp, Artificial Sequence
  chemically synthesized
ttatttaatattttatttacat

SEQ ID NO: 1111314 - DNA, 22 bp, Artificial Sequence
  chemically synthesized
agtttttatttaatattttatt

SEQ ID NO: 1111315 - DNA, 22 bp, Artificial Sequence
  chemically synthesized
gaatatatgtaaataaaatatt

SEQ ID NO: 1111316 - DNA, 22 bp, Artificial Sequence
  chemically synthesized
aagtttttatttaatattttat

SEQ ID NO: 1111317 - DNA, 22 bp, Artificial Sequence
  chemically synthesized
tttaagtttttatttaatattt

SEQ ID NO: 1111318 - DNA, 22 bp, Artificial Sequence
  chemically synthesized
atttaagtttttatttaatatt

SEQ ID NO: 1111319 - DNA, 22 bp, Artificial Sequence
  chemically synthesized
tatttaagtttttatttaatat

SEQ ID NO: 1111320 - DNA, 22 bp, Artificial Sequence
  chemically synthesized
ttatttaagtttttatttaata

SEQ ID NO: 1111321 - DNA, 22 bp, Artificial Sequence
  chemically synthesized
tttttatttaagtttttattta

SEQ ID NO: 1111322 - DNA, 22 bp, Artificial Sequence
  chemically synthesized
gtttttatttaagtttttattt

SEQ ID NO: 1111323 - DNA, 22 bp, Artificial Sequence
  chemically synthesized
tgtttttatttaagtttttatt

SEQ ID NO: 1111324 - DNA, 22 bp, Artificial Sequence
  chemically synthesized
ttgtttttatttaagtttttat

SEQ ID NO: 1111325 - DNA, 22 bp, Artificial Sequence
  chemically synthesized
agcacttttgtttttatttaag

SEQ ID NO: 1111326 - DNA, 22 bp, Artificial Sequence
  chemically synthesized
gagcacttttgtttttatttaa

SEQ ID NO: 1111327 - DNA, 22 bp, Artificial Sequence
  chemically synthesized
tgagcacttttgtttttattta

SEQ ID NO: 1111328 - DNA, 22 bp, Artificial Sequence
  chemically synthesized
aataaaaacttaaataaaaaca

SEQ ID NO: 1111329 - DNA, 22 bp, Artificial Sequence
  chemically synthesized
ccatcagagctttgagcacttt

SEQ ID NO: 1111330 - DNA, 22 bp, Artificial Sequence
  chemically synthesized
aaataaaaacaaaagtgctcaa

SEQ ID NO: 1111331 - DNA, 22 bp, Artificial Sequence
  chemically synthesized
aataaaaacaaaagtgctcaaa

SEQ ID NO: 1111332 - DNA, 22 bp, Artificial Sequence
  chemically synthesized
cagctcccatcagagctttgag

SEQ ID NO: 1111333 - DNA, 22 bp, Artificial Sequence
  chemically synthesized
ccagctcccatcagagctttga

SEQ ID NO: 1111334 - DNA, 22 bp, Artificial Sequence
  chemically synthesized
atgcagccttccagctcccatc

SEQ ID NO: 1111335 - DNA, 22 bp, Artificial Sequence
  chemically synthesized
ttcatgcagccttccagctccc

SEQ ID NO: 1111336 - DNA, 22 bp, Artificial Sequence
  chemically synthesized
aaagctctgatgggagctggaa

SEQ ID NO: 1111337 - DNA, 22 bp, Artificial Sequence
  chemically synthesized
gttcatgcagccttccagctcc

SEQ ID NO: 1111338 - DNA, 22 bp, Artificial Sequence
  chemically synthesized
cttgttcatgcagccttccagc

SEQ ID NO: 1111339 - DNA, 22 bp, Artificial Sequence
  chemically synthesized
tgatgggagctggaaggctgca

SEQ ID NO: 1111340 - DNA, 22 bp, Artificial Sequence
  chemically synthesized
atgggagctggaaggctgcatg

SEQ ID NO: 1111341 - DNA, 22 bp, Artificial Sequence
  chemically synthesized
gaaggctgcatgaacaagtaac

SEQ ID NO: 1111342 - DNA, 22 bp, Artificial Sequence
  chemically synthesized
aaaacatccaaaatgttacttg

SEQ ID NO: 1111343 - DNA, 22 bp, Artificial Sequence
  chemically synthesized
catgaacaagtaacattttgga

SEQ ID NO: 1111344 - DNA, 22 bp, Artificial Sequence
  chemically synthesized
tggatgttttcagatacatttt

SEQ ID NO: 1111345 - DNA, 22 bp, Artificial Sequence
  chemically synthesized
ggatgttttcagatacatttta

SEQ ID NO: 1111346 - DNA, 22 bp, Artificial Sequence
  chemically synthesized
gatgttttcagatacattttac

SEQ ID NO: 1111347 - DNA, 22 bp, Artificial Sequence
  chemically synthesized
agtaatatgtatgatatgtaaa

SEQ ID NO: 1111348 - DNA, 22 bp, Artificial Sequence
  chemically synthesized
gagtaatatgtatgatatgtaa

SEQ ID NO: 1111349 - DNA, 22 bp, Artificial Sequence
  chemically synthesized
tcagatacattttacatatcat

SEQ ID NO: 1111350 - DNA, 22 bp, Artificial Sequence
  chemically synthesized
cagatacattttacatatcata

SEQ ID NO: 1111351 - DNA, 22 bp, Artificial Sequence
  chemically synthesized
agatacattttacatatcatac

SEQ ID NO: 1111352 - DNA, 22 bp, Artificial Sequence
  chemically synthesized
tacatatcatacatattactca

SEQ ID NO: 1111353 - DNA, 22 bp, Artificial Sequence
  chemically synthesized
gggaagtatatttgagtaatat

SEQ ID NO: 1111354 - DNA, 22 bp, Artificial Sequence
  chemically synthesized
acatatcatacatattactcaa

SEQ ID NO: 1111355 - DNA, 22 bp, Artificial Sequence
  chemically synthesized
ggggaagtatatttgagtaata

SEQ ID NO: 1111356 - DNA, 22 bp, Artificial Sequence
  chemically synthesized
catatcatacatattactcaaa

SEQ ID NO: 1111357 - DNA, 22 bp, Artificial Sequence
  chemically synthesized
gtttggggaagtatatttgagt

SEQ ID NO: 1111358 - DNA, 22 bp, Artificial Sequence
  chemically synthesized
ctcaaatatacttccccaaact

SEQ ID NO: 1111359 - DNA, 22 bp, Artificial Sequence
  chemically synthesized
aaaatgtaagttagtttgggga

SEQ ID NO: 1111360 - DNA, 22 bp, Artificial Sequence
  chemically synthesized
aaatatacttccccaaactaac

SEQ ID NO: 1111361 - DNA, 22 bp, Artificial Sequence
  chemically synthesized
aaattaaaaatgtaagttagtt

SEQ ID NO: 1111362 - DNA, 22 bp, Artificial Sequence
  chemically synthesized
aaaattaaaaatgtaagttagt

SEQ ID NO: 1111363 - DNA, 22 bp, Artificial Sequence
  chemically synthesized
taaaattaaaaatgtaagttag

SEQ ID NO: 1111364 - DNA, 22 bp, Artificial Sequence
  chemically synthesized
ttaaaattaaaaatgtaagtta

SEQ ID NO: 1111365 - DNA, 22 bp, Artificial Sequence
  chemically synthesized
ccccaaactaacttacattttt

SEQ ID NO: 1111366 - DNA, 22 bp, Artificial Sequence
  chemically synthesized
cccaaactaacttacattttta

SEQ ID NO: 1111367 - DNA, 22 bp, Artificial Sequence
  chemically synthesized
caagcccatttttaaaattaaa

SEQ ID NO: 1111368 - DNA, 22 bp, Artificial Sequence
  chemically synthesized
ccaagcccatttttaaaattaa

SEQ ID NO: 1111369 - DNA, 22 bp, Artificial Sequence
  chemically synthesized
acttacatttttaattttaaaa

SEQ ID NO: 1111370 - DNA, 22 bp, Artificial Sequence
  chemically synthesized
atttccaagcccatttttaaaa

SEQ ID NO: 1111371 - DNA, 22 bp, Artificial Sequence
  chemically synthesized
acatttttaattttaaaaatgg

SEQ ID NO: 1111372 - DNA, 22 bp, Artificial Sequence
  chemically synthesized
catttttaattttaaaaatggg

SEQ ID NO: 1111373 - DNA, 22 bp, Artificial Sequence
  chemically synthesized
aactaatttccaagcccatttt

SEQ ID NO: 1111374 - DNA, 22 bp, Artificial Sequence
  chemically synthesized
aaactaatttccaagcccattt

SEQ ID NO: 1111375 - DNA, 22 bp, Artificial Sequence
  chemically synthesized
ttaattttaaaaatgggcttgg

SEQ ID NO: 1111376 - DNA, 22 bp, Artificial Sequence
  chemically synthesized
taattttaaaaatgggcttgga

SEQ ID NO: 1111377 - DNA, 22 bp, Artificial Sequence
  chemically synthesized
tttaaactaatttccaagccca

SEQ ID NO: 1111378 - DNA, 22 bp, Artificial Sequence
  chemically synthesized
aattttaaaaatgggcttggaa

SEQ ID NO: 1111379 - DNA, 22 bp, Artificial Sequence
  chemically synthesized
attttaaaaatgggcttggaaa

SEQ ID NO: 1111380 - DNA, 22 bp, Artificial Sequence
  chemically synthesized
taaaaatgggcttggaaattag

SEQ ID NO: 1111381 - DNA, 22 bp, Artificial Sequence
  chemically synthesized
aaaaatgggcttggaaattagt

SEQ ID NO: 1111382 - DNA, 22 bp, Artificial Sequence
  chemically synthesized
aaaatgggcttggaaattagtt

SEQ ID NO: 1111383 - DNA, 22 bp, Artificial Sequence
  chemically synthesized
tgaaaatactatttaaactaat

SEQ ID NO: 1111384 - DNA, 22 bp, Artificial Sequence
  chemically synthesized
aaactatgaaaatactatttaa

SEQ ID NO: 1111385 - DNA, 22 bp, Artificial Sequence
  chemically synthesized
aaaactatgaaaatactattta

SEQ ID NO: 1111386 - DNA, 22 bp, Artificial Sequence
  chemically synthesized
ggaaattagtttaaatagtatt

SEQ ID NO: 1111387 - DNA, 22 bp, Artificial Sequence
  chemically synthesized
taaaactatgaaaatactattt

SEQ ID NO: 1111388 - DNA, 22 bp, Artificial Sequence
  chemically synthesized
gaaattagtttaaatagtattt

SEQ ID NO: 1111389 - DNA, 22 bp, Artificial Sequence
  chemically synthesized
ttaaaactatgaaaatactatt

SEQ ID NO: 1111390 - DNA, 22 bp, Artificial Sequence
  chemically synthesized
tttaaaactatgaaaatactat

SEQ ID NO: 1111391 - DNA, 22 bp, Artificial Sequence
  chemically synthesized
tttttaaaactatgaaaatact

SEQ ID NO: 1111392 - DNA, 22 bp, Artificial Sequence
  chemically synthesized
ctctttttaaaactatgaaaat

SEQ ID NO: 1111393 - DNA, 22 bp, Artificial Sequence
  chemically synthesized
gtttaaatagtattttcatagt

SEQ ID NO: 1111394 - DNA, 22 bp, Artificial Sequence
  chemically synthesized
cctctttttaaaactatgaaaa

SEQ ID NO: 1111395 - DNA, 22 bp, Artificial Sequence
  chemically synthesized
tcctctttttaaaactatgaaa

SEQ ID NO: 1111396 - DNA, 22 bp, Artificial Sequence
  chemically synthesized
ttcctctttttaaaactatgaa

SEQ ID NO: 1111397 - DNA, 22 bp, Artificial Sequence
  chemically synthesized
tttcctctttttaaaactatga

SEQ ID NO: 1111398 - DNA, 22 bp, Artificial Sequence
  chemically synthesized
aaatagtattttcatagtttta

SEQ ID NO: 1111399 - DNA, 22 bp, Artificial Sequence
  chemically synthesized
ttttcctctttttaaaactatg

SEQ ID NO: 1111400 - DNA, 22 bp, Artificial Sequence
  chemically synthesized
aatagtattttcatagttttaa

SEQ ID NO: 1111401 - DNA, 22 bp, Artificial Sequence
  chemically synthesized
tttttcctctttttaaaactat

SEQ ID NO: 1111402 - DNA, 22 bp, Artificial Sequence
  chemically synthesized
gattttttttcctctttttaaa

SEQ ID NO: 1111403 - DNA, 22 bp, Artificial Sequence
  chemically synthesized
ggattttttttcctctttttaa

SEQ ID NO: 1111404 - DNA, 22 bp, Artificial Sequence
  chemically synthesized
tcatagttttaaaaagaggaaa

SEQ ID NO: 1111405 - DNA, 22 bp, Artificial Sequence
  chemically synthesized
catagttttaaaaagaggaaaa

SEQ ID NO: 1111406 - DNA, 22 bp, Artificial Sequence
  chemically synthesized
atagttttaaaaagaggaaaaa

SEQ ID NO: 1111407 - DNA, 22 bp, Artificial Sequence
  chemically synthesized
taaaaagaggaaaaaaaatcca

SEQ ID NO: 1111408 - DNA, 22 bp, Artificial Sequence
  chemically synthesized
aaaaagaggaaaaaaaatccaa

SEQ ID NO: 1111409 - DNA, 22 bp, Artificial Sequence
  chemically synthesized
aaaagaggaaaaaaaatccaag

SEQ ID NO: 1111410 - DNA, 22 bp, Artificial Sequence
  chemically synthesized
taaatgaaataaagaataatct

SEQ ID NO: 1111411 - DNA, 22 bp, Artificial Sequence
  chemically synthesized
tgtaaatgaaataaagaataat

SEQ ID NO: 1111412 - DNA, 22 bp, Artificial Sequence
  chemically synthesized
ctgtaaatgaaataaagaataa

SEQ ID NO: 1111413 - DNA, 22 bp, Artificial Sequence
  chemically synthesized
atcttctgtaaatgaaataaag

SEQ ID NO: 1111414 - DNA, 22 bp, Artificial Sequence
  chemically synthesized
taatcttctgtaaatgaaataa

SEQ ID NO: 1111415 - DNA, 22 bp, Artificial Sequence
  chemically synthesized
ctaatcttctgtaaatgaaata

SEQ ID NO: 1111416 - DNA, 22 bp, Artificial Sequence
  chemically synthesized
tttctaatcttctgtaaatgaa

SEQ ID NO: 1111417 - DNA, 22 bp, Artificial Sequence
  chemically synthesized
atttctaatcttctgtaaatga

SEQ ID NO: 1111418 - DNA, 22 bp, Artificial Sequence
  chemically synthesized
ttctttatttcatttacagaag

SEQ ID NO: 1111419 - DNA, 22 bp, Artificial Sequence
  chemically synthesized
tttatttctaatcttctgtaaa

SEQ ID NO: 1111420 - DNA, 22 bp, Artificial Sequence
  chemically synthesized
tttatttcatttacagaagatt

SEQ ID NO: 1111421 - DNA, 22 bp, Artificial Sequence
  chemically synthesized
tatttcatttacagaagattag

SEQ ID NO: 1111422 - DNA, 22 bp, Artificial Sequence
  chemically synthesized
atttcatttacagaagattaga

SEQ ID NO: 1111423 - DNA, 22 bp, Artificial Sequence
  chemically synthesized
tttcatttacagaagattagaa

SEQ ID NO: 1111424 - DNA, 22 bp, Artificial Sequence
  chemically synthesized
catttacagaagattagaaata

SEQ ID NO: 1111425 - DNA, 22 bp, Artificial Sequence
  chemically synthesized
atttacagaagattagaaataa

SEQ ID NO: 1111426 - DNA, 22 bp, Artificial Sequence
  chemically synthesized
acagaagattagaaataaacag

SEQ ID NO: 1111427 - DNA, 22 bp, Artificial Sequence
  chemically synthesized
cagaagattagaaataaacaga

SEQ ID NO: 1111428 - DNA, 22 bp, Artificial Sequence
  chemically synthesized
gaaataaacagattgtcggctg

SEQ ID NO: 1111429 - DNA, 22 bp, Artificial Sequence
  chemically synthesized
taggcatgagccaccgtgccca

SEQ ID NO: 1111430 - DNA, 22 bp, Artificial Sequence
  chemically synthesized
gaattataggcatgagccaccg

SEQ ID NO: 1111431 - DNA, 22 bp, Artificial Sequence
  chemically synthesized
tcggctgggcacggtggctcat

SEQ ID NO: 1111432 - DNA, 22 bp, Artificial Sequence
  chemically synthesized
ggcacggtggctcatgcctata

SEQ ID NO: 1111433 - DNA, 22 bp, Artificial Sequence
  chemically synthesized
ccaaagtgttggaattataggc

SEQ ID NO: 1111434 - DNA, 22 bp, Artificial Sequence
  chemically synthesized
ggcctcccaaagtgttggaatt

SEQ ID NO: 1111435 - DNA, 22 bp, Artificial Sequence
  chemically synthesized
atgcctataattccaacacttt

SEQ ID NO: 1111436 - DNA, 22 bp, Artificial Sequence
  chemically synthesized
taattccaacactttgggaggc

SEQ ID NO: 1111437 - DNA, 22 bp, Artificial Sequence
  chemically synthesized
caacactttgggaggccgaggt

SEQ ID NO: 1111438 - DNA, 22 bp, Artificial Sequence
  chemically synthesized
ccgatgccgtgatcccccacct

SEQ ID NO: 1111439 - DNA, 22 bp, Artificial Sequence
  chemically synthesized
tgggaggccgaggtgggggatc

SEQ ID NO: 1111440 - DNA, 22 bp, Artificial Sequence
  chemically synthesized
gggaggccgaggtgggggatca

SEQ ID NO: 1111441 - DNA, 22 bp, Artificial Sequence
  chemically synthesized
ggaggccgaggtgggggatcac

SEQ ID NO: 1111442 - DNA, 22 bp, Artificial Sequence
  chemically synthesized
atctcccgatgccgtgatcccc

SEQ ID NO: 1111443 - DNA, 22 bp, Artificial Sequence
  chemically synthesized
gatctcccgatgccgtgatccc

SEQ ID NO: 1111444 - DNA, 22 bp, Artificial Sequence
  chemically synthesized
gccaggatggtcttgatctccc

SEQ ID NO: 1111445 - DNA, 22 bp, Artificial Sequence
  chemically synthesized
accgtgttagccaggatggtct

SEQ ID NO: 1111446 - DNA, 22 bp, Artificial Sequence
  chemically synthesized
caccgtgttagccaggatggtc

SEQ ID NO: 1111447 - DNA, 22 bp, Artificial Sequence
  chemically synthesized
gtagagacggggtttcaccgtg

SEQ ID NO: 1111448 - DNA, 22 bp, Artificial Sequence
  chemically synthesized
agtagagacggggtttcaccgt

SEQ ID NO: 1111449 - DNA, 22 bp, Artificial Sequence
  chemically synthesized
tagtagagacggggtttcaccg

SEQ ID NO: 1111450 - DNA, 22 bp, Artificial Sequence
  chemically synthesized
ttagtagagacggggtttcacc

SEQ ID NO: 1111451 - DNA, 22 bp, Artificial Sequence
  chemically synthesized
gctaacacggtgaaaccccgtc

SEQ ID NO: 1111452 - DNA, 22 bp, Artificial Sequence
  chemically synthesized
tatttttagtagagacggggtt

SEQ ID NO: 1111453 - DNA, 22 bp, Artificial Sequence
  chemically synthesized
gtatttttagtagagacggggt

SEQ ID NO: 1111454 - DNA, 22 bp, Artificial Sequence
  chemically synthesized
tgtatttttagtagagacgggg

SEQ ID NO: 1111455 - DNA, 22 bp, Artificial Sequence
  chemically synthesized
acacggtgaaaccccgtctcta

SEQ ID NO: 1111456 - DNA, 22 bp, Artificial Sequence
  chemically synthesized
ttgtatttttagtagagacggg

SEQ ID NO: 1111457 - DNA, 22 bp, Artificial Sequence
  chemically synthesized
tttgtatttttagtagagacgg

SEQ ID NO: 1111458 - DNA, 22 bp, Artificial Sequence
  chemically synthesized
attttttgtatttttagtagag

SEQ ID NO: 1111459 - DNA, 22 bp, Artificial Sequence
  chemically synthesized
tactaaaaatacaaaaaattag

SEQ ID NO: 1111460 - DNA, 22 bp, Artificial Sequence
  chemically synthesized
ctaaaaatacaaaaaattagcc

SEQ ID NO: 1111461 - DNA, 22 bp, Artificial Sequence
  chemically synthesized
aaaatacaaaaaattagccggg

SEQ ID NO: 1111462 - DNA, 22 bp, Artificial Sequence
  chemically synthesized
gaaccccaggcgcccgccacca

SEQ ID NO: 1111463 - DNA, 22 bp, Artificial Sequence
  chemically synthesized
gccgggcgtggtggcgggcgcc

SEQ ID NO: 1111464 - DNA, 22 bp, Artificial Sequence
  chemically synthesized
ccgagtagctggaaccccaggc

SEQ ID NO: 1111465 - DNA, 22 bp, Artificial Sequence
  chemically synthesized
agcctcccgagtagctggaacc

SEQ ID NO: 1111466 - DNA, 22 bp, Artificial Sequence
  chemically synthesized
cctcagcctcccgagtagctgg

SEQ ID NO: 1111467 - DNA, 22 bp, Artificial Sequence
  chemically synthesized
ctgcctcagcctcccgagtagc

SEQ ID NO: 1111468 - DNA, 22 bp, Artificial Sequence
  chemically synthesized
tcctgcctcagcctcccgagta

SEQ ID NO: 1111469 - DNA, 22 bp, Artificial Sequence
  chemically synthesized
gggttccagctactcgggaggc

SEQ ID NO: 1111470 - DNA, 22 bp, Artificial Sequence
  chemically synthesized
cagctactcgggaggctgaggc

SEQ ID NO: 1111471 - DNA, 22 bp, Artificial Sequence
  chemically synthesized
acgccattctcctgcctcagcc

SEQ ID NO: 1111472 - DNA, 22 bp, Artificial Sequence
  chemically synthesized
ctcgggaggctgaggcaggaga

SEQ ID NO: 1111473 - DNA, 22 bp, Artificial Sequence
  chemically synthesized
gggaggctgaggcaggagaatg

SEQ ID NO: 1111474 - DNA, 22 bp, Artificial Sequence
  chemically synthesized
ccgggttcacgccattctcctg

SEQ ID NO: 1111475 - DNA, 22 bp, Artificial Sequence
  chemically synthesized
cgcctcccgggttcacgccatt

SEQ ID NO: 1111476 - DNA, 22 bp, Artificial Sequence
  chemically synthesized
aggcaggagaatggcgtgaacc

SEQ ID NO: 1111477 - DNA, 22 bp, Artificial Sequence
  chemically synthesized
caagctccgcctcccgggttca

SEQ ID NO: 1111478 - DNA, 22 bp, Artificial Sequence
  chemically synthesized
actgcaagctccgcctcccggg

SEQ ID NO: 1111479 - DNA, 22 bp, Artificial Sequence
  chemically synthesized
cgctcactgcaagctccgcctc

SEQ ID NO: 1111480 - DNA, 22 bp, Artificial Sequence
  chemically synthesized
gagtgcagtggcgcgatctccg

SEQ ID NO: 1111481 - DNA, 22 bp, Artificial Sequence
  chemically synthesized
gcagtgagcggagatcgcgcca

SEQ ID NO: 1111482 - DNA, 22 bp, Artificial Sequence
  chemically synthesized
cagtgagcggagatcgcgccac

SEQ ID NO: 1111483 - DNA, 22 bp, Artificial Sequence
  chemically synthesized
tcacccaggctggagtgcagtg

SEQ ID NO: 1111484 - DNA, 22 bp, Artificial Sequence
  chemically synthesized
tgtcacccaggctggagtgcag

SEQ ID NO: 1111485 - DNA, 22 bp, Artificial Sequence
  chemically synthesized
gctctgtcacccaggctggagt

SEQ ID NO: 1111486 - DNA, 22 bp, Artificial Sequence
  chemically synthesized
cactccagcctgggtgacagag

SEQ ID NO: 1111487 - DNA, 22 bp, Artificial Sequence
  chemically synthesized
cagcctgggtgacagagcgaga

SEQ ID NO: 1111488 - DNA, 22 bp, Artificial Sequence
  chemically synthesized
ggtgacagagcgagactctgtc

SEQ ID NO: 1111489 - DNA, 22 bp, Artificial Sequence
  chemically synthesized
gcatccatggacaatatgagac

SEQ ID NO: 1111490 - DNA, 22 bp, Artificial Sequence
  chemically synthesized
ctcgcatccatggacaatatga

SEQ ID NO: 1111491 - DNA, 22 bp, Artificial Sequence
  chemically synthesized
cctcgcatccatggacaatatg

SEQ ID NO: 1111492 - DNA, 22 bp, Artificial Sequence
  chemically synthesized
ttcctcgcatccatggacaata

SEQ ID NO: 1111493 - DNA, 22 bp, Artificial Sequence
  chemically synthesized
cttcctcgcatccatggacaat

SEQ ID NO: 1111494 - DNA, 22 bp, Artificial Sequence
  chemically synthesized
tcttcctcgcatccatggacaa

SEQ ID NO: 1111495 - DNA, 22 bp, Artificial Sequence
  chemically synthesized
ttcttcctcgcatccatggaca

SEQ ID NO: 1111496 - DNA, 22 bp, Artificial Sequence
  chemically synthesized
tgtctcatattgtccatggatg

SEQ ID NO: 1111497 - DNA, 22 bp, Artificial Sequence
  chemically synthesized
tttttcttcctcgcatccatgg

SEQ ID NO: 1111498 - DNA, 22 bp, Artificial Sequence
  chemically synthesized
tctcatattgtccatggatgcg

SEQ ID NO: 1111499 - DNA, 22 bp, Artificial Sequence
  chemically synthesized
gtttttcttcctcgcatccatg

SEQ ID NO: 1111500 - DNA, 22 bp, Artificial Sequence
  chemically synthesized
atattgtccatggatgcgagga

SEQ ID NO: 1111501 - DNA, 22 bp, Artificial Sequence
  chemically synthesized
gtacttgtttttcttcctcgca

SEQ ID NO: 1111502 - DNA, 22 bp, Artificial Sequence
  chemically synthesized
ctagtacttgtttttcttcctc

SEQ ID NO: 1111503 - DNA, 22 bp, Artificial Sequence
  chemically synthesized
tccatggatgcgaggaagaaaa

SEQ ID NO: 1111504 - DNA, 22 bp, Artificial Sequence
  chemically synthesized
cctagtacttgtttttcttcct

SEQ ID NO: 1111505 - DNA, 22 bp, Artificial Sequence
  chemically synthesized
tcctagtacttgtttttcttcc

SEQ ID NO: 1111506 - DNA, 22 bp, Artificial Sequence
  chemically synthesized
ttcctagtacttgtttttcttc

SEQ ID NO: 1111507 - DNA, 22 bp, Artificial Sequence
  chemically synthesized
tttttcctagtacttgtttttc

SEQ ID NO: 1111508 - DNA, 22 bp, Artificial Sequence
  chemically synthesized
gaaagattatttttcctagtac

SEQ ID NO: 1111509 - DNA, 22 bp, Artificial Sequence
  chemically synthesized
acattagaaagattatttttcc

SEQ ID NO: 1111510 - DNA, 22 bp, Artificial Sequence
  chemically synthesized
cacattagaaagattatttttc

SEQ ID NO: 1111511 - DNA, 22 bp, Artificial Sequence
  chemically synthesized
aaaatgtttcacattagaaaga

SEQ ID NO: 1111512 - DNA, 22 bp, Artificial Sequence
  chemically synthesized
aaaaatgtttcacattagaaag

SEQ ID NO: 1111513 - DNA, 22 bp, Artificial Sequence
  chemically synthesized
ggaaaaataatctttctaatgt

SEQ ID NO: 1111514 - DNA, 22 bp, Artificial Sequence
  chemically synthesized
taaatttaaaaatgtttcacat

SEQ ID NO: 1111515 - DNA, 22 bp, Artificial Sequence
  chemically synthesized
ataaatttaaaaatgtttcaca

SEQ ID NO: 1111516 - DNA, 22 bp, Artificial Sequence
  chemically synthesized
catttataaatttaaaaatgtt

SEQ ID NO: 1111517 - DNA, 22 bp, Artificial Sequence
  chemically synthesized
tctaatgtgaaacatttttaaa

SEQ ID NO: 1111518 - DNA, 22 bp, Artificial Sequence
  chemically synthesized
tacatttataaatttaaaaatg

SEQ ID NO: 1111519 - DNA, 22 bp, Artificial Sequence
  chemically synthesized
ctaatgtgaaacatttttaaat

SEQ ID NO: 1111520 - DNA, 22 bp, Artificial Sequence
  chemically synthesized
ctacatttataaatttaaaaat

SEQ ID NO: 1111521 - DNA, 22 bp, Artificial Sequence
  chemically synthesized
taatgtgaaacatttttaaatt

SEQ ID NO: 1111522 - DNA, 22 bp, Artificial Sequence
  chemically synthesized
atgtgaaacatttttaaattta

SEQ ID NO: 1111523 - DNA, 22 bp, Artificial Sequence
  chemically synthesized
agatcaacttctacatttataa

SEQ ID NO: 1111524 - DNA, 22 bp, Artificial Sequence
  chemically synthesized
gagatcaacttctacatttata

SEQ ID NO: 1111525 - DNA, 22 bp, Artificial Sequence
  chemically synthesized
tgagatcaacttctacatttat

SEQ ID NO: 1111526 - DNA, 22 bp, Artificial Sequence
  chemically synthesized
ttaaatttataaatgtagaagt

SEQ ID NO: 1111527 - DNA, 22 bp, Artificial Sequence
  chemically synthesized
taaatttataaatgtagaagtt

SEQ ID NO: 1111528 - DNA, 22 bp, Artificial Sequence
  chemically synthesized
aaatttataaatgtagaagttg

SEQ ID NO: 1111529 - DNA, 22 bp, Artificial Sequence
  chemically synthesized
aaactttgagatcaacttctac

SEQ ID NO: 1111530 - DNA, 22 bp, Artificial Sequence
  chemically synthesized
aatttataaatgtagaagttga

SEQ ID NO: 1111531 - DNA, 22 bp, Artificial Sequence
  chemically synthesized
aaaactttgagatcaacttcta

SEQ ID NO: 1111532 - DNA, 22 bp, Artificial Sequence
  chemically synthesized
taaaactttgagatcaacttct

SEQ ID NO: 1111533 - DNA, 22 bp, Artificial Sequence
  chemically synthesized
ataaatgtagaagttgatctca

SEQ ID NO: 1111534 - DNA, 22 bp, Artificial Sequence
  chemically synthesized
taaatgtagaagttgatctcaa

SEQ ID NO: 1111535 - DNA, 22 bp, Artificial Sequence
  chemically synthesized
cagatgattttaaaactttgag

SEQ ID NO: 1111536 - DNA, 22 bp, Artificial Sequence
  chemically synthesized
ctacagatgattttaaaacttt

SEQ ID NO: 1111537 - DNA, 22 bp, Artificial Sequence
  chemically synthesized
gtattactacagatgattttaa

SEQ ID NO: 1111538 - DNA, 22 bp, Artificial Sequence
  chemically synthesized
atctcaaagttttaaaatcatc

SEQ ID NO: 1111539 - DNA, 22 bp, Artificial Sequence
  chemically synthesized
ggtattactacagatgatttta

SEQ ID NO: 1111540 - DNA, 22 bp, Artificial Sequence
  chemically synthesized
aaagttttaaaatcatctgtag

SEQ ID NO: 1111541 - DNA, 22 bp, Artificial Sequence
  chemically synthesized
ggtttggtattactacagatga

SEQ ID NO: 1111542 - DNA, 22 bp, Artificial Sequence
  chemically synthesized
tgggtttggtattactacagat

SEQ ID NO: 1111543 - DNA, 22 bp, Artificial Sequence
  chemically synthesized
ctgggtttggtattactacaga

SEQ ID NO: 1111544 - DNA, 22 bp, Artificial Sequence
  chemically synthesized
tctgggtttggtattactacag

SEQ ID NO: 1111545 - DNA, 22 bp, Artificial Sequence
  chemically synthesized
taaaatcatctgtagtaatacc

SEQ ID NO: 1111546 - DNA, 22 bp, Artificial Sequence
  chemically synthesized
aaaatcatctgtagtaatacca

SEQ ID NO: 1111547 - DNA, 22 bp, Artificial Sequence
  chemically synthesized
aaatcatctgtagtaataccaa

SEQ ID NO: 1111548 - DNA, 22 bp, Artificial Sequence
  chemically synthesized
ataaagttttctgggtttggta

SEQ ID NO: 1111549 - DNA, 22 bp, Artificial Sequence
  chemically synthesized
gataaagttttctgggtttggt

SEQ ID NO: 1111550 - DNA, 22 bp, Artificial Sequence
  chemically synthesized
ccttgataaagttttctgggtt

SEQ ID NO: 1111551 - DNA, 22 bp, Artificial Sequence
  chemically synthesized
tagtaataccaaacccagaaaa

SEQ ID NO: 1111552 - DNA, 22 bp, Artificial Sequence
  chemically synthesized
cccttgataaagttttctgggt

SEQ ID NO: 1111553 - DNA, 22 bp, Artificial Sequence
  chemically synthesized
tcccttgataaagttttctggg

SEQ ID NO: 1111554 - DNA, 22 bp, Artificial Sequence
  chemically synthesized
ttcccttgataaagttttctgg

SEQ ID NO: 1111555 - DNA, 22 bp, Artificial Sequence
  chemically synthesized
catttttcccttgataaagttt

SEQ ID NO: 1111556 - DNA, 22 bp, Artificial Sequence
  chemically synthesized
ccatttttcccttgataaagtt

SEQ ID NO: 1111557 - DNA, 22 bp, Artificial Sequence
  chemically synthesized
tgtttccatttttcccttgata

SEQ ID NO: 1111558 - DNA, 22 bp, Artificial Sequence
  chemically synthesized
gtgtttccatttttcccttgat

SEQ ID NO: 1111559 - DNA, 22 bp, Artificial Sequence
  chemically synthesized
tatcaagggaaaaatggaaaca

SEQ ID NO: 1111560 - DNA, 22 bp, Artificial Sequence
  chemically synthesized
atcaagggaaaaatggaaacac

SEQ ID NO: 1111561 - DNA, 22 bp, Artificial Sequence
  chemically synthesized
tcaagggaaaaatggaaacaca

SEQ ID NO: 1111562 - DNA, 22 bp, Artificial Sequence
  chemically synthesized
cagaatggtaatggtgataatg

SEQ ID NO: 1111563 - DNA, 22 bp, Artificial Sequence
  chemically synthesized
tcaccattaccattctggagta

SEQ ID NO: 1111564 - DNA, 22 bp, Artificial Sequence
  chemically synthesized
catggtacatagtaggtactcc

SEQ ID NO: 1111565 - DNA, 22 bp, Artificial Sequence
  chemically synthesized
ccattctggagtacctactatg

SEQ ID NO: 1111566 - DNA, 22 bp, Artificial Sequence
  chemically synthesized
tggagtacctactatgtaccat

SEQ ID NO: 1111567 - DNA, 22 bp, Artificial Sequence
  chemically synthesized
gagtacctactatgtaccatgg

SEQ ID NO: 1111568 - DNA, 22 bp, Artificial Sequence
  chemically synthesized
ctatgtaccatggaatatgcta

SEQ ID NO: 1111569 - DNA, 22 bp, Artificial Sequence
  chemically synthesized
tgtaccatggaatatgctatgt

SEQ ID NO: 1111570 - DNA, 22 bp, Artificial Sequence
  chemically synthesized
gtcatatatgaaatgacatagc

SEQ ID NO: 1111571 - DNA, 22 bp, Artificial Sequence
  chemically synthesized
gcgttcgtcatatatgaaatga

SEQ ID NO: 1111572 - DNA, 22 bp, Artificial Sequence
  chemically synthesized
gactggcgttcgtcatatatga

SEQ ID NO: 1111573 - DNA, 22 bp, Artificial Sequence
  chemically synthesized
ggactggcgttcgtcatatatg

SEQ ID NO: 1111574 - DNA, 22 bp, Artificial Sequence
  chemically synthesized
tgtcatttcatatatgacgaac

SEQ ID NO: 1111575 - DNA, 22 bp, Artificial Sequence
  chemically synthesized
catatatgacgaacgccagtcc

SEQ ID NO: 1111576 - DNA, 22 bp, Artificial Sequence
  chemically synthesized
atatatgacgaacgccagtcca

SEQ ID NO: 1111577 - DNA, 22 bp, Artificial Sequence
  chemically synthesized
tgtatggaataatatgtacttg

SEQ ID NO: 1111578 - DNA, 22 bp, Artificial Sequence
  chemically synthesized
atgctatgtatggaataatatg

SEQ ID NO: 1111579 - DNA, 22 bp, Artificial Sequence
  chemically synthesized
catgctatgtatggaataatat

SEQ ID NO: 1111580 - DNA, 22 bp, Artificial Sequence
  chemically synthesized
tcatgctatgtatggaataata

SEQ ID NO: 1111581 - DNA, 22 bp, Artificial Sequence
  chemically synthesized
ccatgctttcatgctatgtatg

SEQ ID NO: 1111582 - DNA, 22 bp, Artificial Sequence
  chemically synthesized
ttccatacatagcatgaaagca

SEQ ID NO: 1111583 - DNA, 22 bp, Artificial Sequence
  chemically synthesized
catacatagcatgaaagcatgg

SEQ ID NO: 1111584 - DNA, 22 bp, Artificial Sequence
  chemically synthesized
acccatagcacagcgtgatgtt

SEQ ID NO: 1111585 - DNA, 22 bp, Artificial Sequence
  chemically synthesized
aacccatagcacagcgtgatgt

SEQ ID NO: 1111586 - DNA, 22 bp, Artificial Sequence
  chemically synthesized
taacccatagcacagcgtgatg

SEQ ID NO: 1111587 - DNA, 22 bp, Artificial Sequence
  chemically synthesized
aatattttaacccatagcacag

SEQ ID NO: 1111588 - DNA, 22 bp, Artificial Sequence
  chemically synthesized
gaatattttaacccatagcaca

SEQ ID NO: 1111589 - DNA, 22 bp, Artificial Sequence
  chemically synthesized
gagagtttgaatattttaaccc

SEQ ID NO: 1111590 - DNA, 22 bp, Artificial Sequence
  chemically synthesized
agagagtttgaatattttaacc

SEQ ID NO: 1111591 - DNA, 22 bp, Artificial Sequence
  chemically synthesized
tagagagtttgaatattttaac

SEQ ID NO: 1111592 - DNA, 22 bp, Artificial Sequence
  chemically synthesized
tgctatgggttaaaatattcaa

SEQ ID NO: 1111593 - DNA, 22 bp, Artificial Sequence
  chemically synthesized
actttagagagtttgaatattt

SEQ ID NO: 1111594 - DNA, 22 bp, Artificial Sequence
  chemically synthesized
tgggttaaaatattcaaactct

SEQ ID NO: 1111595 - DNA, 22 bp, Artificial Sequence
  chemically synthesized
taaactaactttagagagtttg

SEQ ID NO: 1111596 - DNA, 22 bp, Artificial Sequence
  chemically synthesized
gtaaactaactttagagagttt

SEQ ID NO: 1111597 - DNA, 22 bp, Artificial Sequence
  chemically synthesized
tgtaaactaactttagagagtt

SEQ ID NO: 1111598 - DNA, 22 bp, Artificial Sequence
  chemically synthesized
aaatattcaaactctctaaagt

SEQ ID NO: 1111599 - DNA, 22 bp, Artificial Sequence
  chemically synthesized
aattttgtaaactaactttaga

SEQ ID NO: 1111600 - DNA, 22 bp, Artificial Sequence
  chemically synthesized
aaactctctaaagttagtttac

SEQ ID NO: 1111601 - DNA, 22 bp, Artificial Sequence
  chemically synthesized
agaaagtctaaattttgtaaac

SEQ ID NO: 1111602 - DNA, 22 bp, Artificial Sequence
  chemically synthesized
tctaaagttagtttacaaaatt

SEQ ID NO: 1111603 - DNA, 22 bp, Artificial Sequence
  chemically synthesized
taaagttagtttacaaaattta

SEQ ID NO: 1111604 - DNA, 22 bp, Artificial Sequence
  chemically synthesized
aagttagtttacaaaatttaga

SEQ ID NO: 1111605 - DNA, 22 bp, Artificial Sequence
  chemically synthesized
ataaatctaagaaagtctaaat

SEQ ID NO: 1111606 - DNA, 22 bp, Artificial Sequence
  chemically synthesized
gtttacaaaatttagactttct

SEQ ID NO: 1111607 - DNA, 22 bp, Artificial Sequence
  chemically synthesized
acaaaatttagactttcttaga

SEQ ID NO: 1111608 - DNA, 22 bp, Artificial Sequence
  chemically synthesized
caaaatttagactttcttagat

SEQ ID NO: 1111609 - DNA, 22 bp, Artificial Sequence
  chemically synthesized
tataagctaataaatctaagaa

SEQ ID NO: 1111610 - DNA, 22 bp, Artificial Sequence
  chemically synthesized
agactttcttagatttattagc

SEQ ID NO: 1111611 - DNA, 22 bp, Artificial Sequence
  chemically synthesized
gactttcttagatttattagct

SEQ ID NO: 1111612 - DNA, 22 bp, Artificial Sequence
  chemically synthesized
agaaaactatataagctaataa

SEQ ID NO: 1111613 - DNA, 22 bp, Artificial Sequence
  chemically synthesized
tcttagatttattagcttatat

SEQ ID NO: 1111614 - DNA, 22 bp, Artificial Sequence
  chemically synthesized
cttagatttattagcttatata

SEQ ID NO: 1111615 - DNA, 22 bp, Artificial Sequence
  chemically synthesized
ttagatttattagcttatatag

SEQ ID NO: 1111616 - DNA, 22 bp, Artificial Sequence
  chemically synthesized
tcattaagaaaactatataagc

SEQ ID NO: 1111617 - DNA, 22 bp, Artificial Sequence
  chemically synthesized
agatttattagcttatatagtt

SEQ ID NO: 1111618 - DNA, 22 bp, Artificial Sequence
  chemically synthesized
tgtcattaagaaaactatataa

SEQ ID NO: 1111619 - DNA, 22 bp, Artificial Sequence
  chemically synthesized
gatttattagcttatatagttt

SEQ ID NO: 1111620 - DNA, 22 bp, Artificial Sequence
  chemically synthesized
tattctgtcattaagaaaacta

SEQ ID NO: 1111621 - DNA, 22 bp, Artificial Sequence
  chemically synthesized
attagcttatatagttttctta

SEQ ID NO: 1111622 - DNA, 22 bp, Artificial Sequence
  chemically synthesized
atattctgtcattaagaaaact

SEQ ID NO: 1111623 - DNA, 22 bp, Artificial Sequence
  chemically synthesized
ttagcttatatagttttcttaa

SEQ ID NO: 1111624 - DNA, 22 bp, Artificial Sequence
  chemically synthesized
tatattctgtcattaagaaaac

SEQ ID NO: 1111625 - DNA, 22 bp, Artificial Sequence
  chemically synthesized
ttatattctgtcattaagaaaa

SEQ ID NO: 1111626 - DNA, 22 bp, Artificial Sequence
  chemically synthesized
gcttatatagttttcttaatga

SEQ ID NO: 1111627 - DNA, 22 bp, Artificial Sequence
  chemically synthesized
ttttatattctgtcattaagaa

SEQ ID NO: 1111628 - DNA, 22 bp, Artificial Sequence
  chemically synthesized
tcttttatattctgtcattaag

SEQ ID NO: 1111629 - DNA, 22 bp, Artificial Sequence
  chemically synthesized
ctcttttatattctgtcattaa

SEQ ID NO: 1111630 - DNA, 22 bp, Artificial Sequence
  chemically synthesized
atatagttttcttaatgacaga

SEQ ID NO: 1111631 - DNA, 22 bp, Artificial Sequence
  chemically synthesized
tctcttttatattctgtcatta

SEQ ID NO: 1111632 - DNA, 22 bp, Artificial Sequence
  chemically synthesized
tatagttttcttaatgacagaa

SEQ ID NO: 1111633 - DNA, 22 bp, Artificial Sequence
  chemically synthesized
tcttaatgacagaatataaaag

SEQ ID NO: 1111634 - DNA, 22 bp, Artificial Sequence
  chemically synthesized
cttaatgacagaatataaaaga

SEQ ID NO: 1111635 - DNA, 22 bp, Artificial Sequence
  chemically synthesized
ttaatgacagaatataaaagag

SEQ ID NO: 1111636 - DNA, 22 bp, Artificial Sequence
  chemically synthesized
aatgacagaatataaaagagaa

SEQ ID NO: 1111637 - DNA, 22 bp, Artificial Sequence
  chemically synthesized
atgacagaatataaaagagaaa

SEQ ID NO: 1111638 - DNA, 22 bp, Artificial Sequence
  chemically synthesized
aaaatgcatgatatcatatgta

SEQ ID NO: 1111639 - DNA, 22 bp, Artificial Sequence
  chemically synthesized
aaaaatgcatgatatcatatgt

SEQ ID NO: 1111640 - DNA, 22 bp, Artificial Sequence
  chemically synthesized
tgtttaaaaatgcatgatatca

SEQ ID NO: 1111641 - DNA, 22 bp, Artificial Sequence
  chemically synthesized
catatgatatcatgcattttta

SEQ ID NO: 1111642 - DNA, 22 bp, Artificial Sequence
  chemically synthesized
atgtagctatgtttaaaaatgc

SEQ ID NO: 1111643 - DNA, 22 bp, Artificial Sequence
  chemically synthesized
tcagtgctaatgtagctatgtt

SEQ ID NO: 1111644 - DNA, 22 bp, Artificial Sequence
  chemically synthesized
ttaaacatagctacattagcac

SEQ ID NO: 1111645 - DNA, 22 bp, Artificial Sequence
  chemically synthesized
taaacatagctacattagcact

SEQ ID NO: 1111646 - DNA, 22 bp, Artificial Sequence
  chemically synthesized
aaacatagctacattagcactg

SEQ ID NO: 1111647 - DNA, 22 bp, Artificial Sequence
  chemically synthesized
aacatagctacattagcactga

SEQ ID NO: 1111648 - DNA, 22 bp, Artificial Sequence
  chemically synthesized
caaagtataagaaagttatcag

SEQ ID NO: 1111649 - DNA, 22 bp, Artificial Sequence
  chemically synthesized
ccaaagtataagaaagttatca

SEQ ID NO: 1111650 - DNA, 22 bp, Artificial Sequence
  chemically synthesized
cattagcactgataactttctt

SEQ ID NO: 1111651 - DNA, 22 bp, Artificial Sequence
  chemically synthesized
agtatttccaaagtataagaaa

SEQ ID NO: 1111652 - DNA, 22 bp, Artificial Sequence
  chemically synthesized
gcactgataactttcttatact

SEQ ID NO: 1111653 - DNA, 22 bp, Artificial Sequence
  chemically synthesized
ataactttcttatactttggaa

SEQ ID NO: 1111654 - DNA, 22 bp, Artificial Sequence
  chemically synthesized
aatattcagtatttccaaagta

SEQ ID NO: 1111655 - DNA, 22 bp, Artificial Sequence
  chemically synthesized
aaatattcagtatttccaaagt

SEQ ID NO: 1111656 - DNA, 22 bp, Artificial Sequence
  chemically synthesized
tcttatactttggaaatactga

SEQ ID NO: 1111657 - DNA, 22 bp, Artificial Sequence
  chemically synthesized
cttatactttggaaatactgaa

SEQ ID NO: 1111658 - DNA, 22 bp, Artificial Sequence
  chemically synthesized
ttatactttggaaatactgaat

SEQ ID NO: 1111659 - DNA, 22 bp, Artificial Sequence
  chemically synthesized
atactttggaaatactgaatat

SEQ ID NO: 1111660 - DNA, 22 bp, Artificial Sequence
  chemically synthesized
tactttggaaatactgaatatt

SEQ ID NO: 1111661 - DNA, 22 bp, Artificial Sequence
  chemically synthesized
tggaaatactgaatatttaaat

SEQ ID NO: 1111662 - DNA, 22 bp, Artificial Sequence
  chemically synthesized
ggaaatactgaatatttaaatg

SEQ ID NO: 1111663 - DNA, 22 bp, Artificial Sequence
  chemically synthesized
gaaatactgaatatttaaatgt

SEQ ID NO: 1111664 - DNA, 22 bp, Artificial Sequence
  chemically synthesized
aatatttaaatgttttatgttc

SEQ ID NO: 1111665 - DNA, 22 bp, Artificial Sequence
  chemically synthesized
taggtacatgagggaacataaa

SEQ ID NO: 1111666 - DNA, 22 bp, Artificial Sequence
  chemically synthesized
tgtaggtacatgagggaacata

SEQ ID NO: 1111667 - DNA, 22 bp, Artificial Sequence
  chemically synthesized
aaatgttttatgttccctcatg

SEQ ID NO: 1111668 - DNA, 22 bp, Artificial Sequence
  chemically synthesized
aatgttttatgttccctcatgt

SEQ ID NO: 1111669 - DNA, 22 bp, Artificial Sequence
  chemically synthesized
agatctctgtaggtacatgagg

SEQ ID NO: 1111670 - DNA, 22 bp, Artificial Sequence
  chemically synthesized
gagatctctgtaggtacatgag

SEQ ID NO: 1111671 - DNA, 22 bp, Artificial Sequence
  chemically synthesized
tgagatctctgtaggtacatga

SEQ ID NO: 1111672 - DNA, 22 bp, Artificial Sequence
  chemically synthesized
ttgagatctctgtaggtacatg

SEQ ID NO: 1111673 - DNA, 22 bp, Artificial Sequence
  chemically synthesized
tatgttccctcatgtacctaca

SEQ ID NO: 1111674 - DNA, 22 bp, Artificial Sequence
  chemically synthesized
ttttgagatctctgtaggtaca

SEQ ID NO: 1111675 - DNA, 22 bp, Artificial Sequence
  chemically synthesized
atgttccctcatgtacctacag

SEQ ID NO: 1111676 - DNA, 22 bp, Artificial Sequence
  chemically synthesized
tgttccctcatgtacctacaga

SEQ ID NO: 1111677 - DNA, 22 bp, Artificial Sequence
  chemically synthesized
tgttcttttgagatctctgtag

SEQ ID NO: 1111678 - DNA, 22 bp, Artificial Sequence
  chemically synthesized
atgttcttttgagatctctgta

SEQ ID NO: 1111679 - DNA, 22 bp, Artificial Sequence
  chemically synthesized
cctcatgtacctacagagatct

SEQ ID NO: 1111680 - DNA, 22 bp, Artificial Sequence
  chemically synthesized
atgtacctacagagatctcaaa

SEQ ID NO: 1111681 - DNA, 22 bp, Artificial Sequence
  chemically synthesized
cagtgagtttatgttcttttga

SEQ ID NO: 1111682 - DNA, 22 bp, Artificial Sequence
  chemically synthesized
acagtgagtttatgttcttttg

SEQ ID NO: 1111683 - DNA, 22 bp, Artificial Sequence
  chemically synthesized
cagagatctcaaaagaacataa

SEQ ID NO: 1111684 - DNA, 22 bp, Artificial Sequence
  chemically synthesized
aaaagaacataaactcactgta

SEQ ID NO: 1111685 - DNA, 22 bp, Artificial Sequence
  chemically synthesized
gagaaagaaccttacagtgagt

SEQ ID NO: 1111686 - DNA, 22 bp, Artificial Sequence
  chemically synthesized
acctagagaaagaaccttacag

SEQ ID NO: 1111687 - DNA, 22 bp, Artificial Sequence
  chemically synthesized
aacctagagaaagaaccttaca

SEQ ID NO: 1111688 - DNA, 22 bp, Artificial Sequence
  chemically synthesized
taacctagagaaagaaccttac

SEQ ID NO: 1111689 - DNA, 22 bp, Artificial Sequence
  chemically synthesized
ggtattttaacctagagaaaga

SEQ ID NO: 1111690 - DNA, 22 bp, Artificial Sequence
  chemically synthesized
aggtattttaacctagagaaag

SEQ ID NO: 1111691 - DNA, 22 bp, Artificial Sequence
  chemically synthesized
actgtaaggttctttctctagg

SEQ ID NO: 1111692 - DNA, 22 bp, Artificial Sequence
  chemically synthesized
taggtattttaacctagagaaa

SEQ ID NO: 1111693 - DNA, 22 bp, Artificial Sequence
  chemically synthesized
ttaggtattttaacctagagaa

SEQ ID NO: 1111694 - DNA, 22 bp, Artificial Sequence
  chemically synthesized
taaggttctttctctaggttaa

SEQ ID NO: 1111695 - DNA, 22 bp, Artificial Sequence
  chemically synthesized
gaacttttaggtattttaacct

SEQ ID NO: 1111696 - DNA, 22 bp, Artificial Sequence
  chemically synthesized
cgaacttttaggtattttaacc

SEQ ID NO: 1111697 - DNA, 22 bp, Artificial Sequence
  chemically synthesized
ttcgaacttttaggtattttaa

SEQ ID NO: 1111698 - DNA, 22 bp, Artificial Sequence
  chemically synthesized
tttctctaggttaaaataccta

SEQ ID NO: 1111699 - DNA, 22 bp, Artificial Sequence
  chemically synthesized
ctcttcgaacttttaggtattt

SEQ ID NO: 1111700 - DNA, 22 bp, Artificial Sequence
  chemically synthesized
tctctaggttaaaatacctaaa

SEQ ID NO: 1111701 - DNA, 22 bp, Artificial Sequence
  chemically synthesized
ctctaggttaaaatacctaaaa

SEQ ID NO: 1111702 - DNA, 22 bp, Artificial Sequence
  chemically synthesized
tctaggttaaaatacctaaaag

SEQ ID NO: 1111703 - DNA, 22 bp, Artificial Sequence
  chemically synthesized
taggttaaaatacctaaaagtt

SEQ ID NO: 1111704 - DNA, 22 bp, Artificial Sequence
  chemically synthesized
ggttaaaatacctaaaagttcg

SEQ ID NO: 1111705 - DNA, 22 bp, Artificial Sequence
  chemically synthesized
ccaaactactcttcgaactttt

SEQ ID NO: 1111706 - DNA, 22 bp, Artificial Sequence
  chemically synthesized
taccaaactactcttcgaactt

SEQ ID NO: 1111707 - DNA, 22 bp, Artificial Sequence
  chemically synthesized
ctaccaaactactcttcgaact

SEQ ID NO: 1111708 - DNA, 22 bp, Artificial Sequence
  chemically synthesized
aaatacctaaaagttcgaagag

SEQ ID NO: 1111709 - DNA, 22 bp, Artificial Sequence
  chemically synthesized
ttctaccaaactactcttcgaa

SEQ ID NO: 1111710 - DNA, 22 bp, Artificial Sequence
  chemically synthesized
ctcttctaccaaactactcttc

SEQ ID NO: 1111711 - DNA, 22 bp, Artificial Sequence
  chemically synthesized
aaagttcgaagagtagtttggt

SEQ ID NO: 1111712 - DNA, 22 bp, Artificial Sequence
  chemically synthesized
ggcaacctactcttctaccaaa

SEQ ID NO: 1111713 - DNA, 22 bp, Artificial Sequence
  chemically synthesized
aggcaacctactcttctaccaa

SEQ ID NO: 1111714 - DNA, 22 bp, Artificial Sequence
  chemically synthesized
gaagagtagtttggtagaagag

SEQ ID NO: 1111715 - DNA, 22 bp, Artificial Sequence
  chemically synthesized
tcttaggcaacctactcttcta

SEQ ID NO: 1111716 - DNA, 22 bp, Artificial Sequence
  chemically synthesized
ggtagaagagtaggttgcctaa

SEQ ID NO: 1111717 - DNA, 22 bp, Artificial Sequence
  chemically synthesized
gtagaagagtaggttgcctaag

SEQ ID NO: 1111718 - DNA, 22 bp, Artificial Sequence
  chemically synthesized
taaaagtagattatcttaggca

SEQ ID NO: 1111719 - DNA, 22 bp, Artificial Sequence
  chemically synthesized
ataaaagtagattatcttaggc

SEQ ID NO: 1111720 - DNA, 22 bp, Artificial Sequence
  chemically synthesized
cctaagataatctacttttata

SEQ ID NO: 1111721 - DNA, 22 bp, Artificial Sequence
  chemically synthesized
agtaaaatgaacatttataaaa

SEQ ID NO: 1111722 - DNA, 22 bp, Artificial Sequence
  chemically synthesized
agataatctacttttataaatg

SEQ ID NO: 1111723 - DNA, 22 bp, Artificial Sequence
  chemically synthesized
cttttataaatgttcattttac

SEQ ID NO: 1111724 - DNA, 22 bp, Artificial Sequence
  chemically synthesized
ccagaaaattaagtaaaatgaa

SEQ ID NO: 1111725 - DNA, 22 bp, Artificial Sequence
  chemically synthesized
ttataaatgttcattttactta

SEQ ID NO: 1111726 - DNA, 22 bp, Artificial Sequence
  chemically synthesized
tataaatgttcattttacttaa

SEQ ID NO: 1111727 - DNA, 22 bp, Artificial Sequence
  chemically synthesized
ataaatgttcattttacttaat

SEQ ID NO: 1111728 - DNA, 22 bp, Artificial Sequence
  chemically synthesized
tattaccagaaaattaagtaaa

SEQ ID NO: 1111729 - DNA, 22 bp, Artificial Sequence
  chemically synthesized
taaatgttcattttacttaatt

SEQ ID NO: 1111730 - DNA, 22 bp, Artificial Sequence
  chemically synthesized
aattatattaccagaaaattaa

SEQ ID NO: 1111731 - DNA, 22 bp, Artificial Sequence
  chemically synthesized
actaaattatattaccagaaaa

SEQ ID NO: 1111732 - DNA, 22 bp, Artificial Sequence
  chemically synthesized
attttacttaattttctggtaa

SEQ ID NO: 1111733 - DNA, 22 bp, Artificial Sequence
  chemically synthesized
aactaaattatattaccagaaa

SEQ ID NO: 1111734 - DNA, 22 bp, Artificial Sequence
  chemically synthesized
taactaaattatattaccagaa

SEQ ID NO: 1111735 - DNA, 22 bp, Artificial Sequence
  chemically synthesized
tacttaattttctggtaatata

SEQ ID NO: 1111736 - DNA, 22 bp, Artificial Sequence
  chemically synthesized
acttaattttctggtaatataa

SEQ ID NO: 1111737 - DNA, 22 bp, Artificial Sequence
  chemically synthesized
cctttaactaaattatattacc

SEQ ID NO: 1111738 - DNA, 22 bp, Artificial Sequence
  chemically synthesized
cttaattttctggtaatataat

SEQ ID NO: 1111739 - DNA, 22 bp, Artificial Sequence
  chemically synthesized
ccctttaactaaattatattac

SEQ ID NO: 1111740 - DNA, 22 bp, Artificial Sequence
  chemically synthesized
aattttctggtaatataattta

SEQ ID NO: 1111741 - DNA, 22 bp, Artificial Sequence
  chemically synthesized
attttctggtaatataatttag

SEQ ID NO: 1111742 - DNA, 22 bp, Artificial Sequence
  chemically synthesized
gcttccctttaactaaattata

SEQ ID NO: 1111743 - DNA, 22 bp, Artificial Sequence
  chemically synthesized
agcttccctttaactaaattat

SEQ ID NO: 1111744 - DNA, 22 bp, Artificial Sequence
  chemically synthesized
tctggtaatataatttagttaa

SEQ ID NO: 1111745 - DNA, 22 bp, Artificial Sequence
  chemically synthesized
ctggtaatataatttagttaaa

SEQ ID NO: 1111746 - DNA, 22 bp, Artificial Sequence
  chemically synthesized
tggtaatataatttagttaaag

SEQ ID NO: 1111747 - DNA, 22 bp, Artificial Sequence
  chemically synthesized
gtaatataatttagttaaaggg

SEQ ID NO: 1111748 - DNA, 22 bp, Artificial Sequence
  chemically synthesized
agaacttagcttccctttaact

SEQ ID NO: 1111749 - DNA, 22 bp, Artificial Sequence
  chemically synthesized
aagaacttagcttccctttaac

SEQ ID NO: 1111750 - DNA, 22 bp, Artificial Sequence
  chemically synthesized
taagaacttagcttccctttaa

SEQ ID NO: 1111751 - DNA, 22 bp, Artificial Sequence
  chemically synthesized
ttaagaacttagcttcccttta

SEQ ID NO: 1111752 - DNA, 22 bp, Artificial Sequence
  chemically synthesized
tttaagaacttagcttcccttt

SEQ ID NO: 1111753 - DNA, 22 bp, Artificial Sequence
  chemically synthesized
agactttttaagaacttagctt

SEQ ID NO: 1111754 - DNA, 22 bp, Artificial Sequence
  chemically synthesized
cagactttttaagaacttagct

SEQ ID NO: 1111755 - DNA, 22 bp, Artificial Sequence
  chemically synthesized
agttaaagggaagctaagttct

SEQ ID NO: 1111756 - DNA, 22 bp, Artificial Sequence
  chemically synthesized
gttaaagggaagctaagttctt

SEQ ID NO: 1111757 - DNA, 22 bp, Artificial Sequence
  chemically synthesized
ttcagactttttaagaacttag

SEQ ID NO: 1111758 - DNA, 22 bp, Artificial Sequence
  chemically synthesized
aagggaagctaagttcttaaaa

SEQ ID NO: 1111759 - DNA, 22 bp, Artificial Sequence
  chemically synthesized
gagacgttcttcagacttttta

SEQ ID NO: 1111760 - DNA, 22 bp, Artificial Sequence
  chemically synthesized
tagagacgttcttcagactttt

SEQ ID NO: 1111761 - DNA, 22 bp, Artificial Sequence
  chemically synthesized
ctagagacgttcttcagacttt

SEQ ID NO: 1111762 - DNA, 22 bp, Artificial Sequence
  chemically synthesized
agttcttaaaaagtctgaagaa

SEQ ID NO: 1111763 - DNA, 22 bp, Artificial Sequence
  chemically synthesized
tgtttctagagacgttcttcag

SEQ ID NO: 1111764 - DNA, 22 bp, Artificial Sequence
  chemically synthesized
atgtttctagagacgttcttca

SEQ ID NO: 1111765 - DNA, 22 bp, Artificial Sequence
  chemically synthesized
ttaaaaagtctgaagaacgtct

SEQ ID NO: 1111766 - DNA, 22 bp, Artificial Sequence
  chemically synthesized
aaaaagtctgaagaacgtctct

SEQ ID NO: 1111767 - DNA, 22 bp, Artificial Sequence
  chemically synthesized
aaaagtctgaagaacgtctcta

SEQ ID NO: 1111768 - DNA, 22 bp, Artificial Sequence
  chemically synthesized
aagaacgtctctagaaacataa

SEQ ID NO: 1111769 - DNA, 22 bp, Artificial Sequence
  chemically synthesized
gcaaaaccacaggccttatgtt

SEQ ID NO: 1111770 - DNA, 22 bp, Artificial Sequence
  chemically synthesized
tagaaacataaggcctgtggtt

SEQ ID NO: 1111771 - DNA, 22 bp, Artificial Sequence
  chemically synthesized
gaaacataaggcctgtggtttt

SEQ ID NO: 1111772 - DNA, 22 bp, Artificial Sequence
  chemically synthesized
tggttttgctaacttgcacatg

SEQ ID NO: 1111773 - DNA, 22 bp, Artificial Sequence
  chemically synthesized
tgctaacttgcacatgcctccc

SEQ ID NO: 1111774 - DNA, 22 bp, Artificial Sequence
  chemically synthesized
gctaacttgcacatgcctccca

SEQ ID NO: 1111775 - DNA, 22 bp, Artificial Sequence
  chemically synthesized
aaaaggataaagtgggaggcat

SEQ ID NO: 1111776 - DNA, 22 bp, Artificial Sequence
  chemically synthesized
ctaacttgcacatgcctcccac

SEQ ID NO: 1111777 - DNA, 22 bp, Artificial Sequence
  chemically synthesized
aaaaaggataaagtgggaggca

SEQ ID NO: 1111778 - DNA, 22 bp, Artificial Sequence
  chemically synthesized
taaaaaggataaagtgggaggc

SEQ ID NO: 1111779 - DNA, 22 bp, Artificial Sequence
  chemically synthesized
acttgcacatgcctcccacttt

SEQ ID NO: 1111780 - DNA, 22 bp, Artificial Sequence
  chemically synthesized
gtctttaaaaaggataaagtgg

SEQ ID NO: 1111781 - DNA, 22 bp, Artificial Sequence
  chemically synthesized
gcacatgcctcccactttatcc

SEQ ID NO: 1111782 - DNA, 22 bp, Artificial Sequence
  chemically synthesized
agtctttaaaaaggataaagtg

SEQ ID NO: 1111783 - DNA, 22 bp, Artificial Sequence
  chemically synthesized
cacatgcctcccactttatcct

SEQ ID NO: 1111784 - DNA, 22 bp, Artificial Sequence
  chemically synthesized
tagtctttaaaaaggataaagt

SEQ ID NO: 1111785 - DNA, 22 bp, Artificial Sequence
  chemically synthesized
ttagtctttaaaaaggataaag

SEQ ID NO: 1111786 - DNA, 22 bp, Artificial Sequence
  chemically synthesized
tttagtctttaaaaaggataaa

SEQ ID NO: 1111787 - DNA, 22 bp, Artificial Sequence
  chemically synthesized
ttttagtctttaaaaaggataa

SEQ ID NO: 1111788 - DNA, 22 bp, Artificial Sequence
  chemically synthesized
tttttagtctttaaaaaggata

SEQ ID NO: 1111789 - DNA, 22 bp, Artificial Sequence
  chemically synthesized
tattttttttagtctttaaaaa

SEQ ID NO: 1111790 - DNA, 22 bp, Artificial Sequence
  chemically synthesized
ccactttatcctttttaaagac

SEQ ID NO: 1111791 - DNA, 22 bp, Artificial Sequence
  chemically synthesized
tatcctttttaaagactaaaaa

SEQ ID NO: 1111792 - DNA, 22 bp, Artificial Sequence
  chemically synthesized
acatctatattttttttagtct

SEQ ID NO: 1111793 - DNA, 22 bp, Artificial Sequence
  chemically synthesized
atcctttttaaagactaaaaaa

SEQ ID NO: 1111794 - DNA, 22 bp, Artificial Sequence
  chemically synthesized
tcctttttaaagactaaaaaaa

SEQ ID NO: 1111795 - DNA, 22 bp, Artificial Sequence
  chemically synthesized
aattcacatctatatttttttt

SEQ ID NO: 1111796 - DNA, 22 bp, Artificial Sequence
  chemically synthesized
tttaaagactaaaaaaaatata

SEQ ID NO: 1111797 - DNA, 22 bp, Artificial Sequence
  chemically synthesized
ttaaagactaaaaaaaatatag

SEQ ID NO: 1111798 - DNA, 22 bp, Artificial Sequence
  chemically synthesized
ttgaattcacatctatattttt

SEQ ID NO: 1111799 - DNA, 22 bp, Artificial Sequence
  chemically synthesized
taaagactaaaaaaaatataga

SEQ ID NO: 1111800 - DNA, 22 bp, Artificial Sequence
  chemically synthesized
aaagactaaaaaaaatatagat

SEQ ID NO: 1111801 - DNA, 22 bp, Artificial Sequence
  chemically synthesized
aagactaaaaaaaatatagatg

SEQ ID NO: 1111802 - DNA, 22 bp, Artificial Sequence
  chemically synthesized
aaaaaaatatagatgtgaattc

SEQ ID NO: 1111803 - DNA, 22 bp, Artificial Sequence
  chemically synthesized
aacaactatattattttatcct

SEQ ID NO: 1111804 - DNA, 22 bp, Artificial Sequence
  chemically synthesized
tattattttatcctctttcact

SEQ ID NO: 1111805 - DNA, 22 bp, Artificial Sequence
  chemically synthesized
tcagggcagagggaagtgaaag

SEQ ID NO: 1111806 - DNA, 22 bp, Artificial Sequence
  chemically synthesized
ttttatcctctttcacttccct

SEQ ID NO: 1111807 - DNA, 22 bp, Artificial Sequence
  chemically synthesized
gactatcagggcagagggaagt

SEQ ID NO: 1111808 - DNA, 22 bp, Artificial Sequence
  chemically synthesized
tatcctctttcacttccctctg

SEQ ID NO: 1111809 - DNA, 22 bp, Artificial Sequence
  chemically synthesized
atcctctttcacttccctctgc

SEQ ID NO: 1111810 - DNA, 22 bp, Artificial Sequence
  chemically synthesized
tcctctttcacttccctctgcc

SEQ ID NO: 1111811 - DNA, 22 bp, Artificial Sequence
  chemically synthesized
tttcacttccctctgccctgat

SEQ ID NO: 1111812 - DNA, 22 bp, Artificial Sequence
  chemically synthesized
tcacttccctctgccctgatag

SEQ ID NO: 1111813 - DNA, 22 bp, Artificial Sequence
  chemically synthesized
cacttccctctgccctgatagt

SEQ ID NO: 1111814 - DNA, 22 bp, Artificial Sequence
  chemically synthesized
acttccctctgccctgatagtc

SEQ ID NO: 1111815 - DNA, 22 bp, Artificial Sequence
  chemically synthesized
ccctctgccctgatagtctaat

SEQ ID NO: 1111816 - DNA, 22 bp, Artificial Sequence
  chemically synthesized
cctctgccctgatagtctaatg

SEQ ID NO: 1111817 - DNA, 22 bp, Artificial Sequence
  chemically synthesized
tgacaaatagaacattagacta

SEQ ID NO: 1111818 - DNA, 22 bp, Artificial Sequence
  chemically synthesized
tgccctgatagtctaatgttct

SEQ ID NO: 1111819 - DNA, 22 bp, Artificial Sequence
  chemically synthesized
ccctgatagtctaatgttctat

SEQ ID NO: 1111820 - DNA, 22 bp, Artificial Sequence
  chemically synthesized
atatcattatgacaaatagaac

SEQ ID NO: 1111821 - DNA, 22 bp, Artificial Sequence
  chemically synthesized
atagtctaatgttctatttgtc

SEQ ID NO: 1111822 - DNA, 22 bp, Artificial Sequence
  chemically synthesized
gcagcattaatatcattatgac

SEQ ID NO: 1111823 - DNA, 22 bp, Artificial Sequence
  chemically synthesized
atgttctatttgtcataatgat

SEQ ID NO: 1111824 - DNA, 22 bp, Artificial Sequence
  chemically synthesized
ggcagcattaatatcattatga

SEQ ID NO: 1111825 - DNA, 22 bp, Artificial Sequence
  chemically synthesized
tatttgtcataatgatattaat

SEQ ID NO: 1111826 - DNA, 22 bp, Artificial Sequence
  chemically synthesized
tttgtcataatgatattaatgc

SEQ ID NO: 1111827 - DNA, 22 bp, Artificial Sequence
  chemically synthesized
gtcataatgatattaatgctgc

SEQ ID NO: 1111828 - DNA, 22 bp, Artificial Sequence
  chemically synthesized
tcataatgatattaatgctgcc

SEQ ID NO: 1111829 - DNA, 22 bp, Artificial Sequence
  chemically synthesized
agggacatggtttggcagcatt

SEQ ID NO: 1111830 - DNA, 22 bp, Artificial Sequence
  chemically synthesized
aaatgaattgagggacatggtt

SEQ ID NO: 1111831 - DNA, 22 bp, Artificial Sequence
  chemically synthesized
caaatgaattgagggacatggt

SEQ ID NO: 1111832 - DNA, 22 bp, Artificial Sequence
  chemically synthesized
atgctgccaaaccatgtccctc

SEQ ID NO: 1111833 - DNA, 22 bp, Artificial Sequence
  chemically synthesized
tgtttcaaatgaattgagggac

SEQ ID NO: 1111834 - DNA, 22 bp, Artificial Sequence
  chemically synthesized
ccaaaccatgtccctcaattca

SEQ ID NO: 1111835 - DNA, 22 bp, Artificial Sequence
  chemically synthesized
cagttgtgtttcaaatgaattg

SEQ ID NO: 1111836 - DNA, 22 bp, Artificial Sequence
  chemically synthesized
gtgaagttacagttgtgtttca

SEQ ID NO: 1111837 - DNA, 22 bp, Artificial Sequence
  chemically synthesized
aattcatttgaaacacaactgt

SEQ ID NO: 1111838 - DNA, 22 bp, Artificial Sequence
  chemically synthesized
aaattagtgaagttacagttgt

SEQ ID NO: 1111839 - DNA, 22 bp, Artificial Sequence
  chemically synthesized
gaaattagtgaagttacagttg

SEQ ID NO: 1111840 - DNA, 22 bp, Artificial Sequence
  chemically synthesized
tgaaattagtgaagttacagtt

SEQ ID NO: 1111841 - DNA, 22 bp, Artificial Sequence
  chemically synthesized
atttgaaacacaactgtaactt

SEQ ID NO: 1111842 - DNA, 22 bp, Artificial Sequence
  chemically synthesized
gaaacacaactgtaacttcact

SEQ ID NO: 1111843 - DNA, 22 bp, Artificial Sequence
  chemically synthesized
tgctttgaaattagtgaagtta

SEQ ID NO: 1111844 - DNA, 22 bp, Artificial Sequence
  chemically synthesized
aaacacaactgtaacttcacta

SEQ ID NO: 1111845 - DNA, 22 bp, Artificial Sequence
  chemically synthesized
agtagcattatgctttgaaatt

SEQ ID NO: 1111846 - DNA, 22 bp, Artificial Sequence
  chemically synthesized
taacttcactaatttcaaagca

SEQ ID NO: 1111847 - DNA, 22 bp, Artificial Sequence
  chemically synthesized
cactaatttcaaagcataatgc

SEQ ID NO: 1111848 - DNA, 22 bp, Artificial Sequence
  chemically synthesized
actaatttcaaagcataatgct

SEQ ID NO: 1111849 - DNA, 22 bp, Artificial Sequence
  chemically synthesized
accgccatcctgagtagcatta

SEQ ID NO: 1111850 - DNA, 22 bp, Artificial Sequence
  chemically synthesized
atttcaaagcataatgctactc

SEQ ID NO: 1111851 - DNA, 22 bp, Artificial Sequence
  chemically synthesized
caccgccatcctgagtagcatt

SEQ ID NO: 1111852 - DNA, 22 bp, Artificial Sequence
  chemically synthesized
cttcaccgccatcctgagtagc

SEQ ID NO: 1111853 - DNA, 22 bp, Artificial Sequence
  chemically synthesized
caaagcataatgctactcagga

SEQ ID NO: 1111854 - DNA, 22 bp, Artificial Sequence
  chemically synthesized
aaagcataatgctactcaggat

SEQ ID NO: 1111855 - DNA, 22 bp, Artificial Sequence
  chemically synthesized
tctccttcaccgccatcctgag

SEQ ID NO: 1111856 - DNA, 22 bp, Artificial Sequence
  chemically synthesized
gtctccttcaccgccatcctga

SEQ ID NO: 1111857 - DNA, 22 bp, Artificial Sequence
  chemically synthesized
caaagtttgtctccttcaccgc

SEQ ID NO: 1111858 - DNA, 22 bp, Artificial Sequence
  chemically synthesized
gcaaagtttgtctccttcaccg

SEQ ID NO: 1111859 - DNA, 22 bp, Artificial Sequence
  chemically synthesized
ctcaggatggcggtgaaggaga

SEQ ID NO: 1111860 - DNA, 22 bp, Artificial Sequence
  chemically synthesized
aggatggcggtgaaggagacaa

SEQ ID NO: 1111861 - DNA, 22 bp, Artificial Sequence
  chemically synthesized
acgataatatttgcaaagtttg

SEQ ID NO: 1111862 - DNA, 22 bp, Artificial Sequence
  chemically synthesized
tgcaaatattatcgtcaactat

SEQ ID NO: 1111863 - DNA, 22 bp, Artificial Sequence
  chemically synthesized
gcaaatattatcgtcaactatt

SEQ ID NO: 1111864 - DNA, 22 bp, Artificial Sequence
  chemically synthesized
caaatattatcgtcaactattt

SEQ ID NO: 1111865 - DNA, 22 bp, Artificial Sequence
  chemically synthesized
tcgtcaactattttcccctcct

SEQ ID NO: 1111866 - DNA, 22 bp, Artificial Sequence
  chemically synthesized
aaaatatatcagggaagaagga

SEQ ID NO: 1111867 - DNA, 22 bp, Artificial Sequence
  chemically synthesized
ttttcccctccttcttccctga

SEQ ID NO: 1111868 - DNA, 22 bp, Artificial Sequence
  chemically synthesized
attaaaaatatatcagggaaga

SEQ ID NO: 1111869 - DNA, 22 bp, Artificial Sequence
  chemically synthesized
tcccctccttcttccctgatat

SEQ ID NO: 1111870 - DNA, 22 bp, Artificial Sequence
  chemically synthesized
cccctccttcttccctgatata

SEQ ID NO: 1111871 - DNA, 22 bp, Artificial Sequence
  chemically synthesized
ccctccttcttccctgatatat

SEQ ID NO: 1111872 - DNA, 22 bp, Artificial Sequence
  chemically synthesized
tatctcattaaaaatatatcag

SEQ ID NO: 1111873 - DNA, 22 bp, Artificial Sequence
  chemically synthesized
cttcttccctgatatattttta

SEQ ID NO: 1111874 - DNA, 22 bp, Artificial Sequence
  chemically synthesized
cattgtatctcattaaaaatat

SEQ ID NO: 1111875 - DNA, 22 bp, Artificial Sequence
  chemically synthesized
ccattgtatctcattaaaaata

SEQ ID NO: 1111876 - DNA, 22 bp, Artificial Sequence
  chemically synthesized
cttccctgatatatttttaatg

SEQ ID NO: 1111877 - DNA, 22 bp, Artificial Sequence
  chemically synthesized
ttccctgatatatttttaatga

SEQ ID NO: 1111878 - DNA, 22 bp, Artificial Sequence
  chemically synthesized
tttccattgtatctcattaaaa

SEQ ID NO: 1111879 - DNA, 22 bp, Artificial Sequence
  chemically synthesized
ccctgatatatttttaatgaga

SEQ ID NO: 1111880 - DNA, 22 bp, Artificial Sequence
  chemically synthesized
cctgatatatttttaatgagat

SEQ ID NO: 1111881 - DNA, 22 bp, Artificial Sequence
  chemically synthesized
ttatttccattgtatctcatta

SEQ ID NO: 1111882 - DNA, 22 bp, Artificial Sequence
  chemically synthesized
tattatttccattgtatctcat

SEQ ID NO: 1111883 - DNA, 22 bp, Artificial Sequence
  chemically synthesized
atatatttttaatgagatacaa

SEQ ID NO: 1111884 - DNA, 22 bp, Artificial Sequence
  chemically synthesized
cattctattatttccattgtat

SEQ ID NO: 1111885 - DNA, 22 bp, Artificial Sequence
  chemically synthesized
acattctattatttccattgta

SEQ ID NO: 1111886 - DNA, 22 bp, Artificial Sequence
  chemically synthesized
tacattctattatttccattgt

SEQ ID NO: 1111887 - DNA, 22 bp, Artificial Sequence
  chemically synthesized
ttacattctattatttccattg

SEQ ID NO: 1111888 - DNA, 22 bp, Artificial Sequence
  chemically synthesized
ttaatgagatacaatggaaata

SEQ ID NO: 1111889 - DNA, 22 bp, Artificial Sequence
  chemically synthesized
tttacattctattatttccatt

SEQ ID NO: 1111890 - DNA, 22 bp, Artificial Sequence
  chemically synthesized
taatgagatacaatggaaataa

SEQ ID NO: 1111891 - DNA, 22 bp, Artificial Sequence
  chemically synthesized
aatgagatacaatggaaataat

SEQ ID NO: 1111892 - DNA, 22 bp, Artificial Sequence
  chemically synthesized
tttttacattctattatttcca

SEQ ID NO: 1111893 - DNA, 22 bp, Artificial Sequence
  chemically synthesized
atgagatacaatggaaataata

SEQ ID NO: 1111894 - DNA, 22 bp, Artificial Sequence
  chemically synthesized
gatatatggagccatgtatata

SEQ ID NO: 1111895 - DNA, 22 bp, Artificial Sequence
  chemically synthesized
agatatatggagccatgtatat

SEQ ID NO: 1111896 - DNA, 22 bp, Artificial Sequence
  chemically synthesized
tacttagatatatggagccatg

SEQ ID NO: 1111897 - DNA, 22 bp, Artificial Sequence
  chemically synthesized
atacttagatatatggagccat

SEQ ID NO: 1111898 - DNA, 22 bp, Artificial Sequence
  chemically synthesized
tatacttagatatatggagcca

SEQ ID NO: 1111899 - DNA, 22 bp, Artificial Sequence
  chemically synthesized
ttatacttagatatatggagcc

SEQ ID NO: 1111900 - DNA, 22 bp, Artificial Sequence
  chemically synthesized
ttttatacttagatatatggag

SEQ ID NO: 1111901 - DNA, 22 bp, Artificial Sequence
  chemically synthesized
cttttatacttagatatatgga

SEQ ID NO: 1111902 - DNA, 22 bp, Artificial Sequence
  chemically synthesized
catatatctaagtataaaagaa

SEQ ID NO: 1111903 - DNA, 22 bp, Artificial Sequence
  chemically synthesized
taggccacggacttcttttata

SEQ ID NO: 1111904 - DNA, 22 bp, Artificial Sequence
  chemically synthesized
ctgtaggccacggacttctttt

SEQ ID NO: 1111905 - DNA, 22 bp, Artificial Sequence
  chemically synthesized
agtataaaagaagtccgtggcc

SEQ ID NO: 1111906 - DNA, 22 bp, Artificial Sequence
  chemically synthesized
gaatatgtagctcctgtaggcc

SEQ ID NO: 1111907 - DNA, 22 bp, Artificial Sequence
  chemically synthesized
ggaggatattagaatatgtagc

SEQ ID NO: 1111908 - DNA, 22 bp, Artificial Sequence
  chemically synthesized
caggagctacatattctaatat

SEQ ID NO: 1111909 - DNA, 22 bp, Artificial Sequence
  chemically synthesized
agcattaggaggatattagaat

SEQ ID NO: 1111910 - DNA, 22 bp, Artificial Sequence
  chemically synthesized
aagcattaggaggatattagaa

SEQ ID NO: 1111911 - DNA, 22 bp, Artificial Sequence
  chemically synthesized
cttaagcattaggaggatatta

SEQ ID NO: 1111912 - DNA, 22 bp, Artificial Sequence
  chemically synthesized
ccttaagcattaggaggatatt

SEQ ID NO: 1111913 - DNA, 22 bp, Artificial Sequence
  chemically synthesized
cttccttaagcattaggaggat

SEQ ID NO: 1111914 - DNA, 22 bp, Artificial Sequence
  chemically synthesized
catattctaatatcctcctaat

SEQ ID NO: 1111915 - DNA, 22 bp, Artificial Sequence
  chemically synthesized
taatatcctcctaatgcttaag

SEQ ID NO: 1111916 - DNA, 22 bp, Artificial Sequence
  chemically synthesized
atatcctcctaatgcttaagga

SEQ ID NO: 1111917 - DNA, 22 bp, Artificial Sequence
  chemically synthesized
ctaatgcttaaggaagcaattg

SEQ ID NO: 1111918 - DNA, 22 bp, Artificial Sequence
  chemically synthesized
atgcttaaggaagcaattgtga

SEQ ID NO: 1111919 - DNA, 22 bp, Artificial Sequence
  chemically synthesized
aaggaagcaattgtgacatgct

SEQ ID NO: 1111920 - DNA, 22 bp, Artificial Sequence
  chemically synthesized
acgatcaaaaacagcatgtcac

SEQ ID NO: 1111921 - DNA, 22 bp, Artificial Sequence
  chemically synthesized
aggaagcaattgtgacatgctg

SEQ ID NO: 1111922 - DNA, 22 bp, Artificial Sequence
  chemically synthesized
aaaatctaacgatcaaaaacag

SEQ ID NO: 1111923 - DNA, 22 bp, Artificial Sequence
  chemically synthesized
ctcaaaatctaacgatcaaaaa

SEQ ID NO: 1111924 - DNA, 22 bp, Artificial Sequence
  chemically synthesized
tgacatgctgtttttgatcgtt

SEQ ID NO: 1111925 - DNA, 22 bp, Artificial Sequence
  chemically synthesized
atcactcctcaaaatctaacga

SEQ ID NO: 1111926 - DNA, 22 bp, Artificial Sequence
  chemically synthesized
gatcactcctcaaaatctaacg

SEQ ID NO: 1111927 - DNA, 22 bp, Artificial Sequence
  chemically synthesized
tgatcactcctcaaaatctaac

SEQ ID NO: 1111928 - DNA, 22 bp, Artificial Sequence
  chemically synthesized
ttgatcactcctcaaaatctaa

SEQ ID NO: 1111929 - DNA, 22 bp, Artificial Sequence
  chemically synthesized
tttttgatcgttagattttgag

SEQ ID NO: 1111930 - DNA, 22 bp, Artificial Sequence
  chemically synthesized
ttgatcgttagattttgaggag

SEQ ID NO: 1111931 - DNA, 22 bp, Artificial Sequence
  chemically synthesized
tgatcgttagattttgaggagt

SEQ ID NO: 1111932 - DNA, 22 bp, Artificial Sequence
  chemically synthesized
gatcgttagattttgaggagtg

SEQ ID NO: 1111933 - DNA, 22 bp, Artificial Sequence
  chemically synthesized
atcgttagattttgaggagtga

SEQ ID NO: 1111934 - DNA, 22 bp, Artificial Sequence
  chemically synthesized
gtacaatttttgatcactcctc

SEQ ID NO: 1111935 - DNA, 22 bp, Artificial Sequence
  chemically synthesized
ggtacaatttttgatcactcct

SEQ ID NO: 1111936 - DNA, 22 bp, Artificial Sequence
  chemically synthesized
tggtacaatttttgatcactcc

SEQ ID NO: 1111937 - DNA, 22 bp, Artificial Sequence
  chemically synthesized
gattttgaggagtgatcaaaaa

SEQ ID NO: 1111938 - DNA, 22 bp, Artificial Sequence
  chemically synthesized
tgaggagtgatcaaaaattgta

SEQ ID NO: 1111939 - DNA, 22 bp, Artificial Sequence
  chemically synthesized
gaggagtgatcaaaaattgtac

SEQ ID NO: 1111940 - DNA, 22 bp, Artificial Sequence
  chemically synthesized
acaaatattttggtacaatttt

SEQ ID NO: 1111941 - DNA, 22 bp, Artificial Sequence
  chemically synthesized
aggagtgatcaaaaattgtacc

SEQ ID NO: 1111942 - DNA, 22 bp, Artificial Sequence
  chemically synthesized
aacaaatattttggtacaattt

SEQ ID NO: 1111943 - DNA, 22 bp, Artificial Sequence
  chemically synthesized
atcgcatcgcttaacaaatatt

SEQ ID NO: 1111944 - DNA, 22 bp, Artificial Sequence
  chemically synthesized
aatcgcatcgcttaacaaatat

SEQ ID NO: 1111945 - DNA, 22 bp, Artificial Sequence
  chemically synthesized
cttaatcgcatcgcttaacaaa

SEQ ID NO: 1111946 - DNA, 22 bp, Artificial Sequence
  chemically synthesized
taccaaaatatttgttaagcga

SEQ ID NO: 1111947 - DNA, 22 bp, Artificial Sequence
  chemically synthesized
taacaacagttacttaatcgca

SEQ ID NO: 1111948 - DNA, 22 bp, Artificial Sequence
  chemically synthesized
ataacaacagttacttaatcgc

SEQ ID NO: 1111949 - DNA, 22 bp, Artificial Sequence
  chemically synthesized
tataacaacagttacttaatcg

SEQ ID NO: 1111950 - DNA, 22 bp, Artificial Sequence
  chemically synthesized
gttaagcgatgcgattaagtaa

SEQ ID NO: 1111951 - DNA, 22 bp, Artificial Sequence
  chemically synthesized
ttaagcgatgcgattaagtaac

SEQ ID NO: 1111952 - DNA, 22 bp, Artificial Sequence
  chemically synthesized
agcgatgcgattaagtaactgt

SEQ ID NO: 1111953 - DNA, 22 bp, Artificial Sequence
  chemically synthesized
agtaactgttgttataaaatga

SEQ ID NO: 1111954 - DNA, 22 bp, Artificial Sequence
  chemically synthesized
taccaaatgtggtcattttata

SEQ ID NO: 1111955 - DNA, 22 bp, Artificial Sequence
  chemically synthesized
ataccaaatgtggtcattttat

SEQ ID NO: 1111956 - DNA, 22 bp, Artificial Sequence
  chemically synthesized
tataccaaatgtggtcatttta

SEQ ID NO: 1111957 - DNA, 22 bp, Artificial Sequence
  chemically synthesized
cactttataccaaatgtggtca

SEQ ID NO: 1111958 - DNA, 22 bp, Artificial Sequence
  chemically synthesized
ttgttataaaatgaccacattt

SEQ ID NO: 1111959 - DNA, 22 bp, Artificial Sequence
  chemically synthesized
acactttataccaaatgtggtc

SEQ ID NO: 1111960 - DNA, 22 bp, Artificial Sequence
  chemically synthesized
ttacactttataccaaatgtgg

SEQ ID NO: 1111961 - DNA, 22 bp, Artificial Sequence
  chemically synthesized
ttataaaatgaccacatttggt

SEQ ID NO: 1111962 - DNA, 22 bp, Artificial Sequence
  chemically synthesized
tcttacactttataccaaatgt

SEQ ID NO: 1111963 - DNA, 22 bp, Artificial Sequence
  chemically synthesized
ctcttacactttataccaaatg

SEQ ID NO: 1111964 - DNA, 22 bp, Artificial Sequence
  chemically synthesized
taaaatgaccacatttggtata

SEQ ID NO: 1111965 - DNA, 22 bp, Artificial Sequence
  chemically synthesized
ttctcttacactttataccaaa

SEQ ID NO: 1111966 - DNA, 22 bp, Artificial Sequence
  chemically synthesized
atattcttctcttacactttat

SEQ ID NO: 1111967 - DNA, 22 bp, Artificial Sequence
  chemically synthesized
catattcttctcttacacttta

SEQ ID NO: 1111968 - DNA, 22 bp, Artificial Sequence
  chemically synthesized
aagtttcatattcttctcttac

SEQ ID NO: 1111969 - DNA, 22 bp, Artificial Sequence
  chemically synthesized
ggtataaagtgtaagagaagaa

SEQ ID NO: 1111970 - DNA, 22 bp, Artificial Sequence
  chemically synthesized
gtataaagtgtaagagaagaat

SEQ ID NO: 1111971 - DNA, 22 bp, Artificial Sequence
  chemically synthesized
atacgattgaagtttcatattc

SEQ ID NO: 1111972 - DNA, 22 bp, Artificial Sequence
  chemically synthesized
aaacggagtgctcatacgattg

SEQ ID NO: 1111973 - DNA, 22 bp, Artificial Sequence
  chemically synthesized
caaacggagtgctcatacgatt

SEQ ID NO: 1111974 - DNA, 22 bp, Artificial Sequence
  chemically synthesized
tcaaacggagtgctcatacgat

SEQ ID NO: 1111975 - DNA, 22 bp, Artificial Sequence
  chemically synthesized
ttcaaacggagtgctcatacga

SEQ ID NO: 1111976 - DNA, 22 bp, Artificial Sequence
  chemically synthesized
tttcaaacggagtgctcatacg

SEQ ID NO: 1111977 - DNA, 22 bp, Artificial Sequence
  chemically synthesized
ttttcaaacggagtgctcatac

SEQ ID NO: 1111978 - DNA, 22 bp, Artificial Sequence
  chemically synthesized
caatcgtatgagcactccgttt

SEQ ID NO: 1111979 - DNA, 22 bp, Artificial Sequence
  chemically synthesized
aatcgtatgagcactccgtttg

SEQ ID NO: 1111980 - DNA, 22 bp, Artificial Sequence
  chemically synthesized
tcataatacttttttcaaacgg

SEQ ID NO: 1111981 - DNA, 22 bp, Artificial Sequence
  chemically synthesized
atcataatacttttttcaaacg

SEQ ID NO: 1111982 - DNA, 22 bp, Artificial Sequence
  chemically synthesized
tatcataatacttttttcaaac

SEQ ID NO: 1111983 - DNA, 22 bp, Artificial Sequence
  chemically synthesized
acgttttatcataatacttttt

SEQ ID NO: 1111984 - DNA, 22 bp, Artificial Sequence
  chemically synthesized
cgtttgaaaaaagtattatgat

SEQ ID NO: 1111985 - DNA, 22 bp, Artificial Sequence
  chemically synthesized
gaaaaaagtattatgataaaac

SEQ ID NO: 1111986 - DNA, 22 bp, Artificial Sequence
  chemically synthesized
aaaaaagtattatgataaaacg

SEQ ID NO: 1111987 - DNA, 22 bp, Artificial Sequence
  chemically synthesized
cagaaatgttaacgttttatca

SEQ ID NO: 1111988 - DNA, 22 bp, Artificial Sequence
  chemically synthesized
ccagaaatgttaacgttttatc

SEQ ID NO: 1111989 - DNA, 22 bp, Artificial Sequence
  chemically synthesized
tccagaaatgttaacgttttat

SEQ ID NO: 1111990 - DNA, 22 bp, Artificial Sequence
  chemically synthesized
ttttccagaaatgttaacgttt

SEQ ID NO: 1111991 - DNA, 22 bp, Artificial Sequence
  chemically synthesized
attttccagaaatgttaacgtt

SEQ ID NO: 1111992 - DNA, 22 bp, Artificial Sequence
  chemically synthesized
tattttccagaaatgttaacgt

SEQ ID NO: 1111993 - DNA, 22 bp, Artificial Sequence
  chemically synthesized
ttattttccagaaatgttaacg

SEQ ID NO: 1111994 - DNA, 22 bp, Artificial Sequence
  chemically synthesized
tttattttccagaaatgttaac

SEQ ID NO: 1111995 - DNA, 22 bp, Artificial Sequence
  chemically synthesized
tgataaaacgttaacatttctg

SEQ ID NO: 1111996 - DNA, 22 bp, Artificial Sequence
  chemically synthesized
tctttttattttccagaaatgt

SEQ ID NO: 1111997 - DNA, 22 bp, Artificial Sequence
  chemically synthesized
attatctttttattttccagaa

SEQ ID NO: 1111998 - DNA, 22 bp, Artificial Sequence
  chemically synthesized
taattatctttttattttccag

SEQ ID NO: 1111999 - DNA, 22 bp, Artificial Sequence
  chemically synthesized
ctaattatctttttattttcca

SEQ ID NO: 1112000 - DNA, 22 bp, Artificial Sequence
  chemically synthesized
tctaattatctttttattttcc

SEQ ID NO: 1112001 - DNA, 22 bp, Artificial Sequence
  chemically synthesized
acatttctggaaaataaaaaga

SEQ ID NO: 1112002 - DNA, 22 bp, Artificial Sequence
  chemically synthesized
ctggaaaataaaaagataatta

SEQ ID NO: 1112003 - DNA, 22 bp, Artificial Sequence
  chemically synthesized
tggaaaataaaaagataattag

SEQ ID NO: 1112004 - DNA, 22 bp, Artificial Sequence
  chemically synthesized
tccagtatattttctaattatc

SEQ ID NO: 1112005 - DNA, 22 bp, Artificial Sequence
  chemically synthesized
gaaaataaaaagataattagaa

SEQ ID NO: 1112006 - DNA, 22 bp, Artificial Sequence
  chemically synthesized
tgtccagtatattttctaatta

SEQ ID NO: 1112007 - DNA, 22 bp, Artificial Sequence
  chemically synthesized
aaaattctgtccagtatatttt

SEQ ID NO: 1112008 - DNA, 22 bp, Artificial Sequence
  chemically synthesized
aaaaattctgtccagtatattt

SEQ ID NO: 1112009 - DNA, 22 bp, Artificial Sequence
  chemically synthesized
acataatttaaaaattctgtcc

SEQ ID NO: 1112010 - DNA, 22 bp, Artificial Sequence
  chemically synthesized
gaaaatatactggacagaattt

SEQ ID NO: 1112011 - DNA, 22 bp, Artificial Sequence
  chemically synthesized
ttaacataatttaaaaattctg

SEQ ID NO: 1112012 - DNA, 22 bp, Artificial Sequence
  chemically synthesized
ttattaacataatttaaaaatt

SEQ ID NO: 1112013 - DNA, 22 bp, Artificial Sequence
  chemically synthesized
gttattaacataatttaaaaat

SEQ ID NO: 1112014 - DNA, 22 bp, Artificial Sequence
  chemically synthesized
tgttattaacataatttaaaaa

SEQ ID NO: 1112015 - DNA, 22 bp, Artificial Sequence
  chemically synthesized
ttgttattaacataatttaaaa

SEQ ID NO: 1112016 - DNA, 22 bp, Artificial Sequence
  chemically synthesized
tttgttattaacataatttaaa

SEQ ID NO: 1112017 - DNA, 22 bp, Artificial Sequence
  chemically synthesized
gacagaatttttaaattatgtt

SEQ ID NO: 1112018 - DNA, 22 bp, Artificial Sequence
  chemically synthesized
ttaaattatgttaataacaaaa

SEQ ID NO: 1112019 - DNA, 22 bp, Artificial Sequence
  chemically synthesized
taaattatgttaataacaaaaa

SEQ ID NO: 1112020 - DNA, 22 bp, Artificial Sequence
  chemically synthesized
aaattatgttaataacaaaaaa

SEQ ID NO: 1112021 - DNA, 22 bp, Artificial Sequence
  chemically synthesized
aattatgttaataacaaaaaat

SEQ ID NO: 1112022 - DNA, 22 bp, Artificial Sequence
  chemically synthesized
gatccatgccacattttttgtt

SEQ ID NO: 1112023 - DNA, 22 bp, Artificial Sequence
  chemically synthesized
agatccatgccacattttttgt

SEQ ID NO: 1112024 - DNA, 22 bp, Artificial Sequence
  chemically synthesized
tgttaataacaaaaaatgtggc

SEQ ID NO: 1112025 - DNA, 22 bp, Artificial Sequence
  chemically synthesized
atcatttagatccatgccacat

SEQ ID NO: 1112026 - DNA, 22 bp, Artificial Sequence
  chemically synthesized
ataacaaaaaatgtggcatgga

SEQ ID NO: 1112027 - DNA, 22 bp, Artificial Sequence
  chemically synthesized
aatatctgatcatttagatcca

SEQ ID NO: 1112028 - DNA, 22 bp, Artificial Sequence
  chemically synthesized
ctaaatatctgatcatttagat

SEQ ID NO: 1112029 - DNA, 22 bp, Artificial Sequence
  chemically synthesized
tcctaaatatctgatcatttag

SEQ ID NO: 1112030 - DNA, 22 bp, Artificial Sequence
  chemically synthesized
ctcctaaatatctgatcattta

SEQ ID NO: 1112031 - DNA, 22 bp, Artificial Sequence
  chemically synthesized
aaaatatttctcctaaatatct

SEQ ID NO: 1112032 - DNA, 22 bp, Artificial Sequence
  chemically synthesized
aatgatcagatatttaggagaa

SEQ ID NO: 1112033 - DNA, 22 bp, Artificial Sequence
  chemically synthesized
aacatatgctgaaaatatttct

SEQ ID NO: 1112034 - DNA, 22 bp, Artificial Sequence
  chemically synthesized
aagttcaacatatgctgaaaat

SEQ ID NO: 1112035 - DNA, 22 bp, Artificial Sequence
  chemically synthesized
aggagaaatattttcagcatat

SEQ ID NO: 1112036 - DNA, 22 bp, Artificial Sequence
  chemically synthesized
ttcaagttcaacatatgctgaa

SEQ ID NO: 1112037 - DNA, 22 bp, Artificial Sequence
  chemically synthesized
ggagaaatattttcagcatatg

SEQ ID NO: 1112038 - DNA, 22 bp, Artificial Sequence
  chemically synthesized
gttcaagttcaacatatgctga

SEQ ID NO: 1112039 - DNA, 22 bp, Artificial Sequence
  chemically synthesized
cttgttcaagttcaacatatgc

SEQ ID NO: 1112040 - DNA, 22 bp, Artificial Sequence
  chemically synthesized
actgcttgttcaagttcaacat

SEQ ID NO: 1112041 - DNA, 22 bp, Artificial Sequence
  chemically synthesized
taactgcttgttcaagttcaac

SEQ ID NO: 1112042 - DNA, 22 bp, Artificial Sequence
  chemically synthesized
ctaactgcttgttcaagttcaa

SEQ ID NO: 1112043 - DNA, 22 bp, Artificial Sequence
  chemically synthesized
tcagcatatgttgaacttgaac

SEQ ID NO: 1112044 - DNA, 22 bp, Artificial Sequence
  chemically synthesized
cagcatatgttgaacttgaaca

SEQ ID NO: 1112045 - DNA, 22 bp, Artificial Sequence
  chemically synthesized
agcatatgttgaacttgaacaa

SEQ ID NO: 1112046 - DNA, 22 bp, Artificial Sequence
  chemically synthesized
atggacttctaactgcttgttc

SEQ ID NO: 1112047 - DNA, 22 bp, Artificial Sequence
  chemically synthesized
catggacttctaactgcttgtt

SEQ ID NO: 1112048 - DNA, 22 bp, Artificial Sequence
  chemically synthesized
aacttgaacaagcagttagaag

SEQ ID NO: 1112049 - DNA, 22 bp, Artificial Sequence
  chemically synthesized
acccttcatggacttctaactg

SEQ ID NO: 1112050 - DNA, 22 bp, Artificial Sequence
  chemically synthesized
cacccttcatggacttctaact

SEQ ID NO: 1112051 - DNA, 22 bp, Artificial Sequence
  chemically synthesized
gaacaagcagttagaagtccat

SEQ ID NO: 1112052 - DNA, 22 bp, Artificial Sequence
  chemically synthesized
aacaagcagttagaagtccatg

SEQ ID NO: 1112053 - DNA, 22 bp, Artificial Sequence
  chemically synthesized
acgtttcacccttcatggactt

SEQ ID NO: 1112054 - DNA, 22 bp, Artificial Sequence
  chemically synthesized
atgttgacgtttcacccttcat

SEQ ID NO: 1112055 - DNA, 22 bp, Artificial Sequence
  chemically synthesized
gttcatgttgacgtttcaccct

SEQ ID NO: 1112056 - DNA, 22 bp, Artificial Sequence
  chemically synthesized
gaagtccatgaagggtgaaacg

SEQ ID NO: 1112057 - DNA, 22 bp, Artificial Sequence
  chemically synthesized
atacctggttcatgttgacgtt

SEQ ID NO: 1112058 - DNA, 22 bp, Artificial Sequence
  chemically synthesized
aatacctggttcatgttgacgt

SEQ ID NO: 1112059 - DNA, 22 bp, Artificial Sequence
  chemically synthesized
tttaatacctggttcatgttga

SEQ ID NO: 1112060 - DNA, 22 bp, Artificial Sequence
  chemically synthesized
cctgtttaatacctggttcatg

SEQ ID NO: 1112061 - DNA, 22 bp, Artificial Sequence
  chemically synthesized
gcctgtttaatacctggttcat

SEQ ID NO: 1112062 - DNA, 22 bp, Artificial Sequence
  chemically synthesized
tgcctgtttaatacctggttca

SEQ ID NO: 1112063 - DNA, 22 bp, Artificial Sequence
  chemically synthesized
ttgcctgtttaatacctggttc

SEQ ID NO: 1112064 - DNA, 22 bp, Artificial Sequence
  chemically synthesized
tttgcctgtttaatacctggtt

SEQ ID NO: 1112065 - DNA, 22 bp, Artificial Sequence
  chemically synthesized
ttttgcctgtttaatacctggt

SEQ ID NO: 1112066 - DNA, 22 bp, Artificial Sequence
  chemically synthesized
ttttttgcctgtttaatacctg

SEQ ID NO: 1112067 - DNA, 22 bp, Artificial Sequence
  chemically synthesized
cttttttgcctgtttaatacct

SEQ ID NO: 1112068 - DNA, 22 bp, Artificial Sequence
  chemically synthesized
gcatttcttttttgcctgttta

SEQ ID NO: 1112069 - DNA, 22 bp, Artificial Sequence
  chemically synthesized
agcatttcttttttgcctgttt

SEQ ID NO: 1112070 - DNA, 22 bp, Artificial Sequence
  chemically synthesized
atttagcatttcttttttgcct

SEQ ID NO: 1112071 - DNA, 22 bp, Artificial Sequence
  chemically synthesized
aatttagcatttcttttttgcc

SEQ ID NO: 1112072 - DNA, 22 bp, Artificial Sequence
  chemically synthesized
taatttagcatttcttttttgc

SEQ ID NO: 1112073 - DNA, 22 bp, Artificial Sequence
  chemically synthesized
aacaggcaaaaaagaaatgcta

SEQ ID NO: 1112074 - DNA, 22 bp, Artificial Sequence
  chemically synthesized
tcggtccctttaatttagcatt

SEQ ID NO: 1112075 - DNA, 22 bp, Artificial Sequence
  chemically synthesized
aatccagcatcagtctatcggt

SEQ ID NO: 1112076 - DNA, 22 bp, Artificial Sequence
  chemically synthesized
aattaaagggaccgatagactg

SEQ ID NO: 1112077 - DNA, 22 bp, Artificial Sequence
  chemically synthesized
aagggaccgatagactgatgct

SEQ ID NO: 1112078 - DNA, 22 bp, Artificial Sequence
  chemically synthesized
aataagactcaatccagcatca

SEQ ID NO: 1112079 - DNA, 22 bp, Artificial Sequence
  chemically synthesized
gacaaatgttgaataagactca

SEQ ID NO: 1112080 - DNA, 22 bp, Artificial Sequence
  chemically synthesized
agacaaatgttgaataagactc

SEQ ID NO: 1112081 - DNA, 22 bp, Artificial Sequence
  chemically synthesized
atgctggattgagtcttattca

SEQ ID NO: 1112082 - DNA, 22 bp, Artificial Sequence
  chemically synthesized
atttagacaaatgttgaataag

SEQ ID NO: 1112083 - DNA, 22 bp, Artificial Sequence
  chemically synthesized
gattgagtcttattcaacattt

SEQ ID NO: 1112084 - DNA, 22 bp, Artificial Sequence
  chemically synthesized
ccgtctcatttagacaaatgtt

SEQ ID NO: 1112085 - DNA, 22 bp, Artificial Sequence
  chemically synthesized
agtcttattcaacatttgtcta

SEQ ID NO: 1112086 - DNA, 22 bp, Artificial Sequence
  chemically synthesized
tgttcccgtctcatttagacaa

SEQ ID NO: 1112087 - DNA, 22 bp, Artificial Sequence
  chemically synthesized
tgtgttcccgtctcatttagac

SEQ ID NO: 1112088 - DNA, 22 bp, Artificial Sequence
  chemically synthesized
attcaacatttgtctaaatgag

SEQ ID NO: 1112089 - DNA, 22 bp, Artificial Sequence
  chemically synthesized
ttcaacatttgtctaaatgaga

SEQ ID NO: 1112090 - DNA, 22 bp, Artificial Sequence
  chemically synthesized
tctgtgttcccgtctcatttag

SEQ ID NO: 1112091 - DNA, 22 bp, Artificial Sequence
  chemically synthesized
tctctgtgttcccgtctcattt

SEQ ID NO: 1112092 - DNA, 22 bp, Artificial Sequence
  chemically synthesized
aacatttgtctaaatgagacgg

SEQ ID NO: 1112093 - DNA, 22 bp, Artificial Sequence
  chemically synthesized
ctctctgtgttcccgtctcatt

SEQ ID NO: 1112094 - DNA, 22 bp, Artificial Sequence
  chemically synthesized
gtctaaatgagacgggaacaca

SEQ ID NO: 1112095 - DNA, 22 bp, Artificial Sequence
  chemically synthesized
tctaaatgagacgggaacacag

SEQ ID NO: 1112096 - DNA, 22 bp, Artificial Sequence
  chemically synthesized
aatgagacgggaacacagagag

SEQ ID NO: 1112097 - DNA, 22 bp, Artificial Sequence
  chemically synthesized
agggacacaaagtgatttctct

SEQ ID NO: 1112098 - DNA, 22 bp, Artificial Sequence
  chemically synthesized
tcagggacacaaagtgatttct

SEQ ID NO: 1112099 - DNA, 22 bp, Artificial Sequence
  chemically synthesized
ctcagggacacaaagtgatttc

SEQ ID NO: 1112100 - DNA, 22 bp, Artificial Sequence
  chemically synthesized
tctcagggacacaaagtgattt

SEQ ID NO: 1112101 - DNA, 22 bp, Artificial Sequence
  chemically synthesized
acctttctcagggacacaaagt

SEQ ID NO: 1112102 - DNA, 22 bp, Artificial Sequence
  chemically synthesized
tatggttgacctttctcaggga

SEQ ID NO: 1112103 - DNA, 22 bp, Artificial Sequence
  chemically synthesized
gtatggttgacctttctcaggg

SEQ ID NO: 1112104 - DNA, 22 bp, Artificial Sequence
  chemically synthesized
cgatttgtatggttgacctttc

SEQ ID NO: 1112105 - DNA, 22 bp, Artificial Sequence
  chemically synthesized
tgtgtccctgagaaaggtcaac

SEQ ID NO: 1112106 - DNA, 22 bp, Artificial Sequence
  chemically synthesized
gtgtccctgagaaaggtcaacc

SEQ ID NO: 1112107 - DNA, 22 bp, Artificial Sequence
  chemically synthesized
tgtccctgagaaaggtcaacca

SEQ ID NO: 1112108 - DNA, 22 bp, Artificial Sequence
  chemically synthesized
ctacgatttgtatggttgacct

SEQ ID NO: 1112109 - DNA, 22 bp, Artificial Sequence
  chemically synthesized
gctacgatttgtatggttgacc

SEQ ID NO: 1112110 - DNA, 22 bp, Artificial Sequence
  chemically synthesized
atttgctacgatttgtatggtt

SEQ ID NO: 1112111 - DNA, 22 bp, Artificial Sequence
  chemically synthesized
catttgctacgatttgtatggt

SEQ ID NO: 1112112 - DNA, 22 bp, Artificial Sequence
  chemically synthesized
tcatttgctacgatttgtatgg

SEQ ID NO: 1112113 - DNA, 22 bp, Artificial Sequence
  chemically synthesized
agaaaggtcaaccatacaaatc

SEQ ID NO: 1112114 - DNA, 22 bp, Artificial Sequence
  chemically synthesized
ttcatttgctacgatttgtatg

SEQ ID NO: 1112115 - DNA, 22 bp, Artificial Sequence
  chemically synthesized
tttcatttgctacgatttgtat

SEQ ID NO: 1112116 - DNA, 22 bp, Artificial Sequence
  chemically synthesized
attttttcatttgctacgattt

SEQ ID NO: 1112117 - DNA, 22 bp, Artificial Sequence
  chemically synthesized
cattttttcatttgctacgatt

SEQ ID NO: 1112118 - DNA, 22 bp, Artificial Sequence
  chemically synthesized
tagtttcattttttcatttgct

SEQ ID NO: 1112119 - DNA, 22 bp, Artificial Sequence
  chemically synthesized
atagtttcattttttcatttgc

SEQ ID NO: 1112120 - DNA, 22 bp, Artificial Sequence
  chemically synthesized
aaaatcaacttatagtttcatt

SEQ ID NO: 1112121 - DNA, 22 bp, Artificial Sequence
  chemically synthesized
acatatccatattgaaaatcaa

SEQ ID NO: 1112122 - DNA, 22 bp, Artificial Sequence
  chemically synthesized
taagttgattttcaatatggat

SEQ ID NO: 1112123 - DNA, 22 bp, Artificial Sequence
  chemically synthesized
acaaaattaacatatccatatt

SEQ ID NO: 1112124 - DNA, 22 bp, Artificial Sequence
  chemically synthesized
aacaaaattaacatatccatat

SEQ ID NO: 1112125 - DNA, 22 bp, Artificial Sequence
  chemically synthesized
attttcaatatggatatgttaa

SEQ ID NO: 1112126 - DNA, 22 bp, Artificial Sequence
  chemically synthesized
tcatttaacaaaattaacatat

SEQ ID NO: 1112127 - DNA, 22 bp, Artificial Sequence
  chemically synthesized
atcatttaacaaaattaacata

SEQ ID NO: 1112128 - DNA, 22 bp, Artificial Sequence
  chemically synthesized
tatcatttaacaaaattaacat

SEQ ID NO: 1112129 - DNA, 22 bp, Artificial Sequence
  chemically synthesized
tcaatatggatatgttaatttt

SEQ ID NO: 1112130 - DNA, 22 bp, Artificial Sequence
  chemically synthesized
caatatggatatgttaattttg

SEQ ID NO: 1112131 - DNA, 22 bp, Artificial Sequence
  chemically synthesized
aatatggatatgttaattttgt

SEQ ID NO: 1112132 - DNA, 22 bp, Artificial Sequence
  chemically synthesized
tagttttatcatttaacaaaat

SEQ ID NO: 1112133 - DNA, 22 bp, Artificial Sequence
  chemically synthesized
actgtagttttatcatttaaca

SEQ ID NO: 1112134 - DNA, 22 bp, Artificial Sequence
  chemically synthesized
cactgtagttttatcatttaac

SEQ ID NO: 1112135 - DNA, 22 bp, Artificial Sequence
  chemically synthesized
gtacttcactgtagttttatca

SEQ ID NO: 1112136 - DNA, 22 bp, Artificial Sequence
  chemically synthesized
attttgttaaatgataaaacta

SEQ ID NO: 1112137 - DNA, 22 bp, Artificial Sequence
  chemically synthesized
ttggtacttcactgtagtttta

SEQ ID NO: 1112138 - DNA, 22 bp, Artificial Sequence
  chemically synthesized
tgttaaatgataaaactacagt

SEQ ID NO: 1112139 - DNA, 22 bp, Artificial Sequence
  chemically synthesized
gttaaatgataaaactacagtg

SEQ ID NO: 1112140 - DNA, 22 bp, Artificial Sequence
  chemically synthesized
ttaaatgataaaactacagtga

SEQ ID NO: 1112141 - DNA, 22 bp, Artificial Sequence
  chemically synthesized
aatgataaaactacagtgaagt

SEQ ID NO: 1112142 - DNA, 22 bp, Artificial Sequence
  chemically synthesized
cagagcctattggtacttcact

SEQ ID NO: 1112143 - DNA, 22 bp, Artificial Sequence
  chemically synthesized
acggatactgcagagcctattg

SEQ ID NO: 1112144 - DNA, 22 bp, Artificial Sequence
  chemically synthesized
cagtgaagtaccaataggctct

SEQ ID NO: 1112145 - DNA, 22 bp, Artificial Sequence
  chemically synthesized
aacggatactgcagagcctatt

SEQ ID NO: 1112146 - DNA, 22 bp, Artificial Sequence
  chemically synthesized
taacggatactgcagagcctat

SEQ ID NO: 1112147 - DNA, 22 bp, Artificial Sequence
  chemically synthesized
gattttaacggatactgcagag

SEQ ID NO: 1112148 - DNA, 22 bp, Artificial Sequence
  chemically synthesized
tccctagattttaacggatact

SEQ ID NO: 1112149 - DNA, 22 bp, Artificial Sequence
  chemically synthesized
aaacctgtccctagattttaac

SEQ ID NO: 1112150 - DNA, 22 bp, Artificial Sequence
  chemically synthesized
tgcagtatccgttaaaatctag

SEQ ID NO: 1112151 - DNA, 22 bp, Artificial Sequence
  chemically synthesized
cagtatccgttaaaatctaggg

SEQ ID NO: 1112152 - DNA, 22 bp, Artificial Sequence
  chemically synthesized
attaaaacctgtccctagattt

SEQ ID NO: 1112153 - DNA, 22 bp, Artificial Sequence
  chemically synthesized
aaatctagggacaggttttaat

SEQ ID NO: 1112154 - DNA, 22 bp, Artificial Sequence
  chemically synthesized
gggacaggttttaatgagtcat

SEQ ID NO: 1112155 - DNA, 22 bp, Artificial Sequence
  chemically synthesized
tgtaatgatcaacaatgactca

SEQ ID NO: 1112156 - DNA, 22 bp, Artificial Sequence
  chemically synthesized
gtgtaatgatcaacaatgactc

SEQ ID NO: 1112157 - DNA, 22 bp, Artificial Sequence
  chemically synthesized
tgtgtaatgatcaacaatgact

SEQ ID NO: 1112158 - DNA, 22 bp, Artificial Sequence
  chemically synthesized
taatgagtcattgttgatcatt

SEQ ID NO: 1112159 - DNA, 22 bp, Artificial Sequence
  chemically synthesized
aatgagtcattgttgatcatta

SEQ ID NO: 1112160 - DNA, 22 bp, Artificial Sequence
  chemically synthesized
atgagtcattgttgatcattac

SEQ ID NO: 1112161 - DNA, 22 bp, Artificial Sequence
  chemically synthesized
ttgatcattacacaaaactcta

SEQ ID NO: 1112162 - DNA, 22 bp, Artificial Sequence
  chemically synthesized
gggggcaaaacatagagttttg

SEQ ID NO: 1112163 - DNA, 22 bp, Artificial Sequence
  chemically synthesized
ggggggcaaaacatagagtttt

SEQ ID NO: 1112164 - DNA, 22 bp, Artificial Sequence
  chemically synthesized
tggggggcaaaacatagagttt

SEQ ID NO: 1112165 - DNA, 22 bp, Artificial Sequence
  chemically synthesized
atcattacacaaaactctatgt

SEQ ID NO: 1112166 - DNA, 22 bp, Artificial Sequence
  chemically synthesized
ttggggggcaaaacatagagtt

SEQ ID NO: 1112167 - DNA, 22 bp, Artificial Sequence
  chemically synthesized
tttggggggcaaaacatagagt

SEQ ID NO: 1112168 - DNA, 22 bp, Artificial Sequence
  chemically synthesized
cacaaaactctatgttttgccc

SEQ ID NO: 1112169 - DNA, 22 bp, Artificial Sequence
  chemically synthesized
caacattttttggggggcaaaa

SEQ ID NO: 1112170 - DNA, 22 bp, Artificial Sequence
  chemically synthesized
tatgttttgccccccaaaaaat

SEQ ID NO: 1112171 - DNA, 22 bp, Artificial Sequence
  chemically synthesized
tgttttgccccccaaaaaatgt

SEQ ID NO: 1112172 - DNA, 22 bp, Artificial Sequence
  chemically synthesized
cagtgatatattgcaacatttt

SEQ ID NO: 1112173 - DNA, 22 bp, Artificial Sequence
  chemically synthesized
acagtgatatattgcaacattt

SEQ ID NO: 1112174 - DNA, 22 bp, Artificial Sequence
  chemically synthesized
tgccccccaaaaaatgttgcaa

SEQ ID NO: 1112175 - DNA, 22 bp, Artificial Sequence
  chemically synthesized
tacagtgatatattgcaacatt

SEQ ID NO: 1112176 - DNA, 22 bp, Artificial Sequence
  chemically synthesized
gccccccaaaaaatgttgcaat

SEQ ID NO: 1112177 - DNA, 22 bp, Artificial Sequence
  chemically synthesized
ttacagtgatatattgcaacat

SEQ ID NO: 1112178 - DNA, 22 bp, Artificial Sequence
  chemically synthesized
ccccccaaaaaatgttgcaata

SEQ ID NO: 1112179 - DNA, 22 bp, Artificial Sequence
  chemically synthesized
ttttacagtgatatattgcaac

SEQ ID NO: 1112180 - DNA, 22 bp, Artificial Sequence
  chemically synthesized
cttttacagtgatatattgcaa

SEQ ID NO: 1112181 - DNA, 22 bp, Artificial Sequence
  chemically synthesized
aatttcttttacagtgatatat

SEQ ID NO: 1112182 - DNA, 22 bp, Artificial Sequence
  chemically synthesized
aaatttcttttacagtgatata

SEQ ID NO: 1112183 - DNA, 22 bp, Artificial Sequence
  chemically synthesized
accatttaaatttcttttacag

SEQ ID NO: 1112184 - DNA, 22 bp, Artificial Sequence
  chemically synthesized
caccatttaaatttcttttaca

SEQ ID NO: 1112185 - DNA, 22 bp, Artificial Sequence
  chemically synthesized
caatatatcactgtaaaagaaa

SEQ ID NO: 1112186 - DNA, 22 bp, Artificial Sequence
  chemically synthesized
ttcaccatttaaatttctttta

SEQ ID NO: 1112187 - DNA, 22 bp, Artificial Sequence
  chemically synthesized
cttcaccatttaaatttctttt

SEQ ID NO: 1112188 - DNA, 22 bp, Artificial Sequence
  chemically synthesized
tcttcaccatttaaatttcttt

SEQ ID NO: 1112189 - DNA, 22 bp, Artificial Sequence
  chemically synthesized
ttcttcaccatttaaatttctt

SEQ ID NO: 1112190 - DNA, 22 bp, Artificial Sequence
  chemically synthesized
acttttcttcaccatttaaatt

SEQ ID NO: 1112191 - DNA, 22 bp, Artificial Sequence
  chemically synthesized
taaaagaaatttaaatggtgaa

SEQ ID NO: 1112192 - DNA, 22 bp, Artificial Sequence
  chemically synthesized
tacaaagctgacttttcttcac

SEQ ID NO: 1112193 - DNA, 22 bp, Artificial Sequence
  chemically synthesized
gtacaaagctgacttttcttca

SEQ ID NO: 1112194 - DNA, 22 bp, Artificial Sequence
  chemically synthesized
aaatggtgaagaaaagtcagct

SEQ ID NO: 1112195 - DNA, 22 bp, Artificial Sequence
  chemically synthesized
aatggtgaagaaaagtcagctt

SEQ ID NO: 1112196 - DNA, 22 bp, Artificial Sequence
  chemically synthesized
tgaatttgtacaaagctgactt

SEQ ID NO: 1112197 - DNA, 22 bp, Artificial Sequence
  chemically synthesized
agtgttatgaatttgtacaaag

SEQ ID NO: 1112198 - DNA, 22 bp, Artificial Sequence
  chemically synthesized
cagtgttatgaatttgtacaaa

SEQ ID NO: 1112199 - DNA, 22 bp, Artificial Sequence
  chemically synthesized
taaatttcagtgttatgaattt

SEQ ID NO: 1112200 - DNA, 22 bp, Artificial Sequence
  chemically synthesized
tgtacaaattcataacactgaa

SEQ ID NO: 1112201 - DNA, 22 bp, Artificial Sequence
  chemically synthesized
gtacaaattcataacactgaaa

SEQ ID NO: 1112202 - DNA, 22 bp, Artificial Sequence
  chemically synthesized
tacaaattcataacactgaaat

SEQ ID NO: 1112203 - DNA, 22 bp, Artificial Sequence
  chemically synthesized
ataacactgaaatttataatac

SEQ ID NO: 1112204 - DNA, 22 bp, Artificial Sequence
  chemically synthesized
aaatttataatacgctctattt

SEQ ID NO: 1112205 - DNA, 22 bp, Artificial Sequence
  chemically synthesized
ataatacgctctatttatttgc

SEQ ID NO: 1112206 - DNA, 22 bp, Artificial Sequence
  chemically synthesized
taatacgctctatttatttgca

SEQ ID NO: 1112207 - DNA, 22 bp, Artificial Sequence
  chemically synthesized
taaagatcaatatgcaaataaa

SEQ ID NO: 1112208 - DNA, 22 bp, Artificial Sequence
  chemically synthesized
agttataaagatcaatatgcaa

SEQ ID NO: 1112209 - DNA, 22 bp, Artificial Sequence
  chemically synthesized
tatttatttgcatattgatctt

SEQ ID NO: 1112210 - DNA, 22 bp, Artificial Sequence
  chemically synthesized
cattcagttataaagatcaata

SEQ ID NO: 1112211 - DNA, 22 bp, Artificial Sequence
  chemically synthesized
tttatttgcatattgatcttta

SEQ ID NO: 1112212 - DNA, 22 bp, Artificial Sequence
  chemically synthesized
cctgcattcagttataaagatc

SEQ ID NO: 1112213 - DNA, 22 bp, Artificial Sequence
  chemically synthesized
atttgcatattgatctttataa

SEQ ID NO: 1112214 - DNA, 22 bp, Artificial Sequence
  chemically synthesized
tttgcatattgatctttataac

SEQ ID NO: 1112215 - DNA, 22 bp, Artificial Sequence
  chemically synthesized
attgcctgcattcagttataaa

SEQ ID NO: 1112216 - DNA, 22 bp, Artificial Sequence
  chemically synthesized
gcatattgatctttataactga

SEQ ID NO: 1112217 - DNA, 22 bp, Artificial Sequence
  chemically synthesized
cattgcctgcattcagttataa

SEQ ID NO: 1112218 - DNA, 22 bp, Artificial Sequence
  chemically synthesized
catattgatctttataactgaa

SEQ ID NO: 1112219 - DNA, 22 bp, Artificial Sequence
  chemically synthesized
tcattgcctgcattcagttata

SEQ ID NO: 1112220 - DNA, 22 bp, Artificial Sequence
  chemically synthesized
cattttcattgcctgcattcag

SEQ ID NO: 1112221 - DNA, 22 bp, Artificial Sequence
  chemically synthesized
atctttataactgaatgcaggc

SEQ ID NO: 1112222 - DNA, 22 bp, Artificial Sequence
  chemically synthesized
tcactgcattttcattgcctgc

SEQ ID NO: 1112223 - DNA, 22 bp, Artificial Sequence
  chemically synthesized
tataactgaatgcaggcaatga

SEQ ID NO: 1112224 - DNA, 22 bp, Artificial Sequence
  chemically synthesized
ataactgaatgcaggcaatgaa

SEQ ID NO: 1112225 - DNA, 22 bp, Artificial Sequence
  chemically synthesized
taactgaatgcaggcaatgaaa

SEQ ID NO: 1112226 - DNA, 22 bp, Artificial Sequence
  chemically synthesized
cctatcactgcattttcattgc

SEQ ID NO: 1112227 - DNA, 22 bp, Artificial Sequence
  chemically synthesized
acctatcactgcattttcattg

SEQ ID NO: 1112228 - DNA, 22 bp, Artificial Sequence
  chemically synthesized
tacctatcactgcattttcatt

SEQ ID NO: 1112229 - DNA, 22 bp, Artificial Sequence
  chemically synthesized
ttacctatcactgcattttcat

SEQ ID NO: 1112230 - DNA, 22 bp, Artificial Sequence
  chemically synthesized
aatgcaggcaatgaaaatgcag

SEQ ID NO: 1112231 - DNA, 22 bp, Artificial Sequence
  chemically synthesized
ttttacctatcactgcattttc

SEQ ID NO: 1112232 - DNA, 22 bp, Artificial Sequence
  chemically synthesized
tagatgtcgttcttttacctat

SEQ ID NO: 1112233 - DNA, 22 bp, Artificial Sequence
  chemically synthesized
ttatagatgtcgttcttttacc

SEQ ID NO: 1112234 - DNA, 22 bp, Artificial Sequence
  chemically synthesized
ctattatagatgtcgttctttt

SEQ ID NO: 1112235 - DNA, 22 bp, Artificial Sequence
  chemically synthesized
gctattatagatgtcgttcttt

SEQ ID NO: 1112236 - DNA, 22 bp, Artificial Sequence
  chemically synthesized
tgctattatagatgtcgttctt

SEQ ID NO: 1112237 - DNA, 22 bp, Artificial Sequence
  chemically synthesized
ttgctattatagatgtcgttct

SEQ ID NO: 1112238 - DNA, 22 bp, Artificial Sequence
  chemically synthesized
tttgctattatagatgtcgttc

SEQ ID NO: 1112239 - DNA, 22 bp, Artificial Sequence
  chemically synthesized
cccctttttgctattatagatg

SEQ ID NO: 1112240 - DNA, 22 bp, Artificial Sequence
  chemically synthesized
cctccccctttttgctattata

SEQ ID NO: 1112241 - DNA, 22 bp, Artificial Sequence
  chemically synthesized
cctgcctccccctttttgctat

SEQ ID NO: 1112242 - DNA, 22 bp, Artificial Sequence
  chemically synthesized
tgcctgcctccccctttttgct

SEQ ID NO: 1112243 - DNA, 22 bp, Artificial Sequence
  chemically synthesized
ctgcctgcctccccctttttgc

SEQ ID NO: 1112244 - DNA, 22 bp, Artificial Sequence
  chemically synthesized
tctgcctgcctccccctttttg

SEQ ID NO: 1112245 - DNA, 22 bp, Artificial Sequence
  chemically synthesized
cctttctgcctgcctccccctt

SEQ ID NO: 1112246 - DNA, 22 bp, Artificial Sequence
  chemically synthesized
taatagcaaaaagggggaggca

SEQ ID NO: 1112247 - DNA, 22 bp, Artificial Sequence
  chemically synthesized
tgcctttctgcctgcctccccc

SEQ ID NO: 1112248 - DNA, 22 bp, Artificial Sequence
  chemically synthesized
tctgcctttctgcctgcctccc

SEQ ID NO: 1112249 - DNA, 22 bp, Artificial Sequence
  chemically synthesized
ctctgcctttctgcctgcctcc

SEQ ID NO: 1112250 - DNA, 22 bp, Artificial Sequence
  chemically synthesized
accggtcatttctctgcctttc

SEQ ID NO: 1112251 - DNA, 22 bp, Artificial Sequence
  chemically synthesized
tcaccggtcatttctctgcctt

SEQ ID NO: 1112252 - DNA, 22 bp, Artificial Sequence
  chemically synthesized
acgccagaattctcaccggtca

SEQ ID NO: 1112253 - DNA, 22 bp, Artificial Sequence
  chemically synthesized
aacgccagaattctcaccggtc

SEQ ID NO: 1112254 - DNA, 22 bp, Artificial Sequence
  chemically synthesized
taacgccagaattctcaccggt

SEQ ID NO: 1112255 - DNA, 22 bp, Artificial Sequence
  chemically synthesized
tttaacgccagaattctcaccg

SEQ ID NO: 1112256 - DNA, 22 bp, Artificial Sequence
  chemically synthesized
cggtctctttaacgccagaatt

SEQ ID NO: 1112257 - DNA, 22 bp, Artificial Sequence
  chemically synthesized
aactccggtctctttaacgcca

SEQ ID NO: 1112258 - DNA, 22 bp, Artificial Sequence
  chemically synthesized
gaactccggtctctttaacgcc

SEQ ID NO: 1112259 - DNA, 22 bp, Artificial Sequence
  chemically synthesized
tggcgttaaagagaccggagtt

SEQ ID NO: 1112260 - DNA, 22 bp, Artificial Sequence
  chemically synthesized
gcgttaaagagaccggagttca

SEQ ID NO: 1112261 - DNA, 22 bp, Artificial Sequence
  chemically synthesized
gtaaggggcatcaaatttgaac

SEQ ID NO: 1112262 - DNA, 22 bp, Artificial Sequence
  chemically synthesized
aagagaccggagttcaaatttg

SEQ ID NO: 1112263 - DNA, 22 bp, Artificial Sequence
  chemically synthesized
acacatctagtaaggggcatca

SEQ ID NO: 1112264 - DNA, 22 bp, Artificial Sequence
  chemically synthesized
cacacatctagtaaggggcatc

SEQ ID NO: 1112265 - DNA, 22 bp, Artificial Sequence
  chemically synthesized
aaatttgatgccccttactaga

SEQ ID NO: 1112266 - DNA, 22 bp, Artificial Sequence
  chemically synthesized
aacccatttcacacatctagta

SEQ ID NO: 1112267 - DNA, 22 bp, Artificial Sequence
  chemically synthesized
gatgccccttactagatgtgtg

SEQ ID NO: 1112268 - DNA, 22 bp, Artificial Sequence
  chemically synthesized
atgccccttactagatgtgtga

SEQ ID NO: 1112269 - DNA, 22 bp, Artificial Sequence
  chemically synthesized
agtaactgaacccatttcacac

SEQ ID NO: 1112270 - DNA, 22 bp, Artificial Sequence
  chemically synthesized
actagatgtgtgaaatgggttc

SEQ ID NO: 1112271 - DNA, 22 bp, Artificial Sequence
  chemically synthesized
ctagatgtgtgaaatgggttca

SEQ ID NO: 1112272 - DNA, 22 bp, Artificial Sequence
  chemically synthesized
gatgtgtgaaatgggttcagtt

SEQ ID NO: 1112273 - DNA, 22 bp, Artificial Sequence
  chemically synthesized
agttacttaatttcactggatc

SEQ ID NO: 1112274 - DNA, 22 bp, Artificial Sequence
  chemically synthesized
cttaatttcactggatcttgtt

SEQ ID NO: 1112275 - DNA, 22 bp, Artificial Sequence
  chemically synthesized
atggatgagaaaaacaagatcc

SEQ ID NO: 1112276 - DNA, 22 bp, Artificial Sequence
  chemically synthesized
catggatgagaaaaacaagatc

SEQ ID NO: 1112277 - DNA, 22 bp, Artificial Sequence
  chemically synthesized
aatttcactggatcttgttttt

SEQ ID NO: 1112278 - DNA, 22 bp, Artificial Sequence
  chemically synthesized
atttcactggatcttgtttttc

SEQ ID NO: 1112279 - DNA, 22 bp, Artificial Sequence
  chemically synthesized
atttcatggatgagaaaaacaa

SEQ ID NO: 1112280 - DNA, 22 bp, Artificial Sequence
  chemically synthesized
cactggatcttgtttttctcat

SEQ ID NO: 1112281 - DNA, 22 bp, Artificial Sequence
  chemically synthesized
actggatcttgtttttctcatc

SEQ ID NO: 1112282 - DNA, 22 bp, Artificial Sequence
  chemically synthesized
atcctcatttcatggatgagaa

SEQ ID NO: 1112283 - DNA, 22 bp, Artificial Sequence
  chemically synthesized
aatcctcatttcatggatgaga

SEQ ID NO: 1112284 - DNA, 22 bp, Artificial Sequence
  chemically synthesized
gatcttgtttttctcatccatg

SEQ ID NO: 1112285 - DNA, 22 bp, Artificial Sequence
  chemically synthesized
taatcctcatttcatggatgag

SEQ ID NO: 1112286 - DNA, 22 bp, Artificial Sequence
  chemically synthesized
ttaatcctcatttcatggatga

SEQ ID NO: 1112287 - DNA, 22 bp, Artificial Sequence
  chemically synthesized
tttttaatcctcatttcatgga

SEQ ID NO: 1112288 - DNA, 22 bp, Artificial Sequence
  chemically synthesized
gtttttctcatccatgaaatga

SEQ ID NO: 1112289 - DNA, 22 bp, Artificial Sequence
  chemically synthesized
tatttttaatcctcatttcatg

SEQ ID NO: 1112290 - DNA, 22 bp, Artificial Sequence
  chemically synthesized
tttttctcatccatgaaatgag

SEQ ID NO: 1112291 - DNA, 22 bp, Artificial Sequence
  chemically synthesized
ttctcatccatgaaatgaggat

SEQ ID NO: 1112292 - DNA, 22 bp, Artificial Sequence
  chemically synthesized
tctcatccatgaaatgaggatt

SEQ ID NO: 1112293 - DNA, 22 bp, Artificial Sequence
  chemically synthesized
ctcatccatgaaatgaggatta

SEQ ID NO: 1112294 - DNA, 22 bp, Artificial Sequence
  chemically synthesized
tcatccatgaaatgaggattaa

SEQ ID NO: 1112295 - DNA, 22 bp, Artificial Sequence
  chemically synthesized
atccatgaaatgaggattaaaa

SEQ ID NO: 1112296 - DNA, 22 bp, Artificial Sequence
  chemically synthesized
tgaggtcgattctatttttaat

SEQ ID NO: 1112297 - DNA, 22 bp, Artificial Sequence
  chemically synthesized
gtaagtatcctatgaggtcgat

SEQ ID NO: 1112298 - DNA, 22 bp, Artificial Sequence
  chemically synthesized
ggtaagtatcctatgaggtcga

SEQ ID NO: 1112299 - DNA, 22 bp, Artificial Sequence
  chemically synthesized
tggtaagtatcctatgaggtcg

SEQ ID NO: 1112300 - DNA, 22 bp, Artificial Sequence
  chemically synthesized
aaaatagaatcgacctcatagg

SEQ ID NO: 1112301 - DNA, 22 bp, Artificial Sequence
  chemically synthesized
agaactttggtaagtatcctat

SEQ ID NO: 1112302 - DNA, 22 bp, Artificial Sequence
  chemically synthesized
actcagaactttggtaagtatc

SEQ ID NO: 1112303 - DNA, 22 bp, Artificial Sequence
  chemically synthesized
ataggatacttaccaaagttct

SEQ ID NO: 1112304 - DNA, 22 bp, Artificial Sequence
  chemically synthesized
tatatgttaactcagaactttg

SEQ ID NO: 1112305 - DNA, 22 bp, Artificial Sequence
  chemically synthesized
accaaagttctgagttaacata

SEQ ID NO: 1112306 - DNA, 22 bp, Artificial Sequence
  chemically synthesized
ccaaagttctgagttaacatat

SEQ ID NO: 1112307 - DNA, 22 bp, Artificial Sequence
  chemically synthesized
taagtaagttatatatgttaac

SEQ ID NO: 1112308 - DNA, 22 bp, Artificial Sequence
  chemically synthesized
ttataagtaagttatatatgtt

SEQ ID NO: 1112309 - DNA, 22 bp, Artificial Sequence
  chemically synthesized
gttataagtaagttatatatgt

SEQ ID NO: 1112310 - DNA, 22 bp, Artificial Sequence
  chemically synthesized
tgagttaacatatataacttac

SEQ ID NO: 1112311 - DNA, 22 bp, Artificial Sequence
  chemically synthesized
agttaacatatataacttactt

SEQ ID NO: 1112312 - DNA, 22 bp, Artificial Sequence
  chemically synthesized
acatatataacttacttataac

SEQ ID NO: 1112313 - DNA, 22 bp, Artificial Sequence
  chemically synthesized
gtatgtgtcagcatttgttata

SEQ ID NO: 1112314 - DNA, 22 bp, Artificial Sequence
  chemically synthesized
cctagtatgtgtcagcatttgt

SEQ ID NO: 1112315 - DNA, 22 bp, Artificial Sequence
  chemically synthesized
ttgcctagtatgtgtcagcatt

SEQ ID NO: 1112316 - DNA, 22 bp, Artificial Sequence
  chemically synthesized
gttgcctagtatgtgtcagcat

SEQ ID NO: 1112317 - DNA, 22 bp, Artificial Sequence
  chemically synthesized
acttataacaaatgctgacaca

SEQ ID NO: 1112318 - DNA, 22 bp, Artificial Sequence
  chemically synthesized
tgttgcctagtatgtgtcagca

SEQ ID NO: 1112319 - DNA, 22 bp, Artificial Sequence
  chemically synthesized
cttataacaaatgctgacacat

SEQ ID NO: 1112320 - DNA, 22 bp, Artificial Sequence
  chemically synthesized
ataacaaatgctgacacatact

SEQ ID NO: 1112321 - DNA, 22 bp, Artificial Sequence
  chemically synthesized
taacaaatgctgacacatacta

SEQ ID NO: 1112322 - DNA, 22 bp, Artificial Sequence
  chemically synthesized
atatgtctttgttgcctagtat

SEQ ID NO: 1112323 - DNA, 22 bp, Artificial Sequence
  chemically synthesized
tctaatatgtctttgttgccta

SEQ ID NO: 1112324 - DNA, 22 bp, Artificial Sequence
  chemically synthesized
acacatactaggcaacaaagac

SEQ ID NO: 1112325 - DNA, 22 bp, Artificial Sequence
  chemically synthesized
tatggcattgtctaatatgtct

SEQ ID NO: 1112326 - DNA, 22 bp, Artificial Sequence
  chemically synthesized
tatatggcattgtctaatatgt

SEQ ID NO: 1112327 - DNA, 22 bp, Artificial Sequence
  chemically synthesized
ggcaacaaagacatattagaca

SEQ ID NO: 1112328 - DNA, 22 bp, Artificial Sequence
  chemically synthesized
ctctatatggcattgtctaata

SEQ ID NO: 1112329 - DNA, 22 bp, Artificial Sequence
  chemically synthesized
cctctatatggcattgtctaat

SEQ ID NO: 1112330 - DNA, 22 bp, Artificial Sequence
  chemically synthesized
atttcctctatatggcattgtc

SEQ ID NO: 1112331 - DNA, 22 bp, Artificial Sequence
  chemically synthesized
catttcctctatatggcattgt

SEQ ID NO: 1112332 - DNA, 22 bp, Artificial Sequence
  chemically synthesized
tcatttcctctatatggcattg

SEQ ID NO: 1112333 - DNA, 22 bp, Artificial Sequence
  chemically synthesized
ttcatttcctctatatggcatt

SEQ ID NO: 1112334 - DNA, 22 bp, Artificial Sequence
  chemically synthesized
tttcatttcctctatatggcat

SEQ ID NO: 1112335 - DNA, 22 bp, Artificial Sequence
  chemically synthesized
tttttcatttcctctatatggc

SEQ ID NO: 1112336 - DNA, 22 bp, Artificial Sequence
  chemically synthesized
gacaatgccatatagaggaaat

SEQ ID NO: 1112337 - DNA, 22 bp, Artificial Sequence
  chemically synthesized
aatattctttttcatttcctct

SEQ ID NO: 1112338 - DNA, 22 bp, Artificial Sequence
  chemically synthesized
tgaatattctttttcatttcct

SEQ ID NO: 1112339 - DNA, 22 bp, Artificial Sequence
  chemically synthesized
ctgaatattctttttcatttcc

SEQ ID NO: 1112340 - DNA, 22 bp, Artificial Sequence
  chemically synthesized
tctgaatattctttttcatttc

SEQ ID NO: 1112341 - DNA, 22 bp, Artificial Sequence
  chemically synthesized
ttttctgaatattctttttcat

SEQ ID NO: 1112342 - DNA, 22 bp, Artificial Sequence
  chemically synthesized
gttttctgaatattctttttca

SEQ ID NO: 1112343 - DNA, 22 bp, Artificial Sequence
  chemically synthesized
gtcccttgttttctgaatattc

SEQ ID NO: 1112344 - DNA, 22 bp, Artificial Sequence
  chemically synthesized
acacaagagagctggtcccttg

SEQ ID NO: 1112345 - DNA, 22 bp, Artificial Sequence
  chemically synthesized
cacacaagagagctggtccctt

SEQ ID NO: 1112346 - DNA, 22 bp, Artificial Sequence
  chemically synthesized
tcacacaagagagctggtccct

SEQ ID NO: 1112347 - DNA, 22 bp, Artificial Sequence
  chemically synthesized
agaaaacaagggaccagctctc

SEQ ID NO: 1112348 - DNA, 22 bp, Artificial Sequence
  chemically synthesized
attttcacacaagagagctggt

SEQ ID NO: 1112349 - DNA, 22 bp, Artificial Sequence
  chemically synthesized
cccctaattttcacacaagaga

SEQ ID NO: 1112350 - DNA, 22 bp, Artificial Sequence
  chemically synthesized
tccccctaattttcacacaaga

SEQ ID NO: 1112351 - DNA, 22 bp, Artificial Sequence
  chemically synthesized
ctctccccctaattttcacaca

SEQ ID NO: 1112352 - DNA, 22 bp, Artificial Sequence
  chemically synthesized
cctctccccctaattttcacac

SEQ ID NO: 1112353 - DNA, 22 bp, Artificial Sequence
  chemically synthesized
tcttgtgtgaaaattaggggga

SEQ ID NO: 1112354 - DNA, 22 bp, Artificial Sequence
  chemically synthesized
agaagacttcctctccccctaa

SEQ ID NO: 1112355 - DNA, 22 bp, Artificial Sequence
  chemically synthesized
ttgtgtgaaaattagggggaga

SEQ ID NO: 1112356 - DNA, 22 bp, Artificial Sequence
  chemically synthesized
gtgtgaaaattagggggagagg

SEQ ID NO: 1112357 - DNA, 22 bp, Artificial Sequence
  chemically synthesized
tgtgaaaattagggggagagga

SEQ ID NO: 1112358 - DNA, 22 bp, Artificial Sequence
  chemically synthesized
agtcattaagaagacttcctct

SEQ ID NO: 1112359 - DNA, 22 bp, Artificial Sequence
  chemically synthesized
cagtcattaagaagacttcctc

SEQ ID NO: 1112360 - DNA, 22 bp, Artificial Sequence
  chemically synthesized
tttcagtcattaagaagacttc

SEQ ID NO: 1112361 - DNA, 22 bp, Artificial Sequence
  chemically synthesized
gggggagaggaagtcttcttaa

SEQ ID NO: 1112362 - DNA, 22 bp, Artificial Sequence
  chemically synthesized
tacatgtcctgtttcagtcatt

SEQ ID NO: 1112363 - DNA, 22 bp, Artificial Sequence
  chemically synthesized
atacatgtcctgtttcagtcat

SEQ ID NO: 1112364 - DNA, 22 bp, Artificial Sequence
  chemically synthesized
tatacatgtcctgtttcagtca

SEQ ID NO: 1112365 - DNA, 22 bp, Artificial Sequence
  chemically synthesized
ttatacatgtcctgtttcagtc

SEQ ID NO: 1112366 - DNA, 22 bp, Artificial Sequence
  chemically synthesized
tttatacatgtcctgtttcagt

SEQ ID NO: 1112367 - DNA, 22 bp, Artificial Sequence
  chemically synthesized
actttttatacatgtcctgttt

SEQ ID NO: 1112368 - DNA, 22 bp, Artificial Sequence
  chemically synthesized
cttaatgactgaaacaggacat

SEQ ID NO: 1112369 - DNA, 22 bp, Artificial Sequence
  chemically synthesized
ttaatgactgaaacaggacatg

SEQ ID NO: 1112370 - DNA, 22 bp, Artificial Sequence
  chemically synthesized
ttaactttttatacatgtcctg

SEQ ID NO: 1112371 - DNA, 22 bp, Artificial Sequence
  chemically synthesized
aatgactgaaacaggacatgta

SEQ ID NO: 1112372 - DNA, 22 bp, Artificial Sequence
  chemically synthesized
atgactgaaacaggacatgtat

SEQ ID NO: 1112373 - DNA, 22 bp, Artificial Sequence
  chemically synthesized
aaacaggacatgtataaaaagt

SEQ ID NO: 1112374 - DNA, 22 bp, Artificial Sequence
  chemically synthesized
aaatagtattattaacttttta

SEQ ID NO: 1112375 - DNA, 22 bp, Artificial Sequence
  chemically synthesized
aaaatagtattattaacttttt

SEQ ID NO: 1112376 - DNA, 22 bp, Artificial Sequence
  chemically synthesized
taaaatagtattattaactttt

SEQ ID NO: 1112377 - DNA, 22 bp, Artificial Sequence
  chemically synthesized
attttaaaatagtattattaac

SEQ ID NO: 1112378 - DNA, 22 bp, Artificial Sequence
  chemically synthesized
ggactaattttaaaatagtatt

SEQ ID NO: 1112379 - DNA, 22 bp, Artificial Sequence
  chemically synthesized
ataatactattttaaaattagt

SEQ ID NO: 1112380 - DNA, 22 bp, Artificial Sequence
  chemically synthesized
tataaaattaggactaatttta

SEQ ID NO: 1112381 - DNA, 22 bp, Artificial Sequence
  chemically synthesized
ttttaaaattagtcctaatttt

SEQ ID NO: 1112382 - DNA, 22 bp, Artificial Sequence
  chemically synthesized
gtcatatattatataaaattag

SEQ ID NO: 1112383 - DNA, 22 bp, Artificial Sequence
  chemically synthesized
taaaattagtcctaattttata

SEQ ID NO: 1112384 - DNA, 22 bp, Artificial Sequence
  chemically synthesized
aaaattagtcctaattttatat

SEQ ID NO: 1112385 - DNA, 22 bp, Artificial Sequence
  chemically synthesized
aaattagtcctaattttatata

SEQ ID NO: 1112386 - DNA, 22 bp, Artificial Sequence
  chemically synthesized
gtcctaattttatataatatat

SEQ ID NO: 1112387 - DNA, 22 bp, Artificial Sequence
  chemically synthesized
tatcccatattagtcatatatt

SEQ ID NO: 1112388 - DNA, 22 bp, Artificial Sequence
  chemically synthesized
tatatcccatattagtcatata

SEQ ID NO: 1112389 - DNA, 22 bp, Artificial Sequence
  chemically synthesized
attttatataatatatgactaa

SEQ ID NO: 1112390 - DNA, 22 bp, Artificial Sequence
  chemically synthesized
ctatatcccatattagtcatat

SEQ ID NO: 1112391 - DNA, 22 bp, Artificial Sequence
  chemically synthesized
tatataatatatgactaatatg

SEQ ID NO: 1112392 - DNA, 22 bp, Artificial Sequence
  chemically synthesized
atataatatatgactaatatgg

SEQ ID NO: 1112393 - DNA, 22 bp, Artificial Sequence
  chemically synthesized
tataatatatgactaatatggg

SEQ ID NO: 1112394 - DNA, 22 bp, Artificial Sequence
  chemically synthesized
atatgggatatagaaggtgtat

SEQ ID NO: 1112395 - DNA, 22 bp, Artificial Sequence
  chemically synthesized
aaaaatgtataaatacaccttc

SEQ ID NO: 1112396 - DNA, 22 bp, Artificial Sequence
  chemically synthesized
aaaaaatgtataaatacacctt

SEQ ID NO: 1112397 - DNA, 22 bp, Artificial Sequence
  chemically synthesized
taaaaaatgtataaatacacct

SEQ ID NO: 1112398 - DNA, 22 bp, Artificial Sequence
  chemically synthesized
tttaaaaaatgtataaatacac

SEQ ID NO: 1112399 - DNA, 22 bp, Artificial Sequence
  chemically synthesized
ctttaaaaaatgtataaataca

SEQ ID NO: 1112400 - DNA, 22 bp, Artificial Sequence
  chemically synthesized
ataaaacttctttaaaaaatgt

SEQ ID NO: 1112401 - DNA, 22 bp, Artificial Sequence
  chemically synthesized
ttgataaaacttctttaaaaaa

SEQ ID NO: 1112402 - DNA, 22 bp, Artificial Sequence
  chemically synthesized
gttattgataaaacttctttaa

SEQ ID NO: 1112403 - DNA, 22 bp, Artificial Sequence
  chemically synthesized
atacattttttaaagaagtttt

SEQ ID NO: 1112404 - DNA, 22 bp, Artificial Sequence
  chemically synthesized
tacattttttaaagaagtttta

SEQ ID NO: 1112405 - DNA, 22 bp, Artificial Sequence
  chemically synthesized
tttaaagaagttttatcaataa

SEQ ID NO: 1112406 - DNA, 22 bp, Artificial Sequence
  chemically synthesized
ttaaagaagttttatcaataac

SEQ ID NO: 1112407 - DNA, 22 bp, Artificial Sequence
  chemically synthesized
aaaggatccctggttattgata

SEQ ID NO: 1112408 - DNA, 22 bp, Artificial Sequence
  chemically synthesized
taaagaagttttatcaataacc

SEQ ID NO: 1112409 - DNA, 22 bp, Artificial Sequence
  chemically synthesized
aaagaagttttatcaataacca

SEQ ID NO: 1112410 - DNA, 22 bp, Artificial Sequence
  chemically synthesized
aagaagttttatcaataaccag

SEQ ID NO: 1112411 - DNA, 22 bp, Artificial Sequence
  chemically synthesized
gtctcaaaggatccctggttat

SEQ ID NO: 1112412 - DNA, 22 bp, Artificial Sequence
  chemically synthesized
ctggtctcaaaggatccctggt

SEQ ID NO: 1112413 - DNA, 22 bp, Artificial Sequence
  chemically synthesized
tatcaataaccagggatccttt

SEQ ID NO: 1112414 - DNA, 22 bp, Artificial Sequence
  chemically synthesized
atcaataaccagggatcctttg

SEQ ID NO: 1112415 - DNA, 22 bp, Artificial Sequence
  chemically synthesized
tcaataaccagggatcctttga

SEQ ID NO: 1112416 - DNA, 22 bp, Artificial Sequence
  chemically synthesized
gaactcctggtctcaaaggatc

SEQ ID NO: 1112417 - DNA, 22 bp, Artificial Sequence
  chemically synthesized
agtgcagcctcgaactcctggt

SEQ ID NO: 1112418 - DNA, 22 bp, Artificial Sequence
  chemically synthesized
tgagaccaggagttcgaggctg

SEQ ID NO: 1112419 - DNA, 22 bp, Artificial Sequence
  chemically synthesized
gagaccaggagttcgaggctgc

SEQ ID NO: 1112420 - DNA, 22 bp, Artificial Sequence
  chemically synthesized
agaccaggagttcgaggctgca

SEQ ID NO: 1112421 - DNA, 22 bp, Artificial Sequence
  chemically synthesized
gaggctgcactgagctatgatt

SEQ ID NO: 1112422 - DNA, 22 bp, Artificial Sequence
  chemically synthesized
gaatacagtgatgcaatcatag

SEQ ID NO: 1112423 - DNA, 22 bp, Artificial Sequence
  chemically synthesized
cactgagctatgattgcatcac

SEQ ID NO: 1112424 - DNA, 22 bp, Artificial Sequence
  chemically synthesized
cccaggctagaatacagtgatg

SEQ ID NO: 1112425 - DNA, 22 bp, Artificial Sequence
  chemically synthesized
agctatgattgcatcactgtat

SEQ ID NO: 1112426 - DNA, 22 bp, Artificial Sequence
  chemically synthesized
ttgcccaggctagaatacagtg

SEQ ID NO: 1112427 - DNA, 22 bp, Artificial Sequence
  chemically synthesized
tgttgcccaggctagaatacag

SEQ ID NO: 1112428 - DNA, 22 bp, Artificial Sequence
  chemically synthesized
tgattgcatcactgtattctag

SEQ ID NO: 1112429 - DNA, 22 bp, Artificial Sequence
  chemically synthesized
ctctgttgcccaggctagaata

SEQ ID NO: 1112430 - DNA, 22 bp, Artificial Sequence
  chemically synthesized
gctctgttgcccaggctagaat

SEQ ID NO: 1112431 - DNA, 22 bp, Artificial Sequence
  chemically synthesized
ttgctctgttgcccaggctaga

SEQ ID NO: 1112432 - DNA, 22 bp, Artificial Sequence
  chemically synthesized
catcactgtattctagcctggg

SEQ ID NO: 1112433 - DNA, 22 bp, Artificial Sequence
  chemically synthesized
tattctagcctgggcaacagag

SEQ ID NO: 1112434 - DNA, 22 bp, Artificial Sequence
  chemically synthesized
gtgacaggctcttgctctgttg

SEQ ID NO: 1112435 - DNA, 22 bp, Artificial Sequence
  chemically synthesized
tagcctgggcaacagagcaaga

SEQ ID NO: 1112436 - DNA, 22 bp, Artificial Sequence
  chemically synthesized
gttggtgacaggctcttgctct

SEQ ID NO: 1112437 - DNA, 22 bp, Artificial Sequence
  chemically synthesized
gcctgggcaacagagcaagagc

SEQ ID NO: 1112438 - DNA, 22 bp, Artificial Sequence
  chemically synthesized
agttggtgacaggctcttgctc

SEQ ID NO: 1112439 - DNA, 22 bp, Artificial Sequence
  chemically synthesized
tagttggtgacaggctcttgct

SEQ ID NO: 1112440 - DNA, 22 bp, Artificial Sequence
  chemically synthesized
ttttagttggtgacaggctctt

SEQ ID NO: 1112441 - DNA, 22 bp, Artificial Sequence
  chemically synthesized
ggcaacagagcaagagcctgtc

SEQ ID NO: 1112442 - DNA, 22 bp, Artificial Sequence
  chemically synthesized
attttagttggtgacaggctct

SEQ ID NO: 1112443 - DNA, 22 bp, Artificial Sequence
  chemically synthesized
tattttagttggtgacaggctc

SEQ ID NO: 1112444 - DNA, 22 bp, Artificial Sequence
  chemically synthesized
ttattttagttggtgacaggct

SEQ ID NO: 1112445 - DNA, 22 bp, Artificial Sequence
  chemically synthesized
tttttattttagttggtgacag

SEQ ID NO: 1112446 - DNA, 22 bp, Artificial Sequence
  chemically synthesized
atttttattttagttggtgaca

SEQ ID NO: 1112447 - DNA, 22 bp, Artificial Sequence
  chemically synthesized
tatttttattttagttggtgac

SEQ ID NO: 1112448 - DNA, 22 bp, Artificial Sequence
  chemically synthesized
ttatttttattttagttggtga

SEQ ID NO: 1112449 - DNA, 22 bp, Artificial Sequence
  chemically synthesized
tttatttttattttagttggtg

SEQ ID NO: 1112450 - DNA, 22 bp, Artificial Sequence
  chemically synthesized
tttttatttttattttagttgg

SEQ ID NO: 1112451 - DNA, 22 bp, Artificial Sequence
  chemically synthesized
tcaccaactaaaataaaaataa

SEQ ID NO: 1112452 - DNA, 22 bp, Artificial Sequence
  chemically synthesized
ccaaataaactctttttatttt

SEQ ID NO: 1112453 - DNA, 22 bp, Artificial Sequence
  chemically synthesized
aaataaaaataaaaagagttta

SEQ ID NO: 1112454 - DNA, 22 bp, Artificial Sequence
  chemically synthesized
caggattcccaaataaactctt

SEQ ID NO: 1112455 - DNA, 22 bp, Artificial Sequence
  chemically synthesized
taaatgtggcagaatattccag

SEQ ID NO: 1112456 - DNA, 22 bp, Artificial Sequence
  chemically synthesized
atttgggaatcctggaatattc

SEQ ID NO: 1112457 - DNA, 22 bp, Artificial Sequence
  chemically synthesized
tttgggaatcctggaatattct

SEQ ID NO: 1112458 - DNA, 22 bp, Artificial Sequence
  chemically synthesized
gggaatcctggaatattctgcc

SEQ ID NO: 1112459 - DNA, 22 bp, Artificial Sequence
  chemically synthesized
ggaatcctggaatattctgcca

SEQ ID NO: 1112460 - DNA, 22 bp, Artificial Sequence
  chemically synthesized
acatgattataaatgtggcaga

SEQ ID NO: 1112461 - DNA, 22 bp, Artificial Sequence
  chemically synthesized
gaatattctgccacatttataa

SEQ ID NO: 1112462 - DNA, 22 bp, Artificial Sequence
  chemically synthesized
aatctcacatgattataaatgt

SEQ ID NO: 1112463 - DNA, 22 bp, Artificial Sequence
  chemically synthesized
caatctcacatgattataaatg

SEQ ID NO: 1112464 - DNA, 22 bp, Artificial Sequence
  chemically synthesized
taacttcaatctcacatgatta

SEQ ID NO: 1112465 - DNA, 22 bp, Artificial Sequence
  chemically synthesized
tgccacatttataatcatgtga

SEQ ID NO: 1112466 - DNA, 22 bp, Artificial Sequence
  chemically synthesized
ataacttcaatctcacatgatt

SEQ ID NO: 1112467 - DNA, 22 bp, Artificial Sequence
  chemically synthesized
tataacttcaatctcacatgat

SEQ ID NO: 1112468 - DNA, 22 bp, Artificial Sequence
  chemically synthesized
ccacatttataatcatgtgaga

SEQ ID NO: 1112469 - DNA, 22 bp, Artificial Sequence
  chemically synthesized
tttataacttcaatctcacatg

SEQ ID NO: 1112470 - DNA, 22 bp, Artificial Sequence
  chemically synthesized
ctttataacttcaatctcacat

SEQ ID NO: 1112471 - DNA, 22 bp, Artificial Sequence
  chemically synthesized
gtttctttataacttcaatctc

SEQ ID NO: 1112472 - DNA, 22 bp, Artificial Sequence
  chemically synthesized
cgtttctttataacttcaatct

SEQ ID NO: 1112473 - DNA, 22 bp, Artificial Sequence
  chemically synthesized
ataatcatgtgagattgaagtt

SEQ ID NO: 1112474 - DNA, 22 bp, Artificial Sequence
  chemically synthesized
tcgtttctttataacttcaatc

SEQ ID NO: 1112475 - DNA, 22 bp, Artificial Sequence
  chemically synthesized
taatcatgtgagattgaagtta

SEQ ID NO: 1112476 - DNA, 22 bp, Artificial Sequence
  chemically synthesized
aaatgttttcgtttctttataa

SEQ ID NO: 1112477 - DNA, 22 bp, Artificial Sequence
  chemically synthesized
gaaatgttttcgtttctttata

SEQ ID NO: 1112478 - DNA, 22 bp, Artificial Sequence
  chemically synthesized
tgaaatgttttcgtttctttat

SEQ ID NO: 1112479 - DNA, 22 bp, Artificial Sequence
  chemically synthesized
ttgaaatgttttcgtttcttta

SEQ ID NO: 1112480 - DNA, 22 bp, Artificial Sequence
  chemically synthesized
tttgaaatgttttcgtttcttt

SEQ ID NO: 1112481 - DNA, 22 bp, Artificial Sequence
  chemically synthesized
ttttgaaatgttttcgtttctt

SEQ ID NO: 1112482 - DNA, 22 bp, Artificial Sequence
  chemically synthesized
tttttgaaatgttttcgtttct

SEQ ID NO: 1112483 - DNA, 22 bp, Artificial Sequence
  chemically synthesized
aagttataaagaaacgaaaaca

SEQ ID NO: 1112484 - DNA, 22 bp, Artificial Sequence
  chemically synthesized
cacgttttttttgaaatgtttt

SEQ ID NO: 1112485 - DNA, 22 bp, Artificial Sequence
  chemically synthesized
ccacgttttttttgaaatgttt

SEQ ID NO: 1112486 - DNA, 22 bp, Artificial Sequence
  chemically synthesized
taaagaaacgaaaacatttcaa

SEQ ID NO: 1112487 - DNA, 22 bp, Artificial Sequence
  chemically synthesized
gaaatttccacgttttttttga

SEQ ID NO: 1112488 - DNA, 22 bp, Artificial Sequence
  chemically synthesized
gtaacatctagaaatttccacg

SEQ ID NO: 1112489 - DNA, 22 bp, Artificial Sequence
  chemically synthesized
tagtaacatctagaaatttcca

SEQ ID NO: 1112490 - DNA, 22 bp, Artificial Sequence
  chemically synthesized
caaaaaaaacgtggaaatttct

SEQ ID NO: 1112491 - DNA, 22 bp, Artificial Sequence
  chemically synthesized
ctagtaacatctagaaatttcc

SEQ ID NO: 1112492 - DNA, 22 bp, Artificial Sequence
  chemically synthesized
aaaaaaaacgtggaaatttcta

SEQ ID NO: 1112493 - DNA, 22 bp, Artificial Sequence
  chemically synthesized
tctagtaacatctagaaatttc

SEQ ID NO: 1112494 - DNA, 22 bp, Artificial Sequence
  chemically synthesized
ttctagtaacatctagaaattt

SEQ ID NO: 1112495 - DNA, 22 bp, Artificial Sequence
  chemically synthesized
tgtcttttctagtaacatctag

SEQ ID NO: 1112496 - DNA, 22 bp, Artificial Sequence
  chemically synthesized
ctagatgttactagaaaagaca

SEQ ID NO: 1112497 - DNA, 22 bp, Artificial Sequence
  chemically synthesized
tgcccaacattatgtcttttct

SEQ ID NO: 1112498 - DNA, 22 bp, Artificial Sequence
  chemically synthesized
tagatgttactagaaaagacat

SEQ ID NO: 1112499 - DNA, 22 bp, Artificial Sequence
  chemically synthesized
tgtgcccaacattatgtctttt

SEQ ID NO: 1112500 - DNA, 22 bp, Artificial Sequence
  chemically synthesized
gatgttactagaaaagacataa

SEQ ID NO: 1112501 - DNA, 22 bp, Artificial Sequence
  chemically synthesized
ctgtgcccaacattatgtcttt

SEQ ID NO: 1112502 - DNA, 22 bp, Artificial Sequence
  chemically synthesized
tctgtgcccaacattatgtctt

SEQ ID NO: 1112503 - DNA, 22 bp, Artificial Sequence
  chemically synthesized
attttctgtgcccaacattatg

SEQ ID NO: 1112504 - DNA, 22 bp, Artificial Sequence
  chemically synthesized
ctagaaaagacataatgttggg

SEQ ID NO: 1112505 - DNA, 22 bp, Artificial Sequence
  chemically synthesized
tgattttctgtgcccaacatta

SEQ ID NO: 1112506 - DNA, 22 bp, Artificial Sequence
  chemically synthesized
ctgattttctgtgcccaacatt

SEQ ID NO: 1112507 - DNA, 22 bp, Artificial Sequence
  chemically synthesized
gaaaagacataatgttgggcac

SEQ ID NO: 1112508 - DNA, 22 bp, Artificial Sequence
  chemically synthesized
atagcaagacttctgattttct

SEQ ID NO: 1112509 - DNA, 22 bp, Artificial Sequence
  chemically synthesized
catagcaagacttctgattttc

SEQ ID NO: 1112510 - DNA, 22 bp, Artificial Sequence
  chemically synthesized
ggcacagaaaatcagaagtctt

SEQ ID NO: 1112511 - DNA, 22 bp, Artificial Sequence
  chemically synthesized
catacaaatccttcatagcaag

SEQ ID NO: 1112512 - DNA, 22 bp, Artificial Sequence
  chemically synthesized
gcatacaaatccttcatagcaa

SEQ ID NO: 1112513 - DNA, 22 bp, Artificial Sequence
  chemically synthesized
atacaatgtttgcatacaaatc

SEQ ID NO: 1112514 - DNA, 22 bp, Artificial Sequence
  chemically synthesized
gctatgaaggatttgtatgcaa

SEQ ID NO: 1112515 - DNA, 22 bp, Artificial Sequence
  chemically synthesized
ctatgaaggatttgtatgcaaa

SEQ ID NO: 1112516 - DNA, 22 bp, Artificial Sequence
  chemically synthesized
tgaaggatttgtatgcaaacat

SEQ ID NO: 1112517 - DNA, 22 bp, Artificial Sequence
  chemically synthesized
acaatgaattaatacaatgttt

SEQ ID NO: 1112518 - DNA, 22 bp, Artificial Sequence
  chemically synthesized
gtatgcaaacattgtattaatt

SEQ ID NO: 1112519 - DNA, 22 bp, Artificial Sequence
  chemically synthesized
tatgcaaacattgtattaattc

SEQ ID NO: 1112520 - DNA, 22 bp, Artificial Sequence
  chemically synthesized
agcaggcagcatattcacaatg

SEQ ID NO: 1112521 - DNA, 22 bp, Artificial Sequence
  chemically synthesized
ttgagcaggcagcatattcaca

SEQ ID NO: 1112522 - DNA, 22 bp, Artificial Sequence
  chemically synthesized
tattaattcattgtgaatatgc

SEQ ID NO: 1112523 - DNA, 22 bp, Artificial Sequence
  chemically synthesized
gttgagcaggcagcatattcac

SEQ ID NO: 1112524 - DNA, 22 bp, Artificial Sequence
  chemically synthesized
attcattgtgaatatgctgcct

SEQ ID NO: 1112525 - DNA, 22 bp, Artificial Sequence
  chemically synthesized
tgcccttgttgagcaggcagca

SEQ ID NO: 1112526 - DNA, 22 bp, Artificial Sequence
  chemically synthesized
atgcccttgttgagcaggcagc

SEQ ID NO: 1112527 - DNA, 22 bp, Artificial Sequence
  chemically synthesized
attgtgaatatgctgcctgctc

SEQ ID NO: 1112528 - DNA, 22 bp, Artificial Sequence
  chemically synthesized
tgaatatgctgcctgctcaaca

SEQ ID NO: 1112529 - DNA, 22 bp, Artificial Sequence
  chemically synthesized
gaaggacagtttatgcccttgt

SEQ ID NO: 1112530 - DNA, 22 bp, Artificial Sequence
  chemically synthesized
agaaggacagtttatgcccttg

SEQ ID NO: 1112531 - DNA, 22 bp, Artificial Sequence
  chemically synthesized
cctgctcaacaagggcataaac

SEQ ID NO: 1112532 - DNA, 22 bp, Artificial Sequence
  chemically synthesized
tagtttagaaggacagtttatg

SEQ ID NO: 1112533 - DNA, 22 bp, Artificial Sequence
  chemically synthesized
ctcaacaagggcataaactgtc

SEQ ID NO: 1112534 - DNA, 22 bp, Artificial Sequence
  chemically synthesized
atagtttagaaggacagtttat

SEQ ID NO: 1112535 - DNA, 22 bp, Artificial Sequence
  chemically synthesized
aacaagggcataaactgtcctt

SEQ ID NO: 1112536 - DNA, 22 bp, Artificial Sequence
  chemically synthesized
taggagtttatagtttagaagg

SEQ ID NO: 1112537 - DNA, 22 bp, Artificial Sequence
  chemically synthesized
ctataggagtttatagtttaga

SEQ ID NO: 1112538 - DNA, 22 bp, Artificial Sequence
  chemically synthesized
cctataggagtttatagtttag

SEQ ID NO: 1112539 - DNA, 22 bp, Artificial Sequence
  chemically synthesized
tccttctaaactataaactcct

SEQ ID NO: 1112540 - DNA, 22 bp, Artificial Sequence
  chemically synthesized
ctaaactataaactcctatagg

SEQ ID NO: 1112541 - DNA, 22 bp, Artificial Sequence
  chemically synthesized
taaactataaactcctatagga

SEQ ID NO: 1112542 - DNA, 22 bp, Artificial Sequence
  chemically synthesized
aactataaactcctataggaaa

SEQ ID NO: 1112543 - DNA, 22 bp, Artificial Sequence
  chemically synthesized
ccagtggagacatttcctatag

SEQ ID NO: 1112544 - DNA, 22 bp, Artificial Sequence
  chemically synthesized
taaactcctataggaaatgtct

SEQ ID NO: 1112545 - DNA, 22 bp, Artificial Sequence
  chemically synthesized
gatactgccagtggagacattt

SEQ ID NO: 1112546 - DNA, 22 bp, Artificial Sequence
  chemically synthesized
ttagatactgccagtggagaca

SEQ ID NO: 1112547 - DNA, 22 bp, Artificial Sequence
  chemically synthesized
ctataggaaatgtctccactgg

SEQ ID NO: 1112548 - DNA, 22 bp, Artificial Sequence
  chemically synthesized
tattagatactgccagtggaga

SEQ ID NO: 1112549 - DNA, 22 bp, Artificial Sequence
  chemically synthesized
taggaaatgtctccactggcag

SEQ ID NO: 1112550 - DNA, 22 bp, Artificial Sequence
  chemically synthesized
agaattctattagatactgcca

SEQ ID NO: 1112551 - DNA, 22 bp, Artificial Sequence
  chemically synthesized
caagctgagaattctattagat

SEQ ID NO: 1112552 - DNA, 22 bp, Artificial Sequence
  chemically synthesized
cactggcagtatctaatagaat

SEQ ID NO: 1112553 - DNA, 22 bp, Artificial Sequence
  chemically synthesized
ctccaagctgagaattctatta

SEQ ID NO: 1112554 - DNA, 22 bp, Artificial Sequence
  chemically synthesized
tactccaagctgagaattctat

SEQ ID NO: 1112555 - DNA, 22 bp, Artificial Sequence
  chemically synthesized
ctactccaagctgagaattcta

SEQ ID NO: 1112556 - DNA, 22 bp, Artificial Sequence
  chemically synthesized
gcagtatctaatagaattctca

SEQ ID NO: 1112557 - DNA, 22 bp, Artificial Sequence
  chemically synthesized
tctactccaagctgagaattct

SEQ ID NO: 1112558 - DNA, 22 bp, Artificial Sequence
  chemically synthesized
tttctactccaagctgagaatt

SEQ ID NO: 1112559 - DNA, 22 bp, Artificial Sequence
  chemically synthesized
tactctttctactccaagctga

SEQ ID NO: 1112560 - DNA, 22 bp, Artificial Sequence
  chemically synthesized
atagaattctcagcttggagta

SEQ ID NO: 1112561 - DNA, 22 bp, Artificial Sequence
  chemically synthesized
tcagcttggagtagaaagagta

SEQ ID NO: 1112562 - DNA, 22 bp, Artificial Sequence
  chemically synthesized
agcttggagtagaaagagtata

SEQ ID NO: 1112563 - DNA, 22 bp, Artificial Sequence
  chemically synthesized
atgagtacagtgtagttatact

SEQ ID NO: 1112564 - DNA, 22 bp, Artificial Sequence
  chemically synthesized
ggagtagaaagagtataactac

SEQ ID NO: 1112565 - DNA, 22 bp, Artificial Sequence
  chemically synthesized
gagtagaaagagtataactaca

SEQ ID NO: 1112566 - DNA, 22 bp, Artificial Sequence
  chemically synthesized
aatgagttcatgagtacagtgt

SEQ ID NO: 1112567 - DNA, 22 bp, Artificial Sequence
  chemically synthesized
gtattgaatgagttcatgagta

SEQ ID NO: 1112568 - DNA, 22 bp, Artificial Sequence
  chemically synthesized
ggtattgaatgagttcatgagt

SEQ ID NO: 1112569 - DNA, 22 bp, Artificial Sequence
  chemically synthesized
atttggtattgaatgagttcat

SEQ ID NO: 1112570 - DNA, 22 bp, Artificial Sequence
  chemically synthesized
cactgtactcatgaactcattc

SEQ ID NO: 1112571 - DNA, 22 bp, Artificial Sequence
  chemically synthesized
ttgatttggtattgaatgagtt

SEQ ID NO: 1112572 - DNA, 22 bp, Artificial Sequence
  chemically synthesized
tactcatgaactcattcaatac

SEQ ID NO: 1112573 - DNA, 22 bp, Artificial Sequence
  chemically synthesized
atgaactcattcaataccaaat

SEQ ID NO: 1112574 - DNA, 22 bp, Artificial Sequence
  chemically synthesized
atatagagtacactattgattt

SEQ ID NO: 1112575 - DNA, 22 bp, Artificial Sequence
  chemically synthesized
attcaataccaaatcaatagtg

SEQ ID NO: 1112576 - DNA, 22 bp, Artificial Sequence
  chemically synthesized
tattcatatagagtacactatt

SEQ ID NO: 1112577 - DNA, 22 bp, Artificial Sequence
  chemically synthesized
aataccaaatcaatagtgtact

SEQ ID NO: 1112578 - DNA, 22 bp, Artificial Sequence
  chemically synthesized
atattcatatagagtacactat

SEQ ID NO: 1112579 - DNA, 22 bp, Artificial Sequence
  chemically synthesized
tatattcatatagagtacacta

SEQ ID NO: 1112580 - DNA, 22 bp, Artificial Sequence
  chemically synthesized
ttatattcatatagagtacact

SEQ ID NO: 1112581 - DNA, 22 bp, Artificial Sequence
  chemically synthesized
ataatttttatattcatataga

SEQ ID NO: 1112582 - DNA, 22 bp, Artificial Sequence
  chemically synthesized
gtctcataatttttatattcat

SEQ ID NO: 1112583 - DNA, 22 bp, Artificial Sequence
  chemically synthesized
tatatgaatataaaaattatga

SEQ ID NO: 1112584 - DNA, 22 bp, Artificial Sequence
  chemically synthesized
tatgaatataaaaattatgaga

SEQ ID NO: 1112585 - DNA, 22 bp, Artificial Sequence
  chemically synthesized
agtgtacattggtctcataatt

SEQ ID NO: 1112586 - DNA, 22 bp, Artificial Sequence
  chemically synthesized
cagtgtacattggtctcataat

SEQ ID NO: 1112587 - DNA, 22 bp, Artificial Sequence
  chemically synthesized
gcttcagtgtacattggtctca

SEQ ID NO: 1112588 - DNA, 22 bp, Artificial Sequence
  chemically synthesized
ggcttcagtgtacattggtctc

SEQ ID NO: 1112589 - DNA, 22 bp, Artificial Sequence
  chemically synthesized
tggcttcagtgtacattggtct

SEQ ID NO: 1112590 - DNA, 22 bp, Artificial Sequence
  chemically synthesized
ttggcttcagtgtacattggtc

SEQ ID NO: 1112591 - DNA, 22 bp, Artificial Sequence
  chemically synthesized
tgagaccaatgtacactgaagc

SEQ ID NO: 1112592 - DNA, 22 bp, Artificial Sequence
  chemically synthesized
tgtatggcttttggcttcagtg

SEQ ID NO: 1112593 - DNA, 22 bp, Artificial Sequence
  chemically synthesized
gtgtatggcttttggcttcagt

SEQ ID NO: 1112594 - DNA, 22 bp, Artificial Sequence
  chemically synthesized
tttgtgtatggcttttggcttc

SEQ ID NO: 1112595 - DNA, 22 bp, Artificial Sequence
  chemically synthesized
gtttgtgtatggcttttggctt

SEQ ID NO: 1112596 - DNA, 22 bp, Artificial Sequence
  chemically synthesized
tgtgcttgtttgtgtatggctt

SEQ ID NO: 1112597 - DNA, 22 bp, Artificial Sequence
  chemically synthesized
aagccaaaagccatacacaaac

SEQ ID NO: 1112598 - DNA, 22 bp, Artificial Sequence
  chemically synthesized
atacaagagagattgtgtgctt

SEQ ID NO: 1112599 - DNA, 22 bp, Artificial Sequence
  chemically synthesized
gatacaagagagattgtgtgct

SEQ ID NO: 1112600 - DNA, 22 bp, Artificial Sequence
  chemically synthesized
aagcaaatttgatacaagagag

SEQ ID NO: 1112601 - DNA, 22 bp, Artificial Sequence
  chemically synthesized
aaagcaaatttgatacaagaga

SEQ ID NO: 1112602 - DNA, 22 bp, Artificial Sequence
  chemically synthesized
taaagcaaatttgatacaagag

SEQ ID NO: 1112603 - DNA, 22 bp, Artificial Sequence
  chemically synthesized
cccaagtattttaaagcaaatt

SEQ ID NO: 1112604 - DNA, 22 bp, Artificial Sequence
  chemically synthesized
tcttgtatcaaatttgctttaa

SEQ ID NO: 1112605 - DNA, 22 bp, Artificial Sequence
  chemically synthesized
ttgtatcaaatttgctttaaaa

SEQ ID NO: 1112606 - DNA, 22 bp, Artificial Sequence
  chemically synthesized
gtatcaaatttgctttaaaata

SEQ ID NO: 1112607 - DNA, 22 bp, Artificial Sequence
  chemically synthesized
tatcaaatttgctttaaaatac

SEQ ID NO: 1112608 - DNA, 22 bp, Artificial Sequence
  chemically synthesized
catcccctgcccaagtatttta

SEQ ID NO: 1112609 - DNA, 22 bp, Artificial Sequence
  chemically synthesized
tccatcccctgcccaagtattt

SEQ ID NO: 1112610 - DNA, 22 bp, Artificial Sequence
  chemically synthesized
gctttaaaatacttgggcaggg

SEQ ID NO: 1112611 - DNA, 22 bp, Artificial Sequence
  chemically synthesized
ctttaaaatacttgggcagggg

SEQ ID NO: 1112612 - DNA, 22 bp, Artificial Sequence
  chemically synthesized
taaaatacttgggcaggggatg

SEQ ID NO: 1112613 - DNA, 22 bp, Artificial Sequence
  chemically synthesized
aaaatacttgggcaggggatgg

SEQ ID NO: 1112614 - DNA, 22 bp, Artificial Sequence
  chemically synthesized
aaatacttgggcaggggatgga

SEQ ID NO: 1112615 - DNA, 22 bp, Artificial Sequence
  chemically synthesized
gggcaggggatggagaggatgg

SEQ ID NO: 1112616 - DNA, 22 bp, Artificial Sequence
  chemically synthesized
ggcaggggatggagaggatggt

SEQ ID NO: 1112617 - DNA, 22 bp, Artificial Sequence
  chemically synthesized
acgtgacagtgtcagtaagtaa

SEQ ID NO: 1112618 - DNA, 22 bp, Artificial Sequence
  chemically synthesized
ttaacgtgacagtgtcagtaag

SEQ ID NO: 1112619 - DNA, 22 bp, Artificial Sequence
  chemically synthesized
cttactgacactgtcacgttaa

SEQ ID NO: 1112620 - DNA, 22 bp, Artificial Sequence
  chemically synthesized
actgacactgtcacgttaataa

SEQ ID NO: 1112621 - DNA, 22 bp, Artificial Sequence
  chemically synthesized
ctgacactgtcacgttaataac

SEQ ID NO: 1112622 - DNA, 22 bp, Artificial Sequence
  chemically synthesized
acactgtcacgttaataaccga

SEQ ID NO: 1112623 - DNA, 22 bp, Artificial Sequence
  chemically synthesized
agtaatgtgacagtgtcggtta

SEQ ID NO: 1112624 - DNA, 22 bp, Artificial Sequence
  chemically synthesized
tcacgttaataaccgacactgt

SEQ ID NO: 1112625 - DNA, 22 bp, Artificial Sequence
  chemically synthesized
ataaccgacactgtcacattac

SEQ ID NO: 1112626 - DNA, 22 bp, Artificial Sequence
  chemically synthesized
aagagaggtacattaagtaatg

SEQ ID NO: 1112627 - DNA, 22 bp, Artificial Sequence
  chemically synthesized
attgaagagaggtacattaagt

SEQ ID NO: 1112628 - DNA, 22 bp, Artificial Sequence
  chemically synthesized
aattgaagagaggtacattaag

SEQ ID NO: 1112629 - DNA, 22 bp, Artificial Sequence
  chemically synthesized
taattgaagagaggtacattaa

SEQ ID NO: 1112630 - DNA, 22 bp, Artificial Sequence
  chemically synthesized
tcacattacttaatgtacctct

SEQ ID NO: 1112631 - DNA, 22 bp, Artificial Sequence
  chemically synthesized
attttaattgaagagaggtaca

SEQ ID NO: 1112632 - DNA, 22 bp, Artificial Sequence
  chemically synthesized
tcattttaattgaagagaggta

SEQ ID NO: 1112633 - DNA, 22 bp, Artificial Sequence
  chemically synthesized
ctcattttaattgaagagaggt

SEQ ID NO: 1112634 - DNA, 22 bp, Artificial Sequence
  chemically synthesized
cttaatgtacctctcttcaatt

SEQ ID NO: 1112635 - DNA, 22 bp, Artificial Sequence
  chemically synthesized
aatgtacctctcttcaattaaa

SEQ ID NO: 1112636 - DNA, 22 bp, Artificial Sequence
  chemically synthesized
atgtacctctcttcaattaaaa

SEQ ID NO: 1112637 - DNA, 22 bp, Artificial Sequence
  chemically synthesized
aagtaatagcatttctcatttt

SEQ ID NO: 1112638 - DNA, 22 bp, Artificial Sequence
  chemically synthesized
tcttcaattaaaatgagaaatg

SEQ ID NO: 1112639 - DNA, 22 bp, Artificial Sequence
  chemically synthesized
ttcaattaaaatgagaaatgct

SEQ ID NO: 1112640 - DNA, 22 bp, Artificial Sequence
  chemically synthesized
caattaaaatgagaaatgctat

SEQ ID NO: 1112641 - DNA, 22 bp, Artificial Sequence
  chemically synthesized
aattaaaatgagaaatgctatt

SEQ ID NO: 1112642 - DNA, 22 bp, Artificial Sequence
  chemically synthesized
ataaagttgaagtaatagcatt

SEQ ID NO: 1112643 - DNA, 22 bp, Artificial Sequence
  chemically synthesized
aaatgagaaatgctattacttc

SEQ ID NO: 1112644 - DNA, 22 bp, Artificial Sequence
  chemically synthesized
attcataaagttgaagtaatag

SEQ ID NO: 1112645 - DNA, 22 bp, Artificial Sequence
  chemically synthesized
gatggtcaattaattcataaag

SEQ ID NO: 1112646 - DNA, 22 bp, Artificial Sequence
  chemically synthesized
agatggtcaattaattcataaa

SEQ ID NO: 1112647 - DNA, 22 bp, Artificial Sequence
  chemically synthesized
ttacttcaactttatgaattaa

SEQ ID NO: 1112648 - DNA, 22 bp, Artificial Sequence
  chemically synthesized
cttcaactttatgaattaattg

SEQ ID NO: 1112649 - DNA, 22 bp, Artificial Sequence
  chemically synthesized
gcatttagatggtcaattaatt

SEQ ID NO: 1112650 - DNA, 22 bp, Artificial Sequence
  chemically synthesized
caactttatgaattaattgacc

SEQ ID NO: 1112651 - DNA, 22 bp, Artificial Sequence
  chemically synthesized
tggcatttagatggtcaattaa

SEQ ID NO: 1112652 - DNA, 22 bp, Artificial Sequence
  chemically synthesized
aactttatgaattaattgacca

SEQ ID NO: 1112653 - DNA, 22 bp, Artificial Sequence
  chemically synthesized
tatgaattaattgaccatctaa

SEQ ID NO: 1112654 - DNA, 22 bp, Artificial Sequence
  chemically synthesized
atgaattaattgaccatctaaa

SEQ ID NO: 1112655 - DNA, 22 bp, Artificial Sequence
  chemically synthesized
tgaattaattgaccatctaaat

SEQ ID NO: 1112656 - DNA, 22 bp, Artificial Sequence
  chemically synthesized
attgaccatctaaatgccagaa

SEQ ID NO: 1112657 - DNA, 22 bp, Artificial Sequence
  chemically synthesized
gaaaatcaacagtagttctggc

SEQ ID NO: 1112658 - DNA, 22 bp, Artificial Sequence
  chemically synthesized
accatctaaatgccagaactac

SEQ ID NO: 1112659 - DNA, 22 bp, Artificial Sequence
  chemically synthesized
agaaaatcaacagtagttctgg

SEQ ID NO: 1112660 - DNA, 22 bp, Artificial Sequence
  chemically synthesized
ttagaaaatcaacagtagttct

SEQ ID NO: 1112661 - DNA, 22 bp, Artificial Sequence
  chemically synthesized
cttagaaaatcaacagtagttc

SEQ ID NO: 1112662 - DNA, 22 bp, Artificial Sequence
  chemically synthesized
tcttagaaaatcaacagtagtt

SEQ ID NO: 1112663 - DNA, 22 bp, Artificial Sequence
  chemically synthesized
aatgccagaactactgttgatt

SEQ ID NO: 1112664 - DNA, 22 bp, Artificial Sequence
  chemically synthesized
atggactttcttagaaaatcaa

SEQ ID NO: 1112665 - DNA, 22 bp, Artificial Sequence
  chemically synthesized
aatggactttcttagaaaatca

SEQ ID NO: 1112666 - DNA, 22 bp, Artificial Sequence
  chemically synthesized
taatggactttcttagaaaatc

SEQ ID NO: 1112667 - DNA, 22 bp, Artificial Sequence
  chemically synthesized
ctgttgattttctaagaaagtc

SEQ ID NO: 1112668 - DNA, 22 bp, Artificial Sequence
  chemically synthesized
gaaaggttttaatggactttct

SEQ ID NO: 1112669 - DNA, 22 bp, Artificial Sequence
  chemically synthesized
ttgattttctaagaaagtccat

SEQ ID NO: 1112670 - DNA, 22 bp, Artificial Sequence
  chemically synthesized
tagaaaggttttaatggacttt

SEQ ID NO: 1112671 - DNA, 22 bp, Artificial Sequence
  chemically synthesized
attttctaagaaagtccattaa

SEQ ID NO: 1112672 - DNA, 22 bp, Artificial Sequence
  chemically synthesized
attctagaaaggttttaatgga

SEQ ID NO: 1112673 - DNA, 22 bp, Artificial Sequence
  chemically synthesized
cattctagaaaggttttaatgg

SEQ ID NO: 1112674 - DNA, 22 bp, Artificial Sequence
  chemically synthesized
tctaagaaagtccattaaaacc

SEQ ID NO: 1112675 - DNA, 22 bp, Artificial Sequence
  chemically synthesized
tcattctagaaaggttttaatg

SEQ ID NO: 1112676 - DNA, 22 bp, Artificial Sequence
  chemically synthesized
ctaagaaagtccattaaaacct

SEQ ID NO: 1112677 - DNA, 22 bp, Artificial Sequence
  chemically synthesized
ttcattctagaaaggttttaat

SEQ ID NO: 1112678 - DNA, 22 bp, Artificial Sequence
  chemically synthesized
taagaaagtccattaaaacctt

SEQ ID NO: 1112679 - DNA, 22 bp, Artificial Sequence
  chemically synthesized
tttcattctagaaaggttttaa

SEQ ID NO: 1112680 - DNA, 22 bp, Artificial Sequence
  chemically synthesized
agaaagtccattaaaacctttc

SEQ ID NO: 1112681 - DNA, 22 bp, Artificial Sequence
  chemically synthesized
aaccctttttcattctagaaag

SEQ ID NO: 1112682 - DNA, 22 bp, Artificial Sequence
  chemically synthesized
gaaccctttttcattctagaaa

SEQ ID NO: 1112683 - DNA, 22 bp, Artificial Sequence
  chemically synthesized
tgaaccctttttcattctagaa

SEQ ID NO: 1112684 - DNA, 22 bp, Artificial Sequence
  chemically synthesized
aaacctttctagaatgaaaaag

SEQ ID NO: 1112685 - DNA, 22 bp, Artificial Sequence
  chemically synthesized
gataacgctttgaacccttttt

SEQ ID NO: 1112686 - DNA, 22 bp, Artificial Sequence
  chemically synthesized
ggataacgctttgaaccctttt

SEQ ID NO: 1112687 - DNA, 22 bp, Artificial Sequence
  chemically synthesized
tctagaatgaaaaagggttcaa

SEQ ID NO: 1112688 - DNA, 22 bp, Artificial Sequence
  chemically synthesized
ctagaatgaaaaagggttcaaa

SEQ ID NO: 1112689 - DNA, 22 bp, Artificial Sequence
  chemically synthesized
cttggataacgctttgaaccct

SEQ ID NO: 1112690 - DNA, 22 bp, Artificial Sequence
  chemically synthesized
tagaatgaaaaagggttcaaag

SEQ ID NO: 1112691 - DNA, 22 bp, Artificial Sequence
  chemically synthesized
acttggataacgctttgaaccc

SEQ ID NO: 1112692 - DNA, 22 bp, Artificial Sequence
  chemically synthesized
gaatgaaaaagggttcaaagcg

SEQ ID NO: 1112693 - DNA, 22 bp, Artificial Sequence
  chemically synthesized
aaagcgttatccaagtaaatat

SEQ ID NO: 1112694 - DNA, 22 bp, Artificial Sequence
  chemically synthesized
tccaagtaaatatttgcatatg

SEQ ID NO: 1112695 - DNA, 22 bp, Artificial Sequence
  chemically synthesized
tatataataataaaatccatat

SEQ ID NO: 1112696 - DNA, 22 bp, Artificial Sequence
  chemically synthesized
gcatatggattttattattata

SEQ ID NO: 1112697 - DNA, 22 bp, Artificial Sequence
  chemically synthesized
catatggattttattattatat

SEQ ID NO: 1112698 - DNA, 22 bp, Artificial Sequence
  chemically synthesized
tattattatatataattgtttt

SEQ ID NO: 1112699 - DNA, 22 bp, Artificial Sequence
  chemically synthesized
tggaatacatataaaacaatta

SEQ ID NO: 1112700 - DNA, 22 bp, Artificial Sequence
  chemically synthesized
attattatatataattgtttta

SEQ ID NO: 1112701 - DNA, 22 bp, Artificial Sequence
  chemically synthesized
ttattatatataattgttttat

SEQ ID NO: 1112702 - DNA, 22 bp, Artificial Sequence
  chemically synthesized
tatggaatacatataaaacaat

SEQ ID NO: 1112703 - DNA, 22 bp, Artificial Sequence
  chemically synthesized
ttatatataattgttttatatg

SEQ ID NO: 1112704 - DNA, 22 bp, Artificial Sequence
  chemically synthesized
tatataattgttttatatgtat

SEQ ID NO: 1112705 - DNA, 22 bp, Artificial Sequence
  chemically synthesized
ttttatatgtattccatagaat

SEQ ID NO: 1112706 - DNA, 22 bp, Artificial Sequence
  chemically synthesized
agtcaaggagcataattctatg

SEQ ID NO: 1112707 - DNA, 22 bp, Artificial Sequence
  chemically synthesized
tatatgtattccatagaattat

SEQ ID NO: 1112708 - DNA, 22 bp, Artificial Sequence
  chemically synthesized
atatgtattccatagaattatg

SEQ ID NO: 1112709 - DNA, 22 bp, Artificial Sequence
  chemically synthesized
tatgtattccatagaattatgc

SEQ ID NO: 1112710 - DNA, 22 bp, Artificial Sequence
  chemically synthesized
cattgagtcaaggagcataatt

SEQ ID NO: 1112711 - DNA, 22 bp, Artificial Sequence
  chemically synthesized
ccattgagtcaaggagcataat

SEQ ID NO: 1112712 - DNA, 22 bp, Artificial Sequence
  chemically synthesized
tccattgagtcaaggagcataa

SEQ ID NO: 1112713 - DNA, 22 bp, Artificial Sequence
  chemically synthesized
catagaattatgctccttgact

SEQ ID NO: 1112714 - DNA, 22 bp, Artificial Sequence
  chemically synthesized
aaattttccattgagtcaagga

SEQ ID NO: 1112715 - DNA, 22 bp, Artificial Sequence
  chemically synthesized
tgctccttgactcaatggaaaa

SEQ ID NO: 1112716 - DNA, 22 bp, Artificial Sequence
  chemically synthesized
gaaaagttaaaattttccattg

SEQ ID NO: 1112717 - DNA, 22 bp, Artificial Sequence
  chemically synthesized
agaaaagttaaaattttccatt

SEQ ID NO: 1112718 - DNA, 22 bp, Artificial Sequence
  chemically synthesized
ttagaaaagttaaaattttcca

SEQ ID NO: 1112719 - DNA, 22 bp, Artificial Sequence
  chemically synthesized
cttgactcaatggaaaatttta

SEQ ID NO: 1112720 - DNA, 22 bp, Artificial Sequence
  chemically synthesized
gactcaatggaaaattttaact

SEQ ID NO: 1112721 - DNA, 22 bp, Artificial Sequence
  chemically synthesized
actcaatggaaaattttaactt

SEQ ID NO: 1112722 - DNA, 22 bp, Artificial Sequence
  chemically synthesized
caaactcttagaaaagttaaaa

SEQ ID NO: 1112723 - DNA, 22 bp, Artificial Sequence
  chemically synthesized
acaaactcttagaaaagttaaa

SEQ ID NO: 1112724 - DNA, 22 bp, Artificial Sequence
  chemically synthesized
aatggaaaattttaacttttct

SEQ ID NO: 1112725 - DNA, 22 bp, Artificial Sequence
  chemically synthesized
cacttacaaactcttagaaaag

SEQ ID NO: 1112726 - DNA, 22 bp, Artificial Sequence
  chemically synthesized
acacttacaaactcttagaaaa

SEQ ID NO: 1112727 - DNA, 22 bp, Artificial Sequence
  chemically synthesized
taacttttctaagagtttgtaa

SEQ ID NO: 1112728 - DNA, 22 bp, Artificial Sequence
  chemically synthesized
agatatttacacttacaaactc

SEQ ID NO: 1112729 - DNA, 22 bp, Artificial Sequence
  chemically synthesized
aacttttctaagagtttgtaag

SEQ ID NO: 1112730 - DNA, 22 bp, Artificial Sequence
  chemically synthesized
cagatatttacacttacaaact

SEQ ID NO: 1112731 - DNA, 22 bp, Artificial Sequence
  chemically synthesized
acttttctaagagtttgtaagt

SEQ ID NO: 1112732 - DNA, 22 bp, Artificial Sequence
  chemically synthesized
tcagatatttacacttacaaac

SEQ ID NO: 1112733 - DNA, 22 bp, Artificial Sequence
  chemically synthesized
ttcagatatttacacttacaaa

SEQ ID NO: 1112734 - DNA, 22 bp, Artificial Sequence
  chemically synthesized
ttctaagagtttgtaagtgtaa

SEQ ID NO: 1112735 - DNA, 22 bp, Artificial Sequence
  chemically synthesized
tctaagagtttgtaagtgtaaa

SEQ ID NO: 1112736 - DNA, 22 bp, Artificial Sequence
  chemically synthesized
ctaagagtttgtaagtgtaaat

SEQ ID NO: 1112737 - DNA, 22 bp, Artificial Sequence
  chemically synthesized
taagagtttgtaagtgtaaata

SEQ ID NO: 1112738 - DNA, 22 bp, Artificial Sequence
  chemically synthesized
aaacttttcagatatttacact

SEQ ID NO: 1112739 - DNA, 22 bp, Artificial Sequence
  chemically synthesized
aaaacttttcagatatttacac

SEQ ID NO: 1112740 - DNA, 22 bp, Artificial Sequence
  chemically synthesized
agagtttgtaagtgtaaatatc

SEQ ID NO: 1112741 - DNA, 22 bp, Artificial Sequence
  chemically synthesized
atacttaaaacttttcagatat

SEQ ID NO: 1112742 - DNA, 22 bp, Artificial Sequence
  chemically synthesized
gtaagtgtaaatatctgaaaag

SEQ ID NO: 1112743 - DNA, 22 bp, Artificial Sequence
  chemically synthesized
taagtgtaaatatctgaaaagt

SEQ ID NO: 1112744 - DNA, 22 bp, Artificial Sequence
  chemically synthesized
agatgattgatacttaaaactt

SEQ ID NO: 1112745 - DNA, 22 bp, Artificial Sequence
  chemically synthesized
aaaagttttaagtatcaatcat

SEQ ID NO: 1112746 - DNA, 22 bp, Artificial Sequence
  chemically synthesized
gaaaacagatgctcagatgatt

SEQ ID NO: 1112747 - DNA, 22 bp, Artificial Sequence
  chemically synthesized
taagtatcaatcatctgagcat

SEQ ID NO: 1112748 - DNA, 22 bp, Artificial Sequence
  chemically synthesized
aagtatcaatcatctgagcatc

SEQ ID NO: 1112749 - DNA, 22 bp, Artificial Sequence
  chemically synthesized
agtatcaatcatctgagcatct

SEQ ID NO: 1112750 - DNA, 22 bp, Artificial Sequence
  chemically synthesized
acacaaaattagaaaacagatg

SEQ ID NO: 1112751 - DNA, 22 bp, Artificial Sequence
  chemically synthesized
aatagctaacacaaaattagaa

SEQ ID NO: 1112752 - DNA, 22 bp, Artificial Sequence
  chemically synthesized
aaatagctaacacaaaattaga

SEQ ID NO: 1112753 - DNA, 22 bp, Artificial Sequence
  chemically synthesized
agcatctgttttctaattttgt

SEQ ID NO: 1112754 - DNA, 22 bp, Artificial Sequence
  chemically synthesized
ttaaatagctaacacaaaatta

SEQ ID NO: 1112755 - DNA, 22 bp, Artificial Sequence
  chemically synthesized
tattcttaaatagctaacacaa

SEQ ID NO: 1112756 - DNA, 22 bp, Artificial Sequence
  chemically synthesized
gtattcttaaatagctaacaca

SEQ ID NO: 1112757 - DNA, 22 bp, Artificial Sequence
  chemically synthesized
ttttctaattttgtgttagcta

SEQ ID NO: 1112758 - DNA, 22 bp, Artificial Sequence
  chemically synthesized
tctaattttgtgttagctattt

SEQ ID NO: 1112759 - DNA, 22 bp, Artificial Sequence
  chemically synthesized
ctaattttgtgttagctattta

SEQ ID NO: 1112760 - DNA, 22 bp, Artificial Sequence
  chemically synthesized
taattttgtgttagctatttaa

SEQ ID NO: 1112761 - DNA, 22 bp, Artificial Sequence
  chemically synthesized
gtatttgtattcttaaatagct

SEQ ID NO: 1112762 - DNA, 22 bp, Artificial Sequence
  chemically synthesized
attttgtgttagctatttaaga

SEQ ID NO: 1112763 - DNA, 22 bp, Artificial Sequence
  chemically synthesized
tgtgttagctatttaagaatac

SEQ ID NO: 1112764 - DNA, 22 bp, Artificial Sequence
  chemically synthesized
gtgttagctatttaagaataca

SEQ ID NO: 1112765 - DNA, 22 bp, Artificial Sequence
  chemically synthesized
tgttagctatttaagaatacaa

SEQ ID NO: 1112766 - DNA, 22 bp, Artificial Sequence
  chemically synthesized
gtgtgttagtatttgtattctt

SEQ ID NO: 1112767 - DNA, 22 bp, Artificial Sequence
  chemically synthesized
gctatttaagaatacaaatact

SEQ ID NO: 1112768 - DNA, 22 bp, Artificial Sequence
  chemically synthesized
tttaagaatacaaatactaaca

SEQ ID NO: 1112769 - DNA, 22 bp, Artificial Sequence
  chemically synthesized
ataatgcctggtgtgttagtat

SEQ ID NO: 1112770 - DNA, 22 bp, Artificial Sequence
  chemically synthesized
aagaatacaaatactaacacac

SEQ ID NO: 1112771 - DNA, 22 bp, Artificial Sequence
  chemically synthesized
agaatacaaatactaacacacc

SEQ ID NO: 1112772 - DNA, 22 bp, Artificial Sequence
  chemically synthesized
ctcataatgcctggtgtgttag

SEQ ID NO: 1112773 - DNA, 22 bp, Artificial Sequence
  chemically synthesized
cataagtattgctcataatgcc

SEQ ID NO: 1112774 - DNA, 22 bp, Artificial Sequence
  chemically synthesized
ccataagtattgctcataatgc

SEQ ID NO: 1112775 - DNA, 22 bp, Artificial Sequence
  chemically synthesized
acacaccaggcattatgagcaa

SEQ ID NO: 1112776 - DNA, 22 bp, Artificial Sequence
  chemically synthesized
caacaaaatggtttccataagt

SEQ ID NO: 1112777 - DNA, 22 bp, Artificial Sequence
  chemically synthesized
tgagcaatacttatggaaacca

SEQ ID NO: 1112778 - DNA, 22 bp, Artificial Sequence
  chemically synthesized
atgtgctacaacaaaatggttt

SEQ ID NO: 1112779 - DNA, 22 bp, Artificial Sequence
  chemically synthesized
taatgtgctacaacaaaatggt

SEQ ID NO: 1112780 - DNA, 22 bp, Artificial Sequence
  chemically synthesized
atggaaaccattttgttgtagc

SEQ ID NO: 1112781 - DNA, 22 bp, Artificial Sequence
  chemically synthesized
agattctaatgtgctacaacaa

SEQ ID NO: 1112782 - DNA, 22 bp, Artificial Sequence
  chemically synthesized
tggaaaccattttgttgtagca

SEQ ID NO: 1112783 - DNA, 22 bp, Artificial Sequence
  chemically synthesized
tccctgagattctaatgtgcta

SEQ ID NO: 1112784 - DNA, 22 bp, Artificial Sequence
  chemically synthesized
tgttgtagcacattagaatctc

SEQ ID NO: 1112785 - DNA, 22 bp, Artificial Sequence
  chemically synthesized
gttgtagcacattagaatctca

SEQ ID NO: 1112786 - DNA, 22 bp, Artificial Sequence
  chemically synthesized
ttgtagcacattagaatctcag

SEQ ID NO: 1112787 - DNA, 22 bp, Artificial Sequence
  chemically synthesized
tgatccattatccctgagattc

SEQ ID NO: 1112788 - DNA, 22 bp, Artificial Sequence
  chemically synthesized
tagcacattagaatctcaggga

SEQ ID NO: 1112789 - DNA, 22 bp, Artificial Sequence
  chemically synthesized
gaatctcagggataatggatca

SEQ ID NO: 1112790 - DNA, 22 bp, Artificial Sequence
  chemically synthesized
agggataatggatcataatcca

SEQ ID NO: 1112791 - DNA, 22 bp, Artificial Sequence
  chemically synthesized
gaatatgagatgtgaatggatt

SEQ ID NO: 1112792 - DNA, 22 bp, Artificial Sequence
  chemically synthesized
agaatatgagatgtgaatggat

SEQ ID NO: 1112793 - DNA, 22 bp, Artificial Sequence
  chemically synthesized
tttagaatatgagatgtgaatg

SEQ ID NO: 1112794 - DNA, 22 bp, Artificial Sequence
  chemically synthesized
aggggttgtttagaatatgaga

SEQ ID NO: 1112795 - DNA, 22 bp, Artificial Sequence
  chemically synthesized
caggggttgtttagaatatgag

SEQ ID NO: 1112796 - DNA, 22 bp, Artificial Sequence
  chemically synthesized
tttcaggggttgtttagaatat

SEQ ID NO: 1112797 - DNA, 22 bp, Artificial Sequence
  chemically synthesized
acatctcatattctaaacaacc

SEQ ID NO: 1112798 - DNA, 22 bp, Artificial Sequence
  chemically synthesized
acagactatttcaggggttgtt

SEQ ID NO: 1112799 - DNA, 22 bp, Artificial Sequence
  chemically synthesized
ttcacagactatttcaggggtt

SEQ ID NO: 1112800 - DNA, 22 bp, Artificial Sequence
  chemically synthesized
atattctaaacaacccctgaaa

SEQ ID NO: 1112801 - DNA, 22 bp, Artificial Sequence
  chemically synthesized
attcacagactatttcaggggt

SEQ ID NO: 1112802 - DNA, 22 bp, Artificial Sequence
  chemically synthesized
taaacaacccctgaaatagtct

SEQ ID NO: 1112803 - DNA, 22 bp, Artificial Sequence
  chemically synthesized
aacaacccctgaaatagtctgt

SEQ ID NO: 1112804 - DNA, 22 bp, Artificial Sequence
  chemically synthesized
ggtgcaatatatttattcacag

SEQ ID NO: 1112805 - DNA, 22 bp, Artificial Sequence
  chemically synthesized
tgggtgcaatatatttattcac

SEQ ID NO: 1112806 - DNA, 22 bp, Artificial Sequence
  chemically synthesized
aaatagtctgtgaataaatata

SEQ ID NO: 1112807 - DNA, 22 bp, Artificial Sequence
  chemically synthesized
ctctgggtgcaatatatttatt

SEQ ID NO: 1112808 - DNA, 22 bp, Artificial Sequence
  chemically synthesized
cctctgggtgcaatatatttat

SEQ ID NO: 1112809 - DNA, 22 bp, Artificial Sequence
  chemically synthesized
tgaataaatatattgcacccag

SEQ ID NO: 1112810 - DNA, 22 bp, Artificial Sequence
  chemically synthesized
aagtaatgatccatttcctctg

SEQ ID NO: 1112811 - DNA, 22 bp, Artificial Sequence
  chemically synthesized
caagtaatgatccatttcctct

SEQ ID NO: 1112812 - DNA, 22 bp, Artificial Sequence
  chemically synthesized
cacccagaggaaatggatcatt

SEQ ID NO: 1112813 - DNA, 22 bp, Artificial Sequence
  chemically synthesized
atggatacacttcaagtaatga

SEQ ID NO: 1112814 - DNA, 22 bp, Artificial Sequence
  chemically synthesized
cttgaagtgtatccattaattt

SEQ ID NO: 1112815 - DNA, 22 bp, Artificial Sequence
  chemically synthesized
tacacaagtaataaaattaatg

SEQ ID NO: 1112816 - DNA, 22 bp, Artificial Sequence
  chemically synthesized
gaagtgtatccattaattttat

SEQ ID NO: 1112817 - DNA, 22 bp, Artificial Sequence
  chemically synthesized
aagtgtatccattaattttatt

SEQ ID NO: 1112818 - DNA, 22 bp, Artificial Sequence
  chemically synthesized
tgcactgtacacaagtaataaa

SEQ ID NO: 1112819 - DNA, 22 bp, Artificial Sequence
  chemically synthesized
ttatgcactgtacacaagtaat

SEQ ID NO: 1112820 - DNA, 22 bp, Artificial Sequence
  chemically synthesized
attttattacttgtgtacagtg

SEQ ID NO: 1112821 - DNA, 22 bp, Artificial Sequence
  chemically synthesized
acagtctgttatgcactgtaca

SEQ ID NO: 1112822 - DNA, 22 bp, Artificial Sequence
  chemically synthesized
taacagtctgttatgcactgta

SEQ ID NO: 1112823 - DNA, 22 bp, Artificial Sequence
  chemically synthesized
tattacttgtgtacagtgcata

SEQ ID NO: 1112824 - DNA, 22 bp, Artificial Sequence
  chemically synthesized
attacttgtgtacagtgcataa

SEQ ID NO: 1112825 - DNA, 22 bp, Artificial Sequence
  chemically synthesized
ttacttgtgtacagtgcataac

SEQ ID NO: 1112826 - DNA, 22 bp, Artificial Sequence
  chemically synthesized
ttctaacagtctgttatgcact

SEQ ID NO: 1112827 - DNA, 22 bp, Artificial Sequence
  chemically synthesized
cttgtgtacagtgcataacaga

SEQ ID NO: 1112828 - DNA, 22 bp, Artificial Sequence
  chemically synthesized
gtgtacagtgcataacagactg

SEQ ID NO: 1112829 - DNA, 22 bp, Artificial Sequence
  chemically synthesized
acattattctaacagtctgtta

SEQ ID NO: 1112830 - DNA, 22 bp, Artificial Sequence
  chemically synthesized
tgtacagtgcataacagactgt

SEQ ID NO: 1112831 - DNA, 22 bp, Artificial Sequence
  chemically synthesized
aacattattctaacagtctgtt

SEQ ID NO: 1112832 - DNA, 22 bp, Artificial Sequence
  chemically synthesized
ttagaataatgttaaatgtgca

SEQ ID NO: 1112833 - DNA, 22 bp, Artificial Sequence
  chemically synthesized
catggaaggtggtgcacattta

SEQ ID NO: 1112834 - DNA, 22 bp, Artificial Sequence
  chemically synthesized
gcatggaaggtggtgcacattt

SEQ ID NO: 1112835 - DNA, 22 bp, Artificial Sequence
  chemically synthesized
gaataatgttaaatgtgcacca

SEQ ID NO: 1112836 - DNA, 22 bp, Artificial Sequence
  chemically synthesized
aagtacttgcatggaaggtggt

SEQ ID NO: 1112837 - DNA, 22 bp, Artificial Sequence
  chemically synthesized
tgaagtacttgcatggaaggtg

SEQ ID NO: 1112838 - DNA, 22 bp, Artificial Sequence
  chemically synthesized
aatgtgcaccaccttccatgca

SEQ ID NO: 1112839 - DNA, 22 bp, Artificial Sequence
  chemically synthesized
agtggcagttctgaagtacttg

SEQ ID NO: 1112840 - DNA, 22 bp, Artificial Sequence
  chemically synthesized
aagtggcagttctgaagtactt

SEQ ID NO: 1112841 - DNA, 22 bp, Artificial Sequence
  chemically synthesized
taagtggcagttctgaagtact

SEQ ID NO: 1112842 - DNA, 22 bp, Artificial Sequence
  chemically synthesized
actttaagtggcagttctgaag

SEQ ID NO: 1112843 - DNA, 22 bp, Artificial Sequence
  chemically synthesized
ccatgcaagtacttcagaactg

SEQ ID NO: 1112844 - DNA, 22 bp, Artificial Sequence
  chemically synthesized
cactttaagtggcagttctgaa

SEQ ID NO: 1112845 - DNA, 22 bp, Artificial Sequence
  chemically synthesized
catgcaagtacttcagaactgc

SEQ ID NO: 1112846 - DNA, 22 bp, Artificial Sequence
  chemically synthesized
atgaggaatacttcactttaag

SEQ ID NO: 1112847 - DNA, 22 bp, Artificial Sequence
  chemically synthesized
cagaactgccacttaaagtgaa

SEQ ID NO: 1112848 - DNA, 22 bp, Artificial Sequence
  chemically synthesized
gatgaggaatacttcactttaa

SEQ ID NO: 1112849 - DNA, 22 bp, Artificial Sequence
  chemically synthesized
agaactgccacttaaagtgaag

SEQ ID NO: 1112850 - DNA, 22 bp, Artificial Sequence
  chemically synthesized
ccacttaaagtgaagtattcct

SEQ ID NO: 1112851 - DNA, 22 bp, Artificial Sequence
  chemically synthesized
aaagtgaagtattcctcatcaa

SEQ ID NO: 1112852 - DNA, 22 bp, Artificial Sequence
  chemically synthesized
aagtgaagtattcctcatcaag

SEQ ID NO: 1112853 - DNA, 22 bp, Artificial Sequence
  chemically synthesized
atgatgaatatacttgatgagg

SEQ ID NO: 1112854 - DNA, 22 bp, Artificial Sequence
  chemically synthesized
atggctaatgatgaatatactt

SEQ ID NO: 1112855 - DNA, 22 bp, Artificial Sequence
  chemically synthesized
catggctaatgatgaatatact

SEQ ID NO: 1112856 - DNA, 22 bp, Artificial Sequence
  chemically synthesized
gcttcatggctaatgatgaata

SEQ ID NO: 1112857 - DNA, 22 bp, Artificial Sequence
  chemically synthesized
ctcatcaagtatattcatcatt

SEQ ID NO: 1112858 - DNA, 22 bp, Artificial Sequence
  chemically synthesized
atcaagtatattcatcattagc

SEQ ID NO: 1112859 - DNA, 22 bp, Artificial Sequence
  chemically synthesized
ccctggcttcatggctaatgat

SEQ ID NO: 1112860 - DNA, 22 bp, Artificial Sequence
  chemically synthesized
taccctggcttcatggctaatg

SEQ ID NO: 1112861 - DNA, 22 bp, Artificial Sequence
  chemically synthesized
ttctaccctggcttcatggcta

SEQ ID NO: 1112862 - DNA, 22 bp, Artificial Sequence
  chemically synthesized
tgttattctaccctggcttcat

SEQ ID NO: 1112863 - DNA, 22 bp, Artificial Sequence
  chemically synthesized
gtgttattctaccctggcttca

SEQ ID NO: 1112864 - DNA, 22 bp, Artificial Sequence
  chemically synthesized
atcattagccatgaagccaggg

SEQ ID NO: 1112865 - DNA, 22 bp, Artificial Sequence
  chemically synthesized
tgtgttattctaccctggcttc

SEQ ID NO: 1112866 - DNA, 22 bp, Artificial Sequence
  chemically synthesized
ttttgtgttattctaccctggc

SEQ ID NO: 1112867 - DNA, 22 bp, Artificial Sequence
  chemically synthesized
gttttgtgttattctaccctgg

SEQ ID NO: 1112868 - DNA, 22 bp, Artificial Sequence
  chemically synthesized
gccatgaagccagggtagaata

SEQ ID NO: 1112869 - DNA, 22 bp, Artificial Sequence
  chemically synthesized
gaaacacttgttttgtgttatt

SEQ ID NO: 1112870 - DNA, 22 bp, Artificial Sequence
  chemically synthesized
tggaaacacttgttttgtgtta

SEQ ID NO: 1112871 - DNA, 22 bp, Artificial Sequence
  chemically synthesized
aagagctctggaaacacttgtt

SEQ ID NO: 1112872 - DNA, 22 bp, Artificial Sequence
  chemically synthesized
attcaagagctctggaaacact

SEQ ID NO: 1112873 - DNA, 22 bp, Artificial Sequence
  chemically synthesized
aattcaagagctctggaaacac

SEQ ID NO: 1112874 - DNA, 22 bp, Artificial Sequence
  chemically synthesized
taattcaagagctctggaaaca

SEQ ID NO: 1112875 - DNA, 22 bp, Artificial Sequence
  chemically synthesized
ttaattcaagagctctggaaac

SEQ ID NO: 1112876 - DNA, 22 bp, Artificial Sequence
  chemically synthesized
ttttaattcaagagctctggaa

SEQ ID NO: 1112877 - DNA, 22 bp, Artificial Sequence
  chemically synthesized
caaatattcttttaattcaaga

SEQ ID NO: 1112878 - DNA, 22 bp, Artificial Sequence
  chemically synthesized
ttccaaatattcttttaattca

SEQ ID NO: 1112879 - DNA, 22 bp, Artificial Sequence
  chemically synthesized
ccagagctcttgaattaaaaga

SEQ ID NO: 1112880 - DNA, 22 bp, Artificial Sequence
  chemically synthesized
tattccaaatattcttttaatt

SEQ ID NO: 1112881 - DNA, 22 bp, Artificial Sequence
  chemically synthesized
cagagctcttgaattaaaagaa

SEQ ID NO: 1112882 - DNA, 22 bp, Artificial Sequence
  chemically synthesized
ctattccaaatattcttttaat

SEQ ID NO: 1112883 - DNA, 22 bp, Artificial Sequence
  chemically synthesized
agtttctattccaaatattctt

SEQ ID NO: 1112884 - DNA, 22 bp, Artificial Sequence
  chemically synthesized
aagtttctattccaaatattct

SEQ ID NO: 1112885 - DNA, 22 bp, Artificial Sequence
  chemically synthesized
taagtttctattccaaatattc

SEQ ID NO: 1112886 - DNA, 22 bp, Artificial Sequence
  chemically synthesized
ttgaattaaaagaatatttgga

SEQ ID NO: 1112887 - DNA, 22 bp, Artificial Sequence
  chemically synthesized
gaattaaaagaatatttggaat

SEQ ID NO: 1112888 - DNA, 22 bp, Artificial Sequence
  chemically synthesized
ttttaagtttctattccaaata

SEQ ID NO: 1112889 - DNA, 22 bp, Artificial Sequence
  chemically synthesized
aattaaaagaatatttggaata

SEQ ID NO: 1112890 - DNA, 22 bp, Artificial Sequence
  chemically synthesized
attttaagtttctattccaaat

SEQ ID NO: 1112891 - DNA, 22 bp, Artificial Sequence
  chemically synthesized
tattttaagtttctattccaaa

SEQ ID NO: 1112892 - DNA, 22 bp, Artificial Sequence
  chemically synthesized
aaagaatatttggaatagaaac

SEQ ID NO: 1112893 - DNA, 22 bp, Artificial Sequence
  chemically synthesized
gcagctttattttaagtttcta

SEQ ID NO: 1112894 - DNA, 22 bp, Artificial Sequence
  chemically synthesized
ttagcagctttattttaagttt

SEQ ID NO: 1112895 - DNA, 22 bp, Artificial Sequence
  chemically synthesized
attagcagctttattttaagtt

SEQ ID NO: 1112896 - DNA, 22 bp, Artificial Sequence
  chemically synthesized
tttattagcagctttattttaa

SEQ ID NO: 1112897 - DNA, 22 bp, Artificial Sequence
  chemically synthesized
ggaatagaaacttaaaataaag

SEQ ID NO: 1112898 - DNA, 22 bp, Artificial Sequence
  chemically synthesized
gaatagaaacttaaaataaagc

SEQ ID NO: 1112899 - DNA, 22 bp, Artificial Sequence
  chemically synthesized
aaaataaagctgctaataaaca

SEQ ID NO: 1112900 - DNA, 22 bp, Artificial Sequence
  chemically synthesized
aaataaagctgctaataaacag

SEQ ID NO: 1112901 - DNA, 22 bp, Artificial Sequence
  chemically synthesized
agcaaaaataggagactgttta

SEQ ID NO: 1112902 - DNA, 22 bp, Artificial Sequence
  chemically synthesized
aagttcagcaaaaataggagac

SEQ ID NO: 1112903 - DNA, 22 bp, Artificial Sequence
  chemically synthesized
aaagttcagcaaaaataggaga

SEQ ID NO: 1112904 - DNA, 22 bp, Artificial Sequence
  chemically synthesized
ctaataaacagtctcctatttt

SEQ ID NO: 1112905 - DNA, 22 bp, Artificial Sequence
  chemically synthesized
ataaacagtctcctatttttgc

SEQ ID NO: 1112906 - DNA, 22 bp, Artificial Sequence
  chemically synthesized
acttaaagttcagcaaaaatag

SEQ ID NO: 1112907 - DNA, 22 bp, Artificial Sequence
  chemically synthesized
taataaccctcacttaaagttc

SEQ ID NO: 1112908 - DNA, 22 bp, Artificial Sequence
  chemically synthesized
ctatttttgctgaactttaagt

SEQ ID NO: 1112909 - DNA, 22 bp, Artificial Sequence
  chemically synthesized
gtaataaccctcacttaaagtt

SEQ ID NO: 1112910 - DNA, 22 bp, Artificial Sequence
  chemically synthesized
tttttgctgaactttaagtgag

SEQ ID NO: 1112911 - DNA, 22 bp, Artificial Sequence
  chemically synthesized
ttgctgaactttaagtgagggt

SEQ ID NO: 1112912 - DNA, 22 bp, Artificial Sequence
  chemically synthesized
tgctgaactttaagtgagggtt

SEQ ID NO: 1112913 - DNA, 22 bp, Artificial Sequence
  chemically synthesized
gctgaactttaagtgagggtta

SEQ ID NO: 1112914 - DNA, 22 bp, Artificial Sequence
  chemically synthesized
ctgaactttaagtgagggttat

SEQ ID NO: 1112915 - DNA, 22 bp, Artificial Sequence
  chemically synthesized
aatggacttgtaataaccctca

SEQ ID NO: 1112916 - DNA, 22 bp, Artificial Sequence
  chemically synthesized
aactttaagtgagggttattac

SEQ ID NO: 1112917 - DNA, 22 bp, Artificial Sequence
  chemically synthesized
aatgctaaatggacttgtaata

SEQ ID NO: 1112918 - DNA, 22 bp, Artificial Sequence
  chemically synthesized
taagtgagggttattacaagtc

SEQ ID NO: 1112919 - DNA, 22 bp, Artificial Sequence
  chemically synthesized
aagtgagggttattacaagtcc

SEQ ID NO: 1112920 - DNA, 22 bp, Artificial Sequence
  chemically synthesized
agtgagggttattacaagtcca

SEQ ID NO: 1112921 - DNA, 22 bp, Artificial Sequence
  chemically synthesized
cattgaatgctaaatggacttg

SEQ ID NO: 1112922 - DNA, 22 bp, Artificial Sequence
  chemically synthesized
ttacattgaatgctaaatggac

SEQ ID NO: 1112923 - DNA, 22 bp, Artificial Sequence
  chemically synthesized
gactattacattgaatgctaaa

SEQ ID NO: 1112924 - DNA, 22 bp, Artificial Sequence
  chemically synthesized
ttacaagtccatttagcattca

SEQ ID NO: 1112925 - DNA, 22 bp, Artificial Sequence
  chemically synthesized
agactattacattgaatgctaa

SEQ ID NO: 1112926 - DNA, 22 bp, Artificial Sequence
  chemically synthesized
tagactattacattgaatgcta

SEQ ID NO: 1112927 - DNA, 22 bp, Artificial Sequence
  chemically synthesized
caagtccatttagcattcaatg

SEQ ID NO: 1112928 - DNA, 22 bp, Artificial Sequence
  chemically synthesized
cattttagactattacattgaa

SEQ ID NO: 1112929 - DNA, 22 bp, Artificial Sequence
  chemically synthesized
tattacattttagactattaca

SEQ ID NO: 1112930 - DNA, 22 bp, Artificial Sequence
  chemically synthesized
tatattacattttagactatta

SEQ ID NO: 1112931 - DNA, 22 bp, Artificial Sequence
  chemically synthesized
agcattcaatgtaatagtctaa

SEQ ID NO: 1112932 - DNA, 22 bp, Artificial Sequence
  chemically synthesized
gcattcaatgtaatagtctaaa

SEQ ID NO: 1112933 - DNA, 22 bp, Artificial Sequence
  chemically synthesized
aatgtaatagtctaaaatgtaa

SEQ ID NO: 1112934 - DNA, 22 bp, Artificial Sequence
  chemically synthesized
aatatctctatattacatttta

SEQ ID NO: 1112935 - DNA, 22 bp, Artificial Sequence
  chemically synthesized
gaatatctctatattacatttt

SEQ ID NO: 1112936 - DNA, 22 bp, Artificial Sequence
  chemically synthesized
tgaatatctctatattacattt

SEQ ID NO: 1112937 - DNA, 22 bp, Artificial Sequence
  chemically synthesized
acaggttttgaatatctctata

SEQ ID NO: 1112938 - DNA, 22 bp, Artificial Sequence
  chemically synthesized
cacaggttttgaatatctctat

SEQ ID NO: 1112939 - DNA, 22 bp, Artificial Sequence
  chemically synthesized
aaatgtaatatagagatattca

SEQ ID NO: 1112940 - DNA, 22 bp, Artificial Sequence
  chemically synthesized
tcttcacaggttttgaatatct

SEQ ID NO: 1112941 - DNA, 22 bp, Artificial Sequence
  chemically synthesized
gtcttcacaggttttgaatatc

SEQ ID NO: 1112942 - DNA, 22 bp, Artificial Sequence
  chemically synthesized
agaacttgtcttcacaggtttt

SEQ ID NO: 1112943 - DNA, 22 bp, Artificial Sequence
  chemically synthesized
gcctcagaacttgtcttcacag

SEQ ID NO: 1112944 - DNA, 22 bp, Artificial Sequence
  chemically synthesized
agcctcagaacttgtcttcaca

SEQ ID NO: 1112945 - DNA, 22 bp, Artificial Sequence
  chemically synthesized
aaaacctgtgaagacaagttct

SEQ ID NO: 1112946 - DNA, 22 bp, Artificial Sequence
  chemically synthesized
aaatttagcctcagaacttgtc

SEQ ID NO: 1112947 - DNA, 22 bp, Artificial Sequence
  chemically synthesized
taaaatttagcctcagaacttg

SEQ ID NO: 1112948 - DNA, 22 bp, Artificial Sequence
  chemically synthesized
tgaagacaagttctgaggctaa

SEQ ID NO: 1112949 - DNA, 22 bp, Artificial Sequence
  chemically synthesized
tgaggctaaattttagaggttt

SEQ ID NO: 1112950 - DNA, 22 bp, Artificial Sequence
  chemically synthesized
aggctaaattttagaggtttct

SEQ ID NO: 1112951 - DNA, 22 bp, Artificial Sequence
  chemically synthesized
agtcagtgtggtcacagaaacc

SEQ ID NO: 1112952 - DNA, 22 bp, Artificial Sequence
  chemically synthesized
aagtcagtgtggtcacagaaac

SEQ ID NO: 1112953 - DNA, 22 bp, Artificial Sequence
  chemically synthesized
taagtcagtgtggtcacagaaa

SEQ ID NO: 1112954 - DNA, 22 bp, Artificial Sequence
  chemically synthesized
aattttagaggtttctgtgacc

SEQ ID NO: 1112955 - DNA, 22 bp, Artificial Sequence
  chemically synthesized
ctttaagtcagtgtggtcacag

SEQ ID NO: 1112956 - DNA, 22 bp, Artificial Sequence
  chemically synthesized
tagaggtttctgtgaccacact

SEQ ID NO: 1112957 - DNA, 22 bp, Artificial Sequence
  chemically synthesized
ttactttaagtcagtgtggtca

SEQ ID NO: 1112958 - DNA, 22 bp, Artificial Sequence
  chemically synthesized
agaggtttctgtgaccacactg

SEQ ID NO: 1112959 - DNA, 22 bp, Artificial Sequence
  chemically synthesized
gaggtttctgtgaccacactga

SEQ ID NO: 1112960 - DNA, 22 bp, Artificial Sequence
  chemically synthesized
aaagctattactttaagtcagt

SEQ ID NO: 1112961 - DNA, 22 bp, Artificial Sequence
  chemically synthesized
aaaagctattactttaagtcag

SEQ ID NO: 1112962 - DNA, 22 bp, Artificial Sequence
  chemically synthesized
ctgtgaccacactgacttaaag

SEQ ID NO: 1112963 - DNA, 22 bp, Artificial Sequence
  chemically synthesized
taaaagctattactttaagtca

SEQ ID NO: 1112964 - DNA, 22 bp, Artificial Sequence
  chemically synthesized
tgtgaccacactgacttaaagt

SEQ ID NO: 1112965 - DNA, 22 bp, Artificial Sequence
  chemically synthesized
ttaaaagctattactttaagtc

SEQ ID NO: 1112966 - DNA, 22 bp, Artificial Sequence
  chemically synthesized
tgaccacactgacttaaagtaa

SEQ ID NO: 1112967 - DNA, 22 bp, Artificial Sequence
  chemically synthesized
atttttaaaagctattacttta

SEQ ID NO: 1112968 - DNA, 22 bp, Artificial Sequence
  chemically synthesized
ttaatttttaaaagctattact

SEQ ID NO: 1112969 - DNA, 22 bp, Artificial Sequence
  chemically synthesized
acttaaagtaatagcttttaaa

SEQ ID NO: 1112970 - DNA, 22 bp, Artificial Sequence
  chemically synthesized
tatatactattaatttttaaaa

SEQ ID NO: 1112971 - DNA, 22 bp, Artificial Sequence
  chemically synthesized
aaagtaatagcttttaaaaatt

SEQ ID NO: 1112972 - DNA, 22 bp, Artificial Sequence
  chemically synthesized
atatatactattaatttttaaa

SEQ ID NO: 1112973 - DNA, 22 bp, Artificial Sequence
  chemically synthesized
aagtaatagcttttaaaaatta

SEQ ID NO: 1112974 - DNA, 22 bp, Artificial Sequence
  chemically synthesized
tatatatactattaatttttaa

SEQ ID NO: 1112975 - DNA, 22 bp, Artificial Sequence
  chemically synthesized
ttatatatactattaattttta

SEQ ID NO: 1112976 - DNA, 22 bp, Artificial Sequence
  chemically synthesized
cttttatatatactattaattt

SEQ ID NO: 1112977 - DNA, 22 bp, Artificial Sequence
  chemically synthesized
ttaaaaattaatagtatatata

SEQ ID NO: 1112978 - DNA, 22 bp, Artificial Sequence
  chemically synthesized
taaaaattaatagtatatataa

SEQ ID NO: 1112979 - DNA, 22 bp, Artificial Sequence
  chemically synthesized
ggggtattacttttatatatac

SEQ ID NO: 1112980 - DNA, 22 bp, Artificial Sequence
  chemically synthesized
aaaaattaatagtatatataaa

SEQ ID NO: 1112981 - DNA, 22 bp, Artificial Sequence
  chemically synthesized
aaaattaatagtatatataaaa

SEQ ID NO: 1112982 - DNA, 22 bp, Artificial Sequence
  chemically synthesized
actaggggtattacttttatat

SEQ ID NO: 1112983 - DNA, 22 bp, Artificial Sequence
  chemically synthesized
atagtatatataaaagtaatac

SEQ ID NO: 1112984 - DNA, 22 bp, Artificial Sequence
  chemically synthesized
ccctcactaggggtattacttt

SEQ ID NO: 1112985 - DNA, 22 bp, Artificial Sequence
  chemically synthesized
tattgccctcactaggggtatt

SEQ ID NO: 1112986 - DNA, 22 bp, Artificial Sequence
  chemically synthesized
atattgccctcactaggggtat

SEQ ID NO: 1112987 - DNA, 22 bp, Artificial Sequence
  chemically synthesized
gtaaaatttatattgccctcac

SEQ ID NO: 1112988 - DNA, 22 bp, Artificial Sequence
  chemically synthesized
tattagtaaaatttatattgcc

SEQ ID NO: 1112989 - DNA, 22 bp, Artificial Sequence
  chemically synthesized
gtgagggcaatataaattttac

SEQ ID NO: 1112990 - DNA, 22 bp, Artificial Sequence
  chemically synthesized
aaaataaaaacgcaaaagggct

SEQ ID NO: 1112991 - DNA, 22 bp, Artificial Sequence
  chemically synthesized
gaaaataaaaacgcaaaagggc

SEQ ID NO: 1112992 - DNA, 22 bp, Artificial Sequence
  chemically synthesized
tactaatatagcccttttgcgt

SEQ ID NO: 1112993 - DNA, 22 bp, Artificial Sequence
  chemically synthesized
actaatatagcccttttgcgtt

SEQ ID NO: 1112994 - DNA, 22 bp, Artificial Sequence
  chemically synthesized
ctaatatagcccttttgcgttt

SEQ ID NO: 1112995 - DNA, 22 bp, Artificial Sequence
  chemically synthesized
atatagcccttttgcgttttta

SEQ ID NO: 1112996 - DNA, 22 bp, Artificial Sequence
  chemically synthesized
tgatgtttgaaaataaaaacgc

SEQ ID NO: 1112997 - DNA, 22 bp, Artificial Sequence
  chemically synthesized
atgatgtttgaaaataaaaacg

SEQ ID NO: 1112998 - DNA, 22 bp, Artificial Sequence
  chemically synthesized
tatgatgtttgaaaataaaaac

SEQ ID NO: 1112999 - DNA, 22 bp, Artificial Sequence
  chemically synthesized
attttatgatgtttgaaaataa

SEQ ID NO: 1113000 - DNA, 22 bp, Artificial Sequence
  chemically synthesized
aattttatgatgtttgaaaata

SEQ ID NO: 1113001 - DNA, 22 bp, Artificial Sequence
  chemically synthesized
taattttatgatgtttgaaaat

SEQ ID NO: 1113002 - DNA, 22 bp, Artificial Sequence
  chemically synthesized
ttaattttatgatgtttgaaaa

SEQ ID NO: 1113003 - DNA, 22 bp, Artificial Sequence
  chemically synthesized
ttgcgtttttattttcaaacat

SEQ ID NO: 1113004 - DNA, 22 bp, Artificial Sequence
  chemically synthesized
tttaattttatgatgtttgaaa

SEQ ID NO: 1113005 - DNA, 22 bp, Artificial Sequence
  chemically synthesized
tgcgtttttattttcaaacatc

SEQ ID NO: 1113006 - DNA, 22 bp, Artificial Sequence
  chemically synthesized
ttttaattttatgatgtttgaa

SEQ ID NO: 1113007 - DNA, 22 bp, Artificial Sequence
  chemically synthesized
gcgtttttattttcaaacatca

SEQ ID NO: 1113008 - DNA, 22 bp, Artificial Sequence
  chemically synthesized
tttttaattttatgatgtttga

SEQ ID NO: 1113009 - DNA, 22 bp, Artificial Sequence
  chemically synthesized
cgtttttattttcaaacatcat

SEQ ID NO: 1113010 - DNA, 22 bp, Artificial Sequence
  chemically synthesized
actttttttaattttatgatgt

SEQ ID NO: 1113011 - DNA, 22 bp, Artificial Sequence
  chemically synthesized
ttattttcaaacatcataaaat

SEQ ID NO: 1113012 - DNA, 22 bp, Artificial Sequence
  chemically synthesized
tattttcaaacatcataaaatt

SEQ ID NO: 1113013 - DNA, 22 bp, Artificial Sequence
  chemically synthesized
attttcaaacatcataaaatta

SEQ ID NO: 1113014 - DNA, 22 bp, Artificial Sequence
  chemically synthesized
ttttcaaacatcataaaattaa

SEQ ID NO: 1113015 - DNA, 22 bp, Artificial Sequence
  chemically synthesized
tcaaacatcataaaattaaaaa

SEQ ID NO: 1113016 - DNA, 22 bp, Artificial Sequence
  chemically synthesized
caaacatcataaaattaaaaaa

SEQ ID NO: 1113017 - DNA, 22 bp, Artificial Sequence
  chemically synthesized
aaacatcataaaattaaaaaaa

SEQ ID NO: 1113018 - DNA, 22 bp, Artificial Sequence
  chemically synthesized
aaaaaagtcagatttttactca

SEQ ID NO: 1113019 - DNA, 22 bp, Artificial Sequence
  chemically synthesized
tgggaaatgagtggccaaaaca

SEQ ID NO: 1113020 - DNA, 22 bp, Artificial Sequence
  chemically synthesized
ttactcatatttgttttggcca

SEQ ID NO: 1113021 - DNA, 22 bp, Artificial Sequence
  chemically synthesized
tactcatatttgttttggccac

SEQ ID NO: 1113022 - DNA, 22 bp, Artificial Sequence
  chemically synthesized
actcatatttgttttggccact

SEQ ID NO: 1113023 - DNA, 22 bp, Artificial Sequence
  chemically synthesized
ttgtgggaaatgagtggccaaa

SEQ ID NO: 1113024 - DNA, 22 bp, Artificial Sequence
  chemically synthesized
ctcatatttgttttggccactc

SEQ ID NO: 1113025 - DNA, 22 bp, Artificial Sequence
  chemically synthesized
ttgttgtgggaaatgagtggcc

SEQ ID NO: 1113026 - DNA, 22 bp, Artificial Sequence
  chemically synthesized
atatttgttttggccactcatt

SEQ ID NO: 1113027 - DNA, 22 bp, Artificial Sequence
  chemically synthesized
tcactgttgttgtgggaaatga

SEQ ID NO: 1113028 - DNA, 22 bp, Artificial Sequence
  chemically synthesized
gttttggccactcatttcccac

SEQ ID NO: 1113029 - DNA, 22 bp, Artificial Sequence
  chemically synthesized
ttttggccactcatttcccaca

SEQ ID NO: 1113030 - DNA, 22 bp, Artificial Sequence
  chemically synthesized
ttgtcactgttgttgtgggaaa

SEQ ID NO: 1113031 - DNA, 22 bp, Artificial Sequence
  chemically synthesized
tggccactcatttcccacaaca

SEQ ID NO: 1113032 - DNA, 22 bp, Artificial Sequence
  chemically synthesized
ggccactcatttcccacaacaa

SEQ ID NO: 1113033 - DNA, 22 bp, Artificial Sequence
  chemically synthesized
ttgttgtcactgttgttgtggg

SEQ ID NO: 1113034 - DNA, 22 bp, Artificial Sequence
  chemically synthesized
gccactcatttcccacaacaac

SEQ ID NO: 1113035 - DNA, 22 bp, Artificial Sequence
  chemically synthesized
atttcccacaacaacagtgaca

SEQ ID NO: 1113036 - DNA, 22 bp, Artificial Sequence
  chemically synthesized
cccacaacaacagtgacaacaa

SEQ ID NO: 1113037 - DNA, 22 bp, Artificial Sequence
  chemically synthesized
ccacaacaacagtgacaacaac

SEQ ID NO: 1113038 - DNA, 22 bp, Artificial Sequence
  chemically synthesized
tttctttcacacacatggacac

SEQ ID NO: 1113039 - DNA, 22 bp, Artificial Sequence
  chemically synthesized
tctttcacacacatggacacac

SEQ ID NO: 1113040 - DNA, 22 bp, Artificial Sequence
  chemically synthesized
ctttcacacacatggacacaca

SEQ ID NO: 1113041 - DNA, 22 bp, Artificial Sequence
  chemically synthesized
tttcacacacatggacacacac

SEQ ID NO: 1113042 - DNA, 22 bp, Artificial Sequence
  chemically synthesized
tcacacacatggacacacacac

SEQ ID NO: 1113043 - DNA, 22 bp, Artificial Sequence
  chemically synthesized
cacacacatggacacacacacg

SEQ ID NO: 1113044 - DNA, 22 bp, Artificial Sequence
  chemically synthesized
acacacatggacacacacacgc

SEQ ID NO: 1113045 - DNA, 22 bp, Artificial Sequence
  chemically synthesized
gcatgcgcagacatgtgcgtgt

SEQ ID NO: 1113046 - DNA, 22 bp, Artificial Sequence
  chemically synthesized
cgcatgcgagttcacccgtgca

SEQ ID NO: 1113047 - DNA, 22 bp, Artificial Sequence
  chemically synthesized
acccgtgcatgcacgccgtgct

SEQ ID NO: 1113048 - DNA, 22 bp, Artificial Sequence
  chemically synthesized
tgggtgtgtgtgagcacggcgt

SEQ ID NO: 1113049 - DNA, 22 bp, Artificial Sequence
  chemically synthesized
tgtgggtgtgtgtgagcacggc

SEQ ID NO: 1113050 - DNA, 22 bp, Artificial Sequence
  chemically synthesized
caaaaggaagagcctctgtggg

SEQ ID NO: 1113051 - DNA, 22 bp, Artificial Sequence
  chemically synthesized
acacacacccacagaggctctt

SEQ ID NO: 1113052 - DNA, 22 bp, Artificial Sequence
  chemically synthesized
atctccaaaaggaagagcctct

SEQ ID NO: 1113053 - DNA, 22 bp, Artificial Sequence
  chemically synthesized
agtctaatctccaaaaggaaga

SEQ ID NO: 1113054 - DNA, 22 bp, Artificial Sequence
  chemically synthesized
aagtctaatctccaaaaggaag

SEQ ID NO: 1113055 - DNA, 22 bp, Artificial Sequence
  chemically synthesized
gtttaagtctaatctccaaaag

SEQ ID NO: 1113056 - DNA, 22 bp, Artificial Sequence
  chemically synthesized
cgtttaagtctaatctccaaaa

SEQ ID NO: 1113057 - DNA, 22 bp, Artificial Sequence
  chemically synthesized
ttcgtttaagtctaatctccaa

SEQ ID NO: 1113058 - DNA, 22 bp, Artificial Sequence
  chemically synthesized
cttcgtttaagtctaatctcca

SEQ ID NO: 1113059 - DNA, 22 bp, Artificial Sequence
  chemically synthesized
tcttcgtttaagtctaatctcc

SEQ ID NO: 1113060 - DNA, 22 bp, Artificial Sequence
  chemically synthesized
ttcttcgtttaagtctaatctc

SEQ ID NO: 1113061 - DNA, 22 bp, Artificial Sequence
  chemically synthesized
ttccttttggagattagactta

SEQ ID NO: 1113062 - DNA, 22 bp, Artificial Sequence
  chemically synthesized
ccttttggagattagacttaaa

SEQ ID NO: 1113063 - DNA, 22 bp, Artificial Sequence
  chemically synthesized
cttttggagattagacttaaac

SEQ ID NO: 1113064 - DNA, 22 bp, Artificial Sequence
  chemically synthesized
ttggagattagacttaaacgaa

SEQ ID NO: 1113065 - DNA, 22 bp, Artificial Sequence
  chemically synthesized
tggagattagacttaaacgaag

SEQ ID NO: 1113066 - DNA, 22 bp, Artificial Sequence
  chemically synthesized
ggagattagacttaaacgaaga

SEQ ID NO: 1113067 - DNA, 22 bp, Artificial Sequence
  chemically synthesized
gagattagacttaaacgaagaa

SEQ ID NO: 1113068 - DNA, 22 bp, Artificial Sequence
  chemically synthesized
acaggcacatttttcttcgttt

SEQ ID NO: 1113069 - DNA, 22 bp, Artificial Sequence
  chemically synthesized
attgacaggcacatttttcttc

SEQ ID NO: 1113070 - DNA, 22 bp, Artificial Sequence
  chemically synthesized
aattgacaggcacatttttctt

SEQ ID NO: 1113071 - DNA, 22 bp, Artificial Sequence
  chemically synthesized
taattgacaggcacatttttct

SEQ ID NO: 1113072 - DNA, 22 bp, Artificial Sequence
  chemically synthesized
gacttaaacgaagaaaaatgtg

SEQ ID NO: 1113073 - DNA, 22 bp, Artificial Sequence
  chemically synthesized
ttaattgacaggcacatttttc

SEQ ID NO: 1113074 - DNA, 22 bp, Artificial Sequence
  chemically synthesized
aaacgaagaaaaatgtgcctgt

SEQ ID NO: 1113075 - DNA, 22 bp, Artificial Sequence
  chemically synthesized
aacgaagaaaaatgtgcctgtc

SEQ ID NO: 1113076 - DNA, 22 bp, Artificial Sequence
  chemically synthesized
aataaatgtttttaattgacag

SEQ ID NO: 1113077 - DNA, 22 bp, Artificial Sequence
  chemically synthesized
acattcaataaatgtttttaat

SEQ ID NO: 1113078 - DNA, 22 bp, Artificial Sequence
  chemically synthesized
tcaattaaaaacatttattgaa

SEQ ID NO: 1113079 - DNA, 22 bp, Artificial Sequence
  chemically synthesized
cacagagttcacattcaataaa

SEQ ID NO: 1113080 - DNA, 22 bp, Artificial Sequence
  chemically synthesized
tacacagagttcacattcaata

SEQ ID NO: 1113081 - DNA, 22 bp, Artificial Sequence
  chemically synthesized
aaaacatttattgaatgtgaac

SEQ ID NO: 1113082 - DNA, 22 bp, Artificial Sequence
  chemically synthesized
gtataatgctctacacagagtt

SEQ ID NO: 1113083 - DNA, 22 bp, Artificial Sequence
  chemically synthesized
agtataatgctctacacagagt

SEQ ID NO: 1113084 - DNA, 22 bp, Artificial Sequence
  chemically synthesized
attgaatgtgaactctgtgtag

SEQ ID NO: 1113085 - DNA, 22 bp, Artificial Sequence
  chemically synthesized
ttgaatgtgaactctgtgtaga

SEQ ID NO: 1113086 - DNA, 22 bp, Artificial Sequence
  chemically synthesized
aatgtgaactctgtgtagagca

SEQ ID NO: 1113087 - DNA, 22 bp, Artificial Sequence
  chemically synthesized
cacatgacacttagtataatgc

SEQ ID NO: 1113088 - DNA, 22 bp, Artificial Sequence
  chemically synthesized
tccacatgacacttagtataat

SEQ ID NO: 1113089 - DNA, 22 bp, Artificial Sequence
  chemically synthesized
ctccacatgacacttagtataa

SEQ ID NO: 1113090 - DNA, 22 bp, Artificial Sequence
  chemically synthesized
tgtgtagagcattatactaagt

SEQ ID NO: 1113091 - DNA, 22 bp, Artificial Sequence
  chemically synthesized
tctccacatgacacttagtata

SEQ ID NO: 1113092 - DNA, 22 bp, Artificial Sequence
  chemically synthesized
tgtagagcattatactaagtgt

SEQ ID NO: 1113093 - DNA, 22 bp, Artificial Sequence
  chemically synthesized
tttctccacatgacacttagta

SEQ ID NO: 1113094 - DNA, 22 bp, Artificial Sequence
  chemically synthesized
ctttctccacatgacacttagt

SEQ ID NO: 1113095 - DNA, 22 bp, Artificial Sequence
  chemically synthesized
ttctttctccacatgacactta

SEQ ID NO: 1113096 - DNA, 22 bp, Artificial Sequence
  chemically synthesized
cttctttctccacatgacactt

SEQ ID NO: 1113097 - DNA, 22 bp, Artificial Sequence
  chemically synthesized
tatttcttctttctccacatga

SEQ ID NO: 1113098 - DNA, 22 bp, Artificial Sequence
  chemically synthesized
atatttcttctttctccacatg

SEQ ID NO: 1113099 - DNA, 22 bp, Artificial Sequence
  chemically synthesized
tactaagtgtcatgtggagaaa

SEQ ID NO: 1113100 - DNA, 22 bp, Artificial Sequence
  chemically synthesized
atttatatttcttctttctcca

SEQ ID NO: 1113101 - DNA, 22 bp, Artificial Sequence
  chemically synthesized
gatttatatttcttctttctcc

SEQ ID NO: 1113102 - DNA, 22 bp, Artificial Sequence
  chemically synthesized
agtgtcatgtggagaaagaaga

SEQ ID NO: 1113103 - DNA, 22 bp, Artificial Sequence
  chemically synthesized
ggcagtttgatttatatttctt

SEQ ID NO: 1113104 - DNA, 22 bp, Artificial Sequence
  chemically synthesized
agtactgggcagtttgatttat

SEQ ID NO: 1113105 - DNA, 22 bp, Artificial Sequence
  chemically synthesized
ctcagtactgggcagtttgatt

SEQ ID NO: 1113106 - DNA, 22 bp, Artificial Sequence
  chemically synthesized
cctcagtactgggcagtttgat

SEQ ID NO: 1113107 - DNA, 22 bp, Artificial Sequence
  chemically synthesized
cttcctcagtactgggcagttt

SEQ ID NO: 1113108 - DNA, 22 bp, Artificial Sequence
  chemically synthesized
ttccttcctcagtactgggcag

SEQ ID NO: 1113109 - DNA, 22 bp, Artificial Sequence
  chemically synthesized
attccttcctcagtactgggca

SEQ ID NO: 1113110 - DNA, 22 bp, Artificial Sequence
  chemically synthesized
ttattccttcctcagtactggg

SEQ ID NO: 1113111 - DNA, 22 bp, Artificial Sequence
  chemically synthesized
tcttattccttcctcagtactg

SEQ ID NO: 1113112 - DNA, 22 bp, Artificial Sequence
  chemically synthesized
ctcttattccttcctcagtact

SEQ ID NO: 1113113 - DNA, 22 bp, Artificial Sequence
  chemically synthesized
ttctcttattccttcctcagta

SEQ ID NO: 1113114 - DNA, 22 bp, Artificial Sequence
  chemically synthesized
ctcttctcttattccttcctca

SEQ ID NO: 1113115 - DNA, 22 bp, Artificial Sequence
  chemically synthesized
cctcttctcttattccttcctc

SEQ ID NO: 1113116 - DNA, 22 bp, Artificial Sequence
  chemically synthesized
cccagtactgaggaaggaataa

SEQ ID NO: 1113117 - DNA, 22 bp, Artificial Sequence
  chemically synthesized
catatatttcctcttctcttat

SEQ ID NO: 1113118 - DNA, 22 bp, Artificial Sequence
  chemically synthesized
aggaaggaataagagaagagga

SEQ ID NO: 1113119 - DNA, 22 bp, Artificial Sequence
  chemically synthesized
cacagttgcatatatttcctct

SEQ ID NO: 1113120 - DNA, 22 bp, Artificial Sequence
  chemically synthesized
ccacagttgcatatatttcctc

SEQ ID NO: 1113121 - DNA, 22 bp, Artificial Sequence
  chemically synthesized
atcatgaatgagtagccttcca

SEQ ID NO: 1113122 - DNA, 22 bp, Artificial Sequence
  chemically synthesized
catcatgaatgagtagccttcc

SEQ ID NO: 1113123 - DNA, 22 bp, Artificial Sequence
  chemically synthesized
tggaaggctactcattcatgat

SEQ ID NO: 1113124 - DNA, 22 bp, Artificial Sequence
  chemically synthesized
tagtagcccagccccttcatca

SEQ ID NO: 1113125 - DNA, 22 bp, Artificial Sequence
  chemically synthesized
gtagtagcccagccccttcatc

SEQ ID NO: 1113126 - DNA, 22 bp, Artificial Sequence
  chemically synthesized
ctcattcatgatgaaggggctg

SEQ ID NO: 1113127 - DNA, 22 bp, Artificial Sequence
  chemically synthesized
attcatgatgaaggggctgggc

SEQ ID NO: 1113128 - DNA, 22 bp, Artificial Sequence
  chemically synthesized
taccacttgtagtagcccagcc

SEQ ID NO: 1113129 - DNA, 22 bp, Artificial Sequence
  chemically synthesized
atgatgaaggggctgggctact

SEQ ID NO: 1113130 - DNA, 22 bp, Artificial Sequence
  chemically synthesized
ggctactacaagtggtacagtc

SEQ ID NO: 1113131 - DNA, 22 bp, Artificial Sequence
  chemically synthesized
ctacaagtggtacagtctccat

SEQ ID NO: 1113132 - DNA, 22 bp, Artificial Sequence
  chemically synthesized
tatacaaatgtggcatggagac

SEQ ID NO: 1113133 - DNA, 22 bp, Artificial Sequence
  chemically synthesized
caagtggtacagtctccatgcc

SEQ ID NO: 1113134 - DNA, 22 bp, Artificial Sequence
  chemically synthesized
caaatagtctgtatacaaatgt

SEQ ID NO: 1113135 - DNA, 22 bp, Artificial Sequence
  chemically synthesized
catgccacatttgtatacagac

SEQ ID NO: 1113136 - DNA, 22 bp, Artificial Sequence
  chemically synthesized
atggcaagacatattgcaaata

SEQ ID NO: 1113137 - DNA, 22 bp, Artificial Sequence
  chemically synthesized
aatggcaagacatattgcaaat

SEQ ID NO: 1113138 - DNA, 22 bp, Artificial Sequence
  chemically synthesized
gtatacagactatttgcaatat

SEQ ID NO: 1113139 - DNA, 22 bp, Artificial Sequence
  chemically synthesized
taatggcaagacatattgcaaa

SEQ ID NO: 1113140 - DNA, 22 bp, Artificial Sequence
  chemically synthesized
tatacagactatttgcaatatg

SEQ ID NO: 1113141 - DNA, 22 bp, Artificial Sequence
  chemically synthesized
atcatatattttaatggcaaga

SEQ ID NO: 1113142 - DNA, 22 bp, Artificial Sequence
  chemically synthesized
tttgcaatatgtcttgccatta

SEQ ID NO: 1113143 - DNA, 22 bp, Artificial Sequence
  chemically synthesized
taatcatatattttaatggcaa

SEQ ID NO: 1113144 - DNA, 22 bp, Artificial Sequence
  chemically synthesized
ctaatcatatattttaatggca

SEQ ID NO: 1113145 - DNA, 22 bp, Artificial Sequence
  chemically synthesized
gcaatatgtcttgccattaaaa

SEQ ID NO: 1113146 - DNA, 22 bp, Artificial Sequence
  chemically synthesized
caatatgtcttgccattaaaat

SEQ ID NO: 1113147 - DNA, 22 bp, Artificial Sequence
  chemically synthesized
gccattaaaatatatgattaga

SEQ ID NO: 1113148 - DNA, 22 bp, Artificial Sequence
  chemically synthesized
ccattaaaatatatgattagaa

SEQ ID NO: 1113149 - DNA, 22 bp, Artificial Sequence
  chemically synthesized
agtagcagcaagtcttctaatc

SEQ ID NO: 1113150 - DNA, 22 bp, Artificial Sequence
  chemically synthesized
cagtagcagcaagtcttctaat

SEQ ID NO: 1113151 - DNA, 22 bp, Artificial Sequence
  chemically synthesized
tcagtagcagcaagtcttctaa

SEQ ID NO: 1113152 - DNA, 22 bp, Artificial Sequence
  chemically synthesized
aaatatatgattagaagacttg

SEQ ID NO: 1113153 - DNA, 22 bp, Artificial Sequence
  chemically synthesized
gaaaaactttcagtagcagcaa

SEQ ID NO: 1113154 - DNA, 22 bp, Artificial Sequence
  chemically synthesized
gaagacttgctgctactgaaag

SEQ ID NO: 1113155 - DNA, 22 bp, Artificial Sequence
  chemically synthesized
atgatcactggaaaaactttca

SEQ ID NO: 1113156 - DNA, 22 bp, Artificial Sequence
  chemically synthesized
tcatgatcactggaaaaacttt

SEQ ID NO: 1113157 - DNA, 22 bp, Artificial Sequence
  chemically synthesized
gctgctactgaaagtttttcca

SEQ ID NO: 1113158 - DNA, 22 bp, Artificial Sequence
  chemically synthesized
ctgctactgaaagtttttccag

SEQ ID NO: 1113159 - DNA, 22 bp, Artificial Sequence
  chemically synthesized
ctactgaaagtttttccagtga

SEQ ID NO: 1113160 - DNA, 22 bp, Artificial Sequence
  chemically synthesized
aaactctcatgatcactggaaa

SEQ ID NO: 1113161 - DNA, 22 bp, Artificial Sequence
  chemically synthesized
ctgaaagtttttccagtgatca

SEQ ID NO: 1113162 - DNA, 22 bp, Artificial Sequence
  chemically synthesized
aaagtttttccagtgatcatga

SEQ ID NO: 1113163 - DNA, 22 bp, Artificial Sequence
  chemically synthesized
aaagctaaaactctcatgatca

SEQ ID NO: 1113164 - DNA, 22 bp, Artificial Sequence
  chemically synthesized
atctcaaagctaaaactctcat

SEQ ID NO: 1113165 - DNA, 22 bp, Artificial Sequence
  chemically synthesized
ttccagtgatcatgagagtttt

SEQ ID NO: 1113166 - DNA, 22 bp, Artificial Sequence
  chemically synthesized
tccagtgatcatgagagtttta

SEQ ID NO: 1113167 - DNA, 22 bp, Artificial Sequence
  chemically synthesized
ccagtgatcatgagagttttag

SEQ ID NO: 1113168 - DNA, 22 bp, Artificial Sequence
  chemically synthesized
cagtgatcatgagagttttagc

SEQ ID NO: 1113169 - DNA, 22 bp, Artificial Sequence
  chemically synthesized
gctcatctcaaagctaaaactc

SEQ ID NO: 1113170 - DNA, 22 bp, Artificial Sequence
  chemically synthesized
tggtcagtctggctcatctcaa

SEQ ID NO: 1113171 - DNA, 22 bp, Artificial Sequence
  chemically synthesized
tagctttgagatgagccagact

SEQ ID NO: 1113172 - DNA, 22 bp, Artificial Sequence
  chemically synthesized
agctttgagatgagccagactg

SEQ ID NO: 1113173 - DNA, 22 bp, Artificial Sequence
  chemically synthesized
gctttgagatgagccagactga

SEQ ID NO: 1113174 - DNA, 22 bp, Artificial Sequence
  chemically synthesized
tgagatgagccagactgaccat

SEQ ID NO: 1113175 - DNA, 22 bp, Artificial Sequence
  chemically synthesized
gagatgagccagactgaccata

SEQ ID NO: 1113176 - DNA, 22 bp, Artificial Sequence
  chemically synthesized
agatgagccagactgaccataa

SEQ ID NO: 1113177 - DNA, 22 bp, Artificial Sequence
  chemically synthesized
tcagatgggtgagggtagggat

SEQ ID NO: 1113178 - DNA, 22 bp, Artificial Sequence
  chemically synthesized
gtcagatgggtgagggtaggga

SEQ ID NO: 1113179 - DNA, 22 bp, Artificial Sequence
  chemically synthesized
tgtcagatgggtgagggtaggg

SEQ ID NO: 1113180 - DNA, 22 bp, Artificial Sequence
  chemically synthesized
accataatccctaccctcaccc

SEQ ID NO: 1113181 - DNA, 22 bp, Artificial Sequence
  chemically synthesized
ccctcacccatctgacaaaatc

SEQ ID NO: 1113182 - DNA, 22 bp, Artificial Sequence
  chemically synthesized
aggtgggcaaccagattttgtc

SEQ ID NO: 1113183 - DNA, 22 bp, Artificial Sequence
  chemically synthesized
gaggtgggcaaccagattttgt

SEQ ID NO: 1113184 - DNA, 22 bp, Artificial Sequence
  chemically synthesized
acccatctgacaaaatctggtt

SEQ ID NO: 1113185 - DNA, 22 bp, Artificial Sequence
  chemically synthesized
tttgaggtgggcaaccagattt

SEQ ID NO: 1113186 - DNA, 22 bp, Artificial Sequence
  chemically synthesized
tgttatttgaggtgggcaacca

SEQ ID NO: 1113187 - DNA, 22 bp, Artificial Sequence
  chemically synthesized
acaaaatctggttgcccacctc

SEQ ID NO: 1113188 - DNA, 22 bp, Artificial Sequence
  chemically synthesized
acatgaattatgttatttgagg

SEQ ID NO: 1113189 - DNA, 22 bp, Artificial Sequence
  chemically synthesized
cacatgaattatgttatttgag

SEQ ID NO: 1113190 - DNA, 22 bp, Artificial Sequence
  chemically synthesized
gttgcccacctcaaataacata

SEQ ID NO: 1113191 - DNA, 22 bp, Artificial Sequence
  chemically synthesized
cccacctcaaataacataattc

SEQ ID NO: 1113192 - DNA, 22 bp, Artificial Sequence
  chemically synthesized
gataatttcacatgaattatgt

SEQ ID NO: 1113193 - DNA, 22 bp, Artificial Sequence
  chemically synthesized
attagataatttcacatgaatt

SEQ ID NO: 1113194 - DNA, 22 bp, Artificial Sequence
  chemically synthesized
aaataacataattcatgtgaaa

SEQ ID NO: 1113195 - DNA, 22 bp, Artificial Sequence
  chemically synthesized
atagctcattagataatttcac

SEQ ID NO: 1113196 - DNA, 22 bp, Artificial Sequence
  chemically synthesized
gttcatagctcattagataatt

SEQ ID NO: 1113197 - DNA, 22 bp, Artificial Sequence
  chemically synthesized
ggttcatagctcattagataat

SEQ ID NO: 1113198 - DNA, 22 bp, Artificial Sequence
  chemically synthesized
tggttcatagctcattagataa

SEQ ID NO: 1113199 - DNA, 22 bp, Artificial Sequence
  chemically synthesized
atgtgaaattatctaatgagct

SEQ ID NO: 1113200 - DNA, 22 bp, Artificial Sequence
  chemically synthesized
tattttggttcatagctcatta

SEQ ID NO: 1113201 - DNA, 22 bp, Artificial Sequence
  chemically synthesized
gtattttggttcatagctcatt

SEQ ID NO: 1113202 - DNA, 22 bp, Artificial Sequence
  chemically synthesized
ttgtattttggttcatagctca

SEQ ID NO: 1113203 - DNA, 22 bp, Artificial Sequence
  chemically synthesized
cttgtattttggttcatagctc

SEQ ID NO: 1113204 - DNA, 22 bp, Artificial Sequence
  chemically synthesized
tcttgtattttggttcatagct

SEQ ID NO: 1113205 - DNA, 22 bp, Artificial Sequence
  chemically synthesized
ttcttgtattttggttcatagc

SEQ ID NO: 1113206 - DNA, 22 bp, Artificial Sequence
  chemically synthesized
tttcttgtattttggttcatag

SEQ ID NO: 1113207 - DNA, 22 bp, Artificial Sequence
  chemically synthesized
ttttcttgtattttggttcata

SEQ ID NO: 1113208 - DNA, 22 bp, Artificial Sequence
  chemically synthesized
tttttcttgtattttggttcat

SEQ ID NO: 1113209 - DNA, 22 bp, Artificial Sequence
  chemically synthesized
tctaatgagctatgaaccaaaa

SEQ ID NO: 1113210 - DNA, 22 bp, Artificial Sequence
  chemically synthesized
tctttttttcttgtattttggt

SEQ ID NO: 1113211 - DNA, 22 bp, Artificial Sequence
  chemically synthesized
atgagctatgaaccaaaataca

SEQ ID NO: 1113212 - DNA, 22 bp, Artificial Sequence
  chemically synthesized
tgaaccaaaatacaagaaaaaa

SEQ ID NO: 1113213 - DNA, 22 bp, Artificial Sequence
  chemically synthesized
accaagtaactatctttttttc

SEQ ID NO: 1113214 - DNA, 22 bp, Artificial Sequence
  chemically synthesized
tccataacattaaccaagtaac

SEQ ID NO: 1113215 - DNA, 22 bp, Artificial Sequence
  chemically synthesized
atccataacattaaccaagtaa

SEQ ID NO: 1113216 - DNA, 22 bp, Artificial Sequence
  chemically synthesized
ttatccataacattaaccaagt

SEQ ID NO: 1113217 - DNA, 22 bp, Artificial Sequence
  chemically synthesized
cttatccataacattaaccaag

SEQ ID NO: 1113218 - DNA, 22 bp, Artificial Sequence
  chemically synthesized
ttcttatccataacattaacca

SEQ ID NO: 1113219 - DNA, 22 bp, Artificial Sequence
  chemically synthesized
cttggttaatgttatggataag

SEQ ID NO: 1113220 - DNA, 22 bp, Artificial Sequence
  chemically synthesized
acgagagctcttcttatccata

SEQ ID NO: 1113221 - DNA, 22 bp, Artificial Sequence
  chemically synthesized
ggttaatgttatggataagaag

SEQ ID NO: 1113222 - DNA, 22 bp, Artificial Sequence
  chemically synthesized
gttaatgttatggataagaaga

SEQ ID NO: 1113223 - DNA, 22 bp, Artificial Sequence
  chemically synthesized
atgttatggataagaagagctc

SEQ ID NO: 1113224 - DNA, 22 bp, Artificial Sequence
  chemically synthesized
tggataagaagagctctcgtca

SEQ ID NO: 1113225 - DNA, 22 bp, Artificial Sequence
  chemically synthesized
aatggcacagaatgataacact

SEQ ID NO: 1113226 - DNA, 22 bp, Artificial Sequence
  chemically synthesized
taattaaatggcacagaatgat

SEQ ID NO: 1113227 - DNA, 22 bp, Artificial Sequence
  chemically synthesized
tcgtcagtgttatcattctgtg

SEQ ID NO: 1113228 - DNA, 22 bp, Artificial Sequence
  chemically synthesized
gtcagtgttatcattctgtgcc

SEQ ID NO: 1113229 - DNA, 22 bp, Artificial Sequence
  chemically synthesized
ttgtaattaaatggcacagaat

SEQ ID NO: 1113230 - DNA, 22 bp, Artificial Sequence
  chemically synthesized
actgttgtaattaaatggcaca

SEQ ID NO: 1113231 - DNA, 22 bp, Artificial Sequence
  chemically synthesized
tcattctgtgccatttaattac

SEQ ID NO: 1113232 - DNA, 22 bp, Artificial Sequence
  chemically synthesized
tgtgccatttaattacaacagt

SEQ ID NO: 1113233 - DNA, 22 bp, Artificial Sequence
  chemically synthesized
tgccatttaattacaacagtta

SEQ ID NO: 1113234 - DNA, 22 bp, Artificial Sequence
  chemically synthesized
ataataagtatgctaactgttg

SEQ ID NO: 1113235 - DNA, 22 bp, Artificial Sequence
  chemically synthesized
aattacaacagttagcatactt

SEQ ID NO: 1113236 - DNA, 22 bp, Artificial Sequence
  chemically synthesized
attacaacagttagcatactta

SEQ ID NO: 1113237 - DNA, 22 bp, Artificial Sequence
  chemically synthesized
caacagttagcatacttattat

SEQ ID NO: 1113238 - DNA, 22 bp, Artificial Sequence
  chemically synthesized
aggtgatacctgataataagta

SEQ ID NO: 1113239 - DNA, 22 bp, Artificial Sequence
  chemically synthesized
aaggtgatacctgataataagt

SEQ ID NO: 1113240 - DNA, 22 bp, Artificial Sequence
  chemically synthesized
gcatacttattatcaggtatca

SEQ ID NO: 1113241 - DNA, 22 bp, Artificial Sequence
  chemically synthesized
tagtgtttaaggtgatacctga

SEQ ID NO: 1113242 - DNA, 22 bp, Artificial Sequence
  chemically synthesized
gattatagtgtttaaggtgata

SEQ ID NO: 1113243 - DNA, 22 bp, Artificial Sequence
  chemically synthesized
attatcaggtatcaccttaaac

SEQ ID NO: 1113244 - DNA, 22 bp, Artificial Sequence
  chemically synthesized
ttatcaggtatcaccttaaaca

SEQ ID NO: 1113245 - DNA, 22 bp, Artificial Sequence
  chemically synthesized
tcaggtatcaccttaaacacta

SEQ ID NO: 1113246 - DNA, 22 bp, Artificial Sequence
  chemically synthesized
agtgctagattatagtgtttaa

SEQ ID NO: 1113247 - DNA, 22 bp, Artificial Sequence
  chemically synthesized
cctgagtgctagattatagtgt

SEQ ID NO: 1113248 - DNA, 22 bp, Artificial Sequence
  chemically synthesized
tcattccctgagtgctagatta

SEQ ID NO: 1113249 - DNA, 22 bp, Artificial Sequence
  chemically synthesized
aaacactataatctagcactca

SEQ ID NO: 1113250 - DNA, 22 bp, Artificial Sequence
  chemically synthesized
aacactataatctagcactcag

SEQ ID NO: 1113251 - DNA, 22 bp, Artificial Sequence
  chemically synthesized
aaaactatcattccctgagtgc

SEQ ID NO: 1113252 - DNA, 22 bp, Artificial Sequence
  chemically synthesized
taatctagcactcagggaatga

SEQ ID NO: 1113253 - DNA, 22 bp, Artificial Sequence
  chemically synthesized
aagaacatctcaaaactatcat

SEQ ID NO: 1113254 - DNA, 22 bp, Artificial Sequence
  chemically synthesized
gcactcagggaatgatagtttt

SEQ ID NO: 1113255 - DNA, 22 bp, Artificial Sequence
  chemically synthesized
gactaaagaacatctcaaaact

SEQ ID NO: 1113256 - DNA, 22 bp, Artificial Sequence
  chemically synthesized
agggaatgatagttttgagatg

SEQ ID NO: 1113257 - DNA, 22 bp, Artificial Sequence
  chemically synthesized
gtatattagactaaagaacatc

SEQ ID NO: 1113258 - DNA, 22 bp, Artificial Sequence
  chemically synthesized
ttagtatattagactaaagaac

SEQ ID NO: 1113259 - DNA, 22 bp, Artificial Sequence
  chemically synthesized
tgagatgttctttagtctaata

SEQ ID NO: 1113260 - DNA, 22 bp, Artificial Sequence
  chemically synthesized
gagatgttctttagtctaatat

SEQ ID NO: 1113261 - DNA, 22 bp, Artificial Sequence
  chemically synthesized
agatgttctttagtctaatata

SEQ ID NO: 1113262 - DNA, 22 bp, Artificial Sequence
  chemically synthesized
tttagtctaatatactaataat

SEQ ID NO: 1113263 - DNA, 22 bp, Artificial Sequence
  chemically synthesized
aataaaagtagtaattattagt

SEQ ID NO: 1113264 - DNA, 22 bp, Artificial Sequence
  chemically synthesized
tagtctaatatactaataatta

SEQ ID NO: 1113265 - DNA, 22 bp, Artificial Sequence
  chemically synthesized
aaataaaagtagtaattattag

SEQ ID NO: 1113266 - DNA, 22 bp, Artificial Sequence
  chemically synthesized
agtctaatatactaataattac

SEQ ID NO: 1113267 - DNA, 22 bp, Artificial Sequence
  chemically synthesized
gtctaatatactaataattact

SEQ ID NO: 1113268 - DNA, 22 bp, Artificial Sequence
  chemically synthesized
atatactaataattactacttt

SEQ ID NO: 1113269 - DNA, 22 bp, Artificial Sequence
  chemically synthesized
ataattactacttttatttaaa

SEQ ID NO: 1113270 - DNA, 22 bp, Artificial Sequence
  chemically synthesized
ctacttttatttaaacatgtcc

SEQ ID NO: 1113271 - DNA, 22 bp, Artificial Sequence
  chemically synthesized
cttttatttaaacatgtccttg

SEQ ID NO: 1113272 - DNA, 22 bp, Artificial Sequence
  chemically synthesized
aggacagtcacatcaaggacat

SEQ ID NO: 1113273 - DNA, 22 bp, Artificial Sequence
  chemically synthesized
ttatttaaacatgtccttgatg

SEQ ID NO: 1113274 - DNA, 22 bp, Artificial Sequence
  chemically synthesized
tatttaaacatgtccttgatgt

SEQ ID NO: 1113275 - DNA, 22 bp, Artificial Sequence
  chemically synthesized
atttaaacatgtccttgatgtg

SEQ ID NO: 1113276 - DNA, 22 bp, Artificial Sequence
  chemically synthesized
tttaaacatgtccttgatgtga

SEQ ID NO: 1113277 - DNA, 22 bp, Artificial Sequence
  chemically synthesized
aaacatgtccttgatgtgactg

SEQ ID NO: 1113278 - DNA, 22 bp, Artificial Sequence
  chemically synthesized
agagtctaaggacagtcacatc

SEQ ID NO: 1113279 - DNA, 22 bp, Artificial Sequence
  chemically synthesized
aacatgtccttgatgtgactgt

SEQ ID NO: 1113280 - DNA, 22 bp, Artificial Sequence
  chemically synthesized
attaagagtctaaggacagtca

SEQ ID NO: 1113281 - DNA, 22 bp, Artificial Sequence
  chemically synthesized
tgtgttaattaagagtctaagg

SEQ ID NO: 1113282 - DNA, 22 bp, Artificial Sequence
  chemically synthesized
gatgtgactgtccttagactct

SEQ ID NO: 1113283 - DNA, 22 bp, Artificial Sequence
  chemically synthesized
atgtgactgtccttagactctt

SEQ ID NO: 1113284 - DNA, 22 bp, Artificial Sequence
  chemically synthesized
tgtgtgttaattaagagtctaa

SEQ ID NO: 1113285 - DNA, 22 bp, Artificial Sequence
  chemically synthesized
ctgtgtgttaattaagagtcta

SEQ ID NO: 1113286 - DNA, 22 bp, Artificial Sequence
  chemically synthesized
tctgtgtgttaattaagagtct

SEQ ID NO: 1113287 - DNA, 22 bp, Artificial Sequence
  chemically synthesized
tagttttctgtgtgttaattaa

SEQ ID NO: 1113288 - DNA, 22 bp, Artificial Sequence
  chemically synthesized
tccttagactcttaattaacac

SEQ ID NO: 1113289 - DNA, 22 bp, Artificial Sequence
  chemically synthesized
gtagttttctgtgtgttaatta

SEQ ID NO: 1113290 - DNA, 22 bp, Artificial Sequence
  chemically synthesized
tttgtagttttctgtgtgttaa

SEQ ID NO: 1113291 - DNA, 22 bp, Artificial Sequence
  chemically synthesized
agactcttaattaacacacaga

SEQ ID NO: 1113292 - DNA, 22 bp, Artificial Sequence
  chemically synthesized
tatttgtagttttctgtgtgtt

SEQ ID NO: 1113293 - DNA, 22 bp, Artificial Sequence
  chemically synthesized
gactcttaattaacacacagaa

SEQ ID NO: 1113294 - DNA, 22 bp, Artificial Sequence
  chemically synthesized
ctatttgtagttttctgtgtgt

SEQ ID NO: 1113295 - DNA, 22 bp, Artificial Sequence
  chemically synthesized
ttaattaacacacagaaaacta

SEQ ID NO: 1113296 - DNA, 22 bp, Artificial Sequence
  chemically synthesized
aatttctatttgtagttttctg

SEQ ID NO: 1113297 - DNA, 22 bp, Artificial Sequence
  chemically synthesized
caatttctatttgtagttttct

SEQ ID NO: 1113298 - DNA, 22 bp, Artificial Sequence
  chemically synthesized
aattaacacacagaaaactaca

SEQ ID NO: 1113299 - DNA, 22 bp, Artificial Sequence
  chemically synthesized
tcaatttctatttgtagttttc

SEQ ID NO: 1113300 - DNA, 22 bp, Artificial Sequence
  chemically synthesized
attaacacacagaaaactacaa

SEQ ID NO: 1113301 - DNA, 22 bp, Artificial Sequence
  chemically synthesized
attttcaatttctatttgtagt

SEQ ID NO: 1113302 - DNA, 22 bp, Artificial Sequence
  chemically synthesized
acacacagaaaactacaaatag

SEQ ID NO: 1113303 - DNA, 22 bp, Artificial Sequence
  chemically synthesized
tgattcattttcaatttctatt

SEQ ID NO: 1113304 - DNA, 22 bp, Artificial Sequence
  chemically synthesized
aattgtgattcattttcaattt

SEQ ID NO: 1113305 - DNA, 22 bp, Artificial Sequence
  chemically synthesized
gttaaattgtgattcattttca

SEQ ID NO: 1113306 - DNA, 22 bp, Artificial Sequence
  chemically synthesized
caaatagaaattgaaaatgaat

SEQ ID NO: 1113307 - DNA, 22 bp, Artificial Sequence
  chemically synthesized
tgtaatagggttagttaaattg

SEQ ID NO: 1113308 - DNA, 22 bp, Artificial Sequence
  chemically synthesized
aaaatgaatcacaatttaacta

SEQ ID NO: 1113309 - DNA, 22 bp, Artificial Sequence
  chemically synthesized
taattatgtaatagggttagtt

SEQ ID NO: 1113310 - DNA, 22 bp, Artificial Sequence
  chemically synthesized
aactaaccctattacataatta

SEQ ID NO: 1113311 - DNA, 22 bp, Artificial Sequence
  chemically synthesized
gaggagatactataattatgta

SEQ ID NO: 1113312 - DNA, 22 bp, Artificial Sequence
  chemically synthesized
actaaccctattacataattat

SEQ ID NO: 1113313 - DNA, 22 bp, Artificial Sequence
  chemically synthesized
tagaggagatactataattatg

SEQ ID NO: 1113314 - DNA, 22 bp, Artificial Sequence
  chemically synthesized
ctagaggagatactataattat

SEQ ID NO: 1113315 - DNA, 22 bp, Artificial Sequence
  chemically synthesized
accctattacataattatagta

SEQ ID NO: 1113316 - DNA, 22 bp, Artificial Sequence
  chemically synthesized
ttacataattatagtatctcct

SEQ ID NO: 1113317 - DNA, 22 bp, Artificial Sequence
  chemically synthesized
accataatttctagaggagata

SEQ ID NO: 1113318 - DNA, 22 bp, Artificial Sequence
  chemically synthesized
cataattatagtatctcctcta

SEQ ID NO: 1113319 - DNA, 22 bp, Artificial Sequence
  chemically synthesized
caccataatttctagaggagat

SEQ ID NO: 1113320 - DNA, 22 bp, Artificial Sequence
  chemically synthesized
tcaccataatttctagaggaga

SEQ ID NO: 1113321 - DNA, 22 bp, Artificial Sequence
  chemically synthesized
tagtatctcctctagaaattat

SEQ ID NO: 1113322 - DNA, 22 bp, Artificial Sequence
  chemically synthesized
agatcctttcaccataatttct

SEQ ID NO: 1113323 - DNA, 22 bp, Artificial Sequence
  chemically synthesized
taagatcctttcaccataattt

SEQ ID NO: 1113324 - DNA, 22 bp, Artificial Sequence
  chemically synthesized
gtctctaagatcctttcaccat

SEQ ID NO: 1113325 - DNA, 22 bp, Artificial Sequence
  chemically synthesized
ctctagaaattatggtgaaagg

SEQ ID NO: 1113326 - DNA, 22 bp, Artificial Sequence
  chemically synthesized
agtctctaagatcctttcacca

SEQ ID NO: 1113327 - DNA, 22 bp, Artificial Sequence
  chemically synthesized
tagtctctaagatcctttcacc

SEQ ID NO: 1113328 - DNA, 22 bp, Artificial Sequence
  chemically synthesized
tagaaattatggtgaaaggatc

SEQ ID NO: 1113329 - DNA, 22 bp, Artificial Sequence
  chemically synthesized
tttagtctctaagatcctttca

SEQ ID NO: 1113330 - DNA, 22 bp, Artificial Sequence
  chemically synthesized
gaaattatggtgaaaggatctt

SEQ ID NO: 1113331 - DNA, 22 bp, Artificial Sequence
  chemically synthesized
gttctttagtctctaagatcct

SEQ ID NO: 1113332 - DNA, 22 bp, Artificial Sequence
  chemically synthesized
tcgttctttagtctctaagatc

SEQ ID NO: 1113333 - DNA, 22 bp, Artificial Sequence
  chemically synthesized
tggtgaaaggatcttagagact

SEQ ID NO: 1113334 - DNA, 22 bp, Artificial Sequence
  chemically synthesized
aggttctcgttctttagtctct

SEQ ID NO: 1113335 - DNA, 22 bp, Artificial Sequence
  chemically synthesized
agagactaaagaacgagaacct

SEQ ID NO: 1113336 - DNA, 22 bp, Artificial Sequence
  chemically synthesized
gagactaaagaacgagaacctg

SEQ ID NO: 1113337 - DNA, 22 bp, Artificial Sequence
  chemically synthesized
aagaacgagaacctgagctacg

SEQ ID NO: 1113338 - DNA, 22 bp, Artificial Sequence
  chemically synthesized
aaaacatatgtaggcgtagctc

SEQ ID NO: 1113339 - DNA, 22 bp, Artificial Sequence
  chemically synthesized
gaaaacatatgtaggcgtagct

SEQ ID NO: 1113340 - DNA, 22 bp, Artificial Sequence
  chemically synthesized
tttgaaaacatatgtaggcgta

SEQ ID NO: 1113341 - DNA, 22 bp, Artificial Sequence
  chemically synthesized
atttgaaaacatatgtaggcgt

SEQ ID NO: 1113342 - DNA, 22 bp, Artificial Sequence
  chemically synthesized
agctacgcctacatatgttttc

SEQ ID NO: 1113343 - DNA, 22 bp, Artificial Sequence
  chemically synthesized
cgcctacatatgttttcaaata

SEQ ID NO: 1113344 - DNA, 22 bp, Artificial Sequence
  chemically synthesized
catatgttttcaaataaatgtt

SEQ ID NO: 1113345 - DNA, 22 bp, Artificial Sequence
  chemically synthesized
ccaaaagatgaccatatcaaaa

SEQ ID NO: 1113346 - DNA, 22 bp, Artificial Sequence
  chemically synthesized
tcaaataaatgttttgatatgg

SEQ ID NO: 1113347 - DNA, 22 bp, Artificial Sequence
  chemically synthesized
caaataaatgttttgatatggt

SEQ ID NO: 1113348 - DNA, 22 bp, Artificial Sequence
  chemically synthesized
aaataaatgttttgatatggtc

SEQ ID NO: 1113349 - DNA, 22 bp, Artificial Sequence
  chemically synthesized
aaattaccaaaagatgaccata

SEQ ID NO: 1113350 - DNA, 22 bp, Artificial Sequence
  chemically synthesized
atactgaaattaccaaaagatg

SEQ ID NO: 1113351 - DNA, 22 bp, Artificial Sequence
  chemically synthesized
tgatatggtcatcttttggtaa

SEQ ID NO: 1113352 - DNA, 22 bp, Artificial Sequence
  chemically synthesized
gatatggtcatcttttggtaat

SEQ ID NO: 1113353 - DNA, 22 bp, Artificial Sequence
  chemically synthesized
atatggtcatcttttggtaatt

SEQ ID NO: 1113354 - DNA, 22 bp, Artificial Sequence
  chemically synthesized
catattaatactgaaattacca

SEQ ID NO: 1113355 - DNA, 22 bp, Artificial Sequence
  chemically synthesized
ccatattaatactgaaattacc

SEQ ID NO: 1113356 - DNA, 22 bp, Artificial Sequence
  chemically synthesized
tccatattaatactgaaattac

SEQ ID NO: 1113357 - DNA, 22 bp, Artificial Sequence
  chemically synthesized
gttttccatattaatactgaaa

SEQ ID NO: 1113358 - DNA, 22 bp, Artificial Sequence
  chemically synthesized
ttggtaatttcagtattaatat

SEQ ID NO: 1113359 - DNA, 22 bp, Artificial Sequence
  chemically synthesized
tggtaatttcagtattaatatg

SEQ ID NO: 1113360 - DNA, 22 bp, Artificial Sequence
  chemically synthesized
ggtaatttcagtattaatatgg

SEQ ID NO: 1113361 - DNA, 22 bp, Artificial Sequence
  chemically synthesized
gtaatttcagtattaatatgga

SEQ ID NO: 1113362 - DNA, 22 bp, Artificial Sequence
  chemically synthesized
gataaactggttttccatatta

SEQ ID NO: 1113363 - DNA, 22 bp, Artificial Sequence
  chemically synthesized
agataaactggttttccatatt

SEQ ID NO: 1113364 - DNA, 22 bp, Artificial Sequence
  chemically synthesized
gtttagataaactggttttcca

SEQ ID NO: 1113365 - DNA, 22 bp, Artificial Sequence
  chemically synthesized
cagtattaatatggaaaaccag

SEQ ID NO: 1113366 - DNA, 22 bp, Artificial Sequence
  chemically synthesized
agtattaatatggaaaaccagt

SEQ ID NO: 1113367 - DNA, 22 bp, Artificial Sequence
  chemically synthesized
atatggaaaaccagtttatcta

SEQ ID NO: 1113368 - DNA, 22 bp, Artificial Sequence
  chemically synthesized
atctaaactaggcttttttgtg

SEQ ID NO: 1113369 - DNA, 22 bp, Artificial Sequence
  chemically synthesized
tctaaactaggcttttttgtgt

SEQ ID NO: 1113370 - DNA, 22 bp, Artificial Sequence
  chemically synthesized
atcaatcaggcataacacaaaa

SEQ ID NO: 1113371 - DNA, 22 bp, Artificial Sequence
  chemically synthesized
aactaggcttttttgtgttatg

SEQ ID NO: 1113372 - DNA, 22 bp, Artificial Sequence
  chemically synthesized
ggcttttttgtgttatgcctga

SEQ ID NO: 1113373 - DNA, 22 bp, Artificial Sequence
  chemically synthesized
ttttgtgttatgcctgattgat

SEQ ID NO: 1113374 - DNA, 22 bp, Artificial Sequence
  chemically synthesized
tttgtgttatgcctgattgatg

SEQ ID NO: 1113375 - DNA, 22 bp, Artificial Sequence
  chemically synthesized
ttgtgttatgcctgattgatga

SEQ ID NO: 1113376 - DNA, 22 bp, Artificial Sequence
  chemically synthesized
tgtgttatgcctgattgatgag

SEQ ID NO: 1113377 - DNA, 22 bp, Artificial Sequence
  chemically synthesized
gtgttatgcctgattgatgaga

SEQ ID NO: 1113378 - DNA, 22 bp, Artificial Sequence
  chemically synthesized
tgttatgcctgattgatgagac

SEQ ID NO: 1113379 - DNA, 22 bp, Artificial Sequence
  chemically synthesized
gcatgagtacatacagtctcat

SEQ ID NO: 1113380 - DNA, 22 bp, Artificial Sequence
  chemically synthesized
tgcctgattgatgagactgtat

SEQ ID NO: 1113381 - DNA, 22 bp, Artificial Sequence
  chemically synthesized
tcgcatgagtacatacagtctc

SEQ ID NO: 1113382 - DNA, 22 bp, Artificial Sequence
  chemically synthesized
attgatgagactgtatgtactc

SEQ ID NO: 1113383 - DNA, 22 bp, Artificial Sequence
  chemically synthesized
atgagactgtatgtactcatgc

SEQ ID NO: 1113384 - DNA, 22 bp, Artificial Sequence
  chemically synthesized
taaaacagtgttctcgcatgag

SEQ ID NO: 1113385 - DNA, 22 bp, Artificial Sequence
  chemically synthesized
gtaaaacagtgttctcgcatga

SEQ ID NO: 1113386 - DNA, 22 bp, Artificial Sequence
  chemically synthesized
tgtaaaacagtgttctcgcatg

SEQ ID NO: 1113387 - DNA, 22 bp, Artificial Sequence
  chemically synthesized
ttgtaaaacagtgttctcgcat

SEQ ID NO: 1113388 - DNA, 22 bp, Artificial Sequence
  chemically synthesized
tttgtaaaacagtgttctcgca

SEQ ID NO: 1113389 - DNA, 22 bp, Artificial Sequence
  chemically synthesized
tatgtactcatgcgagaacact

SEQ ID NO: 1113390 - DNA, 22 bp, Artificial Sequence
  chemically synthesized
atgcgagaacactgttttacaa

SEQ ID NO: 1113391 - DNA, 22 bp, Artificial Sequence
  chemically synthesized
gacgtaatcctttttgtaaaac

SEQ ID NO: 1113392 - DNA, 22 bp, Artificial Sequence
  chemically synthesized
ggattagacgtaatcctttttg

SEQ ID NO: 1113393 - DNA, 22 bp, Artificial Sequence
  chemically synthesized
aggattagacgtaatccttttt

SEQ ID NO: 1113394 - DNA, 22 bp, Artificial Sequence
  chemically synthesized
tttaggattagacgtaatcctt

SEQ ID NO: 1113395 - DNA, 22 bp, Artificial Sequence
  chemically synthesized
ttttacaaaaaggattacgtct

SEQ ID NO: 1113396 - DNA, 22 bp, Artificial Sequence
  chemically synthesized
tctatttaggattagacgtaat

SEQ ID NO: 1113397 - DNA, 22 bp, Artificial Sequence
  chemically synthesized
atctatttaggattagacgtaa

SEQ ID NO: 1113398 - DNA, 22 bp, Artificial Sequence
  chemically synthesized
tacaaaaaggattacgtctaat

SEQ ID NO: 1113399 - DNA, 22 bp, Artificial Sequence
  chemically synthesized
tatctatttaggattagacgta

SEQ ID NO: 1113400 - DNA, 22 bp, Artificial Sequence
  chemically synthesized
acaaaaaggattacgtctaatc

SEQ ID NO: 1113401 - DNA, 22 bp, Artificial Sequence
  chemically synthesized
ttatctatttaggattagacgt

SEQ ID NO: 1113402 - DNA, 22 bp, Artificial Sequence
  chemically synthesized
caaaaaggattacgtctaatcc

SEQ ID NO: 1113403 - DNA, 22 bp, Artificial Sequence
  chemically synthesized
tttttatctatttaggattaga

SEQ ID NO: 1113404 - DNA, 22 bp, Artificial Sequence
  chemically synthesized
cgtctaatcctaaatagataaa

SEQ ID NO: 1113405 - DNA, 22 bp, Artificial Sequence
  chemically synthesized
aacatatgtctgtttttatcta

SEQ ID NO: 1113406 - DNA, 22 bp, Artificial Sequence
  chemically synthesized
atcctaaatagataaaaacaga

SEQ ID NO: 1113407 - DNA, 22 bp, Artificial Sequence
  chemically synthesized
tacctaaacatatgtctgtttt

SEQ ID NO: 1113408 - DNA, 22 bp, Artificial Sequence
  chemically synthesized
aatagataaaaacagacatatg

SEQ ID NO: 1113409 - DNA, 22 bp, Artificial Sequence
  chemically synthesized
aaataatatacatatgattata

SEQ ID NO: 1113410 - DNA, 22 bp, Artificial Sequence
  chemically synthesized
gggctaaaataatatacatatg

SEQ ID NO: 1113411 - DNA, 22 bp, Artificial Sequence
  chemically synthesized
aggtataatcatatgtatatta

SEQ ID NO: 1113412 - DNA, 22 bp, Artificial Sequence
  chemically synthesized
ggtataatcatatgtatattat

SEQ ID NO: 1113413 - DNA, 22 bp, Artificial Sequence
  chemically synthesized
ggacaacctagggctaaaataa

SEQ ID NO: 1113414 - DNA, 22 bp, Artificial Sequence
  chemically synthesized
aggacaacctagggctaaaata

SEQ ID NO: 1113415 - DNA, 22 bp, Artificial Sequence
  chemically synthesized
taggacaacctagggctaaaat

SEQ ID NO: 1113416 - DNA, 22 bp, Artificial Sequence
  chemically synthesized
tggagttttaggacaacctagg

SEQ ID NO: 1113417 - DNA, 22 bp, Artificial Sequence
  chemically synthesized
ttttagccctaggttgtcctaa

SEQ ID NO: 1113418 - DNA, 22 bp, Artificial Sequence
  chemically synthesized
agattgtggagttttaggacaa

SEQ ID NO: 1113419 - DNA, 22 bp, Artificial Sequence
  chemically synthesized
tagccctaggttgtcctaaaac

SEQ ID NO: 1113420 - DNA, 22 bp, Artificial Sequence
  chemically synthesized
agccctaggttgtcctaaaact

SEQ ID NO: 1113421 - DNA, 22 bp, Artificial Sequence
  chemically synthesized
ttgagattgtggagttttagga

SEQ ID NO: 1113422 - DNA, 22 bp, Artificial Sequence
  chemically synthesized
gccctaggttgtcctaaaactc

SEQ ID NO: 1113423 - DNA, 22 bp, Artificial Sequence
  chemically synthesized
ggttgtcctaaaactccacaat

SEQ ID NO: 1113424 - DNA, 22 bp, Artificial Sequence
  chemically synthesized
agtgtattattgagattgtgga

SEQ ID NO: 1113425 - DNA, 22 bp, Artificial Sequence
  chemically synthesized
cagtgtattattgagattgtgg

SEQ ID NO: 1113426 - DNA, 22 bp, Artificial Sequence
  chemically synthesized
tcagtgtattattgagattgtg

SEQ ID NO: 1113427 - DNA, 22 bp, Artificial Sequence
  chemically synthesized
tcctaaaactccacaatctcaa

SEQ ID NO: 1113428 - DNA, 22 bp, Artificial Sequence
  chemically synthesized
aaactccacaatctcaataata

SEQ ID NO: 1113429 - DNA, 22 bp, Artificial Sequence
  chemically synthesized
cacaatctcaataatacactga

SEQ ID NO: 1113430 - DNA, 22 bp, Artificial Sequence
  chemically synthesized
atgaccaaggcctttcagtgta

SEQ ID NO: 1113431 - DNA, 22 bp, Artificial Sequence
  chemically synthesized
catgaccaaggcctttcagtgt

SEQ ID NO: 1113432 - DNA, 22 bp, Artificial Sequence
  chemically synthesized
tcatgaccaaggcctttcagtg

SEQ ID NO: 1113433 - DNA, 22 bp, Artificial Sequence
  chemically synthesized
aataatacactgaaaggccttg

SEQ ID NO: 1113434 - DNA, 22 bp, Artificial Sequence
  chemically synthesized
atgcctttcatgaccaaggcct

SEQ ID NO: 1113435 - DNA, 22 bp, Artificial Sequence
  chemically synthesized
aactgatgcctttcatgaccaa

SEQ ID NO: 1113436 - DNA, 22 bp, Artificial Sequence
  chemically synthesized
aaactgatgcctttcatgacca

SEQ ID NO: 1113437 - DNA, 22 bp, Artificial Sequence
  chemically synthesized
taaactgatgcctttcatgacc

SEQ ID NO: 1113438 - DNA, 22 bp, Artificial Sequence
  chemically synthesized
aaaggccttggtcatgaaaggc

SEQ ID NO: 1113439 - DNA, 22 bp, Artificial Sequence
  chemically synthesized
aacagtctttaaactgatgcct

SEQ ID NO: 1113440 - DNA, 22 bp, Artificial Sequence
  chemically synthesized
gaacagtctttaaactgatgcc

SEQ ID NO: 1113441 - DNA, 22 bp, Artificial Sequence
  chemically synthesized
ggtcatgaaaggcatcagttta

SEQ ID NO: 1113442 - DNA, 22 bp, Artificial Sequence
  chemically synthesized
gtcatgaaaggcatcagtttaa

SEQ ID NO: 1113443 - DNA, 22 bp, Artificial Sequence
  chemically synthesized
atttgaacagtctttaaactga

SEQ ID NO: 1113444 - DNA, 22 bp, Artificial Sequence
  chemically synthesized
aatttgaacagtctttaaactg

SEQ ID NO: 1113445 - DNA, 22 bp, Artificial Sequence
  chemically synthesized
taatttgaacagtctttaaact

SEQ ID NO: 1113446 - DNA, 22 bp, Artificial Sequence
  chemically synthesized
agattttaatttgaacagtctt

SEQ ID NO: 1113447 - DNA, 22 bp, Artificial Sequence
  chemically synthesized
taagattttaatttgaacagtc

SEQ ID NO: 1113448 - DNA, 22 bp, Artificial Sequence
  chemically synthesized
ctaagattttaatttgaacagt

SEQ ID NO: 1113449 - DNA, 22 bp, Artificial Sequence
  chemically synthesized
tctaagattttaatttgaacag

SEQ ID NO: 1113450 - DNA, 22 bp, Artificial Sequence
  chemically synthesized
aaagactgttcaaattaaaatc

SEQ ID NO: 1113451 - DNA, 22 bp, Artificial Sequence
  chemically synthesized
aagactgttcaaattaaaatct

SEQ ID NO: 1113452 - DNA, 22 bp, Artificial Sequence
  chemically synthesized
ataatggttttctaagatttta

SEQ ID NO: 1113453 - DNA, 22 bp, Artificial Sequence
  chemically synthesized
actaataatggttttctaagat

SEQ ID NO: 1113454 - DNA, 22 bp, Artificial Sequence
  chemically synthesized
ttcaaattaaaatcttagaaaa

SEQ ID NO: 1113455 - DNA, 22 bp, Artificial Sequence
  chemically synthesized
ctaactaataatggttttctaa

SEQ ID NO: 1113456 - DNA, 22 bp, Artificial Sequence
  chemically synthesized
aaattaaaatcttagaaaacca

SEQ ID NO: 1113457 - DNA, 22 bp, Artificial Sequence
  chemically synthesized
aaatcttagaaaaccattatta

SEQ ID NO: 1113458 - DNA, 22 bp, Artificial Sequence
  chemically synthesized
ataatattgctaactaataatg

SEQ ID NO: 1113459 - DNA, 22 bp, Artificial Sequence
  chemically synthesized
aataatattgctaactaataat

SEQ ID NO: 1113460 - DNA, 22 bp, Artificial Sequence
  chemically synthesized
taataatattgctaactaataa

SEQ ID NO: 1113461 - DNA, 22 bp, Artificial Sequence
  chemically synthesized
agaaaaccattattagttagca

SEQ ID NO: 1113462 - DNA, 22 bp, Artificial Sequence
  chemically synthesized
gaaaaccattattagttagcaa

SEQ ID NO: 1113463 - DNA, 22 bp, Artificial Sequence
  chemically synthesized
atgctttaataatattgctaac

SEQ ID NO: 1113464 - DNA, 22 bp, Artificial Sequence
  chemically synthesized
taatgctttaataatattgcta

SEQ ID NO: 1113465 - DNA, 22 bp, Artificial Sequence
  chemically synthesized
ctaatgctttaataatattgct

SEQ ID NO: 1113466 - DNA, 22 bp, Artificial Sequence
  chemically synthesized
tctaatgctttaataatattgc

SEQ ID NO: 1113467 - DNA, 22 bp, Artificial Sequence
  chemically synthesized
ttagttagcaatattattaaag

SEQ ID NO: 1113468 - DNA, 22 bp, Artificial Sequence
  chemically synthesized
gttagcaatattattaaagcat

SEQ ID NO: 1113469 - DNA, 22 bp, Artificial Sequence
  chemically synthesized
gcaatattattaaagcattaga

SEQ ID NO: 1113470 - DNA, 22 bp, Artificial Sequence
  chemically synthesized
aatatagtaagtaatctttcta

SEQ ID NO: 1113471 - DNA, 22 bp, Artificial Sequence
  chemically synthesized
ttaaagcattagaaagattact

SEQ ID NO: 1113472 - DNA, 22 bp, Artificial Sequence
  chemically synthesized
aagcattagaaagattacttac

SEQ ID NO: 1113473 - DNA, 22 bp, Artificial Sequence
  chemically synthesized
gccattaaatatagtaagtaat

SEQ ID NO: 1113474 - DNA, 22 bp, Artificial Sequence
  chemically synthesized
agccattaaatatagtaagtaa

SEQ ID NO: 1113475 - DNA, 22 bp, Artificial Sequence
  chemically synthesized
gaaagattacttactatattta

SEQ ID NO: 1113476 - DNA, 22 bp, Artificial Sequence
  chemically synthesized
gaaaaatttagccattaaatat

SEQ ID NO: 1113477 - DNA, 22 bp, Artificial Sequence
  chemically synthesized
agaaaaatttagccattaaata

SEQ ID NO: 1113478 - DNA, 22 bp, Artificial Sequence
  chemically synthesized
cttactatatttaatggctaaa

SEQ ID NO: 1113479 - DNA, 22 bp, Artificial Sequence
  chemically synthesized
gaaatttagaaaaatttagcca

SEQ ID NO: 1113480 - DNA, 22 bp, Artificial Sequence
  chemically synthesized
actatatttaatggctaaattt

SEQ ID NO: 1113481 - DNA, 22 bp, Artificial Sequence
  chemically synthesized
agaaatttagaaaaatttagcc

SEQ ID NO: 1113482 - DNA, 22 bp, Artificial Sequence
  chemically synthesized
ctatatttaatggctaaatttt

SEQ ID NO: 1113483 - DNA, 22 bp, Artificial Sequence
  chemically synthesized
tatttaatggctaaatttttct

SEQ ID NO: 1113484 - DNA, 22 bp, Artificial Sequence
  chemically synthesized
aatggctaaatttttctaaatt

SEQ ID NO: 1113485 - DNA, 22 bp, Artificial Sequence
  chemically synthesized
atggctaaatttttctaaattt

SEQ ID NO: 1113486 - DNA, 22 bp, Artificial Sequence
  chemically synthesized
taaataatttagaaatttagaa

SEQ ID NO: 1113487 - DNA, 22 bp, Artificial Sequence
  chemically synthesized
aatttttctaaatttctaaatt

SEQ ID NO: 1113488 - DNA, 22 bp, Artificial Sequence
  chemically synthesized
ttctaaatttctaaattattta

SEQ ID NO: 1113489 - DNA, 22 bp, Artificial Sequence
  chemically synthesized
tctaaatttctaaattatttat

SEQ ID NO: 1113490 - DNA, 22 bp, Artificial Sequence
  chemically synthesized
ctaaatttctaaattatttata

SEQ ID NO: 1113491 - DNA, 22 bp, Artificial Sequence
  chemically synthesized
aatacaaaatgttataaataat

SEQ ID NO: 1113492 - DNA, 22 bp, Artificial Sequence
  chemically synthesized
taaatttctaaattatttataa

SEQ ID NO: 1113493 - DNA, 22 bp, Artificial Sequence
  chemically synthesized
aaatacaaaatgttataaataa

SEQ ID NO: 1113494 - DNA, 22 bp, Artificial Sequence
  chemically synthesized
aatttctaaattatttataaca

SEQ ID NO: 1113495 - DNA, 22 bp, Artificial Sequence
  chemically synthesized
atttaaatacaaaatgttataa

SEQ ID NO: 1113496 - DNA, 22 bp, Artificial Sequence
  chemically synthesized
aatttaaatacaaaatgttata

SEQ ID NO: 1113497 - DNA, 22 bp, Artificial Sequence
  chemically synthesized
ctaaattatttataacattttg

SEQ ID NO: 1113498 - DNA, 22 bp, Artificial Sequence
  chemically synthesized
ttaatttaaatacaaaatgtta

SEQ ID NO: 1113499 - DNA, 22 bp, Artificial Sequence
  chemically synthesized
taaattatttataacattttgt

SEQ ID NO: 1113500 - DNA, 22 bp, Artificial Sequence
  chemically synthesized
cttaatttaaatacaaaatgtt

SEQ ID NO: 1113501 - DNA, 22 bp, Artificial Sequence
  chemically synthesized
aattatttataacattttgtat

SEQ ID NO: 1113502 - DNA, 22 bp, Artificial Sequence
  chemically synthesized
catttcttaatttaaatacaaa

SEQ ID NO: 1113503 - DNA, 22 bp, Artificial Sequence
  chemically synthesized
acatttcttaatttaaatacaa

SEQ ID NO: 1113504 - DNA, 22 bp, Artificial Sequence
  chemically synthesized
tttataacattttgtatttaaa

SEQ ID NO: 1113505 - DNA, 22 bp, Artificial Sequence
  chemically synthesized
tacatttcttaatttaaataca

SEQ ID NO: 1113506 - DNA, 22 bp, Artificial Sequence
  chemically synthesized
ttacatttcttaatttaaatac

SEQ ID NO: 1113507 - DNA, 22 bp, Artificial Sequence
  chemically synthesized
ataacattttgtatttaaatta

SEQ ID NO: 1113508 - DNA, 22 bp, Artificial Sequence
  chemically synthesized
taacattttgtatttaaattaa

SEQ ID NO: 1113509 - DNA, 22 bp, Artificial Sequence
  chemically synthesized
tttttacatttcttaatttaaa

SEQ ID NO: 1113510 - DNA, 22 bp, Artificial Sequence
  chemically synthesized
atttttacatttcttaatttaa

SEQ ID NO: 1113511 - DNA, 22 bp, Artificial Sequence
  chemically synthesized
aggtttatttttacatttctta

SEQ ID NO: 1113512 - DNA, 22 bp, Artificial Sequence
  chemically synthesized
tgtatttaaattaagaaatgta

SEQ ID NO: 1113513 - DNA, 22 bp, Artificial Sequence
  chemically synthesized
aaggtttatttttacatttctt

SEQ ID NO: 1113514 - DNA, 22 bp, Artificial Sequence
  chemically synthesized
gtatttaaattaagaaatgtaa

SEQ ID NO: 1113515 - DNA, 22 bp, Artificial Sequence
  chemically synthesized
taaggtttatttttacatttct

SEQ ID NO: 1113516 - DNA, 22 bp, Artificial Sequence
  chemically synthesized
tatttaaattaagaaatgtaaa

SEQ ID NO: 1113517 - DNA, 22 bp, Artificial Sequence
  chemically synthesized
aaattaagaaatgtaaaaataa

SEQ ID NO: 1113518 - DNA, 22 bp, Artificial Sequence
  chemically synthesized
aattaagaaatgtaaaaataaa

SEQ ID NO: 1113519 - DNA, 22 bp, Artificial Sequence
  chemically synthesized
agaaatgtaaaaataaacctta

SEQ ID NO: 1113520 - DNA, 22 bp, Artificial Sequence
  chemically synthesized
agaaagatgtgatataacttta

SEQ ID NO: 1113521 - DNA, 22 bp, Artificial Sequence
  chemically synthesized
aagaaagatgtgatataacttt

SEQ ID NO: 1113522 - DNA, 22 bp, Artificial Sequence
  chemically synthesized
taagaaagatgtgatataactt

SEQ ID NO: 1113523 - DNA, 22 bp, Artificial Sequence
  chemically synthesized
ttaagaaagatgtgatataact

SEQ ID NO: 1113524 - DNA, 22 bp, Artificial Sequence
  chemically synthesized
tttaagaaagatgtgatataac

SEQ ID NO: 1113525 - DNA, 22 bp, Artificial Sequence
  chemically synthesized
ctttttaagaaagatgtgatat

SEQ ID NO: 1113526 - DNA, 22 bp, Artificial Sequence
  chemically synthesized
actttttaagaaagatgtgata

SEQ ID NO: 1113527 - DNA, 22 bp, Artificial Sequence
  chemically synthesized
tactttttaagaaagatgtgat

SEQ ID NO: 1113528 - DNA, 22 bp, Artificial Sequence
  chemically synthesized
ttttactttttaagaaagatgt

SEQ ID NO: 1113529 - DNA, 22 bp, Artificial Sequence
  chemically synthesized
aaagttatatcacatctttctt

SEQ ID NO: 1113530 - DNA, 22 bp, Artificial Sequence
  chemically synthesized
attttactttttaagaaagatg

SEQ ID NO: 1113531 - DNA, 22 bp, Artificial Sequence
  chemically synthesized
aagttatatcacatctttctta

SEQ ID NO: 1113532 - DNA, 22 bp, Artificial Sequence
  chemically synthesized
tattttactttttaagaaagat

SEQ ID NO: 1113533 - DNA, 22 bp, Artificial Sequence
  chemically synthesized
tttattttactttttaagaaag

SEQ ID NO: 1113534 - DNA, 22 bp, Artificial Sequence
  chemically synthesized
tatcacatctttcttaaaaagt

SEQ ID NO: 1113535 - DNA, 22 bp, Artificial Sequence
  chemically synthesized
caaattctttattttacttttt

SEQ ID NO: 1113536 - DNA, 22 bp, Artificial Sequence
  chemically synthesized
ccaaattctttattttactttt

SEQ ID NO: 1113537 - DNA, 22 bp, Artificial Sequence
  chemically synthesized
tcttaaaaagtaaaataaagaa

SEQ ID NO: 1113538 - DNA, 22 bp, Artificial Sequence
  chemically synthesized
cttaaaaagtaaaataaagaat

SEQ ID NO: 1113539 - DNA, 22 bp, Artificial Sequence
  chemically synthesized
ttaaaaagtaaaataaagaatt

SEQ ID NO: 1113540 - DNA, 22 bp, Artificial Sequence
  chemically synthesized
aaaaagtaaaataaagaatttg

SEQ ID NO: 1113541 - DNA, 22 bp, Artificial Sequence
  chemically synthesized
aaaagtaaaataaagaatttgg

SEQ ID NO: 1113542 - DNA, 22 bp, Artificial Sequence
  chemically synthesized
aaaagggagtttccaaattctt

SEQ ID NO: 1113543 - DNA, 22 bp, Artificial Sequence
  chemically synthesized
tgcatattgaaaagggagtttc

SEQ ID NO: 1113544 - DNA, 22 bp, Artificial Sequence
  chemically synthesized
atgtagctgtgcatattgaaaa

SEQ ID NO: 1113545 - DNA, 22 bp, Artificial Sequence
  chemically synthesized
ggaaactcccttttcaatatgc

SEQ ID NO: 1113546 - DNA, 22 bp, Artificial Sequence
  chemically synthesized
gaaactcccttttcaatatgca

SEQ ID NO: 1113547 - DNA, 22 bp, Artificial Sequence
  chemically synthesized
tatattcatgtagctgtgcata

SEQ ID NO: 1113548 - DNA, 22 bp, Artificial Sequence
  chemically synthesized
atatattcatgtagctgtgcat

SEQ ID NO: 1113549 - DNA, 22 bp, Artificial Sequence
  chemically synthesized
ccttttcaatatgcacagctac

SEQ ID NO: 1113550 - DNA, 22 bp, Artificial Sequence
  chemically synthesized
ttcaatatgcacagctacatga

SEQ ID NO: 1113551 - DNA, 22 bp, Artificial Sequence
  chemically synthesized
tcaatatgcacagctacatgaa

SEQ ID NO: 1113552 - DNA, 22 bp, Artificial Sequence
  chemically synthesized
caatatgcacagctacatgaat

SEQ ID NO: 1113553 - DNA, 22 bp, Artificial Sequence
  chemically synthesized
aatatgcacagctacatgaata

SEQ ID NO: 1113554 - DNA, 22 bp, Artificial Sequence
  chemically synthesized
gtgatgtatttatatattcatg

SEQ ID NO: 1113555 - DNA, 22 bp, Artificial Sequence
  chemically synthesized
catgaatatataaatacatcac

SEQ ID NO: 1113556 - DNA, 22 bp, Artificial Sequence
  chemically synthesized
gaccaggtatctagtgatgtat

SEQ ID NO: 1113557 - DNA, 22 bp, Artificial Sequence
  chemically synthesized
atgagggcaagtgagaggctag

SEQ ID NO: 1113558 - DNA, 22 bp, Artificial Sequence
  chemically synthesized
aatgagggcaagtgagaggcta

SEQ ID NO: 1113559 - DNA, 22 bp, Artificial Sequence
  chemically synthesized
gatacctggtctagcctctcac

SEQ ID NO: 1113560 - DNA, 22 bp, Artificial Sequence
  chemically synthesized
acttaatgagggcaagtgagag

SEQ ID NO: 1113561 - DNA, 22 bp, Artificial Sequence
  chemically synthesized
ttaacttaatgagggcaagtga

SEQ ID NO: 1113562 - DNA, 22 bp, Artificial Sequence
  chemically synthesized
gtctagcctctcacttgccctc

SEQ ID NO: 1113563 - DNA, 22 bp, Artificial Sequence
  chemically synthesized
gcctctcacttgccctcattaa

SEQ ID NO: 1113564 - DNA, 22 bp, Artificial Sequence
  chemically synthesized
aggaaactgttaacttaatgag

SEQ ID NO: 1113565 - DNA, 22 bp, Artificial Sequence
  chemically synthesized
tcacttgccctcattaagttaa

SEQ ID NO: 1113566 - DNA, 22 bp, Artificial Sequence
  chemically synthesized
acttgccctcattaagttaaca

SEQ ID NO: 1113567 - DNA, 22 bp, Artificial Sequence
  chemically synthesized
gtctcaggaaactgttaactta

SEQ ID NO: 1113568 - DNA, 22 bp, Artificial Sequence
  chemically synthesized
gccctcattaagttaacagttt

SEQ ID NO: 1113569 - DNA, 22 bp, Artificial Sequence
  chemically synthesized
ccctcattaagttaacagtttc

SEQ ID NO: 1113570 - DNA, 22 bp, Artificial Sequence
  chemically synthesized
attaagttaacagtttcctgag

SEQ ID NO: 1113571 - DNA, 22 bp, Artificial Sequence
  chemically synthesized
gatcataaccctggtctcagga

SEQ ID NO: 1113572 - DNA, 22 bp, Artificial Sequence
  chemically synthesized
agttaacagtttcctgagacca

SEQ ID NO: 1113573 - DNA, 22 bp, Artificial Sequence
  chemically synthesized
ggatcataaccctggtctcagg

SEQ ID NO: 1113574 - DNA, 22 bp, Artificial Sequence
  chemically synthesized
tggatcataaccctggtctcag

SEQ ID NO: 1113575 - DNA, 22 bp, Artificial Sequence
  chemically synthesized
acagtttcctgagaccagggtt

SEQ ID NO: 1113576 - DNA, 22 bp, Artificial Sequence
  chemically synthesized
cctgagaccagggttatgatcc

SEQ ID NO: 1113577 - DNA, 22 bp, Artificial Sequence
  chemically synthesized
ctgagaccagggttatgatcca

SEQ ID NO: 1113578 - DNA, 22 bp, Artificial Sequence
  chemically synthesized
agaccagggttatgatccaaag

SEQ ID NO: 1113579 - DNA, 22 bp, Artificial Sequence
  chemically synthesized
ccgtcaatatgtaagctttgga

SEQ ID NO: 1113580 - DNA, 22 bp, Artificial Sequence
  chemically synthesized
accgtcaatatgtaagctttgg

SEQ ID NO: 1113581 - DNA, 22 bp, Artificial Sequence
  chemically synthesized
tgatccaaagcttacatattga

SEQ ID NO: 1113582 - DNA, 22 bp, Artificial Sequence
  chemically synthesized
atgcagcttaccgtcaatatgt

SEQ ID NO: 1113583 - DNA, 22 bp, Artificial Sequence
  chemically synthesized
catgcagcttaccgtcaatatg

SEQ ID NO: 1113584 - DNA, 22 bp, Artificial Sequence
  chemically synthesized
tcatgcagcttaccgtcaatat

SEQ ID NO: 1113585 - DNA, 22 bp, Artificial Sequence
  chemically synthesized
taattttcatgcagcttaccgt

SEQ ID NO: 1113586 - DNA, 22 bp, Artificial Sequence
  chemically synthesized
acatattgacggtaagctgcat

SEQ ID NO: 1113587 - DNA, 22 bp, Artificial Sequence
  chemically synthesized
catattgacggtaagctgcatg

SEQ ID NO: 1113588 - DNA, 22 bp, Artificial Sequence
  chemically synthesized
gatagctgtaattttcatgcag

SEQ ID NO: 1113589 - DNA, 22 bp, Artificial Sequence
  chemically synthesized
ggatagctgtaattttcatgca

SEQ ID NO: 1113590 - DNA, 22 bp, Artificial Sequence
  chemically synthesized
tggatagctgtaattttcatgc

SEQ ID NO: 1113591 - DNA, 22 bp, Artificial Sequence
  chemically synthesized
ttggatagctgtaattttcatg

SEQ ID NO: 1113592 - DNA, 22 bp, Artificial Sequence
  chemically synthesized
acggtaagctgcatgaaaatta

SEQ ID NO: 1113593 - DNA, 22 bp, Artificial Sequence
  chemically synthesized
gagacatttttggatagctgta

SEQ ID NO: 1113594 - DNA, 22 bp, Artificial Sequence
  chemically synthesized
catgaaaattacagctatccaa

SEQ ID NO: 1113595 - DNA, 22 bp, Artificial Sequence
  chemically synthesized
ctagagacatttttggatagct

SEQ ID NO: 1113596 - DNA, 22 bp, Artificial Sequence
  chemically synthesized
actagagacatttttggatagc

SEQ ID NO: 1113597 - DNA, 22 bp, Artificial Sequence
  chemically synthesized
tactagagacatttttggatag

SEQ ID NO: 1113598 - DNA, 22 bp, Artificial Sequence
  chemically synthesized
ttactagagacatttttggata

SEQ ID NO: 1113599 - DNA, 22 bp, Artificial Sequence
  chemically synthesized
tttactagagacatttttggat

SEQ ID NO: 1113600 - DNA, 22 bp, Artificial Sequence
  chemically synthesized
tttttactagagacatttttgg

SEQ ID NO: 1113601 - DNA, 22 bp, Artificial Sequence
  chemically synthesized
cagctatccaaaaatgtctcta

SEQ ID NO: 1113602 - DNA, 22 bp, Artificial Sequence
  chemically synthesized
tccaaaaatgtctctagtaaaa

SEQ ID NO: 1113603 - DNA, 22 bp, Artificial Sequence
  chemically synthesized
gatggtgcaaagtacctctttt

SEQ ID NO: 1113604 - DNA, 22 bp, Artificial Sequence
  chemically synthesized
tagtaaaaagaggtactttgca

SEQ ID NO: 1113605 - DNA, 22 bp, Artificial Sequence
  chemically synthesized
gtaaaaagaggtactttgcacc

SEQ ID NO: 1113606 - DNA, 22 bp, Artificial Sequence
  chemically synthesized
gataaatgtgacagaatattgg

SEQ ID NO: 1113607 - DNA, 22 bp, Artificial Sequence
  chemically synthesized
tgcaccatccaatattctgtca

SEQ ID NO: 1113608 - DNA, 22 bp, Artificial Sequence
  chemically synthesized
gttggataaatgtgacagaata

SEQ ID NO: 1113609 - DNA, 22 bp, Artificial Sequence
  chemically synthesized
gcaccatccaatattctgtcac

SEQ ID NO: 1113610 - DNA, 22 bp, Artificial Sequence
  chemically synthesized
caccatccaatattctgtcaca

SEQ ID NO: 1113611 - DNA, 22 bp, Artificial Sequence
  chemically synthesized
attggttggataaatgtgacag

SEQ ID NO: 1113612 - DNA, 22 bp, Artificial Sequence
  chemically synthesized
tgtcagcattaattggttggat

SEQ ID NO: 1113613 - DNA, 22 bp, Artificial Sequence
  chemically synthesized
atgtcagcattaattggttgga

SEQ ID NO: 1113614 - DNA, 22 bp, Artificial Sequence
  chemically synthesized
tgtcacatttatccaaccaatt

SEQ ID NO: 1113615 - DNA, 22 bp, Artificial Sequence
  chemically synthesized
ttatgtcagcattaattggttg

SEQ ID NO: 1113616 - DNA, 22 bp, Artificial Sequence
  chemically synthesized
tcacatttatccaaccaattaa

SEQ ID NO: 1113617 - DNA, 22 bp, Artificial Sequence
  chemically synthesized
ttcttatgtcagcattaattgg

SEQ ID NO: 1113618 - DNA, 22 bp, Artificial Sequence
  chemically synthesized
ctgttcttatgtcagcattaat

SEQ ID NO: 1113619 - DNA, 22 bp, Artificial Sequence
  chemically synthesized
actgttcttatgtcagcattaa

SEQ ID NO: 1113620 - DNA, 22 bp, Artificial Sequence
  chemically synthesized
atccaaccaattaatgctgaca

SEQ ID NO: 1113621 - DNA, 22 bp, Artificial Sequence
  chemically synthesized
tccaaccaattaatgctgacat

SEQ ID NO: 1113622 - DNA, 22 bp, Artificial Sequence
  chemically synthesized
atttactgttcttatgtcagca

SEQ ID NO: 1113623 - DNA, 22 bp, Artificial Sequence
  chemically synthesized
aaattaatttactgttcttatg

SEQ ID NO: 1113624 - DNA, 22 bp, Artificial Sequence
  chemically synthesized
atgctgacataagaacagtaaa

SEQ ID NO: 1113625 - DNA, 22 bp, Artificial Sequence
  chemically synthesized
acattaaaattaatttactgtt

SEQ ID NO: 1113626 - DNA, 22 bp, Artificial Sequence
  chemically synthesized
acataagaacagtaaattaatt

SEQ ID NO: 1113627 - DNA, 22 bp, Artificial Sequence
  chemically synthesized
aactaacattaaaattaattta

SEQ ID NO: 1113628 - DNA, 22 bp, Artificial Sequence
  chemically synthesized
gaactaacattaaaattaattt

SEQ ID NO: 1113629 - DNA, 22 bp, Artificial Sequence
  chemically synthesized
tttgaactaacattaaaattaa

SEQ ID NO: 1113630 - DNA, 22 bp, Artificial Sequence
  chemically synthesized
gtttgaactaacattaaaatta

SEQ ID NO: 1113631 - DNA, 22 bp, Artificial Sequence
  chemically synthesized
tgtttgaactaacattaaaatt

SEQ ID NO: 1113632 - DNA, 22 bp, Artificial Sequence
  chemically synthesized
ttgtttgaactaacattaaaat

SEQ ID NO: 1113633 - DNA, 22 bp, Artificial Sequence
  chemically synthesized
tttgtttgaactaacattaaaa

SEQ ID NO: 1113634 - DNA, 22 bp, Artificial Sequence
  chemically synthesized
tattttttgtttgaactaacat

SEQ ID NO: 1113635 - DNA, 22 bp, Artificial Sequence
  chemically synthesized
gctgtattttttgtttgaacta

SEQ ID NO: 1113636 - DNA, 22 bp, Artificial Sequence
  chemically synthesized
agctgtattttttgtttgaact

SEQ ID NO: 1113637 - DNA, 22 bp, Artificial Sequence
  chemically synthesized
attttaatgttagttcaaacaa

SEQ ID NO: 1113638 - DNA, 22 bp, Artificial Sequence
  chemically synthesized
tcttagctgtattttttgtttg

SEQ ID NO: 1113639 - DNA, 22 bp, Artificial Sequence
  chemically synthesized
taatgttagttcaaacaaaaaa

SEQ ID NO: 1113640 - DNA, 22 bp, Artificial Sequence
  chemically synthesized
aatgttagttcaaacaaaaaat

SEQ ID NO: 1113641 - DNA, 22 bp, Artificial Sequence
  chemically synthesized
tatcttagctgtattttttgtt

SEQ ID NO: 1113642 - DNA, 22 bp, Artificial Sequence
  chemically synthesized
atgttagttcaaacaaaaaata

SEQ ID NO: 1113643 - DNA, 22 bp, Artificial Sequence
  chemically synthesized
tctctatcttagctgtattttt

SEQ ID NO: 1113644 - DNA, 22 bp, Artificial Sequence
  chemically synthesized
atctctatcttagctgtatttt

SEQ ID NO: 1113645 - DNA, 22 bp, Artificial Sequence
  chemically synthesized
gttcaaacaaaaaatacagcta

SEQ ID NO: 1113646 - DNA, 22 bp, Artificial Sequence
  chemically synthesized
atttatctctatcttagctgta

SEQ ID NO: 1113647 - DNA, 22 bp, Artificial Sequence
  chemically synthesized
aaacaaaaaatacagctaagat

SEQ ID NO: 1113648 - DNA, 22 bp, Artificial Sequence
  chemically synthesized
actgatttatctctatcttagc

SEQ ID NO: 1113649 - DNA, 22 bp, Artificial Sequence
  chemically synthesized
aactgatttatctctatcttag

SEQ ID NO: 1113650 - DNA, 22 bp, Artificial Sequence
  chemically synthesized
taactgatttatctctatctta

SEQ ID NO: 1113651 - DNA, 22 bp, Artificial Sequence
  chemically synthesized
ttaactgatttatctctatctt

SEQ ID NO: 1113652 - DNA, 22 bp, Artificial Sequence
  chemically synthesized
gtataatttttaactgatttat

SEQ ID NO: 1113653 - DNA, 22 bp, Artificial Sequence
  chemically synthesized
ggtataatttttaactgattta

SEQ ID NO: 1113654 - DNA, 22 bp, Artificial Sequence
  chemically synthesized
tggtataatttttaactgattt

SEQ ID NO: 1113655 - DNA, 22 bp, Artificial Sequence
  chemically synthesized
agatagagataaatcagttaaa

SEQ ID NO: 1113656 - DNA, 22 bp, Artificial Sequence
  chemically synthesized
gcatgaaattttggtataattt

SEQ ID NO: 1113657 - DNA, 22 bp, Artificial Sequence
  chemically synthesized
ggcatgaaattttggtataatt

SEQ ID NO: 1113658 - DNA, 22 bp, Artificial Sequence
  chemically synthesized
tggcatgaaattttggtataat

SEQ ID NO: 1113659 - DNA, 22 bp, Artificial Sequence
  chemically synthesized
gcattttggcatgaaattttgg

SEQ ID NO: 1113660 - DNA, 22 bp, Artificial Sequence
  chemically synthesized
tggcattttggcatgaaatttt

SEQ ID NO: 1113661 - DNA, 22 bp, Artificial Sequence
  chemically synthesized
aaaattataccaaaatttcatg

SEQ ID NO: 1113662 - DNA, 22 bp, Artificial Sequence
  chemically synthesized
ctggcattttggcatgaaattt

SEQ ID NO: 1113663 - DNA, 22 bp, Artificial Sequence
  chemically synthesized
taccaaaatttcatgccaaaat

SEQ ID NO: 1113664 - DNA, 22 bp, Artificial Sequence
  chemically synthesized
catgccaaaatgccagaaacgt

SEQ ID NO: 1113665 - DNA, 22 bp, Artificial Sequence
  chemically synthesized
aaaaaaaaaatcacgtttctgg

SEQ ID NO: 1113666 - DNA, 22 bp, Artificial Sequence
  chemically synthesized
atgccaaaatgccagaaacgtg

SEQ ID NO: 1113667 - DNA, 22 bp, Artificial Sequence
  chemically synthesized
actaaaaaaaaaaatcacgttt

SEQ ID NO: 1113668 - DNA, 22 bp, Artificial Sequence
  chemically synthesized
aaaggagagtgttaactaaaaa

SEQ ID NO: 1113669 - DNA, 22 bp, Artificial Sequence
  chemically synthesized
ctaaaaggagagtgttaactaa

SEQ ID NO: 1113670 - DNA, 22 bp, Artificial Sequence
  chemically synthesized
ttttttttagttaacactctcc

SEQ ID NO: 1113671 - DNA, 22 bp, Artificial Sequence
  chemically synthesized
tttttttagttaacactctcct

SEQ ID NO: 1113672 - DNA, 22 bp, Artificial Sequence
  chemically synthesized
ttttttagttaacactctcctt

SEQ ID NO: 1113673 - DNA, 22 bp, Artificial Sequence
  chemically synthesized
tttttagttaacactctccttt

SEQ ID NO: 1113674 - DNA, 22 bp, Artificial Sequence
  chemically synthesized
ttttagttaacactctcctttt

SEQ ID NO: 1113675 - DNA, 22 bp, Artificial Sequence
  chemically synthesized
tttagttaacactctcctttta

SEQ ID NO: 1113676 - DNA, 22 bp, Artificial Sequence
  chemically synthesized
ttagttaacactctccttttag

SEQ ID NO: 1113677 - DNA, 22 bp, Artificial Sequence
  chemically synthesized
tagttaacactctccttttagt

SEQ ID NO: 1113678 - DNA, 22 bp, Artificial Sequence
  chemically synthesized
aaaagagaagctactaaaagga

SEQ ID NO: 1113679 - DNA, 22 bp, Artificial Sequence
  chemically synthesized
agttaacactctccttttagta

SEQ ID NO: 1113680 - DNA, 22 bp, Artificial Sequence
  chemically synthesized
gttaacactctccttttagtag

SEQ ID NO: 1113681 - DNA, 22 bp, Artificial Sequence
  chemically synthesized
acactctccttttagtagcttc

SEQ ID NO: 1113682 - DNA, 22 bp, Artificial Sequence
  chemically synthesized
tccttttagtagcttctctttt

SEQ ID NO: 1113683 - DNA, 22 bp, Artificial Sequence
  chemically synthesized
cttttagtagcttctcttttta

SEQ ID NO: 1113684 - DNA, 22 bp, Artificial Sequence
  chemically synthesized
acgatcatagactaaaaagaga

SEQ ID NO: 1113685 - DNA, 22 bp, Artificial Sequence
  chemically synthesized
cacgatcatagactaaaaagag

SEQ ID NO: 1113686 - DNA, 22 bp, Artificial Sequence
  chemically synthesized
tcacgatcatagactaaaaaga

SEQ ID NO: 1113687 - DNA, 22 bp, Artificial Sequence
  chemically synthesized
ttagtagcttctctttttagtc

SEQ ID NO: 1113688 - DNA, 22 bp, Artificial Sequence
  chemically synthesized
tagtagcttctctttttagtct

SEQ ID NO: 1113689 - DNA, 22 bp, Artificial Sequence
  chemically synthesized
agtagcttctctttttagtcta

SEQ ID NO: 1113690 - DNA, 22 bp, Artificial Sequence
  chemically synthesized
gtagcttctctttttagtctat

SEQ ID NO: 1113691 - DNA, 22 bp, Artificial Sequence
  chemically synthesized
ctctttttagtctatgatcgtg

SEQ ID NO: 1113692 - DNA, 22 bp, Artificial Sequence
  chemically synthesized
tctttttagtctatgatcgtga

SEQ ID NO: 1113693 - DNA, 22 bp, Artificial Sequence
  chemically synthesized
tttttagtctatgatcgtgaaa

SEQ ID NO: 1113694 - DNA, 22 bp, Artificial Sequence
  chemically synthesized
tttagtctatgatcgtgaaaga

SEQ ID NO: 1113695 - DNA, 22 bp, Artificial Sequence
  chemically synthesized
ttagtctatgatcgtgaaagat

SEQ ID NO: 1113696 - DNA, 22 bp, Artificial Sequence
  chemically synthesized
tagtctatgatcgtgaaagatc

SEQ ID NO: 1113697 - DNA, 22 bp, Artificial Sequence
  chemically synthesized
agtctatgatcgtgaaagatca

SEQ ID NO: 1113698 - DNA, 22 bp, Artificial Sequence
  chemically synthesized
gtctatgatcgtgaaagatcac

SEQ ID NO: 1113699 - DNA, 22 bp, Artificial Sequence
  chemically synthesized
gtcagagtagaagtgatctttc

SEQ ID NO: 1113700 - DNA, 22 bp, Artificial Sequence
  chemically synthesized
ggtcagagtagaagtgatcttt

SEQ ID NO: 1113701 - DNA, 22 bp, Artificial Sequence
  chemically synthesized
tggtcagagtagaagtgatctt

SEQ ID NO: 1113702 - DNA, 22 bp, Artificial Sequence
  chemically synthesized
ttggtcagagtagaagtgatct

SEQ ID NO: 1113703 - DNA, 22 bp, Artificial Sequence
  chemically synthesized
tgatcgtgaaagatcacttcta

SEQ ID NO: 1113704 - DNA, 22 bp, Artificial Sequence
  chemically synthesized
ttttggtcagagtagaagtgat

SEQ ID NO: 1113705 - DNA, 22 bp, Artificial Sequence
  chemically synthesized
cagttcttttggtcagagtaga

SEQ ID NO: 1113706 - DNA, 22 bp, Artificial Sequence
  chemically synthesized
tggatgttccagttcttttggt

SEQ ID NO: 1113707 - DNA, 22 bp, Artificial Sequence
  chemically synthesized
atggatgttccagttcttttgg

SEQ ID NO: 1113708 - DNA, 22 bp, Artificial Sequence
  chemically synthesized
ctactctgaccaaaagaactgg

SEQ ID NO: 1113709 - DNA, 22 bp, Artificial Sequence
  chemically synthesized
cttatggatgttccagttcttt

SEQ ID NO: 1113710 - DNA, 22 bp, Artificial Sequence
  chemically synthesized
tactctgaccaaaagaactgga

SEQ ID NO: 1113711 - DNA, 22 bp, Artificial Sequence
  chemically synthesized
ccttatggatgttccagttctt

SEQ ID NO: 1113712 - DNA, 22 bp, Artificial Sequence
  chemically synthesized
tccttatggatgttccagttct

SEQ ID NO: 1113713 - DNA, 22 bp, Artificial Sequence
  chemically synthesized
ctctgaccaaaagaactggaac

SEQ ID NO: 1113714 - DNA, 22 bp, Artificial Sequence
  chemically synthesized
tgaccaaaagaactggaacatc

SEQ ID NO: 1113715 - DNA, 22 bp, Artificial Sequence
  chemically synthesized
accaaaagaactggaacatcca

SEQ ID NO: 1113716 - DNA, 22 bp, Artificial Sequence
  chemically synthesized
tacatggacgttttccttatgg

SEQ ID NO: 1113717 - DNA, 22 bp, Artificial Sequence
  chemically synthesized
gaacatccataaggaaaacgtc

SEQ ID NO: 1113718 - DNA, 22 bp, Artificial Sequence
  chemically synthesized
aaactatacatggacgttttcc

SEQ ID NO: 1113719 - DNA, 22 bp, Artificial Sequence
  chemically synthesized
aaaactatacatggacgttttc

SEQ ID NO: 1113720 - DNA, 22 bp, Artificial Sequence
  chemically synthesized
taaaactatacatggacgtttt

SEQ ID NO: 1113721 - DNA, 22 bp, Artificial Sequence
  chemically synthesized
ctttaaaactatacatggacgt

SEQ ID NO: 1113722 - DNA, 22 bp, Artificial Sequence
  chemically synthesized
cctgctttaaaactatacatgg

SEQ ID NO: 1113723 - DNA, 22 bp, Artificial Sequence
  chemically synthesized
gcctgctttaaaactatacatg

SEQ ID NO: 1113724 - DNA, 22 bp, Artificial Sequence
  chemically synthesized
cttgcctgctttaaaactatac

SEQ ID NO: 1113725 - DNA, 22 bp, Artificial Sequence
  chemically synthesized
gccaaattccttgcctgcttta

SEQ ID NO: 1113726 - DNA, 22 bp, Artificial Sequence
  chemically synthesized
taaagcaggcaaggaatttggc

SEQ ID NO: 1113727 - DNA, 22 bp, Artificial Sequence
  chemically synthesized
aaagcaggcaaggaatttggcc

SEQ ID NO: 1113728 - DNA, 22 bp, Artificial Sequence
  chemically synthesized
aagcaggcaaggaatttggcca

SEQ ID NO: 1113729 - DNA, 22 bp, Artificial Sequence
  chemically synthesized
accaaagaaatgagttggccaa

SEQ ID NO: 1113730 - DNA, 22 bp, Artificial Sequence
  chemically synthesized
aaccaaagaaatgagttggcca

SEQ ID NO: 1113731 - DNA, 22 bp, Artificial Sequence
  chemically synthesized
taaccaaagaaatgagttggcc

SEQ ID NO: 1113732 - DNA, 22 bp, Artificial Sequence
  chemically synthesized
ttaaccaaagaaatgagttggc

SEQ ID NO: 1113733 - DNA, 22 bp, Artificial Sequence
  chemically synthesized
gaatttttaaccaaagaaatga

SEQ ID NO: 1113734 - DNA, 22 bp, Artificial Sequence
  chemically synthesized
ggaatttttaaccaaagaaatg

SEQ ID NO: 1113735 - DNA, 22 bp, Artificial Sequence
  chemically synthesized
tttggaatttttaaccaaagaa

SEQ ID NO: 1113736 - DNA, 22 bp, Artificial Sequence
  chemically synthesized
ggccaactcatttctttggtta

SEQ ID NO: 1113737 - DNA, 22 bp, Artificial Sequence
  chemically synthesized
atttggaatttttaaccaaaga

SEQ ID NO: 1113738 - DNA, 22 bp, Artificial Sequence
  chemically synthesized
gccaactcatttctttggttaa

SEQ ID NO: 1113739 - DNA, 22 bp, Artificial Sequence
  chemically synthesized
atttatttggaatttttaacca

SEQ ID NO: 1113740 - DNA, 22 bp, Artificial Sequence
  chemically synthesized
ctaatttatttggaatttttaa

SEQ ID NO: 1113741 - DNA, 22 bp, Artificial Sequence
  chemically synthesized
actaatttatttggaattttta

SEQ ID NO: 1113742 - DNA, 22 bp, Artificial Sequence
  chemically synthesized
atttctttggttaaaaattcca

SEQ ID NO: 1113743 - DNA, 22 bp, Artificial Sequence
  chemically synthesized
ttactaatttatttggaatttt

SEQ ID NO: 1113744 - DNA, 22 bp, Artificial Sequence
  chemically synthesized
ctttggttaaaaattccaaata

SEQ ID NO: 1113745 - DNA, 22 bp, Artificial Sequence
  chemically synthesized
tttggttaaaaattccaaataa

SEQ ID NO: 1113746 - DNA, 22 bp, Artificial Sequence
  chemically synthesized
tggttaaaaattccaaataaat

SEQ ID NO: 1113747 - DNA, 22 bp, Artificial Sequence
  chemically synthesized
ggttaaaaattccaaataaatt

SEQ ID NO: 1113748 - DNA, 22 bp, Artificial Sequence
  chemically synthesized
gttaaaaattccaaataaatta

SEQ ID NO: 1113749 - DNA, 22 bp, Artificial Sequence
  chemically synthesized
aaaattccaaataaattagtaa

SEQ ID NO: 1113750 - DNA, 22 bp, Artificial Sequence
  chemically synthesized
accgtaagagattcttactaat

SEQ ID NO: 1113751 - DNA, 22 bp, Artificial Sequence
  chemically synthesized
ttgaccgtaagagattcttact

SEQ ID NO: 1113752 - DNA, 22 bp, Artificial Sequence
  chemically synthesized
attgaccgtaagagattcttac

SEQ ID NO: 1113753 - DNA, 22 bp, Artificial Sequence
  chemically synthesized
caaataaattagtaagaatctc

SEQ ID NO: 1113754 - DNA, 22 bp, Artificial Sequence
  chemically synthesized
agagtttattgaccgtaagaga

SEQ ID NO: 1113755 - DNA, 22 bp, Artificial Sequence
  chemically synthesized
gtaagaatctcttacggtcaat

SEQ ID NO: 1113756 - DNA, 22 bp, Artificial Sequence
  chemically synthesized
tatattaagagtttattgaccg

SEQ ID NO: 1113757 - DNA, 22 bp, Artificial Sequence
  chemically synthesized
gtatattaagagtttattgacc

SEQ ID NO: 1113758 - DNA, 22 bp, Artificial Sequence
  chemically synthesized
ttacggtcaataaactcttaat

SEQ ID NO: 1113759 - DNA, 22 bp, Artificial Sequence
  chemically synthesized
acggtcaataaactcttaatat

SEQ ID NO: 1113760 - DNA, 22 bp, Artificial Sequence
  chemically synthesized
cggtcaataaactcttaatata

SEQ ID NO: 1113761 - DNA, 22 bp, Artificial Sequence
  chemically synthesized
cagcaataatttgtatattaag

SEQ ID NO: 1113762 - DNA, 22 bp, Artificial Sequence
  chemically synthesized
acagcaataatttgtatattaa

SEQ ID NO: 1113763 - DNA, 22 bp, Artificial Sequence
  chemically synthesized
tacagcaataatttgtatatta

SEQ ID NO: 1113764 - DNA, 22 bp, Artificial Sequence
  chemically synthesized
attttacagcaataatttgtat

SEQ ID NO: 1113765 - DNA, 22 bp, Artificial Sequence
  chemically synthesized
ttaatatacaaattattgctgt

SEQ ID NO: 1113766 - DNA, 22 bp, Artificial Sequence
  chemically synthesized
aatatacaaattattgctgtaa

SEQ ID NO: 1113767 - DNA, 22 bp, Artificial Sequence
  chemically synthesized
atatacaaattattgctgtaaa

SEQ ID NO: 1113768 - DNA, 22 bp, Artificial Sequence
  chemically synthesized
accatatcattaattttacagc

SEQ ID NO: 1113769 - DNA, 22 bp, Artificial Sequence
  chemically synthesized
atattaaccatatcattaattt

SEQ ID NO: 1113770 - DNA, 22 bp, Artificial Sequence
  chemically synthesized
ttgctgtaaaattaatgatatg

SEQ ID NO: 1113771 - DNA, 22 bp, Artificial Sequence
  chemically synthesized
ctgtaaaattaatgatatggtt

SEQ ID NO: 1113772 - DNA, 22 bp, Artificial Sequence
  chemically synthesized
aaacagttaatattaaccatat

SEQ ID NO: 1113773 - DNA, 22 bp, Artificial Sequence
  chemically synthesized
taaaattaatgatatggttaat

SEQ ID NO: 1113774 - DNA, 22 bp, Artificial Sequence
  chemically synthesized
aaaacagttaatattaaccata

SEQ ID NO: 1113775 - DNA, 22 bp, Artificial Sequence
  chemically synthesized
taaaacagttaatattaaccat

SEQ ID NO: 1113776 - DNA, 22 bp, Artificial Sequence
  chemically synthesized
atgatatggttaatattaactg

SEQ ID NO: 1113777 - DNA, 22 bp, Artificial Sequence
  chemically synthesized
tatgcagaattttaaaacagtt

SEQ ID NO: 1113778 - DNA, 22 bp, Artificial Sequence
  chemically synthesized
atattaactgttttaaaattct

SEQ ID NO: 1113779 - DNA, 22 bp, Artificial Sequence
  chemically synthesized
actgttttaaaattctgcatac

SEQ ID NO: 1113780 - DNA, 22 bp, Artificial Sequence
  chemically synthesized
ttttaaaattctgcatacaact

SEQ ID NO: 1113781 - DNA, 22 bp, Artificial Sequence
  chemically synthesized
tcaaatgtgaagagttgtatgc

SEQ ID NO: 1113782 - DNA, 22 bp, Artificial Sequence
  chemically synthesized
atcaaatgtgaagagttgtatg

SEQ ID NO: 1113783 - DNA, 22 bp, Artificial Sequence
  chemically synthesized
tatcaaatgtgaagagttgtat

SEQ ID NO: 1113784 - DNA, 22 bp, Artificial Sequence
  chemically synthesized
taaaattctgcatacaactctt

SEQ ID NO: 1113785 - DNA, 22 bp, Artificial Sequence
  chemically synthesized
aaaattctgcatacaactcttc

SEQ ID NO: 1113786 - DNA, 22 bp, Artificial Sequence
  chemically synthesized
aaattctgcatacaactcttca

SEQ ID NO: 1113787 - DNA, 22 bp, Artificial Sequence
  chemically synthesized
tattttatcaaatgtgaagagt

SEQ ID NO: 1113788 - DNA, 22 bp, Artificial Sequence
  chemically synthesized
tgcatacaactcttcacatttg

SEQ ID NO: 1113789 - DNA, 22 bp, Artificial Sequence
  chemically synthesized
actgtattttatcaaatgtgaa

SEQ ID NO: 1113790 - DNA, 22 bp, Artificial Sequence
  chemically synthesized
cactgtattttatcaaatgtga

SEQ ID NO: 1113791 - DNA, 22 bp, Artificial Sequence
  chemically synthesized
catacaactcttcacatttgat

SEQ ID NO: 1113792 - DNA, 22 bp, Artificial Sequence
  chemically synthesized
tcactgtattttatcaaatgtg

SEQ ID NO: 1113793 - DNA, 22 bp, Artificial Sequence
  chemically synthesized
ttttcactgtattttatcaaat

SEQ ID NO: 1113794 - DNA, 22 bp, Artificial Sequence
  chemically synthesized
attttcactgtattttatcaaa

SEQ ID NO: 1113795 - DNA, 22 bp, Artificial Sequence
  chemically synthesized
tattttcactgtattttatcaa

SEQ ID NO: 1113796 - DNA, 22 bp, Artificial Sequence
  chemically synthesized
ttattttcactgtattttatca

SEQ ID NO: 1113797 - DNA, 22 bp, Artificial Sequence
  chemically synthesized
tttattttcactgtattttatc

SEQ ID NO: 1113798 - DNA, 22 bp, Artificial Sequence
  chemically synthesized
ttcacatttgataaaatacagt

SEQ ID NO: 1113799 - DNA, 22 bp, Artificial Sequence
  chemically synthesized
cacatttgataaaatacagtga

SEQ ID NO: 1113800 - DNA, 22 bp, Artificial Sequence
  chemically synthesized
acatttgataaaatacagtgaa

SEQ ID NO: 1113801 - DNA, 22 bp, Artificial Sequence
  chemically synthesized
gaagatactttttattttcact

SEQ ID NO: 1113802 - DNA, 22 bp, Artificial Sequence
  chemically synthesized
gataaaatacagtgaaaataaa

SEQ ID NO: 1113803 - DNA, 22 bp, Artificial Sequence
  chemically synthesized
ataaaatacagtgaaaataaaa

SEQ ID NO: 1113804 - DNA, 22 bp, Artificial Sequence
  chemically synthesized
tgatcaattggaagatactttt

SEQ ID NO: 1113805 - DNA, 22 bp, Artificial Sequence
  chemically synthesized
atgatcaattggaagatacttt

SEQ ID NO: 1113806 - DNA, 22 bp, Artificial Sequence
  chemically synthesized
tatgatcaattggaagatactt

SEQ ID NO: 1113807 - DNA, 22 bp, Artificial Sequence
  chemically synthesized
agtgtcacatacaagttttatg

SEQ ID NO: 1113808 - DNA, 22 bp, Artificial Sequence
  chemically synthesized
cagtgtcacatacaagttttat

SEQ ID NO: 1113809 - DNA, 22 bp, Artificial Sequence
  chemically synthesized
tcagtgtcacatacaagtttta

SEQ ID NO: 1113810 - DNA, 22 bp, Artificial Sequence
  chemically synthesized
ccaattgatcataaaacttgta

SEQ ID NO: 1113811 - DNA, 22 bp, Artificial Sequence
  chemically synthesized
ttcagtgtcacatacaagtttt

SEQ ID NO: 1113812 - DNA, 22 bp, Artificial Sequence
  chemically synthesized
caattgatcataaaacttgtat

SEQ ID NO: 1113813 - DNA, 22 bp, Artificial Sequence
  chemically synthesized
atcataaaacttgtatgtgaca

SEQ ID NO: 1113814 - DNA, 22 bp, Artificial Sequence
  chemically synthesized
gtaacatatgtacagtttttca

SEQ ID NO: 1113815 - DNA, 22 bp, Artificial Sequence
  chemically synthesized
gtatgtgacactgaaaaactgt

SEQ ID NO: 1113816 - DNA, 22 bp, Artificial Sequence
  chemically synthesized
tatgtgacactgaaaaactgta

SEQ ID NO: 1113817 - DNA, 22 bp, Artificial Sequence
  chemically synthesized
aaaaactgtacatatgttacta

SEQ ID NO: 1113818 - DNA, 22 bp, Artificial Sequence
  chemically synthesized
gaaacagtatgtctagtaacat

SEQ ID NO: 1113819 - DNA, 22 bp, Artificial Sequence
  chemically synthesized
tagaaacagtatgtctagtaac

SEQ ID NO: 1113820 - DNA, 22 bp, Artificial Sequence
  chemically synthesized
tacatatgttactagacatact

SEQ ID NO: 1113821 - DNA, 22 bp, Artificial Sequence
  chemically synthesized
tacgttctagaaacagtatgtc

SEQ ID NO: 1113822 - DNA, 22 bp, Artificial Sequence
  chemically synthesized
ctagacatactgtttctagaac

SEQ ID NO: 1113823 - DNA, 22 bp, Artificial Sequence
  chemically synthesized
aaaatcagttgtacgttctaga

SEQ ID NO: 1113824 - DNA, 22 bp, Artificial Sequence
  chemically synthesized
gacatactgtttctagaacgta

SEQ ID NO: 1113825 - DNA, 22 bp, Artificial Sequence
  chemically synthesized
ttaaaaatcagttgtacgttct

SEQ ID NO: 1113826 - DNA, 22 bp, Artificial Sequence
  chemically synthesized
tttctagaacgtacaactgatt

SEQ ID NO: 1113827 - DNA, 22 bp, Artificial Sequence
  chemically synthesized
ctagaacgtacaactgattttt

SEQ ID NO: 1113828 - DNA, 22 bp, Artificial Sequence
  chemically synthesized
tagaacgtacaactgattttta

SEQ ID NO: 1113829 - DNA, 22 bp, Artificial Sequence
  chemically synthesized
gaacgtacaactgatttttaac

SEQ ID NO: 1113830 - DNA, 22 bp, Artificial Sequence
  chemically synthesized
atggtgcaaagtattgttaaaa

SEQ ID NO: 1113831 - DNA, 22 bp, Artificial Sequence
  chemically synthesized
gatggtgcaaagtattgttaaa

SEQ ID NO: 1113832 - DNA, 22 bp, Artificial Sequence
  chemically synthesized
atttgatggtgcaaagtattgt

SEQ ID NO: 1113833 - DNA, 22 bp, Artificial Sequence
  chemically synthesized
atttttaacaatactttgcacc

SEQ ID NO: 1113834 - DNA, 22 bp, Artificial Sequence
  chemically synthesized
ttaacaatactttgcaccatca

SEQ ID NO: 1113835 - DNA, 22 bp, Artificial Sequence
  chemically synthesized
taacaatactttgcaccatcaa

SEQ ID NO: 1113836 - DNA, 22 bp, Artificial Sequence
  chemically synthesized
aacaatactttgcaccatcaaa

SEQ ID NO: 1113837 - DNA, 22 bp, Artificial Sequence
  chemically synthesized
acaatactttgcaccatcaaat

SEQ ID NO: 1113838 - DNA, 22 bp, Artificial Sequence
  chemically synthesized
caatgtagaagggaacctcatt

SEQ ID NO: 1113839 - DNA, 22 bp, Artificial Sequence
  chemically synthesized
tgcaccatcaaatgaggttccc

SEQ ID NO: 1113840 - DNA, 22 bp, Artificial Sequence
  chemically synthesized
gcaccatcaaatgaggttccct

SEQ ID NO: 1113841 - DNA, 22 bp, Artificial Sequence
  chemically synthesized
caccatcaaatgaggttccctt

SEQ ID NO: 1113842 - DNA, 22 bp, Artificial Sequence
  chemically synthesized
ccatggttacaatgtagaaggg

SEQ ID NO: 1113843 - DNA, 22 bp, Artificial Sequence
  chemically synthesized
accatggttacaatgtagaagg

SEQ ID NO: 1113844 - DNA, 22 bp, Artificial Sequence
  chemically synthesized
ccttctacattgtaaccatggt

SEQ ID NO: 1113845 - DNA, 22 bp, Artificial Sequence
  chemically synthesized
aaagtacaaaatttaccatggt

SEQ ID NO: 1113846 - DNA, 22 bp, Artificial Sequence
  chemically synthesized
ctacattgtaaccatggtaaat

SEQ ID NO: 1113847 - DNA, 22 bp, Artificial Sequence
  chemically synthesized
tacattgtaaccatggtaaatt

SEQ ID NO: 1113848 - DNA, 22 bp, Artificial Sequence
  chemically synthesized
ttgaaagtacaaaatttaccat

SEQ ID NO: 1113849 - DNA, 22 bp, Artificial Sequence
  chemically synthesized
cattgtaaccatggtaaatttt

SEQ ID NO: 1113850 - DNA, 22 bp, Artificial Sequence
  chemically synthesized
aggttgttgaaagtacaaaatt

SEQ ID NO: 1113851 - DNA, 22 bp, Artificial Sequence
  chemically synthesized
taaccatggtaaattttgtact

SEQ ID NO: 1113852 - DNA, 22 bp, Artificial Sequence
  chemically synthesized
tgtactttcaacaaccttaaca

SEQ ID NO: 1113853 - DNA, 22 bp, Artificial Sequence
  chemically synthesized
gtactttcaacaaccttaacac

SEQ ID NO: 1113854 - DNA, 22 bp, Artificial Sequence
  chemically synthesized
tactttcaacaaccttaacacc

SEQ ID NO: 1113855 - DNA, 22 bp, Artificial Sequence
  chemically synthesized
agaagacaggatagggtgttaa

SEQ ID NO: 1113856 - DNA, 22 bp, Artificial Sequence
  chemically synthesized
tcaacaaccttaacaccctatc

SEQ ID NO: 1113857 - DNA, 22 bp, Artificial Sequence
  chemically synthesized
caacaaccttaacaccctatcc

SEQ ID NO: 1113858 - DNA, 22 bp, Artificial Sequence
  chemically synthesized
aacaaccttaacaccctatcct

SEQ ID NO: 1113859 - DNA, 22 bp, Artificial Sequence
  chemically synthesized
agacatatgctgagaagacagg

SEQ ID NO: 1113860 - DNA, 22 bp, Artificial Sequence
  chemically synthesized
aagacatatgctgagaagacag

SEQ ID NO: 1113861 - DNA, 22 bp, Artificial Sequence
  chemically synthesized
aacaccctatcctgtcttctca

SEQ ID NO: 1113862 - DNA, 22 bp, Artificial Sequence
  chemically synthesized
acaccctatcctgtcttctcag

SEQ ID NO: 1113863 - DNA, 22 bp, Artificial Sequence
  chemically synthesized
aaggaatttaagacatatgctg

SEQ ID NO: 1113864 - DNA, 22 bp, Artificial Sequence
  chemically synthesized
tcctgtcttctcagcatatgtc

SEQ ID NO: 1113865 - DNA, 22 bp, Artificial Sequence
  chemically synthesized
ttgaaggaatttaagacatatg

SEQ ID NO: 1113866 - DNA, 22 bp, Artificial Sequence
  chemically synthesized
gttgaaggaatttaagacatat

SEQ ID NO: 1113867 - DNA, 22 bp, Artificial Sequence
  chemically synthesized
tcttctcagcatatgtcttaaa

SEQ ID NO: 1113868 - DNA, 22 bp, Artificial Sequence
  chemically synthesized
ctcagcatatgtcttaaattcc

SEQ ID NO: 1113869 - DNA, 22 bp, Artificial Sequence
  chemically synthesized
tcagcatatgtcttaaattcct

SEQ ID NO: 1113870 - DNA, 22 bp, Artificial Sequence
  chemically synthesized
agcatatgtcttaaattccttc

SEQ ID NO: 1113871 - DNA, 22 bp, Artificial Sequence
  chemically synthesized
aaggcaatttgttgaaggaatt

SEQ ID NO: 1113872 - DNA, 22 bp, Artificial Sequence
  chemically synthesized
tcctgaaggcaatttgttgaag

SEQ ID NO: 1113873 - DNA, 22 bp, Artificial Sequence
  chemically synthesized
gtcctgaaggcaatttgttgaa

SEQ ID NO: 1113874 - DNA, 22 bp, Artificial Sequence
  chemically synthesized
tttgtcctgaaggcaatttgtt

SEQ ID NO: 1113875 - DNA, 22 bp, Artificial Sequence
  chemically synthesized
aaattccttcaacaaattgcct

SEQ ID NO: 1113876 - DNA, 22 bp, Artificial Sequence
  chemically synthesized
aattccttcaacaaattgcctt

SEQ ID NO: 1113877 - DNA, 22 bp, Artificial Sequence
  chemically synthesized
cttcaacaaattgccttcagga

SEQ ID NO: 1113878 - DNA, 22 bp, Artificial Sequence
  chemically synthesized
caacaaattgccttcaggacaa

SEQ ID NO: 1113879 - DNA, 22 bp, Artificial Sequence
  chemically synthesized
aacaaattgccttcaggacaaa

SEQ ID NO: 1113880 - DNA, 22 bp, Artificial Sequence
  chemically synthesized
ccttcaggacaaacagattttg

SEQ ID NO: 1113881 - DNA, 22 bp, Artificial Sequence
  chemically synthesized
agtaatgcagaaaacaaaatct

SEQ ID NO: 1113882 - DNA, 22 bp, Artificial Sequence
  chemically synthesized
aagtaatgcagaaaacaaaatc

SEQ ID NO: 1113883 - DNA, 22 bp, Artificial Sequence
  chemically synthesized
caggacaaacagattttgtttt

SEQ ID NO: 1113884 - DNA, 22 bp, Artificial Sequence
  chemically synthesized
aggacaaacagattttgttttc

SEQ ID NO: 1113885 - DNA, 22 bp, Artificial Sequence
  chemically synthesized
aacatcacttaagtaatgcaga

SEQ ID NO: 1113886 - DNA, 22 bp, Artificial Sequence
  chemically synthesized
tgttttctgcattacttaagtg

SEQ ID NO: 1113887 - DNA, 22 bp, Artificial Sequence
  chemically synthesized
aagattcaacatcacttaagta

SEQ ID NO: 1113888 - DNA, 22 bp, Artificial Sequence
  chemically synthesized
gttttctgcattacttaagtga

SEQ ID NO: 1113889 - DNA, 22 bp, Artificial Sequence
  chemically synthesized
ttttctgcattacttaagtgat

SEQ ID NO: 1113890 - DNA, 22 bp, Artificial Sequence
  chemically synthesized
tctgcattacttaagtgatgtt

SEQ ID NO: 1113891 - DNA, 22 bp, Artificial Sequence
  chemically synthesized
ctgcattacttaagtgatgttg

SEQ ID NO: 1113892 - DNA, 22 bp, Artificial Sequence
  chemically synthesized
tgcattacttaagtgatgttga

SEQ ID NO: 1113893 - DNA, 22 bp, Artificial Sequence
  chemically synthesized
cattacttaagtgatgttgaat

SEQ ID NO: 1113894 - DNA, 22 bp, Artificial Sequence
  chemically synthesized
tgaagcattgaagattcaacat

SEQ ID NO: 1113895 - DNA, 22 bp, Artificial Sequence
  chemically synthesized
cttaagtgatgttgaatcttca

SEQ ID NO: 1113896 - DNA, 22 bp, Artificial Sequence
  chemically synthesized
aagtgatgttgaatcttcaatg

SEQ ID NO: 1113897 - DNA, 22 bp, Artificial Sequence
  chemically synthesized
agtgatgttgaatcttcaatgc

SEQ ID NO: 1113898 - DNA, 22 bp, Artificial Sequence
  chemically synthesized
aatgtctatgaagcattgaaga

SEQ ID NO: 1113899 - DNA, 22 bp, Artificial Sequence
  chemically synthesized
taaatgtctatgaagcattgaa

SEQ ID NO: 1113900 - DNA, 22 bp, Artificial Sequence
  chemically synthesized
ctaaatgtctatgaagcattga

SEQ ID NO: 1113901 - DNA, 22 bp, Artificial Sequence
  chemically synthesized
aatcttcaatgcttcatagaca

SEQ ID NO: 1113902 - DNA, 22 bp, Artificial Sequence
  chemically synthesized
tccgtttctaaatgtctatgaa

SEQ ID NO: 1113903 - DNA, 22 bp, Artificial Sequence
  chemically synthesized
tgtccgtttctaaatgtctatg

SEQ ID NO: 1113904 - DNA, 22 bp, Artificial Sequence
  chemically synthesized
ctgtccgtttctaaatgtctat

SEQ ID NO: 1113905 - DNA, 22 bp, Artificial Sequence
  chemically synthesized
caatgcttcatagacatttaga

SEQ ID NO: 1113906 - DNA, 22 bp, Artificial Sequence
  chemically synthesized
aatgcttcatagacatttagaa

SEQ ID NO: 1113907 - DNA, 22 bp, Artificial Sequence
  chemically synthesized
caaatgatttctgtccgtttct

SEQ ID NO: 1113908 - DNA, 22 bp, Artificial Sequence
  chemically synthesized
catagacatttagaaacggaca

SEQ ID NO: 1113909 - DNA, 22 bp, Artificial Sequence
  chemically synthesized
ccaaatgatttctgtccgtttc

SEQ ID NO: 1113910 - DNA, 22 bp, Artificial Sequence
  chemically synthesized
atagacatttagaaacggacag

SEQ ID NO: 1113911 - DNA, 22 bp, Artificial Sequence
  chemically synthesized
agaaacggacagaaatcatttg

SEQ ID NO: 1113912 - DNA, 22 bp, Artificial Sequence
  chemically synthesized
gaaacggacagaaatcatttgg

SEQ ID NO: 1113913 - DNA, 22 bp, Artificial Sequence
  chemically synthesized
aaatggtacatcagacatattt

SEQ ID NO: 1113914 - DNA, 22 bp, Artificial Sequence
  chemically synthesized
acctgaaatggtacatcagaca

SEQ ID NO: 1113915 - DNA, 22 bp, Artificial Sequence
  chemically synthesized
gacctgaaatggtacatcagac

SEQ ID NO: 1113916 - DNA, 22 bp, Artificial Sequence
  chemically synthesized
tgacctgaaatggtacatcaga

SEQ ID NO: 1113917 - DNA, 22 bp, Artificial Sequence
  chemically synthesized
ggaaatatgtctgatgtaccat

SEQ ID NO: 1113918 - DNA, 22 bp, Artificial Sequence
  chemically synthesized
gaaatatgtctgatgtaccatt

SEQ ID NO: 1113919 - DNA, 22 bp, Artificial Sequence
  chemically synthesized
agttttgacctgaaatggtaca

SEQ ID NO: 1113920 - DNA, 22 bp, Artificial Sequence
  chemically synthesized
cagttttgacctgaaatggtac

SEQ ID NO: 1113921 - DNA, 22 bp, Artificial Sequence
  chemically synthesized
cttcagttttgacctgaaatgg

SEQ ID NO: 1113922 - DNA, 22 bp, Artificial Sequence
  chemically synthesized
acttcagttttgacctgaaatg

SEQ ID NO: 1113923 - DNA, 22 bp, Artificial Sequence
  chemically synthesized
tacttcagttttgacctgaaat

SEQ ID NO: 1113924 - DNA, 22 bp, Artificial Sequence
  chemically synthesized
atgtaccatttcaggtcaaaac

SEQ ID NO: 1113925 - DNA, 22 bp, Artificial Sequence
  chemically synthesized
aattttacttcagttttgacct

SEQ ID NO: 1113926 - DNA, 22 bp, Artificial Sequence
  chemically synthesized
aaattttacttcagttttgacc

SEQ ID NO: 1113927 - DNA, 22 bp, Artificial Sequence
  chemically synthesized
ataacttaaattttacttcagt

SEQ ID NO: 1113928 - DNA, 22 bp, Artificial Sequence
  chemically synthesized
tcataacttaaattttacttca

SEQ ID NO: 1113929 - DNA, 22 bp, Artificial Sequence
  chemically synthesized
caggtcaaaactgaagtaaaat

SEQ ID NO: 1113930 - DNA, 22 bp, Artificial Sequence
  chemically synthesized
ctcataacttaaattttacttc

SEQ ID NO: 1113931 - DNA, 22 bp, Artificial Sequence
  chemically synthesized
aggtcaaaactgaagtaaaatt

SEQ ID NO: 1113932 - DNA, 22 bp, Artificial Sequence
  chemically synthesized
aagtaaaatttaagttatgaga

SEQ ID NO: 1113933 - DNA, 22 bp, Artificial Sequence
  chemically synthesized
caagatggaaaaaataatttct

SEQ ID NO: 1113934 - DNA, 22 bp, Artificial Sequence
  chemically synthesized
aagttatgagaaattatttttt

SEQ ID NO: 1113935 - DNA, 22 bp, Artificial Sequence
  chemically synthesized
agttatgagaaattattttttc

SEQ ID NO: 1113936 - DNA, 22 bp, Artificial Sequence
  chemically synthesized
tgagaaattattttttccatct

SEQ ID NO: 1113937 - DNA, 22 bp, Artificial Sequence
  chemically synthesized
gaatgaaattccaagatggaaa

SEQ ID NO: 1113938 - DNA, 22 bp, Artificial Sequence
  chemically synthesized
agaatgaaattccaagatggaa

SEQ ID NO: 1113939 - DNA, 22 bp, Artificial Sequence
  chemically synthesized
tagaatgaaattccaagatgga

SEQ ID NO: 1113940 - DNA, 22 bp, Artificial Sequence
  chemically synthesized
ttagaatgaaattccaagatgg

SEQ ID NO: 1113941 - DNA, 22 bp, Artificial Sequence
  chemically synthesized
cttttagaatgaaattccaaga

SEQ ID NO: 1113942 - DNA, 22 bp, Artificial Sequence
  chemically synthesized
gcttttagaatgaaattccaag

SEQ ID NO: 1113943 - DNA, 22 bp, Artificial Sequence
  chemically synthesized
ttttttccatcttggaatttca

SEQ ID NO: 1113944 - DNA, 22 bp, Artificial Sequence
  chemically synthesized
tttccatcttggaatttcattc

SEQ ID NO: 1113945 - DNA, 22 bp, Artificial Sequence
  chemically synthesized
ttccatcttggaatttcattct

SEQ ID NO: 1113946 - DNA, 22 bp, Artificial Sequence
  chemically synthesized
tccatcttggaatttcattcta

SEQ ID NO: 1113947 - DNA, 22 bp, Artificial Sequence
  chemically synthesized
ccatcttggaatttcattctaa

SEQ ID NO: 1113948 - DNA, 22 bp, Artificial Sequence
  chemically synthesized
atcagtttgcttttagaatgaa

SEQ ID NO: 1113949 - DNA, 22 bp, Artificial Sequence
  chemically synthesized
catcttggaatttcattctaaa

SEQ ID NO: 1113950 - DNA, 22 bp, Artificial Sequence
  chemically synthesized
taattcatcagtttgcttttag

SEQ ID NO: 1113951 - DNA, 22 bp, Artificial Sequence
  chemically synthesized
ggaatttcattctaaaagcaaa

SEQ ID NO: 1113952 - DNA, 22 bp, Artificial Sequence
  chemically synthesized
gtaattcatcagtttgctttta

SEQ ID NO: 1113953 - DNA, 22 bp, Artificial Sequence
  chemically synthesized
gaatttcattctaaaagcaaac

SEQ ID NO: 1113954 - DNA, 22 bp, Artificial Sequence
  chemically synthesized
tgtaattcatcagtttgctttt

SEQ ID NO: 1113955 - DNA, 22 bp, Artificial Sequence
  chemically synthesized
cattctaaaagcaaactgatga

SEQ ID NO: 1113956 - DNA, 22 bp, Artificial Sequence
  chemically synthesized
attctaaaagcaaactgatgaa

SEQ ID NO: 1113957 - DNA, 22 bp, Artificial Sequence
  chemically synthesized
gaataattttgtaattcatcag

SEQ ID NO: 1113958 - DNA, 22 bp, Artificial Sequence
  chemically synthesized
agaataattttgtaattcatca

SEQ ID NO: 1113959 - DNA, 22 bp, Artificial Sequence
  chemically synthesized
taaaagcaaactgatgaattac

SEQ ID NO: 1113960 - DNA, 22 bp, Artificial Sequence
  chemically synthesized
aaagcaaactgatgaattacaa

SEQ ID NO: 1113961 - DNA, 22 bp, Artificial Sequence
  chemically synthesized
aaaatttagaataattttgtaa

SEQ ID NO: 1113962 - DNA, 22 bp, Artificial Sequence
  chemically synthesized
aaaaatttagaataattttgta

SEQ ID NO: 1113963 - DNA, 22 bp, Artificial Sequence
  chemically synthesized
taaaaatttagaataattttgt

SEQ ID NO: 1113964 - DNA, 22 bp, Artificial Sequence
  chemically synthesized
ttaaaaatttagaataattttg

SEQ ID NO: 1113965 - DNA, 22 bp, Artificial Sequence
  chemically synthesized
tttaaaaatttagaataatttt

SEQ ID NO: 1113966 - DNA, 22 bp, Artificial Sequence
  chemically synthesized
atgaattacaaaattattctaa

SEQ ID NO: 1113967 - DNA, 22 bp, Artificial Sequence
  chemically synthesized
ctttttaaaaatttagaataat

SEQ ID NO: 1113968 - DNA, 22 bp, Artificial Sequence
  chemically synthesized
aactactttttaaaaatttaga

SEQ ID NO: 1113969 - DNA, 22 bp, Artificial Sequence
  chemically synthesized
caaaattattctaaatttttaa

SEQ ID NO: 1113970 - DNA, 22 bp, Artificial Sequence
  chemically synthesized
agattaaactactttttaaaaa

SEQ ID NO: 1113971 - DNA, 22 bp, Artificial Sequence
  chemically synthesized
ttctaaatttttaaaaagtagt

SEQ ID NO: 1113972 - DNA, 22 bp, Artificial Sequence
  chemically synthesized
ccctaagattaaactacttttt

SEQ ID NO: 1113973 - DNA, 22 bp, Artificial Sequence
  chemically synthesized
gccctaagattaaactactttt

SEQ ID NO: 1113974 - DNA, 22 bp, Artificial Sequence
  chemically synthesized
taaatttttaaaaagtagttta

SEQ ID NO: 1113975 - DNA, 22 bp, Artificial Sequence
  chemically synthesized
aatttttaaaaagtagtttaat

SEQ ID NO: 1113976 - DNA, 22 bp, Artificial Sequence
  chemically synthesized
ttaaaaagtagtttaatcttag

SEQ ID NO: 1113977 - DNA, 22 bp, Artificial Sequence
  chemically synthesized
aaataatttgccctaagattaa

SEQ ID NO: 1113978 - DNA, 22 bp, Artificial Sequence
  chemically synthesized
taaaaagtagtttaatcttagg

SEQ ID NO: 1113979 - DNA, 22 bp, Artificial Sequence
  chemically synthesized
aaaataatttgccctaagatta

SEQ ID NO: 1113980 - DNA, 22 bp, Artificial Sequence
  chemically synthesized
aaaaagtagtttaatcttaggg

SEQ ID NO: 1113981 - DNA, 22 bp, Artificial Sequence
  chemically synthesized
aaaagtagtttaatcttagggc

SEQ ID NO: 1113982 - DNA, 22 bp, Artificial Sequence
  chemically synthesized
cttaaaataatttgccctaaga

SEQ ID NO: 1113983 - DNA, 22 bp, Artificial Sequence
  chemically synthesized
tacttaaaataatttgccctaa

SEQ ID NO: 1113984 - DNA, 22 bp, Artificial Sequence
  chemically synthesized
ctacttaaaataatttgcccta

SEQ ID NO: 1113985 - DNA, 22 bp, Artificial Sequence
  chemically synthesized
tctacttaaaataatttgccct

SEQ ID NO: 1113986 - DNA, 22 bp, Artificial Sequence
  chemically synthesized
aattttctacttaaaataattt

SEQ ID NO: 1113987 - DNA, 22 bp, Artificial Sequence
  chemically synthesized
aatcttagggcaaattatttta

SEQ ID NO: 1113988 - DNA, 22 bp, Artificial Sequence
  chemically synthesized
atcttagggcaaattattttaa

SEQ ID NO: 1113989 - DNA, 22 bp, Artificial Sequence
  chemically synthesized
agggcaaattattttaagtaga

SEQ ID NO: 1113990 - DNA, 22 bp, Artificial Sequence
  chemically synthesized
gggcaaattattttaagtagaa

SEQ ID NO: 1113991 - DNA, 22 bp, Artificial Sequence
  chemically synthesized
ttttaagtagaaaattcagttt

SEQ ID NO: 1113992 - DNA, 22 bp, Artificial Sequence
  chemically synthesized
gtatatgcatagcaaactgaat

SEQ ID NO: 1113993 - DNA, 22 bp, Artificial Sequence
  chemically synthesized
taagtagaaaattcagtttgct

SEQ ID NO: 1113994 - DNA, 22 bp, Artificial Sequence
  chemically synthesized
aagtagaaaattcagtttgcta

SEQ ID NO: 1113995 - DNA, 22 bp, Artificial Sequence
  chemically synthesized
agtagaaaattcagtttgctat

SEQ ID NO: 1113996 - DNA, 22 bp, Artificial Sequence
  chemically synthesized
tactggtatatgcatagcaaac

SEQ ID NO: 1113997 - DNA, 22 bp, Artificial Sequence
  chemically synthesized
tatgtatctatactggtatatg

SEQ ID NO: 1113998 - DNA, 22 bp, Artificial Sequence
  chemically synthesized
agtttgctatgcatataccagt

SEQ ID NO: 1113999 - DNA, 22 bp, Artificial Sequence
  chemically synthesized
atatgtatctatactggtatat

SEQ ID NO: 1114000 - DNA, 22 bp, Artificial Sequence
  chemically synthesized
tatatgtatctatactggtata

SEQ ID NO: 1114001 - DNA, 22 bp, Artificial Sequence
  chemically synthesized
gctatgcatataccagtataga

SEQ ID NO: 1114002 - DNA, 22 bp, Artificial Sequence
  chemically synthesized
ctatgcatataccagtatagat

SEQ ID NO: 1114003 - DNA, 22 bp, Artificial Sequence
  chemically synthesized
tattttatatgtatctatactg

SEQ ID NO: 1114004 - DNA, 22 bp, Artificial Sequence
  chemically synthesized
tgcatataccagtatagataca

SEQ ID NO: 1114005 - DNA, 22 bp, Artificial Sequence
  chemically synthesized
tgaactatattttatatgtatc

SEQ ID NO: 1114006 - DNA, 22 bp, Artificial Sequence
  chemically synthesized
tgtgaactatattttatatgta

SEQ ID NO: 1114007 - DNA, 22 bp, Artificial Sequence
  chemically synthesized
aaaaattctgtgaactatattt

SEQ ID NO: 1114008 - DNA, 22 bp, Artificial Sequence
  chemically synthesized
aaaaaattctgtgaactatatt

SEQ ID NO: 1114009 - DNA, 22 bp, Artificial Sequence
  chemically synthesized
taaaaaattctgtgaactatat

SEQ ID NO: 1114010 - DNA, 22 bp, Artificial Sequence
  chemically synthesized
tagattttaaaaaattctgtga

SEQ ID NO: 1114011 - DNA, 22 bp, Artificial Sequence
  chemically synthesized
ttatagattttaaaaaattctg

SEQ ID NO: 1114012 - DNA, 22 bp, Artificial Sequence
  chemically synthesized
acagaattttttaaaatctata

SEQ ID NO: 1114013 - DNA, 22 bp, Artificial Sequence
  chemically synthesized
tttaaaatctataatagctata

SEQ ID NO: 1114014 - DNA, 22 bp, Artificial Sequence
  chemically synthesized
ttaaaatctataatagctatac

SEQ ID NO: 1114015 - DNA, 22 bp, Artificial Sequence
  chemically synthesized
taaaatctataatagctatact

SEQ ID NO: 1114016 - DNA, 22 bp, Artificial Sequence
  chemically synthesized
aaaatctataatagctatactt

SEQ ID NO: 1114017 - DNA, 22 bp, Artificial Sequence
  chemically synthesized
aaatctataatagctatactta

SEQ ID NO: 1114018 - DNA, 22 bp, Artificial Sequence
  chemically synthesized
taatagctatacttatgctatt

SEQ ID NO: 1114019 - DNA, 22 bp, Artificial Sequence
  chemically synthesized
atagtgtaaaaatatgtagaat

SEQ ID NO: 1114020 - DNA, 22 bp, Artificial Sequence
  chemically synthesized
tacttatgctattctacatatt

SEQ ID NO: 1114021 - DNA, 22 bp, Artificial Sequence
  chemically synthesized
atgctattctacatatttttac

SEQ ID NO: 1114022 - DNA, 22 bp, Artificial Sequence
  chemically synthesized
tgctattctacatatttttaca

SEQ ID NO: 1114023 - DNA, 22 bp, Artificial Sequence
  chemically synthesized
acatatattcatagtgtaaaaa

SEQ ID NO: 1114024 - DNA, 22 bp, Artificial Sequence
  chemically synthesized
aacatatattcatagtgtaaaa

SEQ ID NO: 1114025 - DNA, 22 bp, Artificial Sequence
  chemically synthesized
ttctacatatttttacactatg

SEQ ID NO: 1114026 - DNA, 22 bp, Artificial Sequence
  chemically synthesized
tacatatttttacactatgaat

SEQ ID NO: 1114027 - DNA, 22 bp, Artificial Sequence
  chemically synthesized
catatttttacactatgaatat

SEQ ID NO: 1114028 - DNA, 22 bp, Artificial Sequence
  chemically synthesized
ttacactatgaatatatgttaa

SEQ ID NO: 1114029 - DNA, 22 bp, Artificial Sequence
  chemically synthesized
tacactatgaatatatgttaaa

SEQ ID NO: 1114030 - DNA, 22 bp, Artificial Sequence
  chemically synthesized
acactatgaatatatgttaaat

SEQ ID NO: 1114031 - DNA, 22 bp, Artificial Sequence
  chemically synthesized
cactatgaatatatgttaaata

SEQ ID NO: 1114032 - DNA, 22 bp, Artificial Sequence
  chemically synthesized
ccacagtgaaaatatttaacat

SEQ ID NO: 1114033 - DNA, 22 bp, Artificial Sequence
  chemically synthesized
accacagtgaaaatatttaaca

SEQ ID NO: 1114034 - DNA, 22 bp, Artificial Sequence
  chemically synthesized
tgaatatatgttaaatattttc

SEQ ID NO: 1114035 - DNA, 22 bp, Artificial Sequence
  chemically synthesized
atgtgtgcttaccacagtgaaa

SEQ ID NO: 1114036 - DNA, 22 bp, Artificial Sequence
  chemically synthesized
gatgtgtgcttaccacagtgaa

SEQ ID NO: 1114037 - DNA, 22 bp, Artificial Sequence
  chemically synthesized
aatattttcactgtggtaagca

SEQ ID NO: 1114038 - DNA, 22 bp, Artificial Sequence
  chemically synthesized
taaatttgatgtgtgcttacca

SEQ ID NO: 1114039 - DNA, 22 bp, Artificial Sequence
  chemically synthesized
ataaatttgatgtgtgcttacc

SEQ ID NO: 1114040 - DNA, 22 bp, Artificial Sequence
  chemically synthesized
tcactgtggtaagcacacatca

SEQ ID NO: 1114041 - DNA, 22 bp, Artificial Sequence
  chemically synthesized
cactgtggtaagcacacatcaa

SEQ ID NO: 1114042 - DNA, 22 bp, Artificial Sequence
  chemically synthesized
actgtggtaagcacacatcaaa

SEQ ID NO: 1114043 - DNA, 22 bp, Artificial Sequence
  chemically synthesized
tggtaagcacacatcaaattta

SEQ ID NO: 1114044 - DNA, 22 bp, Artificial Sequence
  chemically synthesized
ataaaaatatgtgcgtatatat

SEQ ID NO: 1114045 - DNA, 22 bp, Artificial Sequence
  chemically synthesized
ataaatatatacgcacatattt

SEQ ID NO: 1114046 - DNA, 22 bp, Artificial Sequence
  chemically synthesized
tgccactaataaaaatatgtgc

SEQ ID NO: 1114047 - DNA, 22 bp, Artificial Sequence
  chemically synthesized
taaatatatacgcacatatttt

SEQ ID NO: 1114048 - DNA, 22 bp, Artificial Sequence
  chemically synthesized
ttatgccactaataaaaatatg

SEQ ID NO: 1114049 - DNA, 22 bp, Artificial Sequence
  chemically synthesized
atattattatgccactaataaa

SEQ ID NO: 1114050 - DNA, 22 bp, Artificial Sequence
  chemically synthesized
tataaaccactcatattattat

SEQ ID NO: 1114051 - DNA, 22 bp, Artificial Sequence
  chemically synthesized
ttattagtggcataataatatg

SEQ ID NO: 1114052 - DNA, 22 bp, Artificial Sequence
  chemically synthesized
gtataaaccactcatattatta

SEQ ID NO: 1114053 - DNA, 22 bp, Artificial Sequence
  chemically synthesized
tattagtggcataataatatga

SEQ ID NO: 1114054 - DNA, 22 bp, Artificial Sequence
  chemically synthesized
attagtggcataataatatgag

SEQ ID NO: 1114055 - DNA, 22 bp, Artificial Sequence
  chemically synthesized
ttgtataaaccactcatattat

SEQ ID NO: 1114056 - DNA, 22 bp, Artificial Sequence
  chemically synthesized
ttagtggcataataatatgagt

SEQ ID NO: 1114057 - DNA, 22 bp, Artificial Sequence
  chemically synthesized
gtggcataataatatgagtggt

SEQ ID NO: 1114058 - DNA, 22 bp, Artificial Sequence
  chemically synthesized
agataaagatgaaccactcttg

SEQ ID NO: 1114059 - DNA, 22 bp, Artificial Sequence
  chemically synthesized
agaagttaagataaagatgaac

SEQ ID NO: 1114060 - DNA, 22 bp, Artificial Sequence
  chemically synthesized
atacaagagtggttcatcttta

SEQ ID NO: 1114061 - DNA, 22 bp, Artificial Sequence
  chemically synthesized
tacaagagtggttcatctttat

SEQ ID NO: 1114062 - DNA, 22 bp, Artificial Sequence
  chemically synthesized
ctcagaagttaagataaagatg

SEQ ID NO: 1114063 - DNA, 22 bp, Artificial Sequence
  chemically synthesized
cctcagaagttaagataaagat

SEQ ID NO: 1114064 - DNA, 22 bp, Artificial Sequence
  chemically synthesized
atctttatcttaacttctgagg

SEQ ID NO: 1114065 - DNA, 22 bp, Artificial Sequence
  chemically synthesized
accacgtatagtttcctcagaa

SEQ ID NO: 1114066 - DNA, 22 bp, Artificial Sequence
  chemically synthesized
aaccacgtatagtttcctcaga

SEQ ID NO: 1114067 - DNA, 22 bp, Artificial Sequence
  chemically synthesized
tatcttaacttctgaggaaact

SEQ ID NO: 1114068 - DNA, 22 bp, Artificial Sequence
  chemically synthesized
ttaaccacgtatagtttcctca

SEQ ID NO: 1114069 - DNA, 22 bp, Artificial Sequence
  chemically synthesized
atcttaacttctgaggaaacta

SEQ ID NO: 1114070 - DNA, 22 bp, Artificial Sequence
  chemically synthesized
tcttaacttctgaggaaactat

SEQ ID NO: 1114071 - DNA, 22 bp, Artificial Sequence
  chemically synthesized
ctcttaaccacgtatagtttcc

SEQ ID NO: 1114072 - DNA, 22 bp, Artificial Sequence
  chemically synthesized
aacttctgaggaaactatacgt

SEQ ID NO: 1114073 - DNA, 22 bp, Artificial Sequence
  chemically synthesized
ttcctcttaaccacgtatagtt

SEQ ID NO: 1114074 - DNA, 22 bp, Artificial Sequence
  chemically synthesized
acttctgaggaaactatacgtg

SEQ ID NO: 1114075 - DNA, 22 bp, Artificial Sequence
  chemically synthesized
ctgaggaaactatacgtggtta

SEQ ID NO: 1114076 - DNA, 22 bp, Artificial Sequence
  chemically synthesized
tgaggaaactatacgtggttaa

SEQ ID NO: 1114077 - DNA, 22 bp, Artificial Sequence
  chemically synthesized
aggaaactatacgtggttaaga

SEQ ID NO: 1114078 - DNA, 22 bp, Artificial Sequence
  chemically synthesized
atgtaaatggctgttcctctta

SEQ ID NO: 1114079 - DNA, 22 bp, Artificial Sequence
  chemically synthesized
tacgtggttaagaggaacagcc

SEQ ID NO: 1114080 - DNA, 22 bp, Artificial Sequence
  chemically synthesized
ggacctcatgtaaatggctgtt

SEQ ID NO: 1114081 - DNA, 22 bp, Artificial Sequence
  chemically synthesized
aggacctcatgtaaatggctgt

SEQ ID NO: 1114082 - DNA, 22 bp, Artificial Sequence
  chemically synthesized
atttaggacctcatgtaaatgg

SEQ ID NO: 1114083 - DNA, 22 bp, Artificial Sequence
  chemically synthesized
catttaggacctcatgtaaatg

SEQ ID NO: 1114084 - DNA, 22 bp, Artificial Sequence
  chemically synthesized
agaggaacagccatttacatga

SEQ ID NO: 1114085 - DNA, 22 bp, Artificial Sequence
  chemically synthesized
aatcagtgtgcttcatttagga

SEQ ID NO: 1114086 - DNA, 22 bp, Artificial Sequence
  chemically synthesized
acatgaggtcctaaatgaagca

SEQ ID NO: 1114087 - DNA, 22 bp, Artificial Sequence
  chemically synthesized
catgaggtcctaaatgaagcac

SEQ ID NO: 1114088 - DNA, 22 bp, Artificial Sequence
  chemically synthesized
aatgaagcacactgattcagct

SEQ ID NO: 1114089 - DNA, 22 bp, Artificial Sequence
  chemically synthesized
tatagaaaggaaaatgagagct

SEQ ID NO: 1114090 - DNA, 22 bp, Artificial Sequence
  chemically synthesized
gtatagaaaggaaaatgagagc

SEQ ID NO: 1114091 - DNA, 22 bp, Artificial Sequence
  chemically synthesized
tgtatagaaaggaaaatgagag

SEQ ID NO: 1114092 - DNA, 22 bp, Artificial Sequence
  chemically synthesized
ttgtatagaaaggaaaatgaga

SEQ ID NO: 1114093 - DNA, 22 bp, Artificial Sequence
  chemically synthesized
tttgtatagaaaggaaaatgag

SEQ ID NO: 1114094 - DNA, 22 bp, Artificial Sequence
  chemically synthesized
attcagctctcattttcctttc

SEQ ID NO: 1114095 - DNA, 22 bp, Artificial Sequence
  chemically synthesized
ccctttttgtatagaaaggaaa

SEQ ID NO: 1114096 - DNA, 22 bp, Artificial Sequence
  chemically synthesized
gccctttttgtatagaaaggaa

SEQ ID NO: 1114097 - DNA, 22 bp, Artificial Sequence
  chemically synthesized
agctctcattttcctttctata

SEQ ID NO: 1114098 - DNA, 22 bp, Artificial Sequence
  chemically synthesized
ttgccctttttgtatagaaagg

SEQ ID NO: 1114099 - DNA, 22 bp, Artificial Sequence
  chemically synthesized
tcattttcctttctatacaaaa

SEQ ID NO: 1114100 - DNA, 22 bp, Artificial Sequence
  chemically synthesized
attttcctttctatacaaaaag

SEQ ID NO: 1114101 - DNA, 22 bp, Artificial Sequence
  chemically synthesized
tcctttctatacaaaaagggca

SEQ ID NO: 1114102 - DNA, 22 bp, Artificial Sequence
  chemically synthesized
cctttctatacaaaaagggcaa

SEQ ID NO: 1114103 - DNA, 22 bp, Artificial Sequence
  chemically synthesized
ctttctatacaaaaagggcaag

SEQ ID NO: 1114104 - DNA, 22 bp, Artificial Sequence
  chemically synthesized
tctatacaaaaagggcaagaat

SEQ ID NO: 1114105 - DNA, 22 bp, Artificial Sequence
  chemically synthesized
ctatacaaaaagggcaagaatg

SEQ ID NO: 1114106 - DNA, 22 bp, Artificial Sequence
  chemically synthesized
tatacaaaaagggcaagaatgt

SEQ ID NO: 1114107 - DNA, 22 bp, Artificial Sequence
  chemically synthesized
tacaaaaagggcaagaatgtat

SEQ ID NO: 1114108 - DNA, 22 bp, Artificial Sequence
  chemically synthesized
acaaccacgtaagacacataca

SEQ ID NO: 1114109 - DNA, 22 bp, Artificial Sequence
  chemically synthesized
tggagatataataaatctcaca

SEQ ID NO: 1114110 - DNA, 22 bp, Artificial Sequence
  chemically synthesized
acgtggttgtgagatttattat

SEQ ID NO: 1114111 - DNA, 22 bp, Artificial Sequence
  chemically synthesized
ggctatggagatataataaatc

SEQ ID NO: 1114112 - DNA, 22 bp, Artificial Sequence
  chemically synthesized
cgtggttgtgagatttattata

SEQ ID NO: 1114113 - DNA, 22 bp, Artificial Sequence
  chemically synthesized
aggctatggagatataataaat

SEQ ID NO: 1114114 - DNA, 22 bp, Artificial Sequence
  chemically synthesized
tgagatttattatatctccata

SEQ ID NO: 1114115 - DNA, 22 bp, Artificial Sequence
  chemically synthesized
ccaagcttaggctatggagata

SEQ ID NO: 1114116 - DNA, 22 bp, Artificial Sequence
  chemically synthesized
cccaagcttaggctatggagat

SEQ ID NO: 1114117 - DNA, 22 bp, Artificial Sequence
  chemically synthesized
cttcccaagcttaggctatgga

SEQ ID NO: 1114118 - DNA, 22 bp, Artificial Sequence
  chemically synthesized
ccttcccaagcttaggctatgg

SEQ ID NO: 1114119 - DNA, 22 bp, Artificial Sequence
  chemically synthesized
attatatctccatagcctaagc

SEQ ID NO: 1114120 - DNA, 22 bp, Artificial Sequence
  chemically synthesized
ttatatctccatagcctaagct

SEQ ID NO: 1114121 - DNA, 22 bp, Artificial Sequence
  chemically synthesized
tatctccatagcctaagcttgg

SEQ ID NO: 1114122 - DNA, 22 bp, Artificial Sequence
  chemically synthesized
catagcctaagcttgggaagga

SEQ ID NO: 1114123 - DNA, 22 bp, Artificial Sequence
  chemically synthesized
taagtccagaatcttccttccc

SEQ ID NO: 1114124 - DNA, 22 bp, Artificial Sequence
  chemically synthesized
ataagtccagaatcttccttcc

SEQ ID NO: 1114125 - DNA, 22 bp, Artificial Sequence
  chemically synthesized
aatttataagtccagaatcttc

SEQ ID NO: 1114126 - DNA, 22 bp, Artificial Sequence
  chemically synthesized
agcttgggaaggaagattctgg

SEQ ID NO: 1114127 - DNA, 22 bp, Artificial Sequence
  chemically synthesized
aaatttataagtccagaatctt

SEQ ID NO: 1114128 - DNA, 22 bp, Artificial Sequence
  chemically synthesized
ttaaatttataagtccagaatc

SEQ ID NO: 1114129 - DNA, 22 bp, Artificial Sequence
  chemically synthesized
gggaaggaagattctggactta

SEQ ID NO: 1114130 - DNA, 22 bp, Artificial Sequence
  chemically synthesized
ggaaggaagattctggacttat

SEQ ID NO: 1114131 - DNA, 22 bp, Artificial Sequence
  chemically synthesized
aagctcttaaatttataagtcc

SEQ ID NO: 1114132 - DNA, 22 bp, Artificial Sequence
  chemically synthesized
cattaaagctcttaaatttata

SEQ ID NO: 1114133 - DNA, 22 bp, Artificial Sequence
  chemically synthesized
ttgcattaaagctcttaaattt

SEQ ID NO: 1114134 - DNA, 22 bp, Artificial Sequence
  chemically synthesized
tggacttataaatttaagagct

SEQ ID NO: 1114135 - DNA, 22 bp, Artificial Sequence
  chemically synthesized
gacttataaatttaagagcttt

SEQ ID NO: 1114136 - DNA, 22 bp, Artificial Sequence
  chemically synthesized
ataaatttaagagctttaatgc

SEQ ID NO: 1114137 - DNA, 22 bp, Artificial Sequence
  chemically synthesized
taaatttaagagctttaatgca

SEQ ID NO: 1114138 - DNA, 22 bp, Artificial Sequence
  chemically synthesized
ggagtccagcaattattgcatt

SEQ ID NO: 1114139 - DNA, 22 bp, Artificial Sequence
  chemically synthesized
aagagctttaatgcaataattg

SEQ ID NO: 1114140 - DNA, 22 bp, Artificial Sequence
  chemically synthesized
agagctttaatgcaataattgc

SEQ ID NO: 1114141 - DNA, 22 bp, Artificial Sequence
  chemically synthesized
taaactaggagtccagcaatta

SEQ ID NO: 1114142 - DNA, 22 bp, Artificial Sequence
  chemically synthesized
tgtaaactaggagtccagcaat

SEQ ID NO: 1114143 - DNA, 22 bp, Artificial Sequence
  chemically synthesized
ctgtaaactaggagtccagcaa

SEQ ID NO: 1114144 - DNA, 22 bp, Artificial Sequence
  chemically synthesized
taatgcaataattgctggactc

SEQ ID NO: 1114145 - DNA, 22 bp, Artificial Sequence
  chemically synthesized
tctgtaaactaggagtccagca

SEQ ID NO: 1114146 - DNA, 22 bp, Artificial Sequence
  chemically synthesized
aatgcaataattgctggactcc

SEQ ID NO: 1114147 - DNA, 22 bp, Artificial Sequence
  chemically synthesized
atgcaataattgctggactcct

SEQ ID NO: 1114148 - DNA, 22 bp, Artificial Sequence
  chemically synthesized
ctggactcctagtttacagaaa

SEQ ID NO: 1114149 - DNA, 22 bp, Artificial Sequence
  chemically synthesized
gactcctagtttacagaaagct

SEQ ID NO: 1114150 - DNA, 22 bp, Artificial Sequence
  chemically synthesized
aaagacaaatgaagctttctgt

SEQ ID NO: 1114151 - DNA, 22 bp, Artificial Sequence
  chemically synthesized
ctagtttacagaaagcttcatt

SEQ ID NO: 1114152 - DNA, 22 bp, Artificial Sequence
  chemically synthesized
gtttacagaaagcttcatttgt

SEQ ID NO: 1114153 - DNA, 22 bp, Artificial Sequence
  chemically synthesized
atgaagctgaaagacaaatgaa

SEQ ID NO: 1114154 - DNA, 22 bp, Artificial Sequence
  chemically synthesized
acagaaagcttcatttgtcttt

SEQ ID NO: 1114155 - DNA, 22 bp, Artificial Sequence
  chemically synthesized
cagaaagcttcatttgtctttc

SEQ ID NO: 1114156 - DNA, 22 bp, Artificial Sequence
  chemically synthesized
agtggtgtagctcatgaagctg

SEQ ID NO: 1114157 - DNA, 22 bp, Artificial Sequence
  chemically synthesized
catttgtctttcagcttcatga

SEQ ID NO: 1114158 - DNA, 22 bp, Artificial Sequence
  chemically synthesized
atttgtctttcagcttcatgag

SEQ ID NO: 1114159 - DNA, 22 bp, Artificial Sequence
  chemically synthesized
gtctttcagcttcatgagctac

SEQ ID NO: 1114160 - DNA, 22 bp, Artificial Sequence
  chemically synthesized
tctttcagcttcatgagctaca

SEQ ID NO: 1114161 - DNA, 22 bp, Artificial Sequence
  chemically synthesized
tcagcttcatgagctacaccac

SEQ ID NO: 1114162 - DNA, 22 bp, Artificial Sequence
  chemically synthesized
cagcttcatgagctacaccact

SEQ ID NO: 1114163 - DNA, 22 bp, Artificial Sequence
  chemically synthesized
agcttcatgagctacaccactc

SEQ ID NO: 1114164 - DNA, 22 bp, Artificial Sequence
  chemically synthesized
catgagctacaccactcaactg

SEQ ID NO: 1114165 - DNA, 22 bp, Artificial Sequence
  chemically synthesized
atgagctacaccactcaactgt

SEQ ID NO: 1114166 - DNA, 22 bp, Artificial Sequence
  chemically synthesized
gtatagagcccaaaagtacagt

SEQ ID NO: 1114167 - DNA, 22 bp, Artificial Sequence
  chemically synthesized
agtatagagcccaaaagtacag

SEQ ID NO: 1114168 - DNA, 22 bp, Artificial Sequence
  chemically synthesized
tagtatagagcccaaaagtaca

SEQ ID NO: 1114169 - DNA, 22 bp, Artificial Sequence
  chemically synthesized
caccactcaactgtacttttgg

SEQ ID NO: 1114170 - DNA, 22 bp, Artificial Sequence
  chemically synthesized
ctttagtatagagcccaaaagt

SEQ ID NO: 1114171 - DNA, 22 bp, Artificial Sequence
  chemically synthesized
aactgtacttttgggctctata

SEQ ID NO: 1114172 - DNA, 22 bp, Artificial Sequence
  chemically synthesized
tacttttgggctctatactaaa

SEQ ID NO: 1114173 - DNA, 22 bp, Artificial Sequence
  chemically synthesized
aatcataatagctcctttagta

SEQ ID NO: 1114174 - DNA, 22 bp, Artificial Sequence
  chemically synthesized
ttgggctctatactaaaggagc

SEQ ID NO: 1114175 - DNA, 22 bp, Artificial Sequence
  chemically synthesized
tgggctctatactaaaggagct

SEQ ID NO: 1114176 - DNA, 22 bp, Artificial Sequence
  chemically synthesized
gggctctatactaaaggagcta

SEQ ID NO: 1114177 - DNA, 22 bp, Artificial Sequence
  chemically synthesized
ggctctatactaaaggagctat

SEQ ID NO: 1114178 - DNA, 22 bp, Artificial Sequence
  chemically synthesized
ccctaaatcataatagctcctt

SEQ ID NO: 1114179 - DNA, 22 bp, Artificial Sequence
  chemically synthesized
ctaccctaaatcataatagctc

SEQ ID NO: 1114180 - DNA, 22 bp, Artificial Sequence
  chemically synthesized
tatactaaaggagctattatga

SEQ ID NO: 1114181 - DNA, 22 bp, Artificial Sequence
  chemically synthesized
tactaaaggagctattatgatt

SEQ ID NO: 1114182 - DNA, 22 bp, Artificial Sequence
  chemically synthesized
aaggagctattatgatttaggg

SEQ ID NO: 1114183 - DNA, 22 bp, Artificial Sequence
  chemically synthesized
agagggactgctaccctaaatc

SEQ ID NO: 1114184 - DNA, 22 bp, Artificial Sequence
  chemically synthesized
cagagggactgctaccctaaat

SEQ ID NO: 1114185 - DNA, 22 bp, Artificial Sequence
  chemically synthesized
ttatgatttagggtagcagtcc

SEQ ID NO: 1114186 - DNA, 22 bp, Artificial Sequence
  chemically synthesized
tgatttagggtagcagtccctc

SEQ ID NO: 1114187 - DNA, 22 bp, Artificial Sequence
  chemically synthesized
aggtgtatttcagagggactgc

SEQ ID NO: 1114188 - DNA, 22 bp, Artificial Sequence
  chemically synthesized
caggtgtatttcagagggactg

SEQ ID NO: 1114189 - DNA, 22 bp, Artificial Sequence
  chemically synthesized
agggtagcagtccctctgaaat

SEQ ID NO: 1114190 - DNA, 22 bp, Artificial Sequence
  chemically synthesized
gggtagcagtccctctgaaata

SEQ ID NO: 1114191 - DNA, 22 bp, Artificial Sequence
  chemically synthesized
aagtaccccttcaggtgtattt

SEQ ID NO: 1114192 - DNA, 22 bp, Artificial Sequence
  chemically synthesized
agtgcctgaagtaccccttcag

SEQ ID NO: 1114193 - DNA, 22 bp, Artificial Sequence
  chemically synthesized
tgaaatacacctgaaggggtac

SEQ ID NO: 1114194 - DNA, 22 bp, Artificial Sequence
  chemically synthesized
aaatacacctgaaggggtactt

SEQ ID NO: 1114195 - DNA, 22 bp, Artificial Sequence
  chemically synthesized
gacacatattaagtgcctgaag

SEQ ID NO: 1114196 - DNA, 22 bp, Artificial Sequence
  chemically synthesized
aaggggtacttcaggcacttaa

SEQ ID NO: 1114197 - DNA, 22 bp, Artificial Sequence
  chemically synthesized
tgagataagctagacacatatt

SEQ ID NO: 1114198 - DNA, 22 bp, Artificial Sequence
  chemically synthesized
caggcacttaatatgtgtctag

SEQ ID NO: 1114199 - DNA, 22 bp, Artificial Sequence
  chemically synthesized
aggcacttaatatgtgtctagc

SEQ ID NO: 1114200 - DNA, 22 bp, Artificial Sequence
  chemically synthesized
tgcaaattgtgagataagctag

SEQ ID NO: 1114201 - DNA, 22 bp, Artificial Sequence
  chemically synthesized
aatatgtgtctagcttatctca

SEQ ID NO: 1114202 - DNA, 22 bp, Artificial Sequence
  chemically synthesized
atatgtgtctagcttatctcac

SEQ ID NO: 1114203 - DNA, 22 bp, Artificial Sequence
  chemically synthesized
tgattgtgcaaattgtgagata

SEQ ID NO: 1114204 - DNA, 22 bp, Artificial Sequence
  chemically synthesized
tgtgattgtgcaaattgtgaga

SEQ ID NO: 1114205 - DNA, 22 bp, Artificial Sequence
  chemically synthesized
ctgtgattgtgcaaattgtgag

SEQ ID NO: 1114206 - DNA, 22 bp, Artificial Sequence
  chemically synthesized
tctgtgattgtgcaaattgtga

SEQ ID NO: 1114207 - DNA, 22 bp, Artificial Sequence
  chemically synthesized
ttttctgtgattgtgcaaattg

SEQ ID NO: 1114208 - DNA, 22 bp, Artificial Sequence
  chemically synthesized
attttctgtgattgtgcaaatt

SEQ ID NO: 1114209 - DNA, 22 bp, Artificial Sequence
  chemically synthesized
gcttatctcacaatttgcacaa

SEQ ID NO: 1114210 - DNA, 22 bp, Artificial Sequence
  chemically synthesized
atctcacaatttgcacaatcac

SEQ ID NO: 1114211 - DNA, 22 bp, Artificial Sequence
  chemically synthesized
tctcacaatttgcacaatcaca

SEQ ID NO: 1114212 - DNA, 22 bp, Artificial Sequence
  chemically synthesized
acaatttgcacaatcacagaaa

SEQ ID NO: 1114213 - DNA, 22 bp, Artificial Sequence
  chemically synthesized
cataatatttattttctgtgat

SEQ ID NO: 1114214 - DNA, 22 bp, Artificial Sequence
  chemically synthesized
gcacaatcacagaaaataaata

SEQ ID NO: 1114215 - DNA, 22 bp, Artificial Sequence
  chemically synthesized
cacaatcacagaaaataaatat

SEQ ID NO: 1114216 - DNA, 22 bp, Artificial Sequence
  chemically synthesized
aaggaacaaattgcataatatt

SEQ ID NO: 1114217 - DNA, 22 bp, Artificial Sequence
  chemically synthesized
tcgttcaaggaacaaattgcat

SEQ ID NO: 1114218 - DNA, 22 bp, Artificial Sequence
  chemically synthesized
gtcgttcaaggaacaaattgca

SEQ ID NO: 1114219 - DNA, 22 bp, Artificial Sequence
  chemically synthesized
tgtcgttcaaggaacaaattgc

SEQ ID NO: 1114220 - DNA, 22 bp, Artificial Sequence
  chemically synthesized
ttgtcgttcaaggaacaaattg

SEQ ID NO: 1114221 - DNA, 22 bp, Artificial Sequence
  chemically synthesized
cgtttttgtcgttcaaggaaca

SEQ ID NO: 1114222 - DNA, 22 bp, Artificial Sequence
  chemically synthesized
ttccgtttttgtcgttcaagga

SEQ ID NO: 1114223 - DNA, 22 bp, Artificial Sequence
  chemically synthesized
gttccgtttttgtcgttcaagg

SEQ ID NO: 1114224 - DNA, 22 bp, Artificial Sequence
  chemically synthesized
tgcaatttgttccttgaacgac

SEQ ID NO: 1114225 - DNA, 22 bp, Artificial Sequence
  chemically synthesized
tttgttccgtttttgtcgttca

SEQ ID NO: 1114226 - DNA, 22 bp, Artificial Sequence
  chemically synthesized
tctatttgttccgtttttgtcg

SEQ ID NO: 1114227 - DNA, 22 bp, Artificial Sequence
  chemically synthesized
atctatttgttccgtttttgtc

SEQ ID NO: 1114228 - DNA, 22 bp, Artificial Sequence
  chemically synthesized
gttccttgaacgacaaaaacgg

SEQ ID NO: 1114229 - DNA, 22 bp, Artificial Sequence
  chemically synthesized
ttccttgaacgacaaaaacgga

SEQ ID NO: 1114230 - DNA, 22 bp, Artificial Sequence
  chemically synthesized
acttatctatttgttccgtttt

SEQ ID NO: 1114231 - DNA, 22 bp, Artificial Sequence
  chemically synthesized
cttgaacgacaaaaacggaaca

SEQ ID NO: 1114232 - DNA, 22 bp, Artificial Sequence
  chemically synthesized
taacttatctatttgttccgtt

SEQ ID NO: 1114233 - DNA, 22 bp, Artificial Sequence
  chemically synthesized
gaacgacaaaaacggaacaaat

SEQ ID NO: 1114234 - DNA, 22 bp, Artificial Sequence
  chemically synthesized
aacgacaaaaacggaacaaata

SEQ ID NO: 1114235 - DNA, 22 bp, Artificial Sequence
  chemically synthesized
aaatattctaacttatctattt

SEQ ID NO: 1114236 - DNA, 22 bp, Artificial Sequence
  chemically synthesized
aaggctcaaatattctaactta

SEQ ID NO: 1114237 - DNA, 22 bp, Artificial Sequence
  chemically synthesized
aaaggctcaaatattctaactt

SEQ ID NO: 1114238 - DNA, 22 bp, Artificial Sequence
  chemically synthesized
cttaaaggctcaaatattctaa

SEQ ID NO: 1114239 - DNA, 22 bp, Artificial Sequence
  chemically synthesized
tgaaattacttaaaggctcaaa

SEQ ID NO: 1114240 - DNA, 22 bp, Artificial Sequence
  chemically synthesized
atgaaattacttaaaggctcaa

SEQ ID NO: 1114241 - DNA, 22 bp, Artificial Sequence
  chemically synthesized
gaatatttgagcctttaagtaa

SEQ ID NO: 1114242 - DNA, 22 bp, Artificial Sequence
  chemically synthesized
aataaaataatttatgaaatta

SEQ ID NO: 1114243 - DNA, 22 bp, Artificial Sequence
  chemically synthesized
gagcctttaagtaatttcataa

SEQ ID NO: 1114244 - DNA, 22 bp, Artificial Sequence
  chemically synthesized
agcctttaagtaatttcataaa

SEQ ID NO: 1114245 - DNA, 22 bp, Artificial Sequence
  chemically synthesized
cccattaaataaaataatttat

SEQ ID NO: 1114246 - DNA, 22 bp, Artificial Sequence
  chemically synthesized
taagtaatttcataaattattt

SEQ ID NO: 1114247 - DNA, 22 bp, Artificial Sequence
  chemically synthesized
ccccattaaataaaataattta

SEQ ID NO: 1114248 - DNA, 22 bp, Artificial Sequence
  chemically synthesized
aagtaatttcataaattatttt

SEQ ID NO: 1114249 - DNA, 22 bp, Artificial Sequence
  chemically synthesized
agtaatttcataaattatttta

SEQ ID NO: 1114250 - DNA, 22 bp, Artificial Sequence
  chemically synthesized
tttccccattaaataaaataat

SEQ ID NO: 1114251 - DNA, 22 bp, Artificial Sequence
  chemically synthesized
tgtttccccattaaataaaata

SEQ ID NO: 1114252 - DNA, 22 bp, Artificial Sequence
  chemically synthesized
cataaattattttatttaatgg

SEQ ID NO: 1114253 - DNA, 22 bp, Artificial Sequence
  chemically synthesized
ataaattattttatttaatggg

SEQ ID NO: 1114254 - DNA, 22 bp, Artificial Sequence
  chemically synthesized
ttttatttaatggggaaacaga

SEQ ID NO: 1114255 - DNA, 22 bp, Artificial Sequence
  chemically synthesized
aaatgaccatagctctgtttcc

SEQ ID NO: 1114256 - DNA, 22 bp, Artificial Sequence
  chemically synthesized
aaaatgaccatagctctgtttc

SEQ ID NO: 1114257 - DNA, 22 bp, Artificial Sequence
  chemically synthesized
tatttaatggggaaacagagct

SEQ ID NO: 1114258 - DNA, 22 bp, Artificial Sequence
  chemically synthesized
atttaatggggaaacagagcta

SEQ ID NO: 1114259 - DNA, 22 bp, Artificial Sequence
  chemically synthesized
tttaatggggaaacagagctat

SEQ ID NO: 1114260 - DNA, 22 bp, Artificial Sequence
  chemically synthesized
cttaaaatgaccatagctctgt

SEQ ID NO: 1114261 - DNA, 22 bp, Artificial Sequence
  chemically synthesized
aatggggaaacagagctatggt

SEQ ID NO: 1114262 - DNA, 22 bp, Artificial Sequence
  chemically synthesized
atggggaaacagagctatggtc

SEQ ID NO: 1114263 - DNA, 22 bp, Artificial Sequence
  chemically synthesized
ggatgactacttaaaatgacca

SEQ ID NO: 1114264 - DNA, 22 bp, Artificial Sequence
  chemically synthesized
ggccataactaggatgactact

SEQ ID NO: 1114265 - DNA, 22 bp, Artificial Sequence
  chemically synthesized
tggtcattttaagtagtcatcc

SEQ ID NO: 1114266 - DNA, 22 bp, Artificial Sequence
  chemically synthesized
gggccataactaggatgactac

SEQ ID NO: 1114267 - DNA, 22 bp, Artificial Sequence
  chemically synthesized
aagtttgggccataactaggat

SEQ ID NO: 1114268 - DNA, 22 bp, Artificial Sequence
  chemically synthesized
taagtagtcatcctagttatgg

SEQ ID NO: 1114269 - DNA, 22 bp, Artificial Sequence
  chemically synthesized
aagtagtcatcctagttatggc

SEQ ID NO: 1114270 - DNA, 22 bp, Artificial Sequence
  chemically synthesized
agtagtcatcctagttatggcc

SEQ ID NO: 1114271 - DNA, 22 bp, Artificial Sequence
  chemically synthesized
ggctcaagtttgggccataact

SEQ ID NO: 1114272 - DNA, 22 bp, Artificial Sequence
  chemically synthesized
atacgtcattaggctcaagttt

SEQ ID NO: 1114273 - DNA, 22 bp, Artificial Sequence
  chemically synthesized
gttatggcccaaacttgagcct

SEQ ID NO: 1114274 - DNA, 22 bp, Artificial Sequence
  chemically synthesized
tggcccaaacttgagcctaatg

SEQ ID NO: 1114275 - DNA, 22 bp, Artificial Sequence
  chemically synthesized
gagcctaatgacgtatcagttc

SEQ ID NO: 1114276 - DNA, 22 bp, Artificial Sequence
  chemically synthesized
agcctaatgacgtatcagttcg

SEQ ID NO: 1114277 - DNA, 22 bp, Artificial Sequence
  chemically synthesized
ccagtaaagatatggtcgaact

SEQ ID NO: 1114278 - DNA, 22 bp, Artificial Sequence
  chemically synthesized
atgacgtatcagttcgaccata

SEQ ID NO: 1114279 - DNA, 22 bp, Artificial Sequence
  chemically synthesized
taccagtaaagatatggtcgaa

SEQ ID NO: 1114280 - DNA, 22 bp, Artificial Sequence
  chemically synthesized
ttctaccagtaaagatatggtc

SEQ ID NO: 1114281 - DNA, 22 bp, Artificial Sequence
  chemically synthesized
gttctaccagtaaagatatggt

SEQ ID NO: 1114282 - DNA, 22 bp, Artificial Sequence
  chemically synthesized
tgttctaccagtaaagatatgg

SEQ ID NO: 1114283 - DNA, 22 bp, Artificial Sequence
  chemically synthesized
ttgttctaccagtaaagatatg

SEQ ID NO: 1114284 - DNA, 22 bp, Artificial Sequence
  chemically synthesized
cccttttgttctaccagtaaag

SEQ ID NO: 1114285 - DNA, 22 bp, Artificial Sequence
  chemically synthesized
gaccatatctttactggtagaa

SEQ ID NO: 1114286 - DNA, 22 bp, Artificial Sequence
  chemically synthesized
tgctacccttttgttctaccag

SEQ ID NO: 1114287 - DNA, 22 bp, Artificial Sequence
  chemically synthesized
atgctacccttttgttctacca

SEQ ID NO: 1114288 - DNA, 22 bp, Artificial Sequence
  chemically synthesized
tatgctacccttttgttctacc

SEQ ID NO: 1114289 - DNA, 22 bp, Artificial Sequence
  chemically synthesized
tactggtagaacaaaagggtag

SEQ ID NO: 1114290 - DNA, 22 bp, Artificial Sequence
  chemically synthesized
actggtagaacaaaagggtagc

SEQ ID NO: 1114291 - DNA, 22 bp, Artificial Sequence
  chemically synthesized
atcaaattttatgctacccttt

SEQ ID NO: 1114292 - DNA, 22 bp, Artificial Sequence
  chemically synthesized
ctggtagaacaaaagggtagca

SEQ ID NO: 1114293 - DNA, 22 bp, Artificial Sequence
  chemically synthesized
gtagaacaaaagggtagcataa

SEQ ID NO: 1114294 - DNA, 22 bp, Artificial Sequence
  chemically synthesized
tgttaatcaaattttatgctac

SEQ ID NO: 1114295 - DNA, 22 bp, Artificial Sequence
  chemically synthesized
actgtgttaatcaaattttatg

SEQ ID NO: 1114296 - DNA, 22 bp, Artificial Sequence
  chemically synthesized
gttgactgtgttaatcaaattt

SEQ ID NO: 1114297 - DNA, 22 bp, Artificial Sequence
  chemically synthesized
ggttgactgtgttaatcaaatt

SEQ ID NO: 1114298 - DNA, 22 bp, Artificial Sequence
  chemically synthesized
tttggttgactgtgttaatcaa

SEQ ID NO: 1114299 - DNA, 22 bp, Artificial Sequence
  chemically synthesized
ctgtttggttgactgtgttaat

SEQ ID NO: 1114300 - DNA, 22 bp, Artificial Sequence
  chemically synthesized
agacattcctgtttggttgact

SEQ ID NO: 1114301 - DNA, 22 bp, Artificial Sequence
  chemically synthesized
gagacattcctgtttggttgac

SEQ ID NO: 1114302 - DNA, 22 bp, Artificial Sequence
  chemically synthesized
gattaacacagtcaaccaaaca

SEQ ID NO: 1114303 - DNA, 22 bp, Artificial Sequence
  chemically synthesized
attaacacagtcaaccaaacag

SEQ ID NO: 1114304 - DNA, 22 bp, Artificial Sequence
  chemically synthesized
acacagtcaaccaaacaggaat

SEQ ID NO: 1114305 - DNA, 22 bp, Artificial Sequence
  chemically synthesized
gggggtaggggtgtgatttgag

SEQ ID NO: 1114306 - DNA, 22 bp, Artificial Sequence
  chemically synthesized
aaatcacacccctaccccccag

SEQ ID NO: 1114307 - DNA, 22 bp, Artificial Sequence
  chemically synthesized
gcagataccagggaacactggg

SEQ ID NO: 1114308 - DNA, 22 bp, Artificial Sequence
  chemically synthesized
ggcagataccagggaacactgg

SEQ ID NO: 1114309 - DNA, 22 bp, Artificial Sequence
  chemically synthesized
tggcagataccagggaacactg

SEQ ID NO: 1114310 - DNA, 22 bp, Artificial Sequence
  chemically synthesized
actttggcagataccagggaac

SEQ ID NO: 1114311 - DNA, 22 bp, Artificial Sequence
  chemically synthesized
ccccccagtgttccctggtatc

SEQ ID NO: 1114312 - DNA, 22 bp, Artificial Sequence
  chemically synthesized
aaggaaaatgctaactttggca

SEQ ID NO: 1114313 - DNA, 22 bp, Artificial Sequence
  chemically synthesized
cctggtatctgccaaagttagc

SEQ ID NO: 1114314 - DNA, 22 bp, Artificial Sequence
  chemically synthesized
gtatctgccaaagttagcattt

SEQ ID NO: 1114315 - DNA, 22 bp, Artificial Sequence
  chemically synthesized
ccaaagttagcattttccttca

SEQ ID NO: 1114316 - DNA, 22 bp, Artificial Sequence
  chemically synthesized
gcattttccttcagatggatta

SEQ ID NO: 1114317 - DNA, 22 bp, Artificial Sequence
  chemically synthesized
gtgtgaaaataataatccatct

SEQ ID NO: 1114318 - DNA, 22 bp, Artificial Sequence
  chemically synthesized
ggtgtgaaaataataatccatc

SEQ ID NO: 1114319 - DNA, 22 bp, Artificial Sequence
  chemically synthesized
tggtgtgaaaataataatccat

SEQ ID NO: 1114320 - DNA, 22 bp, Artificial Sequence
  chemically synthesized
tccttcagatggattattattt

SEQ ID NO: 1114321 - DNA, 22 bp, Artificial Sequence
  chemically synthesized
ccttcagatggattattatttt

SEQ ID NO: 1114322 - DNA, 22 bp, Artificial Sequence
  chemically synthesized
cttcagatggattattattttc

SEQ ID NO: 1114323 - DNA, 22 bp, Artificial Sequence
  chemically synthesized
gtaattttggtgtgaaaataat

SEQ ID NO: 1114324 - DNA, 22 bp, Artificial Sequence
  chemically synthesized
cagatggattattattttcaca

SEQ ID NO: 1114325 - DNA, 22 bp, Artificial Sequence
  chemically synthesized
agatggattattattttcacac

SEQ ID NO: 1114326 - DNA, 22 bp, Artificial Sequence
  chemically synthesized
ttattttcacaccaaaattacc

SEQ ID NO: 1114327 - DNA, 22 bp, Artificial Sequence
  chemically synthesized
aggtaataacgttggtaatttt

SEQ ID NO: 1114328 - DNA, 22 bp, Artificial Sequence
  chemically synthesized
ttttcacaccaaaattaccaac

SEQ ID NO: 1114329 - DNA, 22 bp, Artificial Sequence
  chemically synthesized
tcacaccaaaattaccaacgtt

SEQ ID NO: 1114330 - DNA, 22 bp, Artificial Sequence
  chemically synthesized
cacaccaaaattaccaacgtta

SEQ ID NO: 1114331 - DNA, 22 bp, Artificial Sequence
  chemically synthesized
acaccaaaattaccaacgttat

SEQ ID NO: 1114332 - DNA, 22 bp, Artificial Sequence
  chemically synthesized
aggcagtcgttgaggtaataac

SEQ ID NO: 1114333 - DNA, 22 bp, Artificial Sequence
  chemically synthesized
ccaacgttattacctcaacgac

SEQ ID NO: 1114334 - DNA, 22 bp, Artificial Sequence
  chemically synthesized
gaaaagcaaaattaaggcagtc

SEQ ID NO: 1114335 - DNA, 22 bp, Artificial Sequence
  chemically synthesized
agaaaagcaaaattaaggcagt

SEQ ID NO: 1114336 - DNA, 22 bp, Artificial Sequence
  chemically synthesized
ttacctcaacgactgccttaat

SEQ ID NO: 1114337 - DNA, 22 bp, Artificial Sequence
  chemically synthesized
tttagaaaagcaaaattaaggc

SEQ ID NO: 1114338 - DNA, 22 bp, Artificial Sequence
  chemically synthesized
cctcaacgactgccttaatttt

SEQ ID NO: 1114339 - DNA, 22 bp, Artificial Sequence
  chemically synthesized
tgtttagaaaagcaaaattaag

SEQ ID NO: 1114340 - DNA, 22 bp, Artificial Sequence
  chemically synthesized
aacgactgccttaattttgctt

SEQ ID NO: 1114341 - DNA, 22 bp, Artificial Sequence
  chemically synthesized
accagattctgtttagaaaagc

SEQ ID NO: 1114342 - DNA, 22 bp, Artificial Sequence
  chemically synthesized
ccttaattttgcttttctaaac

SEQ ID NO: 1114343 - DNA, 22 bp, Artificial Sequence
  chemically synthesized
attgaccagattctgtttagaa

SEQ ID NO: 1114344 - DNA, 22 bp, Artificial Sequence
  chemically synthesized
aattttgcttttctaaacagaa

SEQ ID NO: 1114345 - DNA, 22 bp, Artificial Sequence
  chemically synthesized
attttgcttttctaaacagaat

SEQ ID NO: 1114346 - DNA, 22 bp, Artificial Sequence
  chemically synthesized
tgcttttctaaacagaatctgg

SEQ ID NO: 1114347 - DNA, 22 bp, Artificial Sequence
  chemically synthesized
gcttttctaaacagaatctggt

SEQ ID NO: 1114348 - DNA, 22 bp, Artificial Sequence
  chemically synthesized
cttttctaaacagaatctggtc

SEQ ID NO: 1114349 - DNA, 22 bp, Artificial Sequence
  chemically synthesized
gtaaatattaattgaccagatt

SEQ ID NO: 1114350 - DNA, 22 bp, Artificial Sequence
  chemically synthesized
agtaaatattaattgaccagat

SEQ ID NO: 1114351 - DNA, 22 bp, Artificial Sequence
  chemically synthesized
ttctaaacagaatctggtcaat

SEQ ID NO: 1114352 - DNA, 22 bp, Artificial Sequence
  chemically synthesized
tctaaacagaatctggtcaatt

SEQ ID NO: 1114353 - DNA, 22 bp, Artificial Sequence
  chemically synthesized
ctaaacagaatctggtcaatta

SEQ ID NO: 1114354 - DNA, 22 bp, Artificial Sequence
  chemically synthesized
taaacagaatctggtcaattaa

SEQ ID NO: 1114355 - DNA, 22 bp, Artificial Sequence
  chemically synthesized
aacagaatctggtcaattaata

SEQ ID NO: 1114356 - DNA, 22 bp, Artificial Sequence
  chemically synthesized
gtcaattaatatttactaagca

SEQ ID NO: 1114357 - DNA, 22 bp, Artificial Sequence
  chemically synthesized
atatttactaagcacctactat

SEQ ID NO: 1114358 - DNA, 22 bp, Artificial Sequence
  chemically synthesized
actaagcacctactatgtgtcc

SEQ ID NO: 1114359 - DNA, 22 bp, Artificial Sequence
  chemically synthesized
ctaagcacctactatgtgtcct

SEQ ID NO: 1114360 - DNA, 22 bp, Artificial Sequence
  chemically synthesized
agcacctactatgtgtcctgac

SEQ ID NO: 1114361 - DNA, 22 bp, Artificial Sequence
  chemically synthesized
gaggcatgtagaaaagtcagga

SEQ ID NO: 1114362 - DNA, 22 bp, Artificial Sequence
  chemically synthesized
ggaggcatgtagaaaagtcagg

SEQ ID NO: 1114363 - DNA, 22 bp, Artificial Sequence
  chemically synthesized
tggaggcatgtagaaaagtcag

SEQ ID NO: 1114364 - DNA, 22 bp, Artificial Sequence
  chemically synthesized
ttggaggcatgtagaaaagtca

SEQ ID NO: 1114365 - DNA, 22 bp, Artificial Sequence
  chemically synthesized
ctatgtgtcctgacttttctac

SEQ ID NO: 1114366 - DNA, 22 bp, Artificial Sequence
  chemically synthesized
atttttggaggcatgtagaaaa

SEQ ID NO: 1114367 - DNA, 22 bp, Artificial Sequence
  chemically synthesized
tgtgtcctgacttttctacatg

SEQ ID NO: 1114368 - DNA, 22 bp, Artificial Sequence
  chemically synthesized
taatttttggaggcatgtagaa

SEQ ID NO: 1114369 - DNA, 22 bp, Artificial Sequence
  chemically synthesized
atagttctaatttttggaggca

SEQ ID NO: 1114370 - DNA, 22 bp, Artificial Sequence
  chemically synthesized
acttttctacatgcctccaaaa

SEQ ID NO: 1114371 - DNA, 22 bp, Artificial Sequence
  chemically synthesized
cctcatagttctaatttttgga

SEQ ID NO: 1114372 - DNA, 22 bp, Artificial Sequence
  chemically synthesized
ttctacatgcctccaaaaatta

SEQ ID NO: 1114373 - DNA, 22 bp, Artificial Sequence
  chemically synthesized
ccctcatagttctaatttttgg

SEQ ID NO: 1114374 - DNA, 22 bp, Artificial Sequence
  chemically synthesized
tctacatgcctccaaaaattag

SEQ ID NO: 1114375 - DNA, 22 bp, Artificial Sequence
  chemically synthesized
ctacatgcctccaaaaattaga

SEQ ID NO: 1114376 - DNA, 22 bp, Artificial Sequence
  chemically synthesized
tacatgcctccaaaaattagaa

SEQ ID NO: 1114377 - DNA, 22 bp, Artificial Sequence
  chemically synthesized
tttccctcatagttctaatttt

SEQ ID NO: 1114378 - DNA, 22 bp, Artificial Sequence
  chemically synthesized
catgcctccaaaaattagaact

SEQ ID NO: 1114379 - DNA, 22 bp, Artificial Sequence
  chemically synthesized
attatttccctcatagttctaa

SEQ ID NO: 1114380 - DNA, 22 bp, Artificial Sequence
  chemically synthesized
gattatttccctcatagttcta

SEQ ID NO: 1114381 - DNA, 22 bp, Artificial Sequence
  chemically synthesized
ttgattatttccctcatagttc

SEQ ID NO: 1114382 - DNA, 22 bp, Artificial Sequence
  chemically synthesized
cttgattatttccctcatagtt

SEQ ID NO: 1114383 - DNA, 22 bp, Artificial Sequence
  chemically synthesized
tcttgattatttccctcatagt

SEQ ID NO: 1114384 - DNA, 22 bp, Artificial Sequence
  chemically synthesized
caaaaattagaactatgaggga

SEQ ID NO: 1114385 - DNA, 22 bp, Artificial Sequence
  chemically synthesized
attttcttgattatttccctca

SEQ ID NO: 1114386 - DNA, 22 bp, Artificial Sequence
  chemically synthesized
gaactatgagggaaataatcaa

SEQ ID NO: 1114387 - DNA, 22 bp, Artificial Sequence
  chemically synthesized
tgagggaaataatcaagaaaat

SEQ ID NO: 1114388 - DNA, 22 bp, Artificial Sequence
  chemically synthesized
gtgagaatattaattttcttga

SEQ ID NO: 1114389 - DNA, 22 bp, Artificial Sequence
  chemically synthesized
aatgatcgtgtgactagtgaga

SEQ ID NO: 1114390 - DNA, 22 bp, Artificial Sequence
  chemically synthesized
aaatgatcgtgtgactagtgag

SEQ ID NO: 1114391 - DNA, 22 bp, Artificial Sequence
  chemically synthesized
atattctcactagtcacacgat

SEQ ID NO: 1114392 - DNA, 22 bp, Artificial Sequence
  chemically synthesized
catgcaggatttaaatgatcgt

SEQ ID NO: 1114393 - DNA, 22 bp, Artificial Sequence
  chemically synthesized
tcactagtcacacgatcattta

SEQ ID NO: 1114394 - DNA, 22 bp, Artificial Sequence
  chemically synthesized
actagtcacacgatcatttaaa

SEQ ID NO: 1114395 - DNA, 22 bp, Artificial Sequence
  chemically synthesized
gtcacacgatcatttaaatcct

SEQ ID NO: 1114396 - DNA, 22 bp, Artificial Sequence
  chemically synthesized
gtaagtaaaactacatgcagga

SEQ ID NO: 1114397 - DNA, 22 bp, Artificial Sequence
  chemically synthesized
ggtaagtaaaactacatgcagg

SEQ ID NO: 1114398 - DNA, 22 bp, Artificial Sequence
  chemically synthesized
tggtaagtaaaactacatgcag

SEQ ID NO: 1114399 - DNA, 22 bp, Artificial Sequence
  chemically synthesized
ttggtaagtaaaactacatgca

SEQ ID NO: 1114400 - DNA, 22 bp, Artificial Sequence
  chemically synthesized
atttttggtaagtaaaactaca

SEQ ID NO: 1114401 - DNA, 22 bp, Artificial Sequence
  chemically synthesized
aatttttggtaagtaaaactac

SEQ ID NO: 1114402 - DNA, 22 bp, Artificial Sequence
  chemically synthesized
aaatcctgcatgtagttttact

SEQ ID NO: 1114403 - DNA, 22 bp, Artificial Sequence
  chemically synthesized
taatttttggtaagtaaaacta

SEQ ID NO: 1114404 - DNA, 22 bp, Artificial Sequence
  chemically synthesized
aatcctgcatgtagttttactt

SEQ ID NO: 1114405 - DNA, 22 bp, Artificial Sequence
  chemically synthesized
ttaatttttggtaagtaaaact

SEQ ID NO: 1114406 - DNA, 22 bp, Artificial Sequence
  chemically synthesized
catgtagttttacttaccaaaa

SEQ ID NO: 1114407 - DNA, 22 bp, Artificial Sequence
  chemically synthesized
cgggaatgatttttaatttttg

SEQ ID NO: 1114408 - DNA, 22 bp, Artificial Sequence
  chemically synthesized
tacttaccaaaaattaaaaatc

SEQ ID NO: 1114409 - DNA, 22 bp, Artificial Sequence
  chemically synthesized
acttaccaaaaattaaaaatca

SEQ ID NO: 1114410 - DNA, 22 bp, Artificial Sequence
  chemically synthesized
cttaccaaaaattaaaaatcat

SEQ ID NO: 1114411 - DNA, 22 bp, Artificial Sequence
  chemically synthesized
gaaattacgggaatgattttta

SEQ ID NO: 1114412 - DNA, 22 bp, Artificial Sequence
  chemically synthesized
agaaattacgggaatgattttt

SEQ ID NO: 1114413 - DNA, 22 bp, Artificial Sequence
  chemically synthesized
accaaaaattaaaaatcattcc

SEQ ID NO: 1114414 - DNA, 22 bp, Artificial Sequence
  chemically synthesized
ccaaaaattaaaaatcattccc

SEQ ID NO: 1114415 - DNA, 22 bp, Artificial Sequence
  chemically synthesized
aacatttagaaattacgggaat

SEQ ID NO: 1114416 - DNA, 22 bp, Artificial Sequence
  chemically synthesized
aaacatttagaaattacgggaa

SEQ ID NO: 1114417 - DNA, 22 bp, Artificial Sequence
  chemically synthesized
aaaatcattcccgtaatttcta

SEQ ID NO: 1114418 - DNA, 22 bp, Artificial Sequence
  chemically synthesized
atcagaaataatttaaacattt

SEQ ID NO: 1114419 - DNA, 22 bp, Artificial Sequence
  chemically synthesized
ccgtaatttctaaatgtttaaa

SEQ ID NO: 1114420 - DNA, 22 bp, Artificial Sequence
  chemically synthesized
aattaatcagaaataatttaaa

SEQ ID NO: 1114421 - DNA, 22 bp, Artificial Sequence
  chemically synthesized
ctaaatgtttaaattatttctg

SEQ ID NO: 1114422 - DNA, 22 bp, Artificial Sequence
  chemically synthesized
cactgaattaatcagaaataat

SEQ ID NO: 1114423 - DNA, 22 bp, Artificial Sequence
  chemically synthesized
taaatgtttaaattatttctga

SEQ ID NO: 1114424 - DNA, 22 bp, Artificial Sequence
  chemically synthesized
aatgtttaaattatttctgatt

SEQ ID NO: 1114425 - DNA, 22 bp, Artificial Sequence
  chemically synthesized
cctacactgaattaatcagaaa

SEQ ID NO: 1114426 - DNA, 22 bp, Artificial Sequence
  chemically synthesized
acctacactgaattaatcagaa

SEQ ID NO: 1114427 - DNA, 22 bp, Artificial Sequence
  chemically synthesized
aaattatttctgattaattcag

SEQ ID NO: 1114428 - DNA, 22 bp, Artificial Sequence
  chemically synthesized
aattatttctgattaattcagt

SEQ ID NO: 1114429 - DNA, 22 bp, Artificial Sequence
  chemically synthesized
tttctgattaattcagtgtagg

SEQ ID NO: 1114430 - DNA, 22 bp, Artificial Sequence
  chemically synthesized
tatatcaagcttacctacactg

SEQ ID NO: 1114431 - DNA, 22 bp, Artificial Sequence
  chemically synthesized
ctgattaattcagtgtaggtaa

SEQ ID NO: 1114432 - DNA, 22 bp, Artificial Sequence
  chemically synthesized
tgattaattcagtgtaggtaag

SEQ ID NO: 1114433 - DNA, 22 bp, Artificial Sequence
  chemically synthesized
attaattcagtgtaggtaagct

SEQ ID NO: 1114434 - DNA, 22 bp, Artificial Sequence
  chemically synthesized
attcagtgtaggtaagcttgat

SEQ ID NO: 1114435 - DNA, 22 bp, Artificial Sequence
  chemically synthesized
atgtcatagttatatatcaagc

SEQ ID NO: 1114436 - DNA, 22 bp, Artificial Sequence
  chemically synthesized
agtgtaggtaagcttgatatat

SEQ ID NO: 1114437 - DNA, 22 bp, Artificial Sequence
  chemically synthesized
aatggtctcatgtcatagttat

SEQ ID NO: 1114438 - DNA, 22 bp, Artificial Sequence
  chemically synthesized
aaatggtctcatgtcatagtta

SEQ ID NO: 1114439 - DNA, 22 bp, Artificial Sequence
  chemically synthesized
taaatggtctcatgtcatagtt

SEQ ID NO: 1114440 - DNA, 22 bp, Artificial Sequence
  chemically synthesized
gatatataactatgacatgaga

SEQ ID NO: 1114441 - DNA, 22 bp, Artificial Sequence
  chemically synthesized
tactttaaatggtctcatgtca

SEQ ID NO: 1114442 - DNA, 22 bp, Artificial Sequence
  chemically synthesized
atatataactatgacatgagac

SEQ ID NO: 1114443 - DNA, 22 bp, Artificial Sequence
  chemically synthesized
tgacatgagaccatttaaagta

SEQ ID NO: 1114444 - DNA, 22 bp, Artificial Sequence
  chemically synthesized
atgcaagagctatactttaaat

SEQ ID NO: 1114445 - DNA, 22 bp, Artificial Sequence
  chemically synthesized
ataagctgatgcaagagctata

SEQ ID NO: 1114446 - DNA, 22 bp, Artificial Sequence
  chemically synthesized
aataagctgatgcaagagctat

SEQ ID NO: 1114447 - DNA, 22 bp, Artificial Sequence
  chemically synthesized
taataagctgatgcaagagcta

SEQ ID NO: 1114448 - DNA, 22 bp, Artificial Sequence
  chemically synthesized
attttaataagctgatgcaaga

SEQ ID NO: 1114449 - DNA, 22 bp, Artificial Sequence
  chemically synthesized
cattttaataagctgatgcaag

SEQ ID NO: 1114450 - DNA, 22 bp, Artificial Sequence
  chemically synthesized
aaagtatagctcttgcatcagc

SEQ ID NO: 1114451 - DNA, 22 bp, Artificial Sequence
  chemically synthesized
tcattttaataagctgatgcaa

SEQ ID NO: 1114452 - DNA, 22 bp, Artificial Sequence
  chemically synthesized
aagtatagctcttgcatcagct

SEQ ID NO: 1114453 - DNA, 22 bp, Artificial Sequence
  chemically synthesized
ttcattttaataagctgatgca

SEQ ID NO: 1114454 - DNA, 22 bp, Artificial Sequence
  chemically synthesized
tttcattttaataagctgatgc

SEQ ID NO: 1114455 - DNA, 22 bp, Artificial Sequence
  chemically synthesized
tcactttttcattttaataagc

SEQ ID NO: 1114456 - DNA, 22 bp, Artificial Sequence
  chemically synthesized
ttgcatcagcttattaaaatga

SEQ ID NO: 1114457 - DNA, 22 bp, Artificial Sequence
  chemically synthesized
tattatcactttttcattttaa

SEQ ID NO: 1114458 - DNA, 22 bp, Artificial Sequence
  chemically synthesized
gcatcagcttattaaaatgaaa

SEQ ID NO: 1114459 - DNA, 22 bp, Artificial Sequence
  chemically synthesized
catcagcttattaaaatgaaaa

SEQ ID NO: 1114460 - DNA, 22 bp, Artificial Sequence
  chemically synthesized
gaaactgtattatcactttttc

SEQ ID NO: 1114461 - DNA, 22 bp, Artificial Sequence
  chemically synthesized
attaaaatgaaaaagtgataat

SEQ ID NO: 1114462 - DNA, 22 bp, Artificial Sequence
  chemically synthesized
ttaaaatgaaaaagtgataata

SEQ ID NO: 1114463 - DNA, 22 bp, Artificial Sequence
  chemically synthesized
cccctagaaactgtattatcac

SEQ ID NO: 1114464 - DNA, 22 bp, Artificial Sequence
  chemically synthesized
aaatgaaaaagtgataatacag

SEQ ID NO: 1114465 - DNA, 22 bp, Artificial Sequence
  chemically synthesized
tgtaagttccccctagaaactg

SEQ ID NO: 1114466 - DNA, 22 bp, Artificial Sequence
  chemically synthesized
ttatgtaagttccccctagaaa

SEQ ID NO: 1114467 - DNA, 22 bp, Artificial Sequence
  chemically synthesized
gttgttatgtaagttcccccta

SEQ ID NO: 1114468 - DNA, 22 bp, Artificial Sequence
  chemically synthesized
ctagttgttatgtaagttcccc

SEQ ID NO: 1114469 - DNA, 22 bp, Artificial Sequence
  chemically synthesized
tcctagttgttatgtaagttcc

SEQ ID NO: 1114470 - DNA, 22 bp, Artificial Sequence
  chemically synthesized
ctagggggaacttacataacaa

SEQ ID NO: 1114471 - DNA, 22 bp, Artificial Sequence
  chemically synthesized
tagggggaacttacataacaac

SEQ ID NO: 1114472 - DNA, 22 bp, Artificial Sequence
  chemically synthesized
gggggaacttacataacaacta

SEQ ID NO: 1114473 - DNA, 22 bp, Artificial Sequence
  chemically synthesized
aaaatattctcctagttgttat

SEQ ID NO: 1114474 - DNA, 22 bp, Artificial Sequence
  chemically synthesized
tgtgatctaaaaatattctcct

SEQ ID NO: 1114475 - DNA, 22 bp, Artificial Sequence
  chemically synthesized
acataacaactaggagaatatt

SEQ ID NO: 1114476 - DNA, 22 bp, Artificial Sequence
  chemically synthesized
cataacaactaggagaatattt

SEQ ID NO: 1114477 - DNA, 22 bp, Artificial Sequence
  chemically synthesized
aataaaattatgtgatctaaaa

SEQ ID NO: 1114478 - DNA, 22 bp, Artificial Sequence
  chemically synthesized
ggagaatatttttagatcacat

SEQ ID NO: 1114479 - DNA, 22 bp, Artificial Sequence
  chemically synthesized
atgttaaataaaattatgtgat

SEQ ID NO: 1114480 - DNA, 22 bp, Artificial Sequence
  chemically synthesized
ttagatcacataattttattta

SEQ ID NO: 1114481 - DNA, 22 bp, Artificial Sequence
  chemically synthesized
tagatcacataattttatttaa

SEQ ID NO: 1114482 - DNA, 22 bp, Artificial Sequence
  chemically synthesized
agatcacataattttatttaac

SEQ ID NO: 1114483 - DNA, 22 bp, Artificial Sequence
  chemically synthesized
gatcacataattttatttaaca

SEQ ID NO: 1114484 - DNA, 22 bp, Artificial Sequence
  chemically synthesized
acagcatattcatgttaaataa

SEQ ID NO: 1114485 - DNA, 22 bp, Artificial Sequence
  chemically synthesized
aacagcatattcatgttaaata

SEQ ID NO: 1114486 - DNA, 22 bp, Artificial Sequence
  chemically synthesized
atcaacttaacagcatattcat

SEQ ID NO: 1114487 - DNA, 22 bp, Artificial Sequence
  chemically synthesized
tatttaacatgaatatgctgtt

SEQ ID NO: 1114488 - DNA, 22 bp, Artificial Sequence
  chemically synthesized
actgatcaacttaacagcatat

SEQ ID NO: 1114489 - DNA, 22 bp, Artificial Sequence
  chemically synthesized
atttaacatgaatatgctgtta

SEQ ID NO: 1114490 - DNA, 22 bp, Artificial Sequence
  chemically synthesized
aactgatcaacttaacagcata

SEQ ID NO: 1114491 - DNA, 22 bp, Artificial Sequence
  chemically synthesized
tttaacatgaatatgctgttaa

SEQ ID NO: 1114492 - DNA, 22 bp, Artificial Sequence
  chemically synthesized
taactgatcaacttaacagcat

SEQ ID NO: 1114493 - DNA, 22 bp, Artificial Sequence
  chemically synthesized
aacatgaatatgctgttaagtt

SEQ ID NO: 1114494 - DNA, 22 bp, Artificial Sequence
  chemically synthesized
acatgaatatgctgttaagttg

SEQ ID NO: 1114495 - DNA, 22 bp, Artificial Sequence
  chemically synthesized
gtaattttaactgatcaactta

SEQ ID NO: 1114496 - DNA, 22 bp, Artificial Sequence
  chemically synthesized
ggtaattttaactgatcaactt

SEQ ID NO: 1114497 - DNA, 22 bp, Artificial Sequence
  chemically synthesized
cttggtaattttaactgatcaa

SEQ ID NO: 1114498 - DNA, 22 bp, Artificial Sequence
  chemically synthesized
ttaagttgatcagttaaaatta

SEQ ID NO: 1114499 - DNA, 22 bp, Artificial Sequence
  chemically synthesized
agttgatcagttaaaattacca

SEQ ID NO: 1114500 - DNA, 22 bp, Artificial Sequence
  chemically synthesized
gatgtatgttgcttggtaattt

SEQ ID NO: 1114501 - DNA, 22 bp, Artificial Sequence
  chemically synthesized
agatgtatgttgcttggtaatt

SEQ ID NO: 1114502 - DNA, 22 bp, Artificial Sequence
  chemically synthesized
atcagttaaaattaccaagcaa

SEQ ID NO: 1114503 - DNA, 22 bp, Artificial Sequence
  chemically synthesized
tttagatgtatgttgcttggta

SEQ ID NO: 1114504 - DNA, 22 bp, Artificial Sequence
  chemically synthesized
atttagatgtatgttgcttggt

SEQ ID NO: 1114505 - DNA, 22 bp, Artificial Sequence
  chemically synthesized
tatttagatgtatgttgcttgg

SEQ ID NO: 1114506 - DNA, 22 bp, Artificial Sequence
  chemically synthesized
ttatttagatgtatgttgcttg

SEQ ID NO: 1114507 - DNA, 22 bp, Artificial Sequence
  chemically synthesized
aaattaccaagcaacatacatc

SEQ ID NO: 1114508 - DNA, 22 bp, Artificial Sequence
  chemically synthesized
ccaagcaacatacatctaaata

SEQ ID NO: 1114509 - DNA, 22 bp, Artificial Sequence
  chemically synthesized
aataaaaatctactggtatttt

SEQ ID NO: 1114510 - DNA, 22 bp, Artificial Sequence
  chemically synthesized
agaacaggtaatgaaaatacca

SEQ ID NO: 1114511 - DNA, 22 bp, Artificial Sequence
  chemically synthesized
aagaacaggtaatgaaaatacc

SEQ ID NO: 1114512 - DNA, 22 bp, Artificial Sequence
  chemically synthesized
ctggtattttcattacctgttc

SEQ ID NO: 1114513 - DNA, 22 bp, Artificial Sequence
  chemically synthesized
gtattttcattacctgttctta

SEQ ID NO: 1114514 - DNA, 22 bp, Artificial Sequence
  chemically synthesized
agtgaacaagtttaagaacagg

SEQ ID NO: 1114515 - DNA, 22 bp, Artificial Sequence
  chemically synthesized
gagtgaacaagtttaagaacag

SEQ ID NO: 1114516 - DNA, 22 bp, Artificial Sequence
  chemically synthesized
tcattacctgttcttaaacttg

SEQ ID NO: 1114517 - DNA, 22 bp, Artificial Sequence
  chemically synthesized
cattacctgttcttaaacttgt

SEQ ID NO: 1114518 - DNA, 22 bp, Artificial Sequence
  chemically synthesized
attacctgttcttaaacttgtt

SEQ ID NO: 1114519 - DNA, 22 bp, Artificial Sequence
  chemically synthesized
cctgttcttaaacttgttcact

SEQ ID NO: 1114520 - DNA, 22 bp, Artificial Sequence
  chemically synthesized
ttcttaaacttgttcactcaag

SEQ ID NO: 1114521 - DNA, 22 bp, Artificial Sequence
  chemically synthesized
ttaaacttgttcactcaagtct

SEQ ID NO: 1114522 - DNA, 22 bp, Artificial Sequence
  chemically synthesized
aaacttgttcactcaagtctca

SEQ ID NO: 1114523 - DNA, 22 bp, Artificial Sequence
  chemically synthesized
aacttgttcactcaagtctcac

SEQ ID NO: 1114524 - DNA, 22 bp, Artificial Sequence
  chemically synthesized
gttcactcaagtctcacctgtt

SEQ ID NO: 1114525 - DNA, 22 bp, Artificial Sequence
  chemically synthesized
ttcactcaagtctcacctgtta

SEQ ID NO: 1114526 - DNA, 22 bp, Artificial Sequence
  chemically synthesized
actcaagtctcacctgttatat

SEQ ID NO: 1114527 - DNA, 22 bp, Artificial Sequence
  chemically synthesized
aagtctcacctgttatatttgt

SEQ ID NO: 1114528 - DNA, 22 bp, Artificial Sequence
  chemically synthesized
aaaatgaaaacaaacaaatata

SEQ ID NO: 1114529 - DNA, 22 bp, Artificial Sequence
  chemically synthesized
gttaaaaatgaaaacaaacaaa

SEQ ID NO: 1114530 - DNA, 22 bp, Artificial Sequence
  chemically synthesized
ggttaaaaatgaaaacaaacaa

SEQ ID NO: 1114531 - DNA, 22 bp, Artificial Sequence
  chemically synthesized
acctgttatatttgtttgtttt

SEQ ID NO: 1114532 - DNA, 22 bp, Artificial Sequence
  chemically synthesized
tatttggttaaaaatgaaaaca

SEQ ID NO: 1114533 - DNA, 22 bp, Artificial Sequence
  chemically synthesized
ttatatttgtttgttttcattt

SEQ ID NO: 1114534 - DNA, 22 bp, Artificial Sequence
  chemically synthesized
tatttgtttgttttcattttta

SEQ ID NO: 1114535 - DNA, 22 bp, Artificial Sequence
  chemically synthesized
actgtatttggttaaaaatgaa

SEQ ID NO: 1114536 - DNA, 22 bp, Artificial Sequence
  chemically synthesized
gtttgttttcatttttaaccaa

SEQ ID NO: 1114537 - DNA, 22 bp, Artificial Sequence
  chemically synthesized
tttgttttcatttttaaccaaa

SEQ ID NO: 1114538 - DNA, 22 bp, Artificial Sequence
  chemically synthesized
gttttcatttttaaccaaatac

SEQ ID NO: 1114539 - DNA, 22 bp, Artificial Sequence
  chemically synthesized
ttttcatttttaaccaaataca

SEQ ID NO: 1114540 - DNA, 22 bp, Artificial Sequence
  chemically synthesized
tcatttttaaccaaatacagtc

SEQ ID NO: 1114541 - DNA, 22 bp, Artificial Sequence
  chemically synthesized
catttttaaccaaatacagtca

SEQ ID NO: 1114542 - DNA, 22 bp, Artificial Sequence
  chemically synthesized
atttttaaccaaatacagtcag

SEQ ID NO: 1114543 - DNA, 22 bp, Artificial Sequence
  chemically synthesized
atgagtcccatgactgactgta

SEQ ID NO: 1114544 - DNA, 22 bp, Artificial Sequence
  chemically synthesized
taatgagtcccatgactgactg

SEQ ID NO: 1114545 - DNA, 22 bp, Artificial Sequence
  chemically synthesized
ttaaccaaatacagtcagtcat

SEQ ID NO: 1114546 - DNA, 22 bp, Artificial Sequence
  chemically synthesized
ctaatgagtcccatgactgact

SEQ ID NO: 1114547 - DNA, 22 bp, Artificial Sequence
  chemically synthesized
taaccaaatacagtcagtcatg

SEQ ID NO: 1114548 - DNA, 22 bp, Artificial Sequence
  chemically synthesized
aaccaaatacagtcagtcatgg

SEQ ID NO: 1114549 - DNA, 22 bp, Artificial Sequence
  chemically synthesized
ttctaatgagtcccatgactga

SEQ ID NO: 1114550 - DNA, 22 bp, Artificial Sequence
  chemically synthesized
accaaatacagtcagtcatggg

SEQ ID NO: 1114551 - DNA, 22 bp, Artificial Sequence
  chemically synthesized
cttctaatgagtcccatgactg

SEQ ID NO: 1114552 - DNA, 22 bp, Artificial Sequence
  chemically synthesized
ttcttctaatgagtcccatgac

SEQ ID NO: 1114553 - DNA, 22 bp, Artificial Sequence
  chemically synthesized
cttcttctaatgagtcccatga

SEQ ID NO: 1114554 - DNA, 22 bp, Artificial Sequence
  chemically synthesized
tcttcttctaatgagtcccatg

SEQ ID NO: 1114555 - DNA, 22 bp, Artificial Sequence
  chemically synthesized
attttcttcttctaatgagtcc

SEQ ID NO: 1114556 - DNA, 22 bp, Artificial Sequence
  chemically synthesized
gaaaatcaattcattttcttct

SEQ ID NO: 1114557 - DNA, 22 bp, Artificial Sequence
  chemically synthesized
ctagaaaatcaattcattttct

SEQ ID NO: 1114558 - DNA, 22 bp, Artificial Sequence
  chemically synthesized
cctagaaaatcaattcattttc

SEQ ID NO: 1114559 - DNA, 22 bp, Artificial Sequence
  chemically synthesized
attagaagaagaaaatgaattg

SEQ ID NO: 1114560 - DNA, 22 bp, Artificial Sequence
  chemically synthesized
gaagaagaaaatgaattgattt

SEQ ID NO: 1114561 - DNA, 22 bp, Artificial Sequence
  chemically synthesized
agtggtcttcctagaaaatcaa

SEQ ID NO: 1114562 - DNA, 22 bp, Artificial Sequence
  chemically synthesized
aaaagttcagtggtcttcctag

SEQ ID NO: 1114563 - DNA, 22 bp, Artificial Sequence
  chemically synthesized
gcattcaaaagttcagtggtct

SEQ ID NO: 1114564 - DNA, 22 bp, Artificial Sequence
  chemically synthesized
attttctaggaagaccactgaa

SEQ ID NO: 1114565 - DNA, 22 bp, Artificial Sequence
  chemically synthesized
ggcattcaaaagttcagtggtc

SEQ ID NO: 1114566 - DNA, 22 bp, Artificial Sequence
  chemically synthesized
tctaggaagaccactgaacttt

SEQ ID NO: 1114567 - DNA, 22 bp, Artificial Sequence
  chemically synthesized
ctaggaagaccactgaactttt

SEQ ID NO: 1114568 - DNA, 22 bp, Artificial Sequence
  chemically synthesized
taggaagaccactgaacttttg

SEQ ID NO: 1114569 - DNA, 22 bp, Artificial Sequence
  chemically synthesized
caaatttggcattcaaaagttc

SEQ ID NO: 1114570 - DNA, 22 bp, Artificial Sequence
  chemically synthesized
ggaagaccactgaacttttgaa

SEQ ID NO: 1114571 - DNA, 22 bp, Artificial Sequence
  chemically synthesized
attgcaaatttggcattcaaaa

SEQ ID NO: 1114572 - DNA, 22 bp, Artificial Sequence
  chemically synthesized
aattgcaaatttggcattcaaa

SEQ ID NO: 1114573 - DNA, 22 bp, Artificial Sequence
  chemically synthesized
ccttaattgcaaatttggcatt

SEQ ID NO: 1114574 - DNA, 22 bp, Artificial Sequence
  chemically synthesized
gccttaattgcaaatttggcat

SEQ ID NO: 1114575 - DNA, 22 bp, Artificial Sequence
  chemically synthesized
tgccttaattgcaaatttggca

SEQ ID NO: 1114576 - DNA, 22 bp, Artificial Sequence
  chemically synthesized
ttgccttaattgcaaatttggc

SEQ ID NO: 1114577 - DNA, 22 bp, Artificial Sequence
  chemically synthesized
aacttttgaatgccaaatttgc

SEQ ID NO: 1114578 - DNA, 22 bp, Artificial Sequence
  chemically synthesized
tttgccttaattgcaaatttgg

SEQ ID NO: 1114579 - DNA, 22 bp, Artificial Sequence
  chemically synthesized
ttttttgccttaattgcaaatt

SEQ ID NO: 1114580 - DNA, 22 bp, Artificial Sequence
  chemically synthesized
ttgaatgccaaatttgcaatta

SEQ ID NO: 1114581 - DNA, 22 bp, Artificial Sequence
  chemically synthesized
tgaatgccaaatttgcaattaa

SEQ ID NO: 1114582 - DNA, 22 bp, Artificial Sequence
  chemically synthesized
gaatgccaaatttgcaattaag

SEQ ID NO: 1114583 - DNA, 22 bp, Artificial Sequence
  chemically synthesized
aatgccaaatttgcaattaagg

SEQ ID NO: 1114584 - DNA, 22 bp, Artificial Sequence
  chemically synthesized
tgtataagttattttttgcctt

SEQ ID NO: 1114585 - DNA, 22 bp, Artificial Sequence
  chemically synthesized
tgtgtataagttattttttgcc

SEQ ID NO: 1114586 - DNA, 22 bp, Artificial Sequence
  chemically synthesized
gcaattaaggcaaaaaataact

SEQ ID NO: 1114587 - DNA, 22 bp, Artificial Sequence
  chemically synthesized
caattaaggcaaaaaataactt

SEQ ID NO: 1114588 - DNA, 22 bp, Artificial Sequence
  chemically synthesized
aggcaaaaaataacttatacac

SEQ ID NO: 1114589 - DNA, 22 bp, Artificial Sequence
  chemically synthesized
gggcataaattctgtgtataag

SEQ ID NO: 1114590 - DNA, 22 bp, Artificial Sequence
  chemically synthesized
ggggcataaattctgtgtataa

SEQ ID NO: 1114591 - DNA, 22 bp, Artificial Sequence
  chemically synthesized
tggggcataaattctgtgtata

SEQ ID NO: 1114592 - DNA, 22 bp, Artificial Sequence
  chemically synthesized
cattttggggcataaattctgt

SEQ ID NO: 1114593 - DNA, 22 bp, Artificial Sequence
  chemically synthesized
cctgcattttggggcataaatt

SEQ ID NO: 1114594 - DNA, 22 bp, Artificial Sequence
  chemically synthesized
atacacagaatttatgccccaa

SEQ ID NO: 1114595 - DNA, 22 bp, Artificial Sequence
  chemically synthesized
tacacagaatttatgccccaaa

SEQ ID NO: 1114596 - DNA, 22 bp, Artificial Sequence
  chemically synthesized
agaatctgcctgcattttgggg

SEQ ID NO: 1114597 - DNA, 22 bp, Artificial Sequence
  chemically synthesized
cagaatctgcctgcattttggg

SEQ ID NO: 1114598 - DNA, 22 bp, Artificial Sequence
  chemically synthesized
tcagaatctgcctgcattttgg

SEQ ID NO: 1114599 - DNA, 22 bp, Artificial Sequence
  chemically synthesized
ttcagaatctgcctgcattttg

SEQ ID NO: 1114600 - DNA, 22 bp, Artificial Sequence
  chemically synthesized
tttcagaatctgcctgcatttt

SEQ ID NO: 1114601 - DNA, 22 bp, Artificial Sequence
  chemically synthesized
ttttcagaatctgcctgcattt

SEQ ID NO: 1114602 - DNA, 22 bp, Artificial Sequence
  chemically synthesized
atgccccaaaatgcaggcagat

SEQ ID NO: 1114603 - DNA, 22 bp, Artificial Sequence
  chemically synthesized
tgccccaaaatgcaggcagatt

SEQ ID NO: 1114604 - DNA, 22 bp, Artificial Sequence
  chemically synthesized
tgcatgtcagcttttttcagaa

SEQ ID NO: 1114605 - DNA, 22 bp, Artificial Sequence
  chemically synthesized
ttgtgcatgtcagcttttttca

SEQ ID NO: 1114606 - DNA, 22 bp, Artificial Sequence
  chemically synthesized
gttgtgcatgtcagcttttttc

SEQ ID NO: 1114607 - DNA, 22 bp, Artificial Sequence
  chemically synthesized
tgttgtgcatgtcagctttttt

SEQ ID NO: 1114608 - DNA, 22 bp, Artificial Sequence
  chemically synthesized
ttgttgtgcatgtcagcttttt

SEQ ID NO: 1114609 - DNA, 22 bp, Artificial Sequence
  chemically synthesized
tgaaaaaagctgacatgcacaa

SEQ ID NO: 1114610 - DNA, 22 bp, Artificial Sequence
  chemically synthesized
aaaaaagctgacatgcacaaca

SEQ ID NO: 1114611 - DNA, 22 bp, Artificial Sequence
  chemically synthesized
acatgcacaacaaaaacatttg

SEQ ID NO: 1114612 - DNA, 22 bp, Artificial Sequence
  chemically synthesized
caagaacatcataaataaatac

SEQ ID NO: 1114613 - DNA, 22 bp, Artificial Sequence
  chemically synthesized
acaagaacatcataaataaata

SEQ ID NO: 1114614 - DNA, 22 bp, Artificial Sequence
  chemically synthesized
gttgtatttatttatgatgttc

SEQ ID NO: 1114615 - DNA, 22 bp, Artificial Sequence
  chemically synthesized
ttgtatttatttatgatgttct

SEQ ID NO: 1114616 - DNA, 22 bp, Artificial Sequence
  chemically synthesized
tatttatttatgatgttcttgt

SEQ ID NO: 1114617 - DNA, 22 bp, Artificial Sequence
  chemically synthesized
tagaagacgtttacaagaacat

SEQ ID NO: 1114618 - DNA, 22 bp, Artificial Sequence
  chemically synthesized
gtagaagacgtttacaagaaca

SEQ ID NO: 1114619 - DNA, 22 bp, Artificial Sequence
  chemically synthesized
tgtagaagacgtttacaagaac

SEQ ID NO: 1114620 - DNA, 22 bp, Artificial Sequence
  chemically synthesized
atttatgatgttcttgtaaacg

SEQ ID NO: 1114621 - DNA, 22 bp, Artificial Sequence
  chemically synthesized
tttatgatgttcttgtaaacgt

SEQ ID NO: 1114622 - DNA, 22 bp, Artificial Sequence
  chemically synthesized
attttgtagaagacgtttacaa

SEQ ID NO: 1114623 - DNA, 22 bp, Artificial Sequence
  chemically synthesized
cattttgtagaagacgtttaca

SEQ ID NO: 1114624 - DNA, 22 bp, Artificial Sequence
  chemically synthesized
tcattttgtagaagacgtttac

SEQ ID NO: 1114625 - DNA, 22 bp, Artificial Sequence
  chemically synthesized
atgatgttcttgtaaacgtctt

SEQ ID NO: 1114626 - DNA, 22 bp, Artificial Sequence
  chemically synthesized
ttcattttgtagaagacgttta

SEQ ID NO: 1114627 - DNA, 22 bp, Artificial Sequence
  chemically synthesized
tgatgttcttgtaaacgtcttc

SEQ ID NO: 1114628 - DNA, 22 bp, Artificial Sequence
  chemically synthesized
tttttcattttgtagaagacgt

SEQ ID NO: 1114629 - DNA, 22 bp, Artificial Sequence
  chemically synthesized
ttgtaaacgtcttctacaaaat

SEQ ID NO: 1114630 - DNA, 22 bp, Artificial Sequence
  chemically synthesized
gtaaacgtcttctacaaaatga

SEQ ID NO: 1114631 - DNA, 22 bp, Artificial Sequence
  chemically synthesized
taaacgtcttctacaaaatgaa

SEQ ID NO: 1114632 - DNA, 22 bp, Artificial Sequence
  chemically synthesized
caaataagattatttttcattt

SEQ ID NO: 1114633 - DNA, 22 bp, Artificial Sequence
  chemically synthesized
ccaaataagattatttttcatt

SEQ ID NO: 1114634 - DNA, 22 bp, Artificial Sequence
  chemically synthesized
tttccaaataagattatttttc

SEQ ID NO: 1114635 - DNA, 22 bp, Artificial Sequence
  chemically synthesized
ctacaaaatgaaaaataatctt

SEQ ID NO: 1114636 - DNA, 22 bp, Artificial Sequence
  chemically synthesized
tacaaaatgaaaaataatctta

SEQ ID NO: 1114637 - DNA, 22 bp, Artificial Sequence
  chemically synthesized
caaaatgaaaaataatcttatt

SEQ ID NO: 1114638 - DNA, 22 bp, Artificial Sequence
  chemically synthesized
cgaaaatcagggataatgctat

SEQ ID NO: 1114639 - DNA, 22 bp, Artificial Sequence
  chemically synthesized
acgaaaatcagggataatgcta

SEQ ID NO: 1114640 - DNA, 22 bp, Artificial Sequence
  chemically synthesized
tacgaaaatcagggataatgct

SEQ ID NO: 1114641 - DNA, 22 bp, Artificial Sequence
  chemically synthesized
atttggaaatagcattatccct

SEQ ID NO: 1114642 - DNA, 22 bp, Artificial Sequence
  chemically synthesized
tttggaaatagcattatccctg

SEQ ID NO: 1114643 - DNA, 22 bp, Artificial Sequence
  chemically synthesized
ggaaatagcattatccctgatt

SEQ ID NO: 1114644 - DNA, 22 bp, Artificial Sequence
  chemically synthesized
gaaatagcattatccctgattt

SEQ ID NO: 1114645 - DNA, 22 bp, Artificial Sequence
  chemically synthesized
cagataaaattttacgaaaatc

SEQ ID NO: 1114646 - DNA, 22 bp, Artificial Sequence
  chemically synthesized
ccagataaaattttacgaaaat

SEQ ID NO: 1114647 - DNA, 22 bp, Artificial Sequence
  chemically synthesized
tatttccagataaaattttacg

SEQ ID NO: 1114648 - DNA, 22 bp, Artificial Sequence
  chemically synthesized
tccctgattttcgtaaaatttt

SEQ ID NO: 1114649 - DNA, 22 bp, Artificial Sequence
  chemically synthesized
ctatatttccagataaaatttt

SEQ ID NO: 1114650 - DNA, 22 bp, Artificial Sequence
  chemically synthesized
attttcgtaaaattttatctgg

SEQ ID NO: 1114651 - DNA, 22 bp, Artificial Sequence
  chemically synthesized
tactactatatttccagataaa

SEQ ID NO: 1114652 - DNA, 22 bp, Artificial Sequence
  chemically synthesized
tcgtaaaattttatctggaaat

SEQ ID NO: 1114653 - DNA, 22 bp, Artificial Sequence
  chemically synthesized
ctatactactatatttccagat

SEQ ID NO: 1114654 - DNA, 22 bp, Artificial Sequence
  chemically synthesized
cgtaaaattttatctggaaata

SEQ ID NO: 1114655 - DNA, 22 bp, Artificial Sequence
  chemically synthesized
gtaaaattttatctggaaatat

SEQ ID NO: 1114656 - DNA, 22 bp, Artificial Sequence
  chemically synthesized
tcattgctatactactatattt

SEQ ID NO: 1114657 - DNA, 22 bp, Artificial Sequence
  chemically synthesized
tatctggaaatatagtagtata

SEQ ID NO: 1114658 - DNA, 22 bp, Artificial Sequence
  chemically synthesized
atctggaaatatagtagtatag

SEQ ID NO: 1114659 - DNA, 22 bp, Artificial Sequence
  chemically synthesized
aaattatcattgctatactact

SEQ ID NO: 1114660 - DNA, 22 bp, Artificial Sequence
  chemically synthesized
tctggaaatatagtagtatagc

SEQ ID NO: 1114661 - DNA, 22 bp, Artificial Sequence
  chemically synthesized
caaattatcattgctatactac

SEQ ID NO: 1114662 - DNA, 22 bp, Artificial Sequence
  chemically synthesized
tcaaattatcattgctatacta

SEQ ID NO: 1114663 - DNA, 22 bp, Artificial Sequence
  chemically synthesized
tttcaaattatcattgctatac

SEQ ID NO: 1114664 - DNA, 22 bp, Artificial Sequence
  chemically synthesized
gaaatatagtagtatagcaatg

SEQ ID NO: 1114665 - DNA, 22 bp, Artificial Sequence
  chemically synthesized
ctttcaaattatcattgctata

SEQ ID NO: 1114666 - DNA, 22 bp, Artificial Sequence
  chemically synthesized
acatgatatgtaaacaaccttc

SEQ ID NO: 1114667 - DNA, 22 bp, Artificial Sequence
  chemically synthesized
gaaagaaggttgtttacatatc

SEQ ID NO: 1114668 - DNA, 22 bp, Artificial Sequence
  chemically synthesized
aaagaaggttgtttacatatca

SEQ ID NO: 1114669 - DNA, 22 bp, Artificial Sequence
  chemically synthesized
tttacatatcatgtcaatgaca

SEQ ID NO: 1114670 - DNA, 22 bp, Artificial Sequence
  chemically synthesized
tgtgtaccaaatgtgtcattga

SEQ ID NO: 1114671 - DNA, 22 bp, Artificial Sequence
  chemically synthesized
acatatcatgtcaatgacacat

SEQ ID NO: 1114672 - DNA, 22 bp, Artificial Sequence
  chemically synthesized
catatcatgtcaatgacacatt

SEQ ID NO: 1114673 - DNA, 22 bp, Artificial Sequence
  chemically synthesized
aaaagttatgtgtaccaaatgt

SEQ ID NO: 1114674 - DNA, 22 bp, Artificial Sequence
  chemically synthesized
agtgcctcaaaagttatgtgta

SEQ ID NO: 1114675 - DNA, 22 bp, Artificial Sequence
  chemically synthesized
atactcagtgcctcaaaagtta

SEQ ID NO: 1114676 - DNA, 22 bp, Artificial Sequence
  chemically synthesized
taatactcagtgcctcaaaagt

SEQ ID NO: 1114677 - DNA, 22 bp, Artificial Sequence
  chemically synthesized
ctaatactcagtgcctcaaaag

SEQ ID NO: 1114678 - DNA, 22 bp, Artificial Sequence
  chemically synthesized
ggtacacataacttttgaggca

SEQ ID NO: 1114679 - DNA, 22 bp, Artificial Sequence
  chemically synthesized
tctaatactcagtgcctcaaaa

SEQ ID NO: 1114680 - DNA, 22 bp, Artificial Sequence
  chemically synthesized
gtacacataacttttgaggcac

SEQ ID NO: 1114681 - DNA, 22 bp, Artificial Sequence
  chemically synthesized
ttctaatactcagtgcctcaaa

SEQ ID NO: 1114682 - DNA, 22 bp, Artificial Sequence
  chemically synthesized
atcttttctaatactcagtgcc

SEQ ID NO: 1114683 - DNA, 22 bp, Artificial Sequence
  chemically synthesized
aaattaatcttttctaatactc

SEQ ID NO: 1114684 - DNA, 22 bp, Artificial Sequence
  chemically synthesized
ttgaggcactgagtattagaaa

SEQ ID NO: 1114685 - DNA, 22 bp, Artificial Sequence
  chemically synthesized
tgaggcactgagtattagaaaa

SEQ ID NO: 1114686 - DNA, 22 bp, Artificial Sequence
  chemically synthesized
gaggcactgagtattagaaaag

SEQ ID NO: 1114687 - DNA, 22 bp, Artificial Sequence
  chemically synthesized
aggcactgagtattagaaaaga

SEQ ID NO: 1114688 - DNA, 22 bp, Artificial Sequence
  chemically synthesized
aagaataaattaaaattaatct

SEQ ID NO: 1114689 - DNA, 22 bp, Artificial Sequence
  chemically synthesized
agtattagaaaagattaatttt

SEQ ID NO: 1114690 - DNA, 22 bp, Artificial Sequence
  chemically synthesized
caagaataaattaaaattaatc

SEQ ID NO: 1114691 - DNA, 22 bp, Artificial Sequence
  chemically synthesized
tcaagaataaattaaaattaat

SEQ ID NO: 1114692 - DNA, 22 bp, Artificial Sequence
  chemically synthesized
ttcaagaataaattaaaattaa

SEQ ID NO: 1114693 - DNA, 22 bp, Artificial Sequence
  chemically synthesized
tttcaagaataaattaaaatta

SEQ ID NO: 1114694 - DNA, 22 bp, Artificial Sequence
  chemically synthesized
tttttcaagaataaattaaaat

SEQ ID NO: 1114695 - DNA, 22 bp, Artificial Sequence
  chemically synthesized
ctttttcaagaataaattaaaa

SEQ ID NO: 1114696 - DNA, 22 bp, Artificial Sequence
  chemically synthesized
gaaaagattaattttaatttat

SEQ ID NO: 1114697 - DNA, 22 bp, Artificial Sequence
  chemically synthesized
tctttttcaagaataaattaaa

SEQ ID NO: 1114698 - DNA, 22 bp, Artificial Sequence
  chemically synthesized
tctttctttttcaagaataaat

SEQ ID NO: 1114699 - DNA, 22 bp, Artificial Sequence
  chemically synthesized
gtctttctttttcaagaataaa

SEQ ID NO: 1114700 - DNA, 22 bp, Artificial Sequence
  chemically synthesized
tgtctttctttttcaagaataa

SEQ ID NO: 1114701 - DNA, 22 bp, Artificial Sequence
  chemically synthesized
ttgtctttctttttcaagaata

SEQ ID NO: 1114702 - DNA, 22 bp, Artificial Sequence
  chemically synthesized
attttaatttattcttgaaaaa

SEQ ID NO: 1114703 - DNA, 22 bp, Artificial Sequence
  chemically synthesized
taatttattcttgaaaaagaaa

SEQ ID NO: 1114704 - DNA, 22 bp, Artificial Sequence
  chemically synthesized
aatttattcttgaaaaagaaag

SEQ ID NO: 1114705 - DNA, 22 bp, Artificial Sequence
  chemically synthesized
atttattcttgaaaaagaaaga

SEQ ID NO: 1114706 - DNA, 22 bp, Artificial Sequence
  chemically synthesized
gccaagtttttgtctttctttt

SEQ ID NO: 1114707 - DNA, 22 bp, Artificial Sequence
  chemically synthesized
attcttgaaaaagaaagacaaa

SEQ ID NO: 1114708 - DNA, 22 bp, Artificial Sequence
  chemically synthesized
ttcttgaaaaagaaagacaaaa

SEQ ID NO: 1114709 - DNA, 22 bp, Artificial Sequence
  chemically synthesized
ttgaaaaagaaagacaaaaact

SEQ ID NO: 1114710 - DNA, 22 bp, Artificial Sequence
  chemically synthesized
gaaaaagaaagacaaaaacttg

SEQ ID NO: 1114711 - DNA, 22 bp, Artificial Sequence
  chemically synthesized
aaaaagaaagacaaaaacttgg

SEQ ID NO: 1114712 - DNA, 22 bp, Artificial Sequence
  chemically synthesized
gagtgagataaaagcacaaagc

SEQ ID NO: 1114713 - DNA, 22 bp, Artificial Sequence
  chemically synthesized
agagtgagataaaagcacaaag

SEQ ID NO: 1114714 - DNA, 22 bp, Artificial Sequence
  chemically synthesized
tagagtgagataaaagcacaaa

SEQ ID NO: 1114715 - DNA, 22 bp, Artificial Sequence
  chemically synthesized
ttagagtgagataaaagcacaa

SEQ ID NO: 1114716 - DNA, 22 bp, Artificial Sequence
  chemically synthesized
tttagagtgagataaaagcaca

SEQ ID NO: 1114717 - DNA, 22 bp, Artificial Sequence
  chemically synthesized
ttttagagtgagataaaagcac

SEQ ID NO: 1114718 - DNA, 22 bp, Artificial Sequence
  chemically synthesized
ggctagctttgtgcttttatct

SEQ ID NO: 1114719 - DNA, 22 bp, Artificial Sequence
  chemically synthesized
gctagctttgtgcttttatctc

SEQ ID NO: 1114720 - DNA, 22 bp, Artificial Sequence
  chemically synthesized
gctttgtgcttttatctcactc

SEQ ID NO: 1114721 - DNA, 22 bp, Artificial Sequence
  chemically synthesized
agtaacttttttagagtgagat

SEQ ID NO: 1114722 - DNA, 22 bp, Artificial Sequence
  chemically synthesized
aagtaacttttttagagtgaga

SEQ ID NO: 1114723 - DNA, 22 bp, Artificial Sequence
  chemically synthesized
taagtaacttttttagagtgag

SEQ ID NO: 1114724 - DNA, 22 bp, Artificial Sequence
  chemically synthesized
tgtgcttttatctcactctaaa

SEQ ID NO: 1114725 - DNA, 22 bp, Artificial Sequence
  chemically synthesized
ttaagtaacttttttagagtga

SEQ ID NO: 1114726 - DNA, 22 bp, Artificial Sequence
  chemically synthesized
gtgcttttatctcactctaaaa

SEQ ID NO: 1114727 - DNA, 22 bp, Artificial Sequence
  chemically synthesized
tgcttttatctcactctaaaaa

SEQ ID NO: 1114728 - DNA, 22 bp, Artificial Sequence
  chemically synthesized
cttttaagtaacttttttagag

SEQ ID NO: 1114729 - DNA, 22 bp, Artificial Sequence
  chemically synthesized
acttttaagtaacttttttaga

SEQ ID NO: 1114730 - DNA, 22 bp, Artificial Sequence
  chemically synthesized
tacttttaagtaacttttttag

SEQ ID NO: 1114731 - DNA, 22 bp, Artificial Sequence
  chemically synthesized
ttatctcactctaaaaaagtta

SEQ ID NO: 1114732 - DNA, 22 bp, Artificial Sequence
  chemically synthesized
tatctcactctaaaaaagttac

SEQ ID NO: 1114733 - DNA, 22 bp, Artificial Sequence
  chemically synthesized
atctcactctaaaaaagttact

SEQ ID NO: 1114734 - DNA, 22 bp, Artificial Sequence
  chemically synthesized
tctcactctaaaaaagttactt

SEQ ID NO: 1114735 - DNA, 22 bp, Artificial Sequence
  chemically synthesized
actctaaaaaagttacttaaaa

SEQ ID NO: 1114736 - DNA, 22 bp, Artificial Sequence
  chemically synthesized
gggataacctttacttttaagt

SEQ ID NO: 1114737 - DNA, 22 bp, Artificial Sequence
  chemically synthesized
cgggataacctttacttttaag

SEQ ID NO: 1114738 - DNA, 22 bp, Artificial Sequence
  chemically synthesized
taaaaaagttacttaaaagtaa

SEQ ID NO: 1114739 - DNA, 22 bp, Artificial Sequence
  chemically synthesized
ttcgggataacctttactttta

SEQ ID NO: 1114740 - DNA, 22 bp, Artificial Sequence
  chemically synthesized
aaaaagttacttaaaagtaaag

SEQ ID NO: 1114741 - DNA, 22 bp, Artificial Sequence
  chemically synthesized
cttaaaagtaaaggttatcccg

SEQ ID NO: 1114742 - DNA, 22 bp, Artificial Sequence
  chemically synthesized
aaaagtaaaggttatcccgaag

SEQ ID NO: 1114743 - DNA, 22 bp, Artificial Sequence
  chemically synthesized
aaaaagaagtctcttcgggata

SEQ ID NO: 1114744 - DNA, 22 bp, Artificial Sequence
  chemically synthesized
aaagtaaaggttatcccgaaga

SEQ ID NO: 1114745 - DNA, 22 bp, Artificial Sequence
  chemically synthesized
aaaaaagaagtctcttcgggat

SEQ ID NO: 1114746 - DNA, 22 bp, Artificial Sequence
  chemically synthesized
atttaaaaaagaagtctcttcg

SEQ ID NO: 1114747 - DNA, 22 bp, Artificial Sequence
  chemically synthesized
tcatttaaaaaagaagtctctt

SEQ ID NO: 1114748 - DNA, 22 bp, Artificial Sequence
  chemically synthesized
ctctcatttaaaaaagaagtct

SEQ ID NO: 1114749 - DNA, 22 bp, Artificial Sequence
  chemically synthesized
cctctcatttaaaaaagaagtc

SEQ ID NO: 1114750 - DNA, 22 bp, Artificial Sequence
  chemically synthesized
tcccgaagagacttctttttta

SEQ ID NO: 1114751 - DNA, 22 bp, Artificial Sequence
  chemically synthesized
tcacttcctctcatttaaaaaa

SEQ ID NO: 1114752 - DNA, 22 bp, Artificial Sequence
  chemically synthesized
atcacttcctctcatttaaaaa

SEQ ID NO: 1114753 - DNA, 22 bp, Artificial Sequence
  chemically synthesized
tatcacttcctctcatttaaaa

SEQ ID NO: 1114754 - DNA, 22 bp, Artificial Sequence
  chemically synthesized
ttatcacttcctctcatttaaa

SEQ ID NO: 1114755 - DNA, 22 bp, Artificial Sequence
  chemically synthesized
tttatcacttcctctcatttaa

SEQ ID NO: 1114756 - DNA, 22 bp, Artificial Sequence
  chemically synthesized
ctttttatcacttcctctcatt

SEQ ID NO: 1114757 - DNA, 22 bp, Artificial Sequence
  chemically synthesized
cttttttaaatgagaggaagtg

SEQ ID NO: 1114758 - DNA, 22 bp, Artificial Sequence
  chemically synthesized
ttttttaaatgagaggaagtga

SEQ ID NO: 1114759 - DNA, 22 bp, Artificial Sequence
  chemically synthesized
tgttactttttatcacttcctc

SEQ ID NO: 1114760 - DNA, 22 bp, Artificial Sequence
  chemically synthesized
ttttaaatgagaggaagtgata

SEQ ID NO: 1114761 - DNA, 22 bp, Artificial Sequence
  chemically synthesized
tgtgttactttttatcacttcc

SEQ ID NO: 1114762 - DNA, 22 bp, Artificial Sequence
  chemically synthesized
tttaaatgagaggaagtgataa

SEQ ID NO: 1114763 - DNA, 22 bp, Artificial Sequence
  chemically synthesized
ctgtgttactttttatcacttc

SEQ ID NO: 1114764 - DNA, 22 bp, Artificial Sequence
  chemically synthesized
ttaaatgagaggaagtgataaa

SEQ ID NO: 1114765 - DNA, 22 bp, Artificial Sequence
  chemically synthesized
tctgtgttactttttatcactt

SEQ ID NO: 1114766 - DNA, 22 bp, Artificial Sequence
  chemically synthesized
taaatgagaggaagtgataaaa

SEQ ID NO: 1114767 - DNA, 22 bp, Artificial Sequence
  chemically synthesized
aaatgagaggaagtgataaaaa

SEQ ID NO: 1114768 - DNA, 22 bp, Artificial Sequence
  chemically synthesized
aatgagaggaagtgataaaaag

SEQ ID NO: 1114769 - DNA, 22 bp, Artificial Sequence
  chemically synthesized
taataatatatatgacattttc

SEQ ID NO: 1114770 - DNA, 22 bp, Artificial Sequence
  chemically synthesized
gtaataatatatatgacatttt

SEQ ID NO: 1114771 - DNA, 22 bp, Artificial Sequence
  chemically synthesized
tgtaataatatatatgacattt

SEQ ID NO: 1114772 - DNA, 22 bp, Artificial Sequence
  chemically synthesized
ttttgtaataatatatatgaca

SEQ ID NO: 1114773 - DNA, 22 bp, Artificial Sequence
  chemically synthesized
ctgttttgtaataatatatatg

SEQ ID NO: 1114774 - DNA, 22 bp, Artificial Sequence
  chemically synthesized
ccgtcattcctgttttgtaata

SEQ ID NO: 1114775 - DNA, 22 bp, Artificial Sequence
  chemically synthesized
accgtcattcctgttttgtaat

SEQ ID NO: 1114776 - DNA, 22 bp, Artificial Sequence
  chemically synthesized
taccgtcattcctgttttgtaa

SEQ ID NO: 1114777 - DNA, 22 bp, Artificial Sequence
  chemically synthesized
ttacaaaacaggaatgacggta

SEQ ID NO: 1114778 - DNA, 22 bp, Artificial Sequence
  chemically synthesized
tatggaatgttttaccgtcatt

SEQ ID NO: 1114779 - DNA, 22 bp, Artificial Sequence
  chemically synthesized
caaaacaggaatgacggtaaaa

SEQ ID NO: 1114780 - DNA, 22 bp, Artificial Sequence
  chemically synthesized
aaattatatggaatgttttacc

SEQ ID NO: 1114781 - DNA, 22 bp, Artificial Sequence
  chemically synthesized
caaacactaaaattatatggaa

SEQ ID NO: 1114782 - DNA, 22 bp, Artificial Sequence
  chemically synthesized
ccaaacactaaaattatatgga

SEQ ID NO: 1114783 - DNA, 22 bp, Artificial Sequence
  chemically synthesized
tccaaacactaaaattatatgg

SEQ ID NO: 1114784 - DNA, 22 bp, Artificial Sequence
  chemically synthesized
ttccaaacactaaaattatatg

SEQ ID NO: 1114785 - DNA, 22 bp, Artificial Sequence
  chemically synthesized
caatatgtttttccaaacacta

SEQ ID NO: 1114786 - DNA, 22 bp, Artificial Sequence
  chemically synthesized
gcaatatgtttttccaaacact

SEQ ID NO: 1114787 - DNA, 22 bp, Artificial Sequence
  chemically synthesized
catataattttagtgtttggaa

SEQ ID NO: 1114788 - DNA, 22 bp, Artificial Sequence
  chemically synthesized
tgcaatatgtttttccaaacac

SEQ ID NO: 1114789 - DNA, 22 bp, Artificial Sequence
  chemically synthesized
ttgcaatatgtttttccaaaca

SEQ ID NO: 1114790 - DNA, 22 bp, Artificial Sequence
  chemically synthesized
aatcatttttgcaatatgtttt

SEQ ID NO: 1114791 - DNA, 22 bp, Artificial Sequence
  chemically synthesized
tagtgtttggaaaaacatattg

SEQ ID NO: 1114792 - DNA, 22 bp, Artificial Sequence
  chemically synthesized
aaatcatttttgcaatatgttt

SEQ ID NO: 1114793 - DNA, 22 bp, Artificial Sequence
  chemically synthesized
agtgtttggaaaaacatattgc

SEQ ID NO: 1114794 - DNA, 22 bp, Artificial Sequence
  chemically synthesized
taaatcatttttgcaatatgtt

SEQ ID NO: 1114795 - DNA, 22 bp, Artificial Sequence
  chemically synthesized
gtgtttggaaaaacatattgca

SEQ ID NO: 1114796 - DNA, 22 bp, Artificial Sequence
  chemically synthesized
attttaaatcatttttgcaata

SEQ ID NO: 1114797 - DNA, 22 bp, Artificial Sequence
  chemically synthesized
ggaaaaacatattgcaaaaatg

SEQ ID NO: 1114798 - DNA, 22 bp, Artificial Sequence
  chemically synthesized
gaaaaacatattgcaaaaatga

SEQ ID NO: 1114799 - DNA, 22 bp, Artificial Sequence
  chemically synthesized
atcatcatctgattttaaatca

SEQ ID NO: 1114800 - DNA, 22 bp, Artificial Sequence
  chemically synthesized
caaaaatgatttaaaatcagat

SEQ ID NO: 1114801 - DNA, 22 bp, Artificial Sequence
  chemically synthesized
tatgtgtaaaactgatcatcat

SEQ ID NO: 1114802 - DNA, 22 bp, Artificial Sequence
  chemically synthesized
aaaatcagatgatgatcagttt

SEQ ID NO: 1114803 - DNA, 22 bp, Artificial Sequence
  chemically synthesized
aaatcagatgatgatcagtttt

SEQ ID NO: 1114804 - DNA, 22 bp, Artificial Sequence
  chemically synthesized
acagtcatgttatatgtgtaaa

SEQ ID NO: 1114805 - DNA, 22 bp, Artificial Sequence
  chemically synthesized
aaaacattaacagtcatgttat

SEQ ID NO: 1114806 - DNA, 22 bp, Artificial Sequence
  chemically synthesized
gaaaacattaacagtcatgtta

SEQ ID NO: 1114807 - DNA, 22 bp, Artificial Sequence
  chemically synthesized
tacacatataacatgactgtta

SEQ ID NO: 1114808 - DNA, 22 bp, Artificial Sequence
  chemically synthesized
acacatataacatgactgttaa

SEQ ID NO: 1114809 - DNA, 22 bp, Artificial Sequence
  chemically synthesized
cacatataacatgactgttaat

SEQ ID NO: 1114810 - DNA, 22 bp, Artificial Sequence
  chemically synthesized
acagaaatttgaaaacattaac

SEQ ID NO: 1114811 - DNA, 22 bp, Artificial Sequence
  chemically synthesized
ttaatgttttcaaatttctgtt

SEQ ID NO: 1114812 - DNA, 22 bp, Artificial Sequence
  chemically synthesized
agaaaataaggttaacagaaat

SEQ ID NO: 1114813 - DNA, 22 bp, Artificial Sequence
  chemically synthesized
aagaaaataaggttaacagaaa

SEQ ID NO: 1114814 - DNA, 22 bp, Artificial Sequence
  chemically synthesized
atgttttcaaatttctgttaac

SEQ ID NO: 1114815 - DNA, 22 bp, Artificial Sequence
  chemically synthesized
tcaaatttctgttaaccttatt

SEQ ID NO: 1114816 - DNA, 22 bp, Artificial Sequence
  chemically synthesized
caaatttctgttaaccttattt

SEQ ID NO: 1114817 - DNA, 22 bp, Artificial Sequence
  chemically synthesized
aaatttctgttaaccttatttt

SEQ ID NO: 1114818 - DNA, 22 bp, Artificial Sequence
  chemically synthesized
tccaaataatttaagaaaataa

SEQ ID NO: 1114819 - DNA, 22 bp, Artificial Sequence
  chemically synthesized
atccaaataatttaagaaaata

SEQ ID NO: 1114820 - DNA, 22 bp, Artificial Sequence
  chemically synthesized
ctgttaaccttattttcttaaa

SEQ ID NO: 1114821 - DNA, 22 bp, Artificial Sequence
  chemically synthesized
tgttaaccttattttcttaaat

SEQ ID NO: 1114822 - DNA, 22 bp, Artificial Sequence
  chemically synthesized
ttaaccttattttcttaaatta

SEQ ID NO: 1114823 - DNA, 22 bp, Artificial Sequence
  chemically synthesized
gaatttatccaaataatttaag

SEQ ID NO: 1114824 - DNA, 22 bp, Artificial Sequence
  chemically synthesized
accttattttcttaaattattt

SEQ ID NO: 1114825 - DNA, 22 bp, Artificial Sequence
  chemically synthesized
ctagaatttatccaaataattt

SEQ ID NO: 1114826 - DNA, 22 bp, Artificial Sequence
  chemically synthesized
attttcttaaattatttggata

SEQ ID NO: 1114827 - DNA, 22 bp, Artificial Sequence
  chemically synthesized
ttttcttaaattatttggataa

SEQ ID NO: 1114828 - DNA, 22 bp, Artificial Sequence
  chemically synthesized
tcttaaattatttggataaatt

SEQ ID NO: 1114829 - DNA, 22 bp, Artificial Sequence
  chemically synthesized
cttaaattatttggataaattc

SEQ ID NO: 1114830 - DNA, 22 bp, Artificial Sequence
  chemically synthesized
ttaaattatttggataaattct

SEQ ID NO: 1114831 - DNA, 22 bp, Artificial Sequence
  chemically synthesized
atgcaaatctgctagaatttat

SEQ ID NO: 1114832 - DNA, 22 bp, Artificial Sequence
  chemically synthesized
aaattatttggataaattctag

SEQ ID NO: 1114833 - DNA, 22 bp, Artificial Sequence
  chemically synthesized
aatgcaaatctgctagaattta

SEQ ID NO: 1114834 - DNA, 22 bp, Artificial Sequence
  chemically synthesized
aattatttggataaattctagc

SEQ ID NO: 1114835 - DNA, 22 bp, Artificial Sequence
  chemically synthesized
taatgcaaatctgctagaattt

SEQ ID NO: 1114836 - DNA, 22 bp, Artificial Sequence
  chemically synthesized
tttggataaattctagcagatt

SEQ ID NO: 1114837 - DNA, 22 bp, Artificial Sequence
  chemically synthesized
ggataaattctagcagatttgc

SEQ ID NO: 1114838 - DNA, 22 bp, Artificial Sequence
  chemically synthesized
gataaattctagcagatttgca

SEQ ID NO: 1114839 - DNA, 22 bp, Artificial Sequence
  chemically synthesized
tagcagatttgcattaaaattt

SEQ ID NO: 1114840 - DNA, 22 bp, Artificial Sequence
  chemically synthesized
tagcagagaaataaattttaat

SEQ ID NO: 1114841 - DNA, 22 bp, Artificial Sequence
  chemically synthesized
gcagatttgcattaaaatttat

SEQ ID NO: 1114842 - DNA, 22 bp, Artificial Sequence
  chemically synthesized
tcagtctgtagcagagaaataa

SEQ ID NO: 1114843 - DNA, 22 bp, Artificial Sequence
  chemically synthesized
atcagtctgtagcagagaaata

SEQ ID NO: 1114844 - DNA, 22 bp, Artificial Sequence
  chemically synthesized
gcattaaaatttatttctctgc

SEQ ID NO: 1114845 - DNA, 22 bp, Artificial Sequence
  chemically synthesized
tatcagtctgtagcagagaaat

SEQ ID NO: 1114846 - DNA, 22 bp, Artificial Sequence
  chemically synthesized
cattaaaatttatttctctgct

SEQ ID NO: 1114847 - DNA, 22 bp, Artificial Sequence
  chemically synthesized
aaatttatttctctgctacaga

SEQ ID NO: 1114848 - DNA, 22 bp, Artificial Sequence
  chemically synthesized
atttctctgctacagactgata

SEQ ID NO: 1114849 - DNA, 22 bp, Artificial Sequence
  chemically synthesized
tttctctgctacagactgataa

SEQ ID NO: 1114850 - DNA, 22 bp, Artificial Sequence
  chemically synthesized
ctctgctacagactgataaaat

SEQ ID NO: 1114851 - DNA, 22 bp, Artificial Sequence
  chemically synthesized
tctgctacagactgataaaata

SEQ ID NO: 1114852 - DNA, 22 bp, Artificial Sequence
  chemically synthesized
tgctacagactgataaaatatt

SEQ ID NO: 1114853 - DNA, 22 bp, Artificial Sequence
  chemically synthesized
ctacagactgataaaatattct

SEQ ID NO: 1114854 - DNA, 22 bp, Artificial Sequence
  chemically synthesized
cagactgataaaatattctacc

SEQ ID NO: 1114855 - DNA, 22 bp, Artificial Sequence
  chemically synthesized
gaagaaaatgggatgtggtaga

SEQ ID NO: 1114856 - DNA, 22 bp, Artificial Sequence
  chemically synthesized
ataaaatattctaccacatccc

SEQ ID NO: 1114857 - DNA, 22 bp, Artificial Sequence
  chemically synthesized
attggaagaaaatgggatgtgg

SEQ ID NO: 1114858 - DNA, 22 bp, Artificial Sequence
  chemically synthesized
agttcattggaagaaaatggga

SEQ ID NO: 1114859 - DNA, 22 bp, Artificial Sequence
  chemically synthesized
gagttcattggaagaaaatggg

SEQ ID NO: 1114860 - DNA, 22 bp, Artificial Sequence
  chemically synthesized
tgagttcattggaagaaaatgg

SEQ ID NO: 1114861 - DNA, 22 bp, Artificial Sequence
  chemically synthesized
taccacatcccattttcttcca

SEQ ID NO: 1114862 - DNA, 22 bp, Artificial Sequence
  chemically synthesized
ccacatcccattttcttccaat

SEQ ID NO: 1114863 - DNA, 22 bp, Artificial Sequence
  chemically synthesized
aactttgagttcattggaagaa

SEQ ID NO: 1114864 - DNA, 22 bp, Artificial Sequence
  chemically synthesized
ggagaaattcaactttgagttc

SEQ ID NO: 1114865 - DNA, 22 bp, Artificial Sequence
  chemically synthesized
tcttccaatgaactcaaagttg

SEQ ID NO: 1114866 - DNA, 22 bp, Artificial Sequence
  chemically synthesized
ttaggagaaattcaactttgag

SEQ ID NO: 1114867 - DNA, 22 bp, Artificial Sequence
  chemically synthesized
cttccaatgaactcaaagttga

SEQ ID NO: 1114868 - DNA, 22 bp, Artificial Sequence
  chemically synthesized
ttccaatgaactcaaagttgaa

SEQ ID NO: 1114869 - DNA, 22 bp, Artificial Sequence
  chemically synthesized
ccaatgaactcaaagttgaatt

SEQ ID NO: 1114870 - DNA, 22 bp, Artificial Sequence
  chemically synthesized
caatgaactcaaagttgaattt

SEQ ID NO: 1114871 - DNA, 22 bp, Artificial Sequence
  chemically synthesized
aggaaattattaggagaaattc

SEQ ID NO: 1114872 - DNA, 22 bp, Artificial Sequence
  chemically synthesized
aaagttgaatttctcctaataa

SEQ ID NO: 1114873 - DNA, 22 bp, Artificial Sequence
  chemically synthesized
atgctaaggaaattattaggag

SEQ ID NO: 1114874 - DNA, 22 bp, Artificial Sequence
  chemically synthesized
aatgctaaggaaattattagga

SEQ ID NO: 1114875 - DNA, 22 bp, Artificial Sequence
  chemically synthesized
taatgctaaggaaattattagg

SEQ ID NO: 1114876 - DNA, 22 bp, Artificial Sequence
  chemically synthesized
ttaatgctaaggaaattattag

SEQ ID NO: 1114877 - DNA, 22 bp, Artificial Sequence
  chemically synthesized
tttaatgctaaggaaattatta

SEQ ID NO: 1114878 - DNA, 22 bp, Artificial Sequence
  chemically synthesized
ttttaatgctaaggaaattatt

SEQ ID NO: 1114879 - DNA, 22 bp, Artificial Sequence
  chemically synthesized
tttttaatgctaaggaaattat

SEQ ID NO: 1114880 - DNA, 22 bp, Artificial Sequence
  chemically synthesized
aatttctcctaataatttcctt

SEQ ID NO: 1114881 - DNA, 22 bp, Artificial Sequence
  chemically synthesized
tttttttaatgctaaggaaatt

SEQ ID NO: 1114882 - DNA, 22 bp, Artificial Sequence
  chemically synthesized
ttctttttttaatgctaaggaa

SEQ ID NO: 1114883 - DNA, 22 bp, Artificial Sequence
  chemically synthesized
ctcctaataatttccttagcat

SEQ ID NO: 1114884 - DNA, 22 bp, Artificial Sequence
  chemically synthesized
tcctaataatttccttagcatt

SEQ ID NO: 1114885 - DNA, 22 bp, Artificial Sequence
  chemically synthesized
ttattctttttttaatgctaag

SEQ ID NO: 1114886 - DNA, 22 bp, Artificial Sequence
  chemically synthesized
ctaataatttccttagcattaa

SEQ ID NO: 1114887 - DNA, 22 bp, Artificial Sequence
  chemically synthesized
attattctttttttaatgctaa

SEQ ID NO: 1114888 - DNA, 22 bp, Artificial Sequence
  chemically synthesized
tattattctttttttaatgcta

SEQ ID NO: 1114889 - DNA, 22 bp, Artificial Sequence
  chemically synthesized
ttattattctttttttaatgct

SEQ ID NO: 1114890 - DNA, 22 bp, Artificial Sequence
  chemically synthesized
ataatttccttagcattaaaaa

SEQ ID NO: 1114891 - DNA, 22 bp, Artificial Sequence
  chemically synthesized
tttattattctttttttaatgc

SEQ ID NO: 1114892 - DNA, 22 bp, Artificial Sequence
  chemically synthesized
ccttagcattaaaaaaagaata

SEQ ID NO: 1114893 - DNA, 22 bp, Artificial Sequence
  chemically synthesized
tatgttttttattattcttttt

SEQ ID NO: 1114894 - DNA, 22 bp, Artificial Sequence
  chemically synthesized
cttagcattaaaaaaagaataa

SEQ ID NO: 1114895 - DNA, 22 bp, Artificial Sequence
  chemically synthesized
gtatgttttttattattctttt

SEQ ID NO: 1114896 - DNA, 22 bp, Artificial Sequence
  chemically synthesized
agcattaaaaaaagaataataa

SEQ ID NO: 1114897 - DNA, 22 bp, Artificial Sequence
  chemically synthesized
gcattaaaaaaagaataataaa

SEQ ID NO: 1114898 - DNA, 22 bp, Artificial Sequence
  chemically synthesized
aaaaaagaataataaaaaacat

SEQ ID NO: 1114899 - DNA, 22 bp, Artificial Sequence
  chemically synthesized
aaaggtgtttgtatgtttttta

SEQ ID NO: 1114900 - DNA, 22 bp, Artificial Sequence
  chemically synthesized
aattaaaaggtgtttgtatgtt

SEQ ID NO: 1114901 - DNA, 22 bp, Artificial Sequence
  chemically synthesized
aaattaaaaggtgtttgtatgt

SEQ ID NO: 1114902 - DNA, 22 bp, Artificial Sequence
  chemically synthesized
aatacaaatttaaattaaaagg

SEQ ID NO: 1114903 - DNA, 22 bp, Artificial Sequence
  chemically synthesized
ttaaatacaaatttaaattaaa

SEQ ID NO: 1114904 - DNA, 22 bp, Artificial Sequence
  chemically synthesized
gttaaatacaaatttaaattaa

SEQ ID NO: 1114905 - DNA, 22 bp, Artificial Sequence
  chemically synthesized
ttaatttaaatttgtatttaac

SEQ ID NO: 1114906 - DNA, 22 bp, Artificial Sequence
  chemically synthesized
taatttaaatttgtatttaaca

SEQ ID NO: 1114907 - DNA, 22 bp, Artificial Sequence
  chemically synthesized
aatttaaatttgtatttaacaa

SEQ ID NO: 1114908 - DNA, 22 bp, Artificial Sequence
  chemically synthesized
atttaaatttgtatttaacaag

SEQ ID NO: 1114909 - DNA, 22 bp, Artificial Sequence
  chemically synthesized
tatcagacaagcacttgttaaa

SEQ ID NO: 1114910 - DNA, 22 bp, Artificial Sequence
  chemically synthesized
aaatttgtatttaacaagtgct

SEQ ID NO: 1114911 - DNA, 22 bp, Artificial Sequence
  chemically synthesized
aatttgtatttaacaagtgctt

SEQ ID NO: 1114912 - DNA, 22 bp, Artificial Sequence
  chemically synthesized
aattatatcagacaagcacttg

SEQ ID NO: 1114913 - DNA, 22 bp, Artificial Sequence
  chemically synthesized
gtatttaacaagtgcttgtctg

SEQ ID NO: 1114914 - DNA, 22 bp, Artificial Sequence
  chemically synthesized
tatttaacaagtgcttgtctga

SEQ ID NO: 1114915 - DNA, 22 bp, Artificial Sequence
  chemically synthesized
tcagctgaattatatcagacaa

SEQ ID NO: 1114916 - DNA, 22 bp, Artificial Sequence
  chemically synthesized
atcagctgaattatatcagaca

SEQ ID NO: 1114917 - DNA, 22 bp, Artificial Sequence
  chemically synthesized
aacaagtgcttgtctgatataa

SEQ ID NO: 1114918 - DNA, 22 bp, Artificial Sequence
  chemically synthesized
acaagtgcttgtctgatataat

SEQ ID NO: 1114919 - DNA, 22 bp, Artificial Sequence
  chemically synthesized
atatttatcagctgaattatat

SEQ ID NO: 1114920 - DNA, 22 bp, Artificial Sequence
  chemically synthesized
gtctgatataattcagctgata

SEQ ID NO: 1114921 - DNA, 22 bp, Artificial Sequence
  chemically synthesized
tctgatataattcagctgataa

SEQ ID NO: 1114922 - DNA, 22 bp, Artificial Sequence
  chemically synthesized
atataattcagctgataaatat

SEQ ID NO: 1114923 - DNA, 22 bp, Artificial Sequence
  chemically synthesized
ataaacacataggttcatattt

SEQ ID NO: 1114924 - DNA, 22 bp, Artificial Sequence
  chemically synthesized
gataaacacataggttcatatt

SEQ ID NO: 1114925 - DNA, 22 bp, Artificial Sequence
  chemically synthesized
agctgataaatatgaacctatg

SEQ ID NO: 1114926 - DNA, 22 bp, Artificial Sequence
  chemically synthesized
gggatttgataaacacataggt

SEQ ID NO: 1114927 - DNA, 22 bp, Artificial Sequence
  chemically synthesized
agggatttgataaacacatagg

SEQ ID NO: 1114928 - DNA, 22 bp, Artificial Sequence
  chemically synthesized
ataaatatgaacctatgtgttt

SEQ ID NO: 1114929 - DNA, 22 bp, Artificial Sequence
  chemically synthesized
ttagggatttgataaacacata

SEQ ID NO: 1114930 - DNA, 22 bp, Artificial Sequence
  chemically synthesized
cttagggatttgataaacacat

SEQ ID NO: 1114931 - DNA, 22 bp, Artificial Sequence
  chemically synthesized
gataatcttcttagggatttga

SEQ ID NO: 1114932 - DNA, 22 bp, Artificial Sequence
  chemically synthesized
agataatcttcttagggatttg

SEQ ID NO: 1114933 - DNA, 22 bp, Artificial Sequence
  chemically synthesized
tgtgtttatcaaatccctaaga

SEQ ID NO: 1114934 - DNA, 22 bp, Artificial Sequence
  chemically synthesized
atttagataatcttcttaggga

SEQ ID NO: 1114935 - DNA, 22 bp, Artificial Sequence
  chemically synthesized
atcaaatccctaagaagattat

SEQ ID NO: 1114936 - DNA, 22 bp, Artificial Sequence
  chemically synthesized
tcaaatccctaagaagattatc

SEQ ID NO: 1114937 - DNA, 22 bp, Artificial Sequence
  chemically synthesized
cacgagttgatttagataatct

SEQ ID NO: 1114938 - DNA, 22 bp, Artificial Sequence
  chemically synthesized
agaagattatctaaatcaactc

SEQ ID NO: 1114939 - DNA, 22 bp, Artificial Sequence
  chemically synthesized
tctaaatcaactcgtgtaatta

SEQ ID NO: 1114940 - DNA, 22 bp, Artificial Sequence
  chemically synthesized
aatcaactcgtgtaattaccat

SEQ ID NO: 1114941 - DNA, 22 bp, Artificial Sequence
  chemically synthesized
gtggaacagatggtgaatggta

SEQ ID NO: 1114942 - DNA, 22 bp, Artificial Sequence
  chemically synthesized
gtgtaattaccattcaccatct

SEQ ID NO: 1114943 - DNA, 22 bp, Artificial Sequence
  chemically synthesized
aggccctggtggaacagatggt

SEQ ID NO: 1114944 - DNA, 22 bp, Artificial Sequence
  chemically synthesized
ccattcaccatctgttccacca

SEQ ID NO: 1114945 - DNA, 22 bp, Artificial Sequence
  chemically synthesized
accatctgttccaccagggcct

SEQ ID NO: 1114946 - DNA, 22 bp, Artificial Sequence
  chemically synthesized
ttccaccagggcctgagctgat

SEQ ID NO: 1114947 - DNA, 22 bp, Artificial Sequence
  chemically synthesized
caagatgccagcagatcagctc

SEQ ID NO: 1114948 - DNA, 22 bp, Artificial Sequence
  chemically synthesized
caccagggcctgagctgatctg

SEQ ID NO: 1114949 - DNA, 22 bp, Artificial Sequence
  chemically synthesized
agaaaactgcaagatgccagca

SEQ ID NO: 1114950 - DNA, 22 bp, Artificial Sequence
  chemically synthesized
agctgatctgctggcatcttgc

SEQ ID NO: 1114951 - DNA, 22 bp, Artificial Sequence
  chemically synthesized
agaagttcagaaaactgcaaga

SEQ ID NO: 1114952 - DNA, 22 bp, Artificial Sequence
  chemically synthesized
atctgctggcatcttgcagttt

SEQ ID NO: 1114953 - DNA, 22 bp, Artificial Sequence
  chemically synthesized
ctggcatcttgcagttttctga

SEQ ID NO: 1114954 - DNA, 22 bp, Artificial Sequence
  chemically synthesized
gcatcttgcagttttctgaact

SEQ ID NO: 1114955 - DNA, 22 bp, Artificial Sequence
  chemically synthesized
gcagttttctgaacttctcagc

SEQ ID NO: 1114956 - DNA, 22 bp, Artificial Sequence
  chemically synthesized
cagttttctgaacttctcagct

SEQ ID NO: 1114957 - DNA, 22 bp, Artificial Sequence
  chemically synthesized
tctgaacttctcagctttttct

SEQ ID NO: 1114958 - DNA, 22 bp, Artificial Sequence
  chemically synthesized
ctgaacttctcagctttttctc

SEQ ID NO: 1114959 - DNA, 22 bp, Artificial Sequence
  chemically synthesized
tgaacttctcagctttttctcg

SEQ ID NO: 1114960 - DNA, 22 bp, Artificial Sequence
  chemically synthesized
caggccatagagcgagaaaaag

SEQ ID NO: 1114961 - DNA, 22 bp, Artificial Sequence
  chemically synthesized
aacttctcagctttttctcgct

SEQ ID NO: 1114962 - DNA, 22 bp, Artificial Sequence
  chemically synthesized
atgctgcaggccatagagcgag

SEQ ID NO: 1114963 - DNA, 22 bp, Artificial Sequence
  chemically synthesized
ctcagctttttctcgctctatg

SEQ ID NO: 1114964 - DNA, 22 bp, Artificial Sequence
  chemically synthesized
tcagctttttctcgctctatgg

SEQ ID NO: 1114965 - DNA, 22 bp, Artificial Sequence
  chemically synthesized
tcatgctgcaggccatagagcg

SEQ ID NO: 1114966 - DNA, 22 bp, Artificial Sequence
  chemically synthesized
agctttttctcgctctatggcc

SEQ ID NO: 1114967 - DNA, 22 bp, Artificial Sequence
  chemically synthesized
ctctcatgctgcaggccataga

SEQ ID NO: 1114968 - DNA, 22 bp, Artificial Sequence
  chemically synthesized
gctctcatgctgcaggccatag

SEQ ID NO: 1114969 - DNA, 22 bp, Artificial Sequence
  chemically synthesized
tgctctcatgctgcaggccata

SEQ ID NO: 1114970 - DNA, 22 bp, Artificial Sequence
  chemically synthesized
tttctcgctctatggcctgcag

SEQ ID NO: 1114971 - DNA, 22 bp, Artificial Sequence
  chemically synthesized
ttctcgctctatggcctgcagc

SEQ ID NO: 1114972 - DNA, 22 bp, Artificial Sequence
  chemically synthesized
tctcgctctatggcctgcagca

SEQ ID NO: 1114973 - DNA, 22 bp, Artificial Sequence
  chemically synthesized
ctcgctctatggcctgcagcat

SEQ ID NO: 1114974 - DNA, 22 bp, Artificial Sequence
  chemically synthesized
atctttgctctcatgctgcagg

SEQ ID NO: 1114975 - DNA, 22 bp, Artificial Sequence
  chemically synthesized
tcgctctatggcctgcagcatg

SEQ ID NO: 1114976 - DNA, 22 bp, Artificial Sequence
  chemically synthesized
gctctatggcctgcagcatgag

SEQ ID NO: 1114977 - DNA, 22 bp, Artificial Sequence
  chemically synthesized
ctcatctttgctctcatgctgc

SEQ ID NO: 1114978 - DNA, 22 bp, Artificial Sequence
  chemically synthesized
tatggcctgcagcatgagagca

SEQ ID NO: 1114979 - DNA, 22 bp, Artificial Sequence
  chemically synthesized
aattactcatctttgctctcat

SEQ ID NO: 1114980 - DNA, 22 bp, Artificial Sequence
  chemically synthesized
tggcctgcagcatgagagcaaa

SEQ ID NO: 1114981 - DNA, 22 bp, Artificial Sequence
  chemically synthesized
tattgaattactcatctttgct

SEQ ID NO: 1114982 - DNA, 22 bp, Artificial Sequence
  chemically synthesized
gtattgaattactcatctttgc

SEQ ID NO: 1114983 - DNA, 22 bp, Artificial Sequence
  chemically synthesized
cagcatgagagcaaagatgagt

SEQ ID NO: 1114984 - DNA, 22 bp, Artificial Sequence
  chemically synthesized
acagtccttgtattgaattact

SEQ ID NO: 1114985 - DNA, 22 bp, Artificial Sequence
  chemically synthesized
tgtagattcacagtccttgtat

SEQ ID NO: 1114986 - DNA, 22 bp, Artificial Sequence
  chemically synthesized
ttgtgtagattcacagtccttg

SEQ ID NO: 1114987 - DNA, 22 bp, Artificial Sequence
  chemically synthesized
taattattgtgtagattcacag

SEQ ID NO: 1114988 - DNA, 22 bp, Artificial Sequence
  chemically synthesized
aatacaaggactgtgaatctac

SEQ ID NO: 1114989 - DNA, 22 bp, Artificial Sequence
  chemically synthesized
tgaatctacacaataattataa

SEQ ID NO: 1114990 - DNA, 22 bp, Artificial Sequence
  chemically synthesized
aaagggcaagtagaagttataa

SEQ ID NO: 1114991 - DNA, 22 bp, Artificial Sequence
  chemically synthesized
gaaagggcaagtagaagttata

SEQ ID NO: 1114992 - DNA, 22 bp, Artificial Sequence
  chemically synthesized
cacaataattataacttctact

SEQ ID NO: 1114993 - DNA, 22 bp, Artificial Sequence
  chemically synthesized
aggcttgaaagggcaagtagaa

SEQ ID NO: 1114994 - DNA, 22 bp, Artificial Sequence
  chemically synthesized
aaggcttgaaagggcaagtaga

SEQ ID NO: 1114995 - DNA, 22 bp, Artificial Sequence
  chemically synthesized
taacttctacttgccctttcaa

SEQ ID NO: 1114996 - DNA, 22 bp, Artificial Sequence
  chemically synthesized
ctacttgccctttcaagcctta

SEQ ID NO: 1114997 - DNA, 22 bp, Artificial Sequence
  chemically synthesized
tacttgccctttcaagccttaa

SEQ ID NO: 1114998 - DNA, 22 bp, Artificial Sequence
  chemically synthesized
cttgccctttcaagccttaaga

SEQ ID NO: 1114999 - DNA, 22 bp, Artificial Sequence
  chemically synthesized
acagagtgaaacatcttaaggc

SEQ ID NO: 1115000 - DNA, 22 bp, Artificial Sequence
  chemically synthesized
gccctttcaagccttaagatgt

SEQ ID NO: 1115001 - DNA, 22 bp, Artificial Sequence
  chemically synthesized
ccctttcaagccttaagatgtt

SEQ ID NO: 1115002 - DNA, 22 bp, Artificial Sequence
  chemically synthesized
tcaagccttaagatgtttcact

SEQ ID NO: 1115003 - DNA, 22 bp, Artificial Sequence
  chemically synthesized
caagccttaagatgtttcactc

SEQ ID NO: 1115004 - DNA, 22 bp, Artificial Sequence
  chemically synthesized
aagccttaagatgtttcactct

SEQ ID NO: 1115005 - DNA, 22 bp, Artificial Sequence
  chemically synthesized
acgtgataagctgacagagtga

SEQ ID NO: 1115006 - DNA, 22 bp, Artificial Sequence
  chemically synthesized
aagatgtttcactctgtcagct

SEQ ID NO: 1115007 - DNA, 22 bp, Artificial Sequence
  chemically synthesized
agatgtttcactctgtcagctt

SEQ ID NO: 1115008 - DNA, 22 bp, Artificial Sequence
  chemically synthesized
gattcacgtgataagctgacag

SEQ ID NO: 1115009 - DNA, 22 bp, Artificial Sequence
  chemically synthesized
agattcacgtgataagctgaca

SEQ ID NO: 1115010 - DNA, 22 bp, Artificial Sequence
  chemically synthesized
tagattcacgtgataagctgac

SEQ ID NO: 1115011 - DNA, 22 bp, Artificial Sequence
  chemically synthesized
cactctgtcagcttatcacgtg

SEQ ID NO: 1115012 - DNA, 22 bp, Artificial Sequence
  chemically synthesized
actctgtcagcttatcacgtga

SEQ ID NO: 1115013 - DNA, 22 bp, Artificial Sequence
  chemically synthesized
tgtcagcttatcacgtgaatct

SEQ ID NO: 1115014 - DNA, 22 bp, Artificial Sequence
  chemically synthesized
agaaaaagtctttagattcacg

SEQ ID NO: 1115015 - DNA, 22 bp, Artificial Sequence
  chemically synthesized
tcagcttatcacgtgaatctaa

SEQ ID NO: 1115016 - DNA, 22 bp, Artificial Sequence
  chemically synthesized
atcacgtgaatctaaagacttt

SEQ ID NO: 1115017 - DNA, 22 bp, Artificial Sequence
  chemically synthesized
tcacgtgaatctaaagactttt

SEQ ID NO: 1115018 - DNA, 22 bp, Artificial Sequence
  chemically synthesized
atggcaaaagtgttgagaaaaa

SEQ ID NO: 1115019 - DNA, 22 bp, Artificial Sequence
  chemically synthesized
gatggcaaaagtgttgagaaaa

SEQ ID NO: 1115020 - DNA, 22 bp, Artificial Sequence
  chemically synthesized
tgatggcaaaagtgttgagaaa

SEQ ID NO: 1115021 - DNA, 22 bp, Artificial Sequence
  chemically synthesized
ttgatggcaaaagtgttgagaa

SEQ ID NO: 1115022 - DNA, 22 bp, Artificial Sequence
  chemically synthesized
aagactttttctcaacactttt

SEQ ID NO: 1115023 - DNA, 22 bp, Artificial Sequence
  chemically synthesized
atgtttttgatggcaaaagtgt

SEQ ID NO: 1115024 - DNA, 22 bp, Artificial Sequence
  chemically synthesized
gatgtttttgatggcaaaagtg

SEQ ID NO: 1115025 - DNA, 22 bp, Artificial Sequence
  chemically synthesized
tgatgtttttgatggcaaaagt

SEQ ID NO: 1115026 - DNA, 22 bp, Artificial Sequence
  chemically synthesized
tttctcaacacttttgccatca

SEQ ID NO: 1115027 - DNA, 22 bp, Artificial Sequence
  chemically synthesized
ttctcaacacttttgccatcaa

SEQ ID NO: 1115028 - DNA, 22 bp, Artificial Sequence
  chemically synthesized
tctcaacacttttgccatcaaa

SEQ ID NO: 1115029 - DNA, 22 bp, Artificial Sequence
  chemically synthesized
ctcaacacttttgccatcaaaa

SEQ ID NO: 1115030 - DNA, 22 bp, Artificial Sequence
  chemically synthesized
ccattttgatgtttttgatggc

SEQ ID NO: 1115031 - DNA, 22 bp, Artificial Sequence
  chemically synthesized
tcaacacttttgccatcaaaaa

SEQ ID NO: 1115032 - DNA, 22 bp, Artificial Sequence
  chemically synthesized
aacacttttgccatcaaaaaca

SEQ ID NO: 1115033 - DNA, 22 bp, Artificial Sequence
  chemically synthesized
ttgccattttgatgtttttgat

SEQ ID NO: 1115034 - DNA, 22 bp, Artificial Sequence
  chemically synthesized
attgccattttgatgtttttga

SEQ ID NO: 1115035 - DNA, 22 bp, Artificial Sequence
  chemically synthesized
tattgccattttgatgtttttg

SEQ ID NO: 1115036 - DNA, 22 bp, Artificial Sequence
  chemically synthesized
ttattgccattttgatgttttt

SEQ ID NO: 1115037 - DNA, 22 bp, Artificial Sequence
  chemically synthesized
ttgccatcaaaaacatcaaaat

SEQ ID NO: 1115038 - DNA, 22 bp, Artificial Sequence
  chemically synthesized
tgccatcaaaaacatcaaaatg

SEQ ID NO: 1115039 - DNA, 22 bp, Artificial Sequence
  chemically synthesized
gccatcaaaaacatcaaaatgg

SEQ ID NO: 1115040 - DNA, 22 bp, Artificial Sequence
  chemically synthesized
atgcttttattgccattttgat

SEQ ID NO: 1115041 - DNA, 22 bp, Artificial Sequence
  chemically synthesized
ccatcaaaaacatcaaaatggc

SEQ ID NO: 1115042 - DNA, 22 bp, Artificial Sequence
  chemically synthesized
tagcaagtcatgaaaatggctc

SEQ ID NO: 1115043 - DNA, 22 bp, Artificial Sequence
  chemically synthesized
aaagttgtagcaagtcatgaaa

SEQ ID NO: 1115044 - DNA, 22 bp, Artificial Sequence
  chemically synthesized
taattaaaagttgtagcaagtc

SEQ ID NO: 1115045 - DNA, 22 bp, Artificial Sequence
  chemically synthesized
ataattaaaagttgtagcaagt

SEQ ID NO: 1115046 - DNA, 22 bp, Artificial Sequence
  chemically synthesized
tcatgacttgctacaactttta

SEQ ID NO: 1115047 - DNA, 22 bp, Artificial Sequence
  chemically synthesized
catgacttgctacaacttttaa

SEQ ID NO: 1115048 - DNA, 22 bp, Artificial Sequence
  chemically synthesized
atgacttgctacaacttttaat

SEQ ID NO: 1115049 - DNA, 22 bp, Artificial Sequence
  chemically synthesized
agtagaaatcttataattaaaa

SEQ ID NO: 1115050 - DNA, 22 bp, Artificial Sequence
  chemically synthesized
gctacaacttttaattataaga

SEQ ID NO: 1115051 - DNA, 22 bp, Artificial Sequence
  chemically synthesized
ctacaacttttaattataagat

SEQ ID NO: 1115052 - DNA, 22 bp, Artificial Sequence
  chemically synthesized
caacttttaattataagatttc

SEQ ID NO: 1115053 - DNA, 22 bp, Artificial Sequence
  chemically synthesized
ttaattataagatttctactca

SEQ ID NO: 1115054 - DNA, 22 bp, Artificial Sequence
  chemically synthesized
taattataagatttctactcag

SEQ ID NO: 1115055 - DNA, 22 bp, Artificial Sequence
  chemically synthesized
aattataagatttctactcagc

SEQ ID NO: 1115056 - DNA, 22 bp, Artificial Sequence
  chemically synthesized
attataagatttctactcagct

SEQ ID NO: 1115057 - DNA, 22 bp, Artificial Sequence
  chemically synthesized
taatgtaaaaaaaagctgagta

SEQ ID NO: 1115058 - DNA, 22 bp, Artificial Sequence
  chemically synthesized
taagatttctactcagcttttt

SEQ ID NO: 1115059 - DNA, 22 bp, Artificial Sequence
  chemically synthesized
ctactcagcttttttttacatt

SEQ ID NO: 1115060 - DNA, 22 bp, Artificial Sequence
  chemically synthesized
tactcagcttttttttacatta

SEQ ID NO: 1115061 - DNA, 22 bp, Artificial Sequence
  chemically synthesized
ctcagcttttttttacattata

SEQ ID NO: 1115062 - DNA, 22 bp, Artificial Sequence
  chemically synthesized
agcttttttttacattatagtt

SEQ ID NO: 1115063 - DNA, 22 bp, Artificial Sequence
  chemically synthesized
aaatgtatcagaaactataatg

SEQ ID NO: 1115064 - DNA, 22 bp, Artificial Sequence
  chemically synthesized
ttttttacattatagtttctga

SEQ ID NO: 1115065 - DNA, 22 bp, Artificial Sequence
  chemically synthesized
cgttgaaatgtatcagaaacta

SEQ ID NO: 1115066 - DNA, 22 bp, Artificial Sequence
  chemically synthesized
tttttacattatagtttctgat

SEQ ID NO: 1115067 - DNA, 22 bp, Artificial Sequence
  chemically synthesized
gcgttgaaatgtatcagaaact

SEQ ID NO: 1115068 - DNA, 22 bp, Artificial Sequence
  chemically synthesized
ttttacattatagtttctgata

SEQ ID NO: 1115069 - DNA, 22 bp, Artificial Sequence
  chemically synthesized
tttacattatagtttctgatac

SEQ ID NO: 1115070 - DNA, 22 bp, Artificial Sequence
  chemically synthesized
ttacattatagtttctgataca

SEQ ID NO: 1115071 - DNA, 22 bp, Artificial Sequence
  chemically synthesized
tacattatagtttctgatacat

SEQ ID NO: 1115072 - DNA, 22 bp, Artificial Sequence
  chemically synthesized
acattatagtttctgatacatt

SEQ ID NO: 1115073 - DNA, 22 bp, Artificial Sequence
  chemically synthesized
cattatagtttctgatacattt

SEQ ID NO: 1115074 - DNA, 22 bp, Artificial Sequence
  chemically synthesized
cagtcttgcgttgaaatgtatc

SEQ ID NO: 1115075 - DNA, 22 bp, Artificial Sequence
  chemically synthesized
gcagtcttgcgttgaaatgtat

SEQ ID NO: 1115076 - DNA, 22 bp, Artificial Sequence
  chemically synthesized
tgcagtcttgcgttgaaatgta

SEQ ID NO: 1115077 - DNA, 22 bp, Artificial Sequence
  chemically synthesized
ttgcagtcttgcgttgaaatgt

SEQ ID NO: 1115078 - DNA, 22 bp, Artificial Sequence
  chemically synthesized
tagtttctgatacatttcaacg

SEQ ID NO: 1115079 - DNA, 22 bp, Artificial Sequence
  chemically synthesized
tttgcagtcttgcgttgaaatg

SEQ ID NO: 1115080 - DNA, 22 bp, Artificial Sequence
  chemically synthesized
ctttttgcagtcttgcgttgaa

SEQ ID NO: 1115081 - DNA, 22 bp, Artificial Sequence
  chemically synthesized
actttttgcagtcttgcgttga

SEQ ID NO: 1115082 - DNA, 22 bp, Artificial Sequence
  chemically synthesized
tactttttgcagtcttgcgttg

SEQ ID NO: 1115083 - DNA, 22 bp, Artificial Sequence
  chemically synthesized
ctgatacatttcaacgcaagac

SEQ ID NO: 1115084 - DNA, 22 bp, Artificial Sequence
  chemically synthesized
ttactttttgcagtcttgcgtt

SEQ ID NO: 1115085 - DNA, 22 bp, Artificial Sequence
  chemically synthesized
tgatacatttcaacgcaagact

SEQ ID NO: 1115086 - DNA, 22 bp, Artificial Sequence
  chemically synthesized
tttactttttgcagtcttgcgt

SEQ ID NO: 1115087 - DNA, 22 bp, Artificial Sequence
  chemically synthesized
atacatttcaacgcaagactgc

SEQ ID NO: 1115088 - DNA, 22 bp, Artificial Sequence
  chemically synthesized
cctttttactttttgcagtctt

SEQ ID NO: 1115089 - DNA, 22 bp, Artificial Sequence
  chemically synthesized
caacgcaagactgcaaaaagta

SEQ ID NO: 1115090 - DNA, 22 bp, Artificial Sequence
  chemically synthesized
aacgcaagactgcaaaaagtaa

SEQ ID NO: 1115091 - DNA, 22 bp, Artificial Sequence
  chemically synthesized
tgaattgcctttttactttttg

SEQ ID NO: 1115092 - DNA, 22 bp, Artificial Sequence
  chemically synthesized
ttatgaattgcctttttacttt

SEQ ID NO: 1115093 - DNA, 22 bp, Artificial Sequence
  chemically synthesized
attgttatgaattgccttttta

SEQ ID NO: 1115094 - DNA, 22 bp, Artificial Sequence
  chemically synthesized
cattgttatgaattgccttttt

SEQ ID NO: 1115095 - DNA, 22 bp, Artificial Sequence
  chemically synthesized
tcattgttatgaattgcctttt

SEQ ID NO: 1115096 - DNA, 22 bp, Artificial Sequence
  chemically synthesized
caaaaagtaaaaaggcaattca

SEQ ID NO: 1115097 - DNA, 22 bp, Artificial Sequence
  chemically synthesized
tctttcattgttatgaattgcc

SEQ ID NO: 1115098 - DNA, 22 bp, Artificial Sequence
  chemically synthesized
atctttcattgttatgaattgc

SEQ ID NO: 1115099 - DNA, 22 bp, Artificial Sequence
  chemically synthesized
tatctttcattgttatgaattg

SEQ ID NO: 1115100 - DNA, 22 bp, Artificial Sequence
  chemically synthesized
tgtgacactttatctttcattg

SEQ ID NO: 1115101 - DNA, 22 bp, Artificial Sequence
  chemically synthesized
gttatgtgacactttatctttc

SEQ ID NO: 1115102 - DNA, 22 bp, Artificial Sequence
  chemically synthesized
agttatgtgacactttatcttt

SEQ ID NO: 1115103 - DNA, 22 bp, Artificial Sequence
  chemically synthesized
tagttatgtgacactttatctt

SEQ ID NO: 1115104 - DNA, 22 bp, Artificial Sequence
  chemically synthesized
ataacaatgaaagataaagtgt

SEQ ID NO: 1115105 - DNA, 22 bp, Artificial Sequence
  chemically synthesized
attttagttatgtgacacttta

SEQ ID NO: 1115106 - DNA, 22 bp, Artificial Sequence
  chemically synthesized
cattttagttatgtgacacttt

SEQ ID NO: 1115107 - DNA, 22 bp, Artificial Sequence
  chemically synthesized
aaagataaatttcattttagtt

SEQ ID NO: 1115108 - DNA, 22 bp, Artificial Sequence
  chemically synthesized
aaaagataaatttcattttagt

SEQ ID NO: 1115109 - DNA, 22 bp, Artificial Sequence
  chemically synthesized
taaaagataaatttcattttag

SEQ ID NO: 1115110 - DNA, 22 bp, Artificial Sequence
  chemically synthesized
aatggtgtatctttaaaagata

SEQ ID NO: 1115111 - DNA, 22 bp, Artificial Sequence
  chemically synthesized
caatggtgtatctttaaaagat

SEQ ID NO: 1115112 - DNA, 22 bp, Artificial Sequence
  chemically synthesized
aaatgaaatttatcttttaaag

SEQ ID NO: 1115113 - DNA, 22 bp, Artificial Sequence
  chemically synthesized
gtaatttcaatggtgtatcttt

SEQ ID NO: 1115114 - DNA, 22 bp, Artificial Sequence
  chemically synthesized
ttagtaatttcaatggtgtatc

SEQ ID NO: 1115115 - DNA, 22 bp, Artificial Sequence
  chemically synthesized
attagtaatttcaatggtgtat

SEQ ID NO: 1115116 - DNA, 22 bp, Artificial Sequence
  chemically synthesized
atcttttaaagatacaccattg

SEQ ID NO: 1115117 - DNA, 22 bp, Artificial Sequence
  chemically synthesized
tcttttaaagatacaccattga

SEQ ID NO: 1115118 - DNA, 22 bp, Artificial Sequence
  chemically synthesized
ttaaagatacaccattgaaatt

SEQ ID NO: 1115119 - DNA, 22 bp, Artificial Sequence
  chemically synthesized
taaagatacaccattgaaatta

SEQ ID NO: 1115120 - DNA, 22 bp, Artificial Sequence
  chemically synthesized
tatacttattagtaatttcaat

SEQ ID NO: 1115121 - DNA, 22 bp, Artificial Sequence
  chemically synthesized
aaagatacaccattgaaattac

SEQ ID NO: 1115122 - DNA, 22 bp, Artificial Sequence
  chemically synthesized
aagatacaccattgaaattact

SEQ ID NO: 1115123 - DNA, 22 bp, Artificial Sequence
  chemically synthesized
ataccgcctatatacttattag

SEQ ID NO: 1115124 - DNA, 22 bp, Artificial Sequence
  chemically synthesized
aataccgcctatatacttatta

SEQ ID NO: 1115125 - DNA, 22 bp, Artificial Sequence
  chemically synthesized
taataccgcctatatacttatt

SEQ ID NO: 1115126 - DNA, 22 bp, Artificial Sequence
  chemically synthesized
ttaataccgcctatatacttat

SEQ ID NO: 1115127 - DNA, 22 bp, Artificial Sequence
  chemically synthesized
aaattactaataagtatatagg

SEQ ID NO: 1115128 - DNA, 22 bp, Artificial Sequence
  chemically synthesized
atttttaataccgcctatatac

SEQ ID NO: 1115129 - DNA, 22 bp, Artificial Sequence
  chemically synthesized
gatttttaataccgcctatata

SEQ ID NO: 1115130 - DNA, 22 bp, Artificial Sequence
  chemically synthesized
ctaataagtatataggcggtat

SEQ ID NO: 1115131 - DNA, 22 bp, Artificial Sequence
  chemically synthesized
aatttgatttttaataccgcct

SEQ ID NO: 1115132 - DNA, 22 bp, Artificial Sequence
  chemically synthesized
ataagtatataggcggtattaa

SEQ ID NO: 1115133 - DNA, 22 bp, Artificial Sequence
  chemically synthesized
tcaatttgatttttaataccgc

SEQ ID NO: 1115134 - DNA, 22 bp, Artificial Sequence
  chemically synthesized
gattctcaatttgatttttaat

SEQ ID NO: 1115135 - DNA, 22 bp, Artificial Sequence
  chemically synthesized
tatacatactggattctcaatt

SEQ ID NO: 1115136 - DNA, 22 bp, Artificial Sequence
  chemically synthesized
atatacatactggattctcaat

SEQ ID NO: 1115137 - DNA, 22 bp, Artificial Sequence
  chemically synthesized
aaaatcaaattgagaatccagt

SEQ ID NO: 1115138 - DNA, 22 bp, Artificial Sequence
  chemically synthesized
catcttatatacatactggatt

SEQ ID NO: 1115139 - DNA, 22 bp, Artificial Sequence
  chemically synthesized
ccatcttatatacatactggat

SEQ ID NO: 1115140 - DNA, 22 bp, Artificial Sequence
  chemically synthesized
tccatcttatatacatactgga

SEQ ID NO: 1115141 - DNA, 22 bp, Artificial Sequence
  chemically synthesized
ttccatcttatatacatactgg

SEQ ID NO: 1115142 - DNA, 22 bp, Artificial Sequence
  chemically synthesized
tttccatcttatatacatactg

SEQ ID NO: 1115143 - DNA, 22 bp, Artificial Sequence
  chemically synthesized
ttttttccatcttatatacata

SEQ ID NO: 1115144 - DNA, 22 bp, Artificial Sequence
  chemically synthesized
attttttccatcttatatacat

SEQ ID NO: 1115145 - DNA, 22 bp, Artificial Sequence
  chemically synthesized
agaatccagtatgtatataaga

SEQ ID NO: 1115146 - DNA, 22 bp, Artificial Sequence
  chemically synthesized
tggtagtttattttttccatct

SEQ ID NO: 1115147 - DNA, 22 bp, Artificial Sequence
  chemically synthesized
atggtagtttattttttccatc

SEQ ID NO: 1115148 - DNA, 22 bp, Artificial Sequence
  chemically synthesized
tttatggtagtttattttttcc

SEQ ID NO: 1115149 - DNA, 22 bp, Artificial Sequence
  chemically synthesized
aattatttatggtagtttattt

SEQ ID NO: 1115150 - DNA, 22 bp, Artificial Sequence
  chemically synthesized
ctaaattatttatggtagttta

SEQ ID NO: 1115151 - DNA, 22 bp, Artificial Sequence
  chemically synthesized
tgctaaattatttatggtagtt

SEQ ID NO: 1115152 - DNA, 22 bp, Artificial Sequence
  chemically synthesized
ctgctaaattatttatggtagt

SEQ ID NO: 1115153 - DNA, 22 bp, Artificial Sequence
  chemically synthesized
tatatttctgctaaattattta

SEQ ID NO: 1115154 - DNA, 22 bp, Artificial Sequence
  chemically synthesized
ccataaataatttagcagaaat

SEQ ID NO: 1115155 - DNA, 22 bp, Artificial Sequence
  chemically synthesized
aatatatatgtacatatattat

SEQ ID NO: 1115156 - DNA, 22 bp, Artificial Sequence
  chemically synthesized
agcagaaatatataatatatgt

SEQ ID NO: 1115157 - DNA, 22 bp, Artificial Sequence
  chemically synthesized
aaatatatatgtacatatatta

SEQ ID NO: 1115158 - DNA, 22 bp, Artificial Sequence
  chemically synthesized
gcagaaatatataatatatgta

SEQ ID NO: 1115159 - DNA, 22 bp, Artificial Sequence
  chemically synthesized
gtatttaaatatatatgtacat

SEQ ID NO: 1115160 - DNA, 22 bp, Artificial Sequence
  chemically synthesized
cagcctggtatttaaatatata

SEQ ID NO: 1115161 - DNA, 22 bp, Artificial Sequence
  chemically synthesized
gcctacagcctggtatttaaat

SEQ ID NO: 1115162 - DNA, 22 bp, Artificial Sequence
  chemically synthesized
aaagaaaaattagcctacagcc

SEQ ID NO: 1115163 - DNA, 22 bp, Artificial Sequence
  chemically synthesized
gaaagaaaaattagcctacagc

SEQ ID NO: 1115164 - DNA, 22 bp, Artificial Sequence
  chemically synthesized
tgaaagaaaaattagcctacag

SEQ ID NO: 1115165 - DNA, 22 bp, Artificial Sequence
  chemically synthesized
ttgaaagaaaaattagcctaca

SEQ ID NO: 1115166 - DNA, 22 bp, Artificial Sequence
  chemically synthesized
aaataccaggctgtaggctaat

SEQ ID NO: 1115167 - DNA, 22 bp, Artificial Sequence
  chemically synthesized
aataccaggctgtaggctaatt

SEQ ID NO: 1115168 - DNA, 22 bp, Artificial Sequence
  chemically synthesized
tttttgaaagaaaaattagcct

SEQ ID NO: 1115169 - DNA, 22 bp, Artificial Sequence
  chemically synthesized
attatttttgaaagaaaaatta

SEQ ID NO: 1115170 - DNA, 22 bp, Artificial Sequence
  chemically synthesized
gattatttttgaaagaaaaatt

SEQ ID NO: 1115171 - DNA, 22 bp, Artificial Sequence
  chemically synthesized
tgattatttttgaaagaaaaat

SEQ ID NO: 1115172 - DNA, 22 bp, Artificial Sequence
  chemically synthesized
taggctaatttttctttcaaaa

SEQ ID NO: 1115173 - DNA, 22 bp, Artificial Sequence
  chemically synthesized
atttttctttcaaaaataatca

SEQ ID NO: 1115174 - DNA, 22 bp, Artificial Sequence
  chemically synthesized
gaaataggagtactttgattat

SEQ ID NO: 1115175 - DNA, 22 bp, Artificial Sequence
  chemically synthesized
ttctttcaaaaataatcaaagt

SEQ ID NO: 1115176 - DNA, 22 bp, Artificial Sequence
  chemically synthesized
ggaaataggagtactttgatta

SEQ ID NO: 1115177 - DNA, 22 bp, Artificial Sequence
  chemically synthesized
tctttcaaaaataatcaaagta

SEQ ID NO: 1115178 - DNA, 22 bp, Artificial Sequence
  chemically synthesized
ctttcaaaaataatcaaagtac

SEQ ID NO: 1115179 - DNA, 22 bp, Artificial Sequence
  chemically synthesized
tttcaaaaataatcaaagtact

SEQ ID NO: 1115180 - DNA, 22 bp, Artificial Sequence
  chemically synthesized
cttggaaataggagtactttga

SEQ ID NO: 1115181 - DNA, 22 bp, Artificial Sequence
  chemically synthesized
ccttggaaataggagtactttg

SEQ ID NO: 1115182 - DNA, 22 bp, Artificial Sequence
  chemically synthesized
tcaaaaataatcaaagtactcc

SEQ ID NO: 1115183 - DNA, 22 bp, Artificial Sequence
  chemically synthesized
caaaaataatcaaagtactcct

SEQ ID NO: 1115184 - DNA, 22 bp, Artificial Sequence
  chemically synthesized
aaaaataatcaaagtactccta

SEQ ID NO: 1115185 - DNA, 22 bp, Artificial Sequence
  chemically synthesized
tcttccttggaaataggagtac

SEQ ID NO: 1115186 - DNA, 22 bp, Artificial Sequence
  chemically synthesized
gtcttccttggaaataggagta

SEQ ID NO: 1115187 - DNA, 22 bp, Artificial Sequence
  chemically synthesized
aatcttgtcttccttggaaata

SEQ ID NO: 1115188 - DNA, 22 bp, Artificial Sequence
  chemically synthesized
aaactcaatcttgtcttccttg

SEQ ID NO: 1115189 - DNA, 22 bp, Artificial Sequence
  chemically synthesized
gaaactcaatcttgtcttcctt

SEQ ID NO: 1115190 - DNA, 22 bp, Artificial Sequence
  chemically synthesized
tgaaactcaatcttgtcttcct

SEQ ID NO: 1115191 - DNA, 22 bp, Artificial Sequence
  chemically synthesized
ttgaaactcaatcttgtcttcc

SEQ ID NO: 1115192 - DNA, 22 bp, Artificial Sequence
  chemically synthesized
tttgaaactcaatcttgtcttc

SEQ ID NO: 1115193 - DNA, 22 bp, Artificial Sequence
  chemically synthesized
ctatttccaaggaagacaagat

SEQ ID NO: 1115194 - DNA, 22 bp, Artificial Sequence
  chemically synthesized
tttccaaggaagacaagattga

SEQ ID NO: 1115195 - DNA, 22 bp, Artificial Sequence
  chemically synthesized
ccaaggaagacaagattgagtt

SEQ ID NO: 1115196 - DNA, 22 bp, Artificial Sequence
  chemically synthesized
caaggaagacaagattgagttt

SEQ ID NO: 1115197 - DNA, 22 bp, Artificial Sequence
  chemically synthesized
agaaagttttttgaaactcaat

SEQ ID NO: 1115198 - DNA, 22 bp, Artificial Sequence
  chemically synthesized
agtttcaaaaaactttctgaat

SEQ ID NO: 1115199 - DNA, 22 bp, Artificial Sequence
  chemically synthesized
agggaaataaaggaattcagaa

SEQ ID NO: 1115200 - DNA, 22 bp, Artificial Sequence
  chemically synthesized
aagggaaataaaggaattcaga

SEQ ID NO: 1115201 - DNA, 22 bp, Artificial Sequence
  chemically synthesized
caaaaaactttctgaattcctt

SEQ ID NO: 1115202 - DNA, 22 bp, Artificial Sequence
  chemically synthesized
ttaagggaaataaaggaattca

SEQ ID NO: 1115203 - DNA, 22 bp, Artificial Sequence
  chemically synthesized
aaaaaactttctgaattccttt

SEQ ID NO: 1115204 - DNA, 22 bp, Artificial Sequence
  chemically synthesized
tctgaattcctttatttccctt

SEQ ID NO: 1115205 - DNA, 22 bp, Artificial Sequence
  chemically synthesized
ctgaattcctttatttccctta

SEQ ID NO: 1115206 - DNA, 22 bp, Artificial Sequence
  chemically synthesized
tgaattcctttatttcccttaa

SEQ ID NO: 1115207 - DNA, 22 bp, Artificial Sequence
  chemically synthesized
aaaatgtaactcttaagggaaa

SEQ ID NO: 1115208 - DNA, 22 bp, Artificial Sequence
  chemically synthesized
aattcctttatttcccttaaga

SEQ ID NO: 1115209 - DNA, 22 bp, Artificial Sequence
  chemically synthesized
tggttcaaaatgtaactcttaa

SEQ ID NO: 1115210 - DNA, 22 bp, Artificial Sequence
  chemically synthesized
ctttatttcccttaagagttac

SEQ ID NO: 1115211 - DNA, 22 bp, Artificial Sequence
  chemically synthesized
gtggttcaaaatgtaactctta

SEQ ID NO: 1115212 - DNA, 22 bp, Artificial Sequence
  chemically synthesized
tatttcccttaagagttacatt

SEQ ID NO: 1115213 - DNA, 22 bp, Artificial Sequence
  chemically synthesized
atttcccttaagagttacattt

SEQ ID NO: 1115214 - DNA, 22 bp, Artificial Sequence
  chemically synthesized
tttcccttaagagttacatttt

SEQ ID NO: 1115215 - DNA, 22 bp, Artificial Sequence
  chemically synthesized
catttgtggttcaaaatgtaac

SEQ ID NO: 1115216 - DNA, 22 bp, Artificial Sequence
  chemically synthesized
gcatttgtggttcaaaatgtaa

SEQ ID NO: 1115217 - DNA, 22 bp, Artificial Sequence
  chemically synthesized
tgcatttgtggttcaaaatgta

SEQ ID NO: 1115218 - DNA, 22 bp, Artificial Sequence
  chemically synthesized
cccttaagagttacattttgaa

SEQ ID NO: 1115219 - DNA, 22 bp, Artificial Sequence
  chemically synthesized
ccttaagagttacattttgaac

SEQ ID NO: 1115220 - DNA, 22 bp, Artificial Sequence
  chemically synthesized
aagagttacattttgaaccaca

SEQ ID NO: 1115221 - DNA, 22 bp, Artificial Sequence
  chemically synthesized
agagttacattttgaaccacaa

SEQ ID NO: 1115222 - DNA, 22 bp, Artificial Sequence
  chemically synthesized
aaataattttgcatttgtggtt

SEQ ID NO: 1115223 - DNA, 22 bp, Artificial Sequence
  chemically synthesized
actgaaataattttgcatttgt

SEQ ID NO: 1115224 - DNA, 22 bp, Artificial Sequence
  chemically synthesized
cattttgaaccacaaatgcaaa

SEQ ID NO: 1115225 - DNA, 22 bp, Artificial Sequence
  chemically synthesized
ttaactgaaataattttgcatt

SEQ ID NO: 1115226 - DNA, 22 bp, Artificial Sequence
  chemically synthesized
tgaaccacaaatgcaaaattat

SEQ ID NO: 1115227 - DNA, 22 bp, Artificial Sequence
  chemically synthesized
ttgttaactgaaataattttgc

SEQ ID NO: 1115228 - DNA, 22 bp, Artificial Sequence
  chemically synthesized
gaaccacaaatgcaaaattatt

SEQ ID NO: 1115229 - DNA, 22 bp, Artificial Sequence
  chemically synthesized
aaccacaaatgcaaaattattt

SEQ ID NO: 1115230 - DNA, 22 bp, Artificial Sequence
  chemically synthesized
gctattgttaactgaaataatt

SEQ ID NO: 1115231 - DNA, 22 bp, Artificial Sequence
  chemically synthesized
tggctattgttaactgaaataa

SEQ ID NO: 1115232 - DNA, 22 bp, Artificial Sequence
  chemically synthesized
tttcagttaacaatagccagaa

SEQ ID NO: 1115233 - DNA, 22 bp, Artificial Sequence
  chemically synthesized
aatagtatgaaattctggctat

SEQ ID NO: 1115234 - DNA, 22 bp, Artificial Sequence
  chemically synthesized
cagttaacaatagccagaattt

SEQ ID NO: 1115235 - DNA, 22 bp, Artificial Sequence
  chemically synthesized
agttaacaatagccagaatttc

SEQ ID NO: 1115236 - DNA, 22 bp, Artificial Sequence
  chemically synthesized
aactcaatagtatgaaattctg

SEQ ID NO: 1115237 - DNA, 22 bp, Artificial Sequence
  chemically synthesized
acaatagccagaatttcatact

SEQ ID NO: 1115238 - DNA, 22 bp, Artificial Sequence
  chemically synthesized
gctaaactcaatagtatgaaat

SEQ ID NO: 1115239 - DNA, 22 bp, Artificial Sequence
  chemically synthesized
ttagctaaactcaatagtatga

SEQ ID NO: 1115240 - DNA, 22 bp, Artificial Sequence
  chemically synthesized
catactattgagtttagctaat

SEQ ID NO: 1115241 - DNA, 22 bp, Artificial Sequence
  chemically synthesized
cataggaatattattagctaaa

SEQ ID NO: 1115242 - DNA, 22 bp, Artificial Sequence
  chemically synthesized
atactattgagtttagctaata

SEQ ID NO: 1115243 - DNA, 22 bp, Artificial Sequence
  chemically synthesized
tgtctccataggaatattatta

SEQ ID NO: 1115244 - DNA, 22 bp, Artificial Sequence
  chemically synthesized
ttgagtttagctaataatattc

SEQ ID NO: 1115245 - DNA, 22 bp, Artificial Sequence
  chemically synthesized
atgtctccataggaatattatt

SEQ ID NO: 1115246 - DNA, 22 bp, Artificial Sequence
  chemically synthesized
agtttagctaataatattccta

SEQ ID NO: 1115247 - DNA, 22 bp, Artificial Sequence
  chemically synthesized
aaatttatgtctccataggaat

SEQ ID NO: 1115248 - DNA, 22 bp, Artificial Sequence
  chemically synthesized
aaaatttatgtctccataggaa

SEQ ID NO: 1115249 - DNA, 22 bp, Artificial Sequence
  chemically synthesized
agctaataatattcctatggag

SEQ ID NO: 1115250 - DNA, 22 bp, Artificial Sequence
  chemically synthesized
gctaataatattcctatggaga

SEQ ID NO: 1115251 - DNA, 22 bp, Artificial Sequence
  chemically synthesized
ataatattcctatggagacata

SEQ ID NO: 1115252 - DNA, 22 bp, Artificial Sequence
  chemically synthesized
tcatagtttaaaatttatgtct

SEQ ID NO: 1115253 - DNA, 22 bp, Artificial Sequence
  chemically synthesized
tgtcatagtttaaaatttatgt

SEQ ID NO: 1115254 - DNA, 22 bp, Artificial Sequence
  chemically synthesized
ctctgtcatagtttaaaattta

SEQ ID NO: 1115255 - DNA, 22 bp, Artificial Sequence
  chemically synthesized
ctatggagacataaattttaaa

SEQ ID NO: 1115256 - DNA, 22 bp, Artificial Sequence
  chemically synthesized
tactctgtcatagtttaaaatt

SEQ ID NO: 1115257 - DNA, 22 bp, Artificial Sequence
  chemically synthesized
tggagacataaattttaaacta

SEQ ID NO: 1115258 - DNA, 22 bp, Artificial Sequence
  chemically synthesized
tagtaatgtagttctactctgt

SEQ ID NO: 1115259 - DNA, 22 bp, Artificial Sequence
  chemically synthesized
taaactatgacagagtagaact

SEQ ID NO: 1115260 - DNA, 22 bp, Artificial Sequence
  chemically synthesized
aaactatgacagagtagaacta

SEQ ID NO: 1115261 - DNA, 22 bp, Artificial Sequence
  chemically synthesized
aactatgacagagtagaactac

SEQ ID NO: 1115262 - DNA, 22 bp, Artificial Sequence
  chemically synthesized
atgattatagtaatgtagttct

SEQ ID NO: 1115263 - DNA, 22 bp, Artificial Sequence
  chemically synthesized
gatgattatagtaatgtagttc

SEQ ID NO: 1115264 - DNA, 22 bp, Artificial Sequence
  chemically synthesized
tgacagagtagaactacattac

SEQ ID NO: 1115265 - DNA, 22 bp, Artificial Sequence
  chemically synthesized
ttgatgattatagtaatgtagt

SEQ ID NO: 1115266 - DNA, 22 bp, Artificial Sequence
  chemically synthesized
cttgatgattatagtaatgtag

SEQ ID NO: 1115267 - DNA, 22 bp, Artificial Sequence
  chemically synthesized
tagtcaacacttcttgatgatt

SEQ ID NO: 1115268 - DNA, 22 bp, Artificial Sequence
  chemically synthesized
cattactataatcatcaagaag

SEQ ID NO: 1115269 - DNA, 22 bp, Artificial Sequence
  chemically synthesized
ttatagtcaacacttcttgatg

SEQ ID NO: 1115270 - DNA, 22 bp, Artificial Sequence
  chemically synthesized
ctataatcatcaagaagtgttg

SEQ ID NO: 1115271 - DNA, 22 bp, Artificial Sequence
  chemically synthesized
taatcatcaagaagtgttgact

SEQ ID NO: 1115272 - DNA, 22 bp, Artificial Sequence
  chemically synthesized
ggacatacacattgttatagtc

SEQ ID NO: 1115273 - DNA, 22 bp, Artificial Sequence
  chemically synthesized
aggacatacacattgttatagt

SEQ ID NO: 1115274 - DNA, 22 bp, Artificial Sequence
  chemically synthesized
taggacatacacattgttatag

SEQ ID NO: 1115275 - DNA, 22 bp, Artificial Sequence
  chemically synthesized
tgttttaggacatacacattgt

SEQ ID NO: 1115276 - DNA, 22 bp, Artificial Sequence
  chemically synthesized
actataacaatgtgtatgtcct

SEQ ID NO: 1115277 - DNA, 22 bp, Artificial Sequence
  chemically synthesized
aatagttatgttttaggacata

SEQ ID NO: 1115278 - DNA, 22 bp, Artificial Sequence
  chemically synthesized
gaatagttatgttttaggacat

SEQ ID NO: 1115279 - DNA, 22 bp, Artificial Sequence
  chemically synthesized
taacaatgtgtatgtcctaaaa

SEQ ID NO: 1115280 - DNA, 22 bp, Artificial Sequence
  chemically synthesized
tttgaatagttatgttttagga

SEQ ID NO: 1115281 - DNA, 22 bp, Artificial Sequence
  chemically synthesized
tagttatttgaatagttatgtt

SEQ ID NO: 1115282 - DNA, 22 bp, Artificial Sequence
  chemically synthesized
cgttatagttatttgaatagtt

SEQ ID NO: 1115283 - DNA, 22 bp, Artificial Sequence
  chemically synthesized
attgcgttatagttatttgaat

SEQ ID NO: 1115284 - DNA, 22 bp, Artificial Sequence
  chemically synthesized
aattgcgttatagttatttgaa

SEQ ID NO: 1115285 - DNA, 22 bp, Artificial Sequence
  chemically synthesized
aaacataactattcaaataact

SEQ ID NO: 1115286 - DNA, 22 bp, Artificial Sequence
  chemically synthesized
taattgcgttatagttatttga

SEQ ID NO: 1115287 - DNA, 22 bp, Artificial Sequence
  chemically synthesized
tattttaattgcgttatagtta

SEQ ID NO: 1115288 - DNA, 22 bp, Artificial Sequence
  chemically synthesized
ctatattttaattgcgttatag

SEQ ID NO: 1115289 - DNA, 22 bp, Artificial Sequence
  chemically synthesized
actatattttaattgcgttata

SEQ ID NO: 1115290 - DNA, 22 bp, Artificial Sequence
  chemically synthesized
ttcaaataactataacgcaatt

SEQ ID NO: 1115291 - DNA, 22 bp, Artificial Sequence
  chemically synthesized
ttactatattttaattgcgtta

SEQ ID NO: 1115292 - DNA, 22 bp, Artificial Sequence
  chemically synthesized
aaataactataacgcaattaaa

SEQ ID NO: 1115293 - DNA, 22 bp, Artificial Sequence
  chemically synthesized
ttcttactatattttaattgcg

SEQ ID NO: 1115294 - DNA, 22 bp, Artificial Sequence
  chemically synthesized
taacgcaattaaaatatagtaa

SEQ ID NO: 1115295 - DNA, 22 bp, Artificial Sequence
  chemically synthesized
agtcacaggtgtgttgttctta

SEQ ID NO: 1115296 - DNA, 22 bp, Artificial Sequence
  chemically synthesized
ttaagtcacaggtgtgttgttc

SEQ ID NO: 1115297 - DNA, 22 bp, Artificial Sequence
  chemically synthesized
aaatatagtaagaacaacacac

SEQ ID NO: 1115298 - DNA, 22 bp, Artificial Sequence
  chemically synthesized
taatatgattgttaagtcacag

SEQ ID NO: 1115299 - DNA, 22 bp, Artificial Sequence
  chemically synthesized
ttataatatgattgttaagtca

SEQ ID NO: 1115300 - DNA, 22 bp, Artificial Sequence
  chemically synthesized
gttataatatgattgttaagtc

SEQ ID NO: 1115301 - DNA, 22 bp, Artificial Sequence
  chemically synthesized
tgttataatatgattgttaagt

SEQ ID NO: 1115302 - DNA, 22 bp, Artificial Sequence
  chemically synthesized
tgacttaacaatcatattataa

SEQ ID NO: 1115303 - DNA, 22 bp, Artificial Sequence
  chemically synthesized
aagagaaatctttgttataata

SEQ ID NO: 1115304 - DNA, 22 bp, Artificial Sequence
  chemically synthesized
aacaatcatattataacaaaga

SEQ ID NO: 1115305 - DNA, 22 bp, Artificial Sequence
  chemically synthesized
acaatcatattataacaaagat

SEQ ID NO: 1115306 - DNA, 22 bp, Artificial Sequence
  chemically synthesized
aaattcaagagaaatctttgtt

SEQ ID NO: 1115307 - DNA, 22 bp, Artificial Sequence
  chemically synthesized
cctcaaattcaagagaaatctt

SEQ ID NO: 1115308 - DNA, 22 bp, Artificial Sequence
  chemically synthesized
tgcctcaaattcaagagaaatc

SEQ ID NO: 1115309 - DNA, 22 bp, Artificial Sequence
  chemically synthesized
ctgcctcaaattcaagagaaat

SEQ ID NO: 1115310 - DNA, 22 bp, Artificial Sequence
  chemically synthesized
taacaaagatttctcttgaatt

SEQ ID NO: 1115311 - DNA, 22 bp, Artificial Sequence
  chemically synthesized
atgtagaataaccttctgcctc

SEQ ID NO: 1115312 - DNA, 22 bp, Artificial Sequence
  chemically synthesized
ctcttgaatttgaggcagaagg

SEQ ID NO: 1115313 - DNA, 22 bp, Artificial Sequence
  chemically synthesized
tcttgaatttgaggcagaaggt

SEQ ID NO: 1115314 - DNA, 22 bp, Artificial Sequence
  chemically synthesized
ttgaatttgaggcagaaggtta

SEQ ID NO: 1115315 - DNA, 22 bp, Artificial Sequence
  chemically synthesized
gaatttgaggcagaaggttatt

SEQ ID NO: 1115316 - DNA, 22 bp, Artificial Sequence
  chemically synthesized
aatttgaggcagaaggttattc

SEQ ID NO: 1115317 - DNA, 22 bp, Artificial Sequence
  chemically synthesized
gaggcagaaggttattctacat

SEQ ID NO: 1115318 - DNA, 22 bp, Artificial Sequence
  chemically synthesized
aaaaatagtctcatgtagaata

SEQ ID NO: 1115319 - DNA, 22 bp, Artificial Sequence
  chemically synthesized
aggcagaaggttattctacatg

SEQ ID NO: 1115320 - DNA, 22 bp, Artificial Sequence
  chemically synthesized
aaaaaatagtctcatgtagaat

SEQ ID NO: 1115321 - DNA, 22 bp, Artificial Sequence
  chemically synthesized
ttctacatgagactatttttta

SEQ ID NO: 1115322 - DNA, 22 bp, Artificial Sequence
  chemically synthesized
tacatgagactattttttaaga

SEQ ID NO: 1115323 - DNA, 22 bp, Artificial Sequence
  chemically synthesized
catgagactattttttaagact

SEQ ID NO: 1115324 - DNA, 22 bp, Artificial Sequence
  chemically synthesized
tggatgtaaatgaagtcttaaa

SEQ ID NO: 1115325 - DNA, 22 bp, Artificial Sequence
  chemically synthesized
aatgcctgtggatgtaaatgaa

SEQ ID NO: 1115326 - DNA, 22 bp, Artificial Sequence
  chemically synthesized
ttttttaagacttcatttacat

SEQ ID NO: 1115327 - DNA, 22 bp, Artificial Sequence
  chemically synthesized
aaatgcctgtggatgtaaatga

SEQ ID NO: 1115328 - DNA, 22 bp, Artificial Sequence
  chemically synthesized
taaatgcctgtggatgtaaatg

SEQ ID NO: 1115329 - DNA, 22 bp, Artificial Sequence
  chemically synthesized
ttaaatgcctgtggatgtaaat

SEQ ID NO: 1115330 - DNA, 22 bp, Artificial Sequence
  chemically synthesized
tttaagacttcatttacatcca

SEQ ID NO: 1115331 - DNA, 22 bp, Artificial Sequence
  chemically synthesized
tttaaatgcctgtggatgtaaa

SEQ ID NO: 1115332 - DNA, 22 bp, Artificial Sequence
  chemically synthesized
ttaagacttcatttacatccac

SEQ ID NO: 1115333 - DNA, 22 bp, Artificial Sequence
  chemically synthesized
ttttaaatgcctgtggatgtaa

SEQ ID NO: 1115334 - DNA, 22 bp, Artificial Sequence
  chemically synthesized
taagacttcatttacatccaca

SEQ ID NO: 1115335 - DNA, 22 bp, Artificial Sequence
  chemically synthesized
aagacttcatttacatccacag

SEQ ID NO: 1115336 - DNA, 22 bp, Artificial Sequence
  chemically synthesized
agacttcatttacatccacagg

SEQ ID NO: 1115337 - DNA, 22 bp, Artificial Sequence
  chemically synthesized
catttacatccacaggcattta

SEQ ID NO: 1115338 - DNA, 22 bp, Artificial Sequence
  chemically synthesized
gaaatatttttttaaatgcctg

SEQ ID NO: 1115339 - DNA, 22 bp, Artificial Sequence
  chemically synthesized
atttacatccacaggcatttaa

SEQ ID NO: 1115340 - DNA, 22 bp, Artificial Sequence
  chemically synthesized
cctggaaatatttttttaaatg

SEQ ID NO: 1115341 - DNA, 22 bp, Artificial Sequence
  chemically synthesized
acatccacaggcatttaaaaaa

SEQ ID NO: 1115342 - DNA, 22 bp, Artificial Sequence
  chemically synthesized
acctggaaatatttttttaaat

SEQ ID NO: 1115343 - DNA, 22 bp, Artificial Sequence
  chemically synthesized
catccacaggcatttaaaaaaa

SEQ ID NO: 1115344 - DNA, 22 bp, Artificial Sequence
  chemically synthesized
tacctggaaatatttttttaaa

SEQ ID NO: 1115345 - DNA, 22 bp, Artificial Sequence
  chemically synthesized
cagtattttacctggaaatatt

SEQ ID NO: 1115346 - DNA, 22 bp, Artificial Sequence
  chemically synthesized
tactccagtattttacctggaa

SEQ ID NO: 1115347 - DNA, 22 bp, Artificial Sequence
  chemically synthesized
aaaaaaatatttccaggtaaaa

SEQ ID NO: 1115348 - DNA, 22 bp, Artificial Sequence
  chemically synthesized
aaaaaatatttccaggtaaaat

SEQ ID NO: 1115349 - DNA, 22 bp, Artificial Sequence
  chemically synthesized
ccatctgtactccagtatttta

SEQ ID NO: 1115350 - DNA, 22 bp, Artificial Sequence
  chemically synthesized
ccctcccatctgtactccagta

SEQ ID NO: 1115351 - DNA, 22 bp, Artificial Sequence
  chemically synthesized
gccctcccatctgtactccagt

SEQ ID NO: 1115352 - DNA, 22 bp, Artificial Sequence
  chemically synthesized
ccaggtaaaatactggagtaca

SEQ ID NO: 1115353 - DNA, 22 bp, Artificial Sequence
  chemically synthesized
caggtaaaatactggagtacag

SEQ ID NO: 1115354 - DNA, 22 bp, Artificial Sequence
  chemically synthesized
tttgccctcccatctgtactcc

SEQ ID NO: 1115355 - DNA, 22 bp, Artificial Sequence
  chemically synthesized
ttatttgccctcccatctgtac

SEQ ID NO: 1115356 - DNA, 22 bp, Artificial Sequence
  chemically synthesized
gagtacagatgggagggcaaat

SEQ ID NO: 1115357 - DNA, 22 bp, Artificial Sequence
  chemically synthesized
tccatgtatctgttatttgccc

SEQ ID NO: 1115358 - DNA, 22 bp, Artificial Sequence
  chemically synthesized
aacagtggtgcagactgtccat

SEQ ID NO: 1115359 - DNA, 22 bp, Artificial Sequence
  chemically synthesized
tactcaacagtggtgcagactg

SEQ ID NO: 1115360 - DNA, 22 bp, Artificial Sequence
  chemically synthesized
atactcaacagtggtgcagact

SEQ ID NO: 1115361 - DNA, 22 bp, Artificial Sequence
  chemically synthesized
cacaaatttatactcaacagtg

SEQ ID NO: 1115362 - DNA, 22 bp, Artificial Sequence
  chemically synthesized
catccctgcacaaatttatact

SEQ ID NO: 1115363 - DNA, 22 bp, Artificial Sequence
  chemically synthesized
caccactgttgagtataaattt

SEQ ID NO: 1115364 - DNA, 22 bp, Artificial Sequence
  chemically synthesized
ccatccctgcacaaatttatac

SEQ ID NO: 1115365 - DNA, 22 bp, Artificial Sequence
  chemically synthesized
ttgagtataaatttgtgcaggg

SEQ ID NO: 1115366 - DNA, 22 bp, Artificial Sequence
  chemically synthesized
agtataaatttgtgcagggatg

SEQ ID NO: 1115367 - DNA, 22 bp, Artificial Sequence
  chemically synthesized
gtgcagggatggaaatgatctg

SEQ ID NO: 1115368 - DNA, 22 bp, Artificial Sequence
  chemically synthesized
tgcagggatggaaatgatctgt

SEQ ID NO: 1115369 - DNA, 22 bp, Artificial Sequence
  chemically synthesized
gatgacacagatacagatcatt

SEQ ID NO: 1115370 - DNA, 22 bp, Artificial Sequence
  chemically synthesized
tcatattggatgacacagatac

SEQ ID NO: 1115371 - DNA, 22 bp, Artificial Sequence
  chemically synthesized
gctatcatattggatgacacag

SEQ ID NO: 1115372 - DNA, 22 bp, Artificial Sequence
  chemically synthesized
ttggctatcatattggatgaca

SEQ ID NO: 1115373 - DNA, 22 bp, Artificial Sequence
  chemically synthesized
tatctgtgtcatccaatatgat

SEQ ID NO: 1115374 - DNA, 22 bp, Artificial Sequence
  chemically synthesized
tgtcatccaatatgatagccaa

SEQ ID NO: 1115375 - DNA, 22 bp, Artificial Sequence
  chemically synthesized
aatacccacatgtggttattgg

SEQ ID NO: 1115376 - DNA, 22 bp, Artificial Sequence
  chemically synthesized
aagtgctgaatacccacatgtg

SEQ ID NO: 1115377 - DNA, 22 bp, Artificial Sequence
  chemically synthesized
caagtgctgaatacccacatgt

SEQ ID NO: 1115378 - DNA, 22 bp, Artificial Sequence
  chemically synthesized
tcaagtgctgaatacccacatg

SEQ ID NO: 1115379 - DNA, 22 bp, Artificial Sequence
  chemically synthesized
accacctttcaagtgctgaata

SEQ ID NO: 1115380 - DNA, 22 bp, Artificial Sequence
  chemically synthesized
aagtcatgctgaccacctttca

SEQ ID NO: 1115381 - DNA, 22 bp, Artificial Sequence
  chemically synthesized
caagtcatgctgaccacctttc

SEQ ID NO: 1115382 - DNA, 22 bp, Artificial Sequence
  chemically synthesized
tcaagtcatgctgaccaccttt

SEQ ID NO: 1115383 - DNA, 22 bp, Artificial Sequence
  chemically synthesized
ttttcaagtcatgctgaccacc

SEQ ID NO: 1115384 - DNA, 22 bp, Artificial Sequence
  chemically synthesized
agcacttgaaaggtggtcagca

SEQ ID NO: 1115385 - DNA, 22 bp, Artificial Sequence
  chemically synthesized
attttcaagtcatgctgaccac

SEQ ID NO: 1115386 - DNA, 22 bp, Artificial Sequence
  chemically synthesized
tattttcaagtcatgctgacca

SEQ ID NO: 1115387 - DNA, 22 bp, Artificial Sequence
  chemically synthesized
ttattttcaagtcatgctgacc

SEQ ID NO: 1115388 - DNA, 22 bp, Artificial Sequence
  chemically synthesized
ttttattttcaagtcatgctga

SEQ ID NO: 1115389 - DNA, 22 bp, Artificial Sequence
  chemically synthesized
gaaaggtggtcagcatgacttg

SEQ ID NO: 1115390 - DNA, 22 bp, Artificial Sequence
  chemically synthesized
aaaggtggtcagcatgacttga

SEQ ID NO: 1115391 - DNA, 22 bp, Artificial Sequence
  chemically synthesized
aatattcttttattttcaagtc

SEQ ID NO: 1115392 - DNA, 22 bp, Artificial Sequence
  chemically synthesized
aattaaatattcttttattttc

SEQ ID NO: 1115393 - DNA, 22 bp, Artificial Sequence
  chemically synthesized
gattaaattaaatattctttta

SEQ ID NO: 1115394 - DNA, 22 bp, Artificial Sequence
  chemically synthesized
gaaaataaaagaatatttaatt

SEQ ID NO: 1115395 - DNA, 22 bp, Artificial Sequence
  chemically synthesized
aaaataaaagaatatttaattt

SEQ ID NO: 1115396 - DNA, 22 bp, Artificial Sequence
  chemically synthesized
aaataaataaaattagattaaa

SEQ ID NO: 1115397 - DNA, 22 bp, Artificial Sequence
  chemically synthesized
aaaataaataaaattagattaa

SEQ ID NO: 1115398 - DNA, 22 bp, Artificial Sequence
  chemically synthesized
tttaaaataaataaaattagat

SEQ ID NO: 1115399 - DNA, 22 bp, Artificial Sequence
  chemically synthesized
aattatttaaaataaataaaat

SEQ ID NO: 1115400 - DNA, 22 bp, Artificial Sequence
  chemically synthesized
aatttaatctaattttatttat

SEQ ID NO: 1115401 - DNA, 22 bp, Artificial Sequence
  chemically synthesized
aaattatttaaaataaataaaa

SEQ ID NO: 1115402 - DNA, 22 bp, Artificial Sequence
  chemically synthesized
atttaatctaattttatttatt

SEQ ID NO: 1115403 - DNA, 22 bp, Artificial Sequence
  chemically synthesized
taaattatttaaaataaataaa

SEQ ID NO: 1115404 - DNA, 22 bp, Artificial Sequence
  chemically synthesized
aatctaattttatttattttaa

SEQ ID NO: 1115405 - DNA, 22 bp, Artificial Sequence
  chemically synthesized
atctaattttatttattttaaa

SEQ ID NO: 1115406 - DNA, 22 bp, Artificial Sequence
  chemically synthesized
aattttaaattatttaaaataa

SEQ ID NO: 1115407 - DNA, 22 bp, Artificial Sequence
  chemically synthesized
aaattttaaattatttaaaata

SEQ ID NO: 1115408 - DNA, 22 bp, Artificial Sequence
  chemically synthesized
taaattttaaattatttaaaat

SEQ ID NO: 1115409 - DNA, 22 bp, Artificial Sequence
  chemically synthesized
attttatttattttaaataatt

SEQ ID NO: 1115410 - DNA, 22 bp, Artificial Sequence
  chemically synthesized
tatttattttaaataatttaaa

SEQ ID NO: 1115411 - DNA, 22 bp, Artificial Sequence
  chemically synthesized
atttattttaaataatttaaaa

SEQ ID NO: 1115412 - DNA, 22 bp, Artificial Sequence
  chemically synthesized
tttattttaaataatttaaaat

SEQ ID NO: 1115413 - DNA, 22 bp, Artificial Sequence
  chemically synthesized
attttaaataatttaaaattta

SEQ ID NO: 1115414 - DNA, 22 bp, Artificial Sequence
  chemically synthesized
ttttaaataatttaaaatttaa

SEQ ID NO: 1115415 - DNA, 22 bp, Artificial Sequence
  chemically synthesized
gtcacatgtaacctttaaattt

SEQ ID NO: 1115416 - DNA, 22 bp, Artificial Sequence
  chemically synthesized
taaataatttaaaatttaaagg

SEQ ID NO: 1115417 - DNA, 22 bp, Artificial Sequence
  chemically synthesized
aaataatttaaaatttaaaggt

SEQ ID NO: 1115418 - DNA, 22 bp, Artificial Sequence
  chemically synthesized
aataatttaaaatttaaaggtt

SEQ ID NO: 1115419 - DNA, 22 bp, Artificial Sequence
  chemically synthesized
acactggtcacatgtaaccttt

SEQ ID NO: 1115420 - DNA, 22 bp, Artificial Sequence
  chemically synthesized
aaaatttaaaggttacatgtga

SEQ ID NO: 1115421 - DNA, 22 bp, Artificial Sequence
  chemically synthesized
aaatttaaaggttacatgtgac

SEQ ID NO: 1115422 - DNA, 22 bp, Artificial Sequence
  chemically synthesized
aaaggttacatgtgaccagtgt

SEQ ID NO: 1115423 - DNA, 22 bp, Artificial Sequence
  chemically synthesized
aaggttacatgtgaccagtgtt

SEQ ID NO: 1115424 - DNA, 22 bp, Artificial Sequence
  chemically synthesized
tacaatcacagttaacactggt

SEQ ID NO: 1115425 - DNA, 22 bp, Artificial Sequence
  chemically synthesized
cgctgtacaatcacagttaaca

SEQ ID NO: 1115426 - DNA, 22 bp, Artificial Sequence
  chemically synthesized
catgtgaccagtgttaactgtg

SEQ ID NO: 1115427 - DNA, 22 bp, Artificial Sequence
  chemically synthesized
gatctgcgctgtacaatcacag

SEQ ID NO: 1115428 - DNA, 22 bp, Artificial Sequence
  chemically synthesized
actgtgattgtacagcgcagat

SEQ ID NO: 1115429 - DNA, 22 bp, Artificial Sequence
  chemically synthesized
aaggaatgtattagatctgcgc

SEQ ID NO: 1115430 - DNA, 22 bp, Artificial Sequence
  chemically synthesized
aaaggaatgtattagatctgcg

SEQ ID NO: 1115431 - DNA, 22 bp, Artificial Sequence
  chemically synthesized
tgattgtacagcgcagatctaa

SEQ ID NO: 1115432 - DNA, 22 bp, Artificial Sequence
  chemically synthesized
taaaggaatgtattagatctgc

SEQ ID NO: 1115433 - DNA, 22 bp, Artificial Sequence
  chemically synthesized
ttaaaggaatgtattagatctg

SEQ ID NO: 1115434 - DNA, 22 bp, Artificial Sequence
  chemically synthesized
cttttaaaggaatgtattagat

SEQ ID NO: 1115435 - DNA, 22 bp, Artificial Sequence
  chemically synthesized
gcttttaaaggaatgtattaga

SEQ ID NO: 1115436 - DNA, 22 bp, Artificial Sequence
  chemically synthesized
tacagcgcagatctaatacatt

SEQ ID NO: 1115437 - DNA, 22 bp, Artificial Sequence
  chemically synthesized
tttgcttttaaaggaatgtatt

SEQ ID NO: 1115438 - DNA, 22 bp, Artificial Sequence
  chemically synthesized
actatttgcttttaaaggaatg

SEQ ID NO: 1115439 - DNA, 22 bp, Artificial Sequence
  chemically synthesized
aactatttgcttttaaaggaat

SEQ ID NO: 1115440 - DNA, 22 bp, Artificial Sequence
  chemically synthesized
ttaactatttgcttttaaagga

SEQ ID NO: 1115441 - DNA, 22 bp, Artificial Sequence
  chemically synthesized
tctcttaactatttgcttttaa

SEQ ID NO: 1115442 - DNA, 22 bp, Artificial Sequence
  chemically synthesized
atacattcctttaaaagcaaat

SEQ ID NO: 1115443 - DNA, 22 bp, Artificial Sequence
  chemically synthesized
caggcctatctcttaactattt

SEQ ID NO: 1115444 - DNA, 22 bp, Artificial Sequence
  chemically synthesized
ctttaaaagcaaatagttaaga

SEQ ID NO: 1115445 - DNA, 22 bp, Artificial Sequence
  chemically synthesized
taaaagcaaatagttaagagat

SEQ ID NO: 1115446 - DNA, 22 bp, Artificial Sequence
  chemically synthesized
aaaagcaaatagttaagagata

SEQ ID NO: 1115447 - DNA, 22 bp, Artificial Sequence
  chemically synthesized
ggattacaggcctatctcttaa

SEQ ID NO: 1115448 - DNA, 22 bp, Artificial Sequence
  chemically synthesized
aaagcaaatagttaagagatag

SEQ ID NO: 1115449 - DNA, 22 bp, Artificial Sequence
  chemically synthesized
agtagctcggattacaggccta

SEQ ID NO: 1115450 - DNA, 22 bp, Artificial Sequence
  chemically synthesized
tgagtagctcggattacaggcc

SEQ ID NO: 1115451 - DNA, 22 bp, Artificial Sequence
  chemically synthesized
ctgagtagctcggattacaggc

SEQ ID NO: 1115452 - DNA, 22 bp, Artificial Sequence
  chemically synthesized
agagataggcctgtaatccgag

SEQ ID NO: 1115453 - DNA, 22 bp, Artificial Sequence
  chemically synthesized
cccaggccttctgagtagctcg

SEQ ID NO: 1115454 - DNA, 22 bp, Artificial Sequence
  chemically synthesized
ctgcccaggccttctgagtagc

SEQ ID NO: 1115455 - DNA, 22 bp, Artificial Sequence
  chemically synthesized
cctgcccaggccttctgagtag

SEQ ID NO: 1115456 - DNA, 22 bp, Artificial Sequence
  chemically synthesized
taatccgagctactcagaaggc

SEQ ID NO: 1115457 - DNA, 22 bp, Artificial Sequence
  chemically synthesized
aagcagtcttcctgcccaggcc

SEQ ID NO: 1115458 - DNA, 22 bp, Artificial Sequence
  chemically synthesized
ctcagaaggcctgggcaggaag

SEQ ID NO: 1115459 - DNA, 22 bp, Artificial Sequence
  chemically synthesized
gactgaagcagtcttcctgccc

SEQ ID NO: 1115460 - DNA, 22 bp, Artificial Sequence
  chemically synthesized
agaaggcctgggcaggaagact

SEQ ID NO: 1115461 - DNA, 22 bp, Artificial Sequence
  chemically synthesized
aaatccctggactgaagcagtc

SEQ ID NO: 1115462 - DNA, 22 bp, Artificial Sequence
  chemically synthesized
ggcaggaagactgcttcagtcc

SEQ ID NO: 1115463 - DNA, 22 bp, Artificial Sequence
  chemically synthesized
atctcaaatccctggactgaag

SEQ ID NO: 1115464 - DNA, 22 bp, Artificial Sequence
  chemically synthesized
ggctgatctcaaatccctggac

SEQ ID NO: 1115465 - DNA, 22 bp, Artificial Sequence
  chemically synthesized
cctaggctgatctcaaatccct

SEQ ID NO: 1115466 - DNA, 22 bp, Artificial Sequence
  chemically synthesized
gcctaggctgatctcaaatccc

SEQ ID NO: 1115467 - DNA, 22 bp, Artificial Sequence
  chemically synthesized
tgcctaggctgatctcaaatcc

SEQ ID NO: 1115468 - DNA, 22 bp, Artificial Sequence
  chemically synthesized
cttcagtccagggatttgagat

SEQ ID NO: 1115469 - DNA, 22 bp, Artificial Sequence
  chemically synthesized
cagtccagggatttgagatcag

SEQ ID NO: 1115470 - DNA, 22 bp, Artificial Sequence
  chemically synthesized
agtccagggatttgagatcagc

SEQ ID NO: 1115471 - DNA, 22 bp, Artificial Sequence
  chemically synthesized
gattttgcctaggctgatctca

SEQ ID NO: 1115472 - DNA, 22 bp, Artificial Sequence
  chemically synthesized
tcgattttgcctaggctgatct

SEQ ID NO: 1115473 - DNA, 22 bp, Artificial Sequence
  chemically synthesized
gagatcagcctaggcaaaatcg

SEQ ID NO: 1115474 - DNA, 22 bp, Artificial Sequence
  chemically synthesized
agatcagcctaggcaaaatcga

SEQ ID NO: 1115475 - DNA, 22 bp, Artificial Sequence
  chemically synthesized
gagatggaggtctctcgatttt

SEQ ID NO: 1115476 - DNA, 22 bp, Artificial Sequence
  chemically synthesized
agagatggaggtctctcgattt

SEQ ID NO: 1115477 - DNA, 22 bp, Artificial Sequence
  chemically synthesized
tttagagatggaggtctctcga

SEQ ID NO: 1115478 - DNA, 22 bp, Artificial Sequence
  chemically synthesized
gtttagagatggaggtctctcg

SEQ ID NO: 1115479 - DNA, 22 bp, Artificial Sequence
  chemically synthesized
tttgtttagagatggaggtctc

SEQ ID NO: 1115480 - DNA, 22 bp, Artificial Sequence
  chemically synthesized
ggcaaaatcgagagacctccat

SEQ ID NO: 1115481 - DNA, 22 bp, Artificial Sequence
  chemically synthesized
aaattgtttgtttagagatgga

SEQ ID NO: 1115482 - DNA, 22 bp, Artificial Sequence
  chemically synthesized
aaaattgtttgtttagagatgg

SEQ ID NO: 1115483 - DNA, 22 bp, Artificial Sequence
  chemically synthesized
taaaattgtttgtttagagatg

SEQ ID NO: 1115484 - DNA, 22 bp, Artificial Sequence
  chemically synthesized
ttaaaattgtttgtttagagat

SEQ ID NO: 1115485 - DNA, 22 bp, Artificial Sequence
  chemically synthesized
tttaaaattgtttgtttagaga

SEQ ID NO: 1115486 - DNA, 22 bp, Artificial Sequence
  chemically synthesized
attttttaaaattgtttgttta

SEQ ID NO: 1115487 - DNA, 22 bp, Artificial Sequence
  chemically synthesized
actaattttttaaaattgtttg

SEQ ID NO: 1115488 - DNA, 22 bp, Artificial Sequence
  chemically synthesized
catctctaaacaaacaatttta

SEQ ID NO: 1115489 - DNA, 22 bp, Artificial Sequence
  chemically synthesized
taaacaaacaattttaaaaaat

SEQ ID NO: 1115490 - DNA, 22 bp, Artificial Sequence
  chemically synthesized
aacaaacaattttaaaaaatta

SEQ ID NO: 1115491 - DNA, 22 bp, Artificial Sequence
  chemically synthesized
tcaccacgcctgactaattttt

SEQ ID NO: 1115492 - DNA, 22 bp, Artificial Sequence
  chemically synthesized
ctgtcaccacgcctgactaatt

SEQ ID NO: 1115493 - DNA, 22 bp, Artificial Sequence
  chemically synthesized
taaaaaattagtcaggcgtggt

SEQ ID NO: 1115494 - DNA, 22 bp, Artificial Sequence
  chemically synthesized
caggctcctgtcaccacgcctg

SEQ ID NO: 1115495 - DNA, 22 bp, Artificial Sequence
  chemically synthesized
aaaaaattagtcaggcgtggtg

SEQ ID NO: 1115496 - DNA, 22 bp, Artificial Sequence
  chemically synthesized
aaaaattagtcaggcgtggtga

SEQ ID NO: 1115497 - DNA, 22 bp, Artificial Sequence
  chemically synthesized
ggactacaggctcctgtcacca

SEQ ID NO: 1115498 - DNA, 22 bp, Artificial Sequence
  chemically synthesized
gtcaggcgtggtgacaggagcc

SEQ ID NO: 1115499 - DNA, 22 bp, Artificial Sequence
  chemically synthesized
agtagctgggactacaggctcc

SEQ ID NO: 1115500 - DNA, 22 bp, Artificial Sequence
  chemically synthesized
ctgagtagctgggactacaggc

SEQ ID NO: 1115501 - DNA, 22 bp, Artificial Sequence
  chemically synthesized
agattcctgagtagctgggact

SEQ ID NO: 1115502 - DNA, 22 bp, Artificial Sequence
  chemically synthesized
cctcagattcctgagtagctgg

SEQ ID NO: 1115503 - DNA, 22 bp, Artificial Sequence
  chemically synthesized
tgcctcagattcctgagtagct

SEQ ID NO: 1115504 - DNA, 22 bp, Artificial Sequence
  chemically synthesized
ctgcctcagattcctgagtagc

SEQ ID NO: 1115505 - DNA, 22 bp, Artificial Sequence
  chemically synthesized
tagtcccagctactcaggaatc

SEQ ID NO: 1115506 - DNA, 22 bp, Artificial Sequence
  chemically synthesized
aagcagtccttctgcctcagat

SEQ ID NO: 1115507 - DNA, 22 bp, Artificial Sequence
  chemically synthesized
ctcaggaatctgaggcagaagg

SEQ ID NO: 1115508 - DNA, 22 bp, Artificial Sequence
  chemically synthesized
tgctcaagcagtccttctgcct

SEQ ID NO: 1115509 - DNA, 22 bp, Artificial Sequence
  chemically synthesized
aggaatctgaggcagaaggact

SEQ ID NO: 1115510 - DNA, 22 bp, Artificial Sequence
  chemically synthesized
ctgtgctcaagcagtccttctg

SEQ ID NO: 1115511 - DNA, 22 bp, Artificial Sequence
  chemically synthesized
agactactgtgctcaagcagtc

SEQ ID NO: 1115512 - DNA, 22 bp, Artificial Sequence
  chemically synthesized
aggcagaaggactgcttgagca

SEQ ID NO: 1115513 - DNA, 22 bp, Artificial Sequence
  chemically synthesized
ctcagactactgtgctcaagca

SEQ ID NO: 1115514 - DNA, 22 bp, Artificial Sequence
  chemically synthesized
cagcctactcagactactgtgc

SEQ ID NO: 1115515 - DNA, 22 bp, Artificial Sequence
  chemically synthesized
gttgcagcctactcagactact

SEQ ID NO: 1115516 - DNA, 22 bp, Artificial Sequence
  chemically synthesized
cttgagcacagtagtctgagta

SEQ ID NO: 1115517 - DNA, 22 bp, Artificial Sequence
  chemically synthesized
gagcacagtagtctgagtaggc

SEQ ID NO: 1115518 - DNA, 22 bp, Artificial Sequence
  chemically synthesized
agcacagtagtctgagtaggct

SEQ ID NO: 1115519 - DNA, 22 bp, Artificial Sequence
  chemically synthesized
agtaggctgcaacgaactatca

SEQ ID NO: 1115520 - DNA, 22 bp, Artificial Sequence
  chemically synthesized
gagtacagtggcgcaatgatag

SEQ ID NO: 1115521 - DNA, 22 bp, Artificial Sequence
  chemically synthesized
caacgaactatcattgcgccac

SEQ ID NO: 1115522 - DNA, 22 bp, Artificial Sequence
  chemically synthesized
tcgcccaggctggagtacagtg

SEQ ID NO: 1115523 - DNA, 22 bp, Artificial Sequence
  chemically synthesized
tgtcgcccaggctggagtacag

SEQ ID NO: 1115524 - DNA, 22 bp, Artificial Sequence
  chemically synthesized
tcattgcgccactgtactccag

SEQ ID NO: 1115525 - DNA, 22 bp, Artificial Sequence
  chemically synthesized
cctctgtcgcccaggctggagt

SEQ ID NO: 1115526 - DNA, 22 bp, Artificial Sequence
  chemically synthesized
ccctctgtcgcccaggctggag

SEQ ID NO: 1115527 - DNA, 22 bp, Artificial Sequence
  chemically synthesized
cgccactgtactccagcctggg

SEQ ID NO: 1115528 - DNA, 22 bp, Artificial Sequence
  chemically synthesized
tactccagcctgggcgacagag

SEQ ID NO: 1115529 - DNA, 22 bp, Artificial Sequence
  chemically synthesized
tatgaaagagtttccctctgtc

SEQ ID NO: 1115530 - DNA, 22 bp, Artificial Sequence
  chemically synthesized
cagcctgggcgacagagggaaa

SEQ ID NO: 1115531 - DNA, 22 bp, Artificial Sequence
  chemically synthesized
ccatattatatgaaagagtttc

SEQ ID NO: 1115532 - DNA, 22 bp, Artificial Sequence
  chemically synthesized
ggcgacagagggaaactctttc

SEQ ID NO: 1115533 - DNA, 22 bp, Artificial Sequence
  chemically synthesized
atattgccatattatatgaaag

SEQ ID NO: 1115534 - DNA, 22 bp, Artificial Sequence
  chemically synthesized
tgatattgccatattatatgaa

SEQ ID NO: 1115535 - DNA, 22 bp, Artificial Sequence
  chemically synthesized
ctgatattgccatattatatga

SEQ ID NO: 1115536 - DNA, 22 bp, Artificial Sequence
  chemically synthesized
tttctgatattgccatattata

SEQ ID NO: 1115537 - DNA, 22 bp, Artificial Sequence
  chemically synthesized
caactatttctgatattgccat

SEQ ID NO: 1115538 - DNA, 22 bp, Artificial Sequence
  chemically synthesized
tttcatataatatggcaatatc

SEQ ID NO: 1115539 - DNA, 22 bp, Artificial Sequence
  chemically synthesized
tgcaactatttctgatattgcc

SEQ ID NO: 1115540 - DNA, 22 bp, Artificial Sequence
  chemically synthesized
tcatataatatggcaatatcag

SEQ ID NO: 1115541 - DNA, 22 bp, Artificial Sequence
  chemically synthesized
catataatatggcaatatcaga

SEQ ID NO: 1115542 - DNA, 22 bp, Artificial Sequence
  chemically synthesized
tctgcaactatttctgatattg

SEQ ID NO: 1115543 - DNA, 22 bp, Artificial Sequence
  chemically synthesized
atataatatggcaatatcagaa

SEQ ID NO: 1115544 - DNA, 22 bp, Artificial Sequence
  chemically synthesized
ctctgcaactatttctgatatt

SEQ ID NO: 1115545 - DNA, 22 bp, Artificial Sequence
  chemically synthesized
tctctgcaactatttctgatat

SEQ ID NO: 1115546 - DNA, 22 bp, Artificial Sequence
  chemically synthesized
ttctctgcaactatttctgata

SEQ ID NO: 1115547 - DNA, 22 bp, Artificial Sequence
  chemically synthesized
tttctctgcaactatttctgat

SEQ ID NO: 1115548 - DNA, 22 bp, Artificial Sequence
  chemically synthesized
ctttttctctgcaactatttct

SEQ ID NO: 1115549 - DNA, 22 bp, Artificial Sequence
  chemically synthesized
gatgattactttttctctgcaa

SEQ ID NO: 1115550 - DNA, 22 bp, Artificial Sequence
  chemically synthesized
tctagatgattactttttctct

SEQ ID NO: 1115551 - DNA, 22 bp, Artificial Sequence
  chemically synthesized
cagagaaaaagtaatcatctag

SEQ ID NO: 1115552 - DNA, 22 bp, Artificial Sequence
  chemically synthesized
gtaaatagtgttgtctagatga

SEQ ID NO: 1115553 - DNA, 22 bp, Artificial Sequence
  chemically synthesized
agtaaatagtgttgtctagatg

SEQ ID NO: 1115554 - DNA, 22 bp, Artificial Sequence
  chemically synthesized
atgtgcttagtaaatagtgttg

SEQ ID NO: 1115555 - DNA, 22 bp, Artificial Sequence
  chemically synthesized
aatgtgcttagtaaatagtgtt

SEQ ID NO: 1115556 - DNA, 22 bp, Artificial Sequence
  chemically synthesized
cataatttaatgtgcttagtaa

SEQ ID NO: 1115557 - DNA, 22 bp, Artificial Sequence
  chemically synthesized
gacaacactatttactaagcac

SEQ ID NO: 1115558 - DNA, 22 bp, Artificial Sequence
  chemically synthesized
acataatttaatgtgcttagta

SEQ ID NO: 1115559 - DNA, 22 bp, Artificial Sequence
  chemically synthesized
tttactaagcacattaaattat

SEQ ID NO: 1115560 - DNA, 22 bp, Artificial Sequence
  chemically synthesized
tataagcatttacataatttaa

SEQ ID NO: 1115561 - DNA, 22 bp, Artificial Sequence
  chemically synthesized
actaagcacattaaattatgta

SEQ ID NO: 1115562 - DNA, 22 bp, Artificial Sequence
  chemically synthesized
ctaagcacattaaattatgtaa

SEQ ID NO: 1115563 - DNA, 22 bp, Artificial Sequence
  chemically synthesized
ttgtataagcatttacataatt

SEQ ID NO: 1115564 - DNA, 22 bp, Artificial Sequence
  chemically synthesized
agcacattaaattatgtaaatg

SEQ ID NO: 1115565 - DNA, 22 bp, Artificial Sequence
  chemically synthesized
aattatgtaaatgcttatacaa

SEQ ID NO: 1115566 - DNA, 22 bp, Artificial Sequence
  chemically synthesized
tgtaaatgcttatacaataatc

SEQ ID NO: 1115567 - DNA, 22 bp, Artificial Sequence
  chemically synthesized
agatacataaaaatatgtggat

SEQ ID NO: 1115568 - DNA, 22 bp, Artificial Sequence
  chemically synthesized
cagatacataaaaatatgtgga

SEQ ID NO: 1115569 - DNA, 22 bp, Artificial Sequence
  chemically synthesized
tcagatacataaaaatatgtgg

SEQ ID NO: 1115570 - DNA, 22 bp, Artificial Sequence
  chemically synthesized
ttcagatacataaaaatatgtg

SEQ ID NO: 1115571 - DNA, 22 bp, Artificial Sequence
  chemically synthesized
atacaataatccacatattttt

SEQ ID NO: 1115572 - DNA, 22 bp, Artificial Sequence
  chemically synthesized
tacaataatccacatattttta

SEQ ID NO: 1115573 - DNA, 22 bp, Artificial Sequence
  chemically synthesized
gatagtcttttcagatacataa

SEQ ID NO: 1115574 - DNA, 22 bp, Artificial Sequence
  chemically synthesized
aattagatagtcttttcagata

SEQ ID NO: 1115575 - DNA, 22 bp, Artificial Sequence
  chemically synthesized
aaattagatagtcttttcagat

SEQ ID NO: 1115576 - DNA, 22 bp, Artificial Sequence
  chemically synthesized
taaattagatagtcttttcaga

SEQ ID NO: 1115577 - DNA, 22 bp, Artificial Sequence
  chemically synthesized
tttaaattagatagtcttttca

SEQ ID NO: 1115578 - DNA, 22 bp, Artificial Sequence
  chemically synthesized
ctttaaattagatagtcttttc

SEQ ID NO: 1115579 - DNA, 22 bp, Artificial Sequence
  chemically synthesized
ttatgtatctgaaaagactatc

SEQ ID NO: 1115580 - DNA, 22 bp, Artificial Sequence
  chemically synthesized
tatgtatctgaaaagactatct

SEQ ID NO: 1115581 - DNA, 22 bp, Artificial Sequence
  chemically synthesized
tttctttaaattagatagtctt

SEQ ID NO: 1115582 - DNA, 22 bp, Artificial Sequence
  chemically synthesized
atgtatctgaaaagactatcta

SEQ ID NO: 1115583 - DNA, 22 bp, Artificial Sequence
  chemically synthesized
tgtatctgaaaagactatctaa

SEQ ID NO: 1115584 - DNA, 22 bp, Artificial Sequence
  chemically synthesized
tagctatttctttaaattagat

SEQ ID NO: 1115585 - DNA, 22 bp, Artificial Sequence
  chemically synthesized
gtagctatttctttaaattaga

SEQ ID NO: 1115586 - DNA, 22 bp, Artificial Sequence
  chemically synthesized
aaaagactatctaatttaaaga

SEQ ID NO: 1115587 - DNA, 22 bp, Artificial Sequence
  chemically synthesized
catttgtagctatttctttaaa

SEQ ID NO: 1115588 - DNA, 22 bp, Artificial Sequence
  chemically synthesized
acatttgtagctatttctttaa

SEQ ID NO: 1115589 - DNA, 22 bp, Artificial Sequence
  chemically synthesized
tacatttgtagctatttcttta

SEQ ID NO: 1115590 - DNA, 22 bp, Artificial Sequence
  chemically synthesized
tctaatttaaagaaatagctac

SEQ ID NO: 1115591 - DNA, 22 bp, Artificial Sequence
  chemically synthesized
atttaaagaaatagctacaaat

SEQ ID NO: 1115592 - DNA, 22 bp, Artificial Sequence
  chemically synthesized
aaagaaatagctacaaatgtaa

SEQ ID NO: 1115593 - DNA, 22 bp, Artificial Sequence
  chemically synthesized
aagaaatagctacaaatgtaaa

SEQ ID NO: 1115594 - DNA, 22 bp, Artificial Sequence
  chemically synthesized
aaagagaaacaaaaacaaaaag

SEQ ID NO: 1115595 - DNA, 22 bp, Artificial Sequence
  chemically synthesized
caaatgtaaagctttttgtttt

SEQ ID NO: 1115596 - DNA, 22 bp, Artificial Sequence
  chemically synthesized
tctcaaagagaaacaaaaacaa

SEQ ID NO: 1115597 - DNA, 22 bp, Artificial Sequence
  chemically synthesized
tgtctcaaagagaaacaaaaac

SEQ ID NO: 1115598 - DNA, 22 bp, Artificial Sequence
  chemically synthesized
tttgtttttgtttctctttgag

SEQ ID NO: 1115599 - DNA, 22 bp, Artificial Sequence
  chemically synthesized
ttgtttttgtttctctttgaga

SEQ ID NO: 1115600 - DNA, 22 bp, Artificial Sequence
  chemically synthesized
tgtttttgtttctctttgagac

SEQ ID NO: 1115601 - DNA, 22 bp, Artificial Sequence
  chemically synthesized
gtttttgtttctctttgagaca

SEQ ID NO: 1115602 - DNA, 22 bp, Artificial Sequence
  chemically synthesized
tttttgtttctctttgagacag

SEQ ID NO: 1115603 - DNA, 22 bp, Artificial Sequence
  chemically synthesized
ttgtttctctttgagacagagt

SEQ ID NO: 1115604 - DNA, 22 bp, Artificial Sequence
  chemically synthesized
tgtttctctttgagacagagtc

SEQ ID NO: 1115605 - DNA, 22 bp, Artificial Sequence
  chemically synthesized
gtttctctttgagacagagtct

SEQ ID NO: 1115606 - DNA, 22 bp, Artificial Sequence
  chemically synthesized
ggcgacagagtgagactctgtc

SEQ ID NO: 1115607 - DNA, 22 bp, Artificial Sequence
  chemically synthesized
tttctctttgagacagagtctc

SEQ ID NO: 1115608 - DNA, 22 bp, Artificial Sequence
  chemically synthesized
ctctttgagacagagtctcact

SEQ ID NO: 1115609 - DNA, 22 bp, Artificial Sequence
  chemically synthesized
tctttgagacagagtctcactc

SEQ ID NO: 1115610 - DNA, 22 bp, Artificial Sequence
  chemically synthesized
tttgagacagagtctcactctg

SEQ ID NO: 1115611 - DNA, 22 bp, Artificial Sequence
  chemically synthesized
cagcctgggcgacagagtgaga

SEQ ID NO: 1115612 - DNA, 22 bp, Artificial Sequence
  chemically synthesized
tgagacagagtctcactctgtc

SEQ ID NO: 1115613 - DNA, 22 bp, Artificial Sequence
  chemically synthesized
gagacagagtctcactctgtcg

SEQ ID NO: 1115614 - DNA, 22 bp, Artificial Sequence
  chemically synthesized
agacagagtctcactctgtcgc

SEQ ID NO: 1115615 - DNA, 22 bp, Artificial Sequence
  chemically synthesized
cactccagcctgggcgacagag

SEQ ID NO: 1115616 - DNA, 22 bp, Artificial Sequence
  chemically synthesized
actctgtcgcccaggctggagt

SEQ ID NO: 1115617 - DNA, 22 bp, Artificial Sequence
  chemically synthesized
agatcatgccactgcactccag

SEQ ID NO: 1115618 - DNA, 22 bp, Artificial Sequence
  chemically synthesized
tgtcgcccaggctggagtgcag

SEQ ID NO: 1115619 - DNA, 22 bp, Artificial Sequence
  chemically synthesized
tcgcccaggctggagtgcagtg

SEQ ID NO: 1115620 - DNA, 22 bp, Artificial Sequence
  chemically synthesized
cagtgagctgagatcatgccac

SEQ ID NO: 1115621 - DNA, 22 bp, Artificial Sequence
  chemically synthesized
gagtgcagtggcatgatctcag

SEQ ID NO: 1115622 - DNA, 22 bp, Artificial Sequence
  chemically synthesized
aacccgggaggcagaggttgca

SEQ ID NO: 1115623 - DNA, 22 bp, Artificial Sequence
  chemically synthesized
gaacccgggaggcagaggttgc

SEQ ID NO: 1115624 - DNA, 22 bp, Artificial Sequence
  chemically synthesized
cttgaacccgggaggcagaggt

SEQ ID NO: 1115625 - DNA, 22 bp, Artificial Sequence
  chemically synthesized
agctcactgcaacctctgcctc

SEQ ID NO: 1115626 - DNA, 22 bp, Artificial Sequence
  chemically synthesized
actgcaacctctgcctcccggg

SEQ ID NO: 1115627 - DNA, 22 bp, Artificial Sequence
  chemically synthesized
caacctctgcctcccgggttca

SEQ ID NO: 1115628 - DNA, 22 bp, Artificial Sequence
  chemically synthesized
aagcaggagagttgcttgaacc

SEQ ID NO: 1115629 - DNA, 22 bp, Artificial Sequence
  chemically synthesized
tgcctcccgggttcaagcaact

SEQ ID NO: 1115630 - DNA, 22 bp, Artificial Sequence
  chemically synthesized
cctcccgggttcaagcaactct

SEQ ID NO: 1115631 - DNA, 22 bp, Artificial Sequence
  chemically synthesized
ccgggttcaagcaactctcctg

SEQ ID NO: 1115632 - DNA, 22 bp, Artificial Sequence
  chemically synthesized
gggaggctgaagcaggagagtt

SEQ ID NO: 1115633 - DNA, 22 bp, Artificial Sequence
  chemically synthesized
ctcgggaggctgaagcaggaga

SEQ ID NO: 1115634 - DNA, 22 bp, Artificial Sequence
  chemically synthesized
aagcaactctcctgcttcagcc

SEQ ID NO: 1115635 - DNA, 22 bp, Artificial Sequence
  chemically synthesized
taatcccggctactcgggaggc

SEQ ID NO: 1115636 - DNA, 22 bp, Artificial Sequence
  chemically synthesized
tcctgcttcagcctcccgagta

SEQ ID NO: 1115637 - DNA, 22 bp, Artificial Sequence
  chemically synthesized
ctgcttcagcctcccgagtagc

SEQ ID NO: 1115638 - DNA, 22 bp, Artificial Sequence
  chemically synthesized
cttcagcctcccgagtagccgg

SEQ ID NO: 1115639 - DNA, 22 bp, Artificial Sequence
  chemically synthesized
cagcctcccgagtagccgggat

SEQ ID NO: 1115640 - DNA, 22 bp, Artificial Sequence
  chemically synthesized
agcctcccgagtagccgggatt

SEQ ID NO: 1115641 - DNA, 22 bp, Artificial Sequence
  chemically synthesized
ccgagtagccgggattacaggc

SEQ ID NO: 1115642 - DNA, 22 bp, Artificial Sequence
  chemically synthesized
ggcgtggtggtgcacgcctgta

SEQ ID NO: 1115643 - DNA, 22 bp, Artificial Sequence
  chemically synthesized
gctgggcgtggtggtgcacgcc

SEQ ID NO: 1115644 - DNA, 22 bp, Artificial Sequence
  chemically synthesized
caggcgtgcaccaccacgccca

SEQ ID NO: 1115645 - DNA, 22 bp, Artificial Sequence
  chemically synthesized
aaaatacaaaaattagctgggc

SEQ ID NO: 1115646 - DNA, 22 bp, Artificial Sequence
  chemically synthesized
ctaaaaatacaaaaattagctg

SEQ ID NO: 1115647 - DNA, 22 bp, Artificial Sequence
  chemically synthesized
tactaaaaatacaaaaattagc

SEQ ID NO: 1115648 - DNA, 22 bp, Artificial Sequence
  chemically synthesized
tctctactaaaaatacaaaaat

SEQ ID NO: 1115649 - DNA, 22 bp, Artificial Sequence
  chemically synthesized
atttttgtatttttagtagaga

SEQ ID NO: 1115650 - DNA, 22 bp, Artificial Sequence
  chemically synthesized
ttgtatttttagtagagacagg

SEQ ID NO: 1115651 - DNA, 22 bp, Artificial Sequence
  chemically synthesized
tgtatttttagtagagacaggg

SEQ ID NO: 1115652 - DNA, 22 bp, Artificial Sequence
  chemically synthesized
gtatttttagtagagacagggt

SEQ ID NO: 1115653 - DNA, 22 bp, Artificial Sequence
  chemically synthesized
tatttttagtagagacagggtt

SEQ ID NO: 1115654 - DNA, 22 bp, Artificial Sequence
  chemically synthesized
gccaacatggtgaaaccctgtc

SEQ ID NO: 1115655 - DNA, 22 bp, Artificial Sequence
  chemically synthesized
ttagtagagacagggtttcacc

SEQ ID NO: 1115656 - DNA, 22 bp, Artificial Sequence
  chemically synthesized
tagtagagacagggtttcacca

SEQ ID NO: 1115657 - DNA, 22 bp, Artificial Sequence
  chemically synthesized
agtagagacagggtttcaccat

SEQ ID NO: 1115658 - DNA, 22 bp, Artificial Sequence
  chemically synthesized
gtagagacagggtttcaccatg

SEQ ID NO: 1115659 - DNA, 22 bp, Artificial Sequence
  chemically synthesized
agaccagcctggccaacatggt

SEQ ID NO: 1115660 - DNA, 22 bp, Artificial Sequence
  chemically synthesized
gagaccagcctggccaacatgg

SEQ ID NO: 1115661 - DNA, 22 bp, Artificial Sequence
  chemically synthesized
caccatgttggccaggctggtc

SEQ ID NO: 1115662 - DNA, 22 bp, Artificial Sequence
  chemically synthesized
accatgttggccaggctggtct

SEQ ID NO: 1115663 - DNA, 22 bp, Artificial Sequence
  chemically synthesized
gccaggctggtctcaaactcct

SEQ ID NO: 1115664 - DNA, 22 bp, Artificial Sequence
  chemically synthesized
ggcggatgatgaggtcaggagt

SEQ ID NO: 1115665 - DNA, 22 bp, Artificial Sequence
  chemically synthesized
gtctcaaactcctgacctcatc

SEQ ID NO: 1115666 - DNA, 22 bp, Artificial Sequence
  chemically synthesized
agctgggcggatgatgaggtca

SEQ ID NO: 1115667 - DNA, 22 bp, Artificial Sequence
  chemically synthesized
aaactcctgacctcatcatccg

SEQ ID NO: 1115668 - DNA, 22 bp, Artificial Sequence
  chemically synthesized
ctgacctcatcatccgcccagc

SEQ ID NO: 1115669 - DNA, 22 bp, Artificial Sequence
  chemically synthesized
acctcatcatccgcccagctca

SEQ ID NO: 1115670 - DNA, 22 bp, Artificial Sequence
  chemically synthesized
atcatccgcccagctcagtgct

SEQ ID NO: 1115671 - DNA, 22 bp, Artificial Sequence
  chemically synthesized
taatccccccgccccaccccag

SEQ ID NO: 1115672 - DNA, 22 bp, Artificial Sequence
  chemically synthesized
acacctgtaatccccccgcccc

SEQ ID NO: 1115673 - DNA, 22 bp, Artificial Sequence
  chemically synthesized
agtgctggggtggggcgggggg

SEQ ID NO: 1115674 - DNA, 22 bp, Artificial Sequence
  chemically synthesized
gggtggggcggggggattacag

SEQ ID NO: 1115675 - DNA, 22 bp, Artificial Sequence
  chemically synthesized
aggccaggcacggtggctcaca

SEQ ID NO: 1115676 - DNA, 22 bp, Artificial Sequence
  chemically synthesized
ttcaggccaggcacggtggctc

SEQ ID NO: 1115677 - DNA, 22 bp, Artificial Sequence
  chemically synthesized
attcaggccaggcacggtggct

SEQ ID NO: 1115678 - DNA, 22 bp, Artificial Sequence
  chemically synthesized
tattcaggccaggcacggtggc

SEQ ID NO: 1115679 - DNA, 22 bp, Artificial Sequence
  chemically synthesized
caggtgtgagccaccgtgcctg

SEQ ID NO: 1115680 - DNA, 22 bp, Artificial Sequence
  chemically synthesized
agaaaacctttattcaggccag

SEQ ID NO: 1115681 - DNA, 22 bp, Artificial Sequence
  chemically synthesized
aagaaaacctttattcaggcca

SEQ ID NO: 1115682 - DNA, 22 bp, Artificial Sequence
  chemically synthesized
taagaaaacctttattcaggcc

SEQ ID NO: 1115683 - DNA, 22 bp, Artificial Sequence
  chemically synthesized
ttaagaaaacctttattcaggc

SEQ ID NO: 1115684 - DNA, 22 bp, Artificial Sequence
  chemically synthesized
aaataaatttttaagaaaacct

SEQ ID NO: 1115685 - DNA, 22 bp, Artificial Sequence
  chemically synthesized
aaaataaatttttaagaaaacc

SEQ ID NO: 1115686 - DNA, 22 bp, Artificial Sequence
  chemically synthesized
gcctgaataaaggttttcttaa

SEQ ID NO: 1115687 - DNA, 22 bp, Artificial Sequence
  chemically synthesized
taaaataaatttttaagaaaac

SEQ ID NO: 1115688 - DNA, 22 bp, Artificial Sequence
  chemically synthesized
tttaaaataaatttttaagaaa

SEQ ID NO: 1115689 - DNA, 22 bp, Artificial Sequence
  chemically synthesized
aataaaggttttcttaaaaatt

SEQ ID NO: 1115690 - DNA, 22 bp, Artificial Sequence
  chemically synthesized
ggaaactctttaaaataaattt

SEQ ID NO: 1115691 - DNA, 22 bp, Artificial Sequence
  chemically synthesized
aggaaactctttaaaataaatt

SEQ ID NO: 1115692 - DNA, 22 bp, Artificial Sequence
  chemically synthesized
tcttaaaaatttattttaaaga

SEQ ID NO: 1115693 - DNA, 22 bp, Artificial Sequence
  chemically synthesized
cttaaaaatttattttaaagag

SEQ ID NO: 1115694 - DNA, 22 bp, Artificial Sequence
  chemically synthesized
ccacttaggaaactctttaaaa

SEQ ID NO: 1115695 - DNA, 22 bp, Artificial Sequence
  chemically synthesized
ttaaaaatttattttaaagagt

SEQ ID NO: 1115696 - DNA, 22 bp, Artificial Sequence
  chemically synthesized
aaaaatttattttaaagagttt

SEQ ID NO: 1115697 - DNA, 22 bp, Artificial Sequence
  chemically synthesized
aaaatttattttaaagagtttc

SEQ ID NO: 1115698 - DNA, 22 bp, Artificial Sequence
  chemically synthesized
attttaaagagtttcctaagtg

SEQ ID NO: 1115699 - DNA, 22 bp, Artificial Sequence
  chemically synthesized
ttttaaagagtttcctaagtgg

SEQ ID NO: 1115700 - DNA, 22 bp, Artificial Sequence
  chemically synthesized
taaagagtttcctaagtgggag

SEQ ID NO: 1115701 - DNA, 22 bp, Artificial Sequence
  chemically synthesized
aaagagtttcctaagtgggaga

SEQ ID NO: 1115702 - DNA, 22 bp, Artificial Sequence
  chemically synthesized
aagagtttcctaagtgggagac

SEQ ID NO: 1115703 - DNA, 22 bp, Artificial Sequence
  chemically synthesized
aagtcagatatcgtcaggtctc

SEQ ID NO: 1115704 - DNA, 22 bp, Artificial Sequence
  chemically synthesized
gaagtcagatatcgtcaggtct

SEQ ID NO: 1115705 - DNA, 22 bp, Artificial Sequence
  chemically synthesized
cctaagtgggagacctgacgat

SEQ ID NO: 1115706 - DNA, 22 bp, Artificial Sequence
  chemically synthesized
ctaagtgggagacctgacgata

SEQ ID NO: 1115707 - DNA, 22 bp, Artificial Sequence
  chemically synthesized
agtgggagacctgacgatatct

SEQ ID NO: 1115708 - DNA, 22 bp, Artificial Sequence
  chemically synthesized
tatcaagccttgaagtcagata

SEQ ID NO: 1115709 - DNA, 22 bp, Artificial Sequence
  chemically synthesized
atatcaagccttgaagtcagat

SEQ ID NO: 1115710 - DNA, 22 bp, Artificial Sequence
  chemically synthesized
tatatcaagccttgaagtcaga

SEQ ID NO: 1115711 - DNA, 22 bp, Artificial Sequence
  chemically synthesized
acgatatctgacttcaaggctt

SEQ ID NO: 1115712 - DNA, 22 bp, Artificial Sequence
  chemically synthesized
cagttttatatcaagccttgaa

SEQ ID NO: 1115713 - DNA, 22 bp, Artificial Sequence
  chemically synthesized
ctgcagttttatatcaagcctt

SEQ ID NO: 1115714 - DNA, 22 bp, Artificial Sequence
  chemically synthesized
attactgcagttttatatcaag

SEQ ID NO: 1115715 - DNA, 22 bp, Artificial Sequence
  chemically synthesized
gattactgcagttttatatcaa

SEQ ID NO: 1115716 - DNA, 22 bp, Artificial Sequence
  chemically synthesized
acttcaaggcttgatataaaac

SEQ ID NO: 1115717 - DNA, 22 bp, Artificial Sequence
  chemically synthesized
tcttgattactgcagttttata

SEQ ID NO: 1115718 - DNA, 22 bp, Artificial Sequence
  chemically synthesized
caaggcttgatataaaactgca

SEQ ID NO: 1115719 - DNA, 22 bp, Artificial Sequence
  chemically synthesized
tgtcttgattactgcagtttta

SEQ ID NO: 1115720 - DNA, 22 bp, Artificial Sequence
  chemically synthesized
aaggcttgatataaaactgcag

SEQ ID NO: 1115721 - DNA, 22 bp, Artificial Sequence
  chemically synthesized
ctctgtcttgattactgcagtt

SEQ ID NO: 1115722 - DNA, 22 bp, Artificial Sequence
  chemically synthesized
gatataaaactgcagtaatcaa

SEQ ID NO: 1115723 - DNA, 22 bp, Artificial Sequence
  chemically synthesized
atataaaactgcagtaatcaag

SEQ ID NO: 1115724 - DNA, 22 bp, Artificial Sequence
  chemically synthesized
ccaatattactctgtcttgatt

SEQ ID NO: 1115725 - DNA, 22 bp, Artificial Sequence
  chemically synthesized
gccaatattactctgtcttgat

SEQ ID NO: 1115726 - DNA, 22 bp, Artificial Sequence
  chemically synthesized
tgccaatattactctgtcttga

SEQ ID NO: 1115727 - DNA, 22 bp, Artificial Sequence
  chemically synthesized
ttgccaatattactctgtcttg

SEQ ID NO: 1115728 - DNA, 22 bp, Artificial Sequence
  chemically synthesized
ttttgccaatattactctgtct

SEQ ID NO: 1115729 - DNA, 22 bp, Artificial Sequence
  chemically synthesized
cagtaatcaagacagagtaata

SEQ ID NO: 1115730 - DNA, 22 bp, Artificial Sequence
  chemically synthesized
ttcttttgccaatattactctg

SEQ ID NO: 1115731 - DNA, 22 bp, Artificial Sequence
  chemically synthesized
tctgttcttttgccaatattac

SEQ ID NO: 1115732 - DNA, 22 bp, Artificial Sequence
  chemically synthesized
cctgtctgttcttttgccaata

SEQ ID NO: 1115733 - DNA, 22 bp, Artificial Sequence
  chemically synthesized
acctgtctgttcttttgccaat

SEQ ID NO: 1115734 - DNA, 22 bp, Artificial Sequence
  chemically synthesized
atttacctgtctgttcttttgc

SEQ ID NO: 1115735 - DNA, 22 bp, Artificial Sequence
  chemically synthesized
cattgatttacctgtctgttct

SEQ ID NO: 1115736 - DNA, 22 bp, Artificial Sequence
  chemically synthesized
ttccattgatttacctgtctgt

SEQ ID NO: 1115737 - DNA, 22 bp, Artificial Sequence
  chemically synthesized
tgttccattgatttacctgtct

SEQ ID NO: 1115738 - DNA, 22 bp, Artificial Sequence
  chemically synthesized
gcaaaagaacagacaggtaaat

SEQ ID NO: 1115739 - DNA, 22 bp, Artificial Sequence
  chemically synthesized
ttctgttccattgatttacctg

SEQ ID NO: 1115740 - DNA, 22 bp, Artificial Sequence
  chemically synthesized
tattctgttccattgatttacc

SEQ ID NO: 1115741 - DNA, 22 bp, Artificial Sequence
  chemically synthesized
ctattctgttccattgatttac

SEQ ID NO: 1115742 - DNA, 22 bp, Artificial Sequence
  chemically synthesized
tctattctgttccattgattta

SEQ ID NO: 1115743 - DNA, 22 bp, Artificial Sequence
  chemically synthesized
agctttctattctgttccattg

SEQ ID NO: 1115744 - DNA, 22 bp, Artificial Sequence
  chemically synthesized
tgagctttctattctgttccat

SEQ ID NO: 1115745 - DNA, 22 bp, Artificial Sequence
  chemically synthesized
ctgagctttctattctgttcca

SEQ ID NO: 1115746 - DNA, 22 bp, Artificial Sequence
  chemically synthesized
tttctgagctttctattctgtt

SEQ ID NO: 1115747 - DNA, 22 bp, Artificial Sequence
  chemically synthesized
tgtggatctgtttctgagcttt

SEQ ID NO: 1115748 - DNA, 22 bp, Artificial Sequence
  chemically synthesized
atgtggatctgtttctgagctt

SEQ ID NO: 1115749 - DNA, 22 bp, Artificial Sequence
  chemically synthesized
tatttatgtggatctgtttctg

SEQ ID NO: 1115750 - DNA, 22 bp, Artificial Sequence
  chemically synthesized
attatatttatgtggatctgtt

SEQ ID NO: 1115751 - DNA, 22 bp, Artificial Sequence
  chemically synthesized
agaaacagatccacataaatat

SEQ ID NO: 1115752 - DNA, 22 bp, Artificial Sequence
  chemically synthesized
ccaaaaatcaattgattatatt

SEQ ID NO: 1115753 - DNA, 22 bp, Artificial Sequence
  chemically synthesized
gccaaaaatcaattgattatat

SEQ ID NO: 1115754 - DNA, 22 bp, Artificial Sequence
  chemically synthesized
tgccaaaaatcaattgattata

SEQ ID NO: 1115755 - DNA, 22 bp, Artificial Sequence
  chemically synthesized
ctttgccaaaaatcaattgatt

SEQ ID NO: 1115756 - DNA, 22 bp, Artificial Sequence
  chemically synthesized
gttcctttgccaaaaatcaatt

SEQ ID NO: 1115757 - DNA, 22 bp, Artificial Sequence
  chemically synthesized
ggttcctttgccaaaaatcaat

SEQ ID NO: 1115758 - DNA, 22 bp, Artificial Sequence
  chemically synthesized
ccttggttcctttgccaaaaat

SEQ ID NO: 1115759 - DNA, 22 bp, Artificial Sequence
  chemically synthesized
tattgccttggttcctttgcca

SEQ ID NO: 1115760 - DNA, 22 bp, Artificial Sequence
  chemically synthesized
cactgtattgccttggttcctt

SEQ ID NO: 1115761 - DNA, 22 bp, Artificial Sequence
  chemically synthesized
atttttggcaaaggaaccaagg

SEQ ID NO: 1115762 - DNA, 22 bp, Artificial Sequence
  chemically synthesized
tccactgtattgccttggttcc

SEQ ID NO: 1115763 - DNA, 22 bp, Artificial Sequence
  chemically synthesized
ctccactgtattgccttggttc

SEQ ID NO: 1115764 - DNA, 22 bp, Artificial Sequence
  chemically synthesized
tctccactgtattgccttggtt

SEQ ID NO: 1115765 - DNA, 22 bp, Artificial Sequence
  chemically synthesized
ttctccactgtattgccttggt

SEQ ID NO: 1115766 - DNA, 22 bp, Artificial Sequence
  chemically synthesized
ttggcaaaggaaccaaggcaat

SEQ ID NO: 1115767 - DNA, 22 bp, Artificial Sequence
  chemically synthesized
tttctccactgtattgccttgg

SEQ ID NO: 1115768 - DNA, 22 bp, Artificial Sequence
  chemically synthesized
tggcaaaggaaccaaggcaata

SEQ ID NO: 1115769 - DNA, 22 bp, Artificial Sequence
  chemically synthesized
ggcaaaggaaccaaggcaatac

SEQ ID NO: 1115770 - DNA, 22 bp, Artificial Sequence
  chemically synthesized
gcaaaggaaccaaggcaataca

SEQ ID NO: 1115771 - DNA, 22 bp, Artificial Sequence
  chemically synthesized
aagactttttctccactgtatt

SEQ ID NO: 1115772 - DNA, 22 bp, Artificial Sequence
  chemically synthesized
aaagactttttctccactgtat

SEQ ID NO: 1115773 - DNA, 22 bp, Artificial Sequence
  chemically synthesized
tttaaagactttttctccactg

SEQ ID NO: 1115774 - DNA, 22 bp, Artificial Sequence
  chemically synthesized
gtttaaagactttttctccact

SEQ ID NO: 1115775 - DNA, 22 bp, Artificial Sequence
  chemically synthesized
aggaccatttgtttaaagactt

SEQ ID NO: 1115776 - DNA, 22 bp, Artificial Sequence
  chemically synthesized
ttcaggaccatttgtttaaaga

SEQ ID NO: 1115777 - DNA, 22 bp, Artificial Sequence
  chemically synthesized
tgttgttcaggaccatttgttt

SEQ ID NO: 1115778 - DNA, 22 bp, Artificial Sequence
  chemically synthesized
taaacaaatggtcctgaacaac

SEQ ID NO: 1115779 - DNA, 22 bp, Artificial Sequence
  chemically synthesized
aaacaaatggtcctgaacaaca

SEQ ID NO: 1115780 - DNA, 22 bp, Artificial Sequence
  chemically synthesized
aacaaatggtcctgaacaacac

SEQ ID NO: 1115781 - DNA, 22 bp, Artificial Sequence
  chemically synthesized
catgtagatgttgtgttgttca

SEQ ID NO: 1115782 - DNA, 22 bp, Artificial Sequence
  chemically synthesized
gcatgtagatgttgtgttgttc

SEQ ID NO: 1115783 - DNA, 22 bp, Artificial Sequence
  chemically synthesized
tgcatgtagatgttgtgttgtt

SEQ ID NO: 1115784 - DNA, 22 bp, Artificial Sequence
  chemically synthesized
ttgcatgtagatgttgtgttgt

SEQ ID NO: 1115785 - DNA, 22 bp, Artificial Sequence
  chemically synthesized
tttgcatgtagatgttgtgttg

SEQ ID NO: 1115786 - DNA, 22 bp, Artificial Sequence
  chemically synthesized
ttttgcatgtagatgttgtgtt

SEQ ID NO: 1115787 - DNA, 22 bp, Artificial Sequence
  chemically synthesized
aacaacacaacatctacatgca

SEQ ID NO: 1115788 - DNA, 22 bp, Artificial Sequence
  chemically synthesized
gataaacttttttgcatgtaga

SEQ ID NO: 1115789 - DNA, 22 bp, Artificial Sequence
  chemically synthesized
tgcctagataaacttttttgca

SEQ ID NO: 1115790 - DNA, 22 bp, Artificial Sequence
  chemically synthesized
atgcctagataaacttttttgc

SEQ ID NO: 1115791 - DNA, 22 bp, Artificial Sequence
  chemically synthesized
catgcaaaaaagtttatctagg

SEQ ID NO: 1115792 - DNA, 22 bp, Artificial Sequence
  chemically synthesized
atctaggcataaaccttacacc

SEQ ID NO: 1115793 - DNA, 22 bp, Artificial Sequence
  chemically synthesized
aaacaaaagaagggtgtaaggt

SEQ ID NO: 1115794 - DNA, 22 bp, Artificial Sequence
  chemically synthesized
tctaggcataaaccttacaccc

SEQ ID NO: 1115795 - DNA, 22 bp, Artificial Sequence
  chemically synthesized
ggcataaaccttacacccttct

SEQ ID NO: 1115796 - DNA, 22 bp, Artificial Sequence
  chemically synthesized
taattaaaacaaaagaagggtg

SEQ ID NO: 1115797 - DNA, 22 bp, Artificial Sequence
  chemically synthesized
aataattgtaattaaaacaaaa

SEQ ID NO: 1115798 - DNA, 22 bp, Artificial Sequence
  chemically synthesized
acacccttcttttgttttaatt

SEQ ID NO: 1115799 - DNA, 22 bp, Artificial Sequence
  chemically synthesized
cacccttcttttgttttaatta

SEQ ID NO: 1115800 - DNA, 22 bp, Artificial Sequence
  chemically synthesized
gaattaaataattgtaattaaa

SEQ ID NO: 1115801 - DNA, 22 bp, Artificial Sequence
  chemically synthesized
cttttgttttaattacaattat

SEQ ID NO: 1115802 - DNA, 22 bp, Artificial Sequence
  chemically synthesized
ttttgttttaattacaattatt

SEQ ID NO: 1115803 - DNA, 22 bp, Artificial Sequence
  chemically synthesized
ttgttttaattacaattattta

SEQ ID NO: 1115804 - DNA, 22 bp, Artificial Sequence
  chemically synthesized
tgttttaattacaattatttaa

SEQ ID NO: 1115805 - DNA, 22 bp, Artificial Sequence
  chemically synthesized
gttttaattacaattatttaat

SEQ ID NO: 1115806 - DNA, 22 bp, Artificial Sequence
  chemically synthesized
ttttaattacaattatttaatt

SEQ ID NO: 1115807 - DNA, 22 bp, Artificial Sequence
  chemically synthesized
taattacaattatttaattcca

SEQ ID NO: 1115808 - DNA, 22 bp, Artificial Sequence
  chemically synthesized
aattacaattatttaattccaa

SEQ ID NO: 1115809 - DNA, 22 bp, Artificial Sequence
  chemically synthesized
attacaattatttaattccaat

SEQ ID NO: 1115810 - DNA, 22 bp, Artificial Sequence
  chemically synthesized
caattatttaattccaatttat

SEQ ID NO: 1115811 - DNA, 22 bp, Artificial Sequence
  chemically synthesized
tttaattccaatttatttactt

SEQ ID NO: 1115812 - DNA, 22 bp, Artificial Sequence
  chemically synthesized
aattccaatttatttactttca

SEQ ID NO: 1115813 - DNA, 22 bp, Artificial Sequence
  chemically synthesized
attccaatttatttactttcat

SEQ ID NO: 1115814 - DNA, 22 bp, Artificial Sequence
  chemically synthesized
atccagtgaataacatgaaagt

SEQ ID NO: 1115815 - DNA, 22 bp, Artificial Sequence
  chemically synthesized
caatttatttactttcatgtta

SEQ ID NO: 1115816 - DNA, 22 bp, Artificial Sequence
  chemically synthesized
atttactttcatgttattcact

SEQ ID NO: 1115817 - DNA, 22 bp, Artificial Sequence
  chemically synthesized
tttactttcatgttattcactg

SEQ ID NO: 1115818 - DNA, 22 bp, Artificial Sequence
  chemically synthesized
caatgaagttgatccagtgaat

SEQ ID NO: 1115819 - DNA, 22 bp, Artificial Sequence
  chemically synthesized
actttcatgttattcactggat

SEQ ID NO: 1115820 - DNA, 22 bp, Artificial Sequence
  chemically synthesized
ccaatgaagttgatccagtgaa

SEQ ID NO: 1115821 - DNA, 22 bp, Artificial Sequence
  chemically synthesized
ctttcatgttattcactggatc

SEQ ID NO: 1115822 - DNA, 22 bp, Artificial Sequence
  chemically synthesized
tcatgttattcactggatcaac

SEQ ID NO: 1115823 - DNA, 22 bp, Artificial Sequence
  chemically synthesized
catgttattcactggatcaact

SEQ ID NO: 1115824 - DNA, 22 bp, Artificial Sequence
  chemically synthesized
atgttattcactggatcaactt

SEQ ID NO: 1115825 - DNA, 22 bp, Artificial Sequence
  chemically synthesized
ttcactggatcaacttcattgg

SEQ ID NO: 1115826 - DNA, 22 bp, Artificial Sequence
  chemically synthesized
actggatcaacttcattggaag

SEQ ID NO: 1115827 - DNA, 22 bp, Artificial Sequence
  chemically synthesized
gatcaacttcattggaagttta

SEQ ID NO: 1115828 - DNA, 22 bp, Artificial Sequence
  chemically synthesized
accatcaaaagtataaacttcc

SEQ ID NO: 1115829 - DNA, 22 bp, Artificial Sequence
  chemically synthesized
caccatcaaaagtataaacttc

SEQ ID NO: 1115830 - DNA, 22 bp, Artificial Sequence
  chemically synthesized
cattggaagtttatacttttga

SEQ ID NO: 1115831 - DNA, 22 bp, Artificial Sequence
  chemically synthesized
attggaagtttatacttttgat

SEQ ID NO: 1115832 - DNA, 22 bp, Artificial Sequence
  chemically synthesized
gaagtttatacttttgatggtg

SEQ ID NO: 1115833 - DNA, 22 bp, Artificial Sequence
  chemically synthesized
atacttttgatggtgaaatatc

SEQ ID NO: 1115834 - DNA, 22 bp, Artificial Sequence
  chemically synthesized
acaataatgtcagatatttcac

SEQ ID NO: 1115835 - DNA, 22 bp, Artificial Sequence
  chemically synthesized
tacttttgatggtgaaatatct

SEQ ID NO: 1115836 - DNA, 22 bp, Artificial Sequence
  chemically synthesized
ttgatggtgaaatatctgacat

SEQ ID NO: 1115837 - DNA, 22 bp, Artificial Sequence
  chemically synthesized
tgatggtgaaatatctgacatt

SEQ ID NO: 1115838 - DNA, 22 bp, Artificial Sequence
  chemically synthesized
gatggtgaaatatctgacatta

SEQ ID NO: 1115839 - DNA, 22 bp, Artificial Sequence
  chemically synthesized
atggtgaaatatctgacattat

SEQ ID NO: 1115840 - DNA, 22 bp, Artificial Sequence
  chemically synthesized
tgataaaattcacaataatgtc

SEQ ID NO: 1115841 - DNA, 22 bp, Artificial Sequence
  chemically synthesized
gtgataaaattcacaataatgt

SEQ ID NO: 1115842 - DNA, 22 bp, Artificial Sequence
  chemically synthesized
aagtgaatttgtgataaaattc

SEQ ID NO: 1115843 - DNA, 22 bp, Artificial Sequence
  chemically synthesized
aaagtgaatttgtgataaaatt

SEQ ID NO: 1115844 - DNA, 22 bp, Artificial Sequence
  chemically synthesized
acattattgtgaattttatcac

SEQ ID NO: 1115845 - DNA, 22 bp, Artificial Sequence
  chemically synthesized
taaagtgaatttgtgataaaat

SEQ ID NO: 1115846 - DNA, 22 bp, Artificial Sequence
  chemically synthesized
ttgtgaattttatcacaaattc

SEQ ID NO: 1115847 - DNA, 22 bp, Artificial Sequence
  chemically synthesized
aaattttaaagtgaatttgtga

SEQ ID NO: 1115848 - DNA, 22 bp, Artificial Sequence
  chemically synthesized
tgaattttatcacaaattcact

SEQ ID NO: 1115849 - DNA, 22 bp, Artificial Sequence
  chemically synthesized
aatgttgaaattttaaagtgaa

SEQ ID NO: 1115850 - DNA, 22 bp, Artificial Sequence
  chemically synthesized
tatcacaaattcactttaaaat

SEQ ID NO: 1115851 - DNA, 22 bp, Artificial Sequence
  chemically synthesized
atcacaaattcactttaaaatt

SEQ ID NO: 1115852 - DNA, 22 bp, Artificial Sequence
  chemically synthesized
tcacaaattcactttaaaattt

SEQ ID NO: 1115853 - DNA, 22 bp, Artificial Sequence
  chemically synthesized
tacagatatattcaatgttgaa

SEQ ID NO: 1115854 - DNA, 22 bp, Artificial Sequence
  chemically synthesized
gtacagatatattcaatgttga

SEQ ID NO: 1115855 - DNA, 22 bp, Artificial Sequence
  chemically synthesized
actttaaaatttcaacattgaa

SEQ ID NO: 1115856 - DNA, 22 bp, Artificial Sequence
  chemically synthesized
taaaatttcaacattgaatata

SEQ ID NO: 1115857 - DNA, 22 bp, Artificial Sequence
  chemically synthesized
aaaatttcaacattgaatatat

SEQ ID NO: 1115858 - DNA, 22 bp, Artificial Sequence
  chemically synthesized
tcatttgtacagatatattcaa

SEQ ID NO: 1115859 - DNA, 22 bp, Artificial Sequence
  chemically synthesized
aaatttcaacattgaatatatc

SEQ ID NO: 1115860 - DNA, 22 bp, Artificial Sequence
  chemically synthesized
caacattgaatatatctgtaca

SEQ ID NO: 1115861 - DNA, 22 bp, Artificial Sequence
  chemically synthesized
aacattgaatatatctgtacaa

SEQ ID NO: 1115862 - DNA, 22 bp, Artificial Sequence
  chemically synthesized
aatatatctgtacaaatgataa

SEQ ID NO: 1115863 - DNA, 22 bp, Artificial Sequence
  chemically synthesized
cacccagcccatgttatcattt

SEQ ID NO: 1115864 - DNA, 22 bp, Artificial Sequence
  chemically synthesized
tacaaatgataacatgggctgg

SEQ ID NO: 1115865 - DNA, 22 bp, Artificial Sequence
  chemically synthesized
caggtgtgagccactgcaccca

SEQ ID NO: 1115866 - DNA, 22 bp, Artificial Sequence
  chemically synthesized
ggattacaggtgtgagccactg

SEQ ID NO: 1115867 - DNA, 22 bp, Artificial Sequence
  chemically synthesized
ggtgcagtggctcacacctgta

SEQ ID NO: 1115868 - DNA, 22 bp, Artificial Sequence
  chemically synthesized
gccccccaaagtgctgggatta

SEQ ID NO: 1115869 - DNA, 22 bp, Artificial Sequence
  chemically synthesized
acacctgtaatcccagcacttt

SEQ ID NO: 1115870 - DNA, 22 bp, Artificial Sequence
  chemically synthesized
taatcccagcactttggggggc

SEQ ID NO: 1115871 - DNA, 22 bp, Artificial Sequence
  chemically synthesized
aggtgatccacccgcgttggcc

SEQ ID NO: 1115872 - DNA, 22 bp, Artificial Sequence
  chemically synthesized
tggggggccaacgcgggtggat

SEQ ID NO: 1115873 - DNA, 22 bp, Artificial Sequence
  chemically synthesized
ggggggccaacgcgggtggatc

SEQ ID NO: 1115874 - DNA, 22 bp, Artificial Sequence
  chemically synthesized
ccgacctcaggtgatccacccg

SEQ ID NO: 1115875 - DNA, 22 bp, Artificial Sequence
  chemically synthesized
gggggccaacgcgggtggatca

SEQ ID NO: 1115876 - DNA, 22 bp, Artificial Sequence
  chemically synthesized
gaactcccgacctcaggtgatc

SEQ ID NO: 1115877 - DNA, 22 bp, Artificial Sequence
  chemically synthesized
gtctcgaactcccgacctcagg

SEQ ID NO: 1115878 - DNA, 22 bp, Artificial Sequence
  chemically synthesized
gccaggctggtctcgaactccc

SEQ ID NO: 1115879 - DNA, 22 bp, Artificial Sequence
  chemically synthesized
aggtcgggagttcgagaccagc

SEQ ID NO: 1115880 - DNA, 22 bp, Artificial Sequence
  chemically synthesized
accatgttggccaggctggtct

SEQ ID NO: 1115881 - DNA, 22 bp, Artificial Sequence
  chemically synthesized
caccatgttggccaggctggtc

SEQ ID NO: 1115882 - DNA, 22 bp, Artificial Sequence
  chemically synthesized
gagaccagcctggccaacatgg

SEQ ID NO: 1115883 - DNA, 22 bp, Artificial Sequence
  chemically synthesized
gtagagacagggtttcaccatg

SEQ ID NO: 1115884 - DNA, 22 bp, Artificial Sequence
  chemically synthesized
agtagagacagggtttcaccat

SEQ ID NO: 1115885 - DNA, 22 bp, Artificial Sequence
  chemically synthesized
tagtagagacagggtttcacca

SEQ ID NO: 1115886 - DNA, 22 bp, Artificial Sequence
  chemically synthesized
ttagtagagacagggtttcacc

SEQ ID NO: 1115887 - DNA, 22 bp, Artificial Sequence
  chemically synthesized
gccaacatggtgaaaccctgtc

SEQ ID NO: 1115888 - DNA, 22 bp, Artificial Sequence
  chemically synthesized
tatttttagtagagacagggtt

SEQ ID NO: 1115889 - DNA, 22 bp, Artificial Sequence
  chemically synthesized
gtatttttagtagagacagggt

SEQ ID NO: 1115890 - DNA, 22 bp, Artificial Sequence
  chemically synthesized
tgtttgtatttttagtagagac

SEQ ID NO: 1115891 - DNA, 22 bp, Artificial Sequence
  chemically synthesized
tctctactaaaaatacaaacat

SEQ ID NO: 1115892 - DNA, 22 bp, Artificial Sequence
  chemically synthesized
tactaaaaatacaaacataatt

SEQ ID NO: 1115893 - DNA, 22 bp, Artificial Sequence
  chemically synthesized
ctaaaaatacaaacataattat

SEQ ID NO: 1115894 - DNA, 22 bp, Artificial Sequence
  chemically synthesized
ccaccatgcccagataattatg

SEQ ID NO: 1115895 - DNA, 22 bp, Artificial Sequence
  chemically synthesized
aaaatacaaacataattatctg

SEQ ID NO: 1115896 - DNA, 22 bp, Artificial Sequence
  chemically synthesized
taggtgcctgccaccatgccca

SEQ ID NO: 1115897 - DNA, 22 bp, Artificial Sequence
  chemically synthesized
ggattataggtgcctgccacca

SEQ ID NO: 1115898 - DNA, 22 bp, Artificial Sequence
  chemically synthesized
tctgggcatggtggcaggcacc

SEQ ID NO: 1115899 - DNA, 22 bp, Artificial Sequence
  chemically synthesized
ggcatggtggcaggcacctata

SEQ ID NO: 1115900 - DNA, 22 bp, Artificial Sequence
  chemically synthesized
cagagtagctgggattataggt

SEQ ID NO: 1115901 - DNA, 22 bp, Artificial Sequence
  chemically synthesized
agcctccagagtagctgggatt

SEQ ID NO: 1115902 - DNA, 22 bp, Artificial Sequence
  chemically synthesized
cctcagcctccagagtagctgg

SEQ ID NO: 1115903 - DNA, 22 bp, Artificial Sequence
  chemically synthesized
ctgcctcagcctccagagtagc

SEQ ID NO: 1115904 - DNA, 22 bp, Artificial Sequence
  chemically synthesized
cctgcctcagcctccagagtag

SEQ ID NO: 1115905 - DNA, 22 bp, Artificial Sequence
  chemically synthesized
tcctgcctcagcctccagagta

SEQ ID NO: 1115906 - DNA, 22 bp, Artificial Sequence
  chemically synthesized
taatcccagctactctggaggc

SEQ ID NO: 1115907 - DNA, 22 bp, Artificial Sequence
  chemically synthesized
aagggattttcctgcctcagcc

SEQ ID NO: 1115908 - DNA, 22 bp, Artificial Sequence
  chemically synthesized
ctctggaggctgaggcaggaaa

SEQ ID NO: 1115909 - DNA, 22 bp, Artificial Sequence
  chemically synthesized
tggaggctgaggcaggaaaatc

SEQ ID NO: 1115910 - DNA, 22 bp, Artificial Sequence
  chemically synthesized
ccgggttcaagggattttcctg

SEQ ID NO: 1115911 - DNA, 22 bp, Artificial Sequence
  chemically synthesized
gaggctgaggcaggaaaatccc

SEQ ID NO: 1115912 - DNA, 22 bp, Artificial Sequence
  chemically synthesized
cctcccgggttcaagggatttt

SEQ ID NO: 1115913 - DNA, 22 bp, Artificial Sequence
  chemically synthesized
tgcctcccgggttcaagggatt

SEQ ID NO: 1115914 - DNA, 22 bp, Artificial Sequence
  chemically synthesized
aggcaggaaaatcccttgaacc

SEQ ID NO: 1115915 - DNA, 22 bp, Artificial Sequence
  chemically synthesized
caacctctgcctcccgggttca

SEQ ID NO: 1115916 - DNA, 22 bp, Artificial Sequence
  chemically synthesized
actgcaacctctgcctcccggg

SEQ ID NO: 1115917 - DNA, 22 bp, Artificial Sequence
  chemically synthesized
ggctcactgcaacctctgcctc

SEQ ID NO: 1115918 - DNA, 22 bp, Artificial Sequence
  chemically synthesized
gaacccgggaggcagaggttgc

SEQ ID NO: 1115919 - DNA, 22 bp, Artificial Sequence
  chemically synthesized
aacccgggaggcagaggttgca

SEQ ID NO: 1115920 - DNA, 22 bp, Artificial Sequence
  chemically synthesized
gagtgcaatggtgtgatctcgg

SEQ ID NO: 1115921 - DNA, 22 bp, Artificial Sequence
  chemically synthesized
cagtgagccgagatcacaccat

SEQ ID NO: 1115922 - DNA, 22 bp, Artificial Sequence
  chemically synthesized
tcacccaggctggagtgcaatg

SEQ ID NO: 1115923 - DNA, 22 bp, Artificial Sequence
  chemically synthesized
tgtcacccaggctggagtgcaa

SEQ ID NO: 1115924 - DNA, 22 bp, Artificial Sequence
  chemically synthesized
ctctgtcacccaggctggagtg

SEQ ID NO: 1115925 - DNA, 22 bp, Artificial Sequence
  chemically synthesized
actctgtcacccaggctggagt

SEQ ID NO: 1115926 - DNA, 22 bp, Artificial Sequence
  chemically synthesized
cactccagcctgggtgacagag

SEQ ID NO: 1115927 - DNA, 22 bp, Artificial Sequence
  chemically synthesized
agacagagtcttactctgtcac

SEQ ID NO: 1115928 - DNA, 22 bp, Artificial Sequence
  chemically synthesized
gagacagagtcttactctgtca

SEQ ID NO: 1115929 - DNA, 22 bp, Artificial Sequence
  chemically synthesized
tgagacagagtcttactctgtc

SEQ ID NO: 1115930 - DNA, 22 bp, Artificial Sequence
  chemically synthesized
ttgagacagagtcttactctgt

SEQ ID NO: 1115931 - DNA, 22 bp, Artificial Sequence
  chemically synthesized
cagcctgggtgacagagtaaga

SEQ ID NO: 1115932 - DNA, 22 bp, Artificial Sequence
  chemically synthesized
tttttgagacagagtcttactc

SEQ ID NO: 1115933 - DNA, 22 bp, Artificial Sequence
  chemically synthesized
atttttgagacagagtcttact

SEQ ID NO: 1115934 - DNA, 22 bp, Artificial Sequence
  chemically synthesized
tttatttttgagacagagtctt

SEQ ID NO: 1115935 - DNA, 22 bp, Artificial Sequence
  chemically synthesized
ggtgacagagtaagactctgtc

SEQ ID NO: 1115936 - DNA, 22 bp, Artificial Sequence
  chemically synthesized
atttatttttgagacagagtct

SEQ ID NO: 1115937 - DNA, 22 bp, Artificial Sequence
  chemically synthesized
tttatttatttttgagacagag

SEQ ID NO: 1115938 - DNA, 22 bp, Artificial Sequence
  chemically synthesized
atttatttatttttgagacaga

SEQ ID NO: 1115939 - DNA, 22 bp, Artificial Sequence
  chemically synthesized
tatttatttatttttgagacag

SEQ ID NO: 1115940 - DNA, 22 bp, Artificial Sequence
  chemically synthesized
ttttatttatttatttttgaga

SEQ ID NO: 1115941 - DNA, 22 bp, Artificial Sequence
  chemically synthesized
attttatttatttatttttgag

SEQ ID NO: 1115942 - DNA, 22 bp, Artificial Sequence
  chemically synthesized
tattttatttatttatttttga

SEQ ID NO: 1115943 - DNA, 22 bp, Artificial Sequence
  chemically synthesized
ttttattttatttatttatttt

SEQ ID NO: 1115944 - DNA, 22 bp, Artificial Sequence
  chemically synthesized
tgtctcaaaaataaataaataa

SEQ ID NO: 1115945 - DNA, 22 bp, Artificial Sequence
  chemically synthesized
atgttattttattttatttatt

SEQ ID NO: 1115946 - DNA, 22 bp, Artificial Sequence
  chemically synthesized
tctcaaaaataaataaataaaa

SEQ ID NO: 1115947 - DNA, 22 bp, Artificial Sequence
  chemically synthesized
aaaaataaataaataaaataaa

SEQ ID NO: 1115948 - DNA, 22 bp, Artificial Sequence
  chemically synthesized
cacaaaaatatatgttcatgtt

SEQ ID NO: 1115949 - DNA, 22 bp, Artificial Sequence
  chemically synthesized
tgttccacaaaaatatatgttc

SEQ ID NO: 1115950 - DNA, 22 bp, Artificial Sequence
  chemically synthesized
aaccataatgctgtgttccaca

SEQ ID NO: 1115951 - DNA, 22 bp, Artificial Sequence
  chemically synthesized
caaccataatgctgtgttccac

SEQ ID NO: 1115952 - DNA, 22 bp, Artificial Sequence
  chemically synthesized
tcaaccataatgctgtgttcca

SEQ ID NO: 1115953 - DNA, 22 bp, Artificial Sequence
  chemically synthesized
ttgtggaacacagcattatggt

SEQ ID NO: 1115954 - DNA, 22 bp, Artificial Sequence
  chemically synthesized
tgtggaacacagcattatggtt

SEQ ID NO: 1115955 - DNA, 22 bp, Artificial Sequence
  chemically synthesized
gtggaacacagcattatggttg

SEQ ID NO: 1115956 - DNA, 22 bp, Artificial Sequence
  chemically synthesized
tggaacacagcattatggttga

SEQ ID NO: 1115957 - DNA, 22 bp, Artificial Sequence
  chemically synthesized
tggttgaaaaccatgttttctt

SEQ ID NO: 1115958 - DNA, 22 bp, Artificial Sequence
  chemically synthesized
tatccatgtgtatccaagaaaa

SEQ ID NO: 1115959 - DNA, 22 bp, Artificial Sequence
  chemically synthesized
atatccatgtgtatccaagaaa

SEQ ID NO: 1115960 - DNA, 22 bp, Artificial Sequence
  chemically synthesized
tatatccatgtgtatccaagaa

SEQ ID NO: 1115961 - DNA, 22 bp, Artificial Sequence
  chemically synthesized
aaaaccatgttttcttggatac

SEQ ID NO: 1115962 - DNA, 22 bp, Artificial Sequence
  chemically synthesized
ccatctttatatccatgtgtat

SEQ ID NO: 1115963 - DNA, 22 bp, Artificial Sequence
  chemically synthesized
ttcccatctttatatccatgtg

SEQ ID NO: 1115964 - DNA, 22 bp, Artificial Sequence
  chemically synthesized
gttcccatctttatatccatgt

SEQ ID NO: 1115965 - DNA, 22 bp, Artificial Sequence
  chemically synthesized
tcttggatacacatggatataa

SEQ ID NO: 1115966 - DNA, 22 bp, Artificial Sequence
  chemically synthesized
ttgttcccatctttatatccat

SEQ ID NO: 1115967 - DNA, 22 bp, Artificial Sequence
  chemically synthesized
cttggatacacatggatataaa

SEQ ID NO: 1115968 - DNA, 22 bp, Artificial Sequence
  chemically synthesized
cttgttcccatctttatatcca

SEQ ID NO: 1115969 - DNA, 22 bp, Artificial Sequence
  chemically synthesized
ttggatacacatggatataaag

SEQ ID NO: 1115970 - DNA, 22 bp, Artificial Sequence
  chemically synthesized
ggatacacatggatataaagat

SEQ ID NO: 1115971 - DNA, 22 bp, Artificial Sequence
  chemically synthesized
gatacacatggatataaagatg

SEQ ID NO: 1115972 - DNA, 22 bp, Artificial Sequence
  chemically synthesized
gtagtccgcagtgtttcttgtt

SEQ ID NO: 1115973 - DNA, 22 bp, Artificial Sequence
  chemically synthesized
tagtagtccgcagtgtttcttg

SEQ ID NO: 1115974 - DNA, 22 bp, Artificial Sequence
  chemically synthesized
cccactctagtagtccgcagtg

SEQ ID NO: 1115975 - DNA, 22 bp, Artificial Sequence
  chemically synthesized
cctccccactctagtagtccgc

SEQ ID NO: 1115976 - DNA, 22 bp, Artificial Sequence
  chemically synthesized
actccctccccactctagtagt

SEQ ID NO: 1115977 - DNA, 22 bp, Artificial Sequence
  chemically synthesized
ccctcactccctccccactcta

SEQ ID NO: 1115978 - DNA, 22 bp, Artificial Sequence
  chemically synthesized
cccctcactccctccccactct

SEQ ID NO: 1115979 - DNA, 22 bp, Artificial Sequence
  chemically synthesized
tcccctcactccctccccactc

SEQ ID NO: 1115980 - DNA, 22 bp, Artificial Sequence
  chemically synthesized
ttcccctcactccctccccact

SEQ ID NO: 1115981 - DNA, 22 bp, Artificial Sequence
  chemically synthesized
cggactactagagtggggaggg

SEQ ID NO: 1115982 - DNA, 22 bp, Artificial Sequence
  chemically synthesized
gaccttttcccctcactccctc

SEQ ID NO: 1115983 - DNA, 22 bp, Artificial Sequence
  chemically synthesized
ggaccttttcccctcactccct

SEQ ID NO: 1115984 - DNA, 22 bp, Artificial Sequence
  chemically synthesized
ctagagtggggagggagtgagg

SEQ ID NO: 1115985 - DNA, 22 bp, Artificial Sequence
  chemically synthesized
tggaccttttcccctcactccc

SEQ ID NO: 1115986 - DNA, 22 bp, Artificial Sequence
  chemically synthesized
gagtggggagggagtgagggga

SEQ ID NO: 1115987 - DNA, 22 bp, Artificial Sequence
  chemically synthesized
ttttggaccttttcccctcact

SEQ ID NO: 1115988 - DNA, 22 bp, Artificial Sequence
  chemically synthesized
ctattttggaccttttcccctc

SEQ ID NO: 1115989 - DNA, 22 bp, Artificial Sequence
  chemically synthesized
agcatagtatccaatagctact

SEQ ID NO: 1115990 - DNA, 22 bp, Artificial Sequence
  chemically synthesized
gtgctgagcatagtatccaata

SEQ ID NO: 1115991 - DNA, 22 bp, Artificial Sequence
  chemically synthesized
ggtgctgagcatagtatccaat

SEQ ID NO: 1115992 - DNA, 22 bp, Artificial Sequence
  chemically synthesized
aggtttggtgctgagcatagta

SEQ ID NO: 1115993 - DNA, 22 bp, Artificial Sequence
  chemically synthesized
ttggatactatgctcagcacca

SEQ ID NO: 1115994 - DNA, 22 bp, Artificial Sequence
  chemically synthesized
gatactatgctcagcaccaaac

SEQ ID NO: 1115995 - DNA, 22 bp, Artificial Sequence
  chemically synthesized
tgtgacactgaggtttggtgct

SEQ ID NO: 1115996 - DNA, 22 bp, Artificial Sequence
  chemically synthesized
tgctcagcaccaaacctcagtg

SEQ ID NO: 1115997 - DNA, 22 bp, Artificial Sequence
  chemically synthesized
agcaccaaacctcagtgtcaca

SEQ ID NO: 1115998 - DNA, 22 bp, Artificial Sequence
  chemically synthesized
cgtgtgtatattgtgtgacact

SEQ ID NO: 1115999 - DNA, 22 bp, Artificial Sequence
  chemically synthesized
ttacgtgtgtatattgtgtgac

SEQ ID NO: 1116000 - DNA, 22 bp, Artificial Sequence
  chemically synthesized
gttacgtgtgtatattgtgtga

SEQ ID NO: 1116001 - DNA, 22 bp, Artificial Sequence
  chemically synthesized
agtgtcacacaatatacacacg

SEQ ID NO: 1116002 - DNA, 22 bp, Artificial Sequence
  chemically synthesized
aagagtaaatgtgcaggtttgt

SEQ ID NO: 1116003 - DNA, 22 bp, Artificial Sequence
  chemically synthesized
gattcaagagtaaatgtgcagg

SEQ ID NO: 1116004 - DNA, 22 bp, Artificial Sequence
  chemically synthesized
ggattcaagagtaaatgtgcag

SEQ ID NO: 1116005 - DNA, 22 bp, Artificial Sequence
  chemically synthesized
tggattcaagagtaaatgtgca

SEQ ID NO: 1116006 - DNA, 22 bp, Artificial Sequence
  chemically synthesized
ttggattcaagagtaaatgtgc

SEQ ID NO: 1116007 - DNA, 22 bp, Artificial Sequence
  chemically synthesized
aacttttggattcaagagtaaa

SEQ ID NO: 1116008 - DNA, 22 bp, Artificial Sequence
  chemically synthesized
caacttttggattcaagagtaa

SEQ ID NO: 1116009 - DNA, 22 bp, Artificial Sequence
  chemically synthesized
taatttcaacttttggattcaa

SEQ ID NO: 1116010 - DNA, 22 bp, Artificial Sequence
  chemically synthesized
cacatttactcttgaatccaaa

SEQ ID NO: 1116011 - DNA, 22 bp, Artificial Sequence
  chemically synthesized
ataatttcaacttttggattca

SEQ ID NO: 1116012 - DNA, 22 bp, Artificial Sequence
  chemically synthesized
tataatttcaacttttggattc

SEQ ID NO: 1116013 - DNA, 22 bp, Artificial Sequence
  chemically synthesized
ttataatttcaacttttggatt

SEQ ID NO: 1116014 - DNA, 22 bp, Artificial Sequence
  chemically synthesized
tttataatttcaacttttggat

SEQ ID NO: 1116015 - DNA, 22 bp, Artificial Sequence
  chemically synthesized
ttttttataatttcaacttttg

SEQ ID NO: 1116016 - DNA, 22 bp, Artificial Sequence
  chemically synthesized
actcttgaatccaaaagttgaa

SEQ ID NO: 1116017 - DNA, 22 bp, Artificial Sequence
  chemically synthesized
attttttataatttcaactttt

SEQ ID NO: 1116018 - DNA, 22 bp, Artificial Sequence
  chemically synthesized
ctcttgaatccaaaagttgaaa

SEQ ID NO: 1116019 - DNA, 22 bp, Artificial Sequence
  chemically synthesized
tattttttataatttcaacttt

SEQ ID NO: 1116020 - DNA, 22 bp, Artificial Sequence
  chemically synthesized
ttgaatccaaaagttgaaatta

SEQ ID NO: 1116021 - DNA, 22 bp, Artificial Sequence
  chemically synthesized
ttttattttttataatttcaac

SEQ ID NO: 1116022 - DNA, 22 bp, Artificial Sequence
  chemically synthesized
attttattttttataatttcaa

SEQ ID NO: 1116023 - DNA, 22 bp, Artificial Sequence
  chemically synthesized
gaatccaaaagttgaaattata

SEQ ID NO: 1116024 - DNA, 22 bp, Artificial Sequence
  chemically synthesized
tattttattttttataatttca

SEQ ID NO: 1116025 - DNA, 22 bp, Artificial Sequence
  chemically synthesized
aatccaaaagttgaaattataa

SEQ ID NO: 1116026 - DNA, 22 bp, Artificial Sequence
  chemically synthesized
ttattttattttttataatttc

SEQ ID NO: 1116027 - DNA, 22 bp, Artificial Sequence
  chemically synthesized
atttttattttattttttataa

SEQ ID NO: 1116028 - DNA, 22 bp, Artificial Sequence
  chemically synthesized
catttttattttattttttata

SEQ ID NO: 1116029 - DNA, 22 bp, Artificial Sequence
  chemically synthesized
tcatttttattttattttttat

SEQ ID NO: 1116030 - DNA, 22 bp, Artificial Sequence
  chemically synthesized
ttcatttttattttatttttta

SEQ ID NO: 1116031 - DNA, 22 bp, Artificial Sequence
  chemically synthesized
tttttcatttttattttatttt

SEQ ID NO: 1116032 - DNA, 22 bp, Artificial Sequence
  chemically synthesized
atttttcatttttattttattt

SEQ ID NO: 1116033 - DNA, 22 bp, Artificial Sequence
  chemically synthesized
aaattataaaaaataaaataaa

SEQ ID NO: 1116034 - DNA, 22 bp, Artificial Sequence
  chemically synthesized
taaaaaataaaataaaaatgaa

SEQ ID NO: 1116035 - DNA, 22 bp, Artificial Sequence
  chemically synthesized
gtatgtttatttttcattttta

SEQ ID NO: 1116036 - DNA, 22 bp, Artificial Sequence
  chemically synthesized
ggtatgtttatttttcattttt

SEQ ID NO: 1116037 - DNA, 22 bp, Artificial Sequence
  chemically synthesized
tggtatgtttatttttcatttt

SEQ ID NO: 1116038 - DNA, 22 bp, Artificial Sequence
  chemically synthesized
ttggtatgtttatttttcattt

SEQ ID NO: 1116039 - DNA, 22 bp, Artificial Sequence
  chemically synthesized
tttttggtatgtttatttttca

SEQ ID NO: 1116040 - DNA, 22 bp, Artificial Sequence
  chemically synthesized
atttttggtatgtttatttttc

SEQ ID NO: 1116041 - DNA, 22 bp, Artificial Sequence
  chemically synthesized
agtggaaatgtatttatttttg

SEQ ID NO: 1116042 - DNA, 22 bp, Artificial Sequence
  chemically synthesized
aattcagtggaaatgtatttat

SEQ ID NO: 1116043 - DNA, 22 bp, Artificial Sequence
  chemically synthesized
taaattcagtggaaatgtattt

SEQ ID NO: 1116044 - DNA, 22 bp, Artificial Sequence
  chemically synthesized
ctaaattcagtggaaatgtatt

SEQ ID NO: 1116045 - DNA, 22 bp, Artificial Sequence
  chemically synthesized
cacaaatttctaaattcagtgg

SEQ ID NO: 1116046 - DNA, 22 bp, Artificial Sequence
  chemically synthesized
aagcagttacacaaatttctaa

SEQ ID NO: 1116047 - DNA, 22 bp, Artificial Sequence
  chemically synthesized
caagcagttacacaaatttcta

SEQ ID NO: 1116048 - DNA, 22 bp, Artificial Sequence
  chemically synthesized
tcaagcagttacacaaatttct

SEQ ID NO: 1116049 - DNA, 22 bp, Artificial Sequence
  chemically synthesized
ccactgaatttagaaatttgtg

SEQ ID NO: 1116050 - DNA, 22 bp, Artificial Sequence
  chemically synthesized
cactgaatttagaaatttgtgt

SEQ ID NO: 1116051 - DNA, 22 bp, Artificial Sequence
  chemically synthesized
ctttcaagcagttacacaaatt

SEQ ID NO: 1116052 - DNA, 22 bp, Artificial Sequence
  chemically synthesized
aatttagaaatttgtgtaactg

SEQ ID NO: 1116053 - DNA, 22 bp, Artificial Sequence
  chemically synthesized
agaaatttgtgtaactgcttga

SEQ ID NO: 1116054 - DNA, 22 bp, Artificial Sequence
  chemically synthesized
gaaatttgtgtaactgcttgaa

SEQ ID NO: 1116055 - DNA, 22 bp, Artificial Sequence
  chemically synthesized
gtgtaactgcttgaaagtaatt

SEQ ID NO: 1116056 - DNA, 22 bp, Artificial Sequence
  chemically synthesized
tatgaacaccacaattactttc

SEQ ID NO: 1116057 - DNA, 22 bp, Artificial Sequence
  chemically synthesized
tgtaactgcttgaaagtaattg

SEQ ID NO: 1116058 - DNA, 22 bp, Artificial Sequence
  chemically synthesized
tgaattatatgaacaccacaat

SEQ ID NO: 1116059 - DNA, 22 bp, Artificial Sequence
  chemically synthesized
atgaattatatgaacaccacaa

SEQ ID NO: 1116060 - DNA, 22 bp, Artificial Sequence
  chemically synthesized
cttgaaagtaattgtggtgttc

SEQ ID NO: 1116061 - DNA, 22 bp, Artificial Sequence
  chemically synthesized
tatgaattatatgaacaccaca

SEQ ID NO: 1116062 - DNA, 22 bp, Artificial Sequence
  chemically synthesized
gaaagtaattgtggtgttcata

SEQ ID NO: 1116063 - DNA, 22 bp, Artificial Sequence
  chemically synthesized
aaagtaattgtggtgttcatat

SEQ ID NO: 1116064 - DNA, 22 bp, Artificial Sequence
  chemically synthesized
actttatgaattatatgaacac

SEQ ID NO: 1116065 - DNA, 22 bp, Artificial Sequence
  chemically synthesized
attaactttatgaattatatga

SEQ ID NO: 1116066 - DNA, 22 bp, Artificial Sequence
  chemically synthesized
ttaattaactttatgaattata

SEQ ID NO: 1116067 - DNA, 22 bp, Artificial Sequence
  chemically synthesized
tggtgttcatataattcataaa

SEQ ID NO: 1116068 - DNA, 22 bp, Artificial Sequence
  chemically synthesized
attattaattaactttatgaat

SEQ ID NO: 1116069 - DNA, 22 bp, Artificial Sequence
  chemically synthesized
attcattattaattaactttat

SEQ ID NO: 1116070 - DNA, 22 bp, Artificial Sequence
  chemically synthesized
atataattcataaagttaatta

SEQ ID NO: 1116071 - DNA, 22 bp, Artificial Sequence
  chemically synthesized
tgattgattcattattaattaa

SEQ ID NO: 1116072 - DNA, 22 bp, Artificial Sequence
  chemically synthesized
ataaagttaattaataatgaat

SEQ ID NO: 1116073 - DNA, 22 bp, Artificial Sequence
  chemically synthesized
gagtctgtgattgattcattat

SEQ ID NO: 1116074 - DNA, 22 bp, Artificial Sequence
  chemically synthesized
tagagtctgtgattgattcatt

SEQ ID NO: 1116075 - DNA, 22 bp, Artificial Sequence
  chemically synthesized
ctctagagtctgtgattgattc

SEQ ID NO: 1116076 - DNA, 22 bp, Artificial Sequence
  chemically synthesized
actctagagtctgtgattgatt

SEQ ID NO: 1116077 - DNA, 22 bp, Artificial Sequence
  chemically synthesized
tactctagagtctgtgattgat

SEQ ID NO: 1116078 - DNA, 22 bp, Artificial Sequence
  chemically synthesized
attaataatgaatcaatcacag

SEQ ID NO: 1116079 - DNA, 22 bp, Artificial Sequence
  chemically synthesized
ataatgaatcaatcacagactc

SEQ ID NO: 1116080 - DNA, 22 bp, Artificial Sequence
  chemically synthesized
cattttactctagagtctgtga

SEQ ID NO: 1116081 - DNA, 22 bp, Artificial Sequence
  chemically synthesized
acattttactctagagtctgtg

SEQ ID NO: 1116082 - DNA, 22 bp, Artificial Sequence
  chemically synthesized
tacattttactctagagtctgt

SEQ ID NO: 1116083 - DNA, 22 bp, Artificial Sequence
  chemically synthesized
tagttttacattttactctaga

SEQ ID NO: 1116084 - DNA, 22 bp, Artificial Sequence
  chemically synthesized
atagttttacattttactctag

SEQ ID NO: 1116085 - DNA, 22 bp, Artificial Sequence
  chemically synthesized
tatagttttacattttactcta

SEQ ID NO: 1116086 - DNA, 22 bp, Artificial Sequence
  chemically synthesized
ggagttttatagttttacattt

SEQ ID NO: 1116087 - DNA, 22 bp, Artificial Sequence
  chemically synthesized
ctaggagttttatagttttaca

SEQ ID NO: 1116088 - DNA, 22 bp, Artificial Sequence
  chemically synthesized
tagagtaaaatgtaaaactata

SEQ ID NO: 1116089 - DNA, 22 bp, Artificial Sequence
  chemically synthesized
gagtaaaatgtaaaactataaa

SEQ ID NO: 1116090 - DNA, 22 bp, Artificial Sequence
  chemically synthesized
tctgctaggagttttatagttt

SEQ ID NO: 1116091 - DNA, 22 bp, Artificial Sequence
  chemically synthesized
ctatctgctaggagttttatag

SEQ ID NO: 1116092 - DNA, 22 bp, Artificial Sequence
  chemically synthesized
cactgctatctgctaggagttt

SEQ ID NO: 1116093 - DNA, 22 bp, Artificial Sequence
  chemically synthesized
tccactgctatctgctaggagt

SEQ ID NO: 1116094 - DNA, 22 bp, Artificial Sequence
  chemically synthesized
ctccactgctatctgctaggag

SEQ ID NO: 1116095 - DNA, 22 bp, Artificial Sequence
  chemically synthesized
tctccactgctatctgctagga

SEQ ID NO: 1116096 - DNA, 22 bp, Artificial Sequence
  chemically synthesized
ttttctccactgctatctgcta

SEQ ID NO: 1116097 - DNA, 22 bp, Artificial Sequence
  chemically synthesized
tgttttctccactgctatctgc

SEQ ID NO: 1116098 - DNA, 22 bp, Artificial Sequence
  chemically synthesized
taaaactcctagcagatagcag

SEQ ID NO: 1116099 - DNA, 22 bp, Artificial Sequence
  chemically synthesized
ctagcagatagcagtggagaaa

SEQ ID NO: 1116100 - DNA, 22 bp, Artificial Sequence
  chemically synthesized
aaagtcacctctgttttctcca

SEQ ID NO: 1116101 - DNA, 22 bp, Artificial Sequence
  chemically synthesized
gcagatagcagtggagaaaaca

SEQ ID NO: 1116102 - DNA, 22 bp, Artificial Sequence
  chemically synthesized
tcaacaaactcaaagtcacctc

SEQ ID NO: 1116103 - DNA, 22 bp, Artificial Sequence
  chemically synthesized
aaaaactatcaacaaactcaaa

SEQ ID NO: 1116104 - DNA, 22 bp, Artificial Sequence
  chemically synthesized
gtggtgtatctaaaaaactatc

SEQ ID NO: 1116105 - DNA, 22 bp, Artificial Sequence
  chemically synthesized
ggtggtgtatctaaaaaactat

SEQ ID NO: 1116106 - DNA, 22 bp, Artificial Sequence
  chemically synthesized
tgagtttgttgatagtttttta

SEQ ID NO: 1116107 - DNA, 22 bp, Artificial Sequence
  chemically synthesized
tggtggtgtatctaaaaaacta

SEQ ID NO: 1116108 - DNA, 22 bp, Artificial Sequence
  chemically synthesized
gagtttgttgatagttttttag

SEQ ID NO: 1116109 - DNA, 22 bp, Artificial Sequence
  chemically synthesized
agtttgttgatagttttttaga

SEQ ID NO: 1116110 - DNA, 22 bp, Artificial Sequence
  chemically synthesized
gttgatagttttttagatacac

SEQ ID NO: 1116111 - DNA, 22 bp, Artificial Sequence
  chemically synthesized
ttgatagttttttagatacacc

SEQ ID NO: 1116112 - DNA, 22 bp, Artificial Sequence
  chemically synthesized
atagttttttagatacaccacc

SEQ ID NO: 1116113 - DNA, 22 bp, Artificial Sequence
  chemically synthesized
atggatcatccctttggtggtg

SEQ ID NO: 1116114 - DNA, 22 bp, Artificial Sequence
  chemically synthesized
catggatcatccctttggtggt

SEQ ID NO: 1116115 - DNA, 22 bp, Artificial Sequence
  chemically synthesized
tcatggatcatccctttggtgg

SEQ ID NO: 1116116 - DNA, 22 bp, Artificial Sequence
  chemically synthesized
tttagatacaccaccaaaggga

SEQ ID NO: 1116117 - DNA, 22 bp, Artificial Sequence
  chemically synthesized
tttcatggatcatccctttggt

SEQ ID NO: 1116118 - DNA, 22 bp, Artificial Sequence
  chemically synthesized
ttagatacaccaccaaagggat

SEQ ID NO: 1116119 - DNA, 22 bp, Artificial Sequence
  chemically synthesized
ctttcatggatcatccctttgg

SEQ ID NO: 1116120 - DNA, 22 bp, Artificial Sequence
  chemically synthesized
tagatacaccaccaaagggatg

SEQ ID NO: 1116121 - DNA, 22 bp, Artificial Sequence
  chemically synthesized
tctttcatggatcatccctttg

SEQ ID NO: 1116122 - DNA, 22 bp, Artificial Sequence
  chemically synthesized
agatacaccaccaaagggatga

SEQ ID NO: 1116123 - DNA, 22 bp, Artificial Sequence
  chemically synthesized
gatacaccaccaaagggatgat

SEQ ID NO: 1116124 - DNA, 22 bp, Artificial Sequence
  chemically synthesized
tttctttcatggatcatccctt

SEQ ID NO: 1116125 - DNA, 22 bp, Artificial Sequence
  chemically synthesized
attctttctttcatggatcatc

SEQ ID NO: 1116126 - DNA, 22 bp, Artificial Sequence
  chemically synthesized
ttaattctttctttcatggatc

SEQ ID NO: 1116127 - DNA, 22 bp, Artificial Sequence
  chemically synthesized
attaattctttctttcatggat

SEQ ID NO: 1116128 - DNA, 22 bp, Artificial Sequence
  chemically synthesized
aacttattaattctttctttca

SEQ ID NO: 1116129 - DNA, 22 bp, Artificial Sequence
  chemically synthesized
ttcaacttattaattctttctt

SEQ ID NO: 1116130 - DNA, 22 bp, Artificial Sequence
  chemically synthesized
gtactattcaacttattaattc

SEQ ID NO: 1116131 - DNA, 22 bp, Artificial Sequence
  chemically synthesized
agtactattcaacttattaatt

SEQ ID NO: 1116132 - DNA, 22 bp, Artificial Sequence
  chemically synthesized
acttagtactattcaacttatt

SEQ ID NO: 1116133 - DNA, 22 bp, Artificial Sequence
  chemically synthesized
aacttagtactattcaacttat

SEQ ID NO: 1116134 - DNA, 22 bp, Artificial Sequence
  chemically synthesized
taacttagtactattcaactta

SEQ ID NO: 1116135 - DNA, 22 bp, Artificial Sequence
  chemically synthesized
ttaacttagtactattcaactt

SEQ ID NO: 1116136 - DNA, 22 bp, Artificial Sequence
  chemically synthesized
ataagttgaatagtactaagtt

SEQ ID NO: 1116137 - DNA, 22 bp, Artificial Sequence
  chemically synthesized
acagagcagaaccttttaactt

SEQ ID NO: 1116138 - DNA, 22 bp, Artificial Sequence
  chemically synthesized
cacagagcagaaccttttaact

SEQ ID NO: 1116139 - DNA, 22 bp, Artificial Sequence
  chemically synthesized
tcacagagcagaaccttttaac

SEQ ID NO: 1116140 - DNA, 22 bp, Artificial Sequence
  chemically synthesized
aatagtactaagttaaaaggtt

SEQ ID NO: 1116141 - DNA, 22 bp, Artificial Sequence
  chemically synthesized
gcagcatctttcacagagcaga

SEQ ID NO: 1116142 - DNA, 22 bp, Artificial Sequence
  chemically synthesized
agttaaaaggttctgctctgtg

SEQ ID NO: 1116143 - DNA, 22 bp, Artificial Sequence
  chemically synthesized
ggcagcatctttcacagagcag

SEQ ID NO: 1116144 - DNA, 22 bp, Artificial Sequence
  chemically synthesized
tggcagcatctttcacagagca

SEQ ID NO: 1116145 - DNA, 22 bp, Artificial Sequence
  chemically synthesized
ttggcagcatctttcacagagc

SEQ ID NO: 1116146 - DNA, 22 bp, Artificial Sequence
  chemically synthesized
ttttggcagcatctttcacaga

SEQ ID NO: 1116147 - DNA, 22 bp, Artificial Sequence
  chemically synthesized
aaaggttctgctctgtgaaaga

SEQ ID NO: 1116148 - DNA, 22 bp, Artificial Sequence
  chemically synthesized
gttcttttggcagcatctttca

SEQ ID NO: 1116149 - DNA, 22 bp, Artificial Sequence
  chemically synthesized
cgttcttttggcagcatctttc

SEQ ID NO: 1116150 - DNA, 22 bp, Artificial Sequence
  chemically synthesized
tcgttcttttggcagcatcttt

SEQ ID NO: 1116151 - DNA, 22 bp, Artificial Sequence
  chemically synthesized
ttcgttcttttggcagcatctt

SEQ ID NO: 1116152 - DNA, 22 bp, Artificial Sequence
  chemically synthesized
tgctctgtgaaagatgctgcca

SEQ ID NO: 1116153 - DNA, 22 bp, Artificial Sequence
  chemically synthesized
ttttcgttcttttggcagcatc

SEQ ID NO: 1116154 - DNA, 22 bp, Artificial Sequence
  chemically synthesized
cttttcgttcttttggcagcat

SEQ ID NO: 1116155 - DNA, 22 bp, Artificial Sequence
  chemically synthesized
ctctgtgaaagatgctgccaaa

SEQ ID NO: 1116156 - DNA, 22 bp, Artificial Sequence
  chemically synthesized
tcttttcgttcttttggcagca

SEQ ID NO: 1116157 - DNA, 22 bp, Artificial Sequence
  chemically synthesized
ttcttttcgttcttttggcagc

SEQ ID NO: 1116158 - DNA, 22 bp, Artificial Sequence
  chemically synthesized
tgtgaaagatgctgccaaaaga

SEQ ID NO: 1116159 - DNA, 22 bp, Artificial Sequence
  chemically synthesized
tgaaagatgctgccaaaagaac

SEQ ID NO: 1116160 - DNA, 22 bp, Artificial Sequence
  chemically synthesized
tggcttttcttttcgttctttt

SEQ ID NO: 1116161 - DNA, 22 bp, Artificial Sequence
  chemically synthesized
agcctgtggcttttcttttcgt

SEQ ID NO: 1116162 - DNA, 22 bp, Artificial Sequence
  chemically synthesized
gagcctgtggcttttcttttcg

SEQ ID NO: 1116163 - DNA, 22 bp, Artificial Sequence
  chemically synthesized
tgagcctgtggcttttcttttc

SEQ ID NO: 1116164 - DNA, 22 bp, Artificial Sequence
  chemically synthesized
ccaaaagaacgaaaagaaaagc

SEQ ID NO: 1116165 - DNA, 22 bp, Artificial Sequence
  chemically synthesized
tttgagcctgtggcttttcttt

SEQ ID NO: 1116166 - DNA, 22 bp, Artificial Sequence
  chemically synthesized
ctttgagcctgtggcttttctt

SEQ ID NO: 1116167 - DNA, 22 bp, Artificial Sequence
  chemically synthesized
tctttgagcctgtggcttttct

SEQ ID NO: 1116168 - DNA, 22 bp, Artificial Sequence
  chemically synthesized
gtaaatattttctttgagcctg

SEQ ID NO: 1116169 - DNA, 22 bp, Artificial Sequence
  chemically synthesized
cgtaaatattttctttgagcct

SEQ ID NO: 1116170 - DNA, 22 bp, Artificial Sequence
  chemically synthesized
tcgtaaatattttctttgagcc

SEQ ID NO: 1116171 - DNA, 22 bp, Artificial Sequence
  chemically synthesized
ccagatatgtctttcgtaaata

SEQ ID NO: 1116172 - DNA, 22 bp, Artificial Sequence
  chemically synthesized
taccagatatgtctttcgtaaa

SEQ ID NO: 1116173 - DNA, 22 bp, Artificial Sequence
  chemically synthesized
aaagaaaatatttacgaaagac

SEQ ID NO: 1116174 - DNA, 22 bp, Artificial Sequence
  chemically synthesized
tctaccagatatgtctttcgta

SEQ ID NO: 1116175 - DNA, 22 bp, Artificial Sequence
  chemically synthesized
ggataagaattctctaccagat

SEQ ID NO: 1116176 - DNA, 22 bp, Artificial Sequence
  chemically synthesized
acgaaagacatatctggtagag

SEQ ID NO: 1116177 - DNA, 22 bp, Artificial Sequence
  chemically synthesized
cggataagaattctctaccaga

SEQ ID NO: 1116178 - DNA, 22 bp, Artificial Sequence
  chemically synthesized
cgaaagacatatctggtagaga

SEQ ID NO: 1116179 - DNA, 22 bp, Artificial Sequence
  chemically synthesized
tgtatttcggataagaattctc

SEQ ID NO: 1116180 - DNA, 22 bp, Artificial Sequence
  chemically synthesized
gtgtatttcggataagaattct

SEQ ID NO: 1116181 - DNA, 22 bp, Artificial Sequence
  chemically synthesized
tgtgtatttcggataagaattc

SEQ ID NO: 1116182 - DNA, 22 bp, Artificial Sequence
  chemically synthesized
tttgtgtatttcggataagaat

SEQ ID NO: 1116183 - DNA, 22 bp, Artificial Sequence
  chemically synthesized
gtagagaattcttatccgaaat

SEQ ID NO: 1116184 - DNA, 22 bp, Artificial Sequence
  chemically synthesized
agagttctttgtgtatttcgga

SEQ ID NO: 1116185 - DNA, 22 bp, Artificial Sequence
  chemically synthesized
aagagttctttgtgtatttcgg

SEQ ID NO: 1116186 - DNA, 22 bp, Artificial Sequence
  chemically synthesized
taagagttctttgtgtatttcg

SEQ ID NO: 1116187 - DNA, 22 bp, Artificial Sequence
  chemically synthesized
agttttaagagttctttgtgta

SEQ ID NO: 1116188 - DNA, 22 bp, Artificial Sequence
  chemically synthesized
ttatccgaaatacacaaagaac

SEQ ID NO: 1116189 - DNA, 22 bp, Artificial Sequence
  chemically synthesized
ctgagttttaagagttctttgt

SEQ ID NO: 1116190 - DNA, 22 bp, Artificial Sequence
  chemically synthesized
atccgaaatacacaaagaactc

SEQ ID NO: 1116191 - DNA, 22 bp, Artificial Sequence
  chemically synthesized
tccgaaatacacaaagaactct

SEQ ID NO: 1116192 - DNA, 22 bp, Artificial Sequence
  chemically synthesized
ttactgagttttaagagttctt

SEQ ID NO: 1116193 - DNA, 22 bp, Artificial Sequence
  chemically synthesized
gttactgagttttaagagttct

SEQ ID NO: 1116194 - DNA, 22 bp, Artificial Sequence
  chemically synthesized
tgttactgagttttaagagttc

SEQ ID NO: 1116195 - DNA, 22 bp, Artificial Sequence
  chemically synthesized
ttgttactgagttttaagagtt

SEQ ID NO: 1116196 - DNA, 22 bp, Artificial Sequence
  chemically synthesized
tttttgttactgagttttaaga

SEQ ID NO: 1116197 - DNA, 22 bp, Artificial Sequence
  chemically synthesized
gtttttgttactgagttttaag

SEQ ID NO: 1116198 - DNA, 22 bp, Artificial Sequence
  chemically synthesized
tttgtttttgttactgagtttt

SEQ ID NO: 1116199 - DNA, 22 bp, Artificial Sequence
  chemically synthesized
gtttgtttttgttactgagttt

SEQ ID NO: 1116200 - DNA, 22 bp, Artificial Sequence
  chemically synthesized
gtttgtttgtttttgttactga

SEQ ID NO: 1116201 - DNA, 22 bp, Artificial Sequence
  chemically synthesized
agtttgtttgtttttgttactg

SEQ ID NO: 1116202 - DNA, 22 bp, Artificial Sequence
  chemically synthesized
tagtttgtttgtttttgttact

SEQ ID NO: 1116203 - DNA, 22 bp, Artificial Sequence
  chemically synthesized
ttaaaactcagtaacaaaaaca

SEQ ID NO: 1116204 - DNA, 22 bp, Artificial Sequence
  chemically synthesized
aaaactcagtaacaaaaacaaa

SEQ ID NO: 1116205 - DNA, 22 bp, Artificial Sequence
  chemically synthesized
aaactcagtaacaaaaacaaac

SEQ ID NO: 1116206 - DNA, 22 bp, Artificial Sequence
  chemically synthesized
cccatgttttagtttgtttgtt

SEQ ID NO: 1116207 - DNA, 22 bp, Artificial Sequence
  chemically synthesized
gcccatgttttagtttgtttgt

SEQ ID NO: 1116208 - DNA, 22 bp, Artificial Sequence
  chemically synthesized
tgcccatgttttagtttgtttg

SEQ ID NO: 1116209 - DNA, 22 bp, Artificial Sequence
  chemically synthesized
agtaacaaaaacaaacaaacta

SEQ ID NO: 1116210 - DNA, 22 bp, Artificial Sequence
  chemically synthesized
ttgcccatgttttagtttgttt

SEQ ID NO: 1116211 - DNA, 22 bp, Artificial Sequence
  chemically synthesized
aggatttttgcccatgttttag

SEQ ID NO: 1116212 - DNA, 22 bp, Artificial Sequence
  chemically synthesized
ttaaggatttttgcccatgttt

SEQ ID NO: 1116213 - DNA, 22 bp, Artificial Sequence
  chemically synthesized
aaacatgggcaaaaatccttaa

SEQ ID NO: 1116214 - DNA, 22 bp, Artificial Sequence
  chemically synthesized
gtgaggtgtctgttaaggattt

SEQ ID NO: 1116215 - DNA, 22 bp, Artificial Sequence
  chemically synthesized
ggtgaggtgtctgttaaggatt

SEQ ID NO: 1116216 - DNA, 22 bp, Artificial Sequence
  chemically synthesized
tggtgaggtgtctgttaaggat

SEQ ID NO: 1116217 - DNA, 22 bp, Artificial Sequence
  chemically synthesized
ctttggtgaggtgtctgttaag

SEQ ID NO: 1116218 - DNA, 22 bp, Artificial Sequence
  chemically synthesized
cctttggtgaggtgtctgttaa

SEQ ID NO: 1116219 - DNA, 22 bp, Artificial Sequence
  chemically synthesized
tatacttcctttggtgaggtgt

SEQ ID NO: 1116220 - DNA, 22 bp, Artificial Sequence
  chemically synthesized
aacagacacctcaccaaaggaa

SEQ ID NO: 1116221 - DNA, 22 bp, Artificial Sequence
  chemically synthesized
ccatctgtatacttcctttggt

SEQ ID NO: 1116222 - DNA, 22 bp, Artificial Sequence
  chemically synthesized
acagacacctcaccaaaggaag

SEQ ID NO: 1116223 - DNA, 22 bp, Artificial Sequence
  chemically synthesized
gccatctgtatacttcctttgg

SEQ ID NO: 1116224 - DNA, 22 bp, Artificial Sequence
  chemically synthesized
tttgccatctgtatacttcctt

SEQ ID NO: 1116225 - DNA, 22 bp, Artificial Sequence
  chemically synthesized
atttgccatctgtatacttcct

SEQ ID NO: 1116226 - DNA, 22 bp, Artificial Sequence
  chemically synthesized
cttatttgccatctgtatactt

SEQ ID NO: 1116227 - DNA, 22 bp, Artificial Sequence
  chemically synthesized
gcttatttgccatctgtatact

SEQ ID NO: 1116228 - DNA, 22 bp, Artificial Sequence
  chemically synthesized
accaaaggaagtatacagatgg

SEQ ID NO: 1116229 - DNA, 22 bp, Artificial Sequence
  chemically synthesized
atttgcttatttgccatctgta

SEQ ID NO: 1116230 - DNA, 22 bp, Artificial Sequence
  chemically synthesized
catttgcttatttgccatctgt

SEQ ID NO: 1116231 - DNA, 22 bp, Artificial Sequence
  chemically synthesized
tcatttgcttatttgccatctg

SEQ ID NO: 1116232 - DNA, 22 bp, Artificial Sequence
  chemically synthesized
gtaacatatgatgtgaaacata

SEQ ID NO: 1116233 - DNA, 22 bp, Artificial Sequence
  chemically synthesized
cctggtaacatatgatgtgaaa

SEQ ID NO: 1116234 - DNA, 22 bp, Artificial Sequence
  chemically synthesized
taattccctggtaacatatgat

SEQ ID NO: 1116235 - DNA, 22 bp, Artificial Sequence
  chemically synthesized
gtaattccctggtaacatatga

SEQ ID NO: 1116236 - DNA, 22 bp, Artificial Sequence
  chemically synthesized
atttgtaattccctggtaacat

SEQ ID NO: 1116237 - DNA, 22 bp, Artificial Sequence
  chemically synthesized
aatttgtaattccctggtaaca

SEQ ID NO: 1116238 - DNA, 22 bp, Artificial Sequence
  chemically synthesized
cacatcatatgttaccagggaa

SEQ ID NO: 1116239 - DNA, 22 bp, Artificial Sequence
  chemically synthesized
tttaatttgtaattccctggta

SEQ ID NO: 1116240 - DNA, 22 bp, Artificial Sequence
  chemically synthesized
acatcatatgttaccagggaat

SEQ ID NO: 1116241 - DNA, 22 bp, Artificial Sequence
  chemically synthesized
attgtttaatttgtaattccct

SEQ ID NO: 1116242 - DNA, 22 bp, Artificial Sequence
  chemically synthesized
ccagggaattacaaattaaaca

SEQ ID NO: 1116243 - DNA, 22 bp, Artificial Sequence
  chemically synthesized
caaattaaacaatgagatacca

SEQ ID NO: 1116244 - DNA, 22 bp, Artificial Sequence
  chemically synthesized
ataggtgtgtagtggtatctca

SEQ ID NO: 1116245 - DNA, 22 bp, Artificial Sequence
  chemically synthesized
taataggtgtgtagtggtatct

SEQ ID NO: 1116246 - DNA, 22 bp, Artificial Sequence
  chemically synthesized
aacaatgagataccactacaca

SEQ ID NO: 1116247 - DNA, 22 bp, Artificial Sequence
  chemically synthesized
gccattctaataggtgtgtagt

SEQ ID NO: 1116248 - DNA, 22 bp, Artificial Sequence
  chemically synthesized
ggccattctaataggtgtgtag

SEQ ID NO: 1116249 - DNA, 22 bp, Artificial Sequence
  chemically synthesized
tggccattctaataggtgtgta

SEQ ID NO: 1116250 - DNA, 22 bp, Artificial Sequence
  chemically synthesized
gattttggccattctaataggt

SEQ ID NO: 1116251 - DNA, 22 bp, Artificial Sequence
  chemically synthesized
ggattttggccattctaatagg

SEQ ID NO: 1116252 - DNA, 22 bp, Artificial Sequence
  chemically synthesized
ttggattttggccattctaata

SEQ ID NO: 1116253 - DNA, 22 bp, Artificial Sequence
  chemically synthesized
cacacctattagaatggccaaa

SEQ ID NO: 1116254 - DNA, 22 bp, Artificial Sequence
  chemically synthesized
tcagtgttcttggattttggcc

SEQ ID NO: 1116255 - DNA, 22 bp, Artificial Sequence
  chemically synthesized
gtcagtgttcttggattttggc

SEQ ID NO: 1116256 - DNA, 22 bp, Artificial Sequence
  chemically synthesized
tgtcagtgttcttggattttgg

SEQ ID NO: 1116257 - DNA, 22 bp, Artificial Sequence
  chemically synthesized
ttagaatggccaaaatccaaga

SEQ ID NO: 1116258 - DNA, 22 bp, Artificial Sequence
  chemically synthesized
gttttgtcagtgttcttggatt

SEQ ID NO: 1116259 - DNA, 22 bp, Artificial Sequence
  chemically synthesized
ggttttgtcagtgttcttggat

SEQ ID NO: 1116260 - DNA, 22 bp, Artificial Sequence
  chemically synthesized
gaatggccaaaatccaagaaca

SEQ ID NO: 1116261 - DNA, 22 bp, Artificial Sequence
  chemically synthesized
tggttttgtcagtgttcttgga

SEQ ID NO: 1116262 - DNA, 22 bp, Artificial Sequence
  chemically synthesized
ttggttttgtcagtgttcttgg

SEQ ID NO: 1116263 - DNA, 22 bp, Artificial Sequence
  chemically synthesized
tcggcttttggttttgtcagtg

SEQ ID NO: 1116264 - DNA, 22 bp, Artificial Sequence
  chemically synthesized
tgtcggcttttggttttgtcag

SEQ ID NO: 1116265 - DNA, 22 bp, Artificial Sequence
  chemically synthesized
tctgtcggcttttggttttgtc

SEQ ID NO: 1116266 - DNA, 22 bp, Artificial Sequence
  chemically synthesized
ctctgtcggcttttggttttgt

SEQ ID NO: 1116267 - DNA, 22 bp, Artificial Sequence
  chemically synthesized
ccccatttctctgtcggctttt

SEQ ID NO: 1116268 - DNA, 22 bp, Artificial Sequence
  chemically synthesized
acaaaaccaaaagccgacagag

SEQ ID NO: 1116269 - DNA, 22 bp, Artificial Sequence
  chemically synthesized
ccattgccccatttctctgtcg

SEQ ID NO: 1116270 - DNA, 22 bp, Artificial Sequence
  chemically synthesized
ccaccagaaatgaatgagagtt

SEQ ID NO: 1116271 - DNA, 22 bp, Artificial Sequence
  chemically synthesized
cattgccaccagaaatgaatga

SEQ ID NO: 1116272 - DNA, 22 bp, Artificial Sequence
  chemically synthesized
gcattgccaccagaaatgaatg

SEQ ID NO: 1116273 - DNA, 22 bp, Artificial Sequence
  chemically synthesized
tgcattgccaccagaaatgaat

SEQ ID NO: 1116274 - DNA, 22 bp, Artificial Sequence
  chemically synthesized
tgccattttgcattgccaccag

SEQ ID NO: 1116275 - DNA, 22 bp, Artificial Sequence
  chemically synthesized
tcattcatttctggtggcaatg

SEQ ID NO: 1116276 - DNA, 22 bp, Artificial Sequence
  chemically synthesized
attcatttctggtggcaatgca

SEQ ID NO: 1116277 - DNA, 22 bp, Artificial Sequence
  chemically synthesized
atttctggtggcaatgcaaaat

SEQ ID NO: 1116278 - DNA, 22 bp, Artificial Sequence
  chemically synthesized
caaagtggctgtgccattttgc

SEQ ID NO: 1116279 - DNA, 22 bp, Artificial Sequence
  chemically synthesized
ctggtggcaatgcaaaatggca

SEQ ID NO: 1116280 - DNA, 22 bp, Artificial Sequence
  chemically synthesized
ccaaagtggctgtgccattttg

SEQ ID NO: 1116281 - DNA, 22 bp, Artificial Sequence
  chemically synthesized
tggtggcaatgcaaaatggcac

SEQ ID NO: 1116282 - DNA, 22 bp, Artificial Sequence
  chemically synthesized
gtggcaatgcaaaatggcacag

SEQ ID NO: 1116283 - DNA, 22 bp, Artificial Sequence
  chemically synthesized
tcttccaaagtggctgtgccat

SEQ ID NO: 1116284 - DNA, 22 bp, Artificial Sequence
  chemically synthesized
caaactgtcttccaaagtggct

SEQ ID NO: 1116285 - DNA, 22 bp, Artificial Sequence
  chemically synthesized
taagaaacctccaaactgtctt

SEQ ID NO: 1116286 - DNA, 22 bp, Artificial Sequence
  chemically synthesized
gtaagaaacctccaaactgtct

SEQ ID NO: 1116287 - DNA, 22 bp, Artificial Sequence
  chemically synthesized
tgtaagaaacctccaaactgtc

SEQ ID NO: 1116288 - DNA, 22 bp, Artificial Sequence
  chemically synthesized
ttgtaagaaacctccaaactgt

SEQ ID NO: 1116289 - DNA, 22 bp, Artificial Sequence
  chemically synthesized
cttttgtaagaaacctccaaac

SEQ ID NO: 1116290 - DNA, 22 bp, Artificial Sequence
  chemically synthesized
acttttgtaagaaacctccaaa

SEQ ID NO: 1116291 - DNA, 22 bp, Artificial Sequence
  chemically synthesized
tggaagacagtttggaggtttc

SEQ ID NO: 1116292 - DNA, 22 bp, Artificial Sequence
  chemically synthesized
ggaagacagtttggaggtttct

SEQ ID NO: 1116293 - DNA, 22 bp, Artificial Sequence
  chemically synthesized
gaagacagtttggaggtttctt

SEQ ID NO: 1116294 - DNA, 22 bp, Artificial Sequence
  chemically synthesized
ggaggtttcttacaaaagtaaa

SEQ ID NO: 1116295 - DNA, 22 bp, Artificial Sequence
  chemically synthesized
gaggtttcttacaaaagtaaac

SEQ ID NO: 1116296 - DNA, 22 bp, Artificial Sequence
  chemically synthesized
gatcatatagtagaatgtttac

SEQ ID NO: 1116297 - DNA, 22 bp, Artificial Sequence
  chemically synthesized
cttacaaaagtaaacattctac

SEQ ID NO: 1116298 - DNA, 22 bp, Artificial Sequence
  chemically synthesized
ctggatcatatagtagaatgtt

SEQ ID NO: 1116299 - DNA, 22 bp, Artificial Sequence
  chemically synthesized
ttacaaaagtaaacattctact

SEQ ID NO: 1116300 - DNA, 22 bp, Artificial Sequence
  chemically synthesized
acaaaagtaaacattctactat

SEQ ID NO: 1116301 - DNA, 22 bp, Artificial Sequence
  chemically synthesized
caaaagtaaacattctactata

SEQ ID NO: 1116302 - DNA, 22 bp, Artificial Sequence
  chemically synthesized
agtgcatgattgctggatcata

SEQ ID NO: 1116303 - DNA, 22 bp, Artificial Sequence
  chemically synthesized
tactatatgatccagcaatcat

SEQ ID NO: 1116304 - DNA, 22 bp, Artificial Sequence
  chemically synthesized
ctatatgatccagcaatcatgc

SEQ ID NO: 1116305 - DNA, 22 bp, Artificial Sequence
  chemically synthesized
tatgatccagcaatcatgcact

SEQ ID NO: 1116306 - DNA, 22 bp, Artificial Sequence
  chemically synthesized
tgtaaatgcctaagtgcatgat

SEQ ID NO: 1116307 - DNA, 22 bp, Artificial Sequence
  chemically synthesized
gtgtaaatgcctaagtgcatga

SEQ ID NO: 1116308 - DNA, 22 bp, Artificial Sequence
  chemically synthesized
tgtgtaaatgcctaagtgcatg

SEQ ID NO: 1116309 - DNA, 22 bp, Artificial Sequence
  chemically synthesized
ctttgtgtaaatgcctaagtgc

SEQ ID NO: 1116310 - DNA, 22 bp, Artificial Sequence
  chemically synthesized
agtggacatatgactcctttgt

SEQ ID NO: 1116311 - DNA, 22 bp, Artificial Sequence
  chemically synthesized
gagtggacatatgactcctttg

SEQ ID NO: 1116312 - DNA, 22 bp, Artificial Sequence
  chemically synthesized
aggcatttacacaaaggagtca

SEQ ID NO: 1116313 - DNA, 22 bp, Artificial Sequence
  chemically synthesized
ggcatttacacaaaggagtcat

SEQ ID NO: 1116314 - DNA, 22 bp, Artificial Sequence
  chemically synthesized
acacaaaggagtcatatgtcca

SEQ ID NO: 1116315 - DNA, 22 bp, Artificial Sequence
  chemically synthesized
cacaaaggagtcatatgtccac

SEQ ID NO: 1116316 - DNA, 22 bp, Artificial Sequence
  chemically synthesized
atgtgcaggaatttgagtggac

SEQ ID NO: 1116317 - DNA, 22 bp, Artificial Sequence
  chemically synthesized
cagcattcatgtgcaggaattt

SEQ ID NO: 1116318 - DNA, 22 bp, Artificial Sequence
  chemically synthesized
ctgcagcattcatgtgcaggaa

SEQ ID NO: 1116319 - DNA, 22 bp, Artificial Sequence
  chemically synthesized
aaattcctgcacatgaatgctg

SEQ ID NO: 1116320 - DNA, 22 bp, Artificial Sequence
  chemically synthesized
ctgcacatgaatgctgcagcag

SEQ ID NO: 1116321 - DNA, 22 bp, Artificial Sequence
  chemically synthesized
cacatgaatgctgcagcagctt

SEQ ID NO: 1116322 - DNA, 22 bp, Artificial Sequence
  chemically synthesized
gcaaatacaaacaaagctgctg

SEQ ID NO: 1116323 - DNA, 22 bp, Artificial Sequence
  chemically synthesized
ggcaaatacaaacaaagctgct

SEQ ID NO: 1116324 - DNA, 22 bp, Artificial Sequence
  chemically synthesized
caagtcttggcaaatacaaaca

SEQ ID NO: 1116325 - DNA, 22 bp, Artificial Sequence
  chemically synthesized
ccaagtcttggcaaatacaaac

SEQ ID NO: 1116326 - DNA, 22 bp, Artificial Sequence
  chemically synthesized
cagcagctttgtttgtatttgc

SEQ ID NO: 1116327 - DNA, 22 bp, Artificial Sequence
  chemically synthesized
tttccaagtcttggcaaataca

SEQ ID NO: 1116328 - DNA, 22 bp, Artificial Sequence
  chemically synthesized
attgtttccaagtcttggcaaa

SEQ ID NO: 1116329 - DNA, 22 bp, Artificial Sequence
  chemically synthesized
gattgtttccaagtcttggcaa

SEQ ID NO: 1116330 - DNA, 22 bp, Artificial Sequence
  chemically synthesized
tgtttgtatttgccaagacttg

SEQ ID NO: 1116331 - DNA, 22 bp, Artificial Sequence
  chemically synthesized
gtttgtatttgccaagacttgg

SEQ ID NO: 1116332 - DNA, 22 bp, Artificial Sequence
  chemically synthesized
tttgtatttgccaagacttgga

SEQ ID NO: 1116333 - DNA, 22 bp, Artificial Sequence
  chemically synthesized
gtatttgccaagacttggaaac

SEQ ID NO: 1116334 - DNA, 22 bp, Artificial Sequence
  chemically synthesized
tatttgccaagacttggaaaca

SEQ ID NO: 1116335 - DNA, 22 bp, Artificial Sequence
  chemically synthesized
aagaacatcttgattgtttcca

SEQ ID NO: 1116336 - DNA, 22 bp, Artificial Sequence
  chemically synthesized
gccaagacttggaaacaatcaa

SEQ ID NO: 1116337 - DNA, 22 bp, Artificial Sequence
  chemically synthesized
ctgaagaacatcttgattgttt

SEQ ID NO: 1116338 - DNA, 22 bp, Artificial Sequence
  chemically synthesized
ccaagacttggaaacaatcaag

SEQ ID NO: 1116339 - DNA, 22 bp, Artificial Sequence
  chemically synthesized
atctactgaagaacatcttgat

SEQ ID NO: 1116340 - DNA, 22 bp, Artificial Sequence
  chemically synthesized
ggaaacaatcaagatgttcttc

SEQ ID NO: 1116341 - DNA, 22 bp, Artificial Sequence
  chemically synthesized
gaaacaatcaagatgttcttca

SEQ ID NO: 1116342 - DNA, 22 bp, Artificial Sequence
  chemically synthesized
tccattcatctactgaagaaca

SEQ ID NO: 1116343 - DNA, 22 bp, Artificial Sequence
  chemically synthesized
atccattcatctactgaagaac

SEQ ID NO: 1116344 - DNA, 22 bp, Artificial Sequence
  chemically synthesized
tttatccattcatctactgaag

SEQ ID NO: 1116345 - DNA, 22 bp, Artificial Sequence
  chemically synthesized
atttatccattcatctactgaa

SEQ ID NO: 1116346 - DNA, 22 bp, Artificial Sequence
  chemically synthesized
acagtttatttatccattcatc

SEQ ID NO: 1116347 - DNA, 22 bp, Artificial Sequence
  chemically synthesized
ttcagtagatgaatggataaat

SEQ ID NO: 1116348 - DNA, 22 bp, Artificial Sequence
  chemically synthesized
cagtagatgaatggataaataa

SEQ ID NO: 1116349 - DNA, 22 bp, Artificial Sequence
  chemically synthesized
agtagatgaatggataaataaa

SEQ ID NO: 1116350 - DNA, 22 bp, Artificial Sequence
  chemically synthesized
gatgtctcacagtttatttatc

SEQ ID NO: 1116351 - DNA, 22 bp, Artificial Sequence
  chemically synthesized
tctggatgtctcacagtttatt

SEQ ID NO: 1116352 - DNA, 22 bp, Artificial Sequence
  chemically synthesized
cattgtctggatgtctcacagt

SEQ ID NO: 1116353 - DNA, 22 bp, Artificial Sequence
  chemically synthesized
aataatattccattgtctggat

SEQ ID NO: 1116354 - DNA, 22 bp, Artificial Sequence
  chemically synthesized
tgagacatccagacaatggaat

SEQ ID NO: 1116355 - DNA, 22 bp, Artificial Sequence
  chemically synthesized
agcactgaataatattccattg

SEQ ID NO: 1116356 - DNA, 22 bp, Artificial Sequence
  chemically synthesized
aagcactgaataatattccatt

SEQ ID NO: 1116357 - DNA, 22 bp, Artificial Sequence
  chemically synthesized
taagcactgaataatattccat

SEQ ID NO: 1116358 - DNA, 22 bp, Artificial Sequence
  chemically synthesized
ttaagcactgaataatattcca

SEQ ID NO: 1116359 - DNA, 22 bp, Artificial Sequence
  chemically synthesized
atttttaagcactgaataatat

SEQ ID NO: 1116360 - DNA, 22 bp, Artificial Sequence
  chemically synthesized
atagctcatttttaagcactga

SEQ ID NO: 1116361 - DNA, 22 bp, Artificial Sequence
  chemically synthesized
gatagctcatttttaagcactg

SEQ ID NO: 1116362 - DNA, 22 bp, Artificial Sequence
  chemically synthesized
tggcttgatagctcatttttaa

SEQ ID NO: 1116363 - DNA, 22 bp, Artificial Sequence
  chemically synthesized
atggcttgatagctcattttta

SEQ ID NO: 1116364 - DNA, 22 bp, Artificial Sequence
  chemically synthesized
tatggcttgatagctcattttt

SEQ ID NO: 1116365 - DNA, 22 bp, Artificial Sequence
  chemically synthesized
ttatggcttgatagctcatttt

SEQ ID NO: 1116366 - DNA, 22 bp, Artificial Sequence
  chemically synthesized
ttcagtgcttaaaaatgagcta

SEQ ID NO: 1116367 - DNA, 22 bp, Artificial Sequence
  chemically synthesized
tttatggcttgatagctcattt

SEQ ID NO: 1116368 - DNA, 22 bp, Artificial Sequence
  chemically synthesized
agtgcttaaaaatgagctatca

SEQ ID NO: 1116369 - DNA, 22 bp, Artificial Sequence
  chemically synthesized
catgtctttttatggcttgata

SEQ ID NO: 1116370 - DNA, 22 bp, Artificial Sequence
  chemically synthesized
ccatgtctttttatggcttgat

SEQ ID NO: 1116371 - DNA, 22 bp, Artificial Sequence
  chemically synthesized
aaaaatgagctatcaagccata

SEQ ID NO: 1116372 - DNA, 22 bp, Artificial Sequence
  chemically synthesized
aaaatgagctatcaagccataa

SEQ ID NO: 1116373 - DNA, 22 bp, Artificial Sequence
  chemically synthesized
ttccatgtctttttatggcttg

SEQ ID NO: 1116374 - DNA, 22 bp, Artificial Sequence
  chemically synthesized
agttcttccatgtctttttatg

SEQ ID NO: 1116375 - DNA, 22 bp, Artificial Sequence
  chemically synthesized
aagttcttccatgtctttttat

SEQ ID NO: 1116376 - DNA, 22 bp, Artificial Sequence
  chemically synthesized
tcaagccataaaaagacatgga

SEQ ID NO: 1116377 - DNA, 22 bp, Artificial Sequence
  chemically synthesized
gtaacatgcatttaagttcttc

SEQ ID NO: 1116378 - DNA, 22 bp, Artificial Sequence
  chemically synthesized
agtaacatgcatttaagttctt

SEQ ID NO: 1116379 - DNA, 22 bp, Artificial Sequence
  chemically synthesized
acttagtaacatgcatttaagt

SEQ ID NO: 1116380 - DNA, 22 bp, Artificial Sequence
  chemically synthesized
aacttagtaacatgcatttaag

SEQ ID NO: 1116381 - DNA, 22 bp, Artificial Sequence
  chemically synthesized
taacttagtaacatgcatttaa

SEQ ID NO: 1116382 - DNA, 22 bp, Artificial Sequence
  chemically synthesized
tttaacttagtaacatgcattt

SEQ ID NO: 1116383 - DNA, 22 bp, Artificial Sequence
  chemically synthesized
ctttaacttagtaacatgcatt

SEQ ID NO: 1116384 - DNA, 22 bp, Artificial Sequence
  chemically synthesized
tcttctttaacttagtaacatg

SEQ ID NO: 1116385 - DNA, 22 bp, Artificial Sequence
  chemically synthesized
agattatcttctttaacttagt

SEQ ID NO: 1116386 - DNA, 22 bp, Artificial Sequence
  chemically synthesized
aaatgcatgttactaagttaaa

SEQ ID NO: 1116387 - DNA, 22 bp, Artificial Sequence
  chemically synthesized
cagattatcttctttaacttag

SEQ ID NO: 1116388 - DNA, 22 bp, Artificial Sequence
  chemically synthesized
aatgcatgttactaagttaaag

SEQ ID NO: 1116389 - DNA, 22 bp, Artificial Sequence
  chemically synthesized
tcagattatcttctttaactta

SEQ ID NO: 1116390 - DNA, 22 bp, Artificial Sequence
  chemically synthesized
ttcagattatcttctttaactt

SEQ ID NO: 1116391 - DNA, 22 bp, Artificial Sequence
  chemically synthesized
ctaagttaaagaagataatctg

SEQ ID NO: 1116392 - DNA, 22 bp, Artificial Sequence
  chemically synthesized
agttaaagaagataatctgaaa

SEQ ID NO: 1116393 - DNA, 22 bp, Artificial Sequence
  chemically synthesized
aagaagataatctgaaaaggct

SEQ ID NO: 1116394 - DNA, 22 bp, Artificial Sequence
  chemically synthesized
cggtaaaatatatagccttttc

SEQ ID NO: 1116395 - DNA, 22 bp, Artificial Sequence
  chemically synthesized
aaaaggctatatattttaccgc

SEQ ID NO: 1116396 - DNA, 22 bp, Artificial Sequence
  chemically synthesized
gggtgaaatcctgcggtaaaat

SEQ ID NO: 1116397 - DNA, 22 bp, Artificial Sequence
  chemically synthesized
gaatctagggtgaaatcctgcg

SEQ ID NO: 1116398 - DNA, 22 bp, Artificial Sequence
  chemically synthesized
tatattttaccgcaggatttca

SEQ ID NO: 1116399 - DNA, 22 bp, Artificial Sequence
  chemically synthesized
ggaattggaatctagggtgaaa

SEQ ID NO: 1116400 - DNA, 22 bp, Artificial Sequence
  chemically synthesized
taccgcaggatttcaccctaga

SEQ ID NO: 1116401 - DNA, 22 bp, Artificial Sequence
  chemically synthesized
accgcaggatttcaccctagat

SEQ ID NO: 1116402 - DNA, 22 bp, Artificial Sequence
  chemically synthesized
ccgcaggatttcaccctagatt

SEQ ID NO: 1116403 - DNA, 22 bp, Artificial Sequence
  chemically synthesized
tcatatattcggaattggaatc

SEQ ID NO: 1116404 - DNA, 22 bp, Artificial Sequence
  chemically synthesized
caccctagattccaattccgaa

SEQ ID NO: 1116405 - DNA, 22 bp, Artificial Sequence
  chemically synthesized
accctagattccaattccgaat

SEQ ID NO: 1116406 - DNA, 22 bp, Artificial Sequence
  chemically synthesized
cagactatcatatattcggaat

SEQ ID NO: 1116407 - DNA, 22 bp, Artificial Sequence
  chemically synthesized
ccagactatcatatattcggaa

SEQ ID NO: 1116408 - DNA, 22 bp, Artificial Sequence
  chemically synthesized
tccagactatcatatattcgga

SEQ ID NO: 1116409 - DNA, 22 bp, Artificial Sequence
  chemically synthesized
ttccagactatcatatattcgg

SEQ ID NO: 1116410 - DNA, 22 bp, Artificial Sequence
  chemically synthesized
gattccaattccgaatatatga

SEQ ID NO: 1116411 - DNA, 22 bp, Artificial Sequence
  chemically synthesized
ccttttccagactatcatatat

SEQ ID NO: 1116412 - DNA, 22 bp, Artificial Sequence
  chemically synthesized
accttttccagactatcatata

SEQ ID NO: 1116413 - DNA, 22 bp, Artificial Sequence
  chemically synthesized
taccttttccagactatcatat

SEQ ID NO: 1116414 - DNA, 22 bp, Artificial Sequence
  chemically synthesized
caattccgaatatatgatagtc

SEQ ID NO: 1116415 - DNA, 22 bp, Artificial Sequence
  chemically synthesized
cgaatatatgatagtctggaaa

SEQ ID NO: 1116416 - DNA, 22 bp, Artificial Sequence
  chemically synthesized
catagttttaccttttccagac

SEQ ID NO: 1116417 - DNA, 22 bp, Artificial Sequence
  chemically synthesized
acatagttttaccttttccaga

SEQ ID NO: 1116418 - DNA, 22 bp, Artificial Sequence
  chemically synthesized
tagtttacatagttttaccttt

SEQ ID NO: 1116419 - DNA, 22 bp, Artificial Sequence
  chemically synthesized
gtagtttacatagttttacctt

SEQ ID NO: 1116420 - DNA, 22 bp, Artificial Sequence
  chemically synthesized
tgtagtttacatagttttacct

SEQ ID NO: 1116421 - DNA, 22 bp, Artificial Sequence
  chemically synthesized
ttttgtagtttacatagtttta

SEQ ID NO: 1116422 - DNA, 22 bp, Artificial Sequence
  chemically synthesized
attgttttgtagtttacatagt

SEQ ID NO: 1116423 - DNA, 22 bp, Artificial Sequence
  chemically synthesized
gaaaaggtaaaactatgtaaac

SEQ ID NO: 1116424 - DNA, 22 bp, Artificial Sequence
  chemically synthesized
gaaaccactgattgttttgtag

SEQ ID NO: 1116425 - DNA, 22 bp, Artificial Sequence
  chemically synthesized
tagaaaccactgattgttttgt

SEQ ID NO: 1116426 - DNA, 22 bp, Artificial Sequence
  chemically synthesized
tgtaaactacaaaacaatcagt

SEQ ID NO: 1116427 - DNA, 22 bp, Artificial Sequence
  chemically synthesized
atctctagaaaccactgattgt

SEQ ID NO: 1116428 - DNA, 22 bp, Artificial Sequence
  chemically synthesized
ctaatctctagaaaccactgat

SEQ ID NO: 1116429 - DNA, 22 bp, Artificial Sequence
  chemically synthesized
tcctaatctctagaaaccactg

SEQ ID NO: 1116430 - DNA, 22 bp, Artificial Sequence
  chemically synthesized
tctcctaatctctagaaaccac

SEQ ID NO: 1116431 - DNA, 22 bp, Artificial Sequence
  chemically synthesized
caaaacaatcagtggtttctag

SEQ ID NO: 1116432 - DNA, 22 bp, Artificial Sequence
  chemically synthesized
ctctcctaatctctagaaacca

SEQ ID NO: 1116433 - DNA, 22 bp, Artificial Sequence
  chemically synthesized
cacttctctcctaatctctaga

SEQ ID NO: 1116434 - DNA, 22 bp, Artificial Sequence
  chemically synthesized
atctacacttctctcctaatct

SEQ ID NO: 1116435 - DNA, 22 bp, Artificial Sequence
  chemically synthesized
ccgttcatctacacttctctcc

SEQ ID NO: 1116436 - DNA, 22 bp, Artificial Sequence
  chemically synthesized
cccgttcatctacacttctctc

SEQ ID NO: 1116437 - DNA, 22 bp, Artificial Sequence
  chemically synthesized
ctagagattaggagagaagtgt

SEQ ID NO: 1116438 - DNA, 22 bp, Artificial Sequence
  chemically synthesized
tcccgttcatctacacttctct

SEQ ID NO: 1116439 - DNA, 22 bp, Artificial Sequence
  chemically synthesized
tagagattaggagagaagtgta

SEQ ID NO: 1116440 - DNA, 22 bp, Artificial Sequence
  chemically synthesized
ttcccgttcatctacacttctc

SEQ ID NO: 1116441 - DNA, 22 bp, Artificial Sequence
  chemically synthesized
gagattaggagagaagtgtaga

SEQ ID NO: 1116442 - DNA, 22 bp, Artificial Sequence
  chemically synthesized
aatacttttcccgttcatctac

SEQ ID NO: 1116443 - DNA, 22 bp, Artificial Sequence
  chemically synthesized
ggagagaagtgtagatgaacgg

SEQ ID NO: 1116444 - DNA, 22 bp, Artificial Sequence
  chemically synthesized
ccataaaaatcctcaatacttt

SEQ ID NO: 1116445 - DNA, 22 bp, Artificial Sequence
  chemically synthesized
actgccataaaaatcctcaata

SEQ ID NO: 1116446 - DNA, 22 bp, Artificial Sequence
  chemically synthesized
cactgccataaaaatcctcaat

SEQ ID NO: 1116447 - DNA, 22 bp, Artificial Sequence
  chemically synthesized
tgcggtgtaatttcactgccat

SEQ ID NO: 1116448 - DNA, 22 bp, Artificial Sequence
  chemically synthesized
aggatttttatggcagtgaaat

SEQ ID NO: 1116449 - DNA, 22 bp, Artificial Sequence
  chemically synthesized
gagtgttatgcggtgtaatttc

SEQ ID NO: 1116450 - DNA, 22 bp, Artificial Sequence
  chemically synthesized
agagtgttatgcggtgtaattt

SEQ ID NO: 1116451 - DNA, 22 bp, Artificial Sequence
  chemically synthesized
ttatggcagtgaaattacaccg

SEQ ID NO: 1116452 - DNA, 22 bp, Artificial Sequence
  chemically synthesized
tagagtgttatgcggtgtaatt

SEQ ID NO: 1116453 - DNA, 22 bp, Artificial Sequence
  chemically synthesized
tatggcagtgaaattacaccgc

SEQ ID NO: 1116454 - DNA, 22 bp, Artificial Sequence
  chemically synthesized
atggcagtgaaattacaccgca

SEQ ID NO: 1116455 - DNA, 22 bp, Artificial Sequence
  chemically synthesized
tggcagtgaaattacaccgcat

SEQ ID NO: 1116456 - DNA, 22 bp, Artificial Sequence
  chemically synthesized
tctttagagtgttatgcggtgt

SEQ ID NO: 1116457 - DNA, 22 bp, Artificial Sequence
  chemically synthesized
atctttagagtgttatgcggtg

SEQ ID NO: 1116458 - DNA, 22 bp, Artificial Sequence
  chemically synthesized
caccgcataacactctaaagat

SEQ ID NO: 1116459 - DNA, 22 bp, Artificial Sequence
  chemically synthesized
caatgacatgtatttatcttta

SEQ ID NO: 1116460 - DNA, 22 bp, Artificial Sequence
  chemically synthesized
acaatgacatgtatttatcttt

SEQ ID NO: 1116461 - DNA, 22 bp, Artificial Sequence
  chemically synthesized
aacaaatttacaatgacatgta

SEQ ID NO: 1116462 - DNA, 22 bp, Artificial Sequence
  chemically synthesized
aaacaaatttacaatgacatgt

SEQ ID NO: 1116463 - DNA, 22 bp, Artificial Sequence
  chemically synthesized
taaagataaatacatgtcattg

SEQ ID NO: 1116464 - DNA, 22 bp, Artificial Sequence
  chemically synthesized
aagataaatacatgtcattgta

SEQ ID NO: 1116465 - DNA, 22 bp, Artificial Sequence
  chemically synthesized
tgagtttaaacaaatttacaat

SEQ ID NO: 1116466 - DNA, 22 bp, Artificial Sequence
  chemically synthesized
tgtgagtttaaacaaatttaca

SEQ ID NO: 1116467 - DNA, 22 bp, Artificial Sequence
  chemically synthesized
gtgccacacattctgtgagttt

SEQ ID NO: 1116468 - DNA, 22 bp, Artificial Sequence
  chemically synthesized
taaatttgtttaaactcacaga

SEQ ID NO: 1116469 - DNA, 22 bp, Artificial Sequence
  chemically synthesized
ttggtgccacacattctgtgag

SEQ ID NO: 1116470 - DNA, 22 bp, Artificial Sequence
  chemically synthesized
cctattggtgccacacattctg

SEQ ID NO: 1116471 - DNA, 22 bp, Artificial Sequence
  chemically synthesized
gtttaaactcacagaatgtgtg

SEQ ID NO: 1116472 - DNA, 22 bp, Artificial Sequence
  chemically synthesized
ccctattggtgccacacattct

SEQ ID NO: 1116473 - DNA, 22 bp, Artificial Sequence
  chemically synthesized
tttaaactcacagaatgtgtgg

SEQ ID NO: 1116474 - DNA, 22 bp, Artificial Sequence
  chemically synthesized
tccctattggtgccacacattc

SEQ ID NO: 1116475 - DNA, 22 bp, Artificial Sequence
  chemically synthesized
aaactcacagaatgtgtggcac

SEQ ID NO: 1116476 - DNA, 22 bp, Artificial Sequence
  chemically synthesized
aactcacagaatgtgtggcacc

SEQ ID NO: 1116477 - DNA, 22 bp, Artificial Sequence
  chemically synthesized
gctttccctattggtgccacac

SEQ ID NO: 1116478 - DNA, 22 bp, Artificial Sequence
  chemically synthesized
acagaatgtgtggcaccaatag

SEQ ID NO: 1116479 - DNA, 22 bp, Artificial Sequence
  chemically synthesized
tacattagctttccctattggt

SEQ ID NO: 1116480 - DNA, 22 bp, Artificial Sequence
  chemically synthesized
atacattagctttccctattgg

SEQ ID NO: 1116481 - DNA, 22 bp, Artificial Sequence
  chemically synthesized
atagtttatacattagctttcc

SEQ ID NO: 1116482 - DNA, 22 bp, Artificial Sequence
  chemically synthesized
ccaaagttcatagtttatacat

SEQ ID NO: 1116483 - DNA, 22 bp, Artificial Sequence
  chemically synthesized
tctcccaaagttcatagtttat

SEQ ID NO: 1116484 - DNA, 22 bp, Artificial Sequence
  chemically synthesized
atgtataaactatgaactttgg

SEQ ID NO: 1116485 - DNA, 22 bp, Artificial Sequence
  chemically synthesized
acacatcattatctcccaaagt

SEQ ID NO: 1116486 - DNA, 22 bp, Artificial Sequence
  chemically synthesized
cattgacacatcattatctccc

SEQ ID NO: 1116487 - DNA, 22 bp, Artificial Sequence
  chemically synthesized
acattgacacatcattatctcc

SEQ ID NO: 1116488 - DNA, 22 bp, Artificial Sequence
  chemically synthesized
tgaactttgggagataatgatg

SEQ ID NO: 1116489 - DNA, 22 bp, Artificial Sequence
  chemically synthesized
tgggagataatgatgtgtcaat

SEQ ID NO: 1116490 - DNA, 22 bp, Artificial Sequence
  chemically synthesized
gggagataatgatgtgtcaatg

SEQ ID NO: 1116491 - DNA, 22 bp, Artificial Sequence
  chemically synthesized
ggagataatgatgtgtcaatgt

SEQ ID NO: 1116492 - DNA, 22 bp, Artificial Sequence
  chemically synthesized
aacagatgaacttacattgaca

SEQ ID NO: 1116493 - DNA, 22 bp, Artificial Sequence
  chemically synthesized
caacagatgaacttacattgac

SEQ ID NO: 1116494 - DNA, 22 bp, Artificial Sequence
  chemically synthesized
tttcaacagatgaacttacatt

SEQ ID NO: 1116495 - DNA, 22 bp, Artificial Sequence
  chemically synthesized
gtttcaacagatgaacttacat

SEQ ID NO: 1116496 - DNA, 22 bp, Artificial Sequence
  chemically synthesized
gagtggtatatttgtttcaaca

SEQ ID NO: 1116497 - DNA, 22 bp, Artificial Sequence
  chemically synthesized
ccactagagtggtatatttgtt

SEQ ID NO: 1116498 - DNA, 22 bp, Artificial Sequence
  chemically synthesized
cccactagagtggtatatttgt

SEQ ID NO: 1116499 - DNA, 22 bp, Artificial Sequence
  chemically synthesized
atctgttgaaacaaatatacca

SEQ ID NO: 1116500 - DNA, 22 bp, Artificial Sequence
  chemically synthesized
ttgaaacaaatataccactcta

SEQ ID NO: 1116501 - DNA, 22 bp, Artificial Sequence
  chemically synthesized
tcaacatttcccactagagtgg

SEQ ID NO: 1116502 - DNA, 22 bp, Artificial Sequence
  chemically synthesized
aaacaaatataccactctagtg

SEQ ID NO: 1116503 - DNA, 22 bp, Artificial Sequence
  chemically synthesized
ccccactgtcaacatttcccac

SEQ ID NO: 1116504 - DNA, 22 bp, Artificial Sequence
  chemically synthesized
tagtgggaaatgttgacagtgg

SEQ ID NO: 1116505 - DNA, 22 bp, Artificial Sequence
  chemically synthesized
gtgggaaatgttgacagtgggg

SEQ ID NO: 1116506 - DNA, 22 bp, Artificial Sequence
  chemically synthesized
ccacagatacatagcctgcccc

SEQ ID NO: 1116507 - DNA, 22 bp, Artificial Sequence
  chemically synthesized
acagtggggcaggctatgtatc

SEQ ID NO: 1116508 - DNA, 22 bp, Artificial Sequence
  chemically synthesized
ccatataacccggctcccacag

SEQ ID NO: 1116509 - DNA, 22 bp, Artificial Sequence
  chemically synthesized
cccatataacccggctcccaca

SEQ ID NO: 1116510 - DNA, 22 bp, Artificial Sequence
  chemically synthesized
tgtatctgtgggagccgggtta

SEQ ID NO: 1116511 - DNA, 22 bp, Artificial Sequence
  chemically synthesized
tgggagccgggttatatgggaa

SEQ ID NO: 1116512 - DNA, 22 bp, Artificial Sequence
  chemically synthesized
aacagaaggtacaaaaatttcc

SEQ ID NO: 1116513 - DNA, 22 bp, Artificial Sequence
  chemically synthesized
tatgggaaatttttgtaccttc

SEQ ID NO: 1116514 - DNA, 22 bp, Artificial Sequence
  chemically synthesized
acagcacaattgaacagaaggt

SEQ ID NO: 1116515 - DNA, 22 bp, Artificial Sequence
  chemically synthesized
taggttcacagcacaattgaac

SEQ ID NO: 1116516 - DNA, 22 bp, Artificial Sequence
  chemically synthesized
ttgtaccttctgttcaattgtg

SEQ ID NO: 1116517 - DNA, 22 bp, Artificial Sequence
  chemically synthesized
tgtaccttctgttcaattgtgc

SEQ ID NO: 1116518 - DNA, 22 bp, Artificial Sequence
  chemically synthesized
gtaccttctgttcaattgtgct

SEQ ID NO: 1116519 - DNA, 22 bp, Artificial Sequence
  chemically synthesized
taccttctgttcaattgtgctg

SEQ ID NO: 1116520 - DNA, 22 bp, Artificial Sequence
  chemically synthesized
gagtaattataggttcacagca

SEQ ID NO: 1116521 - DNA, 22 bp, Artificial Sequence
  chemically synthesized
ctgttcaattgtgctgtgaacc

SEQ ID NO: 1116522 - DNA, 22 bp, Artificial Sequence
  chemically synthesized
agagtaattataggttcacagc

SEQ ID NO: 1116523 - DNA, 22 bp, Artificial Sequence
  chemically synthesized
tgttcaattgtgctgtgaacct

SEQ ID NO: 1116524 - DNA, 22 bp, Artificial Sequence
  chemically synthesized
tagagtaattataggttcacag

SEQ ID NO: 1116525 - DNA, 22 bp, Artificial Sequence
  chemically synthesized
ttagagtaattataggttcaca

SEQ ID NO: 1116526 - DNA, 22 bp, Artificial Sequence
  chemically synthesized
ttcaattgtgctgtgaacctat

SEQ ID NO: 1116527 - DNA, 22 bp, Artificial Sequence
  chemically synthesized
aattgtgctgtgaacctataat

SEQ ID NO: 1116528 - DNA, 22 bp, Artificial Sequence
  chemically synthesized
catttttagagtaattataggt

SEQ ID NO: 1116529 - DNA, 22 bp, Artificial Sequence
  chemically synthesized
tgctgtgaacctataattactc

SEQ ID NO: 1116530 - DNA, 22 bp, Artificial Sequence
  chemically synthesized
atagactccatttttagagtaa

SEQ ID NO: 1116531 - DNA, 22 bp, Artificial Sequence
  chemically synthesized
tgaacctataattactctaaaa

SEQ ID NO: 1116532 - DNA, 22 bp, Artificial Sequence
  chemically synthesized
aatagactccatttttagagta

SEQ ID NO: 1116533 - DNA, 22 bp, Artificial Sequence
  chemically synthesized
taatagactccatttttagagt

SEQ ID NO: 1116534 - DNA, 22 bp, Artificial Sequence
  chemically synthesized
tgattttaatagactccatttt

SEQ ID NO: 1116535 - DNA, 22 bp, Artificial Sequence
  chemically synthesized
taattactctaaaaatggagtc

SEQ ID NO: 1116536 - DNA, 22 bp, Artificial Sequence
  chemically synthesized
gtgattttaatagactccattt

SEQ ID NO: 1116537 - DNA, 22 bp, Artificial Sequence
  chemically synthesized
tgtgattttaatagactccatt

SEQ ID NO: 1116538 - DNA, 22 bp, Artificial Sequence
  chemically synthesized
ttgtgattttaatagactccat

SEQ ID NO: 1116539 - DNA, 22 bp, Artificial Sequence
  chemically synthesized
tttgtgattttaatagactcca

SEQ ID NO: 1116540 - DNA, 22 bp, Artificial Sequence
  chemically synthesized
ttttgtgattttaatagactcc

SEQ ID NO: 1116541 - DNA, 22 bp, Artificial Sequence
  chemically synthesized
tttttgtgattttaatagactc

SEQ ID NO: 1116542 - DNA, 22 bp, Artificial Sequence
  chemically synthesized
ctctaaaaatggagtctattaa

SEQ ID NO: 1116543 - DNA, 22 bp, Artificial Sequence
  chemically synthesized
taaaaatggagtctattaaaat

SEQ ID NO: 1116544 - DNA, 22 bp, Artificial Sequence
  chemically synthesized
aaaatggagtctattaaaatca

SEQ ID NO: 1116545 - DNA, 22 bp, Artificial Sequence
  chemically synthesized
atgaaacctttttttgtgattt

SEQ ID NO: 1116546 - DNA, 22 bp, Artificial Sequence
  chemically synthesized
attcatgaaacctttttttgtg

SEQ ID NO: 1116547 - DNA, 22 bp, Artificial Sequence
  chemically synthesized
ctaattcatgaaaccttttttt

SEQ ID NO: 1116548 - DNA, 22 bp, Artificial Sequence
  chemically synthesized
ttaaaatcacaaaaaaaggttt

SEQ ID NO: 1116549 - DNA, 22 bp, Artificial Sequence
  chemically synthesized
aaatcacaaaaaaaggtttcat

SEQ ID NO: 1116550 - DNA, 22 bp, Artificial Sequence
  chemically synthesized
aatccagtattcctaattcatg

SEQ ID NO: 1116551 - DNA, 22 bp, Artificial Sequence
  chemically synthesized
atattgaatccagtattcctaa

SEQ ID NO: 1116552 - DNA, 22 bp, Artificial Sequence
  chemically synthesized
gatattgaatccagtattccta

SEQ ID NO: 1116553 - DNA, 22 bp, Artificial Sequence
  chemically synthesized
ttgatattgaatccagtattcc

SEQ ID NO: 1116554 - DNA, 22 bp, Artificial Sequence
  chemically synthesized
catgaattaggaatactggatt

SEQ ID NO: 1116555 - DNA, 22 bp, Artificial Sequence
  chemically synthesized
atgaattaggaatactggattc

SEQ ID NO: 1116556 - DNA, 22 bp, Artificial Sequence
  chemically synthesized
tactcttgatattgaatccagt

SEQ ID NO: 1116557 - DNA, 22 bp, Artificial Sequence
  chemically synthesized
gtactcttgatattgaatccag

SEQ ID NO: 1116558 - DNA, 22 bp, Artificial Sequence
  chemically synthesized
tgtactcttgatattgaatcca

SEQ ID NO: 1116559 - DNA, 22 bp, Artificial Sequence
  chemically synthesized
ggaatactggattcaatatcaa

SEQ ID NO: 1116560 - DNA, 22 bp, Artificial Sequence
  chemically synthesized
gcattttgtactcttgatattg

SEQ ID NO: 1116561 - DNA, 22 bp, Artificial Sequence
  chemically synthesized
agcattttgtactcttgatatt

SEQ ID NO: 1116562 - DNA, 22 bp, Artificial Sequence
  chemically synthesized
tagcattttgtactcttgatat

SEQ ID NO: 1116563 - DNA, 22 bp, Artificial Sequence
  chemically synthesized
ttagcattttgtactcttgata

SEQ ID NO: 1116564 - DNA, 22 bp, Artificial Sequence
  chemically synthesized
tttagcattttgtactcttgat

SEQ ID NO: 1116565 - DNA, 22 bp, Artificial Sequence
  chemically synthesized
ttttagcattttgtactcttga

SEQ ID NO: 1116566 - DNA, 22 bp, Artificial Sequence
  chemically synthesized
tttttagcattttgtactcttg

SEQ ID NO: 1116567 - DNA, 22 bp, Artificial Sequence
  chemically synthesized
ttttttagcattttgtactctt

SEQ ID NO: 1116568 - DNA, 22 bp, Artificial Sequence
  chemically synthesized
gattcaatatcaagagtacaaa

SEQ ID NO: 1116569 - DNA, 22 bp, Artificial Sequence
  chemically synthesized
tttttttagcattttgtactct

SEQ ID NO: 1116570 - DNA, 22 bp, Artificial Sequence
  chemically synthesized
ttttttttagcattttgtactc

SEQ ID NO: 1116571 - DNA, 22 bp, Artificial Sequence
  chemically synthesized
tttttttttagcattttgtact

SEQ ID NO: 1116572 - DNA, 22 bp, Artificial Sequence
  chemically synthesized
ttttttttttagcattttgtac

SEQ ID NO: 1116573 - DNA, 22 bp, Artificial Sequence
  chemically synthesized
tttttttttttagcattttgta

SEQ ID NO: 1116574 - DNA, 22 bp, Artificial Sequence
  chemically synthesized
aatatcaagagtacaaaatgct

SEQ ID NO: 1116575 - DNA, 22 bp, Artificial Sequence
  chemically synthesized
ttttttttttttagcattttgt

SEQ ID NO: 1116576 - DNA, 22 bp, Artificial Sequence
  chemically synthesized
tttttttttttttagcattttg

SEQ ID NO: 1116577 - DNA, 22 bp, Artificial Sequence
  chemically synthesized
ttttttttttttttagcatttt

SEQ ID NO: 1116578 - DNA, 22 bp, Artificial Sequence
  chemically synthesized
gcttttttttttttttttagca

SEQ ID NO: 1116579 - DNA, 22 bp, Artificial Sequence
  chemically synthesized
tgaatgattggctttttttttt

SEQ ID NO: 1116580 - DNA, 22 bp, Artificial Sequence
  chemically synthesized
tgtgaatgattggctttttttt

SEQ ID NO: 1116581 - DNA, 22 bp, Artificial Sequence
  chemically synthesized
ttctgtgaatgattggcttttt

SEQ ID NO: 1116582 - DNA, 22 bp, Artificial Sequence
  chemically synthesized
attctgtgaatgattggctttt

SEQ ID NO: 1116583 - DNA, 22 bp, Artificial Sequence
  chemically synthesized
aaaaaaaaaaaaaaagccaatc

SEQ ID NO: 1116584 - DNA, 22 bp, Artificial Sequence
  chemically synthesized
atggagtttattctgtgaatga

SEQ ID NO: 1116585 - DNA, 22 bp, Artificial Sequence
  chemically synthesized
ctgatggagtttattctgtgaa

SEQ ID NO: 1116586 - DNA, 22 bp, Artificial Sequence
  chemically synthesized
ttcctgatggagtttattctgt

SEQ ID NO: 1116587 - DNA, 22 bp, Artificial Sequence
  chemically synthesized
cagctattcctgatggagttta

SEQ ID NO: 1116588 - DNA, 22 bp, Artificial Sequence
  chemically synthesized
acagaataaactccatcaggaa

SEQ ID NO: 1116589 - DNA, 22 bp, Artificial Sequence
  chemically synthesized
tatattacagctattcctgatg

SEQ ID NO: 1116590 - DNA, 22 bp, Artificial Sequence
  chemically synthesized
atatattacagctattcctgat

SEQ ID NO: 1116591 - DNA, 22 bp, Artificial Sequence
  chemically synthesized
tatatattacagctattcctga

SEQ ID NO: 1116592 - DNA, 22 bp, Artificial Sequence
  chemically synthesized
gtattttatatattacagctat

SEQ ID NO: 1116593 - DNA, 22 bp, Artificial Sequence
  chemically synthesized
catcaggaatagctgtaatata

SEQ ID NO: 1116594 - DNA, 22 bp, Artificial Sequence
  chemically synthesized
attagtattttatatattacag

SEQ ID NO: 1116595 - DNA, 22 bp, Artificial Sequence
  chemically synthesized
aattagtattttatatattaca

SEQ ID NO: 1116596 - DNA, 22 bp, Artificial Sequence
  chemically synthesized
taattagtattttatatattac

SEQ ID NO: 1116597 - DNA, 22 bp, Artificial Sequence
  chemically synthesized
agttttaattagtattttatat

SEQ ID NO: 1116598 - DNA, 22 bp, Artificial Sequence
  chemically synthesized
tcagttttaattagtattttat

SEQ ID NO: 1116599 - DNA, 22 bp, Artificial Sequence
  chemically synthesized
ttctcagttttaattagtattt

SEQ ID NO: 1116600 - DNA, 22 bp, Artificial Sequence
  chemically synthesized
attctcagttttaattagtatt

SEQ ID NO: 1116601 - DNA, 22 bp, Artificial Sequence
  chemically synthesized
taatatataaaatactaattaa

SEQ ID NO: 1116602 - DNA, 22 bp, Artificial Sequence
  chemically synthesized
atttattctcagttttaattag

SEQ ID NO: 1116603 - DNA, 22 bp, Artificial Sequence
  chemically synthesized
aatttattctcagttttaatta

SEQ ID NO: 1116604 - DNA, 22 bp, Artificial Sequence
  chemically synthesized
ttaatttattctcagttttaat

SEQ ID NO: 1116605 - DNA, 22 bp, Artificial Sequence
  chemically synthesized
ctcttaatttattctcagtttt

SEQ ID NO: 1116606 - DNA, 22 bp, Artificial Sequence
  chemically synthesized
actcttaatttattctcagttt

SEQ ID NO: 1116607 - DNA, 22 bp, Artificial Sequence
  chemically synthesized
tactcttaatttattctcagtt

SEQ ID NO: 1116608 - DNA, 22 bp, Artificial Sequence
  chemically synthesized
aattttactcttaatttattct

SEQ ID NO: 1116609 - DNA, 22 bp, Artificial Sequence
  chemically synthesized
aaattttactcttaatttattc

SEQ ID NO: 1116610 - DNA, 22 bp, Artificial Sequence
  chemically synthesized
attaaaactgagaataaattaa

SEQ ID NO: 1116611 - DNA, 22 bp, Artificial Sequence
  chemically synthesized
taaattttactcttaatttatt

SEQ ID NO: 1116612 - DNA, 22 bp, Artificial Sequence
  chemically synthesized
ttaaattttactcttaatttat

SEQ ID NO: 1116613 - DNA, 22 bp, Artificial Sequence
  chemically synthesized
tttaaattttactcttaattta

SEQ ID NO: 1116614 - DNA, 22 bp, Artificial Sequence
  chemically synthesized
ttttaaattttactcttaattt

SEQ ID NO: 1116615 - DNA, 22 bp, Artificial Sequence
  chemically synthesized
aaactgagaataaattaagagt

SEQ ID NO: 1116616 - DNA, 22 bp, Artificial Sequence
  chemically synthesized
tttttaaattttactcttaatt

SEQ ID NO: 1116617 - DNA, 22 bp, Artificial Sequence
  chemically synthesized
agaataaattaagagtaaaatt

SEQ ID NO: 1116618 - DNA, 22 bp, Artificial Sequence
  chemically synthesized
tagattttttttaaattttact

SEQ ID NO: 1116619 - DNA, 22 bp, Artificial Sequence
  chemically synthesized
atagattttttttaaattttac

SEQ ID NO: 1116620 - DNA, 22 bp, Artificial Sequence
  chemically synthesized
ccttatagattttttttaaatt

SEQ ID NO: 1116621 - DNA, 22 bp, Artificial Sequence
  chemically synthesized
ctaccttatagattttttttaa

SEQ ID NO: 1116622 - DNA, 22 bp, Artificial Sequence
  chemically synthesized
agagtaaaatttaaaaaaaatc

SEQ ID NO: 1116623 - DNA, 22 bp, Artificial Sequence
  chemically synthesized
aaaaaaaatctataaggtagta

SEQ ID NO: 1116624 - DNA, 22 bp, Artificial Sequence
  chemically synthesized
aaaaaaatctataaggtagtaa

SEQ ID NO: 1116625 - DNA, 22 bp, Artificial Sequence
  chemically synthesized
agaaaataaaacaaaattacta

SEQ ID NO: 1116626 - DNA, 22 bp, Artificial Sequence
  chemically synthesized
aagaaaataaaacaaaattact

SEQ ID NO: 1116627 - DNA, 22 bp, Artificial Sequence
  chemically synthesized
taaggtagtaattttgttttat

SEQ ID NO: 1116628 - DNA, 22 bp, Artificial Sequence
  chemically synthesized
agagataggtatttaagaaaat

SEQ ID NO: 1116629 - DNA, 22 bp, Artificial Sequence
  chemically synthesized
agctaagagataggtatttaag

SEQ ID NO: 1116630 - DNA, 22 bp, Artificial Sequence
  chemically synthesized
tgttttattttcttaaatacct

SEQ ID NO: 1116631 - DNA, 22 bp, Artificial Sequence
  chemically synthesized
cagctaagagataggtatttaa

SEQ ID NO: 1116632 - DNA, 22 bp, Artificial Sequence
  chemically synthesized
gttttattttcttaaataccta

SEQ ID NO: 1116633 - DNA, 22 bp, Artificial Sequence
  chemically synthesized
tcagctaagagataggtattta

SEQ ID NO: 1116634 - DNA, 22 bp, Artificial Sequence
  chemically synthesized
ttttattttcttaaatacctat

SEQ ID NO: 1116635 - DNA, 22 bp, Artificial Sequence
  chemically synthesized
tattttcttaaatacctatctc

SEQ ID NO: 1116636 - DNA, 22 bp, Artificial Sequence
  chemically synthesized
attttcttaaatacctatctct

SEQ ID NO: 1116637 - DNA, 22 bp, Artificial Sequence
  chemically synthesized
ttttcttaaatacctatctctt

SEQ ID NO: 1116638 - DNA, 22 bp, Artificial Sequence
  chemically synthesized
tcttaaatacctatctcttagc

SEQ ID NO: 1116639 - DNA, 22 bp, Artificial Sequence
  chemically synthesized
cttaaatacctatctcttagct

SEQ ID NO: 1116640 - DNA, 22 bp, Artificial Sequence
  chemically synthesized
ttaaatacctatctcttagctg

SEQ ID NO: 1116641 - DNA, 22 bp, Artificial Sequence
  chemically synthesized
aaatacctatctcttagctgaa

SEQ ID NO: 1116642 - DNA, 22 bp, Artificial Sequence
  chemically synthesized
aatacctatctcttagctgaaa

SEQ ID NO: 1116643 - DNA, 22 bp, Artificial Sequence
  chemically synthesized
tctcttagctgaaagatacaca

SEQ ID NO: 1116644 - DNA, 22 bp, Artificial Sequence
  chemically synthesized
ttagctgaaagatacacatttt

SEQ ID NO: 1116645 - DNA, 22 bp, Artificial Sequence
  chemically synthesized
agagcaccatgtaaaatgtgta

SEQ ID NO: 1116646 - DNA, 22 bp, Artificial Sequence
  chemically synthesized
cagagcaccatgtaaaatgtgt

SEQ ID NO: 1116647 - DNA, 22 bp, Artificial Sequence
  chemically synthesized
agctgaaagatacacattttac

SEQ ID NO: 1116648 - DNA, 22 bp, Artificial Sequence
  chemically synthesized
gctgaaagatacacattttaca

SEQ ID NO: 1116649 - DNA, 22 bp, Artificial Sequence
  chemically synthesized
cccttcagagcaccatgtaaaa

SEQ ID NO: 1116650 - DNA, 22 bp, Artificial Sequence
  chemically synthesized
aaagatacacattttacatggt

SEQ ID NO: 1116651 - DNA, 22 bp, Artificial Sequence
  chemically synthesized
ttgcccttcagagcaccatgta

SEQ ID NO: 1116652 - DNA, 22 bp, Artificial Sequence
  chemically synthesized
gttgcccttcagagcaccatgt

SEQ ID NO: 1116653 - DNA, 22 bp, Artificial Sequence
  chemically synthesized
atttgttgcccttcagagcacc

SEQ ID NO: 1116654 - DNA, 22 bp, Artificial Sequence
  chemically synthesized
catttgttgcccttcagagcac

SEQ ID NO: 1116655 - DNA, 22 bp, Artificial Sequence
  chemically synthesized
tcatttgttgcccttcagagca

SEQ ID NO: 1116656 - DNA, 22 bp, Artificial Sequence
  chemically synthesized
tacatggtgctctgaagggcaa

SEQ ID NO: 1116657 - DNA, 22 bp, Artificial Sequence
  chemically synthesized
agttttcatttgttgcccttca

SEQ ID NO: 1116658 - DNA, 22 bp, Artificial Sequence
  chemically synthesized
acatggtgctctgaagggcaac

SEQ ID NO: 1116659 - DNA, 22 bp, Artificial Sequence
  chemically synthesized
catggtgctctgaagggcaaca

SEQ ID NO: 1116660 - DNA, 22 bp, Artificial Sequence
  chemically synthesized
gacaaaactgagttttcatttg

SEQ ID NO: 1116661 - DNA, 22 bp, Artificial Sequence
  chemically synthesized
tgaagggcaacaaatgaaaact

SEQ ID NO: 1116662 - DNA, 22 bp, Artificial Sequence
  chemically synthesized
aagggcaacaaatgaaaactca

SEQ ID NO: 1116663 - DNA, 22 bp, Artificial Sequence
  chemically synthesized
attagacaaaactgagttttca

SEQ ID NO: 1116664 - DNA, 22 bp, Artificial Sequence
  chemically synthesized
actaattagacaaaactgagtt

SEQ ID NO: 1116665 - DNA, 22 bp, Artificial Sequence
  chemically synthesized
aactaattagacaaaactgagt

SEQ ID NO: 1116666 - DNA, 22 bp, Artificial Sequence
  chemically synthesized
ttaactaattagacaaaactga

SEQ ID NO: 1116667 - DNA, 22 bp, Artificial Sequence
  chemically synthesized
cttaactaattagacaaaactg

SEQ ID NO: 1116668 - DNA, 22 bp, Artificial Sequence
  chemically synthesized
agagtttcttaactaattagac

SEQ ID NO: 1116669 - DNA, 22 bp, Artificial Sequence
  chemically synthesized
cagagtttcttaactaattaga

SEQ ID NO: 1116670 - DNA, 22 bp, Artificial Sequence
  chemically synthesized
tcagagtttcttaactaattag

SEQ ID NO: 1116671 - DNA, 22 bp, Artificial Sequence
  chemically synthesized
agttttgtctaattagttaaga

SEQ ID NO: 1116672 - DNA, 22 bp, Artificial Sequence
  chemically synthesized
tcactttcagagtttcttaact

SEQ ID NO: 1116673 - DNA, 22 bp, Artificial Sequence
  chemically synthesized
tgtctaattagttaagaaactc

SEQ ID NO: 1116674 - DNA, 22 bp, Artificial Sequence
  chemically synthesized
gtctaattagttaagaaactct

SEQ ID NO: 1116675 - DNA, 22 bp, Artificial Sequence
  chemically synthesized
tctaattagttaagaaactctg

SEQ ID NO: 1116676 - DNA, 22 bp, Artificial Sequence
  chemically synthesized
attagttaagaaactctgaaag

SEQ ID NO: 1116677 - DNA, 22 bp, Artificial Sequence
  chemically synthesized
aaaagtgtctgtcactttcaga

SEQ ID NO: 1116678 - DNA, 22 bp, Artificial Sequence
  chemically synthesized
gttaagaaactctgaaagtgac

SEQ ID NO: 1116679 - DNA, 22 bp, Artificial Sequence
  chemically synthesized
agaaactctgaaagtgacagac

SEQ ID NO: 1116680 - DNA, 22 bp, Artificial Sequence
  chemically synthesized
tgaaagtgacagacacttttta

SEQ ID NO: 1116681 - DNA, 22 bp, Artificial Sequence
  chemically synthesized
aaagtgacagacactttttaat

SEQ ID NO: 1116682 - DNA, 22 bp, Artificial Sequence
  chemically synthesized
aagtggaatgtaagatattaaa

SEQ ID NO: 1116683 - DNA, 22 bp, Artificial Sequence
  chemically synthesized
caagtggaatgtaagatattaa

SEQ ID NO: 1116684 - DNA, 22 bp, Artificial Sequence
  chemically synthesized
tcaagtggaatgtaagatatta

SEQ ID NO: 1116685 - DNA, 22 bp, Artificial Sequence
  chemically synthesized
aaattttcaagtggaatgtaag

SEQ ID NO: 1116686 - DNA, 22 bp, Artificial Sequence
  chemically synthesized
gaaattttcaagtggaatgtaa

SEQ ID NO: 1116687 - DNA, 22 bp, Artificial Sequence
  chemically synthesized
tgaaattttcaagtggaatgta

SEQ ID NO: 1116688 - DNA, 22 bp, Artificial Sequence
  chemically synthesized
tttaatatcttacattccactt

SEQ ID NO: 1116689 - DNA, 22 bp, Artificial Sequence
  chemically synthesized
ttaatatcttacattccacttg

SEQ ID NO: 1116690 - DNA, 22 bp, Artificial Sequence
  chemically synthesized
taatatcttacattccacttga

SEQ ID NO: 1116691 - DNA, 22 bp, Artificial Sequence
  chemically synthesized
aatatcttacattccacttgaa

SEQ ID NO: 1116692 - DNA, 22 bp, Artificial Sequence
  chemically synthesized
atatcttacattccacttgaaa

SEQ ID NO: 1116693 - DNA, 22 bp, Artificial Sequence
  chemically synthesized
ggtgctttgaaattttcaagtg

SEQ ID NO: 1116694 - DNA, 22 bp, Artificial Sequence
  chemically synthesized
acattccacttgaaaatttcaa

SEQ ID NO: 1116695 - DNA, 22 bp, Artificial Sequence
  chemically synthesized
cattccacttgaaaatttcaaa

SEQ ID NO: 1116696 - DNA, 22 bp, Artificial Sequence
  chemically synthesized
cacttgaaaatttcaaagcacc

SEQ ID NO: 1116697 - DNA, 22 bp, Artificial Sequence
  chemically synthesized
gaaaatttcaaagcacccagtt

SEQ ID NO: 1116698 - DNA, 22 bp, Artificial Sequence
  chemically synthesized
aaaatttcaaagcacccagttt

SEQ ID NO: 1116699 - DNA, 22 bp, Artificial Sequence
  chemically synthesized
caaagcacccagtttgtggtat

SEQ ID NO: 1116700 - DNA, 22 bp, Artificial Sequence
  chemically synthesized
aaagcacccagtttgtggtatt

SEQ ID NO: 1116701 - DNA, 22 bp, Artificial Sequence
  chemically synthesized
ggaacataaaatcacaaaatac

SEQ ID NO: 1116702 - DNA, 22 bp, Artificial Sequence
  chemically synthesized
gtggtattttgtgattttatgt

SEQ ID NO: 1116703 - DNA, 22 bp, Artificial Sequence
  chemically synthesized
tggtattttgtgattttatgtt

SEQ ID NO: 1116704 - DNA, 22 bp, Artificial Sequence
  chemically synthesized
gaaagggatcctgggaacataa

SEQ ID NO: 1116705 - DNA, 22 bp, Artificial Sequence
  chemically synthesized
attggaaagggatcctgggaac

SEQ ID NO: 1116706 - DNA, 22 bp, Artificial Sequence
  chemically synthesized
tgtgattttatgttcccaggat

SEQ ID NO: 1116707 - DNA, 22 bp, Artificial Sequence
  chemically synthesized
gtgattttatgttcccaggatc

SEQ ID NO: 1116708 - DNA, 22 bp, Artificial Sequence
  chemically synthesized
tgattttatgttcccaggatcc

SEQ ID NO: 1116709 - DNA, 22 bp, Artificial Sequence
  chemically synthesized
ctaattggaaagggatcctggg

SEQ ID NO: 1116710 - DNA, 22 bp, Artificial Sequence
  chemically synthesized
cctgctaattggaaagggatcc

SEQ ID NO: 1116711 - DNA, 22 bp, Artificial Sequence
  chemically synthesized
acctgctaattggaaagggatc

SEQ ID NO: 1116712 - DNA, 22 bp, Artificial Sequence
  chemically synthesized
tatgttcccaggatccctttcc

SEQ ID NO: 1116713 - DNA, 22 bp, Artificial Sequence
  chemically synthesized
tacctgctaattggaaagggat

SEQ ID NO: 1116714 - DNA, 22 bp, Artificial Sequence
  chemically synthesized
atgttcccaggatccctttcca

SEQ ID NO: 1116715 - DNA, 22 bp, Artificial Sequence
  chemically synthesized
tgttcccaggatccctttccaa

SEQ ID NO: 1116716 - DNA, 22 bp, Artificial Sequence
  chemically synthesized
ccaggatccctttccaattagc

SEQ ID NO: 1116717 - DNA, 22 bp, Artificial Sequence
  chemically synthesized
agaagttttacctgctaattgg

SEQ ID NO: 1116718 - DNA, 22 bp, Artificial Sequence
  chemically synthesized
aagacaactcagaagttttacc

SEQ ID NO: 1116719 - DNA, 22 bp, Artificial Sequence
  chemically synthesized
tccaattagcaggtaaaacttc

SEQ ID NO: 1116720 - DNA, 22 bp, Artificial Sequence
  chemically synthesized
caagacaactcagaagttttac

SEQ ID NO: 1116721 - DNA, 22 bp, Artificial Sequence
  chemically synthesized
ccaattagcaggtaaaacttct

SEQ ID NO: 1116722 - DNA, 22 bp, Artificial Sequence
  chemically synthesized
caattagcaggtaaaacttctg

SEQ ID NO: 1116723 - DNA, 22 bp, Artificial Sequence
  chemically synthesized
aatttcaagacaactcagaagt

SEQ ID NO: 1116724 - DNA, 22 bp, Artificial Sequence
  chemically synthesized
gcaggtaaaacttctgagttgt

SEQ ID NO: 1116725 - DNA, 22 bp, Artificial Sequence
  chemically synthesized
tgaaactgaatttcaagacaac

SEQ ID NO: 1116726 - DNA, 22 bp, Artificial Sequence
  chemically synthesized
gtgaaactgaatttcaagacaa

SEQ ID NO: 1116727 - DNA, 22 bp, Artificial Sequence
  chemically synthesized
tgtgaaactgaatttcaagaca

SEQ ID NO: 1116728 - DNA, 22 bp, Artificial Sequence
  chemically synthesized
tctttgtgaaactgaatttcaa

SEQ ID NO: 1116729 - DNA, 22 bp, Artificial Sequence
  chemically synthesized
ctgagttgtcttgaaattcagt

SEQ ID NO: 1116730 - DNA, 22 bp, Artificial Sequence
  chemically synthesized
tgagttgtcttgaaattcagtt

SEQ ID NO: 1116731 - DNA, 22 bp, Artificial Sequence
  chemically synthesized
agttgtcttgaaattcagtttc

SEQ ID NO: 1116732 - DNA, 22 bp, Artificial Sequence
  chemically synthesized
aatactgtctttgtgaaactga

SEQ ID NO: 1116733 - DNA, 22 bp, Artificial Sequence
  chemically synthesized
tcttgaaattcagtttcacaaa

SEQ ID NO: 1116734 - DNA, 22 bp, Artificial Sequence
  chemically synthesized
gaaattcagtttcacaaagaca

SEQ ID NO: 1116735 - DNA, 22 bp, Artificial Sequence
  chemically synthesized
aaattcagtttcacaaagacag

SEQ ID NO: 1116736 - DNA, 22 bp, Artificial Sequence
  chemically synthesized
gaaacaattcaatactgtcttt

SEQ ID NO: 1116737 - DNA, 22 bp, Artificial Sequence
  chemically synthesized
ctggaaacaattcaatactgtc

SEQ ID NO: 1116738 - DNA, 22 bp, Artificial Sequence
  chemically synthesized
agtttcacaaagacagtattga

SEQ ID NO: 1116739 - DNA, 22 bp, Artificial Sequence
  chemically synthesized
cacaaagacagtattgaattgt

SEQ ID NO: 1116740 - DNA, 22 bp, Artificial Sequence
  chemically synthesized
acaaagacagtattgaattgtt

SEQ ID NO: 1116741 - DNA, 22 bp, Artificial Sequence
  chemically synthesized
tgcacgttcctggaaacaattc

SEQ ID NO: 1116742 - DNA, 22 bp, Artificial Sequence
  chemically synthesized
aattgtttccaggaacgtgcac

SEQ ID NO: 1116743 - DNA, 22 bp, Artificial Sequence
  chemically synthesized
gaaccatccatgattgtgcacg

SEQ ID NO: 1116744 - DNA, 22 bp, Artificial Sequence
  chemically synthesized
tttccaggaacgtgcacaatca

SEQ ID NO: 1116745 - DNA, 22 bp, Artificial Sequence
  chemically synthesized
ccaggaacgtgcacaatcatgg

SEQ ID NO: 1116746 - DNA, 22 bp, Artificial Sequence
  chemically synthesized
caggaacgtgcacaatcatgga

SEQ ID NO: 1116747 - DNA, 22 bp, Artificial Sequence
  chemically synthesized
aaccaacaaattagaaccatcc

SEQ ID NO: 1116748 - DNA, 22 bp, Artificial Sequence
  chemically synthesized
agttcaaccaacaaattagaac

SEQ ID NO: 1116749 - DNA, 22 bp, Artificial Sequence
  chemically synthesized
cagttcaaccaacaaattagaa

SEQ ID NO: 1116750 - DNA, 22 bp, Artificial Sequence
  chemically synthesized
tcagttcaaccaacaaattaga

SEQ ID NO: 1116751 - DNA, 22 bp, Artificial Sequence
  chemically synthesized
ttcagttcaaccaacaaattag

SEQ ID NO: 1116752 - DNA, 22 bp, Artificial Sequence
  chemically synthesized
atggacttttcagttcaaccaa

SEQ ID NO: 1116753 - DNA, 22 bp, Artificial Sequence
  chemically synthesized
catggacttttcagttcaacca

SEQ ID NO: 1116754 - DNA, 22 bp, Artificial Sequence
  chemically synthesized
tcatggacttttcagttcaacc

SEQ ID NO: 1116755 - DNA, 22 bp, Artificial Sequence
  chemically synthesized
taatttgttggttgaactgaaa

SEQ ID NO: 1116756 - DNA, 22 bp, Artificial Sequence
  chemically synthesized
ttttcatggacttttcagttca

SEQ ID NO: 1116757 - DNA, 22 bp, Artificial Sequence
  chemically synthesized
atttgttggttgaactgaaaag

SEQ ID NO: 1116758 - DNA, 22 bp, Artificial Sequence
  chemically synthesized
tattttcatggacttttcagtt

SEQ ID NO: 1116759 - DNA, 22 bp, Artificial Sequence
  chemically synthesized
ctctattttcatggacttttca

SEQ ID NO: 1116760 - DNA, 22 bp, Artificial Sequence
  chemically synthesized
gttggttgaactgaaaagtcca

SEQ ID NO: 1116761 - DNA, 22 bp, Artificial Sequence
  chemically synthesized
ttggttgaactgaaaagtccat

SEQ ID NO: 1116762 - DNA, 22 bp, Artificial Sequence
  chemically synthesized
gttgaactgaaaagtccatgaa

SEQ ID NO: 1116763 - DNA, 22 bp, Artificial Sequence
  chemically synthesized
tagctactctattttcatggac

SEQ ID NO: 1116764 - DNA, 22 bp, Artificial Sequence
  chemically synthesized
aactgaaaagtccatgaaaata

SEQ ID NO: 1116765 - DNA, 22 bp, Artificial Sequence
  chemically synthesized
gatgttgtagctactctatttt

SEQ ID NO: 1116766 - DNA, 22 bp, Artificial Sequence
  chemically synthesized
aaaagtccatgaaaatagagta

SEQ ID NO: 1116767 - DNA, 22 bp, Artificial Sequence
  chemically synthesized
actagatgttgtagctactcta

SEQ ID NO: 1116768 - DNA, 22 bp, Artificial Sequence
  chemically synthesized
aactagatgttgtagctactct

SEQ ID NO: 1116769 - DNA, 22 bp, Artificial Sequence
  chemically synthesized
taactagatgttgtagctactc

SEQ ID NO: 1116770 - DNA, 22 bp, Artificial Sequence
  chemically synthesized
ttaactagatgttgtagctact

SEQ ID NO: 1116771 - DNA, 22 bp, Artificial Sequence
  chemically synthesized
cttttaactagatgttgtagct

SEQ ID NO: 1116772 - DNA, 22 bp, Artificial Sequence
  chemically synthesized
acttttaactagatgttgtagc

SEQ ID NO: 1116773 - DNA, 22 bp, Artificial Sequence
  chemically synthesized
ggatcttacttttaactagatg

SEQ ID NO: 1116774 - DNA, 22 bp, Artificial Sequence
  chemically synthesized
atctaggatcttacttttaact

SEQ ID NO: 1116775 - DNA, 22 bp, Artificial Sequence
  chemically synthesized
catctaggatcttacttttaac

SEQ ID NO: 1116776 - DNA, 22 bp, Artificial Sequence
  chemically synthesized
caacatctagttaaaagtaaga

SEQ ID NO: 1116777 - DNA, 22 bp, Artificial Sequence
  chemically synthesized
gagcttcatctaggatcttact

SEQ ID NO: 1116778 - DNA, 22 bp, Artificial Sequence
  chemically synthesized
gttaaaagtaagatcctagatg

SEQ ID NO: 1116779 - DNA, 22 bp, Artificial Sequence
  chemically synthesized
aaagtaagatcctagatgaagc

SEQ ID NO: 1116780 - DNA, 22 bp, Artificial Sequence
  chemically synthesized
agaaaatagaaatattggagct

SEQ ID NO: 1116781 - DNA, 22 bp, Artificial Sequence
  chemically synthesized
gatgaagctccaatatttctat

SEQ ID NO: 1116782 - DNA, 22 bp, Artificial Sequence
  chemically synthesized
ataagttgagaaaatagaaata

SEQ ID NO: 1116783 - DNA, 22 bp, Artificial Sequence
  chemically synthesized
caatatttctattttctcaact

SEQ ID NO: 1116784 - DNA, 22 bp, Artificial Sequence
  chemically synthesized
gatcacaaaaactaataagttg

SEQ ID NO: 1116785 - DNA, 22 bp, Artificial Sequence
  chemically synthesized
agatcacaaaaactaataagtt

SEQ ID NO: 1116786 - DNA, 22 bp, Artificial Sequence
  chemically synthesized
ctattttctcaacttattagtt

SEQ ID NO: 1116787 - DNA, 22 bp, Artificial Sequence
  chemically synthesized
tattttctcaacttattagttt

SEQ ID NO: 1116788 - DNA, 22 bp, Artificial Sequence
  chemically synthesized
ttttctcaacttattagttttt

SEQ ID NO: 1116789 - DNA, 22 bp, Artificial Sequence
  chemically synthesized
tctcaacttattagtttttgtg

SEQ ID NO: 1116790 - DNA, 22 bp, Artificial Sequence
  chemically synthesized
ctcaacttattagtttttgtga

SEQ ID NO: 1116791 - DNA, 22 bp, Artificial Sequence
  chemically synthesized
tcaacttattagtttttgtgat

SEQ ID NO: 1116792 - DNA, 22 bp, Artificial Sequence
  chemically synthesized
aacttattagtttttgtgatct

SEQ ID NO: 1116793 - DNA, 22 bp, Artificial Sequence
  chemically synthesized
aggacagataacttagatcaca

SEQ ID NO: 1116794 - DNA, 22 bp, Artificial Sequence
  chemically synthesized
attagtttttgtgatctaagtt

SEQ ID NO: 1116795 - DNA, 22 bp, Artificial Sequence
  chemically synthesized
ctaaggacagataacttagatc

SEQ ID NO: 1116796 - DNA, 22 bp, Artificial Sequence
  chemically synthesized
ttagtttttgtgatctaagtta

SEQ ID NO: 1116797 - DNA, 22 bp, Artificial Sequence
  chemically synthesized
gtttttgtgatctaagttatct

SEQ ID NO: 1116798 - DNA, 22 bp, Artificial Sequence
  chemically synthesized
ttgtgatctaagttatctgtcc

SEQ ID NO: 1116799 - DNA, 22 bp, Artificial Sequence
  chemically synthesized
tgtgatctaagttatctgtcct

SEQ ID NO: 1116800 - DNA, 22 bp, Artificial Sequence
  chemically synthesized
gtgatctaagttatctgtcctt

SEQ ID NO: 1116801 - DNA, 22 bp, Artificial Sequence
  chemically synthesized
tgatctaagttatctgtcctta

SEQ ID NO: 1116802 - DNA, 22 bp, Artificial Sequence
  chemically synthesized
agttatctgtccttagcagctt

SEQ ID NO: 1116803 - DNA, 22 bp, Artificial Sequence
  chemically synthesized
tctgtccttagcagcttatggc

SEQ ID NO: 1116804 - DNA, 22 bp, Artificial Sequence
  chemically synthesized
tccttagcagcttatggcatac

SEQ ID NO: 1116805 - DNA, 22 bp, Artificial Sequence
  chemically synthesized
agcagcttatggcatacttgtt

SEQ ID NO: 1116806 - DNA, 22 bp, Artificial Sequence
  chemically synthesized
gcagcttatggcatacttgttt

SEQ ID NO: 1116807 - DNA, 22 bp, Artificial Sequence
  chemically synthesized
atggcatacttgtttttcacta

SEQ ID NO: 1116808 - DNA, 22 bp, Artificial Sequence
  chemically synthesized
tggcatacttgtttttcactac

SEQ ID NO: 1116809 - DNA, 22 bp, Artificial Sequence
  chemically synthesized
atggagaataaatgtaagtagt

SEQ ID NO: 1116810 - DNA, 22 bp, Artificial Sequence
  chemically synthesized
aatggagaataaatgtaagtag

SEQ ID NO: 1116811 - DNA, 22 bp, Artificial Sequence
  chemically synthesized
taatggagaataaatgtaagta

SEQ ID NO: 1116812 - DNA, 22 bp, Artificial Sequence
  chemically synthesized
ttaatggagaataaatgtaagt

SEQ ID NO: 1116813 - DNA, 22 bp, Artificial Sequence
  chemically synthesized
gtttttcactacttacatttat

SEQ ID NO: 1116814 - DNA, 22 bp, Artificial Sequence
  chemically synthesized
tttttcactacttacatttatt

SEQ ID NO: 1116815 - DNA, 22 bp, Artificial Sequence
  chemically synthesized
ccttttaatggagaataaatgt

SEQ ID NO: 1116816 - DNA, 22 bp, Artificial Sequence
  chemically synthesized
accttttaatggagaataaatg

SEQ ID NO: 1116817 - DNA, 22 bp, Artificial Sequence
  chemically synthesized
ttcactacttacatttattctc

SEQ ID NO: 1116818 - DNA, 22 bp, Artificial Sequence
  chemically synthesized
tcactacttacatttattctcc

SEQ ID NO: 1116819 - DNA, 22 bp, Artificial Sequence
  chemically synthesized
cactacttacatttattctcca

SEQ ID NO: 1116820 - DNA, 22 bp, Artificial Sequence
  chemically synthesized
actacttacatttattctccat

SEQ ID NO: 1116821 - DNA, 22 bp, Artificial Sequence
  chemically synthesized
cttacatttattctccattaaa

SEQ ID NO: 1116822 - DNA, 22 bp, Artificial Sequence
  chemically synthesized
acatttattctccattaaaagg

SEQ ID NO: 1116823 - DNA, 22 bp, Artificial Sequence
  chemically synthesized
catttattctccattaaaaggt

SEQ ID NO: 1116824 - DNA, 22 bp, Artificial Sequence
  chemically synthesized
catataacatttaccttttaat

SEQ ID NO: 1116825 - DNA, 22 bp, Artificial Sequence
  chemically synthesized
ccatataacatttaccttttaa

SEQ ID NO: 1116826 - DNA, 22 bp, Artificial Sequence
  chemically synthesized
tccatataacatttacctttta

SEQ ID NO: 1116827 - DNA, 22 bp, Artificial Sequence
  chemically synthesized
attctccattaaaaggtaaatg

SEQ ID NO: 1116828 - DNA, 22 bp, Artificial Sequence
  chemically synthesized
ttctccattaaaaggtaaatgt

SEQ ID NO: 1116829 - DNA, 22 bp, Artificial Sequence
  chemically synthesized
tccattaaaaggtaaatgttat

SEQ ID NO: 1116830 - DNA, 22 bp, Artificial Sequence
  chemically synthesized
cattaaaaggtaaatgttatat

SEQ ID NO: 1116831 - DNA, 22 bp, Artificial Sequence
  chemically synthesized
agggtgctttccatataacatt

SEQ ID NO: 1116832 - DNA, 22 bp, Artificial Sequence
  chemically synthesized
aaaggtaaatgttatatggaaa

SEQ ID NO: 1116833 - DNA, 22 bp, Artificial Sequence
  chemically synthesized
agatgctcagggtgctttccat

SEQ ID NO: 1116834 - DNA, 22 bp, Artificial Sequence
  chemically synthesized
taagatgctcagggtgctttcc

SEQ ID NO: 1116835 - DNA, 22 bp, Artificial Sequence
  chemically synthesized
ctctaagatgctcagggtgctt

SEQ ID NO: 1116836 - DNA, 22 bp, Artificial Sequence
  chemically synthesized
tcctctaagatgctcagggtgc

SEQ ID NO: 1116837 - DNA, 22 bp, Artificial Sequence
  chemically synthesized
ctcctctaagatgctcagggtg

SEQ ID NO: 1116838 - DNA, 22 bp, Artificial Sequence
  chemically synthesized
tctcctctaagatgctcagggt

SEQ ID NO: 1116839 - DNA, 22 bp, Artificial Sequence
  chemically synthesized
ttctcctctaagatgctcaggg

SEQ ID NO: 1116840 - DNA, 22 bp, Artificial Sequence
  chemically synthesized
tatggaaagcaccctgagcatc

SEQ ID NO: 1116841 - DNA, 22 bp, Artificial Sequence
  chemically synthesized
tttctcctctaagatgctcagg

SEQ ID NO: 1116842 - DNA, 22 bp, Artificial Sequence
  chemically synthesized
ttttttctcctctaagatgctc

SEQ ID NO: 1116843 - DNA, 22 bp, Artificial Sequence
  chemically synthesized
attttttctcctctaagatgct

SEQ ID NO: 1116844 - DNA, 22 bp, Artificial Sequence
  chemically synthesized
aatgtgcttattttttctcctc

SEQ ID NO: 1116845 - DNA, 22 bp, Artificial Sequence
  chemically synthesized
aaatgtgcttattttttctcct

SEQ ID NO: 1116846 - DNA, 22 bp, Artificial Sequence
  chemically synthesized
agcatcttagaggagaaaaaat

SEQ ID NO: 1116847 - DNA, 22 bp, Artificial Sequence
  chemically synthesized
cttaaatgtgcttattttttct

SEQ ID NO: 1116848 - DNA, 22 bp, Artificial Sequence
  chemically synthesized
acttaaatgtgcttattttttc

SEQ ID NO: 1116849 - DNA, 22 bp, Artificial Sequence
  chemically synthesized
agaggagaaaaaataagcacat

SEQ ID NO: 1116850 - DNA, 22 bp, Artificial Sequence
  chemically synthesized
gaggagaaaaaataagcacatt

SEQ ID NO: 1116851 - DNA, 22 bp, Artificial Sequence
  chemically synthesized
catatttacttaaatgtgctta

SEQ ID NO: 1116852 - DNA, 22 bp, Artificial Sequence
  chemically synthesized
cattacatatttacttaaatgt

SEQ ID NO: 1116853 - DNA, 22 bp, Artificial Sequence
  chemically synthesized
acattacatatttacttaaatg

SEQ ID NO: 1116854 - DNA, 22 bp, Artificial Sequence
  chemically synthesized
atatttacattacatatttact

SEQ ID NO: 1116855 - DNA, 22 bp, Artificial Sequence
  chemically synthesized
gatatttacattacatatttac

SEQ ID NO: 1116856 - DNA, 22 bp, Artificial Sequence
  chemically synthesized
ttgatatttacattacatattt

SEQ ID NO: 1116857 - DNA, 22 bp, Artificial Sequence
  chemically synthesized
cttgatatttacattacatatt

SEQ ID NO: 1116858 - DNA, 22 bp, Artificial Sequence
  chemically synthesized
tcttgatatttacattacatat

SEQ ID NO: 1116859 - DNA, 22 bp, Artificial Sequence
  chemically synthesized
tctttcttgatatttacattac

SEQ ID NO: 1116860 - DNA, 22 bp, Artificial Sequence
  chemically synthesized
aagtaaatatgtaatgtaaata

SEQ ID NO: 1116861 - DNA, 22 bp, Artificial Sequence
  chemically synthesized
agtaaatatgtaatgtaaatat

SEQ ID NO: 1116862 - DNA, 22 bp, Artificial Sequence
  chemically synthesized
ctgtctttcttgatatttacat

SEQ ID NO: 1116863 - DNA, 22 bp, Artificial Sequence
  chemically synthesized
gacaccccaaatcctcctgtct

SEQ ID NO: 1116864 - DNA, 22 bp, Artificial Sequence
  chemically synthesized
tggacaccccaaatcctcctgt

SEQ ID NO: 1116865 - DNA, 22 bp, Artificial Sequence
  chemically synthesized
aaattctggacaccccaaatcc

SEQ ID NO: 1116866 - DNA, 22 bp, Artificial Sequence
  chemically synthesized
gataaagttcaaattctggaca

SEQ ID NO: 1116867 - DNA, 22 bp, Artificial Sequence
  chemically synthesized
tggataaagttcaaattctgga

SEQ ID NO: 1116868 - DNA, 22 bp, Artificial Sequence
  chemically synthesized
ctggataaagttcaaattctgg

SEQ ID NO: 1116869 - DNA, 22 bp, Artificial Sequence
  chemically synthesized
tctggataaagttcaaattctg

SEQ ID NO: 1116870 - DNA, 22 bp, Artificial Sequence
  chemically synthesized
ttttctggataaagttcaaatt

SEQ ID NO: 1116871 - DNA, 22 bp, Artificial Sequence
  chemically synthesized
ggggtgtccagaatttgaactt

SEQ ID NO: 1116872 - DNA, 22 bp, Artificial Sequence
  chemically synthesized
gggtgtccagaatttgaacttt

SEQ ID NO: 1116873 - DNA, 22 bp, Artificial Sequence
  chemically synthesized
tatattgttttctggataaagt

SEQ ID NO: 1116874 - DNA, 22 bp, Artificial Sequence
  chemically synthesized
atctgtatattgttttctggat

SEQ ID NO: 1116875 - DNA, 22 bp, Artificial Sequence
  chemically synthesized
catctgtatattgttttctgga

SEQ ID NO: 1116876 - DNA, 22 bp, Artificial Sequence
  chemically synthesized
tcatctgtatattgttttctgg

SEQ ID NO: 1116877 - DNA, 22 bp, Artificial Sequence
  chemically synthesized
tttcatctgtatattgttttct

SEQ ID NO: 1116878 - DNA, 22 bp, Artificial Sequence
  chemically synthesized
gaactttatccagaaaacaata

SEQ ID NO: 1116879 - DNA, 22 bp, Artificial Sequence
  chemically synthesized
ctttcatctgtatattgttttc

SEQ ID NO: 1116880 - DNA, 22 bp, Artificial Sequence
  chemically synthesized
aactttatccagaaaacaatat

SEQ ID NO: 1116881 - DNA, 22 bp, Artificial Sequence
  chemically synthesized
tctttcatctgtatattgtttt

SEQ ID NO: 1116882 - DNA, 22 bp, Artificial Sequence
  chemically synthesized
ttctttcatctgtatattgttt

SEQ ID NO: 1116883 - DNA, 22 bp, Artificial Sequence
  chemically synthesized
tttctttcatctgtatattgtt

SEQ ID NO: 1116884 - DNA, 22 bp, Artificial Sequence
  chemically synthesized
tatccagaaaacaatatacaga

SEQ ID NO: 1116885 - DNA, 22 bp, Artificial Sequence
  chemically synthesized
atccagaaaacaatatacagat

SEQ ID NO: 1116886 - DNA, 22 bp, Artificial Sequence
  chemically synthesized
tccagaaaacaatatacagatg

SEQ ID NO: 1116887 - DNA, 22 bp, Artificial Sequence
  chemically synthesized
tggtatatattttttctttcat

SEQ ID NO: 1116888 - DNA, 22 bp, Artificial Sequence
  chemically synthesized
tattgtggtatatattttttct

SEQ ID NO: 1116889 - DNA, 22 bp, Artificial Sequence
  chemically synthesized
tgtgttgtattgtggtatatat

SEQ ID NO: 1116890 - DNA, 22 bp, Artificial Sequence
  chemically synthesized
atgtgttgtattgtggtatata

SEQ ID NO: 1116891 - DNA, 22 bp, Artificial Sequence
  chemically synthesized
tatgtgttgtattgtggtatat

SEQ ID NO: 1116892 - DNA, 22 bp, Artificial Sequence
  chemically synthesized
ctttatgtgttgtattgtggta

SEQ ID NO: 1116893 - DNA, 22 bp, Artificial Sequence
  chemically synthesized
ttcctttatgtgttgtattgtg

SEQ ID NO: 1116894 - DNA, 22 bp, Artificial Sequence
  chemically synthesized
tcattgttcctttatgtgttgt

SEQ ID NO: 1116895 - DNA, 22 bp, Artificial Sequence
  chemically synthesized
ttgtcattgttcctttatgtgt

SEQ ID NO: 1116896 - DNA, 22 bp, Artificial Sequence
  chemically synthesized
gttgtcattgttcctttatgtg

SEQ ID NO: 1116897 - DNA, 22 bp, Artificial Sequence
  chemically synthesized
agcttgttgtcattgttccttt

SEQ ID NO: 1116898 - DNA, 22 bp, Artificial Sequence
  chemically synthesized
ctcagcttgttgtcattgttcc

SEQ ID NO: 1116899 - DNA, 22 bp, Artificial Sequence
  chemically synthesized
actcagcttgttgtcattgttc

SEQ ID NO: 1116900 - DNA, 22 bp, Artificial Sequence
  chemically synthesized
tactcagcttgttgtcattgtt

SEQ ID NO: 1116901 - DNA, 22 bp, Artificial Sequence
  chemically synthesized
aaagaacatcactttactcagc

SEQ ID NO: 1116902 - DNA, 22 bp, Artificial Sequence
  chemically synthesized
aaagtaactcaaagaacatcac

SEQ ID NO: 1116903 - DNA, 22 bp, Artificial Sequence
  chemically synthesized
taaaagtaactcaaagaacatc

SEQ ID NO: 1116904 - DNA, 22 bp, Artificial Sequence
  chemically synthesized
agtaaagtgatgttctttgagt

SEQ ID NO: 1116905 - DNA, 22 bp, Artificial Sequence
  chemically synthesized
ataggagaagataactctaaaa

SEQ ID NO: 1116906 - DNA, 22 bp, Artificial Sequence
  chemically synthesized
tttgagttacttttagagttat

SEQ ID NO: 1116907 - DNA, 22 bp, Artificial Sequence
  chemically synthesized
tgataggagaagataactctaa

SEQ ID NO: 1116908 - DNA, 22 bp, Artificial Sequence
  chemically synthesized
tgagttacttttagagttatct

SEQ ID NO: 1116909 - DNA, 22 bp, Artificial Sequence
  chemically synthesized
gagttacttttagagttatctt

SEQ ID NO: 1116910 - DNA, 22 bp, Artificial Sequence
  chemically synthesized
agttacttttagagttatcttc

SEQ ID NO: 1116911 - DNA, 22 bp, Artificial Sequence
  chemically synthesized
cttttagagttatcttctccta

SEQ ID NO: 1116912 - DNA, 22 bp, Artificial Sequence
  chemically synthesized
ttagagttatcttctcctatca

SEQ ID NO: 1116913 - DNA, 22 bp, Artificial Sequence
  chemically synthesized
tagagttatcttctcctatcag

SEQ ID NO: 1116914 - DNA, 22 bp, Artificial Sequence
  chemically synthesized
agagttatcttctcctatcaga

SEQ ID NO: 1116915 - DNA, 22 bp, Artificial Sequence
  chemically synthesized
gagttatcttctcctatcagag

SEQ ID NO: 1116916 - DNA, 22 bp, Artificial Sequence
  chemically synthesized
tcttctcctatcagaggggttt

SEQ ID NO: 1116917 - DNA, 22 bp, Artificial Sequence
  chemically synthesized
ctcctatcagaggggtttctat

SEQ ID NO: 1116918 - DNA, 22 bp, Artificial Sequence
  chemically synthesized
aatgtagataaaatagaaaccc

SEQ ID NO: 1116919 - DNA, 22 bp, Artificial Sequence
  chemically synthesized
tcctatcagaggggtttctatt

SEQ ID NO: 1116920 - DNA, 22 bp, Artificial Sequence
  chemically synthesized
ctatcagaggggtttctatttt

SEQ ID NO: 1116921 - DNA, 22 bp, Artificial Sequence
  chemically synthesized
tcagaggggtttctattttatc

SEQ ID NO: 1116922 - DNA, 22 bp, Artificial Sequence
  chemically synthesized
aagcaaaagctcaatgtagata

SEQ ID NO: 1116923 - DNA, 22 bp, Artificial Sequence
  chemically synthesized
ctattttatctacattgagctt

SEQ ID NO: 1116924 - DNA, 22 bp, Artificial Sequence
  chemically synthesized
tattttatctacattgagcttt

SEQ ID NO: 1116925 - DNA, 22 bp, Artificial Sequence
  chemically synthesized
ttttatctacattgagcttttg

SEQ ID NO: 1116926 - DNA, 22 bp, Artificial Sequence
  chemically synthesized
acaaaaactaaagcaaaagctc

SEQ ID NO: 1116927 - DNA, 22 bp, Artificial Sequence
  chemically synthesized
cacaaaaactaaagcaaaagct

SEQ ID NO: 1116928 - DNA, 22 bp, Artificial Sequence
  chemically synthesized
tatctacattgagcttttgctt

SEQ ID NO: 1116929 - DNA, 22 bp, Artificial Sequence
  chemically synthesized
atctacattgagcttttgcttt

SEQ ID NO: 1116930 - DNA, 22 bp, Artificial Sequence
  chemically synthesized
tctacattgagcttttgcttta

SEQ ID NO: 1116931 - DNA, 22 bp, Artificial Sequence
  chemically synthesized
cattgagcttttgctttagttt

SEQ ID NO: 1116932 - DNA, 22 bp, Artificial Sequence
  chemically synthesized
tatcatttcacaaaaactaaag

SEQ ID NO: 1116933 - DNA, 22 bp, Artificial Sequence
  chemically synthesized
atatcatttcacaaaaactaaa

SEQ ID NO: 1116934 - DNA, 22 bp, Artificial Sequence
  chemically synthesized
tatatcatttcacaaaaactaa

SEQ ID NO: 1116935 - DNA, 22 bp, Artificial Sequence
  chemically synthesized
ttatatcatttcacaaaaacta

SEQ ID NO: 1116936 - DNA, 22 bp, Artificial Sequence
  chemically synthesized
agcttttgctttagtttttgtg

SEQ ID NO: 1116937 - DNA, 22 bp, Artificial Sequence
  chemically synthesized
tttatatcatttcacaaaaact

SEQ ID NO: 1116938 - DNA, 22 bp, Artificial Sequence
  chemically synthesized
ctttttatatcatttcacaaaa

SEQ ID NO: 1116939 - DNA, 22 bp, Artificial Sequence
  chemically synthesized
ttgctttagtttttgtgaaatg

SEQ ID NO: 1116940 - DNA, 22 bp, Artificial Sequence
  chemically synthesized
tactttttatatcatttcacaa

SEQ ID NO: 1116941 - DNA, 22 bp, Artificial Sequence
  chemically synthesized
tgctttagtttttgtgaaatga

SEQ ID NO: 1116942 - DNA, 22 bp, Artificial Sequence
  chemically synthesized
gctttagtttttgtgaaatgat

SEQ ID NO: 1116943 - DNA, 22 bp, Artificial Sequence
  chemically synthesized
ctttagtttttgtgaaatgata

SEQ ID NO: 1116944 - DNA, 22 bp, Artificial Sequence
  chemically synthesized
attctactttttatatcatttc

SEQ ID NO: 1116945 - DNA, 22 bp, Artificial Sequence
  chemically synthesized
tagtttttgtgaaatgatataa

SEQ ID NO: 1116946 - DNA, 22 bp, Artificial Sequence
  chemically synthesized
tcattctactttttatatcatt

SEQ ID NO: 1116947 - DNA, 22 bp, Artificial Sequence
  chemically synthesized
agtttttgtgaaatgatataaa

SEQ ID NO: 1116948 - DNA, 22 bp, Artificial Sequence
  chemically synthesized
gtttttgtgaaatgatataaaa

SEQ ID NO: 1116949 - DNA, 22 bp, Artificial Sequence
  chemically synthesized
ttgtgaaatgatataaaaagta

SEQ ID NO: 1116950 - DNA, 22 bp, Artificial Sequence
  chemically synthesized
tgtgaaatgatataaaaagtag

SEQ ID NO: 1116951 - DNA, 22 bp, Artificial Sequence
  chemically synthesized
gtgaaatgatataaaaagtaga

SEQ ID NO: 1116952 - DNA, 22 bp, Artificial Sequence
  chemically synthesized
tgaaatgatataaaaagtagaa

SEQ ID NO: 1116953 - DNA, 22 bp, Artificial Sequence
  chemically synthesized
taaagaccacatagtgttctca

SEQ ID NO: 1116954 - DNA, 22 bp, Artificial Sequence
  chemically synthesized
ataaagaccacatagtgttctc

SEQ ID NO: 1116955 - DNA, 22 bp, Artificial Sequence
  chemically synthesized
aatatttataaagaccacatag

SEQ ID NO: 1116956 - DNA, 22 bp, Artificial Sequence
  chemically synthesized
caatatttataaagaccacata

SEQ ID NO: 1116957 - DNA, 22 bp, Artificial Sequence
  chemically synthesized
tcaatatttataaagaccacat

SEQ ID NO: 1116958 - DNA, 22 bp, Artificial Sequence
  chemically synthesized
ttttcaatatttataaagacca

SEQ ID NO: 1116959 - DNA, 22 bp, Artificial Sequence
  chemically synthesized
attttcaatatttataaagacc

SEQ ID NO: 1116960 - DNA, 22 bp, Artificial Sequence
  chemically synthesized
ataatttattttcaatatttat

SEQ ID NO: 1116961 - DNA, 22 bp, Artificial Sequence
  chemically synthesized
tgtggtctttataaatattgaa

SEQ ID NO: 1116962 - DNA, 22 bp, Artificial Sequence
  chemically synthesized
ttgataatttattttcaatatt

SEQ ID NO: 1116963 - DNA, 22 bp, Artificial Sequence
  chemically synthesized
tataaatattgaaaataaatta

SEQ ID NO: 1116964 - DNA, 22 bp, Artificial Sequence
  chemically synthesized
gagggctattgataatttattt

SEQ ID NO: 1116965 - DNA, 22 bp, Artificial Sequence
  chemically synthesized
ataaatattgaaaataaattat

SEQ ID NO: 1116966 - DNA, 22 bp, Artificial Sequence
  chemically synthesized
agagggctattgataatttatt

SEQ ID NO: 1116967 - DNA, 22 bp, Artificial Sequence
  chemically synthesized
taaatattgaaaataaattatc

SEQ ID NO: 1116968 - DNA, 22 bp, Artificial Sequence
  chemically synthesized
aaaataaattatcaatagccct

SEQ ID NO: 1116969 - DNA, 22 bp, Artificial Sequence
  chemically synthesized
tgatgataacatttagagggct

SEQ ID NO: 1116970 - DNA, 22 bp, Artificial Sequence
  chemically synthesized
tcaatagccctctaaatgttat

SEQ ID NO: 1116971 - DNA, 22 bp, Artificial Sequence
  chemically synthesized
gaataaagagattatgatgata

SEQ ID NO: 1116972 - DNA, 22 bp, Artificial Sequence
  chemically synthesized
agaataaagagattatgatgat

SEQ ID NO: 1116973 - DNA, 22 bp, Artificial Sequence
  chemically synthesized
taaatgttatcatcataatctc

SEQ ID NO: 1116974 - DNA, 22 bp, Artificial Sequence
  chemically synthesized
aatgttatcatcataatctctt

SEQ ID NO: 1116975 - DNA, 22 bp, Artificial Sequence
  chemically synthesized
gtaagcttagaataaagagatt

SEQ ID NO: 1116976 - DNA, 22 bp, Artificial Sequence
  chemically synthesized
tagtaagcttagaataaagaga

SEQ ID NO: 1116977 - DNA, 22 bp, Artificial Sequence
  chemically synthesized
tcatcataatctctttattcta

SEQ ID NO: 1116978 - DNA, 22 bp, Artificial Sequence
  chemically synthesized
attctagtaagcttagaataaa

SEQ ID NO: 1116979 - DNA, 22 bp, Artificial Sequence
  chemically synthesized
attgattctagtaagcttagaa

SEQ ID NO: 1116980 - DNA, 22 bp, Artificial Sequence
  chemically synthesized
tttattctaagcttactagaat

SEQ ID NO: 1116981 - DNA, 22 bp, Artificial Sequence
  chemically synthesized
gtaatattaattgattctagta

SEQ ID NO: 1116982 - DNA, 22 bp, Artificial Sequence
  chemically synthesized
tattctaagcttactagaatca

SEQ ID NO: 1116983 - DNA, 22 bp, Artificial Sequence
  chemically synthesized
attctaagcttactagaatcaa

SEQ ID NO: 1116984 - DNA, 22 bp, Artificial Sequence
  chemically synthesized
ttctaagcttactagaatcaat

SEQ ID NO: 1116985 - DNA, 22 bp, Artificial Sequence
  chemically synthesized
ttagtaatattaattgattcta

SEQ ID NO: 1116986 - DNA, 22 bp, Artificial Sequence
  chemically synthesized
tgttagtaatattaattgattc

SEQ ID NO: 1116987 - DNA, 22 bp, Artificial Sequence
  chemically synthesized
taagcttactagaatcaattaa

SEQ ID NO: 1116988 - DNA, 22 bp, Artificial Sequence
  chemically synthesized
tctgttagtaatattaattgat

SEQ ID NO: 1116989 - DNA, 22 bp, Artificial Sequence
  chemically synthesized
agcttactagaatcaattaata

SEQ ID NO: 1116990 - DNA, 22 bp, Artificial Sequence
  chemically synthesized
ttctctgttagtaatattaatt

SEQ ID NO: 1116991 - DNA, 22 bp, Artificial Sequence
  chemically synthesized
gttctctgttagtaatattaat

SEQ ID NO: 1116992 - DNA, 22 bp, Artificial Sequence
  chemically synthesized
tgttctctgttagtaatattaa

SEQ ID NO: 1116993 - DNA, 22 bp, Artificial Sequence
  chemically synthesized
actagaatcaattaatattact

SEQ ID NO: 1116994 - DNA, 22 bp, Artificial Sequence
  chemically synthesized
ctagaatcaattaatattacta

SEQ ID NO: 1116995 - DNA, 22 bp, Artificial Sequence
  chemically synthesized
gaatcaattaatattactaaca

SEQ ID NO: 1116996 - DNA, 22 bp, Artificial Sequence
  chemically synthesized
aaatataagttttgttctctgt

SEQ ID NO: 1116997 - DNA, 22 bp, Artificial Sequence
  chemically synthesized
atattactaacagagaacaaaa

SEQ ID NO: 1116998 - DNA, 22 bp, Artificial Sequence
  chemically synthesized
agatattcaaatataagttttg

SEQ ID NO: 1116999 - DNA, 22 bp, Artificial Sequence
  chemically synthesized
ctaacagagaacaaaacttata

SEQ ID NO: 1117000 - DNA, 22 bp, Artificial Sequence
  chemically synthesized
ctgagatattcaaatataagtt

SEQ ID NO: 1117001 - DNA, 22 bp, Artificial Sequence
  chemically synthesized
acagagaacaaaacttatattt

SEQ ID NO: 1117002 - DNA, 22 bp, Artificial Sequence
  chemically synthesized
atatttgaatatctcaggaatc

SEQ ID NO: 1117003 - DNA, 22 bp, Artificial Sequence
  chemically synthesized
aaggtcaaatatgattcctgag

SEQ ID NO: 1117004 - DNA, 22 bp, Artificial Sequence
  chemically synthesized
tatttgaatatctcaggaatca

SEQ ID NO: 1117005 - DNA, 22 bp, Artificial Sequence
  chemically synthesized
gaatatctcaggaatcatattt

SEQ ID NO: 1117006 - DNA, 22 bp, Artificial Sequence
  chemically synthesized
aatatctcaggaatcatatttg

SEQ ID NO: 1117007 - DNA, 22 bp, Artificial Sequence
  chemically synthesized
acaagatattaaaggtcaaata

SEQ ID NO: 1117008 - DNA, 22 bp, Artificial Sequence
  chemically synthesized
aggaatcatatttgacctttaa

SEQ ID NO: 1117009 - DNA, 22 bp, Artificial Sequence
  chemically synthesized
gaacaatgtggttaacaagata

SEQ ID NO: 1117010 - DNA, 22 bp, Artificial Sequence
  chemically synthesized
gacctttaatatcttgttaacc

SEQ ID NO: 1117011 - DNA, 22 bp, Artificial Sequence
  chemically synthesized
acctttaatatcttgttaacca

SEQ ID NO: 1117012 - DNA, 22 bp, Artificial Sequence
  chemically synthesized
taatatcttgttaaccacattg

SEQ ID NO: 1117013 - DNA, 22 bp, Artificial Sequence
  chemically synthesized
gaataactggaacaatgtggtt

SEQ ID NO: 1117014 - DNA, 22 bp, Artificial Sequence
  chemically synthesized
aatatcttgttaaccacattgt

SEQ ID NO: 1117015 - DNA, 22 bp, Artificial Sequence
  chemically synthesized
atatcttgttaaccacattgtt

SEQ ID NO: 1117016 - DNA, 22 bp, Artificial Sequence
  chemically synthesized
tattagaataactggaacaatg

SEQ ID NO: 1117017 - DNA, 22 bp, Artificial Sequence
  chemically synthesized
atattagaataactggaacaat

SEQ ID NO: 1117018 - DNA, 22 bp, Artificial Sequence
  chemically synthesized
gttaaccacattgttccagtta

SEQ ID NO: 1117019 - DNA, 22 bp, Artificial Sequence
  chemically synthesized
tttatattagaataactggaac

SEQ ID NO: 1117020 - DNA, 22 bp, Artificial Sequence
  chemically synthesized
ttaaccacattgttccagttat

SEQ ID NO: 1117021 - DNA, 22 bp, Artificial Sequence
  chemically synthesized
accacattgttccagttattct

SEQ ID NO: 1117022 - DNA, 22 bp, Artificial Sequence
  chemically synthesized
agactatttatattagaataac

SEQ ID NO: 1117023 - DNA, 22 bp, Artificial Sequence
  chemically synthesized
ctgagactatttatattagaat

SEQ ID NO: 1117024 - DNA, 22 bp, Artificial Sequence
  chemically synthesized
ttactgagactatttatattag

SEQ ID NO: 1117025 - DNA, 22 bp, Artificial Sequence
  chemically synthesized
ttccagttattctaatataaat

SEQ ID NO: 1117026 - DNA, 22 bp, Artificial Sequence
  chemically synthesized
cagttattctaatataaatagt

SEQ ID NO: 1117027 - DNA, 22 bp, Artificial Sequence
  chemically synthesized
tggtggttgttactgagactat

SEQ ID NO: 1117028 - DNA, 22 bp, Artificial Sequence
  chemically synthesized
ttctaatataaatagtctcagt

SEQ ID NO: 1117029 - DNA, 22 bp, Artificial Sequence
  chemically synthesized
taatataaatagtctcagtaac

SEQ ID NO: 1117030 - DNA, 22 bp, Artificial Sequence
  chemically synthesized
atataaatagtctcagtaacaa

SEQ ID NO: 1117031 - DNA, 22 bp, Artificial Sequence
  chemically synthesized
tagttgtggtggttgttactga

SEQ ID NO: 1117032 - DNA, 22 bp, Artificial Sequence
  chemically synthesized
ttgtagttgtggtggttgttac

SEQ ID NO: 1117033 - DNA, 22 bp, Artificial Sequence
  chemically synthesized
gttgtagttgtggtggttgtta

SEQ ID NO: 1117034 - DNA, 22 bp, Artificial Sequence
  chemically synthesized
tgttgtagttgtggtggttgtt

SEQ ID NO: 1117035 - DNA, 22 bp, Artificial Sequence
  chemically synthesized
ttgttgtagttgtggtggttgt

SEQ ID NO: 1117036 - DNA, 22 bp, Artificial Sequence
  chemically synthesized
tttttgttgtagttgtggtggt

SEQ ID NO: 1117037 - DNA, 22 bp, Artificial Sequence
  chemically synthesized
ttgtttttgttgtagttgtggt

SEQ ID NO: 1117038 - DNA, 22 bp, Artificial Sequence
  chemically synthesized
agtaacaaccaccacaactaca

SEQ ID NO: 1117039 - DNA, 22 bp, Artificial Sequence
  chemically synthesized
tagattattgtttttgttgtag

SEQ ID NO: 1117040 - DNA, 22 bp, Artificial Sequence
  chemically synthesized
atagattattgtttttgttgta

SEQ ID NO: 1117041 - DNA, 22 bp, Artificial Sequence
  chemically synthesized
tatagattattgtttttgttgt

SEQ ID NO: 1117042 - DNA, 22 bp, Artificial Sequence
  chemically synthesized
ctttatagattattgtttttgt

SEQ ID NO: 1117043 - DNA, 22 bp, Artificial Sequence
  chemically synthesized
caacaaaaacaataatctataa

SEQ ID NO: 1117044 - DNA, 22 bp, Artificial Sequence
  chemically synthesized
tcaaaatgggaaagtaatagta

SEQ ID NO: 1117045 - DNA, 22 bp, Artificial Sequence
  chemically synthesized
tgtcaaaatgggaaagtaatag

SEQ ID NO: 1117046 - DNA, 22 bp, Artificial Sequence
  chemically synthesized
taaagtaggtactattactttc

SEQ ID NO: 1117047 - DNA, 22 bp, Artificial Sequence
  chemically synthesized
ctctgtcaaaatgggaaagtaa

SEQ ID NO: 1117048 - DNA, 22 bp, Artificial Sequence
  chemically synthesized
cctcctctgtcaaaatgggaaa

SEQ ID NO: 1117049 - DNA, 22 bp, Artificial Sequence
  chemically synthesized
ccctcctctgtcaaaatgggaa

SEQ ID NO: 1117050 - DNA, 22 bp, Artificial Sequence
  chemically synthesized
acttccctcctctgtcaaaatg

SEQ ID NO: 1117051 - DNA, 22 bp, Artificial Sequence
  chemically synthesized
ttactttcccattttgacagag

SEQ ID NO: 1117052 - DNA, 22 bp, Artificial Sequence
  chemically synthesized
ctttcccattttgacagaggag

SEQ ID NO: 1117053 - DNA, 22 bp, Artificial Sequence
  chemically synthesized
tgcctcacttccctcctctgtc

SEQ ID NO: 1117054 - DNA, 22 bp, Artificial Sequence
  chemically synthesized
tgtgcctcacttccctcctctg

SEQ ID NO: 1117055 - DNA, 22 bp, Artificial Sequence
  chemically synthesized
tcccattttgacagaggaggga

SEQ ID NO: 1117056 - DNA, 22 bp, Artificial Sequence
  chemically synthesized
cccattttgacagaggagggaa

SEQ ID NO: 1117057 - DNA, 22 bp, Artificial Sequence
  chemically synthesized
tctgtgcctcacttccctcctc

SEQ ID NO: 1117058 - DNA, 22 bp, Artificial Sequence
  chemically synthesized
ccattttgacagaggagggaag

SEQ ID NO: 1117059 - DNA, 22 bp, Artificial Sequence
  chemically synthesized
tgacagaggagggaagtgaggc

SEQ ID NO: 1117060 - DNA, 22 bp, Artificial Sequence
  chemically synthesized
gacagaggagggaagtgaggca

SEQ ID NO: 1117061 - DNA, 22 bp, Artificial Sequence
  chemically synthesized
acagaggagggaagtgaggcac

SEQ ID NO: 1117062 - DNA, 22 bp, Artificial Sequence
  chemically synthesized
acaaacctctctgtgcctcact

SEQ ID NO: 1117063 - DNA, 22 bp, Artificial Sequence
  chemically synthesized
cacaaacctctctgtgcctcac

SEQ ID NO: 1117064 - DNA, 22 bp, Artificial Sequence
  chemically synthesized
tcacaaacctctctgtgcctca

SEQ ID NO: 1117065 - DNA, 22 bp, Artificial Sequence
  chemically synthesized
aaaattttcacaaacctctctg

SEQ ID NO: 1117066 - DNA, 22 bp, Artificial Sequence
  chemically synthesized
caaaattttcacaaacctctct

SEQ ID NO: 1117067 - DNA, 22 bp, Artificial Sequence
  chemically synthesized
tcaaaattttcacaaacctctc

SEQ ID NO: 1117068 - DNA, 22 bp, Artificial Sequence
  chemically synthesized
ttttcaaaattttcacaaacct

SEQ ID NO: 1117069 - DNA, 22 bp, Artificial Sequence
  chemically synthesized
cattgttttcaaaattttcaca

SEQ ID NO: 1117070 - DNA, 22 bp, Artificial Sequence
  chemically synthesized
ttgcattgttttcaaaattttc

SEQ ID NO: 1117071 - DNA, 22 bp, Artificial Sequence
  chemically synthesized
gtgaaaattttgaaaacaatgc

SEQ ID NO: 1117072 - DNA, 22 bp, Artificial Sequence
  chemically synthesized
aatgtggctattgcattgtttt

SEQ ID NO: 1117073 - DNA, 22 bp, Artificial Sequence
  chemically synthesized
tgaaaattttgaaaacaatgca

SEQ ID NO: 1117074 - DNA, 22 bp, Artificial Sequence
  chemically synthesized
caatgtggctattgcattgttt

SEQ ID NO: 1117075 - DNA, 22 bp, Artificial Sequence
  chemically synthesized
tcaatgtggctattgcattgtt

SEQ ID NO: 1117076 - DNA, 22 bp, Artificial Sequence
  chemically synthesized
ttttcaatgtggctattgcatt

SEQ ID NO: 1117077 - DNA, 22 bp, Artificial Sequence
  chemically synthesized
attttcaatgtggctattgcat

SEQ ID NO: 1117078 - DNA, 22 bp, Artificial Sequence
  chemically synthesized
tgaaaacaatgcaatagccaca

SEQ ID NO: 1117079 - DNA, 22 bp, Artificial Sequence
  chemically synthesized
gaaaacaatgcaatagccacat

SEQ ID NO: 1117080 - DNA, 22 bp, Artificial Sequence
  chemically synthesized
aaaacaatgcaatagccacatt

SEQ ID NO: 1117081 - DNA, 22 bp, Artificial Sequence
  chemically synthesized
gtagtataaggaatcttatttt

SEQ ID NO: 1117082 - DNA, 22 bp, Artificial Sequence
  chemically synthesized
ggtagtataaggaatcttattt

SEQ ID NO: 1117083 - DNA, 22 bp, Artificial Sequence
  chemically synthesized
taatttggtagtataaggaatc

SEQ ID NO: 1117084 - DNA, 22 bp, Artificial Sequence
  chemically synthesized
aaaataagattccttatactac

SEQ ID NO: 1117085 - DNA, 22 bp, Artificial Sequence
  chemically synthesized
tgtacataaactataatttggt

SEQ ID NO: 1117086 - DNA, 22 bp, Artificial Sequence
  chemically synthesized
cttatactaccaaattatagtt

SEQ ID NO: 1117087 - DNA, 22 bp, Artificial Sequence
  chemically synthesized
atactaccaaattatagtttat

SEQ ID NO: 1117088 - DNA, 22 bp, Artificial Sequence
  chemically synthesized
tactaccaaattatagtttatg

SEQ ID NO: 1117089 - DNA, 22 bp, Artificial Sequence
  chemically synthesized
ccaaattatagtttatgtacat

SEQ ID NO: 1117090 - DNA, 22 bp, Artificial Sequence
  chemically synthesized
tgacatacatatggaaattatg

SEQ ID NO: 1117091 - DNA, 22 bp, Artificial Sequence
  chemically synthesized
tagtttatgtacataatttcca

SEQ ID NO: 1117092 - DNA, 22 bp, Artificial Sequence
  chemically synthesized
ttatgacatacatatggaaatt

SEQ ID NO: 1117093 - DNA, 22 bp, Artificial Sequence
  chemically synthesized
atgtacataatttccatatgta

SEQ ID NO: 1117094 - DNA, 22 bp, Artificial Sequence
  chemically synthesized
tgtacataatttccatatgtat

SEQ ID NO: 1117095 - DNA, 22 bp, Artificial Sequence
  chemically synthesized
caattattatgacatacatatg

SEQ ID NO: 1117096 - DNA, 22 bp, Artificial Sequence
  chemically synthesized
acaattattatgacatacatat

SEQ ID NO: 1117097 - DNA, 22 bp, Artificial Sequence
  chemically synthesized
ttacaattattatgacatacat

SEQ ID NO: 1117098 - DNA, 22 bp, Artificial Sequence
  chemically synthesized
cttacaattattatgacataca

SEQ ID NO: 1117099 - DNA, 22 bp, Artificial Sequence
  chemically synthesized
tcttacaattattatgacatac

SEQ ID NO: 1117100 - DNA, 22 bp, Artificial Sequence
  chemically synthesized
tttcttacaattattatgacat

SEQ ID NO: 1117101 - DNA, 22 bp, Artificial Sequence
  chemically synthesized
ctttcttacaattattatgaca

SEQ ID NO: 1117102 - DNA, 22 bp, Artificial Sequence
  chemically synthesized
ttctttcttacaattattatga

SEQ ID NO: 1117103 - DNA, 22 bp, Artificial Sequence
  chemically synthesized
ccatatgtatgtcataataatt

SEQ ID NO: 1117104 - DNA, 22 bp, Artificial Sequence
  chemically synthesized
cttctttcttacaattattatg

SEQ ID NO: 1117105 - DNA, 22 bp, Artificial Sequence
  chemically synthesized
catatgtatgtcataataattg

SEQ ID NO: 1117106 - DNA, 22 bp, Artificial Sequence
  chemically synthesized
atttcttctttcttacaattat

SEQ ID NO: 1117107 - DNA, 22 bp, Artificial Sequence
  chemically synthesized
taagaaagaagaaatcagcatt

SEQ ID NO: 1117108 - DNA, 22 bp, Artificial Sequence
  chemically synthesized
tataaaatggtatacaacaatg

SEQ ID NO: 1117109 - DNA, 22 bp, Artificial Sequence
  chemically synthesized
gtataaaatggtatacaacaat

SEQ ID NO: 1117110 - DNA, 22 bp, Artificial Sequence
  chemically synthesized
ttgtataaaatggtatacaaca

SEQ ID NO: 1117111 - DNA, 22 bp, Artificial Sequence
  chemically synthesized
tcttgtataaaatggtatacaa

SEQ ID NO: 1117112 - DNA, 22 bp, Artificial Sequence
  chemically synthesized
ctcttgtataaaatggtataca

SEQ ID NO: 1117113 - DNA, 22 bp, Artificial Sequence
  chemically synthesized
tctcttgtataaaatggtatac

SEQ ID NO: 1117114 - DNA, 22 bp, Artificial Sequence
  chemically synthesized
agttttctcttgtataaaatgg

SEQ ID NO: 1117115 - DNA, 22 bp, Artificial Sequence
  chemically synthesized
ttgtataccattttatacaaga

SEQ ID NO: 1117116 - DNA, 22 bp, Artificial Sequence
  chemically synthesized
atgctcagttttctcttgtata

SEQ ID NO: 1117117 - DNA, 22 bp, Artificial Sequence
  chemically synthesized
tataccattttatacaagagaa

SEQ ID NO: 1117118 - DNA, 22 bp, Artificial Sequence
  chemically synthesized
ctgatgctcagttttctcttgt

SEQ ID NO: 1117119 - DNA, 22 bp, Artificial Sequence
  chemically synthesized
actgatgctcagttttctcttg

SEQ ID NO: 1117120 - DNA, 22 bp, Artificial Sequence
  chemically synthesized
atcttactgatgctcagttttc

SEQ ID NO: 1117121 - DNA, 22 bp, Artificial Sequence
  chemically synthesized
aatcttactgatgctcagtttt

SEQ ID NO: 1117122 - DNA, 22 bp, Artificial Sequence
  chemically synthesized
tatacaagagaaaactgagcat

SEQ ID NO: 1117123 - DNA, 22 bp, Artificial Sequence
  chemically synthesized
atacaagagaaaactgagcatc

SEQ ID NO: 1117124 - DNA, 22 bp, Artificial Sequence
  chemically synthesized
tacaagagaaaactgagcatca

SEQ ID NO: 1117125 - DNA, 22 bp, Artificial Sequence
  chemically synthesized
atatacgatttaatcttactga

SEQ ID NO: 1117126 - DNA, 22 bp, Artificial Sequence
  chemically synthesized
gatatacgatttaatcttactg

SEQ ID NO: 1117127 - DNA, 22 bp, Artificial Sequence
  chemically synthesized
tgatatacgatttaatcttact

SEQ ID NO: 1117128 - DNA, 22 bp, Artificial Sequence
  chemically synthesized
agcatcagtaagattaaatcgt

SEQ ID NO: 1117129 - DNA, 22 bp, Artificial Sequence
  chemically synthesized
atatgatgacctttgatatacg

SEQ ID NO: 1117130 - DNA, 22 bp, Artificial Sequence
  chemically synthesized
ctaatatgatgacctttgatat

SEQ ID NO: 1117131 - DNA, 22 bp, Artificial Sequence
  chemically synthesized
cctaatatgatgacctttgata

SEQ ID NO: 1117132 - DNA, 22 bp, Artificial Sequence
  chemically synthesized
aatcgtatatcaaaggtcatca

SEQ ID NO: 1117133 - DNA, 22 bp, Artificial Sequence
  chemically synthesized
aaacttcctaatatgatgacct

SEQ ID NO: 1117134 - DNA, 22 bp, Artificial Sequence
  chemically synthesized
aatctaaaacttcctaatatga

SEQ ID NO: 1117135 - DNA, 22 bp, Artificial Sequence
  chemically synthesized
atattgaatctaaaacttccta

SEQ ID NO: 1117136 - DNA, 22 bp, Artificial Sequence
  chemically synthesized
taatattgaatctaaaacttcc

SEQ ID NO: 1117137 - DNA, 22 bp, Artificial Sequence
  chemically synthesized
ggaagttttagattcaatatta

SEQ ID NO: 1117138 - DNA, 22 bp, Artificial Sequence
  chemically synthesized
tagattcaatattagaaccctg

SEQ ID NO: 1117139 - DNA, 22 bp, Artificial Sequence
  chemically synthesized
taagtagaagagcagggttcta

SEQ ID NO: 1117140 - DNA, 22 bp, Artificial Sequence
  chemically synthesized
agattcaatattagaaccctgc

SEQ ID NO: 1117141 - DNA, 22 bp, Artificial Sequence
  chemically synthesized
gattcaatattagaaccctgct

SEQ ID NO: 1117142 - DNA, 22 bp, Artificial Sequence
  chemically synthesized
aaattataagtagaagagcagg

SEQ ID NO: 1117143 - DNA, 22 bp, Artificial Sequence
  chemically synthesized
aatattagaaccctgctcttct

SEQ ID NO: 1117144 - DNA, 22 bp, Artificial Sequence
  chemically synthesized
gaaccctgctcttctacttata

SEQ ID NO: 1117145 - DNA, 22 bp, Artificial Sequence
  chemically synthesized
aaagaaagctgaaattataagt

SEQ ID NO: 1117146 - DNA, 22 bp, Artificial Sequence
  chemically synthesized
ctcttctacttataatttcagc

SEQ ID NO: 1117147 - DNA, 22 bp, Artificial Sequence
  chemically synthesized
ttctacttataatttcagcttt

SEQ ID NO: 1117148 - DNA, 22 bp, Artificial Sequence
  chemically synthesized
ctacttataatttcagctttct

SEQ ID NO: 1117149 - DNA, 22 bp, Artificial Sequence
  chemically synthesized
tacttataatttcagctttctt

SEQ ID NO: 1117150 - DNA, 22 bp, Artificial Sequence
  chemically synthesized
cttataatttcagctttctttc

SEQ ID NO: 1117151 - DNA, 22 bp, Artificial Sequence
  chemically synthesized
ataatttcagctttctttcaga

SEQ ID NO: 1117152 - DNA, 22 bp, Artificial Sequence
  chemically synthesized
taatttcagctttctttcagac

SEQ ID NO: 1117153 - DNA, 22 bp, Artificial Sequence
  chemically synthesized
gcaacagcagagcatgtctgaa

SEQ ID NO: 1117154 - DNA, 22 bp, Artificial Sequence
  chemically synthesized
cagctttctttcagacatgctc

SEQ ID NO: 1117155 - DNA, 22 bp, Artificial Sequence
  chemically synthesized
agctttctttcagacatgctct

SEQ ID NO: 1117156 - DNA, 22 bp, Artificial Sequence
  chemically synthesized
tctttcagacatgctctgctgt

SEQ ID NO: 1117157 - DNA, 22 bp, Artificial Sequence
  chemically synthesized
ctttcagacatgctctgctgtt

SEQ ID NO: 1117158 - DNA, 22 bp, Artificial Sequence
  chemically synthesized
tttcagacatgctctgctgttg

SEQ ID NO: 1117159 - DNA, 22 bp, Artificial Sequence
  chemically synthesized
aaatacccctagcaacagcaga

SEQ ID NO: 1117160 - DNA, 22 bp, Artificial Sequence
  chemically synthesized
tcagacatgctctgctgttgct

SEQ ID NO: 1117161 - DNA, 22 bp, Artificial Sequence
  chemically synthesized
cagacatgctctgctgttgcta

SEQ ID NO: 1117162 - DNA, 22 bp, Artificial Sequence
  chemically synthesized
agacatgctctgctgttgctag

SEQ ID NO: 1117163 - DNA, 22 bp, Artificial Sequence
  chemically synthesized
tgctgttgctaggggtatttca

SEQ ID NO: 1117164 - DNA, 22 bp, Artificial Sequence
  chemically synthesized
aataatatccattgaaataccc

SEQ ID NO: 1117165 - DNA, 22 bp, Artificial Sequence
  chemically synthesized
gaataatatccattgaaatacc

SEQ ID NO: 1117166 - DNA, 22 bp, Artificial Sequence
  chemically synthesized
ctgttgctaggggtatttcaat

SEQ ID NO: 1117167 - DNA, 22 bp, Artificial Sequence
  chemically synthesized
tgaataatatccattgaaatac

SEQ ID NO: 1117168 - DNA, 22 bp, Artificial Sequence
  chemically synthesized
ttgaataatatccattgaaata

SEQ ID NO: 1117169 - DNA, 22 bp, Artificial Sequence
  chemically synthesized
tttgaataatatccattgaaat

SEQ ID NO: 1117170 - DNA, 22 bp, Artificial Sequence
  chemically synthesized
ttgctaggggtatttcaatgga

SEQ ID NO: 1117171 - DNA, 22 bp, Artificial Sequence
  chemically synthesized
ctaggggtatttcaatggatat

SEQ ID NO: 1117172 - DNA, 22 bp, Artificial Sequence
  chemically synthesized
ggggtatttcaatggatattat

SEQ ID NO: 1117173 - DNA, 22 bp, Artificial Sequence
  chemically synthesized
acacctttttgaataatatcca

SEQ ID NO: 1117174 - DNA, 22 bp, Artificial Sequence
  chemically synthesized
atacgctcacacctttttgaat

SEQ ID NO: 1117175 - DNA, 22 bp, Artificial Sequence
  chemically synthesized
caatggatattattcaaaaagg

SEQ ID NO: 1117176 - DNA, 22 bp, Artificial Sequence
  chemically synthesized
aatggatattattcaaaaaggt

SEQ ID NO: 1117177 - DNA, 22 bp, Artificial Sequence
  chemically synthesized
tgatacgctcacacctttttga

SEQ ID NO: 1117178 - DNA, 22 bp, Artificial Sequence
  chemically synthesized
atatatattctgatacgctcac

SEQ ID NO: 1117179 - DNA, 22 bp, Artificial Sequence
  chemically synthesized
ttcaaaaaggtgtgagcgtatc

SEQ ID NO: 1117180 - DNA, 22 bp, Artificial Sequence
  chemically synthesized
tgatatatattctgatacgctc

SEQ ID NO: 1117181 - DNA, 22 bp, Artificial Sequence
  chemically synthesized
aaaaaggtgtgagcgtatcaga

SEQ ID NO: 1117182 - DNA, 22 bp, Artificial Sequence
  chemically synthesized
ctctgatatatattctgatacg

SEQ ID NO: 1117183 - DNA, 22 bp, Artificial Sequence
  chemically synthesized
gctctgatatatattctgatac

SEQ ID NO: 1117184 - DNA, 22 bp, Artificial Sequence
  chemically synthesized
tttgctctgatatatattctga

SEQ ID NO: 1117185 - DNA, 22 bp, Artificial Sequence
  chemically synthesized
tgtttgctctgatatatattct

SEQ ID NO: 1117186 - DNA, 22 bp, Artificial Sequence
  chemically synthesized
taagctctgtttgctctgatat

SEQ ID NO: 1117187 - DNA, 22 bp, Artificial Sequence
  chemically synthesized
atacatccaaactataagctct

SEQ ID NO: 1117188 - DNA, 22 bp, Artificial Sequence
  chemically synthesized
aacatccctaatacatccaaac

SEQ ID NO: 1117189 - DNA, 22 bp, Artificial Sequence
  chemically synthesized
atagtttggatgtattagggat

SEQ ID NO: 1117190 - DNA, 22 bp, Artificial Sequence
  chemically synthesized
aatatgttgaacatccctaata

SEQ ID NO: 1117191 - DNA, 22 bp, Artificial Sequence
  chemically synthesized
tagtttggatgtattagggatg

SEQ ID NO: 1117192 - DNA, 22 bp, Artificial Sequence
  chemically synthesized
ggatgtattagggatgttcaac

SEQ ID NO: 1117193 - DNA, 22 bp, Artificial Sequence
  chemically synthesized
atagttaaatatgttgaacatc

SEQ ID NO: 1117194 - DNA, 22 bp, Artificial Sequence
  chemically synthesized
gatgtattagggatgttcaaca

SEQ ID NO: 1117195 - DNA, 22 bp, Artificial Sequence
  chemically synthesized
aattaatagttaaatatgttga

SEQ ID NO: 1117196 - DNA, 22 bp, Artificial Sequence
  chemically synthesized
ctgaattaatagttaaatatgt

SEQ ID NO: 1117197 - DNA, 22 bp, Artificial Sequence
  chemically synthesized
gggatgttcaacatatttaact

SEQ ID NO: 1117198 - DNA, 22 bp, Artificial Sequence
  chemically synthesized
gccctgctgaattaatagttaa

SEQ ID NO: 1117199 - DNA, 22 bp, Artificial Sequence
  chemically synthesized
ttggccctgctgaattaatagt

SEQ ID NO: 1117200 - DNA, 22 bp, Artificial Sequence
  chemically synthesized
gttggccctgctgaattaatag

SEQ ID NO: 1117201 - DNA, 22 bp, Artificial Sequence
  chemically synthesized
aacatatttaactattaattca

SEQ ID NO: 1117202 - DNA, 22 bp, Artificial Sequence
  chemically synthesized
tgatatcttgttggccctgctg

SEQ ID NO: 1117203 - DNA, 22 bp, Artificial Sequence
  chemically synthesized
aactattaattcagcagggcca

SEQ ID NO: 1117204 - DNA, 22 bp, Artificial Sequence
  chemically synthesized
gtgatatcttgttggccctgct

SEQ ID NO: 1117205 - DNA, 22 bp, Artificial Sequence
  chemically synthesized
actattaattcagcagggccaa

SEQ ID NO: 1117206 - DNA, 22 bp, Artificial Sequence
  chemically synthesized
cttgtgatatcttgttggccct

SEQ ID NO: 1117207 - DNA, 22 bp, Artificial Sequence
  chemically synthesized
ttaattcagcagggccaacaag

SEQ ID NO: 1117208 - DNA, 22 bp, Artificial Sequence
  chemically synthesized
attcagcagggccaacaagata

SEQ ID NO: 1117209 - DNA, 22 bp, Artificial Sequence
  chemically synthesized
agcagggccaacaagatatcac

SEQ ID NO: 1117210 - DNA, 22 bp, Artificial Sequence
  chemically synthesized
agtgacccggcattccttgtga

SEQ ID NO: 1117211 - DNA, 22 bp, Artificial Sequence
  chemically synthesized
tgagtgacccggcattccttgt

SEQ ID NO: 1117212 - DNA, 22 bp, Artificial Sequence
  chemically synthesized
tcagagaccattctgagtgacc

SEQ ID NO: 1117213 - DNA, 22 bp, Artificial Sequence
  chemically synthesized
tagactgtcagagaccattctg

SEQ ID NO: 1117214 - DNA, 22 bp, Artificial Sequence
  chemically synthesized
gtaatcagcctatagactgtca

SEQ ID NO: 1117215 - DNA, 22 bp, Artificial Sequence
  chemically synthesized
agaatggtctctgacagtctat

SEQ ID NO: 1117216 - DNA, 22 bp, Artificial Sequence
  chemically synthesized
tgacagtctataggctgattac

SEQ ID NO: 1117217 - DNA, 22 bp, Artificial Sequence
  chemically synthesized
tatacagagttggtaatcagcc

SEQ ID NO: 1117218 - DNA, 22 bp, Artificial Sequence
  chemically synthesized
acagtctataggctgattacca

SEQ ID NO: 1117219 - DNA, 22 bp, Artificial Sequence
  chemically synthesized
agctgtatacagagttggtaat

SEQ ID NO: 1117220 - DNA, 22 bp, Artificial Sequence
  chemically synthesized
gagctgtatacagagttggtaa

SEQ ID NO: 1117221 - DNA, 22 bp, Artificial Sequence
  chemically synthesized
tttgagctgtatacagagttgg

SEQ ID NO: 1117222 - DNA, 22 bp, Artificial Sequence
  chemically synthesized
taggctgattaccaactctgta

SEQ ID NO: 1117223 - DNA, 22 bp, Artificial Sequence
  chemically synthesized
atttgagctgtatacagagttg

SEQ ID NO: 1117224 - DNA, 22 bp, Artificial Sequence
  chemically synthesized
agtttatttgagctgtatacag

SEQ ID NO: 1117225 - DNA, 22 bp, Artificial Sequence
  chemically synthesized
attaccaactctgtatacagct

SEQ ID NO: 1117226 - DNA, 22 bp, Artificial Sequence
  chemically synthesized
ttcagtttatttgagctgtata

SEQ ID NO: 1117227 - DNA, 22 bp, Artificial Sequence
  chemically synthesized
ccaactctgtatacagctcaaa

SEQ ID NO: 1117228 - DNA, 22 bp, Artificial Sequence
  chemically synthesized
tgtatacagctcaaataaactg

SEQ ID NO: 1117229 - DNA, 22 bp, Artificial Sequence
  chemically synthesized
tgcaccagttattcagtttatt

SEQ ID NO: 1117230 - DNA, 22 bp, Artificial Sequence
  chemically synthesized
tatacagctcaaataaactgaa

SEQ ID NO: 1117231 - DNA, 22 bp, Artificial Sequence
  chemically synthesized
atgcaccagttattcagtttat

SEQ ID NO: 1117232 - DNA, 22 bp, Artificial Sequence
  chemically synthesized
tatgcaccagttattcagttta

SEQ ID NO: 1117233 - DNA, 22 bp, Artificial Sequence
  chemically synthesized
tttatgcaccagttattcagtt

SEQ ID NO: 1117234 - DNA, 22 bp, Artificial Sequence
  chemically synthesized
aaataaactgaataactggtgc

SEQ ID NO: 1117235 - DNA, 22 bp, Artificial Sequence
  chemically synthesized
tgtgtctctttatgcaccagtt

SEQ ID NO: 1117236 - DNA, 22 bp, Artificial Sequence
  chemically synthesized
gggtctatgtgtctctttatgc

SEQ ID NO: 1117237 - DNA, 22 bp, Artificial Sequence
  chemically synthesized
aataactggtgcataaagagac

SEQ ID NO: 1117238 - DNA, 22 bp, Artificial Sequence
  chemically synthesized
tggggtctatgtgtctctttat

SEQ ID NO: 1117239 - DNA, 22 bp, Artificial Sequence
  chemically synthesized
ctggggtctatgtgtctcttta

SEQ ID NO: 1117240 - DNA, 22 bp, Artificial Sequence
  chemically synthesized
tctggggtctatgtgtctcttt

SEQ ID NO: 1117241 - DNA, 22 bp, Artificial Sequence
  chemically synthesized
tttctggggtctatgtgtctct

SEQ ID NO: 1117242 - DNA, 22 bp, Artificial Sequence
  chemically synthesized
ctttctggggtctatgtgtctc

SEQ ID NO: 1117243 - DNA, 22 bp, Artificial Sequence
  chemically synthesized
gtgcataaagagacacatagac

SEQ ID NO: 1117244 - DNA, 22 bp, Artificial Sequence
  chemically synthesized
cttctttctggggtctatgtgt

SEQ ID NO: 1117245 - DNA, 22 bp, Artificial Sequence
  chemically synthesized
actgcttctttctggggtctat

SEQ ID NO: 1117246 - DNA, 22 bp, Artificial Sequence
  chemically synthesized
acaaatatgcagataccattga

SEQ ID NO: 1117247 - DNA, 22 bp, Artificial Sequence
  chemically synthesized
aacattgacaaatatgcagata

SEQ ID NO: 1117248 - DNA, 22 bp, Artificial Sequence
  chemically synthesized
catatttgtcaatgttcagacg

SEQ ID NO: 1117249 - DNA, 22 bp, Artificial Sequence
  chemically synthesized
acagaacccagatatcgtctga

SEQ ID NO: 1117250 - DNA, 22 bp, Artificial Sequence
  chemically synthesized
gtcaatgttcagacgatatctg

SEQ ID NO: 1117251 - DNA, 22 bp, Artificial Sequence
  chemically synthesized
tcaatgttcagacgatatctgg

SEQ ID NO: 1117252 - DNA, 22 bp, Artificial Sequence
  chemically synthesized
agacgatatctgggttctgtta

SEQ ID NO: 1117253 - DNA, 22 bp, Artificial Sequence
  chemically synthesized
aaagtaatgtgccctaacagaa

SEQ ID NO: 1117254 - DNA, 22 bp, Artificial Sequence
  chemically synthesized
gaaagtaatgtgccctaacaga

SEQ ID NO: 1117255 - DNA, 22 bp, Artificial Sequence
  chemically synthesized
ttgaaagtaatgtgccctaaca

SEQ ID NO: 1117256 - DNA, 22 bp, Artificial Sequence
  chemically synthesized
ctcttgaaagtaatgtgcccta

SEQ ID NO: 1117257 - DNA, 22 bp, Artificial Sequence
  chemically synthesized
ggttctgttagggcacattact

SEQ ID NO: 1117258 - DNA, 22 bp, Artificial Sequence
  chemically synthesized
caatgttcctcttgaaagtaat

SEQ ID NO: 1117259 - DNA, 22 bp, Artificial Sequence
  chemically synthesized
tgttagggcacattactttcaa

SEQ ID NO: 1117260 - DNA, 22 bp, Artificial Sequence
  chemically synthesized
gcaatgttcctcttgaaagtaa

SEQ ID NO: 1117261 - DNA, 22 bp, Artificial Sequence
  chemically synthesized
tgcaatgttcctcttgaaagta

SEQ ID NO: 1117262 - DNA, 22 bp, Artificial Sequence
  chemically synthesized
ttagggcacattactttcaaga

SEQ ID NO: 1117263 - DNA, 22 bp, Artificial Sequence
  chemically synthesized
gggcacattactttcaagagga

SEQ ID NO: 1117264 - DNA, 22 bp, Artificial Sequence
  chemically synthesized
attttgcaatgttcctcttgaa

SEQ ID NO: 1117265 - DNA, 22 bp, Artificial Sequence
  chemically synthesized
cattttgcaatgttcctcttga

SEQ ID NO: 1117266 - DNA, 22 bp, Artificial Sequence
  chemically synthesized
ttcattttgcaatgttcctctt

SEQ ID NO: 1117267 - DNA, 22 bp, Artificial Sequence
  chemically synthesized
ctcttcattttgcaatgttcct

SEQ ID NO: 1117268 - DNA, 22 bp, Artificial Sequence
  chemically synthesized
ctttcaagaggaacattgcaaa

SEQ ID NO: 1117269 - DNA, 22 bp, Artificial Sequence
  chemically synthesized
tcaagaggaacattgcaaaatg

SEQ ID NO: 1117270 - DNA, 22 bp, Artificial Sequence
  chemically synthesized
caagaggaacattgcaaaatga

SEQ ID NO: 1117271 - DNA, 22 bp, Artificial Sequence
  chemically synthesized
aagaggaacattgcaaaatgaa

SEQ ID NO: 1117272 - DNA, 22 bp, Artificial Sequence
  chemically synthesized
tatgcatattcctcttcatttt

SEQ ID NO: 1117273 - DNA, 22 bp, Artificial Sequence
  chemically synthesized
gtatgcatattcctcttcattt

SEQ ID NO: 1117274 - DNA, 22 bp, Artificial Sequence
  chemically synthesized
caaaatgaagaggaatatgcat

SEQ ID NO: 1117275 - DNA, 22 bp, Artificial Sequence
  chemically synthesized
aaggcatacttgtatgcatatt

SEQ ID NO: 1117276 - DNA, 22 bp, Artificial Sequence
  chemically synthesized
caaggcatacttgtatgcatat

SEQ ID NO: 1117277 - DNA, 22 bp, Artificial Sequence
  chemically synthesized
ttcaaggcatacttgtatgcat

SEQ ID NO: 1117278 - DNA, 22 bp, Artificial Sequence
  chemically synthesized
acactcttcaaggcatacttgt

SEQ ID NO: 1117279 - DNA, 22 bp, Artificial Sequence
  chemically synthesized
attcacactcttcaaggcatac

SEQ ID NO: 1117280 - DNA, 22 bp, Artificial Sequence
  chemically synthesized
tctcattcacactcttcaaggc

SEQ ID NO: 1117281 - DNA, 22 bp, Artificial Sequence
  chemically synthesized
actgtctcattcacactcttca

SEQ ID NO: 1117282 - DNA, 22 bp, Artificial Sequence
  chemically synthesized
cactgtctcattcacactcttc

SEQ ID NO: 1117283 - DNA, 22 bp, Artificial Sequence
  chemically synthesized
ttcactgtctcattcacactct

SEQ ID NO: 1117284 - DNA, 22 bp, Artificial Sequence
  chemically synthesized
ggctcttcactgtctcattcac

SEQ ID NO: 1117285 - DNA, 22 bp, Artificial Sequence
  chemically synthesized
tgggctcttcactgtctcattc

SEQ ID NO: 1117286 - DNA, 22 bp, Artificial Sequence
  chemically synthesized
ctgggctcttcactgtctcatt

SEQ ID NO: 1117287 - DNA, 22 bp, Artificial Sequence
  chemically synthesized
tctgggctcttcactgtctcat

SEQ ID NO: 1117288 - DNA, 22 bp, Artificial Sequence
  chemically synthesized
gaagagtgtgaatgagacagtg

SEQ ID NO: 1117289 - DNA, 22 bp, Artificial Sequence
  chemically synthesized
aagagtgtgaatgagacagtga

SEQ ID NO: 1117290 - DNA, 22 bp, Artificial Sequence
  chemically synthesized
aaatgaaatgttttctgggctc

SEQ ID NO: 1117291 - DNA, 22 bp, Artificial Sequence
  chemically synthesized
tgtctgaaatgaaatgttttct

SEQ ID NO: 1117292 - DNA, 22 bp, Artificial Sequence
  chemically synthesized
cagctgtgtctgaaatgaaatg

SEQ ID NO: 1117293 - DNA, 22 bp, Artificial Sequence
  chemically synthesized
tctacagctgtgtctgaaatga

SEQ ID NO: 1117294 - DNA, 22 bp, Artificial Sequence
  chemically synthesized
atcaactatctacagctgtgtc

SEQ ID NO: 1117295 - DNA, 22 bp, Artificial Sequence
  chemically synthesized
aatcaactatctacagctgtgt

SEQ ID NO: 1117296 - DNA, 22 bp, Artificial Sequence
  chemically synthesized
taatcaactatctacagctgtg

SEQ ID NO: 1117297 - DNA, 22 bp, Artificial Sequence
  chemically synthesized
ttaatcaactatctacagctgt

SEQ ID NO: 1117298 - DNA, 22 bp, Artificial Sequence
  chemically synthesized
catttcagacacagctgtagat

SEQ ID NO: 1117299 - DNA, 22 bp, Artificial Sequence
  chemically synthesized
atttcagacacagctgtagata

SEQ ID NO: 1117300 - DNA, 22 bp, Artificial Sequence
  chemically synthesized
tttttaatcaactatctacagc

SEQ ID NO: 1117301 - DNA, 22 bp, Artificial Sequence
  chemically synthesized
ttatttttaatcaactatctac

SEQ ID NO: 1117302 - DNA, 22 bp, Artificial Sequence
  chemically synthesized
cagacacagctgtagatagttg

SEQ ID NO: 1117303 - DNA, 22 bp, Artificial Sequence
  chemically synthesized
attatttttaatcaactatcta

SEQ ID NO: 1117304 - DNA, 22 bp, Artificial Sequence
  chemically synthesized
agacacagctgtagatagttga

SEQ ID NO: 1117305 - DNA, 22 bp, Artificial Sequence
  chemically synthesized
tattatttttaatcaactatct

SEQ ID NO: 1117306 - DNA, 22 bp, Artificial Sequence
  chemically synthesized
aattttattatttttaatcaac

SEQ ID NO: 1117307 - DNA, 22 bp, Artificial Sequence
  chemically synthesized
tactaaattttattatttttaa

SEQ ID NO: 1117308 - DNA, 22 bp, Artificial Sequence
  chemically synthesized
tagatagttgattaaaaataat

SEQ ID NO: 1117309 - DNA, 22 bp, Artificial Sequence
  chemically synthesized
ttatactaaattttattatttt

SEQ ID NO: 1117310 - DNA, 22 bp, Artificial Sequence
  chemically synthesized
gttatactaaattttattattt

SEQ ID NO: 1117311 - DNA, 22 bp, Artificial Sequence
  chemically synthesized
tgttatactaaattttattatt

SEQ ID NO: 1117312 - DNA, 22 bp, Artificial Sequence
  chemically synthesized
tttgttatactaaattttatta

SEQ ID NO: 1117313 - DNA, 22 bp, Artificial Sequence
  chemically synthesized
attaaaaataataaaatttagt

SEQ ID NO: 1117314 - DNA, 22 bp, Artificial Sequence
  chemically synthesized
acatctctttgttatactaaat

SEQ ID NO: 1117315 - DNA, 22 bp, Artificial Sequence
  chemically synthesized
aaaataataaaatttagtataa

SEQ ID NO: 1117316 - DNA, 22 bp, Artificial Sequence
  chemically synthesized
aacatctctttgttatactaaa

SEQ ID NO: 1117317 - DNA, 22 bp, Artificial Sequence
  chemically synthesized
taacatctctttgttatactaa

SEQ ID NO: 1117318 - DNA, 22 bp, Artificial Sequence
  chemically synthesized
tttaacatctctttgttatact

SEQ ID NO: 1117319 - DNA, 22 bp, Artificial Sequence
  chemically synthesized
ctttaacatctctttgttatac

SEQ ID NO: 1117320 - DNA, 22 bp, Artificial Sequence
  chemically synthesized
tagtatcttctttaacatctct

SEQ ID NO: 1117321 - DNA, 22 bp, Artificial Sequence
  chemically synthesized
agtataacaaagagatgttaaa

SEQ ID NO: 1117322 - DNA, 22 bp, Artificial Sequence
  chemically synthesized
gtataacaaagagatgttaaag

SEQ ID NO: 1117323 - DNA, 22 bp, Artificial Sequence
  chemically synthesized
ttgtagtatcttctttaacatc

SEQ ID NO: 1117324 - DNA, 22 bp, Artificial Sequence
  chemically synthesized
gttgtagtatcttctttaacat

SEQ ID NO: 1117325 - DNA, 22 bp, Artificial Sequence
  chemically synthesized
tgttgtagtatcttctttaaca

SEQ ID NO: 1117326 - DNA, 22 bp, Artificial Sequence
  chemically synthesized
ttgttgtagtatcttctttaac

SEQ ID NO: 1117327 - DNA, 22 bp, Artificial Sequence
  chemically synthesized
caggcccttttgttgtagtatc

SEQ ID NO: 1117328 - DNA, 22 bp, Artificial Sequence
  chemically synthesized
aagaagatactacaacaaaagg

SEQ ID NO: 1117329 - DNA, 22 bp, Artificial Sequence
  chemically synthesized
caacaaaagggcctgcagtcac

SEQ ID NO: 1117330 - DNA, 22 bp, Artificial Sequence
  chemically synthesized
ataacagcagagcaaaaagggt

SEQ ID NO: 1117331 - DNA, 22 bp, Artificial Sequence
  chemically synthesized
cagtcaccctttttgctctgct

SEQ ID NO: 1117332 - DNA, 22 bp, Artificial Sequence
  chemically synthesized
tttgctctgctgttatcagttc

SEQ ID NO: 1117333 - DNA, 22 bp, Artificial Sequence
  chemically synthesized
ttgctctgctgttatcagttct

SEQ ID NO: 1117334 - DNA, 22 bp, Artificial Sequence
  chemically synthesized
tgctctgctgttatcagttctg

SEQ ID NO: 1117335 - DNA, 22 bp, Artificial Sequence
  chemically synthesized
gctctgctgttatcagttctgt

SEQ ID NO: 1117336 - DNA, 22 bp, Artificial Sequence
  chemically synthesized
ctctgctgttatcagttctgtc

SEQ ID NO: 1117337 - DNA, 22 bp, Artificial Sequence
  chemically synthesized
tgctgttatcagttctgtctct

SEQ ID NO: 1117338 - DNA, 22 bp, Artificial Sequence
  chemically synthesized
ctgttatcagttctgtctctac

SEQ ID NO: 1117339 - DNA, 22 bp, Artificial Sequence
  chemically synthesized
ttatcagttctgtctctactgc

SEQ ID NO: 1117340 - DNA, 22 bp, Artificial Sequence
  chemically synthesized
gggacagatagtaagcagtaga

SEQ ID NO: 1117341 - DNA, 22 bp, Artificial Sequence
  chemically synthesized
tcagttctgtctctactgctta

SEQ ID NO: 1117342 - DNA, 22 bp, Artificial Sequence
  chemically synthesized
ttagggacagatagtaagcagt

SEQ ID NO: 1117343 - DNA, 22 bp, Artificial Sequence
  chemically synthesized
attagggacagatagtaagcag

SEQ ID NO: 1117344 - DNA, 22 bp, Artificial Sequence
  chemically synthesized
tattagggacagatagtaagca

SEQ ID NO: 1117345 - DNA, 22 bp, Artificial Sequence
  chemically synthesized
tgtctctactgcttactatctg

SEQ ID NO: 1117346 - DNA, 22 bp, Artificial Sequence
  chemically synthesized
tctctactgcttactatctgtc

SEQ ID NO: 1117347 - DNA, 22 bp, Artificial Sequence
  chemically synthesized
tactgcttactatctgtcccta

SEQ ID NO: 1117348 - DNA, 22 bp, Artificial Sequence
  chemically synthesized
ctgcttactatctgtccctaat

SEQ ID NO: 1117349 - DNA, 22 bp, Artificial Sequence
  chemically synthesized
cttactatctgtccctaataaa

SEQ ID NO: 1117350 - DNA, 22 bp, Artificial Sequence
  chemically synthesized
actatctgtccctaataaagta

SEQ ID NO: 1117351 - DNA, 22 bp, Artificial Sequence
  chemically synthesized
ctatctgtccctaataaagtac

SEQ ID NO: 1117352 - DNA, 22 bp, Artificial Sequence
  chemically synthesized
agaaaggtcgaagtactttatt

SEQ ID NO: 1117353 - DNA, 22 bp, Artificial Sequence
  chemically synthesized
tctgtccctaataaagtacttc

SEQ ID NO: 1117354 - DNA, 22 bp, Artificial Sequence
  chemically synthesized
aggttcagaaaggtcgaagtac

SEQ ID NO: 1117355 - DNA, 22 bp, Artificial Sequence
  chemically synthesized
tccctaataaagtacttcgacc

SEQ ID NO: 1117356 - DNA, 22 bp, Artificial Sequence
  chemically synthesized
ataaagtacttcgacctttctg

SEQ ID NO: 1117357 - DNA, 22 bp, Artificial Sequence
  chemically synthesized
cataggaaatactgaggttcag

SEQ ID NO: 1117358 - DNA, 22 bp, Artificial Sequence
  chemically synthesized
acataggaaatactgaggttca

SEQ ID NO: 1117359 - DNA, 22 bp, Artificial Sequence
  chemically synthesized
tacataggaaatactgaggttc

SEQ ID NO: 1117360 - DNA, 22 bp, Artificial Sequence
  chemically synthesized
cgacctttctgaacctcagtat

SEQ ID NO: 1117361 - DNA, 22 bp, Artificial Sequence
  chemically synthesized
gacctttctgaacctcagtatt

SEQ ID NO: 1117362 - DNA, 22 bp, Artificial Sequence
  chemically synthesized
ttttacataggaaatactgagg

SEQ ID NO: 1117363 - DNA, 22 bp, Artificial Sequence
  chemically synthesized
ctattttacataggaaatactg

SEQ ID NO: 1117364 - DNA, 22 bp, Artificial Sequence
  chemically synthesized
tctgaacctcagtatttcctat

SEQ ID NO: 1117365 - DNA, 22 bp, Artificial Sequence
  chemically synthesized
ttgctattttacataggaaata

SEQ ID NO: 1117366 - DNA, 22 bp, Artificial Sequence
  chemically synthesized
ctgaacctcagtatttcctatg

SEQ ID NO: 1117367 - DNA, 22 bp, Artificial Sequence
  chemically synthesized
attgctattttacataggaaat

SEQ ID NO: 1117368 - DNA, 22 bp, Artificial Sequence
  chemically synthesized
tgaacctcagtatttcctatgt

SEQ ID NO: 1117369 - DNA, 22 bp, Artificial Sequence
  chemically synthesized
tattgctattttacataggaaa

SEQ ID NO: 1117370 - DNA, 22 bp, Artificial Sequence
  chemically synthesized
aacctcagtatttcctatgtaa

SEQ ID NO: 1117371 - DNA, 22 bp, Artificial Sequence
  chemically synthesized
agtatttcctatgtaaaatagc

SEQ ID NO: 1117372 - DNA, 22 bp, Artificial Sequence
  chemically synthesized
cctatgtaaaatagcaataaag

SEQ ID NO: 1117373 - DNA, 22 bp, Artificial Sequence
  chemically synthesized
ctatgtaaaatagcaataaaga

SEQ ID NO: 1117374 - DNA, 22 bp, Artificial Sequence
  chemically synthesized
tgtaaaatagcaataaagatac

SEQ ID NO: 1117375 - DNA, 22 bp, Artificial Sequence
  chemically synthesized
agaagtcccacatggtaggtat

SEQ ID NO: 1117376 - DNA, 22 bp, Artificial Sequence
  chemically synthesized
atcccctcagaagtcccacatg

SEQ ID NO: 1117377 - DNA, 22 bp, Artificial Sequence
  chemically synthesized
aatcccctcagaagtcccacat

SEQ ID NO: 1117378 - DNA, 22 bp, Artificial Sequence
  chemically synthesized
taatcccctcagaagtcccaca

SEQ ID NO: 1117379 - DNA, 22 bp, Artificial Sequence
  chemically synthesized
ctttaatcccctcagaagtccc

SEQ ID NO: 1117380 - DNA, 22 bp, Artificial Sequence
  chemically synthesized
cctttaatcccctcagaagtcc

SEQ ID NO: 1117381 - DNA, 22 bp, Artificial Sequence
  chemically synthesized
ccatgtgggacttctgagggga

SEQ ID NO: 1117382 - DNA, 22 bp, Artificial Sequence
  chemically synthesized
ctgaggggattaaaggaagctc

SEQ ID NO: 1117383 - DNA, 22 bp, Artificial Sequence
  chemically synthesized
tgaggggattaaaggaagctcg

SEQ ID NO: 1117384 - DNA, 22 bp, Artificial Sequence
  chemically synthesized
ggaaataaatagcgagcttcct

SEQ ID NO: 1117385 - DNA, 22 bp, Artificial Sequence
  chemically synthesized
gggaaataaatagcgagcttcc

SEQ ID NO: 1117386 - DNA, 22 bp, Artificial Sequence
  chemically synthesized
aggggattaaaggaagctcgct

SEQ ID NO: 1117387 - DNA, 22 bp, Artificial Sequence
  chemically synthesized
tgggaaataaatagcgagcttc

SEQ ID NO: 1117388 - DNA, 22 bp, Artificial Sequence
  chemically synthesized
attttgggaaataaatagcgag

SEQ ID NO: 1117389 - DNA, 22 bp, Artificial Sequence
  chemically synthesized
tctcattttgggaaataaatag

SEQ ID NO: 1117390 - DNA, 22 bp, Artificial Sequence
  chemically synthesized
aaggaagctcgctatttatttc

SEQ ID NO: 1117391 - DNA, 22 bp, Artificial Sequence
  chemically synthesized
taaaaactatctcattttggga

SEQ ID NO: 1117392 - DNA, 22 bp, Artificial Sequence
  chemically synthesized
gctatttatttcccaaaatgag

SEQ ID NO: 1117393 - DNA, 22 bp, Artificial Sequence
  chemically synthesized
ctataaaaactatctcattttg

SEQ ID NO: 1117394 - DNA, 22 bp, Artificial Sequence
  chemically synthesized
actataaaaactatctcatttt

SEQ ID NO: 1117395 - DNA, 22 bp, Artificial Sequence
  chemically synthesized
tactataaaaactatctcattt

SEQ ID NO: 1117396 - DNA, 22 bp, Artificial Sequence
  chemically synthesized
tttatttcccaaaatgagatag

SEQ ID NO: 1117397 - DNA, 22 bp, Artificial Sequence
  chemically synthesized
atttcccaaaatgagatagttt

SEQ ID NO: 1117398 - DNA, 22 bp, Artificial Sequence
  chemically synthesized
tttcccaaaatgagatagtttt

SEQ ID NO: 1117399 - DNA, 22 bp, Artificial Sequence
  chemically synthesized
cccattttactataaaaactat

SEQ ID NO: 1117400 - DNA, 22 bp, Artificial Sequence
  chemically synthesized
cccaaaatgagatagtttttat

SEQ ID NO: 1117401 - DNA, 22 bp, Artificial Sequence
  chemically synthesized
ccaaaatgagatagtttttata

SEQ ID NO: 1117402 - DNA, 22 bp, Artificial Sequence
  chemically synthesized
gctccccattttactataaaaa

SEQ ID NO: 1117403 - DNA, 22 bp, Artificial Sequence
  chemically synthesized
ctagctccccattttactataa

SEQ ID NO: 1117404 - DNA, 22 bp, Artificial Sequence
  chemically synthesized
ttcctagctccccattttacta

SEQ ID NO: 1117405 - DNA, 22 bp, Artificial Sequence
  chemically synthesized
attattcctagctccccatttt

SEQ ID NO: 1117406 - DNA, 22 bp, Artificial Sequence
  chemically synthesized
aattattcctagctccccattt

SEQ ID NO: 1117407 - DNA, 22 bp, Artificial Sequence
  chemically synthesized
ttatagtaaaatggggagctag

SEQ ID NO: 1117408 - DNA, 22 bp, Artificial Sequence
  chemically synthesized
tatagtaaaatggggagctagg

SEQ ID NO: 1117409 - DNA, 22 bp, Artificial Sequence
  chemically synthesized
agcttaattattcctagctccc

SEQ ID NO: 1117410 - DNA, 22 bp, Artificial Sequence
  chemically synthesized
atagtaaaatggggagctagga

SEQ ID NO: 1117411 - DNA, 22 bp, Artificial Sequence
  chemically synthesized
tagtaaaatggggagctaggaa

SEQ ID NO: 1117412 - DNA, 22 bp, Artificial Sequence
  chemically synthesized
tcagcttaattattcctagctc

SEQ ID NO: 1117413 - DNA, 22 bp, Artificial Sequence
  chemically synthesized
ctcagcttaattattcctagct

SEQ ID NO: 1117414 - DNA, 22 bp, Artificial Sequence
  chemically synthesized
tctcagcttaattattcctagc

SEQ ID NO: 1117415 - DNA, 22 bp, Artificial Sequence
  chemically synthesized
ttctcagcttaattattcctag

SEQ ID NO: 1117416 - DNA, 22 bp, Artificial Sequence
  chemically synthesized
tgtcaaaccatttttctcagct

SEQ ID NO: 1117417 - DNA, 22 bp, Artificial Sequence
  chemically synthesized
atgtcaaaccatttttctcagc

SEQ ID NO: 1117418 - DNA, 22 bp, Artificial Sequence
  chemically synthesized
ggaataattaagctgagaaaaa

SEQ ID NO: 1117419 - DNA, 22 bp, Artificial Sequence
  chemically synthesized
gcttatgtcaaaccatttttct

SEQ ID NO: 1117420 - DNA, 22 bp, Artificial Sequence
  chemically synthesized
agcttatgtcaaaccatttttc

SEQ ID NO: 1117421 - DNA, 22 bp, Artificial Sequence
  chemically synthesized
agctgagaaaaatggtttgaca

SEQ ID NO: 1117422 - DNA, 22 bp, Artificial Sequence
  chemically synthesized
agaaaaatggtttgacataagc

SEQ ID NO: 1117423 - DNA, 22 bp, Artificial Sequence
  chemically synthesized
tcgggtatagtcttagcttatg

SEQ ID NO: 1117424 - DNA, 22 bp, Artificial Sequence
  chemically synthesized
gtcgggtatagtcttagcttat

SEQ ID NO: 1117425 - DNA, 22 bp, Artificial Sequence
  chemically synthesized
agtttgtcgggtatagtcttag

SEQ ID NO: 1117426 - DNA, 22 bp, Artificial Sequence
  chemically synthesized
cagtttgtcgggtatagtctta

SEQ ID NO: 1117427 - DNA, 22 bp, Artificial Sequence
  chemically synthesized
gacataagctaagactataccc

SEQ ID NO: 1117428 - DNA, 22 bp, Artificial Sequence
  chemically synthesized
acataagctaagactatacccg

SEQ ID NO: 1117429 - DNA, 22 bp, Artificial Sequence
  chemically synthesized
agactatacccgacaaactgaa

SEQ ID NO: 1117430 - DNA, 22 bp, Artificial Sequence
  chemically synthesized
tacccgacaaactgaaatatgt

SEQ ID NO: 1117431 - DNA, 22 bp, Artificial Sequence
  chemically synthesized
agtagaatgagcacatatttca

SEQ ID NO: 1117432 - DNA, 22 bp, Artificial Sequence
  chemically synthesized
aagtagaatgagcacatatttc

SEQ ID NO: 1117433 - DNA, 22 bp, Artificial Sequence
  chemically synthesized
taagtagaatgagcacatattt

SEQ ID NO: 1117434 - DNA, 22 bp, Artificial Sequence
  chemically synthesized
cctttaagtagaatgagcacat

SEQ ID NO: 1117435 - DNA, 22 bp, Artificial Sequence
  chemically synthesized
aagttacctttaagtagaatga

SEQ ID NO: 1117436 - DNA, 22 bp, Artificial Sequence
  chemically synthesized
aaatatgtgctcattctactta

SEQ ID NO: 1117437 - DNA, 22 bp, Artificial Sequence
  chemically synthesized
ttgaagttacctttaagtagaa

SEQ ID NO: 1117438 - DNA, 22 bp, Artificial Sequence
  chemically synthesized
agattattgaagttacctttaa

SEQ ID NO: 1117439 - DNA, 22 bp, Artificial Sequence
  chemically synthesized
aagattattgaagttaccttta

SEQ ID NO: 1117440 - DNA, 22 bp, Artificial Sequence
  chemically synthesized
taagattattgaagttaccttt

SEQ ID NO: 1117441 - DNA, 22 bp, Artificial Sequence
  chemically synthesized
ttaagattattgaagttacctt

SEQ ID NO: 1117442 - DNA, 22 bp, Artificial Sequence
  chemically synthesized
tttaagattattgaagttacct

SEQ ID NO: 1117443 - DNA, 22 bp, Artificial Sequence
  chemically synthesized
attctacttaaaggtaacttca

SEQ ID NO: 1117444 - DNA, 22 bp, Artificial Sequence
  chemically synthesized
tttttaagattattgaagttac

SEQ ID NO: 1117445 - DNA, 22 bp, Artificial Sequence
  chemically synthesized
ctttttaagattattgaagtta

SEQ ID NO: 1117446 - DNA, 22 bp, Artificial Sequence
  chemically synthesized
tacttaaaggtaacttcaataa

SEQ ID NO: 1117447 - DNA, 22 bp, Artificial Sequence
  chemically synthesized
cttaaaggtaacttcaataatc

SEQ ID NO: 1117448 - DNA, 22 bp, Artificial Sequence
  chemically synthesized
aatttctttttaagattattga

SEQ ID NO: 1117449 - DNA, 22 bp, Artificial Sequence
  chemically synthesized
aaaggtaacttcaataatctta

SEQ ID NO: 1117450 - DNA, 22 bp, Artificial Sequence
  chemically synthesized
aaggtaacttcaataatcttaa

SEQ ID NO: 1117451 - DNA, 22 bp, Artificial Sequence
  chemically synthesized
ctaaatttctttttaagattat

SEQ ID NO: 1117452 - DNA, 22 bp, Artificial Sequence
  chemically synthesized
cctaaatttctttttaagatta

SEQ ID NO: 1117453 - DNA, 22 bp, Artificial Sequence
  chemically synthesized
caataatcttaaaaagaaattt

SEQ ID NO: 1117454 - DNA, 22 bp, Artificial Sequence
  chemically synthesized
aataatcttaaaaagaaattta

SEQ ID NO: 1117455 - DNA, 22 bp, Artificial Sequence
  chemically synthesized
aaaaagaaatttaggaaacttt

SEQ ID NO: 1117456 - DNA, 22 bp, Artificial Sequence
  chemically synthesized
aaaagaaatttaggaaactttt

SEQ ID NO: 1117457 - DNA, 22 bp, Artificial Sequence
  chemically synthesized
aaaaagaaaaaaaaaaaaagtt

SEQ ID NO: 1117458 - DNA, 22 bp, Artificial Sequence
  chemically synthesized
cgtctcaaaaagaaaaaaaaaa

SEQ ID NO: 1117459 - DNA, 22 bp, Artificial Sequence
  chemically synthesized
aggaaactttttttttttttct

SEQ ID NO: 1117460 - DNA, 22 bp, Artificial Sequence
  chemically synthesized
ggaaactttttttttttttctt

SEQ ID NO: 1117461 - DNA, 22 bp, Artificial Sequence
  chemically synthesized
tttttttttttctttttgagac

SEQ ID NO: 1117462 - DNA, 22 bp, Artificial Sequence
  chemically synthesized
ttttttttttctttttgagacg

SEQ ID NO: 1117463 - DNA, 22 bp, Artificial Sequence
  chemically synthesized
tttttttttctttttgagacgg

SEQ ID NO: 1117464 - DNA, 22 bp, Artificial Sequence
  chemically synthesized
ttttttttctttttgagacgga

SEQ ID NO: 1117465 - DNA, 22 bp, Artificial Sequence
  chemically synthesized
tttttttctttttgagacggag

SEQ ID NO: 1117466 - DNA, 22 bp, Artificial Sequence
  chemically synthesized
ttttttctttttgagacggagt

SEQ ID NO: 1117467 - DNA, 22 bp, Artificial Sequence
  chemically synthesized
tttttctttttgagacggagtc

SEQ ID NO: 1117468 - DNA, 22 bp, Artificial Sequence
  chemically synthesized
ttttctttttgagacggagtct

SEQ ID NO: 1117469 - DNA, 22 bp, Artificial Sequence
  chemically synthesized
ggcgacagagcgagactccgtc

SEQ ID NO: 1117470 - DNA, 22 bp, Artificial Sequence
  chemically synthesized
tttctttttgagacggagtctc

SEQ ID NO: 1117471 - DNA, 22 bp, Artificial Sequence
  chemically synthesized
ttctttttgagacggagtctcg

SEQ ID NO: 1117472 - DNA, 22 bp, Artificial Sequence
  chemically synthesized
tctttttgagacggagtctcgc

SEQ ID NO: 1117473 - DNA, 22 bp, Artificial Sequence
  chemically synthesized
ctttttgagacggagtctcgct

SEQ ID NO: 1117474 - DNA, 22 bp, Artificial Sequence
  chemically synthesized
tttttgagacggagtctcgctc

SEQ ID NO: 1117475 - DNA, 22 bp, Artificial Sequence
  chemically synthesized
tttgagacggagtctcgctctg

SEQ ID NO: 1117476 - DNA, 22 bp, Artificial Sequence
  chemically synthesized
cagcctgggcgacagagcgaga

SEQ ID NO: 1117477 - DNA, 22 bp, Artificial Sequence
  chemically synthesized
ttgagacggagtctcgctctgt

SEQ ID NO: 1117478 - DNA, 22 bp, Artificial Sequence
  chemically synthesized
tgagacggagtctcgctctgtc

SEQ ID NO: 1117479 - DNA, 22 bp, Artificial Sequence
  chemically synthesized
gagacggagtctcgctctgtcg

SEQ ID NO: 1117480 - DNA, 22 bp, Artificial Sequence
  chemically synthesized
agacggagtctcgctctgtcgc

SEQ ID NO: 1117481 - DNA, 22 bp, Artificial Sequence
  chemically synthesized
cactccagcctgggcgacagag

SEQ ID NO: 1117482 - DNA, 22 bp, Artificial Sequence
  chemically synthesized
cgccactgcactccagcctggg

SEQ ID NO: 1117483 - DNA, 22 bp, Artificial Sequence
  chemically synthesized
gctctgtcgcccaggctggagt

SEQ ID NO: 1117484 - DNA, 22 bp, Artificial Sequence
  chemically synthesized
tgtcgcccaggctggagtgcag

SEQ ID NO: 1117485 - DNA, 22 bp, Artificial Sequence
  chemically synthesized
tcgcccaggctggagtgcagtg

SEQ ID NO: 1117486 - DNA, 22 bp, Artificial Sequence
  chemically synthesized
cagtgagccaagattgcgccac

SEQ ID NO: 1117487 - DNA, 22 bp, Artificial Sequence
  chemically synthesized
gcagtgagccaagattgcgcca

SEQ ID NO: 1117488 - DNA, 22 bp, Artificial Sequence
  chemically synthesized
gagtgcagtggcgcaatcttgg

SEQ ID NO: 1117489 - DNA, 22 bp, Artificial Sequence
  chemically synthesized
ggctcactgcaagctccgcctc

SEQ ID NO: 1117490 - DNA, 22 bp, Artificial Sequence
  chemically synthesized
gctcactgcaagctccgcctcc

SEQ ID NO: 1117491 - DNA, 22 bp, Artificial Sequence
  chemically synthesized
actgcaagctccgcctcccggg

SEQ ID NO: 1117492 - DNA, 22 bp, Artificial Sequence
  chemically synthesized
caagctccgcctcccgggttca

SEQ ID NO: 1117493 - DNA, 22 bp, Artificial Sequence
  chemically synthesized
aggaaggagaatggcgtgaacc

SEQ ID NO: 1117494 - DNA, 22 bp, Artificial Sequence
  chemically synthesized
cgcctcccgggttcacgccatt

SEQ ID NO: 1117495 - DNA, 22 bp, Artificial Sequence
  chemically synthesized
ccgggttcacgccattctcctt

SEQ ID NO: 1117496 - DNA, 22 bp, Artificial Sequence
  chemically synthesized
aggaggctgaggaaggagaatg

SEQ ID NO: 1117497 - DNA, 22 bp, Artificial Sequence
  chemically synthesized
ctcaggaggctgaggaaggaga

SEQ ID NO: 1117498 - DNA, 22 bp, Artificial Sequence
  chemically synthesized
acgccattctccttcctcagcc

SEQ ID NO: 1117499 - DNA, 22 bp, Artificial Sequence
  chemically synthesized
tagtcccagctactcaggaggc

SEQ ID NO: 1117500 - DNA, 22 bp, Artificial Sequence
  chemically synthesized
tccttcctcagcctcctgagta

SEQ ID NO: 1117501 - DNA, 22 bp, Artificial Sequence
  chemically synthesized
cttcctcagcctcctgagtagc

SEQ ID NO: 1117502 - DNA, 22 bp, Artificial Sequence
  chemically synthesized
cctcagcctcctgagtagctgg

SEQ ID NO: 1117503 - DNA, 22 bp, Artificial Sequence
  chemically synthesized
ctcagcctcctgagtagctggg

SEQ ID NO: 1117504 - DNA, 22 bp, Artificial Sequence
  chemically synthesized
cgggcgcctgtagtcccagcta

SEQ ID NO: 1117505 - DNA, 22 bp, Artificial Sequence
  chemically synthesized
agcctcctgagtagctgggact

SEQ ID NO: 1117506 - DNA, 22 bp, Artificial Sequence
  chemically synthesized
ctgagtagctgggactacaggc

SEQ ID NO: 1117507 - DNA, 22 bp, Artificial Sequence
  chemically synthesized
agtagctgggactacaggcgcc

SEQ ID NO: 1117508 - DNA, 22 bp, Artificial Sequence
  chemically synthesized
gccgggcatggttgcgggcgcc

SEQ ID NO: 1117509 - DNA, 22 bp, Artificial Sequence
  chemically synthesized
ggactacaggcgcccgcaacca

SEQ ID NO: 1117510 - DNA, 22 bp, Artificial Sequence
  chemically synthesized
caggcgcccgcaaccatgcccg

SEQ ID NO: 1117511 - DNA, 22 bp, Artificial Sequence
  chemically synthesized
aaaatacaaaaaattagccggg

SEQ ID NO: 1117512 - DNA, 22 bp, Artificial Sequence
  chemically synthesized
ctaaaaatacaaaaaattagcc

SEQ ID NO: 1117513 - DNA, 22 bp, Artificial Sequence
  chemically synthesized
tactaaaaatacaaaaaattag

SEQ ID NO: 1117514 - DNA, 22 bp, Artificial Sequence
  chemically synthesized
gtctctactaaaaatacaaaaa

SEQ ID NO: 1117515 - DNA, 22 bp, Artificial Sequence
  chemically synthesized
attttttgtatttttagtagag

SEQ ID NO: 1117516 - DNA, 22 bp, Artificial Sequence
  chemically synthesized
tttgtatttttagtagagacga

SEQ ID NO: 1117517 - DNA, 22 bp, Artificial Sequence
  chemically synthesized
ttgtatttttagtagagacgag

SEQ ID NO: 1117518 - DNA, 22 bp, Artificial Sequence
  chemically synthesized
acaccatgaagcctcgtctcta

SEQ ID NO: 1117519 - DNA, 22 bp, Artificial Sequence
  chemically synthesized
tgtatttttagtagagacgagg

SEQ ID NO: 1117520 - DNA, 22 bp, Artificial Sequence
  chemically synthesized
gtatttttagtagagacgaggc

SEQ ID NO: 1117521 - DNA, 22 bp, Artificial Sequence
  chemically synthesized
tatttttagtagagacgaggct

SEQ ID NO: 1117522 - DNA, 22 bp, Artificial Sequence
  chemically synthesized
ttagtagagacgaggcttcatg

SEQ ID NO: 1117523 - DNA, 22 bp, Artificial Sequence
  chemically synthesized
tagtagagacgaggcttcatgg

SEQ ID NO: 1117524 - DNA, 22 bp, Artificial Sequence
  chemically synthesized
agtagagacgaggcttcatggt

SEQ ID NO: 1117525 - DNA, 22 bp, Artificial Sequence
  chemically synthesized
gtagagacgaggcttcatggtg

SEQ ID NO: 1117526 - DNA, 22 bp, Artificial Sequence
  chemically synthesized
catggtgtcaaccatgatggtc

SEQ ID NO: 1117527 - DNA, 22 bp, Artificial Sequence
  chemically synthesized
atggtgtcaaccatgatggtct

SEQ ID NO: 1117528 - DNA, 22 bp, Artificial Sequence
  chemically synthesized
gatctcctgacttcatgatcca

SEQ ID NO: 1117529 - DNA, 22 bp, Artificial Sequence
  chemically synthesized
atctcctgacttcatgatccac

SEQ ID NO: 1117530 - DNA, 22 bp, Artificial Sequence
  chemically synthesized
ggaggtcgaggcgggtggatca

SEQ ID NO: 1117531 - DNA, 22 bp, Artificial Sequence
  chemically synthesized
gggaggtcgaggcgggtggatc

SEQ ID NO: 1117532 - DNA, 22 bp, Artificial Sequence
  chemically synthesized
tgggaggtcgaggcgggtggat

SEQ ID NO: 1117533 - DNA, 22 bp, Artificial Sequence
  chemically synthesized
ctgacttcatgatccacccgcc

SEQ ID NO: 1117534 - DNA, 22 bp, Artificial Sequence
  chemically synthesized
acttcatgatccacccgcctcg

SEQ ID NO: 1117535 - DNA, 22 bp, Artificial Sequence
  chemically synthesized
agcactttgggaggtcgaggcg

SEQ ID NO: 1117536 - DNA, 22 bp, Artificial Sequence
  chemically synthesized
catgatccacccgcctcgacct

SEQ ID NO: 1117537 - DNA, 22 bp, Artificial Sequence
  chemically synthesized
atgatccacccgcctcgacctc

SEQ ID NO: 1117538 - DNA, 22 bp, Artificial Sequence
  chemically synthesized
taatctcagcactttgggaggt

SEQ ID NO: 1117539 - DNA, 22 bp, Artificial Sequence
  chemically synthesized
acgcctgtaatctcagcacttt

SEQ ID NO: 1117540 - DNA, 22 bp, Artificial Sequence
  chemically synthesized
gacctcccaaagtgctgagatt

SEQ ID NO: 1117541 - DNA, 22 bp, Artificial Sequence
  chemically synthesized
ccaaagtgctgagattacaggc

SEQ ID NO: 1117542 - DNA, 22 bp, Artificial Sequence
  chemically synthesized
agattacaggcgtgagccaccg

SEQ ID NO: 1117543 - DNA, 22 bp, Artificial Sequence
  chemically synthesized
cgtggccaggcacggtggctca

SEQ ID NO: 1117544 - DNA, 22 bp, Artificial Sequence
  chemically synthesized
ccgtggccaggcacggtggctc

SEQ ID NO: 1117545 - DNA, 22 bp, Artificial Sequence
  chemically synthesized
caggcgtgagccaccgtgcctg

SEQ ID NO: 1117546 - DNA, 22 bp, Artificial Sequence
  chemically synthesized
tgtcaaaaatgtttccgtggcc

SEQ ID NO: 1117547 - DNA, 22 bp, Artificial Sequence
  chemically synthesized
gtgtcaaaaatgtttccgtggc

SEQ ID NO: 1117548 - DNA, 22 bp, Artificial Sequence
  chemically synthesized
ttgtgtcaaaaatgtttccgtg

SEQ ID NO: 1117549 - DNA, 22 bp, Artificial Sequence
  chemically synthesized
atcatctcttgtgtcaaaaatg

SEQ ID NO: 1117550 - DNA, 22 bp, Artificial Sequence
  chemically synthesized
gccacggaaacatttttgacac

SEQ ID NO: 1117551 - DNA, 22 bp, Artificial Sequence
  chemically synthesized
tcatcatctcttgtgtcaaaaa

SEQ ID NO: 1117552 - DNA, 22 bp, Artificial Sequence
  chemically synthesized
ttgacacaagagatgatgagag

SEQ ID NO: 1117553 - DNA, 22 bp, Artificial Sequence
  chemically synthesized
tgacacaagagatgatgagagt

SEQ ID NO: 1117554 - DNA, 22 bp, Artificial Sequence
  chemically synthesized
cacgaacaaggtactctcatca

SEQ ID NO: 1117555 - DNA, 22 bp, Artificial Sequence
  chemically synthesized
gacacaagagatgatgagagta

SEQ ID NO: 1117556 - DNA, 22 bp, Artificial Sequence
  chemically synthesized
ccacgaacaaggtactctcatc

SEQ ID NO: 1117557 - DNA, 22 bp, Artificial Sequence
  chemically synthesized
acacaagagatgatgagagtac

SEQ ID NO: 1117558 - DNA, 22 bp, Artificial Sequence
  chemically synthesized
gacatttccacgaacaaggtac

SEQ ID NO: 1117559 - DNA, 22 bp, Artificial Sequence
  chemically synthesized
ggacatttccacgaacaaggta

SEQ ID NO: 1117560 - DNA, 22 bp, Artificial Sequence
  chemically synthesized
tttggacatttccacgaacaag

SEQ ID NO: 1117561 - DNA, 22 bp, Artificial Sequence
  chemically synthesized
tatgtggttatttggacatttc

SEQ ID NO: 1117562 - DNA, 22 bp, Artificial Sequence
  chemically synthesized
atatgtggttatttggacattt

SEQ ID NO: 1117563 - DNA, 22 bp, Artificial Sequence
  chemically synthesized
tatatgtggttatttggacatt

SEQ ID NO: 1117564 - DNA, 22 bp, Artificial Sequence
  chemically synthesized
ttatatgtggttatttggacat

SEQ ID NO: 1117565 - DNA, 22 bp, Artificial Sequence
  chemically synthesized
tttatatgtggttatttggaca

SEQ ID NO: 1117566 - DNA, 22 bp, Artificial Sequence
  chemically synthesized
gttcgtggaaatgtccaaataa

SEQ ID NO: 1117567 - DNA, 22 bp, Artificial Sequence
  chemically synthesized
ttcgtggaaatgtccaaataac

SEQ ID NO: 1117568 - DNA, 22 bp, Artificial Sequence
  chemically synthesized
gtggaaatgtccaaataaccac

SEQ ID NO: 1117569 - DNA, 22 bp, Artificial Sequence
  chemically synthesized
acactttttatatgtggttatt

SEQ ID NO: 1117570 - DNA, 22 bp, Artificial Sequence
  chemically synthesized
aacactttttatatgtggttat

SEQ ID NO: 1117571 - DNA, 22 bp, Artificial Sequence
  chemically synthesized
taacactttttatatgtggtta

SEQ ID NO: 1117572 - DNA, 22 bp, Artificial Sequence
  chemically synthesized
ttaacactttttatatgtggtt

SEQ ID NO: 1117573 - DNA, 22 bp, Artificial Sequence
  chemically synthesized
tttaacactttttatatgtggt

SEQ ID NO: 1117574 - DNA, 22 bp, Artificial Sequence
  chemically synthesized
ttttaacactttttatatgtgg

SEQ ID NO: 1117575 - DNA, 22 bp, Artificial Sequence
  chemically synthesized
tttttaacactttttatatgtg

SEQ ID NO: 1117576 - DNA, 22 bp, Artificial Sequence
  chemically synthesized
ttttttaacactttttatatgt

SEQ ID NO: 1117577 - DNA, 22 bp, Artificial Sequence
  chemically synthesized
tttttttaacactttttatatg

SEQ ID NO: 1117578 - DNA, 22 bp, Artificial Sequence
  chemically synthesized
ttttttttaacactttttatat

SEQ ID NO: 1117579 - DNA, 22 bp, Artificial Sequence
  chemically synthesized
tttttttttaacactttttata

SEQ ID NO: 1117580 - DNA, 22 bp, Artificial Sequence
  chemically synthesized
ttttttttttaacactttttat

SEQ ID NO: 1117581 - DNA, 22 bp, Artificial Sequence
  chemically synthesized
tttttttttttaacacttttta

SEQ ID NO: 1117582 - DNA, 22 bp, Artificial Sequence
  chemically synthesized
ttttttttttttaacacttttt

SEQ ID NO: 1117583 - DNA, 22 bp, Artificial Sequence
  chemically synthesized
tttttttttttttaacactttt

SEQ ID NO: 1117584 - DNA, 22 bp, Artificial Sequence
  chemically synthesized
ttttttttttttttaacacttt

SEQ ID NO: 1117585 - DNA, 22 bp, Artificial Sequence
  chemically synthesized
tttttttttttttttaacactt

SEQ ID NO: 1117586 - DNA, 22 bp, Artificial Sequence
  chemically synthesized
ttttttttttttttttaacact

SEQ ID NO: 1117587 - DNA, 22 bp, Artificial Sequence
  chemically synthesized
tttttttttttttttttaacac

SEQ ID NO: 1117588 - DNA, 22 bp, Artificial Sequence
  chemically synthesized
accttttttttttttttttttt

SEQ ID NO: 1117589 - DNA, 22 bp, Artificial Sequence
  chemically synthesized
aacctttttttttttttttttt

SEQ ID NO: 1117590 - DNA, 22 bp, Artificial Sequence
  chemically synthesized
cttaaccttttttttttttttt

SEQ ID NO: 1117591 - DNA, 22 bp, Artificial Sequence
  chemically synthesized
acttaacctttttttttttttt

SEQ ID NO: 1117592 - DNA, 22 bp, Artificial Sequence
  chemically synthesized
tttacttaaccttttttttttt

SEQ ID NO: 1117593 - DNA, 22 bp, Artificial Sequence
  chemically synthesized
atttacttaacctttttttttt

SEQ ID NO: 1117594 - DNA, 22 bp, Artificial Sequence
  chemically synthesized
aaaaaaaaaaaaaaaaaaggtt

SEQ ID NO: 1117595 - DNA, 22 bp, Artificial Sequence
  chemically synthesized
agtgatgtttatttacttaacc

SEQ ID NO: 1117596 - DNA, 22 bp, Artificial Sequence
  chemically synthesized
cagtgatgtttatttacttaac

SEQ ID NO: 1117597 - DNA, 22 bp, Artificial Sequence
  chemically synthesized
tcagtgatgtttatttacttaa

SEQ ID NO: 1117598 - DNA, 22 bp, Artificial Sequence
  chemically synthesized
agtaaataaacatcactgaaaa

SEQ ID NO: 1117599 - DNA, 22 bp, Artificial Sequence
  chemically synthesized
aaaatcgccatttctcctggga

SEQ ID NO: 1117600 - DNA, 22 bp, Artificial Sequence
  chemically synthesized
aggacgaacgtatgggtggcca

SEQ ID NO: 1117601 - DNA, 22 bp, Artificial Sequence
  chemically synthesized
ctcctgggatctggccacccat

SEQ ID NO: 1117602 - DNA, 22 bp, Artificial Sequence
  chemically synthesized
gaggacgaacgtatgggtggcc

SEQ ID NO: 1117603 - DNA, 22 bp, Artificial Sequence
  chemically synthesized
tcctgggatctggccacccata

SEQ ID NO: 1117604 - DNA, 22 bp, Artificial Sequence
  chemically synthesized
ctgggatctggccacccatacg

SEQ ID NO: 1117605 - DNA, 22 bp, Artificial Sequence
  chemically synthesized
atttgaggacgaacgtatgggt

SEQ ID NO: 1117606 - DNA, 22 bp, Artificial Sequence
  chemically synthesized
catttgaggacgaacgtatggg

SEQ ID NO: 1117607 - DNA, 22 bp, Artificial Sequence
  chemically synthesized
ggatctggccacccatacgttc

SEQ ID NO: 1117608 - DNA, 22 bp, Artificial Sequence
  chemically synthesized
gccacccatacgttcgtcctca

SEQ ID NO: 1117609 - DNA, 22 bp, Artificial Sequence
  chemically synthesized
atatatttcatttgaggacgaa

SEQ ID NO: 1117610 - DNA, 22 bp, Artificial Sequence
  chemically synthesized
aaaacagaagttcatatatttc

SEQ ID NO: 1117611 - DNA, 22 bp, Artificial Sequence
  chemically synthesized
gtcctcaaatgaaatatatgaa

SEQ ID NO: 1117612 - DNA, 22 bp, Artificial Sequence
  chemically synthesized
cctgaaaacagaagttcatata

SEQ ID NO: 1117613 - DNA, 22 bp, Artificial Sequence
  chemically synthesized
aaatgaaatatatgaacttctg

SEQ ID NO: 1117614 - DNA, 22 bp, Artificial Sequence
  chemically synthesized
atccaacctacctgaaaacaga

SEQ ID NO: 1117615 - DNA, 22 bp, Artificial Sequence
  chemically synthesized
ctgatccaacctacctgaaaac

SEQ ID NO: 1117616 - DNA, 22 bp, Artificial Sequence
  chemically synthesized
ggaactactgatccaacctacc

SEQ ID NO: 1117617 - DNA, 22 bp, Artificial Sequence
  chemically synthesized
aggaactactgatccaacctac

SEQ ID NO: 1117618 - DNA, 22 bp, Artificial Sequence
  chemically synthesized
taggaactactgatccaaccta

SEQ ID NO: 1117619 - DNA, 22 bp, Artificial Sequence
  chemically synthesized
ctgttttcaggtaggttggatc

SEQ ID NO: 1117620 - DNA, 22 bp, Artificial Sequence
  chemically synthesized
tgttttcaggtaggttggatca

SEQ ID NO: 1117621 - DNA, 22 bp, Artificial Sequence
  chemically synthesized
ttttcaggtaggttggatcagt

SEQ ID NO: 1117622 - DNA, 22 bp, Artificial Sequence
  chemically synthesized
tcaggtaggttggatcagtagt

SEQ ID NO: 1117623 - DNA, 22 bp, Artificial Sequence
  chemically synthesized
caggtaggttggatcagtagtt

SEQ ID NO: 1117624 - DNA, 22 bp, Artificial Sequence
  chemically synthesized
aggtaggttggatcagtagttc

SEQ ID NO: 1117625 - DNA, 22 bp, Artificial Sequence
  chemically synthesized
gatcagtagttcctaaaatttc

SEQ ID NO: 1117626 - DNA, 22 bp, Artificial Sequence
  chemically synthesized
atgggagacggtagaaatttta

SEQ ID NO: 1117627 - DNA, 22 bp, Artificial Sequence
  chemically synthesized
tgagttaatgggagacggtaga

SEQ ID NO: 1117628 - DNA, 22 bp, Artificial Sequence
  chemically synthesized
tgtgagttaatgggagacggta

SEQ ID NO: 1117629 - DNA, 22 bp, Artificial Sequence
  chemically synthesized
ctgtgagttaatgggagacggt

SEQ ID NO: 1117630 - DNA, 22 bp, Artificial Sequence
  chemically synthesized
ctaaaatttctaccgtctccca

SEQ ID NO: 1117631 - DNA, 22 bp, Artificial Sequence
  chemically synthesized
aaatttctaccgtctcccatta

SEQ ID NO: 1117632 - DNA, 22 bp, Artificial Sequence
  chemically synthesized
ctaccgtctcccattaactcac

SEQ ID NO: 1117633 - DNA, 22 bp, Artificial Sequence
  chemically synthesized
atgtatatttctgtgagttaat

SEQ ID NO: 1117634 - DNA, 22 bp, Artificial Sequence
  chemically synthesized
taccgtctcccattaactcaca

SEQ ID NO: 1117635 - DNA, 22 bp, Artificial Sequence
  chemically synthesized
aatgtatatttctgtgagttaa

SEQ ID NO: 1117636 - DNA, 22 bp, Artificial Sequence
  chemically synthesized
taatgtatatttctgtgagtta

SEQ ID NO: 1117637 - DNA, 22 bp, Artificial Sequence
  chemically synthesized
ccgtctcccattaactcacaga

SEQ ID NO: 1117638 - DNA, 22 bp, Artificial Sequence
  chemically synthesized
ttaatgtatatttctgtgagtt

SEQ ID NO: 1117639 - DNA, 22 bp, Artificial Sequence
  chemically synthesized
tttaatgtatatttctgtgagt

SEQ ID NO: 1117640 - DNA, 22 bp, Artificial Sequence
  chemically synthesized
tgctttttaatgtatatttctg

SEQ ID NO: 1117641 - DNA, 22 bp, Artificial Sequence
  chemically synthesized
ccattaactcacagaaatatac

SEQ ID NO: 1117642 - DNA, 22 bp, Artificial Sequence
  chemically synthesized
tgtgctttttaatgtatatttc

SEQ ID NO: 1117643 - DNA, 22 bp, Artificial Sequence
  chemically synthesized
ctgtgctttttaatgtatattt

SEQ ID NO: 1117644 - DNA, 22 bp, Artificial Sequence
  chemically synthesized
tctgtgctttttaatgtatatt

SEQ ID NO: 1117645 - DNA, 22 bp, Artificial Sequence
  chemically synthesized
ttctgtgctttttaatgtatat

SEQ ID NO: 1117646 - DNA, 22 bp, Artificial Sequence
  chemically synthesized
actcacagaaatatacattaaa

SEQ ID NO: 1117647 - DNA, 22 bp, Artificial Sequence
  chemically synthesized
tgcttttctgtgctttttaatg

SEQ ID NO: 1117648 - DNA, 22 bp, Artificial Sequence
  chemically synthesized
acagaaatatacattaaaaagc

SEQ ID NO: 1117649 - DNA, 22 bp, Artificial Sequence
  chemically synthesized
gtgcttttctgtgctttttaat

SEQ ID NO: 1117650 - DNA, 22 bp, Artificial Sequence
  chemically synthesized
tgtgcttttctgtgctttttaa

SEQ ID NO: 1117651 - DNA, 22 bp, Artificial Sequence
  chemically synthesized
ttgtgcttttctgtgcttttta

SEQ ID NO: 1117652 - DNA, 22 bp, Artificial Sequence
  chemically synthesized
gtttttgtgcttttctgtgctt

SEQ ID NO: 1117653 - DNA, 22 bp, Artificial Sequence
  chemically synthesized
ggtttttgtgcttttctgtgct

SEQ ID NO: 1117654 - DNA, 22 bp, Artificial Sequence
  chemically synthesized
tggtttttgtgcttttctgtgc

SEQ ID NO: 1117655 - DNA, 22 bp, Artificial Sequence
  chemically synthesized
ttggtttttgtgcttttctgtg

SEQ ID NO: 1117656 - DNA, 22 bp, Artificial Sequence
  chemically synthesized
tttttggtttttgtgcttttct

SEQ ID NO: 1117657 - DNA, 22 bp, Artificial Sequence
  chemically synthesized
gtttttggtttttgtgcttttc

SEQ ID NO: 1117658 - DNA, 22 bp, Artificial Sequence
  chemically synthesized
tgtttttggtttttgtgctttt

SEQ ID NO: 1117659 - DNA, 22 bp, Artificial Sequence
  chemically synthesized
aaaagcacagaaaagcacaaaa

SEQ ID NO: 1117660 - DNA, 22 bp, Artificial Sequence
  chemically synthesized
gactttgtttttggtttttgtg

SEQ ID NO: 1117661 - DNA, 22 bp, Artificial Sequence
  chemically synthesized
agactttgtttttggtttttgt

SEQ ID NO: 1117662 - DNA, 22 bp, Artificial Sequence
  chemically synthesized
tagactttgtttttggtttttg

SEQ ID NO: 1117663 - DNA, 22 bp, Artificial Sequence
  chemically synthesized
tttagactttgtttttggtttt

SEQ ID NO: 1117664 - DNA, 22 bp, Artificial Sequence
  chemically synthesized
agcaaaatatatctctttagac

SEQ ID NO: 1117665 - DNA, 22 bp, Artificial Sequence
  chemically synthesized
cagcaaaatatatctctttaga

SEQ ID NO: 1117666 - DNA, 22 bp, Artificial Sequence
  chemically synthesized
tcagcaaaatatatctctttag

SEQ ID NO: 1117667 - DNA, 22 bp, Artificial Sequence
  chemically synthesized
ttcagcaaaatatatctcttta

SEQ ID NO: 1117668 - DNA, 22 bp, Artificial Sequence
  chemically synthesized
tttcagcaaaatatatctcttt

SEQ ID NO: 1117669 - DNA, 22 bp, Artificial Sequence
  chemically synthesized
ctttttcagcaaaatatatctc

SEQ ID NO: 1117670 - DNA, 22 bp, Artificial Sequence
  chemically synthesized
cctttttcagcaaaatatatct

SEQ ID NO: 1117671 - DNA, 22 bp, Artificial Sequence
  chemically synthesized
tcttcctttttcagcaaaatat

SEQ ID NO: 1117672 - DNA, 22 bp, Artificial Sequence
  chemically synthesized
aagagatatattttgctgaaaa

SEQ ID NO: 1117673 - DNA, 22 bp, Artificial Sequence
  chemically synthesized
aaatgaggacagttatcttcct

SEQ ID NO: 1117674 - DNA, 22 bp, Artificial Sequence
  chemically synthesized
aaaatgaggacagttatcttcc

SEQ ID NO: 1117675 - DNA, 22 bp, Artificial Sequence
  chemically synthesized
tgctgaaaaaggaagataactg

SEQ ID NO: 1117676 - DNA, 22 bp, Artificial Sequence
  chemically synthesized
gctgaaaaaggaagataactgt

SEQ ID NO: 1117677 - DNA, 22 bp, Artificial Sequence
  chemically synthesized
ctgaaaaaggaagataactgtc

SEQ ID NO: 1117678 - DNA, 22 bp, Artificial Sequence
  chemically synthesized
aaaaaggaagataactgtcctc

SEQ ID NO: 1117679 - DNA, 22 bp, Artificial Sequence
  chemically synthesized
atacacagtcacttaaaatgag

SEQ ID NO: 1117680 - DNA, 22 bp, Artificial Sequence
  chemically synthesized
ttgatacacagtcacttaaaat

SEQ ID NO: 1117681 - DNA, 22 bp, Artificial Sequence
  chemically synthesized
gttgatacacagtcacttaaaa

SEQ ID NO: 1117682 - DNA, 22 bp, Artificial Sequence
  chemically synthesized
tgttgatacacagtcacttaaa

SEQ ID NO: 1117683 - DNA, 22 bp, Artificial Sequence
  chemically synthesized
tttgttgatacacagtcactta

SEQ ID NO: 1117684 - DNA, 22 bp, Artificial Sequence
  chemically synthesized
tcctcattttaagtgactgtgt

SEQ ID NO: 1117685 - DNA, 22 bp, Artificial Sequence
  chemically synthesized
ctctttgttgatacacagtcac

SEQ ID NO: 1117686 - DNA, 22 bp, Artificial Sequence
  chemically synthesized
attttaagtgactgtgtatcaa

SEQ ID NO: 1117687 - DNA, 22 bp, Artificial Sequence
  chemically synthesized
tgttcctctttgttgatacaca

SEQ ID NO: 1117688 - DNA, 22 bp, Artificial Sequence
  chemically synthesized
taagtgactgtgtatcaacaaa

SEQ ID NO: 1117689 - DNA, 22 bp, Artificial Sequence
  chemically synthesized
aagtgactgtgtatcaacaaag

SEQ ID NO: 1117690 - DNA, 22 bp, Artificial Sequence
  chemically synthesized
agtgactgtgtatcaacaaaga

SEQ ID NO: 1117691 - DNA, 22 bp, Artificial Sequence
  chemically synthesized
tggaaggcctatgttcctcttt

SEQ ID NO: 1117692 - DNA, 22 bp, Artificial Sequence
  chemically synthesized
tgtatcaacaaagaggaacata

SEQ ID NO: 1117693 - DNA, 22 bp, Artificial Sequence
  chemically synthesized
caagatagacctgtggaaggcc

SEQ ID NO: 1117694 - DNA, 22 bp, Artificial Sequence
  chemically synthesized
gcaagatagacctgtggaaggc

SEQ ID NO: 1117695 - DNA, 22 bp, Artificial Sequence
  chemically synthesized
tgcaagatagacctgtggaagg

SEQ ID NO: 1117696 - DNA, 22 bp, Artificial Sequence
  chemically synthesized
ctttgcaagatagacctgtgga

SEQ ID NO: 1117697 - DNA, 22 bp, Artificial Sequence
  chemically synthesized
actttgcaagatagacctgtgg

SEQ ID NO: 1117698 - DNA, 22 bp, Artificial Sequence
  chemically synthesized
tactttgcaagatagacctgtg

SEQ ID NO: 1117699 - DNA, 22 bp, Artificial Sequence
  chemically synthesized
ttactttgcaagatagacctgt

SEQ ID NO: 1117700 - DNA, 22 bp, Artificial Sequence
  chemically synthesized
aaccagtttttactttgcaaga

SEQ ID NO: 1117701 - DNA, 22 bp, Artificial Sequence
  chemically synthesized
ccacaggtctatcttgcaaagt

SEQ ID NO: 1117702 - DNA, 22 bp, Artificial Sequence
  chemically synthesized
gaaccagtttttactttgcaag

SEQ ID NO: 1117703 - DNA, 22 bp, Artificial Sequence
  chemically synthesized
cacaggtctatcttgcaaagta

SEQ ID NO: 1117704 - DNA, 22 bp, Artificial Sequence
  chemically synthesized
tgaaccagtttttactttgcaa

SEQ ID NO: 1117705 - DNA, 22 bp, Artificial Sequence
  chemically synthesized
ttttgaaccagtttttactttg

SEQ ID NO: 1117706 - DNA, 22 bp, Artificial Sequence
  chemically synthesized
gttttgaaccagtttttacttt

SEQ ID NO: 1117707 - DNA, 22 bp, Artificial Sequence
  chemically synthesized
tgttttgaaccagtttttactt

SEQ ID NO: 1117708 - DNA, 22 bp, Artificial Sequence
  chemically synthesized
ttgttttgaaccagtttttact

SEQ ID NO: 1117709 - DNA, 22 bp, Artificial Sequence
  chemically synthesized
tttttgttttgaaccagttttt

SEQ ID NO: 1117710 - DNA, 22 bp, Artificial Sequence
  chemically synthesized
tcttgcaaagtaaaaactggtt

SEQ ID NO: 1117711 - DNA, 22 bp, Artificial Sequence
  chemically synthesized
gtttttgttttgaaccagtttt

SEQ ID NO: 1117712 - DNA, 22 bp, Artificial Sequence
  chemically synthesized
tgtttttgttttgaaccagttt

SEQ ID NO: 1117713 - DNA, 22 bp, Artificial Sequence
  chemically synthesized
ttgtttttgttttgaaccagtt

SEQ ID NO: 1117714 - DNA, 22 bp, Artificial Sequence
  chemically synthesized
gcaaagtaaaaactggttcaaa

SEQ ID NO: 1117715 - DNA, 22 bp, Artificial Sequence
  chemically synthesized
caaagtaaaaactggttcaaaa

SEQ ID NO: 1117716 - DNA, 22 bp, Artificial Sequence
  chemically synthesized
gttcaaaacaaaaacaaaaact

SEQ ID NO: 1117717 - DNA, 22 bp, Artificial Sequence
  chemically synthesized
aaaacaaaaacaaaaactggct

SEQ ID NO: 1117718 - DNA, 22 bp, Artificial Sequence
  chemically synthesized
agtaagagaatagatgtgagag

SEQ ID NO: 1117719 - DNA, 22 bp, Artificial Sequence
  chemically synthesized
atgggactgagtaagagaatag

SEQ ID NO: 1117720 - DNA, 22 bp, Artificial Sequence
  chemically synthesized
gatgggactgagtaagagaata

SEQ ID NO: 1117721 - DNA, 22 bp, Artificial Sequence
  chemically synthesized
gctctcacatctattctcttac

SEQ ID NO: 1117722 - DNA, 22 bp, Artificial Sequence
  chemically synthesized
tgatgggactgagtaagagaat

SEQ ID NO: 1117723 - DNA, 22 bp, Artificial Sequence
  chemically synthesized
tcacatctattctcttactcag

SEQ ID NO: 1117724 - DNA, 22 bp, Artificial Sequence
  chemically synthesized
acatctattctcttactcagtc

SEQ ID NO: 1117725 - DNA, 22 bp, Artificial Sequence
  chemically synthesized
ttctcttactcagtcccatcaa

SEQ ID NO: 1117726 - DNA, 22 bp, Artificial Sequence
  chemically synthesized
ataagagcagttttgatgggac

SEQ ID NO: 1117727 - DNA, 22 bp, Artificial Sequence
  chemically synthesized
tcttactcagtcccatcaaaac

SEQ ID NO: 1117728 - DNA, 22 bp, Artificial Sequence
  chemically synthesized
ttactcagtcccatcaaaactg

SEQ ID NO: 1117729 - DNA, 22 bp, Artificial Sequence
  chemically synthesized
actcagtcccatcaaaactgct

SEQ ID NO: 1117730 - DNA, 22 bp, Artificial Sequence
  chemically synthesized
ctcagtcccatcaaaactgctc

SEQ ID NO: 1117731 - DNA, 22 bp, Artificial Sequence
  chemically synthesized
agtcccatcaaaactgctctta

SEQ ID NO: 1117732 - DNA, 22 bp, Artificial Sequence
  chemically synthesized
ggggccaatggtgagactgata

SEQ ID NO: 1117733 - DNA, 22 bp, Artificial Sequence
  chemically synthesized
gggggccaatggtgagactgat

SEQ ID NO: 1117734 - DNA, 22 bp, Artificial Sequence
  chemically synthesized
ctcttatcagtctcaccattgg

SEQ ID NO: 1117735 - DNA, 22 bp, Artificial Sequence
  chemically synthesized
ttatcagtctcaccattggccc

SEQ ID NO: 1117736 - DNA, 22 bp, Artificial Sequence
  chemically synthesized
atcagtctcaccattggccccc

SEQ ID NO: 1117737 - DNA, 22 bp, Artificial Sequence
  chemically synthesized
tcagtctcaccattggccccca

SEQ ID NO: 1117738 - DNA, 22 bp, Artificial Sequence
  chemically synthesized
aatgcagtagcttgggggccaa

SEQ ID NO: 1117739 - DNA, 22 bp, Artificial Sequence
  chemically synthesized
accattggcccccaagctactg

SEQ ID NO: 1117740 - DNA, 22 bp, Artificial Sequence
  chemically synthesized
aacatcagtcattgaatgcagt

SEQ ID NO: 1117741 - DNA, 22 bp, Artificial Sequence
  chemically synthesized
gcccccaagctactgcattcaa

SEQ ID NO: 1117742 - DNA, 22 bp, Artificial Sequence
  chemically synthesized
ctgcattcaatgactgatgttc

SEQ ID NO: 1117743 - DNA, 22 bp, Artificial Sequence
  chemically synthesized
cattcaatgactgatgttcagt

SEQ ID NO: 1117744 - DNA, 22 bp, Artificial Sequence
  chemically synthesized
aatgactgatgttcagttctca

SEQ ID NO: 1117745 - DNA, 22 bp, Artificial Sequence
  chemically synthesized
atgttcagttctcactttacct

SEQ ID NO: 1117746 - DNA, 22 bp, Artificial Sequence
  chemically synthesized
aatcaaatcatggtgataggta

SEQ ID NO: 1117747 - DNA, 22 bp, Artificial Sequence
  chemically synthesized
agttctcactttacctatcacc

SEQ ID NO: 1117748 - DNA, 22 bp, Artificial Sequence
  chemically synthesized
tcaatcaaatcatggtgatagg

SEQ ID NO: 1117749 - DNA, 22 bp, Artificial Sequence
  chemically synthesized
tcactttacctatcaccatgat

SEQ ID NO: 1117750 - DNA, 22 bp, Artificial Sequence
  chemically synthesized
actttacctatcaccatgattt

SEQ ID NO: 1117751 - DNA, 22 bp, Artificial Sequence
  chemically synthesized
tacctatcaccatgatttgatt

SEQ ID NO: 1117752 - DNA, 22 bp, Artificial Sequence
  chemically synthesized
acctatcaccatgatttgattg

SEQ ID NO: 1117753 - DNA, 22 bp, Artificial Sequence
  chemically synthesized
cctatcaccatgatttgattga

SEQ ID NO: 1117754 - DNA, 22 bp, Artificial Sequence
  chemically synthesized
tcaccatgatttgattgagagg

SEQ ID NO: 1117755 - DNA, 22 bp, Artificial Sequence
  chemically synthesized
agaagaaaaaggaatcctctca

SEQ ID NO: 1117756 - DNA, 22 bp, Artificial Sequence
  chemically synthesized
taagaagaaaaaggaatcctct

SEQ ID NO: 1117757 - DNA, 22 bp, Artificial Sequence
  chemically synthesized
ctaagaagaaaaaggaatcctc

SEQ ID NO: 1117758 - DNA, 22 bp, Artificial Sequence
  chemically synthesized
gattgagaggattcctttttct

SEQ ID NO: 1117759 - DNA, 22 bp, Artificial Sequence
  chemically synthesized
attgagaggattcctttttctt

SEQ ID NO: 1117760 - DNA, 22 bp, Artificial Sequence
  chemically synthesized
gcaaatacttctaagaagaaaa

SEQ ID NO: 1117761 - DNA, 22 bp, Artificial Sequence
  chemically synthesized
agaggattcctttttcttctta

SEQ ID NO: 1117762 - DNA, 22 bp, Artificial Sequence
  chemically synthesized
ctttttcttcttagaagtattt

SEQ ID NO: 1117763 - DNA, 22 bp, Artificial Sequence
  chemically synthesized
tttcttcttagaagtatttgct

SEQ ID NO: 1117764 - DNA, 22 bp, Artificial Sequence
  chemically synthesized
ttcttcttagaagtatttgcta

SEQ ID NO: 1117765 - DNA, 22 bp, Artificial Sequence
  chemically synthesized
tcttcttagaagtatttgctaa

SEQ ID NO: 1117766 - DNA, 22 bp, Artificial Sequence
  chemically synthesized
cttcttagaagtatttgctaat

SEQ ID NO: 1117767 - DNA, 22 bp, Artificial Sequence
  chemically synthesized
ttcttagaagtatttgctaatt

SEQ ID NO: 1117768 - DNA, 22 bp, Artificial Sequence
  chemically synthesized
cttagaagtatttgctaatttg

SEQ ID NO: 1117769 - DNA, 22 bp, Artificial Sequence
  chemically synthesized
ttagaagtatttgctaatttgg

SEQ ID NO: 1117770 - DNA, 22 bp, Artificial Sequence
  chemically synthesized
agaagtatttgctaatttggct

SEQ ID NO: 1117771 - DNA, 22 bp, Artificial Sequence
  chemically synthesized
gaagtatttgctaatttggctt

SEQ ID NO: 1117772 - DNA, 22 bp, Artificial Sequence
  chemically synthesized
aagtagtacgtgaagccaaatt

SEQ ID NO: 1117773 - DNA, 22 bp, Artificial Sequence
  chemically synthesized
tgttcaagtagtacgtgaagcc

SEQ ID NO: 1117774 - DNA, 22 bp, Artificial Sequence
  chemically synthesized
gctaatttggcttcacgtacta

SEQ ID NO: 1117775 - DNA, 22 bp, Artificial Sequence
  chemically synthesized
ctaatttggcttcacgtactac

SEQ ID NO: 1117776 - DNA, 22 bp, Artificial Sequence
  chemically synthesized
atttggcttcacgtactacttg

SEQ ID NO: 1117777 - DNA, 22 bp, Artificial Sequence
  chemically synthesized
gaggaaaactgtgttcaagtag

SEQ ID NO: 1117778 - DNA, 22 bp, Artificial Sequence
  chemically synthesized
ggcttcacgtactacttgaaca

SEQ ID NO: 1117779 - DNA, 22 bp, Artificial Sequence
  chemically synthesized
gcttcacgtactacttgaacac

SEQ ID NO: 1117780 - DNA, 22 bp, Artificial Sequence
  chemically synthesized
cacgtactacttgaacacagtt

SEQ ID NO: 1117781 - DNA, 22 bp, Artificial Sequence
  chemically synthesized
aagttggaggaaaactgtgttc

SEQ ID NO: 1117782 - DNA, 22 bp, Artificial Sequence
  chemically synthesized
acgtactacttgaacacagttt

SEQ ID NO: 1117783 - DNA, 22 bp, Artificial Sequence
  chemically synthesized
tgaagttggaggaaaactgtgt

SEQ ID NO: 1117784 - DNA, 22 bp, Artificial Sequence
  chemically synthesized
cttgaacacagttttcctccaa

SEQ ID NO: 1117785 - DNA, 22 bp, Artificial Sequence
  chemically synthesized
gaacacagttttcctccaactt

SEQ ID NO: 1117786 - DNA, 22 bp, Artificial Sequence
  chemically synthesized
aacacagttttcctccaacttc

SEQ ID NO: 1117787 - DNA, 22 bp, Artificial Sequence
  chemically synthesized
tcctccaacttcagaggtcacc

SEQ ID NO: 1117788 - DNA, 22 bp, Artificial Sequence
  chemically synthesized
cctccaacttcagaggtcacct

SEQ ID NO: 1117789 - DNA, 22 bp, Artificial Sequence
  chemically synthesized
ctccaacttcagaggtcacctt

SEQ ID NO: 1117790 - DNA, 22 bp, Artificial Sequence
  chemically synthesized
caacttcagaggtcacctttcc

SEQ ID NO: 1117791 - DNA, 22 bp, Artificial Sequence
  chemically synthesized
caaaggagatggaggaaaggtg

SEQ ID NO: 1117792 - DNA, 22 bp, Artificial Sequence
  chemically synthesized
cagaggtcacctttcctccatc

SEQ ID NO: 1117793 - DNA, 22 bp, Artificial Sequence
  chemically synthesized
agaggtcacctttcctccatct

SEQ ID NO: 1117794 - DNA, 22 bp, Artificial Sequence
  chemically synthesized
ggaacctgcaaaggagatggag

SEQ ID NO: 1117795 - DNA, 22 bp, Artificial Sequence
  chemically synthesized
tcctccatctcctttgcaggtt

SEQ ID NO: 1117796 - DNA, 22 bp, Artificial Sequence
  chemically synthesized
cctccatctcctttgcaggttc

SEQ ID NO: 1117797 - DNA, 22 bp, Artificial Sequence
  chemically synthesized
ctccatctcctttgcaggttcc

SEQ ID NO: 1117798 - DNA, 22 bp, Artificial Sequence
  chemically synthesized
agggacatgattaggaacctgc

SEQ ID NO: 1117799 - DNA, 22 bp, Artificial Sequence
  chemically synthesized
catctcctttgcaggttcctaa

SEQ ID NO: 1117800 - DNA, 22 bp, Artificial Sequence
  chemically synthesized
ctttgcaggttcctaatcatgt

SEQ ID NO: 1117801 - DNA, 22 bp, Artificial Sequence
  chemically synthesized
tgcaggttcctaatcatgtccc

SEQ ID NO: 1117802 - DNA, 22 bp, Artificial Sequence
  chemically synthesized
gcaggttcctaatcatgtccct

SEQ ID NO: 1117803 - DNA, 22 bp, Artificial Sequence
  chemically synthesized
caggttcctaatcatgtccctg

SEQ ID NO: 1117804 - DNA, 22 bp, Artificial Sequence
  chemically synthesized
caaagtgcgagctcagggacat

SEQ ID NO: 1117805 - DNA, 22 bp, Artificial Sequence
  chemically synthesized
ctaatcatgtccctgagctcgc

SEQ ID NO: 1117806 - DNA, 22 bp, Artificial Sequence
  chemically synthesized
ggacactccaaagtgcgagctc

SEQ ID NO: 1117807 - DNA, 22 bp, Artificial Sequence
  chemically synthesized
atcatgtccctgagctcgcact

SEQ ID NO: 1117808 - DNA, 22 bp, Artificial Sequence
  chemically synthesized
aggcctaggacactccaaagtg

SEQ ID NO: 1117809 - DNA, 22 bp, Artificial Sequence
  chemically synthesized
agctcgcactttggagtgtcct

SEQ ID NO: 1117810 - DNA, 22 bp, Artificial Sequence
  chemically synthesized
gcactttggagtgtcctaggcc

SEQ ID NO: 1117811 - DNA, 22 bp, Artificial Sequence
  chemically synthesized
tggagtgtcctaggcctcaatc

SEQ ID NO: 1117812 - DNA, 22 bp, Artificial Sequence
  chemically synthesized
ggagtgtcctaggcctcaatct

SEQ ID NO: 1117813 - DNA, 22 bp, Artificial Sequence
  chemically synthesized
gagtgtcctaggcctcaatctg

SEQ ID NO: 1117814 - DNA, 22 bp, Artificial Sequence
  chemically synthesized
aacaaaggaaaacacagattga

SEQ ID NO: 1117815 - DNA, 22 bp, Artificial Sequence
  chemically synthesized
gcctaaacaaaggaaaacacag

SEQ ID NO: 1117816 - DNA, 22 bp, Artificial Sequence
  chemically synthesized
ggcctaaacaaaggaaaacaca

SEQ ID NO: 1117817 - DNA, 22 bp, Artificial Sequence
  chemically synthesized
tggcctaaacaaaggaaaacac

SEQ ID NO: 1117818 - DNA, 22 bp, Artificial Sequence
  chemically synthesized
ggcctcaatctgtgttttcctt

SEQ ID NO: 1117819 - DNA, 22 bp, Artificial Sequence
  chemically synthesized
ttggcctaaacaaaggaaaaca

SEQ ID NO: 1117820 - DNA, 22 bp, Artificial Sequence
  chemically synthesized
tttttggcctaaacaaaggaaa

SEQ ID NO: 1117821 - DNA, 22 bp, Artificial Sequence
  chemically synthesized
tgtttttggcctaaacaaagga

SEQ ID NO: 1117822 - DNA, 22 bp, Artificial Sequence
  chemically synthesized
aatctgtgttttcctttgttta

SEQ ID NO: 1117823 - DNA, 22 bp, Artificial Sequence
  chemically synthesized
tgttttcctttgtttaggccaa

SEQ ID NO: 1117824 - DNA, 22 bp, Artificial Sequence
  chemically synthesized
tcctttgtttaggccaaaaaca

SEQ ID NO: 1117825 - DNA, 22 bp, Artificial Sequence
  chemically synthesized
cctttgtttaggccaaaaacag

SEQ ID NO: 1117826 - DNA, 22 bp, Artificial Sequence
  chemically synthesized
ctttgtttaggccaaaaacaga

SEQ ID NO: 1117827 - DNA, 22 bp, Artificial Sequence
  chemically synthesized
tgtttaggccaaaaacagaatc

SEQ ID NO: 1117828 - DNA, 22 bp, Artificial Sequence
  chemically synthesized
gtttaggccaaaaacagaatcc

SEQ ID NO: 1117829 - DNA, 22 bp, Artificial Sequence
  chemically synthesized
tttaggccaaaaacagaatcct

SEQ ID NO: 1117830 - DNA, 22 bp, Artificial Sequence
  chemically synthesized
aggccaaaaacagaatcctcca

SEQ ID NO: 1117831 - DNA, 22 bp, Artificial Sequence
  chemically synthesized
ggccaaaaacagaatcctccac

SEQ ID NO: 1117832 - DNA, 22 bp, Artificial Sequence
  chemically synthesized
agagagagaggggagtggagga

SEQ ID NO: 1117833 - DNA, 22 bp, Artificial Sequence
  chemically synthesized
gagagagagaggggagtggagg

SEQ ID NO: 1117834 - DNA, 22 bp, Artificial Sequence
  chemically synthesized
aatgtgaggcttgagagagaga

SEQ ID NO: 1117835 - DNA, 22 bp, Artificial Sequence
  chemically synthesized
cactcccctctctctctcaagc

SEQ ID NO: 1117836 - DNA, 22 bp, Artificial Sequence
  chemically synthesized
ccctctctctctcaagcctcac

SEQ ID NO: 1117837 - DNA, 22 bp, Artificial Sequence
  chemically synthesized
tgatggattgaatgtgaggctt

SEQ ID NO: 1117838 - DNA, 22 bp, Artificial Sequence
  chemically synthesized
gtgatggattgaatgtgaggct

SEQ ID NO: 1117839 - DNA, 22 bp, Artificial Sequence
  chemically synthesized
tgtgatggattgaatgtgaggc

SEQ ID NO: 1117840 - DNA, 22 bp, Artificial Sequence
  chemically synthesized
tctctctcaagcctcacattca

SEQ ID NO: 1117841 - DNA, 22 bp, Artificial Sequence
  chemically synthesized
tctctcaagcctcacattcaat

SEQ ID NO: 1117842 - DNA, 22 bp, Artificial Sequence
  chemically synthesized
tctcaagcctcacattcaatcc

SEQ ID NO: 1117843 - DNA, 22 bp, Artificial Sequence
  chemically synthesized
tcaagcctcacattcaatccat

SEQ ID NO: 1117844 - DNA, 22 bp, Artificial Sequence
  chemically synthesized
aagcctcacattcaatccatca

SEQ ID NO: 1117845 - DNA, 22 bp, Artificial Sequence
  chemically synthesized
gagccaacaggactttgtgatg

SEQ ID NO: 1117846 - DNA, 22 bp, Artificial Sequence
  chemically synthesized
acattcaatccatcacaaagtc

SEQ ID NO: 1117847 - DNA, 22 bp, Artificial Sequence
  chemically synthesized
aggttagagccaacaggacttt

SEQ ID NO: 1117848 - DNA, 22 bp, Artificial Sequence
  chemically synthesized
gaggttagagccaacaggactt

SEQ ID NO: 1117849 - DNA, 22 bp, Artificial Sequence
  chemically synthesized
aatccatcacaaagtcctgttg

SEQ ID NO: 1117850 - DNA, 22 bp, Artificial Sequence
  chemically synthesized
tgaggttagagccaacaggact

SEQ ID NO: 1117851 - DNA, 22 bp, Artificial Sequence
  chemically synthesized
tgttttgaggttagagccaaca

SEQ ID NO: 1117852 - DNA, 22 bp, Artificial Sequence
  chemically synthesized
gctatgttttgaggttagagcc

SEQ ID NO: 1117853 - DNA, 22 bp, Artificial Sequence
  chemically synthesized
tggctatgttttgaggttagag

SEQ ID NO: 1117854 - DNA, 22 bp, Artificial Sequence
  chemically synthesized
ctggctatgttttgaggttaga

SEQ ID NO: 1117855 - DNA, 22 bp, Artificial Sequence
  chemically synthesized
tctggctatgttttgaggttag

SEQ ID NO: 1117856 - DNA, 22 bp, Artificial Sequence
  chemically synthesized
actttctggctatgttttgagg

SEQ ID NO: 1117857 - DNA, 22 bp, Artificial Sequence
  chemically synthesized
ttggctctaacctcaaaacata

SEQ ID NO: 1117858 - DNA, 22 bp, Artificial Sequence
  chemically synthesized
gctctaacctcaaaacatagcc

SEQ ID NO: 1117859 - DNA, 22 bp, Artificial Sequence
  chemically synthesized
taacctcaaaacatagccagaa

SEQ ID NO: 1117860 - DNA, 22 bp, Artificial Sequence
  chemically synthesized
acctcaaaacatagccagaaag

SEQ ID NO: 1117861 - DNA, 22 bp, Artificial Sequence
  chemically synthesized
aaaacatagccagaaagtgagt

SEQ ID NO: 1117862 - DNA, 22 bp, Artificial Sequence
  chemically synthesized
atgtggtagtagtgagcaccat

SEQ ID NO: 1117863 - DNA, 22 bp, Artificial Sequence
  chemically synthesized
tctaatgtggtagtagtgagca

SEQ ID NO: 1117864 - DNA, 22 bp, Artificial Sequence
  chemically synthesized
gtctaatgtggtagtagtgagc

SEQ ID NO: 1117865 - DNA, 22 bp, Artificial Sequence
  chemically synthesized
tgtctaatgtggtagtagtgag

SEQ ID NO: 1117866 - DNA, 22 bp, Artificial Sequence
  chemically synthesized
tcatggtgctcactactaccac

SEQ ID NO: 1117867 - DNA, 22 bp, Artificial Sequence
  chemically synthesized
actactaccacattagacaaag

SEQ ID NO: 1117868 - DNA, 22 bp, Artificial Sequence
  chemically synthesized
agagatgatggggtactttgtc

SEQ ID NO: 1117869 - DNA, 22 bp, Artificial Sequence
  chemically synthesized
ctaccacattagacaaagtacc

SEQ ID NO: 1117870 - DNA, 22 bp, Artificial Sequence
  chemically synthesized
ccacattagacaaagtacccca

SEQ ID NO: 1117871 - DNA, 22 bp, Artificial Sequence
  chemically synthesized
atacccctcagagatgatgggg

SEQ ID NO: 1117872 - DNA, 22 bp, Artificial Sequence
  chemically synthesized
gacaaagtaccccatcatctct

SEQ ID NO: 1117873 - DNA, 22 bp, Artificial Sequence
  chemically synthesized
aaacattcatacccctcagaga

SEQ ID NO: 1117874 - DNA, 22 bp, Artificial Sequence
  chemically synthesized
gaaacattcatacccctcagag

SEQ ID NO: 1117875 - DNA, 22 bp, Artificial Sequence
  chemically synthesized
tgaaacattcatacccctcaga

SEQ ID NO: 1117876 - DNA, 22 bp, Artificial Sequence
  chemically synthesized
ttttgaaacattcatacccctc

SEQ ID NO: 1117877 - DNA, 22 bp, Artificial Sequence
  chemically synthesized
gtatcctattttgaaacattca

SEQ ID NO: 1117878 - DNA, 22 bp, Artificial Sequence
  chemically synthesized
agtatcctattttgaaacattc

SEQ ID NO: 1117879 - DNA, 22 bp, Artificial Sequence
  chemically synthesized
tagtatcctattttgaaacatt

SEQ ID NO: 1117880 - DNA, 22 bp, Artificial Sequence
  chemically synthesized
tgaggggtatgaatgtttcaaa

SEQ ID NO: 1117881 - DNA, 22 bp, Artificial Sequence
  chemically synthesized
aggggtatgaatgtttcaaaat

SEQ ID NO: 1117882 - DNA, 22 bp, Artificial Sequence
  chemically synthesized
caaaataggatactaaaggtct

SEQ ID NO: 1117883 - DNA, 22 bp, Artificial Sequence
  chemically synthesized
aaaataggatactaaaggtctt

SEQ ID NO: 1117884 - DNA, 22 bp, Artificial Sequence
  chemically synthesized
aaggtctttatatttcaccctt

SEQ ID NO: 1117885 - DNA, 22 bp, Artificial Sequence
  chemically synthesized
tatatttcaccctttgttctct

SEQ ID NO: 1117886 - DNA, 22 bp, Artificial Sequence
  chemically synthesized
atatttcaccctttgttctctg

SEQ ID NO: 1117887 - DNA, 22 bp, Artificial Sequence
  chemically synthesized
ataatatataatcagagaacaa

SEQ ID NO: 1117888 - DNA, 22 bp, Artificial Sequence
  chemically synthesized
tatttcaccctttgttctctga

SEQ ID NO: 1117889 - DNA, 22 bp, Artificial Sequence
  chemically synthesized
tgttgataatatataatcagag

SEQ ID NO: 1117890 - DNA, 22 bp, Artificial Sequence
  chemically synthesized
caccctttgttctctgattata

SEQ ID NO: 1117891 - DNA, 22 bp, Artificial Sequence
  chemically synthesized
accctttgttctctgattatat

SEQ ID NO: 1117892 - DNA, 22 bp, Artificial Sequence
  chemically synthesized
ctgtgttgataatatataatca

SEQ ID NO: 1117893 - DNA, 22 bp, Artificial Sequence
  chemically synthesized
tctgctgtgttgataatatata

SEQ ID NO: 1117894 - DNA, 22 bp, Artificial Sequence
  chemically synthesized
tgttctctgattatatattatc

SEQ ID NO: 1117895 - DNA, 22 bp, Artificial Sequence
  chemically synthesized
gttctctgattatatattatca

SEQ ID NO: 1117896 - DNA, 22 bp, Artificial Sequence
  chemically synthesized
tgtctgctgtgttgataatata

SEQ ID NO: 1117897 - DNA, 22 bp, Artificial Sequence
  chemically synthesized
ttctctgattatatattatcaa

SEQ ID NO: 1117898 - DNA, 22 bp, Artificial Sequence
  chemically synthesized
tctgattatatattatcaacac

SEQ ID NO: 1117899 - DNA, 22 bp, Artificial Sequence
  chemically synthesized
tctctgtctgctgtgttgataa

SEQ ID NO: 1117900 - DNA, 22 bp, Artificial Sequence
  chemically synthesized
tgattatatattatcaacacag

SEQ ID NO: 1117901 - DNA, 22 bp, Artificial Sequence
  chemically synthesized
ttgtctctgtctgctgtgttga

SEQ ID NO: 1117902 - DNA, 22 bp, Artificial Sequence
  chemically synthesized
attatatattatcaacacagca

SEQ ID NO: 1117903 - DNA, 22 bp, Artificial Sequence
  chemically synthesized
tatattatcaacacagcagaca

SEQ ID NO: 1117904 - DNA, 22 bp, Artificial Sequence
  chemically synthesized
aatcctgttgtctctgtctgct

SEQ ID NO: 1117905 - DNA, 22 bp, Artificial Sequence
  chemically synthesized
tcaacacagcagacagagacaa

SEQ ID NO: 1117906 - DNA, 22 bp, Artificial Sequence
  chemically synthesized
agctgaatcctgttgtctctgt

SEQ ID NO: 1117907 - DNA, 22 bp, Artificial Sequence
  chemically synthesized
tcagcgagttgagctgaatcct

SEQ ID NO: 1117908 - DNA, 22 bp, Artificial Sequence
  chemically synthesized
agctgtcagcgagttgagctga

SEQ ID NO: 1117909 - DNA, 22 bp, Artificial Sequence
  chemically synthesized
ttcagctgtcagcgagttgagc

SEQ ID NO: 1117910 - DNA, 22 bp, Artificial Sequence
  chemically synthesized
attcagctgtcagcgagttgag

SEQ ID NO: 1117911 - DNA, 22 bp, Artificial Sequence
  chemically synthesized
tattcagctgtcagcgagttga

SEQ ID NO: 1117912 - DNA, 22 bp, Artificial Sequence
  chemically synthesized
ttattcagctgtcagcgagttg

SEQ ID NO: 1117913 - DNA, 22 bp, Artificial Sequence
  chemically synthesized
agcttttattcagctgtcagcg

SEQ ID NO: 1117914 - DNA, 22 bp, Artificial Sequence
  chemically synthesized
gagcttttattcagctgtcagc

SEQ ID NO: 1117915 - DNA, 22 bp, Artificial Sequence
  chemically synthesized
agctcaactcgctgacagctga

SEQ ID NO: 1117916 - DNA, 22 bp, Artificial Sequence
  chemically synthesized
aactcgctgacagctgaataaa

SEQ ID NO: 1117917 - DNA, 22 bp, Artificial Sequence
  chemically synthesized
gctgacagctgaataaaagctc

SEQ ID NO: 1117918 - DNA, 22 bp, Artificial Sequence
  chemically synthesized
acagctgaataaaagctcaagt

SEQ ID NO: 1117919 - DNA, 22 bp, Artificial Sequence
  chemically synthesized
aataaaagctcaagtccttacc

SEQ ID NO: 1117920 - DNA, 22 bp, Artificial Sequence
  chemically synthesized
agatcagaccatggtaaggact

SEQ ID NO: 1117921 - DNA, 22 bp, Artificial Sequence
  chemically synthesized
attaagatcagaccatggtaag

SEQ ID NO: 1117922 - DNA, 22 bp, Artificial Sequence
  chemically synthesized
aagtccttaccatggtctgatc

SEQ ID NO: 1117923 - DNA, 22 bp, Artificial Sequence
  chemically synthesized
aggaagttaattaagatcagac

SEQ ID NO: 1117924 - DNA, 22 bp, Artificial Sequence
  chemically synthesized
accatggtctgatcttaattaa

SEQ ID NO: 1117925 - DNA, 22 bp, Artificial Sequence
  chemically synthesized
ccatggtctgatcttaattaac

SEQ ID NO: 1117926 - DNA, 22 bp, Artificial Sequence
  chemically synthesized
agaaaggttaaggaagttaatt

SEQ ID NO: 1117927 - DNA, 22 bp, Artificial Sequence
  chemically synthesized
atcttaattaacttccttaacc

SEQ ID NO: 1117928 - DNA, 22 bp, Artificial Sequence
  chemically synthesized
aattaacttccttaacctttct

SEQ ID NO: 1117929 - DNA, 22 bp, Artificial Sequence
  chemically synthesized
attaacttccttaacctttctg

SEQ ID NO: 1117930 - DNA, 22 bp, Artificial Sequence
  chemically synthesized
gcagcagaagaattcagaaagg

SEQ ID NO: 1117931 - DNA, 22 bp, Artificial Sequence
  chemically synthesized
agcagcagaagaattcagaaag

SEQ ID NO: 1117932 - DNA, 22 bp, Artificial Sequence
  chemically synthesized
acttccttaacctttctgaatt

SEQ ID NO: 1117933 - DNA, 22 bp, Artificial Sequence
  chemically synthesized
ccttaacctttctgaattcttc

SEQ ID NO: 1117934 - DNA, 22 bp, Artificial Sequence
  chemically synthesized
cttaacctttctgaattcttct

SEQ ID NO: 1117935 - DNA, 22 bp, Artificial Sequence
  chemically synthesized
aacctttctgaattcttctgct

SEQ ID NO: 1117936 - DNA, 22 bp, Artificial Sequence
  chemically synthesized
acctttctgaattcttctgctg

SEQ ID NO: 1117937 - DNA, 22 bp, Artificial Sequence
  chemically synthesized
tctgaattcttctgctgctaaa

SEQ ID NO: 1117938 - DNA, 22 bp, Artificial Sequence
  chemically synthesized
ctgaattcttctgctgctaaac

SEQ ID NO: 1117939 - DNA, 22 bp, Artificial Sequence
  chemically synthesized
tgaattcttctgctgctaaaca

SEQ ID NO: 1117940 - DNA, 22 bp, Artificial Sequence
  chemically synthesized
aattcttctgctgctaaacatc

SEQ ID NO: 1117941 - DNA, 22 bp, Artificial Sequence
  chemically synthesized
cagcagaaaaatcacgatgttt

SEQ ID NO: 1117942 - DNA, 22 bp, Artificial Sequence
  chemically synthesized
ttctgctgctaaacatcgtgat

SEQ ID NO: 1117943 - DNA, 22 bp, Artificial Sequence
  chemically synthesized
ctgctgctaaacatcgtgattt

SEQ ID NO: 1117944 - DNA, 22 bp, Artificial Sequence
  chemically synthesized
tgctgctaaacatcgtgatttt

SEQ ID NO: 1117945 - DNA, 22 bp, Artificial Sequence
  chemically synthesized
ctgctaaacatcgtgatttttc

SEQ ID NO: 1117946 - DNA, 22 bp, Artificial Sequence
  chemically synthesized
ctaaacatcgtgatttttctgc

SEQ ID NO: 1117947 - DNA, 22 bp, Artificial Sequence
  chemically synthesized
aacatcgtgatttttctgctgc

SEQ ID NO: 1117948 - DNA, 22 bp, Artificial Sequence
  chemically synthesized
ttctgctgcagccacacgctta

SEQ ID NO: 1117949 - DNA, 22 bp, Artificial Sequence
  chemically synthesized
tctgctgcagccacacgcttac

SEQ ID NO: 1117950 - DNA, 22 bp, Artificial Sequence
  chemically synthesized
ctgctgcagccacacgcttacc

SEQ ID NO: 1117951 - DNA, 22 bp, Artificial Sequence
  chemically synthesized
tgctgcagccacacgcttacct

SEQ ID NO: 1117952 - DNA, 22 bp, Artificial Sequence
  chemically synthesized
ctgcagccacacgcttaccttt

SEQ ID NO: 1117953 - DNA, 22 bp, Artificial Sequence
  chemically synthesized
tagcatcagggaaaaggtaagc

SEQ ID NO: 1117954 - DNA, 22 bp, Artificial Sequence
  chemically synthesized
cagccacacgcttaccttttcc

SEQ ID NO: 1117955 - DNA, 22 bp, Artificial Sequence
  chemically synthesized
accttttccctgatgctacagg

SEQ ID NO: 1117956 - DNA, 22 bp, Artificial Sequence
  chemically synthesized
ccttttccctgatgctacaggc

SEQ ID NO: 1117957 - DNA, 22 bp, Artificial Sequence
  chemically synthesized
ttccctgatgctacaggcatgc

SEQ ID NO: 1117958 - DNA, 22 bp, Artificial Sequence
  chemically synthesized
tccctgatgctacaggcatgct

SEQ ID NO: 1117959 - DNA, 22 bp, Artificial Sequence
  chemically synthesized
ccctgatgctacaggcatgctg

SEQ ID NO: 1117960 - DNA, 22 bp, Artificial Sequence
  chemically synthesized
cctgatgctacaggcatgctgc

SEQ ID NO: 1117961 - DNA, 22 bp, Artificial Sequence
  chemically synthesized
atgctacaggcatgctgctgtt

SEQ ID NO: 1117962 - DNA, 22 bp, Artificial Sequence
  chemically synthesized
caggcatgctgctgttacacgg

SEQ ID NO: 1117963 - DNA, 22 bp, Artificial Sequence
  chemically synthesized
ctgttacacggctgtgcattta

SEQ ID NO: 1117964 - DNA, 22 bp, Artificial Sequence
  chemically synthesized
ggcatggggaaaaataaatgca

SEQ ID NO: 1117965 - DNA, 22 bp, Artificial Sequence
  chemically synthesized
ttacacggctgtgcatttattt

SEQ ID NO: 1117966 - DNA, 22 bp, Artificial Sequence
  chemically synthesized
aggcatggggaaaaataaatgc

SEQ ID NO: 1117967 - DNA, 22 bp, Artificial Sequence
  chemically synthesized
taggcatggggaaaaataaatg

SEQ ID NO: 1117968 - DNA, 22 bp, Artificial Sequence
  chemically synthesized
ttaggcatggggaaaaataaat

SEQ ID NO: 1117969 - DNA, 22 bp, Artificial Sequence
  chemically synthesized
cacggctgtgcatttatttttc

SEQ ID NO: 1117970 - DNA, 22 bp, Artificial Sequence
  chemically synthesized
tttaggcatggggaaaaataaa

SEQ ID NO: 1117971 - DNA, 22 bp, Artificial Sequence
  chemically synthesized
gggcctttttaggcatggggaa

SEQ ID NO: 1117972 - DNA, 22 bp, Artificial Sequence
  chemically synthesized
tgcatttatttttccccatgcc

SEQ ID NO: 1117973 - DNA, 22 bp, Artificial Sequence
  chemically synthesized
agggcctttttaggcatgggga

SEQ ID NO: 1117974 - DNA, 22 bp, Artificial Sequence
  chemically synthesized
atttttccccatgcctaaaaag

SEQ ID NO: 1117975 - DNA, 22 bp, Artificial Sequence
  chemically synthesized
tttttccccatgcctaaaaagg

SEQ ID NO: 1117976 - DNA, 22 bp, Artificial Sequence
  chemically synthesized
ttccccatgcctaaaaaggccc

SEQ ID NO: 1117977 - DNA, 22 bp, Artificial Sequence
  chemically synthesized
tccccatgcctaaaaaggccct

SEQ ID NO: 1117978 - DNA, 22 bp, Artificial Sequence
  chemically synthesized
ccccatgcctaaaaaggcccta

SEQ ID NO: 1117979 - DNA, 22 bp, Artificial Sequence
  chemically synthesized
cccatgcctaaaaaggccctaa

SEQ ID NO: 1117980 - DNA, 22 bp, Artificial Sequence
  chemically synthesized
aaaaggccctaaattacttact

SEQ ID NO: 1117981 - DNA, 22 bp, Artificial Sequence
  chemically synthesized
atgggggaaaatgtccaagtaa

SEQ ID NO: 1117982 - DNA, 22 bp, Artificial Sequence
  chemically synthesized
gatgggggaaaatgtccaagta

SEQ ID NO: 1117983 - DNA, 22 bp, Artificial Sequence
  chemically synthesized
aattacttacttggacattttc

SEQ ID NO: 1117984 - DNA, 22 bp, Artificial Sequence
  chemically synthesized
cttacttggacattttccccca

SEQ ID NO: 1117985 - DNA, 22 bp, Artificial Sequence
  chemically synthesized
acttggacattttcccccatca

SEQ ID NO: 1117986 - DNA, 22 bp, Artificial Sequence
  chemically synthesized
cttggacattttcccccatcaa

SEQ ID NO: 1117987 - DNA, 22 bp, Artificial Sequence
  chemically synthesized
aaaaagtggcatttgatggggg

SEQ ID NO: 1117988 - DNA, 22 bp, Artificial Sequence
  chemically synthesized
ggacattttcccccatcaaatg

SEQ ID NO: 1117989 - DNA, 22 bp, Artificial Sequence
  chemically synthesized
gacattttcccccatcaaatgc

SEQ ID NO: 1117990 - DNA, 22 bp, Artificial Sequence
  chemically synthesized
gctgaaaaagtggcatttgatg

SEQ ID NO: 1117991 - DNA, 22 bp, Artificial Sequence
  chemically synthesized
tcccccatcaaatgccactttt

SEQ ID NO: 1117992 - DNA, 22 bp, Artificial Sequence
  chemically synthesized
cccccatcaaatgccacttttt

SEQ ID NO: 1117993 - DNA, 22 bp, Artificial Sequence
  chemically synthesized
ccccatcaaatgccactttttc

SEQ ID NO: 1117994 - DNA, 22 bp, Artificial Sequence
  chemically synthesized
aaaggcctagctgaaaaagtgg

SEQ ID NO: 1117995 - DNA, 22 bp, Artificial Sequence
  chemically synthesized
tagacagagtggcactaaaagg

SEQ ID NO: 1117996 - DNA, 22 bp, Artificial Sequence
  chemically synthesized
tttcagctaggccttttagtgc

SEQ ID NO: 1117997 - DNA, 22 bp, Artificial Sequence
  chemically synthesized
gtagacagagtggcactaaaag

SEQ ID NO: 1117998 - DNA, 22 bp, Artificial Sequence
  chemically synthesized
ttcagctaggccttttagtgcc

SEQ ID NO: 1117999 - DNA, 22 bp, Artificial Sequence
  chemically synthesized
tcagctaggccttttagtgcca

SEQ ID NO: 1118000 - DNA, 22 bp, Artificial Sequence
  chemically synthesized
cagctaggccttttagtgccac

SEQ ID NO: 1118001 - DNA, 22 bp, Artificial Sequence
  chemically synthesized
agctaggccttttagtgccact

SEQ ID NO: 1118002 - DNA, 22 bp, Artificial Sequence
  chemically synthesized
ggccttttagtgccactctgtc

SEQ ID NO: 1118003 - DNA, 22 bp, Artificial Sequence
  chemically synthesized
ttagtgccactctgtctacaag

SEQ ID NO: 1118004 - DNA, 22 bp, Artificial Sequence
  chemically synthesized
tagtgccactctgtctacaagc

SEQ ID NO: 1118005 - DNA, 22 bp, Artificial Sequence
  chemically synthesized
agtgccactctgtctacaagca

SEQ ID NO: 1118006 - DNA, 22 bp, Artificial Sequence
  chemically synthesized
gtgccactctgtctacaagcac

SEQ ID NO: 1118007 - DNA, 22 bp, Artificial Sequence
  chemically synthesized
tgtctacaagcacatgcatacc

SEQ ID NO: 1118008 - DNA, 22 bp, Artificial Sequence
  chemically synthesized
tctacaagcacatgcataccct

SEQ ID NO: 1118009 - DNA, 22 bp, Artificial Sequence
  chemically synthesized
caagcacatgcataccctctca

SEQ ID NO: 1118010 - DNA, 22 bp, Artificial Sequence
  chemically synthesized
caaggagcagaataaaatgaga

SEQ ID NO: 1118011 - DNA, 22 bp, Artificial Sequence
  chemically synthesized
gtgataagttccaaggagcaga

SEQ ID NO: 1118012 - DNA, 22 bp, Artificial Sequence
  chemically synthesized
tcattttattctgctccttgga

SEQ ID NO: 1118013 - DNA, 22 bp, Artificial Sequence
  chemically synthesized
attttattctgctccttggaac

SEQ ID NO: 1118014 - DNA, 22 bp, Artificial Sequence
  chemically synthesized
tattctgctccttggaacttat

SEQ ID NO: 1118015 - DNA, 22 bp, Artificial Sequence
  chemically synthesized
attctgctccttggaacttatc

SEQ ID NO: 1118016 - DNA, 22 bp, Artificial Sequence
  chemically synthesized
ttctgctccttggaacttatca

SEQ ID NO: 1118017 - DNA, 22 bp, Artificial Sequence
  chemically synthesized
tgctccttggaacttatcacta

SEQ ID NO: 1118018 - DNA, 22 bp, Artificial Sequence
  chemically synthesized
ctccttggaacttatcactaac

SEQ ID NO: 1118019 - DNA, 22 bp, Artificial Sequence
  chemically synthesized
cttggaacttatcactaacatt

SEQ ID NO: 1118020 - DNA, 22 bp, Artificial Sequence
  chemically synthesized
ggaacttatcactaacattcca

SEQ ID NO: 1118021 - DNA, 22 bp, Artificial Sequence
  chemically synthesized
gaacttatcactaacattccac

SEQ ID NO: 1118022 - DNA, 22 bp, Artificial Sequence
  chemically synthesized
atatgtaaagcatgtggaatgt

SEQ ID NO: 1118023 - DNA, 22 bp, Artificial Sequence
  chemically synthesized
atcactaacattccacatgctt

SEQ ID NO: 1118024 - DNA, 22 bp, Artificial Sequence
  chemically synthesized
tcactaacattccacatgcttt

SEQ ID NO: 1118025 - DNA, 22 bp, Artificial Sequence
  chemically synthesized
acattccacatgctttacatat

SEQ ID NO: 1118026 - DNA, 22 bp, Artificial Sequence
  chemically synthesized
cacatgctttacatattagtct

SEQ ID NO: 1118027 - DNA, 22 bp, Artificial Sequence
  chemically synthesized
tacatattagtcttgcttcatt

SEQ ID NO: 1118028 - DNA, 22 bp, Artificial Sequence
  chemically synthesized
acatattagtcttgcttcattt

SEQ ID NO: 1118029 - DNA, 22 bp, Artificial Sequence
  chemically synthesized
catattagtcttgcttcatttc

SEQ ID NO: 1118030 - DNA, 22 bp, Artificial Sequence
  chemically synthesized
gtgggaaagatggaaatgaagc

SEQ ID NO: 1118031 - DNA, 22 bp, Artificial Sequence
  chemically synthesized
tagtgggaaagatggaaatgaa

SEQ ID NO: 1118032 - DNA, 22 bp, Artificial Sequence
  chemically synthesized
gtcttgcttcatttccatcttt

SEQ ID NO: 1118033 - DNA, 22 bp, Artificial Sequence
  chemically synthesized
cattctagtgggaaagatggaa

SEQ ID NO: 1118034 - DNA, 22 bp, Artificial Sequence
  chemically synthesized
acattctagtgggaaagatgga

SEQ ID NO: 1118035 - DNA, 22 bp, Artificial Sequence
  chemically synthesized
gcttcatttccatctttcccac

SEQ ID NO: 1118036 - DNA, 22 bp, Artificial Sequence
  chemically synthesized
cttcatttccatctttcccact

SEQ ID NO: 1118037 - DNA, 22 bp, Artificial Sequence
  chemically synthesized
catttccatctttcccactaga

SEQ ID NO: 1118038 - DNA, 22 bp, Artificial Sequence
  chemically synthesized
tatagtttacattctagtggga

SEQ ID NO: 1118039 - DNA, 22 bp, Artificial Sequence
  chemically synthesized
atttccatctttcccactagaa

SEQ ID NO: 1118040 - DNA, 22 bp, Artificial Sequence
  chemically synthesized
atatagtttacattctagtggg

SEQ ID NO: 1118041 - DNA, 22 bp, Artificial Sequence
  chemically synthesized
ccatctttcccactagaatgta

SEQ ID NO: 1118042 - DNA, 22 bp, Artificial Sequence
  chemically synthesized
catctttcccactagaatgtaa

SEQ ID NO: 1118043 - DNA, 22 bp, Artificial Sequence
  chemically synthesized
accttatatagtttacattcta

SEQ ID NO: 1118044 - DNA, 22 bp, Artificial Sequence
  chemically synthesized
tcccactagaatgtaaactata

SEQ ID NO: 1118045 - DNA, 22 bp, Artificial Sequence
  chemically synthesized
cccactagaatgtaaactatat

SEQ ID NO: 1118046 - DNA, 22 bp, Artificial Sequence
  chemically synthesized
ccactagaatgtaaactatata

SEQ ID NO: 1118047 - DNA, 22 bp, Artificial Sequence
  chemically synthesized
gaatgtaaactatataaggtca

SEQ ID NO: 1118048 - DNA, 22 bp, Artificial Sequence
  chemically synthesized
tataaggtcaggtatccttatc

SEQ ID NO: 1118049 - DNA, 22 bp, Artificial Sequence
  chemically synthesized
ggatagagtagagaaggatata

SEQ ID NO: 1118050 - DNA, 22 bp, Artificial Sequence
  chemically synthesized
gggatagagtagagaaggatat

SEQ ID NO: 1118051 - DNA, 22 bp, Artificial Sequence
  chemically synthesized
atctatatccttctctactcta

SEQ ID NO: 1118052 - DNA, 22 bp, Artificial Sequence
  chemically synthesized
tctatatccttctctactctat

SEQ ID NO: 1118053 - DNA, 22 bp, Artificial Sequence
  chemically synthesized
atggagacttgggatagagtag

SEQ ID NO: 1118054 - DNA, 22 bp, Artificial Sequence
  chemically synthesized
catggagacttgggatagagta

SEQ ID NO: 1118055 - DNA, 22 bp, Artificial Sequence
  chemically synthesized
tcatggagacttgggatagagt

SEQ ID NO: 1118056 - DNA, 22 bp, Artificial Sequence
  chemically synthesized
tatccttctctactctatccca

SEQ ID NO: 1118057 - DNA, 22 bp, Artificial Sequence
  chemically synthesized
ctctactctatcccaagtctcc

SEQ ID NO: 1118058 - DNA, 22 bp, Artificial Sequence
  chemically synthesized
tctactctatcccaagtctcca

SEQ ID NO: 1118059 - DNA, 22 bp, Artificial Sequence
  chemically synthesized
tactctatcccaagtctccatg

SEQ ID NO: 1118060 - DNA, 22 bp, Artificial Sequence
  chemically synthesized
ctctatcccaagtctccatgaa

SEQ ID NO: 1118061 - DNA, 22 bp, Artificial Sequence
  chemically synthesized
tatcccaagtctccatgaaagt

SEQ ID NO: 1118062 - DNA, 22 bp, Artificial Sequence
  chemically synthesized
taatgtaccagccactttcatg

SEQ ID NO: 1118063 - DNA, 22 bp, Artificial Sequence
  chemically synthesized
tcccaagtctccatgaaagtgg

SEQ ID NO: 1118064 - DNA, 22 bp, Artificial Sequence
  chemically synthesized
tgtacctataatgtaccagcca

SEQ ID NO: 1118065 - DNA, 22 bp, Artificial Sequence
  chemically synthesized
ttatgtacctataatgtaccag

SEQ ID NO: 1118066 - DNA, 22 bp, Artificial Sequence
  chemically synthesized
catgaaagtggctggtacatta

SEQ ID NO: 1118067 - DNA, 22 bp, Artificial Sequence
  chemically synthesized
attatgtacctataatgtacca

SEQ ID NO: 1118068 - DNA, 22 bp, Artificial Sequence
  chemically synthesized
gccttattatgtacctataatg

SEQ ID NO: 1118069 - DNA, 22 bp, Artificial Sequence
  chemically synthesized
gtacattataggtacataataa

SEQ ID NO: 1118070 - DNA, 22 bp, Artificial Sequence
  chemically synthesized
aaatagagctcgccttattatg

SEQ ID NO: 1118071 - DNA, 22 bp, Artificial Sequence
  chemically synthesized
cgctaaaatagagctcgcctta

SEQ ID NO: 1118072 - DNA, 22 bp, Artificial Sequence
  chemically synthesized
taggtacataataaggcgagct

SEQ ID NO: 1118073 - DNA, 22 bp, Artificial Sequence
  chemically synthesized
tatatggacgcgttacgctaaa

SEQ ID NO: 1118074 - DNA, 22 bp, Artificial Sequence
  chemically synthesized
tattttagcgtaacgcgtccat

SEQ ID NO: 1118075 - DNA, 22 bp, Artificial Sequence
  chemically synthesized
ttttagcgtaacgcgtccatat

SEQ ID NO: 1118076 - DNA, 22 bp, Artificial Sequence
  chemically synthesized
tagcgtaacgcgtccatataca

SEQ ID NO: 1118077 - DNA, 22 bp, Artificial Sequence
  chemically synthesized
agcgtaacgcgtccatatacaa

SEQ ID NO: 1118078 - DNA, 22 bp, Artificial Sequence
  chemically synthesized
gcgtaacgcgtccatatacaat

SEQ ID NO: 1118079 - DNA, 22 bp, Artificial Sequence
  chemically synthesized
tgggtaaggggagagaccataa

SEQ ID NO: 1118080 - DNA, 22 bp, Artificial Sequence
  chemically synthesized
agagagcattgtgggtaagggg

SEQ ID NO: 1118081 - DNA, 22 bp, Artificial Sequence
  chemically synthesized
aagagagcattgtgggtaaggg

SEQ ID NO: 1118082 - DNA, 22 bp, Artificial Sequence
  chemically synthesized
taagagagcattgtgggtaagg

SEQ ID NO: 1118083 - DNA, 22 bp, Artificial Sequence
  chemically synthesized
tggtctctccccttacccacaa

SEQ ID NO: 1118084 - DNA, 22 bp, Artificial Sequence
  chemically synthesized
cactttaagagagcattgtggg

SEQ ID NO: 1118085 - DNA, 22 bp, Artificial Sequence
  chemically synthesized
gcactttaagagagcattgtgg

SEQ ID NO: 1118086 - DNA, 22 bp, Artificial Sequence
  chemically synthesized
tccccttacccacaatgctctc

SEQ ID NO: 1118087 - DNA, 22 bp, Artificial Sequence
  chemically synthesized
cccttacccacaatgctctctt

SEQ ID NO: 1118088 - DNA, 22 bp, Artificial Sequence
  chemically synthesized
tgaatttgcactttaagagagc

SEQ ID NO: 1118089 - DNA, 22 bp, Artificial Sequence
  chemically synthesized
acccacaatgctctcttaaagt

SEQ ID NO: 1118090 - DNA, 22 bp, Artificial Sequence
  chemically synthesized
cccacaatgctctcttaaagtg

SEQ ID NO: 1118091 - DNA, 22 bp, Artificial Sequence
  chemically synthesized
gttatgaatttgcactttaaga

SEQ ID NO: 1118092 - DNA, 22 bp, Artificial Sequence
  chemically synthesized
gagttcgttatgaatttgcact

SEQ ID NO: 1118093 - DNA, 22 bp, Artificial Sequence
  chemically synthesized
ttagagttcgttatgaatttgc

SEQ ID NO: 1118094 - DNA, 22 bp, Artificial Sequence
  chemically synthesized
tcttaaagtgcaaattcataac

SEQ ID NO: 1118095 - DNA, 22 bp, Artificial Sequence
  chemically synthesized
ttaaagtgcaaattcataacga

SEQ ID NO: 1118096 - DNA, 22 bp, Artificial Sequence
  chemically synthesized
aaagtgcaaattcataacgaac

SEQ ID NO: 1118097 - DNA, 22 bp, Artificial Sequence
  chemically synthesized
aagtgcaaattcataacgaact

SEQ ID NO: 1118098 - DNA, 22 bp, Artificial Sequence
  chemically synthesized
tataaagctattagagttcgtt

SEQ ID NO: 1118099 - DNA, 22 bp, Artificial Sequence
  chemically synthesized
atataaagctattagagttcgt

SEQ ID NO: 1118100 - DNA, 22 bp, Artificial Sequence
  chemically synthesized
tatataaagctattagagttcg

SEQ ID NO: 1118101 - DNA, 22 bp, Artificial Sequence
  chemically synthesized
ataacgaactctaatagcttta

SEQ ID NO: 1118102 - DNA, 22 bp, Artificial Sequence
  chemically synthesized
tggccactttatataaagctat

SEQ ID NO: 1118103 - DNA, 22 bp, Artificial Sequence
  chemically synthesized
atggccactttatataaagcta

SEQ ID NO: 1118104 - DNA, 22 bp, Artificial Sequence
  chemically synthesized
tatggccactttatataaagct

SEQ ID NO: 1118105 - DNA, 22 bp, Artificial Sequence
  chemically synthesized
gttttatggccactttatataa

SEQ ID NO: 1118106 - DNA, 22 bp, Artificial Sequence
  chemically synthesized
taatagctttatataaagtggc

SEQ ID NO: 1118107 - DNA, 22 bp, Artificial Sequence
  chemically synthesized
atagctttatataaagtggcca

SEQ ID NO: 1118108 - DNA, 22 bp, Artificial Sequence
  chemically synthesized
tatataaagtggccataaaacc

SEQ ID NO: 1118109 - DNA, 22 bp, Artificial Sequence
  chemically synthesized
tccccatgtactggttttatgg

SEQ ID NO: 1118110 - DNA, 22 bp, Artificial Sequence
  chemically synthesized
atataaagtggccataaaacca

SEQ ID NO: 1118111 - DNA, 22 bp, Artificial Sequence
  chemically synthesized
tataaagtggccataaaaccag

SEQ ID NO: 1118112 - DNA, 22 bp, Artificial Sequence
  chemically synthesized
cagcacctgtccccatgtactg

SEQ ID NO: 1118113 - DNA, 22 bp, Artificial Sequence
  chemically synthesized
gcagcacctgtccccatgtact

SEQ ID NO: 1118114 - DNA, 22 bp, Artificial Sequence
  chemically synthesized
agcttgcagcacctgtccccat

SEQ ID NO: 1118115 - DNA, 22 bp, Artificial Sequence
  chemically synthesized
ctgagcttgcagcacctgtccc

SEQ ID NO: 1118116 - DNA, 22 bp, Artificial Sequence
  chemically synthesized
actgagcttgcagcacctgtcc

SEQ ID NO: 1118117 - DNA, 22 bp, Artificial Sequence
  chemically synthesized
tactgagcttgcagcacctgtc

SEQ ID NO: 1118118 - DNA, 22 bp, Artificial Sequence
  chemically synthesized
ctttactgagcttgcagcacct

SEQ ID NO: 1118119 - DNA, 22 bp, Artificial Sequence
  chemically synthesized
cctttactgagcttgcagcacc

SEQ ID NO: 1118120 - DNA, 22 bp, Artificial Sequence
  chemically synthesized
atccatccttcctttactgagc

SEQ ID NO: 1118121 - DNA, 22 bp, Artificial Sequence
  chemically synthesized
aatccatccttcctttactgag

SEQ ID NO: 1118122 - DNA, 22 bp, Artificial Sequence
  chemically synthesized
atttaatccatccttcctttac

SEQ ID NO: 1118123 - DNA, 22 bp, Artificial Sequence
  chemically synthesized
gatttaatccatccttccttta

SEQ ID NO: 1118124 - DNA, 22 bp, Artificial Sequence
  chemically synthesized
tgatttaatccatccttccttt

SEQ ID NO: 1118125 - DNA, 22 bp, Artificial Sequence
  chemically synthesized
caagctcagtaaaggaaggatg

SEQ ID NO: 1118126 - DNA, 22 bp, Artificial Sequence
  chemically synthesized
gaatactttgatttaatccatc

SEQ ID NO: 1118127 - DNA, 22 bp, Artificial Sequence
  chemically synthesized
agtaaaggaaggatggattaaa

SEQ ID NO: 1118128 - DNA, 22 bp, Artificial Sequence
  chemically synthesized
tagaatactttgatttaatcca

SEQ ID NO: 1118129 - DNA, 22 bp, Artificial Sequence
  chemically synthesized
ctagaatactttgatttaatcc

SEQ ID NO: 1118130 - DNA, 22 bp, Artificial Sequence
  chemically synthesized
atatgcagtttctagaatactt

SEQ ID NO: 1118131 - DNA, 22 bp, Artificial Sequence
  chemically synthesized
actaatatgcagtttctagaat

SEQ ID NO: 1118132 - DNA, 22 bp, Artificial Sequence
  chemically synthesized
aatcaaagtattctagaaactg

SEQ ID NO: 1118133 - DNA, 22 bp, Artificial Sequence
  chemically synthesized
cctaactaatatgcagtttcta

SEQ ID NO: 1118134 - DNA, 22 bp, Artificial Sequence
  chemically synthesized
tagaaactgcatattagttagg

SEQ ID NO: 1118135 - DNA, 22 bp, Artificial Sequence
  chemically synthesized
gaaactgcatattagttaggga

SEQ ID NO: 1118136 - DNA, 22 bp, Artificial Sequence
  chemically synthesized
catattagttagggagttgggc

SEQ ID NO: 1118137 - DNA, 22 bp, Artificial Sequence
  chemically synthesized
aagaaaagatggatgtgcccaa

SEQ ID NO: 1118138 - DNA, 22 bp, Artificial Sequence
  chemically synthesized
gttagggagttgggcacatcca

SEQ ID NO: 1118139 - DNA, 22 bp, Artificial Sequence
  chemically synthesized
agctgaagaaaagatggatgtg

SEQ ID NO: 1118140 - DNA, 22 bp, Artificial Sequence
  chemically synthesized
gagctgaagaaaagatggatgt

SEQ ID NO: 1118141 - DNA, 22 bp, Artificial Sequence
  chemically synthesized
gggagttgggcacatccatctt

SEQ ID NO: 1118142 - DNA, 22 bp, Artificial Sequence
  chemically synthesized
ggcacatccatcttttcttcag

SEQ ID NO: 1118143 - DNA, 22 bp, Artificial Sequence
  chemically synthesized
ccagtatcaggacttgagctga

SEQ ID NO: 1118144 - DNA, 22 bp, Artificial Sequence
  chemically synthesized
ttaccagtatcaggacttgagc

SEQ ID NO: 1118145 - DNA, 22 bp, Artificial Sequence
  chemically synthesized
attaccagtatcaggacttgag

SEQ ID NO: 1118146 - DNA, 22 bp, Artificial Sequence
  chemically synthesized
ttcttcagctcaagtcctgata

SEQ ID NO: 1118147 - DNA, 22 bp, Artificial Sequence
  chemically synthesized
gtttattaccagtatcaggact

SEQ ID NO: 1118148 - DNA, 22 bp, Artificial Sequence
  chemically synthesized
tcttcagctcaagtcctgatac

SEQ ID NO: 1118149 - DNA, 22 bp, Artificial Sequence
  chemically synthesized
cttcagctcaagtcctgatact

SEQ ID NO: 1118150 - DNA, 22 bp, Artificial Sequence
  chemically synthesized
ttcagctcaagtcctgatactg

SEQ ID NO: 1118151 - DNA, 22 bp, Artificial Sequence
  chemically synthesized
cagctcaagtcctgatactggt

SEQ ID NO: 1118152 - DNA, 22 bp, Artificial Sequence
  chemically synthesized
agctcaagtcctgatactggta

SEQ ID NO: 1118153 - DNA, 22 bp, Artificial Sequence
  chemically synthesized
ggtattggtttattaccagtat

SEQ ID NO: 1118154 - DNA, 22 bp, Artificial Sequence
  chemically synthesized
aggtattggtttattaccagta

SEQ ID NO: 1118155 - DNA, 22 bp, Artificial Sequence
  chemically synthesized
aagtcctgatactggtaataaa

SEQ ID NO: 1118156 - DNA, 22 bp, Artificial Sequence
  chemically synthesized
cttaggtattggtttattacca

SEQ ID NO: 1118157 - DNA, 22 bp, Artificial Sequence
  chemically synthesized
tacttaggtattggtttattac

SEQ ID NO: 1118158 - DNA, 22 bp, Artificial Sequence
  chemically synthesized
ctacttaggtattggtttatta

SEQ ID NO: 1118159 - DNA, 22 bp, Artificial Sequence
  chemically synthesized
tctacttaggtattggtttatt

SEQ ID NO: 1118160 - DNA, 22 bp, Artificial Sequence
  chemically synthesized
ttctacttaggtattggtttat

SEQ ID NO: 1118161 - DNA, 22 bp, Artificial Sequence
  chemically synthesized
ttttctacttaggtattggttt

SEQ ID NO: 1118162 - DNA, 22 bp, Artificial Sequence
  chemically synthesized
atactggtaataaaccaatacc

SEQ ID NO: 1118163 - DNA, 22 bp, Artificial Sequence
  chemically synthesized
cttttctacttaggtattggtt

SEQ ID NO: 1118164 - DNA, 22 bp, Artificial Sequence
  chemically synthesized
tcttttctacttaggtattggt

SEQ ID NO: 1118165 - DNA, 22 bp, Artificial Sequence
  chemically synthesized
tttcttttctacttaggtattg

SEQ ID NO: 1118166 - DNA, 22 bp, Artificial Sequence
  chemically synthesized
gtaataaaccaatacctaagta

SEQ ID NO: 1118167 - DNA, 22 bp, Artificial Sequence
  chemically synthesized
tatatggtactctttcttttct

SEQ ID NO: 1118168 - DNA, 22 bp, Artificial Sequence
  chemically synthesized
atggattgtatatggtactctt

SEQ ID NO: 1118169 - DNA, 22 bp, Artificial Sequence
  chemically synthesized
agtagaaaagaaagagtaccat

SEQ ID NO: 1118170 - DNA, 22 bp, Artificial Sequence
  chemically synthesized
actcatggattgtatatggtac

SEQ ID NO: 1118171 - DNA, 22 bp, Artificial Sequence
  chemically synthesized
gactcatggattgtatatggta

SEQ ID NO: 1118172 - DNA, 22 bp, Artificial Sequence
  chemically synthesized
tgactcatggattgtatatggt

SEQ ID NO: 1118173 - DNA, 22 bp, Artificial Sequence
  chemically synthesized
ccaagttttgactcatggattg

SEQ ID NO: 1118174 - DNA, 22 bp, Artificial Sequence
  chemically synthesized
taccaagttttgactcatggat

SEQ ID NO: 1118175 - DNA, 22 bp, Artificial Sequence
  chemically synthesized
ggtagaatcttacctctctgtt

SEQ ID NO: 1118176 - DNA, 22 bp, Artificial Sequence
  chemically synthesized
gtagaatcttacctctctgttt

SEQ ID NO: 1118177 - DNA, 22 bp, Artificial Sequence
  chemically synthesized
acctctctgtttttatttcatg

SEQ ID NO: 1118178 - DNA, 22 bp, Artificial Sequence
  chemically synthesized
cctctctgtttttatttcatgg

SEQ ID NO: 1118179 - DNA, 22 bp, Artificial Sequence
  chemically synthesized
tctgtttttatttcatggctct

SEQ ID NO: 1118180 - DNA, 22 bp, Artificial Sequence
  chemically synthesized
tgtttttatttcatggctctga

SEQ ID NO: 1118181 - DNA, 22 bp, Artificial Sequence
  chemically synthesized
tttttatttcatggctctgatc

SEQ ID NO: 1118182 - DNA, 22 bp, Artificial Sequence
  chemically synthesized
ttatttcatggctctgatcttc

SEQ ID NO: 1118183 - DNA, 22 bp, Artificial Sequence
  chemically synthesized
tatttcatggctctgatcttcc

SEQ ID NO: 1118184 - DNA, 22 bp, Artificial Sequence
  chemically synthesized
atttcatggctctgatcttcca

SEQ ID NO: 1118185 - DNA, 22 bp, Artificial Sequence
  chemically synthesized
tttcatggctctgatcttccac

SEQ ID NO: 1118186 - DNA, 22 bp, Artificial Sequence
  chemically synthesized
catggctctgatcttccacctc

SEQ ID NO: 1118187 - DNA, 22 bp, Artificial Sequence
  chemically synthesized
atggctctgatcttccacctcc

SEQ ID NO: 1118188 - DNA, 22 bp, Artificial Sequence
  chemically synthesized
tgatcttccacctcctctctct

SEQ ID NO: 1118189 - DNA, 22 bp, Artificial Sequence
  chemically synthesized
atcttccacctcctctctctat

SEQ ID NO: 1118190 - DNA, 22 bp, Artificial Sequence
  chemically synthesized
ccacctcctctctctatgtgtg

SEQ ID NO: 1118191 - DNA, 22 bp, Artificial Sequence
  chemically synthesized
cacctcctctctctatgtgtgt

SEQ ID NO: 1118192 - DNA, 22 bp, Artificial Sequence
  chemically synthesized
ctctctctatgtgtgtgtatgt

SEQ ID NO: 1118193 - DNA, 22 bp, Artificial Sequence
  chemically synthesized
tctctatgtgtgtgtatgtaca

SEQ ID NO: 1118194 - DNA, 22 bp, Artificial Sequence
  chemically synthesized
tctatgtgtgtgtatgtacata

SEQ ID NO: 1118195 - DNA, 22 bp, Artificial Sequence
  chemically synthesized
tatgtgtgtgtatgtacatata

SEQ ID NO: 1118196 - DNA, 22 bp, Artificial Sequence
  chemically synthesized
tgtgtgtgtatgtacatatatg

SEQ ID NO: 1118197 - DNA, 22 bp, Artificial Sequence
  chemically synthesized
aaaacatgggaaaggggtatat

SEQ ID NO: 1118198 - DNA, 22 bp, Artificial Sequence
  chemically synthesized
gaaaacatgggaaaggggtata

SEQ ID NO: 1118199 - DNA, 22 bp, Artificial Sequence
  chemically synthesized
gtcttgaaaacatgggaaaggg

SEQ ID NO: 1118200 - DNA, 22 bp, Artificial Sequence
  chemically synthesized
ggtcttgaaaacatgggaaagg

SEQ ID NO: 1118201 - DNA, 22 bp, Artificial Sequence
  chemically synthesized
tatatatacccctttcccatgt

SEQ ID NO: 1118202 - DNA, 22 bp, Artificial Sequence
  chemically synthesized
agatgatacccttggtcttgaa

SEQ ID NO: 1118203 - DNA, 22 bp, Artificial Sequence
  chemically synthesized
tcccatgttttcaagaccaagg

SEQ ID NO: 1118204 - DNA, 22 bp, Artificial Sequence
  chemically synthesized
cccatgttttcaagaccaaggg

SEQ ID NO: 1118205 - DNA, 22 bp, Artificial Sequence
  chemically synthesized
ccatgttttcaagaccaagggt

SEQ ID NO: 1118206 - DNA, 22 bp, Artificial Sequence
  chemically synthesized
aagagtattcagatgataccct

SEQ ID NO: 1118207 - DNA, 22 bp, Artificial Sequence
  chemically synthesized
tcaagaccaagggtatcatctg

SEQ ID NO: 1118208 - DNA, 22 bp, Artificial Sequence
  chemically synthesized
caagaccaagggtatcatctga

SEQ ID NO: 1118209 - DNA, 22 bp, Artificial Sequence
  chemically synthesized
aagaccaagggtatcatctgaa

SEQ ID NO: 1118210 - DNA, 22 bp, Artificial Sequence
  chemically synthesized
tggttgaagagtattcagatga

SEQ ID NO: 1118211 - DNA, 22 bp, Artificial Sequence
  chemically synthesized
aatactcttcaaccacagtctt

SEQ ID NO: 1118212 - DNA, 22 bp, Artificial Sequence
  chemically synthesized
ttcaaccacagtcttcattttc

SEQ ID NO: 1118213 - DNA, 22 bp, Artificial Sequence
  chemically synthesized
caaccacagtcttcattttctt

SEQ ID NO: 1118214 - DNA, 22 bp, Artificial Sequence
  chemically synthesized
aaccacagtcttcattttcttt

SEQ ID NO: 1118215 - DNA, 22 bp, Artificial Sequence
  chemically synthesized
aagatgaaatatataaaagaaa

SEQ ID NO: 1118216 - DNA, 22 bp, Artificial Sequence
  chemically synthesized
attgaagatgaaatatataaaa

SEQ ID NO: 1118217 - DNA, 22 bp, Artificial Sequence
  chemically synthesized
cattgaagatgaaatatataaa

SEQ ID NO: 1118218 - DNA, 22 bp, Artificial Sequence
  chemically synthesized
cattttcttttatatatttcat

SEQ ID NO: 1118219 - DNA, 22 bp, Artificial Sequence
  chemically synthesized
attttcttttatatatttcatc

SEQ ID NO: 1118220 - DNA, 22 bp, Artificial Sequence
  chemically synthesized
tcttttatatatttcatcttca

SEQ ID NO: 1118221 - DNA, 22 bp, Artificial Sequence
  chemically synthesized
cttttatatatttcatcttcaa

SEQ ID NO: 1118222 - DNA, 22 bp, Artificial Sequence
  chemically synthesized
gtccaaatttcattgaagatga

SEQ ID NO: 1118223 - DNA, 22 bp, Artificial Sequence
  chemically synthesized
ttttatatatttcatcttcaat

SEQ ID NO: 1118224 - DNA, 22 bp, Artificial Sequence
  chemically synthesized
ttatatatttcatcttcaatga

SEQ ID NO: 1118225 - DNA, 22 bp, Artificial Sequence
  chemically synthesized
tatatatttcatcttcaatgaa

SEQ ID NO: 1118226 - DNA, 22 bp, Artificial Sequence
  chemically synthesized
atatatttcatcttcaatgaaa

SEQ ID NO: 1118227 - DNA, 22 bp, Artificial Sequence
  chemically synthesized
tatatttcatcttcaatgaaat

SEQ ID NO: 1118228 - DNA, 22 bp, Artificial Sequence
  chemically synthesized
catcttcaatgaaatttggact

SEQ ID NO: 1118229 - DNA, 22 bp, Artificial Sequence
  chemically synthesized
atcttcaatgaaatttggacta

SEQ ID NO: 1118230 - DNA, 22 bp, Artificial Sequence
  chemically synthesized
atatggtaatattagtccaaat

SEQ ID NO: 1118231 - DNA, 22 bp, Artificial Sequence
  chemically synthesized
caatgaaatttggactaatatt

SEQ ID NO: 1118232 - DNA, 22 bp, Artificial Sequence
  chemically synthesized
gactaatatggtaatattagtc

SEQ ID NO: 1118233 - DNA, 22 bp, Artificial Sequence
  chemically synthesized
aatgaaatttggactaatatta

SEQ ID NO: 1118234 - DNA, 22 bp, Artificial Sequence
  chemically synthesized
ggactaatatggtaatattagt

SEQ ID NO: 1118235 - DNA, 22 bp, Artificial Sequence
  chemically synthesized
gaatttggactaatatggtaat

SEQ ID NO: 1118236 - DNA, 22 bp, Artificial Sequence
  chemically synthesized
ggactaatattaccatattagt

SEQ ID NO: 1118237 - DNA, 22 bp, Artificial Sequence
  chemically synthesized
gactaatattaccatattagtc

SEQ ID NO: 1118238 - DNA, 22 bp, Artificial Sequence
  chemically synthesized
aaatactggaatttggactaat

SEQ ID NO: 1118239 - DNA, 22 bp, Artificial Sequence
  chemically synthesized
atattaccatattagtccaaat

SEQ ID NO: 1118240 - DNA, 22 bp, Artificial Sequence
  chemically synthesized
ccatattagtccaaattccagt

SEQ ID NO: 1118241 - DNA, 22 bp, Artificial Sequence
  chemically synthesized
gagtaatattgaaatactggaa

SEQ ID NO: 1118242 - DNA, 22 bp, Artificial Sequence
  chemically synthesized
ggagtaatattgaaatactgga

SEQ ID NO: 1118243 - DNA, 22 bp, Artificial Sequence
  chemically synthesized
gtccaaattccagtatttcaat

SEQ ID NO: 1118244 - DNA, 22 bp, Artificial Sequence
  chemically synthesized
taggtatttggagtaatattga

SEQ ID NO: 1118245 - DNA, 22 bp, Artificial Sequence
  chemically synthesized
actgtaggtatttggagtaata

SEQ ID NO: 1118246 - DNA, 22 bp, Artificial Sequence
  chemically synthesized
cagtatttcaatattactccaa

SEQ ID NO: 1118247 - DNA, 22 bp, Artificial Sequence
  chemically synthesized
aagtctgactgtaggtatttgg

SEQ ID NO: 1118248 - DNA, 22 bp, Artificial Sequence
  chemically synthesized
caatattactccaaatacctac

SEQ ID NO: 1118249 - DNA, 22 bp, Artificial Sequence
  chemically synthesized
aatattactccaaatacctaca

SEQ ID NO: 1118250 - DNA, 22 bp, Artificial Sequence
  chemically synthesized
ctccaaatacctacagtcagac

SEQ ID NO: 1118251 - DNA, 22 bp, Artificial Sequence
  chemically synthesized
caaatacctacagtcagacttc

SEQ ID NO: 1118252 - DNA, 22 bp, Artificial Sequence
  chemically synthesized
tacagtagtgaaggctgaagtc

SEQ ID NO: 1118253 - DNA, 22 bp, Artificial Sequence
  chemically synthesized
gtacagtagtgaaggctgaagt

SEQ ID NO: 1118254 - DNA, 22 bp, Artificial Sequence
  chemically synthesized
tgtacagtagtgaaggctgaag

SEQ ID NO: 1118255 - DNA, 22 bp, Artificial Sequence
  chemically synthesized
ttgtacagtagtgaaggctgaa

SEQ ID NO: 1118256 - DNA, 22 bp, Artificial Sequence
  chemically synthesized
tttgtacagtagtgaaggctga

SEQ ID NO: 1118257 - DNA, 22 bp, Artificial Sequence
  chemically synthesized
cagtcagacttcagccttcact

SEQ ID NO: 1118258 - DNA, 22 bp, Artificial Sequence
  chemically synthesized
acaaaataactttttgtacagt

SEQ ID NO: 1118259 - DNA, 22 bp, Artificial Sequence
  chemically synthesized
cagccttcactactgtacaaaa

SEQ ID NO: 1118260 - DNA, 22 bp, Artificial Sequence
  chemically synthesized
cacaaaataactttttgtacag

SEQ ID NO: 1118261 - DNA, 22 bp, Artificial Sequence
  chemically synthesized
agccttcactactgtacaaaaa

SEQ ID NO: 1118262 - DNA, 22 bp, Artificial Sequence
  chemically synthesized
tcacaaaataactttttgtaca

SEQ ID NO: 1118263 - DNA, 22 bp, Artificial Sequence
  chemically synthesized
cactactgtacaaaaagttatt

SEQ ID NO: 1118264 - DNA, 22 bp, Artificial Sequence
  chemically synthesized
actactgtacaaaaagttattt

SEQ ID NO: 1118265 - DNA, 22 bp, Artificial Sequence
  chemically synthesized
atgactttcacaaaataacttt

SEQ ID NO: 1118266 - DNA, 22 bp, Artificial Sequence
  chemically synthesized
ctgtacaaaaagttattttgtg

SEQ ID NO: 1118267 - DNA, 22 bp, Artificial Sequence
  chemically synthesized
tacaaaaagttattttgtgaaa

SEQ ID NO: 1118268 - DNA, 22 bp, Artificial Sequence
  chemically synthesized
cgcccggccaaattaatgactt

SEQ ID NO: 1118269 - DNA, 22 bp, Artificial Sequence
  chemically synthesized
ttttgtgaaagtcattaatttg

SEQ ID NO: 1118270 - DNA, 22 bp, Artificial Sequence
  chemically synthesized
tgtgaaagtcattaatttggcc

SEQ ID NO: 1118271 - DNA, 22 bp, Artificial Sequence
  chemically synthesized
gtgaaagtcattaatttggccg

SEQ ID NO: 1118272 - DNA, 22 bp, Artificial Sequence
  chemically synthesized
tgaaagtcattaatttggccgg

SEQ ID NO: 1118273 - DNA, 22 bp, Artificial Sequence
  chemically synthesized
caggcgtgagcccctgcgcccg

SEQ ID NO: 1118274 - DNA, 22 bp, Artificial Sequence
  chemically synthesized
atttggccgggcgcaggggctc

SEQ ID NO: 1118275 - DNA, 22 bp, Artificial Sequence
  chemically synthesized
ggattacaggcgtgagcccctg

SEQ ID NO: 1118276 - DNA, 22 bp, Artificial Sequence
  chemically synthesized
ggccgggcgcaggggctcacgc

SEQ ID NO: 1118277 - DNA, 22 bp, Artificial Sequence
  chemically synthesized
gccgggcgcaggggctcacgcc

SEQ ID NO: 1118278 - DNA, 22 bp, Artificial Sequence
  chemically synthesized
ccaaagtgctgggattacaggc

SEQ ID NO: 1118279 - DNA, 22 bp, Artificial Sequence
  chemically synthesized
gcctcccaaagtgctgggatta

SEQ ID NO: 1118280 - DNA, 22 bp, Artificial Sequence
  chemically synthesized
ggcctcccaaagtgctgggatt

SEQ ID NO: 1118281 - DNA, 22 bp, Artificial Sequence
  chemically synthesized
acgcctgtaatcccagcacttt

SEQ ID NO: 1118282 - DNA, 22 bp, Artificial Sequence
  chemically synthesized
ccttggcctcccaaagtgctgg

SEQ ID NO: 1118283 - DNA, 22 bp, Artificial Sequence
  chemically synthesized
taatcccagcactttgggaggc

SEQ ID NO: 1118284 - DNA, 22 bp, Artificial Sequence
  chemically synthesized
tgatccacctgccttggcctcc

SEQ ID NO: 1118285 - DNA, 22 bp, Artificial Sequence
  chemically synthesized
gtgatccacctgccttggcctc

SEQ ID NO: 1118286 - DNA, 22 bp, Artificial Sequence
  chemically synthesized
accttgtgatccacctgccttg

SEQ ID NO: 1118287 - DNA, 22 bp, Artificial Sequence
  chemically synthesized
ctgaccttgtgatccacctgcc

SEQ ID NO: 1118288 - DNA, 22 bp, Artificial Sequence
  chemically synthesized
tgggaggccaaggcaggtggat

SEQ ID NO: 1118289 - DNA, 22 bp, Artificial Sequence
  chemically synthesized
gggaggccaaggcaggtggatc

SEQ ID NO: 1118290 - DNA, 22 bp, Artificial Sequence
  chemically synthesized
ggaggccaaggcaggtggatca

SEQ ID NO: 1118291 - DNA, 22 bp, Artificial Sequence
  chemically synthesized
catctcctgaccttgtgatcca

SEQ ID NO: 1118292 - DNA, 22 bp, Artificial Sequence
  chemically synthesized
gccaggatggtctccatctcct

SEQ ID NO: 1118293 - DNA, 22 bp, Artificial Sequence
  chemically synthesized
ttggccaggatggtctccatct

SEQ ID NO: 1118294 - DNA, 22 bp, Artificial Sequence
  chemically synthesized
aactgttggccaggatggtctc

SEQ ID NO: 1118295 - DNA, 22 bp, Artificial Sequence
  chemically synthesized
caactgttggccaggatggtct

SEQ ID NO: 1118296 - DNA, 22 bp, Artificial Sequence
  chemically synthesized
gtagagacggggtttcaactgt

SEQ ID NO: 1118297 - DNA, 22 bp, Artificial Sequence
  chemically synthesized
agtagagacggggtttcaactg

SEQ ID NO: 1118298 - DNA, 22 bp, Artificial Sequence
  chemically synthesized
tagtagagacggggtttcaact

SEQ ID NO: 1118299 - DNA, 22 bp, Artificial Sequence
  chemically synthesized
ttagtagagacggggtttcaac

SEQ ID NO: 1118300 - DNA, 22 bp, Artificial Sequence
  chemically synthesized
gccaacagttgaaaccccgtct

SEQ ID NO: 1118301 - DNA, 22 bp, Artificial Sequence
  chemically synthesized
tatttttagtagagacggggtt

SEQ ID NO: 1118302 - DNA, 22 bp, Artificial Sequence
  chemically synthesized
gtatttttagtagagacggggt

SEQ ID NO: 1118303 - DNA, 22 bp, Artificial Sequence
  chemically synthesized
tgtatttttagtagagacgggg

SEQ ID NO: 1118304 - DNA, 22 bp, Artificial Sequence
  chemically synthesized
ttgtatttttagtagagacggg

SEQ ID NO: 1118305 - DNA, 22 bp, Artificial Sequence
  chemically synthesized
tttgtatttttagtagagacgg

SEQ ID NO: 1118306 - DNA, 22 bp, Artificial Sequence
  chemically synthesized
attttttgtatttttagtagag

SEQ ID NO: 1118307 - DNA, 22 bp, Artificial Sequence
  chemically synthesized
aaaccccgtctctactaaaaat

SEQ ID NO: 1118308 - DNA, 22 bp, Artificial Sequence
  chemically synthesized
tactaaaaatacaaaaaattag

SEQ ID NO: 1118309 - DNA, 22 bp, Artificial Sequence
  chemically synthesized
ctaaaaatacaaaaaattagct

SEQ ID NO: 1118310 - DNA, 22 bp, Artificial Sequence
  chemically synthesized
aaaatacaaaaaattagctgga

SEQ ID NO: 1118311 - DNA, 22 bp, Artificial Sequence
  chemically synthesized
caggcacgtgccaccacgtcca

SEQ ID NO: 1118312 - DNA, 22 bp, Artificial Sequence
  chemically synthesized
ggactacaggcacgtgccacca

SEQ ID NO: 1118313 - DNA, 22 bp, Artificial Sequence
  chemically synthesized
gctggacgtggtggcacgtgcc

SEQ ID NO: 1118314 - DNA, 22 bp, Artificial Sequence
  chemically synthesized
gacgtggtggcacgtgcctgta

SEQ ID NO: 1118315 - DNA, 22 bp, Artificial Sequence
  chemically synthesized
ccgagtagctgggactacaggc

SEQ ID NO: 1118316 - DNA, 22 bp, Artificial Sequence
  chemically synthesized
agcctcccgagtagctgggact

SEQ ID NO: 1118317 - DNA, 22 bp, Artificial Sequence
  chemically synthesized
cctcagcctcccgagtagctgg

SEQ ID NO: 1118318 - DNA, 22 bp, Artificial Sequence
  chemically synthesized
ctgcctcagcctcccgagtagc

SEQ ID NO: 1118319 - DNA, 22 bp, Artificial Sequence
  chemically synthesized
tcctgcctcagcctcccgagta

SEQ ID NO: 1118320 - DNA, 22 bp, Artificial Sequence
  chemically synthesized
tagtcccagctactcgggaggc

SEQ ID NO: 1118321 - DNA, 22 bp, Artificial Sequence
  chemically synthesized
aagcgattctcctgcctcagcc

SEQ ID NO: 1118322 - DNA, 22 bp, Artificial Sequence
  chemically synthesized
ctcgggaggctgaggcaggaga

SEQ ID NO: 1118323 - DNA, 22 bp, Artificial Sequence
  chemically synthesized
gggaggctgaggcaggagaatc

SEQ ID NO: 1118324 - DNA, 22 bp, Artificial Sequence
  chemically synthesized
ccgggttcaagcgattctcctg

SEQ ID NO: 1118325 - DNA, 22 bp, Artificial Sequence
  chemically synthesized
tctcccgggttcaagcgattct

SEQ ID NO: 1118326 - DNA, 22 bp, Artificial Sequence
  chemically synthesized
tgtctcccgggttcaagcgatt

SEQ ID NO: 1118327 - DNA, 22 bp, Artificial Sequence
  chemically synthesized
ctgtctcccgggttcaagcgat

SEQ ID NO: 1118328 - DNA, 22 bp, Artificial Sequence
  chemically synthesized
aggcaggagaatcgcttgaacc

SEQ ID NO: 1118329 - DNA, 22 bp, Artificial Sequence
  chemically synthesized
caacttctgtctcccgggttca

SEQ ID NO: 1118330 - DNA, 22 bp, Artificial Sequence
  chemically synthesized
actgcaacttctgtctcccggg

SEQ ID NO: 1118331 - DNA, 22 bp, Artificial Sequence
  chemically synthesized
gctcactgcaacttctgtctcc

SEQ ID NO: 1118332 - DNA, 22 bp, Artificial Sequence
  chemically synthesized
ggctcactgcaacttctgtctc

SEQ ID NO: 1118333 - DNA, 22 bp, Artificial Sequence
  chemically synthesized
gaacccgggagacagaagttgc

SEQ ID NO: 1118334 - DNA, 22 bp, Artificial Sequence
  chemically synthesized
aacccgggagacagaagttgca

SEQ ID NO: 1118335 - DNA, 22 bp, Artificial Sequence
  chemically synthesized
gagtgcagtggcgcaatcttgg

SEQ ID NO: 1118336 - DNA, 22 bp, Artificial Sequence
  chemically synthesized
cagtgagccaagattgcgccac

SEQ ID NO: 1118337 - DNA, 22 bp, Artificial Sequence
  chemically synthesized
tcacccaggctggagtgcagtg

SEQ ID NO: 1118338 - DNA, 22 bp, Artificial Sequence
  chemically synthesized
tgtcacccaggctggagtgcag

SEQ ID NO: 1118339 - DNA, 22 bp, Artificial Sequence
  chemically synthesized
gctctgtcacccaggctggagt

SEQ ID NO: 1118340 - DNA, 22 bp, Artificial Sequence
  chemically synthesized
cgccactgcactccagcctggg

SEQ ID NO: 1118341 - DNA, 22 bp, Artificial Sequence
  chemically synthesized
cactccagcctgggtgacagag

SEQ ID NO: 1118342 - DNA, 22 bp, Artificial Sequence
  chemically synthesized
ccgagacggagcctcgctctgt

SEQ ID NO: 1118343 - DNA, 22 bp, Artificial Sequence
  chemically synthesized
cagcctgggtgacagagcgagg

SEQ ID NO: 1118344 - DNA, 22 bp, Artificial Sequence
  chemically synthesized
cccgagacggagcctcgctctg

SEQ ID NO: 1118345 - DNA, 22 bp, Artificial Sequence
  chemically synthesized
tcccgagacggagcctcgctct

SEQ ID NO: 1118346 - DNA, 22 bp, Artificial Sequence
  chemically synthesized
ttcccgagacggagcctcgctc

SEQ ID NO: 1118347 - DNA, 22 bp, Artificial Sequence
  chemically synthesized
tttcccgagacggagcctcgct

SEQ ID NO: 1118348 - DNA, 22 bp, Artificial Sequence
  chemically synthesized
ttttcccgagacggagcctcgc

SEQ ID NO: 1118349 - DNA, 22 bp, Artificial Sequence
  chemically synthesized
tttttcccgagacggagcctcg

SEQ ID NO: 1118350 - DNA, 22 bp, Artificial Sequence
  chemically synthesized
ttttttcccgagacggagcctc

SEQ ID NO: 1118351 - DNA, 22 bp, Artificial Sequence
  chemically synthesized
ggtgacagagcgaggctccgtc

SEQ ID NO: 1118352 - DNA, 22 bp, Artificial Sequence
  chemically synthesized
tttttttcccgagacggagcct

SEQ ID NO: 1118353 - DNA, 22 bp, Artificial Sequence
  chemically synthesized
ttttttttcccgagacggagcc

SEQ ID NO: 1118354 - DNA, 22 bp, Artificial Sequence
  chemically synthesized
tttttttttcccgagacggagc

SEQ ID NO: 1118355 - DNA, 22 bp, Artificial Sequence
  chemically synthesized
ttttttttttcccgagacggag

SEQ ID NO: 1118356 - DNA, 22 bp, Artificial Sequence
  chemically synthesized
tttttttttttcccgagacgga

SEQ ID NO: 1118357 - DNA, 22 bp, Artificial Sequence
  chemically synthesized
ttttttttttttcccgagacgg

SEQ ID NO: 1118358 - DNA, 22 bp, Artificial Sequence
  chemically synthesized
tttttttttttttcccgagacg

SEQ ID NO: 1118359 - DNA, 22 bp, Artificial Sequence
  chemically synthesized
ttttttttttttttcccgagac

SEQ ID NO: 1118360 - DNA, 22 bp, Artificial Sequence
  chemically synthesized
tttttttttttttttcccgaga

SEQ ID NO: 1118361 - DNA, 22 bp, Artificial Sequence
  chemically synthesized
ttttttttttttttttcccgag

SEQ ID NO: 1118362 - DNA, 22 bp, Artificial Sequence
  chemically synthesized
tttttttttttttttttcccga

SEQ ID NO: 1118363 - DNA, 22 bp, Artificial Sequence
  chemically synthesized
ttttttttttttttttttcccg

SEQ ID NO: 1118364 - DNA, 22 bp, Artificial Sequence
  chemically synthesized
tttttttttttttttttttccc

SEQ ID NO: 1118365 - DNA, 22 bp, Artificial Sequence
  chemically synthesized
ttttttttttttttttttttcc

SEQ ID NO: 1118366 - DNA, 22 bp, Artificial Sequence
  chemically synthesized
tttttttttttttttttttttc

SEQ ID NO: 1118367 - DNA, 22 bp, Artificial Sequence
  chemically synthesized
tttttttttttttttttttttt

SEQ ID NO: 1118368 - DNA, 22 bp, Artificial Sequence
  chemically synthesized
cttttttttttttttttttttt

SEQ ID NO: 1118369 - DNA, 22 bp, Artificial Sequence
  chemically synthesized
cgtctcgggaaaaaaaaaaaaa

SEQ ID NO: 1118370 - DNA, 22 bp, Artificial Sequence
  chemically synthesized
tctttttttttttttttttttt

SEQ ID NO: 1118371 - DNA, 22 bp, Artificial Sequence
  chemically synthesized
ttcttttttttttttttttttt

SEQ ID NO: 1118372 - DNA, 22 bp, Artificial Sequence
  chemically synthesized
ttttcttttttttttttttttt

SEQ ID NO: 1118373 - DNA, 22 bp, Artificial Sequence
  chemically synthesized
cttttctttttttttttttttt

SEQ ID NO: 1118374 - DNA, 22 bp, Artificial Sequence
  chemically synthesized
tcttttcttttttttttttttt

SEQ ID NO: 1118375 - DNA, 22 bp, Artificial Sequence
  chemically synthesized
gggaaaaaaaaaaaaaaaaaaa

SEQ ID NO: 1118376 - DNA, 22 bp, Artificial Sequence
  chemically synthesized
atgactttcttttctttttttt

SEQ ID NO: 1118377 - DNA, 22 bp, Artificial Sequence
  chemically synthesized
acaagaagaaaattaatgactt

SEQ ID NO: 1118378 - DNA, 22 bp, Artificial Sequence
  chemically synthesized
ctaacaagaagaaaattaatga

SEQ ID NO: 1118379 - DNA, 22 bp, Artificial Sequence
  chemically synthesized
cctaacaagaagaaaattaatg

SEQ ID NO: 1118380 - DNA, 22 bp, Artificial Sequence
  chemically synthesized
tcctaacaagaagaaaattaat

SEQ ID NO: 1118381 - DNA, 22 bp, Artificial Sequence
  chemically synthesized
ttcctaacaagaagaaaattaa

SEQ ID NO: 1118382 - DNA, 22 bp, Artificial Sequence
  chemically synthesized
taagaagcatttttcctaacaa

SEQ ID NO: 1118383 - DNA, 22 bp, Artificial Sequence
  chemically synthesized
attttcttcttgttaggaaaaa

SEQ ID NO: 1118384 - DNA, 22 bp, Artificial Sequence
  chemically synthesized
tcttcttgttaggaaaaatgct

SEQ ID NO: 1118385 - DNA, 22 bp, Artificial Sequence
  chemically synthesized
aatgttgtaagaagcatttttc

SEQ ID NO: 1118386 - DNA, 22 bp, Artificial Sequence
  chemically synthesized
cttcttgttaggaaaaatgctt

SEQ ID NO: 1118387 - DNA, 22 bp, Artificial Sequence
  chemically synthesized
ttcttgttaggaaaaatgcttc

SEQ ID NO: 1118388 - DNA, 22 bp, Artificial Sequence
  chemically synthesized
cttgttaggaaaaatgcttctt

SEQ ID NO: 1118389 - DNA, 22 bp, Artificial Sequence
  chemically synthesized
ttgttaggaaaaatgcttctta

SEQ ID NO: 1118390 - DNA, 22 bp, Artificial Sequence
  chemically synthesized
gttaggaaaaatgcttcttaca

SEQ ID NO: 1118391 - DNA, 22 bp, Artificial Sequence
  chemically synthesized
ttaggaaaaatgcttcttacaa

SEQ ID NO: 1118392 - DNA, 22 bp, Artificial Sequence
  chemically synthesized
tcagtactgaatgttgtaagaa

SEQ ID NO: 1118393 - DNA, 22 bp, Artificial Sequence
  chemically synthesized
atcagtactgaatgttgtaaga

SEQ ID NO: 1118394 - DNA, 22 bp, Artificial Sequence
  chemically synthesized
ggaaaaatgcttcttacaacat

SEQ ID NO: 1118395 - DNA, 22 bp, Artificial Sequence
  chemically synthesized
tatcagtactgaatgttgtaag

SEQ ID NO: 1118396 - DNA, 22 bp, Artificial Sequence
  chemically synthesized
ttatcagtactgaatgttgtaa

SEQ ID NO: 1118397 - DNA, 22 bp, Artificial Sequence
  chemically synthesized
tagtttttatcagtactgaatg

SEQ ID NO: 1118398 - DNA, 22 bp, Artificial Sequence
  chemically synthesized
cttacaacattcagtactgata

SEQ ID NO: 1118399 - DNA, 22 bp, Artificial Sequence
  chemically synthesized
ttacaacattcagtactgataa

SEQ ID NO: 1118400 - DNA, 22 bp, Artificial Sequence
  chemically synthesized
acaacattcagtactgataaaa

SEQ ID NO: 1118401 - DNA, 22 bp, Artificial Sequence
  chemically synthesized
caacattcagtactgataaaaa

SEQ ID NO: 1118402 - DNA, 22 bp, Artificial Sequence
  chemically synthesized
gaggaggtaattgtagttttta

SEQ ID NO: 1118403 - DNA, 22 bp, Artificial Sequence
  chemically synthesized
cgaggaggtaattgtagttttt

SEQ ID NO: 1118404 - DNA, 22 bp, Artificial Sequence
  chemically synthesized
agtactgataaaaactacaatt

SEQ ID NO: 1118405 - DNA, 22 bp, Artificial Sequence
  chemically synthesized
ataaaaactacaattacctcct

SEQ ID NO: 1118406 - DNA, 22 bp, Artificial Sequence
  chemically synthesized
tgaacatggcaatttcgaggag

SEQ ID NO: 1118407 - DNA, 22 bp, Artificial Sequence
  chemically synthesized
atgaacatggcaatttcgagga

SEQ ID NO: 1118408 - DNA, 22 bp, Artificial Sequence
  chemically synthesized
tatgaacatggcaatttcgagg

SEQ ID NO: 1118409 - DNA, 22 bp, Artificial Sequence
  chemically synthesized
ttatgaacatggcaatttcgag

SEQ ID NO: 1118410 - DNA, 22 bp, Artificial Sequence
  chemically synthesized
caattacctcctcgaaattgcc

SEQ ID NO: 1118411 - DNA, 22 bp, Artificial Sequence
  chemically synthesized
cctcctcgaaattgccatgttc

SEQ ID NO: 1118412 - DNA, 22 bp, Artificial Sequence
  chemically synthesized
ctcgaaattgccatgttcataa

SEQ ID NO: 1118413 - DNA, 22 bp, Artificial Sequence
  chemically synthesized
gaaattgccatgttcataaaaa

SEQ ID NO: 1118414 - DNA, 22 bp, Artificial Sequence
  chemically synthesized
tcaagggcagaggtatttttat

SEQ ID NO: 1118415 - DNA, 22 bp, Artificial Sequence
  chemically synthesized
ccatgttcataaaaatacctct

SEQ ID NO: 1118416 - DNA, 22 bp, Artificial Sequence
  chemically synthesized
ataaaaatacctctgcccttga

SEQ ID NO: 1118417 - DNA, 22 bp, Artificial Sequence
  chemically synthesized
agagaaagataatattgtcaag

SEQ ID NO: 1118418 - DNA, 22 bp, Artificial Sequence
  chemically synthesized
aagagaaagataatattgtcaa

SEQ ID NO: 1118419 - DNA, 22 bp, Artificial Sequence
  chemically synthesized
tgcccttgacaatattatcttt

SEQ ID NO: 1118420 - DNA, 22 bp, Artificial Sequence
  chemically synthesized
cccttgacaatattatctttct

SEQ ID NO: 1118421 - DNA, 22 bp, Artificial Sequence
  chemically synthesized
gacaatattatctttctcttaa

SEQ ID NO: 1118422 - DNA, 22 bp, Artificial Sequence
  chemically synthesized
acaatattatctttctcttaaa

SEQ ID NO: 1118423 - DNA, 22 bp, Artificial Sequence
  chemically synthesized
atgaggacgaaatttaagagaa

SEQ ID NO: 1118424 - DNA, 22 bp, Artificial Sequence
  chemically synthesized
catgaggacgaaatttaagaga

SEQ ID NO: 1118425 - DNA, 22 bp, Artificial Sequence
  chemically synthesized
tctttctcttaaatttcgtcct

SEQ ID NO: 1118426 - DNA, 22 bp, Artificial Sequence
  chemically synthesized
gatgacttcatgaggacgaaat

SEQ ID NO: 1118427 - DNA, 22 bp, Artificial Sequence
  chemically synthesized
tctcttaaatttcgtcctcatg

SEQ ID NO: 1118428 - DNA, 22 bp, Artificial Sequence
  chemically synthesized
ctcttaaatttcgtcctcatga

SEQ ID NO: 1118429 - DNA, 22 bp, Artificial Sequence
  chemically synthesized
tcttaaatttcgtcctcatgaa

SEQ ID NO: 1118430 - DNA, 22 bp, Artificial Sequence
  chemically synthesized
ttaaatttcgtcctcatgaagt

SEQ ID NO: 1118431 - DNA, 22 bp, Artificial Sequence
  chemically synthesized
aaatttcgtcctcatgaagtca

SEQ ID NO: 1118432 - DNA, 22 bp, Artificial Sequence
  chemically synthesized
aatttcgtcctcatgaagtcat

SEQ ID NO: 1118433 - DNA, 22 bp, Artificial Sequence
  chemically synthesized
cgtcctcatgaagtcatccagc

SEQ ID NO: 1118434 - DNA, 22 bp, Artificial Sequence
  chemically synthesized
gtcctcatgaagtcatccagct

SEQ ID NO: 1118435 - DNA, 22 bp, Artificial Sequence
  chemically synthesized
atgaagtcatccagcttttctg

SEQ ID NO: 1118436 - DNA, 22 bp, Artificial Sequence
  chemically synthesized
tagaaaaacacacatacagaaa

SEQ ID NO: 1118437 - DNA, 22 bp, Artificial Sequence
  chemically synthesized
tatagaaaaacacacatacaga

SEQ ID NO: 1118438 - DNA, 22 bp, Artificial Sequence
  chemically synthesized
ttctgtatgtgtgtttttctat

SEQ ID NO: 1118439 - DNA, 22 bp, Artificial Sequence
  chemically synthesized
tctgtatgtgtgtttttctata

SEQ ID NO: 1118440 - DNA, 22 bp, Artificial Sequence
  chemically synthesized
ctgtatgtgtgtttttctatag

SEQ ID NO: 1118441 - DNA, 22 bp, Artificial Sequence
  chemically synthesized
tgtatgtgtgtttttctataga

SEQ ID NO: 1118442 - DNA, 22 bp, Artificial Sequence
  chemically synthesized
tatgtgtgtttttctatagagc

SEQ ID NO: 1118443 - DNA, 22 bp, Artificial Sequence
  chemically synthesized
ttctatagagctgtttatcata

SEQ ID NO: 1118444 - DNA, 22 bp, Artificial Sequence
  chemically synthesized
tctatagagctgtttatcatat

SEQ ID NO: 1118445 - DNA, 22 bp, Artificial Sequence
  chemically synthesized
ctatagagctgtttatcatata

SEQ ID NO: 1118446 - DNA, 22 bp, Artificial Sequence
  chemically synthesized
tatagagctgtttatcatatat

SEQ ID NO: 1118447 - DNA, 22 bp, Artificial Sequence
  chemically synthesized
tagagctgtttatcatatatgt

SEQ ID NO: 1118448 - DNA, 22 bp, Artificial Sequence
  chemically synthesized
tttatcatatatgtgtctacat

SEQ ID NO: 1118449 - DNA, 22 bp, Artificial Sequence
  chemically synthesized
aaaatgtatatgcatgtagaca

SEQ ID NO: 1118450 - DNA, 22 bp, Artificial Sequence
  chemically synthesized
atcatatatgtgtctacatgca

SEQ ID NO: 1118451 - DNA, 22 bp, Artificial Sequence
  chemically synthesized
tcatatatgtgtctacatgcat

SEQ ID NO: 1118452 - DNA, 22 bp, Artificial Sequence
  chemically synthesized
aagattaaaaatgtatatgcat

SEQ ID NO: 1118453 - DNA, 22 bp, Artificial Sequence
  chemically synthesized
caagattaaaaatgtatatgca

SEQ ID NO: 1118454 - DNA, 22 bp, Artificial Sequence
  chemically synthesized
tcaagattaaaaatgtatatgc

SEQ ID NO: 1118455 - DNA, 22 bp, Artificial Sequence
  chemically synthesized
catgcatatacatttttaatct

SEQ ID NO: 1118456 - DNA, 22 bp, Artificial Sequence
  chemically synthesized
tgaaatatagatcctttcaaga

SEQ ID NO: 1118457 - DNA, 22 bp, Artificial Sequence
  chemically synthesized
tatgttatgaaatatagatcct

SEQ ID NO: 1118458 - DNA, 22 bp, Artificial Sequence
  chemically synthesized
ttaatcttgaaaggatctatat

SEQ ID NO: 1118459 - DNA, 22 bp, Artificial Sequence
  chemically synthesized
taatcttgaaaggatctatatt

SEQ ID NO: 1118460 - DNA, 22 bp, Artificial Sequence
  chemically synthesized
aatcttgaaaggatctatattt

SEQ ID NO: 1118461 - DNA, 22 bp, Artificial Sequence
  chemically synthesized
atcttgaaaggatctatatttc

SEQ ID NO: 1118462 - DNA, 22 bp, Artificial Sequence
  chemically synthesized
aaaactgtatgttatgaaatat

SEQ ID NO: 1118463 - DNA, 22 bp, Artificial Sequence
  chemically synthesized
aaaaactgtatgttatgaaata

SEQ ID NO: 1118464 - DNA, 22 bp, Artificial Sequence
  chemically synthesized
gaaaggatctatatttcataac

SEQ ID NO: 1118465 - DNA, 22 bp, Artificial Sequence
  chemically synthesized
aaaggatctatatttcataaca

SEQ ID NO: 1118466 - DNA, 22 bp, Artificial Sequence
  chemically synthesized
tatttcataacatacagttttt

SEQ ID NO: 1118467 - DNA, 22 bp, Artificial Sequence
  chemically synthesized
atagcataatttaaaaactgta

SEQ ID NO: 1118468 - DNA, 22 bp, Artificial Sequence
  chemically synthesized
cataacatacagtttttaaatt

SEQ ID NO: 1118469 - DNA, 22 bp, Artificial Sequence
  chemically synthesized
ataacatacagtttttaaatta

SEQ ID NO: 1118470 - DNA, 22 bp, Artificial Sequence
  chemically synthesized
tatgttaatagcataatttaaa

SEQ ID NO: 1118471 - DNA, 22 bp, Artificial Sequence
  chemically synthesized
tatatgttaatagcataattta

SEQ ID NO: 1118472 - DNA, 22 bp, Artificial Sequence
  chemically synthesized
gtattctatatgttaatagcat

SEQ ID NO: 1118473 - DNA, 22 bp, Artificial Sequence
  chemically synthesized
agtattctatatgttaatagca

SEQ ID NO: 1118474 - DNA, 22 bp, Artificial Sequence
  chemically synthesized
ttaaattatgctattaacatat

SEQ ID NO: 1118475 - DNA, 22 bp, Artificial Sequence
  chemically synthesized
taaattatgctattaacatata

SEQ ID NO: 1118476 - DNA, 22 bp, Artificial Sequence
  chemically synthesized
aaattatgctattaacatatag

SEQ ID NO: 1118477 - DNA, 22 bp, Artificial Sequence
  chemically synthesized
aattatgctattaacatataga

SEQ ID NO: 1118478 - DNA, 22 bp, Artificial Sequence
  chemically synthesized
tgctattaacatatagaatact

SEQ ID NO: 1118479 - DNA, 22 bp, Artificial Sequence
  chemically synthesized
agtaaagtatttagtattctat

SEQ ID NO: 1118480 - DNA, 22 bp, Artificial Sequence
  chemically synthesized
ttaacatatagaatactaaata

SEQ ID NO: 1118481 - DNA, 22 bp, Artificial Sequence
  chemically synthesized
acatatagaatactaaatactt

SEQ ID NO: 1118482 - DNA, 22 bp, Artificial Sequence
  chemically synthesized
agcatatattgagtaaagtatt

SEQ ID NO: 1118483 - DNA, 22 bp, Artificial Sequence
  chemically synthesized
aatactttactcaatatatgct

SEQ ID NO: 1118484 - DNA, 22 bp, Artificial Sequence
  chemically synthesized
tactcaatatatgcttaatata

SEQ ID NO: 1118485 - DNA, 22 bp, Artificial Sequence
  chemically synthesized
aacatgtgatcatatattaagc

SEQ ID NO: 1118486 - DNA, 22 bp, Artificial Sequence
  chemically synthesized
actcaatatatgcttaatatat

SEQ ID NO: 1118487 - DNA, 22 bp, Artificial Sequence
  chemically synthesized
ctcaatatatgcttaatatatg

SEQ ID NO: 1118488 - DNA, 22 bp, Artificial Sequence
  chemically synthesized
taaacatgtgatcatatattaa

SEQ ID NO: 1118489 - DNA, 22 bp, Artificial Sequence
  chemically synthesized
ctaaacatgtgatcatatatta

SEQ ID NO: 1118490 - DNA, 22 bp, Artificial Sequence
  chemically synthesized
aatatatgcttaatatatgatc

SEQ ID NO: 1118491 - DNA, 22 bp, Artificial Sequence
  chemically synthesized
aatatatgatcacatgtttaga

SEQ ID NO: 1118492 - DNA, 22 bp, Artificial Sequence
  chemically synthesized
atatatgatcacatgtttagaa

SEQ ID NO: 1118493 - DNA, 22 bp, Artificial Sequence
  chemically synthesized
gaatccgagtagtggcttctaa

SEQ ID NO: 1118494 - DNA, 22 bp, Artificial Sequence
  chemically synthesized
agaatccgagtagtggcttcta

SEQ ID NO: 1118495 - DNA, 22 bp, Artificial Sequence
  chemically synthesized
aataatttagaatccgagtagt

SEQ ID NO: 1118496 - DNA, 22 bp, Artificial Sequence
  chemically synthesized
agaagccactactcggattcta

SEQ ID NO: 1118497 - DNA, 22 bp, Artificial Sequence
  chemically synthesized
gaagccactactcggattctaa

SEQ ID NO: 1118498 - DNA, 22 bp, Artificial Sequence
  chemically synthesized
tgtgtactaaataatttagaat

SEQ ID NO: 1118499 - DNA, 22 bp, Artificial Sequence
  chemically synthesized
aaattatgtgtactaaataatt

SEQ ID NO: 1118500 - DNA, 22 bp, Artificial Sequence
  chemically synthesized
ctcggattctaaattatttagt

SEQ ID NO: 1118501 - DNA, 22 bp, Artificial Sequence
  chemically synthesized
gaaattatgtgtactaaataat

SEQ ID NO: 1118502 - DNA, 22 bp, Artificial Sequence
  chemically synthesized
ggattctaaattatttagtaca

SEQ ID NO: 1118503 - DNA, 22 bp, Artificial Sequence
  chemically synthesized
cttgaaattatgtgtactaaat

SEQ ID NO: 1118504 - DNA, 22 bp, Artificial Sequence
  chemically synthesized
acttgaaattatgtgtactaaa

SEQ ID NO: 1118505 - DNA, 22 bp, Artificial Sequence
  chemically synthesized
tacttgaaattatgtgtactaa

SEQ ID NO: 1118506 - DNA, 22 bp, Artificial Sequence
  chemically synthesized
taaattatttagtacacataat

SEQ ID NO: 1118507 - DNA, 22 bp, Artificial Sequence
  chemically synthesized
aattatttagtacacataattt

SEQ ID NO: 1118508 - DNA, 22 bp, Artificial Sequence
  chemically synthesized
tatactttacttgaaattatgt

SEQ ID NO: 1118509 - DNA, 22 bp, Artificial Sequence
  chemically synthesized
tgtatactttacttgaaattat

SEQ ID NO: 1118510 - DNA, 22 bp, Artificial Sequence
  chemically synthesized
ctgtatactttacttgaaatta

SEQ ID NO: 1118511 - DNA, 22 bp, Artificial Sequence
  chemically synthesized
tttagtacacataatttcaagt

SEQ ID NO: 1118512 - DNA, 22 bp, Artificial Sequence
  chemically synthesized
agtacacataatttcaagtaaa

SEQ ID NO: 1118513 - DNA, 22 bp, Artificial Sequence
  chemically synthesized
gcttctgtatactttacttgaa

SEQ ID NO: 1118514 - DNA, 22 bp, Artificial Sequence
  chemically synthesized
gtacacataatttcaagtaaag

SEQ ID NO: 1118515 - DNA, 22 bp, Artificial Sequence
  chemically synthesized
agcttctgtatactttacttga

SEQ ID NO: 1118516 - DNA, 22 bp, Artificial Sequence
  chemically synthesized
tagcttctgtatactttacttg

SEQ ID NO: 1118517 - DNA, 22 bp, Artificial Sequence
  chemically synthesized
ttagcttctgtatactttactt

SEQ ID NO: 1118518 - DNA, 22 bp, Artificial Sequence
  chemically synthesized
tttagcttctgtatactttact

SEQ ID NO: 1118519 - DNA, 22 bp, Artificial Sequence
  chemically synthesized
ttttagcttctgtatactttac

SEQ ID NO: 1118520 - DNA, 22 bp, Artificial Sequence
  chemically synthesized
atgccttttttagcttctgtat

SEQ ID NO: 1118521 - DNA, 22 bp, Artificial Sequence
  chemically synthesized
caagtaaagtatacagaagcta

SEQ ID NO: 1118522 - DNA, 22 bp, Artificial Sequence
  chemically synthesized
aagtaaagtatacagaagctaa

SEQ ID NO: 1118523 - DNA, 22 bp, Artificial Sequence
  chemically synthesized
ctgatgccttttttagcttctg

SEQ ID NO: 1118524 - DNA, 22 bp, Artificial Sequence
  chemically synthesized
actgatgccttttttagcttct

SEQ ID NO: 1118525 - DNA, 22 bp, Artificial Sequence
  chemically synthesized
atttactgatgccttttttagc

SEQ ID NO: 1118526 - DNA, 22 bp, Artificial Sequence
  chemically synthesized
atacattgatttactgatgcct

SEQ ID NO: 1118527 - DNA, 22 bp, Artificial Sequence
  chemically synthesized
tgatacattgatttactgatgc

SEQ ID NO: 1118528 - DNA, 22 bp, Artificial Sequence
  chemically synthesized
ctgatacattgatttactgatg

SEQ ID NO: 1118529 - DNA, 22 bp, Artificial Sequence
  chemically synthesized
atttctgatacattgatttact

SEQ ID NO: 1118530 - DNA, 22 bp, Artificial Sequence
  chemically synthesized
aaaaaggcatcagtaaatcaat

SEQ ID NO: 1118531 - DNA, 22 bp, Artificial Sequence
  chemically synthesized
atgagcccacaataatcactca

SEQ ID NO: 1118532 - DNA, 22 bp, Artificial Sequence
  chemically synthesized
catgagcccacaataatcactc

SEQ ID NO: 1118533 - DNA, 22 bp, Artificial Sequence
  chemically synthesized
tcatgagcccacaataatcact

SEQ ID NO: 1118534 - DNA, 22 bp, Artificial Sequence
  chemically synthesized
agaattttcatgagcccacaat

SEQ ID NO: 1118535 - DNA, 22 bp, Artificial Sequence
  chemically synthesized
taagaattttcatgagcccaca

SEQ ID NO: 1118536 - DNA, 22 bp, Artificial Sequence
  chemically synthesized
atgatctctaagaattttcatg

SEQ ID NO: 1118537 - DNA, 22 bp, Artificial Sequence
  chemically synthesized
catgatctctaagaattttcat

SEQ ID NO: 1118538 - DNA, 22 bp, Artificial Sequence
  chemically synthesized
ttgtgggctcatgaaaattctt

SEQ ID NO: 1118539 - DNA, 22 bp, Artificial Sequence
  chemically synthesized
ttcatgatctctaagaattttc

SEQ ID NO: 1118540 - DNA, 22 bp, Artificial Sequence
  chemically synthesized
tgggctcatgaaaattcttaga

SEQ ID NO: 1118541 - DNA, 22 bp, Artificial Sequence
  chemically synthesized
taattcttcatgatctctaaga

SEQ ID NO: 1118542 - DNA, 22 bp, Artificial Sequence
  chemically synthesized
ataattcttcatgatctctaag

SEQ ID NO: 1118543 - DNA, 22 bp, Artificial Sequence
  chemically synthesized
atgaaaattcttagagatcatg

SEQ ID NO: 1118544 - DNA, 22 bp, Artificial Sequence
  chemically synthesized
gtatttataattcttcatgatc

SEQ ID NO: 1118545 - DNA, 22 bp, Artificial Sequence
  chemically synthesized
agtatttataattcttcatgat

SEQ ID NO: 1118546 - DNA, 22 bp, Artificial Sequence
  chemically synthesized
tagtatttataattcttcatga

SEQ ID NO: 1118547 - DNA, 22 bp, Artificial Sequence
  chemically synthesized
ttagagatcatgaagaattata

SEQ ID NO: 1118548 - DNA, 22 bp, Artificial Sequence
  chemically synthesized
agagatcatgaagaattataaa

SEQ ID NO: 1118549 - DNA, 22 bp, Artificial Sequence
  chemically synthesized
cccattttagtatttataattc

SEQ ID NO: 1118550 - DNA, 22 bp, Artificial Sequence
  chemically synthesized
gagatcatgaagaattataaat

SEQ ID NO: 1118551 - DNA, 22 bp, Artificial Sequence
  chemically synthesized
ggttacccattttagtatttat

SEQ ID NO: 1118552 - DNA, 22 bp, Artificial Sequence
  chemically synthesized
aggttacccattttagtattta

SEQ ID NO: 1118553 - DNA, 22 bp, Artificial Sequence
  chemically synthesized
catttaggttacccattttagt

SEQ ID NO: 1118554 - DNA, 22 bp, Artificial Sequence
  chemically synthesized
gcatttaggttacccattttag

SEQ ID NO: 1118555 - DNA, 22 bp, Artificial Sequence
  chemically synthesized
tgcatttaggttacccatttta

SEQ ID NO: 1118556 - DNA, 22 bp, Artificial Sequence
  chemically synthesized
ttttgcatttaggttacccatt

SEQ ID NO: 1118557 - DNA, 22 bp, Artificial Sequence
  chemically synthesized
attttgcatttaggttacccat

SEQ ID NO: 1118558 - DNA, 22 bp, Artificial Sequence
  chemically synthesized
taaatactaaaatgggtaacct

SEQ ID NO: 1118559 - DNA, 22 bp, Artificial Sequence
  chemically synthesized
tattttgcatttaggttaccca

SEQ ID NO: 1118560 - DNA, 22 bp, Artificial Sequence
  chemically synthesized
ttattttgcatttaggttaccc

SEQ ID NO: 1118561 - DNA, 22 bp, Artificial Sequence
  chemically synthesized
ccttttattttgcatttaggtt

SEQ ID NO: 1118562 - DNA, 22 bp, Artificial Sequence
  chemically synthesized
aaatgggtaacctaaatgcaaa

SEQ ID NO: 1118563 - DNA, 22 bp, Artificial Sequence
  chemically synthesized
gttgccttttattttgcattta

SEQ ID NO: 1118564 - DNA, 22 bp, Artificial Sequence
  chemically synthesized
agttgccttttattttgcattt

SEQ ID NO: 1118565 - DNA, 22 bp, Artificial Sequence
  chemically synthesized
tataacttagttgccttttatt

SEQ ID NO: 1118566 - DNA, 22 bp, Artificial Sequence
  chemically synthesized
aatgcaaaataaaaggcaacta

SEQ ID NO: 1118567 - DNA, 22 bp, Artificial Sequence
  chemically synthesized
aatattatataacttagttgcc

SEQ ID NO: 1118568 - DNA, 22 bp, Artificial Sequence
  chemically synthesized
ttgaatattatataacttagtt

SEQ ID NO: 1118569 - DNA, 22 bp, Artificial Sequence
  chemically synthesized
attgaatattatataacttagt

SEQ ID NO: 1118570 - DNA, 22 bp, Artificial Sequence
  chemically synthesized
tattgaatattatataacttag

SEQ ID NO: 1118571 - DNA, 22 bp, Artificial Sequence
  chemically synthesized
ttattgaatattatataactta

SEQ ID NO: 1118572 - DNA, 22 bp, Artificial Sequence
  chemically synthesized
cttttattgaatattatataac

SEQ ID NO: 1118573 - DNA, 22 bp, Artificial Sequence
  chemically synthesized
ccttttattgaatattatataa

SEQ ID NO: 1118574 - DNA, 22 bp, Artificial Sequence
  chemically synthesized
ttccttttattgaatattatat

SEQ ID NO: 1118575 - DNA, 22 bp, Artificial Sequence
  chemically synthesized
cttccttttattgaatattata

SEQ ID NO: 1118576 - DNA, 22 bp, Artificial Sequence
  chemically synthesized
tcttccttttattgaatattat

SEQ ID NO: 1118577 - DNA, 22 bp, Artificial Sequence
  chemically synthesized
ttcttccttttattgaatatta

SEQ ID NO: 1118578 - DNA, 22 bp, Artificial Sequence
  chemically synthesized
cttttcttccttttattgaata

SEQ ID NO: 1118579 - DNA, 22 bp, Artificial Sequence
  chemically synthesized
acttttcttccttttattgaat

SEQ ID NO: 1118580 - DNA, 22 bp, Artificial Sequence
  chemically synthesized
agttatataatattcaataaaa

SEQ ID NO: 1118581 - DNA, 22 bp, Artificial Sequence
  chemically synthesized
tacttttcttccttttattgaa

SEQ ID NO: 1118582 - DNA, 22 bp, Artificial Sequence
  chemically synthesized
ttttacttttcttccttttatt

SEQ ID NO: 1118583 - DNA, 22 bp, Artificial Sequence
  chemically synthesized
tataatattcaataaaaggaag

SEQ ID NO: 1118584 - DNA, 22 bp, Artificial Sequence
  chemically synthesized
aaattattttacttttcttcct

SEQ ID NO: 1118585 - DNA, 22 bp, Artificial Sequence
  chemically synthesized
caaattattttacttttcttcc

SEQ ID NO: 1118586 - DNA, 22 bp, Artificial Sequence
  chemically synthesized
cttcaaattattttacttttct

SEQ ID NO: 1118587 - DNA, 22 bp, Artificial Sequence
  chemically synthesized
gcttcaaattattttacttttc

SEQ ID NO: 1118588 - DNA, 22 bp, Artificial Sequence
  chemically synthesized
aataaaaggaagaaaagtaaaa

SEQ ID NO: 1118589 - DNA, 22 bp, Artificial Sequence
  chemically synthesized
tgcttcaaattattttactttt

SEQ ID NO: 1118590 - DNA, 22 bp, Artificial Sequence
  chemically synthesized
tttgcttcaaattattttactt

SEQ ID NO: 1118591 - DNA, 22 bp, Artificial Sequence
  chemically synthesized
tattctttgcttcaaattattt

SEQ ID NO: 1118592 - DNA, 22 bp, Artificial Sequence
  chemically synthesized
tgttgtattctttgcttcaaat

SEQ ID NO: 1118593 - DNA, 22 bp, Artificial Sequence
  chemically synthesized
cctgtgttgtattctttgcttc

SEQ ID NO: 1118594 - DNA, 22 bp, Artificial Sequence
  chemically synthesized
ccctgtgttgtattctttgctt

SEQ ID NO: 1118595 - DNA, 22 bp, Artificial Sequence
  chemically synthesized
tgaacttccctgtgttgtattc

SEQ ID NO: 1118596 - DNA, 22 bp, Artificial Sequence
  chemically synthesized
gtgaacttccctgtgttgtatt

SEQ ID NO: 1118597 - DNA, 22 bp, Artificial Sequence
  chemically synthesized
gaagcaaagaatacaacacagg

SEQ ID NO: 1118598 - DNA, 22 bp, Artificial Sequence
  chemically synthesized
aagcaaagaatacaacacaggg

SEQ ID NO: 1118599 - DNA, 22 bp, Artificial Sequence
  chemically synthesized
aggaatttgtgaacttccctgt

SEQ ID NO: 1118600 - DNA, 22 bp, Artificial Sequence
  chemically synthesized
ttgaggaatttgtgaacttccc

SEQ ID NO: 1118601 - DNA, 22 bp, Artificial Sequence
  chemically synthesized
attgaggaatttgtgaacttcc

SEQ ID NO: 1118602 - DNA, 22 bp, Artificial Sequence
  chemically synthesized
atcaacttattgaggaatttgt

SEQ ID NO: 1118603 - DNA, 22 bp, Artificial Sequence
  chemically synthesized
aatcaacttattgaggaatttg

SEQ ID NO: 1118604 - DNA, 22 bp, Artificial Sequence
  chemically synthesized
taatcaacttattgaggaattt

SEQ ID NO: 1118605 - DNA, 22 bp, Artificial Sequence
  chemically synthesized
acaaattcctcaataagttgat

SEQ ID NO: 1118606 - DNA, 22 bp, Artificial Sequence
  chemically synthesized
aaagaggttttaatcaacttat

SEQ ID NO: 1118607 - DNA, 22 bp, Artificial Sequence
  chemically synthesized
ctcaataagttgattaaaacct

SEQ ID NO: 1118608 - DNA, 22 bp, Artificial Sequence
  chemically synthesized
aataagttgattaaaacctctt

SEQ ID NO: 1118609 - DNA, 22 bp, Artificial Sequence
  chemically synthesized
attaaaacctctttcagacctc

SEQ ID NO: 1118610 - DNA, 22 bp, Artificial Sequence
  chemically synthesized
aaacctctttcagacctctgtt

SEQ ID NO: 1118611 - DNA, 22 bp, Artificial Sequence
  chemically synthesized
ataaagaaggaggaacagaggt

SEQ ID NO: 1118612 - DNA, 22 bp, Artificial Sequence
  chemically synthesized
tttcagacctctgttcctcctt

SEQ ID NO: 1118613 - DNA, 22 bp, Artificial Sequence
  chemically synthesized
tcagacctctgttcctccttct

SEQ ID NO: 1118614 - DNA, 22 bp, Artificial Sequence
  chemically synthesized
cagacctctgttcctccttctt

SEQ ID NO: 1118615 - DNA, 22 bp, Artificial Sequence
  chemically synthesized
agacctctgttcctccttcttt

SEQ ID NO: 1118616 - DNA, 22 bp, Artificial Sequence
  chemically synthesized
agaggtgctaataaagaaggag

SEQ ID NO: 1118617 - DNA, 22 bp, Artificial Sequence
  chemically synthesized
aagaggtgctaataaagaagga

SEQ ID NO: 1118618 - DNA, 22 bp, Artificial Sequence
  chemically synthesized
taagaggtgctaataaagaagg

SEQ ID NO: 1118619 - DNA, 22 bp, Artificial Sequence
  chemically synthesized
ttaagaggtgctaataaagaag

SEQ ID NO: 1118620 - DNA, 22 bp, Artificial Sequence
  chemically synthesized
tgttcctccttctttattagca

SEQ ID NO: 1118621 - DNA, 22 bp, Artificial Sequence
  chemically synthesized
ttcctccttctttattagcacc

SEQ ID NO: 1118622 - DNA, 22 bp, Artificial Sequence
  chemically synthesized
ctccttctttattagcacctct

SEQ ID NO: 1118623 - DNA, 22 bp, Artificial Sequence
  chemically synthesized
cttctttattagcacctcttaa

SEQ ID NO: 1118624 - DNA, 22 bp, Artificial Sequence
  chemically synthesized
ctttattagcacctcttaaaag

SEQ ID NO: 1118625 - DNA, 22 bp, Artificial Sequence
  chemically synthesized
tttattagcacctcttaaaagc

SEQ ID NO: 1118626 - DNA, 22 bp, Artificial Sequence
  chemically synthesized
tattagcacctcttaaaagcct

SEQ ID NO: 1118627 - DNA, 22 bp, Artificial Sequence
  chemically synthesized
attagcacctcttaaaagcctc

SEQ ID NO: 1118628 - DNA, 22 bp, Artificial Sequence
  chemically synthesized
ttagcacctcttaaaagcctcc

SEQ ID NO: 1118629 - DNA, 22 bp, Artificial Sequence
  chemically synthesized
gcacctcttaaaagcctcctct

SEQ ID NO: 1118630 - DNA, 22 bp, Artificial Sequence
  chemically synthesized
gagaagatacagaaagaggagg

SEQ ID NO: 1118631 - DNA, 22 bp, Artificial Sequence
  chemically synthesized
ttaaaagcctcctctttctgta

SEQ ID NO: 1118632 - DNA, 22 bp, Artificial Sequence
  chemically synthesized
aaaagcctcctctttctgtatc

SEQ ID NO: 1118633 - DNA, 22 bp, Artificial Sequence
  chemically synthesized
aaagcctcctctttctgtatct

SEQ ID NO: 1118634 - DNA, 22 bp, Artificial Sequence
  chemically synthesized
ataatgttagagaagatacaga

SEQ ID NO: 1118635 - DNA, 22 bp, Artificial Sequence
  chemically synthesized
cataatgttagagaagatacag

SEQ ID NO: 1118636 - DNA, 22 bp, Artificial Sequence
  chemically synthesized
tcataatgttagagaagataca

SEQ ID NO: 1118637 - DNA, 22 bp, Artificial Sequence
  chemically synthesized
ttttcataatgttagagaagat

SEQ ID NO: 1118638 - DNA, 22 bp, Artificial Sequence
  chemically synthesized
attttcataatgttagagaaga

SEQ ID NO: 1118639 - DNA, 22 bp, Artificial Sequence
  chemically synthesized
ctctttctgtatcttctctaac

SEQ ID NO: 1118640 - DNA, 22 bp, Artificial Sequence
  chemically synthesized
tttctgtatcttctctaacatt

SEQ ID NO: 1118641 - DNA, 22 bp, Artificial Sequence
  chemically synthesized
tctgtatcttctctaacattat

SEQ ID NO: 1118642 - DNA, 22 bp, Artificial Sequence
  chemically synthesized
ctgtatcttctctaacattatg

SEQ ID NO: 1118643 - DNA, 22 bp, Artificial Sequence
  chemically synthesized
tgtatcttctctaacattatga

SEQ ID NO: 1118644 - DNA, 22 bp, Artificial Sequence
  chemically synthesized
tatcttctctaacattatgaaa

SEQ ID NO: 1118645 - DNA, 22 bp, Artificial Sequence
  chemically synthesized
ctctaacattatgaaaataagt

SEQ ID NO: 1118646 - DNA, 22 bp, Artificial Sequence
  chemically synthesized
tctaacattatgaaaataagtt

SEQ ID NO: 1118647 - DNA, 22 bp, Artificial Sequence
  chemically synthesized
atagagatccataacttatttt

SEQ ID NO: 1118648 - DNA, 22 bp, Artificial Sequence
  chemically synthesized
taacattatgaaaataagttat

SEQ ID NO: 1118649 - DNA, 22 bp, Artificial Sequence
  chemically synthesized
acattatgaaaataagttatgg

SEQ ID NO: 1118650 - DNA, 22 bp, Artificial Sequence
  chemically synthesized
tgaaaataagttatggatctct

SEQ ID NO: 1118651 - DNA, 22 bp, Artificial Sequence
  chemically synthesized
atgtcggagtaggactgataga

SEQ ID NO: 1118652 - DNA, 22 bp, Artificial Sequence
  chemically synthesized
taatgtcggagtaggactgata

SEQ ID NO: 1118653 - DNA, 22 bp, Artificial Sequence
  chemically synthesized
ctaatgtcggagtaggactgat

SEQ ID NO: 1118654 - DNA, 22 bp, Artificial Sequence
  chemically synthesized
tggatctctatcagtcctactc

SEQ ID NO: 1118655 - DNA, 22 bp, Artificial Sequence
  chemically synthesized
cttctaatgtcggagtaggact

SEQ ID NO: 1118656 - DNA, 22 bp, Artificial Sequence
  chemically synthesized
attacttctaatgtcggagtag

SEQ ID NO: 1118657 - DNA, 22 bp, Artificial Sequence
  chemically synthesized
aattacttctaatgtcggagta

SEQ ID NO: 1118658 - DNA, 22 bp, Artificial Sequence
  chemically synthesized
ttaattacttctaatgtcggag

SEQ ID NO: 1118659 - DNA, 22 bp, Artificial Sequence
  chemically synthesized
tatcagtcctactccgacatta

SEQ ID NO: 1118660 - DNA, 22 bp, Artificial Sequence
  chemically synthesized
tcagtcctactccgacattaga

SEQ ID NO: 1118661 - DNA, 22 bp, Artificial Sequence
  chemically synthesized
ctccgacattagaagtaattaa

SEQ ID NO: 1118662 - DNA, 22 bp, Artificial Sequence
  chemically synthesized
aatgagtagattcttaattact

SEQ ID NO: 1118663 - DNA, 22 bp, Artificial Sequence
  chemically synthesized
cgacattagaagtaattaagaa

SEQ ID NO: 1118664 - DNA, 22 bp, Artificial Sequence
  chemically synthesized
gaagtaattaagaatctactca

SEQ ID NO: 1118665 - DNA, 22 bp, Artificial Sequence
  chemically synthesized
tagaatgttaaatgagtagatt

SEQ ID NO: 1118666 - DNA, 22 bp, Artificial Sequence
  chemically synthesized
attatagaatgttaaatgagta

SEQ ID NO: 1118667 - DNA, 22 bp, Artificial Sequence
  chemically synthesized
cattatagaatgttaaatgagt

SEQ ID NO: 1118668 - DNA, 22 bp, Artificial Sequence
  chemically synthesized
agaatctactcatttaacattc

SEQ ID NO: 1118669 - DNA, 22 bp, Artificial Sequence
  chemically synthesized
ctcatttaacattctataatga

SEQ ID NO: 1118670 - DNA, 22 bp, Artificial Sequence
  chemically synthesized
atttaacattctataatgaagt

SEQ ID NO: 1118671 - DNA, 22 bp, Artificial Sequence
  chemically synthesized
agtcaaagggtaaaacttcatt

SEQ ID NO: 1118672 - DNA, 22 bp, Artificial Sequence
  chemically synthesized
cagtcaaagggtaaaacttcat

SEQ ID NO: 1118673 - DNA, 22 bp, Artificial Sequence
  chemically synthesized
aacattctataatgaagtttta

SEQ ID NO: 1118674 - DNA, 22 bp, Artificial Sequence
  chemically synthesized
acattctataatgaagttttac

SEQ ID NO: 1118675 - DNA, 22 bp, Artificial Sequence
  chemically synthesized
ttcagtcaaagggtaaaacttc

SEQ ID NO: 1118676 - DNA, 22 bp, Artificial Sequence
  chemically synthesized
ctcttcagtcaaagggtaaaac

SEQ ID NO: 1118677 - DNA, 22 bp, Artificial Sequence
  chemically synthesized
tataatgaagttttaccctttg

SEQ ID NO: 1118678 - DNA, 22 bp, Artificial Sequence
  chemically synthesized
taatgaagttttaccctttgac

SEQ ID NO: 1118679 - DNA, 22 bp, Artificial Sequence
  chemically synthesized
agtgaataagttactcttcagt

SEQ ID NO: 1118680 - DNA, 22 bp, Artificial Sequence
  chemically synthesized
gagtgaataagttactcttcag

SEQ ID NO: 1118681 - DNA, 22 bp, Artificial Sequence
  chemically synthesized
taccctttgactgaagagtaac

SEQ ID NO: 1118682 - DNA, 22 bp, Artificial Sequence
  chemically synthesized
accctttgactgaagagtaact

SEQ ID NO: 1118683 - DNA, 22 bp, Artificial Sequence
  chemically synthesized
ccctttgactgaagagtaactt

SEQ ID NO: 1118684 - DNA, 22 bp, Artificial Sequence
  chemically synthesized
tgactgaagagtaacttattca

SEQ ID NO: 1118685 - DNA, 22 bp, Artificial Sequence
  chemically synthesized
gactgaagagtaacttattcac

SEQ ID NO: 1118686 - DNA, 22 bp, Artificial Sequence
  chemically synthesized
actgaagagtaacttattcact

SEQ ID NO: 1118687 - DNA, 22 bp, Artificial Sequence
  chemically synthesized
aataaacatttgagtgaataag

SEQ ID NO: 1118688 - DNA, 22 bp, Artificial Sequence
  chemically synthesized
tgaataaacatttgagtgaata

SEQ ID NO: 1118689 - DNA, 22 bp, Artificial Sequence
  chemically synthesized
ctgaataaacatttgagtgaat

SEQ ID NO: 1118690 - DNA, 22 bp, Artificial Sequence
  chemically synthesized
aagagtaacttattcactcaaa

SEQ ID NO: 1118691 - DNA, 22 bp, Artificial Sequence
  chemically synthesized
attcactcaaatgtttattcag

SEQ ID NO: 1118692 - DNA, 22 bp, Artificial Sequence
  chemically synthesized
ttcactcaaatgtttattcaga

SEQ ID NO: 1118693 - DNA, 22 bp, Artificial Sequence
  chemically synthesized
actcaaatgtttattcagaagt

SEQ ID NO: 1118694 - DNA, 22 bp, Artificial Sequence
  chemically synthesized
aaatgtttattcagaagttgtt

SEQ ID NO: 1118695 - DNA, 22 bp, Artificial Sequence
  chemically synthesized
ccaatatgaaggatagaacaac

SEQ ID NO: 1118696 - DNA, 22 bp, Artificial Sequence
  chemically synthesized
ttaccaatatgaaggatagaac

SEQ ID NO: 1118697 - DNA, 22 bp, Artificial Sequence
  chemically synthesized
attcagaagttgttctatcctt

SEQ ID NO: 1118698 - DNA, 22 bp, Artificial Sequence
  chemically synthesized
ttcagaagttgttctatccttc

SEQ ID NO: 1118699 - DNA, 22 bp, Artificial Sequence
  chemically synthesized
agaagttgttctatccttcata

SEQ ID NO: 1118700 - DNA, 22 bp, Artificial Sequence
  chemically synthesized
agataggatctattaccaatat

SEQ ID NO: 1118701 - DNA, 22 bp, Artificial Sequence
  chemically synthesized
ttctatccttcatattggtaat

SEQ ID NO: 1118702 - DNA, 22 bp, Artificial Sequence
  chemically synthesized
aagataggatctattaccaata

SEQ ID NO: 1118703 - DNA, 22 bp, Artificial Sequence
  chemically synthesized
tatccttcatattggtaataga

SEQ ID NO: 1118704 - DNA, 22 bp, Artificial Sequence
  chemically synthesized
tccttcatattggtaatagatc

SEQ ID NO: 1118705 - DNA, 22 bp, Artificial Sequence
  chemically synthesized
catttaagataggatctattac

SEQ ID NO: 1118706 - DNA, 22 bp, Artificial Sequence
  chemically synthesized
catattggtaatagatcctatc

SEQ ID NO: 1118707 - DNA, 22 bp, Artificial Sequence
  chemically synthesized
atattggtaatagatcctatct

SEQ ID NO: 1118708 - DNA, 22 bp, Artificial Sequence
  chemically synthesized
cagttgcatttaagataggatc

SEQ ID NO: 1118709 - DNA, 22 bp, Artificial Sequence
  chemically synthesized
tgcagttgcatttaagatagga

SEQ ID NO: 1118710 - DNA, 22 bp, Artificial Sequence
  chemically synthesized
gtaatagatcctatcttaaatg

SEQ ID NO: 1118711 - DNA, 22 bp, Artificial Sequence
  chemically synthesized
agttctgcagttgcatttaaga

SEQ ID NO: 1118712 - DNA, 22 bp, Artificial Sequence
  chemically synthesized
cagttctgcagttgcatttaag

SEQ ID NO: 1118713 - DNA, 22 bp, Artificial Sequence
  chemically synthesized
tcagttctgcagttgcatttaa

SEQ ID NO: 1118714 - DNA, 22 bp, Artificial Sequence
  chemically synthesized
ttcagttctgcagttgcattta

SEQ ID NO: 1118715 - DNA, 22 bp, Artificial Sequence
  chemically synthesized
tttcagttctgcagttgcattt

SEQ ID NO: 1118716 - DNA, 22 bp, Artificial Sequence
  chemically synthesized
ttttcagttctgcagttgcatt

SEQ ID NO: 1118717 - DNA, 22 bp, Artificial Sequence
  chemically synthesized
tcttaaatgcaactgcagaact

SEQ ID NO: 1118718 - DNA, 22 bp, Artificial Sequence
  chemically synthesized
aaatgcaactgcagaactgaaa

SEQ ID NO: 1118719 - DNA, 22 bp, Artificial Sequence
  chemically synthesized
aatgcaactgcagaactgaaaa

SEQ ID NO: 1118720 - DNA, 22 bp, Artificial Sequence
  chemically synthesized
tatggatatgtgatttttttca

SEQ ID NO: 1118721 - DNA, 22 bp, Artificial Sequence
  chemically synthesized
actatatggatatgtgattttt

SEQ ID NO: 1118722 - DNA, 22 bp, Artificial Sequence
  chemically synthesized
aactatatggatatgtgatttt

SEQ ID NO: 1118723 - DNA, 22 bp, Artificial Sequence
  chemically synthesized
cagaactgaaaaaaatcacata

SEQ ID NO: 1118724 - DNA, 22 bp, Artificial Sequence
  chemically synthesized
aaaaaaatcacatatccatata

SEQ ID NO: 1118725 - DNA, 22 bp, Artificial Sequence
  chemically synthesized
acacacaaaccaataaatgttt

SEQ ID NO: 1118726 - DNA, 22 bp, Artificial Sequence
  chemically synthesized
aacatttattggtttgtgtgtt

SEQ ID NO: 1118727 - DNA, 22 bp, Artificial Sequence
  chemically synthesized
gtgtccccatgcctaacacaca

SEQ ID NO: 1118728 - DNA, 22 bp, Artificial Sequence
  chemically synthesized
ggtgtccccatgcctaacacac

SEQ ID NO: 1118729 - DNA, 22 bp, Artificial Sequence
  chemically synthesized
tggtgtccccatgcctaacaca

SEQ ID NO: 1118730 - DNA, 22 bp, Artificial Sequence
  chemically synthesized
ttggtgtccccatgcctaacac

SEQ ID NO: 1118731 - DNA, 22 bp, Artificial Sequence
  chemically synthesized
attggtttgtgtgttaggcatg

SEQ ID NO: 1118732 - DNA, 22 bp, Artificial Sequence
  chemically synthesized
ttggtttgtgtgttaggcatgg

SEQ ID NO: 1118733 - DNA, 22 bp, Artificial Sequence
  chemically synthesized
tttttggtgtccccatgcctaa

SEQ ID NO: 1118734 - DNA, 22 bp, Artificial Sequence
  chemically synthesized
gtttttggtgtccccatgccta

SEQ ID NO: 1118735 - DNA, 22 bp, Artificial Sequence
  chemically synthesized
tgtttttggtgtccccatgcct

SEQ ID NO: 1118736 - DNA, 22 bp, Artificial Sequence
  chemically synthesized
gtttgtgtgttaggcatgggga

SEQ ID NO: 1118737 - DNA, 22 bp, Artificial Sequence
  chemically synthesized
gtgtgttaggcatggggacacc

SEQ ID NO: 1118738 - DNA, 22 bp, Artificial Sequence
  chemically synthesized
tgtgttaggcatggggacacca

SEQ ID NO: 1118739 - DNA, 22 bp, Artificial Sequence
  chemically synthesized
ggcatggggacaccaaaaacaa

SEQ ID NO: 1118740 - DNA, 22 bp, Artificial Sequence
  chemically synthesized
tgtgtgtgtgttttgtttttgg

SEQ ID NO: 1118741 - DNA, 22 bp, Artificial Sequence
  chemically synthesized
atgtgtgtgtgttttgtttttg

SEQ ID NO: 1118742 - DNA, 22 bp, Artificial Sequence
  chemically synthesized
tatgtgtgtgtgttttgttttt

SEQ ID NO: 1118743 - DNA, 22 bp, Artificial Sequence
  chemically synthesized
gttttatgtgtgtgtgttttgt

SEQ ID NO: 1118744 - DNA, 22 bp, Artificial Sequence
  chemically synthesized
ggttttatgtgtgtgtgttttg

SEQ ID NO: 1118745 - DNA, 22 bp, Artificial Sequence
  chemically synthesized
tggttttatgtgtgtgtgtttt

SEQ ID NO: 1118746 - DNA, 22 bp, Artificial Sequence
  chemically synthesized
aacgtgaagtggctttggtttt

SEQ ID NO: 1118747 - DNA, 22 bp, Artificial Sequence
  chemically synthesized
gaacgtgaagtggctttggttt

SEQ ID NO: 1118748 - DNA, 22 bp, Artificial Sequence
  chemically synthesized
gaaatcaggacttgaacgtgaa

SEQ ID NO: 1118749 - DNA, 22 bp, Artificial Sequence
  chemically synthesized
tagaaatcaggacttgaacgtg

SEQ ID NO: 1118750 - DNA, 22 bp, Artificial Sequence
  chemically synthesized
ctagaaatcaggacttgaacgt

SEQ ID NO: 1118751 - DNA, 22 bp, Artificial Sequence
  chemically synthesized
gtttctagaaatcaggacttga

SEQ ID NO: 1118752 - DNA, 22 bp, Artificial Sequence
  chemically synthesized
ttggtttctagaaatcaggact

SEQ ID NO: 1118753 - DNA, 22 bp, Artificial Sequence
  chemically synthesized
cacgttcaagtcctgatttcta

SEQ ID NO: 1118754 - DNA, 22 bp, Artificial Sequence
  chemically synthesized
acgttcaagtcctgatttctag

SEQ ID NO: 1118755 - DNA, 22 bp, Artificial Sequence
  chemically synthesized
cattgttggtttctagaaatca

SEQ ID NO: 1118756 - DNA, 22 bp, Artificial Sequence
  chemically synthesized
aattccattgttggtttctaga

SEQ ID NO: 1118757 - DNA, 22 bp, Artificial Sequence
  chemically synthesized
aagtcctgatttctagaaacca

SEQ ID NO: 1118758 - DNA, 22 bp, Artificial Sequence
  chemically synthesized
caattccattgttggtttctag

SEQ ID NO: 1118759 - DNA, 22 bp, Artificial Sequence
  chemically synthesized
atttcaattccattgttggttt

SEQ ID NO: 1118760 - DNA, 22 bp, Artificial Sequence
  chemically synthesized
catttcaattccattgttggtt

SEQ ID NO: 1118761 - DNA, 22 bp, Artificial Sequence
  chemically synthesized
tcatttcaattccattgttggt

SEQ ID NO: 1118762 - DNA, 22 bp, Artificial Sequence
  chemically synthesized
atttctagaaaccaacaatgga

SEQ ID NO: 1118763 - DNA, 22 bp, Artificial Sequence
  chemically synthesized
ctagaaaccaacaatggaattg

SEQ ID NO: 1118764 - DNA, 22 bp, Artificial Sequence
  chemically synthesized
tagaaaccaacaatggaattga

SEQ ID NO: 1118765 - DNA, 22 bp, Artificial Sequence
  chemically synthesized
gccattttcatttcaattccat

SEQ ID NO: 1118766 - DNA, 22 bp, Artificial Sequence
  chemically synthesized
gaaaccaacaatggaattgaaa

SEQ ID NO: 1118767 - DNA, 22 bp, Artificial Sequence
  chemically synthesized
tagccattttcatttcaattcc

SEQ ID NO: 1118768 - DNA, 22 bp, Artificial Sequence
  chemically synthesized
ctagccattttcatttcaattc

SEQ ID NO: 1118769 - DNA, 22 bp, Artificial Sequence
  chemically synthesized
atttctagccattttcatttca

SEQ ID NO: 1118770 - DNA, 22 bp, Artificial Sequence
  chemically synthesized
cacaaactaatttctagccatt

SEQ ID NO: 1118771 - DNA, 22 bp, Artificial Sequence
  chemically synthesized
gcacaaactaatttctagccat

SEQ ID NO: 1118772 - DNA, 22 bp, Artificial Sequence
  chemically synthesized
cttgcacaaactaatttctagc

SEQ ID NO: 1118773 - DNA, 22 bp, Artificial Sequence
  chemically synthesized
aaatgaaaatggctagaaatta

SEQ ID NO: 1118774 - DNA, 22 bp, Artificial Sequence
  chemically synthesized
acttgcacaaactaatttctag

SEQ ID NO: 1118775 - DNA, 22 bp, Artificial Sequence
  chemically synthesized
tttacttgcacaaactaatttc

SEQ ID NO: 1118776 - DNA, 22 bp, Artificial Sequence
  chemically synthesized
gtttacttgcacaaactaattt

SEQ ID NO: 1118777 - DNA, 22 bp, Artificial Sequence
  chemically synthesized
tgtttacttgcacaaactaatt

SEQ ID NO: 1118778 - DNA, 22 bp, Artificial Sequence
  chemically synthesized
ttgtttacttgcacaaactaat

SEQ ID NO: 1118779 - DNA, 22 bp, Artificial Sequence
  chemically synthesized
atttttgtttacttgcacaaac

SEQ ID NO: 1118780 - DNA, 22 bp, Artificial Sequence
  chemically synthesized
gaaattagtttgtgcaagtaaa

SEQ ID NO: 1118781 - DNA, 22 bp, Artificial Sequence
  chemically synthesized
caatgatctaatttttgtttac

SEQ ID NO: 1118782 - DNA, 22 bp, Artificial Sequence
  chemically synthesized
gtttgtgcaagtaaacaaaaat

SEQ ID NO: 1118783 - DNA, 22 bp, Artificial Sequence
  chemically synthesized
gtgcaagtaaacaaaaattaga

SEQ ID NO: 1118784 - DNA, 22 bp, Artificial Sequence
  chemically synthesized
tgcaagtaaacaaaaattagat

SEQ ID NO: 1118785 - DNA, 22 bp, Artificial Sequence
  chemically synthesized
aagcctacaatgatctaatttt

SEQ ID NO: 1118786 - DNA, 22 bp, Artificial Sequence
  chemically synthesized
aaagcctacaatgatctaattt

SEQ ID NO: 1118787 - DNA, 22 bp, Artificial Sequence
  chemically synthesized
ttaaagcctacaatgatctaat

SEQ ID NO: 1118788 - DNA, 22 bp, Artificial Sequence
  chemically synthesized
ccctcttaaagcctacaatgat

SEQ ID NO: 1118789 - DNA, 22 bp, Artificial Sequence
  chemically synthesized
atattgccctcttaaagcctac

SEQ ID NO: 1118790 - DNA, 22 bp, Artificial Sequence
  chemically synthesized
catattgccctcttaaagccta

SEQ ID NO: 1118791 - DNA, 22 bp, Artificial Sequence
  chemically synthesized
gatcattgtaggctttaagagg

SEQ ID NO: 1118792 - DNA, 22 bp, Artificial Sequence
  chemically synthesized
taggctttaagagggcaatatg

SEQ ID NO: 1118793 - DNA, 22 bp, Artificial Sequence
  chemically synthesized
acaaagtccatgtcttcatatt

SEQ ID NO: 1118794 - DNA, 22 bp, Artificial Sequence
  chemically synthesized
taagagggcaatatgaagacat

SEQ ID NO: 1118795 - DNA, 22 bp, Artificial Sequence
  chemically synthesized
aagagggcaatatgaagacatg

SEQ ID NO: 1118796 - DNA, 22 bp, Artificial Sequence
  chemically synthesized
agagggcaatatgaagacatgg

SEQ ID NO: 1118797 - DNA, 22 bp, Artificial Sequence
  chemically synthesized
aagagtgttgacaaagtccatg

SEQ ID NO: 1118798 - DNA, 22 bp, Artificial Sequence
  chemically synthesized
tctgaagagtgttgacaaagtc

SEQ ID NO: 1118799 - DNA, 22 bp, Artificial Sequence
  chemically synthesized
gtctgaagagtgttgacaaagt

SEQ ID NO: 1118800 - DNA, 22 bp, Artificial Sequence
  chemically synthesized
tgtctgaagagtgttgacaaag

SEQ ID NO: 1118801 - DNA, 22 bp, Artificial Sequence
  chemically synthesized
cagtggtctttgtctgaagagt

SEQ ID NO: 1118802 - DNA, 22 bp, Artificial Sequence
  chemically synthesized
tgtcaacactcttcagacaaag

SEQ ID NO: 1118803 - DNA, 22 bp, Artificial Sequence
  chemically synthesized
gtcaacactcttcagacaaaga

SEQ ID NO: 1118804 - DNA, 22 bp, Artificial Sequence
  chemically synthesized
tcaacactcttcagacaaagac

SEQ ID NO: 1118805 - DNA, 22 bp, Artificial Sequence
  chemically synthesized
caaatatgttccagtggtcttt

SEQ ID NO: 1118806 - DNA, 22 bp, Artificial Sequence
  chemically synthesized
ttcagacaaagaccactggaac

SEQ ID NO: 1118807 - DNA, 22 bp, Artificial Sequence
  chemically synthesized
cagacaaagaccactggaacat

SEQ ID NO: 1118808 - DNA, 22 bp, Artificial Sequence
  chemically synthesized
agacaaagaccactggaacata

SEQ ID NO: 1118809 - DNA, 22 bp, Artificial Sequence
  chemically synthesized
ataacctacaaatatgttccag

SEQ ID NO: 1118810 - DNA, 22 bp, Artificial Sequence
  chemically synthesized
gataacctacaaatatgttcca

SEQ ID NO: 1118811 - DNA, 22 bp, Artificial Sequence
  chemically synthesized
tgataacctacaaatatgttcc

SEQ ID NO: 1118812 - DNA, 22 bp, Artificial Sequence
  chemically synthesized
actttgataacctacaaatatg

SEQ ID NO: 1118813 - DNA, 22 bp, Artificial Sequence
  chemically synthesized
gaacatatttgtaggttatcaa

SEQ ID NO: 1118814 - DNA, 22 bp, Artificial Sequence
  chemically synthesized
gtaggttatcaaagttaacctg

SEQ ID NO: 1118815 - DNA, 22 bp, Artificial Sequence
  chemically synthesized
cagcgtgtaaatcaggttaact

SEQ ID NO: 1118816 - DNA, 22 bp, Artificial Sequence
  chemically synthesized
taggttatcaaagttaacctga

SEQ ID NO: 1118817 - DNA, 22 bp, Artificial Sequence
  chemically synthesized
gttgcagcgtgtaaatcaggtt

SEQ ID NO: 1118818 - DNA, 22 bp, Artificial Sequence
  chemically synthesized
tcgttgcagcgtgtaaatcagg

SEQ ID NO: 1118819 - DNA, 22 bp, Artificial Sequence
  chemically synthesized
tcaaagttaacctgatttacac

SEQ ID NO: 1118820 - DNA, 22 bp, Artificial Sequence
  chemically synthesized
tctcgttgcagcgtgtaaatca

SEQ ID NO: 1118821 - DNA, 22 bp, Artificial Sequence
  chemically synthesized
tctctctcgttgcagcgtgtaa

SEQ ID NO: 1118822 - DNA, 22 bp, Artificial Sequence
  chemically synthesized
acctgatttacacgctgcaacg

SEQ ID NO: 1118823 - DNA, 22 bp, Artificial Sequence
  chemically synthesized
atttacacgctgcaacgagaga

SEQ ID NO: 1118824 - DNA, 22 bp, Artificial Sequence
  chemically synthesized
tgatgcgctgtctctctcgttg

SEQ ID NO: 1118825 - DNA, 22 bp, Artificial Sequence
  chemically synthesized
acacgctgcaacgagagagaca

SEQ ID NO: 1118826 - DNA, 22 bp, Artificial Sequence
  chemically synthesized
cctgtgatgcgctgtctctctc

SEQ ID NO: 1118827 - DNA, 22 bp, Artificial Sequence
  chemically synthesized
cacgctgcaacgagagagacag

SEQ ID NO: 1118828 - DNA, 22 bp, Artificial Sequence
  chemically synthesized
caacgagagagacagcgcatca

SEQ ID NO: 1118829 - DNA, 22 bp, Artificial Sequence
  chemically synthesized
gagacagccccatagttccctg

SEQ ID NO: 1118830 - DNA, 22 bp, Artificial Sequence
  chemically synthesized
agagacagccccatagttccct

SEQ ID NO: 1118831 - DNA, 22 bp, Artificial Sequence
  chemically synthesized
ttagagacagccccatagttcc

SEQ ID NO: 1118832 - DNA, 22 bp, Artificial Sequence
  chemically synthesized
acatactcttagagacagcccc

SEQ ID NO: 1118833 - DNA, 22 bp, Artificial Sequence
  chemically synthesized
taacatactcttagagacagcc

SEQ ID NO: 1118834 - DNA, 22 bp, Artificial Sequence
  chemically synthesized
ctaacatactcttagagacagc

SEQ ID NO: 1118835 - DNA, 22 bp, Artificial Sequence
  chemically synthesized
tctaacatactcttagagacag

SEQ ID NO: 1118836 - DNA, 22 bp, Artificial Sequence
  chemically synthesized
ttctaacatactcttagagaca

SEQ ID NO: 1118837 - DNA, 22 bp, Artificial Sequence
  chemically synthesized
tttctaacatactcttagagac

SEQ ID NO: 1118838 - DNA, 22 bp, Artificial Sequence
  chemically synthesized
tggggctgtctctaagagtatg

SEQ ID NO: 1118839 - DNA, 22 bp, Artificial Sequence
  chemically synthesized
aaataagctttttctaacatac

SEQ ID NO: 1118840 - DNA, 22 bp, Artificial Sequence
  chemically synthesized
aaaataagctttttctaacata

SEQ ID NO: 1118841 - DNA, 22 bp, Artificial Sequence
  chemically synthesized
tctctaagagtatgttagaaaa

SEQ ID NO: 1118842 - DNA, 22 bp, Artificial Sequence
  chemically synthesized
taagagtatgttagaaaaagct

SEQ ID NO: 1118843 - DNA, 22 bp, Artificial Sequence
  chemically synthesized
agagtatgttagaaaaagctta

SEQ ID NO: 1118844 - DNA, 22 bp, Artificial Sequence
  chemically synthesized
gaaaaagcttattttaagatgt

SEQ ID NO: 1118845 - DNA, 22 bp, Artificial Sequence
  chemically synthesized
tcatgtaacacaagcccacatc

SEQ ID NO: 1118846 - DNA, 22 bp, Artificial Sequence
  chemically synthesized
attttaagatgtgggcttgtgt

SEQ ID NO: 1118847 - DNA, 22 bp, Artificial Sequence
  chemically synthesized
ttttaagatgtgggcttgtgtt

SEQ ID NO: 1118848 - DNA, 22 bp, Artificial Sequence
  chemically synthesized
taagatgtgggcttgtgttaca

SEQ ID NO: 1118849 - DNA, 22 bp, Artificial Sequence
  chemically synthesized
aagatgtgggcttgtgttacat

SEQ ID NO: 1118850 - DNA, 22 bp, Artificial Sequence
  chemically synthesized
atgccccctatcatgtaacaca

SEQ ID NO: 1118851 - DNA, 22 bp, Artificial Sequence
  chemically synthesized
agatgtgggcttgtgttacatg

SEQ ID NO: 1118852 - DNA, 22 bp, Artificial Sequence
  chemically synthesized
gatgccccctatcatgtaacac

SEQ ID NO: 1118853 - DNA, 22 bp, Artificial Sequence
  chemically synthesized
cttgatgccccctatcatgtaa

SEQ ID NO: 1118854 - DNA, 22 bp, Artificial Sequence
  chemically synthesized
ccttgatgccccctatcatgta

SEQ ID NO: 1118855 - DNA, 22 bp, Artificial Sequence
  chemically synthesized
gtgttacatgatagggggcatc

SEQ ID NO: 1118856 - DNA, 22 bp, Artificial Sequence
  chemically synthesized
tgttacatgatagggggcatca

SEQ ID NO: 1118857 - DNA, 22 bp, Artificial Sequence
  chemically synthesized
catgatagggggcatcaaggaa

SEQ ID NO: 1118858 - DNA, 22 bp, Artificial Sequence
  chemically synthesized
caacatccaatcaaaacaaagc

SEQ ID NO: 1118859 - DNA, 22 bp, Artificial Sequence
  chemically synthesized
acaacatccaatcaaaacaaag

SEQ ID NO: 1118860 - DNA, 22 bp, Artificial Sequence
  chemically synthesized
cttacaacatccaatcaaaaca

SEQ ID NO: 1118861 - DNA, 22 bp, Artificial Sequence
  chemically synthesized
ccttacaacatccaatcaaaac

SEQ ID NO: 1118862 - DNA, 22 bp, Artificial Sequence
  chemically synthesized
cttccttacaacatccaatcaa

SEQ ID NO: 1118863 - DNA, 22 bp, Artificial Sequence
  chemically synthesized
ccctacttccttacaacatcca

SEQ ID NO: 1118864 - DNA, 22 bp, Artificial Sequence
  chemically synthesized
tgttttgattggatgttgtaag

SEQ ID NO: 1118865 - DNA, 22 bp, Artificial Sequence
  chemically synthesized
gttttgattggatgttgtaagg

SEQ ID NO: 1118866 - DNA, 22 bp, Artificial Sequence
  chemically synthesized
ttttgattggatgttgtaagga

SEQ ID NO: 1118867 - DNA, 22 bp, Artificial Sequence
  chemically synthesized
tgattggatgttgtaaggaagt

SEQ ID NO: 1118868 - DNA, 22 bp, Artificial Sequence
  chemically synthesized
gattggatgttgtaaggaagta

SEQ ID NO: 1118869 - DNA, 22 bp, Artificial Sequence
  chemically synthesized
attggatgttgtaaggaagtag

SEQ ID NO: 1118870 - DNA, 22 bp, Artificial Sequence
  chemically synthesized
aacatagaattaccctacttcc

SEQ ID NO: 1118871 - DNA, 22 bp, Artificial Sequence
  chemically synthesized
gatgttgtaaggaagtagggta

SEQ ID NO: 1118872 - DNA, 22 bp, Artificial Sequence
  chemically synthesized
ggacactcaacatagaattacc

SEQ ID NO: 1118873 - DNA, 22 bp, Artificial Sequence
  chemically synthesized
taaggaagtagggtaattctat

SEQ ID NO: 1118874 - DNA, 22 bp, Artificial Sequence
  chemically synthesized
aggacactcaacatagaattac

SEQ ID NO: 1118875 - DNA, 22 bp, Artificial Sequence
  chemically synthesized
taggacactcaacatagaatta

SEQ ID NO: 1118876 - DNA, 22 bp, Artificial Sequence
  chemically synthesized
gataaaaattttaggacactca

SEQ ID NO: 1118877 - DNA, 22 bp, Artificial Sequence
  chemically synthesized
tatgttgagtgtcctaaaattt

SEQ ID NO: 1118878 - DNA, 22 bp, Artificial Sequence
  chemically synthesized
ccatctagataaaaattttagg

SEQ ID NO: 1118879 - DNA, 22 bp, Artificial Sequence
  chemically synthesized
tgttgagtgtcctaaaattttt

SEQ ID NO: 1118880 - DNA, 22 bp, Artificial Sequence
  chemically synthesized
ctgccatctagataaaaatttt

SEQ ID NO: 1118881 - DNA, 22 bp, Artificial Sequence
  chemically synthesized
ctcctgccatctagataaaaat

SEQ ID NO: 1118882 - DNA, 22 bp, Artificial Sequence
  chemically synthesized
agtgtcctaaaatttttatcta

SEQ ID NO: 1118883 - DNA, 22 bp, Artificial Sequence
  chemically synthesized
cattcctcctgccatctagata

SEQ ID NO: 1118884 - DNA, 22 bp, Artificial Sequence
  chemically synthesized
tgcattcctcctgccatctaga

SEQ ID NO: 1118885 - DNA, 22 bp, Artificial Sequence
  chemically synthesized
tctgcattcctcctgccatcta

SEQ ID NO: 1118886 - DNA, 22 bp, Artificial Sequence
  chemically synthesized
aaatttttatctagatggcagg

SEQ ID NO: 1118887 - DNA, 22 bp, Artificial Sequence
  chemically synthesized
gcctctctgcattcctcctgcc

SEQ ID NO: 1118888 - DNA, 22 bp, Artificial Sequence
  chemically synthesized
agcctctctgcattcctcctgc

SEQ ID NO: 1118889 - DNA, 22 bp, Artificial Sequence
  chemically synthesized
ttatctagatggcaggaggaat

SEQ ID NO: 1118890 - DNA, 22 bp, Artificial Sequence
  chemically synthesized
tagcctctctgcattcctcctg

SEQ ID NO: 1118891 - DNA, 22 bp, Artificial Sequence
  chemically synthesized
tatctagatggcaggaggaatg

SEQ ID NO: 1118892 - DNA, 22 bp, Artificial Sequence
  chemically synthesized
atctagatggcaggaggaatgc

SEQ ID NO: 1118893 - DNA, 22 bp, Artificial Sequence
  chemically synthesized
tctagatggcaggaggaatgca

SEQ ID NO: 1118894 - DNA, 22 bp, Artificial Sequence
  chemically synthesized
gatggcaggaggaatgcagaga

SEQ ID NO: 1118895 - DNA, 22 bp, Artificial Sequence
  chemically synthesized
aacacagctttagcctctctgc

SEQ ID NO: 1118896 - DNA, 22 bp, Artificial Sequence
  chemically synthesized
ctaaacacagctttagcctctc

SEQ ID NO: 1118897 - DNA, 22 bp, Artificial Sequence
  chemically synthesized
actaaacacagctttagcctct

SEQ ID NO: 1118898 - DNA, 22 bp, Artificial Sequence
  chemically synthesized
tactaaacacagctttagcctc

SEQ ID NO: 1118899 - DNA, 22 bp, Artificial Sequence
  chemically synthesized
tttactaaacacagctttagcc

SEQ ID NO: 1118900 - DNA, 22 bp, Artificial Sequence
  chemically synthesized
ctttactaaacacagctttagc

SEQ ID NO: 1118901 - DNA, 22 bp, Artificial Sequence
  chemically synthesized
tgcttctttactaaacacagct

SEQ ID NO: 1118902 - DNA, 22 bp, Artificial Sequence
  chemically synthesized
aagctgtgtttagtaaagaagc

SEQ ID NO: 1118903 - DNA, 22 bp, Artificial Sequence
  chemically synthesized
atgtgacacattatgcttcttt

SEQ ID NO: 1118904 - DNA, 22 bp, Artificial Sequence
  chemically synthesized
tgtttagtaaagaagcataatg

SEQ ID NO: 1118905 - DNA, 22 bp, Artificial Sequence
  chemically synthesized
attaatgtgacacattatgctt

SEQ ID NO: 1118906 - DNA, 22 bp, Artificial Sequence
  chemically synthesized
cattaatgtgacacattatgct

SEQ ID NO: 1118907 - DNA, 22 bp, Artificial Sequence
  chemically synthesized
agtaaagaagcataatgtgtca

SEQ ID NO: 1118908 - DNA, 22 bp, Artificial Sequence
  chemically synthesized
gtaaagaagcataatgtgtcac

SEQ ID NO: 1118909 - DNA, 22 bp, Artificial Sequence
  chemically synthesized
atcttcattaatgtgacacatt

SEQ ID NO: 1118910 - DNA, 22 bp, Artificial Sequence
  chemically synthesized
atgaccaaatatccctcatctt

SEQ ID NO: 1118911 - DNA, 22 bp, Artificial Sequence
  chemically synthesized
atgaagatgagggatatttggt

SEQ ID NO: 1118912 - DNA, 22 bp, Artificial Sequence
  chemically synthesized
tccaaaccacgcctaatgacca

SEQ ID NO: 1118913 - DNA, 22 bp, Artificial Sequence
  chemically synthesized
ggtcattaggcgtggtttggac

SEQ ID NO: 1118914 - DNA, 22 bp, Artificial Sequence
  chemically synthesized
gtcattaggcgtggtttggaca

SEQ ID NO: 1118915 - DNA, 22 bp, Artificial Sequence
  chemically synthesized
ggcgtggtttggacaatgctat

SEQ ID NO: 1118916 - DNA, 22 bp, Artificial Sequence
  chemically synthesized
atacagtaaaaaagaatagcat

SEQ ID NO: 1118917 - DNA, 22 bp, Artificial Sequence
  chemically synthesized
aatacagtaaaaaagaatagca

SEQ ID NO: 1118918 - DNA, 22 bp, Artificial Sequence
  chemically synthesized
ggacaatgctattcttttttac

SEQ ID NO: 1118919 - DNA, 22 bp, Artificial Sequence
  chemically synthesized
gacaatgctattcttttttact

SEQ ID NO: 1118920 - DNA, 22 bp, Artificial Sequence
  chemically synthesized
taatcatatcttaatacagtaa

SEQ ID NO: 1118921 - DNA, 22 bp, Artificial Sequence
  chemically synthesized
gtaatcatatcttaatacagta

SEQ ID NO: 1118922 - DNA, 22 bp, Artificial Sequence
  chemically synthesized
tgtaatcatatcttaatacagt

SEQ ID NO: 1118923 - DNA, 22 bp, Artificial Sequence
  chemically synthesized
ttcttttttactgtattaagat

SEQ ID NO: 1118924 - DNA, 22 bp, Artificial Sequence
  chemically synthesized
ttttttactgtattaagatatg

SEQ ID NO: 1118925 - DNA, 22 bp, Artificial Sequence
  chemically synthesized
ttttactgtattaagatatgat

SEQ ID NO: 1118926 - DNA, 22 bp, Artificial Sequence
  chemically synthesized
tttactgtattaagatatgatt

SEQ ID NO: 1118927 - DNA, 22 bp, Artificial Sequence
  chemically synthesized
ttactgtattaagatatgatta

SEQ ID NO: 1118928 - DNA, 22 bp, Artificial Sequence
  chemically synthesized
tactgtattaagatatgattac

SEQ ID NO: 1118929 - DNA, 22 bp, Artificial Sequence
  chemically synthesized
actgtattaagatatgattaca

SEQ ID NO: 1118930 - DNA, 22 bp, Artificial Sequence
  chemically synthesized
ctgtattaagatatgattacaa

SEQ ID NO: 1118931 - DNA, 22 bp, Artificial Sequence
  chemically synthesized
tattaagatatgattacaaagt

SEQ ID NO: 1118932 - DNA, 22 bp, Artificial Sequence
  chemically synthesized
agatatgattacaaagtggtct

SEQ ID NO: 1118933 - DNA, 22 bp, Artificial Sequence
  chemically synthesized
tgatgaatcaagataaaagcaa

SEQ ID NO: 1118934 - DNA, 22 bp, Artificial Sequence
  chemically synthesized
caaagtggtcttgcttttatct

SEQ ID NO: 1118935 - DNA, 22 bp, Artificial Sequence
  chemically synthesized
tggttgtgatgaatcaagataa

SEQ ID NO: 1118936 - DNA, 22 bp, Artificial Sequence
  chemically synthesized
gcttttatcttgattcatcaca

SEQ ID NO: 1118937 - DNA, 22 bp, Artificial Sequence
  chemically synthesized
cttttatcttgattcatcacaa

SEQ ID NO: 1118938 - DNA, 22 bp, Artificial Sequence
  chemically synthesized
ttatcttgattcatcacaacca

SEQ ID NO: 1118939 - DNA, 22 bp, Artificial Sequence
  chemically synthesized
tatcttgattcatcacaaccat

SEQ ID NO: 1118940 - DNA, 22 bp, Artificial Sequence
  chemically synthesized
atcttgattcatcacaaccata

SEQ ID NO: 1118941 - DNA, 22 bp, Artificial Sequence
  chemically synthesized
tcttgattcatcacaaccatag

SEQ ID NO: 1118942 - DNA, 22 bp, Artificial Sequence
  chemically synthesized
gattcatcacaaccatagcgtg

SEQ ID NO: 1118943 - DNA, 22 bp, Artificial Sequence
  chemically synthesized
attcatcacaaccatagcgtgt

SEQ ID NO: 1118944 - DNA, 22 bp, Artificial Sequence
  chemically synthesized
atcacaaccatagcgtgtccct

SEQ ID NO: 1118945 - DNA, 22 bp, Artificial Sequence
  chemically synthesized
gggatgccagcatcatacaggg

SEQ ID NO: 1118946 - DNA, 22 bp, Artificial Sequence
  chemically synthesized
ctagggatgccagcatcataca

SEQ ID NO: 1118947 - DNA, 22 bp, Artificial Sequence
  chemically synthesized
tatgatgctggcatccctagca

SEQ ID NO: 1118948 - DNA, 22 bp, Artificial Sequence
  chemically synthesized
aatataaataattgctagggat

SEQ ID NO: 1118949 - DNA, 22 bp, Artificial Sequence
  chemically synthesized
gttgaatataaataattgctag

SEQ ID NO: 1118950 - DNA, 22 bp, Artificial Sequence
  chemically synthesized
tggttgaatataaataattgct

SEQ ID NO: 1118951 - DNA, 22 bp, Artificial Sequence
  chemically synthesized
tctggttgaatataaataattg

SEQ ID NO: 1118952 - DNA, 22 bp, Artificial Sequence
  chemically synthesized
gcatccctagcaattatttata

SEQ ID NO: 1118953 - DNA, 22 bp, Artificial Sequence
  chemically synthesized
atgttctctggttgaatataaa

SEQ ID NO: 1118954 - DNA, 22 bp, Artificial Sequence
  chemically synthesized
gcaattatttatattcaaccag

SEQ ID NO: 1118955 - DNA, 22 bp, Artificial Sequence
  chemically synthesized
cagccagtctgatgttctctgg

SEQ ID NO: 1118956 - DNA, 22 bp, Artificial Sequence
  chemically synthesized
tttatattcaaccagagaacat

SEQ ID NO: 1118957 - DNA, 22 bp, Artificial Sequence
  chemically synthesized
gcagccagtctgatgttctctg

SEQ ID NO: 1118958 - DNA, 22 bp, Artificial Sequence
  chemically synthesized
atattcaaccagagaacatcag

SEQ ID NO: 1118959 - DNA, 22 bp, Artificial Sequence
  chemically synthesized
tattcaaccagagaacatcaga

SEQ ID NO: 1118960 - DNA, 22 bp, Artificial Sequence
  chemically synthesized
gtacttgcagccagtctgatgt

SEQ ID NO: 1118961 - DNA, 22 bp, Artificial Sequence
  chemically synthesized
ggtacttgcagccagtctgatg

SEQ ID NO: 1118962 - DNA, 22 bp, Artificial Sequence
  chemically synthesized
aaccagagaacatcagactggc

SEQ ID NO: 1118963 - DNA, 22 bp, Artificial Sequence
  chemically synthesized
ccttggtacttgcagccagtct

SEQ ID NO: 1118964 - DNA, 22 bp, Artificial Sequence
  chemically synthesized
gatgttgccttggtacttgcag

SEQ ID NO: 1118965 - DNA, 22 bp, Artificial Sequence
  chemically synthesized
ctagatgttgccttggtacttg

SEQ ID NO: 1118966 - DNA, 22 bp, Artificial Sequence
  chemically synthesized
gaactgctagatgttgccttgg

SEQ ID NO: 1118967 - DNA, 22 bp, Artificial Sequence
  chemically synthesized
ggaactgctagatgttgccttg

SEQ ID NO: 1118968 - DNA, 22 bp, Artificial Sequence
  chemically synthesized
gctgcaagtaccaaggcaacat

SEQ ID NO: 1118969 - DNA, 22 bp, Artificial Sequence
  chemically synthesized
tggaactgctagatgttgcctt

SEQ ID NO: 1118970 - DNA, 22 bp, Artificial Sequence
  chemically synthesized
caagtaccaaggcaacatctag

SEQ ID NO: 1118971 - DNA, 22 bp, Artificial Sequence
  chemically synthesized
ggctttggaactgctagatgtt

SEQ ID NO: 1118972 - DNA, 22 bp, Artificial Sequence
  chemically synthesized
agttaggctttggaactgctag

SEQ ID NO: 1118973 - DNA, 22 bp, Artificial Sequence
  chemically synthesized
cagttaggctttggaactgcta

SEQ ID NO: 1118974 - DNA, 22 bp, Artificial Sequence
  chemically synthesized
gcacttcagttaggctttggaa

SEQ ID NO: 1118975 - DNA, 22 bp, Artificial Sequence
  chemically synthesized
ggcacttcagttaggctttgga

SEQ ID NO: 1118976 - DNA, 22 bp, Artificial Sequence
  chemically synthesized
gcttggcacttcagttaggctt

SEQ ID NO: 1118977 - DNA, 22 bp, Artificial Sequence
  chemically synthesized
gcagttccaaagcctaactgaa

SEQ ID NO: 1118978 - DNA, 22 bp, Artificial Sequence
  chemically synthesized
caaagcctaactgaagtgccaa

SEQ ID NO: 1118979 - DNA, 22 bp, Artificial Sequence
  chemically synthesized
atagccaggagctggcttggca

SEQ ID NO: 1118980 - DNA, 22 bp, Artificial Sequence
  chemically synthesized
ctgatagccaggagctggcttg

SEQ ID NO: 1118981 - DNA, 22 bp, Artificial Sequence
  chemically synthesized
actgaagtgccaagccagctcc

SEQ ID NO: 1118982 - DNA, 22 bp, Artificial Sequence
  chemically synthesized
aagtgccaagccagctcctggc

SEQ ID NO: 1118983 - DNA, 22 bp, Artificial Sequence
  chemically synthesized
agaaagataaaatcagctactg

SEQ ID NO: 1118984 - DNA, 22 bp, Artificial Sequence
  chemically synthesized
gagaaagataaaatcagctact

SEQ ID NO: 1118985 - DNA, 22 bp, Artificial Sequence
  chemically synthesized
ctggctatcagtagctgatttt

SEQ ID NO: 1118986 - DNA, 22 bp, Artificial Sequence
  chemically synthesized
gctatcagtagctgattttatc

SEQ ID NO: 1118987 - DNA, 22 bp, Artificial Sequence
  chemically synthesized
taatcatttgagaaagataaaa

SEQ ID NO: 1118988 - DNA, 22 bp, Artificial Sequence
  chemically synthesized
tcagtagctgattttatctttc

SEQ ID NO: 1118989 - DNA, 22 bp, Artificial Sequence
  chemically synthesized
ataatcatttgagaaagataaa

SEQ ID NO: 1118990 - DNA, 22 bp, Artificial Sequence
  chemically synthesized
tgtttataatcatttgagaaag

SEQ ID NO: 1118991 - DNA, 22 bp, Artificial Sequence
  chemically synthesized
attttatctttctcaaatgatt

SEQ ID NO: 1118992 - DNA, 22 bp, Artificial Sequence
  chemically synthesized
tgtctgtgtttataatcatttg

SEQ ID NO: 1118993 - DNA, 22 bp, Artificial Sequence
  chemically synthesized
tatctttctcaaatgattataa

SEQ ID NO: 1118994 - DNA, 22 bp, Artificial Sequence
  chemically synthesized
ttatgtctgtgtttataatcat

SEQ ID NO: 1118995 - DNA, 22 bp, Artificial Sequence
  chemically synthesized
atctttctcaaatgattataaa

SEQ ID NO: 1118996 - DNA, 22 bp, Artificial Sequence
  chemically synthesized
gttatgtctgtgtttataatca

SEQ ID NO: 1118997 - DNA, 22 bp, Artificial Sequence
  chemically synthesized
tctttctcaaatgattataaac

SEQ ID NO: 1118998 - DNA, 22 bp, Artificial Sequence
  chemically synthesized
tctcaaatgattataaacacag

SEQ ID NO: 1118999 - DNA, 22 bp, Artificial Sequence
  chemically synthesized
ctcaaatgattataaacacaga

SEQ ID NO: 1119000 - DNA, 22 bp, Artificial Sequence
  chemically synthesized
tcaaatgattataaacacagac

SEQ ID NO: 1119001 - DNA, 22 bp, Artificial Sequence
  chemically synthesized
aaatgattataaacacagacat

SEQ ID NO: 1119002 - DNA, 22 bp, Artificial Sequence
  chemically synthesized
agtatgatcttgttatgtctgt

SEQ ID NO: 1119003 - DNA, 22 bp, Artificial Sequence
  chemically synthesized
taaacacagacataacaagatc

SEQ ID NO: 1119004 - DNA, 22 bp, Artificial Sequence
  chemically synthesized
aaacctcagtatgatcttgtta

SEQ ID NO: 1119005 - DNA, 22 bp, Artificial Sequence
  chemically synthesized
ccaaagcgaacatattaaaacc

SEQ ID NO: 1119006 - DNA, 22 bp, Artificial Sequence
  chemically synthesized
tgccaaagcgaacatattaaaa

SEQ ID NO: 1119007 - DNA, 22 bp, Artificial Sequence
  chemically synthesized
aggttttaatatgttcgctttg

SEQ ID NO: 1119008 - DNA, 22 bp, Artificial Sequence
  chemically synthesized
cacatcacctctgccaaagcga

SEQ ID NO: 1119009 - DNA, 22 bp, Artificial Sequence
  chemically synthesized
ccacatcacctctgccaaagcg

SEQ ID NO: 1119010 - DNA, 22 bp, Artificial Sequence
  chemically synthesized
taatatgttcgctttggcagag

SEQ ID NO: 1119011 - DNA, 22 bp, Artificial Sequence
  chemically synthesized
aatatgttcgctttggcagagg

SEQ ID NO: 1119012 - DNA, 22 bp, Artificial Sequence
  chemically synthesized
atatgttcgctttggcagaggt

SEQ ID NO: 1119013 - DNA, 22 bp, Artificial Sequence
  chemically synthesized
gaagtttccacatcacctctgc

SEQ ID NO: 1119014 - DNA, 22 bp, Artificial Sequence
  chemically synthesized
agaagtttccacatcacctctg

SEQ ID NO: 1119015 - DNA, 22 bp, Artificial Sequence
  chemically synthesized
tagaagtttccacatcacctct

SEQ ID NO: 1119016 - DNA, 22 bp, Artificial Sequence
  chemically synthesized
ctttagaagtttccacatcacc

SEQ ID NO: 1119017 - DNA, 22 bp, Artificial Sequence
  chemically synthesized
gctttggcagaggtgatgtgga

SEQ ID NO: 1119018 - DNA, 22 bp, Artificial Sequence
  chemically synthesized
tggcagaggtgatgtggaaact

SEQ ID NO: 1119019 - DNA, 22 bp, Artificial Sequence
  chemically synthesized
tattcctttagaagtttccaca

SEQ ID NO: 1119020 - DNA, 22 bp, Artificial Sequence
  chemically synthesized
ggcagaggtgatgtggaaactt

SEQ ID NO: 1119021 - DNA, 22 bp, Artificial Sequence
  chemically synthesized
gcagaggtgatgtggaaacttc

SEQ ID NO: 1119022 - DNA, 22 bp, Artificial Sequence
  chemically synthesized
atgttatattcctttagaagtt

SEQ ID NO: 1119023 - DNA, 22 bp, Artificial Sequence
  chemically synthesized
ctaatgttatattcctttagaa

SEQ ID NO: 1119024 - DNA, 22 bp, Artificial Sequence
  chemically synthesized
ctactaatgttatattccttta

SEQ ID NO: 1119025 - DNA, 22 bp, Artificial Sequence
  chemically synthesized
cctgctactaatgttatattcc

SEQ ID NO: 1119026 - DNA, 22 bp, Artificial Sequence
  chemically synthesized
ccctgctactaatgttatattc

SEQ ID NO: 1119027 - DNA, 22 bp, Artificial Sequence
  chemically synthesized
gtcttccctgctactaatgtta

SEQ ID NO: 1119028 - DNA, 22 bp, Artificial Sequence
  chemically synthesized
ctaaaggaatataacattagta

SEQ ID NO: 1119029 - DNA, 22 bp, Artificial Sequence
  chemically synthesized
taaaggaatataacattagtag

SEQ ID NO: 1119030 - DNA, 22 bp, Artificial Sequence
  chemically synthesized
aaggaatataacattagtagca

SEQ ID NO: 1119031 - DNA, 22 bp, Artificial Sequence
  chemically synthesized
tagctggtcttccctgctacta

SEQ ID NO: 1119032 - DNA, 22 bp, Artificial Sequence
  chemically synthesized
gtagcagggaagaccagctaca

SEQ ID NO: 1119033 - DNA, 22 bp, Artificial Sequence
  chemically synthesized
agatgacaatcctgtagctggt

SEQ ID NO: 1119034 - DNA, 22 bp, Artificial Sequence
  chemically synthesized
aagatgacaatcctgtagctgg

SEQ ID NO: 1119035 - DNA, 22 bp, Artificial Sequence
  chemically synthesized
tttaagatgacaatcctgtagc

SEQ ID NO: 1119036 - DNA, 22 bp, Artificial Sequence
  chemically synthesized
tatttaagatgacaatcctgta

SEQ ID NO: 1119037 - DNA, 22 bp, Artificial Sequence
  chemically synthesized
ctatttaagatgacaatcctgt

SEQ ID NO: 1119038 - DNA, 22 bp, Artificial Sequence
  chemically synthesized
cttctatttaagatgacaatcc

SEQ ID NO: 1119039 - DNA, 22 bp, Artificial Sequence
  chemically synthesized
acttctatttaagatgacaatc

SEQ ID NO: 1119040 - DNA, 22 bp, Artificial Sequence
  chemically synthesized
caggattgtcatcttaaataga

SEQ ID NO: 1119041 - DNA, 22 bp, Artificial Sequence
  chemically synthesized
atatcatggcttacttctattt

SEQ ID NO: 1119042 - DNA, 22 bp, Artificial Sequence
  chemically synthesized
tcatcttaaatagaagtaagcc

SEQ ID NO: 1119043 - DNA, 22 bp, Artificial Sequence
  chemically synthesized
aagctaatatcatggcttactt

SEQ ID NO: 1119044 - DNA, 22 bp, Artificial Sequence
  chemically synthesized
attaaagctaatatcatggctt

SEQ ID NO: 1119045 - DNA, 22 bp, Artificial Sequence
  chemically synthesized
aaatagaagtaagccatgatat

SEQ ID NO: 1119046 - DNA, 22 bp, Artificial Sequence
  chemically synthesized
aatagaagtaagccatgatatt

SEQ ID NO: 1119047 - DNA, 22 bp, Artificial Sequence
  chemically synthesized
ccatcaccaaaaccctgattaa

SEQ ID NO: 1119048 - DNA, 22 bp, Artificial Sequence
  chemically synthesized
ttcccatcaccaaaaccctgat

SEQ ID NO: 1119049 - DNA, 22 bp, Artificial Sequence
  chemically synthesized
tattcccatcaccaaaaccctg

SEQ ID NO: 1119050 - DNA, 22 bp, Artificial Sequence
  chemically synthesized
tctattcccatcaccaaaaccc

SEQ ID NO: 1119051 - DNA, 22 bp, Artificial Sequence
  chemically synthesized
gctttaatcagggttttggtga

SEQ ID NO: 1119052 - DNA, 22 bp, Artificial Sequence
  chemically synthesized
tctctattcccatcaccaaaac

SEQ ID NO: 1119053 - DNA, 22 bp, Artificial Sequence
  chemically synthesized
taatcagggttttggtgatggg

SEQ ID NO: 1119054 - DNA, 22 bp, Artificial Sequence
  chemically synthesized
aatcagggttttggtgatggga

SEQ ID NO: 1119055 - DNA, 22 bp, Artificial Sequence
  chemically synthesized
atcagggttttggtgatgggaa

SEQ ID NO: 1119056 - DNA, 22 bp, Artificial Sequence
  chemically synthesized
aaaatgtccagttctctctatt

SEQ ID NO: 1119057 - DNA, 22 bp, Artificial Sequence
  chemically synthesized
gaaaatgtccagttctctctat

SEQ ID NO: 1119058 - DNA, 22 bp, Artificial Sequence
  chemically synthesized
tggtgatgggaatagagagaac

SEQ ID NO: 1119059 - DNA, 22 bp, Artificial Sequence
  chemically synthesized
ggtgatgggaatagagagaact

SEQ ID NO: 1119060 - DNA, 22 bp, Artificial Sequence
  chemically synthesized
ttgaaaatgtccagttctctct

SEQ ID NO: 1119061 - DNA, 22 bp, Artificial Sequence
  chemically synthesized
gtgatgggaatagagagaactg

SEQ ID NO: 1119062 - DNA, 22 bp, Artificial Sequence
  chemically synthesized
acagctcttgaaaatgtccagt

SEQ ID NO: 1119063 - DNA, 22 bp, Artificial Sequence
  chemically synthesized
aacagctcttgaaaatgtccag

SEQ ID NO: 1119064 - DNA, 22 bp, Artificial Sequence
  chemically synthesized
ccttaacagctcttgaaaatgt

SEQ ID NO: 1119065 - DNA, 22 bp, Artificial Sequence
  chemically synthesized
ctcccttaacagctcttgaaaa

SEQ ID NO: 1119066 - DNA, 22 bp, Artificial Sequence
  chemically synthesized
atcctgctcccttaacagctct

SEQ ID NO: 1119067 - DNA, 22 bp, Artificial Sequence
  chemically synthesized
gacattttcaagagctgttaag

SEQ ID NO: 1119068 - DNA, 22 bp, Artificial Sequence
  chemically synthesized
aattaatcctgctcccttaaca

SEQ ID NO: 1119069 - DNA, 22 bp, Artificial Sequence
  chemically synthesized
tcaagagctgttaagggagcag

SEQ ID NO: 1119070 - DNA, 22 bp, Artificial Sequence
  chemically synthesized
caagagctgttaagggagcagg

SEQ ID NO: 1119071 - DNA, 22 bp, Artificial Sequence
  chemically synthesized
aagagctgttaagggagcagga

SEQ ID NO: 1119072 - DNA, 22 bp, Artificial Sequence
  chemically synthesized
acaggttcaattaatcctgctc

SEQ ID NO: 1119073 - DNA, 22 bp, Artificial Sequence
  chemically synthesized
gacaggttcaattaatcctgct

SEQ ID NO: 1119074 - DNA, 22 bp, Artificial Sequence
  chemically synthesized
tgacaggttcaattaatcctgc

SEQ ID NO: 1119075 - DNA, 22 bp, Artificial Sequence
  chemically synthesized
ttaagggagcaggattaattga

SEQ ID NO: 1119076 - DNA, 22 bp, Artificial Sequence
  chemically synthesized
agggagcaggattaattgaacc

SEQ ID NO: 1119077 - DNA, 22 bp, Artificial Sequence
  chemically synthesized
acaagtccaatctttgacaggt

SEQ ID NO: 1119078 - DNA, 22 bp, Artificial Sequence
  chemically synthesized
ccattcacaagtccaatctttg

SEQ ID NO: 1119079 - DNA, 22 bp, Artificial Sequence
  chemically synthesized
attgaacctgtcaaagattgga

SEQ ID NO: 1119080 - DNA, 22 bp, Artificial Sequence
  chemically synthesized
taccattcacaagtccaatctt

SEQ ID NO: 1119081 - DNA, 22 bp, Artificial Sequence
  chemically synthesized
ctaccattcacaagtccaatct

SEQ ID NO: 1119082 - DNA, 22 bp, Artificial Sequence
  chemically synthesized
aacctgtcaaagattggacttg

SEQ ID NO: 1119083 - DNA, 22 bp, Artificial Sequence
  chemically synthesized
ttctaccattcacaagtccaat

SEQ ID NO: 1119084 - DNA, 22 bp, Artificial Sequence
  chemically synthesized
cttctaccattcacaagtccaa

SEQ ID NO: 1119085 - DNA, 22 bp, Artificial Sequence
  chemically synthesized
tcttctaccattcacaagtcca

SEQ ID NO: 1119086 - DNA, 22 bp, Artificial Sequence
  chemically synthesized
ttcttctaccattcacaagtcc

SEQ ID NO: 1119087 - DNA, 22 bp, Artificial Sequence
  chemically synthesized
tcaaagattggacttgtgaatg

SEQ ID NO: 1119088 - DNA, 22 bp, Artificial Sequence
  chemically synthesized
gatttttcttctaccattcaca

SEQ ID NO: 1119089 - DNA, 22 bp, Artificial Sequence
  chemically synthesized
gacttgtgaatggtagaagaaa

SEQ ID NO: 1119090 - DNA, 22 bp, Artificial Sequence
  chemically synthesized
ggtcacctagatttttcttcta

SEQ ID NO: 1119091 - DNA, 22 bp, Artificial Sequence
  chemically synthesized
gtgaatggtagaagaaaaatct

SEQ ID NO: 1119092 - DNA, 22 bp, Artificial Sequence
  chemically synthesized
tgaatggtagaagaaaaatcta

SEQ ID NO: 1119093 - DNA, 22 bp, Artificial Sequence
  chemically synthesized
aaagtgaactgggtcacctaga

SEQ ID NO: 1119094 - DNA, 22 bp, Artificial Sequence
  chemically synthesized
atccagaaacctgaaagtgaac

SEQ ID NO: 1119095 - DNA, 22 bp, Artificial Sequence
  chemically synthesized
ggtgacccagttcactttcagg

SEQ ID NO: 1119096 - DNA, 22 bp, Artificial Sequence
  chemically synthesized
caaacagcctaatccagaaacc

SEQ ID NO: 1119097 - DNA, 22 bp, Artificial Sequence
  chemically synthesized
actttcaggtttctggattagg

SEQ ID NO: 1119098 - DNA, 22 bp, Artificial Sequence
  chemically synthesized
accctgcaaacagcctaatcca

SEQ ID NO: 1119099 - DNA, 22 bp, Artificial Sequence
  chemically synthesized
caccctgcaaacagcctaatcc

SEQ ID NO: 1119100 - DNA, 22 bp, Artificial Sequence
  chemically synthesized
tcaccctgcaaacagcctaatc

SEQ ID NO: 1119101 - DNA, 22 bp, Artificial Sequence
  chemically synthesized
tcaggtttctggattaggctgt

SEQ ID NO: 1119102 - DNA, 22 bp, Artificial Sequence
  chemically synthesized
caggtttctggattaggctgtt

SEQ ID NO: 1119103 - DNA, 22 bp, Artificial Sequence
  chemically synthesized
aggtttctggattaggctgttt

SEQ ID NO: 1119104 - DNA, 22 bp, Artificial Sequence
  chemically synthesized
ctttcaccctgcaaacagccta

SEQ ID NO: 1119105 - DNA, 22 bp, Artificial Sequence
  chemically synthesized
cctttcaccctgcaaacagcct

SEQ ID NO: 1119106 - DNA, 22 bp, Artificial Sequence
  chemically synthesized
cttcctttcaccctgcaaacag

SEQ ID NO: 1119107 - DNA, 22 bp, Artificial Sequence
  chemically synthesized
ctggattaggctgtttgcaggg

SEQ ID NO: 1119108 - DNA, 22 bp, Artificial Sequence
  chemically synthesized
tccttcctttcaccctgcaaac

SEQ ID NO: 1119109 - DNA, 22 bp, Artificial Sequence
  chemically synthesized
tggattaggctgtttgcagggt

SEQ ID NO: 1119110 - DNA, 22 bp, Artificial Sequence
  chemically synthesized
ctccttcctttcaccctgcaaa

SEQ ID NO: 1119111 - DNA, 22 bp, Artificial Sequence
  chemically synthesized
tctccttcctttcaccctgcaa

SEQ ID NO: 1119112 - DNA, 22 bp, Artificial Sequence
  chemically synthesized
gattaggctgtttgcagggtga

SEQ ID NO: 1119113 - DNA, 22 bp, Artificial Sequence
  chemically synthesized
tttctccttcctttcaccctgc

SEQ ID NO: 1119114 - DNA, 22 bp, Artificial Sequence
  chemically synthesized
ttctttctccttcctttcaccc

SEQ ID NO: 1119115 - DNA, 22 bp, Artificial Sequence
  chemically synthesized
ggctgtttgcagggtgaaagga

SEQ ID NO: 1119116 - DNA, 22 bp, Artificial Sequence
  chemically synthesized
attctttctccttcctttcacc

SEQ ID NO: 1119117 - DNA, 22 bp, Artificial Sequence
  chemically synthesized
tattctttctccttcctttcac

SEQ ID NO: 1119118 - DNA, 22 bp, Artificial Sequence
  chemically synthesized
ctttattctttctccttccttt

SEQ ID NO: 1119119 - DNA, 22 bp, Artificial Sequence
  chemically synthesized
tttgcagggtgaaaggaaggag

SEQ ID NO: 1119120 - DNA, 22 bp, Artificial Sequence
  chemically synthesized
gcagggtgaaaggaaggagaaa

SEQ ID NO: 1119121 - DNA, 22 bp, Artificial Sequence
  chemically synthesized
cagggtgaaaggaaggagaaag

SEQ ID NO: 1119122 - DNA, 22 bp, Artificial Sequence
  chemically synthesized
cccagacctcctttattctttc

SEQ ID NO: 1119123 - DNA, 22 bp, Artificial Sequence
  chemically synthesized
ccccagacctcctttattcttt

SEQ ID NO: 1119124 - DNA, 22 bp, Artificial Sequence
  chemically synthesized
tttccccagacctcctttattc

SEQ ID NO: 1119125 - DNA, 22 bp, Artificial Sequence
  chemically synthesized
attatttccccagacctccttt

SEQ ID NO: 1119126 - DNA, 22 bp, Artificial Sequence
  chemically synthesized
aatctcattatttccccagacc

SEQ ID NO: 1119127 - DNA, 22 bp, Artificial Sequence
  chemically synthesized
aaatctcattatttccccagac

SEQ ID NO: 1119128 - DNA, 22 bp, Artificial Sequence
  chemically synthesized
atatcttaaatctcattatttc

SEQ ID NO: 1119129 - DNA, 22 bp, Artificial Sequence
  chemically synthesized
cctgatatcttaaatctcatta

SEQ ID NO: 1119130 - DNA, 22 bp, Artificial Sequence
  chemically synthesized
gcctgatatcttaaatctcatt

SEQ ID NO: 1119131 - DNA, 22 bp, Artificial Sequence
  chemically synthesized
gggaaataatgagatttaagat

SEQ ID NO: 1119132 - DNA, 22 bp, Artificial Sequence
  chemically synthesized
atgtttgcctgatatcttaaat

SEQ ID NO: 1119133 - DNA, 22 bp, Artificial Sequence
  chemically synthesized
attgatgtttgcctgatatctt

SEQ ID NO: 1119134 - DNA, 22 bp, Artificial Sequence
  chemically synthesized
aattgatgtttgcctgatatct

SEQ ID NO: 1119135 - DNA, 22 bp, Artificial Sequence
  chemically synthesized
taattgatgtttgcctgatatc

SEQ ID NO: 1119136 - DNA, 22 bp, Artificial Sequence
  chemically synthesized
aagatatcaggcaaacatcaat

SEQ ID NO: 1119137 - DNA, 22 bp, Artificial Sequence
  chemically synthesized
agatatcaggcaaacatcaatt

SEQ ID NO: 1119138 - DNA, 22 bp, Artificial Sequence
  chemically synthesized
atagacaattttaattgatgtt

SEQ ID NO: 1119139 - DNA, 22 bp, Artificial Sequence
  chemically synthesized
cctaatagacaattttaattga

SEQ ID NO: 1119140 - DNA, 22 bp, Artificial Sequence
  chemically synthesized
actgcctaatagacaattttaa

SEQ ID NO: 1119141 - DNA, 22 bp, Artificial Sequence
  chemically synthesized
aaattgtctattaggcagtcag

SEQ ID NO: 1119142 - DNA, 22 bp, Artificial Sequence
  chemically synthesized
tctattaggcagtcagatatat

SEQ ID NO: 1119143 - DNA, 22 bp, Artificial Sequence
  chemically synthesized
aaacccagggtgatatatctga

SEQ ID NO: 1119144 - DNA, 22 bp, Artificial Sequence
  chemically synthesized
aaaacccagggtgatatatctg

SEQ ID NO: 1119145 - DNA, 22 bp, Artificial Sequence
  chemically synthesized
ttaaaacccagggtgatatatc

SEQ ID NO: 1119146 - DNA, 22 bp, Artificial Sequence
  chemically synthesized
ttaggcagtcagatatatcacc

SEQ ID NO: 1119147 - DNA, 22 bp, Artificial Sequence
  chemically synthesized
cttaaaacccagggtgatatat

SEQ ID NO: 1119148 - DNA, 22 bp, Artificial Sequence
  chemically synthesized
tcttaaaacccagggtgatata

SEQ ID NO: 1119149 - DNA, 22 bp, Artificial Sequence
  chemically synthesized
ggcagtcagatatatcaccctg

SEQ ID NO: 1119150 - DNA, 22 bp, Artificial Sequence
  chemically synthesized
tttcttaaaacccagggtgata

SEQ ID NO: 1119151 - DNA, 22 bp, Artificial Sequence
  chemically synthesized
atctctttcttaaaacccaggg

SEQ ID NO: 1119152 - DNA, 22 bp, Artificial Sequence
  chemically synthesized
gctcatctctttcttaaaaccc

SEQ ID NO: 1119153 - DNA, 22 bp, Artificial Sequence
  chemically synthesized
agctcatctctttcttaaaacc

SEQ ID NO: 1119154 - DNA, 22 bp, Artificial Sequence
  chemically synthesized
tagctcatctctttcttaaaac

SEQ ID NO: 1119155 - DNA, 22 bp, Artificial Sequence
  chemically synthesized
ggttttaagaaagagatgagct

SEQ ID NO: 1119156 - DNA, 22 bp, Artificial Sequence
  chemically synthesized
ccatatgtatctttagctcatc

SEQ ID NO: 1119157 - DNA, 22 bp, Artificial Sequence
  chemically synthesized
tcccatatgtatctttagctca

SEQ ID NO: 1119158 - DNA, 22 bp, Artificial Sequence
  chemically synthesized
taagaaagagatgagctaaaga

SEQ ID NO: 1119159 - DNA, 22 bp, Artificial Sequence
  chemically synthesized
ctcccatatgtatctttagctc

SEQ ID NO: 1119160 - DNA, 22 bp, Artificial Sequence
  chemically synthesized
aagaaagagatgagctaaagat

SEQ ID NO: 1119161 - DNA, 22 bp, Artificial Sequence
  chemically synthesized
agaaagagatgagctaaagata

SEQ ID NO: 1119162 - DNA, 22 bp, Artificial Sequence
  chemically synthesized
aaatgaacccttctcccatatg

SEQ ID NO: 1119163 - DNA, 22 bp, Artificial Sequence
  chemically synthesized
caaatgaacccttctcccatat

SEQ ID NO: 1119164 - DNA, 22 bp, Artificial Sequence
  chemically synthesized
tcaaatgaacccttctcccata

SEQ ID NO: 1119165 - DNA, 22 bp, Artificial Sequence
  chemically synthesized
ttttcaaatgaacccttctccc

SEQ ID NO: 1119166 - DNA, 22 bp, Artificial Sequence
  chemically synthesized
aagatacatatgggagaagggt

SEQ ID NO: 1119167 - DNA, 22 bp, Artificial Sequence
  chemically synthesized
aaatagtgtctattttcaaatg

SEQ ID NO: 1119168 - DNA, 22 bp, Artificial Sequence
  chemically synthesized
ccattcaaatagtgtctatttt

SEQ ID NO: 1119169 - DNA, 22 bp, Artificial Sequence
  chemically synthesized
attcccattcaaatagtgtcta

SEQ ID NO: 1119170 - DNA, 22 bp, Artificial Sequence
  chemically synthesized
atttgaaaatagacactatttg

SEQ ID NO: 1119171 - DNA, 22 bp, Artificial Sequence
  chemically synthesized
attcattcccattcaaatagtg

SEQ ID NO: 1119172 - DNA, 22 bp, Artificial Sequence
  chemically synthesized
gaaaatagacactatttgaatg

SEQ ID NO: 1119173 - DNA, 22 bp, Artificial Sequence
  chemically synthesized
aaaatagacactatttgaatgg

SEQ ID NO: 1119174 - DNA, 22 bp, Artificial Sequence
  chemically synthesized
gatatcctcattcattcccatt

SEQ ID NO: 1119175 - DNA, 22 bp, Artificial Sequence
  chemically synthesized
tggatatcctcattcattccca

SEQ ID NO: 1119176 - DNA, 22 bp, Artificial Sequence
  chemically synthesized
tctggatatcctcattcattcc

SEQ ID NO: 1119177 - DNA, 22 bp, Artificial Sequence
  chemically synthesized
ctctggatatcctcattcattc

SEQ ID NO: 1119178 - DNA, 22 bp, Artificial Sequence
  chemically synthesized
ttctctggatatcctcattcat

SEQ ID NO: 1119179 - DNA, 22 bp, Artificial Sequence
  chemically synthesized
tttgaatgggaatgaatgagga

SEQ ID NO: 1119180 - DNA, 22 bp, Artificial Sequence
  chemically synthesized
cttctctggatatcctcattca

SEQ ID NO: 1119181 - DNA, 22 bp, Artificial Sequence
  chemically synthesized
gaatgggaatgaatgaggatat

SEQ ID NO: 1119182 - DNA, 22 bp, Artificial Sequence
  chemically synthesized
aatgggaatgaatgaggatatc

SEQ ID NO: 1119183 - DNA, 22 bp, Artificial Sequence
  chemically synthesized
tgtttcttctctggatatcctc

SEQ ID NO: 1119184 - DNA, 22 bp, Artificial Sequence
  chemically synthesized
gtgtttcttctctggatatcct

SEQ ID NO: 1119185 - DNA, 22 bp, Artificial Sequence
  chemically synthesized
agagtccttgtgtttcttctct

SEQ ID NO: 1119186 - DNA, 22 bp, Artificial Sequence
  chemically synthesized
cagagtccttgtgtttcttctc

SEQ ID NO: 1119187 - DNA, 22 bp, Artificial Sequence
  chemically synthesized
ttcagagtccttgtgtttcttc

SEQ ID NO: 1119188 - DNA, 22 bp, Artificial Sequence
  chemically synthesized
atattcttcagagtccttgtgt

SEQ ID NO: 1119189 - DNA, 22 bp, Artificial Sequence
  chemically synthesized
atattgatattcttcagagtcc

SEQ ID NO: 1119190 - DNA, 22 bp, Artificial Sequence
  chemically synthesized
aatattgatattcttcagagtc

SEQ ID NO: 1119191 - DNA, 22 bp, Artificial Sequence
  chemically synthesized
taatattgatattcttcagagt

SEQ ID NO: 1119192 - DNA, 22 bp, Artificial Sequence
  chemically synthesized
tttaatattgatattcttcaga

SEQ ID NO: 1119193 - DNA, 22 bp, Artificial Sequence
  chemically synthesized
ctttaatattgatattcttcag

SEQ ID NO: 1119194 - DNA, 22 bp, Artificial Sequence
  chemically synthesized
tctttaatattgatattcttca

SEQ ID NO: 1119195 - DNA, 22 bp, Artificial Sequence
  chemically synthesized
ttctttaatattgatattcttc

SEQ ID NO: 1119196 - DNA, 22 bp, Artificial Sequence
  chemically synthesized
agtttttctttaatattgatat

SEQ ID NO: 1119197 - DNA, 22 bp, Artificial Sequence
  chemically synthesized
tgaagaatatcaatattaaaga

SEQ ID NO: 1119198 - DNA, 22 bp, Artificial Sequence
  chemically synthesized
caattcagtttttctttaatat

SEQ ID NO: 1119199 - DNA, 22 bp, Artificial Sequence
  chemically synthesized
aagaatatcaatattaaagaaa

SEQ ID NO: 1119200 - DNA, 22 bp, Artificial Sequence
  chemically synthesized
ttccaattcagtttttctttaa

SEQ ID NO: 1119201 - DNA, 22 bp, Artificial Sequence
  chemically synthesized
gttccaattcagtttttcttta

SEQ ID NO: 1119202 - DNA, 22 bp, Artificial Sequence
  chemically synthesized
gccatttgttccaattcagttt

SEQ ID NO: 1119203 - DNA, 22 bp, Artificial Sequence
  chemically synthesized
ggccatttgttccaattcagtt

SEQ ID NO: 1119204 - DNA, 22 bp, Artificial Sequence
  chemically synthesized
ttggccatttgttccaattcag

SEQ ID NO: 1119205 - DNA, 22 bp, Artificial Sequence
  chemically synthesized
aagaaaaactgaattggaacaa

SEQ ID NO: 1119206 - DNA, 22 bp, Artificial Sequence
  chemically synthesized
acattcttggccatttgttcca

SEQ ID NO: 1119207 - DNA, 22 bp, Artificial Sequence
  chemically synthesized
cacattcttggccatttgttcc

SEQ ID NO: 1119208 - DNA, 22 bp, Artificial Sequence
  chemically synthesized
tcacattcttggccatttgttc

SEQ ID NO: 1119209 - DNA, 22 bp, Artificial Sequence
  chemically synthesized
tttcacattcttggccatttgt

SEQ ID NO: 1119210 - DNA, 22 bp, Artificial Sequence
  chemically synthesized
attctttcacattcttggccat

SEQ ID NO: 1119211 - DNA, 22 bp, Artificial Sequence
  chemically synthesized
aattggaacaaatggccaagaa

SEQ ID NO: 1119212 - DNA, 22 bp, Artificial Sequence
  chemically synthesized
attaattctttcacattcttgg

SEQ ID NO: 1119213 - DNA, 22 bp, Artificial Sequence
  chemically synthesized
gaacaaatggccaagaatgtga

SEQ ID NO: 1119214 - DNA, 22 bp, Artificial Sequence
  chemically synthesized
ctgattaattctttcacattct

SEQ ID NO: 1119215 - DNA, 22 bp, Artificial Sequence
  chemically synthesized
tcctgattaattctttcacatt

SEQ ID NO: 1119216 - DNA, 22 bp, Artificial Sequence
  chemically synthesized
ctcctgattaattctttcacat

SEQ ID NO: 1119217 - DNA, 22 bp, Artificial Sequence
  chemically synthesized
tctcctgattaattctttcaca

SEQ ID NO: 1119218 - DNA, 22 bp, Artificial Sequence
  chemically synthesized
ctttctcctgattaattctttc

SEQ ID NO: 1119219 - DNA, 22 bp, Artificial Sequence
  chemically synthesized
tgggatactgctttctcctgat

SEQ ID NO: 1119220 - DNA, 22 bp, Artificial Sequence
  chemically synthesized
atgggatactgctttctcctga

SEQ ID NO: 1119221 - DNA, 22 bp, Artificial Sequence
  chemically synthesized
gcttatgggatactgctttctc

SEQ ID NO: 1119222 - DNA, 22 bp, Artificial Sequence
  chemically synthesized
ggcttatgggatactgctttct

SEQ ID NO: 1119223 - DNA, 22 bp, Artificial Sequence
  chemically synthesized
gcttggcttatgggatactgct

SEQ ID NO: 1119224 - DNA, 22 bp, Artificial Sequence
  chemically synthesized
atcaggagaaagcagtatccca

SEQ ID NO: 1119225 - DNA, 22 bp, Artificial Sequence
  chemically synthesized
ctcgcttggcttatgggatact

SEQ ID NO: 1119226 - DNA, 22 bp, Artificial Sequence
  chemically synthesized
cctcgcttggcttatgggatac

SEQ ID NO: 1119227 - DNA, 22 bp, Artificial Sequence
  chemically synthesized
tcctcgcttggcttatgggata

SEQ ID NO: 1119228 - DNA, 22 bp, Artificial Sequence
  chemically synthesized
tttcctcgcttggcttatggga

SEQ ID NO: 1119229 - DNA, 22 bp, Artificial Sequence
  chemically synthesized
atgaaattctttcctcgcttgg

SEQ ID NO: 1119230 - DNA, 22 bp, Artificial Sequence
  chemically synthesized
cctcatgaaattctttcctcgc

SEQ ID NO: 1119231 - DNA, 22 bp, Artificial Sequence
  chemically synthesized
ccctcatgaaattctttcctcg

SEQ ID NO: 1119232 - DNA, 22 bp, Artificial Sequence
  chemically synthesized
tccctcatgaaattctttcctc

SEQ ID NO: 1119233 - DNA, 22 bp, Artificial Sequence
  chemically synthesized
ttccctcatgaaattctttcct

SEQ ID NO: 1119234 - DNA, 22 bp, Artificial Sequence
  chemically synthesized
ttttccctcatgaaattctttc

SEQ ID NO: 1119235 - DNA, 22 bp, Artificial Sequence
  chemically synthesized
acctcttttccctcatgaaatt

SEQ ID NO: 1119236 - DNA, 22 bp, Artificial Sequence
  chemically synthesized
ttaacctcttttccctcatgaa

SEQ ID NO: 1119237 - DNA, 22 bp, Artificial Sequence
  chemically synthesized
gaacctattaacctcttttccc

SEQ ID NO: 1119238 - DNA, 22 bp, Artificial Sequence
  chemically synthesized
catgagggaaaagaggttaata

SEQ ID NO: 1119239 - DNA, 22 bp, Artificial Sequence
  chemically synthesized
atgagggaaaagaggttaatag

SEQ ID NO: 1119240 - DNA, 22 bp, Artificial Sequence
  chemically synthesized
tagaactagaacctattaacct

SEQ ID NO: 1119241 - DNA, 22 bp, Artificial Sequence
  chemically synthesized
tgtagaactagaacctattaac

SEQ ID NO: 1119242 - DNA, 22 bp, Artificial Sequence
  chemically synthesized
aatccctctgtagaactagaac

SEQ ID NO: 1119243 - DNA, 22 bp, Artificial Sequence
  chemically synthesized
ctcaatccctctgtagaactag

SEQ ID NO: 1119244 - DNA, 22 bp, Artificial Sequence
  chemically synthesized
actcaatccctctgtagaacta

SEQ ID NO: 1119245 - DNA, 22 bp, Artificial Sequence
  chemically synthesized
ataggttctagttctacagagg

SEQ ID NO: 1119246 - DNA, 22 bp, Artificial Sequence
  chemically synthesized
tcttactcaatccctctgtaga

SEQ ID NO: 1119247 - DNA, 22 bp, Artificial Sequence
  chemically synthesized
atcttactcaatccctctgtag

SEQ ID NO: 1119248 - DNA, 22 bp, Artificial Sequence
  chemically synthesized
tagttctacagagggattgagt

SEQ ID NO: 1119249 - DNA, 22 bp, Artificial Sequence
  chemically synthesized
gttctacagagggattgagtaa

SEQ ID NO: 1119250 - DNA, 22 bp, Artificial Sequence
  chemically synthesized
acgtgccttatcttactcaatc

SEQ ID NO: 1119251 - DNA, 22 bp, Artificial Sequence
  chemically synthesized
aacgtgccttatcttactcaat

SEQ ID NO: 1119252 - DNA, 22 bp, Artificial Sequence
  chemically synthesized
tacagagggattgagtaagata

SEQ ID NO: 1119253 - DNA, 22 bp, Artificial Sequence
  chemically synthesized
cagagggattgagtaagataag

SEQ ID NO: 1119254 - DNA, 22 bp, Artificial Sequence
  chemically synthesized
agtaagataaggcacgttaagt

SEQ ID NO: 1119255 - DNA, 22 bp, Artificial Sequence
  chemically synthesized
taaacatgcatgtgaatactta

SEQ ID NO: 1119256 - DNA, 22 bp, Artificial Sequence
  chemically synthesized
ctataaacatgcatgtgaatac

SEQ ID NO: 1119257 - DNA, 22 bp, Artificial Sequence
  chemically synthesized
tcctataaacatgcatgtgaat

SEQ ID NO: 1119258 - DNA, 22 bp, Artificial Sequence
  chemically synthesized
agtattcacatgcatgtttata

SEQ ID NO: 1119259 - DNA, 22 bp, Artificial Sequence
  chemically synthesized
gaacgtgtcctctcctataaac

SEQ ID NO: 1119260 - DNA, 22 bp, Artificial Sequence
  chemically synthesized
agaacgtgtcctctcctataaa

SEQ ID NO: 1119261 - DNA, 22 bp, Artificial Sequence
  chemically synthesized
tagaacgtgtcctctcctataa

SEQ ID NO: 1119262 - DNA, 22 bp, Artificial Sequence
  chemically synthesized
ttagaacgtgtcctctcctata

SEQ ID NO: 1119263 - DNA, 22 bp, Artificial Sequence
  chemically synthesized
acatgcatgtttataggagagg

SEQ ID NO: 1119264 - DNA, 22 bp, Artificial Sequence
  chemically synthesized
atcttttagaacgtgtcctctc

SEQ ID NO: 1119265 - DNA, 22 bp, Artificial Sequence
  chemically synthesized
catcttttagaacgtgtcctct

SEQ ID NO: 1119266 - DNA, 22 bp, Artificial Sequence
  chemically synthesized
tcatcttttagaacgtgtcctc

SEQ ID NO: 1119267 - DNA, 22 bp, Artificial Sequence
  chemically synthesized
tgttttcatcttttagaacgtg

SEQ ID NO: 1119268 - DNA, 22 bp, Artificial Sequence
  chemically synthesized
ataggagaggacacgttctaaa

SEQ ID NO: 1119269 - DNA, 22 bp, Artificial Sequence
  chemically synthesized
taggagaggacacgttctaaaa

SEQ ID NO: 1119270 - DNA, 22 bp, Artificial Sequence
  chemically synthesized
aaccggttgtgttttcatcttt

SEQ ID NO: 1119271 - DNA, 22 bp, Artificial Sequence
  chemically synthesized
aaaccggttgtgttttcatctt

SEQ ID NO: 1119272 - DNA, 22 bp, Artificial Sequence
  chemically synthesized
taaaccggttgtgttttcatct

SEQ ID NO: 1119273 - DNA, 22 bp, Artificial Sequence
  chemically synthesized
ttaaaccggttgtgttttcatc

SEQ ID NO: 1119274 - DNA, 22 bp, Artificial Sequence
  chemically synthesized
gcttttaaaccggttgtgtttt

SEQ ID NO: 1119275 - DNA, 22 bp, Artificial Sequence
  chemically synthesized
taaaagatgaaaacacaaccgg

SEQ ID NO: 1119276 - DNA, 22 bp, Artificial Sequence
  chemically synthesized
aaagatgaaaacacaaccggtt

SEQ ID NO: 1119277 - DNA, 22 bp, Artificial Sequence
  chemically synthesized
tcattagcttttaaaccggttg

SEQ ID NO: 1119278 - DNA, 22 bp, Artificial Sequence
  chemically synthesized
atcattagcttttaaaccggtt

SEQ ID NO: 1119279 - DNA, 22 bp, Artificial Sequence
  chemically synthesized
tatcattagcttttaaaccggt

SEQ ID NO: 1119280 - DNA, 22 bp, Artificial Sequence
  chemically synthesized
catcccaggtctttatcattag

SEQ ID NO: 1119281 - DNA, 22 bp, Artificial Sequence
  chemically synthesized
aaaagctaatgataaagacctg

SEQ ID NO: 1119282 - DNA, 22 bp, Artificial Sequence
  chemically synthesized
aaagctaatgataaagacctgg

SEQ ID NO: 1119283 - DNA, 22 bp, Artificial Sequence
  chemically synthesized
tcaaaaatctacatcccaggtc

SEQ ID NO: 1119284 - DNA, 22 bp, Artificial Sequence
  chemically synthesized
atgataaagacctgggatgtag

SEQ ID NO: 1119285 - DNA, 22 bp, Artificial Sequence
  chemically synthesized
tatatccagattgtcaaaaatc

SEQ ID NO: 1119286 - DNA, 22 bp, Artificial Sequence
  chemically synthesized
ggatgtagatttttgacaatct

SEQ ID NO: 1119287 - DNA, 22 bp, Artificial Sequence
  chemically synthesized
agctgtatatccagattgtcaa

SEQ ID NO: 1119288 - DNA, 22 bp, Artificial Sequence
  chemically synthesized
cattcagctgtatatccagatt

SEQ ID NO: 1119289 - DNA, 22 bp, Artificial Sequence
  chemically synthesized
gttccattcagctgtatatcca

SEQ ID NO: 1119290 - DNA, 22 bp, Artificial Sequence
  chemically synthesized
ttgacaatctggatatacagct

SEQ ID NO: 1119291 - DNA, 22 bp, Artificial Sequence
  chemically synthesized
tgacaatctggatatacagctg

SEQ ID NO: 1119292 - DNA, 22 bp, Artificial Sequence
  chemically synthesized
gacaatctggatatacagctga

SEQ ID NO: 1119293 - DNA, 22 bp, Artificial Sequence
  chemically synthesized
acaatctggatatacagctgaa

SEQ ID NO: 1119294 - DNA, 22 bp, Artificial Sequence
  chemically synthesized
agccacctggttccattcagct

SEQ ID NO: 1119295 - DNA, 22 bp, Artificial Sequence
  chemically synthesized
gatatacagctgaatggaacca

SEQ ID NO: 1119296 - DNA, 22 bp, Artificial Sequence
  chemically synthesized
tgtattaagccacctggttcca

SEQ ID NO: 1119297 - DNA, 22 bp, Artificial Sequence
  chemically synthesized
actatgtattaagccacctggt

SEQ ID NO: 1119298 - DNA, 22 bp, Artificial Sequence
  chemically synthesized
aatggaaccaggtggcttaata

SEQ ID NO: 1119299 - DNA, 22 bp, Artificial Sequence
  chemically synthesized
agcagcatcactgactatgtat

SEQ ID NO: 1119300 - DNA, 22 bp, Artificial Sequence
  chemically synthesized
tcagcagcatcactgactatgt

SEQ ID NO: 1119301 - DNA, 22 bp, Artificial Sequence
  chemically synthesized
aatacatagtcagtgatgctgc

SEQ ID NO: 1119302 - DNA, 22 bp, Artificial Sequence
  chemically synthesized
atacatagtcagtgatgctgct

SEQ ID NO: 1119303 - DNA, 22 bp, Artificial Sequence
  chemically synthesized
ggtgtgtgttctcagcagcatc

SEQ ID NO: 1119304 - DNA, 22 bp, Artificial Sequence
  chemically synthesized
tgggtgtgtgttctcagcagca

SEQ ID NO: 1119305 - DNA, 22 bp, Artificial Sequence
  chemically synthesized
atctctgggtgtgtgttctcag

SEQ ID NO: 1119306 - DNA, 22 bp, Artificial Sequence
  chemically synthesized
aggctcatctctgggtgtgtgt

SEQ ID NO: 1119307 - DNA, 22 bp, Artificial Sequence
  chemically synthesized
gttgaggctcatctctgggtgt

SEQ ID NO: 1119308 - DNA, 22 bp, Artificial Sequence
  chemically synthesized
ctgagaacacacacccagagat

SEQ ID NO: 1119309 - DNA, 22 bp, Artificial Sequence
  chemically synthesized
agaacacacacccagagatgag

SEQ ID NO: 1119310 - DNA, 22 bp, Artificial Sequence
  chemically synthesized
acctggttgaggctcatctctg

SEQ ID NO: 1119311 - DNA, 22 bp, Artificial Sequence
  chemically synthesized
cacctggttgaggctcatctct

SEQ ID NO: 1119312 - DNA, 22 bp, Artificial Sequence
  chemically synthesized
tccttcacctggttgaggctca

SEQ ID NO: 1119313 - DNA, 22 bp, Artificial Sequence
  chemically synthesized
gtggaagaggctatccttcacc

SEQ ID NO: 1119314 - DNA, 22 bp, Artificial Sequence
  chemically synthesized
agtggaagaggctatccttcac

SEQ ID NO: 1119315 - DNA, 22 bp, Artificial Sequence
  chemically synthesized
ccttagtggaagaggctatcct

SEQ ID NO: 1119316 - DNA, 22 bp, Artificial Sequence
  chemically synthesized
aaccaggtgaaggatagcctct

SEQ ID NO: 1119317 - DNA, 22 bp, Artificial Sequence
  chemically synthesized
cacctgccttagtggaagaggc

SEQ ID NO: 1119318 - DNA, 22 bp, Artificial Sequence
  chemically synthesized
ccacctgccttagtggaagagg

SEQ ID NO: 1119319 - DNA, 22 bp, Artificial Sequence
  chemically synthesized
tccacctgccttagtggaagag

SEQ ID NO: 1119320 - DNA, 22 bp, Artificial Sequence
  chemically synthesized
ttccacctgccttagtggaaga

SEQ ID NO: 1119321 - DNA, 22 bp, Artificial Sequence
  chemically synthesized
tttccacctgccttagtggaag

SEQ ID NO: 1119322 - DNA, 22 bp, Artificial Sequence
  chemically synthesized
ttttccacctgccttagtggaa

SEQ ID NO: 1119323 - DNA, 22 bp, Artificial Sequence
  chemically synthesized
tttttccacctgccttagtgga

SEQ ID NO: 1119324 - DNA, 22 bp, Artificial Sequence
  chemically synthesized
ttttttccacctgccttagtgg

SEQ ID NO: 1119325 - DNA, 22 bp, Artificial Sequence
  chemically synthesized
tttttttccacctgccttagtg

SEQ ID NO: 1119326 - DNA, 22 bp, Artificial Sequence
  chemically synthesized
ttttttttccacctgccttagt

SEQ ID NO: 1119327 - DNA, 22 bp, Artificial Sequence
  chemically synthesized
tttttttttccacctgccttag

SEQ ID NO: 1119328 - DNA, 22 bp, Artificial Sequence
  chemically synthesized
ttttttttttccacctgcctta

SEQ ID NO: 1119329 - DNA, 22 bp, Artificial Sequence
  chemically synthesized
tttttttttttccacctgcctt

SEQ ID NO: 1119330 - DNA, 22 bp, Artificial Sequence
  chemically synthesized
ttttttttttttccacctgcct

SEQ ID NO: 1119331 - DNA, 22 bp, Artificial Sequence
  chemically synthesized
tttttttttttttccacctgcc

SEQ ID NO: 1119332 - DNA, 22 bp, Artificial Sequence
  chemically synthesized
ttttttttttttttccacctgc

SEQ ID NO: 1119333 - DNA, 22 bp, Artificial Sequence
  chemically synthesized
tttttttttttttttccacctg

SEQ ID NO: 1119334 - DNA, 22 bp, Artificial Sequence
  chemically synthesized
ttccactaaggcaggtggaaaa

SEQ ID NO: 1119335 - DNA, 22 bp, Artificial Sequence
  chemically synthesized
ttttttttttttttttccacct

SEQ ID NO: 1119336 - DNA, 22 bp, Artificial Sequence
  chemically synthesized
ccactaaggcaggtggaaaaaa

SEQ ID NO: 1119337 - DNA, 22 bp, Artificial Sequence
  chemically synthesized
cactaaggcaggtggaaaaaaa

SEQ ID NO: 1119338 - DNA, 22 bp, Artificial Sequence
  chemically synthesized
aggcaggtggaaaaaaaaaaaa

SEQ ID NO: 1119339 - DNA, 22 bp, Artificial Sequence
  chemically synthesized
atagtatctttttttttttttt

SEQ ID NO: 1119340 - DNA, 22 bp, Artificial Sequence
  chemically synthesized
tgctcatagtatcttttttttt

SEQ ID NO: 1119341 - DNA, 22 bp, Artificial Sequence
  chemically synthesized
gtgctcatagtatctttttttt

SEQ ID NO: 1119342 - DNA, 22 bp, Artificial Sequence
  chemically synthesized
tgggtatttgtgctcatagtat

SEQ ID NO: 1119343 - DNA, 22 bp, Artificial Sequence
  chemically synthesized
aaattgtgggtatttgtgctca

SEQ ID NO: 1119344 - DNA, 22 bp, Artificial Sequence
  chemically synthesized
tcaaattgtgggtatttgtgct

SEQ ID NO: 1119345 - DNA, 22 bp, Artificial Sequence
  chemically synthesized
ctcaaattgtgggtatttgtgc

SEQ ID NO: 1119346 - DNA, 22 bp, Artificial Sequence
  chemically synthesized
tgagcacaaatacccacaattt

SEQ ID NO: 1119347 - DNA, 22 bp, Artificial Sequence
  chemically synthesized
gtcgaaataatatttctcaaat

SEQ ID NO: 1119348 - DNA, 22 bp, Artificial Sequence
  chemically synthesized
agtcgaaataatatttctcaaa

SEQ ID NO: 1119349 - DNA, 22 bp, Artificial Sequence
  chemically synthesized
tagtcgaaataatatttctcaa

SEQ ID NO: 1119350 - DNA, 22 bp, Artificial Sequence
  chemically synthesized
ctttagtcgaaataatatttct

SEQ ID NO: 1119351 - DNA, 22 bp, Artificial Sequence
  chemically synthesized
ctactttagtcgaaataatatt

SEQ ID NO: 1119352 - DNA, 22 bp, Artificial Sequence
  chemically synthesized
atctcctactttagtcgaaata

SEQ ID NO: 1119353 - DNA, 22 bp, Artificial Sequence
  chemically synthesized
catctcctactttagtcgaaat

SEQ ID NO: 1119354 - DNA, 22 bp, Artificial Sequence
  chemically synthesized
gagaaatattatttcgactaaa

SEQ ID NO: 1119355 - DNA, 22 bp, Artificial Sequence
  chemically synthesized
agaaatattatttcgactaaag

SEQ ID NO: 1119356 - DNA, 22 bp, Artificial Sequence
  chemically synthesized
tttcgactaaagtaggagatga

SEQ ID NO: 1119357 - DNA, 22 bp, Artificial Sequence
  chemically synthesized
acagtaaatgatttcatctcct

SEQ ID NO: 1119358 - DNA, 22 bp, Artificial Sequence
  chemically synthesized
cgactaaagtaggagatgaaat

SEQ ID NO: 1119359 - DNA, 22 bp, Artificial Sequence
  chemically synthesized
gactaaagtaggagatgaaatc

SEQ ID NO: 1119360 - DNA, 22 bp, Artificial Sequence
  chemically synthesized
aagtaggagatgaaatcattta

SEQ ID NO: 1119361 - DNA, 22 bp, Artificial Sequence
  chemically synthesized
cccatcattcacagtaaatgat

SEQ ID NO: 1119362 - DNA, 22 bp, Artificial Sequence
  chemically synthesized
ccccatcattcacagtaaatga

SEQ ID NO: 1119363 - DNA, 22 bp, Artificial Sequence
  chemically synthesized
tccccatcattcacagtaaatg

SEQ ID NO: 1119364 - DNA, 22 bp, Artificial Sequence
  chemically synthesized
aactttccccatcattcacagt

SEQ ID NO: 1119365 - DNA, 22 bp, Artificial Sequence
  chemically synthesized
tggggtacctaaactttcccca

SEQ ID NO: 1119366 - DNA, 22 bp, Artificial Sequence
  chemically synthesized
actgtgaatgatggggaaagtt

SEQ ID NO: 1119367 - DNA, 22 bp, Artificial Sequence
  chemically synthesized
gtggggtacctaaactttcccc

SEQ ID NO: 1119368 - DNA, 22 bp, Artificial Sequence
  chemically synthesized
ctgtgaatgatggggaaagttt

SEQ ID NO: 1119369 - DNA, 22 bp, Artificial Sequence
  chemically synthesized
tgtggggtacctaaactttccc

SEQ ID NO: 1119370 - DNA, 22 bp, Artificial Sequence
  chemically synthesized
ttgtggggtacctaaactttcc

SEQ ID NO: 1119371 - DNA, 22 bp, Artificial Sequence
  chemically synthesized
tgaatgatggggaaagtttagg

SEQ ID NO: 1119372 - DNA, 22 bp, Artificial Sequence
  chemically synthesized
aagcttttgtggggtacctaaa

SEQ ID NO: 1119373 - DNA, 22 bp, Artificial Sequence
  chemically synthesized
caagcttttgtggggtacctaa

SEQ ID NO: 1119374 - DNA, 22 bp, Artificial Sequence
  chemically synthesized
tttcaagcttttgtggggtacc

SEQ ID NO: 1119375 - DNA, 22 bp, Artificial Sequence
  chemically synthesized
aacaattatttcaagcttttgt

SEQ ID NO: 1119376 - DNA, 22 bp, Artificial Sequence
  chemically synthesized
tcaacaattatttcaagctttt

SEQ ID NO: 1119377 - DNA, 22 bp, Artificial Sequence
  chemically synthesized
aggtaccccacaaaagcttgaa

SEQ ID NO: 1119378 - DNA, 22 bp, Artificial Sequence
  chemically synthesized
ggtaccccacaaaagcttgaaa

SEQ ID NO: 1119379 - DNA, 22 bp, Artificial Sequence
  chemically synthesized
tctcaacaattatttcaagctt

SEQ ID NO: 1119380 - DNA, 22 bp, Artificial Sequence
  chemically synthesized
ctctcaacaattatttcaagct

SEQ ID NO: 1119381 - DNA, 22 bp, Artificial Sequence
  chemically synthesized
gtttctctcaacaattatttca

SEQ ID NO: 1119382 - DNA, 22 bp, Artificial Sequence
  chemically synthesized
agtttctctcaacaattatttc

SEQ ID NO: 1119383 - DNA, 22 bp, Artificial Sequence
  chemically synthesized
aacttagtttctctcaacaatt

SEQ ID NO: 1119384 - DNA, 22 bp, Artificial Sequence
  chemically synthesized
caacttagtttctctcaacaat

SEQ ID NO: 1119385 - DNA, 22 bp, Artificial Sequence
  chemically synthesized
tcaacttagtttctctcaacaa

SEQ ID NO: 1119386 - DNA, 22 bp, Artificial Sequence
  chemically synthesized
gaaataattgttgagagaaact

SEQ ID NO: 1119387 - DNA, 22 bp, Artificial Sequence
  chemically synthesized
aaataattgttgagagaaacta

SEQ ID NO: 1119388 - DNA, 22 bp, Artificial Sequence
  chemically synthesized
agtatattttcaacttagtttc

SEQ ID NO: 1119389 - DNA, 22 bp, Artificial Sequence
  chemically synthesized
ttgagagaaactaagttgaaaa

SEQ ID NO: 1119390 - DNA, 22 bp, Artificial Sequence
  chemically synthesized
agagaaactaagttgaaaatat

SEQ ID NO: 1119391 - DNA, 22 bp, Artificial Sequence
  chemically synthesized
cgtgcatcctaagtatattttc

SEQ ID NO: 1119392 - DNA, 22 bp, Artificial Sequence
  chemically synthesized
ccgtgcatcctaagtatatttt

SEQ ID NO: 1119393 - DNA, 22 bp, Artificial Sequence
  chemically synthesized
tccgtgcatcctaagtatattt

SEQ ID NO: 1119394 - DNA, 22 bp, Artificial Sequence
  chemically synthesized
agttgaaaatatacttaggatg

SEQ ID NO: 1119395 - DNA, 22 bp, Artificial Sequence
  chemically synthesized
ataagctttccgtgcatcctaa

SEQ ID NO: 1119396 - DNA, 22 bp, Artificial Sequence
  chemically synthesized
cataagctttccgtgcatccta

SEQ ID NO: 1119397 - DNA, 22 bp, Artificial Sequence
  chemically synthesized
aaaatatacttaggatgcacgg

SEQ ID NO: 1119398 - DNA, 22 bp, Artificial Sequence
  chemically synthesized
ttcataagctttccgtgcatcc

SEQ ID NO: 1119399 - DNA, 22 bp, Artificial Sequence
  chemically synthesized
aggatgcacggaaagcttatga

SEQ ID NO: 1119400 - DNA, 22 bp, Artificial Sequence
  chemically synthesized
ggatgcacggaaagcttatgaa

SEQ ID NO: 1119401 - DNA, 22 bp, Artificial Sequence
  chemically synthesized
acaaaaccagcagttcttcata

SEQ ID NO: 1119402 - DNA, 22 bp, Artificial Sequence
  chemically synthesized
aacaaaaccagcagttcttcat

SEQ ID NO: 1119403 - DNA, 22 bp, Artificial Sequence
  chemically synthesized
taacaaaaccagcagttcttca

SEQ ID NO: 1119404 - DNA, 22 bp, Artificial Sequence
  chemically synthesized
atgaagaactgctggttttgtt

SEQ ID NO: 1119405 - DNA, 22 bp, Artificial Sequence
  chemically synthesized
acaacatattttaacaaaacca

SEQ ID NO: 1119406 - DNA, 22 bp, Artificial Sequence
  chemically synthesized
tgaagaactgctggttttgtta

SEQ ID NO: 1119407 - DNA, 22 bp, Artificial Sequence
  chemically synthesized
ctggttttgttaaaatatgttg

SEQ ID NO: 1119408 - DNA, 22 bp, Artificial Sequence
  chemically synthesized
gttttgttaaaatatgttgtta

SEQ ID NO: 1119409 - DNA, 22 bp, Artificial Sequence
  chemically synthesized
tgttaaaatatgttgttagtgc

SEQ ID NO: 1119410 - DNA, 22 bp, Artificial Sequence
  chemically synthesized
gttaaaatatgttgttagtgcc

SEQ ID NO: 1119411 - DNA, 22 bp, Artificial Sequence
  chemically synthesized
ttaaaatatgttgttagtgccg

SEQ ID NO: 1119412 - DNA, 22 bp, Artificial Sequence
  chemically synthesized
aaatatgttgttagtgccgggc

SEQ ID NO: 1119413 - DNA, 22 bp, Artificial Sequence
  chemically synthesized
caggcgtgagccaccgcgcccg

SEQ ID NO: 1119414 - DNA, 22 bp, Artificial Sequence
  chemically synthesized
ttagtgccgggcgcggtggctc

SEQ ID NO: 1119415 - DNA, 22 bp, Artificial Sequence
  chemically synthesized
ggattacaggcgtgagccaccg

SEQ ID NO: 1119416 - DNA, 22 bp, Artificial Sequence
  chemically synthesized
gtgccgggcgcggtggctcacg

SEQ ID NO: 1119417 - DNA, 22 bp, Artificial Sequence
  chemically synthesized
ccaaagtgctgggattacaggc

SEQ ID NO: 1119418 - DNA, 22 bp, Artificial Sequence
  chemically synthesized
ggcctcccaaagtgctgggatt

SEQ ID NO: 1119419 - DNA, 22 bp, Artificial Sequence
  chemically synthesized
acgcctgtaatcccagcacttt

SEQ ID NO: 1119420 - DNA, 22 bp, Artificial Sequence
  chemically synthesized
taatcccagcactttgggaggc

SEQ ID NO: 1119421 - DNA, 22 bp, Artificial Sequence
  chemically synthesized
gtgatccgcccgcctcggcctc

SEQ ID NO: 1119422 - DNA, 22 bp, Artificial Sequence
  chemically synthesized
acctcgtgatccgcccgcctcg

SEQ ID NO: 1119423 - DNA, 22 bp, Artificial Sequence
  chemically synthesized
ctgacctcgtgatccgcccgcc

SEQ ID NO: 1119424 - DNA, 22 bp, Artificial Sequence
  chemically synthesized
tgggaggccgaggcgggcggat

SEQ ID NO: 1119425 - DNA, 22 bp, Artificial Sequence
  chemically synthesized
gggaggccgaggcgggcggatc

SEQ ID NO: 1119426 - DNA, 22 bp, Artificial Sequence
  chemically synthesized
ggaggccgaggcgggcggatca

SEQ ID NO: 1119427 - DNA, 22 bp, Artificial Sequence
  chemically synthesized
gatctcctgacctcgtgatccg

SEQ ID NO: 1119428 - DNA, 22 bp, Artificial Sequence
  chemically synthesized
gccaggatggtctcgatctcct

SEQ ID NO: 1119429 - DNA, 22 bp, Artificial Sequence
  chemically synthesized
accgtgttagccaggatggtct

SEQ ID NO: 1119430 - DNA, 22 bp, Artificial Sequence
  chemically synthesized
caccgtgttagccaggatggtc

SEQ ID NO: 1119431 - DNA, 22 bp, Artificial Sequence
  chemically synthesized
gtagagacggggtttcaccgtg

SEQ ID NO: 1119432 - DNA, 22 bp, Artificial Sequence
  chemically synthesized
agtagagacggggtttcaccgt

SEQ ID NO: 1119433 - DNA, 22 bp, Artificial Sequence
  chemically synthesized
tagtagagacggggtttcaccg

SEQ ID NO: 1119434 - DNA, 22 bp, Artificial Sequence
  chemically synthesized
ttagtagagacggggtttcacc

SEQ ID NO: 1119435 - DNA, 22 bp, Artificial Sequence
  chemically synthesized
gctaacacggtgaaaccccgtc

SEQ ID NO: 1119436 - DNA, 22 bp, Artificial Sequence
  chemically synthesized
tatttttagtagagacggggtt

SEQ ID NO: 1119437 - DNA, 22 bp, Artificial Sequence
  chemically synthesized
gtatttttagtagagacggggt

SEQ ID NO: 1119438 - DNA, 22 bp, Artificial Sequence
  chemically synthesized
tgtatttttagtagagacgggg

SEQ ID NO: 1119439 - DNA, 22 bp, Artificial Sequence
  chemically synthesized
acacggtgaaaccccgtctcta

SEQ ID NO: 1119440 - DNA, 22 bp, Artificial Sequence
  chemically synthesized
ttgtatttttagtagagacggg

SEQ ID NO: 1119441 - DNA, 22 bp, Artificial Sequence
  chemically synthesized
agtttttgtatttttagtagag

SEQ ID NO: 1119442 - DNA, 22 bp, Artificial Sequence
  chemically synthesized
tactaaaaatacaaaaacttag

SEQ ID NO: 1119443 - DNA, 22 bp, Artificial Sequence
  chemically synthesized
ctaaaaatacaaaaacttagcc

SEQ ID NO: 1119444 - DNA, 22 bp, Artificial Sequence
  chemically synthesized
aaaatacaaaaacttagccggg

SEQ ID NO: 1119445 - DNA, 22 bp, Artificial Sequence
  chemically synthesized
caggcgcccgccaccacacccg

SEQ ID NO: 1119446 - DNA, 22 bp, Artificial Sequence
  chemically synthesized
ggactacaggcgcccgccacca

SEQ ID NO: 1119447 - DNA, 22 bp, Artificial Sequence
  chemically synthesized
agccgggtgtggtggcgggcgc

SEQ ID NO: 1119448 - DNA, 22 bp, Artificial Sequence
  chemically synthesized
gccgggtgtggtggcgggcgcc

SEQ ID NO: 1119449 - DNA, 22 bp, Artificial Sequence
  chemically synthesized
agtagctgggactacaggcgcc

SEQ ID NO: 1119450 - DNA, 22 bp, Artificial Sequence
  chemically synthesized
ctgagtagctgggactacaggc

SEQ ID NO: 1119451 - DNA, 22 bp, Artificial Sequence
  chemically synthesized
agcctcctgagtagctgggact

SEQ ID NO: 1119452 - DNA, 22 bp, Artificial Sequence
  chemically synthesized
cctcagcctcctgagtagctgg

SEQ ID NO: 1119453 - DNA, 22 bp, Artificial Sequence
  chemically synthesized
ctgcctcagcctcctgagtagc

SEQ ID NO: 1119454 - DNA, 22 bp, Artificial Sequence
  chemically synthesized
tcctgcctcagcctcctgagta

SEQ ID NO: 1119455 - DNA, 22 bp, Artificial Sequence
  chemically synthesized
tagtcccagctactcaggaggc

SEQ ID NO: 1119456 - DNA, 22 bp, Artificial Sequence
  chemically synthesized
acgccgttctcctgcctcagcc

SEQ ID NO: 1119457 - DNA, 22 bp, Artificial Sequence
  chemically synthesized
ctcaggaggctgaggcaggaga

SEQ ID NO: 1119458 - DNA, 22 bp, Artificial Sequence
  chemically synthesized
aggaggctgaggcaggagaacg

SEQ ID NO: 1119459 - DNA, 22 bp, Artificial Sequence
  chemically synthesized
ccgggttcacgccgttctcctg

SEQ ID NO: 1119460 - DNA, 22 bp, Artificial Sequence
  chemically synthesized
cctcccgggttcacgccgttct

SEQ ID NO: 1119461 - DNA, 22 bp, Artificial Sequence
  chemically synthesized
tgcctcccgggttcacgccgtt

SEQ ID NO: 1119462 - DNA, 22 bp, Artificial Sequence
  chemically synthesized
aggcaggagaacggcgtgaacc

SEQ ID NO: 1119463 - DNA, 22 bp, Artificial Sequence
  chemically synthesized
caagctctgcctcccgggttca

SEQ ID NO: 1119464 - DNA, 22 bp, Artificial Sequence
  chemically synthesized
actgcaagctctgcctcccggg

SEQ ID NO: 1119465 - DNA, 22 bp, Artificial Sequence
  chemically synthesized
ggctcactgcaagctctgcctc

SEQ ID NO: 1119466 - DNA, 22 bp, Artificial Sequence
  chemically synthesized
gcagtgagccgagatcgcgcca

SEQ ID NO: 1119467 - DNA, 22 bp, Artificial Sequence
  chemically synthesized
cagtgagccgagatcgcgccac

SEQ ID NO: 1119468 - DNA, 22 bp, Artificial Sequence
  chemically synthesized
tcccaggcgggagtgcagtggc

SEQ ID NO: 1119469 - DNA, 22 bp, Artificial Sequence
  chemically synthesized
tgtcccaggcgggagtgcagtg

SEQ ID NO: 1119470 - DNA, 22 bp, Artificial Sequence
  chemically synthesized
gctctgtcccaggcgggagtgc

SEQ ID NO: 1119471 - DNA, 22 bp, Artificial Sequence
  chemically synthesized
agacggagtctcgctctgtccc

SEQ ID NO: 1119472 - DNA, 22 bp, Artificial Sequence
  chemically synthesized
cactcccgcctgggacagagcg

SEQ ID NO: 1119473 - DNA, 22 bp, Artificial Sequence
  chemically synthesized
gagacggagtctcgctctgtcc

SEQ ID NO: 1119474 - DNA, 22 bp, Artificial Sequence
  chemically synthesized
tgagacggagtctcgctctgtc

SEQ ID NO: 1119475 - DNA, 22 bp, Artificial Sequence
  chemically synthesized
ttgagacggagtctcgctctgt

SEQ ID NO: 1119476 - DNA, 22 bp, Artificial Sequence
  chemically synthesized
tttgagacggagtctcgctctg

SEQ ID NO: 1119477 - DNA, 22 bp, Artificial Sequence
  chemically synthesized
ttttgagacggagtctcgctct

SEQ ID NO: 1119478 - DNA, 22 bp, Artificial Sequence
  chemically synthesized
ccgcctgggacagagcgagact

SEQ ID NO: 1119479 - DNA, 22 bp, Artificial Sequence
  chemically synthesized
tttttttgagacggagtctcgc

SEQ ID NO: 1119480 - DNA, 22 bp, Artificial Sequence
  chemically synthesized
ggacagagcgagactccgtctc

SEQ ID NO: 1119481 - DNA, 22 bp, Artificial Sequence
  chemically synthesized
ataagattatttttttgagacg

SEQ ID NO: 1119482 - DNA, 22 bp, Artificial Sequence
  chemically synthesized
aataagattatttttttgagac

SEQ ID NO: 1119483 - DNA, 22 bp, Artificial Sequence
  chemically synthesized
taataagattatttttttgaga

SEQ ID NO: 1119484 - DNA, 22 bp, Artificial Sequence
  chemically synthesized
tttaataagattatttttttga

SEQ ID NO: 1119485 - DNA, 22 bp, Artificial Sequence
  chemically synthesized
ctttaataagattatttttttg

SEQ ID NO: 1119486 - DNA, 22 bp, Artificial Sequence
  chemically synthesized
catttctttaataagattattt

SEQ ID NO: 1119487 - DNA, 22 bp, Artificial Sequence
  chemically synthesized
cgtctcaaaaaaataatcttat

SEQ ID NO: 1119488 - DNA, 22 bp, Artificial Sequence
  chemically synthesized
ctccatttctttaataagatta

SEQ ID NO: 1119489 - DNA, 22 bp, Artificial Sequence
  chemically synthesized
aaaaaaataatcttattaaaga

SEQ ID NO: 1119490 - DNA, 22 bp, Artificial Sequence
  chemically synthesized
tcaggcattactccatttcttt

SEQ ID NO: 1119491 - DNA, 22 bp, Artificial Sequence
  chemically synthesized
tcattgtcaggcattactccat

SEQ ID NO: 1119492 - DNA, 22 bp, Artificial Sequence
  chemically synthesized
attaaagaaatggagtaatgcc

SEQ ID NO: 1119493 - DNA, 22 bp, Artificial Sequence
  chemically synthesized
ttaaagaaatggagtaatgcct

SEQ ID NO: 1119494 - DNA, 22 bp, Artificial Sequence
  chemically synthesized
aagaaatggagtaatgcctgac

SEQ ID NO: 1119495 - DNA, 22 bp, Artificial Sequence
  chemically synthesized
tatgtatgtagatgttgtcatt

SEQ ID NO: 1119496 - DNA, 22 bp, Artificial Sequence
  chemically synthesized
tcatgattgtatgtatgtagat

SEQ ID NO: 1119497 - DNA, 22 bp, Artificial Sequence
  chemically synthesized
acaatgacaacatctacataca

SEQ ID NO: 1119498 - DNA, 22 bp, Artificial Sequence
  chemically synthesized
ctgtcatgattgtatgtatgta

SEQ ID NO: 1119499 - DNA, 22 bp, Artificial Sequence
  chemically synthesized
cctgctgtcatgattgtatgta

SEQ ID NO: 1119500 - DNA, 22 bp, Artificial Sequence
  chemically synthesized
agctacctgctgtcatgattgt

SEQ ID NO: 1119501 - DNA, 22 bp, Artificial Sequence
  chemically synthesized
catacatacaatcatgacagca

SEQ ID NO: 1119502 - DNA, 22 bp, Artificial Sequence
  chemically synthesized
aattcagctacctgctgtcatg

SEQ ID NO: 1119503 - DNA, 22 bp, Artificial Sequence
  chemically synthesized
ctcaattcagctacctgctgtc

SEQ ID NO: 1119504 - DNA, 22 bp, Artificial Sequence
  chemically synthesized
atctcctcaattcagctacctg

SEQ ID NO: 1119505 - DNA, 22 bp, Artificial Sequence
  chemically synthesized
tcatctcctcaattcagctacc

SEQ ID NO: 1119506 - DNA, 22 bp, Artificial Sequence
  chemically synthesized
tctcatctcctcaattcagcta

SEQ ID NO: 1119507 - DNA, 22 bp, Artificial Sequence
  chemically synthesized
ctctcatctcctcaattcagct

SEQ ID NO: 1119508 - DNA, 22 bp, Artificial Sequence
  chemically synthesized
tttctctcatctcctcaattca

SEQ ID NO: 1119509 - DNA, 22 bp, Artificial Sequence
  chemically synthesized
ttgtttctctcatctcctcaat

SEQ ID NO: 1119510 - DNA, 22 bp, Artificial Sequence
  chemically synthesized
aaagctgttgtttctctcatct

SEQ ID NO: 1119511 - DNA, 22 bp, Artificial Sequence
  chemically synthesized
aattgaggagatgagagaaaca

SEQ ID NO: 1119512 - DNA, 22 bp, Artificial Sequence
  chemically synthesized
tcactaaaagctgttgtttctc

SEQ ID NO: 1119513 - DNA, 22 bp, Artificial Sequence
  chemically synthesized
aggagatgagagaaacaacagc

SEQ ID NO: 1119514 - DNA, 22 bp, Artificial Sequence
  chemically synthesized
ctatcactaaaagctgttgttt

SEQ ID NO: 1119515 - DNA, 22 bp, Artificial Sequence
  chemically synthesized
ctgctatcactaaaagctgttg

SEQ ID NO: 1119516 - DNA, 22 bp, Artificial Sequence
  chemically synthesized
tcctgctatcactaaaagctgt

SEQ ID NO: 1119517 - DNA, 22 bp, Artificial Sequence
  chemically synthesized
tgggctctcctgctatcactaa

SEQ ID NO: 1119518 - DNA, 22 bp, Artificial Sequence
  chemically synthesized
agcatccctgtgggctctcctg

SEQ ID NO: 1119519 - DNA, 22 bp, Artificial Sequence
  chemically synthesized
cagcatccctgtgggctctcct

SEQ ID NO: 1119520 - DNA, 22 bp, Artificial Sequence
  chemically synthesized
ttagtgatagcaggagagccca

SEQ ID NO: 1119521 - DNA, 22 bp, Artificial Sequence
  chemically synthesized
tagtgatagcaggagagcccac

SEQ ID NO: 1119522 - DNA, 22 bp, Artificial Sequence
  chemically synthesized
agtgatagcaggagagcccaca

SEQ ID NO: 1119523 - DNA, 22 bp, Artificial Sequence
  chemically synthesized
tttcagcatccctgtgggctct

SEQ ID NO: 1119524 - DNA, 22 bp, Artificial Sequence
  chemically synthesized
gtgatagcaggagagcccacag

SEQ ID NO: 1119525 - DNA, 22 bp, Artificial Sequence
  chemically synthesized
gttatttcagcatccctgtggg

SEQ ID NO: 1119526 - DNA, 22 bp, Artificial Sequence
  chemically synthesized
agttatttcagcatccctgtgg

SEQ ID NO: 1119527 - DNA, 22 bp, Artificial Sequence
  chemically synthesized
ttagttatttcagcatccctgt

SEQ ID NO: 1119528 - DNA, 22 bp, Artificial Sequence
  chemically synthesized
attcttagttatttcagcatcc

SEQ ID NO: 1119529 - DNA, 22 bp, Artificial Sequence
  chemically synthesized
cattcttagttatttcagcatc

SEQ ID NO: 1119530 - DNA, 22 bp, Artificial Sequence
  chemically synthesized
tcattcttagttatttcagcat

SEQ ID NO: 1119531 - DNA, 22 bp, Artificial Sequence
  chemically synthesized
tttcattcttagttatttcagc

SEQ ID NO: 1119532 - DNA, 22 bp, Artificial Sequence
  chemically synthesized
ttctttcattcttagttatttc

SEQ ID NO: 1119533 - DNA, 22 bp, Artificial Sequence
  chemically synthesized
gttctttcattcttagttattt

SEQ ID NO: 1119534 - DNA, 22 bp, Artificial Sequence
  chemically synthesized
aaccaatttgttctttcattct

SEQ ID NO: 1119535 - DNA, 22 bp, Artificial Sequence
  chemically synthesized
caaccaatttgttctttcattc

SEQ ID NO: 1119536 - DNA, 22 bp, Artificial Sequence
  chemically synthesized
tcaaccaatttgttctttcatt

SEQ ID NO: 1119537 - DNA, 22 bp, Artificial Sequence
  chemically synthesized
aaataactaagaatgaaagaac

SEQ ID NO: 1119538 - DNA, 22 bp, Artificial Sequence
  chemically synthesized
ttcaaccaatttgttctttcat

SEQ ID NO: 1119539 - DNA, 22 bp, Artificial Sequence
  chemically synthesized
tttcaaccaatttgttctttca

SEQ ID NO: 1119540 - DNA, 22 bp, Artificial Sequence
  chemically synthesized
agaatgaaagaacaaattggtt

SEQ ID NO: 1119541 - DNA, 22 bp, Artificial Sequence
  chemically synthesized
gtagattttttcaaccaatttg

SEQ ID NO: 1119542 - DNA, 22 bp, Artificial Sequence
  chemically synthesized
ggttagtagattttttcaacca

SEQ ID NO: 1119543 - DNA, 22 bp, Artificial Sequence
  chemically synthesized
gcactaggttagtagatttttt

SEQ ID NO: 1119544 - DNA, 22 bp, Artificial Sequence
  chemically synthesized
ggcactaggttagtagattttt

SEQ ID NO: 1119545 - DNA, 22 bp, Artificial Sequence
  chemically synthesized
tggcactaggttagtagatttt

SEQ ID NO: 1119546 - DNA, 22 bp, Artificial Sequence
  chemically synthesized
gttgaaaaaatctactaaccta

SEQ ID NO: 1119547 - DNA, 22 bp, Artificial Sequence
  chemically synthesized
aagactttggcactaggttagt

SEQ ID NO: 1119548 - DNA, 22 bp, Artificial Sequence
  chemically synthesized
aaaaaatctactaacctagtgc

SEQ ID NO: 1119549 - DNA, 22 bp, Artificial Sequence
  chemically synthesized
attgaagactttggcactaggt

SEQ ID NO: 1119550 - DNA, 22 bp, Artificial Sequence
  chemically synthesized
tcattgaagactttggcactag

SEQ ID NO: 1119551 - DNA, 22 bp, Artificial Sequence
  chemically synthesized
ctcattgaagactttggcacta

SEQ ID NO: 1119552 - DNA, 22 bp, Artificial Sequence
  chemically synthesized
tctcattgaagactttggcact

SEQ ID NO: 1119553 - DNA, 22 bp, Artificial Sequence
  chemically synthesized
ctaacctagtgccaaagtcttc

SEQ ID NO: 1119554 - DNA, 22 bp, Artificial Sequence
  chemically synthesized
acctagtgccaaagtcttcaat

SEQ ID NO: 1119555 - DNA, 22 bp, Artificial Sequence
  chemically synthesized
tcatattttctcattgaagact

SEQ ID NO: 1119556 - DNA, 22 bp, Artificial Sequence
  chemically synthesized
atcatattttctcattgaagac

SEQ ID NO: 1119557 - DNA, 22 bp, Artificial Sequence
  chemically synthesized
tatcatattttctcattgaaga

SEQ ID NO: 1119558 - DNA, 22 bp, Artificial Sequence
  chemically synthesized
gtgccaaagtcttcaatgagaa

SEQ ID NO: 1119559 - DNA, 22 bp, Artificial Sequence
  chemically synthesized
ccattttatcatattttctcat

SEQ ID NO: 1119560 - DNA, 22 bp, Artificial Sequence
  chemically synthesized
tctaccattttatcatattttc

SEQ ID NO: 1119561 - DNA, 22 bp, Artificial Sequence
  chemically synthesized
atctaccattttatcatatttt

SEQ ID NO: 1119562 - DNA, 22 bp, Artificial Sequence
  chemically synthesized
ttatctaccattttatcatatt

SEQ ID NO: 1119563 - DNA, 22 bp, Artificial Sequence
  chemically synthesized
caatgagaaaatatgataaaat

SEQ ID NO: 1119564 - DNA, 22 bp, Artificial Sequence
  chemically synthesized
aatgagaaaatatgataaaatg

SEQ ID NO: 1119565 - DNA, 22 bp, Artificial Sequence
  chemically synthesized
gccatctcttatctaccatttt

SEQ ID NO: 1119566 - DNA, 22 bp, Artificial Sequence
  chemically synthesized
tggccatctcttatctaccatt

SEQ ID NO: 1119567 - DNA, 22 bp, Artificial Sequence
  chemically synthesized
ctggccatctcttatctaccat

SEQ ID NO: 1119568 - DNA, 22 bp, Artificial Sequence
  chemically synthesized
atgacttctggccatctcttat

SEQ ID NO: 1119569 - DNA, 22 bp, Artificial Sequence
  chemically synthesized
cagttaatgacttctggccatc

SEQ ID NO: 1119570 - DNA, 22 bp, Artificial Sequence
  chemically synthesized
gcagttaatgacttctggccat

SEQ ID NO: 1119571 - DNA, 22 bp, Artificial Sequence
  chemically synthesized
cttgcagttaatgacttctggc

SEQ ID NO: 1119572 - DNA, 22 bp, Artificial Sequence
  chemically synthesized
ccttgcagttaatgacttctgg

SEQ ID NO: 1119573 - DNA, 22 bp, Artificial Sequence
  chemically synthesized
tccttgcagttaatgacttctg

SEQ ID NO: 1119574 - DNA, 22 bp, Artificial Sequence
  chemically synthesized
tttccttgcagttaatgacttc

SEQ ID NO: 1119575 - DNA, 22 bp, Artificial Sequence
  chemically synthesized
atgtaaaaatacctctttcctt

SEQ ID NO: 1119576 - DNA, 22 bp, Artificial Sequence
  chemically synthesized
catgtaaaaatacctctttcct

SEQ ID NO: 1119577 - DNA, 22 bp, Artificial Sequence
  chemically synthesized
ttcatgtaaaaatacctctttc

SEQ ID NO: 1119578 - DNA, 22 bp, Artificial Sequence
  chemically synthesized
tcttcatgtaaaaatacctctt

SEQ ID NO: 1119579 - DNA, 22 bp, Artificial Sequence
  chemically synthesized
actgcaaggaaagaggtatttt

SEQ ID NO: 1119580 - DNA, 22 bp, Artificial Sequence
  chemically synthesized
ctctcttcatgtaaaaatacct

SEQ ID NO: 1119581 - DNA, 22 bp, Artificial Sequence
  chemically synthesized
caaggaaagaggtatttttaca

SEQ ID NO: 1119582 - DNA, 22 bp, Artificial Sequence
  chemically synthesized
caaagatactgctctcttcatg

SEQ ID NO: 1119583 - DNA, 22 bp, Artificial Sequence
  chemically synthesized
ttacatgaagagagcagtatct

SEQ ID NO: 1119584 - DNA, 22 bp, Artificial Sequence
  chemically synthesized
tacatgaagagagcagtatctt

SEQ ID NO: 1119585 - DNA, 22 bp, Artificial Sequence
  chemically synthesized
acatgaagagagcagtatcttt

SEQ ID NO: 1119586 - DNA, 22 bp, Artificial Sequence
  chemically synthesized
catgaagagagcagtatctttg

SEQ ID NO: 1119587 - DNA, 22 bp, Artificial Sequence
  chemically synthesized
acagagacaattccaaagatac

SEQ ID NO: 1119588 - DNA, 22 bp, Artificial Sequence
  chemically synthesized
acctaacagagacaattccaaa

SEQ ID NO: 1119589 - DNA, 22 bp, Artificial Sequence
  chemically synthesized
cctcacctaacagagacaattc

SEQ ID NO: 1119590 - DNA, 22 bp, Artificial Sequence
  chemically synthesized
actccctcacctaacagagaca

SEQ ID NO: 1119591 - DNA, 22 bp, Artificial Sequence
  chemically synthesized
tggaattgtctctgttaggtga

SEQ ID NO: 1119592 - DNA, 22 bp, Artificial Sequence
  chemically synthesized
ggaattgtctctgttaggtgag

SEQ ID NO: 1119593 - DNA, 22 bp, Artificial Sequence
  chemically synthesized
gaattgtctctgttaggtgagg

SEQ ID NO: 1119594 - DNA, 22 bp, Artificial Sequence
  chemically synthesized
gaatgactgactccctcaccta

SEQ ID NO: 1119595 - DNA, 22 bp, Artificial Sequence
  chemically synthesized
agaatgactgactccctcacct

SEQ ID NO: 1119596 - DNA, 22 bp, Artificial Sequence
  chemically synthesized
tagaatgactgactccctcacc

SEQ ID NO: 1119597 - DNA, 22 bp, Artificial Sequence
  chemically synthesized
tctctgttaggtgagggagtca

SEQ ID NO: 1119598 - DNA, 22 bp, Artificial Sequence
  chemically synthesized
ctttagaatgactgactccctc

SEQ ID NO: 1119599 - DNA, 22 bp, Artificial Sequence
  chemically synthesized
tgttaggtgagggagtcagtca

SEQ ID NO: 1119600 - DNA, 22 bp, Artificial Sequence
  chemically synthesized
ttaggtgagggagtcagtcatt

SEQ ID NO: 1119601 - DNA, 22 bp, Artificial Sequence
  chemically synthesized
ggtgagggagtcagtcattcta

SEQ ID NO: 1119602 - DNA, 22 bp, Artificial Sequence
  chemically synthesized
tacccccactactttagaatga

SEQ ID NO: 1119603 - DNA, 22 bp, Artificial Sequence
  chemically synthesized
gtacccccactactttagaatg

SEQ ID NO: 1119604 - DNA, 22 bp, Artificial Sequence
  chemically synthesized
tgtacccccactactttagaat

SEQ ID NO: 1119605 - DNA, 22 bp, Artificial Sequence
  chemically synthesized
ttgtacccccactactttagaa

SEQ ID NO: 1119606 - DNA, 22 bp, Artificial Sequence
  chemically synthesized
ttttgtacccccactactttag

SEQ ID NO: 1119607 - DNA, 22 bp, Artificial Sequence
  chemically synthesized
atccctcttttgtacccccact

SEQ ID NO: 1119608 - DNA, 22 bp, Artificial Sequence
  chemically synthesized
taaagtagtgggggtacaaaag

SEQ ID NO: 1119609 - DNA, 22 bp, Artificial Sequence
  chemically synthesized
tgactcatccctcttttgtacc

SEQ ID NO: 1119610 - DNA, 22 bp, Artificial Sequence
  chemically synthesized
aagtagtgggggtacaaaagag

SEQ ID NO: 1119611 - DNA, 22 bp, Artificial Sequence
  chemically synthesized
gaaaacagcactatgactcatc

SEQ ID NO: 1119612 - DNA, 22 bp, Artificial Sequence
  chemically synthesized
ccctcgaaaacagcactatgac

SEQ ID NO: 1119613 - DNA, 22 bp, Artificial Sequence
  chemically synthesized
accctcgaaaacagcactatga

SEQ ID NO: 1119614 - DNA, 22 bp, Artificial Sequence
  chemically synthesized
taccctcgaaaacagcactatg

SEQ ID NO: 1119615 - DNA, 22 bp, Artificial Sequence
  chemically synthesized
atacgtggaaaccaattttacc

SEQ ID NO: 1119616 - DNA, 22 bp, Artificial Sequence
  chemically synthesized
ctcatacgtggaaaccaatttt

SEQ ID NO: 1119617 - DNA, 22 bp, Artificial Sequence
  chemically synthesized
ttttcgagggtaaaattggttt

SEQ ID NO: 1119618 - DNA, 22 bp, Artificial Sequence
  chemically synthesized
tactcatacgtggaaaccaatt

SEQ ID NO: 1119619 - DNA, 22 bp, Artificial Sequence
  chemically synthesized
tcgagggtaaaattggtttcca

SEQ ID NO: 1119620 - DNA, 22 bp, Artificial Sequence
  chemically synthesized
cgagggtaaaattggtttccac

SEQ ID NO: 1119621 - DNA, 22 bp, Artificial Sequence
  chemically synthesized
ttctactcatacgtggaaacca

SEQ ID NO: 1119622 - DNA, 22 bp, Artificial Sequence
  chemically synthesized
gagggtaaaattggtttccacg

SEQ ID NO: 1119623 - DNA, 22 bp, Artificial Sequence
  chemically synthesized
attctactcatacgtggaaacc

SEQ ID NO: 1119624 - DNA, 22 bp, Artificial Sequence
  chemically synthesized
tatacttattctactcatacgt

SEQ ID NO: 1119625 - DNA, 22 bp, Artificial Sequence
  chemically synthesized
tatatacttattctactcatac

SEQ ID NO: 1119626 - DNA, 22 bp, Artificial Sequence
  chemically synthesized
ctatatacttattctactcata

SEQ ID NO: 1119627 - DNA, 22 bp, Artificial Sequence
  chemically synthesized
gtttccacgtatgagtagaata

SEQ ID NO: 1119628 - DNA, 22 bp, Artificial Sequence
  chemically synthesized
ccacgtatgagtagaataagta

SEQ ID NO: 1119629 - DNA, 22 bp, Artificial Sequence
  chemically synthesized
cacgtatgagtagaataagtat

SEQ ID NO: 1119630 - DNA, 22 bp, Artificial Sequence
  chemically synthesized
aagacaagccttctatatactt

SEQ ID NO: 1119631 - DNA, 22 bp, Artificial Sequence
  chemically synthesized
caagacaagccttctatatact

SEQ ID NO: 1119632 - DNA, 22 bp, Artificial Sequence
  chemically synthesized
tcaagacaagccttctatatac

SEQ ID NO: 1119633 - DNA, 22 bp, Artificial Sequence
  chemically synthesized
ttcaagacaagccttctatata

SEQ ID NO: 1119634 - DNA, 22 bp, Artificial Sequence
  chemically synthesized
tttcaagacaagccttctatat

SEQ ID NO: 1119635 - DNA, 22 bp, Artificial Sequence
  chemically synthesized
aaacactttttcaagacaagcc

SEQ ID NO: 1119636 - DNA, 22 bp, Artificial Sequence
  chemically synthesized
ggcaggctcaaacactttttca

SEQ ID NO: 1119637 - DNA, 22 bp, Artificial Sequence
  chemically synthesized
actcggcaggctcaaacacttt

SEQ ID NO: 1119638 - DNA, 22 bp, Artificial Sequence
  chemically synthesized
tcactcggcaggctcaaacact

SEQ ID NO: 1119639 - DNA, 22 bp, Artificial Sequence
  chemically synthesized
gtcttgaaaaagtgtttgagcc

SEQ ID NO: 1119640 - DNA, 22 bp, Artificial Sequence
  chemically synthesized
tcttgaaaaagtgtttgagcct

SEQ ID NO: 1119641 - DNA, 22 bp, Artificial Sequence
  chemically synthesized
gaaaaagtgtttgagcctgccg

SEQ ID NO: 1119642 - DNA, 22 bp, Artificial Sequence
  chemically synthesized
aaaaagtgtttgagcctgccga

SEQ ID NO: 1119643 - DNA, 22 bp, Artificial Sequence
  chemically synthesized
ccacactctcactcggcaggct

SEQ ID NO: 1119644 - DNA, 22 bp, Artificial Sequence
  chemically synthesized
cccacactctcactcggcaggc

SEQ ID NO: 1119645 - DNA, 22 bp, Artificial Sequence
  chemically synthesized
tcccacactctcactcggcagg

SEQ ID NO: 1119646 - DNA, 22 bp, Artificial Sequence
  chemically synthesized
ctttcccacactctcactcggc

SEQ ID NO: 1119647 - DNA, 22 bp, Artificial Sequence
  chemically synthesized
tgctttcccacactctcactcg

SEQ ID NO: 1119648 - DNA, 22 bp, Artificial Sequence
  chemically synthesized
ctctgctttcccacactctcac

SEQ ID NO: 1119649 - DNA, 22 bp, Artificial Sequence
  chemically synthesized
gagcctgccgagtgagagtgtg

SEQ ID NO: 1119650 - DNA, 22 bp, Artificial Sequence
  chemically synthesized
cctctgctttcccacactctca

SEQ ID NO: 1119651 - DNA, 22 bp, Artificial Sequence
  chemically synthesized
agcctgccgagtgagagtgtgg

SEQ ID NO: 1119652 - DNA, 22 bp, Artificial Sequence
  chemically synthesized
acttcctctgctttcccacact

SEQ ID NO: 1119653 - DNA, 22 bp, Artificial Sequence
  chemically synthesized
cacttcctctgctttcccacac

SEQ ID NO: 1119654 - DNA, 22 bp, Artificial Sequence
  chemically synthesized
ccgagtgagagtgtgggaaagc

SEQ ID NO: 1119655 - DNA, 22 bp, Artificial Sequence
  chemically synthesized
cttcacttcctctgctttccca

SEQ ID NO: 1119656 - DNA, 22 bp, Artificial Sequence
  chemically synthesized
gcttcacttcctctgctttccc

SEQ ID NO: 1119657 - DNA, 22 bp, Artificial Sequence
  chemically synthesized
cttgcttcacttcctctgcttt

SEQ ID NO: 1119658 - DNA, 22 bp, Artificial Sequence
  chemically synthesized
ccttgcttcacttcctctgctt

SEQ ID NO: 1119659 - DNA, 22 bp, Artificial Sequence
  chemically synthesized
tccttgcttcacttcctctgct

SEQ ID NO: 1119660 - DNA, 22 bp, Artificial Sequence
  chemically synthesized
ttccttgcttcacttcctctgc

SEQ ID NO: 1119661 - DNA, 22 bp, Artificial Sequence
  chemically synthesized
ttttccttgcttcacttcctct

SEQ ID NO: 1119662 - DNA, 22 bp, Artificial Sequence
  chemically synthesized
cttttccttgcttcacttcctc

SEQ ID NO: 1119663 - DNA, 22 bp, Artificial Sequence
  chemically synthesized
tcttttccttgcttcacttcct

SEQ ID NO: 1119664 - DNA, 22 bp, Artificial Sequence
  chemically synthesized
cactttcttttccttgcttcac

SEQ ID NO: 1119665 - DNA, 22 bp, Artificial Sequence
  chemically synthesized
ttgcactttcttttccttgctt

SEQ ID NO: 1119666 - DNA, 22 bp, Artificial Sequence
  chemically synthesized
tattgcactttcttttccttgc

SEQ ID NO: 1119667 - DNA, 22 bp, Artificial Sequence
  chemically synthesized
ctctattgcactttcttttcct

SEQ ID NO: 1119668 - DNA, 22 bp, Artificial Sequence
  chemically synthesized
tgctctattgcactttcttttc

SEQ ID NO: 1119669 - DNA, 22 bp, Artificial Sequence
  chemically synthesized
tctgctctattgcactttcttt

SEQ ID NO: 1119670 - DNA, 22 bp, Artificial Sequence
  chemically synthesized
tctctgctctattgcactttct

SEQ ID NO: 1119671 - DNA, 22 bp, Artificial Sequence
  chemically synthesized
tctctctgctctattgcacttt

SEQ ID NO: 1119672 - DNA, 22 bp, Artificial Sequence
  chemically synthesized
ctctctctgctctattgcactt

SEQ ID NO: 1119673 - DNA, 22 bp, Artificial Sequence
  chemically synthesized
tctctctctgctctattgcact

SEQ ID NO: 1119674 - DNA, 22 bp, Artificial Sequence
  chemically synthesized
tctttctctctctgctctattg

SEQ ID NO: 1119675 - DNA, 22 bp, Artificial Sequence
  chemically synthesized
tatctttctctctctgctctat

SEQ ID NO: 1119676 - DNA, 22 bp, Artificial Sequence
  chemically synthesized
ctatctttctctctctgctcta

SEQ ID NO: 1119677 - DNA, 22 bp, Artificial Sequence
  chemically synthesized
ttctatctttctctctctgctc

SEQ ID NO: 1119678 - DNA, 22 bp, Artificial Sequence
  chemically synthesized
cttctatctttctctctctgct

SEQ ID NO: 1119679 - DNA, 22 bp, Artificial Sequence
  chemically synthesized
tcttctatctttctctctctgc

SEQ ID NO: 1119680 - DNA, 22 bp, Artificial Sequence
  chemically synthesized
tattttcttctatctttctctc

SEQ ID NO: 1119681 - DNA, 22 bp, Artificial Sequence
  chemically synthesized
gagtctatattttcttctatct

SEQ ID NO: 1119682 - DNA, 22 bp, Artificial Sequence
  chemically synthesized
cccagagtataggtacctcgag

SEQ ID NO: 1119683 - DNA, 22 bp, Artificial Sequence
  chemically synthesized
ctacccagagtataggtacctc

SEQ ID NO: 1119684 - DNA, 22 bp, Artificial Sequence
  chemically synthesized
actacccagagtataggtacct

SEQ ID NO: 1119685 - DNA, 22 bp, Artificial Sequence
  chemically synthesized
tgtttactacccagagtatagg

SEQ ID NO: 1119686 - DNA, 22 bp, Artificial Sequence
  chemically synthesized
tctgtgtttactacccagagta

SEQ ID NO: 1119687 - DNA, 22 bp, Artificial Sequence
  chemically synthesized
gaggtacctatactctgggtag

SEQ ID NO: 1119688 - DNA, 22 bp, Artificial Sequence
  chemically synthesized
ttatctgtgtttactacccaga

SEQ ID NO: 1119689 - DNA, 22 bp, Artificial Sequence
  chemically synthesized
tgttatctgtgtttactaccca

SEQ ID NO: 1119690 - DNA, 22 bp, Artificial Sequence
  chemically synthesized
tctctgttatctgtgtttacta

SEQ ID NO: 1119691 - DNA, 22 bp, Artificial Sequence
  chemically synthesized
tactctgggtagtaaacacaga

SEQ ID NO: 1119692 - DNA, 22 bp, Artificial Sequence
  chemically synthesized
ctatctctgttatctgtgttta

SEQ ID NO: 1119693 - DNA, 22 bp, Artificial Sequence
  chemically synthesized
tcctatctctgttatctgtgtt

SEQ ID NO: 1119694 - DNA, 22 bp, Artificial Sequence
  chemically synthesized
ctcctatctctgttatctgtgt

SEQ ID NO: 1119695 - DNA, 22 bp, Artificial Sequence
  chemically synthesized
tgggtagtaaacacagataaca

SEQ ID NO: 1119696 - DNA, 22 bp, Artificial Sequence
  chemically synthesized
ggtagtaaacacagataacaga

SEQ ID NO: 1119697 - DNA, 22 bp, Artificial Sequence
  chemically synthesized
caatttctcctatctctgttat

SEQ ID NO: 1119698 - DNA, 22 bp, Artificial Sequence
  chemically synthesized
ccaatttctcctatctctgtta

SEQ ID NO: 1119699 - DNA, 22 bp, Artificial Sequence
  chemically synthesized
atgcttccaatttctcctatct

SEQ ID NO: 1119700 - DNA, 22 bp, Artificial Sequence
  chemically synthesized
gaaatcatcaagccagttaatg

SEQ ID NO: 1119701 - DNA, 22 bp, Artificial Sequence
  chemically synthesized
ccgctggaaatcatcaagccag

SEQ ID NO: 1119702 - DNA, 22 bp, Artificial Sequence
  chemically synthesized
gaagcattaactggcttgatga

SEQ ID NO: 1119703 - DNA, 22 bp, Artificial Sequence
  chemically synthesized
ccaactcccgctggaaatcatc

SEQ ID NO: 1119704 - DNA, 22 bp, Artificial Sequence
  chemically synthesized
accaactcccgctggaaatcat

SEQ ID NO: 1119705 - DNA, 22 bp, Artificial Sequence
  chemically synthesized
taccaactcccgctggaaatca

SEQ ID NO: 1119706 - DNA, 22 bp, Artificial Sequence
  chemically synthesized
ttaccaactcccgctggaaatc

SEQ ID NO: 1119707 - DNA, 22 bp, Artificial Sequence
  chemically synthesized
actggcttgatgatttccagcg

SEQ ID NO: 1119708 - DNA, 22 bp, Artificial Sequence
  chemically synthesized
tttaccaactcccgctggaaat

SEQ ID NO: 1119709 - DNA, 22 bp, Artificial Sequence
  chemically synthesized
gcttgatgatttccagcgggag

SEQ ID NO: 1119710 - DNA, 22 bp, Artificial Sequence
  chemically synthesized
gatgatttccagcgggagttgg

SEQ ID NO: 1119711 - DNA, 22 bp, Artificial Sequence
  chemically synthesized
atgatttccagcgggagttggt

SEQ ID NO: 1119712 - DNA, 22 bp, Artificial Sequence
  chemically synthesized
agaatcaactttttaccaactc

SEQ ID NO: 1119713 - DNA, 22 bp, Artificial Sequence
  chemically synthesized
cagaatcaactttttaccaact

SEQ ID NO: 1119714 - DNA, 22 bp, Artificial Sequence
  chemically synthesized
tcagaatcaactttttaccaac

SEQ ID NO: 1119715 - DNA, 22 bp, Artificial Sequence
  chemically synthesized
tttcagaatcaactttttacca

SEQ ID NO: 1119716 - DNA, 22 bp, Artificial Sequence
  chemically synthesized
ccagcgggagttggtaaaaagt

SEQ ID NO: 1119717 - DNA, 22 bp, Artificial Sequence
  chemically synthesized
cagcgggagttggtaaaaagtt

SEQ ID NO: 1119718 - DNA, 22 bp, Artificial Sequence
  chemically synthesized
ccctctttcagaatcaactttt

SEQ ID NO: 1119719 - DNA, 22 bp, Artificial Sequence
  chemically synthesized
attaccctctttcagaatcaac

SEQ ID NO: 1119720 - DNA, 22 bp, Artificial Sequence
  chemically synthesized
gattaccctctttcagaatcaa

SEQ ID NO: 1119721 - DNA, 22 bp, Artificial Sequence
  chemically synthesized
gtaaaaagttgattctgaaaga

SEQ ID NO: 1119722 - DNA, 22 bp, Artificial Sequence
  chemically synthesized
cacttgattaccctctttcaga

SEQ ID NO: 1119723 - DNA, 22 bp, Artificial Sequence
  chemically synthesized
ggatctgcacttgattaccctc

SEQ ID NO: 1119724 - DNA, 22 bp, Artificial Sequence
  chemically synthesized
attctgaaagagggtaatcaag

SEQ ID NO: 1119725 - DNA, 22 bp, Artificial Sequence
  chemically synthesized
ctcggatctgcacttgattacc

SEQ ID NO: 1119726 - DNA, 22 bp, Artificial Sequence
  chemically synthesized
cctcggatctgcacttgattac

SEQ ID NO: 1119727 - DNA, 22 bp, Artificial Sequence
  chemically synthesized
ttcctcggatctgcacttgatt

SEQ ID NO: 1119728 - DNA, 22 bp, Artificial Sequence
  chemically synthesized
tgaaagagggtaatcaagtgca

SEQ ID NO: 1119729 - DNA, 22 bp, Artificial Sequence
  chemically synthesized
aaagagggtaatcaagtgcaga

SEQ ID NO: 1119730 - DNA, 22 bp, Artificial Sequence
  chemically synthesized
ggctcttcctcggatctgcact

SEQ ID NO: 1119731 - DNA, 22 bp, Artificial Sequence
  chemically synthesized
gggctcttcctcggatctgcac

SEQ ID NO: 1119732 - DNA, 22 bp, Artificial Sequence
  chemically synthesized
tgggctcttcctcggatctgca

SEQ ID NO: 1119733 - DNA, 22 bp, Artificial Sequence
  chemically synthesized
gctttgggctcttcctcggatc

SEQ ID NO: 1119734 - DNA, 22 bp, Artificial Sequence
  chemically synthesized
tggtcatctggctttgggctct

SEQ ID NO: 1119735 - DNA, 22 bp, Artificial Sequence
  chemically synthesized
tcaagtcgttatggtcatctgg

SEQ ID NO: 1119736 - DNA, 22 bp, Artificial Sequence
  chemically synthesized
cctatcaagtcgttatggtcat

SEQ ID NO: 1119737 - DNA, 22 bp, Artificial Sequence
  chemically synthesized
aaaccctccctatcaagtcgtt

SEQ ID NO: 1119738 - DNA, 22 bp, Artificial Sequence
  chemically synthesized
gaaaccctccctatcaagtcgt

SEQ ID NO: 1119739 - DNA, 22 bp, Artificial Sequence
  chemically synthesized
ttgaaaccctccctatcaagtc

SEQ ID NO: 1119740 - DNA, 22 bp, Artificial Sequence
  chemically synthesized
tcttgaaaccctccctatcaag

SEQ ID NO: 1119741 - DNA, 22 bp, Artificial Sequence
  chemically synthesized
tgaggttctcttgaaaccctcc

SEQ ID NO: 1119742 - DNA, 22 bp, Artificial Sequence
  chemically synthesized
tgtgaggttctcttgaaaccct

SEQ ID NO: 1119743 - DNA, 22 bp, Artificial Sequence
  chemically synthesized
ctgtgaggttctcttgaaaccc

SEQ ID NO: 1119744 - DNA, 22 bp, Artificial Sequence
  chemically synthesized
gatagggagggtttcaagagaa

SEQ ID NO: 1119745 - DNA, 22 bp, Artificial Sequence
  chemically synthesized
atagggagggtttcaagagaac

SEQ ID NO: 1119746 - DNA, 22 bp, Artificial Sequence
  chemically synthesized
gagcttctgtgaggttctcttg

SEQ ID NO: 1119747 - DNA, 22 bp, Artificial Sequence
  chemically synthesized
aaaatctggagcttctgtgagg

SEQ ID NO: 1119748 - DNA, 22 bp, Artificial Sequence
  chemically synthesized
caagagaacctcacagaagctc

SEQ ID NO: 1119749 - DNA, 22 bp, Artificial Sequence
  chemically synthesized
aagagaacctcacagaagctcc

SEQ ID NO: 1119750 - DNA, 22 bp, Artificial Sequence
  chemically synthesized
ataaggtgtctgaaaatctgga

SEQ ID NO: 1119751 - DNA, 22 bp, Artificial Sequence
  chemically synthesized
gataaggtgtctgaaaatctgg

SEQ ID NO: 1119752 - DNA, 22 bp, Artificial Sequence
  chemically synthesized
acagaagctccagattttcaga

SEQ ID NO: 1119753 - DNA, 22 bp, Artificial Sequence
  chemically synthesized
cagattttcagacaccttatca

SEQ ID NO: 1119754 - DNA, 22 bp, Artificial Sequence
  chemically synthesized
atcacaaggggatttgataagg

SEQ ID NO: 1119755 - DNA, 22 bp, Artificial Sequence
  chemically synthesized
gatcacaaggggatttgataag

SEQ ID NO: 1119756 - DNA, 22 bp, Artificial Sequence
  chemically synthesized
tgatcacaaggggatttgataa

SEQ ID NO: 1119757 - DNA, 22 bp, Artificial Sequence
  chemically synthesized
tcagacaccttatcaaatcccc

SEQ ID NO: 1119758 - DNA, 22 bp, Artificial Sequence
  chemically synthesized
ctttgatcacaaggggatttga

SEQ ID NO: 1119759 - DNA, 22 bp, Artificial Sequence
  chemically synthesized
cagacaccttatcaaatcccct

SEQ ID NO: 1119760 - DNA, 22 bp, Artificial Sequence
  chemically synthesized
agacaccttatcaaatcccctt

SEQ ID NO: 1119761 - DNA, 22 bp, Artificial Sequence
  chemically synthesized
atcaaatccccttgtgatcaaa

SEQ ID NO: 1119762 - DNA, 22 bp, Artificial Sequence
  chemically synthesized
tcaaatccccttgtgatcaaag

SEQ ID NO: 1119763 - DNA, 22 bp, Artificial Sequence
  chemically synthesized
gtgatcaaaggaggctattttt

SEQ ID NO: 1119764 - DNA, 22 bp, Artificial Sequence
  chemically synthesized
tgatcaaaggaggctatttttt

SEQ ID NO: 1119765 - DNA, 22 bp, Artificial Sequence
  chemically synthesized
gtaatgaaacaaacaaaaaaaa

SEQ ID NO: 1119766 - DNA, 22 bp, Artificial Sequence
  chemically synthesized
ttttttttgtttgtttcattac

SEQ ID NO: 1119767 - DNA, 22 bp, Artificial Sequence
  chemically synthesized
tttttgtttgtttcattaccaa

SEQ ID NO: 1119768 - DNA, 22 bp, Artificial Sequence
  chemically synthesized
ttttgtttgtttcattaccaat

SEQ ID NO: 1119769 - DNA, 22 bp, Artificial Sequence
  chemically synthesized
tttgtttgtttcattaccaatt

SEQ ID NO: 1119770 - DNA, 22 bp, Artificial Sequence
  chemically synthesized
ttgtttgtttcattaccaattt

SEQ ID NO: 1119771 - DNA, 22 bp, Artificial Sequence
  chemically synthesized
tgtttgtttcattaccaatttg

SEQ ID NO: 1119772 - DNA, 22 bp, Artificial Sequence
  chemically synthesized
gtttgtttcattaccaatttgc

SEQ ID NO: 1119773 - DNA, 22 bp, Artificial Sequence
  chemically synthesized
tttgtttcattaccaatttgcg

SEQ ID NO: 1119774 - DNA, 22 bp, Artificial Sequence
  chemically synthesized
gtttcattaccaatttgcgtta

SEQ ID NO: 1119775 - DNA, 22 bp, Artificial Sequence
  chemically synthesized
tttcattaccaatttgcgttac

SEQ ID NO: 1119776 - DNA, 22 bp, Artificial Sequence
  chemically synthesized
cgtgagcacatggtaacgcaaa

SEQ ID NO: 1119777 - DNA, 22 bp, Artificial Sequence
  chemically synthesized
ccgtgagcacatggtaacgcaa

SEQ ID NO: 1119778 - DNA, 22 bp, Artificial Sequence
  chemically synthesized
tccgtgagcacatggtaacgca

SEQ ID NO: 1119779 - DNA, 22 bp, Artificial Sequence
  chemically synthesized
cattaccaatttgcgttaccat

SEQ ID NO: 1119780 - DNA, 22 bp, Artificial Sequence
  chemically synthesized
ttccgtgagcacatggtaacgc

SEQ ID NO: 1119781 - DNA, 22 bp, Artificial Sequence
  chemically synthesized
attaccaatttgcgttaccatg

SEQ ID NO: 1119782 - DNA, 22 bp, Artificial Sequence
  chemically synthesized
tttccgtgagcacatggtaacg

SEQ ID NO: 1119783 - DNA, 22 bp, Artificial Sequence
  chemically synthesized
ccaatttgcgttaccatgtgct

SEQ ID NO: 1119784 - DNA, 22 bp, Artificial Sequence
  chemically synthesized
gaattttttccgtgagcacatg

SEQ ID NO: 1119785 - DNA, 22 bp, Artificial Sequence
  chemically synthesized
gcgttaccatgtgctcacggaa

SEQ ID NO: 1119786 - DNA, 22 bp, Artificial Sequence
  chemically synthesized
cgttaccatgtgctcacggaaa

SEQ ID NO: 1119787 - DNA, 22 bp, Artificial Sequence
  chemically synthesized
acaactcgaattttttccgtga

SEQ ID NO: 1119788 - DNA, 22 bp, Artificial Sequence
  chemically synthesized
taacaactcgaattttttccgt

SEQ ID NO: 1119789 - DNA, 22 bp, Artificial Sequence
  chemically synthesized
ccatgtgctcacggaaaaaatt

SEQ ID NO: 1119790 - DNA, 22 bp, Artificial Sequence
  chemically synthesized
acagattctaacaactcgaatt

SEQ ID NO: 1119791 - DNA, 22 bp, Artificial Sequence
  chemically synthesized
acggaaaaaattcgagttgtta

SEQ ID NO: 1119792 - DNA, 22 bp, Artificial Sequence
  chemically synthesized
aattaacagattctaacaactc

SEQ ID NO: 1119793 - DNA, 22 bp, Artificial Sequence
  chemically synthesized
gctgaattaacagattctaaca

SEQ ID NO: 1119794 - DNA, 22 bp, Artificial Sequence
  chemically synthesized
agctgaattaacagattctaac

SEQ ID NO: 1119795 - DNA, 22 bp, Artificial Sequence
  chemically synthesized
tagctgaattaacagattctaa

SEQ ID NO: 1119796 - DNA, 22 bp, Artificial Sequence
  chemically synthesized
ttagctgaattaacagattcta

SEQ ID NO: 1119797 - DNA, 22 bp, Artificial Sequence
  chemically synthesized
tttagctgaattaacagattct

SEQ ID NO: 1119798 - DNA, 22 bp, Artificial Sequence
  chemically synthesized
gagttgttagaatctgttaatt

SEQ ID NO: 1119799 - DNA, 22 bp, Artificial Sequence
  chemically synthesized
agactttttagctgaattaaca

SEQ ID NO: 1119800 - DNA, 22 bp, Artificial Sequence
  chemically synthesized
ttagaatctgttaattcagcta

SEQ ID NO: 1119801 - DNA, 22 bp, Artificial Sequence
  chemically synthesized
cagttcagactttttagctgaa

SEQ ID NO: 1119802 - DNA, 22 bp, Artificial Sequence
  chemically synthesized
gaatctgttaattcagctaaaa

SEQ ID NO: 1119803 - DNA, 22 bp, Artificial Sequence
  chemically synthesized
ttaattcagctaaaaagtctga

SEQ ID NO: 1119804 - DNA, 22 bp, Artificial Sequence
  chemically synthesized
gtatcactgcagttcagacttt

SEQ ID NO: 1119805 - DNA, 22 bp, Artificial Sequence
  chemically synthesized
agtatcactgcagttcagactt

SEQ ID NO: 1119806 - DNA, 22 bp, Artificial Sequence
  chemically synthesized
attcagctaaaaagtctgaact

SEQ ID NO: 1119807 - DNA, 22 bp, Artificial Sequence
  chemically synthesized
tagtatcactgcagttcagact

SEQ ID NO: 1119808 - DNA, 22 bp, Artificial Sequence
  chemically synthesized
ttagtatcactgcagttcagac

SEQ ID NO: 1119809 - DNA, 22 bp, Artificial Sequence
  chemically synthesized
ttttagtatcactgcagttcag

SEQ ID NO: 1119810 - DNA, 22 bp, Artificial Sequence
  chemically synthesized
agctaaaaagtctgaactgcag

SEQ ID NO: 1119811 - DNA, 22 bp, Artificial Sequence
  chemically synthesized
aaaagtctgaactgcagtgata

SEQ ID NO: 1119812 - DNA, 22 bp, Artificial Sequence
  chemically synthesized
acattcttttagtatcactgca

SEQ ID NO: 1119813 - DNA, 22 bp, Artificial Sequence
  chemically synthesized
tcacattcttttagtatcactg

SEQ ID NO: 1119814 - DNA, 22 bp, Artificial Sequence
  chemically synthesized
cctctcacattcttttagtatc

SEQ ID NO: 1119815 - DNA, 22 bp, Artificial Sequence
  chemically synthesized
aactgcagtgatactaaaagaa

SEQ ID NO: 1119816 - DNA, 22 bp, Artificial Sequence
  chemically synthesized
cagtgatactaaaagaatgtga

SEQ ID NO: 1119817 - DNA, 22 bp, Artificial Sequence
  chemically synthesized
cgtagcagttacctctcacatt

SEQ ID NO: 1119818 - DNA, 22 bp, Artificial Sequence
  chemically synthesized
acgtagcagttacctctcacat

SEQ ID NO: 1119819 - DNA, 22 bp, Artificial Sequence
  chemically synthesized
tacgtagcagttacctctcaca

SEQ ID NO: 1119820 - DNA, 22 bp, Artificial Sequence
  chemically synthesized
ggctttacgtagcagttacctc

SEQ ID NO: 1119821 - DNA, 22 bp, Artificial Sequence
  chemically synthesized
aaagaatgtgagaggtaactgc

SEQ ID NO: 1119822 - DNA, 22 bp, Artificial Sequence
  chemically synthesized
gggctttacgtagcagttacct

SEQ ID NO: 1119823 - DNA, 22 bp, Artificial Sequence
  chemically synthesized
ggacacaatcttgggctttacg

SEQ ID NO: 1119824 - DNA, 22 bp, Artificial Sequence
  chemically synthesized
taggacacaatcttgggcttta

SEQ ID NO: 1119825 - DNA, 22 bp, Artificial Sequence
  chemically synthesized
ctacgtaaagcccaagattgtg

SEQ ID NO: 1119826 - DNA, 22 bp, Artificial Sequence
  chemically synthesized
cgtaaagcccaagattgtgtcc

SEQ ID NO: 1119827 - DNA, 22 bp, Artificial Sequence
  chemically synthesized
gagaatcaatattctaggacac

SEQ ID NO: 1119828 - DNA, 22 bp, Artificial Sequence
  chemically synthesized
tgtcctagaatattgattctcg

SEQ ID NO: 1119829 - DNA, 22 bp, Artificial Sequence
  chemically synthesized
tgcacataaaggctcgagaatc

SEQ ID NO: 1119830 - DNA, 22 bp, Artificial Sequence
  chemically synthesized
ctatgcacataaaggctcgaga

SEQ ID NO: 1119831 - DNA, 22 bp, Artificial Sequence
  chemically synthesized
gaatattgattctcgagccttt

SEQ ID NO: 1119832 - DNA, 22 bp, Artificial Sequence
  chemically synthesized
attctcgagcctttatgtgcat

SEQ ID NO: 1119833 - DNA, 22 bp, Artificial Sequence
  chemically synthesized
caggagtgattcctatgcacat

SEQ ID NO: 1119834 - DNA, 22 bp, Artificial Sequence
  chemically synthesized
ccaggagtgattcctatgcaca

SEQ ID NO: 1119835 - DNA, 22 bp, Artificial Sequence
  chemically synthesized
tcgagcctttatgtgcatagga

SEQ ID NO: 1119836 - DNA, 22 bp, Artificial Sequence
  chemically synthesized
tccaggagtgattcctatgcac

SEQ ID NO: 1119837 - DNA, 22 bp, Artificial Sequence
  chemically synthesized
gagcctttatgtgcataggaat

SEQ ID NO: 1119838 - DNA, 22 bp, Artificial Sequence
  chemically synthesized
aacattttccaggagtgattcc

SEQ ID NO: 1119839 - DNA, 22 bp, Artificial Sequence
  chemically synthesized
gaacattttccaggagtgattc

SEQ ID NO: 1119840 - DNA, 22 bp, Artificial Sequence
  chemically synthesized
tatgtgcataggaatcactcct

SEQ ID NO: 1119841 - DNA, 22 bp, Artificial Sequence
  chemically synthesized
tgaacattttccaggagtgatt

SEQ ID NO: 1119842 - DNA, 22 bp, Artificial Sequence
  chemically synthesized
atgtgcataggaatcactcctg

SEQ ID NO: 1119843 - DNA, 22 bp, Artificial Sequence
  chemically synthesized
tgtgcataggaatcactcctgg

SEQ ID NO: 1119844 - DNA, 22 bp, Artificial Sequence
  chemically synthesized
cctttgaacattttccaggagt

SEQ ID NO: 1119845 - DNA, 22 bp, Artificial Sequence
  chemically synthesized
gcctttgaacattttccaggag

SEQ ID NO: 1119846 - DNA, 22 bp, Artificial Sequence
  chemically synthesized
gtaaatcaaaatttgcctttga

SEQ ID NO: 1119847 - DNA, 22 bp, Artificial Sequence
  chemically synthesized
ctggaaaatgttcaaaggcaaa

SEQ ID NO: 1119848 - DNA, 22 bp, Artificial Sequence
  chemically synthesized
gaaaatgttcaaaggcaaattt

SEQ ID NO: 1119849 - DNA, 22 bp, Artificial Sequence
  chemically synthesized
agaactagtaaatcaaaatttg

SEQ ID NO: 1119850 - DNA, 22 bp, Artificial Sequence
  chemically synthesized
aaaggcaaattttgatttacta

SEQ ID NO: 1119851 - DNA, 22 bp, Artificial Sequence
  chemically synthesized
tcagaaatatagaatctcagaa

SEQ ID NO: 1119852 - DNA, 22 bp, Artificial Sequence
  chemically synthesized
tgatttactagttctgagattc

SEQ ID NO: 1119853 - DNA, 22 bp, Artificial Sequence
  chemically synthesized
gtcagaaatatagaatctcaga

SEQ ID NO: 1119854 - DNA, 22 bp, Artificial Sequence
  chemically synthesized
gatttactagttctgagattct

SEQ ID NO: 1119855 - DNA, 22 bp, Artificial Sequence
  chemically synthesized
atttactagttctgagattcta

SEQ ID NO: 1119856 - DNA, 22 bp, Artificial Sequence
  chemically synthesized
actagttctgagattctatatt

SEQ ID NO: 1119857 - DNA, 22 bp, Artificial Sequence
  chemically synthesized
ctagttctgagattctatattt

SEQ ID NO: 1119858 - DNA, 22 bp, Artificial Sequence
  chemically synthesized
ggagcttgtcagaaatatagaa

SEQ ID NO: 1119859 - DNA, 22 bp, Artificial Sequence
  chemically synthesized
gttctgagattctatatttctg

SEQ ID NO: 1119860 - DNA, 22 bp, Artificial Sequence
  chemically synthesized
tctgggagcttgtcagaaatat

SEQ ID NO: 1119861 - DNA, 22 bp, Artificial Sequence
  chemically synthesized
tgagattctatatttctgacaa

SEQ ID NO: 1119862 - DNA, 22 bp, Artificial Sequence
  chemically synthesized
agattctatatttctgacaagc

SEQ ID NO: 1119863 - DNA, 22 bp, Artificial Sequence
  chemically synthesized
acattatctgggagcttgtcag

SEQ ID NO: 1119864 - DNA, 22 bp, Artificial Sequence
  chemically synthesized
tatatttctgacaagctcccag

SEQ ID NO: 1119865 - DNA, 22 bp, Artificial Sequence
  chemically synthesized
tatttctgacaagctcccagat

SEQ ID NO: 1119866 - DNA, 22 bp, Artificial Sequence
  chemically synthesized
ctgacaagctcccagataatgt

SEQ ID NO: 1119867 - DNA, 22 bp, Artificial Sequence
  chemically synthesized
tgacaagctcccagataatgtc

SEQ ID NO: 1119868 - DNA, 22 bp, Artificial Sequence
  chemically synthesized
gaccaccaatattgacattatc

SEQ ID NO: 1119869 - DNA, 22 bp, Artificial Sequence
  chemically synthesized
acaagctcccagataatgtcaa

SEQ ID NO: 1119870 - DNA, 22 bp, Artificial Sequence
  chemically synthesized
ccagataatgtcaatattggtg

SEQ ID NO: 1119871 - DNA, 22 bp, Artificial Sequence
  chemically synthesized
atcaaaatgtccctggaccacc

SEQ ID NO: 1119872 - DNA, 22 bp, Artificial Sequence
  chemically synthesized
taatcaaaatgtccctggacca

SEQ ID NO: 1119873 - DNA, 22 bp, Artificial Sequence
  chemically synthesized
ctaatcaaaatgtccctggacc

SEQ ID NO: 1119874 - DNA, 22 bp, Artificial Sequence
  chemically synthesized
tctaatcaaaatgtccctggac

SEQ ID NO: 1119875 - DNA, 22 bp, Artificial Sequence
  chemically synthesized
gtggtccagggacattttgatt

SEQ ID NO: 1119876 - DNA, 22 bp, Artificial Sequence
  chemically synthesized
ggggacctttctaatcaaaatg

SEQ ID NO: 1119877 - DNA, 22 bp, Artificial Sequence
  chemically synthesized
tgggggacctttctaatcaaaa

SEQ ID NO: 1119878 - DNA, 22 bp, Artificial Sequence
  chemically synthesized
ctgggggacctttctaatcaaa

SEQ ID NO: 1119879 - DNA, 22 bp, Artificial Sequence
  chemically synthesized
acttctgggggacctttctaat

SEQ ID NO: 1119880 - DNA, 22 bp, Artificial Sequence
  chemically synthesized
aaagctgacttctgggggacct

SEQ ID NO: 1119881 - DNA, 22 bp, Artificial Sequence
  chemically synthesized
aaaagctgacttctgggggacc

SEQ ID NO: 1119882 - DNA, 22 bp, Artificial Sequence
  chemically synthesized
tgattagaaaggtcccccagaa

SEQ ID NO: 1119883 - DNA, 22 bp, Artificial Sequence
  chemically synthesized
gattagaaaggtcccccagaag

SEQ ID NO: 1119884 - DNA, 22 bp, Artificial Sequence
  chemically synthesized
tttaaaagctgacttctggggg

SEQ ID NO: 1119885 - DNA, 22 bp, Artificial Sequence
  chemically synthesized
attagaaaggtcccccagaagt

SEQ ID NO: 1119886 - DNA, 22 bp, Artificial Sequence
  chemically synthesized
atttaaaagctgacttctgggg

SEQ ID NO: 1119887 - DNA, 22 bp, Artificial Sequence
  chemically synthesized
gaaaggtcccccagaagtcagc

SEQ ID NO: 1119888 - DNA, 22 bp, Artificial Sequence
  chemically synthesized
acaaaatgcacttatttaaaag

SEQ ID NO: 1119889 - DNA, 22 bp, Artificial Sequence
  chemically synthesized
atataattaacaaaatgcactt

SEQ ID NO: 1119890 - DNA, 22 bp, Artificial Sequence
  chemically synthesized
ttcatataattaacaaaatgca

SEQ ID NO: 1119891 - DNA, 22 bp, Artificial Sequence
  chemically synthesized
attcatataattaacaaaatgc

SEQ ID NO: 1119892 - DNA, 22 bp, Artificial Sequence
  chemically synthesized
tattcatataattaacaaaatg

SEQ ID NO: 1119893 - DNA, 22 bp, Artificial Sequence
  chemically synthesized
ttaaataagtgcattttgttaa

SEQ ID NO: 1119894 - DNA, 22 bp, Artificial Sequence
  chemically synthesized
taaataagtgcattttgttaat

SEQ ID NO: 1119895 - DNA, 22 bp, Artificial Sequence
  chemically synthesized
aaataagtgcattttgttaatt

SEQ ID NO: 1119896 - DNA, 22 bp, Artificial Sequence
  chemically synthesized
aataagtgcattttgttaatta

SEQ ID NO: 1119897 - DNA, 22 bp, Artificial Sequence
  chemically synthesized
accatgtgttttattcatataa

SEQ ID NO: 1119898 - DNA, 22 bp, Artificial Sequence
  chemically synthesized
tgttaattatatgaataaaaca

SEQ ID NO: 1119899 - DNA, 22 bp, Artificial Sequence
  chemically synthesized
gttaattatatgaataaaacac

SEQ ID NO: 1119900 - DNA, 22 bp, Artificial Sequence
  chemically synthesized
tatattcaccatgtgttttatt

SEQ ID NO: 1119901 - DNA, 22 bp, Artificial Sequence
  chemically synthesized
ttaattatatgaataaaacaca

SEQ ID NO: 1119902 - DNA, 22 bp, Artificial Sequence
  chemically synthesized
gtatattcaccatgtgttttat

SEQ ID NO: 1119903 - DNA, 22 bp, Artificial Sequence
  chemically synthesized
attatatgaataaaacacatgg

SEQ ID NO: 1119904 - DNA, 22 bp, Artificial Sequence
  chemically synthesized
cttgtatattcaccatgtgttt

SEQ ID NO: 1119905 - DNA, 22 bp, Artificial Sequence
  chemically synthesized
ccttgtatattcaccatgtgtt

SEQ ID NO: 1119906 - DNA, 22 bp, Artificial Sequence
  chemically synthesized
tccttgtatattcaccatgtgt

SEQ ID NO: 1119907 - DNA, 22 bp, Artificial Sequence
  chemically synthesized
ttccttgtatattcaccatgtg

SEQ ID NO: 1119908 - DNA, 22 bp, Artificial Sequence
  chemically synthesized
tatgaataaaacacatggtgaa

SEQ ID NO: 1119909 - DNA, 22 bp, Artificial Sequence
  chemically synthesized
tttccttgtatattcaccatgt

SEQ ID NO: 1119910 - DNA, 22 bp, Artificial Sequence
  chemically synthesized
agcataattttttccttgtata

SEQ ID NO: 1119911 - DNA, 22 bp, Artificial Sequence
  chemically synthesized
aacctaagcataattttttcct

SEQ ID NO: 1119912 - DNA, 22 bp, Artificial Sequence
  chemically synthesized
aaacctaagcataattttttcc

SEQ ID NO: 1119913 - DNA, 22 bp, Artificial Sequence
  chemically synthesized
taaacctaagcataattttttc

SEQ ID NO: 1119914 - DNA, 22 bp, Artificial Sequence
  chemically synthesized
ttaaacctaagcataatttttt

SEQ ID NO: 1119915 - DNA, 22 bp, Artificial Sequence
  chemically synthesized
aaaaatgcaacttttaaaccta

SEQ ID NO: 1119916 - DNA, 22 bp, Artificial Sequence
  chemically synthesized
aaaaaatgcaacttttaaacct

SEQ ID NO: 1119917 - DNA, 22 bp, Artificial Sequence
  chemically synthesized
taaaaaatgcaacttttaaacc

SEQ ID NO: 1119918 - DNA, 22 bp, Artificial Sequence
  chemically synthesized
tgcttaggtttaaaagttgcat

SEQ ID NO: 1119919 - DNA, 22 bp, Artificial Sequence
  chemically synthesized
acatattttaaaaaatgcaact

SEQ ID NO: 1119920 - DNA, 22 bp, Artificial Sequence
  chemically synthesized
cacatattttaaaaaatgcaac

SEQ ID NO: 1119921 - DNA, 22 bp, Artificial Sequence
  chemically synthesized
aggtttaaaagttgcatttttt

SEQ ID NO: 1119922 - DNA, 22 bp, Artificial Sequence
  chemically synthesized
ggtttaaaagttgcatttttta

SEQ ID NO: 1119923 - DNA, 22 bp, Artificial Sequence
  chemically synthesized
aatttcacatattttaaaaaat

SEQ ID NO: 1119924 - DNA, 22 bp, Artificial Sequence
  chemically synthesized
aaaagttgcattttttaaaata

SEQ ID NO: 1119925 - DNA, 22 bp, Artificial Sequence
  chemically synthesized
aaagttgcattttttaaaatat

SEQ ID NO: 1119926 - DNA, 22 bp, Artificial Sequence
  chemically synthesized
tcagttcaatttcacatatttt

SEQ ID NO: 1119927 - DNA, 22 bp, Artificial Sequence
  chemically synthesized
cattttttaaaatatgtgaaat

SEQ ID NO: 1119928 - DNA, 22 bp, Artificial Sequence
  chemically synthesized
tttaaaatatgtgaaattgaac

SEQ ID NO: 1119929 - DNA, 22 bp, Artificial Sequence
  chemically synthesized
ttaaaatatgtgaaattgaact

SEQ ID NO: 1119930 - DNA, 22 bp, Artificial Sequence
  chemically synthesized
taaaatatgtgaaattgaactg

SEQ ID NO: 1119931 - DNA, 22 bp, Artificial Sequence
  chemically synthesized
aaaatatgtgaaattgaactga

SEQ ID NO: 1119932 - DNA, 22 bp, Artificial Sequence
  chemically synthesized
aaatatgtgaaattgaactgat

SEQ ID NO: 1119933 - DNA, 22 bp, Artificial Sequence
  chemically synthesized
gcatatcataggccattatcag

SEQ ID NO: 1119934 - DNA, 22 bp, Artificial Sequence
  chemically synthesized
gccagttagcatatcataggcc

SEQ ID NO: 1119935 - DNA, 22 bp, Artificial Sequence
  chemically synthesized
agccagttagcatatcataggc

SEQ ID NO: 1119936 - DNA, 22 bp, Artificial Sequence
  chemically synthesized
aactgataatggcctatgatat

SEQ ID NO: 1119937 - DNA, 22 bp, Artificial Sequence
  chemically synthesized
tagccagttagcatatcatagg

SEQ ID NO: 1119938 - DNA, 22 bp, Artificial Sequence
  chemically synthesized
ttagccagttagcatatcatag

SEQ ID NO: 1119939 - DNA, 22 bp, Artificial Sequence
  chemically synthesized
ataatggcctatgatatgctaa

SEQ ID NO: 1119940 - DNA, 22 bp, Artificial Sequence
  chemically synthesized
aaatgcttttagccagttagca

SEQ ID NO: 1119941 - DNA, 22 bp, Artificial Sequence
  chemically synthesized
caaatgcttttagccagttagc

SEQ ID NO: 1119942 - DNA, 22 bp, Artificial Sequence
  chemically synthesized
tcaaatgcttttagccagttag

SEQ ID NO: 1119943 - DNA, 22 bp, Artificial Sequence
  chemically synthesized
ctttcaaatgcttttagccagt

SEQ ID NO: 1119944 - DNA, 22 bp, Artificial Sequence
  chemically synthesized
tgatatgctaactggctaaaag

SEQ ID NO: 1119945 - DNA, 22 bp, Artificial Sequence
  chemically synthesized
ctcctttcaaatgcttttagcc

SEQ ID NO: 1119946 - DNA, 22 bp, Artificial Sequence
  chemically synthesized
actcctttcaaatgcttttagc

SEQ ID NO: 1119947 - DNA, 22 bp, Artificial Sequence
  chemically synthesized
atttactcctttcaaatgcttt

SEQ ID NO: 1119948 - DNA, 22 bp, Artificial Sequence
  chemically synthesized
catttactcctttcaaatgctt

SEQ ID NO: 1119949 - DNA, 22 bp, Artificial Sequence
  chemically synthesized
ttcatttactcctttcaaatgc

SEQ ID NO: 1119950 - DNA, 22 bp, Artificial Sequence
  chemically synthesized
actggctaaaagcatttgaaag

SEQ ID NO: 1119951 - DNA, 22 bp, Artificial Sequence
  chemically synthesized
cttcatttactcctttcaaatg

SEQ ID NO: 1119952 - DNA, 22 bp, Artificial Sequence
  chemically synthesized
gctaaaagcatttgaaaggagt

SEQ ID NO: 1119953 - DNA, 22 bp, Artificial Sequence
  chemically synthesized
atttcttcatttactcctttca

SEQ ID NO: 1119954 - DNA, 22 bp, Artificial Sequence
  chemically synthesized
gatttcttcatttactcctttc

SEQ ID NO: 1119955 - DNA, 22 bp, Artificial Sequence
  chemically synthesized
aaagcatttgaaaggagtaaat

SEQ ID NO: 1119956 - DNA, 22 bp, Artificial Sequence
  chemically synthesized
acttgatttcttcatttactcc

SEQ ID NO: 1119957 - DNA, 22 bp, Artificial Sequence
  chemically synthesized
cacttgatttcttcatttactc

SEQ ID NO: 1119958 - DNA, 22 bp, Artificial Sequence
  chemically synthesized
tcacttgatttcttcatttact

SEQ ID NO: 1119959 - DNA, 22 bp, Artificial Sequence
  chemically synthesized
ttcacttgatttcttcatttac

SEQ ID NO: 1119960 - DNA, 22 bp, Artificial Sequence
  chemically synthesized
tttcacttgatttcttcattta

SEQ ID NO: 1119961 - DNA, 22 bp, Artificial Sequence
  chemically synthesized
ttttcacttgatttcttcattt

SEQ ID NO: 1119962 - DNA, 22 bp, Artificial Sequence
  chemically synthesized
tttttcacttgatttcttcatt

SEQ ID NO: 1119963 - DNA, 22 bp, Artificial Sequence
  chemically synthesized
ttttttcacttgatttcttcat

SEQ ID NO: 1119964 - DNA, 22 bp, Artificial Sequence
  chemically synthesized
gaaaggagtaaatgaagaaatc

SEQ ID NO: 1119965 - DNA, 22 bp, Artificial Sequence
  chemically synthesized
tttttttcacttgatttcttca

SEQ ID NO: 1119966 - DNA, 22 bp, Artificial Sequence
  chemically synthesized
aaaggagtaaatgaagaaatca

SEQ ID NO: 1119967 - DNA, 22 bp, Artificial Sequence
  chemically synthesized
ttttttttcacttgatttcttc

SEQ ID NO: 1119968 - DNA, 22 bp, Artificial Sequence
  chemically synthesized
ttttttttttcacttgatttct

SEQ ID NO: 1119969 - DNA, 22 bp, Artificial Sequence
  chemically synthesized
ccaactcttttttttttcactt

SEQ ID NO: 1119970 - DNA, 22 bp, Artificial Sequence
  chemically synthesized
aatattaccaactctttttttt

SEQ ID NO: 1119971 - DNA, 22 bp, Artificial Sequence
  chemically synthesized
aaaatggctaaatattaccaac

SEQ ID NO: 1119972 - DNA, 22 bp, Artificial Sequence
  chemically synthesized
attaaaaatggctaaatattac

SEQ ID NO: 1119973 - DNA, 22 bp, Artificial Sequence
  chemically synthesized
cattaaaaatggctaaatatta

SEQ ID NO: 1119974 - DNA, 22 bp, Artificial Sequence
  chemically synthesized
tcattaaaaatggctaaatatt

SEQ ID NO: 1119975 - DNA, 22 bp, Artificial Sequence
  chemically synthesized
ggctttcattaaaaatggctaa

SEQ ID NO: 1119976 - DNA, 22 bp, Artificial Sequence
  chemically synthesized
aggctttcattaaaaatggcta

SEQ ID NO: 1119977 - DNA, 22 bp, Artificial Sequence
  chemically synthesized
taggctttcattaaaaatggct

SEQ ID NO: 1119978 - DNA, 22 bp, Artificial Sequence
  chemically synthesized
ttaggctttcattaaaaatggc

SEQ ID NO: 1119979 - DNA, 22 bp, Artificial Sequence
  chemically synthesized
gtaatatttagccatttttaat

SEQ ID NO: 1119980 - DNA, 22 bp, Artificial Sequence
  chemically synthesized
atccatttttaggctttcatta

SEQ ID NO: 1119981 - DNA, 22 bp, Artificial Sequence
  chemically synthesized
agccatttttaatgaaagccta

SEQ ID NO: 1119982 - DNA, 22 bp, Artificial Sequence
  chemically synthesized
gccatttttaatgaaagcctaa

SEQ ID NO: 1119983 - DNA, 22 bp, Artificial Sequence
  chemically synthesized
agtggtattaatccatttttag

SEQ ID NO: 1119984 - DNA, 22 bp, Artificial Sequence
  chemically synthesized
ttaatgaaagcctaaaaatgga

SEQ ID NO: 1119985 - DNA, 22 bp, Artificial Sequence
  chemically synthesized
gagtggtattaatccattttta

SEQ ID NO: 1119986 - DNA, 22 bp, Artificial Sequence
  chemically synthesized
taatgaaagcctaaaaatggat

SEQ ID NO: 1119987 - DNA, 22 bp, Artificial Sequence
  chemically synthesized
aatgaaagcctaaaaatggatt

SEQ ID NO: 1119988 - DNA, 22 bp, Artificial Sequence
  chemically synthesized
atgaaagcctaaaaatggatta

SEQ ID NO: 1119989 - DNA, 22 bp, Artificial Sequence
  chemically synthesized
gtgtcatgaacttgagtggtat

SEQ ID NO: 1119990 - DNA, 22 bp, Artificial Sequence
  chemically synthesized
aaaatggattaataccactcaa

SEQ ID NO: 1119991 - DNA, 22 bp, Artificial Sequence
  chemically synthesized
atggcaggctcgtgtcatgaac

SEQ ID NO: 1119992 - DNA, 22 bp, Artificial Sequence
  chemically synthesized
ataccactcaagttcatgacac

SEQ ID NO: 1119993 - DNA, 22 bp, Artificial Sequence
  chemically synthesized
aactcatggcaggctcgtgtca

SEQ ID NO: 1119994 - DNA, 22 bp, Artificial Sequence
  chemically synthesized
aaactcatggcaggctcgtgtc

SEQ ID NO: 1119995 - DNA, 22 bp, Artificial Sequence
  chemically synthesized
taaactcatggcaggctcgtgt

SEQ ID NO: 1119996 - DNA, 22 bp, Artificial Sequence
  chemically synthesized
aagttcatgacacgagcctgcc

SEQ ID NO: 1119997 - DNA, 22 bp, Artificial Sequence
  chemically synthesized
ttttaaactcatggcaggctcg

SEQ ID NO: 1119998 - DNA, 22 bp, Artificial Sequence
  chemically synthesized
atgacacgagcctgccatgagt

SEQ ID NO: 1119999 - DNA, 22 bp, Artificial Sequence
  chemically synthesized
tataggttattttaaactcatg

SEQ ID NO: 1120000 - DNA, 22 bp, Artificial Sequence
  chemically synthesized
atataggttattttaaactcat

SEQ ID NO: 1120001 - DNA, 22 bp, Artificial Sequence
  chemically synthesized
tcggtttatataggttatttta

SEQ ID NO: 1120002 - DNA, 22 bp, Artificial Sequence
  chemically synthesized
ccatgagtttaaaataacctat

SEQ ID NO: 1120003 - DNA, 22 bp, Artificial Sequence
  chemically synthesized
catcacctgtcggtttatatag

SEQ ID NO: 1120004 - DNA, 22 bp, Artificial Sequence
  chemically synthesized
ctacatcacctgtcggtttata

SEQ ID NO: 1120005 - DNA, 22 bp, Artificial Sequence
  chemically synthesized
aaaataacctatataaaccgac

SEQ ID NO: 1120006 - DNA, 22 bp, Artificial Sequence
  chemically synthesized
actacatcacctgtcggtttat

SEQ ID NO: 1120007 - DNA, 22 bp, Artificial Sequence
  chemically synthesized
aaataacctatataaaccgaca

SEQ ID NO: 1120008 - DNA, 22 bp, Artificial Sequence
  chemically synthesized
ttactacatcacctgtcggttt

SEQ ID NO: 1120009 - DNA, 22 bp, Artificial Sequence
  chemically synthesized
cttactacatcacctgtcggtt

SEQ ID NO: 1120010 - DNA, 22 bp, Artificial Sequence
  chemically synthesized
tcttactacatcacctgtcggt

SEQ ID NO: 1120011 - DNA, 22 bp, Artificial Sequence
  chemically synthesized
attttcttactacatcacctgt

SEQ ID NO: 1120012 - DNA, 22 bp, Artificial Sequence
  chemically synthesized
tataaaccgacaggtgatgtag

SEQ ID NO: 1120013 - DNA, 22 bp, Artificial Sequence
  chemically synthesized
ggtatccattaattttcttact

SEQ ID NO: 1120014 - DNA, 22 bp, Artificial Sequence
  chemically synthesized
aggtatccattaattttcttac

SEQ ID NO: 1120015 - DNA, 22 bp, Artificial Sequence
  chemically synthesized
agtttaggtatccattaatttt

SEQ ID NO: 1120016 - DNA, 22 bp, Artificial Sequence
  chemically synthesized
cgatgatggatattcagtttag

SEQ ID NO: 1120017 - DNA, 22 bp, Artificial Sequence
  chemically synthesized
atggatacctaaactgaatatc

SEQ ID NO: 1120018 - DNA, 22 bp, Artificial Sequence
  chemically synthesized
aactgaatatccatcatcgtaa

SEQ ID NO: 1120019 - DNA, 22 bp, Artificial Sequence
  chemically synthesized
agagaaatacataattacgatg

SEQ ID NO: 1120020 - DNA, 22 bp, Artificial Sequence
  chemically synthesized
gagagaaatacataattacgat

SEQ ID NO: 1120021 - DNA, 22 bp, Artificial Sequence
  chemically synthesized
aatatccatcatcgtaattatg

SEQ ID NO: 1120022 - DNA, 22 bp, Artificial Sequence
  chemically synthesized
aaaatccttgagagaaatacat

SEQ ID NO: 1120023 - DNA, 22 bp, Artificial Sequence
  chemically synthesized
tgtatttctctcaaggattttt

SEQ ID NO: 1120024 - DNA, 22 bp, Artificial Sequence
  chemically synthesized
ctctcaaggatttttaatacat

SEQ ID NO: 1120025 - DNA, 22 bp, Artificial Sequence
  chemically synthesized
aatacaatgtatatgtattaaa

SEQ ID NO: 1120026 - DNA, 22 bp, Artificial Sequence
  chemically synthesized
tctcaaggatttttaatacata

SEQ ID NO: 1120027 - DNA, 22 bp, Artificial Sequence
  chemically synthesized
tcaaggatttttaatacatata

SEQ ID NO: 1120028 - DNA, 22 bp, Artificial Sequence
  chemically synthesized
aaggatttttaatacatataca

SEQ ID NO: 1120029 - DNA, 22 bp, Artificial Sequence
  chemically synthesized
aggctaaatacaatgtatatgt

SEQ ID NO: 1120030 - DNA, 22 bp, Artificial Sequence
  chemically synthesized
cctcaggctaaatacaatgtat

SEQ ID NO: 1120031 - DNA, 22 bp, Artificial Sequence
  chemically synthesized
ccctcaggctaaatacaatgta

SEQ ID NO: 1120032 - DNA, 22 bp, Artificial Sequence
  chemically synthesized
ttaatacatatacattgtattt

SEQ ID NO: 1120033 - DNA, 22 bp, Artificial Sequence
  chemically synthesized
taatacatatacattgtattta

SEQ ID NO: 1120034 - DNA, 22 bp, Artificial Sequence
  chemically synthesized
aatacatatacattgtatttag

SEQ ID NO: 1120035 - DNA, 22 bp, Artificial Sequence
  chemically synthesized
atacatatacattgtatttagc

SEQ ID NO: 1120036 - DNA, 22 bp, Artificial Sequence
  chemically synthesized
atgtttccctcaggctaaatac

SEQ ID NO: 1120037 - DNA, 22 bp, Artificial Sequence
  chemically synthesized
gatgtttccctcaggctaaata

SEQ ID NO: 1120038 - DNA, 22 bp, Artificial Sequence
  chemically synthesized
ccttgatgtttccctcaggcta

SEQ ID NO: 1120039 - DNA, 22 bp, Artificial Sequence
  chemically synthesized
accttgatgtttccctcaggct

SEQ ID NO: 1120040 - DNA, 22 bp, Artificial Sequence
  chemically synthesized
tatttagcctgagggaaacatc

SEQ ID NO: 1120041 - DNA, 22 bp, Artificial Sequence
  chemically synthesized
agcctgagggaaacatcaaggt

SEQ ID NO: 1120042 - DNA, 22 bp, Artificial Sequence
  chemically synthesized
gcctgagggaaacatcaaggta

SEQ ID NO: 1120043 - DNA, 22 bp, Artificial Sequence
  chemically synthesized
agggaaacatcaaggtaaatca

SEQ ID NO: 1120044 - DNA, 22 bp, Artificial Sequence
  chemically synthesized
aaatgggacatgaaatgattta

SEQ ID NO: 1120045 - DNA, 22 bp, Artificial Sequence
  chemically synthesized
ctaaaatgggacatgaaatgat

SEQ ID NO: 1120046 - DNA, 22 bp, Artificial Sequence
  chemically synthesized
cctactaaaatgggacatgaaa

SEQ ID NO: 1120047 - DNA, 22 bp, Artificial Sequence
  chemically synthesized
attgcctactaaaatgggacat

SEQ ID NO: 1120048 - DNA, 22 bp, Artificial Sequence
  chemically synthesized
aattgcctactaaaatgggaca

SEQ ID NO: 1120049 - DNA, 22 bp, Artificial Sequence
  chemically synthesized
ttaattgcctactaaaatggga

SEQ ID NO: 1120050 - DNA, 22 bp, Artificial Sequence
  chemically synthesized
catgtcccattttagtaggcaa

SEQ ID NO: 1120051 - DNA, 22 bp, Artificial Sequence
  chemically synthesized
atgtcccattttagtaggcaat

SEQ ID NO: 1120052 - DNA, 22 bp, Artificial Sequence
  chemically synthesized
aaataacaacatcattcttaat

SEQ ID NO: 1120053 - DNA, 22 bp, Artificial Sequence
  chemically synthesized
tgaaataacaacatcattctta

SEQ ID NO: 1120054 - DNA, 22 bp, Artificial Sequence
  chemically synthesized
tagtaggcaattaagaatgatg

SEQ ID NO: 1120055 - DNA, 22 bp, Artificial Sequence
  chemically synthesized
ctgaaataacaacatcattctt

SEQ ID NO: 1120056 - DNA, 22 bp, Artificial Sequence
  chemically synthesized
agtaggcaattaagaatgatgt

SEQ ID NO: 1120057 - DNA, 22 bp, Artificial Sequence
  chemically synthesized
tctgaaataacaacatcattct

SEQ ID NO: 1120058 - DNA, 22 bp, Artificial Sequence
  chemically synthesized
gtaggcaattaagaatgatgtt

SEQ ID NO: 1120059 - DNA, 22 bp, Artificial Sequence
  chemically synthesized
attttctgaaataacaacatca

SEQ ID NO: 1120060 - DNA, 22 bp, Artificial Sequence
  chemically synthesized
tcattttctgaaataacaacat

SEQ ID NO: 1120061 - DNA, 22 bp, Artificial Sequence
  chemically synthesized
aactctcattttctgaaataac

SEQ ID NO: 1120062 - DNA, 22 bp, Artificial Sequence
  chemically synthesized
agaatgatgttgttatttcaga

SEQ ID NO: 1120063 - DNA, 22 bp, Artificial Sequence
  chemically synthesized
tcaacctgaactctcattttct

SEQ ID NO: 1120064 - DNA, 22 bp, Artificial Sequence
  chemically synthesized
atcaacctgaactctcattttc

SEQ ID NO: 1120065 - DNA, 22 bp, Artificial Sequence
  chemically synthesized
tatcaacctgaactctcatttt

SEQ ID NO: 1120066 - DNA, 22 bp, Artificial Sequence
  chemically synthesized
ttatttcagaaaatgagagttc

SEQ ID NO: 1120067 - DNA, 22 bp, Artificial Sequence
  chemically synthesized
tttcagaaaatgagagttcagg

SEQ ID NO: 1120068 - DNA, 22 bp, Artificial Sequence
  chemically synthesized
cagaaaatgagagttcaggttg

SEQ ID NO: 1120069 - DNA, 22 bp, Artificial Sequence
  chemically synthesized
agaaaatgagagttcaggttga

SEQ ID NO: 1120070 - DNA, 22 bp, Artificial Sequence
  chemically synthesized
tgagtcccctttatcaacctga

SEQ ID NO: 1120071 - DNA, 22 bp, Artificial Sequence
  chemically synthesized
gtgagtcccctttatcaacctg

SEQ ID NO: 1120072 - DNA, 22 bp, Artificial Sequence
  chemically synthesized
ataccttgtgagtcccctttat

SEQ ID NO: 1120073 - DNA, 22 bp, Artificial Sequence
  chemically synthesized
tgataccttgtgagtccccttt

SEQ ID NO: 1120074 - DNA, 22 bp, Artificial Sequence
  chemically synthesized
ctgataccttgtgagtcccctt

SEQ ID NO: 1120075 - DNA, 22 bp, Artificial Sequence
  chemically synthesized
tctgataccttgtgagtcccct

SEQ ID NO: 1120076 - DNA, 22 bp, Artificial Sequence
  chemically synthesized
aggttgataaaggggactcaca

SEQ ID NO: 1120077 - DNA, 22 bp, Artificial Sequence
  chemically synthesized
gttttctgataccttgtgagtc

SEQ ID NO: 1120078 - DNA, 22 bp, Artificial Sequence
  chemically synthesized
ataaaggggactcacaaggtat

SEQ ID NO: 1120079 - DNA, 22 bp, Artificial Sequence
  chemically synthesized
taactggttttctgataccttg

SEQ ID NO: 1120080 - DNA, 22 bp, Artificial Sequence
  chemically synthesized
ataactggttttctgatacctt

SEQ ID NO: 1120081 - DNA, 22 bp, Artificial Sequence
  chemically synthesized
tataactggttttctgatacct

SEQ ID NO: 1120082 - DNA, 22 bp, Artificial Sequence
  chemically synthesized
acaaggtatcagaaaaccagtt

SEQ ID NO: 1120083 - DNA, 22 bp, Artificial Sequence
  chemically synthesized
aaaaatgtacagtgttttataa

SEQ ID NO: 1120084 - DNA, 22 bp, Artificial Sequence
  chemically synthesized
aaagtgctcaaaaatgtacagt

SEQ ID NO: 1120085 - DNA, 22 bp, Artificial Sequence
  chemically synthesized
taaaacactgtacatttttgag

SEQ ID NO: 1120086 - DNA, 22 bp, Artificial Sequence
  chemically synthesized
tacatttttgagcacttttagt

SEQ ID NO: 1120087 - DNA, 22 bp, Artificial Sequence
  chemically synthesized
ttgagcacttttagtctgtcat

SEQ ID NO: 1120088 - DNA, 22 bp, Artificial Sequence
  chemically synthesized
tgagcacttttagtctgtcatg

SEQ ID NO: 1120089 - DNA, 22 bp, Artificial Sequence
  chemically synthesized
gagcacttttagtctgtcatgc

SEQ ID NO: 1120090 - DNA, 22 bp, Artificial Sequence
  chemically synthesized
tcaatagcgggagcatgacaga

SEQ ID NO: 1120091 - DNA, 22 bp, Artificial Sequence
  chemically synthesized
agcacttttagtctgtcatgct

SEQ ID NO: 1120092 - DNA, 22 bp, Artificial Sequence
  chemically synthesized
atcaatagcgggagcatgacag

SEQ ID NO: 1120093 - DNA, 22 bp, Artificial Sequence
  chemically synthesized
tatcaatagcgggagcatgaca

SEQ ID NO: 1120094 - DNA, 22 bp, Artificial Sequence
  chemically synthesized
cattttatcaatagcgggagca

SEQ ID NO: 1120095 - DNA, 22 bp, Artificial Sequence
  chemically synthesized
ttagtctgtcatgctcccgcta

SEQ ID NO: 1120096 - DNA, 22 bp, Artificial Sequence
  chemically synthesized
gcattttatcaatagcgggagc

SEQ ID NO: 1120097 - DNA, 22 bp, Artificial Sequence
  chemically synthesized
tagtctgtcatgctcccgctat

SEQ ID NO: 1120098 - DNA, 22 bp, Artificial Sequence
  chemically synthesized
agtctgtcatgctcccgctatt

SEQ ID NO: 1120099 - DNA, 22 bp, Artificial Sequence
  chemically synthesized
gtctgtcatgctcccgctattg

SEQ ID NO: 1120100 - DNA, 22 bp, Artificial Sequence
  chemically synthesized
tcatgctcccgctattgataaa

SEQ ID NO: 1120101 - DNA, 22 bp, Artificial Sequence
  chemically synthesized
tgaacgatttgcattttatcaa

SEQ ID NO: 1120102 - DNA, 22 bp, Artificial Sequence
  chemically synthesized
cctatgaacgatttgcatttta

SEQ ID NO: 1120103 - DNA, 22 bp, Artificial Sequence
  chemically synthesized
ccgctattgataaaatgcaaat

SEQ ID NO: 1120104 - DNA, 22 bp, Artificial Sequence
  chemically synthesized
ttgataaaatgcaaatcgttca

SEQ ID NO: 1120105 - DNA, 22 bp, Artificial Sequence
  chemically synthesized
ataaaatgcaaatcgttcatag

SEQ ID NO: 1120106 - DNA, 22 bp, Artificial Sequence
  chemically synthesized
tcatgtggttacctatgaacga

SEQ ID NO: 1120107 - DNA, 22 bp, Artificial Sequence
  chemically synthesized
ttatcatgtggttacctatgaa

SEQ ID NO: 1120108 - DNA, 22 bp, Artificial Sequence
  chemically synthesized
ctgttatcatgtggttacctat

SEQ ID NO: 1120109 - DNA, 22 bp, Artificial Sequence
  chemically synthesized
aaagttcctgttatcatgtggt

SEQ ID NO: 1120110 - DNA, 22 bp, Artificial Sequence
  chemically synthesized
aaaagttcctgttatcatgtgg

SEQ ID NO: 1120111 - DNA, 22 bp, Artificial Sequence
  chemically synthesized
taaaagttcctgttatcatgtg

SEQ ID NO: 1120112 - DNA, 22 bp, Artificial Sequence
  chemically synthesized
ataggtaaccacatgataacag

SEQ ID NO: 1120113 - DNA, 22 bp, Artificial Sequence
  chemically synthesized
aggaatataaattttaaaagtt

SEQ ID NO: 1120114 - DNA, 22 bp, Artificial Sequence
  chemically synthesized
caggaatataaattttaaaagt

SEQ ID NO: 1120115 - DNA, 22 bp, Artificial Sequence
  chemically synthesized
agtatttcaggaatataaattt

SEQ ID NO: 1120116 - DNA, 22 bp, Artificial Sequence
  chemically synthesized
cagtatttcaggaatataaatt

SEQ ID NO: 1120117 - DNA, 22 bp, Artificial Sequence
  chemically synthesized
agtttcagtatttcaggaatat

SEQ ID NO: 1120118 - DNA, 22 bp, Artificial Sequence
  chemically synthesized
ttaaaatttatattcctgaaat

SEQ ID NO: 1120119 - DNA, 22 bp, Artificial Sequence
  chemically synthesized
taaaatttatattcctgaaata

SEQ ID NO: 1120120 - DNA, 22 bp, Artificial Sequence
  chemically synthesized
aaaatttatattcctgaaatac

SEQ ID NO: 1120121 - DNA, 22 bp, Artificial Sequence
  chemically synthesized
aaatttatattcctgaaatact

SEQ ID NO: 1120122 - DNA, 22 bp, Artificial Sequence
  chemically synthesized
atattcctgaaatactgaaact

SEQ ID NO: 1120123 - DNA, 22 bp, Artificial Sequence
  chemically synthesized
tattcctgaaatactgaaactc

SEQ ID NO: 1120124 - DNA, 22 bp, Artificial Sequence
  chemically synthesized
atcaggcaggaaaattgagttt

SEQ ID NO: 1120125 - DNA, 22 bp, Artificial Sequence
  chemically synthesized
ctgaaatactgaaactcaattt

SEQ ID NO: 1120126 - DNA, 22 bp, Artificial Sequence
  chemically synthesized
gatcaggcaggaaaattgagtt

SEQ ID NO: 1120127 - DNA, 22 bp, Artificial Sequence
  chemically synthesized
tgatcaggcaggaaaattgagt

SEQ ID NO: 1120128 - DNA, 22 bp, Artificial Sequence
  chemically synthesized
aaatactgaaactcaattttcc

SEQ ID NO: 1120129 - DNA, 22 bp, Artificial Sequence
  chemically synthesized
agacagctttgatcaggcagga

SEQ ID NO: 1120130 - DNA, 22 bp, Artificial Sequence
  chemically synthesized
aaactcaattttcctgcctgat

SEQ ID NO: 1120131 - DNA, 22 bp, Artificial Sequence
  chemically synthesized
aagacagctttgatcaggcagg

SEQ ID NO: 1120132 - DNA, 22 bp, Artificial Sequence
  chemically synthesized
tcttaagacagctttgatcagg

SEQ ID NO: 1120133 - DNA, 22 bp, Artificial Sequence
  chemically synthesized
atcttaagacagctttgatcag

SEQ ID NO: 1120134 - DNA, 22 bp, Artificial Sequence
  chemically synthesized
aattttcctgcctgatcaaagc

SEQ ID NO: 1120135 - DNA, 22 bp, Artificial Sequence
  chemically synthesized
tatcttaagacagctttgatca

SEQ ID NO: 1120136 - DNA, 22 bp, Artificial Sequence
  chemically synthesized
tttatcttaagacagctttgat

SEQ ID NO: 1120137 - DNA, 22 bp, Artificial Sequence
  chemically synthesized
ctttatcttaagacagctttga

SEQ ID NO: 1120138 - DNA, 22 bp, Artificial Sequence
  chemically synthesized
tcctgcctgatcaaagctgtct

SEQ ID NO: 1120139 - DNA, 22 bp, Artificial Sequence
  chemically synthesized
cctgcctgatcaaagctgtctt

SEQ ID NO: 1120140 - DNA, 22 bp, Artificial Sequence
  chemically synthesized
tttctttatcttaagacagctt

SEQ ID NO: 1120141 - DNA, 22 bp, Artificial Sequence
  chemically synthesized
ctgcctgatcaaagctgtctta

SEQ ID NO: 1120142 - DNA, 22 bp, Artificial Sequence
  chemically synthesized
tgtttctttatcttaagacagc

SEQ ID NO: 1120143 - DNA, 22 bp, Artificial Sequence
  chemically synthesized
cctgatcaaagctgtcttaaga

SEQ ID NO: 1120144 - DNA, 22 bp, Artificial Sequence
  chemically synthesized
atcaaagctgtcttaagataaa

SEQ ID NO: 1120145 - DNA, 22 bp, Artificial Sequence
  chemically synthesized
atactctgtttctttatcttaa

SEQ ID NO: 1120146 - DNA, 22 bp, Artificial Sequence
  chemically synthesized
tctgatactctgtttctttatc

SEQ ID NO: 1120147 - DNA, 22 bp, Artificial Sequence
  chemically synthesized
tgtctgatactctgtttcttta

SEQ ID NO: 1120148 - DNA, 22 bp, Artificial Sequence
  chemically synthesized
ctgtctgatactctgtttcttt

SEQ ID NO: 1120149 - DNA, 22 bp, Artificial Sequence
  chemically synthesized
tcttaagataaagaaacagagt

SEQ ID NO: 1120150 - DNA, 22 bp, Artificial Sequence
  chemically synthesized
aagataaagaaacagagtatca

SEQ ID NO: 1120151 - DNA, 22 bp, Artificial Sequence
  chemically synthesized
agataaagaaacagagtatcag

SEQ ID NO: 1120152 - DNA, 22 bp, Artificial Sequence
  chemically synthesized
acaggtttctgtctgatactct

SEQ ID NO: 1120153 - DNA, 22 bp, Artificial Sequence
  chemically synthesized
tcacaggtttctgtctgatact

SEQ ID NO: 1120154 - DNA, 22 bp, Artificial Sequence
  chemically synthesized
attctcacaggtttctgtctga

SEQ ID NO: 1120155 - DNA, 22 bp, Artificial Sequence
  chemically synthesized
atctgattctcacaggtttctg

SEQ ID NO: 1120156 - DNA, 22 bp, Artificial Sequence
  chemically synthesized
ttgatctgattctcacaggttt

SEQ ID NO: 1120157 - DNA, 22 bp, Artificial Sequence
  chemically synthesized
aaaatgattattgatctgattc

SEQ ID NO: 1120158 - DNA, 22 bp, Artificial Sequence
  chemically synthesized
attaaaaatgattattgatctg

SEQ ID NO: 1120159 - DNA, 22 bp, Artificial Sequence
  chemically synthesized
gctaattaaaaatgattattga

SEQ ID NO: 1120160 - DNA, 22 bp, Artificial Sequence
  chemically synthesized
tgagaatcagatcaataatcat

SEQ ID NO: 1120161 - DNA, 22 bp, Artificial Sequence
  chemically synthesized
ttagctaattaaaaatgattat

SEQ ID NO: 1120162 - DNA, 22 bp, Artificial Sequence
  chemically synthesized
attagctaattaaaaatgatta

SEQ ID NO: 1120163 - DNA, 22 bp, Artificial Sequence
  chemically synthesized
tattagctaattaaaaatgatt

SEQ ID NO: 1120164 - DNA, 22 bp, Artificial Sequence
  chemically synthesized
gcattttattagctaattaaaa

SEQ ID NO: 1120165 - DNA, 22 bp, Artificial Sequence
  chemically synthesized
agcattttattagctaattaaa

SEQ ID NO: 1120166 - DNA, 22 bp, Artificial Sequence
  chemically synthesized
tagcattttattagctaattaa

SEQ ID NO: 1120167 - DNA, 22 bp, Artificial Sequence
  chemically synthesized
ttaattagctaataaaatgcta

SEQ ID NO: 1120168 - DNA, 22 bp, Artificial Sequence
  chemically synthesized
taattagctaataaaatgctaa

SEQ ID NO: 1120169 - DNA, 22 bp, Artificial Sequence
  chemically synthesized
aattagctaataaaatgctaaa

SEQ ID NO: 1120170 - DNA, 22 bp, Artificial Sequence
  chemically synthesized
attagctaataaaatgctaaag

SEQ ID NO: 1120171 - DNA, 22 bp, Artificial Sequence
  chemically synthesized
aaagtatgaatcacctttagca

SEQ ID NO: 1120172 - DNA, 22 bp, Artificial Sequence
  chemically synthesized
gctaataaaatgctaaaggtga

SEQ ID NO: 1120173 - DNA, 22 bp, Artificial Sequence
  chemically synthesized
ataaaatgctaaaggtgattca

SEQ ID NO: 1120174 - DNA, 22 bp, Artificial Sequence
  chemically synthesized
accactgaaagtatgaatcacc

SEQ ID NO: 1120175 - DNA, 22 bp, Artificial Sequence
  chemically synthesized
gaccactgaaagtatgaatcac

SEQ ID NO: 1120176 - DNA, 22 bp, Artificial Sequence
  chemically synthesized
catatttgaccactgaaagtat

SEQ ID NO: 1120177 - DNA, 22 bp, Artificial Sequence
  chemically synthesized
aaggtgattcatactttcagtg

SEQ ID NO: 1120178 - DNA, 22 bp, Artificial Sequence
  chemically synthesized
atactttcagtggtcaaatatg

SEQ ID NO: 1120179 - DNA, 22 bp, Artificial Sequence
  chemically synthesized
aaacatcatgttacatatttga

SEQ ID NO: 1120180 - DNA, 22 bp, Artificial Sequence
  chemically synthesized
caaacatcatgttacatatttg

SEQ ID NO: 1120181 - DNA, 22 bp, Artificial Sequence
  chemically synthesized
tcaaacatcatgttacatattt

SEQ ID NO: 1120182 - DNA, 22 bp, Artificial Sequence
  chemically synthesized
tcagtggtcaaatatgtaacat

SEQ ID NO: 1120183 - DNA, 22 bp, Artificial Sequence
  chemically synthesized
cagtggtcaaatatgtaacatg

SEQ ID NO: 1120184 - DNA, 22 bp, Artificial Sequence
  chemically synthesized
attttcaaacatcatgttacat

SEQ ID NO: 1120185 - DNA, 22 bp, Artificial Sequence
  chemically synthesized
agtggtcaaatatgtaacatga

SEQ ID NO: 1120186 - DNA, 22 bp, Artificial Sequence
  chemically synthesized
taattttcaaacatcatgttac

SEQ ID NO: 1120187 - DNA, 22 bp, Artificial Sequence
  chemically synthesized
aactctaattttcaaacatcat

SEQ ID NO: 1120188 - DNA, 22 bp, Artificial Sequence
  chemically synthesized
gagaacattaaactctaatttt

SEQ ID NO: 1120189 - DNA, 22 bp, Artificial Sequence
  chemically synthesized
attagagaacattaaactctaa

SEQ ID NO: 1120190 - DNA, 22 bp, Artificial Sequence
  chemically synthesized
gaaaattagagtttaatgttct

SEQ ID NO: 1120191 - DNA, 22 bp, Artificial Sequence
  chemically synthesized
aaaattagagtttaatgttctc

SEQ ID NO: 1120192 - DNA, 22 bp, Artificial Sequence
  chemically synthesized
gtagtagaaaattaattagaga

SEQ ID NO: 1120193 - DNA, 22 bp, Artificial Sequence
  chemically synthesized
gagtttaatgttctctaattaa

SEQ ID NO: 1120194 - DNA, 22 bp, Artificial Sequence
  chemically synthesized
agtagtagaaaattaattagag

SEQ ID NO: 1120195 - DNA, 22 bp, Artificial Sequence
  chemically synthesized
ttagtagtagaaaattaattag

SEQ ID NO: 1120196 - DNA, 22 bp, Artificial Sequence
  chemically synthesized
tcttagtagtagaaaattaatt

SEQ ID NO: 1120197 - DNA, 22 bp, Artificial Sequence
  chemically synthesized
aatgttctctaattaattttct

SEQ ID NO: 1120198 - DNA, 22 bp, Artificial Sequence
  chemically synthesized
atgttctctaattaattttcta

SEQ ID NO: 1120199 - DNA, 22 bp, Artificial Sequence
  chemically synthesized
tctaattaattttctactacta

SEQ ID NO: 1120200 - DNA, 22 bp, Artificial Sequence
  chemically synthesized
agggaaattctcttagtagtag

SEQ ID NO: 1120201 - DNA, 22 bp, Artificial Sequence
  chemically synthesized
taattaattttctactactaag

SEQ ID NO: 1120202 - DNA, 22 bp, Artificial Sequence
  chemically synthesized
gagggaaattctcttagtagta

SEQ ID NO: 1120203 - DNA, 22 bp, Artificial Sequence
  chemically synthesized
tgagggaaattctcttagtagt

SEQ ID NO: 1120204 - DNA, 22 bp, Artificial Sequence
  chemically synthesized
attaattttctactactaagag

SEQ ID NO: 1120205 - DNA, 22 bp, Artificial Sequence
  chemically synthesized
ttgagggaaattctcttagtag

SEQ ID NO: 1120206 - DNA, 22 bp, Artificial Sequence
  chemically synthesized
attttctactactaagagaatt

SEQ ID NO: 1120207 - DNA, 22 bp, Artificial Sequence
  chemically synthesized
tgatttttgagggaaattctct

SEQ ID NO: 1120208 - DNA, 22 bp, Artificial Sequence
  chemically synthesized
tctactactaagagaatttccc

SEQ ID NO: 1120209 - DNA, 22 bp, Artificial Sequence
  chemically synthesized
ctactactaagagaatttccct

SEQ ID NO: 1120210 - DNA, 22 bp, Artificial Sequence
  chemically synthesized
ctgtgatttttgagggaaattc

SEQ ID NO: 1120211 - DNA, 22 bp, Artificial Sequence
  chemically synthesized
tactactaagagaatttccctc

SEQ ID NO: 1120212 - DNA, 22 bp, Artificial Sequence
  chemically synthesized
gctgtgatttttgagggaaatt

SEQ ID NO: 1120213 - DNA, 22 bp, Artificial Sequence
  chemically synthesized
ctactaagagaatttccctcaa

SEQ ID NO: 1120214 - DNA, 22 bp, Artificial Sequence
  chemically synthesized
tttgctgtgatttttgagggaa

SEQ ID NO: 1120215 - DNA, 22 bp, Artificial Sequence
  chemically synthesized
ctaagagaatttccctcaaaaa

SEQ ID NO: 1120216 - DNA, 22 bp, Artificial Sequence
  chemically synthesized
agagaatttccctcaaaaatca

SEQ ID NO: 1120217 - DNA, 22 bp, Artificial Sequence
  chemically synthesized
aaggtaaattgtttgctgtgat

SEQ ID NO: 1120218 - DNA, 22 bp, Artificial Sequence
  chemically synthesized
gaaggtaaattgtttgctgtga

SEQ ID NO: 1120219 - DNA, 22 bp, Artificial Sequence
  chemically synthesized
tgaaggtaaattgtttgctgtg

SEQ ID NO: 1120220 - DNA, 22 bp, Artificial Sequence
  chemically synthesized
ccctcaaaaatcacagcaaaca

SEQ ID NO: 1120221 - DNA, 22 bp, Artificial Sequence
  chemically synthesized
cctcaaaaatcacagcaaacaa

SEQ ID NO: 1120222 - DNA, 22 bp, Artificial Sequence
  chemically synthesized
tttgaaggtaaattgtttgctg

SEQ ID NO: 1120223 - DNA, 22 bp, Artificial Sequence
  chemically synthesized
ctttgaaggtaaattgtttgct

SEQ ID NO: 1120224 - DNA, 22 bp, Artificial Sequence
  chemically synthesized
aaaaatcacagcaaacaattta

SEQ ID NO: 1120225 - DNA, 22 bp, Artificial Sequence
  chemically synthesized
aagtatacttctttgaaggtaa

SEQ ID NO: 1120226 - DNA, 22 bp, Artificial Sequence
  chemically synthesized
caagtatacttctttgaaggta

SEQ ID NO: 1120227 - DNA, 22 bp, Artificial Sequence
  chemically synthesized
tcaagtatacttctttgaaggt

SEQ ID NO: 1120228 - DNA, 22 bp, Artificial Sequence
  chemically synthesized
ttcaagtatacttctttgaagg

SEQ ID NO: 1120229 - DNA, 22 bp, Artificial Sequence
  chemically synthesized
tttcaagtatacttctttgaag

SEQ ID NO: 1120230 - DNA, 22 bp, Artificial Sequence
  chemically synthesized
ttttcaagtatacttctttgaa

SEQ ID NO: 1120231 - DNA, 22 bp, Artificial Sequence
  chemically synthesized
aatgtcttttttcaagtatact

SEQ ID NO: 1120232 - DNA, 22 bp, Artificial Sequence
  chemically synthesized
accttcaaagaagtatacttga

SEQ ID NO: 1120233 - DNA, 22 bp, Artificial Sequence
  chemically synthesized
ccttcaaagaagtatacttgaa

SEQ ID NO: 1120234 - DNA, 22 bp, Artificial Sequence
  chemically synthesized
gctaaatgtcttttttcaagta

SEQ ID NO: 1120235 - DNA, 22 bp, Artificial Sequence
  chemically synthesized
caaagaagtatacttgaaaaaa

SEQ ID NO: 1120236 - DNA, 22 bp, Artificial Sequence
  chemically synthesized
aaagaagtatacttgaaaaaag

SEQ ID NO: 1120237 - DNA, 22 bp, Artificial Sequence
  chemically synthesized
tagaaaattagctaaatgtctt

SEQ ID NO: 1120238 - DNA, 22 bp, Artificial Sequence
  chemically synthesized
gaaaaaagacatttagctaatt

SEQ ID NO: 1120239 - DNA, 22 bp, Artificial Sequence
  chemically synthesized
aaaaaagacatttagctaattt

SEQ ID NO: 1120240 - DNA, 22 bp, Artificial Sequence
  chemically synthesized
aaagataatatataattgtaga

SEQ ID NO: 1120241 - DNA, 22 bp, Artificial Sequence
  chemically synthesized
agctaattttctacaattatat

SEQ ID NO: 1120242 - DNA, 22 bp, Artificial Sequence
  chemically synthesized
gctaattttctacaattatata

SEQ ID NO: 1120243 - DNA, 22 bp, Artificial Sequence
  chemically synthesized
attttctacaattatatattat

SEQ ID NO: 1120244 - DNA, 22 bp, Artificial Sequence
  chemically synthesized
tctacaattatatattatcttt

SEQ ID NO: 1120245 - DNA, 22 bp, Artificial Sequence
  chemically synthesized
ctacaattatatattatctttc

SEQ ID NO: 1120246 - DNA, 22 bp, Artificial Sequence
  chemically synthesized
tacaattatatattatctttca

SEQ ID NO: 1120247 - DNA, 22 bp, Artificial Sequence
  chemically synthesized
caattatatattatctttcagt

SEQ ID NO: 1120248 - DNA, 22 bp, Artificial Sequence
  chemically synthesized
tatattatctttcagttttcat

SEQ ID NO: 1120249 - DNA, 22 bp, Artificial Sequence
  chemically synthesized
aagaaatgggaaatatgaaaac

SEQ ID NO: 1120250 - DNA, 22 bp, Artificial Sequence
  chemically synthesized
caagaaatgggaaatatgaaaa

SEQ ID NO: 1120251 - DNA, 22 bp, Artificial Sequence
  chemically synthesized
tttcaagaaatgggaaatatga

SEQ ID NO: 1120252 - DNA, 22 bp, Artificial Sequence
  chemically synthesized
tctttcagttttcatatttccc

SEQ ID NO: 1120253 - DNA, 22 bp, Artificial Sequence
  chemically synthesized
tcagttttcatatttcccattt

SEQ ID NO: 1120254 - DNA, 22 bp, Artificial Sequence
  chemically synthesized
aattgtttcaagaaatgggaaa

SEQ ID NO: 1120255 - DNA, 22 bp, Artificial Sequence
  chemically synthesized
cagttttcatatttcccatttc

SEQ ID NO: 1120256 - DNA, 22 bp, Artificial Sequence
  chemically synthesized
agttttcatatttcccatttct

SEQ ID NO: 1120257 - DNA, 22 bp, Artificial Sequence
  chemically synthesized
taaattgtttcaagaaatggga

SEQ ID NO: 1120258 - DNA, 22 bp, Artificial Sequence
  chemically synthesized
ttctaaattgtttcaagaaatg

SEQ ID NO: 1120259 - DNA, 22 bp, Artificial Sequence
  chemically synthesized
tcatatttcccatttcttgaaa

SEQ ID NO: 1120260 - DNA, 22 bp, Artificial Sequence
  chemically synthesized
catatttcccatttcttgaaac

SEQ ID NO: 1120261 - DNA, 22 bp, Artificial Sequence
  chemically synthesized
atatttcccatttcttgaaaca

SEQ ID NO: 1120262 - DNA, 22 bp, Artificial Sequence
  chemically synthesized
cccatttcttgaaacaatttag

SEQ ID NO: 1120263 - DNA, 22 bp, Artificial Sequence
  chemically synthesized
taatagactattctaaattgtt

SEQ ID NO: 1120264 - DNA, 22 bp, Artificial Sequence
  chemically synthesized
ccatttcttgaaacaatttaga

SEQ ID NO: 1120265 - DNA, 22 bp, Artificial Sequence
  chemically synthesized
cttgaaacaatttagaatagtc

SEQ ID NO: 1120266 - DNA, 22 bp, Artificial Sequence
  chemically synthesized
ttgaaacaatttagaatagtct

SEQ ID NO: 1120267 - DNA, 22 bp, Artificial Sequence
  chemically synthesized
tcagcattataatagactattc

SEQ ID NO: 1120268 - DNA, 22 bp, Artificial Sequence
  chemically synthesized
gaaacaatttagaatagtctat

SEQ ID NO: 1120269 - DNA, 22 bp, Artificial Sequence
  chemically synthesized
aaacaatttagaatagtctatt

SEQ ID NO: 1120270 - DNA, 22 bp, Artificial Sequence
  chemically synthesized
ttgtcagcattataatagacta

SEQ ID NO: 1120271 - DNA, 22 bp, Artificial Sequence
  chemically synthesized
agaatagtctattataatgctg

SEQ ID NO: 1120272 - DNA, 22 bp, Artificial Sequence
  chemically synthesized
gaatagtctattataatgctga

SEQ ID NO: 1120273 - DNA, 22 bp, Artificial Sequence
  chemically synthesized
taagacatgctgttgtcagcat

SEQ ID NO: 1120274 - DNA, 22 bp, Artificial Sequence
  chemically synthesized
ataagacatgctgttgtcagca

SEQ ID NO: 1120275 - DNA, 22 bp, Artificial Sequence
  chemically synthesized
tataagacatgctgttgtcagc

SEQ ID NO: 1120276 - DNA, 22 bp, Artificial Sequence
  chemically synthesized
gctttataagacatgctgttgt

SEQ ID NO: 1120277 - DNA, 22 bp, Artificial Sequence
  chemically synthesized
ttataatgctgacaacagcatg

SEQ ID NO: 1120278 - DNA, 22 bp, Artificial Sequence
  chemically synthesized
ttagctttataagacatgctgt

SEQ ID NO: 1120279 - DNA, 22 bp, Artificial Sequence
  chemically synthesized
taatgctgacaacagcatgtct

SEQ ID NO: 1120280 - DNA, 22 bp, Artificial Sequence
  chemically synthesized
attagctttataagacatgctg

SEQ ID NO: 1120281 - DNA, 22 bp, Artificial Sequence
  chemically synthesized
cttattagctttataagacatg

SEQ ID NO: 1120282 - DNA, 22 bp, Artificial Sequence
  chemically synthesized
acaacagcatgtcttataaagc

SEQ ID NO: 1120283 - DNA, 22 bp, Artificial Sequence
  chemically synthesized
aattacttattagctttataag

SEQ ID NO: 1120284 - DNA, 22 bp, Artificial Sequence
  chemically synthesized
aaattacttattagctttataa

SEQ ID NO: 1120285 - DNA, 22 bp, Artificial Sequence
  chemically synthesized
taaattacttattagctttata

SEQ ID NO: 1120286 - DNA, 22 bp, Artificial Sequence
  chemically synthesized
ttttaaattacttattagcttt

SEQ ID NO: 1120287 - DNA, 22 bp, Artificial Sequence
  chemically synthesized
gaaagctattttaaattactta

SEQ ID NO: 1120288 - DNA, 22 bp, Artificial Sequence
  chemically synthesized
ataaagctaataagtaatttaa

SEQ ID NO: 1120289 - DNA, 22 bp, Artificial Sequence
  chemically synthesized
taaagctaataagtaatttaaa

SEQ ID NO: 1120290 - DNA, 22 bp, Artificial Sequence
  chemically synthesized
taaattggaaagctattttaaa

SEQ ID NO: 1120291 - DNA, 22 bp, Artificial Sequence
  chemically synthesized
ataaattggaaagctattttaa

SEQ ID NO: 1120292 - DNA, 22 bp, Artificial Sequence
  chemically synthesized
ataagtaatttaaaatagcttt

SEQ ID NO: 1120293 - DNA, 22 bp, Artificial Sequence
  chemically synthesized
cttataaattggaaagctattt

SEQ ID NO: 1120294 - DNA, 22 bp, Artificial Sequence
  chemically synthesized
actacttataaattggaaagct

SEQ ID NO: 1120295 - DNA, 22 bp, Artificial Sequence
  chemically synthesized
gagttaactacttataaattgg

SEQ ID NO: 1120296 - DNA, 22 bp, Artificial Sequence
  chemically synthesized
aaaatagctttccaatttataa

SEQ ID NO: 1120297 - DNA, 22 bp, Artificial Sequence
  chemically synthesized
agagttaactacttataaattg

SEQ ID NO: 1120298 - DNA, 22 bp, Artificial Sequence
  chemically synthesized
aaatagctttccaatttataag

SEQ ID NO: 1120299 - DNA, 22 bp, Artificial Sequence
  chemically synthesized
ttagagttaactacttataaat

SEQ ID NO: 1120300 - DNA, 22 bp, Artificial Sequence
  chemically synthesized
cttagagttaactacttataaa

SEQ ID NO: 1120301 - DNA, 22 bp, Artificial Sequence
  chemically synthesized
ttcttagagttaactacttata

SEQ ID NO: 1120302 - DNA, 22 bp, Artificial Sequence
  chemically synthesized
tccaatttataagtagttaact

SEQ ID NO: 1120303 - DNA, 22 bp, Artificial Sequence
  chemically synthesized
ccaatttataagtagttaactc

SEQ ID NO: 1120304 - DNA, 22 bp, Artificial Sequence
  chemically synthesized
caatttataagtagttaactct

SEQ ID NO: 1120305 - DNA, 22 bp, Artificial Sequence
  chemically synthesized
tcaccagttcttcttagagtta

SEQ ID NO: 1120306 - DNA, 22 bp, Artificial Sequence
  chemically synthesized
gtcaccagttcttcttagagtt

SEQ ID NO: 1120307 - DNA, 22 bp, Artificial Sequence
  chemically synthesized
tgtcaccagttcttcttagagt

SEQ ID NO: 1120308 - DNA, 22 bp, Artificial Sequence
  chemically synthesized
ataagtagttaactctaagaag

SEQ ID NO: 1120309 - DNA, 22 bp, Artificial Sequence
  chemically synthesized
taagtagttaactctaagaaga

SEQ ID NO: 1120310 - DNA, 22 bp, Artificial Sequence
  chemically synthesized
actctaagaagaactggtgaca

SEQ ID NO: 1120311 - DNA, 22 bp, Artificial Sequence
  chemically synthesized
taagaagaactggtgacaaaat

SEQ ID NO: 1120312 - DNA, 22 bp, Artificial Sequence
  chemically synthesized
agaagaactggtgacaaaattg

SEQ ID NO: 1120313 - DNA, 22 bp, Artificial Sequence
  chemically synthesized
aaaaagggaagacaattttgtc

SEQ ID NO: 1120314 - DNA, 22 bp, Artificial Sequence
  chemically synthesized
gaaaaagggaagacaattttgt

SEQ ID NO: 1120315 - DNA, 22 bp, Artificial Sequence
  chemically synthesized
cttgaaaaagggaagacaattt

SEQ ID NO: 1120316 - DNA, 22 bp, Artificial Sequence
  chemically synthesized
ggctgcttgaaaaagggaagac

SEQ ID NO: 1120317 - DNA, 22 bp, Artificial Sequence
  chemically synthesized
gtgacaaaattgtcttcccttt

SEQ ID NO: 1120318 - DNA, 22 bp, Artificial Sequence
  chemically synthesized
aggctgcttgaaaaagggaaga

SEQ ID NO: 1120319 - DNA, 22 bp, Artificial Sequence
  chemically synthesized
taggctgcttgaaaaagggaag

SEQ ID NO: 1120320 - DNA, 22 bp, Artificial Sequence
  chemically synthesized
ttaggctgcttgaaaaagggaa

SEQ ID NO: 1120321 - DNA, 22 bp, Artificial Sequence
  chemically synthesized
tttaggctgcttgaaaaaggga

SEQ ID NO: 1120322 - DNA, 22 bp, Artificial Sequence
  chemically synthesized
ttttttaggctgcttgaaaaag

SEQ ID NO: 1120323 - DNA, 22 bp, Artificial Sequence
  chemically synthesized
tcttccctttttcaagcagcct

SEQ ID NO: 1120324 - DNA, 22 bp, Artificial Sequence
  chemically synthesized
ccctttttcaagcagcctaaaa

SEQ ID NO: 1120325 - DNA, 22 bp, Artificial Sequence
  chemically synthesized
cctttttcaagcagcctaaaaa

SEQ ID NO: 1120326 - DNA, 22 bp, Artificial Sequence
  chemically synthesized
gaaaaaaaatctattttttagg

SEQ ID NO: 1120327 - DNA, 22 bp, Artificial Sequence
  chemically synthesized
tttcaagcagcctaaaaaatag

SEQ ID NO: 1120328 - DNA, 22 bp, Artificial Sequence
  chemically synthesized
tggaaaaaaaatctatttttta

SEQ ID NO: 1120329 - DNA, 22 bp, Artificial Sequence
  chemically synthesized
ttcaagcagcctaaaaaataga

SEQ ID NO: 1120330 - DNA, 22 bp, Artificial Sequence
  chemically synthesized
tcaagcagcctaaaaaatagat

SEQ ID NO: 1120331 - DNA, 22 bp, Artificial Sequence
  chemically synthesized
caagcagcctaaaaaatagatt

SEQ ID NO: 1120332 - DNA, 22 bp, Artificial Sequence
  chemically synthesized
aagcagcctaaaaaatagattt

SEQ ID NO: 1120333 - DNA, 22 bp, Artificial Sequence
  chemically synthesized
aaaaatagattttttttccaga

SEQ ID NO: 1120334 - DNA, 22 bp, Artificial Sequence
  chemically synthesized
tttttccagaatatatatatat

SEQ ID NO: 1120335 - DNA, 22 bp, Artificial Sequence
  chemically synthesized
ttttccagaatatatatatatc

SEQ ID NO: 1120336 - DNA, 22 bp, Artificial Sequence
  chemically synthesized
tttccagaatatatatatatct

SEQ ID NO: 1120337 - DNA, 22 bp, Artificial Sequence
  chemically synthesized
gagatcaacaaaagatatatat

SEQ ID NO: 1120338 - DNA, 22 bp, Artificial Sequence
  chemically synthesized
ttccagaatatatatatatctt

SEQ ID NO: 1120339 - DNA, 22 bp, Artificial Sequence
  chemically synthesized
ggagatcaacaaaagatatata

SEQ ID NO: 1120340 - DNA, 22 bp, Artificial Sequence
  chemically synthesized
tccagaatatatatatatcttt

SEQ ID NO: 1120341 - DNA, 22 bp, Artificial Sequence
  chemically synthesized
tggagatcaacaaaagatatat

SEQ ID NO: 1120342 - DNA, 22 bp, Artificial Sequence
  chemically synthesized
ccagaatatatatatatctttt

SEQ ID NO: 1120343 - DNA, 22 bp, Artificial Sequence
  chemically synthesized
ttggagatcaacaaaagatata

SEQ ID NO: 1120344 - DNA, 22 bp, Artificial Sequence
  chemically synthesized
cagaatatatatatatcttttg

SEQ ID NO: 1120345 - DNA, 22 bp, Artificial Sequence
  chemically synthesized
gaacttttggagatcaacaaaa

SEQ ID NO: 1120346 - DNA, 22 bp, Artificial Sequence
  chemically synthesized
gggttggaacttttggagatca

SEQ ID NO: 1120347 - DNA, 22 bp, Artificial Sequence
  chemically synthesized
ttggggttggaacttttggaga

SEQ ID NO: 1120348 - DNA, 22 bp, Artificial Sequence
  chemically synthesized
ctgttggggttggaacttttgg

SEQ ID NO: 1120349 - DNA, 22 bp, Artificial Sequence
  chemically synthesized
gctgttggggttggaacttttg

SEQ ID NO: 1120350 - DNA, 22 bp, Artificial Sequence
  chemically synthesized
ttgttgatctccaaaagttcca

SEQ ID NO: 1120351 - DNA, 22 bp, Artificial Sequence
  chemically synthesized
tgttgatctccaaaagttccaa

SEQ ID NO: 1120352 - DNA, 22 bp, Artificial Sequence
  chemically synthesized
gttgatctccaaaagttccaac

SEQ ID NO: 1120353 - DNA, 22 bp, Artificial Sequence
  chemically synthesized
ttgatctccaaaagttccaacc

SEQ ID NO: 1120354 - DNA, 22 bp, Artificial Sequence
  chemically synthesized
atgtttgctgttggggttggaa

SEQ ID NO: 1120355 - DNA, 22 bp, Artificial Sequence
  chemically synthesized
atctccaaaagttccaacccca

SEQ ID NO: 1120356 - DNA, 22 bp, Artificial Sequence
  chemically synthesized
caaaagttccaaccccaacagc

SEQ ID NO: 1120357 - DNA, 22 bp, Artificial Sequence
  chemically synthesized
caagctaatgtttgctgttggg

SEQ ID NO: 1120358 - DNA, 22 bp, Artificial Sequence
  chemically synthesized
agttacaagctaatgtttgctg

SEQ ID NO: 1120359 - DNA, 22 bp, Artificial Sequence
  chemically synthesized
caaccccaacagcaaacattag

SEQ ID NO: 1120360 - DNA, 22 bp, Artificial Sequence
  chemically synthesized
cctcagttacaagctaatgttt

SEQ ID NO: 1120361 - DNA, 22 bp, Artificial Sequence
  chemically synthesized
caaatacgacattacctcagtt

SEQ ID NO: 1120362 - DNA, 22 bp, Artificial Sequence
  chemically synthesized
acaaatacgacattacctcagt

SEQ ID NO: 1120363 - DNA, 22 bp, Artificial Sequence
  chemically synthesized
tacaaatacgacattacctcag

SEQ ID NO: 1120364 - DNA, 22 bp, Artificial Sequence
  chemically synthesized
ttacaaatacgacattacctca

SEQ ID NO: 1120365 - DNA, 22 bp, Artificial Sequence
  chemically synthesized
gcttgtaactgaggtaatgtcg

SEQ ID NO: 1120366 - DNA, 22 bp, Artificial Sequence
  chemically synthesized
tatttttacaaatacgacatta

SEQ ID NO: 1120367 - DNA, 22 bp, Artificial Sequence
  chemically synthesized
gtaactgaggtaatgtcgtatt

SEQ ID NO: 1120368 - DNA, 22 bp, Artificial Sequence
  chemically synthesized
taactgaggtaatgtcgtattt

SEQ ID NO: 1120369 - DNA, 22 bp, Artificial Sequence
  chemically synthesized
aggtaatgtcgtatttgtaaaa

SEQ ID NO: 1120370 - DNA, 22 bp, Artificial Sequence
  chemically synthesized
aaaatccattgtatttttacaa

SEQ ID NO: 1120371 - DNA, 22 bp, Artificial Sequence
  chemically synthesized
gtaaaaatacaatggattttga

SEQ ID NO: 1120372 - DNA, 22 bp, Artificial Sequence
  chemically synthesized
aaatcatgaagttcaaaatcca

SEQ ID NO: 1120373 - DNA, 22 bp, Artificial Sequence
  chemically synthesized
taaaaatacaatggattttgaa

SEQ ID NO: 1120374 - DNA, 22 bp, Artificial Sequence
  chemically synthesized
caggattcaaatcatgaagttc

SEQ ID NO: 1120375 - DNA, 22 bp, Artificial Sequence
  chemically synthesized
tccaggattcaaatcatgaagt

SEQ ID NO: 1120376 - DNA, 22 bp, Artificial Sequence
  chemically synthesized
tctccaggattcaaatcatgaa

SEQ ID NO: 1120377 - DNA, 22 bp, Artificial Sequence
  chemically synthesized
ctctccaggattcaaatcatga

SEQ ID NO: 1120378 - DNA, 22 bp, Artificial Sequence
  chemically synthesized
tctctccaggattcaaatcatg

SEQ ID NO: 1120379 - DNA, 22 bp, Artificial Sequence
  chemically synthesized
ttctctccaggattcaaatcat

SEQ ID NO: 1120380 - DNA, 22 bp, Artificial Sequence
  chemically synthesized
tttctctccaggattcaaatca

SEQ ID NO: 1120381 - DNA, 22 bp, Artificial Sequence
  chemically synthesized
tgaacttcatgatttgaatcct

SEQ ID NO: 1120382 - DNA, 22 bp, Artificial Sequence
  chemically synthesized
ctttttctctccaggattcaaa

SEQ ID NO: 1120383 - DNA, 22 bp, Artificial Sequence
  chemically synthesized
gaacttcatgatttgaatcctg

SEQ ID NO: 1120384 - DNA, 22 bp, Artificial Sequence
  chemically synthesized
aacttcatgatttgaatcctgg

SEQ ID NO: 1120385 - DNA, 22 bp, Artificial Sequence
  chemically synthesized
tgctttttctctccaggattca

SEQ ID NO: 1120386 - DNA, 22 bp, Artificial Sequence
  chemically synthesized
gctctgctttttctctccagga

SEQ ID NO: 1120387 - DNA, 22 bp, Artificial Sequence
  chemically synthesized
catgatttgaatcctggagaga

SEQ ID NO: 1120388 - DNA, 22 bp, Artificial Sequence
  chemically synthesized
atgatttgaatcctggagagaa

SEQ ID NO: 1120389 - DNA, 22 bp, Artificial Sequence
  chemically synthesized
gaatcctggagagaaaaagcag

SEQ ID NO: 1120390 - DNA, 22 bp, Artificial Sequence
  chemically synthesized
aatcctggagagaaaaagcaga

SEQ ID NO: 1120391 - DNA, 22 bp, Artificial Sequence
  chemically synthesized
aatgtgtatattagctctgctt

SEQ ID NO: 1120392 - DNA, 22 bp, Artificial Sequence
  chemically synthesized
gagagaaaaagcagagctaata

SEQ ID NO: 1120393 - DNA, 22 bp, Artificial Sequence
  chemically synthesized
tccatgggaagatcacatctaa

SEQ ID NO: 1120394 - DNA, 22 bp, Artificial Sequence
  chemically synthesized
atccatgggaagatcacatcta

SEQ ID NO: 1120395 - DNA, 22 bp, Artificial Sequence
  chemically synthesized
atatacacatttagatgtgatc

SEQ ID NO: 1120396 - DNA, 22 bp, Artificial Sequence
  chemically synthesized
tatccatgggaagatcacatct

SEQ ID NO: 1120397 - DNA, 22 bp, Artificial Sequence
  chemically synthesized
agatgtgatcttcccatggata

SEQ ID NO: 1120398 - DNA, 22 bp, Artificial Sequence
  chemically synthesized
gatgtgatcttcccatggataa

SEQ ID NO: 1120399 - DNA, 22 bp, Artificial Sequence
  chemically synthesized
tgaatgaaaagtaattttatcc

SEQ ID NO: 1120400 - DNA, 22 bp, Artificial Sequence
  chemically synthesized
cccatggataaaattacttttc

SEQ ID NO: 1120401 - DNA, 22 bp, Artificial Sequence
  chemically synthesized
ccatggataaaattacttttca

SEQ ID NO: 1120402 - DNA, 22 bp, Artificial Sequence
  chemically synthesized
aggaagcagtgattatgaatga

SEQ ID NO: 1120403 - DNA, 22 bp, Artificial Sequence
  chemically synthesized
cttttcattcataatcactgct

SEQ ID NO: 1120404 - DNA, 22 bp, Artificial Sequence
  chemically synthesized
ttcattcataatcactgcttcc

SEQ ID NO: 1120405 - DNA, 22 bp, Artificial Sequence
  chemically synthesized
tcattcataatcactgcttcct

SEQ ID NO: 1120406 - DNA, 22 bp, Artificial Sequence
  chemically synthesized
cattcataatcactgcttcctt

SEQ ID NO: 1120407 - DNA, 22 bp, Artificial Sequence
  chemically synthesized
attcataatcactgcttcctta

SEQ ID NO: 1120408 - DNA, 22 bp, Artificial Sequence
  chemically synthesized
ataatcactgcttccttagctt

SEQ ID NO: 1120409 - DNA, 22 bp, Artificial Sequence
  chemically synthesized
cttccttagcttgcccatttta

SEQ ID NO: 1120410 - DNA, 22 bp, Artificial Sequence
  chemically synthesized
acaggcagagtaaataaaatgg

SEQ ID NO: 1120411 - DNA, 22 bp, Artificial Sequence
  chemically synthesized
ccttagcttgcccattttattt

SEQ ID NO: 1120412 - DNA, 22 bp, Artificial Sequence
  chemically synthesized
cttagcttgcccattttattta

SEQ ID NO: 1120413 - DNA, 22 bp, Artificial Sequence
  chemically synthesized
taacaggcagagtaaataaaat

SEQ ID NO: 1120414 - DNA, 22 bp, Artificial Sequence
  chemically synthesized
ctaacaggcagagtaaataaaa

SEQ ID NO: 1120415 - DNA, 22 bp, Artificial Sequence
  chemically synthesized
agcttgcccattttatttactc

SEQ ID NO: 1120416 - DNA, 22 bp, Artificial Sequence
  chemically synthesized
gcttgcccattttatttactct

SEQ ID NO: 1120417 - DNA, 22 bp, Artificial Sequence
  chemically synthesized
gcccattttatttactctgcct

SEQ ID NO: 1120418 - DNA, 22 bp, Artificial Sequence
  chemically synthesized
cccattttatttactctgcctg

SEQ ID NO: 1120419 - DNA, 22 bp, Artificial Sequence
  chemically synthesized
taaaataatttctaacaggcag

SEQ ID NO: 1120420 - DNA, 22 bp, Artificial Sequence
  chemically synthesized
gtaaaataatttctaacaggca

SEQ ID NO: 1120421 - DNA, 22 bp, Artificial Sequence
  chemically synthesized
tatttactctgcctgttagaaa

SEQ ID NO: 1120422 - DNA, 22 bp, Artificial Sequence
  chemically synthesized
atttactctgcctgttagaaat

SEQ ID NO: 1120423 - DNA, 22 bp, Artificial Sequence
  chemically synthesized
tttactctgcctgttagaaatt

SEQ ID NO: 1120424 - DNA, 22 bp, Artificial Sequence
  chemically synthesized
actctgcctgttagaaattatt

SEQ ID NO: 1120425 - DNA, 22 bp, Artificial Sequence
  chemically synthesized
ctctgcctgttagaaattattt

SEQ ID NO: 1120426 - DNA, 22 bp, Artificial Sequence
  chemically synthesized
gcaacagtttgtaaaataattt

SEQ ID NO: 1120427 - DNA, 22 bp, Artificial Sequence
  chemically synthesized
tgcctgttagaaattattttac

SEQ ID NO: 1120428 - DNA, 22 bp, Artificial Sequence
  chemically synthesized
cctgttagaaattattttacaa

SEQ ID NO: 1120429 - DNA, 22 bp, Artificial Sequence
  chemically synthesized
ttagaaattattttacaaactg

SEQ ID NO: 1120430 - DNA, 22 bp, Artificial Sequence
  chemically synthesized
tatatgattggcaacagtttgt

SEQ ID NO: 1120431 - DNA, 22 bp, Artificial Sequence
  chemically synthesized
gaaattattttacaaactgttg

SEQ ID NO: 1120432 - DNA, 22 bp, Artificial Sequence
  chemically synthesized
gtatatgattggcaacagtttg

SEQ ID NO: 1120433 - DNA, 22 bp, Artificial Sequence
  chemically synthesized
tgtatatgattggcaacagttt

SEQ ID NO: 1120434 - DNA, 22 bp, Artificial Sequence
  chemically synthesized
ttttacaaactgttgccaatca

SEQ ID NO: 1120435 - DNA, 22 bp, Artificial Sequence
  chemically synthesized
tacaaactgttgccaatcatat

SEQ ID NO: 1120436 - DNA, 22 bp, Artificial Sequence
  chemically synthesized
acaaactgttgccaatcatata

SEQ ID NO: 1120437 - DNA, 22 bp, Artificial Sequence
  chemically synthesized
caaactgttgccaatcatatac

SEQ ID NO: 1120438 - DNA, 22 bp, Artificial Sequence
  chemically synthesized
taaaacatgcatctttgtatat

SEQ ID NO: 1120439 - DNA, 22 bp, Artificial Sequence
  chemically synthesized
ttgccaatcatatacaaagatg

SEQ ID NO: 1120440 - DNA, 22 bp, Artificial Sequence
  chemically synthesized
ccaatcatatacaaagatgcat

SEQ ID NO: 1120441 - DNA, 22 bp, Artificial Sequence
  chemically synthesized
aacaattataaaacatgcatct

SEQ ID NO: 1120442 - DNA, 22 bp, Artificial Sequence
  chemically synthesized
caacaattataaaacatgcatc

SEQ ID NO: 1120443 - DNA, 22 bp, Artificial Sequence
  chemically synthesized
aacttcaacaattataaaacat

SEQ ID NO: 1120444 - DNA, 22 bp, Artificial Sequence
  chemically synthesized
caacttcaacaattataaaaca

SEQ ID NO: 1120445 - DNA, 22 bp, Artificial Sequence
  chemically synthesized
tcaacttcaacaattataaaac

SEQ ID NO: 1120446 - DNA, 22 bp, Artificial Sequence
  chemically synthesized
ttcaacttcaacaattataaaa

SEQ ID NO: 1120447 - DNA, 22 bp, Artificial Sequence
  chemically synthesized
atttttcaacttcaacaattat

SEQ ID NO: 1120448 - DNA, 22 bp, Artificial Sequence
  chemically synthesized
aatttttcaacttcaacaatta

SEQ ID NO: 1120449 - DNA, 22 bp, Artificial Sequence
  chemically synthesized
taatttttcaacttcaacaatt

SEQ ID NO: 1120450 - DNA, 22 bp, Artificial Sequence
  chemically synthesized
tataattgttgaagttgaaaaa

SEQ ID NO: 1120451 - DNA, 22 bp, Artificial Sequence
  chemically synthesized
tcaaggctttaatttttcaact

SEQ ID NO: 1120452 - DNA, 22 bp, Artificial Sequence
  chemically synthesized
ataattgttgaagttgaaaaat

SEQ ID NO: 1120453 - DNA, 22 bp, Artificial Sequence
  chemically synthesized
taattgttgaagttgaaaaatt

SEQ ID NO: 1120454 - DNA, 22 bp, Artificial Sequence
  chemically synthesized
ttgaagttgaaaaattaaagcc

SEQ ID NO: 1120455 - DNA, 22 bp, Artificial Sequence
  chemically synthesized
gggaaattgtcaaggctttaat

SEQ ID NO: 1120456 - DNA, 22 bp, Artificial Sequence
  chemically synthesized
agggaaattgtcaaggctttaa

SEQ ID NO: 1120457 - DNA, 22 bp, Artificial Sequence
  chemically synthesized
aagttgaaaaattaaagccttg

SEQ ID NO: 1120458 - DNA, 22 bp, Artificial Sequence
  chemically synthesized
tagggaaattgtcaaggcttta

SEQ ID NO: 1120459 - DNA, 22 bp, Artificial Sequence
  chemically synthesized
atctttagggaaattgtcaagg

SEQ ID NO: 1120460 - DNA, 22 bp, Artificial Sequence
  chemically synthesized
aaaaattaaagccttgacaatt

SEQ ID NO: 1120461 - DNA, 22 bp, Artificial Sequence
  chemically synthesized
catctttagggaaattgtcaag

SEQ ID NO: 1120462 - DNA, 22 bp, Artificial Sequence
  chemically synthesized
aagccttgacaatttccctaaa

SEQ ID NO: 1120463 - DNA, 22 bp, Artificial Sequence
  chemically synthesized
atataaagtgtttcatctttag

SEQ ID NO: 1120464 - DNA, 22 bp, Artificial Sequence
  chemically synthesized
aatataaagtgtttcatcttta

SEQ ID NO: 1120465 - DNA, 22 bp, Artificial Sequence
  chemically synthesized
gacaatttccctaaagatgaaa

SEQ ID NO: 1120466 - DNA, 22 bp, Artificial Sequence
  chemically synthesized
acaatttccctaaagatgaaac

SEQ ID NO: 1120467 - DNA, 22 bp, Artificial Sequence
  chemically synthesized
atttaatataaagtgtttcatc

SEQ ID NO: 1120468 - DNA, 22 bp, Artificial Sequence
  chemically synthesized
ttaatttaatataaagtgtttc

SEQ ID NO: 1120469 - DNA, 22 bp, Artificial Sequence
  chemically synthesized
attaatttaatataaagtgttt

SEQ ID NO: 1120470 - DNA, 22 bp, Artificial Sequence
  chemically synthesized
ccctaaagatgaaacactttat

SEQ ID NO: 1120471 - DNA, 22 bp, Artificial Sequence
  chemically synthesized
tattaatttaatataaagtgtt

SEQ ID NO: 1120472 - DNA, 22 bp, Artificial Sequence
  chemically synthesized
cctaaagatgaaacactttata

SEQ ID NO: 1120473 - DNA, 22 bp, Artificial Sequence
  chemically synthesized
aagatgaaacactttatattaa

SEQ ID NO: 1120474 - DNA, 22 bp, Artificial Sequence
  chemically synthesized
acaaataggaagttttattaat

SEQ ID NO: 1120475 - DNA, 22 bp, Artificial Sequence
  chemically synthesized
cacaaataggaagttttattaa

SEQ ID NO: 1120476 - DNA, 22 bp, Artificial Sequence
  chemically synthesized
tatattaaattaataaaacttc

SEQ ID NO: 1120477 - DNA, 22 bp, Artificial Sequence
  chemically synthesized
atattaaattaataaaacttcc

SEQ ID NO: 1120478 - DNA, 22 bp, Artificial Sequence
  chemically synthesized
tattaaattaataaaacttcct

SEQ ID NO: 1120479 - DNA, 22 bp, Artificial Sequence
  chemically synthesized
accttcacaaataggaagtttt

SEQ ID NO: 1120480 - DNA, 22 bp, Artificial Sequence
  chemically synthesized
gaccttcacaaataggaagttt

SEQ ID NO: 1120481 - DNA, 22 bp, Artificial Sequence
  chemically synthesized
tgaccttcacaaataggaagtt

SEQ ID NO: 1120482 - DNA, 22 bp, Artificial Sequence
  chemically synthesized
aattaataaaacttcctatttg

SEQ ID NO: 1120483 - DNA, 22 bp, Artificial Sequence
  chemically synthesized
ataaaacttcctatttgtgaag

SEQ ID NO: 1120484 - DNA, 22 bp, Artificial Sequence
  chemically synthesized
agatggtataattttgaccttc

SEQ ID NO: 1120485 - DNA, 22 bp, Artificial Sequence
  chemically synthesized
tgagatggtataattttgacct

SEQ ID NO: 1120486 - DNA, 22 bp, Artificial Sequence
  chemically synthesized
cctatttgtgaaggtcaaaatt

SEQ ID NO: 1120487 - DNA, 22 bp, Artificial Sequence
  chemically synthesized
ctgagatggtataattttgacc

SEQ ID NO: 1120488 - DNA, 22 bp, Artificial Sequence
  chemically synthesized
ctatttgtgaaggtcaaaatta

SEQ ID NO: 1120489 - DNA, 22 bp, Artificial Sequence
  chemically synthesized
tttgtgaaggtcaaaattatac

SEQ ID NO: 1120490 - DNA, 22 bp, Artificial Sequence
  chemically synthesized
ccttctgagatggtataatttt

SEQ ID NO: 1120491 - DNA, 22 bp, Artificial Sequence
  chemically synthesized
gtgaaggtcaaaattataccat

SEQ ID NO: 1120492 - DNA, 22 bp, Artificial Sequence
  chemically synthesized
ttcccttctgagatggtataat

SEQ ID NO: 1120493 - DNA, 22 bp, Artificial Sequence
  chemically synthesized
tgaaggtcaaaattataccatc

SEQ ID NO: 1120494 - DNA, 22 bp, Artificial Sequence
  chemically synthesized
ttattcccttctgagatggtat

SEQ ID NO: 1120495 - DNA, 22 bp, Artificial Sequence
  chemically synthesized
ttgttattcccttctgagatgg

SEQ ID NO: 1120496 - DNA, 22 bp, Artificial Sequence
  chemically synthesized
ttgttgttattcccttctgaga

SEQ ID NO: 1120497 - DNA, 22 bp, Artificial Sequence
  chemically synthesized
gttgttgttattcccttctgag

SEQ ID NO: 1120498 - DNA, 22 bp, Artificial Sequence
  chemically synthesized
tgttgttgttattcccttctga

SEQ ID NO: 1120499 - DNA, 22 bp, Artificial Sequence
  chemically synthesized
taccatctcagaagggaataac

SEQ ID NO: 1120500 - DNA, 22 bp, Artificial Sequence
  chemically synthesized
agaagggaataacaacaacaaa

SEQ ID NO: 1120501 - DNA, 22 bp, Artificial Sequence
  chemically synthesized
catgtggtagcagatgctttgt

SEQ ID NO: 1120502 - DNA, 22 bp, Artificial Sequence
  chemically synthesized
acatgtggtagcagatgctttg

SEQ ID NO: 1120503 - DNA, 22 bp, Artificial Sequence
  chemically synthesized
agtatttacatgtggtagcaga

SEQ ID NO: 1120504 - DNA, 22 bp, Artificial Sequence
  chemically synthesized
tcagtatttacatgtggtagca

SEQ ID NO: 1120505 - DNA, 22 bp, Artificial Sequence
  chemically synthesized
ctcagtatttacatgtggtagc

SEQ ID NO: 1120506 - DNA, 22 bp, Artificial Sequence
  chemically synthesized
tctcagtatttacatgtggtag

SEQ ID NO: 1120507 - DNA, 22 bp, Artificial Sequence
  chemically synthesized
ctaccacatgtaaatactgaga

SEQ ID NO: 1120508 - DNA, 22 bp, Artificial Sequence
  chemically synthesized
ccacatgtaaatactgagaaag

SEQ ID NO: 1120509 - DNA, 22 bp, Artificial Sequence
  chemically synthesized
aaaggtgtccagcctttctcag

SEQ ID NO: 1120510 - DNA, 22 bp, Artificial Sequence
  chemically synthesized
tctaaaaggtgtccagcctttc

SEQ ID NO: 1120511 - DNA, 22 bp, Artificial Sequence
  chemically synthesized
atctaaaaggtgtccagccttt

SEQ ID NO: 1120512 - DNA, 22 bp, Artificial Sequence
  chemically synthesized
ccttatctaaaaggtgtccagc

SEQ ID NO: 1120513 - DNA, 22 bp, Artificial Sequence
  chemically synthesized
agaaaggctggacaccttttag

SEQ ID NO: 1120514 - DNA, 22 bp, Artificial Sequence
  chemically synthesized
tgtattaccttatctaaaaggt

SEQ ID NO: 1120515 - DNA, 22 bp, Artificial Sequence
  chemically synthesized
gtgtattaccttatctaaaagg

SEQ ID NO: 1120516 - DNA, 22 bp, Artificial Sequence
  chemically synthesized
gacaccttttagataaggtaat

SEQ ID NO: 1120517 - DNA, 22 bp, Artificial Sequence
  chemically synthesized
ccagatatttgtgtattacctt

SEQ ID NO: 1120518 - DNA, 22 bp, Artificial Sequence
  chemically synthesized
cccagatatttgtgtattacct

SEQ ID NO: 1120519 - DNA, 22 bp, Artificial Sequence
  chemically synthesized
ttagataaggtaatacacaaat

SEQ ID NO: 1120520 - DNA, 22 bp, Artificial Sequence
  chemically synthesized
aatttcccagatatttgtgtat

SEQ ID NO: 1120521 - DNA, 22 bp, Artificial Sequence
  chemically synthesized
tagataaggtaatacacaaata

SEQ ID NO: 1120522 - DNA, 22 bp, Artificial Sequence
  chemically synthesized
aaatttcccagatatttgtgta

SEQ ID NO: 1120523 - DNA, 22 bp, Artificial Sequence
  chemically synthesized
agataaggtaatacacaaatat

SEQ ID NO: 1120524 - DNA, 22 bp, Artificial Sequence
  chemically synthesized
gataaggtaatacacaaatatc

SEQ ID NO: 1120525 - DNA, 22 bp, Artificial Sequence
  chemically synthesized
taagatatttaaatttcccaga

SEQ ID NO: 1120526 - DNA, 22 bp, Artificial Sequence
  chemically synthesized
tcatatattataagatatttaa

SEQ ID NO: 1120527 - DNA, 22 bp, Artificial Sequence
  chemically synthesized
ggaaatttaaatatcttataat

SEQ ID NO: 1120528 - DNA, 22 bp, Artificial Sequence
  chemically synthesized
aaatatcttataatatatgaca

SEQ ID NO: 1120529 - DNA, 22 bp, Artificial Sequence
  chemically synthesized
aatatcttataatatatgacag

SEQ ID NO: 1120530 - DNA, 22 bp, Artificial Sequence
  chemically synthesized
tagtcatcaatccctgtcatat

SEQ ID NO: 1120531 - DNA, 22 bp, Artificial Sequence
  chemically synthesized
atagtcatcaatccctgtcata

SEQ ID NO: 1120532 - DNA, 22 bp, Artificial Sequence
  chemically synthesized
tatagtcatcaatccctgtcat

SEQ ID NO: 1120533 - DNA, 22 bp, Artificial Sequence
  chemically synthesized
tttatagtcatcaatccctgtc

SEQ ID NO: 1120534 - DNA, 22 bp, Artificial Sequence
  chemically synthesized
ataatatatgacagggattgat

SEQ ID NO: 1120535 - DNA, 22 bp, Artificial Sequence
  chemically synthesized
ttctttatagtcatcaatccct

SEQ ID NO: 1120536 - DNA, 22 bp, Artificial Sequence
  chemically synthesized
taatatatgacagggattgatg

SEQ ID NO: 1120537 - DNA, 22 bp, Artificial Sequence
  chemically synthesized
tcaaaaagttattctttatagt

SEQ ID NO: 1120538 - DNA, 22 bp, Artificial Sequence
  chemically synthesized
ttatcaaaaagttattctttat

SEQ ID NO: 1120539 - DNA, 22 bp, Artificial Sequence
  chemically synthesized
actgttatcaaaaagttattct

SEQ ID NO: 1120540 - DNA, 22 bp, Artificial Sequence
  chemically synthesized
atgactataaagaataactttt

SEQ ID NO: 1120541 - DNA, 22 bp, Artificial Sequence
  chemically synthesized
tcactgttatcaaaaagttatt

SEQ ID NO: 1120542 - DNA, 22 bp, Artificial Sequence
  chemically synthesized
tattctcactgttatcaaaaag

SEQ ID NO: 1120543 - DNA, 22 bp, Artificial Sequence
  chemically synthesized
taaagaataactttttgataac

SEQ ID NO: 1120544 - DNA, 22 bp, Artificial Sequence
  chemically synthesized
tgtctatattctcactgttatc

SEQ ID NO: 1120545 - DNA, 22 bp, Artificial Sequence
  chemically synthesized
ggactatgtctatattctcact

SEQ ID NO: 1120546 - DNA, 22 bp, Artificial Sequence
  chemically synthesized
aggactatgtctatattctcac

SEQ ID NO: 1120547 - DNA, 22 bp, Artificial Sequence
  chemically synthesized
tttgataacagtgagaatatag

SEQ ID NO: 1120548 - DNA, 22 bp, Artificial Sequence
  chemically synthesized
ttgataacagtgagaatataga

SEQ ID NO: 1120549 - DNA, 22 bp, Artificial Sequence
  chemically synthesized
tgataacagtgagaatatagac

SEQ ID NO: 1120550 - DNA, 22 bp, Artificial Sequence
  chemically synthesized
gataacagtgagaatatagaca

SEQ ID NO: 1120551 - DNA, 22 bp, Artificial Sequence
  chemically synthesized
ataacagtgagaatatagacat

SEQ ID NO: 1120552 - DNA, 22 bp, Artificial Sequence
  chemically synthesized
agtatggtatctattatattat

SEQ ID NO: 1120553 - DNA, 22 bp, Artificial Sequence
  chemically synthesized
ttatattattctattctatttt

SEQ ID NO: 1120554 - DNA, 22 bp, Artificial Sequence
  chemically synthesized
tattattctattctattttact

SEQ ID NO: 1120555 - DNA, 22 bp, Artificial Sequence
  chemically synthesized
tgtagagtagaatagagtaaaa

SEQ ID NO: 1120556 - DNA, 22 bp, Artificial Sequence
  chemically synthesized
ttctattctattttactctatt

SEQ ID NO: 1120557 - DNA, 22 bp, Artificial Sequence
  chemically synthesized
tattctattttactctattcta

SEQ ID NO: 1120558 - DNA, 22 bp, Artificial Sequence
  chemically synthesized
ttctattttactctattctact

SEQ ID NO: 1120559 - DNA, 22 bp, Artificial Sequence
  chemically synthesized
cacaattgtgtagagtagaata

SEQ ID NO: 1120560 - DNA, 22 bp, Artificial Sequence
  chemically synthesized
gcacaattgtgtagagtagaat

SEQ ID NO: 1120561 - DNA, 22 bp, Artificial Sequence
  chemically synthesized
tattttactctattctactcta

SEQ ID NO: 1120562 - DNA, 22 bp, Artificial Sequence
  chemically synthesized
ttttactctattctactctaca

SEQ ID NO: 1120563 - DNA, 22 bp, Artificial Sequence
  chemically synthesized
tactctattctactctacacaa

SEQ ID NO: 1120564 - DNA, 22 bp, Artificial Sequence
  chemically synthesized
actctattctactctacacaat

SEQ ID NO: 1120565 - DNA, 22 bp, Artificial Sequence
  chemically synthesized
ctctattctactctacacaatt

SEQ ID NO: 1120566 - DNA, 22 bp, Artificial Sequence
  chemically synthesized
gcaagcttgcacaattgtgtag

SEQ ID NO: 1120567 - DNA, 22 bp, Artificial Sequence
  chemically synthesized
agcaagcttgcacaattgtgta

SEQ ID NO: 1120568 - DNA, 22 bp, Artificial Sequence
  chemically synthesized
tattctactctacacaattgtg

SEQ ID NO: 1120569 - DNA, 22 bp, Artificial Sequence
  chemically synthesized
ttctactctacacaattgtgca

SEQ ID NO: 1120570 - DNA, 22 bp, Artificial Sequence
  chemically synthesized
ggccttagcaagcttgcacaat

SEQ ID NO: 1120571 - DNA, 22 bp, Artificial Sequence
  chemically synthesized
tactctacacaattgtgcaagc

SEQ ID NO: 1120572 - DNA, 22 bp, Artificial Sequence
  chemically synthesized
ctctacacaattgtgcaagctt

SEQ ID NO: 1120573 - DNA, 22 bp, Artificial Sequence
  chemically synthesized
tacacaattgtgcaagcttgct

SEQ ID NO: 1120574 - DNA, 22 bp, Artificial Sequence
  chemically synthesized
aaggctaggccttagcaagctt

SEQ ID NO: 1120575 - DNA, 22 bp, Artificial Sequence
  chemically synthesized
cacaattgtgcaagcttgctaa

SEQ ID NO: 1120576 - DNA, 22 bp, Artificial Sequence
  chemically synthesized
cctcaaggctaggccttagcaa

SEQ ID NO: 1120577 - DNA, 22 bp, Artificial Sequence
  chemically synthesized
tgcaagcttgctaaggcctagc

SEQ ID NO: 1120578 - DNA, 22 bp, Artificial Sequence
  chemically synthesized
agttacctcaaggctaggcctt

SEQ ID NO: 1120579 - DNA, 22 bp, Artificial Sequence
  chemically synthesized
ttcagttacctcaaggctaggc

SEQ ID NO: 1120580 - DNA, 22 bp, Artificial Sequence
  chemically synthesized
gctaaggcctagccttgaggta

SEQ ID NO: 1120581 - DNA, 22 bp, Artificial Sequence
  chemically synthesized
ctaaggcctagccttgaggtaa

SEQ ID NO: 1120582 - DNA, 22 bp, Artificial Sequence
  chemically synthesized
atatattgttcagttacctcaa

SEQ ID NO: 1120583 - DNA, 22 bp, Artificial Sequence
  chemically synthesized
catatattgttcagttacctca

SEQ ID NO: 1120584 - DNA, 22 bp, Artificial Sequence
  chemically synthesized
aggcctagccttgaggtaactg

SEQ ID NO: 1120585 - DNA, 22 bp, Artificial Sequence
  chemically synthesized
tcatatattgttcagttacctc

SEQ ID NO: 1120586 - DNA, 22 bp, Artificial Sequence
  chemically synthesized
ctttcatatattgttcagttac

SEQ ID NO: 1120587 - DNA, 22 bp, Artificial Sequence
  chemically synthesized
gccttgaggtaactgaacaata

SEQ ID NO: 1120588 - DNA, 22 bp, Artificial Sequence
  chemically synthesized
attcctttcatatattgttcag

SEQ ID NO: 1120589 - DNA, 22 bp, Artificial Sequence
  chemically synthesized
gaggtaactgaacaatatatga

SEQ ID NO: 1120590 - DNA, 22 bp, Artificial Sequence
  chemically synthesized
aggtaactgaacaatatatgaa

SEQ ID NO: 1120591 - DNA, 22 bp, Artificial Sequence
  chemically synthesized
atgttgattcctttcatatatt

SEQ ID NO: 1120592 - DNA, 22 bp, Artificial Sequence
  chemically synthesized
attcatgttgattcctttcata

SEQ ID NO: 1120593 - DNA, 22 bp, Artificial Sequence
  chemically synthesized
aacaatatatgaaaggaatcaa

SEQ ID NO: 1120594 - DNA, 22 bp, Artificial Sequence
  chemically synthesized
tgacattaattcatgttgattc

SEQ ID NO: 1120595 - DNA, 22 bp, Artificial Sequence
  chemically synthesized
atgacattaattcatgttgatt

SEQ ID NO: 1120596 - DNA, 22 bp, Artificial Sequence
  chemically synthesized
tatgacattaattcatgttgat

SEQ ID NO: 1120597 - DNA, 22 bp, Artificial Sequence
  chemically synthesized
acaattttatgacattaattca

SEQ ID NO: 1120598 - DNA, 22 bp, Artificial Sequence
  chemically synthesized
taaattaacaattttatgacat

SEQ ID NO: 1120599 - DNA, 22 bp, Artificial Sequence
  chemically synthesized
actataaattaacaattttatg

SEQ ID NO: 1120600 - DNA, 22 bp, Artificial Sequence
  chemically synthesized
aactataaattaacaattttat

SEQ ID NO: 1120601 - DNA, 22 bp, Artificial Sequence
  chemically synthesized
tttaactataaattaacaattt

SEQ ID NO: 1120602 - DNA, 22 bp, Artificial Sequence
  chemically synthesized
atgtcataaaattgttaattta

SEQ ID NO: 1120603 - DNA, 22 bp, Artificial Sequence
  chemically synthesized
catattatttaactataaatta

SEQ ID NO: 1120604 - DNA, 22 bp, Artificial Sequence
  chemically synthesized
acatattatttaactataaatt

SEQ ID NO: 1120605 - DNA, 22 bp, Artificial Sequence
  chemically synthesized
acttacatattatttaactata

SEQ ID NO: 1120606 - DNA, 22 bp, Artificial Sequence
  chemically synthesized
aacttacatattatttaactat

SEQ ID NO: 1120607 - DNA, 22 bp, Artificial Sequence
  chemically synthesized
ccttaacttacatattatttaa

SEQ ID NO: 1120608 - DNA, 22 bp, Artificial Sequence
  chemically synthesized
ttaatttatagttaaataatat

SEQ ID NO: 1120609 - DNA, 22 bp, Artificial Sequence
  chemically synthesized
gccttaacttacatattattta

SEQ ID NO: 1120610 - DNA, 22 bp, Artificial Sequence
  chemically synthesized
atttatagttaaataatatgta

SEQ ID NO: 1120611 - DNA, 22 bp, Artificial Sequence
  chemically synthesized
atagttaaataatatgtaagtt

SEQ ID NO: 1120612 - DNA, 22 bp, Artificial Sequence
  chemically synthesized
tagttaaataatatgtaagtta

SEQ ID NO: 1120613 - DNA, 22 bp, Artificial Sequence
  chemically synthesized
ataaacttgccttaacttacat

SEQ ID NO: 1120614 - DNA, 22 bp, Artificial Sequence
  chemically synthesized
cataaacttgccttaacttaca

SEQ ID NO: 1120615 - DNA, 22 bp, Artificial Sequence
  chemically synthesized
tcataaacttgccttaacttac

SEQ ID NO: 1120616 - DNA, 22 bp, Artificial Sequence
  chemically synthesized
aataatatgtaagttaaggcaa

SEQ ID NO: 1120617 - DNA, 22 bp, Artificial Sequence
  chemically synthesized
gggatgcctttcataaacttgc

SEQ ID NO: 1120618 - DNA, 22 bp, Artificial Sequence
  chemically synthesized
actagggatgcctttcataaac

SEQ ID NO: 1120619 - DNA, 22 bp, Artificial Sequence
  chemically synthesized
aggcaagtttatgaaaggcatc

SEQ ID NO: 1120620 - DNA, 22 bp, Artificial Sequence
  chemically synthesized
tgactgactagggatgcctttc

SEQ ID NO: 1120621 - DNA, 22 bp, Artificial Sequence
  chemically synthesized
tgtgactgactagggatgcctt

SEQ ID NO: 1120622 - DNA, 22 bp, Artificial Sequence
  chemically synthesized
ctgtgactgactagggatgcct

SEQ ID NO: 1120623 - DNA, 22 bp, Artificial Sequence
  chemically synthesized
ttctgtgactgactagggatgc

SEQ ID NO: 1120624 - DNA, 22 bp, Artificial Sequence
  chemically synthesized
atgaaaggcatccctagtcagt

SEQ ID NO: 1120625 - DNA, 22 bp, Artificial Sequence
  chemically synthesized
gattcttctgtgactgactagg

SEQ ID NO: 1120626 - DNA, 22 bp, Artificial Sequence
  chemically synthesized
tgaaaggcatccctagtcagtc

SEQ ID NO: 1120627 - DNA, 22 bp, Artificial Sequence
  chemically synthesized
tggattcttctgtgactgacta

SEQ ID NO: 1120628 - DNA, 22 bp, Artificial Sequence
  chemically synthesized
ctggattcttctgtgactgact

SEQ ID NO: 1120629 - DNA, 22 bp, Artificial Sequence
  chemically synthesized
tctggattcttctgtgactgac

SEQ ID NO: 1120630 - DNA, 22 bp, Artificial Sequence
  chemically synthesized
gagaaatctttctggattcttc

SEQ ID NO: 1120631 - DNA, 22 bp, Artificial Sequence
  chemically synthesized
gtcagtcacagaagaatccaga

SEQ ID NO: 1120632 - DNA, 22 bp, Artificial Sequence
  chemically synthesized
gcctagagaaatctttctggat

SEQ ID NO: 1120633 - DNA, 22 bp, Artificial Sequence
  chemically synthesized
agcctagagaaatctttctgga

SEQ ID NO: 1120634 - DNA, 22 bp, Artificial Sequence
  chemically synthesized
gatagcaagcaaaatcaaagtt

SEQ ID NO: 1120635 - DNA, 22 bp, Artificial Sequence
  chemically synthesized
agatagcaagcaaaatcaaagt

SEQ ID NO: 1120636 - DNA, 22 bp, Artificial Sequence
  chemically synthesized
ctctaggctaaactttgatttt

SEQ ID NO: 1120637 - DNA, 22 bp, Artificial Sequence
  chemically synthesized
tagatagcaagcaaaatcaaag

SEQ ID NO: 1120638 - DNA, 22 bp, Artificial Sequence
  chemically synthesized
tctaggctaaactttgattttg

SEQ ID NO: 1120639 - DNA, 22 bp, Artificial Sequence
  chemically synthesized
taggctaaactttgattttgct

SEQ ID NO: 1120640 - DNA, 22 bp, Artificial Sequence
  chemically synthesized
ggctaaactttgattttgcttg

SEQ ID NO: 1120641 - DNA, 22 bp, Artificial Sequence
  chemically synthesized
aactttgattttgcttgctatc

SEQ ID NO: 1120642 - DNA, 22 bp, Artificial Sequence
  chemically synthesized
aaaatatattttagatagcaag

SEQ ID NO: 1120643 - DNA, 22 bp, Artificial Sequence
  chemically synthesized
aaaaatatattttagatagcaa

SEQ ID NO: 1120644 - DNA, 22 bp, Artificial Sequence
  chemically synthesized
tgattttgcttgctatctaaaa

SEQ ID NO: 1120645 - DNA, 22 bp, Artificial Sequence
  chemically synthesized
gattttgcttgctatctaaaat

SEQ ID NO: 1120646 - DNA, 22 bp, Artificial Sequence
  chemically synthesized
attttgcttgctatctaaaata

SEQ ID NO: 1120647 - DNA, 22 bp, Artificial Sequence
  chemically synthesized
tgcttgctatctaaaatatatt

SEQ ID NO: 1120648 - DNA, 22 bp, Artificial Sequence
  chemically synthesized
atatgtcttaaaaatatatttt

SEQ ID NO: 1120649 - DNA, 22 bp, Artificial Sequence
  chemically synthesized
gcttgctatctaaaatatattt

SEQ ID NO: 1120650 - DNA, 22 bp, Artificial Sequence
  chemically synthesized
aatatgtcttaaaaatatattt

SEQ ID NO: 1120651 - DNA, 22 bp, Artificial Sequence
  chemically synthesized
cttgctatctaaaatatatttt

SEQ ID NO: 1120652 - DNA, 22 bp, Artificial Sequence
  chemically synthesized
tttaatatgtcttaaaaatata

SEQ ID NO: 1120653 - DNA, 22 bp, Artificial Sequence
  chemically synthesized
gctatctaaaatatatttttaa

SEQ ID NO: 1120654 - DNA, 22 bp, Artificial Sequence
  chemically synthesized
ctatctaaaatatatttttaag

SEQ ID NO: 1120655 - DNA, 22 bp, Artificial Sequence
  chemically synthesized
tctaaaatatatttttaagaca

SEQ ID NO: 1120656 - DNA, 22 bp, Artificial Sequence
  chemically synthesized
aaatatatttttaagacatatt

SEQ ID NO: 1120657 - DNA, 22 bp, Artificial Sequence
  chemically synthesized
ttaagacatattaaacagcatt

SEQ ID NO: 1120658 - DNA, 22 bp, Artificial Sequence
  chemically synthesized
taagacatattaaacagcattt

SEQ ID NO: 1120659 - DNA, 22 bp, Artificial Sequence
  chemically synthesized
aagacatattaaacagcatttt

SEQ ID NO: 1120660 - DNA, 22 bp, Artificial Sequence
  chemically synthesized
atgcgatatgataaaatgctgt

SEQ ID NO: 1120661 - DNA, 22 bp, Artificial Sequence
  chemically synthesized
agacatattaaacagcatttta

SEQ ID NO: 1120662 - DNA, 22 bp, Artificial Sequence
  chemically synthesized
atagattaatgcgatatgataa

SEQ ID NO: 1120663 - DNA, 22 bp, Artificial Sequence
  chemically synthesized
aacagcattttatcatatcgca

SEQ ID NO: 1120664 - DNA, 22 bp, Artificial Sequence
  chemically synthesized
gttgatagattaatgcgatatg

SEQ ID NO: 1120665 - DNA, 22 bp, Artificial Sequence
  chemically synthesized
ctagttgatagattaatgcgat

SEQ ID NO: 1120666 - DNA, 22 bp, Artificial Sequence
  chemically synthesized
tactagttgatagattaatgcg

SEQ ID NO: 1120667 - DNA, 22 bp, Artificial Sequence
  chemically synthesized
tatcatatcgcattaatctatc

SEQ ID NO: 1120668 - DNA, 22 bp, Artificial Sequence
  chemically synthesized
atcatatcgcattaatctatca

SEQ ID NO: 1120669 - DNA, 22 bp, Artificial Sequence
  chemically synthesized
tcatatcgcattaatctatcaa

SEQ ID NO: 1120670 - DNA, 22 bp, Artificial Sequence
  chemically synthesized
tgattctactagttgatagatt

SEQ ID NO: 1120671 - DNA, 22 bp, Artificial Sequence
  chemically synthesized
tctgtgattctactagttgata

SEQ ID NO: 1120672 - DNA, 22 bp, Artificial Sequence
  chemically synthesized
ttatctgtgattctactagttg

SEQ ID NO: 1120673 - DNA, 22 bp, Artificial Sequence
  chemically synthesized
gttatctgtgattctactagtt

SEQ ID NO: 1120674 - DNA, 22 bp, Artificial Sequence
  chemically synthesized
tgttatctgtgattctactagt

SEQ ID NO: 1120675 - DNA, 22 bp, Artificial Sequence
  chemically synthesized
atctatcaactagtagaatcac

SEQ ID NO: 1120676 - DNA, 22 bp, Artificial Sequence
  chemically synthesized
cgtgctttgttatctgtgattc

SEQ ID NO: 1120677 - DNA, 22 bp, Artificial Sequence
  chemically synthesized
tcaactagtagaatcacagata

SEQ ID NO: 1120678 - DNA, 22 bp, Artificial Sequence
  chemically synthesized
taaactccgtgctttgttatct

SEQ ID NO: 1120679 - DNA, 22 bp, Artificial Sequence
  chemically synthesized
gtaaactccgtgctttgttatc

SEQ ID NO: 1120680 - DNA, 22 bp, Artificial Sequence
  chemically synthesized
gtagaatcacagataacaaagc

SEQ ID NO: 1120681 - DNA, 22 bp, Artificial Sequence
  chemically synthesized
cttgtaaactccgtgctttgtt

SEQ ID NO: 1120682 - DNA, 22 bp, Artificial Sequence
  chemically synthesized
tgctgcttgtaaactccgtgct

SEQ ID NO: 1120683 - DNA, 22 bp, Artificial Sequence
  chemically synthesized
gtgctgcttgtaaactccgtgc

SEQ ID NO: 1120684 - DNA, 22 bp, Artificial Sequence
  chemically synthesized
tgtgctgcttgtaaactccgtg

SEQ ID NO: 1120685 - DNA, 22 bp, Artificial Sequence
  chemically synthesized
attttgtgctgcttgtaaactc

SEQ ID NO: 1120686 - DNA, 22 bp, Artificial Sequence
  chemically synthesized
tactcattttgtgctgcttgta

SEQ ID NO: 1120687 - DNA, 22 bp, Artificial Sequence
  chemically synthesized
tatctgtactcattttgtgctg

SEQ ID NO: 1120688 - DNA, 22 bp, Artificial Sequence
  chemically synthesized
atatctgtactcattttgtgct

SEQ ID NO: 1120689 - DNA, 22 bp, Artificial Sequence
  chemically synthesized
tatatctgtactcattttgtgc

SEQ ID NO: 1120690 - DNA, 22 bp, Artificial Sequence
  chemically synthesized
ttatatctgtactcattttgtg

SEQ ID NO: 1120691 - DNA, 22 bp, Artificial Sequence
  chemically synthesized
acaagcagcacaaaatgagtac

SEQ ID NO: 1120692 - DNA, 22 bp, Artificial Sequence
  chemically synthesized
atttttatatctgtactcattt

SEQ ID NO: 1120693 - DNA, 22 bp, Artificial Sequence
  chemically synthesized
caagcagcacaaaatgagtaca

SEQ ID NO: 1120694 - DNA, 22 bp, Artificial Sequence
  chemically synthesized
tgcattaatttttatatctgta

SEQ ID NO: 1120695 - DNA, 22 bp, Artificial Sequence
  chemically synthesized
aaagaaaaagtcaatgtaggtt

SEQ ID NO: 1120696 - DNA, 22 bp, Artificial Sequence
  chemically synthesized
aaaagaaaaagtcaatgtaggt

SEQ ID NO: 1120697 - DNA, 22 bp, Artificial Sequence
  chemically synthesized
atgcataacctacattgacttt

SEQ ID NO: 1120698 - DNA, 22 bp, Artificial Sequence
  chemically synthesized
agacttaaaagaaaaagtcaat

SEQ ID NO: 1120699 - DNA, 22 bp, Artificial Sequence
  chemically synthesized
tcagacttaaaagaaaaagtca

SEQ ID NO: 1120700 - DNA, 22 bp, Artificial Sequence
  chemically synthesized
ctcagacttaaaagaaaaagtc

SEQ ID NO: 1120701 - DNA, 22 bp, Artificial Sequence
  chemically synthesized
cattgactttttcttttaagtc

SEQ ID NO: 1120702 - DNA, 22 bp, Artificial Sequence
  chemically synthesized
actttttcttttaagtctgaga

SEQ ID NO: 1120703 - DNA, 22 bp, Artificial Sequence
  chemically synthesized
ggaaggaaggcaacttctcaga

SEQ ID NO: 1120704 - DNA, 22 bp, Artificial Sequence
  chemically synthesized
tttcttttaagtctgagaagtt

SEQ ID NO: 1120705 - DNA, 22 bp, Artificial Sequence
  chemically synthesized
cggaaggaaggcaacttctcag

SEQ ID NO: 1120706 - DNA, 22 bp, Artificial Sequence
  chemically synthesized
ttcttttaagtctgagaagttg

SEQ ID NO: 1120707 - DNA, 22 bp, Artificial Sequence
  chemically synthesized
tcggaaggaaggcaacttctca

SEQ ID NO: 1120708 - DNA, 22 bp, Artificial Sequence
  chemically synthesized
tcttttaagtctgagaagttgc

SEQ ID NO: 1120709 - DNA, 22 bp, Artificial Sequence
  chemically synthesized
cttttaagtctgagaagttgcc

SEQ ID NO: 1120710 - DNA, 22 bp, Artificial Sequence
  chemically synthesized
ttttaagtctgagaagttgcct

SEQ ID NO: 1120711 - DNA, 22 bp, Artificial Sequence
  chemically synthesized
ttaagtctgagaagttgccttc

SEQ ID NO: 1120712 - DNA, 22 bp, Artificial Sequence
  chemically synthesized
taagtctgagaagttgccttcc

SEQ ID NO: 1120713 - DNA, 22 bp, Artificial Sequence
  chemically synthesized
aagtctgagaagttgccttcct

SEQ ID NO: 1120714 - DNA, 22 bp, Artificial Sequence
  chemically synthesized
caatctttcggaaggaaggcaa

SEQ ID NO: 1120715 - DNA, 22 bp, Artificial Sequence
  chemically synthesized
agtctgagaagttgccttcctt

SEQ ID NO: 1120716 - DNA, 22 bp, Artificial Sequence
  chemically synthesized
gcaatctttcggaaggaaggca

SEQ ID NO: 1120717 - DNA, 22 bp, Artificial Sequence
  chemically synthesized
aatttgcaatctttcggaagga

SEQ ID NO: 1120718 - DNA, 22 bp, Artificial Sequence
  chemically synthesized
agaagttgccttccttccgaaa

SEQ ID NO: 1120719 - DNA, 22 bp, Artificial Sequence
  chemically synthesized
ccttccttccgaaagattgcaa

SEQ ID NO: 1120720 - DNA, 22 bp, Artificial Sequence
  chemically synthesized
cagagtcctgaatttgcaatct

SEQ ID NO: 1120721 - DNA, 22 bp, Artificial Sequence
  chemically synthesized
ccttccgaaagattgcaaattc

SEQ ID NO: 1120722 - DNA, 22 bp, Artificial Sequence
  chemically synthesized
cttccgaaagattgcaaattca

SEQ ID NO: 1120723 - DNA, 22 bp, Artificial Sequence
  chemically synthesized
tgttgcagagtcctgaatttgc

SEQ ID NO: 1120724 - DNA, 22 bp, Artificial Sequence
  chemically synthesized
ccgaaagattgcaaattcagga

SEQ ID NO: 1120725 - DNA, 22 bp, Artificial Sequence
  chemically synthesized
cgaaagattgcaaattcaggac

SEQ ID NO: 1120726 - DNA, 22 bp, Artificial Sequence
  chemically synthesized
agaagctgtgttgcagagtcct

SEQ ID NO: 1120727 - DNA, 22 bp, Artificial Sequence
  chemically synthesized
gctcagaagctgtgttgcagag

SEQ ID NO: 1120728 - DNA, 22 bp, Artificial Sequence
  chemically synthesized
caaattcaggactctgcaacac

SEQ ID NO: 1120729 - DNA, 22 bp, Artificial Sequence
  chemically synthesized
ctcgctcagaagctgtgttgca

SEQ ID NO: 1120730 - DNA, 22 bp, Artificial Sequence
  chemically synthesized
aggactctgcaacacagcttct

SEQ ID NO: 1120731 - DNA, 22 bp, Artificial Sequence
  chemically synthesized
gattactcgctcagaagctgtg

SEQ ID NO: 1120732 - DNA, 22 bp, Artificial Sequence
  chemically synthesized
tgcaacacagcttctgagcgag

SEQ ID NO: 1120733 - DNA, 22 bp, Artificial Sequence
  chemically synthesized
acagctggattactcgctcaga

SEQ ID NO: 1120734 - DNA, 22 bp, Artificial Sequence
  chemically synthesized
cacagctggattactcgctcag

SEQ ID NO: 1120735 - DNA, 22 bp, Artificial Sequence
  chemically synthesized
caacacagcttctgagcgagta

SEQ ID NO: 1120736 - DNA, 22 bp, Artificial Sequence
  chemically synthesized
aacttcacagctggattactcg

SEQ ID NO: 1120737 - DNA, 22 bp, Artificial Sequence
  chemically synthesized
ctgagcgagtaatccagctgtg

SEQ ID NO: 1120738 - DNA, 22 bp, Artificial Sequence
  chemically synthesized
tgagcgagtaatccagctgtga

SEQ ID NO: 1120739 - DNA, 22 bp, Artificial Sequence
  chemically synthesized
atataactgaacttcacagctg

SEQ ID NO: 1120740 - DNA, 22 bp, Artificial Sequence
  chemically synthesized
agcgagtaatccagctgtgaag

SEQ ID NO: 1120741 - DNA, 22 bp, Artificial Sequence
  chemically synthesized
gatgttgatataactgaacttc

SEQ ID NO: 1120742 - DNA, 22 bp, Artificial Sequence
  chemically synthesized
ggttggatgttgatataactga

SEQ ID NO: 1120743 - DNA, 22 bp, Artificial Sequence
  chemically synthesized
aggttggatgttgatataactg

SEQ ID NO: 1120744 - DNA, 22 bp, Artificial Sequence
  chemically synthesized
tcttaggttggatgttgatata

SEQ ID NO: 1120745 - DNA, 22 bp, Artificial Sequence
  chemically synthesized
tgaagttcagttatatcaacat

SEQ ID NO: 1120746 - DNA, 22 bp, Artificial Sequence
  chemically synthesized
ctgtcttaggttggatgttgat

SEQ ID NO: 1120747 - DNA, 22 bp, Artificial Sequence
  chemically synthesized
gctgtcttaggttggatgttga

SEQ ID NO: 1120748 - DNA, 22 bp, Artificial Sequence
  chemically synthesized
tgctgtcttaggttggatgttg

SEQ ID NO: 1120749 - DNA, 22 bp, Artificial Sequence
  chemically synthesized
ttgctgtcttaggttggatgtt

SEQ ID NO: 1120750 - DNA, 22 bp, Artificial Sequence
  chemically synthesized
tttgctgtcttaggttggatgt

SEQ ID NO: 1120751 - DNA, 22 bp, Artificial Sequence
  chemically synthesized
agttatatcaacatccaaccta

SEQ ID NO: 1120752 - DNA, 22 bp, Artificial Sequence
  chemically synthesized
ttttttgctgtcttaggttgga

SEQ ID NO: 1120753 - DNA, 22 bp, Artificial Sequence
  chemically synthesized
attttttgctgtcttaggttgg

SEQ ID NO: 1120754 - DNA, 22 bp, Artificial Sequence
  chemically synthesized
tattttttgctgtcttaggttg

SEQ ID NO: 1120755 - DNA, 22 bp, Artificial Sequence
  chemically synthesized
ttattttttgctgtcttaggtt

SEQ ID NO: 1120756 - DNA, 22 bp, Artificial Sequence
  chemically synthesized
tatcaacatccaacctaagaca

SEQ ID NO: 1120757 - DNA, 22 bp, Artificial Sequence
  chemically synthesized
agacagcaaaaaataaaagtca

SEQ ID NO: 1120758 - DNA, 22 bp, Artificial Sequence
  chemically synthesized
atatagaagaaagagataatca

SEQ ID NO: 1120759 - DNA, 22 bp, Artificial Sequence
  chemically synthesized
aatatagaagaaagagataatc

SEQ ID NO: 1120760 - DNA, 22 bp, Artificial Sequence
  chemically synthesized
taatatagaagaaagagataat

SEQ ID NO: 1120761 - DNA, 22 bp, Artificial Sequence
  chemically synthesized
ttaatatagaagaaagagataa

SEQ ID NO: 1120762 - DNA, 22 bp, Artificial Sequence
  chemically synthesized
tttaatatagaagaaagagata

SEQ ID NO: 1120763 - DNA, 22 bp, Artificial Sequence
  chemically synthesized
ttttaatatagaagaaagagat

SEQ ID NO: 1120764 - DNA, 22 bp, Artificial Sequence
  chemically synthesized
tttttaatatagaagaaagaga

SEQ ID NO: 1120765 - DNA, 22 bp, Artificial Sequence
  chemically synthesized
tttcttgattatctctttcttc

SEQ ID NO: 1120766 - DNA, 22 bp, Artificial Sequence
  chemically synthesized
ctttttttaatatagaagaaag

SEQ ID NO: 1120767 - DNA, 22 bp, Artificial Sequence
  chemically synthesized
cttgattatctctttcttctat

SEQ ID NO: 1120768 - DNA, 22 bp, Artificial Sequence
  chemically synthesized
ttgattatctctttcttctata

SEQ ID NO: 1120769 - DNA, 22 bp, Artificial Sequence
  chemically synthesized
gattatctctttcttctatatt

SEQ ID NO: 1120770 - DNA, 22 bp, Artificial Sequence
  chemically synthesized
attatctctttcttctatatta

SEQ ID NO: 1120771 - DNA, 22 bp, Artificial Sequence
  chemically synthesized
tctctttcttctatattaaaaa

SEQ ID NO: 1120772 - DNA, 22 bp, Artificial Sequence
  chemically synthesized
tttcttctatattaaaaaaagc

SEQ ID NO: 1120773 - DNA, 22 bp, Artificial Sequence
  chemically synthesized
tcttctatattaaaaaaagcaa

SEQ ID NO: 1120774 - DNA, 22 bp, Artificial Sequence
  chemically synthesized
cttctatattaaaaaaagcaat

SEQ ID NO: 1120775 - DNA, 22 bp, Artificial Sequence
  chemically synthesized
ttctatattaaaaaaagcaatt

SEQ ID NO: 1120776 - DNA, 22 bp, Artificial Sequence
  chemically synthesized
ctatattaaaaaaagcaattta

SEQ ID NO: 1120777 - DNA, 22 bp, Artificial Sequence
  chemically synthesized
tatattaaaaaaagcaatttat

SEQ ID NO: 1120778 - DNA, 22 bp, Artificial Sequence
  chemically synthesized
tattaaaaaaagcaatttatcc

SEQ ID NO: 1120779 - DNA, 22 bp, Artificial Sequence
  chemically synthesized
aaaaaagcaatttatccacatt

SEQ ID NO: 1120780 - DNA, 22 bp, Artificial Sequence
  chemically synthesized
agaaaagaatgataaatgtgga

SEQ ID NO: 1120781 - DNA, 22 bp, Artificial Sequence
  chemically synthesized
agattgagaaaagaatgataaa

SEQ ID NO: 1120782 - DNA, 22 bp, Artificial Sequence
  chemically synthesized
atccacatttatcattcttttc

SEQ ID NO: 1120783 - DNA, 22 bp, Artificial Sequence
  chemically synthesized
tccacatttatcattcttttct

SEQ ID NO: 1120784 - DNA, 22 bp, Artificial Sequence
  chemically synthesized
atcattcttttctcaatctgag

SEQ ID NO: 1120785 - DNA, 22 bp, Artificial Sequence
  chemically synthesized
tcattcttttctcaatctgaga

SEQ ID NO: 1120786 - DNA, 22 bp, Artificial Sequence
  chemically synthesized
ttttctcaatctgagactcctg

SEQ ID NO: 1120787 - DNA, 22 bp, Artificial Sequence
  chemically synthesized
ttctcaatctgagactcctgcc

SEQ ID NO: 1120788 - DNA, 22 bp, Artificial Sequence
  chemically synthesized
atagaggtgtcaggcaggagtc

SEQ ID NO: 1120789 - DNA, 22 bp, Artificial Sequence
  chemically synthesized
tctcaatctgagactcctgcct

SEQ ID NO: 1120790 - DNA, 22 bp, Artificial Sequence
  chemically synthesized
ctcaatctgagactcctgcctg

SEQ ID NO: 1120791 - DNA, 22 bp, Artificial Sequence
  chemically synthesized
tcaatctgagactcctgcctga

SEQ ID NO: 1120792 - DNA, 22 bp, Artificial Sequence
  chemically synthesized
aatctgagactcctgcctgaca

SEQ ID NO: 1120793 - DNA, 22 bp, Artificial Sequence
  chemically synthesized
atactaatagaggtgtcaggca

SEQ ID NO: 1120794 - DNA, 22 bp, Artificial Sequence
  chemically synthesized
ttaatactaatagaggtgtcag

SEQ ID NO: 1120795 - DNA, 22 bp, Artificial Sequence
  chemically synthesized
agactcctgcctgacacctcta

SEQ ID NO: 1120796 - DNA, 22 bp, Artificial Sequence
  chemically synthesized
ctattaatactaatagaggtgt

SEQ ID NO: 1120797 - DNA, 22 bp, Artificial Sequence
  chemically synthesized
ctgcctgacacctctattagta

SEQ ID NO: 1120798 - DNA, 22 bp, Artificial Sequence
  chemically synthesized
cctgacacctctattagtatta

SEQ ID NO: 1120799 - DNA, 22 bp, Artificial Sequence
  chemically synthesized
acacctctattagtattaatag

SEQ ID NO: 1120800 - DNA, 22 bp, Artificial Sequence
  chemically synthesized
acagggaaaatagtgctgctat

SEQ ID NO: 1120801 - DNA, 22 bp, Artificial Sequence
  chemically synthesized
tattagtattaatagcagcact

SEQ ID NO: 1120802 - DNA, 22 bp, Artificial Sequence
  chemically synthesized
ttagtattaatagcagcactat

SEQ ID NO: 1120803 - DNA, 22 bp, Artificial Sequence
  chemically synthesized
cctaacagggaaaatagtgctg

SEQ ID NO: 1120804 - DNA, 22 bp, Artificial Sequence
  chemically synthesized
gtattaatagcagcactatttt

SEQ ID NO: 1120805 - DNA, 22 bp, Artificial Sequence
  chemically synthesized
agtctacctaacagggaaaata

SEQ ID NO: 1120806 - DNA, 22 bp, Artificial Sequence
  chemically synthesized
gagtctacctaacagggaaaat

SEQ ID NO: 1120807 - DNA, 22 bp, Artificial Sequence
  chemically synthesized
atagcagcactattttccctgt

SEQ ID NO: 1120808 - DNA, 22 bp, Artificial Sequence
  chemically synthesized
caaatttgagtctacctaacag

SEQ ID NO: 1120809 - DNA, 22 bp, Artificial Sequence
  chemically synthesized
actccaaatttgagtctaccta

SEQ ID NO: 1120810 - DNA, 22 bp, Artificial Sequence
  chemically synthesized
ttttccctgttaggtagactca

SEQ ID NO: 1120811 - DNA, 22 bp, Artificial Sequence
  chemically synthesized
tccctgttaggtagactcaaat

SEQ ID NO: 1120812 - DNA, 22 bp, Artificial Sequence
  chemically synthesized
ccctgttaggtagactcaaatt

SEQ ID NO: 1120813 - DNA, 22 bp, Artificial Sequence
  chemically synthesized
cctgttaggtagactcaaattt

SEQ ID NO: 1120814 - DNA, 22 bp, Artificial Sequence
  chemically synthesized
ttaggtagactcaaatttggag

SEQ ID NO: 1120815 - DNA, 22 bp, Artificial Sequence
  chemically synthesized
gatcaaagctgactccaaattt

SEQ ID NO: 1120816 - DNA, 22 bp, Artificial Sequence
  chemically synthesized
tagatcaaagctgactccaaat

SEQ ID NO: 1120817 - DNA, 22 bp, Artificial Sequence
  chemically synthesized
ggtagactcaaatttggagtca

SEQ ID NO: 1120818 - DNA, 22 bp, Artificial Sequence
  chemically synthesized
aaatttggagtcagctttgatc

SEQ ID NO: 1120819 - DNA, 22 bp, Artificial Sequence
  chemically synthesized
tgatcataagactctagatcaa

SEQ ID NO: 1120820 - DNA, 22 bp, Artificial Sequence
  chemically synthesized
ggagtcagctttgatctagagt

SEQ ID NO: 1120821 - DNA, 22 bp, Artificial Sequence
  chemically synthesized
tgtgatcataagactctagatc

SEQ ID NO: 1120822 - DNA, 22 bp, Artificial Sequence
  chemically synthesized
gagtcagctttgatctagagtc

SEQ ID NO: 1120823 - DNA, 22 bp, Artificial Sequence
  chemically synthesized
tgatctagagtcttatgatcac

SEQ ID NO: 1120824 - DNA, 22 bp, Artificial Sequence
  chemically synthesized
gatctagagtcttatgatcaca

SEQ ID NO: 1120825 - DNA, 22 bp, Artificial Sequence
  chemically synthesized
atctagagtcttatgatcacag

SEQ ID NO: 1120826 - DNA, 22 bp, Artificial Sequence
  chemically synthesized
gagtcttatgatcacagaggtc

SEQ ID NO: 1120827 - DNA, 22 bp, Artificial Sequence
  chemically synthesized
aggtgaataaaatgacctctgt

SEQ ID NO: 1120828 - DNA, 22 bp, Artificial Sequence
  chemically synthesized
cattgaggtgaataaaatgacc

SEQ ID NO: 1120829 - DNA, 22 bp, Artificial Sequence
  chemically synthesized
atgatcacagaggtcattttat

SEQ ID NO: 1120830 - DNA, 22 bp, Artificial Sequence
  chemically synthesized
acattgaggtgaataaaatgac

SEQ ID NO: 1120831 - DNA, 22 bp, Artificial Sequence
  chemically synthesized
tgatcacagaggtcattttatt

SEQ ID NO: 1120832 - DNA, 22 bp, Artificial Sequence
  chemically synthesized
tacattgaggtgaataaaatga

SEQ ID NO: 1120833 - DNA, 22 bp, Artificial Sequence
  chemically synthesized
ttacattgaggtgaataaaatg

SEQ ID NO: 1120834 - DNA, 22 bp, Artificial Sequence
  chemically synthesized
tagaagtgatttttacattgag

SEQ ID NO: 1120835 - DNA, 22 bp, Artificial Sequence
  chemically synthesized
tattcacctcaatgtaaaaatc

SEQ ID NO: 1120836 - DNA, 22 bp, Artificial Sequence
  chemically synthesized
attcacctcaatgtaaaaatca

SEQ ID NO: 1120837 - DNA, 22 bp, Artificial Sequence
  chemically synthesized
ttcacctcaatgtaaaaatcac

SEQ ID NO: 1120838 - DNA, 22 bp, Artificial Sequence
  chemically synthesized
acctcaatgtaaaaatcacttc

SEQ ID NO: 1120839 - DNA, 22 bp, Artificial Sequence
  chemically synthesized
caggatatattgtagaagtgat

SEQ ID NO: 1120840 - DNA, 22 bp, Artificial Sequence
  chemically synthesized
acaggatatattgtagaagtga

SEQ ID NO: 1120841 - DNA, 22 bp, Artificial Sequence
  chemically synthesized
aatgtaaaaatcacttctacaa

SEQ ID NO: 1120842 - DNA, 22 bp, Artificial Sequence
  chemically synthesized
ggtaatagcttacaggatatat

SEQ ID NO: 1120843 - DNA, 22 bp, Artificial Sequence
  chemically synthesized
ctacaatatatcctgtaagcta

SEQ ID NO: 1120844 - DNA, 22 bp, Artificial Sequence
  chemically synthesized
tacaatatatcctgtaagctat

SEQ ID NO: 1120845 - DNA, 22 bp, Artificial Sequence
  chemically synthesized
caatatatcctgtaagctatta

SEQ ID NO: 1120846 - DNA, 22 bp, Artificial Sequence
  chemically synthesized
aagcagaggctgggtaatagct

SEQ ID NO: 1120847 - DNA, 22 bp, Artificial Sequence
  chemically synthesized
taagctattacccagcctctgc

SEQ ID NO: 1120848 - DNA, 22 bp, Artificial Sequence
  chemically synthesized
ttacccagcctctgcttgaatg

SEQ ID NO: 1120849 - DNA, 22 bp, Artificial Sequence
  chemically synthesized
aaatagtggaaacattcaagca

SEQ ID NO: 1120850 - DNA, 22 bp, Artificial Sequence
  chemically synthesized
caaatagtggaaacattcaagc

SEQ ID NO: 1120851 - DNA, 22 bp, Artificial Sequence
  chemically synthesized
tcaaatagtggaaacattcaag

SEQ ID NO: 1120852 - DNA, 22 bp, Artificial Sequence
  chemically synthesized
cccagcctctgcttgaatgttt

SEQ ID NO: 1120853 - DNA, 22 bp, Artificial Sequence
  chemically synthesized
ttcaaatagtggaaacattcaa

SEQ ID NO: 1120854 - DNA, 22 bp, Artificial Sequence
  chemically synthesized
tttcaaatagtggaaacattca

SEQ ID NO: 1120855 - DNA, 22 bp, Artificial Sequence
  chemically synthesized
tgcttgaatgtttccactattt

SEQ ID NO: 1120856 - DNA, 22 bp, Artificial Sequence
  chemically synthesized
cttgaatgtttccactatttga

SEQ ID NO: 1120857 - DNA, 22 bp, Artificial Sequence
  chemically synthesized
gaatgtttccactatttgaaaa

SEQ ID NO: 1120858 - DNA, 22 bp, Artificial Sequence
  chemically synthesized
aatgtttccactatttgaaaaa

SEQ ID NO: 1120859 - DNA, 22 bp, Artificial Sequence
  chemically synthesized
tcgtgggaagtagtactttttc

SEQ ID NO: 1120860 - DNA, 22 bp, Artificial Sequence
  chemically synthesized
ccactatttgaaaaagtactac

SEQ ID NO: 1120861 - DNA, 22 bp, Artificial Sequence
  chemically synthesized
cactatttgaaaaagtactact

SEQ ID NO: 1120862 - DNA, 22 bp, Artificial Sequence
  chemically synthesized
tttgaaaaagtactacttccca

SEQ ID NO: 1120863 - DNA, 22 bp, Artificial Sequence
  chemically synthesized
gaaaaagtactacttcccacga

SEQ ID NO: 1120864 - DNA, 22 bp, Artificial Sequence
  chemically synthesized
aaaaagtactacttcccacgat

SEQ ID NO: 1120865 - DNA, 22 bp, Artificial Sequence
  chemically synthesized
caaaaagaaaaggttatcgtgg

SEQ ID NO: 1120866 - DNA, 22 bp, Artificial Sequence
  chemically synthesized
ccaaaaagaaaaggttatcgtg

SEQ ID NO: 1120867 - DNA, 22 bp, Artificial Sequence
  chemically synthesized
tccaaaaagaaaaggttatcgt

SEQ ID NO: 1120868 - DNA, 22 bp, Artificial Sequence
  chemically synthesized
cttcccacgataaccttttctt

SEQ ID NO: 1120869 - DNA, 22 bp, Artificial Sequence
  chemically synthesized
cccacgataaccttttcttttt

SEQ ID NO: 1120870 - DNA, 22 bp, Artificial Sequence
  chemically synthesized
ccacgataaccttttctttttg

SEQ ID NO: 1120871 - DNA, 22 bp, Artificial Sequence
  chemically synthesized
ataaatactttccaaaaagaaa

SEQ ID NO: 1120872 - DNA, 22 bp, Artificial Sequence
  chemically synthesized
tcataaatactttccaaaaaga

SEQ ID NO: 1120873 - DNA, 22 bp, Artificial Sequence
  chemically synthesized
ctcataaatactttccaaaaag

SEQ ID NO: 1120874 - DNA, 22 bp, Artificial Sequence
  chemically synthesized
tctcataaatactttccaaaaa

SEQ ID NO: 1120875 - DNA, 22 bp, Artificial Sequence
  chemically synthesized
ttctcataaatactttccaaaa

SEQ ID NO: 1120876 - DNA, 22 bp, Artificial Sequence
  chemically synthesized
tttctcataaatactttccaaa

SEQ ID NO: 1120877 - DNA, 22 bp, Artificial Sequence
  chemically synthesized
ttttctcataaatactttccaa

SEQ ID NO: 1120878 - DNA, 22 bp, Artificial Sequence
  chemically synthesized
tttttctcataaatactttcca

SEQ ID NO: 1120879 - DNA, 22 bp, Artificial Sequence
  chemically synthesized
ttttttctcataaatactttcc

SEQ ID NO: 1120880 - DNA, 22 bp, Artificial Sequence
  chemically synthesized
tttttttctcataaatactttc

SEQ ID NO: 1120881 - DNA, 22 bp, Artificial Sequence
  chemically synthesized
ttctttttggaaagtatttatg

SEQ ID NO: 1120882 - DNA, 22 bp, Artificial Sequence
  chemically synthesized
tctttttggaaagtatttatga

SEQ ID NO: 1120883 - DNA, 22 bp, Artificial Sequence
  chemically synthesized
ctttttggaaagtatttatgag

SEQ ID NO: 1120884 - DNA, 22 bp, Artificial Sequence
  chemically synthesized
tttttggaaagtatttatgaga

SEQ ID NO: 1120885 - DNA, 22 bp, Artificial Sequence
  chemically synthesized
tttggaaagtatttatgagaaa

SEQ ID NO: 1120886 - DNA, 22 bp, Artificial Sequence
  chemically synthesized
ttggaaagtatttatgagaaaa

SEQ ID NO: 1120887 - DNA, 22 bp, Artificial Sequence
  chemically synthesized
tggaaagtatttatgagaaaaa

SEQ ID NO: 1120888 - DNA, 22 bp, Artificial Sequence
  chemically synthesized
ggaaagtatttatgagaaaaaa

SEQ ID NO: 1120889 - DNA, 22 bp, Artificial Sequence
  chemically synthesized
gaaagtatttatgagaaaaaaa

SEQ ID NO: 1120890 - DNA, 22 bp, Artificial Sequence
  chemically synthesized
atgagaaaaaaaaaattcctgt

SEQ ID NO: 1120891 - DNA, 22 bp, Artificial Sequence
  chemically synthesized
tgagaaaaaaaaaattcctgtt

SEQ ID NO: 1120892 - DNA, 22 bp, Artificial Sequence
  chemically synthesized
aatggtgaccaccaacaggaat

SEQ ID NO: 1120893 - DNA, 22 bp, Artificial Sequence
  chemically synthesized
caatggtgaccaccaacaggaa

SEQ ID NO: 1120894 - DNA, 22 bp, Artificial Sequence
  chemically synthesized
ctgttggtggtcaccattgaaa

SEQ ID NO: 1120895 - DNA, 22 bp, Artificial Sequence
  chemically synthesized
cagaaaagcatgtgtttcaatg

SEQ ID NO: 1120896 - DNA, 22 bp, Artificial Sequence
  chemically synthesized
ttggtggtcaccattgaaacac

SEQ ID NO: 1120897 - DNA, 22 bp, Artificial Sequence
  chemically synthesized
gtggtcaccattgaaacacatg

SEQ ID NO: 1120898 - DNA, 22 bp, Artificial Sequence
  chemically synthesized
gagactacagaaaagcatgtgt

SEQ ID NO: 1120899 - DNA, 22 bp, Artificial Sequence
  chemically synthesized
aaacacatgcttttctgtagtc

SEQ ID NO: 1120900 - DNA, 22 bp, Artificial Sequence
  chemically synthesized
ttctgtagtctccaatcatact

SEQ ID NO: 1120901 - DNA, 22 bp, Artificial Sequence
  chemically synthesized
tctgtagtctccaatcatactg

SEQ ID NO: 1120902 - DNA, 22 bp, Artificial Sequence
  chemically synthesized
ctgtagtctccaatcatactgc

SEQ ID NO: 1120903 - DNA, 22 bp, Artificial Sequence
  chemically synthesized
tgtagtctccaatcatactgcc

SEQ ID NO: 1120904 - DNA, 22 bp, Artificial Sequence
  chemically synthesized
tagtctccaatcatactgcctc

SEQ ID NO: 1120905 - DNA, 22 bp, Artificial Sequence
  chemically synthesized
caatcatactgcctctgggttt

SEQ ID NO: 1120906 - DNA, 22 bp, Artificial Sequence
  chemically synthesized
tgatagaaagtcacgtggccaa

SEQ ID NO: 1120907 - DNA, 22 bp, Artificial Sequence
  chemically synthesized
gtgatagaaagtcacgtggcca

SEQ ID NO: 1120908 - DNA, 22 bp, Artificial Sequence
  chemically synthesized
cctctgggtttggccacgtgac

SEQ ID NO: 1120909 - DNA, 22 bp, Artificial Sequence
  chemically synthesized
tgggtttggccacgtgactttc

SEQ ID NO: 1120910 - DNA, 22 bp, Artificial Sequence
  chemically synthesized
ggtttggccacgtgactttcta

SEQ ID NO: 1120911 - DNA, 22 bp, Artificial Sequence
  chemically synthesized
tcccatttgtgatagaaagtca

SEQ ID NO: 1120912 - DNA, 22 bp, Artificial Sequence
  chemically synthesized
ttgtcccatttgtgatagaaag

SEQ ID NO: 1120913 - DNA, 22 bp, Artificial Sequence
  chemically synthesized
ggccacgtgactttctatcaca

SEQ ID NO: 1120914 - DNA, 22 bp, Artificial Sequence
  chemically synthesized
gccacgtgactttctatcacaa

SEQ ID NO: 1120915 - DNA, 22 bp, Artificial Sequence
  chemically synthesized
ctattgtcccatttgtgataga

SEQ ID NO: 1120916 - DNA, 22 bp, Artificial Sequence
  chemically synthesized
actattgtcccatttgtgatag

SEQ ID NO: 1120917 - DNA, 22 bp, Artificial Sequence
  chemically synthesized
ttactattgtcccatttgtgat

SEQ ID NO: 1120918 - DNA, 22 bp, Artificial Sequence
  chemically synthesized
cagtactcttactattgtccca

SEQ ID NO: 1120919 - DNA, 22 bp, Artificial Sequence
  chemically synthesized
tctatcacaaatgggacaatag

SEQ ID NO: 1120920 - DNA, 22 bp, Artificial Sequence
  chemically synthesized
gcagtactcttactattgtccc

SEQ ID NO: 1120921 - DNA, 22 bp, Artificial Sequence
  chemically synthesized
ctatcacaaatgggacaatagt

SEQ ID NO: 1120922 - DNA, 22 bp, Artificial Sequence
  chemically synthesized
tatcacaaatgggacaatagta

SEQ ID NO: 1120923 - DNA, 22 bp, Artificial Sequence
  chemically synthesized
cttgcagtactcttactattgt

SEQ ID NO: 1120924 - DNA, 22 bp, Artificial Sequence
  chemically synthesized
tcacaaatgggacaatagtaag

SEQ ID NO: 1120925 - DNA, 22 bp, Artificial Sequence
  chemically synthesized
acttgcagtactcttactattg

SEQ ID NO: 1120926 - DNA, 22 bp, Artificial Sequence
  chemically synthesized
aaaaccttacttgcagtactct

SEQ ID NO: 1120927 - DNA, 22 bp, Artificial Sequence
  chemically synthesized
tcaaaaccttacttgcagtact

SEQ ID NO: 1120928 - DNA, 22 bp, Artificial Sequence
  chemically synthesized
ctcaaaaccttacttgcagtac

SEQ ID NO: 1120929 - DNA, 22 bp, Artificial Sequence
  chemically synthesized
acatgcaagcacttctcaaaac

SEQ ID NO: 1120930 - DNA, 22 bp, Artificial Sequence
  chemically synthesized
tgacatgcaagcacttctcaaa

SEQ ID NO: 1120931 - DNA, 22 bp, Artificial Sequence
  chemically synthesized
caagtaaggttttgagaagtgc

SEQ ID NO: 1120932 - DNA, 22 bp, Artificial Sequence
  chemically synthesized
aaaagtcaagctctgacatgca

SEQ ID NO: 1120933 - DNA, 22 bp, Artificial Sequence
  chemically synthesized
tgagaagtgcttgcatgtcaga

SEQ ID NO: 1120934 - DNA, 22 bp, Artificial Sequence
  chemically synthesized
gagaagtgcttgcatgtcagag

SEQ ID NO: 1120935 - DNA, 22 bp, Artificial Sequence
  chemically synthesized
taaaaagtcaagctctgacatg

SEQ ID NO: 1120936 - DNA, 22 bp, Artificial Sequence
  chemically synthesized
agaagtgcttgcatgtcagagc

SEQ ID NO: 1120937 - DNA, 22 bp, Artificial Sequence
  chemically synthesized
gcatgtcagagcttgacttttt

SEQ ID NO: 1120938 - DNA, 22 bp, Artificial Sequence
  chemically synthesized
catgtcagagcttgacttttta

SEQ ID NO: 1120939 - DNA, 22 bp, Artificial Sequence
  chemically synthesized
agaatgtgtgctctaaaaagtc

SEQ ID NO: 1120940 - DNA, 22 bp, Artificial Sequence
  chemically synthesized
tcagaatgtgtgctctaaaaag

SEQ ID NO: 1120941 - DNA, 22 bp, Artificial Sequence
  chemically synthesized
ctcagaatgtgtgctctaaaaa

SEQ ID NO: 1120942 - DNA, 22 bp, Artificial Sequence
  chemically synthesized
tcttctcagaatgtgtgctcta

SEQ ID NO: 1120943 - DNA, 22 bp, Artificial Sequence
  chemically synthesized
ttgtcttctcagaatgtgtgct

SEQ ID NO: 1120944 - DNA, 22 bp, Artificial Sequence
  chemically synthesized
gactttttagagcacacattct

SEQ ID NO: 1120945 - DNA, 22 bp, Artificial Sequence
  chemically synthesized
actttttagagcacacattctg

SEQ ID NO: 1120946 - DNA, 22 bp, Artificial Sequence
  chemically synthesized
tttagagcacacattctgagaa

SEQ ID NO: 1120947 - DNA, 22 bp, Artificial Sequence
  chemically synthesized
ttagagcacacattctgagaag

SEQ ID NO: 1120948 - DNA, 22 bp, Artificial Sequence
  chemically synthesized
tataattgttgtcttctcagaa

SEQ ID NO: 1120949 - DNA, 22 bp, Artificial Sequence
  chemically synthesized
tagagcacacattctgagaaga

SEQ ID NO: 1120950 - DNA, 22 bp, Artificial Sequence
  chemically synthesized
atataattgttgtcttctcaga

SEQ ID NO: 1120951 - DNA, 22 bp, Artificial Sequence
  chemically synthesized
agagcacacattctgagaagac

SEQ ID NO: 1120952 - DNA, 22 bp, Artificial Sequence
  chemically synthesized
gagcacacattctgagaagaca

SEQ ID NO: 1120953 - DNA, 22 bp, Artificial Sequence
  chemically synthesized
ttatataattgttgtcttctca

SEQ ID NO: 1120954 - DNA, 22 bp, Artificial Sequence
  chemically synthesized
cttatataattgttgtcttctc

SEQ ID NO: 1120955 - DNA, 22 bp, Artificial Sequence
  chemically synthesized
tacttcttatataattgttgtc

SEQ ID NO: 1120956 - DNA, 22 bp, Artificial Sequence
  chemically synthesized
tgagaagacaacaattatataa

SEQ ID NO: 1120957 - DNA, 22 bp, Artificial Sequence
  chemically synthesized
agaagacaacaattatataaga

SEQ ID NO: 1120958 - DNA, 22 bp, Artificial Sequence
  chemically synthesized
aaggtcattgtacttcttatat

SEQ ID NO: 1120959 - DNA, 22 bp, Artificial Sequence
  chemically synthesized
tataagaagtacaatgaccttg

SEQ ID NO: 1120960 - DNA, 22 bp, Artificial Sequence
  chemically synthesized
aaacatgatcacctcaaggtca

SEQ ID NO: 1120961 - DNA, 22 bp, Artificial Sequence
  chemically synthesized
aaaacatgatcacctcaaggtc

SEQ ID NO: 1120962 - DNA, 22 bp, Artificial Sequence
  chemically synthesized
cttaaaacatgatcacctcaag

SEQ ID NO: 1120963 - DNA, 22 bp, Artificial Sequence
  chemically synthesized
ccttaaaacatgatcacctcaa

SEQ ID NO: 1120964 - DNA, 22 bp, Artificial Sequence
  chemically synthesized
gaggtgatcatgttttaaggaa

SEQ ID NO: 1120965 - DNA, 22 bp, Artificial Sequence
  chemically synthesized
aggtgatcatgttttaaggaaa

SEQ ID NO: 1120966 - DNA, 22 bp, Artificial Sequence
  chemically synthesized
acatggacagatcaagtttcct

SEQ ID NO: 1120967 - DNA, 22 bp, Artificial Sequence
  chemically synthesized
cacatggacagatcaagtttcc

SEQ ID NO: 1120968 - DNA, 22 bp, Artificial Sequence
  chemically synthesized
ttcacatggacagatcaagttt

SEQ ID NO: 1120969 - DNA, 22 bp, Artificial Sequence
  chemically synthesized
taaggaaacttgatctgtccat

SEQ ID NO: 1120970 - DNA, 22 bp, Artificial Sequence
  chemically synthesized
aaggaaacttgatctgtccatg

SEQ ID NO: 1120971 - DNA, 22 bp, Artificial Sequence
  chemically synthesized
aggaaacttgatctgtccatgt

SEQ ID NO: 1120972 - DNA, 22 bp, Artificial Sequence
  chemically synthesized
atgtggcctcttcacatggaca

SEQ ID NO: 1120973 - DNA, 22 bp, Artificial Sequence
  chemically synthesized
catgtggcctcttcacatggac

SEQ ID NO: 1120974 - DNA, 22 bp, Artificial Sequence
  chemically synthesized
ttcatgtggcctcttcacatgg

SEQ ID NO: 1120975 - DNA, 22 bp, Artificial Sequence
  chemically synthesized
cttcatgtggcctcttcacatg

SEQ ID NO: 1120976 - DNA, 22 bp, Artificial Sequence
  chemically synthesized
gatctgtccatgtgaagaggcc

SEQ ID NO: 1120977 - DNA, 22 bp, Artificial Sequence
  chemically synthesized
atctgtccatgtgaagaggcca

SEQ ID NO: 1120978 - DNA, 22 bp, Artificial Sequence
  chemically synthesized
tccatgtgaagaggccacatga

SEQ ID NO: 1120979 - DNA, 22 bp, Artificial Sequence
  chemically synthesized
gtgccccatgcttcttcatgtg

SEQ ID NO: 1120980 - DNA, 22 bp, Artificial Sequence
  chemically synthesized
catgcctggtgccccatgcttc

SEQ ID NO: 1120981 - DNA, 22 bp, Artificial Sequence
  chemically synthesized
gcatgcctggtgccccatgctt

SEQ ID NO: 1120982 - DNA, 22 bp, Artificial Sequence
  chemically synthesized
tttgcatgcctggtgccccatg

SEQ ID NO: 1120983 - DNA, 22 bp, Artificial Sequence
  chemically synthesized
atttgcatgcctggtgccccat

SEQ ID NO: 1120984 - DNA, 22 bp, Artificial Sequence
  chemically synthesized
tatttgcatgcctggtgcccca

SEQ ID NO: 1120985 - DNA, 22 bp, Artificial Sequence
  chemically synthesized
agatgggtcacagagggcttta

SEQ ID NO: 1120986 - DNA, 22 bp, Artificial Sequence
  chemically synthesized
gcattgagatgggtcacagagg

SEQ ID NO: 1120987 - DNA, 22 bp, Artificial Sequence
  chemically synthesized
agctggcattgagatgggtcac

SEQ ID NO: 1120988 - DNA, 22 bp, Artificial Sequence
  chemically synthesized
cagctggcattgagatgggtca

SEQ ID NO: 1120989 - DNA, 22 bp, Artificial Sequence
  chemically synthesized
tcttcagctggcattgagatgg

SEQ ID NO: 1120990 - DNA, 22 bp, Artificial Sequence
  chemically synthesized
tctgtcttcagctggcattgag

SEQ ID NO: 1120991 - DNA, 22 bp, Artificial Sequence
  chemically synthesized
gtctgtcttcagctggcattga

SEQ ID NO: 1120992 - DNA, 22 bp, Artificial Sequence
  chemically synthesized
tgtgacccatctcaatgccagc

SEQ ID NO: 1120993 - DNA, 22 bp, Artificial Sequence
  chemically synthesized
tgacccatctcaatgccagctg

SEQ ID NO: 1120994 - DNA, 22 bp, Artificial Sequence
  chemically synthesized
atttgtctgtcttcagctggca

SEQ ID NO: 1120995 - DNA, 22 bp, Artificial Sequence
  chemically synthesized
gagcactcatttgtctgtcttc

SEQ ID NO: 1120996 - DNA, 22 bp, Artificial Sequence
  chemically synthesized
aatgccagctgaagacagacaa

SEQ ID NO: 1120997 - DNA, 22 bp, Artificial Sequence
  chemically synthesized
aagacagacaaatgagtgctcc

SEQ ID NO: 1120998 - DNA, 22 bp, Artificial Sequence
  chemically synthesized
tgtggcatcaactggagcactc

SEQ ID NO: 1120999 - DNA, 22 bp, Artificial Sequence
  chemically synthesized
tatgtggcatcaactggagcac

SEQ ID NO: 1121000 - DNA, 22 bp, Artificial Sequence
  chemically synthesized
tctatgtggcatcaactggagc

SEQ ID NO: 1121001 - DNA, 22 bp, Artificial Sequence
  chemically synthesized
ctctatgtggcatcaactggag

SEQ ID NO: 1121002 - DNA, 22 bp, Artificial Sequence
  chemically synthesized
tctctatgtggcatcaactgga

SEQ ID NO: 1121003 - DNA, 22 bp, Artificial Sequence
  chemically synthesized
ttctctatgtggcatcaactgg

SEQ ID NO: 1121004 - DNA, 22 bp, Artificial Sequence
  chemically synthesized
ttttctctatgtggcatcaact

SEQ ID NO: 1121005 - DNA, 22 bp, Artificial Sequence
  chemically synthesized
cttttctctatgtggcatcaac

SEQ ID NO: 1121006 - DNA, 22 bp, Artificial Sequence
  chemically synthesized
ggtatttcttttctctatgtgg

SEQ ID NO: 1121007 - DNA, 22 bp, Artificial Sequence
  chemically synthesized
gggtatttcttttctctatgtg

SEQ ID NO: 1121008 - DNA, 22 bp, Artificial Sequence
  chemically synthesized
tgggtatttcttttctctatgt

SEQ ID NO: 1121009 - DNA, 22 bp, Artificial Sequence
  chemically synthesized
cagttgatgccacatagagaaa

SEQ ID NO: 1121010 - DNA, 22 bp, Artificial Sequence
  chemically synthesized
atgccacatagagaaaagaaat

SEQ ID NO: 1121011 - DNA, 22 bp, Artificial Sequence
  chemically synthesized
aacgtaggcagtgccctttggg

SEQ ID NO: 1121012 - DNA, 22 bp, Artificial Sequence
  chemically synthesized
caacgtaggcagtgccctttgg

SEQ ID NO: 1121013 - DNA, 22 bp, Artificial Sequence
  chemically synthesized
ttcaacgtaggcagtgcccttt

SEQ ID NO: 1121014 - DNA, 22 bp, Artificial Sequence
  chemically synthesized
attcttcaacgtaggcagtgcc

SEQ ID NO: 1121015 - DNA, 22 bp, Artificial Sequence
  chemically synthesized
ctaattcttcaacgtaggcagt

SEQ ID NO: 1121016 - DNA, 22 bp, Artificial Sequence
  chemically synthesized
tcctaattcttcaacgtaggca

SEQ ID NO: 1121017 - DNA, 22 bp, Artificial Sequence
  chemically synthesized
ctcctaattcttcaacgtaggc

SEQ ID NO: 1121018 - DNA, 22 bp, Artificial Sequence
  chemically synthesized
tttctcctaattcttcaacgta

SEQ ID NO: 1121019 - DNA, 22 bp, Artificial Sequence
  chemically synthesized
ttatttctcctaattcttcaac

SEQ ID NO: 1121020 - DNA, 22 bp, Artificial Sequence
  chemically synthesized
attatttctcctaattcttcaa

SEQ ID NO: 1121021 - DNA, 22 bp, Artificial Sequence
  chemically synthesized
tttattatttctcctaattctt

SEQ ID NO: 1121022 - DNA, 22 bp, Artificial Sequence
  chemically synthesized
cctacgttgaagaattaggaga

SEQ ID NO: 1121023 - DNA, 22 bp, Artificial Sequence
  chemically synthesized
cgttgaagaattaggagaaata

SEQ ID NO: 1121024 - DNA, 22 bp, Artificial Sequence
  chemically synthesized
aagaattaggagaaataataaa

SEQ ID NO: 1121025 - DNA, 22 bp, Artificial Sequence
  chemically synthesized
aaacagcacctatttattattt

SEQ ID NO: 1121026 - DNA, 22 bp, Artificial Sequence
  chemically synthesized
aaaacagcacctatttattatt

SEQ ID NO: 1121027 - DNA, 22 bp, Artificial Sequence
  chemically synthesized
ggagaaataataaataggtgct

SEQ ID NO: 1121028 - DNA, 22 bp, Artificial Sequence
  chemically synthesized
acaccaaaatgtagtggcttaa

SEQ ID NO: 1121029 - DNA, 22 bp, Artificial Sequence
  chemically synthesized
ttttaagccactacattttggt

SEQ ID NO: 1121030 - DNA, 22 bp, Artificial Sequence
  chemically synthesized
taagccactacattttggtgtg

SEQ ID NO: 1121031 - DNA, 22 bp, Artificial Sequence
  chemically synthesized
aagccactacattttggtgtga

SEQ ID NO: 1121032 - DNA, 22 bp, Artificial Sequence
  chemically synthesized
agccactacattttggtgtgag

SEQ ID NO: 1121033 - DNA, 22 bp, Artificial Sequence
  chemically synthesized
tggcagcataacaactcacacc

SEQ ID NO: 1121034 - DNA, 22 bp, Artificial Sequence
  chemically synthesized
atggcagcataacaactcacac

SEQ ID NO: 1121035 - DNA, 22 bp, Artificial Sequence
  chemically synthesized
cattttggtgtgagttgttatg

SEQ ID NO: 1121036 - DNA, 22 bp, Artificial Sequence
  chemically synthesized
atatttatggcagcataacaac

SEQ ID NO: 1121037 - DNA, 22 bp, Artificial Sequence
  chemically synthesized
tggtgtgagttgttatgctgcc

SEQ ID NO: 1121038 - DNA, 22 bp, Artificial Sequence
  chemically synthesized
ggtgtgagttgttatgctgcca

SEQ ID NO: 1121039 - DNA, 22 bp, Artificial Sequence
  chemically synthesized
gtgtgagttgttatgctgccat

SEQ ID NO: 1121040 - DNA, 22 bp, Artificial Sequence
  chemically synthesized
ttatgctgccataaatatcaga

SEQ ID NO: 1121041 - DNA, 22 bp, Artificial Sequence
  chemically synthesized
tgctgccataaatatcagatca

SEQ ID NO: 1121042 - DNA, 22 bp, Artificial Sequence
  chemically synthesized
aaaataacaggataggtgatct

SEQ ID NO: 1121043 - DNA, 22 bp, Artificial Sequence
  chemically synthesized
ccataaatatcagatcacctat

SEQ ID NO: 1121044 - DNA, 22 bp, Artificial Sequence
  chemically synthesized
gaaaataacaggataggtgatc

SEQ ID NO: 1121045 - DNA, 22 bp, Artificial Sequence
  chemically synthesized
tcctgttattttcaaacctttt

SEQ ID NO: 1121046 - DNA, 22 bp, Artificial Sequence
  chemically synthesized
ttattttcaaaccttttttttt

SEQ ID NO: 1121047 - DNA, 22 bp, Artificial Sequence
  chemically synthesized
ttttcaaacctttttttttttt

SEQ ID NO: 1121048 - DNA, 22 bp, Artificial Sequence
  chemically synthesized
tcaaaccttttttttttttttt

SEQ ID NO: 1121049 - DNA, 22 bp, Artificial Sequence
  chemically synthesized
caaacctttttttttttttttt

SEQ ID NO: 1121050 - DNA, 22 bp, Artificial Sequence
  chemically synthesized
caaaaaaaaaaaaaaaaaaaaa

SEQ ID NO: 1121051 - DNA, 22 bp, Artificial Sequence
  chemically synthesized
aaaccttttttttttttttttt

SEQ ID NO: 1121052 - DNA, 22 bp, Artificial Sequence
  chemically synthesized
ccaaaaaaaaaaaaaaaaaaaa

SEQ ID NO: 1121053 - DNA, 22 bp, Artificial Sequence
  chemically synthesized
ttccaaaaaaaaaaaaaaaaaa

SEQ ID NO: 1121054 - DNA, 22 bp, Artificial Sequence
  chemically synthesized
tttttttttttttttttttttt

SEQ ID NO: 1121055 - DNA, 22 bp, Artificial Sequence
  chemically synthesized
tttttttttttttttttttttt

SEQ ID NO: 1121056 - DNA, 22 bp, Artificial Sequence
  chemically synthesized
tttttttttttttttttttttt

SEQ ID NO: 1121057 - DNA, 22 bp, Artificial Sequence
  chemically synthesized
tttttttttttttttttttttt

SEQ ID NO: 1121058 - DNA, 22 bp, Artificial Sequence
  chemically synthesized
tttttttttttttttttttttg

SEQ ID NO: 1121059 - DNA, 22 bp, Artificial Sequence
  chemically synthesized
ttttttttttttttttttttgg

SEQ ID NO: 1121060 - DNA, 22 bp, Artificial Sequence
  chemically synthesized
caaagatctcttccaaaaaaaa

SEQ ID NO: 1121061 - DNA, 22 bp, Artificial Sequence
  chemically synthesized
tttttttttttttttttttgga

SEQ ID NO: 1121062 - DNA, 22 bp, Artificial Sequence
  chemically synthesized
ttttttttttttttttttggaa

SEQ ID NO: 1121063 - DNA, 22 bp, Artificial Sequence
  chemically synthesized
tttttttttttttttttggaag

SEQ ID NO: 1121064 - DNA, 22 bp, Artificial Sequence
  chemically synthesized
ttttttttttttttttggaaga

SEQ ID NO: 1121065 - DNA, 22 bp, Artificial Sequence
  chemically synthesized
tttttttttttttttggaagag

SEQ ID NO: 1121066 - DNA, 22 bp, Artificial Sequence
  chemically synthesized
ttttttttttttttggaagaga

SEQ ID NO: 1121067 - DNA, 22 bp, Artificial Sequence
  chemically synthesized
tttttttttttttggaagagat

SEQ ID NO: 1121068 - DNA, 22 bp, Artificial Sequence
  chemically synthesized
gtggctccaaagatctcttcca

SEQ ID NO: 1121069 - DNA, 22 bp, Artificial Sequence
  chemically synthesized
ttttttttttttggaagagatc

SEQ ID NO: 1121070 - DNA, 22 bp, Artificial Sequence
  chemically synthesized
tttttttttttggaagagatct

SEQ ID NO: 1121071 - DNA, 22 bp, Artificial Sequence
  chemically synthesized
ttttttttttggaagagatctt

SEQ ID NO: 1121072 - DNA, 22 bp, Artificial Sequence
  chemically synthesized
tttttttttggaagagatcttt

SEQ ID NO: 1121073 - DNA, 22 bp, Artificial Sequence
  chemically synthesized
ttttttttggaagagatctttg

SEQ ID NO: 1121074 - DNA, 22 bp, Artificial Sequence
  chemically synthesized
tttttttggaagagatctttgg

SEQ ID NO: 1121075 - DNA, 22 bp, Artificial Sequence
  chemically synthesized
tccctggtggctccaaagatct

SEQ ID NO: 1121076 - DNA, 22 bp, Artificial Sequence
  chemically synthesized
ttttttggaagagatctttgga

SEQ ID NO: 1121077 - DNA, 22 bp, Artificial Sequence
  chemically synthesized
atccctggtggctccaaagatc

SEQ ID NO: 1121078 - DNA, 22 bp, Artificial Sequence
  chemically synthesized
tttttggaagagatctttggag

SEQ ID NO: 1121079 - DNA, 22 bp, Artificial Sequence
  chemically synthesized
ttttggaagagatctttggagc

SEQ ID NO: 1121080 - DNA, 22 bp, Artificial Sequence
  chemically synthesized
tttggaagagatctttggagcc

SEQ ID NO: 1121081 - DNA, 22 bp, Artificial Sequence
  chemically synthesized
ttggaagagatctttggagcca

SEQ ID NO: 1121082 - DNA, 22 bp, Artificial Sequence
  chemically synthesized
tggaagagatctttggagccac

SEQ ID NO: 1121083 - DNA, 22 bp, Artificial Sequence
  chemically synthesized
ggaagagatctttggagccacc

SEQ ID NO: 1121084 - DNA, 22 bp, Artificial Sequence
  chemically synthesized
gaagagatctttggagccacca

SEQ ID NO: 1121085 - DNA, 22 bp, Artificial Sequence
  chemically synthesized
gaatgaataatttatccctggt

SEQ ID NO: 1121086 - DNA, 22 bp, Artificial Sequence
  chemically synthesized
tggagccaccagggataaatta

SEQ ID NO: 1121087 - DNA, 22 bp, Artificial Sequence
  chemically synthesized
ggagccaccagggataaattat

SEQ ID NO: 1121088 - DNA, 22 bp, Artificial Sequence
  chemically synthesized
gagccaccagggataaattatt

SEQ ID NO: 1121089 - DNA, 22 bp, Artificial Sequence
  chemically synthesized
aatcaccagattagaatgaata

SEQ ID NO: 1121090 - DNA, 22 bp, Artificial Sequence
  chemically synthesized
tacctaaatcaccagattagaa

SEQ ID NO: 1121091 - DNA, 22 bp, Artificial Sequence
  chemically synthesized
tatacctaaatcaccagattag

SEQ ID NO: 1121092 - DNA, 22 bp, Artificial Sequence
  chemically synthesized
ctatacctaaatcaccagatta

SEQ ID NO: 1121093 - DNA, 22 bp, Artificial Sequence
  chemically synthesized
ttctatacctaaatcaccagat

SEQ ID NO: 1121094 - DNA, 22 bp, Artificial Sequence
  chemically synthesized
ttcattctaatctggtgattta

SEQ ID NO: 1121095 - DNA, 22 bp, Artificial Sequence
  chemically synthesized
gctcttctatacctaaatcacc

SEQ ID NO: 1121096 - DNA, 22 bp, Artificial Sequence
  chemically synthesized
ggctcttctatacctaaatcac

SEQ ID NO: 1121097 - DNA, 22 bp, Artificial Sequence
  chemically synthesized
attctaatctggtgatttaggt

SEQ ID NO: 1121098 - DNA, 22 bp, Artificial Sequence
  chemically synthesized
tggctcttctatacctaaatca

SEQ ID NO: 1121099 - DNA, 22 bp, Artificial Sequence
  chemically synthesized
taatctggtgatttaggtatag

SEQ ID NO: 1121100 - DNA, 22 bp, Artificial Sequence
  chemically synthesized
atctggtgatttaggtatagaa

SEQ ID NO: 1121101 - DNA, 22 bp, Artificial Sequence
  chemically synthesized
catattttggctcttctatacc

SEQ ID NO: 1121102 - DNA, 22 bp, Artificial Sequence
  chemically synthesized
gtgatttaggtatagaagagcc

SEQ ID NO: 1121103 - DNA, 22 bp, Artificial Sequence
  chemically synthesized
attccatattttggctcttcta

SEQ ID NO: 1121104 - DNA, 22 bp, Artificial Sequence
  chemically synthesized
ggttgattccatattttggctc

SEQ ID NO: 1121105 - DNA, 22 bp, Artificial Sequence
  chemically synthesized
gggttgattccatattttggct

SEQ ID NO: 1121106 - DNA, 22 bp, Artificial Sequence
  chemically synthesized
aggtatagaagagccaaaatat

SEQ ID NO: 1121107 - DNA, 22 bp, Artificial Sequence
  chemically synthesized
ggtatagaagagccaaaatatg

SEQ ID NO: 1121108 - DNA, 22 bp, Artificial Sequence
  chemically synthesized
gacacttgggttgattccatat

SEQ ID NO: 1121109 - DNA, 22 bp, Artificial Sequence
  chemically synthesized
cattagacacttgggttgattc

SEQ ID NO: 1121110 - DNA, 22 bp, Artificial Sequence
  chemically synthesized
ttccattagacacttgggttga

SEQ ID NO: 1121111 - DNA, 22 bp, Artificial Sequence
  chemically synthesized
atactattccattagacacttg

SEQ ID NO: 1121112 - DNA, 22 bp, Artificial Sequence
  chemically synthesized
aatactattccattagacactt

SEQ ID NO: 1121113 - DNA, 22 bp, Artificial Sequence
  chemically synthesized
aaggcttaatactattccatta

SEQ ID NO: 1121114 - DNA, 22 bp, Artificial Sequence
  chemically synthesized
aaaggcttaatactattccatt

SEQ ID NO: 1121115 - DNA, 22 bp, Artificial Sequence
  chemically synthesized
atagtcttaaaggcttaatact

SEQ ID NO: 1121116 - DNA, 22 bp, Artificial Sequence
  chemically synthesized
ttcatagtcttaaaggcttaat

SEQ ID NO: 1121117 - DNA, 22 bp, Artificial Sequence
  chemically synthesized
atggaatagtattaagccttta

SEQ ID NO: 1121118 - DNA, 22 bp, Artificial Sequence
  chemically synthesized
caaatgaaaggctattcatagt

SEQ ID NO: 1121119 - DNA, 22 bp, Artificial Sequence
  chemically synthesized
agcctttaagactatgaatagc

SEQ ID NO: 1121120 - DNA, 22 bp, Artificial Sequence
  chemically synthesized
ttgcaaatgaaaggctattcat

SEQ ID NO: 1121121 - DNA, 22 bp, Artificial Sequence
  chemically synthesized
taagactatgaatagcctttca

SEQ ID NO: 1121122 - DNA, 22 bp, Artificial Sequence
  chemically synthesized
aagactatgaatagcctttcat

SEQ ID NO: 1121123 - DNA, 22 bp, Artificial Sequence
  chemically synthesized
agactatgaatagcctttcatt

SEQ ID NO: 1121124 - DNA, 22 bp, Artificial Sequence
  chemically synthesized
atacatgttgttgcaaatgaaa

SEQ ID NO: 1121125 - DNA, 22 bp, Artificial Sequence
  chemically synthesized
tgaatagcctttcatttgcaac

SEQ ID NO: 1121126 - DNA, 22 bp, Artificial Sequence
  chemically synthesized
cgggttcatacatgttgttgca

SEQ ID NO: 1121127 - DNA, 22 bp, Artificial Sequence
  chemically synthesized
ctccgggttcatacatgttgtt

SEQ ID NO: 1121128 - DNA, 22 bp, Artificial Sequence
  chemically synthesized
cctccgggttcatacatgttgt

SEQ ID NO: 1121129 - DNA, 22 bp, Artificial Sequence
  chemically synthesized
tcatttgcaacaacatgtatga

SEQ ID NO: 1121130 - DNA, 22 bp, Artificial Sequence
  chemically synthesized
catttgcaacaacatgtatgaa

SEQ ID NO: 1121131 - DNA, 22 bp, Artificial Sequence
  chemically synthesized
atttgcaacaacatgtatgaac

SEQ ID NO: 1121132 - DNA, 22 bp, Artificial Sequence
  chemically synthesized
gcaacaacatgtatgaacccgg

SEQ ID NO: 1121133 - DNA, 22 bp, Artificial Sequence
  chemically synthesized
acataatttcctccgggttcat

SEQ ID NO: 1121134 - DNA, 22 bp, Artificial Sequence
  chemically synthesized
caacaacatgtatgaacccgga

SEQ ID NO: 1121135 - DNA, 22 bp, Artificial Sequence
  chemically synthesized
aacataatttcctccgggttca

SEQ ID NO: 1121136 - DNA, 22 bp, Artificial Sequence
  chemically synthesized
acttaacataatttcctccggg

SEQ ID NO: 1121137 - DNA, 22 bp, Artificial Sequence
  chemically synthesized
cacttaacataatttcctccgg

SEQ ID NO: 1121138 - DNA, 22 bp, Artificial Sequence
  chemically synthesized
tttcacttaacataatttcctc

SEQ ID NO: 1121139 - DNA, 22 bp, Artificial Sequence
  chemically synthesized
atttcacttaacataatttcct

SEQ ID NO: 1121140 - DNA, 22 bp, Artificial Sequence
  chemically synthesized
gcttatttcacttaacataatt

SEQ ID NO: 1121141 - DNA, 22 bp, Artificial Sequence
  chemically synthesized
cacctggcttatttcacttaac

SEQ ID NO: 1121142 - DNA, 22 bp, Artificial Sequence
  chemically synthesized
tacacctggcttatttcactta

SEQ ID NO: 1121143 - DNA, 22 bp, Artificial Sequence
  chemically synthesized
ctacacctggcttatttcactt

SEQ ID NO: 1121144 - DNA, 22 bp, Artificial Sequence
  chemically synthesized
tctacacctggcttatttcact

SEQ ID NO: 1121145 - DNA, 22 bp, Artificial Sequence
  chemically synthesized
tctttctacacctggcttattt

SEQ ID NO: 1121146 - DNA, 22 bp, Artificial Sequence
  chemically synthesized
gtctttctacacctggcttatt

SEQ ID NO: 1121147 - DNA, 22 bp, Artificial Sequence
  chemically synthesized
tgttaagtgaaataagccaggt

SEQ ID NO: 1121148 - DNA, 22 bp, Artificial Sequence
  chemically synthesized
agtgaaataagccaggtgtaga

SEQ ID NO: 1121149 - DNA, 22 bp, Artificial Sequence
  chemically synthesized
taagtgagatcatgtggtattt

SEQ ID NO: 1121150 - DNA, 22 bp, Artificial Sequence
  chemically synthesized
gtaagtgagatcatgtggtatt

SEQ ID NO: 1121151 - DNA, 22 bp, Artificial Sequence
  chemically synthesized
cacttgtaagtgagatcatgtg

SEQ ID NO: 1121152 - DNA, 22 bp, Artificial Sequence
  chemically synthesized
gattccacttgtaagtgagatc

SEQ ID NO: 1121153 - DNA, 22 bp, Artificial Sequence
  chemically synthesized
agattccacttgtaagtgagat

SEQ ID NO: 1121154 - DNA, 22 bp, Artificial Sequence
  chemically synthesized
tagattccacttgtaagtgaga

SEQ ID NO: 1121155 - DNA, 22 bp, Artificial Sequence
  chemically synthesized
ttagattccacttgtaagtgag

SEQ ID NO: 1121156 - DNA, 22 bp, Artificial Sequence
  chemically synthesized
tttagattccacttgtaagtga

SEQ ID NO: 1121157 - DNA, 22 bp, Artificial Sequence
  chemically synthesized
ttttagattccacttgtaagtg

SEQ ID NO: 1121158 - DNA, 22 bp, Artificial Sequence
  chemically synthesized
tttttagattccacttgtaagt

SEQ ID NO: 1121159 - DNA, 22 bp, Artificial Sequence
  chemically synthesized
ttttttagattccacttgtaag

SEQ ID NO: 1121160 - DNA, 22 bp, Artificial Sequence
  chemically synthesized
tttttttagattccacttgtaa

SEQ ID NO: 1121161 - DNA, 22 bp, Artificial Sequence
  chemically synthesized
ttttttttagattccacttgta

SEQ ID NO: 1121162 - DNA, 22 bp, Artificial Sequence
  chemically synthesized
tttttttttagattccacttgt

SEQ ID NO: 1121163 - DNA, 22 bp, Artificial Sequence
  chemically synthesized
ttttttttttagattccacttg

SEQ ID NO: 1121164 - DNA, 22 bp, Artificial Sequence
  chemically synthesized
tttttttttttagattccactt

SEQ ID NO: 1121165 - DNA, 22 bp, Artificial Sequence
  chemically synthesized
ttttttttttttagattccact

SEQ ID NO: 1121166 - DNA, 22 bp, Artificial Sequence
  chemically synthesized
tttttttttttttagattccac

SEQ ID NO: 1121167 - DNA, 22 bp, Artificial Sequence
  chemically synthesized
ttttttttttttttagattcca

SEQ ID NO: 1121168 - DNA, 22 bp, Artificial Sequence
  chemically synthesized
tttttttttttttttagattcc

SEQ ID NO: 1121169 - DNA, 22 bp, Artificial Sequence
  chemically synthesized
ttttttttttttttttagattc

SEQ ID NO: 1121170 - DNA, 22 bp, Artificial Sequence
  chemically synthesized
acttacaagtggaatctaaaaa

SEQ ID NO: 1121171 - DNA, 22 bp, Artificial Sequence
  chemically synthesized
tttttttttttttttttagatt

SEQ ID NO: 1121172 - DNA, 22 bp, Artificial Sequence
  chemically synthesized
ttttttttttttttttttagat

SEQ ID NO: 1121173 - DNA, 22 bp, Artificial Sequence
  chemically synthesized
acaagtggaatctaaaaaaaaa

SEQ ID NO: 1121174 - DNA, 22 bp, Artificial Sequence
  chemically synthesized
caagtggaatctaaaaaaaaaa

SEQ ID NO: 1121175 - DNA, 22 bp, Artificial Sequence
  chemically synthesized
attttttttttttttttttttt

SEQ ID NO: 1121176 - DNA, 22 bp, Artificial Sequence
  chemically synthesized
gatttttttttttttttttttt

SEQ ID NO: 1121177 - DNA, 22 bp, Artificial Sequence
  chemically synthesized
gtttgatttttttttttttttt

SEQ ID NO: 1121178 - DNA, 22 bp, Artificial Sequence
  chemically synthesized
agtttgattttttttttttttt

SEQ ID NO: 1121179 - DNA, 22 bp, Artificial Sequence
  chemically synthesized
tagtttgatttttttttttttt

SEQ ID NO: 1121180 - DNA, 22 bp, Artificial Sequence
  chemically synthesized
ttagtttgattttttttttttt

SEQ ID NO: 1121181 - DNA, 22 bp, Artificial Sequence
  chemically synthesized
ttttagtttgattttttttttt

SEQ ID NO: 1121182 - DNA, 22 bp, Artificial Sequence
  chemically synthesized
cttttagtttgatttttttttt

SEQ ID NO: 1121183 - DNA, 22 bp, Artificial Sequence
  chemically synthesized
aaaaaaaaaaaaaaaaaaaatc

SEQ ID NO: 1121184 - DNA, 22 bp, Artificial Sequence
  chemically synthesized
tttcttttagtttgattttttt

SEQ ID NO: 1121185 - DNA, 22 bp, Artificial Sequence
  chemically synthesized
tgtttcttttagtttgattttt

SEQ ID NO: 1121186 - DNA, 22 bp, Artificial Sequence
  chemically synthesized
ctgtttcttttagtttgatttt

SEQ ID NO: 1121187 - DNA, 22 bp, Artificial Sequence
  chemically synthesized
tcttctgtttcttttagtttga

SEQ ID NO: 1121188 - DNA, 22 bp, Artificial Sequence
  chemically synthesized
gaaatgaacattgtcttctgtt

SEQ ID NO: 1121189 - DNA, 22 bp, Artificial Sequence
  chemically synthesized
ctggaaatgaacattgtcttct

SEQ ID NO: 1121190 - DNA, 22 bp, Artificial Sequence
  chemically synthesized
aaagaaacagaagacaatgttc

SEQ ID NO: 1121191 - DNA, 22 bp, Artificial Sequence
  chemically synthesized
cacccccaccagctcctggaaa

SEQ ID NO: 1121192 - DNA, 22 bp, Artificial Sequence
  chemically synthesized
tccacccccaccagctcctgga

SEQ ID NO: 1121193 - DNA, 22 bp, Artificial Sequence
  chemically synthesized
ctctccacccccaccagctcct

SEQ ID NO: 1121194 - DNA, 22 bp, Artificial Sequence
  chemically synthesized
atttccaggagctggtgggggt

SEQ ID NO: 1121195 - DNA, 22 bp, Artificial Sequence
  chemically synthesized
caactactctccacccccacca

SEQ ID NO: 1121196 - DNA, 22 bp, Artificial Sequence
  chemically synthesized
ccaactactctccacccccacc

SEQ ID NO: 1121197 - DNA, 22 bp, Artificial Sequence
  chemically synthesized
tccaactactctccacccccac

SEQ ID NO: 1121198 - DNA, 22 bp, Artificial Sequence
  chemically synthesized
ccaggagctggtgggggtggag

SEQ ID NO: 1121199 - DNA, 22 bp, Artificial Sequence
  chemically synthesized
caggagctggtgggggtggaga

SEQ ID NO: 1121200 - DNA, 22 bp, Artificial Sequence
  chemically synthesized
ccaatatctttccaactactct

SEQ ID NO: 1121201 - DNA, 22 bp, Artificial Sequence
  chemically synthesized
gccaatatctttccaactactc

SEQ ID NO: 1121202 - DNA, 22 bp, Artificial Sequence
  chemically synthesized
gtgggggtggagagtagttgga

SEQ ID NO: 1121203 - DNA, 22 bp, Artificial Sequence
  chemically synthesized
tgccaatatctttccaactact

SEQ ID NO: 1121204 - DNA, 22 bp, Artificial Sequence
  chemically synthesized
ttgccaatatctttccaactac

SEQ ID NO: 1121205 - DNA, 22 bp, Artificial Sequence
  chemically synthesized
tatccttttgccaatatctttc

SEQ ID NO: 1121206 - DNA, 22 bp, Artificial Sequence
  chemically synthesized
gtatccttttgccaatatcttt

SEQ ID NO: 1121207 - DNA, 22 bp, Artificial Sequence
  chemically synthesized
tgtatccttttgccaatatctt

SEQ ID NO: 1121208 - DNA, 22 bp, Artificial Sequence
  chemically synthesized
taattttgtatccttttgccaa

SEQ ID NO: 1121209 - DNA, 22 bp, Artificial Sequence
  chemically synthesized
ataattttgtatccttttgcca

SEQ ID NO: 1121210 - DNA, 22 bp, Artificial Sequence
  chemically synthesized
gaaagatattggcaaaaggata

SEQ ID NO: 1121211 - DNA, 22 bp, Artificial Sequence
  chemically synthesized
aaatatttataattttgtatcc

SEQ ID NO: 1121212 - DNA, 22 bp, Artificial Sequence
  chemically synthesized
caaatatttataattttgtatc

SEQ ID NO: 1121213 - DNA, 22 bp, Artificial Sequence
  chemically synthesized
gcaaaaggatacaaaattataa

SEQ ID NO: 1121214 - DNA, 22 bp, Artificial Sequence
  chemically synthesized
aagagcggatttcaaatattta

SEQ ID NO: 1121215 - DNA, 22 bp, Artificial Sequence
  chemically synthesized
aaagagcggatttcaaatattt

SEQ ID NO: 1121216 - DNA, 22 bp, Artificial Sequence
  chemically synthesized
ataaatttaaagagcggatttc

SEQ ID NO: 1121217 - DNA, 22 bp, Artificial Sequence
  chemically synthesized
taaatatttgaaatccgctctt

SEQ ID NO: 1121218 - DNA, 22 bp, Artificial Sequence
  chemically synthesized
ctgataaatttaaagagcggat

SEQ ID NO: 1121219 - DNA, 22 bp, Artificial Sequence
  chemically synthesized
gaaatccgctctttaaatttat

SEQ ID NO: 1121220 - DNA, 22 bp, Artificial Sequence
  chemically synthesized
aaatccgctctttaaatttatc

SEQ ID NO: 1121221 - DNA, 22 bp, Artificial Sequence
  chemically synthesized
atgatcaggtatctactgataa

SEQ ID NO: 1121222 - DNA, 22 bp, Artificial Sequence
  chemically synthesized
tttaaatttatcagtagatacc

SEQ ID NO: 1121223 - DNA, 22 bp, Artificial Sequence
  chemically synthesized
taaatttatcagtagatacctg

SEQ ID NO: 1121224 - DNA, 22 bp, Artificial Sequence
  chemically synthesized
aaatttatcagtagatacctga

SEQ ID NO: 1121225 - DNA, 22 bp, Artificial Sequence
  chemically synthesized
aatttatcagtagatacctgat

SEQ ID NO: 1121226 - DNA, 22 bp, Artificial Sequence
  chemically synthesized
atcagtagatacctgatcatca

SEQ ID NO: 1121227 - DNA, 22 bp, Artificial Sequence
  chemically synthesized
tcagtagatacctgatcatcag

SEQ ID NO: 1121228 - DNA, 22 bp, Artificial Sequence
  chemically synthesized
agcatagggtaggctgatgatc

SEQ ID NO: 1121229 - DNA, 22 bp, Artificial Sequence
  chemically synthesized
aagtaattaagcatagggtagg

SEQ ID NO: 1121230 - DNA, 22 bp, Artificial Sequence
  chemically synthesized
atcatcagcctaccctatgctt

SEQ ID NO: 1121231 - DNA, 22 bp, Artificial Sequence
  chemically synthesized
ccctatgcttaattacttcaac

SEQ ID NO: 1121232 - DNA, 22 bp, Artificial Sequence
  chemically synthesized
tgcttaattacttcaacggata

SEQ ID NO: 1121233 - DNA, 22 bp, Artificial Sequence
  chemically synthesized
aattacttcaacggatattcta

SEQ ID NO: 1121234 - DNA, 22 bp, Artificial Sequence
  chemically synthesized
attacttcaacggatattctat

SEQ ID NO: 1121235 - DNA, 22 bp, Artificial Sequence
  chemically synthesized
agataacaacaagccatagaat

SEQ ID NO: 1121236 - DNA, 22 bp, Artificial Sequence
  chemically synthesized
cttcaacggatattctatggct

SEQ ID NO: 1121237 - DNA, 22 bp, Artificial Sequence
  chemically synthesized
caacggatattctatggcttgt

SEQ ID NO: 1121238 - DNA, 22 bp, Artificial Sequence
  chemically synthesized
aacggatattctatggcttgtt

SEQ ID NO: 1121239 - DNA, 22 bp, Artificial Sequence
  chemically synthesized
aggaaactaagataacaacaag

SEQ ID NO: 1121240 - DNA, 22 bp, Artificial Sequence
  chemically synthesized
aaggaaactaagataacaacaa

SEQ ID NO: 1121241 - DNA, 22 bp, Artificial Sequence
  chemically synthesized
tatggcttgttgttatcttagt

SEQ ID NO: 1121242 - DNA, 22 bp, Artificial Sequence
  chemically synthesized
tggcttgttgttatcttagttt

SEQ ID NO: 1121243 - DNA, 22 bp, Artificial Sequence
  chemically synthesized
agtacccaatttaaggaaacta

SEQ ID NO: 1121244 - DNA, 22 bp, Artificial Sequence
  chemically synthesized
aagtacccaatttaaggaaact

SEQ ID NO: 1121245 - DNA, 22 bp, Artificial Sequence
  chemically synthesized
gttgttatcttagtttccttaa

SEQ ID NO: 1121246 - DNA, 22 bp, Artificial Sequence
  chemically synthesized
taagtacccaatttaaggaaac

SEQ ID NO: 1121247 - DNA, 22 bp, Artificial Sequence
  chemically synthesized
ttgttatcttagtttccttaaa

SEQ ID NO: 1121248 - DNA, 22 bp, Artificial Sequence
  chemically synthesized
ttatcttagtttccttaaattg

SEQ ID NO: 1121249 - DNA, 22 bp, Artificial Sequence
  chemically synthesized
cctttaagtacccaatttaagg

SEQ ID NO: 1121250 - DNA, 22 bp, Artificial Sequence
  chemically synthesized
tcttagtttccttaaattgggt

SEQ ID NO: 1121251 - DNA, 22 bp, Artificial Sequence
  chemically synthesized
agtttccttaaattgggtactt

SEQ ID NO: 1121252 - DNA, 22 bp, Artificial Sequence
  chemically synthesized
gtttccttaaattgggtactta

SEQ ID NO: 1121253 - DNA, 22 bp, Artificial Sequence
  chemically synthesized
atatgttccctttaagtaccca

SEQ ID NO: 1121254 - DNA, 22 bp, Artificial Sequence
  chemically synthesized
ctgatatgttccctttaagtac

SEQ ID NO: 1121255 - DNA, 22 bp, Artificial Sequence
  chemically synthesized
ccttaaattgggtacttaaagg

SEQ ID NO: 1121256 - DNA, 22 bp, Artificial Sequence
  chemically synthesized
cttaaattgggtacttaaaggg

SEQ ID NO: 1121257 - DNA, 22 bp, Artificial Sequence
  chemically synthesized
aaattgggtacttaaagggaac

SEQ ID NO: 1121258 - DNA, 22 bp, Artificial Sequence
  chemically synthesized
aattgggtacttaaagggaaca

SEQ ID NO: 1121259 - DNA, 22 bp, Artificial Sequence
  chemically synthesized
cacactgctgatatgttccctt

SEQ ID NO: 1121260 - DNA, 22 bp, Artificial Sequence
  chemically synthesized
acacactgctgatatgttccct

SEQ ID NO: 1121261 - DNA, 22 bp, Artificial Sequence
  chemically synthesized
tacacactgctgatatgttccc

SEQ ID NO: 1121262 - DNA, 22 bp, Artificial Sequence
  chemically synthesized
ggtacttaaagggaacatatca

SEQ ID NO: 1121263 - DNA, 22 bp, Artificial Sequence
  chemically synthesized
ttttacacactgctgatatgtt

SEQ ID NO: 1121264 - DNA, 22 bp, Artificial Sequence
  chemically synthesized
attttacacactgctgatatgt

SEQ ID NO: 1121265 - DNA, 22 bp, Artificial Sequence
  chemically synthesized
tttattttacacactgctgata

SEQ ID NO: 1121266 - DNA, 22 bp, Artificial Sequence
  chemically synthesized
aaagggaacatatcagcagtgt

SEQ ID NO: 1121267 - DNA, 22 bp, Artificial Sequence
  chemically synthesized
aagggaacatatcagcagtgtg

SEQ ID NO: 1121268 - DNA, 22 bp, Artificial Sequence
  chemically synthesized
cctgtttattttacacactgct

SEQ ID NO: 1121269 - DNA, 22 bp, Artificial Sequence
  chemically synthesized
ccctgtttattttacacactgc

SEQ ID NO: 1121270 - DNA, 22 bp, Artificial Sequence
  chemically synthesized
ttccctgtttattttacacact

SEQ ID NO: 1121271 - DNA, 22 bp, Artificial Sequence
  chemically synthesized
ttcttccctgtttattttacac

SEQ ID NO: 1121272 - DNA, 22 bp, Artificial Sequence
  chemically synthesized
taaaccagaaagataattattc

SEQ ID NO: 1121273 - DNA, 22 bp, Artificial Sequence
  chemically synthesized
tatcaatgaaagtattataaac

SEQ ID NO: 1121274 - DNA, 22 bp, Artificial Sequence
  chemically synthesized
tctttctggtttataatacttt

SEQ ID NO: 1121275 - DNA, 22 bp, Artificial Sequence
  chemically synthesized
tctggtttataatactttcatt

SEQ ID NO: 1121276 - DNA, 22 bp, Artificial Sequence
  chemically synthesized
ctggtttataatactttcattg

SEQ ID NO: 1121277 - DNA, 22 bp, Artificial Sequence
  chemically synthesized
tggtttataatactttcattga

SEQ ID NO: 1121278 - DNA, 22 bp, Artificial Sequence
  chemically synthesized
gtttataatactttcattgata

SEQ ID NO: 1121279 - DNA, 22 bp, Artificial Sequence
  chemically synthesized
aaatcatgggctatatcaatga

SEQ ID NO: 1121280 - DNA, 22 bp, Artificial Sequence
  chemically synthesized
ataatactttcattgatatagc

SEQ ID NO: 1121281 - DNA, 22 bp, Artificial Sequence
  chemically synthesized
ttgaaatcatgggctatatcaa

SEQ ID NO: 1121282 - DNA, 22 bp, Artificial Sequence
  chemically synthesized
taatactttcattgatatagcc

SEQ ID NO: 1121283 - DNA, 22 bp, Artificial Sequence
  chemically synthesized
attgaaatcatgggctatatca

SEQ ID NO: 1121284 - DNA, 22 bp, Artificial Sequence
  chemically synthesized
tcattgatatagcccatgattt

SEQ ID NO: 1121285 - DNA, 22 bp, Artificial Sequence
  chemically synthesized
cattgatatagcccatgatttc

SEQ ID NO: 1121286 - DNA, 22 bp, Artificial Sequence
  chemically synthesized
attgatatagcccatgatttca

SEQ ID NO: 1121287 - DNA, 22 bp, Artificial Sequence
  chemically synthesized
atatagcccatgatttcaataa

SEQ ID NO: 1121288 - DNA, 22 bp, Artificial Sequence
  chemically synthesized
aagtgaaaatatttattgaaat

SEQ ID NO: 1121289 - DNA, 22 bp, Artificial Sequence
  chemically synthesized
atattgaagtgaaaatatttat

SEQ ID NO: 1121290 - DNA, 22 bp, Artificial Sequence
  chemically synthesized
aaagtctaatattgaagtgaaa

SEQ ID NO: 1121291 - DNA, 22 bp, Artificial Sequence
  chemically synthesized
caataaatattttcacttcaat

SEQ ID NO: 1121292 - DNA, 22 bp, Artificial Sequence
  chemically synthesized
aataaatattttcacttcaata

SEQ ID NO: 1121293 - DNA, 22 bp, Artificial Sequence
  chemically synthesized
caatgtgagttgaaagtctaat

SEQ ID NO: 1121294 - DNA, 22 bp, Artificial Sequence
  chemically synthesized
tcacttcaatattagactttca

SEQ ID NO: 1121295 - DNA, 22 bp, Artificial Sequence
  chemically synthesized
cacttcaatattagactttcaa

SEQ ID NO: 1121296 - DNA, 22 bp, Artificial Sequence
  chemically synthesized
acttcaatattagactttcaac

SEQ ID NO: 1121297 - DNA, 22 bp, Artificial Sequence
  chemically synthesized
aattgcaatgtgagttgaaagt

SEQ ID NO: 1121298 - DNA, 22 bp, Artificial Sequence
  chemically synthesized
caatattagactttcaactcac

SEQ ID NO: 1121299 - DNA, 22 bp, Artificial Sequence
  chemically synthesized
aatattagactttcaactcaca

SEQ ID NO: 1121300 - DNA, 22 bp, Artificial Sequence
  chemically synthesized
agtcaattgaattgcaatgtga

SEQ ID NO: 1121301 - DNA, 22 bp, Artificial Sequence
  chemically synthesized
aagtcaattgaattgcaatgtg

SEQ ID NO: 1121302 - DNA, 22 bp, Artificial Sequence
  chemically synthesized
gactttcaactcacattgcaat

SEQ ID NO: 1121303 - DNA, 22 bp, Artificial Sequence
  chemically synthesized
taagtcaattgaattgcaatgt

SEQ ID NO: 1121304 - DNA, 22 bp, Artificial Sequence
  chemically synthesized
tcaactcacattgcaattcaat

SEQ ID NO: 1121305 - DNA, 22 bp, Artificial Sequence
  chemically synthesized
caactcacattgcaattcaatt

SEQ ID NO: 1121306 - DNA, 22 bp, Artificial Sequence
  chemically synthesized
aactcacattgcaattcaattg

SEQ ID NO: 1121307 - DNA, 22 bp, Artificial Sequence
  chemically synthesized
gaagttttaagtcaattgaatt

SEQ ID NO: 1121308 - DNA, 22 bp, Artificial Sequence
  chemically synthesized
ctagaagttttaagtcaattga

SEQ ID NO: 1121309 - DNA, 22 bp, Artificial Sequence
  chemically synthesized
acattgcaattcaattgactta

SEQ ID NO: 1121310 - DNA, 22 bp, Artificial Sequence
  chemically synthesized
caattcaattgacttaaaactt

SEQ ID NO: 1121311 - DNA, 22 bp, Artificial Sequence
  chemically synthesized
tgtgaaaaaattcctagaagtt

SEQ ID NO: 1121312 - DNA, 22 bp, Artificial Sequence
  chemically synthesized
aattgacttaaaacttctagga

SEQ ID NO: 1121313 - DNA, 22 bp, Artificial Sequence
  chemically synthesized
atgtgaaaaaattcctagaagt

SEQ ID NO: 1121314 - DNA, 22 bp, Artificial Sequence
  chemically synthesized
acttaaaacttctaggaatttt

SEQ ID NO: 1121315 - DNA, 22 bp, Artificial Sequence
  chemically synthesized
aaaacttctaggaattttttca

SEQ ID NO: 1121316 - DNA, 22 bp, Artificial Sequence
  chemically synthesized
aaacttctaggaattttttcac

SEQ ID NO: 1121317 - DNA, 22 bp, Artificial Sequence
  chemically synthesized
atgatagtttatgtgaaaaaat

SEQ ID NO: 1121318 - DNA, 22 bp, Artificial Sequence
  chemically synthesized
aatgatagtttatgtgaaaaaa

SEQ ID NO: 1121319 - DNA, 22 bp, Artificial Sequence
  chemically synthesized
gtttaatgatagtttatgtgaa

SEQ ID NO: 1121320 - DNA, 22 bp, Artificial Sequence
  chemically synthesized
ctaggaattttttcacataaac

SEQ ID NO: 1121321 - DNA, 22 bp, Artificial Sequence
  chemically synthesized
taggaattttttcacataaact

SEQ ID NO: 1121322 - DNA, 22 bp, Artificial Sequence
  chemically synthesized
ggaattttttcacataaactat

SEQ ID NO: 1121323 - DNA, 22 bp, Artificial Sequence
  chemically synthesized
tttcacataaactatcattaaa

SEQ ID NO: 1121324 - DNA, 22 bp, Artificial Sequence
  chemically synthesized
tgatataactggtttaatgata

SEQ ID NO: 1121325 - DNA, 22 bp, Artificial Sequence
  chemically synthesized
ttcacataaactatcattaaac

SEQ ID NO: 1121326 - DNA, 22 bp, Artificial Sequence
  chemically synthesized
tcacataaactatcattaaacc

SEQ ID NO: 1121327 - DNA, 22 bp, Artificial Sequence
  chemically synthesized
cacataaactatcattaaacca

SEQ ID NO: 1121328 - DNA, 22 bp, Artificial Sequence
  chemically synthesized
acataaactatcattaaaccag

SEQ ID NO: 1121329 - DNA, 22 bp, Artificial Sequence
  chemically synthesized
ggttgtgatataactggtttaa

SEQ ID NO: 1121330 - DNA, 22 bp, Artificial Sequence
  chemically synthesized
tcattaaaccagttatatcaca

SEQ ID NO: 1121331 - DNA, 22 bp, Artificial Sequence
  chemically synthesized
tgatagtaattaggttgtgata

SEQ ID NO: 1121332 - DNA, 22 bp, Artificial Sequence
  chemically synthesized
gtgatagtaattaggttgtgat

SEQ ID NO: 1121333 - DNA, 22 bp, Artificial Sequence
  chemically synthesized
aaccagttatatcacaacctaa

SEQ ID NO: 1121334 - DNA, 22 bp, Artificial Sequence
  chemically synthesized
tatcacaacctaattactatca

SEQ ID NO: 1121335 - DNA, 22 bp, Artificial Sequence
  chemically synthesized
aatagatcaggtcatatgtttg

SEQ ID NO: 1121336 - DNA, 22 bp, Artificial Sequence
  chemically synthesized
attactatcacaaacatatgac

SEQ ID NO: 1121337 - DNA, 22 bp, Artificial Sequence
  chemically synthesized
ctatcacaaacatatgacctga

SEQ ID NO: 1121338 - DNA, 22 bp, Artificial Sequence
  chemically synthesized
gagttcaatagatcaggtcata

SEQ ID NO: 1121339 - DNA, 22 bp, Artificial Sequence
  chemically synthesized
tcacaaacatatgacctgatct

SEQ ID NO: 1121340 - DNA, 22 bp, Artificial Sequence
  chemically synthesized
aaagtcccaaaactggagttca

SEQ ID NO: 1121341 - DNA, 22 bp, Artificial Sequence
  chemically synthesized
atctattgaactccagttttgg

SEQ ID NO: 1121342 - DNA, 22 bp, Artificial Sequence
  chemically synthesized
tatgattcaaagtcccaaaact

SEQ ID NO: 1121343 - DNA, 22 bp, Artificial Sequence
  chemically synthesized
atatgattcaaagtcccaaaac

SEQ ID NO: 1121344 - DNA, 22 bp, Artificial Sequence
  chemically synthesized
ttgaactccagttttgggactt

SEQ ID NO: 1121345 - DNA, 22 bp, Artificial Sequence
  chemically synthesized
gtttatatgattcaaagtccca

SEQ ID NO: 1121346 - DNA, 22 bp, Artificial Sequence
  chemically synthesized
aactccagttttgggactttga

SEQ ID NO: 1121347 - DNA, 22 bp, Artificial Sequence
  chemically synthesized
actggtttatatgattcaaagt

SEQ ID NO: 1121348 - DNA, 22 bp, Artificial Sequence
  chemically synthesized
cagttttgggactttgaatcat

SEQ ID NO: 1121349 - DNA, 22 bp, Artificial Sequence
  chemically synthesized
taactggtttatatgattcaaa

SEQ ID NO: 1121350 - DNA, 22 bp, Artificial Sequence
  chemically synthesized
tgggactttgaatcatataaac

SEQ ID NO: 1121351 - DNA, 22 bp, Artificial Sequence
  chemically synthesized
gggactttgaatcatataaacc

SEQ ID NO: 1121352 - DNA, 22 bp, Artificial Sequence
  chemically synthesized
ggactttgaatcatataaacca

SEQ ID NO: 1121353 - DNA, 22 bp, Artificial Sequence
  chemically synthesized
tgaatcatataaaccagttaga

SEQ ID NO: 1121354 - DNA, 22 bp, Artificial Sequence
  chemically synthesized
gaatcatataaaccagttagaa

SEQ ID NO: 1121355 - DNA, 22 bp, Artificial Sequence
  chemically synthesized
aatcatataaaccagttagaat

SEQ ID NO: 1121356 - DNA, 22 bp, Artificial Sequence
  chemically synthesized
caacaaatgtgagaaattctaa

SEQ ID NO: 1121357 - DNA, 22 bp, Artificial Sequence
  chemically synthesized
aacaatagcctgcaacaaatgt

SEQ ID NO: 1121358 - DNA, 22 bp, Artificial Sequence
  chemically synthesized
aaacaatagcctgcaacaaatg

SEQ ID NO: 1121359 - DNA, 22 bp, Artificial Sequence
  chemically synthesized
taaacaatagcctgcaacaaat

SEQ ID NO: 1121360 - DNA, 22 bp, Artificial Sequence
  chemically synthesized
gaatttctcacatttgttgcag

SEQ ID NO: 1121361 - DNA, 22 bp, Artificial Sequence
  chemically synthesized
ttaaacaatagcctgcaacaaa

SEQ ID NO: 1121362 - DNA, 22 bp, Artificial Sequence
  chemically synthesized
atttttaaacaatagcctgcaa

SEQ ID NO: 1121363 - DNA, 22 bp, Artificial Sequence
  chemically synthesized
aatttttaaacaatagcctgca

SEQ ID NO: 1121364 - DNA, 22 bp, Artificial Sequence
  chemically synthesized
ctcacatttgttgcaggctatt

SEQ ID NO: 1121365 - DNA, 22 bp, Artificial Sequence
  chemically synthesized
tcacatttgttgcaggctattg

SEQ ID NO: 1121366 - DNA, 22 bp, Artificial Sequence
  chemically synthesized
tttaatttttaaacaatagcct

SEQ ID NO: 1121367 - DNA, 22 bp, Artificial Sequence
  chemically synthesized
acatttgttgcaggctattgtt

SEQ ID NO: 1121368 - DNA, 22 bp, Artificial Sequence
  chemically synthesized
tatctgtttaatttttaaacaa

SEQ ID NO: 1121369 - DNA, 22 bp, Artificial Sequence
  chemically synthesized
gttgcaggctattgtttaaaaa

SEQ ID NO: 1121370 - DNA, 22 bp, Artificial Sequence
  chemically synthesized
ttgcaggctattgtttaaaaat

SEQ ID NO: 1121371 - DNA, 22 bp, Artificial Sequence
  chemically synthesized
tgtatctgtttaatttttaaac

SEQ ID NO: 1121372 - DNA, 22 bp, Artificial Sequence
  chemically synthesized
ctgtatctgtttaatttttaaa

SEQ ID NO: 1121373 - DNA, 22 bp, Artificial Sequence
  chemically synthesized
caggctattgtttaaaaattaa

SEQ ID NO: 1121374 - DNA, 22 bp, Artificial Sequence
  chemically synthesized
atttctgtatctgtttaatttt

SEQ ID NO: 1121375 - DNA, 22 bp, Artificial Sequence
  chemically synthesized
ttgtttaaaaattaaacagata

SEQ ID NO: 1121376 - DNA, 22 bp, Artificial Sequence
  chemically synthesized
cattaatttctgtatctgttta

SEQ ID NO: 1121377 - DNA, 22 bp, Artificial Sequence
  chemically synthesized
tttaaaaattaaacagatacag

SEQ ID NO: 1121378 - DNA, 22 bp, Artificial Sequence
  chemically synthesized
tgttccattaatttctgtatct

SEQ ID NO: 1121379 - DNA, 22 bp, Artificial Sequence
  chemically synthesized
aaaaattaaacagatacagaaa

SEQ ID NO: 1121380 - DNA, 22 bp, Artificial Sequence
  chemically synthesized
gtgttccattaatttctgtatc

SEQ ID NO: 1121381 - DNA, 22 bp, Artificial Sequence
  chemically synthesized
aaaattaaacagatacagaaat

SEQ ID NO: 1121382 - DNA, 22 bp, Artificial Sequence
  chemically synthesized
tgtgttccattaatttctgtat

SEQ ID NO: 1121383 - DNA, 22 bp, Artificial Sequence
  chemically synthesized
aacagatacagaaattaatgga

SEQ ID NO: 1121384 - DNA, 22 bp, Artificial Sequence
  chemically synthesized
agggctttgtgttccattaatt

SEQ ID NO: 1121385 - DNA, 22 bp, Artificial Sequence
  chemically synthesized
taagggctttgtgttccattaa

SEQ ID NO: 1121386 - DNA, 22 bp, Artificial Sequence
  chemically synthesized
ctaagggctttgtgttccatta

SEQ ID NO: 1121387 - DNA, 22 bp, Artificial Sequence
  chemically synthesized
tctaagggctttgtgttccatt

SEQ ID NO: 1121388 - DNA, 22 bp, Artificial Sequence
  chemically synthesized
ttctaagggctttgtgttccat

SEQ ID NO: 1121389 - DNA, 22 bp, Artificial Sequence
  chemically synthesized
atggaacacaaagcccttagaa

SEQ ID NO: 1121390 - DNA, 22 bp, Artificial Sequence
  chemically synthesized
tgagaatataaaatgcgaatat

SEQ ID NO: 1121391 - DNA, 22 bp, Artificial Sequence
  chemically synthesized
gtgagaatataaaatgcgaata

SEQ ID NO: 1121392 - DNA, 22 bp, Artificial Sequence
  chemically synthesized
tgtgagaatataaaatgcgaat

SEQ ID NO: 1121393 - DNA, 22 bp, Artificial Sequence
  chemically synthesized
agaaaaacatattcgcatttta

SEQ ID NO: 1121394 - DNA, 22 bp, Artificial Sequence
  chemically synthesized
gaaaaacatattcgcattttat

SEQ ID NO: 1121395 - DNA, 22 bp, Artificial Sequence
  chemically synthesized
accaaagaattttgtgagaata

SEQ ID NO: 1121396 - DNA, 22 bp, Artificial Sequence
  chemically synthesized
gcattttatattctcacaaaat

SEQ ID NO: 1121397 - DNA, 22 bp, Artificial Sequence
  chemically synthesized
tatattctcacaaaattctttg

SEQ ID NO: 1121398 - DNA, 22 bp, Artificial Sequence
  chemically synthesized
gtgatacctaaccaaagaattt

SEQ ID NO: 1121399 - DNA, 22 bp, Artificial Sequence
  chemically synthesized
atattctcacaaaattctttgg

SEQ ID NO: 1121400 - DNA, 22 bp, Artificial Sequence
  chemically synthesized
tattctcacaaaattctttggt

SEQ ID NO: 1121401 - DNA, 22 bp, Artificial Sequence
  chemically synthesized
gaattggtgatacctaaccaaa

SEQ ID NO: 1121402 - DNA, 22 bp, Artificial Sequence
  chemically synthesized
tcacaaaattctttggttaggt

SEQ ID NO: 1121403 - DNA, 22 bp, Artificial Sequence
  chemically synthesized
acaaaattctttggttaggtat

SEQ ID NO: 1121404 - DNA, 22 bp, Artificial Sequence
  chemically synthesized
tgggcagctggaattggtgata

SEQ ID NO: 1121405 - DNA, 22 bp, Artificial Sequence
  chemically synthesized
tttggttaggtatcaccaattc

SEQ ID NO: 1121406 - DNA, 22 bp, Artificial Sequence
  chemically synthesized
tggttaggtatcaccaattcca

SEQ ID NO: 1121407 - DNA, 22 bp, Artificial Sequence
  chemically synthesized
ggttaggtatcaccaattccag

SEQ ID NO: 1121408 - DNA, 22 bp, Artificial Sequence
  chemically synthesized
gttaggtatcaccaattccagc

SEQ ID NO: 1121409 - DNA, 22 bp, Artificial Sequence
  chemically synthesized
atcctatgggcagctggaattg

SEQ ID NO: 1121410 - DNA, 22 bp, Artificial Sequence
  chemically synthesized
ggtatcaccaattccagctgcc

SEQ ID NO: 1121411 - DNA, 22 bp, Artificial Sequence
  chemically synthesized
catctcatcctatgggcagctg

SEQ ID NO: 1121412 - DNA, 22 bp, Artificial Sequence
  chemically synthesized
aagctccatctcatcctatggg

SEQ ID NO: 1121413 - DNA, 22 bp, Artificial Sequence
  chemically synthesized
tgaagctccatctcatcctatg

SEQ ID NO: 1121414 - DNA, 22 bp, Artificial Sequence
  chemically synthesized
tctgaagctccatctcatccta

SEQ ID NO: 1121415 - DNA, 22 bp, Artificial Sequence
  chemically synthesized
ctctgaagctccatctcatcct

SEQ ID NO: 1121416 - DNA, 22 bp, Artificial Sequence
  chemically synthesized
cagctgcccataggatgagatg

SEQ ID NO: 1121417 - DNA, 22 bp, Artificial Sequence
  chemically synthesized
atttctctgaagctccatctca

SEQ ID NO: 1121418 - DNA, 22 bp, Artificial Sequence
  chemically synthesized
aatttctctgaagctccatctc

SEQ ID NO: 1121419 - DNA, 22 bp, Artificial Sequence
  chemically synthesized
cccataggatgagatggagctt

SEQ ID NO: 1121420 - DNA, 22 bp, Artificial Sequence
  chemically synthesized
acttaatttctctgaagctcca

SEQ ID NO: 1121421 - DNA, 22 bp, Artificial Sequence
  chemically synthesized
aggtcaattaacttaatttctc

SEQ ID NO: 1121422 - DNA, 22 bp, Artificial Sequence
  chemically synthesized
cagagaaattaagttaattgac

SEQ ID NO: 1121423 - DNA, 22 bp, Artificial Sequence
  chemically synthesized
agagaaattaagttaattgacc

SEQ ID NO: 1121424 - DNA, 22 bp, Artificial Sequence
  chemically synthesized
acccatggtattgaggtcaatt

SEQ ID NO: 1121425 - DNA, 22 bp, Artificial Sequence
  chemically synthesized
tgacccatggtattgaggtcaa

SEQ ID NO: 1121426 - DNA, 22 bp, Artificial Sequence
  chemically synthesized
ctgacccatggtattgaggtca

SEQ ID NO: 1121427 - DNA, 22 bp, Artificial Sequence
  chemically synthesized
agttaattgacctcaataccat

SEQ ID NO: 1121428 - DNA, 22 bp, Artificial Sequence
  chemically synthesized
attgacctcaataccatgggtc

SEQ ID NO: 1121429 - DNA, 22 bp, Artificial Sequence
  chemically synthesized
acctcaataccatgggtcagaa

SEQ ID NO: 1121430 - DNA, 22 bp, Artificial Sequence
  chemically synthesized
tgaaccgtcaagtttctgaccc

SEQ ID NO: 1121431 - DNA, 22 bp, Artificial Sequence
  chemically synthesized
aataccatgggtcagaaacttg

SEQ ID NO: 1121432 - DNA, 22 bp, Artificial Sequence
  chemically synthesized
tatgctatgaaccgtcaagttt

SEQ ID NO: 1121433 - DNA, 22 bp, Artificial Sequence
  chemically synthesized
aatctgtatgctatgaaccgtc

SEQ ID NO: 1121434 - DNA, 22 bp, Artificial Sequence
  chemically synthesized
gacggttcatagcatacagatt

SEQ ID NO: 1121435 - DNA, 22 bp, Artificial Sequence
  chemically synthesized
acggttcatagcatacagattg

SEQ ID NO: 1121436 - DNA, 22 bp, Artificial Sequence
  chemically synthesized
gataaataacaactcaatctgt

SEQ ID NO: 1121437 - DNA, 22 bp, Artificial Sequence
  chemically synthesized
atagcatacagattgagttgtt

SEQ ID NO: 1121438 - DNA, 22 bp, Artificial Sequence
  chemically synthesized
gatagcctcgataaataacaac

SEQ ID NO: 1121439 - DNA, 22 bp, Artificial Sequence
  chemically synthesized
aagttggatagcctcgataaat

SEQ ID NO: 1121440 - DNA, 22 bp, Artificial Sequence
  chemically synthesized
caagttggatagcctcgataaa

SEQ ID NO: 1121441 - DNA, 22 bp, Artificial Sequence
  chemically synthesized
agttgttatttatcgaggctat

SEQ ID NO: 1121442 - DNA, 22 bp, Artificial Sequence
  chemically synthesized
atttcaagttggatagcctcga

SEQ ID NO: 1121443 - DNA, 22 bp, Artificial Sequence
  chemically synthesized
aatttcaagttggatagcctcg

SEQ ID NO: 1121444 - DNA, 22 bp, Artificial Sequence
  chemically synthesized
ttaatttcaagttggatagcct

SEQ ID NO: 1121445 - DNA, 22 bp, Artificial Sequence
  chemically synthesized
ttatttatcgaggctatccaac

SEQ ID NO: 1121446 - DNA, 22 bp, Artificial Sequence
  chemically synthesized
tttatcgaggctatccaacttg

SEQ ID NO: 1121447 - DNA, 22 bp, Artificial Sequence
  chemically synthesized
gtctcttaatttcaagttggat

SEQ ID NO: 1121448 - DNA, 22 bp, Artificial Sequence
  chemically synthesized
atcgaggctatccaacttgaaa

SEQ ID NO: 1121449 - DNA, 22 bp, Artificial Sequence
  chemically synthesized
tcgaggctatccaacttgaaat

SEQ ID NO: 1121450 - DNA, 22 bp, Artificial Sequence
  chemically synthesized
tccaacttgaaattaagagact

SEQ ID NO: 1121451 - DNA, 22 bp, Artificial Sequence
  chemically synthesized
gaggaatcaggatccctagtct

SEQ ID NO: 1121452 - DNA, 22 bp, Artificial Sequence
  chemically synthesized
agaggaatcaggatccctagtc

SEQ ID NO: 1121453 - DNA, 22 bp, Artificial Sequence
  chemically synthesized
gaaattaagagactagggatcc

SEQ ID NO: 1121454 - DNA, 22 bp, Artificial Sequence
  chemically synthesized
aaattaagagactagggatcct

SEQ ID NO: 1121455 - DNA, 22 bp, Artificial Sequence
  chemically synthesized
agagactagggatcctgattcc

SEQ ID NO: 1121456 - DNA, 22 bp, Artificial Sequence
  chemically synthesized
agtgacatgggatttagaggaa

SEQ ID NO: 1121457 - DNA, 22 bp, Artificial Sequence
  chemically synthesized
gggatcctgattcctctaaatc

SEQ ID NO: 1121458 - DNA, 22 bp, Artificial Sequence
  chemically synthesized
acattcagtgacatgggattta

SEQ ID NO: 1121459 - DNA, 22 bp, Artificial Sequence
  chemically synthesized
ctgacattcagtgacatgggat

SEQ ID NO: 1121460 - DNA, 22 bp, Artificial Sequence
  chemically synthesized
actgacattcagtgacatggga

SEQ ID NO: 1121461 - DNA, 22 bp, Artificial Sequence
  chemically synthesized
attcctctaaatcccatgtcac

SEQ ID NO: 1121462 - DNA, 22 bp, Artificial Sequence
  chemically synthesized
ctctaaatcccatgtcactgaa

SEQ ID NO: 1121463 - DNA, 22 bp, Artificial Sequence
  chemically synthesized
taaatcccatgtcactgaatgt

SEQ ID NO: 1121464 - DNA, 22 bp, Artificial Sequence
  chemically synthesized
aatcccatgtcactgaatgtca

SEQ ID NO: 1121465 - DNA, 22 bp, Artificial Sequence
  chemically synthesized
taatgcatacacagataactta

SEQ ID NO: 1121466 - DNA, 22 bp, Artificial Sequence
  chemically synthesized
gtaatgcatacacagataactt

SEQ ID NO: 1121467 - DNA, 22 bp, Artificial Sequence
  chemically synthesized
aatgtcagtaagttatctgtgt

SEQ ID NO: 1121468 - DNA, 22 bp, Artificial Sequence
  chemically synthesized
tctgtgtatgcattacaaatgt

SEQ ID NO: 1121469 - DNA, 22 bp, Artificial Sequence
  chemically synthesized
tgtatgcattacaaatgtttat

SEQ ID NO: 1121470 - DNA, 22 bp, Artificial Sequence
  chemically synthesized
caaatgtttatggatttttatt

SEQ ID NO: 1121471 - DNA, 22 bp, Artificial Sequence
  chemically synthesized
atggatttttattgtgtcatat

SEQ ID NO: 1121472 - DNA, 22 bp, Artificial Sequence
  chemically synthesized
tggatttttattgtgtcatata

SEQ ID NO: 1121473 - DNA, 22 bp, Artificial Sequence
  chemically synthesized
ttattgtgtcatatatgatttt

SEQ ID NO: 1121474 - DNA, 22 bp, Artificial Sequence
  chemically synthesized
tattgtgtcatatatgattttt

SEQ ID NO: 1121475 - DNA, 22 bp, Artificial Sequence
  chemically synthesized
attgtgtcatatatgattttta

SEQ ID NO: 1121476 - DNA, 22 bp, Artificial Sequence
  chemically synthesized
ttgtgtcatatatgatttttat

SEQ ID NO: 1121477 - DNA, 22 bp, Artificial Sequence
  chemically synthesized
tgtcatatatgatttttatctt

SEQ ID NO: 1121478 - DNA, 22 bp, Artificial Sequence
  chemically synthesized
tggataaaaaatgtaggaaaga

SEQ ID NO: 1121479 - DNA, 22 bp, Artificial Sequence
  chemically synthesized
gtggataaaaaatgtaggaaag

SEQ ID NO: 1121480 - DNA, 22 bp, Artificial Sequence
  chemically synthesized
ttatctttcctacattttttat

SEQ ID NO: 1121481 - DNA, 22 bp, Artificial Sequence
  chemically synthesized
tatctttcctacattttttatc

SEQ ID NO: 1121482 - DNA, 22 bp, Artificial Sequence
  chemically synthesized
atctttcctacattttttatcc

SEQ ID NO: 1121483 - DNA, 22 bp, Artificial Sequence
  chemically synthesized
tctttcctacattttttatcca

SEQ ID NO: 1121484 - DNA, 22 bp, Artificial Sequence
  chemically synthesized
atagtcaaacttgtggataaaa

SEQ ID NO: 1121485 - DNA, 22 bp, Artificial Sequence
  chemically synthesized
tcctacattttttatccacaag

SEQ ID NO: 1121486 - DNA, 22 bp, Artificial Sequence
  chemically synthesized
cctacattttttatccacaagt

SEQ ID NO: 1121487 - DNA, 22 bp, Artificial Sequence
  chemically synthesized
ctacattttttatccacaagtt

SEQ ID NO: 1121488 - DNA, 22 bp, Artificial Sequence
  chemically synthesized
cattttttatccacaagtttga

SEQ ID NO: 1121489 - DNA, 22 bp, Artificial Sequence
  chemically synthesized
tttatccacaagtttgactatc

SEQ ID NO: 1121490 - DNA, 22 bp, Artificial Sequence
  chemically synthesized
ttatccacaagtttgactatca

SEQ ID NO: 1121491 - DNA, 22 bp, Artificial Sequence
  chemically synthesized
tatccacaagtttgactatcag

SEQ ID NO: 1121492 - DNA, 22 bp, Artificial Sequence
  chemically synthesized
atccacaagtttgactatcagg

SEQ ID NO: 1121493 - DNA, 22 bp, Artificial Sequence
  chemically synthesized
tccacaagtttgactatcaggt

SEQ ID NO: 1121494 - DNA, 22 bp, Artificial Sequence
  chemically synthesized
tgaatgaagaaacaggaacctg

SEQ ID NO: 1121495 - DNA, 22 bp, Artificial Sequence
  chemically synthesized
gactatcaggttcctgtttctt

SEQ ID NO: 1121496 - DNA, 22 bp, Artificial Sequence
  chemically synthesized
actatcaggttcctgtttcttc

SEQ ID NO: 1121497 - DNA, 22 bp, Artificial Sequence
  chemically synthesized
atcaacattatgaatgaagaaa

SEQ ID NO: 1121498 - DNA, 22 bp, Artificial Sequence
  chemically synthesized
tcaggttcctgtttcttcattc

SEQ ID NO: 1121499 - DNA, 22 bp, Artificial Sequence
  chemically synthesized
aatcaacattatgaatgaagaa

SEQ ID NO: 1121500 - DNA, 22 bp, Artificial Sequence
  chemically synthesized
taatcaacattatgaatgaaga

SEQ ID NO: 1121501 - DNA, 22 bp, Artificial Sequence
  chemically synthesized
ctgtttcttcattcataatgtt

SEQ ID NO: 1121502 - DNA, 22 bp, Artificial Sequence
  chemically synthesized
tatattttaatcaacattatga

SEQ ID NO: 1121503 - DNA, 22 bp, Artificial Sequence
  chemically synthesized
tttcttcattcataatgttgat

SEQ ID NO: 1121504 - DNA, 22 bp, Artificial Sequence
  chemically synthesized
tactgtatattttaatcaacat

SEQ ID NO: 1121505 - DNA, 22 bp, Artificial Sequence
  chemically synthesized
cttcattcataatgttgattaa

SEQ ID NO: 1121506 - DNA, 22 bp, Artificial Sequence
  chemically synthesized
ttcattcataatgttgattaaa

SEQ ID NO: 1121507 - DNA, 22 bp, Artificial Sequence
  chemically synthesized
cattcataatgttgattaaaat

SEQ ID NO: 1121508 - DNA, 22 bp, Artificial Sequence
  chemically synthesized
attcataatgttgattaaaata

SEQ ID NO: 1121509 - DNA, 22 bp, Artificial Sequence
  chemically synthesized
ataatgttgattaaaatataca

SEQ ID NO: 1121510 - DNA, 22 bp, Artificial Sequence
  chemically synthesized
cagcatataattgtactgtata

SEQ ID NO: 1121511 - DNA, 22 bp, Artificial Sequence
  chemically synthesized
acagcatataattgtactgtat

SEQ ID NO: 1121512 - DNA, 22 bp, Artificial Sequence
  chemically synthesized
tacagcatataattgtactgta

SEQ ID NO: 1121513 - DNA, 22 bp, Artificial Sequence
  chemically synthesized
ttacagcatataattgtactgt

SEQ ID NO: 1121514 - DNA, 22 bp, Artificial Sequence
  chemically synthesized
attaaaatatacagtacaatta

SEQ ID NO: 1121515 - DNA, 22 bp, Artificial Sequence
  chemically synthesized
aaatatacagtacaattatatg

SEQ ID NO: 1121516 - DNA, 22 bp, Artificial Sequence
  chemically synthesized
aagagagtgtgaaagattttta

SEQ ID NO: 1121517 - DNA, 22 bp, Artificial Sequence
  chemically synthesized
tatgctgtaaaaatctttcaca

SEQ ID NO: 1121518 - DNA, 22 bp, Artificial Sequence
  chemically synthesized
acatcgctgaagagagtgtgaa

SEQ ID NO: 1121519 - DNA, 22 bp, Artificial Sequence
  chemically synthesized
taaaaatctttcacactctctt

SEQ ID NO: 1121520 - DNA, 22 bp, Artificial Sequence
  chemically synthesized
aggagttaacatcgctgaagag

SEQ ID NO: 1121521 - DNA, 22 bp, Artificial Sequence
  chemically synthesized
aaggagttaacatcgctgaaga

SEQ ID NO: 1121522 - DNA, 22 bp, Artificial Sequence
  chemically synthesized
tcacactctcttcagcgatgtt

SEQ ID NO: 1121523 - DNA, 22 bp, Artificial Sequence
  chemically synthesized
cacactctcttcagcgatgtta

SEQ ID NO: 1121524 - DNA, 22 bp, Artificial Sequence
  chemically synthesized
acactctcttcagcgatgttaa

SEQ ID NO: 1121525 - DNA, 22 bp, Artificial Sequence
  chemically synthesized
tcttcagcgatgttaactcctt

SEQ ID NO: 1121526 - DNA, 22 bp, Artificial Sequence
  chemically synthesized
ttcagcgatgttaactccttaa

SEQ ID NO: 1121527 - DNA, 22 bp, Artificial Sequence
  chemically synthesized
cagcgatgttaactccttaaat

SEQ ID NO: 1121528 - DNA, 22 bp, Artificial Sequence
  chemically synthesized
agcgatgttaactccttaaata

SEQ ID NO: 1121529 - DNA, 22 bp, Artificial Sequence
  chemically synthesized
actccttaaatactctcctact

SEQ ID NO: 1121530 - DNA, 22 bp, Artificial Sequence
  chemically synthesized
cttaaatactctcctactatgg

SEQ ID NO: 1121531 - DNA, 22 bp, Artificial Sequence
  chemically synthesized
aaatactctcctactatggtta

SEQ ID NO: 1121532 - DNA, 22 bp, Artificial Sequence
  chemically synthesized
aatactctcctactatggttat

SEQ ID NO: 1121533 - DNA, 22 bp, Artificial Sequence
  chemically synthesized
ggtaggtaatcaaataaccata

SEQ ID NO: 1121534 - DNA, 22 bp, Artificial Sequence
  chemically synthesized
gggtaggtaatcaaataaccat

SEQ ID NO: 1121535 - DNA, 22 bp, Artificial Sequence
  chemically synthesized
gtttgggtaggtaatcaaataa

SEQ ID NO: 1121536 - DNA, 22 bp, Artificial Sequence
  chemically synthesized
tcctactatggttatttgatta

SEQ ID NO: 1121537 - DNA, 22 bp, Artificial Sequence
  chemically synthesized
ctactatggttatttgattacc

SEQ ID NO: 1121538 - DNA, 22 bp, Artificial Sequence
  chemically synthesized
actggtttgggtaggtaatcaa

SEQ ID NO: 1121539 - DNA, 22 bp, Artificial Sequence
  chemically synthesized
ctatggttatttgattacctac

SEQ ID NO: 1121540 - DNA, 22 bp, Artificial Sequence
  chemically synthesized
tggttatttgattacctaccca

SEQ ID NO: 1121541 - DNA, 22 bp, Artificial Sequence
  chemically synthesized
tttgattacctacccaaaccag

SEQ ID NO: 1121542 - DNA, 22 bp, Artificial Sequence
  chemically synthesized
aaatataattcactggtttggg

SEQ ID NO: 1121543 - DNA, 22 bp, Artificial Sequence
  chemically synthesized
gattacctacccaaaccagtga

SEQ ID NO: 1121544 - DNA, 22 bp, Artificial Sequence
  chemically synthesized
attacctacccaaaccagtgaa

SEQ ID NO: 1121545 - DNA, 22 bp, Artificial Sequence
  chemically synthesized
cctacccaaaccagtgaattat

SEQ ID NO: 1121546 - DNA, 22 bp, Artificial Sequence
  chemically synthesized
cccaaaccagtgaattatattt

SEQ ID NO: 1121547 - DNA, 22 bp, Artificial Sequence
  chemically synthesized
tatttcaatcatcttttatgca

SEQ ID NO: 1121548 - DNA, 22 bp, Artificial Sequence
  chemically synthesized
tgatgataaatatgcataaaag

SEQ ID NO: 1121549 - DNA, 22 bp, Artificial Sequence
  chemically synthesized
caatcatcttttatgcatattt

SEQ ID NO: 1121550 - DNA, 22 bp, Artificial Sequence
  chemically synthesized
aatcatcttttatgcatattta

SEQ ID NO: 1121551 - DNA, 22 bp, Artificial Sequence
  chemically synthesized
agacattatgatgataaatatg

SEQ ID NO: 1121552 - DNA, 22 bp, Artificial Sequence
  chemically synthesized
aagacattatgatgataaatat

SEQ ID NO: 1121553 - DNA, 22 bp, Artificial Sequence
  chemically synthesized
taagacattatgatgataaata

SEQ ID NO: 1121554 - DNA, 22 bp, Artificial Sequence
  chemically synthesized
ttatgcatatttatcatcataa

SEQ ID NO: 1121555 - DNA, 22 bp, Artificial Sequence
  chemically synthesized
tatgcatatttatcatcataat

SEQ ID NO: 1121556 - DNA, 22 bp, Artificial Sequence
  chemically synthesized
atgcatatttatcatcataatg

SEQ ID NO: 1121557 - DNA, 22 bp, Artificial Sequence
  chemically synthesized
tgcatatttatcatcataatgt

SEQ ID NO: 1121558 - DNA, 22 bp, Artificial Sequence
  chemically synthesized
atcatcataatgtcttaaaaca

SEQ ID NO: 1121559 - DNA, 22 bp, Artificial Sequence
  chemically synthesized
tcatcataatgtcttaaaacat

SEQ ID NO: 1121560 - DNA, 22 bp, Artificial Sequence
  chemically synthesized
ggccaaagcaaaaataaaaatg

SEQ ID NO: 1121561 - DNA, 22 bp, Artificial Sequence
  chemically synthesized
tgttgggccaaagcaaaaataa

SEQ ID NO: 1121562 - DNA, 22 bp, Artificial Sequence
  chemically synthesized
atgttgggccaaagcaaaaata

SEQ ID NO: 1121563 - DNA, 22 bp, Artificial Sequence
  chemically synthesized
tatgttgggccaaagcaaaaat

SEQ ID NO: 1121564 - DNA, 22 bp, Artificial Sequence
  chemically synthesized
aaaacatttttatttttgcttt

SEQ ID NO: 1121565 - DNA, 22 bp, Artificial Sequence
  chemically synthesized
aaacatttttatttttgctttg

SEQ ID NO: 1121566 - DNA, 22 bp, Artificial Sequence
  chemically synthesized
ttatttttgctttggcccaaca

SEQ ID NO: 1121567 - DNA, 22 bp, Artificial Sequence
  chemically synthesized
tatttttgctttggcccaacat

SEQ ID NO: 1121568 - DNA, 22 bp, Artificial Sequence
  chemically synthesized
atttttgctttggcccaacata

SEQ ID NO: 1121569 - DNA, 22 bp, Artificial Sequence
  chemically synthesized
tttttgctttggcccaacataa

SEQ ID NO: 1121570 - DNA, 22 bp, Artificial Sequence
  chemically synthesized
ttgctttggcccaacataaaat

SEQ ID NO: 1121571 - DNA, 22 bp, Artificial Sequence
  chemically synthesized
tgctttggcccaacataaaatt

SEQ ID NO: 1121572 - DNA, 22 bp, Artificial Sequence
  chemically synthesized
gctttggcccaacataaaattt

SEQ ID NO: 1121573 - DNA, 22 bp, Artificial Sequence
  chemically synthesized
ctttggcccaacataaaatttc

SEQ ID NO: 1121574 - DNA, 22 bp, Artificial Sequence
  chemically synthesized
tggcccaacataaaatttcctg

SEQ ID NO: 1121575 - DNA, 22 bp, Artificial Sequence
  chemically synthesized
ggcccaacataaaatttcctgt

SEQ ID NO: 1121576 - DNA, 22 bp, Artificial Sequence
  chemically synthesized
gcccaacataaaatttcctgtg

SEQ ID NO: 1121577 - DNA, 22 bp, Artificial Sequence
  chemically synthesized
cagatagagagacacaggaaat

SEQ ID NO: 1121578 - DNA, 22 bp, Artificial Sequence
  chemically synthesized
gcagatagagagacacaggaaa

SEQ ID NO: 1121579 - DNA, 22 bp, Artificial Sequence
  chemically synthesized
gcaaatagatgcttgcagatag

SEQ ID NO: 1121580 - DNA, 22 bp, Artificial Sequence
  chemically synthesized
cctgtgtctctctatctgcaag

SEQ ID NO: 1121581 - DNA, 22 bp, Artificial Sequence
  chemically synthesized
ctgtgtctctctatctgcaagc

SEQ ID NO: 1121582 - DNA, 22 bp, Artificial Sequence
  chemically synthesized
tgtctctctatctgcaagcatc

SEQ ID NO: 1121583 - DNA, 22 bp, Artificial Sequence
  chemically synthesized
tctatctgcaagcatctatttg

SEQ ID NO: 1121584 - DNA, 22 bp, Artificial Sequence
  chemically synthesized
tccaatatactggcaaatagat

SEQ ID NO: 1121585 - DNA, 22 bp, Artificial Sequence
  chemically synthesized
tatctgcaagcatctatttgcc

SEQ ID NO: 1121586 - DNA, 22 bp, Artificial Sequence
  chemically synthesized
tgtccaatatactggcaaatag

SEQ ID NO: 1121587 - DNA, 22 bp, Artificial Sequence
  chemically synthesized
tctgcaagcatctatttgccag

SEQ ID NO: 1121588 - DNA, 22 bp, Artificial Sequence
  chemically synthesized
tctgtccaatatactggcaaat

SEQ ID NO: 1121589 - DNA, 22 bp, Artificial Sequence
  chemically synthesized
ctctgtccaatatactggcaaa

SEQ ID NO: 1121590 - DNA, 22 bp, Artificial Sequence
  chemically synthesized
caagcatctatttgccagtata

SEQ ID NO: 1121591 - DNA, 22 bp, Artificial Sequence
  chemically synthesized
cttctctgtccaatatactggc

SEQ ID NO: 1121592 - DNA, 22 bp, Artificial Sequence
  chemically synthesized
cagcactccttctctgtccaat

SEQ ID NO: 1121593 - DNA, 22 bp, Artificial Sequence
  chemically synthesized
tttgccagtatattggacagag

SEQ ID NO: 1121594 - DNA, 22 bp, Artificial Sequence
  chemically synthesized
gccagtatattggacagagaag

SEQ ID NO: 1121595 - DNA, 22 bp, Artificial Sequence
  chemically synthesized
ccagtatattggacagagaagg

SEQ ID NO: 1121596 - DNA, 22 bp, Artificial Sequence
  chemically synthesized
acattccagcactccttctctg

SEQ ID NO: 1121597 - DNA, 22 bp, Artificial Sequence
  chemically synthesized
aagtattaacattccagcactc

SEQ ID NO: 1121598 - DNA, 22 bp, Artificial Sequence
  chemically synthesized
gacagagaaggagtgctggaat

SEQ ID NO: 1121599 - DNA, 22 bp, Artificial Sequence
  chemically synthesized
agggacacccctaaagtattaa

SEQ ID NO: 1121600 - DNA, 22 bp, Artificial Sequence
  chemically synthesized
gttaagggacacccctaaagta

SEQ ID NO: 1121601 - DNA, 22 bp, Artificial Sequence
  chemically synthesized
gaatgttaatactttaggggtg

SEQ ID NO: 1121602 - DNA, 22 bp, Artificial Sequence
  chemically synthesized
actggttaagggacacccctaa

SEQ ID NO: 1121603 - DNA, 22 bp, Artificial Sequence
  chemically synthesized
tcactggttaagggacacccct

SEQ ID NO: 1121604 - DNA, 22 bp, Artificial Sequence
  chemically synthesized
atactttaggggtgtcccttaa

SEQ ID NO: 1121605 - DNA, 22 bp, Artificial Sequence
  chemically synthesized
caagctctcactggttaaggga

SEQ ID NO: 1121606 - DNA, 22 bp, Artificial Sequence
  chemically synthesized
taggggtgtcccttaaccagtg

SEQ ID NO: 1121607 - DNA, 22 bp, Artificial Sequence
  chemically synthesized
aggggtgtcccttaaccagtga

SEQ ID NO: 1121608 - DNA, 22 bp, Artificial Sequence
  chemically synthesized
ggggtgtcccttaaccagtgag

SEQ ID NO: 1121609 - DNA, 22 bp, Artificial Sequence
  chemically synthesized
accaattccaagctctcactgg

SEQ ID NO: 1121610 - DNA, 22 bp, Artificial Sequence
  chemically synthesized
ggaaattcaccaattccaagct

SEQ ID NO: 1121611 - DNA, 22 bp, Artificial Sequence
  chemically synthesized
aaccagtgagagcttggaattg

SEQ ID NO: 1121612 - DNA, 22 bp, Artificial Sequence
  chemically synthesized
accagtgagagcttggaattgg

SEQ ID NO: 1121613 - DNA, 22 bp, Artificial Sequence
  chemically synthesized
aggggcaagggagctgggaaat

SEQ ID NO: 1121614 - DNA, 22 bp, Artificial Sequence
  chemically synthesized
ggaattggtgaatttcccagct

SEQ ID NO: 1121615 - DNA, 22 bp, Artificial Sequence
  chemically synthesized
gaattggtgaatttcccagctc

SEQ ID NO: 1121616 - DNA, 22 bp, Artificial Sequence
  chemically synthesized
gtgaatttcccagctcccttgc

SEQ ID NO: 1121617 - DNA, 22 bp, Artificial Sequence
  chemically synthesized
tccaactgaggggcaagggagc

SEQ ID NO: 1121618 - DNA, 22 bp, Artificial Sequence
  chemically synthesized
aggattgtccaactgaggggca

SEQ ID NO: 1121619 - DNA, 22 bp, Artificial Sequence
  chemically synthesized
cccagctcccttgcccctcagt

SEQ ID NO: 1121620 - DNA, 22 bp, Artificial Sequence
  chemically synthesized
caggattgtccaactgaggggc

SEQ ID NO: 1121621 - DNA, 22 bp, Artificial Sequence
  chemically synthesized
ccagctcccttgcccctcagtt

SEQ ID NO: 1121622 - DNA, 22 bp, Artificial Sequence
  chemically synthesized
ccttgcccctcagttggacaat

SEQ ID NO: 1121623 - DNA, 22 bp, Artificial Sequence
  chemically synthesized
gcccctcagttggacaatcctg

SEQ ID NO: 1121624 - DNA, 22 bp, Artificial Sequence
  chemically synthesized
tgtatcatacttcaggattgtc

SEQ ID NO: 1121625 - DNA, 22 bp, Artificial Sequence
  chemically synthesized
cccctcagttggacaatcctga

SEQ ID NO: 1121626 - DNA, 22 bp, Artificial Sequence
  chemically synthesized
agttggacaatcctgaagtatg

SEQ ID NO: 1121627 - DNA, 22 bp, Artificial Sequence
  chemically synthesized
agacactgtgtatcatacttca

SEQ ID NO: 1121628 - DNA, 22 bp, Artificial Sequence
  chemically synthesized
gagacactgtgtatcatacttc

SEQ ID NO: 1121629 - DNA, 22 bp, Artificial Sequence
  chemically synthesized
gacaatcctgaagtatgataca

SEQ ID NO: 1121630 - DNA, 22 bp, Artificial Sequence
  chemically synthesized
aagtatgatacacagtgtctca

SEQ ID NO: 1121631 - DNA, 22 bp, Artificial Sequence
  chemically synthesized
aatcatgcagggaaccccttga

SEQ ID NO: 1121632 - DNA, 22 bp, Artificial Sequence
  chemically synthesized
gggctcaatcatgcagggaacc

SEQ ID NO: 1121633 - DNA, 22 bp, Artificial Sequence
  chemically synthesized
aaggggttccctgcatgattga

SEQ ID NO: 1121634 - DNA, 22 bp, Artificial Sequence
  chemically synthesized
gaaggaactggggctcaatcat

SEQ ID NO: 1121635 - DNA, 22 bp, Artificial Sequence
  chemically synthesized
ctggaaggaactggggctcaat

SEQ ID NO: 1121636 - DNA, 22 bp, Artificial Sequence
  chemically synthesized
ctgctggaaggaactggggctc

SEQ ID NO: 1121637 - DNA, 22 bp, Artificial Sequence
  chemically synthesized
cctgcatgattgagccccagtt

SEQ ID NO: 1121638 - DNA, 22 bp, Artificial Sequence
  chemically synthesized
catgattgagccccagttcctt

SEQ ID NO: 1121639 - DNA, 22 bp, Artificial Sequence
  chemically synthesized
agccccagttccttccagcagt

SEQ ID NO: 1121640 - DNA, 22 bp, Artificial Sequence
  chemically synthesized
cttccagcagtaacctgatccc

SEQ ID NO: 1121641 - DNA, 22 bp, Artificial Sequence
  chemically synthesized
ccagcagtaacctgatccctat

SEQ ID NO: 1121642 - DNA, 22 bp, Artificial Sequence
  chemically synthesized
cagcagtaacctgatccctata

SEQ ID NO: 1121643 - DNA, 22 bp, Artificial Sequence
  chemically synthesized
atccctatatttgtgccatact

SEQ ID NO: 1121644 - DNA, 22 bp, Artificial Sequence
  chemically synthesized
tatttgtgccatactttattgg

SEQ ID NO: 1121645 - DNA, 22 bp, Artificial Sequence
  chemically synthesized
gtgccatactttattggctgct

SEQ ID NO: 1121646 - DNA, 22 bp, Artificial Sequence
  chemically synthesized
tgccatactttattggctgctt

SEQ ID NO: 1121647 - DNA, 22 bp, Artificial Sequence
  chemically synthesized
tattggctgctttatttttctt

SEQ ID NO: 1121648 - DNA, 22 bp, Artificial Sequence
  chemically synthesized
attggctgctttatttttctta

SEQ ID NO: 1121649 - DNA, 22 bp, Artificial Sequence
  chemically synthesized
ttggctgctttatttttcttat

SEQ ID NO: 1121650 - DNA, 22 bp, Artificial Sequence
  chemically synthesized
gctgctttatttttcttatttc

SEQ ID NO: 1121651 - DNA, 22 bp, Artificial Sequence
  chemically synthesized
ctttatttttcttatttcactt

SEQ ID NO: 1121652 - DNA, 22 bp, Artificial Sequence
  chemically synthesized
tatttttcttatttcacttccc

SEQ ID NO: 1121653 - DNA, 22 bp, Artificial Sequence
  chemically synthesized
atttttcttatttcacttccct

SEQ ID NO: 1121654 - DNA, 22 bp, Artificial Sequence
  chemically synthesized
tttttcttatttcacttcccta

SEQ ID NO: 1121655 - DNA, 22 bp, Artificial Sequence
  chemically synthesized
ttcttatttcacttccctactt

SEQ ID NO: 1121656 - DNA, 22 bp, Artificial Sequence
  chemically synthesized
tcttatttcacttccctacttt

SEQ ID NO: 1121657 - DNA, 22 bp, Artificial Sequence
  chemically synthesized
cttatttcacttccctactttg

SEQ ID NO: 1121658 - DNA, 22 bp, Artificial Sequence
  chemically synthesized
ttatttcacttccctactttgt

SEQ ID NO: 1121659 - DNA, 22 bp, Artificial Sequence
  chemically synthesized
atttcacttccctactttgttt

SEQ ID NO: 1121660 - DNA, 22 bp, Artificial Sequence
  chemically synthesized
tttcacttccctactttgtttc

SEQ ID NO: 1121661 - DNA, 22 bp, Artificial Sequence
  chemically synthesized
gaaagtgatcccaggaaacaaa

SEQ ID NO: 1121662 - DNA, 22 bp, Artificial Sequence
  chemically synthesized
cacttccctactttgtttcctg

SEQ ID NO: 1121663 - DNA, 22 bp, Artificial Sequence
  chemically synthesized
ggaaagtgatcccaggaaacaa

SEQ ID NO: 1121664 - DNA, 22 bp, Artificial Sequence
  chemically synthesized
acttccctactttgtttcctgg

SEQ ID NO: 1121665 - DNA, 22 bp, Artificial Sequence
  chemically synthesized
tttggaaagtgatcccaggaaa

SEQ ID NO: 1121666 - DNA, 22 bp, Artificial Sequence
  chemically synthesized
atttggaaagtgatcccaggaa

SEQ ID NO: 1121667 - DNA, 22 bp, Artificial Sequence
  chemically synthesized
ccctactttgtttcctgggatc

SEQ ID NO: 1121668 - DNA, 22 bp, Artificial Sequence
  chemically synthesized
cctactttgtttcctgggatca

SEQ ID NO: 1121669 - DNA, 22 bp, Artificial Sequence
  chemically synthesized
ctttgtttcctgggatcacttt

SEQ ID NO: 1121670 - DNA, 22 bp, Artificial Sequence
  chemically synthesized
tgtttcctgggatcactttcca

SEQ ID NO: 1121671 - DNA, 22 bp, Artificial Sequence
  chemically synthesized
gtttcctgggatcactttccaa

SEQ ID NO: 1121672 - DNA, 22 bp, Artificial Sequence
  chemically synthesized
tttcctgggatcactttccaaa

SEQ ID NO: 1121673 - DNA, 22 bp, Artificial Sequence
  chemically synthesized
cctgggatcactttccaaataa

SEQ ID NO: 1121674 - DNA, 22 bp, Artificial Sequence
  chemically synthesized
ggtgcaagcagtttatttggaa

SEQ ID NO: 1121675 - DNA, 22 bp, Artificial Sequence
  chemically synthesized
ctgggatcactttccaaataaa

SEQ ID NO: 1121676 - DNA, 22 bp, Artificial Sequence
  chemically synthesized
aggtgcaagcagtttatttgga

SEQ ID NO: 1121677 - DNA, 22 bp, Artificial Sequence
  chemically synthesized
ggatcactttccaaataaactg

SEQ ID NO: 1121678 - DNA, 22 bp, Artificial Sequence
  chemically synthesized
tccaaataaactgcttgcacct

SEQ ID NO: 1121679 - DNA, 22 bp, Artificial Sequence
  chemically synthesized
ccaaataaactgcttgcaccta

SEQ ID NO: 1121680 - DNA, 22 bp, Artificial Sequence
  chemically synthesized
aagagaaggatttaggtgcaag

SEQ ID NO: 1121681 - DNA, 22 bp, Artificial Sequence
  chemically synthesized
caaataaactgcttgcacctaa

SEQ ID NO: 1121682 - DNA, 22 bp, Artificial Sequence
  chemically synthesized
cttgcacctaaatccttctctt

SEQ ID NO: 1121683 - DNA, 22 bp, Artificial Sequence
  chemically synthesized
gcacctaaatccttctcttcag

SEQ ID NO: 1121684 - DNA, 22 bp, Artificial Sequence
  chemically synthesized
cacctaaatccttctcttcaga

SEQ ID NO: 1121685 - DNA, 22 bp, Artificial Sequence
  chemically synthesized
ccccaagagtagatctgaagag

SEQ ID NO: 1121686 - DNA, 22 bp, Artificial Sequence
  chemically synthesized
aatccttctcttcagatctact

SEQ ID NO: 1121687 - DNA, 22 bp, Artificial Sequence
  chemically synthesized
ggttgccccaagagtagatctg

SEQ ID NO: 1121688 - DNA, 22 bp, Artificial Sequence
  chemically synthesized
gggttgccccaagagtagatct

SEQ ID NO: 1121689 - DNA, 22 bp, Artificial Sequence
  chemically synthesized
gtttgggttgccccaagagtag

SEQ ID NO: 1121690 - DNA, 22 bp, Artificial Sequence
  chemically synthesized
agtttgggttgccccaagagta

SEQ ID NO: 1121691 - DNA, 22 bp, Artificial Sequence
  chemically synthesized
ctcttcagatctactcttgggg

SEQ ID NO: 1121692 - DNA, 22 bp, Artificial Sequence
  chemically synthesized
tcttcagatctactcttggggc

SEQ ID NO: 1121693 - DNA, 22 bp, Artificial Sequence
  chemically synthesized
ttcagatctactcttggggcaa

SEQ ID NO: 1121694 - DNA, 22 bp, Artificial Sequence
  chemically synthesized
ccttagtttgggttgccccaag

SEQ ID NO: 1121695 - DNA, 22 bp, Artificial Sequence
  chemically synthesized
cagatctactcttggggcaacc

SEQ ID NO: 1121696 - DNA, 22 bp, Artificial Sequence
  chemically synthesized
agatctactcttggggcaaccc

SEQ ID NO: 1121697 - DNA, 22 bp, Artificial Sequence
  chemically synthesized
ttgccttagtttgggttgcccc

SEQ ID NO: 1121698 - DNA, 22 bp, Artificial Sequence
  chemically synthesized
attattgccttagtttgggttg

SEQ ID NO: 1121699 - DNA, 22 bp, Artificial Sequence
  chemically synthesized
ctcttggggcaacccaaactaa

SEQ ID NO: 1121700 - DNA, 22 bp, Artificial Sequence
  chemically synthesized
ttgattattgccttagtttggg

SEQ ID NO: 1121701 - DNA, 22 bp, Artificial Sequence
  chemically synthesized
ttggggcaacccaaactaaggc

SEQ ID NO: 1121702 - DNA, 22 bp, Artificial Sequence
  chemically synthesized
ggggcaacccaaactaaggcaa

SEQ ID NO: 1121703 - DNA, 22 bp, Artificial Sequence
  chemically synthesized
gggcaacccaaactaaggcaat

SEQ ID NO: 1121704 - DNA, 22 bp, Artificial Sequence
  chemically synthesized
aggctgttgattattgccttag

SEQ ID NO: 1121705 - DNA, 22 bp, Artificial Sequence
  chemically synthesized
gaggctgttgattattgcctta

SEQ ID NO: 1121706 - DNA, 22 bp, Artificial Sequence
  chemically synthesized
atttgaggctgttgattattgc

SEQ ID NO: 1121707 - DNA, 22 bp, Artificial Sequence
  chemically synthesized
ggttcatttgaggctgttgatt

SEQ ID NO: 1121708 - DNA, 22 bp, Artificial Sequence
  chemically synthesized
aggcaataatcaacagcctcaa

SEQ ID NO: 1121709 - DNA, 22 bp, Artificial Sequence
  chemically synthesized
aaatgaacctagcatcctgcca

SEQ ID NO: 1121710 - DNA, 22 bp, Artificial Sequence
  chemically synthesized
gcatcctgccatactttttttt

SEQ ID NO: 1121711 - DNA, 22 bp, Artificial Sequence
  chemically synthesized
ggaaaaaaaaaaaaaaaaaaaa

SEQ ID NO: 1121712 - DNA, 22 bp, Artificial Sequence
  chemically synthesized
gggaaaaaaaaaaaaaaaaaaa

SEQ ID NO: 1121713 - DNA, 22 bp, Artificial Sequence
  chemically synthesized
ccatactttttttttttttttt

SEQ ID NO: 1121714 - DNA, 22 bp, Artificial Sequence
  chemically synthesized
gagcccaacttgggaaaaaaaa

SEQ ID NO: 1121715 - DNA, 22 bp, Artificial Sequence
  chemically synthesized
agagcccaacttgggaaaaaaa

SEQ ID NO: 1121716 - DNA, 22 bp, Artificial Sequence
  chemically synthesized
ttttttttttttttttttccca

SEQ ID NO: 1121717 - DNA, 22 bp, Artificial Sequence
  chemically synthesized
tttttttttttttttttcccaa

SEQ ID NO: 1121718 - DNA, 22 bp, Artificial Sequence
  chemically synthesized
ttttttttttttttttcccaag

SEQ ID NO: 1121719 - DNA, 22 bp, Artificial Sequence
  chemically synthesized
tttttttttttttttcccaagt

SEQ ID NO: 1121720 - DNA, 22 bp, Artificial Sequence
  chemically synthesized
ttttttttttttttcccaagtt

SEQ ID NO: 1121721 - DNA, 22 bp, Artificial Sequence
  chemically synthesized
tttttttttttttcccaagttg

SEQ ID NO: 1121722 - DNA, 22 bp, Artificial Sequence
  chemically synthesized
ttttttttttttcccaagttgg

SEQ ID NO: 1121723 - DNA, 22 bp, Artificial Sequence
  chemically synthesized
tttttttttttcccaagttggg

SEQ ID NO: 1121724 - DNA, 22 bp, Artificial Sequence
  chemically synthesized
ttttttttttcccaagttgggc

SEQ ID NO: 1121725 - DNA, 22 bp, Artificial Sequence
  chemically synthesized
tagagacttagagcccaacttg

SEQ ID NO: 1121726 - DNA, 22 bp, Artificial Sequence
  chemically synthesized
tttttttttcccaagttgggct

SEQ ID NO: 1121727 - DNA, 22 bp, Artificial Sequence
  chemically synthesized
ttttttttcccaagttgggctc

SEQ ID NO: 1121728 - DNA, 22 bp, Artificial Sequence
  chemically synthesized
tttttttcccaagttgggctct

SEQ ID NO: 1121729 - DNA, 22 bp, Artificial Sequence
  chemically synthesized
ctgtagagacttagagcccaac

SEQ ID NO: 1121730 - DNA, 22 bp, Artificial Sequence
  chemically synthesized
ttttttcccaagttgggctcta

SEQ ID NO: 1121731 - DNA, 22 bp, Artificial Sequence
  chemically synthesized
tttttcccaagttgggctctaa

SEQ ID NO: 1121732 - DNA, 22 bp, Artificial Sequence
  chemically synthesized
ttttcccaagttgggctctaag

SEQ ID NO: 1121733 - DNA, 22 bp, Artificial Sequence
  chemically synthesized
tttcccaagttgggctctaagt

SEQ ID NO: 1121734 - DNA, 22 bp, Artificial Sequence
  chemically synthesized
ttcccaagttgggctctaagtc

SEQ ID NO: 1121735 - DNA, 22 bp, Artificial Sequence
  chemically synthesized
tcccaagttgggctctaagtct

SEQ ID NO: 1121736 - DNA, 22 bp, Artificial Sequence
  chemically synthesized
cccaagttgggctctaagtctc

SEQ ID NO: 1121737 - DNA, 22 bp, Artificial Sequence
  chemically synthesized
atagttcctgtagagacttaga

SEQ ID NO: 1121738 - DNA, 22 bp, Artificial Sequence
  chemically synthesized
ccaagttgggctctaagtctct

SEQ ID NO: 1121739 - DNA, 22 bp, Artificial Sequence
  chemically synthesized
aatagttcctgtagagacttag

SEQ ID NO: 1121740 - DNA, 22 bp, Artificial Sequence
  chemically synthesized
taatagttcctgtagagactta

SEQ ID NO: 1121741 - DNA, 22 bp, Artificial Sequence
  chemically synthesized
ggctctaagtctctacaggaac

SEQ ID NO: 1121742 - DNA, 22 bp, Artificial Sequence
  chemically synthesized
ataaaaggttttaatagttcct

SEQ ID NO: 1121743 - DNA, 22 bp, Artificial Sequence
  chemically synthesized
taagtctctacaggaactatta

SEQ ID NO: 1121744 - DNA, 22 bp, Artificial Sequence
  chemically synthesized
gataaaaggttttaatagttcc

SEQ ID NO: 1121745 - DNA, 22 bp, Artificial Sequence
  chemically synthesized
tgataaaaggttttaatagttc

SEQ ID NO: 1121746 - DNA, 22 bp, Artificial Sequence
  chemically synthesized
agtctctacaggaactattaaa

SEQ ID NO: 1121747 - DNA, 22 bp, Artificial Sequence
  chemically synthesized
tacaggaactattaaaaccttt

SEQ ID NO: 1121748 - DNA, 22 bp, Artificial Sequence
  chemically synthesized
caggaactattaaaacctttta

SEQ ID NO: 1121749 - DNA, 22 bp, Artificial Sequence
  chemically synthesized
ttaaaaccttttatcaaagctc

SEQ ID NO: 1121750 - DNA, 22 bp, Artificial Sequence
  chemically synthesized
aaaccttttatcaaagctctgg

SEQ ID NO: 1121751 - DNA, 22 bp, Artificial Sequence
  chemically synthesized
cagaaagaggatgggccagagc

SEQ ID NO: 1121752 - DNA, 22 bp, Artificial Sequence
  chemically synthesized
ttatcaaagctctggcccatcc

SEQ ID NO: 1121753 - DNA, 22 bp, Artificial Sequence
  chemically synthesized
tatcaaagctctggcccatcct

SEQ ID NO: 1121754 - DNA, 22 bp, Artificial Sequence
  chemically synthesized
atcaaagctctggcccatcctc

SEQ ID NO: 1121755 - DNA, 22 bp, Artificial Sequence
  chemically synthesized
tcaaagctctggcccatcctct

SEQ ID NO: 1121756 - DNA, 22 bp, Artificial Sequence
  chemically synthesized
agagagctgcagaaagaggatg

SEQ ID NO: 1121757 - DNA, 22 bp, Artificial Sequence
  chemically synthesized
tggcccatcctctttctgcagc

SEQ ID NO: 1121758 - DNA, 22 bp, Artificial Sequence
  chemically synthesized
gcccatcctctttctgcagctc

SEQ ID NO: 1121759 - DNA, 22 bp, Artificial Sequence
  chemically synthesized
tttctgcagctctctcagatga

SEQ ID NO: 1121760 - DNA, 22 bp, Artificial Sequence
  chemically synthesized
tctgcagctctctcagatgatc

SEQ ID NO: 1121761 - DNA, 22 bp, Artificial Sequence
  chemically synthesized
ctgcagctctctcagatgatct

SEQ ID NO: 1121762 - DNA, 22 bp, Artificial Sequence
  chemically synthesized
tgcagctctctcagatgatctt

SEQ ID NO: 1121763 - DNA, 22 bp, Artificial Sequence
  chemically synthesized
taaggtagggaacaagatcatc

SEQ ID NO: 1121764 - DNA, 22 bp, Artificial Sequence
  chemically synthesized
cagctctctcagatgatcttgt

SEQ ID NO: 1121765 - DNA, 22 bp, Artificial Sequence
  chemically synthesized
tgtaaggtagggaacaagatca

SEQ ID NO: 1121766 - DNA, 22 bp, Artificial Sequence
  chemically synthesized
ctgtaaggtagggaacaagatc

SEQ ID NO: 1121767 - DNA, 22 bp, Artificial Sequence
  chemically synthesized
tttctgtaaggtagggaacaag

SEQ ID NO: 1121768 - DNA, 22 bp, Artificial Sequence
  chemically synthesized
tctcagatgatcttgttcccta

SEQ ID NO: 1121769 - DNA, 22 bp, Artificial Sequence
  chemically synthesized
gtttctgtaaggtagggaacaa

SEQ ID NO: 1121770 - DNA, 22 bp, Artificial Sequence
  chemically synthesized
tcagatgatcttgttccctacc

SEQ ID NO: 1121771 - DNA, 22 bp, Artificial Sequence
  chemically synthesized
agatgatcttgttccctacctt

SEQ ID NO: 1121772 - DNA, 22 bp, Artificial Sequence
  chemically synthesized
cacttgtttctgtaaggtaggg

SEQ ID NO: 1121773 - DNA, 22 bp, Artificial Sequence
  chemically synthesized
ataattgcacttgtttctgtaa

SEQ ID NO: 1121774 - DNA, 22 bp, Artificial Sequence
  chemically synthesized
gttccctaccttacagaaacaa

SEQ ID NO: 1121775 - DNA, 22 bp, Artificial Sequence
  chemically synthesized
tgataattgcacttgtttctgt

SEQ ID NO: 1121776 - DNA, 22 bp, Artificial Sequence
  chemically synthesized
ttccctaccttacagaaacaag

SEQ ID NO: 1121777 - DNA, 22 bp, Artificial Sequence
  chemically synthesized
ctctgataattgcacttgtttc

SEQ ID NO: 1121778 - DNA, 22 bp, Artificial Sequence
  chemically synthesized
cctaccttacagaaacaagtgc

SEQ ID NO: 1121779 - DNA, 22 bp, Artificial Sequence
  chemically synthesized
tactctgataattgcacttgtt

SEQ ID NO: 1121780 - DNA, 22 bp, Artificial Sequence
  chemically synthesized
ccttacagaaacaagtgcaatt

SEQ ID NO: 1121781 - DNA, 22 bp, Artificial Sequence
  chemically synthesized
acagaaacaagtgcaattatca

SEQ ID NO: 1121782 - DNA, 22 bp, Artificial Sequence
  chemically synthesized
cagaaacaagtgcaattatcag

SEQ ID NO: 1121783 - DNA, 22 bp, Artificial Sequence
  chemically synthesized
gaaataggaagtgaaagaagtt

SEQ ID NO: 1121784 - DNA, 22 bp, Artificial Sequence
  chemically synthesized
ggaaataggaagtgaaagaagt

SEQ ID NO: 1121785 - DNA, 22 bp, Artificial Sequence
  chemically synthesized
tcagagtagaacttctttcact

SEQ ID NO: 1121786 - DNA, 22 bp, Artificial Sequence
  chemically synthesized
atggtgtttggaaataggaagt

SEQ ID NO: 1121787 - DNA, 22 bp, Artificial Sequence
  chemically synthesized
ctttcacttcctatttccaaac

SEQ ID NO: 1121788 - DNA, 22 bp, Artificial Sequence
  chemically synthesized
tttcacttcctatttccaaaca

SEQ ID NO: 1121789 - DNA, 22 bp, Artificial Sequence
  chemically synthesized
tcacttcctatttccaaacacc

SEQ ID NO: 1121790 - DNA, 22 bp, Artificial Sequence
  chemically synthesized
cacttcctatttccaaacacca

SEQ ID NO: 1121791 - DNA, 22 bp, Artificial Sequence
  chemically synthesized
acttcctatttccaaacaccat

SEQ ID NO: 1121792 - DNA, 22 bp, Artificial Sequence
  chemically synthesized
catatgcgggtctgatggtgtt

SEQ ID NO: 1121793 - DNA, 22 bp, Artificial Sequence
  chemically synthesized
cctatttccaaacaccatcaga

SEQ ID NO: 1121794 - DNA, 22 bp, Artificial Sequence
  chemically synthesized
ctatttccaaacaccatcagac

SEQ ID NO: 1121795 - DNA, 22 bp, Artificial Sequence
  chemically synthesized
tttccaaacaccatcagacccg

SEQ ID NO: 1121796 - DNA, 22 bp, Artificial Sequence
  chemically synthesized
ccaaacaccatcagacccgcat

SEQ ID NO: 1121797 - DNA, 22 bp, Artificial Sequence
  chemically synthesized
caaacaccatcagacccgcata

SEQ ID NO: 1121798 - DNA, 22 bp, Artificial Sequence
  chemically synthesized
aaatgtaaaagaagggaatgag

SEQ ID NO: 1121799 - DNA, 22 bp, Artificial Sequence
  chemically synthesized
tcattcccttcttttacatttg

SEQ ID NO: 1121800 - DNA, 22 bp, Artificial Sequence
  chemically synthesized
attcccttcttttacatttgag

SEQ ID NO: 1121801 - DNA, 22 bp, Artificial Sequence
  chemically synthesized
aaagaagggaaactcaaatgta

SEQ ID NO: 1121802 - DNA, 22 bp, Artificial Sequence
  chemically synthesized
ccttcttttacatttgagtttc

SEQ ID NO: 1121803 - DNA, 22 bp, Artificial Sequence
  chemically synthesized
attaaaagaagggaaactcaaa

SEQ ID NO: 1121804 - DNA, 22 bp, Artificial Sequence
  chemically synthesized
aattaaaagaagggaaactcaa

SEQ ID NO: 1121805 - DNA, 22 bp, Artificial Sequence
  chemically synthesized
taattaaaagaagggaaactca

SEQ ID NO: 1121806 - DNA, 22 bp, Artificial Sequence
  chemically synthesized
cttttacatttgagtttccctt

SEQ ID NO: 1121807 - DNA, 22 bp, Artificial Sequence
  chemically synthesized
ttttacatttgagtttcccttc

SEQ ID NO: 1121808 - DNA, 22 bp, Artificial Sequence
  chemically synthesized
ttacatttgagtttcccttctt

SEQ ID NO: 1121809 - DNA, 22 bp, Artificial Sequence
  chemically synthesized
tacatttgagtttcccttcttt

SEQ ID NO: 1121810 - DNA, 22 bp, Artificial Sequence
  chemically synthesized
acatttgagtttcccttctttt

SEQ ID NO: 1121811 - DNA, 22 bp, Artificial Sequence
  chemically synthesized
catttgagtttcccttctttta

SEQ ID NO: 1121812 - DNA, 22 bp, Artificial Sequence
  chemically synthesized
gagtttcccttcttttaattaa

SEQ ID NO: 1121813 - DNA, 22 bp, Artificial Sequence
  chemically synthesized
agtttcccttcttttaattaaa

SEQ ID NO: 1121814 - DNA, 22 bp, Artificial Sequence
  chemically synthesized
cccttcttttaattaaagtcat

SEQ ID NO: 1121815 - DNA, 22 bp, Artificial Sequence
  chemically synthesized
ccttcttttaattaaagtcatt

SEQ ID NO: 1121816 - DNA, 22 bp, Artificial Sequence
  chemically synthesized
cttttaattaaagtcattccca

SEQ ID NO: 1121817 - DNA, 22 bp, Artificial Sequence
  chemically synthesized
ttttaattaaagtcattcccac

SEQ ID NO: 1121818 - DNA, 22 bp, Artificial Sequence
  chemically synthesized
aaaatgtaggtagtgggaatga

SEQ ID NO: 1121819 - DNA, 22 bp, Artificial Sequence
  chemically synthesized
ttaattaaagtcattcccacta

SEQ ID NO: 1121820 - DNA, 22 bp, Artificial Sequence
  chemically synthesized
taattaaagtcattcccactac

SEQ ID NO: 1121821 - DNA, 22 bp, Artificial Sequence
  chemically synthesized
aattaaagtcattcccactacc

SEQ ID NO: 1121822 - DNA, 22 bp, Artificial Sequence
  chemically synthesized
attaaagtcattcccactacct

SEQ ID NO: 1121823 - DNA, 22 bp, Artificial Sequence
  chemically synthesized
aagtcattcccactacctacat

SEQ ID NO: 1121824 - DNA, 22 bp, Artificial Sequence
  chemically synthesized
ccactacctacattttgaactt

SEQ ID NO: 1121825 - DNA, 22 bp, Artificial Sequence
  chemically synthesized
cctacattttgaactttattct

SEQ ID NO: 1121826 - DNA, 22 bp, Artificial Sequence
  chemically synthesized
agcaaaagtaagagaataaagt

SEQ ID NO: 1121827 - DNA, 22 bp, Artificial Sequence
  chemically synthesized
gagcaaaagtaagagaataaag

SEQ ID NO: 1121828 - DNA, 22 bp, Artificial Sequence
  chemically synthesized
cattttgaactttattctctta

SEQ ID NO: 1121829 - DNA, 22 bp, Artificial Sequence
  chemically synthesized
tgaactttattctcttactttt

SEQ ID NO: 1121830 - DNA, 22 bp, Artificial Sequence
  chemically synthesized
agatgcttgagcaaaagtaaga

SEQ ID NO: 1121831 - DNA, 22 bp, Artificial Sequence
  chemically synthesized
gaactttattctcttacttttg

SEQ ID NO: 1121832 - DNA, 22 bp, Artificial Sequence
  chemically synthesized
aactttattctcttacttttgc

SEQ ID NO: 1121833 - DNA, 22 bp, Artificial Sequence
  chemically synthesized
tattctcttacttttgctcaag

SEQ ID NO: 1121834 - DNA, 22 bp, Artificial Sequence
  chemically synthesized
attctcttacttttgctcaagc

SEQ ID NO: 1121835 - DNA, 22 bp, Artificial Sequence
  chemically synthesized
ttctcttacttttgctcaagca

SEQ ID NO: 1121836 - DNA, 22 bp, Artificial Sequence
  chemically synthesized
gatggactcagatgcttgagca

SEQ ID NO: 1121837 - DNA, 22 bp, Artificial Sequence
  chemically synthesized
tcttacttttgctcaagcatct

SEQ ID NO: 1121838 - DNA, 22 bp, Artificial Sequence
  chemically synthesized
ttacttttgctcaagcatctga

SEQ ID NO: 1121839 - DNA, 22 bp, Artificial Sequence
  chemically synthesized
acttttgctcaagcatctgagt

SEQ ID NO: 1121840 - DNA, 22 bp, Artificial Sequence
  chemically synthesized
gaaattggatggactcagatgc

SEQ ID NO: 1121841 - DNA, 22 bp, Artificial Sequence
  chemically synthesized
cttttgctcaagcatctgagtc

SEQ ID NO: 1121842 - DNA, 22 bp, Artificial Sequence
  chemically synthesized
ttgctcaagcatctgagtccat

SEQ ID NO: 1121843 - DNA, 22 bp, Artificial Sequence
  chemically synthesized
tgctcaagcatctgagtccatc

SEQ ID NO: 1121844 - DNA, 22 bp, Artificial Sequence
  chemically synthesized
gctcaagcatctgagtccatcc

SEQ ID NO: 1121845 - DNA, 22 bp, Artificial Sequence
  chemically synthesized
ctcaagcatctgagtccatcca

SEQ ID NO: 1121846 - DNA, 22 bp, Artificial Sequence
  chemically synthesized
aagcatctgagtccatccaatt

SEQ ID NO: 1121847 - DNA, 22 bp, Artificial Sequence
  chemically synthesized
aaaataaacaaatactagaaat

SEQ ID NO: 1121848 - DNA, 22 bp, Artificial Sequence
  chemically synthesized
agtccatccaatttctagtatt

SEQ ID NO: 1121849 - DNA, 22 bp, Artificial Sequence
  chemically synthesized
cgtctcaaaataaacaaatact

SEQ ID NO: 1121850 - DNA, 22 bp, Artificial Sequence
  chemically synthesized
ctagtatttgtttattttgaga

SEQ ID NO: 1121851 - DNA, 22 bp, Artificial Sequence
  chemically synthesized
tagtatttgtttattttgagac

SEQ ID NO: 1121852 - DNA, 22 bp, Artificial Sequence
  chemically synthesized
gtatttgtttattttgagacgg

SEQ ID NO: 1121853 - DNA, 22 bp, Artificial Sequence
  chemically synthesized
gtgacagagtgagactccgtct

SEQ ID NO: 1121854 - DNA, 22 bp, Artificial Sequence
  chemically synthesized
gtttattttgagacggagtctc

SEQ ID NO: 1121855 - DNA, 22 bp, Artificial Sequence
  chemically synthesized
tttattttgagacggagtctca

SEQ ID NO: 1121856 - DNA, 22 bp, Artificial Sequence
  chemically synthesized
attttgagacggagtctcactc

SEQ ID NO: 1121857 - DNA, 22 bp, Artificial Sequence
  chemically synthesized
ttttgagacggagtctcactct

SEQ ID NO: 1121858 - DNA, 22 bp, Artificial Sequence
  chemically synthesized
cagcctggtgacagagtgagac

SEQ ID NO: 1121859 - DNA, 22 bp, Artificial Sequence
  chemically synthesized
tgagacggagtctcactctgtc

SEQ ID NO: 1121860 - DNA, 22 bp, Artificial Sequence
  chemically synthesized
gagacggagtctcactctgtca

SEQ ID NO: 1121861 - DNA, 22 bp, Artificial Sequence
  chemically synthesized
agacggagtctcactctgtcac

SEQ ID NO: 1121862 - DNA, 22 bp, Artificial Sequence
  chemically synthesized
cactccagcctggtgacagagt

SEQ ID NO: 1121863 - DNA, 22 bp, Artificial Sequence
  chemically synthesized
caccactgcactccagcctggt

SEQ ID NO: 1121864 - DNA, 22 bp, Artificial Sequence
  chemically synthesized
actctgtcaccaggctggagtg

SEQ ID NO: 1121865 - DNA, 22 bp, Artificial Sequence
  chemically synthesized
tgtcaccaggctggagtgcagt

SEQ ID NO: 1121866 - DNA, 22 bp, Artificial Sequence
  chemically synthesized
tcaccaggctggagtgcagtgg

SEQ ID NO: 1121867 - DNA, 22 bp, Artificial Sequence
  chemically synthesized
tggtgagaccagattgcaccac

SEQ ID NO: 1121868 - DNA, 22 bp, Artificial Sequence
  chemically synthesized
gagtgcagtggtgcaatctggt

SEQ ID NO: 1121869 - DNA, 22 bp, Artificial Sequence
  chemically synthesized
aacccgggaggcagaggttgtg

SEQ ID NO: 1121870 - DNA, 22 bp, Artificial Sequence
  chemically synthesized
gaacccgggaggcagaggttgt

SEQ ID NO: 1121871 - DNA, 22 bp, Artificial Sequence
  chemically synthesized
cttgaacccgggaggcagaggt

SEQ ID NO: 1121872 - DNA, 22 bp, Artificial Sequence
  chemically synthesized
gtctcaccacaacctctgcctc

SEQ ID NO: 1121873 - DNA, 22 bp, Artificial Sequence
  chemically synthesized
accacaacctctgcctcccggg

SEQ ID NO: 1121874 - DNA, 22 bp, Artificial Sequence
  chemically synthesized
aggcaggggaattccttgaacc

SEQ ID NO: 1121875 - DNA, 22 bp, Artificial Sequence
  chemically synthesized
tgcctcccgggttcaaggaatt

SEQ ID NO: 1121876 - DNA, 22 bp, Artificial Sequence
  chemically synthesized
cctcccgggttcaaggaattcc

SEQ ID NO: 1121877 - DNA, 22 bp, Artificial Sequence
  chemically synthesized
ggaggctgaggcaggggaattc

SEQ ID NO: 1121878 - DNA, 22 bp, Artificial Sequence
  chemically synthesized
ccgggttcaaggaattcccctg

SEQ ID NO: 1121879 - DNA, 22 bp, Artificial Sequence
  chemically synthesized
gggaggctgaggcaggggaatt

SEQ ID NO: 1121880 - DNA, 22 bp, Artificial Sequence
  chemically synthesized
cttgggaggctgaggcagggga

SEQ ID NO: 1121881 - DNA, 22 bp, Artificial Sequence
  chemically synthesized
gctacttgggaggctgaggcag

SEQ ID NO: 1121882 - DNA, 22 bp, Artificial Sequence
  chemically synthesized
aaggaattcccctgcctcagcc

SEQ ID NO: 1121883 - DNA, 22 bp, Artificial Sequence
  chemically synthesized
tagtcctagctacttgggaggc

SEQ ID NO: 1121884 - DNA, 22 bp, Artificial Sequence
  chemically synthesized
ccctgcctcagcctcccaagta

SEQ ID NO: 1121885 - DNA, 22 bp, Artificial Sequence
  chemically synthesized
actgtagtcctagctacttggg

SEQ ID NO: 1121886 - DNA, 22 bp, Artificial Sequence
  chemically synthesized
cctcagcctcccaagtagctag

SEQ ID NO: 1121887 - DNA, 22 bp, Artificial Sequence
  chemically synthesized
agcctcccaagtagctaggact

SEQ ID NO: 1121888 - DNA, 22 bp, Artificial Sequence
  chemically synthesized
ccaagtagctaggactacagtt

SEQ ID NO: 1121889 - DNA, 22 bp, Artificial Sequence
  chemically synthesized
ggactacagttaacactgttga

SEQ ID NO: 1121890 - DNA, 22 bp, Artificial Sequence
  chemically synthesized
caaacggatagtatggtcaaca

SEQ ID NO: 1121891 - DNA, 22 bp, Artificial Sequence
  chemically synthesized
cagttaacactgttgaccatac

SEQ ID NO: 1121892 - DNA, 22 bp, Artificial Sequence
  chemically synthesized
acactgttgaccatactatccg

SEQ ID NO: 1121893 - DNA, 22 bp, Artificial Sequence
  chemically synthesized
ttgaccatactatccgtttgta

SEQ ID NO: 1121894 - DNA, 22 bp, Artificial Sequence
  chemically synthesized
accatactatccgtttgtaatt

SEQ ID NO: 1121895 - DNA, 22 bp, Artificial Sequence
  chemically synthesized
tccgtttgtaatttttcttcct

SEQ ID NO: 1121896 - DNA, 22 bp, Artificial Sequence
  chemically synthesized
gtaatttttcttcctttggctt

SEQ ID NO: 1121897 - DNA, 22 bp, Artificial Sequence
  chemically synthesized
taatttttcttcctttggcttc

SEQ ID NO: 1121898 - DNA, 22 bp, Artificial Sequence
  chemically synthesized
gaatagagtggcatcatgaagc

SEQ ID NO: 1121899 - DNA, 22 bp, Artificial Sequence
  chemically synthesized
ttcttcctttggcttcatgatg

SEQ ID NO: 1121900 - DNA, 22 bp, Artificial Sequence
  chemically synthesized
tcttcctttggcttcatgatgc

SEQ ID NO: 1121901 - DNA, 22 bp, Artificial Sequence
  chemically synthesized
cttcctttggcttcatgatgcc

SEQ ID NO: 1121902 - DNA, 22 bp, Artificial Sequence
  chemically synthesized
ttcctttggcttcatgatgcca

SEQ ID NO: 1121903 - DNA, 22 bp, Artificial Sequence
  chemically synthesized
cctttggcttcatgatgccact

SEQ ID NO: 1121904 - DNA, 22 bp, Artificial Sequence
  chemically synthesized
ctttggcttcatgatgccactc

SEQ ID NO: 1121905 - DNA, 22 bp, Artificial Sequence
  chemically synthesized
tggcttcatgatgccactctat

SEQ ID NO: 1121906 - DNA, 22 bp, Artificial Sequence
  chemically synthesized
ggcttcatgatgccactctatt

SEQ ID NO: 1121907 - DNA, 22 bp, Artificial Sequence
  chemically synthesized
gcttcatgatgccactctattc

SEQ ID NO: 1121908 - DNA, 22 bp, Artificial Sequence
  chemically synthesized
catgatgccactctattctaat

SEQ ID NO: 1121909 - DNA, 22 bp, Artificial Sequence
  chemically synthesized
atgatgccactctattctaatt

SEQ ID NO: 1121910 - DNA, 22 bp, Artificial Sequence
  chemically synthesized
tattctaatttgccttctattt

SEQ ID NO: 1121911 - DNA, 22 bp, Artificial Sequence
  chemically synthesized
ccaatggtcatagaaatagaag

SEQ ID NO: 1121912 - DNA, 22 bp, Artificial Sequence
  chemically synthesized
ttctaatttgccttctatttct

SEQ ID NO: 1121913 - DNA, 22 bp, Artificial Sequence
  chemically synthesized
taatttgccttctatttctatg

SEQ ID NO: 1121914 - DNA, 22 bp, Artificial Sequence
  chemically synthesized
atttgccttctatttctatgac

SEQ ID NO: 1121915 - DNA, 22 bp, Artificial Sequence
  chemically synthesized
gccttctatttctatgaccatt

SEQ ID NO: 1121916 - DNA, 22 bp, Artificial Sequence
  chemically synthesized
ccttctatttctatgaccattg

SEQ ID NO: 1121917 - DNA, 22 bp, Artificial Sequence
  chemically synthesized
caaagaaaaaattaccaatggt

SEQ ID NO: 1121918 - DNA, 22 bp, Artificial Sequence
  chemically synthesized
ctatttctatgaccattggtaa

SEQ ID NO: 1121919 - DNA, 22 bp, Artificial Sequence
  chemically synthesized
tatttctatgaccattggtaat

SEQ ID NO: 1121920 - DNA, 22 bp, Artificial Sequence
  chemically synthesized
tttctatgaccattggtaattt

SEQ ID NO: 1121921 - DNA, 22 bp, Artificial Sequence
  chemically synthesized
ctatgaccattggtaatttttt

SEQ ID NO: 1121922 - DNA, 22 bp, Artificial Sequence
  chemically synthesized
tatgaccattggtaattttttc

SEQ ID NO: 1121923 - DNA, 22 bp, Artificial Sequence
  chemically synthesized
tgaccattggtaattttttctt

SEQ ID NO: 1121924 - DNA, 22 bp, Artificial Sequence
  chemically synthesized
gtaattttttctttgcaggtcc

SEQ ID NO: 1121925 - DNA, 22 bp, Artificial Sequence
  chemically synthesized
tttctttgcaggtccatcctcc

SEQ ID NO: 1121926 - DNA, 22 bp, Artificial Sequence
  chemically synthesized
ttctttgcaggtccatcctcct

SEQ ID NO: 1121927 - DNA, 22 bp, Artificial Sequence
  chemically synthesized
tctttgcaggtccatcctcctc

SEQ ID NO: 1121928 - DNA, 22 bp, Artificial Sequence
  chemically synthesized
ctttgcaggtccatcctcctcc

SEQ ID NO: 1121929 - DNA, 22 bp, Artificial Sequence
  chemically synthesized
tttgcaggtccatcctcctcca

SEQ ID NO: 1121930 - DNA, 22 bp, Artificial Sequence
  chemically synthesized
tgcaggtccatcctcctccacc

SEQ ID NO: 1121931 - DNA, 22 bp, Artificial Sequence
  chemically synthesized
gcaggtccatcctcctccaccc

SEQ ID NO: 1121932 - DNA, 22 bp, Artificial Sequence
  chemically synthesized
caggtccatcctcctccaccct

SEQ ID NO: 1121933 - DNA, 22 bp, Artificial Sequence
  chemically synthesized
gtacataatgatagggtggagg

SEQ ID NO: 1121934 - DNA, 22 bp, Artificial Sequence
  chemically synthesized
acatctagtacataatgatagg

SEQ ID NO: 1121935 - DNA, 22 bp, Artificial Sequence
  chemically synthesized
gacatctagtacataatgatag

SEQ ID NO: 1121936 - DNA, 22 bp, Artificial Sequence
  chemically synthesized
ctccaccctatcattatgtact

SEQ ID NO: 1121937 - DNA, 22 bp, Artificial Sequence
  chemically synthesized
ggtcttgacatctagtacataa

SEQ ID NO: 1121938 - DNA, 22 bp, Artificial Sequence
  chemically synthesized
caccctatcattatgtactaga

SEQ ID NO: 1121939 - DNA, 22 bp, Artificial Sequence
  chemically synthesized
tcattatgtactagatgtcaag

SEQ ID NO: 1121940 - DNA, 22 bp, Artificial Sequence
  chemically synthesized
gtaatgaactaggtcttgacat

SEQ ID NO: 1121941 - DNA, 22 bp, Artificial Sequence
  chemically synthesized
tgtactagatgtcaagacctag

SEQ ID NO: 1121942 - DNA, 22 bp, Artificial Sequence
  chemically synthesized
gatgtcaagacctagttcatta

SEQ ID NO: 1121943 - DNA, 22 bp, Artificial Sequence
  chemically synthesized
gttcattaccaatcatcttcta

SEQ ID NO: 1121944 - DNA, 22 bp, Artificial Sequence
  chemically synthesized
attaccaatcatcttctactct

SEQ ID NO: 1121945 - DNA, 22 bp, Artificial Sequence
  chemically synthesized
gtgagagatagtagagtagaag

SEQ ID NO: 1121946 - DNA, 22 bp, Artificial Sequence
  chemically synthesized
tggtgagagatagtagagtaga

SEQ ID NO: 1121947 - DNA, 22 bp, Artificial Sequence
  chemically synthesized
ctggtgagagatagtagagtag

SEQ ID NO: 1121948 - DNA, 22 bp, Artificial Sequence
  chemically synthesized
ccaatcatcttctactctacta

SEQ ID NO: 1121949 - DNA, 22 bp, Artificial Sequence
  chemically synthesized
tctggtgagagatagtagagta

SEQ ID NO: 1121950 - DNA, 22 bp, Artificial Sequence
  chemically synthesized
atgtgttttctggtgagagata

SEQ ID NO: 1121951 - DNA, 22 bp, Artificial Sequence
  chemically synthesized
ctactctactatctctcaccag

SEQ ID NO: 1121952 - DNA, 22 bp, Artificial Sequence
  chemically synthesized
tactctactatctctcaccaga

SEQ ID NO: 1121953 - DNA, 22 bp, Artificial Sequence
  chemically synthesized
ctctactatctctcaccagaaa

SEQ ID NO: 1121954 - DNA, 22 bp, Artificial Sequence
  chemically synthesized
tactatctctcaccagaaaaca

SEQ ID NO: 1121955 - DNA, 22 bp, Artificial Sequence
  chemically synthesized
ctatctctcaccagaaaacaca

SEQ ID NO: 1121956 - DNA, 22 bp, Artificial Sequence
  chemically synthesized
tctctcaccagaaaacacatca

SEQ ID NO: 1121957 - DNA, 22 bp, Artificial Sequence
  chemically synthesized
aaggcatgatgactgatgtgtt

SEQ ID NO: 1121958 - DNA, 22 bp, Artificial Sequence
  chemically synthesized
tcaccagaaaacacatcagtca

SEQ ID NO: 1121959 - DNA, 22 bp, Artificial Sequence
  chemically synthesized
accagaaaacacatcagtcatc

SEQ ID NO: 1121960 - DNA, 22 bp, Artificial Sequence
  chemically synthesized
caattcaaggcatgatgactga

SEQ ID NO: 1121961 - DNA, 22 bp, Artificial Sequence
  chemically synthesized
ataaatagattgcaattcaagg

SEQ ID NO: 1121962 - DNA, 22 bp, Artificial Sequence
  chemically synthesized
gaattgcaatctatttatcaat

SEQ ID NO: 1121963 - DNA, 22 bp, Artificial Sequence
  chemically synthesized
aattgcaatctatttatcaatg

SEQ ID NO: 1121964 - DNA, 22 bp, Artificial Sequence
  chemically synthesized
caatctatttatcaatgattct

SEQ ID NO: 1121965 - DNA, 22 bp, Artificial Sequence
  chemically synthesized
gagatatacatatcagaatcat

SEQ ID NO: 1121966 - DNA, 22 bp, Artificial Sequence
  chemically synthesized
tttatcaatgattctgatatgt

SEQ ID NO: 1121967 - DNA, 22 bp, Artificial Sequence
  chemically synthesized
aattagagatatacatatcaga

SEQ ID NO: 1121968 - DNA, 22 bp, Artificial Sequence
  chemically synthesized
atcaatgattctgatatgtata

SEQ ID NO: 1121969 - DNA, 22 bp, Artificial Sequence
  chemically synthesized
tcaatgattctgatatgtatat

SEQ ID NO: 1121970 - DNA, 22 bp, Artificial Sequence
  chemically synthesized
tgatatgtatatctctaattca

SEQ ID NO: 1121971 - DNA, 22 bp, Artificial Sequence
  chemically synthesized
agaacaagtgcctgaattagag

SEQ ID NO: 1121972 - DNA, 22 bp, Artificial Sequence
  chemically synthesized
atatgtatatctctaattcagg

SEQ ID NO: 1121973 - DNA, 22 bp, Artificial Sequence
  chemically synthesized
tggaattcagaacaagtgcctg

SEQ ID NO: 1121974 - DNA, 22 bp, Artificial Sequence
  chemically synthesized
taattcaggcacttgttctgaa

SEQ ID NO: 1121975 - DNA, 22 bp, Artificial Sequence
  chemically synthesized
tatagctgtggaattcagaaca

SEQ ID NO: 1121976 - DNA, 22 bp, Artificial Sequence
  chemically synthesized
attcaggcacttgttctgaatt

SEQ ID NO: 1121977 - DNA, 22 bp, Artificial Sequence
  chemically synthesized
aggcacttgttctgaattccac

SEQ ID NO: 1121978 - DNA, 22 bp, Artificial Sequence
  chemically synthesized
gttctgaattccacagctatat

SEQ ID NO: 1121979 - DNA, 22 bp, Artificial Sequence
  chemically synthesized
ttctgaattccacagctatata

SEQ ID NO: 1121980 - DNA, 22 bp, Artificial Sequence
  chemically synthesized
tgaattccacagctatataacc

SEQ ID NO: 1121981 - DNA, 22 bp, Artificial Sequence
  chemically synthesized
aattccacagctatataaccat

SEQ ID NO: 1121982 - DNA, 22 bp, Artificial Sequence
  chemically synthesized
cacagctatataaccatctgcc

SEQ ID NO: 1121983 - DNA, 22 bp, Artificial Sequence
  chemically synthesized
tataaccatctgcctattggat

SEQ ID NO: 1121984 - DNA, 22 bp, Artificial Sequence
  chemically synthesized
cagcatgcaagtggagacatcc

SEQ ID NO: 1121985 - DNA, 22 bp, Artificial Sequence
  chemically synthesized
gcagcatgcaagtggagacatc

SEQ ID NO: 1121986 - DNA, 22 bp, Artificial Sequence
  chemically synthesized
tgcagcatgcaagtggagacat

SEQ ID NO: 1121987 - DNA, 22 bp, Artificial Sequence
  chemically synthesized
cctattggatgtctccacttgc

SEQ ID NO: 1121988 - DNA, 22 bp, Artificial Sequence
  chemically synthesized
ttggatgtctccacttgcatgc

SEQ ID NO: 1121989 - DNA, 22 bp, Artificial Sequence
  chemically synthesized
aggagattttgcagcatgcaag

SEQ ID NO: 1121990 - DNA, 22 bp, Artificial Sequence
  chemically synthesized
aaggagattttgcagcatgcaa

SEQ ID NO: 1121991 - DNA, 22 bp, Artificial Sequence
  chemically synthesized
gatgtctccacttgcatgctgc

SEQ ID NO: 1121992 - DNA, 22 bp, Artificial Sequence
  chemically synthesized
cacttgcatgctgcaaaatctc

SEQ ID NO: 1121993 - DNA, 22 bp, Artificial Sequence
  chemically synthesized
gcatataatgtttaaggagatt

SEQ ID NO: 1121994 - DNA, 22 bp, Artificial Sequence
  chemically synthesized
gcatgctgcaaaatctccttaa

SEQ ID NO: 1121995 - DNA, 22 bp, Artificial Sequence
  chemically synthesized
ggcatataatgtttaaggagat

SEQ ID NO: 1121996 - DNA, 22 bp, Artificial Sequence
  chemically synthesized
catgctgcaaaatctccttaaa

SEQ ID NO: 1121997 - DNA, 22 bp, Artificial Sequence
  chemically synthesized
aaccttggcatataatgtttaa

SEQ ID NO: 1121998 - DNA, 22 bp, Artificial Sequence
  chemically synthesized
aaaccttggcatataatgttta

SEQ ID NO: 1121999 - DNA, 22 bp, Artificial Sequence
  chemically synthesized
caaaatctccttaaacattata

SEQ ID NO: 1122000 - DNA, 22 bp, Artificial Sequence
  chemically synthesized
taaaccttggcatataatgttt

SEQ ID NO: 1122001 - DNA, 22 bp, Artificial Sequence
  chemically synthesized
cttaaacattatatgccaaggt

SEQ ID NO: 1122002 - DNA, 22 bp, Artificial Sequence
  chemically synthesized
aaacattatatgccaaggttta

SEQ ID NO: 1122003 - DNA, 22 bp, Artificial Sequence
  chemically synthesized
aacattatatgccaaggtttaa

SEQ ID NO: 1122004 - DNA, 22 bp, Artificial Sequence
  chemically synthesized
agggagaagatcaaactttaaa

SEQ ID NO: 1122005 - DNA, 22 bp, Artificial Sequence
  chemically synthesized
gagggagaagatcaaactttaa

SEQ ID NO: 1122006 - DNA, 22 bp, Artificial Sequence
  chemically synthesized
tatgccaaggtttaaagtttga

SEQ ID NO: 1122007 - DNA, 22 bp, Artificial Sequence
  chemically synthesized
gtttgagggagaagatcaaact

SEQ ID NO: 1122008 - DNA, 22 bp, Artificial Sequence
  chemically synthesized
aaagtttgatcttctccctcaa

SEQ ID NO: 1122009 - DNA, 22 bp, Artificial Sequence
  chemically synthesized
aagtttgatcttctccctcaaa

SEQ ID NO: 1122010 - DNA, 22 bp, Artificial Sequence
  chemically synthesized
atagagtactagtttgagggag

SEQ ID NO: 1122011 - DNA, 22 bp, Artificial Sequence
  chemically synthesized
gatcttctccctcaaactagta

SEQ ID NO: 1122012 - DNA, 22 bp, Artificial Sequence
  chemically synthesized
atcttctccctcaaactagtac

SEQ ID NO: 1122013 - DNA, 22 bp, Artificial Sequence
  chemically synthesized
gggaatactgatagagtactag

SEQ ID NO: 1122014 - DNA, 22 bp, Artificial Sequence
  chemically synthesized
ctccctcaaactagtactctat

SEQ ID NO: 1122015 - DNA, 22 bp, Artificial Sequence
  chemically synthesized
tccctcaaactagtactctatc

SEQ ID NO: 1122016 - DNA, 22 bp, Artificial Sequence
  chemically synthesized
cctcaaactagtactctatcag

SEQ ID NO: 1122017 - DNA, 22 bp, Artificial Sequence
  chemically synthesized
atctggggaatactgatagagt

SEQ ID NO: 1122018 - DNA, 22 bp, Artificial Sequence
  chemically synthesized
ctgatctggggaatactgatag

SEQ ID NO: 1122019 - DNA, 22 bp, Artificial Sequence
  chemically synthesized
aaactagtactctatcagtatt

SEQ ID NO: 1122020 - DNA, 22 bp, Artificial Sequence
  chemically synthesized
attactgatctggggaatactg

SEQ ID NO: 1122021 - DNA, 22 bp, Artificial Sequence
  chemically synthesized
gtactctatcagtattccccag

SEQ ID NO: 1122022 - DNA, 22 bp, Artificial Sequence
  chemically synthesized
tatcagtattccccagatcagt

SEQ ID NO: 1122023 - DNA, 22 bp, Artificial Sequence
  chemically synthesized
tcagtattccccagatcagtaa

SEQ ID NO: 1122024 - DNA, 22 bp, Artificial Sequence
  chemically synthesized
cccagatcagtaattagcatca

SEQ ID NO: 1122025 - DNA, 22 bp, Artificial Sequence
  chemically synthesized
gcatcaccatccctcatatttg

SEQ ID NO: 1122026 - DNA, 22 bp, Artificial Sequence
  chemically synthesized
agtccatagcggagatgaagat

SEQ ID NO: 1122027 - DNA, 22 bp, Artificial Sequence
  chemically synthesized
atatttgttatcttcatctccg

SEQ ID NO: 1122028 - DNA, 22 bp, Artificial Sequence
  chemically synthesized
gttatcttcatctccgctatgg

SEQ ID NO: 1122029 - DNA, 22 bp, Artificial Sequence
  chemically synthesized
ttatcttcatctccgctatgga

SEQ ID NO: 1122030 - DNA, 22 bp, Artificial Sequence
  chemically synthesized
tcttcatctccgctatggactg

SEQ ID NO: 1122031 - DNA, 22 bp, Artificial Sequence
  chemically synthesized
tggggcacaaaattcagtccat

SEQ ID NO: 1122032 - DNA, 22 bp, Artificial Sequence
  chemically synthesized
gtggggcacaaaattcagtcca

SEQ ID NO: 1122033 - DNA, 22 bp, Artificial Sequence
  chemically synthesized
catctccgctatggactgaatt

SEQ ID NO: 1122034 - DNA, 22 bp, Artificial Sequence
  chemically synthesized
tgtggggcacaaaattcagtcc

SEQ ID NO: 1122035 - DNA, 22 bp, Artificial Sequence
  chemically synthesized
atctccgctatggactgaattt

SEQ ID NO: 1122036 - DNA, 22 bp, Artificial Sequence
  chemically synthesized
ttgtggggcacaaaattcagtc

SEQ ID NO: 1122037 - DNA, 22 bp, Artificial Sequence
  chemically synthesized
cgctatggactgaattttgtgc

SEQ ID NO: 1122038 - DNA, 22 bp, Artificial Sequence
  chemically synthesized
tggactgaattttgtgccccac

SEQ ID NO: 1122039 - DNA, 22 bp, Artificial Sequence
  chemically synthesized
aacatacgaacttttgtggggc

SEQ ID NO: 1122040 - DNA, 22 bp, Artificial Sequence
  chemically synthesized
caacatacgaacttttgtgggg

SEQ ID NO: 1122041 - DNA, 22 bp, Artificial Sequence
  chemically synthesized
aattttgtgccccacaaaagtt

SEQ ID NO: 1122042 - DNA, 22 bp, Artificial Sequence
  chemically synthesized
ggcttcaacatacgaacttttg

SEQ ID NO: 1122043 - DNA, 22 bp, Artificial Sequence
  chemically synthesized
tgtgccccacaaaagttcgtat

SEQ ID NO: 1122044 - DNA, 22 bp, Artificial Sequence
  chemically synthesized
gtgccccacaaaagttcgtatg

SEQ ID NO: 1122045 - DNA, 22 bp, Artificial Sequence
  chemically synthesized
tgccccacaaaagttcgtatgt

SEQ ID NO: 1122046 - DNA, 22 bp, Artificial Sequence
  chemically synthesized
ggaattaggcttcaacatacga

SEQ ID NO: 1122047 - DNA, 22 bp, Artificial Sequence
  chemically synthesized
gtatgttgaagcctaattccca

SEQ ID NO: 1122048 - DNA, 22 bp, Artificial Sequence
  chemically synthesized
atatcatcacattgggaattag

SEQ ID NO: 1122049 - DNA, 22 bp, Artificial Sequence
  chemically synthesized
aatatcatcacattgggaatta

SEQ ID NO: 1122050 - DNA, 22 bp, Artificial Sequence
  chemically synthesized
taatatcatcacattgggaatt

SEQ ID NO: 1122051 - DNA, 22 bp, Artificial Sequence
  chemically synthesized
ttaatatcatcacattgggaat

SEQ ID NO: 1122052 - DNA, 22 bp, Artificial Sequence
  chemically synthesized
aagcctaattcccaatgtgatg

SEQ ID NO: 1122053 - DNA, 22 bp, Artificial Sequence
  chemically synthesized
attcccaatgtgatgatattaa

SEQ ID NO: 1122054 - DNA, 22 bp, Artificial Sequence
  chemically synthesized
ccaatgtgatgatattaaaaga

SEQ ID NO: 1122055 - DNA, 22 bp, Artificial Sequence
  chemically synthesized
ccaaatgccccatcttttaata

SEQ ID NO: 1122056 - DNA, 22 bp, Artificial Sequence
  chemically synthesized
cctcccaaatgccccatctttt

SEQ ID NO: 1122057 - DNA, 22 bp, Artificial Sequence
  chemically synthesized
attacctcccaaatgccccatc

SEQ ID NO: 1122058 - DNA, 22 bp, Artificial Sequence
  chemically synthesized
acctaattacctcccaaatgcc

SEQ ID NO: 1122059 - DNA, 22 bp, Artificial Sequence
  chemically synthesized
gacctaattacctcccaaatgc

SEQ ID NO: 1122060 - DNA, 22 bp, Artificial Sequence
  chemically synthesized
ttgacctaattacctcccaaat

SEQ ID NO: 1122061 - DNA, 22 bp, Artificial Sequence
  chemically synthesized
aaagatggggcatttgggaggt

SEQ ID NO: 1122062 - DNA, 22 bp, Artificial Sequence
  chemically synthesized
ccctcttgacctaattacctcc

SEQ ID NO: 1122063 - DNA, 22 bp, Artificial Sequence
  chemically synthesized
taccctcttgacctaattacct

SEQ ID NO: 1122064 - DNA, 22 bp, Artificial Sequence
  chemically synthesized
gggaggtaattaggtcaagagg

SEQ ID NO: 1122065 - DNA, 22 bp, Artificial Sequence
  chemically synthesized
ggaggtaattaggtcaagaggg

SEQ ID NO: 1122066 - DNA, 22 bp, Artificial Sequence
  chemically synthesized
atgagggctctaccctcttgac

SEQ ID NO: 1122067 - DNA, 22 bp, Artificial Sequence
  chemically synthesized
catgagggctctaccctcttga

SEQ ID NO: 1122068 - DNA, 22 bp, Artificial Sequence
  chemically synthesized
atttcatgagggctctaccctc

SEQ ID NO: 1122069 - DNA, 22 bp, Artificial Sequence
  chemically synthesized
ggtcaagagggtagagccctca

SEQ ID NO: 1122070 - DNA, 22 bp, Artificial Sequence
  chemically synthesized
aggggactcatttcatgagggc

SEQ ID NO: 1122071 - DNA, 22 bp, Artificial Sequence
  chemically synthesized
aaggggactcatttcatgaggg

SEQ ID NO: 1122072 - DNA, 22 bp, Artificial Sequence
  chemically synthesized
taaggggactcatttcatgagg

SEQ ID NO: 1122073 - DNA, 22 bp, Artificial Sequence
  chemically synthesized
agatcattttaaggggactcat

SEQ ID NO: 1122074 - DNA, 22 bp, Artificial Sequence
  chemically synthesized
cagatcattttaaggggactca

SEQ ID NO: 1122075 - DNA, 22 bp, Artificial Sequence
  chemically synthesized
ttcagatcattttaaggggact

SEQ ID NO: 1122076 - DNA, 22 bp, Artificial Sequence
  chemically synthesized
atgaaatgagtccccttaaaat

SEQ ID NO: 1122077 - DNA, 22 bp, Artificial Sequence
  chemically synthesized
atctcttcagatcattttaagg

SEQ ID NO: 1122078 - DNA, 22 bp, Artificial Sequence
  chemically synthesized
aaaatgatctgaagagatcagt

SEQ ID NO: 1122079 - DNA, 22 bp, Artificial Sequence
  chemically synthesized
aaatgatctgaagagatcagtg

SEQ ID NO: 1122080 - DNA, 22 bp, Artificial Sequence
  chemically synthesized
acacggtggaaaagaacactga

SEQ ID NO: 1122081 - DNA, 22 bp, Artificial Sequence
  chemically synthesized
aagagatcagtgttcttttcca

SEQ ID NO: 1122082 - DNA, 22 bp, Artificial Sequence
  chemically synthesized
tgccctcacacggtggaaaaga

SEQ ID NO: 1122083 - DNA, 22 bp, Artificial Sequence
  chemically synthesized
actgtgccctcacacggtggaa

SEQ ID NO: 1122084 - DNA, 22 bp, Artificial Sequence
  chemically synthesized
tcactgtgccctcacacggtgg

SEQ ID NO: 1122085 - DNA, 22 bp, Artificial Sequence
  chemically synthesized
tctcactgtgccctcacacggt

SEQ ID NO: 1122086 - DNA, 22 bp, Artificial Sequence
  chemically synthesized
ttttccaccgtgtgagggcaca

SEQ ID NO: 1122087 - DNA, 22 bp, Artificial Sequence
  chemically synthesized
gtgctctctcactgtgccctca

SEQ ID NO: 1122088 - DNA, 22 bp, Artificial Sequence
  chemically synthesized
ggtgctctctcactgtgccctc

SEQ ID NO: 1122089 - DNA, 22 bp, Artificial Sequence
  chemically synthesized
ttccaccgtgtgagggcacagt

SEQ ID NO: 1122090 - DNA, 22 bp, Artificial Sequence
  chemically synthesized
tccaccgtgtgagggcacagtg

SEQ ID NO: 1122091 - DNA, 22 bp, Artificial Sequence
  chemically synthesized
ccaccgtgtgagggcacagtga

SEQ ID NO: 1122092 - DNA, 22 bp, Artificial Sequence
  chemically synthesized
caccgtgtgagggcacagtgag

SEQ ID NO: 1122093 - DNA, 22 bp, Artificial Sequence
  chemically synthesized
atacttggtgctctctcactgt

SEQ ID NO: 1122094 - DNA, 22 bp, Artificial Sequence
  chemically synthesized
gttcatacttggtgctctctca

SEQ ID NO: 1122095 - DNA, 22 bp, Artificial Sequence
  chemically synthesized
ctggttcatacttggtgctctc

SEQ ID NO: 1122096 - DNA, 22 bp, Artificial Sequence
  chemically synthesized
cctggttcatacttggtgctct

SEQ ID NO: 1122097 - DNA, 22 bp, Artificial Sequence
  chemically synthesized
agggcaggcttcctggttcata

SEQ ID NO: 1122098 - DNA, 22 bp, Artificial Sequence
  chemically synthesized
aagggcaggcttcctggttcat

SEQ ID NO: 1122099 - DNA, 22 bp, Artificial Sequence
  chemically synthesized
taagggcaggcttcctggttca

SEQ ID NO: 1122100 - DNA, 22 bp, Artificial Sequence
  chemically synthesized
ttaagggcaggcttcctggttc

SEQ ID NO: 1122101 - DNA, 22 bp, Artificial Sequence
  chemically synthesized
gtgtcttttaagggcaggcttc

SEQ ID NO: 1122102 - DNA, 22 bp, Artificial Sequence
  chemically synthesized
agtgtcttttaagggcaggctt

SEQ ID NO: 1122103 - DNA, 22 bp, Artificial Sequence
  chemically synthesized
gcagatttagtgtcttttaagg

SEQ ID NO: 1122104 - DNA, 22 bp, Artificial Sequence
  chemically synthesized
cccttaaaagacactaaatctg

SEQ ID NO: 1122105 - DNA, 22 bp, Artificial Sequence
  chemically synthesized
atatcaagtaactagcagattt

SEQ ID NO: 1122106 - DNA, 22 bp, Artificial Sequence
  chemically synthesized
aatatcaagtaactagcagatt

SEQ ID NO: 1122107 - DNA, 22 bp, Artificial Sequence
  chemically synthesized
aaaagacactaaatctgctagt

SEQ ID NO: 1122108 - DNA, 22 bp, Artificial Sequence
  chemically synthesized
aaagacactaaatctgctagtt

SEQ ID NO: 1122109 - DNA, 22 bp, Artificial Sequence
  chemically synthesized
ggaagtttaatatcaagtaact

SEQ ID NO: 1122110 - DNA, 22 bp, Artificial Sequence
  chemically synthesized
gggaagtttaatatcaagtaac

SEQ ID NO: 1122111 - DNA, 22 bp, Artificial Sequence
  chemically synthesized
aatctgctagttacttgatatt

SEQ ID NO: 1122112 - DNA, 22 bp, Artificial Sequence
  chemically synthesized
gagtttgggaagtttaatatca

SEQ ID NO: 1122113 - DNA, 22 bp, Artificial Sequence
  chemically synthesized
tggagtttgggaagtttaatat

SEQ ID NO: 1122114 - DNA, 22 bp, Artificial Sequence
  chemically synthesized
ctagttacttgatattaaactt

SEQ ID NO: 1122115 - DNA, 22 bp, Artificial Sequence
  chemically synthesized
ctggagtttgggaagtttaata

SEQ ID NO: 1122116 - DNA, 22 bp, Artificial Sequence
  chemically synthesized
gttacttgatattaaacttccc

SEQ ID NO: 1122117 - DNA, 22 bp, Artificial Sequence
  chemically synthesized
ccatttctggagtttgggaagt

SEQ ID NO: 1122118 - DNA, 22 bp, Artificial Sequence
  chemically synthesized
cttgatattaaacttcccaaac

SEQ ID NO: 1122119 - DNA, 22 bp, Artificial Sequence
  chemically synthesized
gatattaaacttcccaaactcc

SEQ ID NO: 1122120 - DNA, 22 bp, Artificial Sequence
  chemically synthesized
atattaaacttcccaaactcca

SEQ ID NO: 1122121 - DNA, 22 bp, Artificial Sequence
  chemically synthesized
tgtctcccatttctggagtttg

SEQ ID NO: 1122122 - DNA, 22 bp, Artificial Sequence
  chemically synthesized
atgtctcccatttctggagttt

SEQ ID NO: 1122123 - DNA, 22 bp, Artificial Sequence
  chemically synthesized
aacttcccaaactccagaaatg

SEQ ID NO: 1122124 - DNA, 22 bp, Artificial Sequence
  chemically synthesized
cccaaactccagaaatgggaga

SEQ ID NO: 1122125 - DNA, 22 bp, Artificial Sequence
  chemically synthesized
ccaaactccagaaatgggagac

SEQ ID NO: 1122126 - DNA, 22 bp, Artificial Sequence
  chemically synthesized
taaaccacagaaatttatgtct

SEQ ID NO: 1122127 - DNA, 22 bp, Artificial Sequence
  chemically synthesized
ataaaccacagaaatttatgtc

SEQ ID NO: 1122128 - DNA, 22 bp, Artificial Sequence
  chemically synthesized
cagaaatgggagacataaattt

SEQ ID NO: 1122129 - DNA, 22 bp, Artificial Sequence
  chemically synthesized
ggtagcttataaaccacagaaa

SEQ ID NO: 1122130 - DNA, 22 bp, Artificial Sequence
  chemically synthesized
ctgtggtttataagctacccag

SEQ ID NO: 1122131 - DNA, 22 bp, Artificial Sequence
  chemically synthesized
tgtggtttataagctacccagt

SEQ ID NO: 1122132 - DNA, 22 bp, Artificial Sequence
  chemically synthesized
tggtttataagctacccagttt

SEQ ID NO: 1122133 - DNA, 22 bp, Artificial Sequence
  chemically synthesized
taacaaaataccataaactggg

SEQ ID NO: 1122134 - DNA, 22 bp, Artificial Sequence
  chemically synthesized
ctgtaacaaaataccataaact

SEQ ID NO: 1122135 - DNA, 22 bp, Artificial Sequence
  chemically synthesized
ataagctacccagtttatggta

SEQ ID NO: 1122136 - DNA, 22 bp, Artificial Sequence
  chemically synthesized
gctgtaacaaaataccataaac

SEQ ID NO: 1122137 - DNA, 22 bp, Artificial Sequence
  chemically synthesized
taagctacccagtttatggtat

SEQ ID NO: 1122138 - DNA, 22 bp, Artificial Sequence
  chemically synthesized
gtttgctgtaacaaaataccat

SEQ ID NO: 1122139 - DNA, 22 bp, Artificial Sequence
  chemically synthesized
cccagtttatggtattttgtta

SEQ ID NO: 1122140 - DNA, 22 bp, Artificial Sequence
  chemically synthesized
gttggtttgctgtaacaaaata

SEQ ID NO: 1122141 - DNA, 22 bp, Artificial Sequence
  chemically synthesized
agttggtttgctgtaacaaaat

SEQ ID NO: 1122142 - DNA, 22 bp, Artificial Sequence
  chemically synthesized
tagttggtttgctgtaacaaaa

SEQ ID NO: 1122143 - DNA, 22 bp, Artificial Sequence
  chemically synthesized
atggtattttgttacagcaaac

SEQ ID NO: 1122144 - DNA, 22 bp, Artificial Sequence
  chemically synthesized
tggtattttgttacagcaaacc

SEQ ID NO: 1122145 - DNA, 22 bp, Artificial Sequence
  chemically synthesized
tgttacagcaaaccaactaaaa

SEQ ID NO: 1122146 - DNA, 22 bp, Artificial Sequence
  chemically synthesized
gttacagcaaaccaactaaaac

SEQ ID NO: 1122147 - DNA, 22 bp, Artificial Sequence
  chemically synthesized
ttacagcaaaccaactaaaacc

SEQ ID NO: 1122148 - DNA, 22 bp, Artificial Sequence
  chemically synthesized
cagcaaaccaactaaaaccctc

SEQ ID NO: 1122149 - DNA, 22 bp, Artificial Sequence
  chemically synthesized
aacatgggaaggaagagagagg

SEQ ID NO: 1122150 - DNA, 22 bp, Artificial Sequence
  chemically synthesized
aaaccctctctcttccttccca

SEQ ID NO: 1122151 - DNA, 22 bp, Artificial Sequence
  chemically synthesized
caatacattaaacatgggaagg

SEQ ID NO: 1122152 - DNA, 22 bp, Artificial Sequence
  chemically synthesized
gcaatacattaaacatgggaag

SEQ ID NO: 1122153 - DNA, 22 bp, Artificial Sequence
  chemically synthesized
tgcaatacattaaacatgggaa

SEQ ID NO: 1122154 - DNA, 22 bp, Artificial Sequence
  chemically synthesized
tctcttccttcccatgtttaat

SEQ ID NO: 1122155 - DNA, 22 bp, Artificial Sequence
  chemically synthesized
gactttgcaatacattaaacat

SEQ ID NO: 1122156 - DNA, 22 bp, Artificial Sequence
  chemically synthesized
tcttccttcccatgtttaatgt

SEQ ID NO: 1122157 - DNA, 22 bp, Artificial Sequence
  chemically synthesized
ttccttcccatgtttaatgtat

SEQ ID NO: 1122158 - DNA, 22 bp, Artificial Sequence
  chemically synthesized
ccttcccatgtttaatgtattg

SEQ ID NO: 1122159 - DNA, 22 bp, Artificial Sequence
  chemically synthesized
cttcccatgtttaatgtattgc

SEQ ID NO: 1122160 - DNA, 22 bp, Artificial Sequence
  chemically synthesized
cccatgtttaatgtattgcaaa

SEQ ID NO: 1122161 - DNA, 22 bp, Artificial Sequence
  chemically synthesized
ccatgtttaatgtattgcaaag

SEQ ID NO: 1122162 - DNA, 22 bp, Artificial Sequence
  chemically synthesized
aatgtattgcaaagtctaatct

SEQ ID NO: 1122163 - DNA, 22 bp, Artificial Sequence
  chemically synthesized
atgtattgcaaagtctaatctg

SEQ ID NO: 1122164 - DNA, 22 bp, Artificial Sequence
  chemically synthesized
caaagtctaatctgtcacacat

SEQ ID NO: 1122165 - DNA, 22 bp, Artificial Sequence
  chemically synthesized
aggagacagagaatgtatgtgt

SEQ ID NO: 1122166 - DNA, 22 bp, Artificial Sequence
  chemically synthesized
atctgtcacacatacattctct

SEQ ID NO: 1122167 - DNA, 22 bp, Artificial Sequence
  chemically synthesized
tcacacatacattctctgtctc

SEQ ID NO: 1122168 - DNA, 22 bp, Artificial Sequence
  chemically synthesized
tctgtctcctgaatatgtatgc

SEQ ID NO: 1122169 - DNA, 22 bp, Artificial Sequence
  chemically synthesized
tgtctcctgaatatgtatgctt

SEQ ID NO: 1122170 - DNA, 22 bp, Artificial Sequence
  chemically synthesized
tggagacaggaagaagcataca

SEQ ID NO: 1122171 - DNA, 22 bp, Artificial Sequence
  chemically synthesized
tctcctgaatatgtatgcttct

SEQ ID NO: 1122172 - DNA, 22 bp, Artificial Sequence
  chemically synthesized
gctatggagacaggaagaagca

SEQ ID NO: 1122173 - DNA, 22 bp, Artificial Sequence
  chemically synthesized
ctgaatatgtatgcttcttcct

SEQ ID NO: 1122174 - DNA, 22 bp, Artificial Sequence
  chemically synthesized
tggctatggagacaggaagaag

SEQ ID NO: 1122175 - DNA, 22 bp, Artificial Sequence
  chemically synthesized
aatatgtatgcttcttcctgtc

SEQ ID NO: 1122176 - DNA, 22 bp, Artificial Sequence
  chemically synthesized
ggttctggctatggagacagga

SEQ ID NO: 1122177 - DNA, 22 bp, Artificial Sequence
  chemically synthesized
gggttctggctatggagacagg

SEQ ID NO: 1122178 - DNA, 22 bp, Artificial Sequence
  chemically synthesized
cttcctgtctccatagccagaa

SEQ ID NO: 1122179 - DNA, 22 bp, Artificial Sequence
  chemically synthesized
ttcctgtctccatagccagaac

SEQ ID NO: 1122180 - DNA, 22 bp, Artificial Sequence
  chemically synthesized
cctgtctccatagccagaaccc

SEQ ID NO: 1122181 - DNA, 22 bp, Artificial Sequence
  chemically synthesized
ctgtctccatagccagaaccca

SEQ ID NO: 1122182 - DNA, 22 bp, Artificial Sequence
  chemically synthesized
tctccatagccagaacccaaat

SEQ ID NO: 1122183 - DNA, 22 bp, Artificial Sequence
  chemically synthesized
atggcaacacagatttgggttc

SEQ ID NO: 1122184 - DNA, 22 bp, Artificial Sequence
  chemically synthesized
aatggcaacacagatttgggtt

SEQ ID NO: 1122185 - DNA, 22 bp, Artificial Sequence
  chemically synthesized
catagccagaacccaaatctgt

SEQ ID NO: 1122186 - DNA, 22 bp, Artificial Sequence
  chemically synthesized
gtcacatttaatggcaacacag

SEQ ID NO: 1122187 - DNA, 22 bp, Artificial Sequence
  chemically synthesized
ggtcacatttaatggcaacaca

SEQ ID NO: 1122188 - DNA, 22 bp, Artificial Sequence
  chemically synthesized
tggtcacatttaatggcaacac

SEQ ID NO: 1122189 - DNA, 22 bp, Artificial Sequence
  chemically synthesized
ttggtcacatttaatggcaaca

SEQ ID NO: 1122190 - DNA, 22 bp, Artificial Sequence
  chemically synthesized
cggtatttttggtcacatttaa

SEQ ID NO: 1122191 - DNA, 22 bp, Artificial Sequence
  chemically synthesized
ttgcggtatttttggtcacatt

SEQ ID NO: 1122192 - DNA, 22 bp, Artificial Sequence
  chemically synthesized
tgttgccattaaatgtgaccaa

SEQ ID NO: 1122193 - DNA, 22 bp, Artificial Sequence
  chemically synthesized
ccattaaatgtgaccaaaaata

SEQ ID NO: 1122194 - DNA, 22 bp, Artificial Sequence
  chemically synthesized
aatgtgaccaaaaataccgcaa

SEQ ID NO: 1122195 - DNA, 22 bp, Artificial Sequence
  chemically synthesized
cccagaggccaagtgaaaagct

SEQ ID NO: 1122196 - DNA, 22 bp, Artificial Sequence
  chemically synthesized
cataaatactgcccagaggcca

SEQ ID NO: 1122197 - DNA, 22 bp, Artificial Sequence
  chemically synthesized
ttcacttggcctctgggcagta

SEQ ID NO: 1122198 - DNA, 22 bp, Artificial Sequence
  chemically synthesized
tcacttggcctctgggcagtat

SEQ ID NO: 1122199 - DNA, 22 bp, Artificial Sequence
  chemically synthesized
cacttggcctctgggcagtatt

SEQ ID NO: 1122200 - DNA, 22 bp, Artificial Sequence
  chemically synthesized
acttggcctctgggcagtattt

SEQ ID NO: 1122201 - DNA, 22 bp, Artificial Sequence
  chemically synthesized
ggcctctgggcagtatttatgg

SEQ ID NO: 1122202 - DNA, 22 bp, Artificial Sequence
  chemically synthesized
gcctctgggcagtatttatgga

SEQ ID NO: 1122203 - DNA, 22 bp, Artificial Sequence
  chemically synthesized
tgggcagtatttatggaactct

SEQ ID NO: 1122204 - DNA, 22 bp, Artificial Sequence
  chemically synthesized
ggcagtatttatggaactctct

SEQ ID NO: 1122205 - DNA, 22 bp, Artificial Sequence
  chemically synthesized
cagtagtacataaaagagagag

SEQ ID NO: 1122206 - DNA, 22 bp, Artificial Sequence
  chemically synthesized
ccagtagtacataaaagagaga

SEQ ID NO: 1122207 - DNA, 22 bp, Artificial Sequence
  chemically synthesized
tccagtagtacataaaagagag

SEQ ID NO: 1122208 - DNA, 22 bp, Artificial Sequence
  chemically synthesized
ttccagtagtacataaaagaga

SEQ ID NO: 1122209 - DNA, 22 bp, Artificial Sequence
  chemically synthesized
atggaactctctcttttatgta

SEQ ID NO: 1122210 - DNA, 22 bp, Artificial Sequence
  chemically synthesized
tggaactctctcttttatgtac

SEQ ID NO: 1122211 - DNA, 22 bp, Artificial Sequence
  chemically synthesized
tctcttttatgtactactggaa

SEQ ID NO: 1122212 - DNA, 22 bp, Artificial Sequence
  chemically synthesized
tcttttatgtactactggaaaa

SEQ ID NO: 1122213 - DNA, 22 bp, Artificial Sequence
  chemically synthesized
ttttatgtactactggaaaaat

SEQ ID NO: 1122214 - DNA, 22 bp, Artificial Sequence
  chemically synthesized
ttatgtactactggaaaaatta

SEQ ID NO: 1122215 - DNA, 22 bp, Artificial Sequence
  chemically synthesized
tatgtactactggaaaaattat

SEQ ID NO: 1122216 - DNA, 22 bp, Artificial Sequence
  chemically synthesized
atgtactactggaaaaattatc

SEQ ID NO: 1122217 - DNA, 22 bp, Artificial Sequence
  chemically synthesized
tgtactactggaaaaattatca

SEQ ID NO: 1122218 - DNA, 22 bp, Artificial Sequence
  chemically synthesized
aaaaagatagaaatgataattt

SEQ ID NO: 1122219 - DNA, 22 bp, Artificial Sequence
  chemically synthesized
ctggaaaaattatcatttctat

SEQ ID NO: 1122220 - DNA, 22 bp, Artificial Sequence
  chemically synthesized
gaaaaattatcatttctatctt

SEQ ID NO: 1122221 - DNA, 22 bp, Artificial Sequence
  chemically synthesized
tgcgtcaattaaaaaagataga

SEQ ID NO: 1122222 - DNA, 22 bp, Artificial Sequence
  chemically synthesized
ttatgcgtcaattaaaaaagat

SEQ ID NO: 1122223 - DNA, 22 bp, Artificial Sequence
  chemically synthesized
tcatttctatcttttttaattg

SEQ ID NO: 1122224 - DNA, 22 bp, Artificial Sequence
  chemically synthesized
ctatcttttttaattgacgcat

SEQ ID NO: 1122225 - DNA, 22 bp, Artificial Sequence
  chemically synthesized
agtacatctattatgcgtcaat

SEQ ID NO: 1122226 - DNA, 22 bp, Artificial Sequence
  chemically synthesized
tatcttttttaattgacgcata

SEQ ID NO: 1122227 - DNA, 22 bp, Artificial Sequence
  chemically synthesized
tcttttttaattgacgcataat

SEQ ID NO: 1122228 - DNA, 22 bp, Artificial Sequence
  chemically synthesized
ttttaattgacgcataatagat

SEQ ID NO: 1122229 - DNA, 22 bp, Artificial Sequence
  chemically synthesized
tttaattgacgcataatagatg

SEQ ID NO: 1122230 - DNA, 22 bp, Artificial Sequence
  chemically synthesized
ttaattgacgcataatagatgt

SEQ ID NO: 1122231 - DNA, 22 bp, Artificial Sequence
  chemically synthesized
taattgacgcataatagatgta

SEQ ID NO: 1122232 - DNA, 22 bp, Artificial Sequence
  chemically synthesized
aattgacgcataatagatgtac

SEQ ID NO: 1122233 - DNA, 22 bp, Artificial Sequence
  chemically synthesized
attgacgcataatagatgtact

SEQ ID NO: 1122234 - DNA, 22 bp, Artificial Sequence
  chemically synthesized
acgcataatagatgtacttaga

SEQ ID NO: 1122235 - DNA, 22 bp, Artificial Sequence
  chemically synthesized
tcacatgtacccccaatctaag

SEQ ID NO: 1122236 - DNA, 22 bp, Artificial Sequence
  chemically synthesized
aattatcacatgtacccccaat

SEQ ID NO: 1122237 - DNA, 22 bp, Artificial Sequence
  chemically synthesized
agattgggggtacatgtgataa

SEQ ID NO: 1122238 - DNA, 22 bp, Artificial Sequence
  chemically synthesized
gattgggggtacatgtgataat

SEQ ID NO: 1122239 - DNA, 22 bp, Artificial Sequence
  chemically synthesized
tacggatatgttaaattatcac

SEQ ID NO: 1122240 - DNA, 22 bp, Artificial Sequence
  chemically synthesized
ggggtacatgtgataatttaac

SEQ ID NO: 1122241 - DNA, 22 bp, Artificial Sequence
  chemically synthesized
caaattatacggatatgttaaa

SEQ ID NO: 1122242 - DNA, 22 bp, Artificial Sequence
  chemically synthesized
acaaattatacggatatgttaa

SEQ ID NO: 1122243 - DNA, 22 bp, Artificial Sequence
  chemically synthesized
tacaaattatacggatatgtta

SEQ ID NO: 1122244 - DNA, 22 bp, Artificial Sequence
  chemically synthesized
atgcgatctttacaaattatac

SEQ ID NO: 1122245 - DNA, 22 bp, Artificial Sequence
  chemically synthesized
aacatatccgtataatttgtaa

SEQ ID NO: 1122246 - DNA, 22 bp, Artificial Sequence
  chemically synthesized
acatatccgtataatttgtaaa

SEQ ID NO: 1122247 - DNA, 22 bp, Artificial Sequence
  chemically synthesized
tggatatcccaagtacactgat

SEQ ID NO: 1122248 - DNA, 22 bp, Artificial Sequence
  chemically synthesized
gtaaagatcgcatcagtgtact

SEQ ID NO: 1122249 - DNA, 22 bp, Artificial Sequence
  chemically synthesized
taaagatcgcatcagtgtactt

SEQ ID NO: 1122250 - DNA, 22 bp, Artificial Sequence
  chemically synthesized
agattatggatatcccaagtac

SEQ ID NO: 1122251 - DNA, 22 bp, Artificial Sequence
  chemically synthesized
aagattatggatatcccaagta

SEQ ID NO: 1122252 - DNA, 22 bp, Artificial Sequence
  chemically synthesized
gcatagacaaatatttaagatt

SEQ ID NO: 1122253 - DNA, 22 bp, Artificial Sequence
  chemically synthesized
gggatatccataatcttaaata

SEQ ID NO: 1122254 - DNA, 22 bp, Artificial Sequence
  chemically synthesized
ggatatccataatcttaaatat

SEQ ID NO: 1122255 - DNA, 22 bp, Artificial Sequence
  chemically synthesized
aatgtatctagcatagacaaat

SEQ ID NO: 1122256 - DNA, 22 bp, Artificial Sequence
  chemically synthesized
gaatgtatctagcatagacaaa

SEQ ID NO: 1122257 - DNA, 22 bp, Artificial Sequence
  chemically synthesized
aaatatttgtctatgctagata

SEQ ID NO: 1122258 - DNA, 22 bp, Artificial Sequence
  chemically synthesized
aatatttgtctatgctagatac

SEQ ID NO: 1122259 - DNA, 22 bp, Artificial Sequence
  chemically synthesized
gaagagaataatttgaatgtat

SEQ ID NO: 1122260 - DNA, 22 bp, Artificial Sequence
  chemically synthesized
gtctatgctagatacattcaaa

SEQ ID NO: 1122261 - DNA, 22 bp, Artificial Sequence
  chemically synthesized
tctatgctagatacattcaaat

SEQ ID NO: 1122262 - DNA, 22 bp, Artificial Sequence
  chemically synthesized
tgctagatacattcaaattatt

SEQ ID NO: 1122263 - DNA, 22 bp, Artificial Sequence
  chemically synthesized
aaagtagctagaagagaataat

SEQ ID NO: 1122264 - DNA, 22 bp, Artificial Sequence
  chemically synthesized
gatacattcaaattattctctt

SEQ ID NO: 1122265 - DNA, 22 bp, Artificial Sequence
  chemically synthesized
caaagtagctagaagagaataa

SEQ ID NO: 1122266 - DNA, 22 bp, Artificial Sequence
  chemically synthesized
aaattattctcttctagctact

SEQ ID NO: 1122267 - DNA, 22 bp, Artificial Sequence
  chemically synthesized
ccgtatatttcaaagtagctag

SEQ ID NO: 1122268 - DNA, 22 bp, Artificial Sequence
  chemically synthesized
ctaccgtatatttcaaagtagc

SEQ ID NO: 1122269 - DNA, 22 bp, Artificial Sequence
  chemically synthesized
actaccgtatatttcaaagtag

SEQ ID NO: 1122270 - DNA, 22 bp, Artificial Sequence
  chemically synthesized
ttctcttctagctactttgaaa

SEQ ID NO: 1122271 - DNA, 22 bp, Artificial Sequence
  chemically synthesized
tactaccgtatatttcaaagta

SEQ ID NO: 1122272 - DNA, 22 bp, Artificial Sequence
  chemically synthesized
ttactaccgtatatttcaaagt

SEQ ID NO: 1122273 - DNA, 22 bp, Artificial Sequence
  chemically synthesized
tcttctagctactttgaaatat

SEQ ID NO: 1122274 - DNA, 22 bp, Artificial Sequence
  chemically synthesized
ttctagctactttgaaatatac

SEQ ID NO: 1122275 - DNA, 22 bp, Artificial Sequence
  chemically synthesized
ctagctactttgaaatatacgg

SEQ ID NO: 1122276 - DNA, 22 bp, Artificial Sequence
  chemically synthesized
tagctactttgaaatatacggt

SEQ ID NO: 1122277 - DNA, 22 bp, Artificial Sequence
  chemically synthesized
gctactttgaaatatacggtag

SEQ ID NO: 1122278 - DNA, 22 bp, Artificial Sequence
  chemically synthesized
ctttgaaatatacggtagtaaa

SEQ ID NO: 1122279 - DNA, 22 bp, Artificial Sequence
  chemically synthesized
tgaaatatacggtagtaaaaac

SEQ ID NO: 1122280 - DNA, 22 bp, Artificial Sequence
  chemically synthesized
gaaatatacggtagtaaaaaca

SEQ ID NO: 1122281 - DNA, 22 bp, Artificial Sequence
  chemically synthesized
aaatatacggtagtaaaaacat

SEQ ID NO: 1122282 - DNA, 22 bp, Artificial Sequence
  chemically synthesized
cgaatgaaggtaacataatcag

SEQ ID NO: 1122283 - DNA, 22 bp, Artificial Sequence
  chemically synthesized
acgaatgaaggtaacataatca

SEQ ID NO: 1122284 - DNA, 22 bp, Artificial Sequence
  chemically synthesized
tacgaatgaaggtaacataatc

SEQ ID NO: 1122285 - DNA, 22 bp, Artificial Sequence
  chemically synthesized
agtggttttacgaatgaaggta

SEQ ID NO: 1122286 - DNA, 22 bp, Artificial Sequence
  chemically synthesized
gagtggttttacgaatgaaggt

SEQ ID NO: 1122287 - DNA, 22 bp, Artificial Sequence
  chemically synthesized
tgagtggttttacgaatgaagg

SEQ ID NO: 1122288 - DNA, 22 bp, Artificial Sequence
  chemically synthesized
attatgttaccttcattcgtaa

SEQ ID NO: 1122289 - DNA, 22 bp, Artificial Sequence
  chemically synthesized
tgttaccttcattcgtaaaacc

SEQ ID NO: 1122290 - DNA, 22 bp, Artificial Sequence
  chemically synthesized
ccttcattcgtaaaaccactca

SEQ ID NO: 1122291 - DNA, 22 bp, Artificial Sequence
  chemically synthesized
cattcgtaaaaccactcaaaga

SEQ ID NO: 1122292 - DNA, 22 bp, Artificial Sequence
  chemically synthesized
attcgtaaaaccactcaaagac

SEQ ID NO: 1122293 - DNA, 22 bp, Artificial Sequence
  chemically synthesized
agaaaaatgagaaagtctttga

SEQ ID NO: 1122294 - DNA, 22 bp, Artificial Sequence
  chemically synthesized
gtaaaaccactcaaagactttc

SEQ ID NO: 1122295 - DNA, 22 bp, Artificial Sequence
  chemically synthesized
taagaaaaatgagaaagtcttt

SEQ ID NO: 1122296 - DNA, 22 bp, Artificial Sequence
  chemically synthesized
ttctaagaaaaatgagaaagtc

SEQ ID NO: 1122297 - DNA, 22 bp, Artificial Sequence
  chemically synthesized
attctaagaaaaatgagaaagt

SEQ ID NO: 1122298 - DNA, 22 bp, Artificial Sequence
  chemically synthesized
tattctaagaaaaatgagaaag

SEQ ID NO: 1122299 - DNA, 22 bp, Artificial Sequence
  chemically synthesized
tttattctaagaaaaatgagaa

SEQ ID NO: 1122300 - DNA, 22 bp, Artificial Sequence
  chemically synthesized
ttctttattctaagaaaaatga

SEQ ID NO: 1122301 - DNA, 22 bp, Artificial Sequence
  chemically synthesized
gttctttattctaagaaaaatg

SEQ ID NO: 1122302 - DNA, 22 bp, Artificial Sequence
  chemically synthesized
aaagactttctcatttttctta

SEQ ID NO: 1122303 - DNA, 22 bp, Artificial Sequence
  chemically synthesized
tgttctttattctaagaaaaat

SEQ ID NO: 1122304 - DNA, 22 bp, Artificial Sequence
  chemically synthesized
aaattttgttctttattctaag

SEQ ID NO: 1122305 - DNA, 22 bp, Artificial Sequence
  chemically synthesized
tctcatttttcttagaataaag

SEQ ID NO: 1122306 - DNA, 22 bp, Artificial Sequence
  chemically synthesized
ctcatttttcttagaataaaga

SEQ ID NO: 1122307 - DNA, 22 bp, Artificial Sequence
  chemically synthesized
tcatttttcttagaataaagaa

SEQ ID NO: 1122308 - DNA, 22 bp, Artificial Sequence
  chemically synthesized
atttttcttagaataaagaaca

SEQ ID NO: 1122309 - DNA, 22 bp, Artificial Sequence
  chemically synthesized
ttcttagaataaagaacaaaat

SEQ ID NO: 1122310 - DNA, 22 bp, Artificial Sequence
  chemically synthesized
tcttagaataaagaacaaaatt

SEQ ID NO: 1122311 - DNA, 22 bp, Artificial Sequence
  chemically synthesized
cttagaataaagaacaaaattt

SEQ ID NO: 1122312 - DNA, 22 bp, Artificial Sequence
  chemically synthesized
ttagaataaagaacaaaatttc

SEQ ID NO: 1122313 - DNA, 22 bp, Artificial Sequence
  chemically synthesized
agaataaagaacaaaatttcaa

SEQ ID NO: 1122314 - DNA, 22 bp, Artificial Sequence
  chemically synthesized
taaaggatcatgttgaaatttt

SEQ ID NO: 1122315 - DNA, 22 bp, Artificial Sequence
  chemically synthesized
gaataaagaacaaaatttcaac

SEQ ID NO: 1122316 - DNA, 22 bp, Artificial Sequence
  chemically synthesized
tgaaggccagattataaaggat

SEQ ID NO: 1122317 - DNA, 22 bp, Artificial Sequence
  chemically synthesized
caacatgatcctttataatctg

SEQ ID NO: 1122318 - DNA, 22 bp, Artificial Sequence
  chemically synthesized
aacatgatcctttataatctgg

SEQ ID NO: 1122319 - DNA, 22 bp, Artificial Sequence
  chemically synthesized
agaggtctatgaaggccagatt

SEQ ID NO: 1122320 - DNA, 22 bp, Artificial Sequence
  chemically synthesized
tataatctggccttcatagacc

SEQ ID NO: 1122321 - DNA, 22 bp, Artificial Sequence
  chemically synthesized
ataatctggccttcatagacct

SEQ ID NO: 1122322 - DNA, 22 bp, Artificial Sequence
  chemically synthesized
taatctggccttcatagacctc

SEQ ID NO: 1122323 - DNA, 22 bp, Artificial Sequence
  chemically synthesized
gccttcatagacctcttaactg

SEQ ID NO: 1122324 - DNA, 22 bp, Artificial Sequence
  chemically synthesized
catagacctcttaactgtatat

SEQ ID NO: 1122325 - DNA, 22 bp, Artificial Sequence
  chemically synthesized
atagacctcttaactgtatatt

SEQ ID NO: 1122326 - DNA, 22 bp, Artificial Sequence
  chemically synthesized
aataaaagacaaagtagaatat

SEQ ID NO: 1122327 - DNA, 22 bp, Artificial Sequence
  chemically synthesized
gaataaaagacaaagtagaata

SEQ ID NO: 1122328 - DNA, 22 bp, Artificial Sequence
  chemically synthesized
ttaactgtatattctactttgt

SEQ ID NO: 1122329 - DNA, 22 bp, Artificial Sequence
  chemically synthesized
aactgtatattctactttgtct

SEQ ID NO: 1122330 - DNA, 22 bp, Artificial Sequence
  chemically synthesized
actgtatattctactttgtctt

SEQ ID NO: 1122331 - DNA, 22 bp, Artificial Sequence
  chemically synthesized
caagtacttgaataaaagacaa

SEQ ID NO: 1122332 - DNA, 22 bp, Artificial Sequence
  chemically synthesized
tatattctactttgtcttttat

SEQ ID NO: 1122333 - DNA, 22 bp, Artificial Sequence
  chemically synthesized
tacaagtacttgaataaaagac

SEQ ID NO: 1122334 - DNA, 22 bp, Artificial Sequence
  chemically synthesized
ctacaagtacttgaataaaaga

SEQ ID NO: 1122335 - DNA, 22 bp, Artificial Sequence
  chemically synthesized
tttctacaagtacttgaataaa

SEQ ID NO: 1122336 - DNA, 22 bp, Artificial Sequence
  chemically synthesized
gtttctacaagtacttgaataa

SEQ ID NO: 1122337 - DNA, 22 bp, Artificial Sequence
  chemically synthesized
tactttgtcttttattcaagta

SEQ ID NO: 1122338 - DNA, 22 bp, Artificial Sequence
  chemically synthesized
ctttgtcttttattcaagtact

SEQ ID NO: 1122339 - DNA, 22 bp, Artificial Sequence
  chemically synthesized
tgtcttttattcaagtacttgt

SEQ ID NO: 1122340 - DNA, 22 bp, Artificial Sequence
  chemically synthesized
gtcttttattcaagtacttgta

SEQ ID NO: 1122341 - DNA, 22 bp, Artificial Sequence
  chemically synthesized
tcttttattcaagtacttgtag

SEQ ID NO: 1122342 - DNA, 22 bp, Artificial Sequence
  chemically synthesized
ttattcaagtacttgtagaaac

SEQ ID NO: 1122343 - DNA, 22 bp, Artificial Sequence
  chemically synthesized
tattcaagtacttgtagaaaca

SEQ ID NO: 1122344 - DNA, 22 bp, Artificial Sequence
  chemically synthesized
attcaagtacttgtagaaacaa

SEQ ID NO: 1122345 - DNA, 22 bp, Artificial Sequence
  chemically synthesized
ttcaagtacttgtagaaacaaa

SEQ ID NO: 1122346 - DNA, 22 bp, Artificial Sequence
  chemically synthesized
aagtacttgtagaaacaaattt

SEQ ID NO: 1122347 - DNA, 22 bp, Artificial Sequence
  chemically synthesized
gaaaatatgaagcgaaatttgt

SEQ ID NO: 1122348 - DNA, 22 bp, Artificial Sequence
  chemically synthesized
agaaaatatgaagcgaaatttg

SEQ ID NO: 1122349 - DNA, 22 bp, Artificial Sequence
  chemically synthesized
tagaaaatatgaagcgaaattt

SEQ ID NO: 1122350 - DNA, 22 bp, Artificial Sequence
  chemically synthesized
ctttagaaaatatgaagcgaaa

SEQ ID NO: 1122351 - DNA, 22 bp, Artificial Sequence
  chemically synthesized
gtagaaacaaatttcgcttcat

SEQ ID NO: 1122352 - DNA, 22 bp, Artificial Sequence
  chemically synthesized
tagaaacaaatttcgcttcata

SEQ ID NO: 1122353 - DNA, 22 bp, Artificial Sequence
  chemically synthesized
aattactttagaaaatatgaag

SEQ ID NO: 1122354 - DNA, 22 bp, Artificial Sequence
  chemically synthesized
tgaattactttagaaaatatga

SEQ ID NO: 1122355 - DNA, 22 bp, Artificial Sequence
  chemically synthesized
cgcttcatattttctaaagtaa

SEQ ID NO: 1122356 - DNA, 22 bp, Artificial Sequence
  chemically synthesized
gcttcatattttctaaagtaat

SEQ ID NO: 1122357 - DNA, 22 bp, Artificial Sequence
  chemically synthesized
catattttctaaagtaattcag

SEQ ID NO: 1122358 - DNA, 22 bp, Artificial Sequence
  chemically synthesized
atattttctaaagtaattcaga

SEQ ID NO: 1122359 - DNA, 22 bp, Artificial Sequence
  chemically synthesized
tctaaagtaattcagagctatt

SEQ ID NO: 1122360 - DNA, 22 bp, Artificial Sequence
  chemically synthesized
ctaaagtaattcagagctattc

SEQ ID NO: 1122361 - DNA, 22 bp, Artificial Sequence
  chemically synthesized
taaagtaattcagagctattct

SEQ ID NO: 1122362 - DNA, 22 bp, Artificial Sequence
  chemically synthesized
aagtaattcagagctattcttt

SEQ ID NO: 1122363 - DNA, 22 bp, Artificial Sequence
  chemically synthesized
gaggaggaacaagaataaagaa

SEQ ID NO: 1122364 - DNA, 22 bp, Artificial Sequence
  chemically synthesized
agagctattctttattcttgtt

SEQ ID NO: 1122365 - DNA, 22 bp, Artificial Sequence
  chemically synthesized
cattggaggaggaacaagaata

SEQ ID NO: 1122366 - DNA, 22 bp, Artificial Sequence
  chemically synthesized
ttccattggaggaggaacaaga

SEQ ID NO: 1122367 - DNA, 22 bp, Artificial Sequence
  chemically synthesized
attccattggaggaggaacaag

SEQ ID NO: 1122368 - DNA, 22 bp, Artificial Sequence
  chemically synthesized
tattccattggaggaggaacaa

SEQ ID NO: 1122369 - DNA, 22 bp, Artificial Sequence
  chemically synthesized
ttctttattcttgttcctcctc

SEQ ID NO: 1122370 - DNA, 22 bp, Artificial Sequence
  chemically synthesized
tttattcttgttcctcctccaa

SEQ ID NO: 1122371 - DNA, 22 bp, Artificial Sequence
  chemically synthesized
tattcttgttcctcctccaatg

SEQ ID NO: 1122372 - DNA, 22 bp, Artificial Sequence
  chemically synthesized
attcttgttcctcctccaatgg

SEQ ID NO: 1122373 - DNA, 22 bp, Artificial Sequence
  chemically synthesized
ttcttgttcctcctccaatgga

SEQ ID NO: 1122374 - DNA, 22 bp, Artificial Sequence
  chemically synthesized
ttgttcctcctccaatggaata

SEQ ID NO: 1122375 - DNA, 22 bp, Artificial Sequence
  chemically synthesized
gttcctcctccaatggaataaa

SEQ ID NO: 1122376 - DNA, 22 bp, Artificial Sequence
  chemically synthesized
ttcctcctccaatggaataaaa

SEQ ID NO: 1122377 - DNA, 22 bp, Artificial Sequence
  chemically synthesized
ctcctccaatggaataaaatcc

SEQ ID NO: 1122378 - DNA, 22 bp, Artificial Sequence
  chemically synthesized
ctccaatggaataaaatccttc

SEQ ID NO: 1122379 - DNA, 22 bp, Artificial Sequence
  chemically synthesized
tggaagagtcagtgaaggattt

SEQ ID NO: 1122380 - DNA, 22 bp, Artificial Sequence
  chemically synthesized
atggaagagtcagtgaaggatt

SEQ ID NO: 1122381 - DNA, 22 bp, Artificial Sequence
  chemically synthesized
caatggaataaaatccttcact

SEQ ID NO: 1122382 - DNA, 22 bp, Artificial Sequence
  chemically synthesized
aaaatatttatggaagagtcag

SEQ ID NO: 1122383 - DNA, 22 bp, Artificial Sequence
  chemically synthesized
caaaatatttatggaagagtca

SEQ ID NO: 1122384 - DNA, 22 bp, Artificial Sequence
  chemically synthesized
tcaaaatatttatggaagagtc

SEQ ID NO: 1122385 - DNA, 22 bp, Artificial Sequence
  chemically synthesized
cactgactcttccataaatatt

SEQ ID NO: 1122386 - DNA, 22 bp, Artificial Sequence
  chemically synthesized
actgactcttccataaatattt

SEQ ID NO: 1122387 - DNA, 22 bp, Artificial Sequence
  chemically synthesized
acaacccagttttcaaaatatt

SEQ ID NO: 1122388 - DNA, 22 bp, Artificial Sequence
  chemically synthesized
actcttccataaatattttgaa

SEQ ID NO: 1122389 - DNA, 22 bp, Artificial Sequence
  chemically synthesized
ttccataaatattttgaaaact

SEQ ID NO: 1122390 - DNA, 22 bp, Artificial Sequence
  chemically synthesized
tattaacaacccagttttcaaa

SEQ ID NO: 1122391 - DNA, 22 bp, Artificial Sequence
  chemically synthesized
ccataaatattttgaaaactgg

SEQ ID NO: 1122392 - DNA, 22 bp, Artificial Sequence
  chemically synthesized
cataaatattttgaaaactggg

SEQ ID NO: 1122393 - DNA, 22 bp, Artificial Sequence
  chemically synthesized
tgaaaactgggttgttaatata

SEQ ID NO: 1122394 - DNA, 22 bp, Artificial Sequence
  chemically synthesized
gaaaactgggttgttaatataa

SEQ ID NO: 1122395 - DNA, 22 bp, Artificial Sequence
  chemically synthesized
aaaactgggttgttaatataat

SEQ ID NO: 1122396 - DNA, 22 bp, Artificial Sequence
  chemically synthesized
ggttgttaatataatgcatttg

SEQ ID NO: 1122397 - DNA, 22 bp, Artificial Sequence
  chemically synthesized
accaaagtggcccaaatgcatt

SEQ ID NO: 1122398 - DNA, 22 bp, Artificial Sequence
  chemically synthesized
caccaaagtggcccaaatgcat

SEQ ID NO: 1122399 - DNA, 22 bp, Artificial Sequence
  chemically synthesized
ttaatataatgcatttgggcca

SEQ ID NO: 1122400 - DNA, 22 bp, Artificial Sequence
  chemically synthesized
atataatgcatttgggccactt

SEQ ID NO: 1122401 - DNA, 22 bp, Artificial Sequence
  chemically synthesized
agtcagacaaataaatttcacc

SEQ ID NO: 1122402 - DNA, 22 bp, Artificial Sequence
  chemically synthesized
gggccactttggtgaaatttat

SEQ ID NO: 1122403 - DNA, 22 bp, Artificial Sequence
  chemically synthesized
ggccactttggtgaaatttatt

SEQ ID NO: 1122404 - DNA, 22 bp, Artificial Sequence
  chemically synthesized
tggtgaaatttatttgtctgac

SEQ ID NO: 1122405 - DNA, 22 bp, Artificial Sequence
  chemically synthesized
atgtataattgagtcagacaaa

SEQ ID NO: 1122406 - DNA, 22 bp, Artificial Sequence
  chemically synthesized
ggtgaaatttatttgtctgact

SEQ ID NO: 1122407 - DNA, 22 bp, Artificial Sequence
  chemically synthesized
gatgtataattgagtcagacaa

SEQ ID NO: 1122408 - DNA, 22 bp, Artificial Sequence
  chemically synthesized
gtgaaatttatttgtctgactc

SEQ ID NO: 1122409 - DNA, 22 bp, Artificial Sequence
  chemically synthesized
atttgtctgactcaattataca

SEQ ID NO: 1122410 - DNA, 22 bp, Artificial Sequence
  chemically synthesized
tttgtctgactcaattatacat

SEQ ID NO: 1122411 - DNA, 22 bp, Artificial Sequence
  chemically synthesized
gtctgactcaattatacatcaa

SEQ ID NO: 1122412 - DNA, 22 bp, Artificial Sequence
  chemically synthesized
tctgactcaattatacatcaaa

SEQ ID NO: 1122413 - DNA, 22 bp, Artificial Sequence
  chemically synthesized
tgagtcagagggtatttgatgt

SEQ ID NO: 1122414 - DNA, 22 bp, Artificial Sequence
  chemically synthesized
atgagtcagagggtatttgatg

SEQ ID NO: 1122415 - DNA, 22 bp, Artificial Sequence
  chemically synthesized
actcaattatacatcaaatacc

SEQ ID NO: 1122416 - DNA, 22 bp, Artificial Sequence
  chemically synthesized
aattatacatcaaataccctct

SEQ ID NO: 1122417 - DNA, 22 bp, Artificial Sequence
  chemically synthesized
atatttatgagtcagagggtat

SEQ ID NO: 1122418 - DNA, 22 bp, Artificial Sequence
  chemically synthesized
tacatcaaataccctctgactc

SEQ ID NO: 1122419 - DNA, 22 bp, Artificial Sequence
  chemically synthesized
tctcatatttatgagtcagagg

SEQ ID NO: 1122420 - DNA, 22 bp, Artificial Sequence
  chemically synthesized
ctatctcatatttatgagtcag

SEQ ID NO: 1122421 - DNA, 22 bp, Artificial Sequence
  chemically synthesized
gtggatattcctatctcatatt

SEQ ID NO: 1122422 - DNA, 22 bp, Artificial Sequence
  chemically synthesized
tgactcataaatatgagatagg

SEQ ID NO: 1122423 - DNA, 22 bp, Artificial Sequence
  chemically synthesized
actcataaatatgagataggaa

SEQ ID NO: 1122424 - DNA, 22 bp, Artificial Sequence
  chemically synthesized
ataaatatgagataggaatatc

SEQ ID NO: 1122425 - DNA, 22 bp, Artificial Sequence
  chemically synthesized
aaagtgactggtggatattcct

SEQ ID NO: 1122426 - DNA, 22 bp, Artificial Sequence
  chemically synthesized
gaaagtgactggtggatattcc

SEQ ID NO: 1122427 - DNA, 22 bp, Artificial Sequence
  chemically synthesized
aagcgtgaatttgaaagtgact

SEQ ID NO: 1122428 - DNA, 22 bp, Artificial Sequence
  chemically synthesized
aaagcgtgaatttgaaagtgac

SEQ ID NO: 1122429 - DNA, 22 bp, Artificial Sequence
  chemically synthesized
agtttaaagcgtgaatttgaaa

SEQ ID NO: 1122430 - DNA, 22 bp, Artificial Sequence
  chemically synthesized
gagagattaagtttaaagcgtg

SEQ ID NO: 1122431 - DNA, 22 bp, Artificial Sequence
  chemically synthesized
tcaaattcacgctttaaactta

SEQ ID NO: 1122432 - DNA, 22 bp, Artificial Sequence
  chemically synthesized
caaattcacgctttaaacttaa

SEQ ID NO: 1122433 - DNA, 22 bp, Artificial Sequence
  chemically synthesized
aaattcacgctttaaacttaat

SEQ ID NO: 1122434 - DNA, 22 bp, Artificial Sequence
  chemically synthesized
acgctttaaacttaatctctct

SEQ ID NO: 1122435 - DNA, 22 bp, Artificial Sequence
  chemically synthesized
taaacttaatctctctagtctc

SEQ ID NO: 1122436 - DNA, 22 bp, Artificial Sequence
  chemically synthesized
aaacttaatctctctagtctca

SEQ ID NO: 1122437 - DNA, 22 bp, Artificial Sequence
  chemically synthesized
aacttaatctctctagtctcac

SEQ ID NO: 1122438 - DNA, 22 bp, Artificial Sequence
  chemically synthesized
aatcaaatgagggtgagactag

SEQ ID NO: 1122439 - DNA, 22 bp, Artificial Sequence
  chemically synthesized
aatctctctagtctcaccctca

SEQ ID NO: 1122440 - DNA, 22 bp, Artificial Sequence
  chemically synthesized
atctctctagtctcaccctcat

SEQ ID NO: 1122441 - DNA, 22 bp, Artificial Sequence
  chemically synthesized
tctagtctcaccctcatttgat

SEQ ID NO: 1122442 - DNA, 22 bp, Artificial Sequence
  chemically synthesized
gagatagtctaaatcaaatgag

SEQ ID NO: 1122443 - DNA, 22 bp, Artificial Sequence
  chemically synthesized
agagatagtctaaatcaaatga

SEQ ID NO: 1122444 - DNA, 22 bp, Artificial Sequence
  chemically synthesized
tagtctcaccctcatttgattt

SEQ ID NO: 1122445 - DNA, 22 bp, Artificial Sequence
  chemically synthesized
ttagagatagtctaaatcaaat

SEQ ID NO: 1122446 - DNA, 22 bp, Artificial Sequence
  chemically synthesized
gtctcaccctcatttgatttag

SEQ ID NO: 1122447 - DNA, 22 bp, Artificial Sequence
  chemically synthesized
cttagagatagtctaaatcaaa

SEQ ID NO: 1122448 - DNA, 22 bp, Artificial Sequence
  chemically synthesized
tcttagagatagtctaaatcaa

SEQ ID NO: 1122449 - DNA, 22 bp, Artificial Sequence
  chemically synthesized
accctcatttgatttagactat

SEQ ID NO: 1122450 - DNA, 22 bp, Artificial Sequence
  chemically synthesized
atttgatttagactatctctaa

SEQ ID NO: 1122451 - DNA, 22 bp, Artificial Sequence
  chemically synthesized
gatttagactatctctaagaaa

SEQ ID NO: 1122452 - DNA, 22 bp, Artificial Sequence
  chemically synthesized
atttagactatctctaagaaag

SEQ ID NO: 1122453 - DNA, 22 bp, Artificial Sequence
  chemically synthesized
agactatctctaagaaagattg

SEQ ID NO: 1122454 - DNA, 22 bp, Artificial Sequence
  chemically synthesized
agtagaagtgagcaatctttct

SEQ ID NO: 1122455 - DNA, 22 bp, Artificial Sequence
  chemically synthesized
gactatctctaagaaagattgc

SEQ ID NO: 1122456 - DNA, 22 bp, Artificial Sequence
  chemically synthesized
taagtagaagtgagcaatcttt

SEQ ID NO: 1122457 - DNA, 22 bp, Artificial Sequence
  chemically synthesized
tctctaagaaagattgctcact

SEQ ID NO: 1122458 - DNA, 22 bp, Artificial Sequence
  chemically synthesized
taagaaagattgctcacttcta

SEQ ID NO: 1122459 - DNA, 22 bp, Artificial Sequence
  chemically synthesized
agggacctctaagtagaagtga

SEQ ID NO: 1122460 - DNA, 22 bp, Artificial Sequence
  chemically synthesized
agaaagattgctcacttctact

SEQ ID NO: 1122461 - DNA, 22 bp, Artificial Sequence
  chemically synthesized
cagggacctctaagtagaagtg

SEQ ID NO: 1122462 - DNA, 22 bp, Artificial Sequence
  chemically synthesized
agtttcagggacctctaagtag

SEQ ID NO: 1122463 - DNA, 22 bp, Artificial Sequence
  chemically synthesized
gagtttcagggacctctaagta

SEQ ID NO: 1122464 - DNA, 22 bp, Artificial Sequence
  chemically synthesized
ctcacttctacttagaggtccc

SEQ ID NO: 1122465 - DNA, 22 bp, Artificial Sequence
  chemically synthesized
acttctacttagaggtccctga

SEQ ID NO: 1122466 - DNA, 22 bp, Artificial Sequence
  chemically synthesized
aggcacgtttgagtttcaggga

SEQ ID NO: 1122467 - DNA, 22 bp, Artificial Sequence
  chemically synthesized
ctacttagaggtccctgaaact

SEQ ID NO: 1122468 - DNA, 22 bp, Artificial Sequence
  chemically synthesized
gaggcacgtttgagtttcaggg

SEQ ID NO: 1122469 - DNA, 22 bp, Artificial Sequence
  chemically synthesized
tacttagaggtccctgaaactc

SEQ ID NO: 1122470 - DNA, 22 bp, Artificial Sequence
  chemically synthesized
cttagaggtccctgaaactcaa

SEQ ID NO: 1122471 - DNA, 22 bp, Artificial Sequence
  chemically synthesized
agaggtccctgaaactcaaacg

SEQ ID NO: 1122472 - DNA, 22 bp, Artificial Sequence
  chemically synthesized
gaggtccctgaaactcaaacgt

SEQ ID NO: 1122473 - DNA, 22 bp, Artificial Sequence
  chemically synthesized
gtaccttgaggcacgtttgagt

SEQ ID NO: 1122474 - DNA, 22 bp, Artificial Sequence
  chemically synthesized
aaactcaaacgtgcctcaaggt

SEQ ID NO: 1122475 - DNA, 22 bp, Artificial Sequence
  chemically synthesized
tcatgccagcctagtaccttga

SEQ ID NO: 1122476 - DNA, 22 bp, Artificial Sequence
  chemically synthesized
aaacgtgcctcaaggtactagg

SEQ ID NO: 1122477 - DNA, 22 bp, Artificial Sequence
  chemically synthesized
agctgtcatgccagcctagtac

SEQ ID NO: 1122478 - DNA, 22 bp, Artificial Sequence
  chemically synthesized
cagctgtcatgccagcctagta

SEQ ID NO: 1122479 - DNA, 22 bp, Artificial Sequence
  chemically synthesized
tcagctgtcatgccagcctagt

SEQ ID NO: 1122480 - DNA, 22 bp, Artificial Sequence
  chemically synthesized
tttcagctgtcatgccagccta

SEQ ID NO: 1122481 - DNA, 22 bp, Artificial Sequence
  chemically synthesized
ctttcagctgtcatgccagcct

SEQ ID NO: 1122482 - DNA, 22 bp, Artificial Sequence
  chemically synthesized
aaggtactaggctggcatgaca

SEQ ID NO: 1122483 - DNA, 22 bp, Artificial Sequence
  chemically synthesized
agcagatttctttcagctgtca

SEQ ID NO: 1122484 - DNA, 22 bp, Artificial Sequence
  chemically synthesized
cagcagatttctttcagctgtc

SEQ ID NO: 1122485 - DNA, 22 bp, Artificial Sequence
  chemically synthesized
ggctggcatgacagctgaaaga

SEQ ID NO: 1122486 - DNA, 22 bp, Artificial Sequence
  chemically synthesized
gcatgacagctgaaagaaatct

SEQ ID NO: 1122487 - DNA, 22 bp, Artificial Sequence
  chemically synthesized
caacataggcttcagcagattt

SEQ ID NO: 1122488 - DNA, 22 bp, Artificial Sequence
  chemically synthesized
tccaacataggcttcagcagat

SEQ ID NO: 1122489 - DNA, 22 bp, Artificial Sequence
  chemically synthesized
ctccaacataggcttcagcaga

SEQ ID NO: 1122490 - DNA, 22 bp, Artificial Sequence
  chemically synthesized
tctccaacataggcttcagcag

SEQ ID NO: 1122491 - DNA, 22 bp, Artificial Sequence
  chemically synthesized
aaagaaatctgctgaagcctat

SEQ ID NO: 1122492 - DNA, 22 bp, Artificial Sequence
  chemically synthesized
gtagaaatctttctccaacata

SEQ ID NO: 1122493 - DNA, 22 bp, Artificial Sequence
  chemically synthesized
ctgaagcctatgttggagaaag

SEQ ID NO: 1122494 - DNA, 22 bp, Artificial Sequence
  chemically synthesized
aagcctatgttggagaaagatt

SEQ ID NO: 1122495 - DNA, 22 bp, Artificial Sequence
  chemically synthesized
aacgcctagtagaaatctttct

SEQ ID NO: 1122496 - DNA, 22 bp, Artificial Sequence
  chemically synthesized
tgttggagaaagatttctacta

SEQ ID NO: 1122497 - DNA, 22 bp, Artificial Sequence
  chemically synthesized
gagaaagatttctactaggcgt

SEQ ID NO: 1122498 - DNA, 22 bp, Artificial Sequence
  chemically synthesized
ctactaggcgttgaattgacat

SEQ ID NO: 1122499 - DNA, 22 bp, Artificial Sequence
  chemically synthesized
tactaggcgttgaattgacatt

SEQ ID NO: 1122500 - DNA, 22 bp, Artificial Sequence
  chemically synthesized
ctaggcgttgaattgacattgc

SEQ ID NO: 1122501 - DNA, 22 bp, Artificial Sequence
  chemically synthesized
ggcgttgaattgacattgctct

SEQ ID NO: 1122502 - DNA, 22 bp, Artificial Sequence
  chemically synthesized
cagtgtgcaaacaagagcaatg

SEQ ID NO: 1122503 - DNA, 22 bp, Artificial Sequence
  chemically synthesized
aattgacattgctcttgtttgc

SEQ ID NO: 1122504 - DNA, 22 bp, Artificial Sequence
  chemically synthesized
agcccctacagtgtgcaaacaa

SEQ ID NO: 1122505 - DNA, 22 bp, Artificial Sequence
  chemically synthesized
tgagcccctacagtgtgcaaac

SEQ ID NO: 1122506 - DNA, 22 bp, Artificial Sequence
  chemically synthesized
acattgctcttgtttgcacact

SEQ ID NO: 1122507 - DNA, 22 bp, Artificial Sequence
  chemically synthesized
ctgagcccctacagtgtgcaaa

SEQ ID NO: 1122508 - DNA, 22 bp, Artificial Sequence
  chemically synthesized
tctgagcccctacagtgtgcaa

SEQ ID NO: 1122509 - DNA, 22 bp, Artificial Sequence
  chemically synthesized
ctcttgtttgcacactgtaggg

SEQ ID NO: 1122510 - DNA, 22 bp, Artificial Sequence
  chemically synthesized
ttgtttgcacactgtaggggct

SEQ ID NO: 1122511 - DNA, 22 bp, Artificial Sequence
  chemically synthesized
gtttgcacactgtaggggctca

SEQ ID NO: 1122512 - DNA, 22 bp, Artificial Sequence
  chemically synthesized
tttgcacactgtaggggctcag

SEQ ID NO: 1122513 - DNA, 22 bp, Artificial Sequence
  chemically synthesized
gggtatcgttttctgagcccct

SEQ ID NO: 1122514 - DNA, 22 bp, Artificial Sequence
  chemically synthesized
ggggtatcgttttctgagcccc

SEQ ID NO: 1122515 - DNA, 22 bp, Artificial Sequence
  chemically synthesized
tggggtatcgttttctgagccc

SEQ ID NO: 1122516 - DNA, 22 bp, Artificial Sequence
  chemically synthesized
gcacactgtaggggctcagaaa

SEQ ID NO: 1122517 - DNA, 22 bp, Artificial Sequence
  chemically synthesized
cacactgtaggggctcagaaaa

SEQ ID NO: 1122518 - DNA, 22 bp, Artificial Sequence
  chemically synthesized
taggggctcagaaaacgatacc

SEQ ID NO: 1122519 - DNA, 22 bp, Artificial Sequence
  chemically synthesized
agaaaacgataccccaaagtat

SEQ ID NO: 1122520 - DNA, 22 bp, Artificial Sequence
  chemically synthesized
agcatgccaaagtgccatactt

SEQ ID NO: 1122521 - DNA, 22 bp, Artificial Sequence
  chemically synthesized
cagcatgccaaagtgccatact

SEQ ID NO: 1122522 - DNA, 22 bp, Artificial Sequence
  chemically synthesized
aaagtttcagcatgccaaagtg

SEQ ID NO: 1122523 - DNA, 22 bp, Artificial Sequence
  chemically synthesized
gttcaaagtttcagcatgccaa

SEQ ID NO: 1122524 - DNA, 22 bp, Artificial Sequence
  chemically synthesized
agttcaaagtttcagcatgcca

SEQ ID NO: 1122525 - DNA, 22 bp, Artificial Sequence
  chemically synthesized
tagttcaaagtttcagcatgcc

SEQ ID NO: 1122526 - DNA, 22 bp, Artificial Sequence
  chemically synthesized
tttagttcaaagtttcagcatg

SEQ ID NO: 1122527 - DNA, 22 bp, Artificial Sequence
  chemically synthesized
cagtgttctttagttcaaagtt

SEQ ID NO: 1122528 - DNA, 22 bp, Artificial Sequence
  chemically synthesized
tggcatgctgaaactttgaact

SEQ ID NO: 1122529 - DNA, 22 bp, Artificial Sequence
  chemically synthesized
ccagtgttctttagttcaaagt

SEQ ID NO: 1122530 - DNA, 22 bp, Artificial Sequence
  chemically synthesized
ggcatgctgaaactttgaacta

SEQ ID NO: 1122531 - DNA, 22 bp, Artificial Sequence
  chemically synthesized
gcatgctgaaactttgaactaa

SEQ ID NO: 1122532 - DNA, 22 bp, Artificial Sequence
  chemically synthesized
aggccttccagtgttctttagt

SEQ ID NO: 1122533 - DNA, 22 bp, Artificial Sequence
  chemically synthesized
gaggccttccagtgttctttag

SEQ ID NO: 1122534 - DNA, 22 bp, Artificial Sequence
  chemically synthesized
tgaggccttccagtgttcttta

SEQ ID NO: 1122535 - DNA, 22 bp, Artificial Sequence
  chemically synthesized
aaactttgaactaaagaacact

SEQ ID NO: 1122536 - DNA, 22 bp, Artificial Sequence
  chemically synthesized
ttgaggccttccagtgttcttt

SEQ ID NO: 1122537 - DNA, 22 bp, Artificial Sequence
  chemically synthesized
cttttgaggccttccagtgttc

SEQ ID NO: 1122538 - DNA, 22 bp, Artificial Sequence
  chemically synthesized
tgaactaaagaacactggaagg

SEQ ID NO: 1122539 - DNA, 22 bp, Artificial Sequence
  chemically synthesized
gaactaaagaacactggaaggc

SEQ ID NO: 1122540 - DNA, 22 bp, Artificial Sequence
  chemically synthesized
aactaaagaacactggaaggcc

SEQ ID NO: 1122541 - DNA, 22 bp, Artificial Sequence
  chemically synthesized
aggctgcttttgaggccttcca

SEQ ID NO: 1122542 - DNA, 22 bp, Artificial Sequence
  chemically synthesized
gaggctgcttttgaggccttcc

SEQ ID NO: 1122543 - DNA, 22 bp, Artificial Sequence
  chemically synthesized
tgaggctgcttttgaggccttc

SEQ ID NO: 1122544 - DNA, 22 bp, Artificial Sequence
  chemically synthesized
aagaacactggaaggcctcaaa

SEQ ID NO: 1122545 - DNA, 22 bp, Artificial Sequence
  chemically synthesized
gttttgaggctgcttttgaggc

SEQ ID NO: 1122546 - DNA, 22 bp, Artificial Sequence
  chemically synthesized
ggttttgaggctgcttttgagg

SEQ ID NO: 1122547 - DNA, 22 bp, Artificial Sequence
  chemically synthesized
gaaggcctcaaaagcagcctca

SEQ ID NO: 1122548 - DNA, 22 bp, Artificial Sequence
  chemically synthesized
aaaagcagcctcaaaaccaagg

SEQ ID NO: 1122549 - DNA, 22 bp, Artificial Sequence
  chemically synthesized
aaaaccaaggtccctctgacct

SEQ ID NO: 1122550 - DNA, 22 bp, Artificial Sequence
  chemically synthesized
aagacaggaggggaggagaagg

SEQ ID NO: 1122551 - DNA, 22 bp, Artificial Sequence
  chemically synthesized
tgaccttctcctcccctcctgt

SEQ ID NO: 1122552 - DNA, 22 bp, Artificial Sequence
  chemically synthesized
accttctcctcccctcctgtct

SEQ ID NO: 1122553 - DNA, 22 bp, Artificial Sequence
  chemically synthesized
ctcctcccctcctgtctttaac

SEQ ID NO: 1122554 - DNA, 22 bp, Artificial Sequence
  chemically synthesized
tcctcccctcctgtctttaact

SEQ ID NO: 1122555 - DNA, 22 bp, Artificial Sequence
  chemically synthesized
ctcccctcctgtctttaactcc

SEQ ID NO: 1122556 - DNA, 22 bp, Artificial Sequence
  chemically synthesized
agggaagaatgtggagttaaag

SEQ ID NO: 1122557 - DNA, 22 bp, Artificial Sequence
  chemically synthesized
cagggaagaatgtggagttaaa

SEQ ID NO: 1122558 - DNA, 22 bp, Artificial Sequence
  chemically synthesized
ccctcctgtctttaactccaca

SEQ ID NO: 1122559 - DNA, 22 bp, Artificial Sequence
  chemically synthesized
acttcagggaagaatgtggagt

SEQ ID NO: 1122560 - DNA, 22 bp, Artificial Sequence
  chemically synthesized
ctgtctttaactccacattctt

SEQ ID NO: 1122561 - DNA, 22 bp, Artificial Sequence
  chemically synthesized
tctttaactccacattcttccc

SEQ ID NO: 1122562 - DNA, 22 bp, Artificial Sequence
  chemically synthesized
tgactcacttcagggaagaatg

SEQ ID NO: 1122563 - DNA, 22 bp, Artificial Sequence
  chemically synthesized
ctatgactcacttcagggaaga

SEQ ID NO: 1122564 - DNA, 22 bp, Artificial Sequence
  chemically synthesized
taactccacattcttccctgaa

SEQ ID NO: 1122565 - DNA, 22 bp, Artificial Sequence
  chemically synthesized
aactccacattcttccctgaag

SEQ ID NO: 1122566 - DNA, 22 bp, Artificial Sequence
  chemically synthesized
actccacattcttccctgaagt

SEQ ID NO: 1122567 - DNA, 22 bp, Artificial Sequence
  chemically synthesized
gttactatgactcacttcaggg

SEQ ID NO: 1122568 - DNA, 22 bp, Artificial Sequence
  chemically synthesized
tggttactatgactcacttcag

SEQ ID NO: 1122569 - DNA, 22 bp, Artificial Sequence
  chemically synthesized
cacattcttccctgaagtgagt

SEQ ID NO: 1122570 - DNA, 22 bp, Artificial Sequence
  chemically synthesized
ttccctgaagtgagtcatagta

SEQ ID NO: 1122571 - DNA, 22 bp, Artificial Sequence
  chemically synthesized
ccctgaagtgagtcatagtaac

SEQ ID NO: 1122572 - DNA, 22 bp, Artificial Sequence
  chemically synthesized
cctgaagtgagtcatagtaacc

SEQ ID NO: 1122573 - DNA, 22 bp, Artificial Sequence
  chemically synthesized
aagaagaagaattctggttact

SEQ ID NO: 1122574 - DNA, 22 bp, Artificial Sequence
  chemically synthesized
aagtgagtcatagtaaccagaa

SEQ ID NO: 1122575 - DNA, 22 bp, Artificial Sequence
  chemically synthesized
gaagaagaagaattctggttac

SEQ ID NO: 1122576 - DNA, 22 bp, Artificial Sequence
  chemically synthesized
ccttgaagaagaagaattctgg

SEQ ID NO: 1122577 - DNA, 22 bp, Artificial Sequence
  chemically synthesized
tgacctaccttgaagaagaaga

SEQ ID NO: 1122578 - DNA, 22 bp, Artificial Sequence
  chemically synthesized
tatgacctaccttgaagaagaa

SEQ ID NO: 1122579 - DNA, 22 bp, Artificial Sequence
  chemically synthesized
ctatgacctaccttgaagaaga

SEQ ID NO: 1122580 - DNA, 22 bp, Artificial Sequence
  chemically synthesized
gtttctatgacctaccttgaag

SEQ ID NO: 1122581 - DNA, 22 bp, Artificial Sequence
  chemically synthesized
ggtttctatgacctaccttgaa

SEQ ID NO: 1122582 - DNA, 22 bp, Artificial Sequence
  chemically synthesized
tggtttctatgacctaccttga

SEQ ID NO: 1122583 - DNA, 22 bp, Artificial Sequence
  chemically synthesized
ttggtttctatgacctaccttg

SEQ ID NO: 1122584 - DNA, 22 bp, Artificial Sequence
  chemically synthesized
ttcttcttcaaggtaggtcata

SEQ ID NO: 1122585 - DNA, 22 bp, Artificial Sequence
  chemically synthesized
cttcttcaaggtaggtcataga

SEQ ID NO: 1122586 - DNA, 22 bp, Artificial Sequence
  chemically synthesized
ttcttcaaggtaggtcatagaa

SEQ ID NO: 1122587 - DNA, 22 bp, Artificial Sequence
  chemically synthesized
cttcaaggtaggtcatagaaac

SEQ ID NO: 1122588 - DNA, 22 bp, Artificial Sequence
  chemically synthesized
ttcaaggtaggtcatagaaacc

SEQ ID NO: 1122589 - DNA, 22 bp, Artificial Sequence
  chemically synthesized
caaggtaggtcatagaaaccaa

SEQ ID NO: 1122590 - DNA, 22 bp, Artificial Sequence
  chemically synthesized
aaggtaggtcatagaaaccaaa

SEQ ID NO: 1122591 - DNA, 22 bp, Artificial Sequence
  chemically synthesized
gaggagagggtttttggtttct

SEQ ID NO: 1122592 - DNA, 22 bp, Artificial Sequence
  chemically synthesized
ggaggagagggtttttggtttc

SEQ ID NO: 1122593 - DNA, 22 bp, Artificial Sequence
  chemically synthesized
tggaggagagggtttttggttt

SEQ ID NO: 1122594 - DNA, 22 bp, Artificial Sequence
  chemically synthesized
gctttggaggagagggtttttg

SEQ ID NO: 1122595 - DNA, 22 bp, Artificial Sequence
  chemically synthesized
tggttggctttggaggagaggg

SEQ ID NO: 1122596 - DNA, 22 bp, Artificial Sequence
  chemically synthesized
atggttggctttggaggagagg

SEQ ID NO: 1122597 - DNA, 22 bp, Artificial Sequence
  chemically synthesized
tatggttggctttggaggagag

SEQ ID NO: 1122598 - DNA, 22 bp, Artificial Sequence
  chemically synthesized
ttatggttggctttggaggaga

SEQ ID NO: 1122599 - DNA, 22 bp, Artificial Sequence
  chemically synthesized
gcttttatggttggctttggag

SEQ ID NO: 1122600 - DNA, 22 bp, Artificial Sequence
  chemically synthesized
tggcttttatggttggctttgg

SEQ ID NO: 1122601 - DNA, 22 bp, Artificial Sequence
  chemically synthesized
taattctggcttttatggttgg

SEQ ID NO: 1122602 - DNA, 22 bp, Artificial Sequence
  chemically synthesized
tcctccaaagccaaccataaaa

SEQ ID NO: 1122603 - DNA, 22 bp, Artificial Sequence
  chemically synthesized
ctccaaagccaaccataaaagc

SEQ ID NO: 1122604 - DNA, 22 bp, Artificial Sequence
  chemically synthesized
caaagccaaccataaaagccag

SEQ ID NO: 1122605 - DNA, 22 bp, Artificial Sequence
  chemically synthesized
atagagagaaaggtgggcaaaa

SEQ ID NO: 1122606 - DNA, 22 bp, Artificial Sequence
  chemically synthesized
taactctgtattttgcccacct

SEQ ID NO: 1122607 - DNA, 22 bp, Artificial Sequence
  chemically synthesized
gctaatagagagaaaggtgggc

SEQ ID NO: 1122608 - DNA, 22 bp, Artificial Sequence
  chemically synthesized
tgtattttgcccacctttctct

SEQ ID NO: 1122609 - DNA, 22 bp, Artificial Sequence
  chemically synthesized
tattttgcccacctttctctct

SEQ ID NO: 1122610 - DNA, 22 bp, Artificial Sequence
  chemically synthesized
tggctagctaatagagagaaag

SEQ ID NO: 1122611 - DNA, 22 bp, Artificial Sequence
  chemically synthesized
atggctagctaatagagagaaa

SEQ ID NO: 1122612 - DNA, 22 bp, Artificial Sequence
  chemically synthesized
tatggctagctaatagagagaa

SEQ ID NO: 1122613 - DNA, 22 bp, Artificial Sequence
  chemically synthesized
ttatggctagctaatagagaga

SEQ ID NO: 1122614 - DNA, 22 bp, Artificial Sequence
  chemically synthesized
tttatggctagctaatagagag

SEQ ID NO: 1122615 - DNA, 22 bp, Artificial Sequence
  chemically synthesized
tgcccacctttctctctattag

SEQ ID NO: 1122616 - DNA, 22 bp, Artificial Sequence
  chemically synthesized
gcccacctttctctctattagc

SEQ ID NO: 1122617 - DNA, 22 bp, Artificial Sequence
  chemically synthesized
cccacctttctctctattagct

SEQ ID NO: 1122618 - DNA, 22 bp, Artificial Sequence
  chemically synthesized
tctctctattagctagccataa

SEQ ID NO: 1122619 - DNA, 22 bp, Artificial Sequence
  chemically synthesized
ctctctattagctagccataaa

SEQ ID NO: 1122620 - DNA, 22 bp, Artificial Sequence
  chemically synthesized
tctctattagctagccataaaa

SEQ ID NO: 1122621 - DNA, 22 bp, Artificial Sequence
  chemically synthesized
tctattagctagccataaaaaa

SEQ ID NO: 1122622 - DNA, 22 bp, Artificial Sequence
  chemically synthesized
tattagctagccataaaaaatt

SEQ ID NO: 1122623 - DNA, 22 bp, Artificial Sequence
  chemically synthesized
ttagctagccataaaaaattct

SEQ ID NO: 1122624 - DNA, 22 bp, Artificial Sequence
  chemically synthesized
gctagccataaaaaattctctg

SEQ ID NO: 1122625 - DNA, 22 bp, Artificial Sequence
  chemically synthesized
gccataaaaaattctctgacat

SEQ ID NO: 1122626 - DNA, 22 bp, Artificial Sequence
  chemically synthesized
tcaaacaaaagtatgtcagaga

SEQ ID NO: 1122627 - DNA, 22 bp, Artificial Sequence
  chemically synthesized
ctatcaaacaaaagtatgtcag

SEQ ID NO: 1122628 - DNA, 22 bp, Artificial Sequence
  chemically synthesized
tgatctactatcaaacaaaagt

SEQ ID NO: 1122629 - DNA, 22 bp, Artificial Sequence
  chemically synthesized
atgatctactatcaaacaaaag

SEQ ID NO: 1122630 - DNA, 22 bp, Artificial Sequence
  chemically synthesized
tctgacatacttttgtttgata

SEQ ID NO: 1122631 - DNA, 22 bp, Artificial Sequence
  chemically synthesized
tgacatacttttgtttgatagt

SEQ ID NO: 1122632 - DNA, 22 bp, Artificial Sequence
  chemically synthesized
acatacttttgtttgatagtag

SEQ ID NO: 1122633 - DNA, 22 bp, Artificial Sequence
  chemically synthesized
aatgagggtcttatgatctact

SEQ ID NO: 1122634 - DNA, 22 bp, Artificial Sequence
  chemically synthesized
gaatgagggtcttatgatctac

SEQ ID NO: 1122635 - DNA, 22 bp, Artificial Sequence
  chemically synthesized
ttgtttgatagtagatcataag

SEQ ID NO: 1122636 - DNA, 22 bp, Artificial Sequence
  chemically synthesized
tgtttgatagtagatcataaga

SEQ ID NO: 1122637 - DNA, 22 bp, Artificial Sequence
  chemically synthesized
gtttgatagtagatcataagac

SEQ ID NO: 1122638 - DNA, 22 bp, Artificial Sequence
  chemically synthesized
tttgatagtagatcataagacc

SEQ ID NO: 1122639 - DNA, 22 bp, Artificial Sequence
  chemically synthesized
gatagtagatcataagaccctc

SEQ ID NO: 1122640 - DNA, 22 bp, Artificial Sequence
  chemically synthesized
atagtagatcataagaccctca

SEQ ID NO: 1122641 - DNA, 22 bp, Artificial Sequence
  chemically synthesized
cacatggggtaggaccccactt

SEQ ID NO: 1122642 - DNA, 22 bp, Artificial Sequence
  chemically synthesized
ctacacatggggtaggacccca

SEQ ID NO: 1122643 - DNA, 22 bp, Artificial Sequence
  chemically synthesized
ctcctacacatggggtaggacc

SEQ ID NO: 1122644 - DNA, 22 bp, Artificial Sequence
  chemically synthesized
cctcctacacatggggtaggac

SEQ ID NO: 1122645 - DNA, 22 bp, Artificial Sequence
  chemically synthesized
attcaagtggggtcctacccca

SEQ ID NO: 1122646 - DNA, 22 bp, Artificial Sequence
  chemically synthesized
cttcctcctacacatggggtag

SEQ ID NO: 1122647 - DNA, 22 bp, Artificial Sequence
  chemically synthesized
aagtggggtcctaccccatgtg

SEQ ID NO: 1122648 - DNA, 22 bp, Artificial Sequence
  chemically synthesized
tgtagaattccttcctcctaca

SEQ ID NO: 1122649 - DNA, 22 bp, Artificial Sequence
  chemically synthesized
tctgtgtagaattccttcctcc

SEQ ID NO: 1122650 - DNA, 22 bp, Artificial Sequence
  chemically synthesized
ccccatgtgtaggaggaaggaa

SEQ ID NO: 1122651 - DNA, 22 bp, Artificial Sequence
  chemically synthesized
gggacaaccagccaggcctgtc

SEQ ID NO: 1122652 - DNA, 22 bp, Artificial Sequence
  chemically synthesized
tacacagacaggcctggctggt

SEQ ID NO: 1122653 - DNA, 22 bp, Artificial Sequence
  chemically synthesized
cacagacaggcctggctggttg

SEQ ID NO: 1122654 - DNA, 22 bp, Artificial Sequence
  chemically synthesized
atagtaatagactagggacaac

SEQ ID NO: 1122655 - DNA, 22 bp, Artificial Sequence
  chemically synthesized
gctggttgtccctagtctatta

SEQ ID NO: 1122656 - DNA, 22 bp, Artificial Sequence
  chemically synthesized
gttgtccctagtctattactat

SEQ ID NO: 1122657 - DNA, 22 bp, Artificial Sequence
  chemically synthesized
tccctagtctattactatcaga

SEQ ID NO: 1122658 - DNA, 22 bp, Artificial Sequence
  chemically synthesized
gacaaaaagggaatgatctgat

SEQ ID NO: 1122659 - DNA, 22 bp, Artificial Sequence
  chemically synthesized
gtctattactatcagatcattc

SEQ ID NO: 1122660 - DNA, 22 bp, Artificial Sequence
  chemically synthesized
ttactatcagatcattcccttt

SEQ ID NO: 1122661 - DNA, 22 bp, Artificial Sequence
  chemically synthesized
ctatcagatcattccctttttg

SEQ ID NO: 1122662 - DNA, 22 bp, Artificial Sequence
  chemically synthesized
tcagatcattccctttttgtcc

SEQ ID NO: 1122663 - DNA, 22 bp, Artificial Sequence
  chemically synthesized
cctttttgtccaatcacattcc

SEQ ID NO: 1122664 - DNA, 22 bp, Artificial Sequence
  chemically synthesized
tttgtccaatcacattcctaca

SEQ ID NO: 1122665 - DNA, 22 bp, Artificial Sequence
  chemically synthesized
ttgtccaatcacattcctacat

SEQ ID NO: 1122666 - DNA, 22 bp, Artificial Sequence
  chemically synthesized
tgtccaatcacattcctacatg

SEQ ID NO: 1122667 - DNA, 22 bp, Artificial Sequence
  chemically synthesized
gtccaatcacattcctacatgg

SEQ ID NO: 1122668 - DNA, 22 bp, Artificial Sequence
  chemically synthesized
tccaatcacattcctacatggc

SEQ ID NO: 1122669 - DNA, 22 bp, Artificial Sequence
  chemically synthesized
ataaagagtagacagccatgta

SEQ ID NO: 1122670 - DNA, 22 bp, Artificial Sequence
  chemically synthesized
gagttgataaagagtagacagc

SEQ ID NO: 1122671 - DNA, 22 bp, Artificial Sequence
  chemically synthesized
agagttgataaagagtagacag

SEQ ID NO: 1122672 - DNA, 22 bp, Artificial Sequence
  chemically synthesized
ctacatggctgtctactcttta

SEQ ID NO: 1122673 - DNA, 22 bp, Artificial Sequence
  chemically synthesized
tgcttagagttgataaagagta

SEQ ID NO: 1122674 - DNA, 22 bp, Artificial Sequence
  chemically synthesized
atgcttagagttgataaagagt

SEQ ID NO: 1122675 - DNA, 22 bp, Artificial Sequence
  chemically synthesized
catggctgtctactctttatca

SEQ ID NO: 1122676 - DNA, 22 bp, Artificial Sequence
  chemically synthesized
tatgcttagagttgataaagag

SEQ ID NO: 1122677 - DNA, 22 bp, Artificial Sequence
  chemically synthesized
ttatgcttagagttgataaaga

SEQ ID NO: 1122678 - DNA, 22 bp, Artificial Sequence
  chemically synthesized
tttttatgcttagagttgataa

SEQ ID NO: 1122679 - DNA, 22 bp, Artificial Sequence
  chemically synthesized
tctactctttatcaactctaag

SEQ ID NO: 1122680 - DNA, 22 bp, Artificial Sequence
  chemically synthesized
ctctttatcaactctaagcata

SEQ ID NO: 1122681 - DNA, 22 bp, Artificial Sequence
  chemically synthesized
tttatcaactctaagcataaaa

SEQ ID NO: 1122682 - DNA, 22 bp, Artificial Sequence
  chemically synthesized
tatcaactctaagcataaaaac

SEQ ID NO: 1122683 - DNA, 22 bp, Artificial Sequence
  chemically synthesized
atcaactctaagcataaaaaca

SEQ ID NO: 1122684 - DNA, 22 bp, Artificial Sequence
  chemically synthesized
tcaactctaagcataaaaacag

SEQ ID NO: 1122685 - DNA, 22 bp, Artificial Sequence
  chemically synthesized
taagcataaaaacagttttcct

SEQ ID NO: 1122686 - DNA, 22 bp, Artificial Sequence
  chemically synthesized
agcataaaaacagttttccttt

SEQ ID NO: 1122687 - DNA, 22 bp, Artificial Sequence
  chemically synthesized
aaaaatgaagacccaatgaccc

SEQ ID NO: 1122688 - DNA, 22 bp, Artificial Sequence
  chemically synthesized
caaaaatgaagacccaatgacc

SEQ ID NO: 1122689 - DNA, 22 bp, Artificial Sequence
  chemically synthesized
tcctttgggtcattgggtcttc

SEQ ID NO: 1122690 - DNA, 22 bp, Artificial Sequence
  chemically synthesized
cctttgggtcattgggtcttca

SEQ ID NO: 1122691 - DNA, 22 bp, Artificial Sequence
  chemically synthesized
ctttgggtcattgggtcttcat

SEQ ID NO: 1122692 - DNA, 22 bp, Artificial Sequence
  chemically synthesized
tgggtcattgggtcttcatttt

SEQ ID NO: 1122693 - DNA, 22 bp, Artificial Sequence
  chemically synthesized
gggtcattgggtcttcattttt

SEQ ID NO: 1122694 - DNA, 22 bp, Artificial Sequence
  chemically synthesized
ggtcattgggtcttcatttttg

SEQ ID NO: 1122695 - DNA, 22 bp, Artificial Sequence
  chemically synthesized
ggtgacatgggagccttcaaaa

SEQ ID NO: 1122696 - DNA, 22 bp, Artificial Sequence
  chemically synthesized
aggtgacatgggagccttcaaa

SEQ ID NO: 1122697 - DNA, 22 bp, Artificial Sequence
  chemically synthesized
taggtgacatgggagccttcaa

SEQ ID NO: 1122698 - DNA, 22 bp, Artificial Sequence
  chemically synthesized
ggtcttcatttttgaaggctcc

SEQ ID NO: 1122699 - DNA, 22 bp, Artificial Sequence
  chemically synthesized
catttttgaaggctcccatgtc

SEQ ID NO: 1122700 - DNA, 22 bp, Artificial Sequence
  chemically synthesized
atttttgaaggctcccatgtca

SEQ ID NO: 1122701 - DNA, 22 bp, Artificial Sequence
  chemically synthesized
ataaaagttttaggtgacatgg

SEQ ID NO: 1122702 - DNA, 22 bp, Artificial Sequence
  chemically synthesized
ttgaaggctcccatgtcaccta

SEQ ID NO: 1122703 - DNA, 22 bp, Artificial Sequence
  chemically synthesized
tgaaggctcccatgtcacctaa

SEQ ID NO: 1122704 - DNA, 22 bp, Artificial Sequence
  chemically synthesized
gaaggctcccatgtcacctaaa

SEQ ID NO: 1122705 - DNA, 22 bp, Artificial Sequence
  chemically synthesized
tctaataaaagttttaggtgac

SEQ ID NO: 1122706 - DNA, 22 bp, Artificial Sequence
  chemically synthesized
aaggctcccatgtcacctaaaa

SEQ ID NO: 1122707 - DNA, 22 bp, Artificial Sequence
  chemically synthesized
atctaataaaagttttaggtga

SEQ ID NO: 1122708 - DNA, 22 bp, Artificial Sequence
  chemically synthesized
ccatgtcacctaaaacttttat

SEQ ID NO: 1122709 - DNA, 22 bp, Artificial Sequence
  chemically synthesized
aaacttttattagataaatatc

SEQ ID NO: 1122710 - DNA, 22 bp, Artificial Sequence
  chemically synthesized
acaagagaaaagcatgagatat

SEQ ID NO: 1122711 - DNA, 22 bp, Artificial Sequence
  chemically synthesized
ttattagataaatatctcatgc

SEQ ID NO: 1122712 - DNA, 22 bp, Artificial Sequence
  chemically synthesized
tattagataaatatctcatgct

SEQ ID NO: 1122713 - DNA, 22 bp, Artificial Sequence
  chemically synthesized
attagataaatatctcatgctt

SEQ ID NO: 1122714 - DNA, 22 bp, Artificial Sequence
  chemically synthesized
ttagataaatatctcatgcttt

SEQ ID NO: 1122715 - DNA, 22 bp, Artificial Sequence
  chemically synthesized
gataaatatctcatgcttttct

SEQ ID NO: 1122716 - DNA, 22 bp, Artificial Sequence
  chemically synthesized
taacaaaagataggttaacaag

SEQ ID NO: 1122717 - DNA, 22 bp, Artificial Sequence
  chemically synthesized
atgcttttctcttgttaaccta

SEQ ID NO: 1122718 - DNA, 22 bp, Artificial Sequence
  chemically synthesized
ctataacaaaagataggttaac

SEQ ID NO: 1122719 - DNA, 22 bp, Artificial Sequence
  chemically synthesized
ttctcttgttaacctatctttt

SEQ ID NO: 1122720 - DNA, 22 bp, Artificial Sequence
  chemically synthesized
tctcttgttaacctatcttttg

SEQ ID NO: 1122721 - DNA, 22 bp, Artificial Sequence
  chemically synthesized
ctcttgttaacctatcttttgt

SEQ ID NO: 1122722 - DNA, 22 bp, Artificial Sequence
  chemically synthesized
tcttgttaacctatcttttgtt

SEQ ID NO: 1122723 - DNA, 22 bp, Artificial Sequence
  chemically synthesized
ttgttaacctatcttttgttat

SEQ ID NO: 1122724 - DNA, 22 bp, Artificial Sequence
  chemically synthesized
gttaacctatcttttgttatag

SEQ ID NO: 1122725 - DNA, 22 bp, Artificial Sequence
  chemically synthesized
ttaacctatcttttgttatagg

SEQ ID NO: 1122726 - DNA, 22 bp, Artificial Sequence
  chemically synthesized
acctatcttttgttataggaat

SEQ ID NO: 1122727 - DNA, 22 bp, Artificial Sequence
  chemically synthesized
tcttttgttataggaatgtctg

SEQ ID NO: 1122728 - DNA, 22 bp, Artificial Sequence
  chemically synthesized
tacaggtcatagcagacattcc

SEQ ID NO: 1122729 - DNA, 22 bp, Artificial Sequence
  chemically synthesized
atacaggtcatagcagacattc

SEQ ID NO: 1122730 - DNA, 22 bp, Artificial Sequence
  chemically synthesized
ttgttataggaatgtctgctat

SEQ ID NO: 1122731 - DNA, 22 bp, Artificial Sequence
  chemically synthesized
cttatacaggtcatagcagaca

SEQ ID NO: 1122732 - DNA, 22 bp, Artificial Sequence
  chemically synthesized
tgttataggaatgtctgctatg

SEQ ID NO: 1122733 - DNA, 22 bp, Artificial Sequence
  chemically synthesized
gttataggaatgtctgctatga

SEQ ID NO: 1122734 - DNA, 22 bp, Artificial Sequence
  chemically synthesized
ttataggaatgtctgctatgac

SEQ ID NO: 1122735 - DNA, 22 bp, Artificial Sequence
  chemically synthesized
ctccttatacaggtcatagcag

SEQ ID NO: 1122736 - DNA, 22 bp, Artificial Sequence
  chemically synthesized
cctccttatacaggtcatagca

SEQ ID NO: 1122737 - DNA, 22 bp, Artificial Sequence
  chemically synthesized
taggaatgtctgctatgacctg

SEQ ID NO: 1122738 - DNA, 22 bp, Artificial Sequence
  chemically synthesized
cttcctccttatacaggtcata

SEQ ID NO: 1122739 - DNA, 22 bp, Artificial Sequence
  chemically synthesized
ccttcctccttatacaggtcat

SEQ ID NO: 1122740 - DNA, 22 bp, Artificial Sequence
  chemically synthesized
tccttcctccttatacaggtca

SEQ ID NO: 1122741 - DNA, 22 bp, Artificial Sequence
  chemically synthesized
ctatgacctgtataaggaggaa

SEQ ID NO: 1122742 - DNA, 22 bp, Artificial Sequence
  chemically synthesized
tgatccctttccttcctcctta

SEQ ID NO: 1122743 - DNA, 22 bp, Artificial Sequence
  chemically synthesized
tgacctgtataaggaggaagga

SEQ ID NO: 1122744 - DNA, 22 bp, Artificial Sequence
  chemically synthesized
tataaggaggaaggaaagggat

SEQ ID NO: 1122745 - DNA, 22 bp, Artificial Sequence
  chemically synthesized
taggagcagaaaggctgtgatc

SEQ ID NO: 1122746 - DNA, 22 bp, Artificial Sequence
  chemically synthesized
catcaacatgcatgttatagga

SEQ ID NO: 1122747 - DNA, 22 bp, Artificial Sequence
  chemically synthesized
tctgctcctataacatgcatgt

SEQ ID NO: 1122748 - DNA, 22 bp, Artificial Sequence
  chemically synthesized
ctgctcctataacatgcatgtt

SEQ ID NO: 1122749 - DNA, 22 bp, Artificial Sequence
  chemically synthesized
tgctcctataacatgcatgttg

SEQ ID NO: 1122750 - DNA, 22 bp, Artificial Sequence
  chemically synthesized
ctcctataacatgcatgttgat

SEQ ID NO: 1122751 - DNA, 22 bp, Artificial Sequence
  chemically synthesized
ctataacatgcatgttgatgta

SEQ ID NO: 1122752 - DNA, 22 bp, Artificial Sequence
  chemically synthesized
taacatgcatgttgatgtaact

SEQ ID NO: 1122753 - DNA, 22 bp, Artificial Sequence
  chemically synthesized
gaggtggtggtataacagttac

SEQ ID NO: 1122754 - DNA, 22 bp, Artificial Sequence
  chemically synthesized
atgtaactgttataccaccacc

SEQ ID NO: 1122755 - DNA, 22 bp, Artificial Sequence
  chemically synthesized
cagtgaattggaggtggtggta

SEQ ID NO: 1122756 - DNA, 22 bp, Artificial Sequence
  chemically synthesized
tgcagtgaattggaggtggtgg

SEQ ID NO: 1122757 - DNA, 22 bp, Artificial Sequence
  chemically synthesized
ctgcagtgaattggaggtggtg

SEQ ID NO: 1122758 - DNA, 22 bp, Artificial Sequence
  chemically synthesized
tctgcagtgaattggaggtggt

SEQ ID NO: 1122759 - DNA, 22 bp, Artificial Sequence
  chemically synthesized
ttctgcagtgaattggaggtgg

SEQ ID NO: 1122760 - DNA, 22 bp, Artificial Sequence
  chemically synthesized
tttctgcagtgaattggaggtg

SEQ ID NO: 1122761 - DNA, 22 bp, Artificial Sequence
  chemically synthesized
ttttctgcagtgaattggaggt

SEQ ID NO: 1122762 - DNA, 22 bp, Artificial Sequence
  chemically synthesized
ttataccaccacctccaattca

SEQ ID NO: 1122763 - DNA, 22 bp, Artificial Sequence
  chemically synthesized
ttttttctgcagtgaattggag

SEQ ID NO: 1122764 - DNA, 22 bp, Artificial Sequence
  chemically synthesized
cttttttctgcagtgaattgga

SEQ ID NO: 1122765 - DNA, 22 bp, Artificial Sequence
  chemically synthesized
taccaccacctccaattcactg

SEQ ID NO: 1122766 - DNA, 22 bp, Artificial Sequence
  chemically synthesized
tttcttttttctgcagtgaatt

SEQ ID NO: 1122767 - DNA, 22 bp, Artificial Sequence
  chemically synthesized
gtttcttttttctgcagtgaat

SEQ ID NO: 1122768 - DNA, 22 bp, Artificial Sequence
  chemically synthesized
tgtttcttttttctgcagtgaa

SEQ ID NO: 1122769 - DNA, 22 bp, Artificial Sequence
  chemically synthesized
caattcactgcagaaaaaagaa

SEQ ID NO: 1122770 - DNA, 22 bp, Artificial Sequence
  chemically synthesized
aaaacaaacaactttgtttctt

SEQ ID NO: 1122771 - DNA, 22 bp, Artificial Sequence
  chemically synthesized
actgcagaaaaaagaaacaaag

SEQ ID NO: 1122772 - DNA, 22 bp, Artificial Sequence
  chemically synthesized
cagaaaaaagaaacaaagttgt

SEQ ID NO: 1122773 - DNA, 22 bp, Artificial Sequence
  chemically synthesized
aaactaaaaacaaacaactttg

SEQ ID NO: 1122774 - DNA, 22 bp, Artificial Sequence
  chemically synthesized
caaactaaaaacaaacaacttt

SEQ ID NO: 1122775 - DNA, 22 bp, Artificial Sequence
  chemically synthesized
tcaaactaaaaacaaacaactt

SEQ ID NO: 1122776 - DNA, 22 bp, Artificial Sequence
  chemically synthesized
ctttcaaactaaaaacaaacaa

SEQ ID NO: 1122777 - DNA, 22 bp, Artificial Sequence
  chemically synthesized
actttcaaactaaaaacaaaca

SEQ ID NO: 1122778 - DNA, 22 bp, Artificial Sequence
  chemically synthesized
tttactttcaaactaaaaacaa

SEQ ID NO: 1122779 - DNA, 22 bp, Artificial Sequence
  chemically synthesized
tttgtttttagtttgaaagtaa

SEQ ID NO: 1122780 - DNA, 22 bp, Artificial Sequence
  chemically synthesized
gaatgaaaattatttactttca

SEQ ID NO: 1122781 - DNA, 22 bp, Artificial Sequence
  chemically synthesized
ggaatgaaaattatttactttc

SEQ ID NO: 1122782 - DNA, 22 bp, Artificial Sequence
  chemically synthesized
gtttttagtttgaaagtaaata

SEQ ID NO: 1122783 - DNA, 22 bp, Artificial Sequence
  chemically synthesized
tggaatgaaaattatttacttt

SEQ ID NO: 1122784 - DNA, 22 bp, Artificial Sequence
  chemically synthesized
tttttagtttgaaagtaaataa

SEQ ID NO: 1122785 - DNA, 22 bp, Artificial Sequence
  chemically synthesized
ttggaatgaaaattatttactt

SEQ ID NO: 1122786 - DNA, 22 bp, Artificial Sequence
  chemically synthesized
ttttggaatgaaaattatttac

SEQ ID NO: 1122787 - DNA, 22 bp, Artificial Sequence
  chemically synthesized
ttagtttgaaagtaaataattt

SEQ ID NO: 1122788 - DNA, 22 bp, Artificial Sequence
  chemically synthesized
cttttggaatgaaaattattta

SEQ ID NO: 1122789 - DNA, 22 bp, Artificial Sequence
  chemically synthesized
tagtttgaaagtaaataatttt

SEQ ID NO: 1122790 - DNA, 22 bp, Artificial Sequence
  chemically synthesized
agtttgaaagtaaataattttc

SEQ ID NO: 1122791 - DNA, 22 bp, Artificial Sequence
  chemically synthesized
gtttgaaagtaaataattttca

SEQ ID NO: 1122792 - DNA, 22 bp, Artificial Sequence
  chemically synthesized
gaaagtaaataattttcattcc

SEQ ID NO: 1122793 - DNA, 22 bp, Artificial Sequence
  chemically synthesized
aaagtaaataattttcattcca

SEQ ID NO: 1122794 - DNA, 22 bp, Artificial Sequence
  chemically synthesized
tcattccaaaagaaatcttttt

SEQ ID NO: 1122795 - DNA, 22 bp, Artificial Sequence
  chemically synthesized
cattccaaaagaaatctttttt

SEQ ID NO: 1122796 - DNA, 22 bp, Artificial Sequence
  chemically synthesized
aaaaaaaaaaaaaaaaaagatt

SEQ ID NO: 1122797 - DNA, 22 bp, Artificial Sequence
  chemically synthesized
attccaaaagaaatcttttttt

SEQ ID NO: 1122798 - DNA, 22 bp, Artificial Sequence
  chemically synthesized
caaaagaaatcttttttttttt

SEQ ID NO: 1122799 - DNA, 22 bp, Artificial Sequence
  chemically synthesized
cgtctcaaaaaaaaaaaaaaaa

SEQ ID NO: 1122800 - DNA, 22 bp, Artificial Sequence
  chemically synthesized
ttttttttttttttttgagacg

SEQ ID NO: 1122801 - DNA, 22 bp, Artificial Sequence
  chemically synthesized
tttttttttttttttgagacgg

SEQ ID NO: 1122802 - DNA, 22 bp, Artificial Sequence
  chemically synthesized
ttttttttttttttgagacgga

SEQ ID NO: 1122803 - DNA, 22 bp, Artificial Sequence
  chemically synthesized
tttttttttttttgagacggag

SEQ ID NO: 1122804 - DNA, 22 bp, Artificial Sequence
  chemically synthesized
ttttttttttttgagacggagt

SEQ ID NO: 1122805 - DNA, 22 bp, Artificial Sequence
  chemically synthesized
tttttttttttgagacggagtc

SEQ ID NO: 1122806 - DNA, 22 bp, Artificial Sequence
  chemically synthesized
ttttttttttgagacggagtct

SEQ ID NO: 1122807 - DNA, 22 bp, Artificial Sequence
  chemically synthesized
ggtgacagagcaagactccgtc

SEQ ID NO: 1122808 - DNA, 22 bp, Artificial Sequence
  chemically synthesized
tttttttttgagacggagtctt

SEQ ID NO: 1122809 - DNA, 22 bp, Artificial Sequence
  chemically synthesized
ttttttttgagacggagtcttg

SEQ ID NO: 1122810 - DNA, 22 bp, Artificial Sequence
  chemically synthesized
tttttttgagacggagtcttgc

SEQ ID NO: 1122811 - DNA, 22 bp, Artificial Sequence
  chemically synthesized
ttttttgagacggagtcttgct

SEQ ID NO: 1122812 - DNA, 22 bp, Artificial Sequence
  chemically synthesized
tttttgagacggagtcttgctc

SEQ ID NO: 1122813 - DNA, 22 bp, Artificial Sequence
  chemically synthesized
ttttgagacggagtcttgctct

SEQ ID NO: 1122814 - DNA, 22 bp, Artificial Sequence
  chemically synthesized
tttgagacggagtcttgctctg

SEQ ID NO: 1122815 - DNA, 22 bp, Artificial Sequence
  chemically synthesized
caggctgggtgacagagcaaga

SEQ ID NO: 1122816 - DNA, 22 bp, Artificial Sequence
  chemically synthesized
ttgagacggagtcttgctctgt

SEQ ID NO: 1122817 - DNA, 22 bp, Artificial Sequence
  chemically synthesized
tgagacggagtcttgctctgtc

SEQ ID NO: 1122818 - DNA, 22 bp, Artificial Sequence
  chemically synthesized
gagacggagtcttgctctgtca

SEQ ID NO: 1122819 - DNA, 22 bp, Artificial Sequence
  chemically synthesized
agacggagtcttgctctgtcac

SEQ ID NO: 1122820 - DNA, 22 bp, Artificial Sequence
  chemically synthesized
cactccaggctgggtgacagag

SEQ ID NO: 1122821 - DNA, 22 bp, Artificial Sequence
  chemically synthesized
gctctgtcacccagcctggagt

SEQ ID NO: 1122822 - DNA, 22 bp, Artificial Sequence
  chemically synthesized
ctctgtcacccagcctggagtg

SEQ ID NO: 1122823 - DNA, 22 bp, Artificial Sequence
  chemically synthesized
tgtcacccagcctggagtgcag

SEQ ID NO: 1122824 - DNA, 22 bp, Artificial Sequence
  chemically synthesized
tcacccagcctggagtgcagtg

SEQ ID NO: 1122825 - DNA, 22 bp, Artificial Sequence
  chemically synthesized
cagtgagccgagatcgcgccac

SEQ ID NO: 1122826 - DNA, 22 bp, Artificial Sequence
  chemically synthesized
gcagtgagccgagatcgcgcca

SEQ ID NO: 1122827 - DNA, 22 bp, Artificial Sequence
  chemically synthesized
gagtgcagtggcgcgatctcgg

SEQ ID NO: 1122828 - DNA, 22 bp, Artificial Sequence
  chemically synthesized
ggaggcggagcttgcagtgagc

SEQ ID NO: 1122829 - DNA, 22 bp, Artificial Sequence
  chemically synthesized
ggctcactgcaagctccgcctc

SEQ ID NO: 1122830 - DNA, 22 bp, Artificial Sequence
  chemically synthesized
actgcaagctccgcctcccagg

SEQ ID NO: 1122831 - DNA, 22 bp, Artificial Sequence
  chemically synthesized
caagctccgcctcccaggttca

SEQ ID NO: 1122832 - DNA, 22 bp, Artificial Sequence
  chemically synthesized
aggcaggagaatggcgtgaacc

SEQ ID NO: 1122833 - DNA, 22 bp, Artificial Sequence
  chemically synthesized
cgcctcccaggttcacgccatt

SEQ ID NO: 1122834 - DNA, 22 bp, Artificial Sequence
  chemically synthesized
ccaggttcacgccattctcctg

SEQ ID NO: 1122835 - DNA, 22 bp, Artificial Sequence
  chemically synthesized
gggaggctgaggcaggagaatg

SEQ ID NO: 1122836 - DNA, 22 bp, Artificial Sequence
  chemically synthesized
ctcgggaggctgaggcaggaga

SEQ ID NO: 1122837 - DNA, 22 bp, Artificial Sequence
  chemically synthesized
acgccattctcctgcctcagcc

SEQ ID NO: 1122838 - DNA, 22 bp, Artificial Sequence
  chemically synthesized
tggtcccagctactcgggaggc

SEQ ID NO: 1122839 - DNA, 22 bp, Artificial Sequence
  chemically synthesized
tcctgcctcagcctcccgagta

SEQ ID NO: 1122840 - DNA, 22 bp, Artificial Sequence
  chemically synthesized
ctgcctcagcctcccgagtagc

SEQ ID NO: 1122841 - DNA, 22 bp, Artificial Sequence
  chemically synthesized
cctcagcctcccgagtagctgg

SEQ ID NO: 1122842 - DNA, 22 bp, Artificial Sequence
  chemically synthesized
agcctcccgagtagctgggacc

SEQ ID NO: 1122843 - DNA, 22 bp, Artificial Sequence
  chemically synthesized
ccgagtagctgggaccacaggc

SEQ ID NO: 1122844 - DNA, 22 bp, Artificial Sequence
  chemically synthesized
gccgggcgtggtggcgggcgcc

SEQ ID NO: 1122845 - DNA, 22 bp, Artificial Sequence
  chemically synthesized
ggaccacaggcgcccgccacca

SEQ ID NO: 1122846 - DNA, 22 bp, Artificial Sequence
  chemically synthesized
aaaatacaaaaaaaattagccg

SEQ ID NO: 1122847 - DNA, 22 bp, Artificial Sequence
  chemically synthesized
ctaaaaatacaaaaaaaattag

SEQ ID NO: 1122848 - DNA, 22 bp, Artificial Sequence
  chemically synthesized
tactaaaaatacaaaaaaaatt

SEQ ID NO: 1122849 - DNA, 22 bp, Artificial Sequence
  chemically synthesized
attttttttgtatttttagtag

SEQ ID NO: 1122850 - DNA, 22 bp, Artificial Sequence
  chemically synthesized
tttttgtatttttagtagagat

SEQ ID NO: 1122851 - DNA, 22 bp, Artificial Sequence
  chemically synthesized
ttttgtatttttagtagagatg

SEQ ID NO: 1122852 - DNA, 22 bp, Artificial Sequence
  chemically synthesized
tttgtatttttagtagagatgt

SEQ ID NO: 1122853 - DNA, 22 bp, Artificial Sequence
  chemically synthesized
ttgtatttttagtagagatgtg

SEQ ID NO: 1122854 - DNA, 22 bp, Artificial Sequence
  chemically synthesized
acacggtgaaaccacatctcta

SEQ ID NO: 1122855 - DNA, 22 bp, Artificial Sequence
  chemically synthesized
tgtatttttagtagagatgtgg

SEQ ID NO: 1122856 - DNA, 22 bp, Artificial Sequence
  chemically synthesized
gtatttttagtagagatgtggt

SEQ ID NO: 1122857 - DNA, 22 bp, Artificial Sequence
  chemically synthesized
tatttttagtagagatgtggtt

SEQ ID NO: 1122858 - DNA, 22 bp, Artificial Sequence
  chemically synthesized
gctaacacggtgaaaccacatc

SEQ ID NO: 1122859 - DNA, 22 bp, Artificial Sequence
  chemically synthesized
ttagtagagatgtggtttcacc

SEQ ID NO: 1122860 - DNA, 22 bp, Artificial Sequence
  chemically synthesized
tagtagagatgtggtttcaccg

SEQ ID NO: 1122861 - DNA, 22 bp, Artificial Sequence
  chemically synthesized
agtagagatgtggtttcaccgt

SEQ ID NO: 1122862 - DNA, 22 bp, Artificial Sequence
  chemically synthesized
gtagagatgtggtttcaccgtg

SEQ ID NO: 1122863 - DNA, 22 bp, Artificial Sequence
  chemically synthesized
caccgtgttagccaggatggtc

SEQ ID NO: 1122864 - DNA, 22 bp, Artificial Sequence
  chemically synthesized
accgtgttagccaggatggtct

SEQ ID NO: 1122865 - DNA, 22 bp, Artificial Sequence
  chemically synthesized
gaggtcaggagatcgagaccat

SEQ ID NO: 1122866 - DNA, 22 bp, Artificial Sequence
  chemically synthesized
gccaggatggtctcgatctcct

SEQ ID NO: 1122867 - DNA, 22 bp, Artificial Sequence
  chemically synthesized
gatctcctgacctctagatccg

SEQ ID NO: 1122868 - DNA, 22 bp, Artificial Sequence
  chemically synthesized
ggaggccgaggcgggcggatct

SEQ ID NO: 1122869 - DNA, 22 bp, Artificial Sequence
  chemically synthesized
gggaggccgaggcgggcggatc

SEQ ID NO: 1122870 - DNA, 22 bp, Artificial Sequence
  chemically synthesized
tgggaggccgaggcgggcggat

SEQ ID NO: 1122871 - DNA, 22 bp, Artificial Sequence
  chemically synthesized
ctgacctctagatccgcccgcc

SEQ ID NO: 1122872 - DNA, 22 bp, Artificial Sequence
  chemically synthesized
acctctagatccgcccgcctcg

SEQ ID NO: 1122873 - DNA, 22 bp, Artificial Sequence
  chemically synthesized
tagatccgcccgcctcggcctc

SEQ ID NO: 1122874 - DNA, 22 bp, Artificial Sequence
  chemically synthesized
gatccgcccgcctcggcctccc

SEQ ID NO: 1122875 - DNA, 22 bp, Artificial Sequence
  chemically synthesized
taatcccagcactttgggaggc

SEQ ID NO: 1122876 - DNA, 22 bp, Artificial Sequence
  chemically synthesized
acgcctgtaatcccagcacttt

SEQ ID NO: 1122877 - DNA, 22 bp, Artificial Sequence
  chemically synthesized
ggcctcccaaagtgctgggatt

SEQ ID NO: 1122878 - DNA, 22 bp, Artificial Sequence
  chemically synthesized
ccaaagtgctgggattacaggc

SEQ ID NO: 1122879 - DNA, 22 bp, Artificial Sequence
  chemically synthesized
gggccgggcgcggtggctcacg

SEQ ID NO: 1122880 - DNA, 22 bp, Artificial Sequence
  chemically synthesized
ggattacaggcgtgagccaccg

SEQ ID NO: 1122881 - DNA, 22 bp, Artificial Sequence
  chemically synthesized
tggggccgggcgcggtggctca

SEQ ID NO: 1122882 - DNA, 22 bp, Artificial Sequence
  chemically synthesized
ctggggccgggcgcggtggctc

SEQ ID NO: 1122883 - DNA, 22 bp, Artificial Sequence
  chemically synthesized
ttctggggccgggcgcggtggc

SEQ ID NO: 1122884 - DNA, 22 bp, Artificial Sequence
  chemically synthesized
cttctggggccgggcgcggtgg

SEQ ID NO: 1122885 - DNA, 22 bp, Artificial Sequence
  chemically synthesized
caggcgtgagccaccgcgcccg

SEQ ID NO: 1122886 - DNA, 22 bp, Artificial Sequence
  chemically synthesized
caagatttcttctggggccggg

SEQ ID NO: 1122887 - DNA, 22 bp, Artificial Sequence
  chemically synthesized
aaagtgttacaagatttcttct

SEQ ID NO: 1122888 - DNA, 22 bp, Artificial Sequence
  chemically synthesized
taaaagtgttacaagatttctt

SEQ ID NO: 1122889 - DNA, 22 bp, Artificial Sequence
  chemically synthesized
aggaaaatacacctctaaaagt

SEQ ID NO: 1122890 - DNA, 22 bp, Artificial Sequence
  chemically synthesized
caggaaaatacacctctaaaag

SEQ ID NO: 1122891 - DNA, 22 bp, Artificial Sequence
  chemically synthesized
tcaggaaaatacacctctaaaa

SEQ ID NO: 1122892 - DNA, 22 bp, Artificial Sequence
  chemically synthesized
ttcaggaaaatacacctctaaa

SEQ ID NO: 1122893 - DNA, 22 bp, Artificial Sequence
  chemically synthesized
tttcaggaaaatacacctctaa

SEQ ID NO: 1122894 - DNA, 22 bp, Artificial Sequence
  chemically synthesized
gtaacacttttagaggtgtatt

SEQ ID NO: 1122895 - DNA, 22 bp, Artificial Sequence
  chemically synthesized
taacacttttagaggtgtattt

SEQ ID NO: 1122896 - DNA, 22 bp, Artificial Sequence
  chemically synthesized
cctttttcaggaaaatacacct

SEQ ID NO: 1122897 - DNA, 22 bp, Artificial Sequence
  chemically synthesized
gcctttttcaggaaaatacacc

SEQ ID NO: 1122898 - DNA, 22 bp, Artificial Sequence
  chemically synthesized
tgcctttttcaggaaaatacac

SEQ ID NO: 1122899 - DNA, 22 bp, Artificial Sequence
  chemically synthesized
ttagaggtgtattttcctgaaa

SEQ ID NO: 1122900 - DNA, 22 bp, Artificial Sequence
  chemically synthesized
tagaggtgtattttcctgaaaa

SEQ ID NO: 1122901 - DNA, 22 bp, Artificial Sequence
  chemically synthesized
agaggtgtattttcctgaaaaa

SEQ ID NO: 1122902 - DNA, 22 bp, Artificial Sequence
  chemically synthesized
gaggtgtattttcctgaaaaag

SEQ ID NO: 1122903 - DNA, 22 bp, Artificial Sequence
  chemically synthesized
aaaggaaacatacaattttgcc

SEQ ID NO: 1122904 - DNA, 22 bp, Artificial Sequence
  chemically synthesized
aaaaggaaacatacaattttgc

SEQ ID NO: 1122905 - DNA, 22 bp, Artificial Sequence
  chemically synthesized
tcctgaaaaaggcaaaattgta

SEQ ID NO: 1122906 - DNA, 22 bp, Artificial Sequence
  chemically synthesized
taaaaggaaacatacaattttg

SEQ ID NO: 1122907 - DNA, 22 bp, Artificial Sequence
  chemically synthesized
cctgaaaaaggcaaaattgtat

SEQ ID NO: 1122908 - DNA, 22 bp, Artificial Sequence
  chemically synthesized
ctgaaaaaggcaaaattgtatg

SEQ ID NO: 1122909 - DNA, 22 bp, Artificial Sequence
  chemically synthesized
aaaaaggcaaaattgtatgttt

SEQ ID NO: 1122910 - DNA, 22 bp, Artificial Sequence
  chemically synthesized
accgttttaaaaggaaacatac

SEQ ID NO: 1122911 - DNA, 22 bp, Artificial Sequence
  chemically synthesized
gaccgttttaaaaggaaacata

SEQ ID NO: 1122912 - DNA, 22 bp, Artificial Sequence
  chemically synthesized
tatgtttccttttaaaacggtc

SEQ ID NO: 1122913 - DNA, 22 bp, Artificial Sequence
  chemically synthesized
ccttttaaaacggtcaaatgtc

SEQ ID NO: 1122914 - DNA, 22 bp, Artificial Sequence
  chemically synthesized
cttttaaaacggtcaaatgtct

SEQ ID NO: 1122915 - DNA, 22 bp, Artificial Sequence
  chemically synthesized
ttaaaacggtcaaatgtctcct

SEQ ID NO: 1122916 - DNA, 22 bp, Artificial Sequence
  chemically synthesized
taaaacggtcaaatgtctcctt

SEQ ID NO: 1122917 - DNA, 22 bp, Artificial Sequence
  chemically synthesized
aaaacggtcaaatgtctccttt

SEQ ID NO: 1122918 - DNA, 22 bp, Artificial Sequence
  chemically synthesized
tgaaggggaaaaaaaggagaca

SEQ ID NO: 1122919 - DNA, 22 bp, Artificial Sequence
  chemically synthesized
aaacggtcaaatgtctcctttt

SEQ ID NO: 1122920 - DNA, 22 bp, Artificial Sequence
  chemically synthesized
atgaaggggaaaaaaaggagac

SEQ ID NO: 1122921 - DNA, 22 bp, Artificial Sequence
  chemically synthesized
tatgaaggggaaaaaaaggaga

SEQ ID NO: 1122922 - DNA, 22 bp, Artificial Sequence
  chemically synthesized
gtatatgctttatgaaggggaa

SEQ ID NO: 1122923 - DNA, 22 bp, Artificial Sequence
  chemically synthesized
agtatatgctttatgaagggga

SEQ ID NO: 1122924 - DNA, 22 bp, Artificial Sequence
  chemically synthesized
ctttttttccccttcataaagc

SEQ ID NO: 1122925 - DNA, 22 bp, Artificial Sequence
  chemically synthesized
tttttccccttcataaagcata

SEQ ID NO: 1122926 - DNA, 22 bp, Artificial Sequence
  chemically synthesized
ttttccccttcataaagcatat

SEQ ID NO: 1122927 - DNA, 22 bp, Artificial Sequence
  chemically synthesized
tttccccttcataaagcatata

SEQ ID NO: 1122928 - DNA, 22 bp, Artificial Sequence
  chemically synthesized
ttccccttcataaagcatatac

SEQ ID NO: 1122929 - DNA, 22 bp, Artificial Sequence
  chemically synthesized
tccccttcataaagcatatact

SEQ ID NO: 1122930 - DNA, 22 bp, Artificial Sequence
  chemically synthesized
ccccttcataaagcatatacta

SEQ ID NO: 1122931 - DNA, 22 bp, Artificial Sequence
  chemically synthesized
cccttcataaagcatatactaa

SEQ ID NO: 1122932 - DNA, 22 bp, Artificial Sequence
  chemically synthesized
gcacatagtaagcacttagtat

SEQ ID NO: 1122933 - DNA, 22 bp, Artificial Sequence
  chemically synthesized
cataaagcatatactaagtgct

SEQ ID NO: 1122934 - DNA, 22 bp, Artificial Sequence
  chemically synthesized
ataaagcatatactaagtgctt

SEQ ID NO: 1122935 - DNA, 22 bp, Artificial Sequence
  chemically synthesized
atagcatgtctggcacatagta

SEQ ID NO: 1122936 - DNA, 22 bp, Artificial Sequence
  chemically synthesized
agtgcttactatgtgccagaca

SEQ ID NO: 1122937 - DNA, 22 bp, Artificial Sequence
  chemically synthesized
tggagttaatagcatgtctggc

SEQ ID NO: 1122938 - DNA, 22 bp, Artificial Sequence
  chemically synthesized
atggagttaatagcatgtctgg

SEQ ID NO: 1122939 - DNA, 22 bp, Artificial Sequence
  chemically synthesized
tatggagttaatagcatgtctg

SEQ ID NO: 1122940 - DNA, 22 bp, Artificial Sequence
  chemically synthesized
tttatggagttaatagcatgtc

SEQ ID NO: 1122941 - DNA, 22 bp, Artificial Sequence
  chemically synthesized
actatgtgccagacatgctatt

SEQ ID NO: 1122942 - DNA, 22 bp, Artificial Sequence
  chemically synthesized
ctatgtgccagacatgctatta

SEQ ID NO: 1122943 - DNA, 22 bp, Artificial Sequence
  chemically synthesized
ttctttatggagttaatagcat

SEQ ID NO: 1122944 - DNA, 22 bp, Artificial Sequence
  chemically synthesized
tgtgccagacatgctattaact

SEQ ID NO: 1122945 - DNA, 22 bp, Artificial Sequence
  chemically synthesized
tgttctttatggagttaatagc

SEQ ID NO: 1122946 - DNA, 22 bp, Artificial Sequence
  chemically synthesized
gtctctgttctttatggagtta

SEQ ID NO: 1122947 - DNA, 22 bp, Artificial Sequence
  chemically synthesized
tcgtctctgttctttatggagt

SEQ ID NO: 1122948 - DNA, 22 bp, Artificial Sequence
  chemically synthesized
atgcattctcgtctctgttctt

SEQ ID NO: 1122949 - DNA, 22 bp, Artificial Sequence
  chemically synthesized
ttaactccataaagaacagaga

SEQ ID NO: 1122950 - DNA, 22 bp, Artificial Sequence
  chemically synthesized
actccataaagaacagagacga

SEQ ID NO: 1122951 - DNA, 22 bp, Artificial Sequence
  chemically synthesized
cataaagaacagagacgagaat

SEQ ID NO: 1122952 - DNA, 22 bp, Artificial Sequence
  chemically synthesized
ataatgtggactaatgcattct

SEQ ID NO: 1122953 - DNA, 22 bp, Artificial Sequence
  chemically synthesized
gataatgtggactaatgcattc

SEQ ID NO: 1122954 - DNA, 22 bp, Artificial Sequence
  chemically synthesized
cttgataatgtggactaatgca

SEQ ID NO: 1122955 - DNA, 22 bp, Artificial Sequence
  chemically synthesized
aaccaaattacttgataatgtg

SEQ ID NO: 1122956 - DNA, 22 bp, Artificial Sequence
  chemically synthesized
actaaaccaaattacttgataa

SEQ ID NO: 1122957 - DNA, 22 bp, Artificial Sequence
  chemically synthesized
cactaaaccaaattacttgata

SEQ ID NO: 1122958 - DNA, 22 bp, Artificial Sequence
  chemically synthesized
gtccacattatcaagtaatttg

SEQ ID NO: 1122959 - DNA, 22 bp, Artificial Sequence
  chemically synthesized
tcaagtaatttggtttagtgaa

SEQ ID NO: 1122960 - DNA, 22 bp, Artificial Sequence
  chemically synthesized
tcaaacaaatgcttcactaaac

SEQ ID NO: 1122961 - DNA, 22 bp, Artificial Sequence
  chemically synthesized
gtcaaacaaatgcttcactaaa

SEQ ID NO: 1122962 - DNA, 22 bp, Artificial Sequence
  chemically synthesized
tcttgtcaaacaaatgcttcac

SEQ ID NO: 1122963 - DNA, 22 bp, Artificial Sequence
  chemically synthesized
atcttgtcaaacaaatgcttca

SEQ ID NO: 1122964 - DNA, 22 bp, Artificial Sequence
  chemically synthesized
tatcttgtcaaacaaatgcttc

SEQ ID NO: 1122965 - DNA, 22 bp, Artificial Sequence
  chemically synthesized
ttatcttgtcaaacaaatgctt

SEQ ID NO: 1122966 - DNA, 22 bp, Artificial Sequence
  chemically synthesized
ggtttagtgaagcatttgtttg

SEQ ID NO: 1122967 - DNA, 22 bp, Artificial Sequence
  chemically synthesized
gtttagtgaagcatttgtttga

SEQ ID NO: 1122968 - DNA, 22 bp, Artificial Sequence
  chemically synthesized
agtgaagcatttgtttgacaag

SEQ ID NO: 1122969 - DNA, 22 bp, Artificial Sequence
  chemically synthesized
aaccatttttatcttgtcaaac

SEQ ID NO: 1122970 - DNA, 22 bp, Artificial Sequence
  chemically synthesized
gtgaagcatttgtttgacaaga

SEQ ID NO: 1122971 - DNA, 22 bp, Artificial Sequence
  chemically synthesized
tgtctaaaccatttttatcttg

SEQ ID NO: 1122972 - DNA, 22 bp, Artificial Sequence
  chemically synthesized
tgtgtctaaaccatttttatct

SEQ ID NO: 1122973 - DNA, 22 bp, Artificial Sequence
  chemically synthesized
gtttgacaagataaaaatggtt

SEQ ID NO: 1122974 - DNA, 22 bp, Artificial Sequence
  chemically synthesized
tttgacaagataaaaatggttt

SEQ ID NO: 1122975 - DNA, 22 bp, Artificial Sequence
  chemically synthesized
gacaagataaaaatggtttaga

SEQ ID NO: 1122976 - DNA, 22 bp, Artificial Sequence
  chemically synthesized
acaagataaaaatggtttagac

SEQ ID NO: 1122977 - DNA, 22 bp, Artificial Sequence
  chemically synthesized
agccccagttctgtgtctaaac

SEQ ID NO: 1122978 - DNA, 22 bp, Artificial Sequence
  chemically synthesized
agacacagaactggggctcagc

SEQ ID NO: 1122979 - DNA, 22 bp, Artificial Sequence
  chemically synthesized
gacacagaactggggctcagct

SEQ ID NO: 1122980 - DNA, 22 bp, Artificial Sequence
  chemically synthesized
aaaagaccagtgtgagctgagc

SEQ ID NO: 1122981 - DNA, 22 bp, Artificial Sequence
  chemically synthesized
aaaaagaccagtgtgagctgag

SEQ ID NO: 1122982 - DNA, 22 bp, Artificial Sequence
  chemically synthesized
ttaaaaagaccagtgtgagctg

SEQ ID NO: 1122983 - DNA, 22 bp, Artificial Sequence
  chemically synthesized
tcctcttaaaaagaccagtgtg

SEQ ID NO: 1122984 - DNA, 22 bp, Artificial Sequence
  chemically synthesized
gggctcagctcacactggtctt

SEQ ID NO: 1122985 - DNA, 22 bp, Artificial Sequence
  chemically synthesized
attatcctcttaaaaagaccag

SEQ ID NO: 1122986 - DNA, 22 bp, Artificial Sequence
  chemically synthesized
gattatcctcttaaaaagacca

SEQ ID NO: 1122987 - DNA, 22 bp, Artificial Sequence
  chemically synthesized
tgattatcctcttaaaaagacc

SEQ ID NO: 1122988 - DNA, 22 bp, Artificial Sequence
  chemically synthesized
ttgattatcctcttaaaaagac

SEQ ID NO: 1122989 - DNA, 22 bp, Artificial Sequence
  chemically synthesized
agctcacactggtctttttaag

SEQ ID NO: 1122990 - DNA, 22 bp, Artificial Sequence
  chemically synthesized
tttgattatcctcttaaaaaga

SEQ ID NO: 1122991 - DNA, 22 bp, Artificial Sequence
  chemically synthesized
acactggtctttttaagaggat

SEQ ID NO: 1122992 - DNA, 22 bp, Artificial Sequence
  chemically synthesized
gtctttttaagaggataatcaa

SEQ ID NO: 1122993 - DNA, 22 bp, Artificial Sequence
  chemically synthesized
cagagaaggtgttttttgatta

SEQ ID NO: 1122994 - DNA, 22 bp, Artificial Sequence
  chemically synthesized
acagagaaggtgttttttgatt

SEQ ID NO: 1122995 - DNA, 22 bp, Artificial Sequence
  chemically synthesized
tttaagaggataatcaaaaaac

SEQ ID NO: 1122996 - DNA, 22 bp, Artificial Sequence
  chemically synthesized
ttaagaggataatcaaaaaaca

SEQ ID NO: 1122997 - DNA, 22 bp, Artificial Sequence
  chemically synthesized
taagaggataatcaaaaaacac

SEQ ID NO: 1122998 - DNA, 22 bp, Artificial Sequence
  chemically synthesized
aagaggataatcaaaaaacacc

SEQ ID NO: 1122999 - DNA, 22 bp, Artificial Sequence
  chemically synthesized
atttacagagaaggtgtttttt

SEQ ID NO: 1123000 - DNA, 22 bp, Artificial Sequence
  chemically synthesized
agaggataatcaaaaaacacct

SEQ ID NO: 1123001 - DNA, 22 bp, Artificial Sequence
  chemically synthesized
atcctaatttacagagaaggtg

SEQ ID NO: 1123002 - DNA, 22 bp, Artificial Sequence
  chemically synthesized
aatcctaatttacagagaaggt

SEQ ID NO: 1123003 - DNA, 22 bp, Artificial Sequence
  chemically synthesized
atttaatcctaatttacagaga

SEQ ID NO: 1123004 - DNA, 22 bp, Artificial Sequence
  chemically synthesized
gaagctgatttaatcctaattt

SEQ ID NO: 1123005 - DNA, 22 bp, Artificial Sequence
  chemically synthesized
ggctagaagctgatttaatcct

SEQ ID NO: 1123006 - DNA, 22 bp, Artificial Sequence
  chemically synthesized
ctctgtaaattaggattaaatc

SEQ ID NO: 1123007 - DNA, 22 bp, Artificial Sequence
  chemically synthesized
tctgtaaattaggattaaatca

SEQ ID NO: 1123008 - DNA, 22 bp, Artificial Sequence
  chemically synthesized
taggctagaagctgatttaatc

SEQ ID NO: 1123009 - DNA, 22 bp, Artificial Sequence
  chemically synthesized
tgtaaattaggattaaatcagc

SEQ ID NO: 1123010 - DNA, 22 bp, Artificial Sequence
  chemically synthesized
taaattaggattaaatcagctt

SEQ ID NO: 1123011 - DNA, 22 bp, Artificial Sequence
  chemically synthesized
gcagagcctctaggctagaagc

SEQ ID NO: 1123012 - DNA, 22 bp, Artificial Sequence
  chemically synthesized
ggattaaatcagcttctagcct

SEQ ID NO: 1123013 - DNA, 22 bp, Artificial Sequence
  chemically synthesized
ggcagagcctctaggctagaag

SEQ ID NO: 1123014 - DNA, 22 bp, Artificial Sequence
  chemically synthesized
aatcagcttctagcctagaggc

SEQ ID NO: 1123015 - DNA, 22 bp, Artificial Sequence
  chemically synthesized
ctagcctagaggctctgccaag

SEQ ID NO: 1123016 - DNA, 22 bp, Artificial Sequence
  chemically synthesized
tagcctagaggctctgccaagt

SEQ ID NO: 1123017 - DNA, 22 bp, Artificial Sequence
  chemically synthesized
gcctagaggctctgccaagtat

SEQ ID NO: 1123018 - DNA, 22 bp, Artificial Sequence
  chemically synthesized
tgtggagataaccaatatactt

SEQ ID NO: 1123019 - DNA, 22 bp, Artificial Sequence
  chemically synthesized
gaggctctgccaagtatattgg

SEQ ID NO: 1123020 - DNA, 22 bp, Artificial Sequence
  chemically synthesized
gtgtggagataaccaatatact

SEQ ID NO: 1123021 - DNA, 22 bp, Artificial Sequence
  chemically synthesized
tgtgtggagataaccaatatac

SEQ ID NO: 1123022 - DNA, 22 bp, Artificial Sequence
  chemically synthesized
tttgtgtggagataaccaatat

SEQ ID NO: 1123023 - DNA, 22 bp, Artificial Sequence
  chemically synthesized
ctttgtgtggagataaccaata

SEQ ID NO: 1123024 - DNA, 22 bp, Artificial Sequence
  chemically synthesized
tgccaagtatattggttatctc

SEQ ID NO: 1123025 - DNA, 22 bp, Artificial Sequence
  chemically synthesized
ccaagtatattggttatctcca

SEQ ID NO: 1123026 - DNA, 22 bp, Artificial Sequence
  chemically synthesized
cacaaagccttctttgtgtgga

SEQ ID NO: 1123027 - DNA, 22 bp, Artificial Sequence
  chemically synthesized
actccacaaagccttctttgtg

SEQ ID NO: 1123028 - DNA, 22 bp, Artificial Sequence
  chemically synthesized
gttatctccacacaaagaaggc

SEQ ID NO: 1123029 - DNA, 22 bp, Artificial Sequence
  chemically synthesized
tctccacacaaagaaggctttg

SEQ ID NO: 1123030 - DNA, 22 bp, Artificial Sequence
  chemically synthesized
cacacaaagaaggctttgtgga

SEQ ID NO: 1123031 - DNA, 22 bp, Artificial Sequence
  chemically synthesized
ccatggtgttgactccacaaag

SEQ ID NO: 1123032 - DNA, 22 bp, Artificial Sequence
  chemically synthesized
tgtggagtcaacaccatggtaa

SEQ ID NO: 1123033 - DNA, 22 bp, Artificial Sequence
  chemically synthesized
gtggagtcaacaccatggtaac

SEQ ID NO: 1123034 - DNA, 22 bp, Artificial Sequence
  chemically synthesized
tggagtcaacaccatggtaact

SEQ ID NO: 1123035 - DNA, 22 bp, Artificial Sequence
  chemically synthesized
acagacagagaagcaaacagac

SEQ ID NO: 1123036 - DNA, 22 bp, Artificial Sequence
  chemically synthesized
cacagacagagaagcaaacaga

SEQ ID NO: 1123037 - DNA, 22 bp, Artificial Sequence
  chemically synthesized
aaatcttcacagacagagaagc

SEQ ID NO: 1123038 - DNA, 22 bp, Artificial Sequence
  chemically synthesized
aaaatcttcacagacagagaag

SEQ ID NO: 1123039 - DNA, 22 bp, Artificial Sequence
  chemically synthesized
tctgtttgcttctctgtctgtg

SEQ ID NO: 1123040 - DNA, 22 bp, Artificial Sequence
  chemically synthesized
ccttaaaatcttcacagacaga

SEQ ID NO: 1123041 - DNA, 22 bp, Artificial Sequence
  chemically synthesized
tttgcttctctgtctgtgaaga

SEQ ID NO: 1123042 - DNA, 22 bp, Artificial Sequence
  chemically synthesized
gcttctctgtctgtgaagattt

SEQ ID NO: 1123043 - DNA, 22 bp, Artificial Sequence
  chemically synthesized
cttctctgtctgtgaagatttt

SEQ ID NO: 1123044 - DNA, 22 bp, Artificial Sequence
  chemically synthesized
ctctgtctgtgaagattttaag

SEQ ID NO: 1123045 - DNA, 22 bp, Artificial Sequence
  chemically synthesized
tctgtctgtgaagattttaagg

SEQ ID NO: 1123046 - DNA, 22 bp, Artificial Sequence
  chemically synthesized
gtgtccaggcctcccttaaaat

SEQ ID NO: 1123047 - DNA, 22 bp, Artificial Sequence
  chemically synthesized
tgtctgtgaagattttaaggga

SEQ ID NO: 1123048 - DNA, 22 bp, Artificial Sequence
  chemically synthesized
tctgtgaagattttaagggagg

SEQ ID NO: 1123049 - DNA, 22 bp, Artificial Sequence
  chemically synthesized
tgaagattttaagggaggcctg

SEQ ID NO: 1123050 - DNA, 22 bp, Artificial Sequence
  chemically synthesized
cgtgccaactggtgtccaggcc

SEQ ID NO: 1123051 - DNA, 22 bp, Artificial Sequence
  chemically synthesized
taagggaggcctggacaccagt

SEQ ID NO: 1123052 - DNA, 22 bp, Artificial Sequence
  chemically synthesized
aagggaggcctggacaccagtt

SEQ ID NO: 1123053 - DNA, 22 bp, Artificial Sequence
  chemically synthesized
agggaggcctggacaccagttg

SEQ ID NO: 1123054 - DNA, 22 bp, Artificial Sequence
  chemically synthesized
tcagaactacgtgccaactggt

SEQ ID NO: 1123055 - DNA, 22 bp, Artificial Sequence
  chemically synthesized
aattatcagaactacgtgccaa

SEQ ID NO: 1123056 - DNA, 22 bp, Artificial Sequence
  chemically synthesized
gaattatcagaactacgtgcca

SEQ ID NO: 1123057 - DNA, 22 bp, Artificial Sequence
  chemically synthesized
gacaccagttggcacgtagttc

SEQ ID NO: 1123058 - DNA, 22 bp, Artificial Sequence
  chemically synthesized
atttgaattatcagaactacgt

SEQ ID NO: 1123059 - DNA, 22 bp, Artificial Sequence
  chemically synthesized
aattgatttgaattatcagaac

SEQ ID NO: 1123060 - DNA, 22 bp, Artificial Sequence
  chemically synthesized
gaattgatttgaattatcagaa

SEQ ID NO: 1123061 - DNA, 22 bp, Artificial Sequence
  chemically synthesized
tttgaattgatttgaattatca

SEQ ID NO: 1123062 - DNA, 22 bp, Artificial Sequence
  chemically synthesized
gcacgtagttctgataattcaa

SEQ ID NO: 1123063 - DNA, 22 bp, Artificial Sequence
  chemically synthesized
ttgtttgaattgatttgaatta

SEQ ID NO: 1123064 - DNA, 22 bp, Artificial Sequence
  chemically synthesized
acatcctgttgtttgaattgat

SEQ ID NO: 1123065 - DNA, 22 bp, Artificial Sequence
  chemically synthesized
tgataattcaaatcaattcaaa

SEQ ID NO: 1123066 - DNA, 22 bp, Artificial Sequence
  chemically synthesized
cacatcctgttgtttgaattga

SEQ ID NO: 1123067 - DNA, 22 bp, Artificial Sequence
  chemically synthesized
ataattcaaatcaattcaaaca

SEQ ID NO: 1123068 - DNA, 22 bp, Artificial Sequence
  chemically synthesized
tagaatttcacatcctgttgtt

SEQ ID NO: 1123069 - DNA, 22 bp, Artificial Sequence
  chemically synthesized
aaatcaattcaaacaacaggat

SEQ ID NO: 1123070 - DNA, 22 bp, Artificial Sequence
  chemically synthesized
tgtagaatttcacatcctgttg

SEQ ID NO: 1123071 - DNA, 22 bp, Artificial Sequence
  chemically synthesized
ctgtagaatttcacatcctgtt

SEQ ID NO: 1123072 - DNA, 22 bp, Artificial Sequence
  chemically synthesized
tctgtagaatttcacatcctgt

SEQ ID NO: 1123073 - DNA, 22 bp, Artificial Sequence
  chemically synthesized
aaacaacaggatgtgaaattct

SEQ ID NO: 1123074 - DNA, 22 bp, Artificial Sequence
  chemically synthesized
aatgaggaaagacctttctgta

SEQ ID NO: 1123075 - DNA, 22 bp, Artificial Sequence
  chemically synthesized
tacagaaaggtctttcctcatt

SEQ ID NO: 1123076 - DNA, 22 bp, Artificial Sequence
  chemically synthesized
cagaaaggtctttcctcattca

SEQ ID NO: 1123077 - DNA, 22 bp, Artificial Sequence
  chemically synthesized
taaagtcagacaaaaaattgaa

SEQ ID NO: 1123078 - DNA, 22 bp, Artificial Sequence
  chemically synthesized
ataaagtcagacaaaaaattga

SEQ ID NO: 1123079 - DNA, 22 bp, Artificial Sequence
  chemically synthesized
tcctcattcaattttttgtctg

SEQ ID NO: 1123080 - DNA, 22 bp, Artificial Sequence
  chemically synthesized
cctcattcaattttttgtctga

SEQ ID NO: 1123081 - DNA, 22 bp, Artificial Sequence
  chemically synthesized
ctcattcaattttttgtctgac

SEQ ID NO: 1123082 - DNA, 22 bp, Artificial Sequence
  chemically synthesized
caaatttataaagtcagacaaa

SEQ ID NO: 1123083 - DNA, 22 bp, Artificial Sequence
  chemically synthesized
ccaaatttataaagtcagacaa

SEQ ID NO: 1123084 - DNA, 22 bp, Artificial Sequence
  chemically synthesized
tccaaatttataaagtcagaca

SEQ ID NO: 1123085 - DNA, 22 bp, Artificial Sequence
  chemically synthesized
attcaattttttgtctgacttt

SEQ ID NO: 1123086 - DNA, 22 bp, Artificial Sequence
  chemically synthesized
aattttttgtctgactttataa

SEQ ID NO: 1123087 - DNA, 22 bp, Artificial Sequence
  chemically synthesized
tttgtctgactttataaatttg

SEQ ID NO: 1123088 - DNA, 22 bp, Artificial Sequence
  chemically synthesized
ttgtctgactttataaatttgg

SEQ ID NO: 1123089 - DNA, 22 bp, Artificial Sequence
  chemically synthesized
tgtctgactttataaatttgga

SEQ ID NO: 1123090 - DNA, 22 bp, Artificial Sequence
  chemically synthesized
gtctgactttataaatttggaa

SEQ ID NO: 1123091 - DNA, 22 bp, Artificial Sequence
  chemically synthesized
tatgtgacccctttccaaattt

SEQ ID NO: 1123092 - DNA, 22 bp, Artificial Sequence
  chemically synthesized
tctgactttataaatttggaaa

SEQ ID NO: 1123093 - DNA, 22 bp, Artificial Sequence
  chemically synthesized
actttataaatttggaaagggg

SEQ ID NO: 1123094 - DNA, 22 bp, Artificial Sequence
  chemically synthesized
acgcactgtatgtgaccccttt

SEQ ID NO: 1123095 - DNA, 22 bp, Artificial Sequence
  chemically synthesized
tataaatttggaaaggggtcac

SEQ ID NO: 1123096 - DNA, 22 bp, Artificial Sequence
  chemically synthesized
ataaatttggaaaggggtcaca

SEQ ID NO: 1123097 - DNA, 22 bp, Artificial Sequence
  chemically synthesized
taaatttggaaaggggtcacat

SEQ ID NO: 1123098 - DNA, 22 bp, Artificial Sequence
  chemically synthesized
ggaaaggggtcacatacagtgc

SEQ ID NO: 1123099 - DNA, 22 bp, Artificial Sequence
  chemically synthesized
gaaaggggtcacatacagtgcg

SEQ ID NO: 1123100 - DNA, 22 bp, Artificial Sequence
  chemically synthesized
tataaaagggaagttcacgcac

SEQ ID NO: 1123101 - DNA, 22 bp, Artificial Sequence
  chemically synthesized
gtataaaagggaagttcacgca

SEQ ID NO: 1123102 - DNA, 22 bp, Artificial Sequence
  chemically synthesized
tgtataaaagggaagttcacgc

SEQ ID NO: 1123103 - DNA, 22 bp, Artificial Sequence
  chemically synthesized
catacgatctttgtataaaagg

SEQ ID NO: 1123104 - DNA, 22 bp, Artificial Sequence
  chemically synthesized
tccatacgatctttgtataaaa

SEQ ID NO: 1123105 - DNA, 22 bp, Artificial Sequence
  chemically synthesized
cccttttatacaaagatcgtat

SEQ ID NO: 1123106 - DNA, 22 bp, Artificial Sequence
  chemically synthesized
ccttttatacaaagatcgtatg

SEQ ID NO: 1123107 - DNA, 22 bp, Artificial Sequence
  chemically synthesized
ttatacaaagatcgtatggaga

SEQ ID NO: 1123108 - DNA, 22 bp, Artificial Sequence
  chemically synthesized
tatacaaagatcgtatggagag

SEQ ID NO: 1123109 - DNA, 22 bp, Artificial Sequence
  chemically synthesized
atacaaagatcgtatggagagt

SEQ ID NO: 1123110 - DNA, 22 bp, Artificial Sequence
  chemically synthesized
tacaaagatcgtatggagagtg

SEQ ID NO: 1123111 - DNA, 22 bp, Artificial Sequence
  chemically synthesized
tacatcaaaaaacgagcgtaat

SEQ ID NO: 1123112 - DNA, 22 bp, Artificial Sequence
  chemically synthesized
aaaatctgtacatcaaaaaacg

SEQ ID NO: 1123113 - DNA, 22 bp, Artificial Sequence
  chemically synthesized
aaaaatctgtacatcaaaaaac

SEQ ID NO: 1123114 - DNA, 22 bp, Artificial Sequence
  chemically synthesized
taaaaatctgtacatcaaaaaa

SEQ ID NO: 1123115 - DNA, 22 bp, Artificial Sequence
  chemically synthesized
ttaaaaatctgtacatcaaaaa

SEQ ID NO: 1123116 - DNA, 22 bp, Artificial Sequence
  chemically synthesized
tttaaaaatctgtacatcaaaa

SEQ ID NO: 1123117 - DNA, 22 bp, Artificial Sequence
  chemically synthesized
cgctcgttttttgatgtacaga

SEQ ID NO: 1123118 - DNA, 22 bp, Artificial Sequence
  chemically synthesized
cctttttaaaaatctgtacatc

SEQ ID NO: 1123119 - DNA, 22 bp, Artificial Sequence
  chemically synthesized
gttttttgatgtacagattttt

SEQ ID NO: 1123120 - DNA, 22 bp, Artificial Sequence
  chemically synthesized
aaattgcctttttaaaaatctg

SEQ ID NO: 1123121 - DNA, 22 bp, Artificial Sequence
  chemically synthesized
gaaattgcctttttaaaaatct

SEQ ID NO: 1123122 - DNA, 22 bp, Artificial Sequence
  chemically synthesized
tttgatgtacagatttttaaaa

SEQ ID NO: 1123123 - DNA, 22 bp, Artificial Sequence
  chemically synthesized
ttgatgtacagatttttaaaaa

SEQ ID NO: 1123124 - DNA, 22 bp, Artificial Sequence
  chemically synthesized
tgatgtacagatttttaaaaag

SEQ ID NO: 1123125 - DNA, 22 bp, Artificial Sequence
  chemically synthesized
gatgtacagatttttaaaaagg

SEQ ID NO: 1123126 - DNA, 22 bp, Artificial Sequence
  chemically synthesized
atgtacagatttttaaaaaggc

SEQ ID NO: 1123127 - DNA, 22 bp, Artificial Sequence
  chemically synthesized
gtaaaatttgaaattgcctttt

SEQ ID NO: 1123128 - DNA, 22 bp, Artificial Sequence
  chemically synthesized
ccctagtaaaatttgaaattgc

SEQ ID NO: 1123129 - DNA, 22 bp, Artificial Sequence
  chemically synthesized
ttaaaaaggcaatttcaaattt

SEQ ID NO: 1123130 - DNA, 22 bp, Artificial Sequence
  chemically synthesized
taaaaaggcaatttcaaatttt

SEQ ID NO: 1123131 - DNA, 22 bp, Artificial Sequence
  chemically synthesized
aaaaaggcaatttcaaatttta

SEQ ID NO: 1123132 - DNA, 22 bp, Artificial Sequence
  chemically synthesized
aaaaggcaatttcaaattttac

SEQ ID NO: 1123133 - DNA, 22 bp, Artificial Sequence
  chemically synthesized
accactgccctagtaaaatttg

SEQ ID NO: 1123134 - DNA, 22 bp, Artificial Sequence
  chemically synthesized
ctcaccactgccctagtaaaat

SEQ ID NO: 1123135 - DNA, 22 bp, Artificial Sequence
  chemically synthesized
tcctcaccactgccctagtaaa

SEQ ID NO: 1123136 - DNA, 22 bp, Artificial Sequence
  chemically synthesized
caaattttactagggcagtggt

SEQ ID NO: 1123137 - DNA, 22 bp, Artificial Sequence
  chemically synthesized
aaattttactagggcagtggtg

SEQ ID NO: 1123138 - DNA, 22 bp, Artificial Sequence
  chemically synthesized
gacaaaacgctctcctcaccac

SEQ ID NO: 1123139 - DNA, 22 bp, Artificial Sequence
  chemically synthesized
agacaaaacgctctcctcacca

SEQ ID NO: 1123140 - DNA, 22 bp, Artificial Sequence
  chemically synthesized
tactagggcagtggtgaggaga

SEQ ID NO: 1123141 - DNA, 22 bp, Artificial Sequence
  chemically synthesized
actagggcagtggtgaggagag

SEQ ID NO: 1123142 - DNA, 22 bp, Artificial Sequence
  chemically synthesized
ctagggcagtggtgaggagagc

SEQ ID NO: 1123143 - DNA, 22 bp, Artificial Sequence
  chemically synthesized
cttagacaaaacgctctcctca

SEQ ID NO: 1123144 - DNA, 22 bp, Artificial Sequence
  chemically synthesized
ccttagacaaaacgctctcctc

SEQ ID NO: 1123145 - DNA, 22 bp, Artificial Sequence
  chemically synthesized
tccttagacaaaacgctctcct

SEQ ID NO: 1123146 - DNA, 22 bp, Artificial Sequence
  chemically synthesized
gggcagtggtgaggagagcgtt

SEQ ID NO: 1123147 - DNA, 22 bp, Artificial Sequence
  chemically synthesized
ttttccttagacaaaacgctct

SEQ ID NO: 1123148 - DNA, 22 bp, Artificial Sequence
  chemically synthesized
tgaataggttattttccttaga

SEQ ID NO: 1123149 - DNA, 22 bp, Artificial Sequence
  chemically synthesized
atgaataggttattttccttag

SEQ ID NO: 1123150 - DNA, 22 bp, Artificial Sequence
  chemically synthesized
tgcttatgaataggttattttc

SEQ ID NO: 1123151 - DNA, 22 bp, Artificial Sequence
  chemically synthesized
tgtgcttatgaataggttattt

SEQ ID NO: 1123152 - DNA, 22 bp, Artificial Sequence
  chemically synthesized
tgtctaaggaaaataacctatt

SEQ ID NO: 1123153 - DNA, 22 bp, Artificial Sequence
  chemically synthesized
gtctaaggaaaataacctattc

SEQ ID NO: 1123154 - DNA, 22 bp, Artificial Sequence
  chemically synthesized
tctaaggaaaataacctattca

SEQ ID NO: 1123155 - DNA, 22 bp, Artificial Sequence
  chemically synthesized
acctctgtgcttatgaataggt

SEQ ID NO: 1123156 - DNA, 22 bp, Artificial Sequence
  chemically synthesized
aggaaaataacctattcataag

SEQ ID NO: 1123157 - DNA, 22 bp, Artificial Sequence
  chemically synthesized
ttcataagcacagaggttaatg

SEQ ID NO: 1123158 - DNA, 22 bp, Artificial Sequence
  chemically synthesized
gaaaagaagtataacattaacc

SEQ ID NO: 1123159 - DNA, 22 bp, Artificial Sequence
  chemically synthesized
ataagcacagaggttaatgtta

SEQ ID NO: 1123160 - DNA, 22 bp, Artificial Sequence
  chemically synthesized
agaaaagaagtataacattaac

SEQ ID NO: 1123161 - DNA, 22 bp, Artificial Sequence
  chemically synthesized
tagaaaagaagtataacattaa

SEQ ID NO: 1123162 - DNA, 22 bp, Artificial Sequence
  chemically synthesized
cattttagaaaagaagtataac

SEQ ID NO: 1123163 - DNA, 22 bp, Artificial Sequence
  chemically synthesized
ttccattttagaaaagaagtat

SEQ ID NO: 1123164 - DNA, 22 bp, Artificial Sequence
  chemically synthesized
gttccattttagaaaagaagta

SEQ ID NO: 1123165 - DNA, 22 bp, Artificial Sequence
  chemically synthesized
tgttccattttagaaaagaagt

SEQ ID NO: 1123166 - DNA, 22 bp, Artificial Sequence
  chemically synthesized
tttgttccattttagaaaagaa

SEQ ID NO: 1123167 - DNA, 22 bp, Artificial Sequence
  chemically synthesized
ctttgttccattttagaaaaga

SEQ ID NO: 1123168 - DNA, 22 bp, Artificial Sequence
  chemically synthesized
atgttatacttcttttctaaaa

SEQ ID NO: 1123169 - DNA, 22 bp, Artificial Sequence
  chemically synthesized
tacttcttttctaaaatggaac

SEQ ID NO: 1123170 - DNA, 22 bp, Artificial Sequence
  chemically synthesized
atatgtttctttgttccatttt

SEQ ID NO: 1123171 - DNA, 22 bp, Artificial Sequence
  chemically synthesized
attaatatgtttctttgttcca

SEQ ID NO: 1123172 - DNA, 22 bp, Artificial Sequence
  chemically synthesized
cttttctaaaatggaacaaaga

SEQ ID NO: 1123173 - DNA, 22 bp, Artificial Sequence
  chemically synthesized
ttttctaaaatggaacaaagaa

SEQ ID NO: 1123174 - DNA, 22 bp, Artificial Sequence
  chemically synthesized
ttctaaaatggaacaaagaaac

SEQ ID NO: 1123175 - DNA, 22 bp, Artificial Sequence
  chemically synthesized
tctaaaatggaacaaagaaaca

SEQ ID NO: 1123176 - DNA, 22 bp, Artificial Sequence
  chemically synthesized
ctaaaatggaacaaagaaacat

SEQ ID NO: 1123177 - DNA, 22 bp, Artificial Sequence
  chemically synthesized
taaaatggaacaaagaaacata

SEQ ID NO: 1123178 - DNA, 22 bp, Artificial Sequence
  chemically synthesized
aaatggaacaaagaaacatatt

SEQ ID NO: 1123179 - DNA, 22 bp, Artificial Sequence
  chemically synthesized
caacaggtgagaagagtccaaa

SEQ ID NO: 1123180 - DNA, 22 bp, Artificial Sequence
  chemically synthesized
atgagtttggactcttctcacc

SEQ ID NO: 1123181 - DNA, 22 bp, Artificial Sequence
  chemically synthesized
ggactcttctcacctgttggag

SEQ ID NO: 1123182 - DNA, 22 bp, Artificial Sequence
  chemically synthesized
gactcttctcacctgttggagt

SEQ ID NO: 1123183 - DNA, 22 bp, Artificial Sequence
  chemically synthesized
ttctcacctgttggagttcttc

SEQ ID NO: 1123184 - DNA, 22 bp, Artificial Sequence
  chemically synthesized
ctcacctgttggagttcttccc

SEQ ID NO: 1123185 - DNA, 22 bp, Artificial Sequence
  chemically synthesized
tcacctgttggagttcttccct

SEQ ID NO: 1123186 - DNA, 22 bp, Artificial Sequence
  chemically synthesized
acctgttggagttcttcccttt

SEQ ID NO: 1123187 - DNA, 22 bp, Artificial Sequence
  chemically synthesized
ttggagttcttccctttcattt

SEQ ID NO: 1123188 - DNA, 22 bp, Artificial Sequence
  chemically synthesized
gagttcttccctttcatttcta

SEQ ID NO: 1123189 - DNA, 22 bp, Artificial Sequence
  chemically synthesized
ttccctttcatttctatcatta

SEQ ID NO: 1123190 - DNA, 22 bp, Artificial Sequence
  chemically synthesized
ccctttcatttctatcattatt

SEQ ID NO: 1123191 - DNA, 22 bp, Artificial Sequence
  chemically synthesized
cctttcatttctatcattattg

SEQ ID NO: 1123192 - DNA, 22 bp, Artificial Sequence
  chemically synthesized
tcatttctatcattattgtgat

SEQ ID NO: 1123193 - DNA, 22 bp, Artificial Sequence
  chemically synthesized
catttctatcattattgtgata

SEQ ID NO: 1123194 - DNA, 22 bp, Artificial Sequence
  chemically synthesized
atttctatcattattgtgatat

SEQ ID NO: 1123195 - DNA, 22 bp, Artificial Sequence
  chemically synthesized
ccatgaaatcaagatatcacaa

SEQ ID NO: 1123196 - DNA, 22 bp, Artificial Sequence
  chemically synthesized
cccatgaaatcaagatatcaca

SEQ ID NO: 1123197 - DNA, 22 bp, Artificial Sequence
  chemically synthesized
ctatcattattgtgatatcttg

SEQ ID NO: 1123198 - DNA, 22 bp, Artificial Sequence
  chemically synthesized
tatcattattgtgatatcttga

SEQ ID NO: 1123199 - DNA, 22 bp, Artificial Sequence
  chemically synthesized
tttcccatgaaatcaagatatc

SEQ ID NO: 1123200 - DNA, 22 bp, Artificial Sequence
  chemically synthesized
tcattattgtgatatcttgatt

SEQ ID NO: 1123201 - DNA, 22 bp, Artificial Sequence
  chemically synthesized
ttgtgatatcttgatttcatgg

SEQ ID NO: 1123202 - DNA, 22 bp, Artificial Sequence
  chemically synthesized
tgatatcttgatttcatgggaa

SEQ ID NO: 1123203 - DNA, 22 bp, Artificial Sequence
  chemically synthesized
agtgtccacctgtttcccatga

SEQ ID NO: 1123204 - DNA, 22 bp, Artificial Sequence
  chemically synthesized
ggttcagtgtccacctgtttcc

SEQ ID NO: 1123205 - DNA, 22 bp, Artificial Sequence
  chemically synthesized
gatttcatgggaaacaggtgga

SEQ ID NO: 1123206 - DNA, 22 bp, Artificial Sequence
  chemically synthesized
atttcatgggaaacaggtggac

SEQ ID NO: 1123207 - DNA, 22 bp, Artificial Sequence
  chemically synthesized
catgggaaacaggtggacactg

SEQ ID NO: 1123208 - DNA, 22 bp, Artificial Sequence
  chemically synthesized
atgggaaacaggtggacactga

SEQ ID NO: 1123209 - DNA, 22 bp, Artificial Sequence
  chemically synthesized
tgtaagaattgggttcagtgtc

SEQ ID NO: 1123210 - DNA, 22 bp, Artificial Sequence
  chemically synthesized
aattgtgtaagaattgggttca

SEQ ID NO: 1123211 - DNA, 22 bp, Artificial Sequence
  chemically synthesized
gaattgtgtaagaattgggttc

SEQ ID NO: 1123212 - DNA, 22 bp, Artificial Sequence
  chemically synthesized
agagcttgaattgtgtaagaat

SEQ ID NO: 1123213 - DNA, 22 bp, Artificial Sequence
  chemically synthesized
aacccaattcttacacaattca

SEQ ID NO: 1123214 - DNA, 22 bp, Artificial Sequence
  chemically synthesized
ggaatagctcagagcttgaatt

SEQ ID NO: 1123215 - DNA, 22 bp, Artificial Sequence
  chemically synthesized
ggttaggaatagctcagagctt

SEQ ID NO: 1123216 - DNA, 22 bp, Artificial Sequence
  chemically synthesized
ttacacaattcaagctctgagc

SEQ ID NO: 1123217 - DNA, 22 bp, Artificial Sequence
  chemically synthesized
acacaattcaagctctgagcta

SEQ ID NO: 1123218 - DNA, 22 bp, Artificial Sequence
  chemically synthesized
cacaattcaagctctgagctat

SEQ ID NO: 1123219 - DNA, 22 bp, Artificial Sequence
  chemically synthesized
agattaggttaggaatagctca

SEQ ID NO: 1123220 - DNA, 22 bp, Artificial Sequence
  chemically synthesized
aagctctgagctattcctaacc

SEQ ID NO: 1123221 - DNA, 22 bp, Artificial Sequence
  chemically synthesized
tgagctattcctaacctaatct

SEQ ID NO: 1123222 - DNA, 22 bp, Artificial Sequence
  chemically synthesized
agctattcctaacctaatctta

SEQ ID NO: 1123223 - DNA, 22 bp, Artificial Sequence
  chemically synthesized
ttcctaacctaatcttaatatt

SEQ ID NO: 1123224 - DNA, 22 bp, Artificial Sequence
  chemically synthesized
ctaacctaatcttaatatttat

SEQ ID NO: 1123225 - DNA, 22 bp, Artificial Sequence
  chemically synthesized
acctaatcttaatatttatttt

SEQ ID NO: 1123226 - DNA, 22 bp, Artificial Sequence
  chemically synthesized
atcttaatatttattttatgtt

SEQ ID NO: 1123227 - DNA, 22 bp, Artificial Sequence
  chemically synthesized
aatatttattttatgttgcttc

SEQ ID NO: 1123228 - DNA, 22 bp, Artificial Sequence
  chemically synthesized
atatttattttatgttgcttcc

SEQ ID NO: 1123229 - DNA, 22 bp, Artificial Sequence
  chemically synthesized
aaggaagaagtccaaatggaag

SEQ ID NO: 1123230 - DNA, 22 bp, Artificial Sequence
  chemically synthesized
attttatgttgcttccatttgg

SEQ ID NO: 1123231 - DNA, 22 bp, Artificial Sequence
  chemically synthesized
gaaggaagaagtccaaatggaa

SEQ ID NO: 1123232 - DNA, 22 bp, Artificial Sequence
  chemically synthesized
ttttatgttgcttccatttgga

SEQ ID NO: 1123233 - DNA, 22 bp, Artificial Sequence
  chemically synthesized
tatgttgcttccatttggactt

SEQ ID NO: 1123234 - DNA, 22 bp, Artificial Sequence
  chemically synthesized
atgttgcttccatttggacttc

SEQ ID NO: 1123235 - DNA, 22 bp, Artificial Sequence
  chemically synthesized
tgttgcttccatttggacttct

SEQ ID NO: 1123236 - DNA, 22 bp, Artificial Sequence
  chemically synthesized
cttccatttggacttcttcctt

SEQ ID NO: 1123237 - DNA, 22 bp, Artificial Sequence
  chemically synthesized
ccatttggacttcttccttcaa

SEQ ID NO: 1123238 - DNA, 22 bp, Artificial Sequence
  chemically synthesized
catttggacttcttccttcaaa

SEQ ID NO: 1123239 - DNA, 22 bp, Artificial Sequence
  chemically synthesized
ggacttcttccttcaaacatct

SEQ ID NO: 1123240 - DNA, 22 bp, Artificial Sequence
  chemically synthesized
gacttcttccttcaaacatctc

SEQ ID NO: 1123241 - DNA, 22 bp, Artificial Sequence
  chemically synthesized
gcaaggaaatcagagatgtttg

SEQ ID NO: 1123242 - DNA, 22 bp, Artificial Sequence
  chemically synthesized
agcaaggaaatcagagatgttt

SEQ ID NO: 1123243 - DNA, 22 bp, Artificial Sequence
  chemically synthesized
tagcaaggaaatcagagatgtt

SEQ ID NO: 1123244 - DNA, 22 bp, Artificial Sequence
  chemically synthesized
cttccttcaaacatctctgatt

SEQ ID NO: 1123245 - DNA, 22 bp, Artificial Sequence
  chemically synthesized
ttccttcaaacatctctgattt

SEQ ID NO: 1123246 - DNA, 22 bp, Artificial Sequence
  chemically synthesized
ccttcaaacatctctgatttcc

SEQ ID NO: 1123247 - DNA, 22 bp, Artificial Sequence
  chemically synthesized
cttcaaacatctctgatttcct

SEQ ID NO: 1123248 - DNA, 22 bp, Artificial Sequence
  chemically synthesized
caaacatctctgatttccttgc

SEQ ID NO: 1123249 - DNA, 22 bp, Artificial Sequence
  chemically synthesized
aaacatctctgatttccttgct

SEQ ID NO: 1123250 - DNA, 22 bp, Artificial Sequence
  chemically synthesized
tgatttccttgctaaaactctt

SEQ ID NO: 1123251 - DNA, 22 bp, Artificial Sequence
  chemically synthesized
tgtgtggacaaaaagagtttta

SEQ ID NO: 1123252 - DNA, 22 bp, Artificial Sequence
  chemically synthesized
atttccttgctaaaactctttt

SEQ ID NO: 1123253 - DNA, 22 bp, Artificial Sequence
  chemically synthesized
ccttgctaaaactctttttgtc

SEQ ID NO: 1123254 - DNA, 22 bp, Artificial Sequence
  chemically synthesized
cttgctaaaactctttttgtcc

SEQ ID NO: 1123255 - DNA, 22 bp, Artificial Sequence
  chemically synthesized
cacattatgtgtggacaaaaag

SEQ ID NO: 1123256 - DNA, 22 bp, Artificial Sequence
  chemically synthesized
gctaaaactctttttgtccaca

SEQ ID NO: 1123257 - DNA, 22 bp, Artificial Sequence
  chemically synthesized
ctaaaactctttttgtccacac

SEQ ID NO: 1123258 - DNA, 22 bp, Artificial Sequence
  chemically synthesized
actgcacattatgtgtggacaa

SEQ ID NO: 1123259 - DNA, 22 bp, Artificial Sequence
  chemically synthesized
aaactctttttgtccacacata

SEQ ID NO: 1123260 - DNA, 22 bp, Artificial Sequence
  chemically synthesized
tttttgtccacacataatgtgc

SEQ ID NO: 1123261 - DNA, 22 bp, Artificial Sequence
  chemically synthesized
tttgtccacacataatgtgcag

SEQ ID NO: 1123262 - DNA, 22 bp, Artificial Sequence
  chemically synthesized
ttgtccacacataatgtgcagt

SEQ ID NO: 1123263 - DNA, 22 bp, Artificial Sequence
  chemically synthesized
gagtgtaggctgactgcacatt

SEQ ID NO: 1123264 - DNA, 22 bp, Artificial Sequence
  chemically synthesized
tgtccacacataatgtgcagtc

SEQ ID NO: 1123265 - DNA, 22 bp, Artificial Sequence
  chemically synthesized
gtccacacataatgtgcagtca

SEQ ID NO: 1123266 - DNA, 22 bp, Artificial Sequence
  chemically synthesized
tccacacataatgtgcagtcag

SEQ ID NO: 1123267 - DNA, 22 bp, Artificial Sequence
  chemically synthesized
agtattagagtgtaggctgact

SEQ ID NO: 1123268 - DNA, 22 bp, Artificial Sequence
  chemically synthesized
agagatggtggtacatgttaag

SEQ ID NO: 1123269 - DNA, 22 bp, Artificial Sequence
  chemically synthesized
cactctaatacttaacatgtac

SEQ ID NO: 1123270 - DNA, 22 bp, Artificial Sequence
  chemically synthesized
taagagatggtggtacatgtta

SEQ ID NO: 1123271 - DNA, 22 bp, Artificial Sequence
  chemically synthesized
taatacttaacatgtaccacca

SEQ ID NO: 1123272 - DNA, 22 bp, Artificial Sequence
  chemically synthesized
atacttaacatgtaccaccatc

SEQ ID NO: 1123273 - DNA, 22 bp, Artificial Sequence
  chemically synthesized
ccagaactctaagagatggtgg

SEQ ID NO: 1123274 - DNA, 22 bp, Artificial Sequence
  chemically synthesized
aacatgtaccaccatctcttag

SEQ ID NO: 1123275 - DNA, 22 bp, Artificial Sequence
  chemically synthesized
actcccagaactctaagagatg

SEQ ID NO: 1123276 - DNA, 22 bp, Artificial Sequence
  chemically synthesized
acatgtaccaccatctcttaga

SEQ ID NO: 1123277 - DNA, 22 bp, Artificial Sequence
  chemically synthesized
acagttaactcccagaactcta

SEQ ID NO: 1123278 - DNA, 22 bp, Artificial Sequence
  chemically synthesized
gtagctgacagttaactcccag

SEQ ID NO: 1123279 - DNA, 22 bp, Artificial Sequence
  chemically synthesized
ttagagttctgggagttaactg

SEQ ID NO: 1123280 - DNA, 22 bp, Artificial Sequence
  chemically synthesized
agagttctgggagttaactgtc

SEQ ID NO: 1123281 - DNA, 22 bp, Artificial Sequence
  chemically synthesized
gagttctgggagttaactgtca

SEQ ID NO: 1123282 - DNA, 22 bp, Artificial Sequence
  chemically synthesized
tgggagttaactgtcagctact

SEQ ID NO: 1123283 - DNA, 22 bp, Artificial Sequence
  chemically synthesized
ggagttaactgtcagctactag

SEQ ID NO: 1123284 - DNA, 22 bp, Artificial Sequence
  chemically synthesized
gagagaaaacaatgctagtagc

SEQ ID NO: 1123285 - DNA, 22 bp, Artificial Sequence
  chemically synthesized
actgtcagctactagcattgtt

SEQ ID NO: 1123286 - DNA, 22 bp, Artificial Sequence
  chemically synthesized
tcagctactagcattgttttct

SEQ ID NO: 1123287 - DNA, 22 bp, Artificial Sequence
  chemically synthesized
gcagaatattggagagaaaaca

SEQ ID NO: 1123288 - DNA, 22 bp, Artificial Sequence
  chemically synthesized
ctagcattgttttctctccaat

SEQ ID NO: 1123289 - DNA, 22 bp, Artificial Sequence
  chemically synthesized
tccactggcagaatattggaga

SEQ ID NO: 1123290 - DNA, 22 bp, Artificial Sequence
  chemically synthesized
gcattgttttctctccaatatt

SEQ ID NO: 1123291 - DNA, 22 bp, Artificial Sequence
  chemically synthesized
ttttctctccaatattctgcca

SEQ ID NO: 1123292 - DNA, 22 bp, Artificial Sequence
  chemically synthesized
tctctccaatattctgccagtg

SEQ ID NO: 1123293 - DNA, 22 bp, Artificial Sequence
  chemically synthesized
ctctccaatattctgccagtgg

SEQ ID NO: 1123294 - DNA, 22 bp, Artificial Sequence
  chemically synthesized
tctccaatattctgccagtgga

SEQ ID NO: 1123295 - DNA, 22 bp, Artificial Sequence
  chemically synthesized
tccaatattctgccagtggata

SEQ ID NO: 1123296 - DNA, 22 bp, Artificial Sequence
  chemically synthesized
caatattctgccagtggatagc

SEQ ID NO: 1123297 - DNA, 22 bp, Artificial Sequence
  chemically synthesized
gcataaagagatgaggctatcc

SEQ ID NO: 1123298 - DNA, 22 bp, Artificial Sequence
  chemically synthesized
ctggcataaagagatgaggcta

SEQ ID NO: 1123299 - DNA, 22 bp, Artificial Sequence
  chemically synthesized
tgccagtggatagcctcatctc

SEQ ID NO: 1123300 - DNA, 22 bp, Artificial Sequence
  chemically synthesized
ccagtggatagcctcatctctt

SEQ ID NO: 1123301 - DNA, 22 bp, Artificial Sequence
  chemically synthesized
attgctggcataaagagatgag

SEQ ID NO: 1123302 - DNA, 22 bp, Artificial Sequence
  chemically synthesized
catcctcattgctggcataaag

SEQ ID NO: 1123303 - DNA, 22 bp, Artificial Sequence
  chemically synthesized
ccatcctcattgctggcataaa

SEQ ID NO: 1123304 - DNA, 22 bp, Artificial Sequence
  chemically synthesized
acccttccatcctcattgctgg

SEQ ID NO: 1123305 - DNA, 22 bp, Artificial Sequence
  chemically synthesized
atctctttatgccagcaatgag

SEQ ID NO: 1123306 - DNA, 22 bp, Artificial Sequence
  chemically synthesized
cacccttccatcctcattgctg

SEQ ID NO: 1123307 - DNA, 22 bp, Artificial Sequence
  chemically synthesized
ttcacccttccatcctcattgc

SEQ ID NO: 1123308 - DNA, 22 bp, Artificial Sequence
  chemically synthesized
tttatgccagcaatgaggatgg

SEQ ID NO: 1123309 - DNA, 22 bp, Artificial Sequence
  chemically synthesized
ctcttcacccttccatcctcat

SEQ ID NO: 1123310 - DNA, 22 bp, Artificial Sequence
  chemically synthesized
cctcttcacccttccatcctca

SEQ ID NO: 1123311 - DNA, 22 bp, Artificial Sequence
  chemically synthesized
tatgccagcaatgaggatggaa

SEQ ID NO: 1123312 - DNA, 22 bp, Artificial Sequence
  chemically synthesized
atgccagcaatgaggatggaag

SEQ ID NO: 1123313 - DNA, 22 bp, Artificial Sequence
  chemically synthesized
tgccagcaatgaggatggaagg

SEQ ID NO: 1123314 - DNA, 22 bp, Artificial Sequence
  chemically synthesized
cttcctcttcacccttccatcc

SEQ ID NO: 1123315 - DNA, 22 bp, Artificial Sequence
  chemically synthesized
tgcttcctcttcacccttccat

SEQ ID NO: 1123316 - DNA, 22 bp, Artificial Sequence
  chemically synthesized
cctctgcttcctcttcaccctt

SEQ ID NO: 1123317 - DNA, 22 bp, Artificial Sequence
  chemically synthesized
aaaccctgcctctgcttcctct

SEQ ID NO: 1123318 - DNA, 22 bp, Artificial Sequence
  chemically synthesized
gaaaccctgcctctgcttcctc

SEQ ID NO: 1123319 - DNA, 22 bp, Artificial Sequence
  chemically synthesized
agggagagtacatgggaggcct

SEQ ID NO: 1123320 - DNA, 22 bp, Artificial Sequence
  chemically synthesized
gcactcagggagagtacatggg

SEQ ID NO: 1123321 - DNA, 22 bp, Artificial Sequence
  chemically synthesized
caaggcctcccatgtactctcc

SEQ ID NO: 1123322 - DNA, 22 bp, Artificial Sequence
  chemically synthesized
aaggcctcccatgtactctccc

SEQ ID NO: 1123323 - DNA, 22 bp, Artificial Sequence
  chemically synthesized
ccatgtactctccctgagtgcc

SEQ ID NO: 1123324 - DNA, 22 bp, Artificial Sequence
  chemically synthesized
gatgtaggccattggcactcag

SEQ ID NO: 1123325 - DNA, 22 bp, Artificial Sequence
  chemically synthesized
agcgttggatgtaggccattgg

SEQ ID NO: 1123326 - DNA, 22 bp, Artificial Sequence
  chemically synthesized
tccctgagtgccaatggcctac

SEQ ID NO: 1123327 - DNA, 22 bp, Artificial Sequence
  chemically synthesized
cctgagtgccaatggcctacat

SEQ ID NO: 1123328 - DNA, 22 bp, Artificial Sequence
  chemically synthesized
aaactaagcgttggatgtaggc

SEQ ID NO: 1123329 - DNA, 22 bp, Artificial Sequence
  chemically synthesized
agtgccaatggcctacatccaa

SEQ ID NO: 1123330 - DNA, 22 bp, Artificial Sequence
  chemically synthesized
aacctaaaactaagcgttggat

SEQ ID NO: 1123331 - DNA, 22 bp, Artificial Sequence
  chemically synthesized
catccaacgcttagttttaggt

SEQ ID NO: 1123332 - DNA, 22 bp, Artificial Sequence
  chemically synthesized
aaaatgtcactgaacctaaaac

SEQ ID NO: 1123333 - DNA, 22 bp, Artificial Sequence
  chemically synthesized
tgcattgaaaatgtcactgaac

SEQ ID NO: 1123334 - DNA, 22 bp, Artificial Sequence
  chemically synthesized
agttttaggttcagtgacattt

SEQ ID NO: 1123335 - DNA, 22 bp, Artificial Sequence
  chemically synthesized
attgtgcattgaaaatgtcact

SEQ ID NO: 1123336 - DNA, 22 bp, Artificial Sequence
  chemically synthesized
gttttaggttcagtgacatttt

SEQ ID NO: 1123337 - DNA, 22 bp, Artificial Sequence
  chemically synthesized
taggttcagtgacattttcaat

SEQ ID NO: 1123338 - DNA, 22 bp, Artificial Sequence
  chemically synthesized
agttcattgtgcattgaaaatg

SEQ ID NO: 1123339 - DNA, 22 bp, Artificial Sequence
  chemically synthesized
aggttcagtgacattttcaatg

SEQ ID NO: 1123340 - DNA, 22 bp, Artificial Sequence
  chemically synthesized
ggttcagtgacattttcaatgc

SEQ ID NO: 1123341 - DNA, 22 bp, Artificial Sequence
  chemically synthesized
agtgacattttcaatgcacaat

SEQ ID NO: 1123342 - DNA, 22 bp, Artificial Sequence
  chemically synthesized
tcaatgcacaatgaactcagtc

SEQ ID NO: 1123343 - DNA, 22 bp, Artificial Sequence
  chemically synthesized
caatgcacaatgaactcagtct

SEQ ID NO: 1123344 - DNA, 22 bp, Artificial Sequence
  chemically synthesized
aatgcacaatgaactcagtctc

SEQ ID NO: 1123345 - DNA, 22 bp, Artificial Sequence
  chemically synthesized
agtaggatccgggaaggagact

SEQ ID NO: 1123346 - DNA, 22 bp, Artificial Sequence
  chemically synthesized
agtctccttcccggatcctact

SEQ ID NO: 1123347 - DNA, 22 bp, Artificial Sequence
  chemically synthesized
gaagccagggtctgagtaggat

SEQ ID NO: 1123348 - DNA, 22 bp, Artificial Sequence
  chemically synthesized
ggaagccagggtctgagtagga

SEQ ID NO: 1123349 - DNA, 22 bp, Artificial Sequence
  chemically synthesized
ttggaagccagggtctgagtag

SEQ ID NO: 1123350 - DNA, 22 bp, Artificial Sequence
  chemically synthesized
cttcccggatcctactcagacc

SEQ ID NO: 1123351 - DNA, 22 bp, Artificial Sequence
  chemically synthesized
cttggaagccagggtctgagta

SEQ ID NO: 1123352 - DNA, 22 bp, Artificial Sequence
  chemically synthesized
cccggatcctactcagaccctg

SEQ ID NO: 1123353 - DNA, 22 bp, Artificial Sequence
  chemically synthesized
cttcttggaagccagggtctga

SEQ ID NO: 1123354 - DNA, 22 bp, Artificial Sequence
  chemically synthesized
ccggatcctactcagaccctgg

SEQ ID NO: 1123355 - DNA, 22 bp, Artificial Sequence
  chemically synthesized
ctcagaccctggcttccaagaa

SEQ ID NO: 1123356 - DNA, 22 bp, Artificial Sequence
  chemically synthesized
agaccctggcttccaagaagca

SEQ ID NO: 1123357 - DNA, 22 bp, Artificial Sequence
  chemically synthesized
gcttccaagaagcaattgcacg

SEQ ID NO: 1123358 - DNA, 22 bp, Artificial Sequence
  chemically synthesized
ccaagaagcaattgcacgttta

SEQ ID NO: 1123359 - DNA, 22 bp, Artificial Sequence
  chemically synthesized
caagaagcaattgcacgtttat

SEQ ID NO: 1123360 - DNA, 22 bp, Artificial Sequence
  chemically synthesized
ataaggaataaaataaacgtgc

SEQ ID NO: 1123361 - DNA, 22 bp, Artificial Sequence
  chemically synthesized
aattgataaggaataaaataaa

SEQ ID NO: 1123362 - DNA, 22 bp, Artificial Sequence
  chemically synthesized
ctaaattgataaggaataaaat

SEQ ID NO: 1123363 - DNA, 22 bp, Artificial Sequence
  chemically synthesized
cacgtttattttattccttatc

SEQ ID NO: 1123364 - DNA, 22 bp, Artificial Sequence
  chemically synthesized
attttattccttatcaatttag

SEQ ID NO: 1123365 - DNA, 22 bp, Artificial Sequence
  chemically synthesized
ttttattccttatcaatttagc

SEQ ID NO: 1123366 - DNA, 22 bp, Artificial Sequence
  chemically synthesized
tattccttatcaatttagcaac

SEQ ID NO: 1123367 - DNA, 22 bp, Artificial Sequence
  chemically synthesized
attccttatcaatttagcaact

SEQ ID NO: 1123368 - DNA, 22 bp, Artificial Sequence
  chemically synthesized
ttccttatcaatttagcaacta

SEQ ID NO: 1123369 - DNA, 22 bp, Artificial Sequence
  chemically synthesized
cttatcaatttagcaactatcg

SEQ ID NO: 1123370 - DNA, 22 bp, Artificial Sequence
  chemically synthesized
atcaatttagcaactatcgctt

SEQ ID NO: 1123371 - DNA, 22 bp, Artificial Sequence
  chemically synthesized
tcaatttagcaactatcgcttc

SEQ ID NO: 1123372 - DNA, 22 bp, Artificial Sequence
  chemically synthesized
agcaactatcgcttcatcactt

SEQ ID NO: 1123373 - DNA, 22 bp, Artificial Sequence
  chemically synthesized
gcaactatcgcttcatcacttt

SEQ ID NO: 1123374 - DNA, 22 bp, Artificial Sequence
  chemically synthesized
cacgacaaaccacaaaaagtga

SEQ ID NO: 1123375 - DNA, 22 bp, Artificial Sequence
  chemically synthesized
tcgcttcatcactttttgtggt

SEQ ID NO: 1123376 - DNA, 22 bp, Artificial Sequence
  chemically synthesized
catcactttttgtggtttgtcg

SEQ ID NO: 1123377 - DNA, 22 bp, Artificial Sequence
  chemically synthesized
atcactttttgtggtttgtcgt

SEQ ID NO: 1123378 - DNA, 22 bp, Artificial Sequence
  chemically synthesized
tttgtggtttgtcgtgtagttt

SEQ ID NO: 1123379 - DNA, 22 bp, Artificial Sequence
  chemically synthesized
ttgtggtttgtcgtgtagtttt

SEQ ID NO: 1123380 - DNA, 22 bp, Artificial Sequence
  chemically synthesized
tgtggtttgtcgtgtagttttc

SEQ ID NO: 1123381 - DNA, 22 bp, Artificial Sequence
  chemically synthesized
gtggtttgtcgtgtagttttca

SEQ ID NO: 1123382 - DNA, 22 bp, Artificial Sequence
  chemically synthesized
tggtttgtcgtgtagttttcat

SEQ ID NO: 1123383 - DNA, 22 bp, Artificial Sequence
  chemically synthesized
gtagcagtgaaatacatgaaaa

SEQ ID NO: 1123384 - DNA, 22 bp, Artificial Sequence
  chemically synthesized
gtcgtgtagttttcatgtattt

SEQ ID NO: 1123385 - DNA, 22 bp, Artificial Sequence
  chemically synthesized
tcgtgtagttttcatgtatttc

SEQ ID NO: 1123386 - DNA, 22 bp, Artificial Sequence
  chemically synthesized
aggaatatctagtagcagtgaa

SEQ ID NO: 1123387 - DNA, 22 bp, Artificial Sequence
  chemically synthesized
tcatgtatttcactgctactag

SEQ ID NO: 1123388 - DNA, 22 bp, Artificial Sequence
  chemically synthesized
catgtatttcactgctactaga

SEQ ID NO: 1123389 - DNA, 22 bp, Artificial Sequence
  chemically synthesized
atgtatttcactgctactagat

SEQ ID NO: 1123390 - DNA, 22 bp, Artificial Sequence
  chemically synthesized
cactgctactagatattcctca

SEQ ID NO: 1123391 - DNA, 22 bp, Artificial Sequence
  chemically synthesized
agcaaagatatctgaggaatat

SEQ ID NO: 1123392 - DNA, 22 bp, Artificial Sequence
  chemically synthesized
actgctactagatattcctcag

SEQ ID NO: 1123393 - DNA, 22 bp, Artificial Sequence
  chemically synthesized
ctactagatattcctcagatat

SEQ ID NO: 1123394 - DNA, 22 bp, Artificial Sequence
  chemically synthesized
ctagatattcctcagatatctt

SEQ ID NO: 1123395 - DNA, 22 bp, Artificial Sequence
  chemically synthesized
gatattcctcagatatctttgc

SEQ ID NO: 1123396 - DNA, 22 bp, Artificial Sequence
  chemically synthesized
ccatgcatctcagcaaagatat

SEQ ID NO: 1123397 - DNA, 22 bp, Artificial Sequence
  chemically synthesized
gccatgcatctcagcaaagata

SEQ ID NO: 1123398 - DNA, 22 bp, Artificial Sequence
  chemically synthesized
atttgccatgcatctcagcaaa

SEQ ID NO: 1123399 - DNA, 22 bp, Artificial Sequence
  chemically synthesized
ctcagatatctttgctgagatg

SEQ ID NO: 1123400 - DNA, 22 bp, Artificial Sequence
  chemically synthesized
ttcatttgccatgcatctcagc

SEQ ID NO: 1123401 - DNA, 22 bp, Artificial Sequence
  chemically synthesized
agatatctttgctgagatgcat

SEQ ID NO: 1123402 - DNA, 22 bp, Artificial Sequence
  chemically synthesized
tgctgagatgcatggcaaatga

SEQ ID NO: 1123403 - DNA, 22 bp, Artificial Sequence
  chemically synthesized
gctgagatgcatggcaaatgaa

SEQ ID NO: 1123404 - DNA, 22 bp, Artificial Sequence
  chemically synthesized
ctgagatgcatggcaaatgaac

SEQ ID NO: 1123405 - DNA, 22 bp, Artificial Sequence
  chemically synthesized
aatcagaggtgtctgttcattt

SEQ ID NO: 1123406 - DNA, 22 bp, Artificial Sequence
  chemically synthesized
agatgcatggcaaatgaacaga

SEQ ID NO: 1123407 - DNA, 22 bp, Artificial Sequence
  chemically synthesized
aaatcagaggtgtctgttcatt

SEQ ID NO: 1123408 - DNA, 22 bp, Artificial Sequence
  chemically synthesized
aagcatgaagacatttaaatca

SEQ ID NO: 1123409 - DNA, 22 bp, Artificial Sequence
  chemically synthesized
aaagcatgaagacatttaaatc

SEQ ID NO: 1123410 - DNA, 22 bp, Artificial Sequence
  chemically synthesized
tgatttaaatgtcttcatgctt

SEQ ID NO: 1123411 - DNA, 22 bp, Artificial Sequence
  chemically synthesized
atttaaatgtcttcatgcttta

SEQ ID NO: 1123412 - DNA, 22 bp, Artificial Sequence
  chemically synthesized
aaatgtcttcatgctttaaatt

SEQ ID NO: 1123413 - DNA, 22 bp, Artificial Sequence
  chemically synthesized
aatgtcttcatgctttaaattg

SEQ ID NO: 1123414 - DNA, 22 bp, Artificial Sequence
  chemically synthesized
ggaagagtagatagcacccaat

SEQ ID NO: 1123415 - DNA, 22 bp, Artificial Sequence
  chemically synthesized
catgctttaaattgggtgctat

SEQ ID NO: 1123416 - DNA, 22 bp, Artificial Sequence
  chemically synthesized
atgctttaaattgggtgctatc

SEQ ID NO: 1123417 - DNA, 22 bp, Artificial Sequence
  chemically synthesized
taaattgggtgctatctactct

SEQ ID NO: 1123418 - DNA, 22 bp, Artificial Sequence
  chemically synthesized
aaattgggtgctatctactctt

SEQ ID NO: 1123419 - DNA, 22 bp, Artificial Sequence
  chemically synthesized
caaagcactgggaagagtagat

SEQ ID NO: 1123420 - DNA, 22 bp, Artificial Sequence
  chemically synthesized
aattgggtgctatctactcttc

SEQ ID NO: 1123421 - DNA, 22 bp, Artificial Sequence
  chemically synthesized
ggtgctatctactcttcccagt

SEQ ID NO: 1123422 - DNA, 22 bp, Artificial Sequence
  chemically synthesized
tctactcttcccagtgctttgc

SEQ ID NO: 1123423 - DNA, 22 bp, Artificial Sequence
  chemically synthesized
ctcttcccagtgctttgcagat

SEQ ID NO: 1123424 - DNA, 22 bp, Artificial Sequence
  chemically synthesized
ttcccagtgctttgcagatggc

SEQ ID NO: 1123425 - DNA, 22 bp, Artificial Sequence
  chemically synthesized
cccagtgctttgcagatggcat

SEQ ID NO: 1123426 - DNA, 22 bp, Artificial Sequence
  chemically synthesized
ccagtgctttgcagatggcatt

SEQ ID NO: 1123427 - DNA, 22 bp, Artificial Sequence
  chemically synthesized
gtgcaaagtatgatagaaaatg

SEQ ID NO: 1123428 - DNA, 22 bp, Artificial Sequence
  chemically synthesized
agtgcaaagtatgatagaaaat

SEQ ID NO: 1123429 - DNA, 22 bp, Artificial Sequence
  chemically synthesized
tgcagatggcattttctatcat

SEQ ID NO: 1123430 - DNA, 22 bp, Artificial Sequence
  chemically synthesized
gcagatggcattttctatcata

SEQ ID NO: 1123431 - DNA, 22 bp, Artificial Sequence
  chemically synthesized
cagatggcattttctatcatac

SEQ ID NO: 1123432 - DNA, 22 bp, Artificial Sequence
  chemically synthesized
acttagtgcaaagtatgataga

SEQ ID NO: 1123433 - DNA, 22 bp, Artificial Sequence
  chemically synthesized
tctatcatactttgcactaagt

SEQ ID NO: 1123434 - DNA, 22 bp, Artificial Sequence
  chemically synthesized
ctatcatactttgcactaagtg

SEQ ID NO: 1123435 - DNA, 22 bp, Artificial Sequence
  chemically synthesized
aatacccaggctcacttagtgc

SEQ ID NO: 1123436 - DNA, 22 bp, Artificial Sequence
  chemically synthesized
tatcatactttgcactaagtga

SEQ ID NO: 1123437 - DNA, 22 bp, Artificial Sequence
  chemically synthesized
tcatactttgcactaagtgagc

SEQ ID NO: 1123438 - DNA, 22 bp, Artificial Sequence
  chemically synthesized
gtaattaaatacccaggctcac

SEQ ID NO: 1123439 - DNA, 22 bp, Artificial Sequence
  chemically synthesized
tgcactaagtgagcctgggtat

SEQ ID NO: 1123440 - DNA, 22 bp, Artificial Sequence
  chemically synthesized
gttcgtaattaaatacccaggc

SEQ ID NO: 1123441 - DNA, 22 bp, Artificial Sequence
  chemically synthesized
gcactaagtgagcctgggtatt

SEQ ID NO: 1123442 - DNA, 22 bp, Artificial Sequence
  chemically synthesized
cgttcgtaattaaatacccagg

SEQ ID NO: 1123443 - DNA, 22 bp, Artificial Sequence
  chemically synthesized
cactaagtgagcctgggtattt

SEQ ID NO: 1123444 - DNA, 22 bp, Artificial Sequence
  chemically synthesized
agtgagcctgggtatttaatta

SEQ ID NO: 1123445 - DNA, 22 bp, Artificial Sequence
  chemically synthesized
aatgatatatttcgttcgtaat

SEQ ID NO: 1123446 - DNA, 22 bp, Artificial Sequence
  chemically synthesized
ggtatttaattacgaacgaaat

SEQ ID NO: 1123447 - DNA, 22 bp, Artificial Sequence
  chemically synthesized
catctgaatgatatatttcgtt

SEQ ID NO: 1123448 - DNA, 22 bp, Artificial Sequence
  chemically synthesized
aattacgaacgaaatatatcat

SEQ ID NO: 1123449 - DNA, 22 bp, Artificial Sequence
  chemically synthesized
agttgcatctgaatgatatatt

SEQ ID NO: 1123450 - DNA, 22 bp, Artificial Sequence
  chemically synthesized
attacgaacgaaatatatcatt

SEQ ID NO: 1123451 - DNA, 22 bp, Artificial Sequence
  chemically synthesized
cgaacgaaatatatcattcaga

SEQ ID NO: 1123452 - DNA, 22 bp, Artificial Sequence
  chemically synthesized
aagaaggtaactgagttgcatc

SEQ ID NO: 1123453 - DNA, 22 bp, Artificial Sequence
  chemically synthesized
aaagaaggtaactgagttgcat

SEQ ID NO: 1123454 - DNA, 22 bp, Artificial Sequence
  chemically synthesized
taaagaaggtaactgagttgca

SEQ ID NO: 1123455 - DNA, 22 bp, Artificial Sequence
  chemically synthesized
agggttttaaagaaggtaactg

SEQ ID NO: 1123456 - DNA, 22 bp, Artificial Sequence
  chemically synthesized
gagggttttaaagaaggtaact

SEQ ID NO: 1123457 - DNA, 22 bp, Artificial Sequence
  chemically synthesized
agatgcaactcagttaccttct

SEQ ID NO: 1123458 - DNA, 22 bp, Artificial Sequence
  chemically synthesized
cttgagggttttaaagaaggta

SEQ ID NO: 1123459 - DNA, 22 bp, Artificial Sequence
  chemically synthesized
ccttgagggttttaaagaaggt

SEQ ID NO: 1123460 - DNA, 22 bp, Artificial Sequence
  chemically synthesized
tccttgagggttttaaagaagg

SEQ ID NO: 1123461 - DNA, 22 bp, Artificial Sequence
  chemically synthesized
agttaccttctttaaaaccctc

SEQ ID NO: 1123462 - DNA, 22 bp, Artificial Sequence
  chemically synthesized
agtgttttccttgagggtttta

SEQ ID NO: 1123463 - DNA, 22 bp, Artificial Sequence
  chemically synthesized
cagtgttttccttgagggtttt

SEQ ID NO: 1123464 - DNA, 22 bp, Artificial Sequence
  chemically synthesized
ccttctttaaaaccctcaagga

SEQ ID NO: 1123465 - DNA, 22 bp, Artificial Sequence
  chemically synthesized
ctttaaaaccctcaaggaaaac

SEQ ID NO: 1123466 - DNA, 22 bp, Artificial Sequence
  chemically synthesized
tttaaaaccctcaaggaaaaca

SEQ ID NO: 1123467 - DNA, 22 bp, Artificial Sequence
  chemically synthesized
taaaaccctcaaggaaaacact

SEQ ID NO: 1123468 - DNA, 22 bp, Artificial Sequence
  chemically synthesized
aaaaccctcaaggaaaacactg

SEQ ID NO: 1123469 - DNA, 22 bp, Artificial Sequence
  chemically synthesized
aaaataagtcttcagtgttttc

SEQ ID NO: 1123470 - DNA, 22 bp, Artificial Sequence
  chemically synthesized
aaaccctcaaggaaaacactga

SEQ ID NO: 1123471 - DNA, 22 bp, Artificial Sequence
  chemically synthesized
aaggaaaacactgaagacttat

SEQ ID NO: 1123472 - DNA, 22 bp, Artificial Sequence
  chemically synthesized
aatatggcattgaaaataagtc

SEQ ID NO: 1123473 - DNA, 22 bp, Artificial Sequence
  chemically synthesized
aagacttattttcaatgccata

SEQ ID NO: 1123474 - DNA, 22 bp, Artificial Sequence
  chemically synthesized
attttcaatgccatattcaacg

SEQ ID NO: 1123475 - DNA, 22 bp, Artificial Sequence
  chemically synthesized
ttttcaatgccatattcaacgt

SEQ ID NO: 1123476 - DNA, 22 bp, Artificial Sequence
  chemically synthesized
tcaatgccatattcaacgttgg

SEQ ID NO: 1123477 - DNA, 22 bp, Artificial Sequence
  chemically synthesized
caatgccatattcaacgttgga

SEQ ID NO: 1123478 - DNA, 22 bp, Artificial Sequence
  chemically synthesized
aatgccatattcaacgttggat

SEQ ID NO: 1123479 - DNA, 22 bp, Artificial Sequence
  chemically synthesized
aacgttggattctgtacatgta

SEQ ID NO: 1123480 - DNA, 22 bp, Artificial Sequence
  chemically synthesized
tgaagaagcaaaaatacatgta

SEQ ID NO: 1123481 - DNA, 22 bp, Artificial Sequence
  chemically synthesized
atgaagaagcaaaaatacatgt

SEQ ID NO: 1123482 - DNA, 22 bp, Artificial Sequence
  chemically synthesized
tatgaagaagcaaaaatacatg

SEQ ID NO: 1123483 - DNA, 22 bp, Artificial Sequence
  chemically synthesized
gattctgtacatgtatttttgc

SEQ ID NO: 1123484 - DNA, 22 bp, Artificial Sequence
  chemically synthesized
tgtacatgtatttttgcttctt

SEQ ID NO: 1123485 - DNA, 22 bp, Artificial Sequence
  chemically synthesized
tacatgtatttttgcttcttca

SEQ ID NO: 1123486 - DNA, 22 bp, Artificial Sequence
  chemically synthesized
gaaacgagtaattttatgaaga

SEQ ID NO: 1123487 - DNA, 22 bp, Artificial Sequence
  chemically synthesized
ttagaaacgagtaattttatga

SEQ ID NO: 1123488 - DNA, 22 bp, Artificial Sequence
  chemically synthesized
ttgcttcttcataaaattactc

SEQ ID NO: 1123489 - DNA, 22 bp, Artificial Sequence
  chemically synthesized
tgcttcttcataaaattactcg

SEQ ID NO: 1123490 - DNA, 22 bp, Artificial Sequence
  chemically synthesized
gcttcttcataaaattactcgt

SEQ ID NO: 1123491 - DNA, 22 bp, Artificial Sequence
  chemically synthesized
cttcttcataaaattactcgtt

SEQ ID NO: 1123492 - DNA, 22 bp, Artificial Sequence
  chemically synthesized
cttcataaaattactcgtttct

SEQ ID NO: 1123493 - DNA, 22 bp, Artificial Sequence
  chemically synthesized
ttcataaaattactcgtttcta

SEQ ID NO: 1123494 - DNA, 22 bp, Artificial Sequence
  chemically synthesized
cataaaattactcgtttctaat

SEQ ID NO: 1123495 - DNA, 22 bp, Artificial Sequence
  chemically synthesized
ataaaattactcgtttctaata

SEQ ID NO: 1123496 - DNA, 22 bp, Artificial Sequence
  chemically synthesized
aagtggggaaaaaagaattatt

SEQ ID NO: 1123497 - DNA, 22 bp, Artificial Sequence
  chemically synthesized
ctcgtttctaataattcttttt

SEQ ID NO: 1123498 - DNA, 22 bp, Artificial Sequence
  chemically synthesized
ttaaagtggggaaaaaagaatt

SEQ ID NO: 1123499 - DNA, 22 bp, Artificial Sequence
  chemically synthesized
gtttctaataattcttttttcc

SEQ ID NO: 1123500 - DNA, 22 bp, Artificial Sequence
  chemically synthesized
ctaataattcttttttccccac

SEQ ID NO: 1123501 - DNA, 22 bp, Artificial Sequence
  chemically synthesized
taataattcttttttccccact

SEQ ID NO: 1123502 - DNA, 22 bp, Artificial Sequence
  chemically synthesized
tgtgagttgttaaagtggggaa

SEQ ID NO: 1123503 - DNA, 22 bp, Artificial Sequence
  chemically synthesized
ataattcttttttccccacttt

SEQ ID NO: 1123504 - DNA, 22 bp, Artificial Sequence
  chemically synthesized
atgtgagttgttaaagtgggga

SEQ ID NO: 1123505 - DNA, 22 bp, Artificial Sequence
  chemically synthesized
tatgtgagttgttaaagtgggg

SEQ ID NO: 1123506 - DNA, 22 bp, Artificial Sequence
  chemically synthesized
ttttttccccactttaacaact

SEQ ID NO: 1123507 - DNA, 22 bp, Artificial Sequence
  chemically synthesized
ttttccccactttaacaactca

SEQ ID NO: 1123508 - DNA, 22 bp, Artificial Sequence
  chemically synthesized
tttccccactttaacaactcac

SEQ ID NO: 1123509 - DNA, 22 bp, Artificial Sequence
  chemically synthesized
ttccccactttaacaactcaca

SEQ ID NO: 1123510 - DNA, 22 bp, Artificial Sequence
  chemically synthesized
gcaatggttttatgtgagttgt

SEQ ID NO: 1123511 - DNA, 22 bp, Artificial Sequence
  chemically synthesized
tccccactttaacaactcacat

SEQ ID NO: 1123512 - DNA, 22 bp, Artificial Sequence
  chemically synthesized
ccccactttaacaactcacata

SEQ ID NO: 1123513 - DNA, 22 bp, Artificial Sequence
  chemically synthesized
cccactttaacaactcacataa

SEQ ID NO: 1123514 - DNA, 22 bp, Artificial Sequence
  chemically synthesized
attagcaatggttttatgtgag

SEQ ID NO: 1123515 - DNA, 22 bp, Artificial Sequence
  chemically synthesized
taacaactcacataaaaccatt

SEQ ID NO: 1123516 - DNA, 22 bp, Artificial Sequence
  chemically synthesized
aacaactcacataaaaccattg

SEQ ID NO: 1123517 - DNA, 22 bp, Artificial Sequence
  chemically synthesized
acaactcacataaaaccattgc

SEQ ID NO: 1123518 - DNA, 22 bp, Artificial Sequence
  chemically synthesized
tgatacataagttcattagcaa

SEQ ID NO: 1123519 - DNA, 22 bp, Artificial Sequence
  chemically synthesized
acataaaaccattgctaatgaa

SEQ ID NO: 1123520 - DNA, 22 bp, Artificial Sequence
  chemically synthesized
atgatacataagttcattagca

SEQ ID NO: 1123521 - DNA, 22 bp, Artificial Sequence
  chemically synthesized
tgagcaacttatgatacataag

SEQ ID NO: 1123522 - DNA, 22 bp, Artificial Sequence
  chemically synthesized
ctaatgaacttatgtatcataa

SEQ ID NO: 1123523 - DNA, 22 bp, Artificial Sequence
  chemically synthesized
atgaacttatgtatcataagtt

SEQ ID NO: 1123524 - DNA, 22 bp, Artificial Sequence
  chemically synthesized
atgtatcataagttgctcataa

SEQ ID NO: 1123525 - DNA, 22 bp, Artificial Sequence
  chemically synthesized
tgtatcataagttgctcataat

SEQ ID NO: 1123526 - DNA, 22 bp, Artificial Sequence
  chemically synthesized
caaaggtgtagggacacattat

SEQ ID NO: 1123527 - DNA, 22 bp, Artificial Sequence
  chemically synthesized
attccaaaggtgtagggacaca

SEQ ID NO: 1123528 - DNA, 22 bp, Artificial Sequence
  chemically synthesized
ctcataatgtgtccctacacct

SEQ ID NO: 1123529 - DNA, 22 bp, Artificial Sequence
  chemically synthesized
ataatgtgtccctacacctttg

SEQ ID NO: 1123530 - DNA, 22 bp, Artificial Sequence
  chemically synthesized
gtggactgattccaaaggtgta

SEQ ID NO: 1123531 - DNA, 22 bp, Artificial Sequence
  chemically synthesized
aggaatatattagtggactgat

SEQ ID NO: 1123532 - DNA, 22 bp, Artificial Sequence
  chemically synthesized
cacctttggaatcagtccacta

SEQ ID NO: 1123533 - DNA, 22 bp, Artificial Sequence
  chemically synthesized
agcactaaggaatatattagtg

SEQ ID NO: 1123534 - DNA, 22 bp, Artificial Sequence
  chemically synthesized
tggaatcagtccactaatatat

SEQ ID NO: 1123535 - DNA, 22 bp, Artificial Sequence
  chemically synthesized
ggaatcagtccactaatatatt

SEQ ID NO: 1123536 - DNA, 22 bp, Artificial Sequence
  chemically synthesized
gaatcagtccactaatatattc

SEQ ID NO: 1123537 - DNA, 22 bp, Artificial Sequence
  chemically synthesized
atatattccttagtgcttaact

SEQ ID NO: 1123538 - DNA, 22 bp, Artificial Sequence
  chemically synthesized
agtatatgaggaaagtaagtta

SEQ ID NO: 1123539 - DNA, 22 bp, Artificial Sequence
  chemically synthesized
cttagtgcttaacttactttcc

SEQ ID NO: 1123540 - DNA, 22 bp, Artificial Sequence
  chemically synthesized
agtgcttaacttactttcctca

SEQ ID NO: 1123541 - DNA, 22 bp, Artificial Sequence
  chemically synthesized
gtgcttaacttactttcctcat

SEQ ID NO: 1123542 - DNA, 22 bp, Artificial Sequence
  chemically synthesized
agtacagagttaagtatatgag

SEQ ID NO: 1123543 - DNA, 22 bp, Artificial Sequence
  chemically synthesized
aacttactttcctcatatactt

SEQ ID NO: 1123544 - DNA, 22 bp, Artificial Sequence
  chemically synthesized
acttactttcctcatatactta

SEQ ID NO: 1123545 - DNA, 22 bp, Artificial Sequence
  chemically synthesized
actttcctcatatacttaactc

SEQ ID NO: 1123546 - DNA, 22 bp, Artificial Sequence
  chemically synthesized
ctttcctcatatacttaactct

SEQ ID NO: 1123547 - DNA, 22 bp, Artificial Sequence
  chemically synthesized
tcctcatatacttaactctgta

SEQ ID NO: 1123548 - DNA, 22 bp, Artificial Sequence
  chemically synthesized
cctcatatacttaactctgtac

SEQ ID NO: 1123549 - DNA, 22 bp, Artificial Sequence
  chemically synthesized
ctcatatacttaactctgtact

SEQ ID NO: 1123550 - DNA, 22 bp, Artificial Sequence
  chemically synthesized
ggaagtacgttaagtacagagt

SEQ ID NO: 1123551 - DNA, 22 bp, Artificial Sequence
  chemically synthesized
atatacttaactctgtacttaa

SEQ ID NO: 1123552 - DNA, 22 bp, Artificial Sequence
  chemically synthesized
ataacattcggaagtacgttaa

SEQ ID NO: 1123553 - DNA, 22 bp, Artificial Sequence
  chemically synthesized
aactctgtacttaacgtacttc

SEQ ID NO: 1123554 - DNA, 22 bp, Artificial Sequence
  chemically synthesized
actctgtacttaacgtacttcc

SEQ ID NO: 1123555 - DNA, 22 bp, Artificial Sequence
  chemically synthesized
tgtacttaacgtacttccgaat

SEQ ID NO: 1123556 - DNA, 22 bp, Artificial Sequence
  chemically synthesized
tacttaacgtacttccgaatgt

SEQ ID NO: 1123557 - DNA, 22 bp, Artificial Sequence
  chemically synthesized
aacgtacttccgaatgttatca

SEQ ID NO: 1123558 - DNA, 22 bp, Artificial Sequence
  chemically synthesized
agggatagagtctgataacatt

SEQ ID NO: 1123559 - DNA, 22 bp, Artificial Sequence
  chemically synthesized
acgtacttccgaatgttatcag

SEQ ID NO: 1123560 - DNA, 22 bp, Artificial Sequence
  chemically synthesized
aagggatagagtctgataacat

SEQ ID NO: 1123561 - DNA, 22 bp, Artificial Sequence
  chemically synthesized
catttaagggatagagtctgat

SEQ ID NO: 1123562 - DNA, 22 bp, Artificial Sequence
  chemically synthesized
ccgaatgttatcagactctatc

SEQ ID NO: 1123563 - DNA, 22 bp, Artificial Sequence
  chemically synthesized
cgaatgttatcagactctatcc

SEQ ID NO: 1123564 - DNA, 22 bp, Artificial Sequence
  chemically synthesized
gactgcatttaagggatagagt

SEQ ID NO: 1123565 - DNA, 22 bp, Artificial Sequence
  chemically synthesized
tcagactctatcccttaaatgc

SEQ ID NO: 1123566 - DNA, 22 bp, Artificial Sequence
  chemically synthesized
ggtaaagttagactgcatttaa

SEQ ID NO: 1123567 - DNA, 22 bp, Artificial Sequence
  chemically synthesized
agctaggtaaagttagactgca

SEQ ID NO: 1123568 - DNA, 22 bp, Artificial Sequence
  chemically synthesized
tatcccttaaatgcagtctaac

SEQ ID NO: 1123569 - DNA, 22 bp, Artificial Sequence
  chemically synthesized
aagctaggtaaagttagactgc

SEQ ID NO: 1123570 - DNA, 22 bp, Artificial Sequence
  chemically synthesized
taagctaggtaaagttagactg

SEQ ID NO: 1123571 - DNA, 22 bp, Artificial Sequence
  chemically synthesized
tcccttaaatgcagtctaactt

SEQ ID NO: 1123572 - DNA, 22 bp, Artificial Sequence
  chemically synthesized
aaatgcagtctaactttaccta

SEQ ID NO: 1123573 - DNA, 22 bp, Artificial Sequence
  chemically synthesized
aatgcagtctaactttacctag

SEQ ID NO: 1123574 - DNA, 22 bp, Artificial Sequence
  chemically synthesized
aaggagattttaagctaggtaa

SEQ ID NO: 1123575 - DNA, 22 bp, Artificial Sequence
  chemically synthesized
gctaaaggagattttaagctag

SEQ ID NO: 1123576 - DNA, 22 bp, Artificial Sequence
  chemically synthesized
ttagctaaaggagattttaagc

SEQ ID NO: 1123577 - DNA, 22 bp, Artificial Sequence
  chemically synthesized
attagctaaaggagattttaag

SEQ ID NO: 1123578 - DNA, 22 bp, Artificial Sequence
  chemically synthesized
actttacctagcttaaaatctc

SEQ ID NO: 1123579 - DNA, 22 bp, Artificial Sequence
  chemically synthesized
tattagctaaaggagattttaa

SEQ ID NO: 1123580 - DNA, 22 bp, Artificial Sequence
  chemically synthesized
ttattagctaaaggagatttta

SEQ ID NO: 1123581 - DNA, 22 bp, Artificial Sequence
  chemically synthesized
tttattagctaaaggagatttt

SEQ ID NO: 1123582 - DNA, 22 bp, Artificial Sequence
  chemically synthesized
ttttattagctaaaggagattt

SEQ ID NO: 1123583 - DNA, 22 bp, Artificial Sequence
  chemically synthesized
tacctagcttaaaatctccttt

SEQ ID NO: 1123584 - DNA, 22 bp, Artificial Sequence
  chemically synthesized
acctagcttaaaatctccttta

SEQ ID NO: 1123585 - DNA, 22 bp, Artificial Sequence
  chemically synthesized
cctagcttaaaatctcctttag

SEQ ID NO: 1123586 - DNA, 22 bp, Artificial Sequence
  chemically synthesized
tttttttattagctaaaggaga

SEQ ID NO: 1123587 - DNA, 22 bp, Artificial Sequence
  chemically synthesized
gcttaaaatctcctttagctaa

SEQ ID NO: 1123588 - DNA, 22 bp, Artificial Sequence
  chemically synthesized
aaaatctcctttagctaataaa

SEQ ID NO: 1123589 - DNA, 22 bp, Artificial Sequence
  chemically synthesized
aaatctcctttagctaataaaa

SEQ ID NO: 1123590 - DNA, 22 bp, Artificial Sequence
  chemically synthesized
ctttagctaataaaaaaataac

SEQ ID NO: 1123591 - DNA, 22 bp, Artificial Sequence
  chemically synthesized
tagctaataaaaaaataacttc

SEQ ID NO: 1123592 - DNA, 22 bp, Artificial Sequence
  chemically synthesized
agctaataaaaaaataacttct

SEQ ID NO: 1123593 - DNA, 22 bp, Artificial Sequence
  chemically synthesized
gctaataaaaaaataacttctc

SEQ ID NO: 1123594 - DNA, 22 bp, Artificial Sequence
  chemically synthesized
tgaacagagaatgagaagttat

SEQ ID NO: 1123595 - DNA, 22 bp, Artificial Sequence
  chemically synthesized
gtgaacagagaatgagaagtta

SEQ ID NO: 1123596 - DNA, 22 bp, Artificial Sequence
  chemically synthesized
tgtgaacagagaatgagaagtt

SEQ ID NO: 1123597 - DNA, 22 bp, Artificial Sequence
  chemically synthesized
ataaaaaaataacttctcattc

SEQ ID NO: 1123598 - DNA, 22 bp, Artificial Sequence
  chemically synthesized
tagaaataatcattttgtgaac

SEQ ID NO: 1123599 - DNA, 22 bp, Artificial Sequence
  chemically synthesized
ctcattctctgttcacaaaatg

SEQ ID NO: 1123600 - DNA, 22 bp, Artificial Sequence
  chemically synthesized
tcattctctgttcacaaaatga

SEQ ID NO: 1123601 - DNA, 22 bp, Artificial Sequence
  chemically synthesized
attctctgttcacaaaatgatt

SEQ ID NO: 1123602 - DNA, 22 bp, Artificial Sequence
  chemically synthesized
tctgttcacaaaatgattattt

SEQ ID NO: 1123603 - DNA, 22 bp, Artificial Sequence
  chemically synthesized
tgttcacaaaatgattatttct

SEQ ID NO: 1123604 - DNA, 22 bp, Artificial Sequence
  chemically synthesized
atcaataattatagaaataatc

SEQ ID NO: 1123605 - DNA, 22 bp, Artificial Sequence
  chemically synthesized
ttcacaaaatgattatttctat

SEQ ID NO: 1123606 - DNA, 22 bp, Artificial Sequence
  chemically synthesized
acaaaatgattatttctataat

SEQ ID NO: 1123607 - DNA, 22 bp, Artificial Sequence
  chemically synthesized
tttctataattattgatgaata

SEQ ID NO: 1123608 - DNA, 22 bp, Artificial Sequence
  chemically synthesized
ctataattattgatgaatattc

SEQ ID NO: 1123609 - DNA, 22 bp, Artificial Sequence
  chemically synthesized
tataattattgatgaatattct

SEQ ID NO: 1123610 - DNA, 22 bp, Artificial Sequence
  chemically synthesized
aagaatagaggacagaatattc

SEQ ID NO: 1123611 - DNA, 22 bp, Artificial Sequence
  chemically synthesized
taattattgatgaatattctgt

SEQ ID NO: 1123612 - DNA, 22 bp, Artificial Sequence
  chemically synthesized
gaagaatagaggacagaatatt

SEQ ID NO: 1123613 - DNA, 22 bp, Artificial Sequence
  chemically synthesized
ttgatgaatattctgtcctcta

SEQ ID NO: 1123614 - DNA, 22 bp, Artificial Sequence
  chemically synthesized
atgaatattctgtcctctattc

SEQ ID NO: 1123615 - DNA, 22 bp, Artificial Sequence
  chemically synthesized
agatatacttgaagaatagagg

SEQ ID NO: 1123616 - DNA, 22 bp, Artificial Sequence
  chemically synthesized
aagatatacttgaagaatagag

SEQ ID NO: 1123617 - DNA, 22 bp, Artificial Sequence
  chemically synthesized
taagatatacttgaagaataga

SEQ ID NO: 1123618 - DNA, 22 bp, Artificial Sequence
  chemically synthesized
aggttttaagatatacttgaag

SEQ ID NO: 1123619 - DNA, 22 bp, Artificial Sequence
  chemically synthesized
tgtcctctattcttcaagtata

SEQ ID NO: 1123620 - DNA, 22 bp, Artificial Sequence
  chemically synthesized
tcctctattcttcaagtatatc

SEQ ID NO: 1123621 - DNA, 22 bp, Artificial Sequence
  chemically synthesized
tattcttcaagtatatcttaaa

SEQ ID NO: 1123622 - DNA, 22 bp, Artificial Sequence
  chemically synthesized
ttcttcaagtatatcttaaaac

SEQ ID NO: 1123623 - DNA, 22 bp, Artificial Sequence
  chemically synthesized
ttcaagtatatcttaaaacctc

SEQ ID NO: 1123624 - DNA, 22 bp, Artificial Sequence
  chemically synthesized
caagtatatcttaaaacctcaa

SEQ ID NO: 1123625 - DNA, 22 bp, Artificial Sequence
  chemically synthesized
aagtatatcttaaaacctcaat

SEQ ID NO: 1123626 - DNA, 22 bp, Artificial Sequence
  chemically synthesized
accataaataataacaaattga

SEQ ID NO: 1123627 - DNA, 22 bp, Artificial Sequence
  chemically synthesized
ctaaccataaataataacaaat

SEQ ID NO: 1123628 - DNA, 22 bp, Artificial Sequence
  chemically synthesized
aaaacctcaatttgttattatt

SEQ ID NO: 1123629 - DNA, 22 bp, Artificial Sequence
  chemically synthesized
aaacctcaatttgttattattt

SEQ ID NO: 1123630 - DNA, 22 bp, Artificial Sequence
  chemically synthesized
actgctaaccataaataataac

SEQ ID NO: 1123631 - DNA, 22 bp, Artificial Sequence
  chemically synthesized
cactgctaaccataaataataa

SEQ ID NO: 1123632 - DNA, 22 bp, Artificial Sequence
  chemically synthesized
aatttgttattatttatggtta

SEQ ID NO: 1123633 - DNA, 22 bp, Artificial Sequence
  chemically synthesized
tcgcttcactgctaaccataaa

SEQ ID NO: 1123634 - DNA, 22 bp, Artificial Sequence
  chemically synthesized
gttattatttatggttagcagt

SEQ ID NO: 1123635 - DNA, 22 bp, Artificial Sequence
  chemically synthesized
ttattatttatggttagcagtg

SEQ ID NO: 1123636 - DNA, 22 bp, Artificial Sequence
  chemically synthesized
ttatttatggttagcagtgaag

SEQ ID NO: 1123637 - DNA, 22 bp, Artificial Sequence
  chemically synthesized
tttatggttagcagtgaagcga

SEQ ID NO: 1123638 - DNA, 22 bp, Artificial Sequence
  chemically synthesized
atggttagcagtgaagcgacaa

SEQ ID NO: 1123639 - DNA, 22 bp, Artificial Sequence
  chemically synthesized
tggttagcagtgaagcgacaat

SEQ ID NO: 1123640 - DNA, 22 bp, Artificial Sequence
  chemically synthesized
taaaggagaaaaaaattgtcgc

SEQ ID NO: 1123641 - DNA, 22 bp, Artificial Sequence
  chemically synthesized
gtaaaggagaaaaaaattgtcg

SEQ ID NO: 1123642 - DNA, 22 bp, Artificial Sequence
  chemically synthesized
gcagtgaagcgacaattttttt

SEQ ID NO: 1123643 - DNA, 22 bp, Artificial Sequence
  chemically synthesized
atgagtatatttgtaaaggaga

SEQ ID NO: 1123644 - DNA, 22 bp, Artificial Sequence
  chemically synthesized
tgatgagtatatttgtaaagga

SEQ ID NO: 1123645 - DNA, 22 bp, Artificial Sequence
  chemically synthesized
ctgatgagtatatttgtaaagg

SEQ ID NO: 1123646 - DNA, 22 bp, Artificial Sequence
  chemically synthesized
ttttctcctttacaaatatact

SEQ ID NO: 1123647 - DNA, 22 bp, Artificial Sequence
  chemically synthesized
tttctcctttacaaatatactc

SEQ ID NO: 1123648 - DNA, 22 bp, Artificial Sequence
  chemically synthesized
ttctcctttacaaatatactca

SEQ ID NO: 1123649 - DNA, 22 bp, Artificial Sequence
  chemically synthesized
aggggtttctgatgagtatatt

SEQ ID NO: 1123650 - DNA, 22 bp, Artificial Sequence
  chemically synthesized
tctcctttacaaatatactcat

SEQ ID NO: 1123651 - DNA, 22 bp, Artificial Sequence
  chemically synthesized
caggggtttctgatgagtatat

SEQ ID NO: 1123652 - DNA, 22 bp, Artificial Sequence
  chemically synthesized
ctcctttacaaatatactcatc

SEQ ID NO: 1123653 - DNA, 22 bp, Artificial Sequence
  chemically synthesized
tcctttacaaatatactcatca

SEQ ID NO: 1123654 - DNA, 22 bp, Artificial Sequence
  chemically synthesized
ctttacaaatatactcatcaga

SEQ ID NO: 1123655 - DNA, 22 bp, Artificial Sequence
  chemically synthesized
atttcaggggtttctgatgagt

SEQ ID NO: 1123656 - DNA, 22 bp, Artificial Sequence
  chemically synthesized
aatttcaggggtttctgatgag

SEQ ID NO: 1123657 - DNA, 22 bp, Artificial Sequence
  chemically synthesized
taatttcaggggtttctgatga

SEQ ID NO: 1123658 - DNA, 22 bp, Artificial Sequence
  chemically synthesized
tacaaatatactcatcagaaac

SEQ ID NO: 1123659 - DNA, 22 bp, Artificial Sequence
  chemically synthesized
acaaatatactcatcagaaacc

SEQ ID NO: 1123660 - DNA, 22 bp, Artificial Sequence
  chemically synthesized
caaatatactcatcagaaaccc

SEQ ID NO: 1123661 - DNA, 22 bp, Artificial Sequence
  chemically synthesized
caagttttaatttcaggggttt

SEQ ID NO: 1123662 - DNA, 22 bp, Artificial Sequence
  chemically synthesized
acaagttttaatttcaggggtt

SEQ ID NO: 1123663 - DNA, 22 bp, Artificial Sequence
  chemically synthesized
tacaagttttaatttcaggggt

SEQ ID NO: 1123664 - DNA, 22 bp, Artificial Sequence
  chemically synthesized
atcagaaacccctgaaattaaa

SEQ ID NO: 1123665 - DNA, 22 bp, Artificial Sequence
  chemically synthesized
tatgatgggactttacaagttt

SEQ ID NO: 1123666 - DNA, 22 bp, Artificial Sequence
  chemically synthesized
ccctgtatgatgggactttaca

SEQ ID NO: 1123667 - DNA, 22 bp, Artificial Sequence
  chemically synthesized
aaattaaaacttgtaaagtccc

SEQ ID NO: 1123668 - DNA, 22 bp, Artificial Sequence
  chemically synthesized
gccctgtatgatgggactttac

SEQ ID NO: 1123669 - DNA, 22 bp, Artificial Sequence
  chemically synthesized
cttgccctgtatgatgggactt

SEQ ID NO: 1123670 - DNA, 22 bp, Artificial Sequence
  chemically synthesized
acttgccctgtatgatgggact

SEQ ID NO: 1123671 - DNA, 22 bp, Artificial Sequence
  chemically synthesized
aaacttgtaaagtcccatcata

SEQ ID NO: 1123672 - DNA, 22 bp, Artificial Sequence
  chemically synthesized
gtaaagtcccatcatacagggc

SEQ ID NO: 1123673 - DNA, 22 bp, Artificial Sequence
  chemically synthesized
taaagtcccatcatacagggca

SEQ ID NO: 1123674 - DNA, 22 bp, Artificial Sequence
  chemically synthesized
ccaagaaaaaaaaaaatcaaag

SEQ ID NO: 1123675 - DNA, 22 bp, Artificial Sequence
  chemically synthesized
gccaagaaaaaaaaaaatcaaa

SEQ ID NO: 1123676 - DNA, 22 bp, Artificial Sequence
  chemically synthesized
tgccaagaaaaaaaaaaatcaa

SEQ ID NO: 1123677 - DNA, 22 bp, Artificial Sequence
  chemically synthesized
ttgccaagaaaaaaaaaaatca

SEQ ID NO: 1123678 - DNA, 22 bp, Artificial Sequence
  chemically synthesized
tgatttttttttttcttggcaa

SEQ ID NO: 1123679 - DNA, 22 bp, Artificial Sequence
  chemically synthesized
gatttttttttttcttggcaaa

SEQ ID NO: 1123680 - DNA, 22 bp, Artificial Sequence
  chemically synthesized
atttttttttttcttggcaaaa

SEQ ID NO: 1123681 - DNA, 22 bp, Artificial Sequence
  chemically synthesized
gtgtagtaatacacttttgcca

SEQ ID NO: 1123682 - DNA, 22 bp, Artificial Sequence
  chemically synthesized
ggtgtagtaatacacttttgcc

SEQ ID NO: 1123683 - DNA, 22 bp, Artificial Sequence
  chemically synthesized
ttttttttcttggcaaaagtgt

SEQ ID NO: 1123684 - DNA, 22 bp, Artificial Sequence
  chemically synthesized
tttttttcttggcaaaagtgta

SEQ ID NO: 1123685 - DNA, 22 bp, Artificial Sequence
  chemically synthesized
ttttttcttggcaaaagtgtat

SEQ ID NO: 1123686 - DNA, 22 bp, Artificial Sequence
  chemically synthesized
tttttcttggcaaaagtgtatt

SEQ ID NO: 1123687 - DNA, 22 bp, Artificial Sequence
  chemically synthesized
tcttggtgtagtaatacacttt

SEQ ID NO: 1123688 - DNA, 22 bp, Artificial Sequence
  chemically synthesized
ttttcttggcaaaagtgtatta

SEQ ID NO: 1123689 - DNA, 22 bp, Artificial Sequence
  chemically synthesized
tttcttggcaaaagtgtattac

SEQ ID NO: 1123690 - DNA, 22 bp, Artificial Sequence
  chemically synthesized
ttcttggcaaaagtgtattact

SEQ ID NO: 1123691 - DNA, 22 bp, Artificial Sequence
  chemically synthesized
tcttggcaaaagtgtattacta

SEQ ID NO: 1123692 - DNA, 22 bp, Artificial Sequence
  chemically synthesized
cttggcaaaagtgtattactac

SEQ ID NO: 1123693 - DNA, 22 bp, Artificial Sequence
  chemically synthesized
ttggcaaaagtgtattactaca

SEQ ID NO: 1123694 - DNA, 22 bp, Artificial Sequence
  chemically synthesized
ggcaaaagtgtattactacacc

SEQ ID NO: 1123695 - DNA, 22 bp, Artificial Sequence
  chemically synthesized
aaaaattgtcttggtgtagtaa

SEQ ID NO: 1123696 - DNA, 22 bp, Artificial Sequence
  chemically synthesized
gcaaaagtgtattactacacca

SEQ ID NO: 1123697 - DNA, 22 bp, Artificial Sequence
  chemically synthesized
gaaaaattgtcttggtgtagta

SEQ ID NO: 1123698 - DNA, 22 bp, Artificial Sequence
  chemically synthesized
tgaaaaattgtcttggtgtagt

SEQ ID NO: 1123699 - DNA, 22 bp, Artificial Sequence
  chemically synthesized
ttgaaaaattgtcttggtgtag

SEQ ID NO: 1123700 - DNA, 22 bp, Artificial Sequence
  chemically synthesized
tttgaaaaattgtcttggtgta

SEQ ID NO: 1123701 - DNA, 22 bp, Artificial Sequence
  chemically synthesized
ctacaccaagacaatttttcaa

SEQ ID NO: 1123702 - DNA, 22 bp, Artificial Sequence
  chemically synthesized
caccaagacaatttttcaaaaa

SEQ ID NO: 1123703 - DNA, 22 bp, Artificial Sequence
  chemically synthesized
caaaaaatggaaggtctttttg

SEQ ID NO: 1123704 - DNA, 22 bp, Artificial Sequence
  chemically synthesized
ccaaaaaatggaaggtcttttt

SEQ ID NO: 1123705 - DNA, 22 bp, Artificial Sequence
  chemically synthesized
aaacttccaaaaaatggaaggt

SEQ ID NO: 1123706 - DNA, 22 bp, Artificial Sequence
  chemically synthesized
gaaacttccaaaaaatggaagg

SEQ ID NO: 1123707 - DNA, 22 bp, Artificial Sequence
  chemically synthesized
tgaaacttccaaaaaatggaag

SEQ ID NO: 1123708 - DNA, 22 bp, Artificial Sequence
  chemically synthesized
ttcaaaaagaccttccattttt

SEQ ID NO: 1123709 - DNA, 22 bp, Artificial Sequence
  chemically synthesized
tcaaaaagaccttccatttttt

SEQ ID NO: 1123710 - DNA, 22 bp, Artificial Sequence
  chemically synthesized
caaaaagaccttccattttttg

SEQ ID NO: 1123711 - DNA, 22 bp, Artificial Sequence
  chemically synthesized
aaaaagaccttccattttttgg

SEQ ID NO: 1123712 - DNA, 22 bp, Artificial Sequence
  chemically synthesized
atattttgaaacttccaaaaaa

SEQ ID NO: 1123713 - DNA, 22 bp, Artificial Sequence
  chemically synthesized
gatattttgaaacttccaaaaa

SEQ ID NO: 1123714 - DNA, 22 bp, Artificial Sequence
  chemically synthesized
tgatattttgaaacttccaaaa

SEQ ID NO: 1123715 - DNA, 22 bp, Artificial Sequence
  chemically synthesized
ttgatattttgaaacttccaaa

SEQ ID NO: 1123716 - DNA, 22 bp, Artificial Sequence
  chemically synthesized
ccattttttggaagtttcaaaa

SEQ ID NO: 1123717 - DNA, 22 bp, Artificial Sequence
  chemically synthesized
cattttttggaagtttcaaaat

SEQ ID NO: 1123718 - DNA, 22 bp, Artificial Sequence
  chemically synthesized
tttggaagtttcaaaatatcaa

SEQ ID NO: 1123719 - DNA, 22 bp, Artificial Sequence
  chemically synthesized
ttggaagtttcaaaatatcaaa

SEQ ID NO: 1123720 - DNA, 22 bp, Artificial Sequence
  chemically synthesized
tggaagtttcaaaatatcaaaa

SEQ ID NO: 1123721 - DNA, 22 bp, Artificial Sequence
  chemically synthesized
ggaagtttcaaaatatcaaaag

SEQ ID NO: 1123722 - DNA, 22 bp, Artificial Sequence
  chemically synthesized
gaagtttcaaaatatcaaaagc

SEQ ID NO: 1123723 - DNA, 22 bp, Artificial Sequence
  chemically synthesized
gtatatatgccccaggcttttg

SEQ ID NO: 1123724 - DNA, 22 bp, Artificial Sequence
  chemically synthesized
ggtatatatgccccaggctttt

SEQ ID NO: 1123725 - DNA, 22 bp, Artificial Sequence
  chemically synthesized
caaaatatcaaaagcctggggc

SEQ ID NO: 1123726 - DNA, 22 bp, Artificial Sequence
  chemically synthesized
aaaatatcaaaagcctggggca

SEQ ID NO: 1123727 - DNA, 22 bp, Artificial Sequence
  chemically synthesized
aatatttggtatatatgcccca

SEQ ID NO: 1123728 - DNA, 22 bp, Artificial Sequence
  chemically synthesized
tgaatatttggtatatatgccc

SEQ ID NO: 1123729 - DNA, 22 bp, Artificial Sequence
  chemically synthesized
tctgaatatttggtatatatgc

SEQ ID NO: 1123730 - DNA, 22 bp, Artificial Sequence
  chemically synthesized
tcactctctgaatatttggtat

SEQ ID NO: 1123731 - DNA, 22 bp, Artificial Sequence
  chemically synthesized
gggcatatataccaaatattca

SEQ ID NO: 1123732 - DNA, 22 bp, Artificial Sequence
  chemically synthesized
agaaaaattgtcactctctgaa

SEQ ID NO: 1123733 - DNA, 22 bp, Artificial Sequence
  chemically synthesized
agagagtgacaatttttctcag

SEQ ID NO: 1123734 - DNA, 22 bp, Artificial Sequence
  chemically synthesized
tacaatataatactgagaaaaa

SEQ ID NO: 1123735 - DNA, 22 bp, Artificial Sequence
  chemically synthesized
gtacaatataatactgagaaaa

SEQ ID NO: 1123736 - DNA, 22 bp, Artificial Sequence
  chemically synthesized
tttgtacaatataatactgaga

SEQ ID NO: 1123737 - DNA, 22 bp, Artificial Sequence
  chemically synthesized
agtctgtttgtacaatataata

SEQ ID NO: 1123738 - DNA, 22 bp, Artificial Sequence
  chemically synthesized
ttctcagtattatattgtacaa

SEQ ID NO: 1123739 - DNA, 22 bp, Artificial Sequence
  chemically synthesized
tctcagtattatattgtacaaa

SEQ ID NO: 1123740 - DNA, 22 bp, Artificial Sequence
  chemically synthesized
ctcagtattatattgtacaaac

SEQ ID NO: 1123741 - DNA, 22 bp, Artificial Sequence
  chemically synthesized
tcagtattatattgtacaaaca

SEQ ID NO: 1123742 - DNA, 22 bp, Artificial Sequence
  chemically synthesized
agtattatattgtacaaacaga

SEQ ID NO: 1123743 - DNA, 22 bp, Artificial Sequence
  chemically synthesized
gatgaggctgagtctgtttgta

SEQ ID NO: 1123744 - DNA, 22 bp, Artificial Sequence
  chemically synthesized
aactggatgaggctgagtctgt

SEQ ID NO: 1123745 - DNA, 22 bp, Artificial Sequence
  chemically synthesized
tattgtacaaacagactcagcc

SEQ ID NO: 1123746 - DNA, 22 bp, Artificial Sequence
  chemically synthesized
tacaaacagactcagcctcatc

SEQ ID NO: 1123747 - DNA, 22 bp, Artificial Sequence
  chemically synthesized
tgggaaattcaactggatgagg

SEQ ID NO: 1123748 - DNA, 22 bp, Artificial Sequence
  chemically synthesized
atgggaaattcaactggatgag

SEQ ID NO: 1123749 - DNA, 22 bp, Artificial Sequence
  chemically synthesized
tatgggaaattcaactggatga

SEQ ID NO: 1123750 - DNA, 22 bp, Artificial Sequence
  chemically synthesized
ttatgggaaattcaactggatg

SEQ ID NO: 1123751 - DNA, 22 bp, Artificial Sequence
  chemically synthesized
agcctcatccagttgaatttcc

SEQ ID NO: 1123752 - DNA, 22 bp, Artificial Sequence
  chemically synthesized
catcatttttatgggaaattca

SEQ ID NO: 1123753 - DNA, 22 bp, Artificial Sequence
  chemically synthesized
acatcatttttatgggaaattc

SEQ ID NO: 1123754 - DNA, 22 bp, Artificial Sequence
  chemically synthesized
atccagttgaatttcccataaa

SEQ ID NO: 1123755 - DNA, 22 bp, Artificial Sequence
  chemically synthesized
atttacatcatttttatgggaa

SEQ ID NO: 1123756 - DNA, 22 bp, Artificial Sequence
  chemically synthesized
acctaatttacatcatttttat

SEQ ID NO: 1123757 - DNA, 22 bp, Artificial Sequence
  chemically synthesized
aatttcccataaaaatgatgta

SEQ ID NO: 1123758 - DNA, 22 bp, Artificial Sequence
  chemically synthesized
cccataaaaatgatgtaaatta

SEQ ID NO: 1123759 - DNA, 22 bp, Artificial Sequence
  chemically synthesized
ccataaaaatgatgtaaattag

SEQ ID NO: 1123760 - DNA, 22 bp, Artificial Sequence
  chemically synthesized
ccatatgggatgtaattaacct

SEQ ID NO: 1123761 - DNA, 22 bp, Artificial Sequence
  chemically synthesized
accatatgggatgtaattaacc

SEQ ID NO: 1123762 - DNA, 22 bp, Artificial Sequence
  chemically synthesized
agtatttaccatatgggatgta

SEQ ID NO: 1123763 - DNA, 22 bp, Artificial Sequence
  chemically synthesized
tcagtatttaccatatgggatg

SEQ ID NO: 1123764 - DNA, 22 bp, Artificial Sequence
  chemically synthesized
ggttaattacatcccatatggt

SEQ ID NO: 1123765 - DNA, 22 bp, Artificial Sequence
  chemically synthesized
attacatcccatatggtaaata

SEQ ID NO: 1123766 - DNA, 22 bp, Artificial Sequence
  chemically synthesized
catcccatatggtaaatactga

SEQ ID NO: 1123767 - DNA, 22 bp, Artificial Sequence
  chemically synthesized
tatacacaggtatctctcagta

SEQ ID NO: 1123768 - DNA, 22 bp, Artificial Sequence
  chemically synthesized
atatacacaggtatctctcagt

SEQ ID NO: 1123769 - DNA, 22 bp, Artificial Sequence
  chemically synthesized
aacatttatatacacaggtatc

SEQ ID NO: 1123770 - DNA, 22 bp, Artificial Sequence
  chemically synthesized
aaacatttatatacacaggtat

SEQ ID NO: 1123771 - DNA, 22 bp, Artificial Sequence
  chemically synthesized
taaacatttatatacacaggta

SEQ ID NO: 1123772 - DNA, 22 bp, Artificial Sequence
  chemically synthesized
ttttaaacatttatatacacag

SEQ ID NO: 1123773 - DNA, 22 bp, Artificial Sequence
  chemically synthesized
attttaaacatttatatacaca

SEQ ID NO: 1123774 - DNA, 22 bp, Artificial Sequence
  chemically synthesized
agagatacctgtgtatataaat

SEQ ID NO: 1123775 - DNA, 22 bp, Artificial Sequence
  chemically synthesized
aatttattttaaacatttatat

SEQ ID NO: 1123776 - DNA, 22 bp, Artificial Sequence
  chemically synthesized
gaatttattttaaacatttata

SEQ ID NO: 1123777 - DNA, 22 bp, Artificial Sequence
  chemically synthesized
tgaatttattttaaacatttat

SEQ ID NO: 1123778 - DNA, 22 bp, Artificial Sequence
  chemically synthesized
cctttgaatttattttaaacat

SEQ ID NO: 1123779 - DNA, 22 bp, Artificial Sequence
  chemically synthesized
gcctttgaatttattttaaaca

SEQ ID NO: 1123780 - DNA, 22 bp, Artificial Sequence
  chemically synthesized
tgcctttgaatttattttaaac

SEQ ID NO: 1123781 - DNA, 22 bp, Artificial Sequence
  chemically synthesized
tgtatataaatgtttaaaataa

SEQ ID NO: 1123782 - DNA, 22 bp, Artificial Sequence
  chemically synthesized
ttgcctttgaatttattttaaa

SEQ ID NO: 1123783 - DNA, 22 bp, Artificial Sequence
  chemically synthesized
tatgtgtttttgcctttgaatt

SEQ ID NO: 1123784 - DNA, 22 bp, Artificial Sequence
  chemically synthesized
gtatgtgtttttgcctttgaat

SEQ ID NO: 1123785 - DNA, 22 bp, Artificial Sequence
  chemically synthesized
aaaataaattcaaaggcaaaaa

SEQ ID NO: 1123786 - DNA, 22 bp, Artificial Sequence
  chemically synthesized
aaataaattcaaaggcaaaaac

SEQ ID NO: 1123787 - DNA, 22 bp, Artificial Sequence
  chemically synthesized
agatgtttgtatgtgtttttgc

SEQ ID NO: 1123788 - DNA, 22 bp, Artificial Sequence
  chemically synthesized
gagatgtttgtatgtgtttttg

SEQ ID NO: 1123789 - DNA, 22 bp, Artificial Sequence
  chemically synthesized
tgagatgtttgtatgtgttttt

SEQ ID NO: 1123790 - DNA, 22 bp, Artificial Sequence
  chemically synthesized
tttgagatgtttgtatgtgttt

SEQ ID NO: 1123791 - DNA, 22 bp, Artificial Sequence
  chemically synthesized
aaaggcaaaaacacatacaaac

SEQ ID NO: 1123792 - DNA, 22 bp, Artificial Sequence
  chemically synthesized
gttctttgagatgtttgtatgt

SEQ ID NO: 1123793 - DNA, 22 bp, Artificial Sequence
  chemically synthesized
tagttctttgagatgtttgtat

SEQ ID NO: 1123794 - DNA, 22 bp, Artificial Sequence
  chemically synthesized
tctagttctttgagatgtttgt

SEQ ID NO: 1123795 - DNA, 22 bp, Artificial Sequence
  chemically synthesized
ctctagttctttgagatgtttg

SEQ ID NO: 1123796 - DNA, 22 bp, Artificial Sequence
  chemically synthesized
aatggcaaacatttctctagtt

SEQ ID NO: 1123797 - DNA, 22 bp, Artificial Sequence
  chemically synthesized
aaatggcaaacatttctctagt

SEQ ID NO: 1123798 - DNA, 22 bp, Artificial Sequence
  chemically synthesized
ttaaatggcaaacatttctcta

SEQ ID NO: 1123799 - DNA, 22 bp, Artificial Sequence
  chemically synthesized
cttaaatggcaaacatttctct

SEQ ID NO: 1123800 - DNA, 22 bp, Artificial Sequence
  chemically synthesized
aaagaactagagaaatgtttgc

SEQ ID NO: 1123801 - DNA, 22 bp, Artificial Sequence
  chemically synthesized
acaacttcttaaatggcaaaca

SEQ ID NO: 1123802 - DNA, 22 bp, Artificial Sequence
  chemically synthesized
gagaaatgtttgccatttaaga

SEQ ID NO: 1123803 - DNA, 22 bp, Artificial Sequence
  chemically synthesized
aaaattgacaacttcttaaatg

SEQ ID NO: 1123804 - DNA, 22 bp, Artificial Sequence
  chemically synthesized
acaattcaaaattgacaacttc

SEQ ID NO: 1123805 - DNA, 22 bp, Artificial Sequence
  chemically synthesized
gccatttaagaagttgtcaatt

SEQ ID NO: 1123806 - DNA, 22 bp, Artificial Sequence
  chemically synthesized
ttgacaattcaaaattgacaac

SEQ ID NO: 1123807 - DNA, 22 bp, Artificial Sequence
  chemically synthesized
ccatttaagaagttgtcaattt

SEQ ID NO: 1123808 - DNA, 22 bp, Artificial Sequence
  chemically synthesized
ctattgacaattcaaaattgac

SEQ ID NO: 1123809 - DNA, 22 bp, Artificial Sequence
  chemically synthesized
actattgacaattcaaaattga

SEQ ID NO: 1123810 - DNA, 22 bp, Artificial Sequence
  chemically synthesized
tactattgacaattcaaaattg

SEQ ID NO: 1123811 - DNA, 22 bp, Artificial Sequence
  chemically synthesized
aagaagttgtcaattttgaatt

SEQ ID NO: 1123812 - DNA, 22 bp, Artificial Sequence
  chemically synthesized
agaagttgtcaattttgaattg

SEQ ID NO: 1123813 - DNA, 22 bp, Artificial Sequence
  chemically synthesized
tcaattttgaattgtcaatagt

SEQ ID NO: 1123814 - DNA, 22 bp, Artificial Sequence
  chemically synthesized
atgtaatgttttactattgaca

SEQ ID NO: 1123815 - DNA, 22 bp, Artificial Sequence
  chemically synthesized
attcatgtaatgttttactatt

SEQ ID NO: 1123816 - DNA, 22 bp, Artificial Sequence
  chemically synthesized
tgaattgtcaatagtaaaacat

SEQ ID NO: 1123817 - DNA, 22 bp, Artificial Sequence
  chemically synthesized
gaattgtcaatagtaaaacatt

SEQ ID NO: 1123818 - DNA, 22 bp, Artificial Sequence
  chemically synthesized
aattgtcaatagtaaaacatta

SEQ ID NO: 1123819 - DNA, 22 bp, Artificial Sequence
  chemically synthesized
tcaatagtaaaacattacatga

SEQ ID NO: 1123820 - DNA, 22 bp, Artificial Sequence
  chemically synthesized
tatagcactaattcatgtaatg

SEQ ID NO: 1123821 - DNA, 22 bp, Artificial Sequence
  chemically synthesized
gcacagttatatagcactaatt

SEQ ID NO: 1123822 - DNA, 22 bp, Artificial Sequence
  chemically synthesized
catgaattagtgctatataact

SEQ ID NO: 1123823 - DNA, 22 bp, Artificial Sequence
  chemically synthesized
acataattagcacagttatata

SEQ ID NO: 1123824 - DNA, 22 bp, Artificial Sequence
  chemically synthesized
tgacataattagcacagttata

SEQ ID NO: 1123825 - DNA, 22 bp, Artificial Sequence
  chemically synthesized
ctgacataattagcacagttat

SEQ ID NO: 1123826 - DNA, 22 bp, Artificial Sequence
  chemically synthesized
ttctgacataattagcacagtt

SEQ ID NO: 1123827 - DNA, 22 bp, Artificial Sequence
  chemically synthesized
gtgctatataactgtgctaatt

SEQ ID NO: 1123828 - DNA, 22 bp, Artificial Sequence
  chemically synthesized
tataactgtgctaattatgtca

SEQ ID NO: 1123829 - DNA, 22 bp, Artificial Sequence
  chemically synthesized
tgctaattatgtcagaagagcc

SEQ ID NO: 1123830 - DNA, 22 bp, Artificial Sequence
  chemically synthesized
attatgtcagaagagcctcctg

SEQ ID NO: 1123831 - DNA, 22 bp, Artificial Sequence
  chemically synthesized
tgtcagaagagcctcctgatgg

SEQ ID NO: 1123832 - DNA, 22 bp, Artificial Sequence
  chemically synthesized
acagaacacagtgcccatcagg

SEQ ID NO: 1123833 - DNA, 22 bp, Artificial Sequence
  chemically synthesized
taaagaaaattaacagaacaca

SEQ ID NO: 1123834 - DNA, 22 bp, Artificial Sequence
  chemically synthesized
ctgatgggcactgtgttctgtt

SEQ ID NO: 1123835 - DNA, 22 bp, Artificial Sequence
  chemically synthesized
atgggcactgtgttctgttaat

SEQ ID NO: 1123836 - DNA, 22 bp, Artificial Sequence
  chemically synthesized
tgttctgttaattttctttaca

SEQ ID NO: 1123837 - DNA, 22 bp, Artificial Sequence
  chemically synthesized
tgtggcagtcactgtaaagaaa

SEQ ID NO: 1123838 - DNA, 22 bp, Artificial Sequence
  chemically synthesized
tgttaattttctttacagtgac

SEQ ID NO: 1123839 - DNA, 22 bp, Artificial Sequence
  chemically synthesized
ttaattttctttacagtgactg

SEQ ID NO: 1123840 - DNA, 22 bp, Artificial Sequence
  chemically synthesized
ataggttatgtggcagtcactg

SEQ ID NO: 1123841 - DNA, 22 bp, Artificial Sequence
  chemically synthesized
aataggttatgtggcagtcact

SEQ ID NO: 1123842 - DNA, 22 bp, Artificial Sequence
  chemically synthesized
attttctttacagtgactgcca

SEQ ID NO: 1123843 - DNA, 22 bp, Artificial Sequence
  chemically synthesized
gtttaataggttatgtggcagt

SEQ ID NO: 1123844 - DNA, 22 bp, Artificial Sequence
  chemically synthesized
tctttacagtgactgccacata

SEQ ID NO: 1123845 - DNA, 22 bp, Artificial Sequence
  chemically synthesized
agtttaataggttatgtggcag

SEQ ID NO: 1123846 - DNA, 22 bp, Artificial Sequence
  chemically synthesized
ctttacagtgactgccacataa

SEQ ID NO: 1123847 - DNA, 22 bp, Artificial Sequence
  chemically synthesized
tttacagtgactgccacataac

SEQ ID NO: 1123848 - DNA, 22 bp, Artificial Sequence
  chemically synthesized
tacagtgactgccacataacct

SEQ ID NO: 1123849 - DNA, 22 bp, Artificial Sequence
  chemically synthesized
acagtgactgccacataaccta

SEQ ID NO: 1123850 - DNA, 22 bp, Artificial Sequence
  chemically synthesized
cagtgactgccacataacctat

SEQ ID NO: 1123851 - DNA, 22 bp, Artificial Sequence
  chemically synthesized
ccacataacctattaaactaag

SEQ ID NO: 1123852 - DNA, 22 bp, Artificial Sequence
  chemically synthesized
tgtaaatgtgtcatcttagttt

SEQ ID NO: 1123853 - DNA, 22 bp, Artificial Sequence
  chemically synthesized
atgtaaatgtgtcatcttagtt

SEQ ID NO: 1123854 - DNA, 22 bp, Artificial Sequence
  chemically synthesized
aaatttatgtaaatgtgtcatc

SEQ ID NO: 1123855 - DNA, 22 bp, Artificial Sequence
  chemically synthesized
ttaaactaagatgacacattta

SEQ ID NO: 1123856 - DNA, 22 bp, Artificial Sequence
  chemically synthesized
aattaaaatttatgtaaatgtg

SEQ ID NO: 1123857 - DNA, 22 bp, Artificial Sequence
  chemically synthesized
aactaagatgacacatttacat

SEQ ID NO: 1123858 - DNA, 22 bp, Artificial Sequence
  chemically synthesized
agatgacacatttacataaatt

SEQ ID NO: 1123859 - DNA, 22 bp, Artificial Sequence
  chemically synthesized
aaagtgactgaattaaaattta

SEQ ID NO: 1123860 - DNA, 22 bp, Artificial Sequence
  chemically synthesized
tatattgaaagtgactgaatta

SEQ ID NO: 1123861 - DNA, 22 bp, Artificial Sequence
  chemically synthesized
gtatattgaaagtgactgaatt

SEQ ID NO: 1123862 - DNA, 22 bp, Artificial Sequence
  chemically synthesized
acataaattttaattcagtcac

SEQ ID NO: 1123863 - DNA, 22 bp, Artificial Sequence
  chemically synthesized
cataaattttaattcagtcact

SEQ ID NO: 1123864 - DNA, 22 bp, Artificial Sequence
  chemically synthesized
caacttgtatattgaaagtgac

SEQ ID NO: 1123865 - DNA, 22 bp, Artificial Sequence
  chemically synthesized
taattcagtcactttcaatata

SEQ ID NO: 1123866 - DNA, 22 bp, Artificial Sequence
  chemically synthesized
aattcagtcactttcaatatac

SEQ ID NO: 1123867 - DNA, 22 bp, Artificial Sequence
  chemically synthesized
attcagtcactttcaatataca

SEQ ID NO: 1123868 - DNA, 22 bp, Artificial Sequence
  chemically synthesized
agtcactttcaatatacaagtt

SEQ ID NO: 1123869 - DNA, 22 bp, Artificial Sequence
  chemically synthesized
ggaatgatgagttgcaacttgt

SEQ ID NO: 1123870 - DNA, 22 bp, Artificial Sequence
  chemically synthesized
gggaatgatgagttgcaacttg

SEQ ID NO: 1123871 - DNA, 22 bp, Artificial Sequence
  chemically synthesized
tcaatatacaagttgcaactca

SEQ ID NO: 1123872 - DNA, 22 bp, Artificial Sequence
  chemically synthesized
caatatacaagttgcaactcat

SEQ ID NO: 1123873 - DNA, 22 bp, Artificial Sequence
  chemically synthesized
aatatacaagttgcaactcatc

SEQ ID NO: 1123874 - DNA, 22 bp, Artificial Sequence
  chemically synthesized
cacatttgggaatgatgagttg

SEQ ID NO: 1123875 - DNA, 22 bp, Artificial Sequence
  chemically synthesized
acacatttgggaatgatgagtt

SEQ ID NO: 1123876 - DNA, 22 bp, Artificial Sequence
  chemically synthesized
aaagtttacacatttgggaatg

SEQ ID NO: 1123877 - DNA, 22 bp, Artificial Sequence
  chemically synthesized
tcaaagtttacacatttgggaa

SEQ ID NO: 1123878 - DNA, 22 bp, Artificial Sequence
  chemically synthesized
caactcatcattcccaaatgtg

SEQ ID NO: 1123879 - DNA, 22 bp, Artificial Sequence
  chemically synthesized
cactctcaaagtttacacattt

SEQ ID NO: 1123880 - DNA, 22 bp, Artificial Sequence
  chemically synthesized
ccactctcaaagtttacacatt

SEQ ID NO: 1123881 - DNA, 22 bp, Artificial Sequence
  chemically synthesized
atcattcccaaatgtgtaaact

SEQ ID NO: 1123882 - DNA, 22 bp, Artificial Sequence
  chemically synthesized
gaggacttccactctcaaagtt

SEQ ID NO: 1123883 - DNA, 22 bp, Artificial Sequence
  chemically synthesized
ccaaatgtgtaaactttgagag

SEQ ID NO: 1123884 - DNA, 22 bp, Artificial Sequence
  chemically synthesized
ggaggacttccactctcaaagt

SEQ ID NO: 1123885 - DNA, 22 bp, Artificial Sequence
  chemically synthesized
ggagcttggaggacttccactc

SEQ ID NO: 1123886 - DNA, 22 bp, Artificial Sequence
  chemically synthesized
agtctgggagcttggaggactt

SEQ ID NO: 1123887 - DNA, 22 bp, Artificial Sequence
  chemically synthesized
tgagagtggaagtcctccaagc

SEQ ID NO: 1123888 - DNA, 22 bp, Artificial Sequence
  chemically synthesized
gagagtggaagtcctccaagct

SEQ ID NO: 1123889 - DNA, 22 bp, Artificial Sequence
  chemically synthesized
gttaagtctgggagcttggagg

SEQ ID NO: 1123890 - DNA, 22 bp, Artificial Sequence
  chemically synthesized
agagtggaagtcctccaagctc

SEQ ID NO: 1123891 - DNA, 22 bp, Artificial Sequence
  chemically synthesized
atcaaattagttaagtctggga

SEQ ID NO: 1123892 - DNA, 22 bp, Artificial Sequence
  chemically synthesized
actaatcaaattagttaagtct

SEQ ID NO: 1123893 - DNA, 22 bp, Artificial Sequence
  chemically synthesized
caagctcccagacttaactaat

SEQ ID NO: 1123894 - DNA, 22 bp, Artificial Sequence
  chemically synthesized
gttcactaatcaaattagttaa

SEQ ID NO: 1123895 - DNA, 22 bp, Artificial Sequence
  chemically synthesized
ccagacttaactaatttgatta

SEQ ID NO: 1123896 - DNA, 22 bp, Artificial Sequence
  chemically synthesized
ataaacctagttcactaatcaa

SEQ ID NO: 1123897 - DNA, 22 bp, Artificial Sequence
  chemically synthesized
aactaatttgattagtgaacta

SEQ ID NO: 1123898 - DNA, 22 bp, Artificial Sequence
  chemically synthesized
actaatttgattagtgaactag

SEQ ID NO: 1123899 - DNA, 22 bp, Artificial Sequence
  chemically synthesized
atttgattagtgaactaggttt

SEQ ID NO: 1123900 - DNA, 22 bp, Artificial Sequence
  chemically synthesized
gattagtgaactaggtttatga

SEQ ID NO: 1123901 - DNA, 22 bp, Artificial Sequence
  chemically synthesized
attagtgaactaggtttatgaa

SEQ ID NO: 1123902 - DNA, 22 bp, Artificial Sequence
  chemically synthesized
gtgaactaggtttatgaatggc

SEQ ID NO: 1123903 - DNA, 22 bp, Artificial Sequence
  chemically synthesized
aatatgtaaaatggccattcat

SEQ ID NO: 1123904 - DNA, 22 bp, Artificial Sequence
  chemically synthesized
aaatatgtaaaatggccattca

SEQ ID NO: 1123905 - DNA, 22 bp, Artificial Sequence
  chemically synthesized
ggtttatgaatggccattttac

SEQ ID NO: 1123906 - DNA, 22 bp, Artificial Sequence
  chemically synthesized
agatgtttaaatatgtaaaatg

SEQ ID NO: 1123907 - DNA, 22 bp, Artificial Sequence
  chemically synthesized
atgaatggccattttacatatt

SEQ ID NO: 1123908 - DNA, 22 bp, Artificial Sequence
  chemically synthesized
tgaatggccattttacatattt

SEQ ID NO: 1123909 - DNA, 22 bp, Artificial Sequence
  chemically synthesized
catgctaagatgtttaaatatg

SEQ ID NO: 1123910 - DNA, 22 bp, Artificial Sequence
  chemically synthesized
tacatgctaagatgtttaaata

SEQ ID NO: 1123911 - DNA, 22 bp, Artificial Sequence
  chemically synthesized
tacatatttaaacatcttagca

SEQ ID NO: 1123912 - DNA, 22 bp, Artificial Sequence
  chemically synthesized
tgaaattctacatgctaagatg

SEQ ID NO: 1123913 - DNA, 22 bp, Artificial Sequence
  chemically synthesized
acatatttaaacatcttagcat

SEQ ID NO: 1123914 - DNA, 22 bp, Artificial Sequence
  chemically synthesized
atgaaattctacatgctaagat

SEQ ID NO: 1123915 - DNA, 22 bp, Artificial Sequence
  chemically synthesized
catatttaaacatcttagcatg

SEQ ID NO: 1123916 - DNA, 22 bp, Artificial Sequence
  chemically synthesized
tatgaaattctacatgctaaga

SEQ ID NO: 1123917 - DNA, 22 bp, Artificial Sequence
  chemically synthesized
ttatgaaattctacatgctaag

SEQ ID NO: 1123918 - DNA, 22 bp, Artificial Sequence
  chemically synthesized
aaacatcttagcatgtagaatt

SEQ ID NO: 1123919 - DNA, 22 bp, Artificial Sequence
  chemically synthesized
aacatcttagcatgtagaattt

SEQ ID NO: 1123920 - DNA, 22 bp, Artificial Sequence
  chemically synthesized
taagtttttatgaaattctaca

SEQ ID NO: 1123921 - DNA, 22 bp, Artificial Sequence
  chemically synthesized
ataagtttttatgaaattctac

SEQ ID NO: 1123922 - DNA, 22 bp, Artificial Sequence
  chemically synthesized
agcatgtagaatttcataaaaa

SEQ ID NO: 1123923 - DNA, 22 bp, Artificial Sequence
  chemically synthesized
gcatgtagaatttcataaaaac

SEQ ID NO: 1123924 - DNA, 22 bp, Artificial Sequence
  chemically synthesized
aggatgaggcttataagttttt

SEQ ID NO: 1123925 - DNA, 22 bp, Artificial Sequence
  chemically synthesized
taaggatgaggcttataagttt

SEQ ID NO: 1123926 - DNA, 22 bp, Artificial Sequence
  chemically synthesized
ctaaggatgaggcttataagtt

SEQ ID NO: 1123927 - DNA, 22 bp, Artificial Sequence
  chemically synthesized
cataaaaacttataagcctcat

SEQ ID NO: 1123928 - DNA, 22 bp, Artificial Sequence
  chemically synthesized
aggtttctaaggatgaggctta

SEQ ID NO: 1123929 - DNA, 22 bp, Artificial Sequence
  chemically synthesized
ataaaaacttataagcctcatc

SEQ ID NO: 1123930 - DNA, 22 bp, Artificial Sequence
  chemically synthesized
caggtttctaaggatgaggctt

SEQ ID NO: 1123931 - DNA, 22 bp, Artificial Sequence
  chemically synthesized
tcaggtttctaaggatgaggct

SEQ ID NO: 1123932 - DNA, 22 bp, Artificial Sequence
  chemically synthesized
ctttcaggtttctaaggatgag

SEQ ID NO: 1123933 - DNA, 22 bp, Artificial Sequence
  chemically synthesized
cctttcaggtttctaaggatga

SEQ ID NO: 1123934 - DNA, 22 bp, Artificial Sequence
  chemically synthesized
tcctttcaggtttctaaggatg

SEQ ID NO: 1123935 - DNA, 22 bp, Artificial Sequence
  chemically synthesized
ataagcctcatccttagaaacc

SEQ ID NO: 1123936 - DNA, 22 bp, Artificial Sequence
  chemically synthesized
taagcctcatccttagaaacct

SEQ ID NO: 1123937 - DNA, 22 bp, Artificial Sequence
  chemically synthesized
atccttagaaacctgaaaggaa

SEQ ID NO: 1123938 - DNA, 22 bp, Artificial Sequence
  chemically synthesized
acaggcatcagcattttccttt

SEQ ID NO: 1123939 - DNA, 22 bp, Artificial Sequence
  chemically synthesized
cacaggcatcagcattttcctt

SEQ ID NO: 1123940 - DNA, 22 bp, Artificial Sequence
  chemically synthesized
agaaacctgaaaggaaaatgct

SEQ ID NO: 1123941 - DNA, 22 bp, Artificial Sequence
  chemically synthesized
gaaacctgaaaggaaaatgctg

SEQ ID NO: 1123942 - DNA, 22 bp, Artificial Sequence
  chemically synthesized
acgtatttcacaggcatcagca

SEQ ID NO: 1123943 - DNA, 22 bp, Artificial Sequence
  chemically synthesized
aaaggaaaatgctgatgcctgt

SEQ ID NO: 1123944 - DNA, 22 bp, Artificial Sequence
  chemically synthesized
caatggttaacgtatttcacag

SEQ ID NO: 1123945 - DNA, 22 bp, Artificial Sequence
  chemically synthesized
atgcctgtgaaatacgttaacc

SEQ ID NO: 1123946 - DNA, 22 bp, Artificial Sequence
  chemically synthesized
ggaccctgcaatggttaacgta

SEQ ID NO: 1123947 - DNA, 22 bp, Artificial Sequence
  chemically synthesized
tgaaatacgttaaccattgcag

SEQ ID NO: 1123948 - DNA, 22 bp, Artificial Sequence
  chemically synthesized
gagccctgggaccctgcaatgg

SEQ ID NO: 1123949 - DNA, 22 bp, Artificial Sequence
  chemically synthesized
ggcctagagccctgggaccctg

SEQ ID NO: 1123950 - DNA, 22 bp, Artificial Sequence
  chemically synthesized
accattgcagggtcccagggct

SEQ ID NO: 1123951 - DNA, 22 bp, Artificial Sequence
  chemically synthesized
gtctaggcctagagccctggga

SEQ ID NO: 1123952 - DNA, 22 bp, Artificial Sequence
  chemically synthesized
tctggtctaggcctagagccct

SEQ ID NO: 1123953 - DNA, 22 bp, Artificial Sequence
  chemically synthesized
cagggtcccagggctctaggcc

SEQ ID NO: 1123954 - DNA, 22 bp, Artificial Sequence
  chemically synthesized
ataaattatctggtctaggcct

SEQ ID NO: 1123955 - DNA, 22 bp, Artificial Sequence
  chemically synthesized
cataaattatctggtctaggcc

SEQ ID NO: 1123956 - DNA, 22 bp, Artificial Sequence
  chemically synthesized
gtttcataaattatctggtcta

SEQ ID NO: 1123957 - DNA, 22 bp, Artificial Sequence
  chemically synthesized
taggcctagaccagataattta

SEQ ID NO: 1123958 - DNA, 22 bp, Artificial Sequence
  chemically synthesized
agaattggtttcataaattatc

SEQ ID NO: 1123959 - DNA, 22 bp, Artificial Sequence
  chemically synthesized
ggcctagaccagataatttatg

SEQ ID NO: 1123960 - DNA, 22 bp, Artificial Sequence
  chemically synthesized
attaagaattggtttcataaat

SEQ ID NO: 1123961 - DNA, 22 bp, Artificial Sequence
  chemically synthesized
gaccagataatttatgaaacca

SEQ ID NO: 1123962 - DNA, 22 bp, Artificial Sequence
  chemically synthesized
aaatgttcattaagaattggtt

SEQ ID NO: 1123963 - DNA, 22 bp, Artificial Sequence
  chemically synthesized
attaaaatgttcattaagaatt

SEQ ID NO: 1123964 - DNA, 22 bp, Artificial Sequence
  chemically synthesized
atgaaaccaattcttaatgaac

SEQ ID NO: 1123965 - DNA, 22 bp, Artificial Sequence
  chemically synthesized
gctaattaaaatgttcattaag

SEQ ID NO: 1123966 - DNA, 22 bp, Artificial Sequence
  chemically synthesized
tgaaaccaattcttaatgaaca

SEQ ID NO: 1123967 - DNA, 22 bp, Artificial Sequence
  chemically synthesized
ctagctaattaaaatgttcatt

SEQ ID NO: 1123968 - DNA, 22 bp, Artificial Sequence
  chemically synthesized
cctagctaattaaaatgttcat

SEQ ID NO: 1123969 - DNA, 22 bp, Artificial Sequence
  chemically synthesized
cttcctagctaattaaaatgtt

SEQ ID NO: 1123970 - DNA, 22 bp, Artificial Sequence
  chemically synthesized
gcttcctagctaattaaaatgt

SEQ ID NO: 1123971 - DNA, 22 bp, Artificial Sequence
  chemically synthesized
ttaatgaacattttaattagct

SEQ ID NO: 1123972 - DNA, 22 bp, Artificial Sequence
  chemically synthesized
aaacttgcttcctagctaatta

SEQ ID NO: 1123973 - DNA, 22 bp, Artificial Sequence
  chemically synthesized
aatgaacattttaattagctag

SEQ ID NO: 1123974 - DNA, 22 bp, Artificial Sequence
  chemically synthesized
atgaacattttaattagctagg

SEQ ID NO: 1123975 - DNA, 22 bp, Artificial Sequence
  chemically synthesized
atgttaaaacttgcttcctagc

SEQ ID NO: 1123976 - DNA, 22 bp, Artificial Sequence
  chemically synthesized
ttaatgttaaaacttgcttcct

SEQ ID NO: 1123977 - DNA, 22 bp, Artificial Sequence
  chemically synthesized
taattagctaggaagcaagttt

SEQ ID NO: 1123978 - DNA, 22 bp, Artificial Sequence
  chemically synthesized
ctattaatgttaaaacttgctt

SEQ ID NO: 1123979 - DNA, 22 bp, Artificial Sequence
  chemically synthesized
aattagctaggaagcaagtttt

SEQ ID NO: 1123980 - DNA, 22 bp, Artificial Sequence
  chemically synthesized
attagctaggaagcaagtttta

SEQ ID NO: 1123981 - DNA, 22 bp, Artificial Sequence
  chemically synthesized
ttcctattaatgttaaaacttg

SEQ ID NO: 1123982 - DNA, 22 bp, Artificial Sequence
  chemically synthesized
gttcctattaatgttaaaactt

SEQ ID NO: 1123983 - DNA, 22 bp, Artificial Sequence
  chemically synthesized
tgttcctattaatgttaaaact

SEQ ID NO: 1123984 - DNA, 22 bp, Artificial Sequence
  chemically synthesized
gctaggaagcaagttttaacat

SEQ ID NO: 1123985 - DNA, 22 bp, Artificial Sequence
  chemically synthesized
ggaagcaagttttaacattaat

SEQ ID NO: 1123986 - DNA, 22 bp, Artificial Sequence
  chemically synthesized
tagttttgttcctattaatgtt

SEQ ID NO: 1123987 - DNA, 22 bp, Artificial Sequence
  chemically synthesized
taacattaataggaacaaaact

SEQ ID NO: 1123988 - DNA, 22 bp, Artificial Sequence
  chemically synthesized
aacattaataggaacaaaacta

SEQ ID NO: 1123989 - DNA, 22 bp, Artificial Sequence
  chemically synthesized
acattaataggaacaaaactat

SEQ ID NO: 1123990 - DNA, 22 bp, Artificial Sequence
  chemically synthesized
ataggaacaaaactataattat

SEQ ID NO: 1123991 - DNA, 22 bp, Artificial Sequence
  chemically synthesized
ataccaacaaagaataattata

SEQ ID NO: 1123992 - DNA, 22 bp, Artificial Sequence
  chemically synthesized
aataccaacaaagaataattat

SEQ ID NO: 1123993 - DNA, 22 bp, Artificial Sequence
  chemically synthesized
taataccaacaaagaataatta

SEQ ID NO: 1123994 - DNA, 22 bp, Artificial Sequence
  chemically synthesized
tttaataccaacaaagaataat

SEQ ID NO: 1123995 - DNA, 22 bp, Artificial Sequence
  chemically synthesized
ctttaataccaacaaagaataa

SEQ ID NO: 1123996 - DNA, 22 bp, Artificial Sequence
  chemically synthesized
ttctttaataccaacaaagaat

SEQ ID NO: 1123997 - DNA, 22 bp, Artificial Sequence
  chemically synthesized
cttctttaataccaacaaagaa

SEQ ID NO: 1123998 - DNA, 22 bp, Artificial Sequence
  chemically synthesized
tttcttctttaataccaacaaa

SEQ ID NO: 1123999 - DNA, 22 bp, Artificial Sequence
  chemically synthesized
taattattctttgttggtatta

SEQ ID NO: 1124000 - DNA, 22 bp, Artificial Sequence
  chemically synthesized
caaaattatttcttctttaata

SEQ ID NO: 1124001 - DNA, 22 bp, Artificial Sequence
  chemically synthesized
ttctttgttggtattaaagaag

SEQ ID NO: 1124002 - DNA, 22 bp, Artificial Sequence
  chemically synthesized
tttgttggtattaaagaagaaa

SEQ ID NO: 1124003 - DNA, 22 bp, Artificial Sequence
  chemically synthesized
cctccaaaattatttcttcttt

SEQ ID NO: 1124004 - DNA, 22 bp, Artificial Sequence
  chemically synthesized
acctccaaaattatttcttctt

SEQ ID NO: 1124005 - DNA, 22 bp, Artificial Sequence
  chemically synthesized
tgttggtattaaagaagaaata

SEQ ID NO: 1124006 - DNA, 22 bp, Artificial Sequence
  chemically synthesized
gttggtattaaagaagaaataa

SEQ ID NO: 1124007 - DNA, 22 bp, Artificial Sequence
  chemically synthesized
ttggtattaaagaagaaataat

SEQ ID NO: 1124008 - DNA, 22 bp, Artificial Sequence
  chemically synthesized
gtattaaagaagaaataatttt

SEQ ID NO: 1124009 - DNA, 22 bp, Artificial Sequence
  chemically synthesized
gaaaatcttacctccaaaatta

SEQ ID NO: 1124010 - DNA, 22 bp, Artificial Sequence
  chemically synthesized
aagaagaaataattttggaggt

SEQ ID NO: 1124011 - DNA, 22 bp, Artificial Sequence
  chemically synthesized
aaaatacagcaaagttggaaaa

SEQ ID NO: 1124012 - DNA, 22 bp, Artificial Sequence
  chemically synthesized
tggaggtaagattttccaactt

SEQ ID NO: 1124013 - DNA, 22 bp, Artificial Sequence
  chemically synthesized
aaaaatacagcaaagttggaaa

SEQ ID NO: 1124014 - DNA, 22 bp, Artificial Sequence
  chemically synthesized
ggaggtaagattttccaacttt

SEQ ID NO: 1124015 - DNA, 22 bp, Artificial Sequence
  chemically synthesized
taaaaatacagcaaagttggaa

SEQ ID NO: 1124016 - DNA, 22 bp, Artificial Sequence
  chemically synthesized
gaggtaagattttccaactttg

SEQ ID NO: 1124017 - DNA, 22 bp, Artificial Sequence
  chemically synthesized
ttaaaaatacagcaaagttgga

SEQ ID NO: 1124018 - DNA, 22 bp, Artificial Sequence
  chemically synthesized
tccaactttgctgtatttttaa

SEQ ID NO: 1124019 - DNA, 22 bp, Artificial Sequence
  chemically synthesized
ccaactttgctgtatttttaaa

SEQ ID NO: 1124020 - DNA, 22 bp, Artificial Sequence
  chemically synthesized
caactttgctgtatttttaaaa

SEQ ID NO: 1124021 - DNA, 22 bp, Artificial Sequence
  chemically synthesized
aagaagaaaggtgatttttaaa

SEQ ID NO: 1124022 - DNA, 22 bp, Artificial Sequence
  chemically synthesized
tgaagaagaaaggtgattttta

SEQ ID NO: 1124023 - DNA, 22 bp, Artificial Sequence
  chemically synthesized
tgctgtatttttaaaaatcacc

SEQ ID NO: 1124024 - DNA, 22 bp, Artificial Sequence
  chemically synthesized
gctgtatttttaaaaatcacct

SEQ ID NO: 1124025 - DNA, 22 bp, Artificial Sequence
  chemically synthesized
ctgtatttttaaaaatcacctt

SEQ ID NO: 1124026 - DNA, 22 bp, Artificial Sequence
  chemically synthesized
tatttttaaaaatcacctttct

SEQ ID NO: 1124027 - DNA, 22 bp, Artificial Sequence
  chemically synthesized
ggaaaactctgaagaagaaagg

SEQ ID NO: 1124028 - DNA, 22 bp, Artificial Sequence
  chemically synthesized
cggaaaactctgaagaagaaag

SEQ ID NO: 1124029 - DNA, 22 bp, Artificial Sequence
  chemically synthesized
ttaaaaatcacctttcttcttc

SEQ ID NO: 1124030 - DNA, 22 bp, Artificial Sequence
  chemically synthesized
taaaaatcacctttcttcttca

SEQ ID NO: 1124031 - DNA, 22 bp, Artificial Sequence
  chemically synthesized
aaaaatcacctttcttcttcag

SEQ ID NO: 1124032 - DNA, 22 bp, Artificial Sequence
  chemically synthesized
aaaatcacctttcttcttcaga

SEQ ID NO: 1124033 - DNA, 22 bp, Artificial Sequence
  chemically synthesized
acttcggaaaactctgaagaag

SEQ ID NO: 1124034 - DNA, 22 bp, Artificial Sequence
  chemically synthesized
tcacttcggaaaactctgaaga

SEQ ID NO: 1124035 - DNA, 22 bp, Artificial Sequence
  chemically synthesized
ctcacttcggaaaactctgaag

SEQ ID NO: 1124036 - DNA, 22 bp, Artificial Sequence
  chemically synthesized
tcttcttcagagttttccgaag

SEQ ID NO: 1124037 - DNA, 22 bp, Artificial Sequence
  chemically synthesized
cttcttcagagttttccgaagt

SEQ ID NO: 1124038 - DNA, 22 bp, Artificial Sequence
  chemically synthesized
aaatgtcttctcacttcggaaa

SEQ ID NO: 1124039 - DNA, 22 bp, Artificial Sequence
  chemically synthesized
ttcttcagagttttccgaagtg

SEQ ID NO: 1124040 - DNA, 22 bp, Artificial Sequence
  chemically synthesized
cttcagagttttccgaagtgag

SEQ ID NO: 1124041 - DNA, 22 bp, Artificial Sequence
  chemically synthesized
ttcagagttttccgaagtgaga

SEQ ID NO: 1124042 - DNA, 22 bp, Artificial Sequence
  chemically synthesized
cagagttttccgaagtgagaag

SEQ ID NO: 1124043 - DNA, 22 bp, Artificial Sequence
  chemically synthesized
agagttttccgaagtgagaaga

SEQ ID NO: 1124044 - DNA, 22 bp, Artificial Sequence
  chemically synthesized
tccgaagtgagaagacatttta

SEQ ID NO: 1124045 - DNA, 22 bp, Artificial Sequence
  chemically synthesized
ccgaagtgagaagacattttaa

SEQ ID NO: 1124046 - DNA, 22 bp, Artificial Sequence
  chemically synthesized
cgaagtgagaagacattttaat

SEQ ID NO: 1124047 - DNA, 22 bp, Artificial Sequence
  chemically synthesized
tatagtaatatggaattaaaat

SEQ ID NO: 1124048 - DNA, 22 bp, Artificial Sequence
  chemically synthesized
taattccatattactatacagg

SEQ ID NO: 1124049 - DNA, 22 bp, Artificial Sequence
  chemically synthesized
aattccatattactatacaggc

SEQ ID NO: 1124050 - DNA, 22 bp, Artificial Sequence
  chemically synthesized
attccatattactatacaggca

SEQ ID NO: 1124051 - DNA, 22 bp, Artificial Sequence
  chemically synthesized
gggtcaggaaagtgcctgtata

SEQ ID NO: 1124052 - DNA, 22 bp, Artificial Sequence
  chemically synthesized
agggtcaggaaagtgcctgtat

SEQ ID NO: 1124053 - DNA, 22 bp, Artificial Sequence
  chemically synthesized
catattactatacaggcacttt

SEQ ID NO: 1124054 - DNA, 22 bp, Artificial Sequence
  chemically synthesized
gggatttagggtcaggaaagtg

SEQ ID NO: 1124055 - DNA, 22 bp, Artificial Sequence
  chemically synthesized
ctatacaggcactttcctgacc

SEQ ID NO: 1124056 - DNA, 22 bp, Artificial Sequence
  chemically synthesized
tacaggcactttcctgacccta

SEQ ID NO: 1124057 - DNA, 22 bp, Artificial Sequence
  chemically synthesized
aaatggttggggatttagggtc

SEQ ID NO: 1124058 - DNA, 22 bp, Artificial Sequence
  chemically synthesized
caaatggttggggatttagggt

SEQ ID NO: 1124059 - DNA, 22 bp, Artificial Sequence
  chemically synthesized
tcctgaccctaaatccccaacc

SEQ ID NO: 1124060 - DNA, 22 bp, Artificial Sequence
  chemically synthesized
cctgaccctaaatccccaacca

SEQ ID NO: 1124061 - DNA, 22 bp, Artificial Sequence
  chemically synthesized
ctgaccctaaatccccaaccat

SEQ ID NO: 1124062 - DNA, 22 bp, Artificial Sequence
  chemically synthesized
accctaaatccccaaccatttg

SEQ ID NO: 1124063 - DNA, 22 bp, Artificial Sequence
  chemically synthesized
aatccccaaccatttgaagatg

SEQ ID NO: 1124064 - DNA, 22 bp, Artificial Sequence
  chemically synthesized
gaagatgaatagtaggtcatct

SEQ ID NO: 1124065 - DNA, 22 bp, Artificial Sequence
  chemically synthesized
ggaagatgaatagtaggtcatc

SEQ ID NO: 1124066 - DNA, 22 bp, Artificial Sequence
  chemically synthesized
agccttggaagatgaatagtag

SEQ ID NO: 1124067 - DNA, 22 bp, Artificial Sequence
  chemically synthesized
gaagatgacctactattcatct

SEQ ID NO: 1124068 - DNA, 22 bp, Artificial Sequence
  chemically synthesized
aagatgacctactattcatctt

SEQ ID NO: 1124069 - DNA, 22 bp, Artificial Sequence
  chemically synthesized
aactgagccttggaagatgaat

SEQ ID NO: 1124070 - DNA, 22 bp, Artificial Sequence
  chemically synthesized
gaactgagccttggaagatgaa

SEQ ID NO: 1124071 - DNA, 22 bp, Artificial Sequence
  chemically synthesized
ctattcatcttccaaggctcag

SEQ ID NO: 1124072 - DNA, 22 bp, Artificial Sequence
  chemically synthesized
ttcatcttccaaggctcagttc

SEQ ID NO: 1124073 - DNA, 22 bp, Artificial Sequence
  chemically synthesized
atcttccaaggctcagttcaag

SEQ ID NO: 1124074 - DNA, 22 bp, Artificial Sequence
  chemically synthesized
acagatgatgtgcatcttgaac

SEQ ID NO: 1124075 - DNA, 22 bp, Artificial Sequence
  chemically synthesized
cacagatgatgtgcatcttgaa

SEQ ID NO: 1124076 - DNA, 22 bp, Artificial Sequence
  chemically synthesized
ccaaggctcagttcaagatgca

SEQ ID NO: 1124077 - DNA, 22 bp, Artificial Sequence
  chemically synthesized
caaggctcagttcaagatgcac

SEQ ID NO: 1124078 - DNA, 22 bp, Artificial Sequence
  chemically synthesized
agttcaagatgcacatcatctg

SEQ ID NO: 1124079 - DNA, 22 bp, Artificial Sequence
  chemically synthesized
atcaagaaaaccttcacagatg

SEQ ID NO: 1124080 - DNA, 22 bp, Artificial Sequence
  chemically synthesized
aagatgcacatcatctgtgaag

SEQ ID NO: 1124081 - DNA, 22 bp, Artificial Sequence
  chemically synthesized
tgaaggttttcttgatcaacct

SEQ ID NO: 1124082 - DNA, 22 bp, Artificial Sequence
  chemically synthesized
aaaggggaagagtagagagagg

SEQ ID NO: 1124083 - DNA, 22 bp, Artificial Sequence
  chemically synthesized
tcttgatcaacctctctctact

SEQ ID NO: 1124084 - DNA, 22 bp, Artificial Sequence
  chemically synthesized
cttgatcaacctctctctactc

SEQ ID NO: 1124085 - DNA, 22 bp, Artificial Sequence
  chemically synthesized
ttgatcaacctctctctactct

SEQ ID NO: 1124086 - DNA, 22 bp, Artificial Sequence
  chemically synthesized
gatcaacctctctctactcttc

SEQ ID NO: 1124087 - DNA, 22 bp, Artificial Sequence
  chemically synthesized
atcaacctctctctactcttcc

SEQ ID NO: 1124088 - DNA, 22 bp, Artificial Sequence
  chemically synthesized
ccagaaggaaagttgaaagggg

SEQ ID NO: 1124089 - DNA, 22 bp, Artificial Sequence
  chemically synthesized
tctctactcttcccctttcaac

SEQ ID NO: 1124090 - DNA, 22 bp, Artificial Sequence
  chemically synthesized
cccagaaggaaagttgaaaggg

SEQ ID NO: 1124091 - DNA, 22 bp, Artificial Sequence
  chemically synthesized
tcccagaaggaaagttgaaagg

SEQ ID NO: 1124092 - DNA, 22 bp, Artificial Sequence
  chemically synthesized
tctactcttcccctttcaactt

SEQ ID NO: 1124093 - DNA, 22 bp, Artificial Sequence
  chemically synthesized
tactcttcccctttcaactttc

SEQ ID NO: 1124094 - DNA, 22 bp, Artificial Sequence
  chemically synthesized
ctcttcccctttcaactttcct

SEQ ID NO: 1124095 - DNA, 22 bp, Artificial Sequence
  chemically synthesized
ttcccctttcaactttccttct

SEQ ID NO: 1124096 - DNA, 22 bp, Artificial Sequence
  chemically synthesized
cccctttcaactttccttctgg

SEQ ID NO: 1124097 - DNA, 22 bp, Artificial Sequence
  chemically synthesized
ccctttcaactttccttctggg

SEQ ID NO: 1124098 - DNA, 22 bp, Artificial Sequence
  chemically synthesized
tcaactttccttctgggaaaac

SEQ ID NO: 1124099 - DNA, 22 bp, Artificial Sequence
  chemically synthesized
caactttccttctgggaaaact

SEQ ID NO: 1124100 - DNA, 22 bp, Artificial Sequence
  chemically synthesized
aactttccttctgggaaaactt

SEQ ID NO: 1124101 - DNA, 22 bp, Artificial Sequence
  chemically synthesized
tccttctgggaaaacttgtccc

SEQ ID NO: 1124102 - DNA, 22 bp, Artificial Sequence
  chemically synthesized
ccttctgggaaaacttgtccct

SEQ ID NO: 1124103 - DNA, 22 bp, Artificial Sequence
  chemically synthesized
cttctgggaaaacttgtccctc

SEQ ID NO: 1124104 - DNA, 22 bp, Artificial Sequence
  chemically synthesized
ctgggaaaacttgtccctctct

SEQ ID NO: 1124105 - DNA, 22 bp, Artificial Sequence
  chemically synthesized
tgggaaaacttgtccctctctg

SEQ ID NO: 1124106 - DNA, 22 bp, Artificial Sequence
  chemically synthesized
ggaaaacttgtccctctctgct

SEQ ID NO: 1124107 - DNA, 22 bp, Artificial Sequence
  chemically synthesized
gtccctctctgcttgtttccac

SEQ ID NO: 1124108 - DNA, 22 bp, Artificial Sequence
  chemically synthesized
tccctctctgcttgtttccaca

SEQ ID NO: 1124109 - DNA, 22 bp, Artificial Sequence
  chemically synthesized
aagcaaatgccatgtggaaaca

SEQ ID NO: 1124110 - DNA, 22 bp, Artificial Sequence
  chemically synthesized
aaagcaaatgccatgtggaaac

SEQ ID NO: 1124111 - DNA, 22 bp, Artificial Sequence
  chemically synthesized
taaagcaaatgccatgtggaaa

SEQ ID NO: 1124112 - DNA, 22 bp, Artificial Sequence
  chemically synthesized
ttaaagcaaatgccatgtggaa

SEQ ID NO: 1124113 - DNA, 22 bp, Artificial Sequence
  chemically synthesized
tttaaagcaaatgccatgtgga

SEQ ID NO: 1124114 - DNA, 22 bp, Artificial Sequence
  chemically synthesized
ttttaaagcaaatgccatgtgg

SEQ ID NO: 1124115 - DNA, 22 bp, Artificial Sequence
  chemically synthesized
tctgcttgtttccacatggcat

SEQ ID NO: 1124116 - DNA, 22 bp, Artificial Sequence
  chemically synthesized
tttttaaagcaaatgccatgtg

SEQ ID NO: 1124117 - DNA, 22 bp, Artificial Sequence
  chemically synthesized
ttttttaaagcaaatgccatgt

SEQ ID NO: 1124118 - DNA, 22 bp, Artificial Sequence
  chemically synthesized
tgcttgtttccacatggcattt

SEQ ID NO: 1124119 - DNA, 22 bp, Artificial Sequence
  chemically synthesized
cttgtttccacatggcatttgc

SEQ ID NO: 1124120 - DNA, 22 bp, Artificial Sequence
  chemically synthesized
gatttttttttaaagcaaatgc

SEQ ID NO: 1124121 - DNA, 22 bp, Artificial Sequence
  chemically synthesized
gtttccacatggcatttgcttt

SEQ ID NO: 1124122 - DNA, 22 bp, Artificial Sequence
  chemically synthesized
tttccacatggcatttgcttta

SEQ ID NO: 1124123 - DNA, 22 bp, Artificial Sequence
  chemically synthesized
ctcgatttttttttaaagcaaa

SEQ ID NO: 1124124 - DNA, 22 bp, Artificial Sequence
  chemically synthesized
ccacatggcatttgctttaaaa

SEQ ID NO: 1124125 - DNA, 22 bp, Artificial Sequence
  chemically synthesized
cacatggcatttgctttaaaaa

SEQ ID NO: 1124126 - DNA, 22 bp, Artificial Sequence
  chemically synthesized
ttactcgatttttttttaaagc

SEQ ID NO: 1124127 - DNA, 22 bp, Artificial Sequence
  chemically synthesized
tattactcgatttttttttaaa

SEQ ID NO: 1124128 - DNA, 22 bp, Artificial Sequence
  chemically synthesized
tattctattactcgattttttt

SEQ ID NO: 1124129 - DNA, 22 bp, Artificial Sequence
  chemically synthesized
gtattctattactcgatttttt

SEQ ID NO: 1124130 - DNA, 22 bp, Artificial Sequence
  chemically synthesized
gctttaaaaaaaaatcgagtaa

SEQ ID NO: 1124131 - DNA, 22 bp, Artificial Sequence
  chemically synthesized
ctttaaaaaaaaatcgagtaat

SEQ ID NO: 1124132 - DNA, 22 bp, Artificial Sequence
  chemically synthesized
aatttgtattctattactcgat

SEQ ID NO: 1124133 - DNA, 22 bp, Artificial Sequence
  chemically synthesized
taaaaaaaaatcgagtaataga

SEQ ID NO: 1124134 - DNA, 22 bp, Artificial Sequence
  chemically synthesized
aaaaaaaaatcgagtaatagaa

SEQ ID NO: 1124135 - DNA, 22 bp, Artificial Sequence
  chemically synthesized
aaaaaaaatcgagtaatagaat

SEQ ID NO: 1124136 - DNA, 22 bp, Artificial Sequence
  chemically synthesized
atgcaaattgaatttgtattct

SEQ ID NO: 1124137 - DNA, 22 bp, Artificial Sequence
  chemically synthesized
gatgcaaattgaatttgtattc

SEQ ID NO: 1124138 - DNA, 22 bp, Artificial Sequence
  chemically synthesized
tttgatgcaaattgaatttgta

SEQ ID NO: 1124139 - DNA, 22 bp, Artificial Sequence
  chemically synthesized
taagatctatttgatgcaaatt

SEQ ID NO: 1124140 - DNA, 22 bp, Artificial Sequence
  chemically synthesized
ataagatctatttgatgcaaat

SEQ ID NO: 1124141 - DNA, 22 bp, Artificial Sequence
  chemically synthesized
tataagatctatttgatgcaaa

SEQ ID NO: 1124142 - DNA, 22 bp, Artificial Sequence
  chemically synthesized
ttataagatctatttgatgcaa

SEQ ID NO: 1124143 - DNA, 22 bp, Artificial Sequence
  chemically synthesized
atatttttataagatctatttg

SEQ ID NO: 1124144 - DNA, 22 bp, Artificial Sequence
  chemically synthesized
gatatttttataagatctattt

SEQ ID NO: 1124145 - DNA, 22 bp, Artificial Sequence
  chemically synthesized
aatttgcatcaaatagatctta

SEQ ID NO: 1124146 - DNA, 22 bp, Artificial Sequence
  chemically synthesized
atttgatatttttataagatct

SEQ ID NO: 1124147 - DNA, 22 bp, Artificial Sequence
  chemically synthesized
catttgatatttttataagatc

SEQ ID NO: 1124148 - DNA, 22 bp, Artificial Sequence
  chemically synthesized
gcatcaaatagatcttataaaa

SEQ ID NO: 1124149 - DNA, 22 bp, Artificial Sequence
  chemically synthesized
catcaaatagatcttataaaaa

SEQ ID NO: 1124150 - DNA, 22 bp, Artificial Sequence
  chemically synthesized
aatttcatttgatatttttata

SEQ ID NO: 1124151 - DNA, 22 bp, Artificial Sequence
  chemically synthesized
tactgaatttcatttgatattt

SEQ ID NO: 1124152 - DNA, 22 bp, Artificial Sequence
  chemically synthesized
atactgaatttcatttgatatt

SEQ ID NO: 1124153 - DNA, 22 bp, Artificial Sequence
  chemically synthesized
ataaaaatatcaaatgaaattc

SEQ ID NO: 1124154 - DNA, 22 bp, Artificial Sequence
  chemically synthesized
taaaaatatcaaatgaaattca

SEQ ID NO: 1124155 - DNA, 22 bp, Artificial Sequence
  chemically synthesized
ataggatttatactgaatttca

SEQ ID NO: 1124156 - DNA, 22 bp, Artificial Sequence
  chemically synthesized
gaactaataggatttatactga

SEQ ID NO: 1124157 - DNA, 22 bp, Artificial Sequence
  chemically synthesized
agaactaataggatttatactg

SEQ ID NO: 1124158 - DNA, 22 bp, Artificial Sequence
  chemically synthesized
tagaactaataggatttatact

SEQ ID NO: 1124159 - DNA, 22 bp, Artificial Sequence
  chemically synthesized
ttagaactaataggatttatac

SEQ ID NO: 1124160 - DNA, 22 bp, Artificial Sequence
  chemically synthesized
aaaatatttttagaactaatag

SEQ ID NO: 1124161 - DNA, 22 bp, Artificial Sequence
  chemically synthesized
agtataaatcctattagttcta

SEQ ID NO: 1124162 - DNA, 22 bp, Artificial Sequence
  chemically synthesized
aaagtcctaaaaatatttttag

SEQ ID NO: 1124163 - DNA, 22 bp, Artificial Sequence
  chemically synthesized
ttagttctaaaaatatttttag

SEQ ID NO: 1124164 - DNA, 22 bp, Artificial Sequence
  chemically synthesized
gttctaaaaatatttttaggac

SEQ ID NO: 1124165 - DNA, 22 bp, Artificial Sequence
  chemically synthesized
taaaaatatttttaggactttg

SEQ ID NO: 1124166 - DNA, 22 bp, Artificial Sequence
  chemically synthesized
aaaatatttttaggactttgag

SEQ ID NO: 1124167 - DNA, 22 bp, Artificial Sequence
  chemically synthesized
ccatgtagtcaatgcatctcaa

SEQ ID NO: 1124168 - DNA, 22 bp, Artificial Sequence
  chemically synthesized
ttaggactttgagatgcattga

SEQ ID NO: 1124169 - DNA, 22 bp, Artificial Sequence
  chemically synthesized
taggactttgagatgcattgac

SEQ ID NO: 1124170 - DNA, 22 bp, Artificial Sequence
  chemically synthesized
aggactttgagatgcattgact

SEQ ID NO: 1124171 - DNA, 22 bp, Artificial Sequence
  chemically synthesized
ggactttgagatgcattgacta

SEQ ID NO: 1124172 - DNA, 22 bp, Artificial Sequence
  chemically synthesized
tgagatgcattgactacatggc

SEQ ID NO: 1124173 - DNA, 22 bp, Artificial Sequence
  chemically synthesized
gagatgcattgactacatggca

SEQ ID NO: 1124174 - DNA, 22 bp, Artificial Sequence
  chemically synthesized
agatgcattgactacatggcaa

SEQ ID NO: 1124175 - DNA, 22 bp, Artificial Sequence
  chemically synthesized
caaaaatataataattgccatg

SEQ ID NO: 1124176 - DNA, 22 bp, Artificial Sequence
  chemically synthesized
taattccaaaaatataataatt

SEQ ID NO: 1124177 - DNA, 22 bp, Artificial Sequence
  chemically synthesized
actacatggcaattattatatt

SEQ ID NO: 1124178 - DNA, 22 bp, Artificial Sequence
  chemically synthesized
tgtaattccaaaaatataataa

SEQ ID NO: 1124179 - DNA, 22 bp, Artificial Sequence
  chemically synthesized
catggcaattattatatttttg

SEQ ID NO: 1124180 - DNA, 22 bp, Artificial Sequence
  chemically synthesized
ataatattctgtaattccaaaa

SEQ ID NO: 1124181 - DNA, 22 bp, Artificial Sequence
  chemically synthesized
aataatattctgtaattccaaa

SEQ ID NO: 1124182 - DNA, 22 bp, Artificial Sequence
  chemically synthesized
taataatattctgtaattccaa

SEQ ID NO: 1124183 - DNA, 22 bp, Artificial Sequence
  chemically synthesized
ttatatttttggaattacagaa

SEQ ID NO: 1124184 - DNA, 22 bp, Artificial Sequence
  chemically synthesized
ccctttaataatattctgtaat

SEQ ID NO: 1124185 - DNA, 22 bp, Artificial Sequence
  chemically synthesized
cccctttaataatattctgtaa

SEQ ID NO: 1124186 - DNA, 22 bp, Artificial Sequence
  chemically synthesized
tatttttggaattacagaatat

SEQ ID NO: 1124187 - DNA, 22 bp, Artificial Sequence
  chemically synthesized
ttggaattacagaatattatta

SEQ ID NO: 1124188 - DNA, 22 bp, Artificial Sequence
  chemically synthesized
tggaattacagaatattattaa

SEQ ID NO: 1124189 - DNA, 22 bp, Artificial Sequence
  chemically synthesized
ggaattacagaatattattaaa

SEQ ID NO: 1124190 - DNA, 22 bp, Artificial Sequence
  chemically synthesized
gaattacagaatattattaaag

SEQ ID NO: 1124191 - DNA, 22 bp, Artificial Sequence
  chemically synthesized
aataggatttcccctttaataa

SEQ ID NO: 1124192 - DNA, 22 bp, Artificial Sequence
  chemically synthesized
gttaaataggatttccccttta

SEQ ID NO: 1124193 - DNA, 22 bp, Artificial Sequence
  chemically synthesized
cagaatattattaaaggggaaa

SEQ ID NO: 1124194 - DNA, 22 bp, Artificial Sequence
  chemically synthesized
ggttaaataggatttccccttt

SEQ ID NO: 1124195 - DNA, 22 bp, Artificial Sequence
  chemically synthesized
tggttaaataggatttcccctt

SEQ ID NO: 1124196 - DNA, 22 bp, Artificial Sequence
  chemically synthesized
ttggttaaataggatttcccct

SEQ ID NO: 1124197 - DNA, 22 bp, Artificial Sequence
  chemically synthesized
ttttggttaaataggatttccc

SEQ ID NO: 1124198 - DNA, 22 bp, Artificial Sequence
  chemically synthesized
cttttggttaaataggatttcc

SEQ ID NO: 1124199 - DNA, 22 bp, Artificial Sequence
  chemically synthesized
tcttttggttaaataggatttc

SEQ ID NO: 1124200 - DNA, 22 bp, Artificial Sequence
  chemically synthesized
ttttcttttggttaaataggat

SEQ ID NO: 1124201 - DNA, 22 bp, Artificial Sequence
  chemically synthesized
ttaaaggggaaatcctatttaa

SEQ ID NO: 1124202 - DNA, 22 bp, Artificial Sequence
  chemically synthesized
gttttcttttggttaaatagga

SEQ ID NO: 1124203 - DNA, 22 bp, Artificial Sequence
  chemically synthesized
aaggggaaatcctatttaacca

SEQ ID NO: 1124204 - DNA, 22 bp, Artificial Sequence
  chemically synthesized
gcttgttttcttttggttaaat

SEQ ID NO: 1124205 - DNA, 22 bp, Artificial Sequence
  chemically synthesized
aatattagcttgttttcttttg

SEQ ID NO: 1124206 - DNA, 22 bp, Artificial Sequence
  chemically synthesized
tctaaatattagcttgttttct

SEQ ID NO: 1124207 - DNA, 22 bp, Artificial Sequence
  chemically synthesized
atctaaatattagcttgttttc

SEQ ID NO: 1124208 - DNA, 22 bp, Artificial Sequence
  chemically synthesized
tttaaccaaaagaaaacaagct

SEQ ID NO: 1124209 - DNA, 22 bp, Artificial Sequence
  chemically synthesized
tttatctaaatattagcttgtt

SEQ ID NO: 1124210 - DNA, 22 bp, Artificial Sequence
  chemically synthesized
aaccaaaagaaaacaagctaat

SEQ ID NO: 1124211 - DNA, 22 bp, Artificial Sequence
  chemically synthesized
accaaaagaaaacaagctaata

SEQ ID NO: 1124212 - DNA, 22 bp, Artificial Sequence
  chemically synthesized
gagagggaactatttatctaaa

SEQ ID NO: 1124213 - DNA, 22 bp, Artificial Sequence
  chemically synthesized
ggagagggaactatttatctaa

SEQ ID NO: 1124214 - DNA, 22 bp, Artificial Sequence
  chemically synthesized
atttggagagggaactatttat

SEQ ID NO: 1124215 - DNA, 22 bp, Artificial Sequence
  chemically synthesized
gatttggagagggaactattta

SEQ ID NO: 1124216 - DNA, 22 bp, Artificial Sequence
  chemically synthesized
atatttagataaatagttccct

SEQ ID NO: 1124217 - DNA, 22 bp, Artificial Sequence
  chemically synthesized
tcttgatttggagagggaacta

SEQ ID NO: 1124218 - DNA, 22 bp, Artificial Sequence
  chemically synthesized
agataaatagttccctctccaa

SEQ ID NO: 1124219 - DNA, 22 bp, Artificial Sequence
  chemically synthesized
gataaatagttccctctccaaa

SEQ ID NO: 1124220 - DNA, 22 bp, Artificial Sequence
  chemically synthesized
cctctccaaatcaagatagttt

SEQ ID NO: 1124221 - DNA, 22 bp, Artificial Sequence
  chemically synthesized
tgtgtgtgtatacaaactatct

SEQ ID NO: 1124222 - DNA, 22 bp, Artificial Sequence
  chemically synthesized
tccaaatcaagatagtttgtat

SEQ ID NO: 1124223 - DNA, 22 bp, Artificial Sequence
  chemically synthesized
caaatcaagatagtttgtatac

SEQ ID NO: 1124224 - DNA, 22 bp, Artificial Sequence
  chemically synthesized
tacaaacgtgtatgtgttgtgt

SEQ ID NO: 1124225 - DNA, 22 bp, Artificial Sequence
  chemically synthesized
gtatacacacacacaacacata

SEQ ID NO: 1124226 - DNA, 22 bp, Artificial Sequence
  chemically synthesized
tatacacacacacaacacatac

SEQ ID NO: 1124227 - DNA, 22 bp, Artificial Sequence
  chemically synthesized
cactatacaaacgtgtatgtgt

SEQ ID NO: 1124228 - DNA, 22 bp, Artificial Sequence
  chemically synthesized
acactatacaaacgtgtatgtg

SEQ ID NO: 1124229 - DNA, 22 bp, Artificial Sequence
  chemically synthesized
cacagagggagacacacttaca

SEQ ID NO: 1124230 - DNA, 22 bp, Artificial Sequence
  chemically synthesized
ccacagagggagacacacttac

SEQ ID NO: 1124231 - DNA, 22 bp, Artificial Sequence
  chemically synthesized
gtatagtgtaagtgtgtctccc

SEQ ID NO: 1124232 - DNA, 22 bp, Artificial Sequence
  chemically synthesized
tatagtgtaagtgtgtctccct

SEQ ID NO: 1124233 - DNA, 22 bp, Artificial Sequence
  chemically synthesized
cccccttccacagagggagaca

SEQ ID NO: 1124234 - DNA, 22 bp, Artificial Sequence
  chemically synthesized
ccccccttccacagagggagac

SEQ ID NO: 1124235 - DNA, 22 bp, Artificial Sequence
  chemically synthesized
tcttccccccttccacagaggg

SEQ ID NO: 1124236 - DNA, 22 bp, Artificial Sequence
  chemically synthesized
cctctgtggaaggggggaagat

SEQ ID NO: 1124237 - DNA, 22 bp, Artificial Sequence
  chemically synthesized
tgtggaaggggggaagataggg

SEQ ID NO: 1124238 - DNA, 22 bp, Artificial Sequence
  chemically synthesized
tggaaggggggaagatagggcc

SEQ ID NO: 1124239 - DNA, 22 bp, Artificial Sequence
  chemically synthesized
caaaatacaagacaatcatgtg

SEQ ID NO: 1124240 - DNA, 22 bp, Artificial Sequence
  chemically synthesized
tcttgtattttgtaatatgtgt

SEQ ID NO: 1124241 - DNA, 22 bp, Artificial Sequence
  chemically synthesized
gtattttgtaatatgtgtgata

SEQ ID NO: 1124242 - DNA, 22 bp, Artificial Sequence
  chemically synthesized
tattttgtaatatgtgtgatac

SEQ ID NO: 1124243 - DNA, 22 bp, Artificial Sequence
  chemically synthesized
tgtaatatgtgtgatacgtgtg

SEQ ID NO: 1124244 - DNA, 22 bp, Artificial Sequence
  chemically synthesized
gtaatatgtgtgatacgtgtgt

SEQ ID NO: 1124245 - DNA, 22 bp, Artificial Sequence
  chemically synthesized
taatatgtgtgatacgtgtgtg

SEQ ID NO: 1124246 - DNA, 22 bp, Artificial Sequence
  chemically synthesized
aacatacacacaaacacacacg

SEQ ID NO: 1124247 - DNA, 22 bp, Artificial Sequence
  chemically synthesized
aaacatacacacaaacacacac

SEQ ID NO: 1124248 - DNA, 22 bp, Artificial Sequence
  chemically synthesized
aagcaacttaaacatacacaca

SEQ ID NO: 1124249 - DNA, 22 bp, Artificial Sequence
  chemically synthesized
aaagcaacttaaacatacacac

SEQ ID NO: 1124250 - DNA, 22 bp, Artificial Sequence
  chemically synthesized
catttaaagcaacttaaacata

SEQ ID NO: 1124251 - DNA, 22 bp, Artificial Sequence
  chemically synthesized
acatttaaagcaacttaaacat

SEQ ID NO: 1124252 - DNA, 22 bp, Artificial Sequence
  chemically synthesized
tacatttaaagcaacttaaaca

SEQ ID NO: 1124253 - DNA, 22 bp, Artificial Sequence
  chemically synthesized
ctttacatttaaagcaacttaa

SEQ ID NO: 1124254 - DNA, 22 bp, Artificial Sequence
  chemically synthesized
actttacatttaaagcaactta

SEQ ID NO: 1124255 - DNA, 22 bp, Artificial Sequence
  chemically synthesized
gtgtgtatgtttaagttgcttt

SEQ ID NO: 1124256 - DNA, 22 bp, Artificial Sequence
  chemically synthesized
tgtgtatgtttaagttgcttta

SEQ ID NO: 1124257 - DNA, 22 bp, Artificial Sequence
  chemically synthesized
aatgcacatttactttacattt

SEQ ID NO: 1124258 - DNA, 22 bp, Artificial Sequence
  chemically synthesized
aaatgcacatttactttacatt

SEQ ID NO: 1124259 - DNA, 22 bp, Artificial Sequence
  chemically synthesized
aagttgctttaaatgtaaagta

SEQ ID NO: 1124260 - DNA, 22 bp, Artificial Sequence
  chemically synthesized
taaatgcacatttactttacat

SEQ ID NO: 1124261 - DNA, 22 bp, Artificial Sequence
  chemically synthesized
agttgctttaaatgtaaagtaa

SEQ ID NO: 1124262 - DNA, 22 bp, Artificial Sequence
  chemically synthesized
ttaaatgcacatttactttaca

SEQ ID NO: 1124263 - DNA, 22 bp, Artificial Sequence
  chemically synthesized
ctttaaatgtaaagtaaatgtg

SEQ ID NO: 1124264 - DNA, 22 bp, Artificial Sequence
  chemically synthesized
taaatgtaaagtaaatgtgcat

SEQ ID NO: 1124265 - DNA, 22 bp, Artificial Sequence
  chemically synthesized
aaatgtaaagtaaatgtgcatt

SEQ ID NO: 1124266 - DNA, 22 bp, Artificial Sequence
  chemically synthesized
agtatatttttaaatgcacatt

SEQ ID NO: 1124267 - DNA, 22 bp, Artificial Sequence
  chemically synthesized
aatgtaaagtaaatgtgcattt

SEQ ID NO: 1124268 - DNA, 22 bp, Artificial Sequence
  chemically synthesized
agctcagtatatttttaaatgc

SEQ ID NO: 1124269 - DNA, 22 bp, Artificial Sequence
  chemically synthesized
gccctcagctcagtatattttt

SEQ ID NO: 1124270 - DNA, 22 bp, Artificial Sequence
  chemically synthesized
aaaaatatactgagctgagggc

SEQ ID NO: 1124271 - DNA, 22 bp, Artificial Sequence
  chemically synthesized
aaaatatactgagctgagggcc

SEQ ID NO: 1124272 - DNA, 22 bp, Artificial Sequence
  chemically synthesized
caggcatgagccgccacgcctg

SEQ ID NO: 1124273 - DNA, 22 bp, Artificial Sequence
  chemically synthesized
agctgagggccaggcgtggcgg

SEQ ID NO: 1124274 - DNA, 22 bp, Artificial Sequence
  chemically synthesized
gaattacaggcatgagccgcca

SEQ ID NO: 1124275 - DNA, 22 bp, Artificial Sequence
  chemically synthesized
agggccaggcgtggcggctcat

SEQ ID NO: 1124276 - DNA, 22 bp, Artificial Sequence
  chemically synthesized
aaagtgctggaattacaggcat

SEQ ID NO: 1124277 - DNA, 22 bp, Artificial Sequence
  chemically synthesized
tcaaagtgctggaattacaggc

SEQ ID NO: 1124278 - DNA, 22 bp, Artificial Sequence
  chemically synthesized
ggcctctcaaagtgctggaatt

SEQ ID NO: 1124279 - DNA, 22 bp, Artificial Sequence
  chemically synthesized
atgcctgtaattccagcacttt

SEQ ID NO: 1124280 - DNA, 22 bp, Artificial Sequence
  chemically synthesized
cccgcctcggcctctcaaagtg

SEQ ID NO: 1124281 - DNA, 22 bp, Artificial Sequence
  chemically synthesized
taattccagcactttgagaggc

SEQ ID NO: 1124282 - DNA, 22 bp, Artificial Sequence
  chemically synthesized
cagcactttgagaggccgaggc

SEQ ID NO: 1124283 - DNA, 22 bp, Artificial Sequence
  chemically synthesized
aagtgaactgcccgcctcggcc

SEQ ID NO: 1124284 - DNA, 22 bp, Artificial Sequence
  chemically synthesized
acctcaagtgaactgcccgcct

SEQ ID NO: 1124285 - DNA, 22 bp, Artificial Sequence
  chemically synthesized
tgagaggccgaggcgggcagtt

SEQ ID NO: 1124286 - DNA, 22 bp, Artificial Sequence
  chemically synthesized
gagaggccgaggcgggcagttc

SEQ ID NO: 1124287 - DNA, 22 bp, Artificial Sequence
  chemically synthesized
ctgacctcaagtgaactgcccg

SEQ ID NO: 1124288 - DNA, 22 bp, Artificial Sequence
  chemically synthesized
agaggccgaggcgggcagttca

SEQ ID NO: 1124289 - DNA, 22 bp, Artificial Sequence
  chemically synthesized
aactcctgacctcaagtgaact

SEQ ID NO: 1124290 - DNA, 22 bp, Artificial Sequence
  chemically synthesized
gtcctgaactcctgacctcaag

SEQ ID NO: 1124291 - DNA, 22 bp, Artificial Sequence
  chemically synthesized
acttgaggtcaggagttcagga

SEQ ID NO: 1124292 - DNA, 22 bp, Artificial Sequence
  chemically synthesized
gaggtcaggagttcaggaccaa

SEQ ID NO: 1124293 - DNA, 22 bp, Artificial Sequence
  chemically synthesized
aggtcaggagttcaggaccaac

SEQ ID NO: 1124294 - DNA, 22 bp, Artificial Sequence
  chemically synthesized
gtcatggtggccaggttggtcc

SEQ ID NO: 1124295 - DNA, 22 bp, Artificial Sequence
  chemically synthesized
cgtcatggtggccaggttggtc

SEQ ID NO: 1124296 - DNA, 22 bp, Artificial Sequence
  chemically synthesized
aggaccaacctggccaccatga

SEQ ID NO: 1124297 - DNA, 22 bp, Artificial Sequence
  chemically synthesized
gtagagacggggtttcgtcatg

SEQ ID NO: 1124298 - DNA, 22 bp, Artificial Sequence
  chemically synthesized
agtagagacggggtttcgtcat

SEQ ID NO: 1124299 - DNA, 22 bp, Artificial Sequence
  chemically synthesized
tagtagagacggggtttcgtca

SEQ ID NO: 1124300 - DNA, 22 bp, Artificial Sequence
  chemically synthesized
ttagtagagacggggtttcgtc

SEQ ID NO: 1124301 - DNA, 22 bp, Artificial Sequence
  chemically synthesized
gccaccatgacgaaaccccgtc

SEQ ID NO: 1124302 - DNA, 22 bp, Artificial Sequence
  chemically synthesized
tatttttagtagagacggggtt

SEQ ID NO: 1124303 - DNA, 22 bp, Artificial Sequence
  chemically synthesized
gtatttttagtagagacggggt

SEQ ID NO: 1124304 - DNA, 22 bp, Artificial Sequence
  chemically synthesized
tgtatttttagtagagacgggg

SEQ ID NO: 1124305 - DNA, 22 bp, Artificial Sequence
  chemically synthesized
ttgtatttttagtagagacggg

SEQ ID NO: 1124306 - DNA, 22 bp, Artificial Sequence
  chemically synthesized
atttttgtatttttagtagaga

SEQ ID NO: 1124307 - DNA, 22 bp, Artificial Sequence
  chemically synthesized
gctaatttttgtatttttagta

SEQ ID NO: 1124308 - DNA, 22 bp, Artificial Sequence
  chemically synthesized
tactaaaaatacaaaaattagc

SEQ ID NO: 1124309 - DNA, 22 bp, Artificial Sequence
  chemically synthesized
ctaaaaatacaaaaattagcca

SEQ ID NO: 1124310 - DNA, 22 bp, Artificial Sequence
  chemically synthesized
aaaatacaaaaattagccagct

SEQ ID NO: 1124311 - DNA, 22 bp, Artificial Sequence
  chemically synthesized
caggtgcccaccaccacagctg

SEQ ID NO: 1124312 - DNA, 22 bp, Artificial Sequence
  chemically synthesized
ggattacaggtgcccaccacca

SEQ ID NO: 1124313 - DNA, 22 bp, Artificial Sequence
  chemically synthesized
gccagctgtggtggtgggcacc

SEQ ID NO: 1124314 - DNA, 22 bp, Artificial Sequence
  chemically synthesized
ccgagtagctgggattacaggt

SEQ ID NO: 1124315 - DNA, 22 bp, Artificial Sequence
  chemically synthesized
tggtggtgggcacctgtaatcc

SEQ ID NO: 1124316 - DNA, 22 bp, Artificial Sequence
  chemically synthesized
agcctcccgagtagctgggatt

SEQ ID NO: 1124317 - DNA, 22 bp, Artificial Sequence
  chemically synthesized
cctcagcctcccgagtagctgg

SEQ ID NO: 1124318 - DNA, 22 bp, Artificial Sequence
  chemically synthesized
ctgcctcagcctcccgagtagc

SEQ ID NO: 1124319 - DNA, 22 bp, Artificial Sequence
  chemically synthesized
tcctgcctcagcctcccgagta

SEQ ID NO: 1124320 - DNA, 22 bp, Artificial Sequence
  chemically synthesized
taatcccagctactcgggaggc

SEQ ID NO: 1124321 - DNA, 22 bp, Artificial Sequence
  chemically synthesized
aagcaattctcctgcctcagcc

SEQ ID NO: 1124322 - DNA, 22 bp, Artificial Sequence
  chemically synthesized
gttcaagcaattctcctgcctc

SEQ ID NO: 1124323 - DNA, 22 bp, Artificial Sequence
  chemically synthesized
ctcgggaggctgaggcaggaga

SEQ ID NO: 1124324 - DNA, 22 bp, Artificial Sequence
  chemically synthesized
gggaggctgaggcaggagaatt

SEQ ID NO: 1124325 - DNA, 22 bp, Artificial Sequence
  chemically synthesized
cctggttcaagcaattctcctg

SEQ ID NO: 1124326 - DNA, 22 bp, Artificial Sequence
  chemically synthesized
cctccctggttcaagcaattct

SEQ ID NO: 1124327 - DNA, 22 bp, Artificial Sequence
  chemically synthesized
tgcctccctggttcaagcaatt

SEQ ID NO: 1124328 - DNA, 22 bp, Artificial Sequence
  chemically synthesized
ctgcctccctggttcaagcaat

SEQ ID NO: 1124329 - DNA, 22 bp, Artificial Sequence
  chemically synthesized
aggcaggagaattgcttgaacc

SEQ ID NO: 1124330 - DNA, 22 bp, Artificial Sequence
  chemically synthesized
caacttctgcctccctggttca

SEQ ID NO: 1124331 - DNA, 22 bp, Artificial Sequence
  chemically synthesized
actgcaacttctgcctccctgg

SEQ ID NO: 1124332 - DNA, 22 bp, Artificial Sequence
  chemically synthesized
gctcactgcaacttctgcctcc

SEQ ID NO: 1124333 - DNA, 22 bp, Artificial Sequence
  chemically synthesized
ggctcactgcaacttctgcctc

SEQ ID NO: 1124334 - DNA, 22 bp, Artificial Sequence
  chemically synthesized
cttgaaccagggaggcagaagt

SEQ ID NO: 1124335 - DNA, 22 bp, Artificial Sequence
  chemically synthesized
gaaccagggaggcagaagttgc

SEQ ID NO: 1124336 - DNA, 22 bp, Artificial Sequence
  chemically synthesized
aaccagggaggcagaagttgca

SEQ ID NO: 1124337 - DNA, 22 bp, Artificial Sequence
  chemically synthesized
gaatgtagtggcacaatcttgg

SEQ ID NO: 1124338 - DNA, 22 bp, Artificial Sequence
  chemically synthesized
cagtgagccaagattgtgccac

SEQ ID NO: 1124339 - DNA, 22 bp, Artificial Sequence
  chemically synthesized
cccaggctggaatgtagtggca

SEQ ID NO: 1124340 - DNA, 22 bp, Artificial Sequence
  chemically synthesized
ttgcccaggctggaatgtagtg

SEQ ID NO: 1124341 - DNA, 22 bp, Artificial Sequence
  chemically synthesized
tgttgcccaggctggaatgtag

SEQ ID NO: 1124342 - DNA, 22 bp, Artificial Sequence
  chemically synthesized
gttctgttgcccaggctggaat

SEQ ID NO: 1124343 - DNA, 22 bp, Artificial Sequence
  chemically synthesized
tgccactacattccagcctggg

SEQ ID NO: 1124344 - DNA, 22 bp, Artificial Sequence
  chemically synthesized
agtctcgttctgttgcccaggc

SEQ ID NO: 1124345 - DNA, 22 bp, Artificial Sequence
  chemically synthesized
cattccagcctgggcaacagaa

SEQ ID NO: 1124346 - DNA, 22 bp, Artificial Sequence
  chemically synthesized
agactgagtctcgttctgttgc

SEQ ID NO: 1124347 - DNA, 22 bp, Artificial Sequence
  chemically synthesized
gagactgagtctcgttctgttg

SEQ ID NO: 1124348 - DNA, 22 bp, Artificial Sequence
  chemically synthesized
tgagactgagtctcgttctgtt

SEQ ID NO: 1124349 - DNA, 22 bp, Artificial Sequence
  chemically synthesized
ttgagactgagtctcgttctgt

SEQ ID NO: 1124350 - DNA, 22 bp, Artificial Sequence
  chemically synthesized
cagcctgggcaacagaacgaga

SEQ ID NO: 1124351 - DNA, 22 bp, Artificial Sequence
  chemically synthesized
tttgagactgagtctcgttctg

SEQ ID NO: 1124352 - DNA, 22 bp, Artificial Sequence
  chemically synthesized
ttttgagactgagtctcgttct

SEQ ID NO: 1124353 - DNA, 22 bp, Artificial Sequence
  chemically synthesized
ttttttgagactgagtctcgtt

SEQ ID NO: 1124354 - DNA, 22 bp, Artificial Sequence
  chemically synthesized
cttttttgagactgagtctcgt

SEQ ID NO: 1124355 - DNA, 22 bp, Artificial Sequence
  chemically synthesized
tcttttttgagactgagtctcg

SEQ ID NO: 1124356 - DNA, 22 bp, Artificial Sequence
  chemically synthesized
ttcttttttgagactgagtctc

SEQ ID NO: 1124357 - DNA, 22 bp, Artificial Sequence
  chemically synthesized
ggcaacagaacgagactcagtc

SEQ ID NO: 1124358 - DNA, 22 bp, Artificial Sequence
  chemically synthesized
tttcttttttgagactgagtct

SEQ ID NO: 1124359 - DNA, 22 bp, Artificial Sequence
  chemically synthesized
ttttcttttttgagactgagtc

SEQ ID NO: 1124360 - DNA, 22 bp, Artificial Sequence
  chemically synthesized
tttttcttttttgagactgagt

SEQ ID NO: 1124361 - DNA, 22 bp, Artificial Sequence
  chemically synthesized
ttttttcttttttgagactgag

SEQ ID NO: 1124362 - DNA, 22 bp, Artificial Sequence
  chemically synthesized
tttttttttcttttttgagact

SEQ ID NO: 1124363 - DNA, 22 bp, Artificial Sequence
  chemically synthesized
tgttatttttttttcttttttg

SEQ ID NO: 1124364 - DNA, 22 bp, Artificial Sequence
  chemically synthesized
agtctcaaaaaagaaaaaaaaa

SEQ ID NO: 1124365 - DNA, 22 bp, Artificial Sequence
  chemically synthesized
aaaaaagaaaaaaaaataacat

SEQ ID NO: 1124366 - DNA, 22 bp, Artificial Sequence
  chemically synthesized
cacacacatatatagctatgtt

SEQ ID NO: 1124367 - DNA, 22 bp, Artificial Sequence
  chemically synthesized
acacacacatatatagctatgt

SEQ ID NO: 1124368 - DNA, 22 bp, Artificial Sequence
  chemically synthesized
atttacacacacatatatagct

SEQ ID NO: 1124369 - DNA, 22 bp, Artificial Sequence
  chemically synthesized
tggtgcctgatttacacacaca

SEQ ID NO: 1124370 - DNA, 22 bp, Artificial Sequence
  chemically synthesized
aaacctgtggtgcctgatttac

SEQ ID NO: 1124371 - DNA, 22 bp, Artificial Sequence
  chemically synthesized
tatatgtgtgtgtaaatcaggc

SEQ ID NO: 1124372 - DNA, 22 bp, Artificial Sequence
  chemically synthesized
gggattaaaacctgtggtgcct

SEQ ID NO: 1124373 - DNA, 22 bp, Artificial Sequence
  chemically synthesized
taatccctaatttttatctttc

SEQ ID NO: 1124374 - DNA, 22 bp, Artificial Sequence
  chemically synthesized
aatccctaatttttatctttct

SEQ ID NO: 1124375 - DNA, 22 bp, Artificial Sequence
  chemically synthesized
atccctaatttttatctttctg

SEQ ID NO: 1124376 - DNA, 22 bp, Artificial Sequence
  chemically synthesized
cccaagaaaataccagaaagat

SEQ ID NO: 1124377 - DNA, 22 bp, Artificial Sequence
  chemically synthesized
acccaagaaaataccagaaaga

SEQ ID NO: 1124378 - DNA, 22 bp, Artificial Sequence
  chemically synthesized
atttacccaagaaaataccaga

SEQ ID NO: 1124379 - DNA, 22 bp, Artificial Sequence
  chemically synthesized
atttttatctttctggtatttt

SEQ ID NO: 1124380 - DNA, 22 bp, Artificial Sequence
  chemically synthesized
ttatctttctggtattttcttg

SEQ ID NO: 1124381 - DNA, 22 bp, Artificial Sequence
  chemically synthesized
tatctttctggtattttcttgg

SEQ ID NO: 1124382 - DNA, 22 bp, Artificial Sequence
  chemically synthesized
atctttctggtattttcttggg

SEQ ID NO: 1124383 - DNA, 22 bp, Artificial Sequence
  chemically synthesized
tctttctggtattttcttgggt

SEQ ID NO: 1124384 - DNA, 22 bp, Artificial Sequence
  chemically synthesized
tctggtattttcttgggtaaat

SEQ ID NO: 1124385 - DNA, 22 bp, Artificial Sequence
  chemically synthesized
ctggtattttcttgggtaaatt

SEQ ID NO: 1124386 - DNA, 22 bp, Artificial Sequence
  chemically synthesized
tggtattttcttgggtaaatta

SEQ ID NO: 1124387 - DNA, 22 bp, Artificial Sequence
  chemically synthesized
gtattttcttgggtaaattaat

SEQ ID NO: 1124388 - DNA, 22 bp, Artificial Sequence
  chemically synthesized
aagatcgaagaaattaatttac

SEQ ID NO: 1124389 - DNA, 22 bp, Artificial Sequence
  chemically synthesized
tcttgggtaaattaatttcttc

SEQ ID NO: 1124390 - DNA, 22 bp, Artificial Sequence
  chemically synthesized
cttgggtaaattaatttcttcg

SEQ ID NO: 1124391 - DNA, 22 bp, Artificial Sequence
  chemically synthesized
ttgggtaaattaatttcttcga

SEQ ID NO: 1124392 - DNA, 22 bp, Artificial Sequence
  chemically synthesized
gggtaaattaatttcttcgatc

SEQ ID NO: 1124393 - DNA, 22 bp, Artificial Sequence
  chemically synthesized
ggtaaattaatttcttcgatct

SEQ ID NO: 1124394 - DNA, 22 bp, Artificial Sequence
  chemically synthesized
aagcaagaagtcgctgaagatc

SEQ ID NO: 1124395 - DNA, 22 bp, Artificial Sequence
  chemically synthesized
aaagcaagaagtcgctgaagat

SEQ ID NO: 1124396 - DNA, 22 bp, Artificial Sequence
  chemically synthesized
atttcttcgatcttcagcgact

SEQ ID NO: 1124397 - DNA, 22 bp, Artificial Sequence
  chemically synthesized
caatttaaagcaagaagtcgct

SEQ ID NO: 1124398 - DNA, 22 bp, Artificial Sequence
  chemically synthesized
cttcgatcttcagcgacttctt

SEQ ID NO: 1124399 - DNA, 22 bp, Artificial Sequence
  chemically synthesized
acaatttaaagcaagaagtcgc

SEQ ID NO: 1124400 - DNA, 22 bp, Artificial Sequence
  chemically synthesized
ttcgatcttcagcgacttcttg

SEQ ID NO: 1124401 - DNA, 22 bp, Artificial Sequence
  chemically synthesized
tacaatttaaagcaagaagtcg

SEQ ID NO: 1124402 - DNA, 22 bp, Artificial Sequence
  chemically synthesized
ttacaatttaaagcaagaagtc

SEQ ID NO: 1124403 - DNA, 22 bp, Artificial Sequence
  chemically synthesized
cgatcttcagcgacttcttgct

SEQ ID NO: 1124404 - DNA, 22 bp, Artificial Sequence
  chemically synthesized
gatcttcagcgacttcttgctt

SEQ ID NO: 1124405 - DNA, 22 bp, Artificial Sequence
  chemically synthesized
aatttttacaatttaaagcaag

SEQ ID NO: 1124406 - DNA, 22 bp, Artificial Sequence
  chemically synthesized
aaatttttacaatttaaagcaa

SEQ ID NO: 1124407 - DNA, 22 bp, Artificial Sequence
  chemically synthesized
taaatttttacaatttaaagca

SEQ ID NO: 1124408 - DNA, 22 bp, Artificial Sequence
  chemically synthesized
cagcgacttcttgctttaaatt

SEQ ID NO: 1124409 - DNA, 22 bp, Artificial Sequence
  chemically synthesized
ttaaatttttacaatttaaagc

SEQ ID NO: 1124410 - DNA, 22 bp, Artificial Sequence
  chemically synthesized
agcgacttcttgctttaaattg

SEQ ID NO: 1124411 - DNA, 22 bp, Artificial Sequence
  chemically synthesized
cttgctttaaattgtaaaaatt

SEQ ID NO: 1124412 - DNA, 22 bp, Artificial Sequence
  chemically synthesized
ttgctttaaattgtaaaaattt

SEQ ID NO: 1124413 - DNA, 22 bp, Artificial Sequence
  chemically synthesized
ataacagcttttaaatttttac

SEQ ID NO: 1124414 - DNA, 22 bp, Artificial Sequence
  chemically synthesized
gataacagcttttaaattttta

SEQ ID NO: 1124415 - DNA, 22 bp, Artificial Sequence
  chemically synthesized
gctttaaattgtaaaaatttaa

SEQ ID NO: 1124416 - DNA, 22 bp, Artificial Sequence
  chemically synthesized
ctttaaattgtaaaaatttaaa

SEQ ID NO: 1124417 - DNA, 22 bp, Artificial Sequence
  chemically synthesized
taaattgtaaaaatttaaaagc

SEQ ID NO: 1124418 - DNA, 22 bp, Artificial Sequence
  chemically synthesized
aaattgtaaaaatttaaaagct

SEQ ID NO: 1124419 - DNA, 22 bp, Artificial Sequence
  chemically synthesized
aattgtaaaaatttaaaagctg

SEQ ID NO: 1124420 - DNA, 22 bp, Artificial Sequence
  chemically synthesized
aggaccagtttgataacagctt

SEQ ID NO: 1124421 - DNA, 22 bp, Artificial Sequence
  chemically synthesized
taaaaatttaaaagctgttatc

SEQ ID NO: 1124422 - DNA, 22 bp, Artificial Sequence
  chemically synthesized
caggaccagtttgataacagct

SEQ ID NO: 1124423 - DNA, 22 bp, Artificial Sequence
  chemically synthesized
cttcaggaccagtttgataaca

SEQ ID NO: 1124424 - DNA, 22 bp, Artificial Sequence
  chemically synthesized
acttcaggaccagtttgataac

SEQ ID NO: 1124425 - DNA, 22 bp, Artificial Sequence
  chemically synthesized
tacttcaggaccagtttgataa

SEQ ID NO: 1124426 - DNA, 22 bp, Artificial Sequence
  chemically synthesized
ttacttcaggaccagtttgata

SEQ ID NO: 1124427 - DNA, 22 bp, Artificial Sequence
  chemically synthesized
aaaagctgttatcaaactggtc

SEQ ID NO: 1124428 - DNA, 22 bp, Artificial Sequence
  chemically synthesized
aaagctgttatcaaactggtcc

SEQ ID NO: 1124429 - DNA, 22 bp, Artificial Sequence
  chemically synthesized
cagtatgtttttacttcaggac

SEQ ID NO: 1124430 - DNA, 22 bp, Artificial Sequence
  chemically synthesized
ttatcaaactggtcctgaagta

SEQ ID NO: 1124431 - DNA, 22 bp, Artificial Sequence
  chemically synthesized
acagtatgtttttacttcagga

SEQ ID NO: 1124432 - DNA, 22 bp, Artificial Sequence
  chemically synthesized
tcaaactggtcctgaagtaaaa

SEQ ID NO: 1124433 - DNA, 22 bp, Artificial Sequence
  chemically synthesized
gtttacagtatgtttttacttc

SEQ ID NO: 1124434 - DNA, 22 bp, Artificial Sequence
  chemically synthesized
ggtttacagtatgtttttactt

SEQ ID NO: 1124435 - DNA, 22 bp, Artificial Sequence
  chemically synthesized
tggtttacagtatgtttttact

SEQ ID NO: 1124436 - DNA, 22 bp, Artificial Sequence
  chemically synthesized
ttggtttacagtatgtttttac

SEQ ID NO: 1124437 - DNA, 22 bp, Artificial Sequence
  chemically synthesized
tttttggtttacagtatgtttt

SEQ ID NO: 1124438 - DNA, 22 bp, Artificial Sequence
  chemically synthesized
gtcctgaagtaaaaacatactg

SEQ ID NO: 1124439 - DNA, 22 bp, Artificial Sequence
  chemically synthesized
atttttggtttacagtatgttt

SEQ ID NO: 1124440 - DNA, 22 bp, Artificial Sequence
  chemically synthesized
tatttttggtttacagtatgtt

SEQ ID NO: 1124441 - DNA, 22 bp, Artificial Sequence
  chemically synthesized
ttatttttggtttacagtatgt

SEQ ID NO: 1124442 - DNA, 22 bp, Artificial Sequence
  chemically synthesized
aagtaaaaacatactgtaaacc

SEQ ID NO: 1124443 - DNA, 22 bp, Artificial Sequence
  chemically synthesized
gccttttatttttggtttacag

SEQ ID NO: 1124444 - DNA, 22 bp, Artificial Sequence
  chemically synthesized
gagggggagttagccttttatt

SEQ ID NO: 1124445 - DNA, 22 bp, Artificial Sequence
  chemically synthesized
ggagggggagttagccttttat

SEQ ID NO: 1124446 - DNA, 22 bp, Artificial Sequence
  chemically synthesized
tggagggggagttagcctttta

SEQ ID NO: 1124447 - DNA, 22 bp, Artificial Sequence
  chemically synthesized
taaaccaaaaataaaaggctaa

SEQ ID NO: 1124448 - DNA, 22 bp, Artificial Sequence
  chemically synthesized
aggaggaagtccctttggaggg

SEQ ID NO: 1124449 - DNA, 22 bp, Artificial Sequence
  chemically synthesized
gctgaggaggaagtccctttgg

SEQ ID NO: 1124450 - DNA, 22 bp, Artificial Sequence
  chemically synthesized
actccccctccaaagggacttc

SEQ ID NO: 1124451 - DNA, 22 bp, Artificial Sequence
  chemically synthesized
cccctccaaagggacttcctcc

SEQ ID NO: 1124452 - DNA, 22 bp, Artificial Sequence
  chemically synthesized
agagccctggctgaggaggaag

SEQ ID NO: 1124453 - DNA, 22 bp, Artificial Sequence
  chemically synthesized
aagagccctggctgaggaggaa

SEQ ID NO: 1124454 - DNA, 22 bp, Artificial Sequence
  chemically synthesized
taagagccctggctgaggagga

SEQ ID NO: 1124455 - DNA, 22 bp, Artificial Sequence
  chemically synthesized
caaagggacttcctcctcagcc

SEQ ID NO: 1124456 - DNA, 22 bp, Artificial Sequence
  chemically synthesized
aattttaagagccctggctgag

SEQ ID NO: 1124457 - DNA, 22 bp, Artificial Sequence
  chemically synthesized
aggttaaattttaagagccctg

SEQ ID NO: 1124458 - DNA, 22 bp, Artificial Sequence
  chemically synthesized
caggttaaattttaagagccct

SEQ ID NO: 1124459 - DNA, 22 bp, Artificial Sequence
  chemically synthesized
cctcctcagccagggctcttaa

SEQ ID NO: 1124460 - DNA, 22 bp, Artificial Sequence
  chemically synthesized
tcaggttaaattttaagagccc

SEQ ID NO: 1124461 - DNA, 22 bp, Artificial Sequence
  chemically synthesized
ctcctcagccagggctcttaaa

SEQ ID NO: 1124462 - DNA, 22 bp, Artificial Sequence
  chemically synthesized
ctcagccagggctcttaaaatt

SEQ ID NO: 1124463 - DNA, 22 bp, Artificial Sequence
  chemically synthesized
agccagggctcttaaaatttaa

SEQ ID NO: 1124464 - DNA, 22 bp, Artificial Sequence
  chemically synthesized
aaccagtctttcaggttaaatt

SEQ ID NO: 1124465 - DNA, 22 bp, Artificial Sequence
  chemically synthesized
gcctgaaccagtctttcaggtt

SEQ ID NO: 1124466 - DNA, 22 bp, Artificial Sequence
  chemically synthesized
ggcctgaaccagtctttcaggt

SEQ ID NO: 1124467 - DNA, 22 bp, Artificial Sequence
  chemically synthesized
ttaaaatttaacctgaaagact

SEQ ID NO: 1124468 - DNA, 22 bp, Artificial Sequence
  chemically synthesized
ttggcctgaaccagtctttcag

SEQ ID NO: 1124469 - DNA, 22 bp, Artificial Sequence
  chemically synthesized
cttggcctgaaccagtctttca

SEQ ID NO: 1124470 - DNA, 22 bp, Artificial Sequence
  chemically synthesized
aaaatttaacctgaaagactgg

SEQ ID NO: 1124471 - DNA, 22 bp, Artificial Sequence
  chemically synthesized
aaatttaacctgaaagactggt

SEQ ID NO: 1124472 - DNA, 22 bp, Artificial Sequence
  chemically synthesized
ccttcttggcctgaaccagtct

SEQ ID NO: 1124473 - DNA, 22 bp, Artificial Sequence
  chemically synthesized
cccttcttggcctgaaccagtc

SEQ ID NO: 1124474 - DNA, 22 bp, Artificial Sequence
  chemically synthesized
aacctgaaagactggttcaggc

SEQ ID NO: 1124475 - DNA, 22 bp, Artificial Sequence
  chemically synthesized
acctgaaagactggttcaggcc

SEQ ID NO: 1124476 - DNA, 22 bp, Artificial Sequence
  chemically synthesized
aaagactggttcaggccaagaa

SEQ ID NO: 1124477 - DNA, 22 bp, Artificial Sequence
  chemically synthesized
acccccacttcccttcttggcc

SEQ ID NO: 1124478 - DNA, 22 bp, Artificial Sequence
  chemically synthesized
gttcaggccaagaagggaagtg

SEQ ID NO: 1124479 - DNA, 22 bp, Artificial Sequence
  chemically synthesized
aggccaagaagggaagtggggg

SEQ ID NO: 1124480 - DNA, 22 bp, Artificial Sequence
  chemically synthesized
atgtaagtgtcagagaggtata

SEQ ID NO: 1124481 - DNA, 22 bp, Artificial Sequence
  chemically synthesized
tgttgatgtaagtgtcagagag

SEQ ID NO: 1124482 - DNA, 22 bp, Artificial Sequence
  chemically synthesized
attatacctctctgacacttac

SEQ ID NO: 1124483 - DNA, 22 bp, Artificial Sequence
  chemically synthesized
aagtctgtgttgatgtaagtgt

SEQ ID NO: 1124484 - DNA, 22 bp, Artificial Sequence
  chemically synthesized
aaagtctgtgttgatgtaagtg

SEQ ID NO: 1124485 - DNA, 22 bp, Artificial Sequence
  chemically synthesized
tacctctctgacacttacatca

SEQ ID NO: 1124486 - DNA, 22 bp, Artificial Sequence
  chemically synthesized
tctgacacttacatcaacacag

SEQ ID NO: 1124487 - DNA, 22 bp, Artificial Sequence
  chemically synthesized
tcagacttaaagtctgtgttga

SEQ ID NO: 1124488 - DNA, 22 bp, Artificial Sequence
  chemically synthesized
tgacacttacatcaacacagac

SEQ ID NO: 1124489 - DNA, 22 bp, Artificial Sequence
  chemically synthesized
atcagacttaaagtctgtgttg

SEQ ID NO: 1124490 - DNA, 22 bp, Artificial Sequence
  chemically synthesized
acacttacatcaacacagactt

SEQ ID NO: 1124491 - DNA, 22 bp, Artificial Sequence
  chemically synthesized
ttatcagacttaaagtctgtgt

SEQ ID NO: 1124492 - DNA, 22 bp, Artificial Sequence
  chemically synthesized
cttatcagacttaaagtctgtg

SEQ ID NO: 1124493 - DNA, 22 bp, Artificial Sequence
  chemically synthesized
acatcaacacagactttaagtc

SEQ ID NO: 1124494 - DNA, 22 bp, Artificial Sequence
  chemically synthesized
catcaacacagactttaagtct

SEQ ID NO: 1124495 - DNA, 22 bp, Artificial Sequence
  chemically synthesized
tagagtgcttcttatcagactt

SEQ ID NO: 1124496 - DNA, 22 bp, Artificial Sequence
  chemically synthesized
taagtctgataagaagcactct
